United States Patent 7,691,997 (FUNCTIONAL AND HYPERFUNCTIONAL SIRNA) - sequence listing, part 4

SEQ ID NO: 121222 - RNA, 19 nt, Homo sapiens
agaaagaucccagagaauu

SEQ ID NO: 121223 - RNA, 19 nt, Homo sapiens
cagcaguuucugacaauua

SEQ ID NO: 121224 - RNA, 19 nt, Homo sapiens
ccacaagaaauuacgauga

SEQ ID NO: 121225 - RNA, 19 nt, Homo sapiens
gucaggaccuugccuugaa

SEQ ID NO: 121226 - RNA, 19 nt, Homo sapiens
ggaauuacaguuugaaagg

SEQ ID NO: 121227 - RNA, 19 nt, Homo sapiens
ucaaagaacaggaauuaca

SEQ ID NO: 121228 - RNA, 19 nt, Homo sapiens
gaaaagcgcguuguguaua

SEQ ID NO: 121229 - RNA, 19 nt, Homo sapiens
uguuaaagccuguuccaua

SEQ ID NO: 121230 - RNA, 19 nt, Homo sapiens
uaccagccauuucagaauu

SEQ ID NO: 121231 - RNA, 19 nt, Homo sapiens
agucaaagaacaggaauua

SEQ ID NO: 121232 - RNA, 19 nt, Homo sapiens
gcaguauuguucguucuga

SEQ ID NO: 121233 - RNA, 19 nt, Homo sapiens
acaagacacagaauaguuu

SEQ ID NO: 121234 - RNA, 19 nt, Homo sapiens
ucagugggauggaguagga

SEQ ID NO: 121235 - RNA, 19 nt, Homo sapiens
ggaacugccggaagugauu

SEQ ID NO: 121236 - RNA, 19 nt, Homo sapiens
gcaacaacacugcaagcaa

SEQ ID NO: 121237 - RNA, 19 nt, Homo sapiens
gaagaugagcuuacaacag

SEQ ID NO: 121238 - RNA, 19 nt, Homo sapiens
ggcguaaggguuaucguua

SEQ ID NO: 121239 - RNA, 19 nt, Homo sapiens
uuucagaauuccacaagaa

SEQ ID NO: 121240 - RNA, 19 nt, Homo sapiens
cugaagacaucaaacacaa

SEQ ID NO: 121241 - RNA, 19 nt, Homo sapiens
ucaaaacacuggaauuuca

SEQ ID NO: 121242 - RNA, 19 nt, Homo sapiens
cggaagugauucagauguu

SEQ ID NO: 121243 - RNA, 19 nt, Homo sapiens
accgacagcugcaguauug

SEQ ID NO: 121244 - RNA, 19 nt, Homo sapiens
ggacggcuucucacgcuuu

SEQ ID NO: 121245 - RNA, 19 nt, Homo sapiens
uggaaguggucaguauaua

SEQ ID NO: 121246 - RNA, 19 nt, Homo sapiens
gcacccaucaauagucaaa

SEQ ID NO: 121247 - RNA, 19 nt, Homo sapiens
gcaguauugucccucuguu

SEQ ID NO: 121248 - RNA, 19 nt, Homo sapiens
cacaagaaauuacgaugag

SEQ ID NO: 121249 - RNA, 19 nt, Homo sapiens
acgaagugauuaccaagaa

SEQ ID NO: 121250 - RNA, 19 nt, Homo sapiens
gugauaaccaguaaggaaa

SEQ ID NO: 121251 - RNA, 19 nt, Homo sapiens
guauaggaauucuuauggu

SEQ ID NO: 121252 - RNA, 19 nt, Homo sapiens
gaagugauuaccaagaaca

SEQ ID NO: 121253 - RNA, 19 nt, Homo sapiens
gaacaacagcaacaacacu

SEQ ID NO: 121254 - RNA, 19 nt, Homo sapiens
ccacugcgcugcggaacau

SEQ ID NO: 121255 - RNA, 19 nt, Homo sapiens
ccaggaugcccuagcagua

SEQ ID NO: 121256 - RNA, 19 nt, Homo sapiens
ggauuauucuacaggugaa

SEQ ID NO: 121257 - RNA, 19 nt, Homo sapiens
cauccucgccucagucaaa

SEQ ID NO: 121258 - RNA, 19 nt, Homo sapiens
gaggagagacgaggcauuc

SEQ ID NO: 121259 - RNA, 19 nt, Homo sapiens
gaagugcuuuauacugaac

SEQ ID NO: 121260 - RNA, 19 nt, Homo sapiens
gugcaugcauaccacaaga

SEQ ID NO: 121261 - RNA, 19 nt, Homo sapiens
aaggauggauggucacaau

SEQ ID NO: 121262 - RNA, 19 nt, Homo sapiens
ucugaggagucucuacaaa

SEQ ID NO: 121263 - RNA, 19 nt, Homo sapiens
uaucgaagaugagcuuaca

SEQ ID NO: 121264 - RNA, 19 nt, Homo sapiens
gcacaagacacagaauagu

SEQ ID NO: 121265 - RNA, 19 nt, Homo sapiens
uagcgugagcuguaaagua

SEQ ID NO: 121266 - RNA, 19 nt, Homo sapiens
gaaaagauuacgagaccua

SEQ ID NO: 121267 - RNA, 19 nt, Homo sapiens
caacaaccgcucagcaagu

SEQ ID NO: 121268 - RNA, 19 nt, Homo sapiens
gcuguggcacccaucaaua

SEQ ID NO: 121269 - RNA, 19 nt, Homo sapiens
uaacgcggcagccuacuug

SEQ ID NO: 121270 - RNA, 19 nt, Homo sapiens
ucaggaccuugccuugaaa

SEQ ID NO: 121271 - RNA, 19 nt, Homo sapiens
ccuuggacgucagaaauaa

SEQ ID NO: 121272 - RNA, 19 nt, Homo sapiens
gaaggaugagagaguguga

SEQ ID NO: 121273 - RNA, 19 nt, Homo sapiens
gauguugcagcaccaguuu

SEQ ID NO: 121274 - RNA, 19 nt, Homo sapiens
gcuguaaaguaacgagaag

SEQ ID NO: 121275 - RNA, 19 nt, Homo sapiens
gcgcgugucucccaacaac

SEQ ID NO: 121276 - RNA, 19 nt, Homo sapiens
gcuggaaguggucaguaua

SEQ ID NO: 121277 - RNA, 19 nt, Homo sapiens
cuacaggaaucaggaauac

SEQ ID NO: 121278 - RNA, 19 nt, Homo sapiens
caacuaaacaaggcauuca

SEQ ID NO: 121279 - RNA, 19 nt, Homo sapiens
cacaagacacagaauaguu

SEQ ID NO: 121280 - RNA, 19 nt, Homo sapiens
gcacaauacucaagucaug

SEQ ID NO: 121281 - RNA, 19 nt, Homo sapiens
guuaauaccuguagaugaa

SEQ ID NO: 121282 - RNA, 19 nt, Homo sapiens
gaacagaagacuaaaccua

SEQ ID NO: 121283 - RNA, 19 nt, Homo sapiens
gaagggcaauaugaaguua

SEQ ID NO: 121284 - RNA, 19 nt, Homo sapiens
gaauggaaauuguggaguu

SEQ ID NO: 121285 - RNA, 19 nt, Homo sapiens
guuagaagaucaucccuuu

SEQ ID NO: 121286 - RNA, 19 nt, Homo sapiens
caagaugucugucucugaa

SEQ ID NO: 121287 - RNA, 19 nt, Homo sapiens
ucaacuaccucgcaucauu

SEQ ID NO: 121288 - RNA, 19 nt, Homo sapiens
agagauggcugacagauau

SEQ ID NO: 121289 - RNA, 19 nt, Homo sapiens
gaaccucaaguguguguua

SEQ ID NO: 121290 - RNA, 19 nt, Homo sapiens
gauguguacucuaacuuaa

SEQ ID NO: 121291 - RNA, 19 nt, Homo sapiens
caagagacccuucaaacuu

SEQ ID NO: 121292 - RNA, 19 nt, Homo sapiens
gaacauucucuccuuauga

SEQ ID NO: 121293 - RNA, 19 nt, Homo sapiens
ggguauugcuugccacuaa

SEQ ID NO: 121294 - RNA, 19 nt, Homo sapiens
gcuaggauuugaacacuug

SEQ ID NO: 121295 - RNA, 19 nt, Homo sapiens
ggagagagaauggaaauug

SEQ ID NO: 121296 - RNA, 19 nt, Homo sapiens
gacuugaccuuccuauuga

SEQ ID NO: 121297 - RNA, 19 nt, Homo sapiens
gagagagaauggaaauugu

SEQ ID NO: 121298 - RNA, 19 nt, Homo sapiens
ggaacauucucuccuuaug

SEQ ID NO: 121299 - RNA, 19 nt, Homo sapiens
guuuacagcucugacuuua

SEQ ID NO: 121300 - RNA, 19 nt, Homo sapiens
caaauccacuugacacauc

SEQ ID NO: 121301 - RNA, 19 nt, Homo sapiens
ucaaagggacggucaguuu

SEQ ID NO: 121302 - RNA, 19 nt, Homo sapiens
uaacauugaugcaggaaca

SEQ ID NO: 121303 - RNA, 19 nt, Homo sapiens
gguguuauaucaggaauug

SEQ ID NO: 121304 - RNA, 19 nt, Homo sapiens
gaaauacaccgaguucuca

SEQ ID NO: 121305 - RNA, 19 nt, Homo sapiens
gaaguuuguuggccaagau

SEQ ID NO: 121306 - RNA, 19 nt, Homo sapiens
cuggagaccugcucuauug

SEQ ID NO: 121307 - RNA, 19 nt, Homo sapiens
ucaauguucugccauguug

SEQ ID NO: 121308 - RNA, 19 nt, Homo sapiens
ggccgcaggucaaagagua

SEQ ID NO: 121309 - RNA, 19 nt, Homo sapiens
ggaaaucaaguacauagau

SEQ ID NO: 121310 - RNA, 19 nt, Homo sapiens
ccacgaagcuuggcagaag

SEQ ID NO: 121311 - RNA, 19 nt, Homo sapiens
gaugagacaggcguuaaua

SEQ ID NO: 121312 - RNA, 19 nt, Homo sapiens
caaguugucccucauauca

SEQ ID NO: 121313 - RNA, 19 nt, Homo sapiens
acacaucagugaaggagaa

SEQ ID NO: 121314 - RNA, 19 nt, Homo sapiens
gagcauggagagaggauuu

SEQ ID NO: 121315 - RNA, 19 nt, Homo sapiens
uuacagcucugacuuuaca

SEQ ID NO: 121316 - RNA, 19 nt, Homo sapiens
aagagacccuucaaacuug

SEQ ID NO: 121317 - RNA, 19 nt, Homo sapiens
cuaaaacccucucauauau

SEQ ID NO: 121318 - RNA, 19 nt, Homo sapiens
uuggauaccuagaccguua

SEQ ID NO: 121319 - RNA, 19 nt, Homo sapiens
ucugaccacuggaaagaua

SEQ ID NO: 121320 - RNA, 19 nt, Homo sapiens
ggaaagguauuugggaaac

SEQ ID NO: 121321 - RNA, 19 nt, Homo sapiens
agacuugaccuuccuauug

SEQ ID NO: 121322 - RNA, 19 nt, Homo sapiens
gacuaaaccuacccagaau

SEQ ID NO: 121323 - RNA, 19 nt, Homo sapiens
gacucgauguguacucuaa

SEQ ID NO: 121324 - RNA, 19 nt, Homo sapiens
ggaaacacuccuugcauca

SEQ ID NO: 121325 - RNA, 19 nt, Homo sapiens
guaugcaggugcucaaauc

SEQ ID NO: 121326 - RNA, 19 nt, Homo sapiens
cgauguguacucuaacuua

SEQ ID NO: 121327 - RNA, 19 nt, Homo sapiens
gguuacuggugguguuaua

SEQ ID NO: 121328 - RNA, 19 nt, Homo sapiens
agacuaaaccuacccagaa

SEQ ID NO: 121329 - RNA, 19 nt, Homo sapiens
ucacuugcaugucccauca

SEQ ID NO: 121330 - RNA, 19 nt, Homo sapiens
ugaaguacauucugguuac

SEQ ID NO: 121331 - RNA, 19 nt, Homo sapiens
ccucaaguguguguuauug

SEQ ID NO: 121332 - RNA, 19 nt, Homo sapiens
cacauuaccuccagaaagg

SEQ ID NO: 121333 - RNA, 19 nt, Homo sapiens
gaaggagagagaauggaaa

SEQ ID NO: 121334 - RNA, 19 nt, Homo sapiens
gcagacuacuuggaagaga

SEQ ID NO: 121335 - RNA, 19 nt, Homo sapiens
caacaugaaacaccaagau

SEQ ID NO: 121336 - RNA, 19 nt, Homo sapiens
gaaaucaccgaacugaagu

SEQ ID NO: 121337 - RNA, 19 nt, Homo sapiens
aaaauugaccccuacauua

SEQ ID NO: 121338 - RNA, 19 nt, Homo sapiens
gcaagggguuguagauuau

SEQ ID NO: 121339 - RNA, 19 nt, Homo sapiens
uaacauccacgucagucua

SEQ ID NO: 121340 - RNA, 19 nt, Homo sapiens
aauggaaauuguggaguua

SEQ ID NO: 121341 - RNA, 19 nt, Homo sapiens
gugcugggauggcaagaug

SEQ ID NO: 121342 - RNA, 19 nt, Homo sapiens
ggccaucaaccacaaauug

SEQ ID NO: 121343 - RNA, 19 nt, Homo sapiens
ccuggaaccucaagugugu

SEQ ID NO: 121344 - RNA, 19 nt, Homo sapiens
agaugaagauggccuggaa

SEQ ID NO: 121345 - RNA, 19 nt, Homo sapiens
ccagggacaccuauaguga

SEQ ID NO: 121346 - RNA, 19 nt, Homo sapiens
gaaagagauggcugacaga

SEQ ID NO: 121347 - RNA, 19 nt, Homo sapiens
cugaugaaauggaaagaga

SEQ ID NO: 121348 - RNA, 19 nt, Homo sapiens
gaaacacuccuugcaucaa

SEQ ID NO: 121349 - RNA, 19 nt, Homo sapiens
caacuaccucgcaucauug

SEQ ID NO: 121350 - RNA, 19 nt, Homo sapiens
ucaccuuguuucucaacua

SEQ ID NO: 121351 - RNA, 19 nt, Homo sapiens
ggaaacuugucacuugcau

SEQ ID NO: 121352 - RNA, 19 nt, Homo sapiens
uugggaaacuugucacuug

SEQ ID NO: 121353 - RNA, 19 nt, Homo sapiens
uuaaugugaccuagcaaua

SEQ ID NO: 121354 - RNA, 19 nt, Homo sapiens
acugaaguuuccaucaaua

SEQ ID NO: 121355 - RNA, 19 nt, Homo sapiens
ugaaaucaccgaacugaag

SEQ ID NO: 121356 - RNA, 19 nt, Homo sapiens
ggcagugguugaauucuca

SEQ ID NO: 121357 - RNA, 19 nt, Homo sapiens
ucucauauauagacagcuu

SEQ ID NO: 121358 - RNA, 19 nt, Homo sapiens
gaaacaccaagaugucugu

SEQ ID NO: 121359 - RNA, 19 nt, Homo sapiens
ucaguuuggugucaacaug

SEQ ID NO: 121360 - RNA, 19 nt, Homo sapiens
ccuagaccguuauaaagug

SEQ ID NO: 121361 - RNA, 19 nt, Homo sapiens
uggccaagauguugaagga

SEQ ID NO: 121362 - RNA, 19 nt, Homo sapiens
accaagaacucagucauga

SEQ ID NO: 121363 - RNA, 19 nt, Homo sapiens
agagagaacuuuuguaaca

SEQ ID NO: 121364 - RNA, 19 nt, Homo sapiens
uguguacucuaacuuaaga

SEQ ID NO: 121365 - RNA, 19 nt, Homo sapiens
ccaugaaaccagagacaaa

SEQ ID NO: 121366 - RNA, 19 nt, Homo sapiens
gcgcguugccugucgcuuu

SEQ ID NO: 121367 - RNA, 19 nt, Homo sapiens
gaccaagaacucagucaug

SEQ ID NO: 121368 - RNA, 19 nt, Homo sapiens
ccaauucuacagaguuuga

SEQ ID NO: 121369 - RNA, 19 nt, Homo sapiens
ccaggaggauuugguguuc

SEQ ID NO: 121370 - RNA, 19 nt, Homo sapiens
gaugaaauggaaagagaug

SEQ ID NO: 121371 - RNA, 19 nt, Homo sapiens
uaugagcgguuccuugaca

SEQ ID NO: 121372 - RNA, 19 nt, Homo sapiens
gugcgugcgcuuccuauuu

SEQ ID NO: 121373 - RNA, 19 nt, Homo sapiens
ggagagaggauuuuagcua

SEQ ID NO: 121374 - RNA, 19 nt, Homo sapiens
acucaagucaugugguuua

SEQ ID NO: 121375 - RNA, 19 nt, Homo sapiens
ggaaauuguggaguuagaa

SEQ ID NO: 121376 - RNA, 19 nt, Homo sapiens
ucacuuacagaacaaagaa

SEQ ID NO: 121377 - RNA, 19 nt, Homo sapiens
gcugggaaccucaggguau

SEQ ID NO: 121378 - RNA, 19 nt, Homo sapiens
aaagguauuugggaaacuu

SEQ ID NO: 121379 - RNA, 19 nt, Homo sapiens
gaaauuguggaguuagaag

SEQ ID NO: 121380 - RNA, 19 nt, Homo sapiens
ccacagagccucaguaaac

SEQ ID NO: 121381 - RNA, 19 nt, Homo sapiens
ucaguaaacccauggaaca

SEQ ID NO: 121382 - RNA, 19 nt, Homo sapiens
ccaaguacaacgccaacaa

SEQ ID NO: 121383 - RNA, 19 nt, Homo sapiens
uaccuugggugcagaagau

SEQ ID NO: 121384 - RNA, 19 nt, Homo sapiens
ggucguggcuggggaguuu

SEQ ID NO: 121385 - RNA, 19 nt, Homo sapiens
caaguacaacgccaacaag

SEQ ID NO: 121386 - RNA, 19 nt, Homo sapiens
uguccaggaucgugaaugg

SEQ ID NO: 121387 - RNA, 19 nt, Homo sapiens
ugacaucacccugcugaag

SEQ ID NO: 121388 - RNA, 19 nt, Homo sapiens
ggacccuggugggcauugu

SEQ ID NO: 121389 - RNA, 19 nt, Homo sapiens
caacaagaccccugacaag

SEQ ID NO: 121390 - RNA, 19 nt, Homo sapiens
gcauucugaccgugaacaa

SEQ ID NO: 121391 - RNA, 19 nt, Homo sapiens
gcucugacgaggagaacau

SEQ ID NO: 121392 - RNA, 19 nt, Homo sapiens
ggaaacacaugggugcuua

SEQ ID NO: 121393 - RNA, 19 nt, Homo sapiens
ggucauagccuacaacuga

SEQ ID NO: 121394 - RNA, 19 nt, Homo sapiens
gcaagaagccagaacuguu

SEQ ID NO: 121395 - RNA, 19 nt, Homo sapiens
gaauacagaggauacguuu

SEQ ID NO: 121396 - RNA, 19 nt, Homo sapiens
acacgcaucucgccaguuu

SEQ ID NO: 121397 - RNA, 19 nt, Homo sapiens
caaacgaggcucugacuga

SEQ ID NO: 121398 - RNA, 19 nt, Homo sapiens
gcgcgcaccugcuguguau

SEQ ID NO: 121399 - RNA, 19 nt, Homo sapiens
caagaagccagaacuguug

SEQ ID NO: 121400 - RNA, 19 nt, Homo sapiens
gaaagaagaggcuguugag

SEQ ID NO: 121401 - RNA, 19 nt, Homo sapiens
cuaccaccaugaacaauga

SEQ ID NO: 121402 - RNA, 19 nt, Homo sapiens
gcagccuguuuacugaaua

SEQ ID NO: 121403 - RNA, 19 nt, Homo sapiens
aaacgaggcucugacugaa

SEQ ID NO: 121404 - RNA, 19 nt, Homo sapiens
cagaggauacguuuacaaa

SEQ ID NO: 121405 - RNA, 19 nt, Homo sapiens
acacaugggugcuuauugg

SEQ ID NO: 121406 - RNA, 19 nt, Homo sapiens
cacccuagcuggaacucua

SEQ ID NO: 121407 - RNA, 19 nt, Homo sapiens
cagcucaacccauuaaaga

SEQ ID NO: 121408 - RNA, 19 nt, Homo sapiens
caugggugcuuauugguau

SEQ ID NO: 121409 - RNA, 19 nt, Homo sapiens
gggcgaguaugaccgauca

SEQ ID NO: 121410 - RNA, 19 nt, Homo sapiens
ccagaacuguuggaaugaa

SEQ ID NO: 121411 - RNA, 19 nt, Homo sapiens
agccagaacuguuggaaug

SEQ ID NO: 121412 - RNA, 19 nt, Homo sapiens
ggaacucuaccaccaugaa

SEQ ID NO: 121413 - RNA, 19 nt, Homo sapiens
ggagaaagaagaggcuguu

SEQ ID NO: 121414 - RNA, 19 nt, Homo sapiens
agaaagaagaggcuguuga

SEQ ID NO: 121415 - RNA, 19 nt, Homo sapiens
gaaggccucacguguguca

SEQ ID NO: 121416 - RNA, 19 nt, Homo sapiens
cugaaggccucacgugugu

SEQ ID NO: 121417 - RNA, 19 nt, Homo sapiens
cagcagcggcuuccacuuc

SEQ ID NO: 121418 - RNA, 19 nt, Homo sapiens
caaacugaauacgcauaau

SEQ ID NO: 121419 - RNA, 19 nt, Homo sapiens
cagaacuguuggaaugaau

SEQ ID NO: 121420 - RNA, 19 nt, Homo sapiens
acaaacugaauacgcauaa

SEQ ID NO: 121421 - RNA, 19 nt, Homo sapiens
gaaacacaugggugcuuau

SEQ ID NO: 121422 - RNA, 19 nt, Homo sapiens
gaacuguuggaaugaaugg

SEQ ID NO: 121423 - RNA, 19 nt, Homo sapiens
ggcagccuguuuacugaau

SEQ ID NO: 121424 - RNA, 19 nt, Homo sapiens
gaagccagaacuguuggaa

SEQ ID NO: 121425 - RNA, 19 nt, Homo sapiens
aaacacaugggugcuuauu

SEQ ID NO: 121426 - RNA, 19 nt, Homo sapiens
gcugcccacugcaauguca

SEQ ID NO: 121427 - RNA, 19 nt, Homo sapiens
ugaauacagaggauacguu

SEQ ID NO: 121428 - RNA, 19 nt, Homo sapiens
auacagaggauacguuuac

SEQ ID NO: 121429 - RNA, 19 nt, Homo sapiens
agcaguggcucuuccuaga

SEQ ID NO: 121430 - RNA, 19 nt, Homo sapiens
gagcuucagccagaggauu

SEQ ID NO: 121431 - RNA, 19 nt, Homo sapiens
gagaaagaagaggcuguug

SEQ ID NO: 121432 - RNA, 19 nt, Homo sapiens
uuacacacccuagcuggaa

SEQ ID NO: 121433 - RNA, 19 nt, Homo sapiens
ggguccgacucccuacuug

SEQ ID NO: 121434 - RNA, 19 nt, Homo sapiens
ucaguggcgugggcaaugu

SEQ ID NO: 121435 - RNA, 19 nt, Homo sapiens
gcuguguauacucgaguua

SEQ ID NO: 121436 - RNA, 19 nt, Homo sapiens
gcgcaccugcuguguauac

SEQ ID NO: 121437 - RNA, 19 nt, Homo sapiens
gccagaagggaaacacaug

SEQ ID NO: 121438 - RNA, 19 nt, Homo sapiens
gaacucuaccaccaugaac

SEQ ID NO: 121439 - RNA, 19 nt, Homo sapiens
gcagcggcuuccacuucug

SEQ ID NO: 121440 - RNA, 19 nt, Homo sapiens
auacucgaguuagcaaguu

SEQ ID NO: 121441 - RNA, 19 nt, Homo sapiens
acaugggugcuuauuggua

SEQ ID NO: 121442 - RNA, 19 nt, Homo sapiens
gggaaacacaugggugcuu

SEQ ID NO: 121443 - RNA, 19 nt, Homo sapiens
guccgucucucgggccauu

SEQ ID NO: 121444 - RNA, 19 nt, Homo sapiens
gcaaguagcuuuccacauu

SEQ ID NO: 121445 - RNA, 19 nt, Homo sapiens
gacaugagcuacuugaaga

SEQ ID NO: 121446 - RNA, 19 nt, Homo sapiens
cggaugagcuggucaacua

SEQ ID NO: 121447 - RNA, 19 nt, Homo sapiens
ggucaacuaugucaacaaa

SEQ ID NO: 121448 - RNA, 19 nt, Homo sapiens
gacaauggcuucuuuaaaa

SEQ ID NO: 121449 - RNA, 19 nt, Homo sapiens
caaguagcuuuccacauuu

SEQ ID NO: 121450 - RNA, 19 nt, Homo sapiens
ccacugaucucuacuacca

SEQ ID NO: 121451 - RNA, 19 nt, Homo sapiens
gaaugccugugccaauaaa

SEQ ID NO: 121452 - RNA, 19 nt, Homo sapiens
gcuucacccugucaaguua

SEQ ID NO: 121453 - RNA, 19 nt, Homo sapiens
gaaaccagcuuuuacuguu

SEQ ID NO: 121454 - RNA, 19 nt, Homo sapiens
caaccucucugaucuugug

SEQ ID NO: 121455 - RNA, 19 nt, Homo sapiens
cagcaugauucuuuaauag

SEQ ID NO: 121456 - RNA, 19 nt, Homo sapiens
ggacuggauuggccaaaca

SEQ ID NO: 121457 - RNA, 19 nt, Homo sapiens
ggaaugccugugccaauaa

SEQ ID NO: 121458 - RNA, 19 nt, Homo sapiens
ucacguaagauacaaguuu

SEQ ID NO: 121459 - RNA, 19 nt, Homo sapiens
gcacucugcuaaucaugug

SEQ ID NO: 121460 - RNA, 19 nt, Homo sapiens
ugacaauggcuucuuuaaa

SEQ ID NO: 121461 - RNA, 19 nt, Homo sapiens
gcuuggaacuucuggacaa

SEQ ID NO: 121462 - RNA, 19 nt, Homo sapiens
cggaggaccugcucacaug

SEQ ID NO: 121463 - RNA, 19 nt, Homo sapiens
ggacaugagcuacuugaag

SEQ ID NO: 121464 - RNA, 19 nt, Homo sapiens
acagauugccuccuaauga

SEQ ID NO: 121465 - RNA, 19 nt, Homo sapiens
gaaagcggaguuccuaaca

SEQ ID NO: 121466 - RNA, 19 nt, Homo sapiens
agacagagacgcaggaaug

SEQ ID NO: 121467 - RNA, 19 nt, Homo sapiens
gggugacaauggcuucuuu

SEQ ID NO: 121468 - RNA, 19 nt, Homo sapiens
aggaaugccugugccaaua

SEQ ID NO: 121469 - RNA, 19 nt, Homo sapiens
ggauccggcuuccaacaug

SEQ ID NO: 121470 - RNA, 19 nt, Homo sapiens
ggaaaauaguuuaggagaa

SEQ ID NO: 121471 - RNA, 19 nt, Homo sapiens
ggacaagcacuacggauac

SEQ ID NO: 121472 - RNA, 19 nt, Homo sapiens
cgggagaccugugcuaguu

SEQ ID NO: 121473 - RNA, 19 nt, Homo sapiens
ggaucacuguggaaucgaa

SEQ ID NO: 121474 - RNA, 19 nt, Homo sapiens
uugaagaggcuauguggua

SEQ ID NO: 121475 - RNA, 19 nt, Homo sapiens
ggagcuuucucuguguauu

SEQ ID NO: 121476 - RNA, 19 nt, Homo sapiens
acaaacaggacaagcacua

SEQ ID NO: 121477 - RNA, 19 nt, Homo sapiens
caaguggucaggaguuguu

SEQ ID NO: 121478 - RNA, 19 nt, Homo sapiens
cacaaccucucugaucuug

SEQ ID NO: 121479 - RNA, 19 nt, Homo sapiens
cagaagugguggcuggaau

SEQ ID NO: 121480 - RNA, 19 nt, Homo sapiens
gagggagcuuucucugugu

SEQ ID NO: 121481 - RNA, 19 nt, Homo sapiens
gagcaggcccucuuuccau

SEQ ID NO: 121482 - RNA, 19 nt, Homo sapiens
ggaacaauggccacagugu

SEQ ID NO: 121483 - RNA, 19 nt, Homo sapiens
ggagaccugugcuaguuuu

SEQ ID NO: 121484 - RNA, 19 nt, Homo sapiens
ggugacaauggcuucuuua

SEQ ID NO: 121485 - RNA, 19 nt, Homo sapiens
gacaagcacuacggauaca

SEQ ID NO: 121486 - RNA, 19 nt, Homo sapiens
caaggaaaauaguuuagga

SEQ ID NO: 121487 - RNA, 19 nt, Homo sapiens
gauccggcuuccaacaugu

SEQ ID NO: 121488 - RNA, 19 nt, Homo sapiens
ucaacuaugucaacaaacg

SEQ ID NO: 121489 - RNA, 19 nt, Homo sapiens
cagagacgcaggaauggaa

SEQ ID NO: 121490 - RNA, 19 nt, Homo sapiens
cacguaagauacaaguuuc

SEQ ID NO: 121491 - RNA, 19 nt, Homo sapiens
uaucgaguuugcaauguca

SEQ ID NO: 121492 - RNA, 19 nt, Homo sapiens
ccagggagcaagacagaga

SEQ ID NO: 121493 - RNA, 19 nt, Homo sapiens
gugcagacaggccauguga

SEQ ID NO: 121494 - RNA, 19 nt, Homo sapiens
ccugucaaguuaacaagga

SEQ ID NO: 121495 - RNA, 19 nt, Homo sapiens
gcucagcaugauucuuuaa

SEQ ID NO: 121496 - RNA, 19 nt, Homo sapiens
gaucaguacugggaaaaga

SEQ ID NO: 121497 - RNA, 19 nt, Homo sapiens
gugacaauggcuucuuuaa

SEQ ID NO: 121498 - RNA, 19 nt, Homo sapiens
cagauugccuccuaaugac

SEQ ID NO: 121499 - RNA, 19 nt, Homo sapiens
uaaguucacguaagauaca

SEQ ID NO: 121500 - RNA, 19 nt, Homo sapiens
gaagugguggcuggaauuc

SEQ ID NO: 121501 - RNA, 19 nt, Homo sapiens
gagcuggucaacuauguca

SEQ ID NO: 121502 - RNA, 19 nt, Homo sapiens
gagaauggcacacccuacu

SEQ ID NO: 121503 - RNA, 19 nt, Homo sapiens
ccacaaggaaaauaguuua

SEQ ID NO: 121504 - RNA, 19 nt, Homo sapiens
gucacaaccucucugaucu

SEQ ID NO: 121505 - RNA, 19 nt, Homo sapiens
guaagauacaaguuucaga

SEQ ID NO: 121506 - RNA, 19 nt, Homo sapiens
gaauuccacgcaccgauca

SEQ ID NO: 121507 - RNA, 19 nt, Homo sapiens
cuacagcccgaccuacaaa

SEQ ID NO: 121508 - RNA, 19 nt, Homo sapiens
ccuaacaggaugaaaguuc

SEQ ID NO: 121509 - RNA, 19 nt, Homo sapiens
ggucugaaggacuggauug

SEQ ID NO: 121510 - RNA, 19 nt, Homo sapiens
gagcuuucucuguguauuc

SEQ ID NO: 121511 - RNA, 19 nt, Homo sapiens
uaugucaacaaacggaaua

SEQ ID NO: 121512 - RNA, 19 nt, Homo sapiens
ggacaucauggccgagauc

SEQ ID NO: 121513 - RNA, 19 nt, Homo sapiens
gaccugaagcugccugcaa

SEQ ID NO: 121514 - RNA, 19 nt, Homo sapiens
acacgucaccggagagaug

SEQ ID NO: 121515 - RNA, 19 nt, Homo sapiens
gcuacagcccgaccuacaa

SEQ ID NO: 121516 - RNA, 19 nt, Homo sapiens
caggaucacuguggaaucg

SEQ ID NO: 121517 - RNA, 19 nt, Homo sapiens
caucauggccgagaucuac

SEQ ID NO: 121518 - RNA, 19 nt, Homo sapiens
ccuacagcgucuccaauag

SEQ ID NO: 121519 - RNA, 19 nt, Homo sapiens
aggacaagcacuacggaua

SEQ ID NO: 121520 - RNA, 19 nt, Homo sapiens
gaugagcuggucaacuaug

SEQ ID NO: 121521 - RNA, 19 nt, Homo sapiens
ugacgcggcucaaaaggaa

SEQ ID NO: 121522 - RNA, 19 nt, Homo sapiens
gggagaccugugcuaguuu

SEQ ID NO: 121523 - RNA, 19 nt, Homo sapiens
ggauuggccaaacaucaga

SEQ ID NO: 121524 - RNA, 19 nt, Homo sapiens
agaaaucagaggagagaug

SEQ ID NO: 121525 - RNA, 19 nt, Homo sapiens
acagaaaucagaggagaga

SEQ ID NO: 121526 - RNA, 19 nt, Homo sapiens
aaguagcuuuccacauuug

SEQ ID NO: 121527 - RNA, 19 nt, Homo sapiens
ggaauggaaagcggaguuc

SEQ ID NO: 121528 - RNA, 19 nt, Homo sapiens
caacacgucaccggagaga

SEQ ID NO: 121529 - RNA, 19 nt, Homo sapiens
gcacuacggauacaauucc

SEQ ID NO: 121530 - RNA, 19 nt, Homo sapiens
caagcacuacggauacaau

SEQ ID NO: 121531 - RNA, 19 nt, Homo sapiens
ccacagugucccaccauca

SEQ ID NO: 121532 - RNA, 19 nt, Homo sapiens
agucaggaguguaccaaca

SEQ ID NO: 121533 - RNA, 19 nt, Homo sapiens
ucuaggauccggcuuccaa

SEQ ID NO: 121534 - RNA, 19 nt, Homo sapiens
ucacaaccucucugaucuu

SEQ ID NO: 121535 - RNA, 19 nt, Homo sapiens
ugucacaaccucucugauc

SEQ ID NO: 121536 - RNA, 19 nt, Homo sapiens
gcaucuaucgaguuugcaa

SEQ ID NO: 121537 - RNA, 19 nt, Homo sapiens
cccugcaucuaucgaguuu

SEQ ID NO: 121538 - RNA, 19 nt, Homo sapiens
cggacuuccugcucuacaa

SEQ ID NO: 121539 - RNA, 19 nt, Homo sapiens
gacccacugaucucuacua

SEQ ID NO: 121540 - RNA, 19 nt, Homo sapiens
gaccaaguccuggcuacau

SEQ ID NO: 121541 - RNA, 19 nt, Homo sapiens
uggaaucgaaucagaagug

SEQ ID NO: 121542 - RNA, 19 nt, Homo sapiens
ggagcaggcccucuuucca

SEQ ID NO: 121543 - RNA, 19 nt, Homo sapiens
gaucugcauccacaccaau

SEQ ID NO: 121544 - RNA, 19 nt, Homo sapiens
gcaaguagcuuuccacauu

SEQ ID NO: 121545 - RNA, 19 nt, Homo sapiens
gacaugagcuacuugaaga

SEQ ID NO: 121546 - RNA, 19 nt, Homo sapiens
cggaugagcuggucaacua

SEQ ID NO: 121547 - RNA, 19 nt, Homo sapiens
ggucaacuaugucaacaaa

SEQ ID NO: 121548 - RNA, 19 nt, Homo sapiens
gacaauggcuucuuuaaaa

SEQ ID NO: 121549 - RNA, 19 nt, Homo sapiens
caaguagcuuuccacauuu

SEQ ID NO: 121550 - RNA, 19 nt, Homo sapiens
ccacugaucucuacuacca

SEQ ID NO: 121551 - RNA, 19 nt, Homo sapiens
gaaugccugugccaauaaa

SEQ ID NO: 121552 - RNA, 19 nt, Homo sapiens
gcuucacccugucaaguua

SEQ ID NO: 121553 - RNA, 19 nt, Homo sapiens
gaaaccagcuuuuacuguu

SEQ ID NO: 121554 - RNA, 19 nt, Homo sapiens
caaccucucugaucuugug

SEQ ID NO: 121555 - RNA, 19 nt, Homo sapiens
cagcaugauucuuuaauag

SEQ ID NO: 121556 - RNA, 19 nt, Homo sapiens
ggacuggauuggccaaaca

SEQ ID NO: 121557 - RNA, 19 nt, Homo sapiens
ggaaugccugugccaauaa

SEQ ID NO: 121558 - RNA, 19 nt, Homo sapiens
ucacguaagauacaaguuu

SEQ ID NO: 121559 - RNA, 19 nt, Homo sapiens
gcacucugcuaaucaugug

SEQ ID NO: 121560 - RNA, 19 nt, Homo sapiens
ugacaauggcuucuuuaaa

SEQ ID NO: 121561 - RNA, 19 nt, Homo sapiens
gcuuggaacuucuggacaa

SEQ ID NO: 121562 - RNA, 19 nt, Homo sapiens
cggaggaccugcucacaug

SEQ ID NO: 121563 - RNA, 19 nt, Homo sapiens
ggacaugagcuacuugaag

SEQ ID NO: 121564 - RNA, 19 nt, Homo sapiens
acagauugccuccuaauga

SEQ ID NO: 121565 - RNA, 19 nt, Homo sapiens
gaaagcggaguuccuaaca

SEQ ID NO: 121566 - RNA, 19 nt, Homo sapiens
guaccugguuugcauagau

SEQ ID NO: 121567 - RNA, 19 nt, Homo sapiens
agacagagacgcaggaaug

SEQ ID NO: 121568 - RNA, 19 nt, Homo sapiens
gggugacaauggcuucuuu

SEQ ID NO: 121569 - RNA, 19 nt, Homo sapiens
aggaaugccugugccaaua

SEQ ID NO: 121570 - RNA, 19 nt, Homo sapiens
ggaaaauaguuuaggagaa

SEQ ID NO: 121571 - RNA, 19 nt, Homo sapiens
ggacaagcacuacggauac

SEQ ID NO: 121572 - RNA, 19 nt, Homo sapiens
ggauccggcuuccaacaug

SEQ ID NO: 121573 - RNA, 19 nt, Homo sapiens
cgggagaccugugcuaguu

SEQ ID NO: 121574 - RNA, 19 nt, Homo sapiens
ggaucacuguggaaucgaa

SEQ ID NO: 121575 - RNA, 19 nt, Homo sapiens
uugaagaggcuauguggua

SEQ ID NO: 121576 - RNA, 19 nt, Homo sapiens
ggagcuuucucuguguauu

SEQ ID NO: 121577 - RNA, 19 nt, Homo sapiens
caccucagccucccgagua

SEQ ID NO: 121578 - RNA, 19 nt, Homo sapiens
acaaacaggacaagcacua

SEQ ID NO: 121579 - RNA, 19 nt, Homo sapiens
gcaguaccugguuugcaua

SEQ ID NO: 121580 - RNA, 19 nt, Homo sapiens
caaguggucaggaguuguu

SEQ ID NO: 121581 - RNA, 19 nt, Homo sapiens
cacaaccucucugaucuug

SEQ ID NO: 121582 - RNA, 19 nt, Homo sapiens
cagaagugguggcuggaau

SEQ ID NO: 121583 - RNA, 19 nt, Homo sapiens
gagggagcuuucucugugu

SEQ ID NO: 121584 - RNA, 19 nt, Homo sapiens
ggaacaauggccacagugu

SEQ ID NO: 121585 - RNA, 19 nt, Homo sapiens
gagcaggcccucuuuccau

SEQ ID NO: 121586 - RNA, 19 nt, Homo sapiens
ggagaccugugcuaguuuu

SEQ ID NO: 121587 - RNA, 19 nt, Homo sapiens
ggugacaauggcuucuuua

SEQ ID NO: 121588 - RNA, 19 nt, Homo sapiens
gacaagcacuacggauaca

SEQ ID NO: 121589 - RNA, 19 nt, Homo sapiens
caaggaaaauaguuuagga

SEQ ID NO: 121590 - RNA, 19 nt, Homo sapiens
cagagacgcaggaauggaa

SEQ ID NO: 121591 - RNA, 19 nt, Homo sapiens
cacguaagauacaaguuuc

SEQ ID NO: 121592 - RNA, 19 nt, Homo sapiens
gauccggcuuccaacaugu

SEQ ID NO: 121593 - RNA, 19 nt, Homo sapiens
ucaacuaugucaacaaacg

SEQ ID NO: 121594 - RNA, 19 nt, Homo sapiens
uaucgaguuugcaauguca

SEQ ID NO: 121595 - RNA, 19 nt, Homo sapiens
ccagggagcaagacagaga

SEQ ID NO: 121596 - RNA, 19 nt, Homo sapiens
gugcagacaggccauguga

SEQ ID NO: 121597 - RNA, 19 nt, Homo sapiens
ccugucaaguuaacaagga

SEQ ID NO: 121598 - RNA, 19 nt, Homo sapiens
gcucagcaugauucuuuaa

SEQ ID NO: 121599 - RNA, 19 nt, Homo sapiens
ggccugcaguaccugguuu

SEQ ID NO: 121600 - RNA, 19 nt, Homo sapiens
gaucaguacugggaaaaga

SEQ ID NO: 121601 - RNA, 19 nt, Homo sapiens
gugacaauggcuucuuuaa

SEQ ID NO: 121602 - RNA, 19 nt, Homo sapiens
cagauugccuccuaaugac

SEQ ID NO: 121603 - RNA, 19 nt, Homo sapiens
uaaguucacguaagauaca

SEQ ID NO: 121604 - RNA, 19 nt, Homo sapiens
gaagugguggcuggaauuc

SEQ ID NO: 121605 - RNA, 19 nt, Homo sapiens
gagcuggucaacuauguca

SEQ ID NO: 121606 - RNA, 19 nt, Homo sapiens
gagaauggcacacccuacu

SEQ ID NO: 121607 - RNA, 19 nt, Homo sapiens
ccacaaggaaaauaguuua

SEQ ID NO: 121608 - RNA, 19 nt, Homo sapiens
gucacaaccucucugaucu

SEQ ID NO: 121609 - RNA, 19 nt, Homo sapiens
guaagauacaaguuucaga

SEQ ID NO: 121610 - RNA, 19 nt, Homo sapiens
gaauuccacgcaccgauca

SEQ ID NO: 121611 - RNA, 19 nt, Homo sapiens
cuacagcccgaccuacaaa

SEQ ID NO: 121612 - RNA, 19 nt, Homo sapiens
ccucagccacccagaugua

SEQ ID NO: 121613 - RNA, 19 nt, Homo sapiens
ccuaacaggaugaaaguuc

SEQ ID NO: 121614 - RNA, 19 nt, Homo sapiens
ggucugaaggacuggauug

SEQ ID NO: 121615 - RNA, 19 nt, Homo sapiens
gagcuuucucuguguauuc

SEQ ID NO: 121616 - RNA, 19 nt, Homo sapiens
ggacaucauggccgagauc

SEQ ID NO: 121617 - RNA, 19 nt, Homo sapiens
gaccugaagcugccugcaa

SEQ ID NO: 121618 - RNA, 19 nt, Homo sapiens
uaugucaacaaacggaaua

SEQ ID NO: 121619 - RNA, 19 nt, Homo sapiens
acacgucaccggagagaug

SEQ ID NO: 121620 - RNA, 19 nt, Homo sapiens
gcuacagcccgaccuacaa

SEQ ID NO: 121621 - RNA, 19 nt, Homo sapiens
caggaucacuguggaaucg

SEQ ID NO: 121622 - RNA, 19 nt, Homo sapiens
caucauggccgagaucuac

SEQ ID NO: 121623 - RNA, 19 nt, Homo sapiens
ccuacagcgucuccaauag

SEQ ID NO: 121624 - RNA, 19 nt, Homo sapiens
aggacaagcacuacggaua

SEQ ID NO: 121625 - RNA, 19 nt, Homo sapiens
ugacgcggcucaaaaggaa

SEQ ID NO: 121626 - RNA, 19 nt, Homo sapiens
gggagaccugugcuaguuu

SEQ ID NO: 121627 - RNA, 19 nt, Homo sapiens
gaugagcuggucaacuaug

SEQ ID NO: 121628 - RNA, 19 nt, Homo sapiens
ggauuggccaaacaucaga

SEQ ID NO: 121629 - RNA, 19 nt, Homo sapiens
agaaaucagaggagagaug

SEQ ID NO: 121630 - RNA, 19 nt, Homo sapiens
acagaaaucagaggagaga

SEQ ID NO: 121631 - RNA, 19 nt, Homo sapiens
aaguagcuuuccacauuug

SEQ ID NO: 121632 - RNA, 19 nt, Homo sapiens
ggaauggaaagcggaguuc

SEQ ID NO: 121633 - RNA, 19 nt, Homo sapiens
caacacgucaccggagaga

SEQ ID NO: 121634 - RNA, 19 nt, Homo sapiens
gcacuacggauacaauucc

SEQ ID NO: 121635 - RNA, 19 nt, Homo sapiens
caagcacuacggauacaau

SEQ ID NO: 121636 - RNA, 19 nt, Homo sapiens
ccacagugucccaccauca

SEQ ID NO: 121637 - RNA, 19 nt, Homo sapiens
agucaggaguguaccaaca

SEQ ID NO: 121638 - RNA, 19 nt, Homo sapiens
ucacaaccucucugaucuu

SEQ ID NO: 121639 - RNA, 19 nt, Homo sapiens
ugucacaaccucucugauc

SEQ ID NO: 121640 - RNA, 19 nt, Homo sapiens
gcaucuaucgaguuugcaa

SEQ ID NO: 121641 - RNA, 19 nt, Homo sapiens
cccugcaucuaucgaguuu

SEQ ID NO: 121642 - RNA, 19 nt, Homo sapiens
ucuaggauccggcuuccaa

SEQ ID NO: 121643 - RNA, 19 nt, Homo sapiens
cggacuuccugcucuacaa

SEQ ID NO: 121644 - RNA, 19 nt, Homo sapiens
gcaaguagcuuuccacauu

SEQ ID NO: 121645 - RNA, 19 nt, Homo sapiens
gacaugagcuacuugaaga

SEQ ID NO: 121646 - RNA, 19 nt, Homo sapiens
cggaugagcuggucaacua

SEQ ID NO: 121647 - RNA, 19 nt, Homo sapiens
ggucaacuaugucaacaaa

SEQ ID NO: 121648 - RNA, 19 nt, Homo sapiens
gacaauggcuucuuuaaaa

SEQ ID NO: 121649 - RNA, 19 nt, Homo sapiens
caaguagcuuuccacauuu

SEQ ID NO: 121650 - RNA, 19 nt, Homo sapiens
ccacugaucucuacuacca

SEQ ID NO: 121651 - RNA, 19 nt, Homo sapiens
gaaugccugugccaauaaa

SEQ ID NO: 121652 - RNA, 19 nt, Homo sapiens
gcuucacccugucaaguua

SEQ ID NO: 121653 - RNA, 19 nt, Homo sapiens
gaaaccagcuuuuacuguu

SEQ ID NO: 121654 - RNA, 19 nt, Homo sapiens
caaccucucugaucuugug

SEQ ID NO: 121655 - RNA, 19 nt, Homo sapiens
cagcaugauucuuuaauag

SEQ ID NO: 121656 - RNA, 19 nt, Homo sapiens
ggacuggauuggccaaaca

SEQ ID NO: 121657 - RNA, 19 nt, Homo sapiens
ggaaugccugugccaauaa

SEQ ID NO: 121658 - RNA, 19 nt, Homo sapiens
ucacguaagauacaaguuu

SEQ ID NO: 121659 - RNA, 19 nt, Homo sapiens
gcacucugcuaaucaugug

SEQ ID NO: 121660 - RNA, 19 nt, Homo sapiens
ugacaauggcuucuuuaaa

SEQ ID NO: 121661 - RNA, 19 nt, Homo sapiens
gcuuggaacuucuggacaa

SEQ ID NO: 121662 - RNA, 19 nt, Homo sapiens
cggaggaccugcucacaug

SEQ ID NO: 121663 - RNA, 19 nt, Homo sapiens
ggacaugagcuacuugaag

SEQ ID NO: 121664 - RNA, 19 nt, Homo sapiens
acagauugccuccuaauga

SEQ ID NO: 121665 - RNA, 19 nt, Homo sapiens
gaaagcggaguuccuaaca

SEQ ID NO: 121666 - RNA, 19 nt, Homo sapiens
guaccugguuugcauagau

SEQ ID NO: 121667 - RNA, 19 nt, Homo sapiens
agacagagacgcaggaaug

SEQ ID NO: 121668 - RNA, 19 nt, Homo sapiens
gggugacaauggcuucuuu

SEQ ID NO: 121669 - RNA, 19 nt, Homo sapiens
aggaaugccugugccaaua

SEQ ID NO: 121670 - RNA, 19 nt, Homo sapiens
ggaaaauaguuuaggagaa

SEQ ID NO: 121671 - RNA, 19 nt, Homo sapiens
ggacaagcacuacggauac

SEQ ID NO: 121672 - RNA, 19 nt, Homo sapiens
ggauccggcuuccaacaug

SEQ ID NO: 121673 - RNA, 19 nt, Homo sapiens
cgggagaccugugcuaguu

SEQ ID NO: 121674 - RNA, 19 nt, Homo sapiens
ggaucacuguggaaucgaa

SEQ ID NO: 121675 - RNA, 19 nt, Homo sapiens
uugaagaggcuauguggua

SEQ ID NO: 121676 - RNA, 19 nt, Homo sapiens
ggagcuuucucuguguauu

SEQ ID NO: 121677 - RNA, 19 nt, Homo sapiens
acaaacaggacaagcacua

SEQ ID NO: 121678 - RNA, 19 nt, Homo sapiens
gcaguaccugguuugcaua

SEQ ID NO: 121679 - RNA, 19 nt, Homo sapiens
caaguggucaggaguuguu

SEQ ID NO: 121680 - RNA, 19 nt, Homo sapiens
cacaaccucucugaucuug

SEQ ID NO: 121681 - RNA, 19 nt, Homo sapiens
cagaagugguggcuggaau

SEQ ID NO: 121682 - RNA, 19 nt, Homo sapiens
gagggagcuuucucugugu

SEQ ID NO: 121683 - RNA, 19 nt, Homo sapiens
ggaacaauggccacagugu

SEQ ID NO: 121684 - RNA, 19 nt, Homo sapiens
gagcaggcccucuuuccau

SEQ ID NO: 121685 - RNA, 19 nt, Homo sapiens
ggagaccugugcuaguuuu

SEQ ID NO: 121686 - RNA, 19 nt, Homo sapiens
ggugacaauggcuucuuua

SEQ ID NO: 121687 - RNA, 19 nt, Homo sapiens
gacaagcacuacggauaca

SEQ ID NO: 121688 - RNA, 19 nt, Homo sapiens
gauccggcuuccaacaugu

SEQ ID NO: 121689 - RNA, 19 nt, Homo sapiens
caaggaaaauaguuuagga

SEQ ID NO: 121690 - RNA, 19 nt, Homo sapiens
cagagacgcaggaauggaa

SEQ ID NO: 121691 - RNA, 19 nt, Homo sapiens
cacguaagauacaaguuuc

SEQ ID NO: 121692 - RNA, 19 nt, Homo sapiens
ucaacuaugucaacaaacg

SEQ ID NO: 121693 - RNA, 19 nt, Homo sapiens
uaucgaguuugcaauguca

SEQ ID NO: 121694 - RNA, 19 nt, Homo sapiens
ccagggagcaagacagaga

SEQ ID NO: 121695 - RNA, 19 nt, Homo sapiens
gugcagacaggccauguga

SEQ ID NO: 121696 - RNA, 19 nt, Homo sapiens
ccugucaaguuaacaagga

SEQ ID NO: 121697 - RNA, 19 nt, Homo sapiens
gcucagcaugauucuuuaa

SEQ ID NO: 121698 - RNA, 19 nt, Homo sapiens
ggccugcaguaccugguuu

SEQ ID NO: 121699 - RNA, 19 nt, Homo sapiens
gaucaguacugggaaaaga

SEQ ID NO: 121700 - RNA, 19 nt, Homo sapiens
gugacaauggcuucuuuaa

SEQ ID NO: 121701 - RNA, 19 nt, Homo sapiens
cagauugccuccuaaugac

SEQ ID NO: 121702 - RNA, 19 nt, Homo sapiens
gagcuggucaacuauguca

SEQ ID NO: 121703 - RNA, 19 nt, Homo sapiens
uaaguucacguaagauaca

SEQ ID NO: 121704 - RNA, 19 nt, Homo sapiens
gaagugguggcuggaauuc

SEQ ID NO: 121705 - RNA, 19 nt, Homo sapiens
gagaauggcacacccuacu

SEQ ID NO: 121706 - RNA, 19 nt, Homo sapiens
ccacaaggaaaauaguuua

SEQ ID NO: 121707 - RNA, 19 nt, Homo sapiens
gucacaaccucucugaucu

SEQ ID NO: 121708 - RNA, 19 nt, Homo sapiens
guaagauacaaguuucaga

SEQ ID NO: 121709 - RNA, 19 nt, Homo sapiens
gaauuccacgcaccgauca

SEQ ID NO: 121710 - RNA, 19 nt, Homo sapiens
cuacagcccgaccuacaaa

SEQ ID NO: 121711 - RNA, 19 nt, Homo sapiens
ccuaacaggaugaaaguuc

SEQ ID NO: 121712 - RNA, 19 nt, Homo sapiens
ggucugaaggacuggauug

SEQ ID NO: 121713 - RNA, 19 nt, Homo sapiens
uaugucaacaaacggaaua

SEQ ID NO: 121714 - RNA, 19 nt, Homo sapiens
gagcuuucucuguguauuc

SEQ ID NO: 121715 - RNA, 19 nt, Homo sapiens
ggacaucauggccgagauc

SEQ ID NO: 121716 - RNA, 19 nt, Homo sapiens
gaccugaagcugccugcaa

SEQ ID NO: 121717 - RNA, 19 nt, Homo sapiens
acacgucaccggagagaug

SEQ ID NO: 121718 - RNA, 19 nt, Homo sapiens
gcuacagcccgaccuacaa

SEQ ID NO: 121719 - RNA, 19 nt, Homo sapiens
caggaucacuguggaaucg

SEQ ID NO: 121720 - RNA, 19 nt, Homo sapiens
caucauggccgagaucuac

SEQ ID NO: 121721 - RNA, 19 nt, Homo sapiens
ccuacagcgucuccaauag

SEQ ID NO: 121722 - RNA, 19 nt, Homo sapiens
aggacaagcacuacggaua

SEQ ID NO: 121723 - RNA, 19 nt, Homo sapiens
ugacgcggcucaaaaggaa

SEQ ID NO: 121724 - RNA, 19 nt, Homo sapiens
gggagaccugugcuaguuu

SEQ ID NO: 121725 - RNA, 19 nt, Homo sapiens
gaugagcuggucaacuaug

SEQ ID NO: 121726 - RNA, 19 nt, Homo sapiens
ggauuggccaaacaucaga

SEQ ID NO: 121727 - RNA, 19 nt, Homo sapiens
agaaaucagaggagagaug

SEQ ID NO: 121728 - RNA, 19 nt, Homo sapiens
acagaaaucagaggagaga

SEQ ID NO: 121729 - RNA, 19 nt, Homo sapiens
aaguagcuuuccacauuug

SEQ ID NO: 121730 - RNA, 19 nt, Homo sapiens
ggaauggaaagcggaguuc

SEQ ID NO: 121731 - RNA, 19 nt, Homo sapiens
caacacgucaccggagaga

SEQ ID NO: 121732 - RNA, 19 nt, Homo sapiens
gcacuacggauacaauucc

SEQ ID NO: 121733 - RNA, 19 nt, Homo sapiens
caagcacuacggauacaau

SEQ ID NO: 121734 - RNA, 19 nt, Homo sapiens
ccacagugucccaccauca

SEQ ID NO: 121735 - RNA, 19 nt, Homo sapiens
agucaggaguguaccaaca

SEQ ID NO: 121736 - RNA, 19 nt, Homo sapiens
ucacaaccucucugaucuu

SEQ ID NO: 121737 - RNA, 19 nt, Homo sapiens
ugucacaaccucucugauc

SEQ ID NO: 121738 - RNA, 19 nt, Homo sapiens
gcaucuaucgaguuugcaa

SEQ ID NO: 121739 - RNA, 19 nt, Homo sapiens
cccugcaucuaucgaguuu

SEQ ID NO: 121740 - RNA, 19 nt, Homo sapiens
ucuaggauccggcuuccaa

SEQ ID NO: 121741 - RNA, 19 nt, Homo sapiens
cggacuuccugcucuacaa

SEQ ID NO: 121742 - RNA, 19 nt, Homo sapiens
gacccacugaucucuacua

SEQ ID NO: 121743 - RNA, 19 nt, Homo sapiens
ggagcaggcccucuuucca

SEQ ID NO: 121744 - RNA, 19 nt, Homo sapiens
gcaaguagcuuuccacauu

SEQ ID NO: 121745 - RNA, 19 nt, Homo sapiens
gacaugagcuacuugaaga

SEQ ID NO: 121746 - RNA, 19 nt, Homo sapiens
cggaugagcuggucaacua

SEQ ID NO: 121747 - RNA, 19 nt, Homo sapiens
ggucaacuaugucaacaaa

SEQ ID NO: 121748 - RNA, 19 nt, Homo sapiens
gacaauggcuucuuuaaaa

SEQ ID NO: 121749 - RNA, 19 nt, Homo sapiens
caaguagcuuuccacauuu

SEQ ID NO: 121750 - RNA, 19 nt, Homo sapiens
ccacugaucucuacuacca

SEQ ID NO: 121751 - RNA, 19 nt, Homo sapiens
gaaugccugugccaauaaa

SEQ ID NO: 121752 - RNA, 19 nt, Homo sapiens
gcuucacccugucaaguua

SEQ ID NO: 121753 - RNA, 19 nt, Homo sapiens
gaaaccagcuuuuacuguu

SEQ ID NO: 121754 - RNA, 19 nt, Homo sapiens
caaccucucugaucuugug

SEQ ID NO: 121755 - RNA, 19 nt, Homo sapiens
cagcaugauucuuuaauag

SEQ ID NO: 121756 - RNA, 19 nt, Homo sapiens
ggacuggauuggccaaaca

SEQ ID NO: 121757 - RNA, 19 nt, Homo sapiens
ggaaugccugugccaauaa

SEQ ID NO: 121758 - RNA, 19 nt, Homo sapiens
ucacguaagauacaaguuu

SEQ ID NO: 121759 - RNA, 19 nt, Homo sapiens
gcacucugcuaaucaugug

SEQ ID NO: 121760 - RNA, 19 nt, Homo sapiens
ugacaauggcuucuuuaaa

SEQ ID NO: 121761 - RNA, 19 nt, Homo sapiens
gcuuggaacuucuggacaa

SEQ ID NO: 121762 - RNA, 19 nt, Homo sapiens
cggaggaccugcucacaug

SEQ ID NO: 121763 - RNA, 19 nt, Homo sapiens
ggacaugagcuacuugaag

SEQ ID NO: 121764 - RNA, 19 nt, Homo sapiens
acagauugccuccuaauga

SEQ ID NO: 121765 - RNA, 19 nt, Homo sapiens
gaaagcggaguuccuaaca

SEQ ID NO: 121766 - RNA, 19 nt, Homo sapiens
agacagagacgcaggaaug

SEQ ID NO: 121767 - RNA, 19 nt, Homo sapiens
gggugacaauggcuucuuu

SEQ ID NO: 121768 - RNA, 19 nt, Homo sapiens
aggaaugccugugccaaua

SEQ ID NO: 121769 - RNA, 19 nt, Homo sapiens
ggaaaauaguuuaggagaa

SEQ ID NO: 121770 - RNA, 19 nt, Homo sapiens
ggauccggcuuccaacaug

SEQ ID NO: 121771 - RNA, 19 nt, Homo sapiens
ggacaagcacuacggauac

SEQ ID NO: 121772 - RNA, 19 nt, Homo sapiens
cgggagaccugugcuaguu

SEQ ID NO: 121773 - RNA, 19 nt, Homo sapiens
ggaucacuguggaaucgaa

SEQ ID NO: 121774 - RNA, 19 nt, Homo sapiens
uugaagaggcuauguggua

SEQ ID NO: 121775 - RNA, 19 nt, Homo sapiens
ggagcuuucucuguguauu

SEQ ID NO: 121776 - RNA, 19 nt, Homo sapiens
caccucagccucccgagua

SEQ ID NO: 121777 - RNA, 19 nt, Homo sapiens
acaaacaggacaagcacua

SEQ ID NO: 121778 - RNA, 19 nt, Homo sapiens
caaguggucaggaguuguu

SEQ ID NO: 121779 - RNA, 19 nt, Homo sapiens
cacaaccucucugaucuug

SEQ ID NO: 121780 - RNA, 19 nt, Homo sapiens
cagaagugguggcuggaau

SEQ ID NO: 121781 - RNA, 19 nt, Homo sapiens
gagggagcuuucucugugu

SEQ ID NO: 121782 - RNA, 19 nt, Homo sapiens
ggaacaauggccacagugu

SEQ ID NO: 121783 - RNA, 19 nt, Homo sapiens
gagcaggcccucuuuccau

SEQ ID NO: 121784 - RNA, 19 nt, Homo sapiens
ggagaccugugcuaguuuu

SEQ ID NO: 121785 - RNA, 19 nt, Homo sapiens
ggugacaauggcuucuuua

SEQ ID NO: 121786 - RNA, 19 nt, Homo sapiens
gacaagcacuacggauaca

SEQ ID NO: 121787 - RNA, 19 nt, Homo sapiens
caaggaaaauaguuuagga

SEQ ID NO: 121788 - RNA, 19 nt, Homo sapiens
cagagacgcaggaauggaa

SEQ ID NO: 121789 - RNA, 19 nt, Homo sapiens
gauccggcuuccaacaugu

SEQ ID NO: 121790 - RNA, 19 nt, Homo sapiens
cacguaagauacaaguuuc

SEQ ID NO: 121791 - RNA, 19 nt, Homo sapiens
ucaacuaugucaacaaacg

SEQ ID NO: 121792 - RNA, 19 nt, Homo sapiens
uaucgaguuugcaauguca

SEQ ID NO: 121793 - RNA, 19 nt, Homo sapiens
ccagggagcaagacagaga

SEQ ID NO: 121794 - RNA, 19 nt, Homo sapiens
gugcagacaggccauguga

SEQ ID NO: 121795 - RNA, 19 nt, Homo sapiens
ccugucaaguuaacaagga

SEQ ID NO: 121796 - RNA, 19 nt, Homo sapiens
gcucagcaugauucuuuaa

SEQ ID NO: 121797 - RNA, 19 nt, Homo sapiens
gaucaguacugggaaaaga

SEQ ID NO: 121798 - RNA, 19 nt, Homo sapiens
gugacaauggcuucuuuaa

SEQ ID NO: 121799 - RNA, 19 nt, Homo sapiens
cagauugccuccuaaugac

SEQ ID NO: 121800 - RNA, 19 nt, Homo sapiens
uaaguucacguaagauaca

SEQ ID NO: 121801 - RNA, 19 nt, Homo sapiens
gaagugguggcuggaauuc

SEQ ID NO: 121802 - RNA, 19 nt, Homo sapiens
gagcuggucaacuauguca

SEQ ID NO: 121803 - RNA, 19 nt, Homo sapiens
gagaauggcacacccuacu

SEQ ID NO: 121804 - RNA, 19 nt, Homo sapiens
ccacaaggaaaauaguuua

SEQ ID NO: 121805 - RNA, 19 nt, Homo sapiens
gucacaaccucucugaucu

SEQ ID NO: 121806 - RNA, 19 nt, Homo sapiens
ccucagccacccagaugua

SEQ ID NO: 121807 - RNA, 19 nt, Homo sapiens
guaagauacaaguuucaga

SEQ ID NO: 121808 - RNA, 19 nt, Homo sapiens
gaauuccacgcaccgauca

SEQ ID NO: 121809 - RNA, 19 nt, Homo sapiens
cuacagcccgaccuacaaa

SEQ ID NO: 121810 - RNA, 19 nt, Homo sapiens
uaugucaacaaacggaaua

SEQ ID NO: 121811 - RNA, 19 nt, Homo sapiens
ccuaacaggaugaaaguuc

SEQ ID NO: 121812 - RNA, 19 nt, Homo sapiens
ggucugaaggacuggauug

SEQ ID NO: 121813 - RNA, 19 nt, Homo sapiens
gagcuuucucuguguauuc

SEQ ID NO: 121814 - RNA, 19 nt, Homo sapiens
ggacaucauggccgagauc

SEQ ID NO: 121815 - RNA, 19 nt, Homo sapiens
gaccugaagcugccugcaa

SEQ ID NO: 121816 - RNA, 19 nt, Homo sapiens
acacgucaccggagagaug

SEQ ID NO: 121817 - RNA, 19 nt, Homo sapiens
gcuacagcccgaccuacaa

SEQ ID NO: 121818 - RNA, 19 nt, Homo sapiens
caggaucacuguggaaucg

SEQ ID NO: 121819 - RNA, 19 nt, Homo sapiens
caucauggccgagaucuac

SEQ ID NO: 121820 - RNA, 19 nt, Homo sapiens
ccuacagcgucuccaauag

SEQ ID NO: 121821 - RNA, 19 nt, Homo sapiens
aggacaagcacuacggaua

SEQ ID NO: 121822 - RNA, 19 nt, Homo sapiens
ugacgcggcucaaaaggaa

SEQ ID NO: 121823 - RNA, 19 nt, Homo sapiens
gggagaccugugcuaguuu

SEQ ID NO: 121824 - RNA, 19 nt, Homo sapiens
ggauuggccaaacaucaga

SEQ ID NO: 121825 - RNA, 19 nt, Homo sapiens
gaugagcuggucaacuaug

SEQ ID NO: 121826 - RNA, 19 nt, Homo sapiens
agaaaucagaggagagaug

SEQ ID NO: 121827 - RNA, 19 nt, Homo sapiens
acagaaaucagaggagaga

SEQ ID NO: 121828 - RNA, 19 nt, Homo sapiens
aaguagcuuuccacauuug

SEQ ID NO: 121829 - RNA, 19 nt, Homo sapiens
ggaauggaaagcggaguuc

SEQ ID NO: 121830 - RNA, 19 nt, Homo sapiens
caacacgucaccggagaga

SEQ ID NO: 121831 - RNA, 19 nt, Homo sapiens
gcacuacggauacaauucc

SEQ ID NO: 121832 - RNA, 19 nt, Homo sapiens
caagcacuacggauacaau

SEQ ID NO: 121833 - RNA, 19 nt, Homo sapiens
ccacagugucccaccauca

SEQ ID NO: 121834 - RNA, 19 nt, Homo sapiens
agucaggaguguaccaaca

SEQ ID NO: 121835 - RNA, 19 nt, Homo sapiens
ucacaaccucucugaucuu

SEQ ID NO: 121836 - RNA, 19 nt, Homo sapiens
ugucacaaccucucugauc

SEQ ID NO: 121837 - RNA, 19 nt, Homo sapiens
gcaucuaucgaguuugcaa

SEQ ID NO: 121838 - RNA, 19 nt, Homo sapiens
cccugcaucuaucgaguuu

SEQ ID NO: 121839 - RNA, 19 nt, Homo sapiens
cggacuuccugcucuacaa

SEQ ID NO: 121840 - RNA, 19 nt, Homo sapiens
ucuaggauccggcuuccaa

SEQ ID NO: 121841 - RNA, 19 nt, Homo sapiens
gacccacugaucucuacua

SEQ ID NO: 121842 - RNA, 19 nt, Homo sapiens
gaccaaguccuggcuacau

SEQ ID NO: 121843 - RNA, 19 nt, Homo sapiens
uggaaucgaaucagaagug

SEQ ID NO: 121844 - RNA, 19 nt, Homo sapiens
gcaaguagcuuuccacauu

SEQ ID NO: 121845 - RNA, 19 nt, Homo sapiens
gacaugagcuacuugaaga

SEQ ID NO: 121846 - RNA, 19 nt, Homo sapiens
cggaugagcuggucaacua

SEQ ID NO: 121847 - RNA, 19 nt, Homo sapiens
ggucaacuaugucaacaaa

SEQ ID NO: 121848 - RNA, 19 nt, Homo sapiens
gacaauggcuucuuuaaaa

SEQ ID NO: 121849 - RNA, 19 nt, Homo sapiens
caaguagcuuuccacauuu

SEQ ID NO: 121850 - RNA, 19 nt, Homo sapiens
ccacugaucucuacuacca

SEQ ID NO: 121851 - RNA, 19 nt, Homo sapiens
gaaugccugugccaauaaa

SEQ ID NO: 121852 - RNA, 19 nt, Homo sapiens
gcuucacccugucaaguua

SEQ ID NO: 121853 - RNA, 19 nt, Homo sapiens
gaaaccagcuuuuacuguu

SEQ ID NO: 121854 - RNA, 19 nt, Homo sapiens
caaccucucugaucuugug

SEQ ID NO: 121855 - RNA, 19 nt, Homo sapiens
cagcaugauucuuuaauag

SEQ ID NO: 121856 - RNA, 19 nt, Homo sapiens
ggacuggauuggccaaaca

SEQ ID NO: 121857 - RNA, 19 nt, Homo sapiens
ggaaugccugugccaauaa

SEQ ID NO: 121858 - RNA, 19 nt, Homo sapiens
ucacguaagauacaaguuu

SEQ ID NO: 121859 - RNA, 19 nt, Homo sapiens
gcacucugcuaaucaugug

SEQ ID NO: 121860 - RNA, 19 nt, Homo sapiens
ugacaauggcuucuuuaaa

SEQ ID NO: 121861 - RNA, 19 nt, Homo sapiens
gcuuggaacuucuggacaa

SEQ ID NO: 121862 - RNA, 19 nt, Homo sapiens
cggaggaccugcucacaug

SEQ ID NO: 121863 - RNA, 19 nt, Homo sapiens
ggacaugagcuacuugaag

SEQ ID NO: 121864 - RNA, 19 nt, Homo sapiens
acagauugccuccuaauga

SEQ ID NO: 121865 - RNA, 19 nt, Homo sapiens
gaaagcggaguuccuaaca

SEQ ID NO: 121866 - RNA, 19 nt, Homo sapiens
guaccugguuugcauagau

SEQ ID NO: 121867 - RNA, 19 nt, Homo sapiens
agacagagacgcaggaaug

SEQ ID NO: 121868 - RNA, 19 nt, Homo sapiens
gggugacaauggcuucuuu

SEQ ID NO: 121869 - RNA, 19 nt, Homo sapiens
aggaaugccugugccaaua

SEQ ID NO: 121870 - RNA, 19 nt, Homo sapiens
ggaaaauaguuuaggagaa

SEQ ID NO: 121871 - RNA, 19 nt, Homo sapiens
ggacaagcacuacggauac

SEQ ID NO: 121872 - RNA, 19 nt, Homo sapiens
ggauccggcuuccaacaug

SEQ ID NO: 121873 - RNA, 19 nt, Homo sapiens
cgggagaccugugcuaguu

SEQ ID NO: 121874 - RNA, 19 nt, Homo sapiens
ggaucacuguggaaucgaa

SEQ ID NO: 121875 - RNA, 19 nt, Homo sapiens
uugaagaggcuauguggua

SEQ ID NO: 121876 - RNA, 19 nt, Homo sapiens
ggagcuuucucuguguauu

SEQ ID NO: 121877 - RNA, 19 nt, Homo sapiens
acaaacaggacaagcacua

SEQ ID NO: 121878 - RNA, 19 nt, Homo sapiens
gcaguaccugguuugcaua

SEQ ID NO: 121879 - RNA, 19 nt, Homo sapiens
caaguggucaggaguuguu

SEQ ID NO: 121880 - RNA, 19 nt, Homo sapiens
cacaaccucucugaucuug

SEQ ID NO: 121881 - RNA, 19 nt, Homo sapiens
cagaagugguggcuggaau

SEQ ID NO: 121882 - RNA, 19 nt, Homo sapiens
gagggagcuuucucugugu

SEQ ID NO: 121883 - RNA, 19 nt, Homo sapiens
ggaacaauggccacagugu

SEQ ID NO: 121884 - RNA, 19 nt, Homo sapiens
gagcaggcccucuuuccau

SEQ ID NO: 121885 - RNA, 19 nt, Homo sapiens
ggagaccugugcuaguuuu

SEQ ID NO: 121886 - RNA, 19 nt, Homo sapiens
ggugacaauggcuucuuua

SEQ ID NO: 121887 - RNA, 19 nt, Homo sapiens
gacaagcacuacggauaca

SEQ ID NO: 121888 - RNA, 19 nt, Homo sapiens
gauccggcuuccaacaugu

SEQ ID NO: 121889 - RNA, 19 nt, Homo sapiens
caaggaaaauaguuuagga

SEQ ID NO: 121890 - RNA, 19 nt, Homo sapiens
cagagacgcaggaauggaa

SEQ ID NO: 121891 - RNA, 19 nt, Homo sapiens
cacguaagauacaaguuuc

SEQ ID NO: 121892 - RNA, 19 nt, Homo sapiens
ucaacuaugucaacaaacg

SEQ ID NO: 121893 - RNA, 19 nt, Homo sapiens
uaucgaguuugcaauguca

SEQ ID NO: 121894 - RNA, 19 nt, Homo sapiens
ccagggagcaagacagaga

SEQ ID NO: 121895 - RNA, 19 nt, Homo sapiens
gugcagacaggccauguga

SEQ ID NO: 121896 - RNA, 19 nt, Homo sapiens
ccugucaaguuaacaagga

SEQ ID NO: 121897 - RNA, 19 nt, Homo sapiens
gcucagcaugauucuuuaa

SEQ ID NO: 121898 - RNA, 19 nt, Homo sapiens
ggccugcaguaccugguuu

SEQ ID NO: 121899 - RNA, 19 nt, Homo sapiens
gaucaguacugggaaaaga

SEQ ID NO: 121900 - RNA, 19 nt, Homo sapiens
gugacaauggcuucuuuaa

SEQ ID NO: 121901 - RNA, 19 nt, Homo sapiens
cagauugccuccuaaugac

SEQ ID NO: 121902 - RNA, 19 nt, Homo sapiens
gagcuggucaacuauguca

SEQ ID NO: 121903 - RNA, 19 nt, Homo sapiens
uaaguucacguaagauaca

SEQ ID NO: 121904 - RNA, 19 nt, Homo sapiens
gaagugguggcuggaauuc

SEQ ID NO: 121905 - RNA, 19 nt, Homo sapiens
gagaauggcacacccuacu

SEQ ID NO: 121906 - RNA, 19 nt, Homo sapiens
ccacaaggaaaauaguuua

SEQ ID NO: 121907 - RNA, 19 nt, Homo sapiens
gucacaaccucucugaucu

SEQ ID NO: 121908 - RNA, 19 nt, Homo sapiens
guaagauacaaguuucaga

SEQ ID NO: 121909 - RNA, 19 nt, Homo sapiens
gaauuccacgcaccgauca

SEQ ID NO: 121910 - RNA, 19 nt, Homo sapiens
cuacagcccgaccuacaaa

SEQ ID NO: 121911 - RNA, 19 nt, Homo sapiens
ccuaacaggaugaaaguuc

SEQ ID NO: 121912 - RNA, 19 nt, Homo sapiens
ggucugaaggacuggauug

SEQ ID NO: 121913 - RNA, 19 nt, Homo sapiens
uaugucaacaaacggaaua

SEQ ID NO: 121914 - RNA, 19 nt, Homo sapiens
gagcuuucucuguguauuc

SEQ ID NO: 121915 - RNA, 19 nt, Homo sapiens
ggacaucauggccgagauc

SEQ ID NO: 121916 - RNA, 19 nt, Homo sapiens
gaccugaagcugccugcaa

SEQ ID NO: 121917 - RNA, 19 nt, Homo sapiens
acacgucaccggagagaug

SEQ ID NO: 121918 - RNA, 19 nt, Homo sapiens
gcuacagcccgaccuacaa

SEQ ID NO: 121919 - RNA, 19 nt, Homo sapiens
caggaucacuguggaaucg

SEQ ID NO: 121920 - RNA, 19 nt, Homo sapiens
caucauggccgagaucuac

SEQ ID NO: 121921 - RNA, 19 nt, Homo sapiens
ccuacagcgucuccaauag

SEQ ID NO: 121922 - RNA, 19 nt, Homo sapiens
aggacaagcacuacggaua

SEQ ID NO: 121923 - RNA, 19 nt, Homo sapiens
ugacgcggcucaaaaggaa

SEQ ID NO: 121924 - RNA, 19 nt, Homo sapiens
gggagaccugugcuaguuu

SEQ ID NO: 121925 - RNA, 19 nt, Homo sapiens
gaugagcuggucaacuaug

SEQ ID NO: 121926 - RNA, 19 nt, Homo sapiens
ggauuggccaaacaucaga

SEQ ID NO: 121927 - RNA, 19 nt, Homo sapiens
agaaaucagaggagagaug

SEQ ID NO: 121928 - RNA, 19 nt, Homo sapiens
acagaaaucagaggagaga

SEQ ID NO: 121929 - RNA, 19 nt, Homo sapiens
aaguagcuuuccacauuug

SEQ ID NO: 121930 - RNA, 19 nt, Homo sapiens
ggaauggaaagcggaguuc

SEQ ID NO: 121931 - RNA, 19 nt, Homo sapiens
caacacgucaccggagaga

SEQ ID NO: 121932 - RNA, 19 nt, Homo sapiens
gcacuacggauacaauucc

SEQ ID NO: 121933 - RNA, 19 nt, Homo sapiens
caagcacuacggauacaau

SEQ ID NO: 121934 - RNA, 19 nt, Homo sapiens
ccacagugucccaccauca

SEQ ID NO: 121935 - RNA, 19 nt, Homo sapiens
agucaggaguguaccaaca

SEQ ID NO: 121936 - RNA, 19 nt, Homo sapiens
ucacaaccucucugaucuu

SEQ ID NO: 121937 - RNA, 19 nt, Homo sapiens
ugucacaaccucucugauc

SEQ ID NO: 121938 - RNA, 19 nt, Homo sapiens
gcaucuaucgaguuugcaa

SEQ ID NO: 121939 - RNA, 19 nt, Homo sapiens
cccugcaucuaucgaguuu

SEQ ID NO: 121940 - RNA, 19 nt, Homo sapiens
ucuaggauccggcuuccaa

SEQ ID NO: 121941 - RNA, 19 nt, Homo sapiens
cggacuuccugcucuacaa

SEQ ID NO: 121942 - RNA, 19 nt, Homo sapiens
gacccacugaucucuacua

SEQ ID NO: 121943 - RNA, 19 nt, Homo sapiens
ggagcaggcccucuuucca

SEQ ID NO: 121944 - RNA, 19 nt, Homo sapiens
gcacagacuccaaguauua

SEQ ID NO: 121945 - RNA, 19 nt, Homo sapiens
gaagaaugguaccucguuu

SEQ ID NO: 121946 - RNA, 19 nt, Homo sapiens
gcaccuacgugaagaaugg

SEQ ID NO: 121947 - RNA, 19 nt, Homo sapiens
gcuagaggccugaggauga

SEQ ID NO: 121948 - RNA, 19 nt, Homo sapiens
ccgaggugcucaagaacua

SEQ ID NO: 121949 - RNA, 19 nt, Homo sapiens
ggaucccgcugcacaaguu

SEQ ID NO: 121950 - RNA, 19 nt, Homo sapiens
gaacaucuucuccuucuac

SEQ ID NO: 121951 - RNA, 19 nt, Homo sapiens
cagcugacauggaaauaca

SEQ ID NO: 121952 - RNA, 19 nt, Homo sapiens
ggcacagacuccaaguauu

SEQ ID NO: 121953 - RNA, 19 nt, Homo sapiens
ugacauggaaauacaguug

SEQ ID NO: 121954 - RNA, 19 nt, Homo sapiens
cacccuaccuguucagugu

SEQ ID NO: 121955 - RNA, 19 nt, Homo sapiens
cacaggcacuucccucaug

SEQ ID NO: 121956 - RNA, 19 nt, Homo sapiens
aaugguaccucguuugaca

SEQ ID NO: 121957 - RNA, 19 nt, Homo sapiens
ggagggcugugaggccauu

SEQ ID NO: 121958 - RNA, 19 nt, Homo sapiens
cagccgagcucguguaucc

SEQ ID NO: 121959 - RNA, 19 nt, Homo sapiens
ugaagaaugguaccucguu

SEQ ID NO: 121960 - RNA, 19 nt, Homo sapiens
agaaugguaccucguuuga

SEQ ID NO: 121961 - RNA, 19 nt, Homo sapiens
acauggaaauacaguuguu

SEQ ID NO: 121962 - RNA, 19 nt, Homo sapiens
gauccugggcgacgucuuc

SEQ ID NO: 121963 - RNA, 19 nt, Homo sapiens
uggcacagacuccaaguau

SEQ ID NO: 121964 - RNA, 19 nt, Homo sapiens
ccugggcggugucaaagug

SEQ ID NO: 121965 - RNA, 19 nt, Homo sapiens
gcuggauccaccacaagua

SEQ ID NO: 121966 - RNA, 19 nt, Homo sapiens
guaccucguuugacaucca

SEQ ID NO: 121967 - RNA, 19 nt, Homo sapiens
ggcgucaucccggcuauaa

SEQ ID NO: 121968 - RNA, 19 nt, Homo sapiens
cguuugacauccacuaugg

SEQ ID NO: 121969 - RNA, 19 nt, Homo sapiens
cuacauggacgcccaguac

SEQ ID NO: 121970 - RNA, 19 nt, Homo sapiens
ggauccaccacaaguacaa

SEQ ID NO: 121971 - RNA, 19 nt, Homo sapiens
gcagcugaccucuguuguc

SEQ ID NO: 121972 - RNA, 19 nt, Homo sapiens
cuucaucgcagccaaguuc

SEQ ID NO: 121973 - RNA, 19 nt, Homo sapiens
uucccgaggugcucaagaa

SEQ ID NO: 121974 - RNA, 19 nt, Homo sapiens
gcaucuccgucaacaacgu

SEQ ID NO: 121975 - RNA, 19 nt, Homo sapiens
acauggacgcccaguacua

SEQ ID NO: 121976 - RNA, 19 nt, Homo sapiens
gugcuucacagucgucuuc

SEQ ID NO: 121977 - RNA, 19 nt, Homo sapiens
acaaccugaugcagcagaa

SEQ ID NO: 121978 - RNA, 19 nt, Homo sapiens
acaacgugcugcccgucuu

SEQ ID NO: 121979 - RNA, 19 nt, Homo sapiens
ccacacacacccacacacu

SEQ ID NO: 121980 - RNA, 19 nt, Homo sapiens
ucucuguccuaccugaaug

SEQ ID NO: 121981 - RNA, 19 nt, Homo sapiens
gaacuucacugucaucuuc

SEQ ID NO: 121982 - RNA, 19 nt, Homo sapiens
gaugucaccuucaccauua

SEQ ID NO: 121983 - RNA, 19 nt, Homo sapiens
ugacagaccuugaauaugu

SEQ ID NO: 121984 - RNA, 19 nt, Homo sapiens
gaacguugcugguugaaau

SEQ ID NO: 121985 - RNA, 19 nt, Homo sapiens
guaagucucuuuccaucua

SEQ ID NO: 121986 - RNA, 19 nt, Homo sapiens
guucuuggcuuuaaucauu

SEQ ID NO: 121987 - RNA, 19 nt, Homo sapiens
aagcagagaucaugguaua

SEQ ID NO: 121988 - RNA, 19 nt, Homo sapiens
guaguuggauuguuuguau

SEQ ID NO: 121989 - RNA, 19 nt, Homo sapiens
gcccauauauugcauuuau

SEQ ID NO: 121990 - RNA, 19 nt, Homo sapiens
gaauuaagaccaaacagaa

SEQ ID NO: 121991 - RNA, 19 nt, Homo sapiens
caacuugaauuaagaccaa

SEQ ID NO: 121992 - RNA, 19 nt, Homo sapiens
cagagaucaugguauaaua

SEQ ID NO: 121993 - RNA, 19 nt, Homo sapiens
cuacagaguuuagcacauu

SEQ ID NO: 121994 - RNA, 19 nt, Homo sapiens
gggaggcacuguuauguuc

SEQ ID NO: 121995 - RNA, 19 nt, Homo sapiens
ccaaacauaugcacaagca

SEQ ID NO: 121996 - RNA, 19 nt, Homo sapiens
aagcaaggcccauauauug

SEQ ID NO: 121997 - RNA, 19 nt, Homo sapiens
cacacacacuucacacaua

SEQ ID NO: 121998 - RNA, 19 nt, Homo sapiens
aaacagaacaugagaauac

SEQ ID NO: 121999 - RNA, 19 nt, Homo sapiens
guaccuggaucauucugaa

SEQ ID NO: 122000 - RNA, 19 nt, Homo sapiens
ggaccagagugccaaggaa

SEQ ID NO: 122001 - RNA, 19 nt, Homo sapiens
caagcaaggcccauauauu

SEQ ID NO: 122002 - RNA, 19 nt, Homo sapiens
aagcaaauuccgagcauua

SEQ ID NO: 122003 - RNA, 19 nt, Homo sapiens
caagcuuacuggcagauug

SEQ ID NO: 122004 - RNA, 19 nt, Homo sapiens
gaagcaaauuccgagcauu

SEQ ID NO: 122005 - RNA, 19 nt, Homo sapiens
gcagagaucaugguauaau

SEQ ID NO: 122006 - RNA, 19 nt, Homo sapiens
ccaagucucuguggaagga

SEQ ID NO: 122007 - RNA, 19 nt, Homo sapiens
gaaaucccgaggugucauu

SEQ ID NO: 122008 - RNA, 19 nt, Homo sapiens
gaaaaucuccaaacauaug

SEQ ID NO: 122009 - RNA, 19 nt, Homo sapiens
gaacaugagaauacacaca

SEQ ID NO: 122010 - RNA, 19 nt, Homo sapiens
ccaaacagaacaugagaau

SEQ ID NO: 122011 - RNA, 19 nt, Homo sapiens
gacagaccuugaauauguu

SEQ ID NO: 122012 - RNA, 19 nt, Homo sapiens
ggucugagaguuagggaaa

SEQ ID NO: 122013 - RNA, 19 nt, Homo sapiens
ucaagcaucucccauuguc

SEQ ID NO: 122014 - RNA, 19 nt, Homo sapiens
gcuacgaccacucccauuu

SEQ ID NO: 122015 - RNA, 19 nt, Homo sapiens
gagaauacacacacacaca

SEQ ID NO: 122016 - RNA, 19 nt, Homo sapiens
ggaugucaccuucaccauu

SEQ ID NO: 122017 - RNA, 19 nt, Homo sapiens
guuuggaguucuuggcuuu

SEQ ID NO: 122018 - RNA, 19 nt, Homo sapiens
ggaucauucugaagcaaau

SEQ ID NO: 122019 - RNA, 19 nt, Homo sapiens
acacacacacacacauaua

SEQ ID NO: 122020 - RNA, 19 nt, Homo sapiens
ggucaaucuuucuccauuc

SEQ ID NO: 122021 - RNA, 19 nt, Homo sapiens
gcaagacgcacagcagguu

SEQ ID NO: 122022 - RNA, 19 nt, Homo sapiens
gggcaggucugagaguuag

SEQ ID NO: 122023 - RNA, 19 nt, Homo sapiens
acacacacacacacacaua

SEQ ID NO: 122024 - RNA, 19 nt, Homo sapiens
cagagaauguagcuguuuc

SEQ ID NO: 122025 - RNA, 19 nt, Homo sapiens
gagcuuguccgggaucauu

SEQ ID NO: 122026 - RNA, 19 nt, Homo sapiens
ugaauuaagaccaaacaga

SEQ ID NO: 122027 - RNA, 19 nt, Homo sapiens
guugcaacuugaauuaaga

SEQ ID NO: 122028 - RNA, 19 nt, Homo sapiens
gguugcaacuugaauuaag

SEQ ID NO: 122029 - RNA, 19 nt, Homo sapiens
ggacuucguggauggaaug

SEQ ID NO: 122030 - RNA, 19 nt, Homo sapiens
ggccagcaguuuggagaaa

SEQ ID NO: 122031 - RNA, 19 nt, Homo sapiens
gcuggugccucucuauugg

SEQ ID NO: 122032 - RNA, 19 nt, Homo sapiens
ucaacuacuuggauaugga

SEQ ID NO: 122033 - RNA, 19 nt, Homo sapiens
auggaggaauuacguuaua

SEQ ID NO: 122034 - RNA, 19 nt, Homo sapiens
acacacauauacacacaca

SEQ ID NO: 122035 - RNA, 19 nt, Homo sapiens
acacacacauauacacaca

SEQ ID NO: 122036 - RNA, 19 nt, Homo sapiens
caggugggaggcacuguua

SEQ ID NO: 122037 - RNA, 19 nt, Homo sapiens
gcacuagcccagccugcaa

SEQ ID NO: 122038 - RNA, 19 nt, Homo sapiens
caaacagaacaugagaaua

SEQ ID NO: 122039 - RNA, 19 nt, Homo sapiens
agaauaugcuguggagugu

SEQ ID NO: 122040 - RNA, 19 nt, Homo sapiens
caugagcaguaacccagaa

SEQ ID NO: 122041 - RNA, 19 nt, Homo sapiens
ccagccaggucaaucuuuc

SEQ ID NO: 122042 - RNA, 19 nt, Homo sapiens
gauggaggaauuacguuau

SEQ ID NO: 122043 - RNA, 19 nt, Homo sapiens
ugauggaggaauuacguua

SEQ ID NO: 122044 - RNA, 19 nt, Homo sapiens
gaccaaacagaacaugaga

SEQ ID NO: 122045 - RNA, 19 nt, Homo sapiens
gcaaauuccgagcauuaca

SEQ ID NO: 122046 - RNA, 19 nt, Homo sapiens
ugaagcaaauuccgagcau

SEQ ID NO: 122047 - RNA, 19 nt, Homo sapiens
acacacacuucacacauac

SEQ ID NO: 122048 - RNA, 19 nt, Homo sapiens
gaauacacacacacacaca

SEQ ID NO: 122049 - RNA, 19 nt, Homo sapiens
cgaccaagucucuguggaa

SEQ ID NO: 122050 - RNA, 19 nt, Homo sapiens
gucaaucuuucuccauuca

SEQ ID NO: 122051 - RNA, 19 nt, Homo sapiens
caacuacuuggauauggaa

SEQ ID NO: 122052 - RNA, 19 nt, Homo sapiens
cucaucaacuacuuggaua

SEQ ID NO: 122053 - RNA, 19 nt, Homo sapiens
gaguuuagcacauuugaac

SEQ ID NO: 122054 - RNA, 19 nt, Homo sapiens
ucaagcaaggcccauauau

SEQ ID NO: 122055 - RNA, 19 nt, Homo sapiens
gguauaauaaaucccuuug

SEQ ID NO: 122056 - RNA, 19 nt, Homo sapiens
ccaccaccgucaugaugga

SEQ ID NO: 122057 - RNA, 19 nt, Homo sapiens
acaacaugauggcucagaa

SEQ ID NO: 122058 - RNA, 19 nt, Homo sapiens
cuuuguggaugcagaguuu

SEQ ID NO: 122059 - RNA, 19 nt, Homo sapiens
ggaggaauuacguuauaca

SEQ ID NO: 122060 - RNA, 19 nt, Homo sapiens
gaugcagaguuugauggaa

SEQ ID NO: 122061 - RNA, 19 nt, Homo sapiens
gagccaggccagaccuuug

SEQ ID NO: 122062 - RNA, 19 nt, Homo sapiens
ucucugaacuuaucuuucc

SEQ ID NO: 122063 - RNA, 19 nt, Homo sapiens
uacagaguuuagcacauuu

SEQ ID NO: 122064 - RNA, 19 nt, Homo sapiens
uggauuguuuguauuagga

SEQ ID NO: 122065 - RNA, 19 nt, Homo sapiens
auucaagcaucucccauug

SEQ ID NO: 122066 - RNA, 19 nt, Homo sapiens
cuacuuggauauggaauac

SEQ ID NO: 122067 - RNA, 19 nt, Homo sapiens
ggucggacucacaaugaaa

SEQ ID NO: 122068 - RNA, 19 nt, Homo sapiens
ccagagaauguagcuguuu

SEQ ID NO: 122069 - RNA, 19 nt, Homo sapiens
ggaggggccuugugucugu

SEQ ID NO: 122070 - RNA, 19 nt, Homo sapiens
uggaauacuucggcacuau

SEQ ID NO: 122071 - RNA, 19 nt, Homo sapiens
caaauuccgagcauuacau

SEQ ID NO: 122072 - RNA, 19 nt, Homo sapiens
agauugcacuggauaacau

SEQ ID NO: 122073 - RNA, 19 nt, Homo sapiens
caaucuuucuccauucagu

SEQ ID NO: 122074 - RNA, 19 nt, Homo sapiens
ucccauaauuuggacauga

SEQ ID NO: 122075 - RNA, 19 nt, Homo sapiens
acacauauacacacacaca

SEQ ID NO: 122076 - RNA, 19 nt, Homo sapiens
cagcaguggcuuucaagga

SEQ ID NO: 122077 - RNA, 19 nt, Homo sapiens
ggaguucuuggcuuuaauc

SEQ ID NO: 122078 - RNA, 19 nt, Homo sapiens
ggaauacuucggcacuauc

SEQ ID NO: 122079 - RNA, 19 nt, Homo sapiens
auaaaucccuuugcaacuc

SEQ ID NO: 122080 - RNA, 19 nt, Homo sapiens
acaagcagagaucauggua

SEQ ID NO: 122081 - RNA, 19 nt, Homo sapiens
gaacuucacugucaucuuc

SEQ ID NO: 122082 - RNA, 19 nt, Homo sapiens
gaugucaccuucaccauua

SEQ ID NO: 122083 - RNA, 19 nt, Homo sapiens
ugacagaccuugaauaugu

SEQ ID NO: 122084 - RNA, 19 nt, Homo sapiens
gaacguugcugguugaaau

SEQ ID NO: 122085 - RNA, 19 nt, Homo sapiens
guaagucucuuuccaucua

SEQ ID NO: 122086 - RNA, 19 nt, Homo sapiens
guucuuggcuuuaaucauu

SEQ ID NO: 122087 - RNA, 19 nt, Homo sapiens
aagcagagaucaugguaua

SEQ ID NO: 122088 - RNA, 19 nt, Homo sapiens
guaguuggauuguuuguau

SEQ ID NO: 122089 - RNA, 19 nt, Homo sapiens
gcccauauauugcauuuau

SEQ ID NO: 122090 - RNA, 19 nt, Homo sapiens
gaauuaagaccaaacagaa

SEQ ID NO: 122091 - RNA, 19 nt, Homo sapiens
caacuugaauuaagaccaa

SEQ ID NO: 122092 - RNA, 19 nt, Homo sapiens
cagagaucaugguauaaua

SEQ ID NO: 122093 - RNA, 19 nt, Homo sapiens
cuacagaguuuagcacauu

SEQ ID NO: 122094 - RNA, 19 nt, Homo sapiens
ccaaacauaugcacaagca

SEQ ID NO: 122095 - RNA, 19 nt, Homo sapiens
aagcaaggcccauauauug

SEQ ID NO: 122096 - RNA, 19 nt, Homo sapiens
cacacacacuucacacaua

SEQ ID NO: 122097 - RNA, 19 nt, Homo sapiens
aaacagaacaugagaauac

SEQ ID NO: 122098 - RNA, 19 nt, Homo sapiens
guaccuggaucauucugaa

SEQ ID NO: 122099 - RNA, 19 nt, Homo sapiens
ggaccagagugccaaggaa

SEQ ID NO: 122100 - RNA, 19 nt, Homo sapiens
caagcaaggcccauauauu

SEQ ID NO: 122101 - RNA, 19 nt, Homo sapiens
agauugcacuggauaauau

SEQ ID NO: 122102 - RNA, 19 nt, Homo sapiens
aagcaaauuccgagcauua

SEQ ID NO: 122103 - RNA, 19 nt, Homo sapiens
caagcuuacuggcagauug

SEQ ID NO: 122104 - RNA, 19 nt, Homo sapiens
gaagcaaauuccgagcauu

SEQ ID NO: 122105 - RNA, 19 nt, Homo sapiens
gcagagaucaugguauaau

SEQ ID NO: 122106 - RNA, 19 nt, Homo sapiens
ccaagucucuguggaagga

SEQ ID NO: 122107 - RNA, 19 nt, Homo sapiens
gaaaucccgaggugucauu

SEQ ID NO: 122108 - RNA, 19 nt, Homo sapiens
gaaaaucuccaaacauaug

SEQ ID NO: 122109 - RNA, 19 nt, Homo sapiens
gaacaugagaauacacaca

SEQ ID NO: 122110 - RNA, 19 nt, Homo sapiens
ccaaacagaacaugagaau

SEQ ID NO: 122111 - RNA, 19 nt, Homo sapiens
gacagaccuugaauauguu

SEQ ID NO: 122112 - RNA, 19 nt, Homo sapiens
ggucugagaguuagggaaa

SEQ ID NO: 122113 - RNA, 19 nt, Homo sapiens
ucaagcaucucccauuguc

SEQ ID NO: 122114 - RNA, 19 nt, Homo sapiens
gcuacgaccacucccauuu

SEQ ID NO: 122115 - RNA, 19 nt, Homo sapiens
gagaauacacacacacaca

SEQ ID NO: 122116 - RNA, 19 nt, Homo sapiens
ggaugucaccuucaccauu

SEQ ID NO: 122117 - RNA, 19 nt, Homo sapiens
guuuggaguucuuggcuuu

SEQ ID NO: 122118 - RNA, 19 nt, Homo sapiens
ggaucauucugaagcaaau

SEQ ID NO: 122119 - RNA, 19 nt, Homo sapiens
acacacacacacacauaua

SEQ ID NO: 122120 - RNA, 19 nt, Homo sapiens
ggucaaucuuucuccauuc

SEQ ID NO: 122121 - RNA, 19 nt, Homo sapiens
gcaagacgcacagcagguu

SEQ ID NO: 122122 - RNA, 19 nt, Homo sapiens
gggcaggucugagaguuag

SEQ ID NO: 122123 - RNA, 19 nt, Homo sapiens
acacacacacacacacaua

SEQ ID NO: 122124 - RNA, 19 nt, Homo sapiens
cagagaauguagcuguuuc

SEQ ID NO: 122125 - RNA, 19 nt, Homo sapiens
cagauugcacuggauaaua

SEQ ID NO: 122126 - RNA, 19 nt, Homo sapiens
gagcuuguccgggaucauu

SEQ ID NO: 122127 - RNA, 19 nt, Homo sapiens
ugaauuaagaccaaacaga

SEQ ID NO: 122128 - RNA, 19 nt, Homo sapiens
guugcaacuugaauuaaga

SEQ ID NO: 122129 - RNA, 19 nt, Homo sapiens
gguugcaacuugaauuaag

SEQ ID NO: 122130 - RNA, 19 nt, Homo sapiens
ggacuucguggauggaaug

SEQ ID NO: 122131 - RNA, 19 nt, Homo sapiens
ggccagcaguuuggagaaa

SEQ ID NO: 122132 - RNA, 19 nt, Homo sapiens
gcuggugccucucuauugg

SEQ ID NO: 122133 - RNA, 19 nt, Homo sapiens
ucaacuacuuggauaugga

SEQ ID NO: 122134 - RNA, 19 nt, Homo sapiens
auggaggaauuacguuaua

SEQ ID NO: 122135 - RNA, 19 nt, Homo sapiens
acacacauauacacacaca

SEQ ID NO: 122136 - RNA, 19 nt, Homo sapiens
acacacacauauacacaca

SEQ ID NO: 122137 - RNA, 19 nt, Homo sapiens
gcacuagcccagccugcaa

SEQ ID NO: 122138 - RNA, 19 nt, Homo sapiens
caaacagaacaugagaaua

SEQ ID NO: 122139 - RNA, 19 nt, Homo sapiens
caugagcaguaacccagaa

SEQ ID NO: 122140 - RNA, 19 nt, Homo sapiens
ccagccaggucaaucuuuc

SEQ ID NO: 122141 - RNA, 19 nt, Homo sapiens
gauggaggaauuacguuau

SEQ ID NO: 122142 - RNA, 19 nt, Homo sapiens
ugauggaggaauuacguua

SEQ ID NO: 122143 - RNA, 19 nt, Homo sapiens
gaccaaacagaacaugaga

SEQ ID NO: 122144 - RNA, 19 nt, Homo sapiens
gcaaauuccgagcauuaca

SEQ ID NO: 122145 - RNA, 19 nt, Homo sapiens
ugaagcaaauuccgagcau

SEQ ID NO: 122146 - RNA, 19 nt, Homo sapiens
acacacacuucacacauac

SEQ ID NO: 122147 - RNA, 19 nt, Homo sapiens
gaauacacacacacacaca

SEQ ID NO: 122148 - RNA, 19 nt, Homo sapiens
gcagauugcacuggauaau

SEQ ID NO: 122149 - RNA, 19 nt, Homo sapiens
cgaccaagucucuguggaa

SEQ ID NO: 122150 - RNA, 19 nt, Homo sapiens
gucaaucuuucuccauuca

SEQ ID NO: 122151 - RNA, 19 nt, Homo sapiens
caacuacuuggauauggaa

SEQ ID NO: 122152 - RNA, 19 nt, Homo sapiens
cucaucaacuacuuggaua

SEQ ID NO: 122153 - RNA, 19 nt, Homo sapiens
gaguuuagcacauuugaac

SEQ ID NO: 122154 - RNA, 19 nt, Homo sapiens
ucaagcaaggcccauauau

SEQ ID NO: 122155 - RNA, 19 nt, Homo sapiens
gguauaauaaaucccuuug

SEQ ID NO: 122156 - RNA, 19 nt, Homo sapiens
ccaccaccgucaugaugga

SEQ ID NO: 122157 - RNA, 19 nt, Homo sapiens
acaacaugauggcucagaa

SEQ ID NO: 122158 - RNA, 19 nt, Homo sapiens
cuuuguggaugcagaguuu

SEQ ID NO: 122159 - RNA, 19 nt, Homo sapiens
ggaggaauuacguuauaca

SEQ ID NO: 122160 - RNA, 19 nt, Homo sapiens
gaugcagaguuugauggaa

SEQ ID NO: 122161 - RNA, 19 nt, Homo sapiens
gagccaggccagaccuuug

SEQ ID NO: 122162 - RNA, 19 nt, Homo sapiens
ucucugaacuuaucuuucc

SEQ ID NO: 122163 - RNA, 19 nt, Homo sapiens
uacagaguuuagcacauuu

SEQ ID NO: 122164 - RNA, 19 nt, Homo sapiens
uggauuguuuguauuagga

SEQ ID NO: 122165 - RNA, 19 nt, Homo sapiens
auucaagcaucucccauug

SEQ ID NO: 122166 - RNA, 19 nt, Homo sapiens
cuacuuggauauggaauac

SEQ ID NO: 122167 - RNA, 19 nt, Homo sapiens
ggucggacucacaaugaaa

SEQ ID NO: 122168 - RNA, 19 nt, Homo sapiens
ccagagaauguagcuguuu

SEQ ID NO: 122169 - RNA, 19 nt, Homo sapiens
ggaggggccuugugucugu

SEQ ID NO: 122170 - RNA, 19 nt, Homo sapiens
uggaauacuucggcacuau

SEQ ID NO: 122171 - RNA, 19 nt, Homo sapiens
caaauuccgagcauuacau

SEQ ID NO: 122172 - RNA, 19 nt, Homo sapiens
caaucuuucuccauucagu

SEQ ID NO: 122173 - RNA, 19 nt, Homo sapiens
acacauauacacacacaca

SEQ ID NO: 122174 - RNA, 19 nt, Homo sapiens
cagcaguggcuuucaagga

SEQ ID NO: 122175 - RNA, 19 nt, Homo sapiens
ucccauaauuuggacauga

SEQ ID NO: 122176 - RNA, 19 nt, Homo sapiens
ggaguucuuggcuuuaauc

SEQ ID NO: 122177 - RNA, 19 nt, Homo sapiens
ggaauacuucggcacuauc

SEQ ID NO: 122178 - RNA, 19 nt, Homo sapiens
auaaaucccuuugcaacuc

SEQ ID NO: 122179 - RNA, 19 nt, Homo sapiens
acaagcagagaucauggua

SEQ ID NO: 122180 - RNA, 19 nt, Homo sapiens
cgucaugauggaggaauua

SEQ ID NO: 122181 - RNA, 19 nt, Homo sapiens
cauuaaacgucauucagua

SEQ ID NO: 122182 - RNA, 19 nt, Homo sapiens
aaacgucauucaguacuua

SEQ ID NO: 122183 - RNA, 19 nt, Homo sapiens
ggacaacaaugagaagcuu

SEQ ID NO: 122184 - RNA, 19 nt, Homo sapiens
ucaccagggucucaaguuu

SEQ ID NO: 122185 - RNA, 19 nt, Homo sapiens
uaauaaacguccacagagu

SEQ ID NO: 122186 - RNA, 19 nt, Homo sapiens
guccacagaguauaaauaa

SEQ ID NO: 122187 - RNA, 19 nt, Homo sapiens
gauaaggacaacaaugaga

SEQ ID NO: 122188 - RNA, 19 nt, Homo sapiens
aaacguccacagaguauaa

SEQ ID NO: 122189 - RNA, 19 nt, Homo sapiens
ucaaacugcuggaucagau

SEQ ID NO: 122190 - RNA, 19 nt, Homo sapiens
gcuucaaacugcuggauca

SEQ ID NO: 122191 - RNA, 19 nt, Homo sapiens
cagcugagcagaagaguca

SEQ ID NO: 122192 - RNA, 19 nt, Homo sapiens
uaaacgucauucaguacuu

SEQ ID NO: 122193 - RNA, 19 nt, Homo sapiens
gggaagcaauauaaauguc

SEQ ID NO: 122194 - RNA, 19 nt, Homo sapiens
uggauaaggacaacaauga

SEQ ID NO: 122195 - RNA, 19 nt, Homo sapiens
caaguuuccugcccuggau

SEQ ID NO: 122196 - RNA, 19 nt, Homo sapiens
ggcaucgucuccuauggaa

SEQ ID NO: 122197 - RNA, 19 nt, Homo sapiens
ggaagcaauauaaauguca

SEQ ID NO: 122198 - RNA, 19 nt, Homo sapiens
aauaaacguccacagagua

SEQ ID NO: 122199 - RNA, 19 nt, Homo sapiens
caggccagcuccacagugu

SEQ ID NO: 122200 - RNA, 19 nt, Homo sapiens
gccagagccuuaauaaacg

SEQ ID NO: 122201 - RNA, 19 nt, Homo sapiens
uaaccaauuccucauuugu

SEQ ID NO: 122202 - RNA, 19 nt, Homo sapiens
ccgccacccucaauauaau

SEQ ID NO: 122203 - RNA, 19 nt, Homo sapiens
cuuaauaaacguccacaga

SEQ ID NO: 122204 - RNA, 19 nt, Homo sapiens
cagcggaccauccagaaug

SEQ ID NO: 122205 - RNA, 19 nt, Homo sapiens
ccucauuuguucauuaaac

SEQ ID NO: 122206 - RNA, 19 nt, Homo sapiens
ugccagagccuuaauaaac

SEQ ID NO: 122207 - RNA, 19 nt, Homo sapiens
ggccagcuccacaguguug

SEQ ID NO: 122208 - RNA, 19 nt, Homo sapiens
gaaaacacccagcaacaca

SEQ ID NO: 122209 - RNA, 19 nt, Homo sapiens
cguccacagaguauaaaua

SEQ ID NO: 122210 - RNA, 19 nt, Homo sapiens
guugccagagccuuaauaa

SEQ ID NO: 122211 - RNA, 19 nt, Homo sapiens
accaauuccucauuuguuc

SEQ ID NO: 122212 - RNA, 19 nt, Homo sapiens
auaaccaauuccucauuug

SEQ ID NO: 122213 - RNA, 19 nt, Homo sapiens
caucgucuccuauggaaag

SEQ ID NO: 122214 - RNA, 19 nt, Homo sapiens
ggauaaggacaacaaugag

SEQ ID NO: 122215 - RNA, 19 nt, Homo sapiens
ccacagaguauaaauaacc

SEQ ID NO: 122216 - RNA, 19 nt, Homo sapiens
gcagugccuccgcaucuuc

SEQ ID NO: 122217 - RNA, 19 nt, Homo sapiens
agagucagacggaaucgaa

SEQ ID NO: 122218 - RNA, 19 nt, Homo sapiens
gagaggugcagcugagagu

SEQ ID NO: 122219 - RNA, 19 nt, Homo sapiens
cagaagagucagacggaau

SEQ ID NO: 122220 - RNA, 19 nt, Homo sapiens
ucauuaaacgucauucagu

SEQ ID NO: 122221 - RNA, 19 nt, Homo sapiens
auaaggacaacaaugagaa

SEQ ID NO: 122222 - RNA, 19 nt, Homo sapiens
ccagagccuuaauaaacgu

SEQ ID NO: 122223 - RNA, 19 nt, Homo sapiens
uacauggcguaucuucaga

SEQ ID NO: 122224 - RNA, 19 nt, Homo sapiens
aaugagaagcuucaaacug

SEQ ID NO: 122225 - RNA, 19 nt, Homo sapiens
acaaugagaagcuucaaac

SEQ ID NO: 122226 - RNA, 19 nt, Homo sapiens
cauccgccacccucaauau

SEQ ID NO: 122227 - RNA, 19 nt, Homo sapiens
cuacauggcguaucuucag

SEQ ID NO: 122228 - RNA, 19 nt, Homo sapiens
caguguugccagagccuua

SEQ ID NO: 122229 - RNA, 19 nt, Homo sapiens
gugacugacucuucuucuc

SEQ ID NO: 122230 - RNA, 19 nt, Homo sapiens
gcaggucagagcagaugug

SEQ ID NO: 122231 - RNA, 19 nt, Homo sapiens
auaaacguccacagaguau

SEQ ID NO: 122232 - RNA, 19 nt, Homo sapiens
gacggaaucgaaacgugaa

SEQ ID NO: 122233 - RNA, 19 nt, Homo sapiens
cacagaguauaaauaacca

SEQ ID NO: 122234 - RNA, 19 nt, Homo sapiens
uaaacguccacagaguaua

SEQ ID NO: 122235 - RNA, 19 nt, Homo sapiens
ggucagagccucagaauug

SEQ ID NO: 122236 - RNA, 19 nt, Homo sapiens
gacaugagcuuugcugaaa

SEQ ID NO: 122237 - RNA, 19 nt, Homo sapiens
ccacgaauauucuuucugu

SEQ ID NO: 122238 - RNA, 19 nt, Homo sapiens
gauaaacgcccacaacaau

SEQ ID NO: 122239 - RNA, 19 nt, Homo sapiens
uaaaguaaaccaugcagua

SEQ ID NO: 122240 - RNA, 19 nt, Homo sapiens
caugagcuuugcugaaaua

SEQ ID NO: 122241 - RNA, 19 nt, Homo sapiens
gggcuacuuuccacauaua

SEQ ID NO: 122242 - RNA, 19 nt, Homo sapiens
ccacauggaccacgaauau

SEQ ID NO: 122243 - RNA, 19 nt, Homo sapiens
gcccaggacuucaauaauc

SEQ ID NO: 122244 - RNA, 19 nt, Homo sapiens
gagcuuugcugaaauaaaa

SEQ ID NO: 122245 - RNA, 19 nt, Homo sapiens
cuacaacccugugagcuuu

SEQ ID NO: 122246 - RNA, 19 nt, Homo sapiens
aaauggcacugaaccaauu

SEQ ID NO: 122247 - RNA, 19 nt, Homo sapiens
gaagauaaacgcccacaac

SEQ ID NO: 122248 - RNA, 19 nt, Homo sapiens
ccauaaaacuccagauaaa

SEQ ID NO: 122249 - RNA, 19 nt, Homo sapiens
gcaacuggaggaagauaaa

SEQ ID NO: 122250 - RNA, 19 nt, Homo sapiens
gaguauauccuguacaaca

SEQ ID NO: 122251 - RNA, 19 nt, Homo sapiens
gaacggguacuuccucauc

SEQ ID NO: 122252 - RNA, 19 nt, Homo sapiens
cacaaucuaugacgaggaa

SEQ ID NO: 122253 - RNA, 19 nt, Homo sapiens
uagccaacaucacaaucua

SEQ ID NO: 122254 - RNA, 19 nt, Homo sapiens
ucgaguauauccuguacaa

SEQ ID NO: 122255 - RNA, 19 nt, Homo sapiens
ccggaaagaugcuguccuu

SEQ ID NO: 122256 - RNA, 19 nt, Homo sapiens
gaaccaauuuucagacaug

SEQ ID NO: 122257 - RNA, 19 nt, Homo sapiens
gaauugcucagccaccaaa

SEQ ID NO: 122258 - RNA, 19 nt, Homo sapiens
acucaggacuucaugaugu

SEQ ID NO: 122259 - RNA, 19 nt, Homo sapiens
ggaugguuauugcaaguuc

SEQ ID NO: 122260 - RNA, 19 nt, Homo sapiens
ccugugagcuuugccuuug

SEQ ID NO: 122261 - RNA, 19 nt, Homo sapiens
gccaggcuuucgaguauau

SEQ ID NO: 122262 - RNA, 19 nt, Homo sapiens
ggaaaccuacagacaagga

SEQ ID NO: 122263 - RNA, 19 nt, Homo sapiens
gcgcccaggacuucaauaa

SEQ ID NO: 122264 - RNA, 19 nt, Homo sapiens
aggaggaguuccaccauga

SEQ ID NO: 122265 - RNA, 19 nt, Homo sapiens
ggaccacgaauauucuuuc

SEQ ID NO: 122266 - RNA, 19 nt, Homo sapiens
ucaccagccaugugccuua

SEQ ID NO: 122267 - RNA, 19 nt, Homo sapiens
gcuguuggguauggagaaa

SEQ ID NO: 122268 - RNA, 19 nt, Homo sapiens
cccaggacuucaauaauca

SEQ ID NO: 122269 - RNA, 19 nt, Homo sapiens
agucauggaugucuaagca

SEQ ID NO: 122270 - RNA, 19 nt, Homo sapiens
gaagggcuacuuuccacau

SEQ ID NO: 122271 - RNA, 19 nt, Homo sapiens
gccuuaguguccuucuuaa

SEQ ID NO: 122272 - RNA, 19 nt, Homo sapiens
cuacagacaaggaggaguu

SEQ ID NO: 122273 - RNA, 19 nt, Homo sapiens
ggcaguugcuggacuuucu

SEQ ID NO: 122274 - RNA, 19 nt, Homo sapiens
ugcgugaacuccuuagaga

SEQ ID NO: 122275 - RNA, 19 nt, Homo sapiens
aagggcuacuuuccacaua

SEQ ID NO: 122276 - RNA, 19 nt, Homo sapiens
uccaguacuuccugccaua

SEQ ID NO: 122277 - RNA, 19 nt, Homo sapiens
cuaagcaccguaagaccua

SEQ ID NO: 122278 - RNA, 19 nt, Homo sapiens
ucaagucauggaugucuaa

SEQ ID NO: 122279 - RNA, 19 nt, Homo sapiens
aguauauccuguacaacaa

SEQ ID NO: 122280 - RNA, 19 nt, Homo sapiens
ggaugucuaagcaccguaa

SEQ ID NO: 122281 - RNA, 19 nt, Homo sapiens
gaccacgaauauucuuucu

SEQ ID NO: 122282 - RNA, 19 nt, Homo sapiens
ccagccaugugccuuagug

SEQ ID NO: 122283 - RNA, 19 nt, Homo sapiens
aguacuggcuguuggguau

SEQ ID NO: 122284 - RNA, 19 nt, Homo sapiens
ugccuuaguguccuucuua

SEQ ID NO: 122285 - RNA, 19 nt, Homo sapiens
gcagacuggcggagaagga

SEQ ID NO: 122286 - RNA, 19 nt, Homo sapiens
cucaggacuucaugaugua

SEQ ID NO: 122287 - RNA, 19 nt, Homo sapiens
gggacugucuuuucuguau

SEQ ID NO: 122288 - RNA, 19 nt, Homo sapiens
gccaacaucacaaucuaug

SEQ ID NO: 122289 - RNA, 19 nt, Homo sapiens
caccguaagaccuacagua

SEQ ID NO: 122290 - RNA, 19 nt, Homo sapiens
agacaugagcuuugcugaa

SEQ ID NO: 122291 - RNA, 19 nt, Homo sapiens
cuggaaaccuacagacaag

SEQ ID NO: 122292 - RNA, 19 nt, Homo sapiens
acauggaccacgaauauuc

SEQ ID NO: 122293 - RNA, 19 nt, Homo sapiens
uaaacgcccacaacaaugg

SEQ ID NO: 122294 - RNA, 19 nt, Homo sapiens
caacaucacaaucuaugac

SEQ ID NO: 122295 - RNA, 19 nt, Homo sapiens
caucggcuuugucaaggau

SEQ ID NO: 122296 - RNA, 19 nt, Homo sapiens
agauaaacgcccacaacaa

SEQ ID NO: 122297 - RNA, 19 nt, Homo sapiens
uaacagacucaaaccacau

SEQ ID NO: 122298 - RNA, 19 nt, Homo sapiens
aaagaucaccagccaugug

SEQ ID NO: 122299 - RNA, 19 nt, Homo sapiens
gagcucacccgugucuaug

SEQ ID NO: 122300 - RNA, 19 nt, Homo sapiens
ccuggaaaccuacagacaa

SEQ ID NO: 122301 - RNA, 19 nt, Homo sapiens
aaaaugggaucccuuacug

SEQ ID NO: 122302 - RNA, 19 nt, Homo sapiens
gcucagccaccaaaaguaa

SEQ ID NO: 122303 - RNA, 19 nt, Homo sapiens
ggacugucuuuucuguauu

SEQ ID NO: 122304 - RNA, 19 nt, Homo sapiens
gggaaugaacggguacuuc

SEQ ID NO: 122305 - RNA, 19 nt, Homo sapiens
ggaagauaaacgcccacaa

SEQ ID NO: 122306 - RNA, 19 nt, Homo sapiens
ccaacaucacaaucuauga

SEQ ID NO: 122307 - RNA, 19 nt, Homo sapiens
ggccaucggcuuugucaag

SEQ ID NO: 122308 - RNA, 19 nt, Homo sapiens
caacaaugggaaccacaca

SEQ ID NO: 122309 - RNA, 19 nt, Homo sapiens
gccauaaaacuccagauaa

SEQ ID NO: 122310 - RNA, 19 nt, Homo sapiens
gggaaccacacauuuaaaa

SEQ ID NO: 122311 - RNA, 19 nt, Homo sapiens
cuuaguguccuucuuaaca

SEQ ID NO: 122312 - RNA, 19 nt, Homo sapiens
ugagcucacccgugucuau

SEQ ID NO: 122313 - RNA, 19 nt, Homo sapiens
caggacuucaugauguaua

SEQ ID NO: 122314 - RNA, 19 nt, Homo sapiens
ugacucaggacuucaugau

SEQ ID NO: 122315 - RNA, 19 nt, Homo sapiens
aagauaaacgcccacaaca

SEQ ID NO: 122316 - RNA, 19 nt, Homo sapiens
guagccaacaucacaaucu

SEQ ID NO: 122317 - RNA, 19 nt, Homo sapiens
ccagaagggcuacuuucca

SEQ ID NO: 122318 - RNA, 19 nt, Homo sapiens
gcucacccgugucuaugac

SEQ ID NO: 122319 - RNA, 19 nt, Homo sapiens
gacuucaugauguauagaa

SEQ ID NO: 122320 - RNA, 19 nt, Homo sapiens
ccgccgaacugugcgugaa

SEQ ID NO: 122321 - RNA, 19 nt, Homo sapiens
cagcaacuggaggaagaua

SEQ ID NO: 122322 - RNA, 19 nt, Homo sapiens
cgugaacuccuuagagaag

SEQ ID NO: 122323 - RNA, 19 nt, Homo sapiens
gcgcggaaagaacaugugu

SEQ ID NO: 122324 - RNA, 19 nt, Homo sapiens
ccaguacuuccugccauaa

SEQ ID NO: 122325 - RNA, 19 nt, Homo sapiens
ggucagagccucagaauug

SEQ ID NO: 122326 - RNA, 19 nt, Homo sapiens
gacaugagcuuugcugaaa

SEQ ID NO: 122327 - RNA, 19 nt, Homo sapiens
ccacgaauauucuuucugu

SEQ ID NO: 122328 - RNA, 19 nt, Homo sapiens
gauaaacgcccacaacaau

SEQ ID NO: 122329 - RNA, 19 nt, Homo sapiens
uaaaguaaaccaugcagua

SEQ ID NO: 122330 - RNA, 19 nt, Homo sapiens
caugagcuuugcugaaaua

SEQ ID NO: 122331 - RNA, 19 nt, Homo sapiens
gggcuacuuuccacauaua

SEQ ID NO: 122332 - RNA, 19 nt, Homo sapiens
ccacauggaccacgaauau

SEQ ID NO: 122333 - RNA, 19 nt, Homo sapiens
gcccaggacuucaauaauc

SEQ ID NO: 122334 - RNA, 19 nt, Homo sapiens
gagcuuugcugaaauaaaa

SEQ ID NO: 122335 - RNA, 19 nt, Homo sapiens
cuacaacccugugagcuuu

SEQ ID NO: 122336 - RNA, 19 nt, Homo sapiens
aaauggcacugaaccaauu

SEQ ID NO: 122337 - RNA, 19 nt, Homo sapiens
gaagauaaacgcccacaac

SEQ ID NO: 122338 - RNA, 19 nt, Homo sapiens
ccauaaaacuccagauaaa

SEQ ID NO: 122339 - RNA, 19 nt, Homo sapiens
gcaacuggaggaagauaaa

SEQ ID NO: 122340 - RNA, 19 nt, Homo sapiens
gaguauauccuguacaaca

SEQ ID NO: 122341 - RNA, 19 nt, Homo sapiens
gaacggguacuuccucauc

SEQ ID NO: 122342 - RNA, 19 nt, Homo sapiens
cacaaucuaugacgaggaa

SEQ ID NO: 122343 - RNA, 19 nt, Homo sapiens
uagccaacaucacaaucua

SEQ ID NO: 122344 - RNA, 19 nt, Homo sapiens
ucgaguauauccuguacaa

SEQ ID NO: 122345 - RNA, 19 nt, Homo sapiens
ccggaaagaugcuguccuu

SEQ ID NO: 122346 - RNA, 19 nt, Homo sapiens
gaaccaauuuucagacaug

SEQ ID NO: 122347 - RNA, 19 nt, Homo sapiens
gaauugcucagccaccaaa

SEQ ID NO: 122348 - RNA, 19 nt, Homo sapiens
acucaggacuucaugaugu

SEQ ID NO: 122349 - RNA, 19 nt, Homo sapiens
ggaugguuauugcaaguuc

SEQ ID NO: 122350 - RNA, 19 nt, Homo sapiens
ccugugagcuuugccuuug

SEQ ID NO: 122351 - RNA, 19 nt, Homo sapiens
gccaggcuuucgaguauau

SEQ ID NO: 122352 - RNA, 19 nt, Homo sapiens
ggaaaccuacagacaagga

SEQ ID NO: 122353 - RNA, 19 nt, Homo sapiens
gcgcccaggacuucaauaa

SEQ ID NO: 122354 - RNA, 19 nt, Homo sapiens
aggaggaguuccaccauga

SEQ ID NO: 122355 - RNA, 19 nt, Homo sapiens
ggaccacgaauauucuuuc

SEQ ID NO: 122356 - RNA, 19 nt, Homo sapiens
ucaccagccaugugccuua

SEQ ID NO: 122357 - RNA, 19 nt, Homo sapiens
gcuguuggguauggagaaa

SEQ ID NO: 122358 - RNA, 19 nt, Homo sapiens
cccaggacuucaauaauca

SEQ ID NO: 122359 - RNA, 19 nt, Homo sapiens
agucauggaugucuaagca

SEQ ID NO: 122360 - RNA, 19 nt, Homo sapiens
gaagggcuacuuuccacau

SEQ ID NO: 122361 - RNA, 19 nt, Homo sapiens
gccuuaguguccuucuuaa

SEQ ID NO: 122362 - RNA, 19 nt, Homo sapiens
cuacagacaaggaggaguu

SEQ ID NO: 122363 - RNA, 19 nt, Homo sapiens
ggcaguugcuggacuuucu

SEQ ID NO: 122364 - RNA, 19 nt, Homo sapiens
ugcgugaacuccuuagaga

SEQ ID NO: 122365 - RNA, 19 nt, Homo sapiens
aagggcuacuuuccacaua

SEQ ID NO: 122366 - RNA, 19 nt, Homo sapiens
uccaguacuuccugccaua

SEQ ID NO: 122367 - RNA, 19 nt, Homo sapiens
cuaagcaccguaagaccua

SEQ ID NO: 122368 - RNA, 19 nt, Homo sapiens
ucaagucauggaugucuaa

SEQ ID NO: 122369 - RNA, 19 nt, Homo sapiens
aguauauccuguacaacaa

SEQ ID NO: 122370 - RNA, 19 nt, Homo sapiens
ggaugucuaagcaccguaa

SEQ ID NO: 122371 - RNA, 19 nt, Homo sapiens
gaccacgaauauucuuucu

SEQ ID NO: 122372 - RNA, 19 nt, Homo sapiens
ccagccaugugccuuagug

SEQ ID NO: 122373 - RNA, 19 nt, Homo sapiens
aguacuggcuguuggguau

SEQ ID NO: 122374 - RNA, 19 nt, Homo sapiens
ugccuuaguguccuucuua

SEQ ID NO: 122375 - RNA, 19 nt, Homo sapiens
gcagacuggcggagaagga

SEQ ID NO: 122376 - RNA, 19 nt, Homo sapiens
cucaggacuucaugaugua

SEQ ID NO: 122377 - RNA, 19 nt, Homo sapiens
gggacugucuuuucuguau

SEQ ID NO: 122378 - RNA, 19 nt, Homo sapiens
gccaacaucacaaucuaug

SEQ ID NO: 122379 - RNA, 19 nt, Homo sapiens
caccguaagaccuacagua

SEQ ID NO: 122380 - RNA, 19 nt, Homo sapiens
agacaugagcuuugcugaa

SEQ ID NO: 122381 - RNA, 19 nt, Homo sapiens
cuggaaaccuacagacaag

SEQ ID NO: 122382 - RNA, 19 nt, Homo sapiens
acauggaccacgaauauuc

SEQ ID NO: 122383 - RNA, 19 nt, Homo sapiens
uaaacgcccacaacaaugg

SEQ ID NO: 122384 - RNA, 19 nt, Homo sapiens
caacaucacaaucuaugac

SEQ ID NO: 122385 - RNA, 19 nt, Homo sapiens
caucggcuuugucaaggau

SEQ ID NO: 122386 - RNA, 19 nt, Homo sapiens
agauaaacgcccacaacaa

SEQ ID NO: 122387 - RNA, 19 nt, Homo sapiens
uaacagacucaaaccacau

SEQ ID NO: 122388 - RNA, 19 nt, Homo sapiens
aaagaucaccagccaugug

SEQ ID NO: 122389 - RNA, 19 nt, Homo sapiens
gagcucacccgugucuaug

SEQ ID NO: 122390 - RNA, 19 nt, Homo sapiens
ccuggaaaccuacagacaa

SEQ ID NO: 122391 - RNA, 19 nt, Homo sapiens
aaaaugggaucccuuacug

SEQ ID NO: 122392 - RNA, 19 nt, Homo sapiens
gcucagccaccaaaaguaa

SEQ ID NO: 122393 - RNA, 19 nt, Homo sapiens
ggacugucuuuucuguauu

SEQ ID NO: 122394 - RNA, 19 nt, Homo sapiens
gggaaugaacggguacuuc

SEQ ID NO: 122395 - RNA, 19 nt, Homo sapiens
ggaagauaaacgcccacaa

SEQ ID NO: 122396 - RNA, 19 nt, Homo sapiens
ccaacaucacaaucuauga

SEQ ID NO: 122397 - RNA, 19 nt, Homo sapiens
ggccaucggcuuugucaag

SEQ ID NO: 122398 - RNA, 19 nt, Homo sapiens
caacaaugggaaccacaca

SEQ ID NO: 122399 - RNA, 19 nt, Homo sapiens
gccauaaaacuccagauaa

SEQ ID NO: 122400 - RNA, 19 nt, Homo sapiens
gggaaccacacauuuaaaa

SEQ ID NO: 122401 - RNA, 19 nt, Homo sapiens
cuuaguguccuucuuaaca

SEQ ID NO: 122402 - RNA, 19 nt, Homo sapiens
ugagcucacccgugucuau

SEQ ID NO: 122403 - RNA, 19 nt, Homo sapiens
caggacuucaugauguaua

SEQ ID NO: 122404 - RNA, 19 nt, Homo sapiens
ugacucaggacuucaugau

SEQ ID NO: 122405 - RNA, 19 nt, Homo sapiens
aagauaaacgcccacaaca

SEQ ID NO: 122406 - RNA, 19 nt, Homo sapiens
guagccaacaucacaaucu

SEQ ID NO: 122407 - RNA, 19 nt, Homo sapiens
ccagaagggcuacuuucca

SEQ ID NO: 122408 - RNA, 19 nt, Homo sapiens
gcucacccgugucuaugac

SEQ ID NO: 122409 - RNA, 19 nt, Homo sapiens
gacuucaugauguauagaa

SEQ ID NO: 122410 - RNA, 19 nt, Homo sapiens
ccgccgaacugugcgugaa

SEQ ID NO: 122411 - RNA, 19 nt, Homo sapiens
cagcaacuggaggaagaua

SEQ ID NO: 122412 - RNA, 19 nt, Homo sapiens
cgugaacuccuuagagaag

SEQ ID NO: 122413 - RNA, 19 nt, Homo sapiens
gcgcggaaagaacaugugu

SEQ ID NO: 122414 - RNA, 19 nt, Homo sapiens
ccaguacuuccugccauaa

SEQ ID NO: 122415 - RNA, 19 nt, Homo sapiens
gaagaugacuggacucaaa

SEQ ID NO: 122416 - RNA, 19 nt, Homo sapiens
gcaaagguguguauuauga

SEQ ID NO: 122417 - RNA, 19 nt, Homo sapiens
gagauugucuguucaguuu

SEQ ID NO: 122418 - RNA, 19 nt, Homo sapiens
gaacaacgccuguggcauu

SEQ ID NO: 122419 - RNA, 19 nt, Homo sapiens
ugacagcuguguacucuua

SEQ ID NO: 122420 - RNA, 19 nt, Homo sapiens
gaagggaguuggugugcua

SEQ ID NO: 122421 - RNA, 19 nt, Homo sapiens
aacaagcacuggauaauua

SEQ ID NO: 122422 - RNA, 19 nt, Homo sapiens
cgaaagaaaggauauguua

SEQ ID NO: 122423 - RNA, 19 nt, Homo sapiens
gguacaaguuuacaugaua

SEQ ID NO: 122424 - RNA, 19 nt, Homo sapiens
gaagaugccuacccauaug

SEQ ID NO: 122425 - RNA, 19 nt, Homo sapiens
ggcaaacucuuaaaucuga

SEQ ID NO: 122426 - RNA, 19 nt, Homo sapiens
ugaaaucucucggcguuua

SEQ ID NO: 122427 - RNA, 19 nt, Homo sapiens
caaaugauccuuccuacuu

SEQ ID NO: 122428 - RNA, 19 nt, Homo sapiens
guaaugacacccuuuauau

SEQ ID NO: 122429 - RNA, 19 nt, Homo sapiens
ggaagaagacccacaggaa

SEQ ID NO: 122430 - RNA, 19 nt, Homo sapiens
ggaaacaagcacuggauaa

SEQ ID NO: 122431 - RNA, 19 nt, Homo sapiens
cagcaaagguguguauuau

SEQ ID NO: 122432 - RNA, 19 nt, Homo sapiens
gcaguaaugacacccuuua

SEQ ID NO: 122433 - RNA, 19 nt, Homo sapiens
ugaagcagauguggugaua

SEQ ID NO: 122434 - RNA, 19 nt, Homo sapiens
ccacgauggugcaguguaa

SEQ ID NO: 122435 - RNA, 19 nt, Homo sapiens
ggaagagaguuguauguac

SEQ ID NO: 122436 - RNA, 19 nt, Homo sapiens
gaccaaugccuuccaauau

SEQ ID NO: 122437 - RNA, 19 nt, Homo sapiens
gaagcaauauaacaacaag

SEQ ID NO: 122438 - RNA, 19 nt, Homo sapiens
guauuuaucuccugucuac

SEQ ID NO: 122439 - RNA, 19 nt, Homo sapiens
gaagaaaacuggcaaacuc

SEQ ID NO: 122440 - RNA, 19 nt, Homo sapiens
gaaacaagcacuggauaau

SEQ ID NO: 122441 - RNA, 19 nt, Homo sapiens
uagguuagauucucauuca

SEQ ID NO: 122442 - RNA, 19 nt, Homo sapiens
auacugagauugucuguuc

SEQ ID NO: 122443 - RNA, 19 nt, Homo sapiens
gaagccagacaacagauuu

SEQ ID NO: 122444 - RNA, 19 nt, Homo sapiens
caagguggaugaaaucucu

SEQ ID NO: 122445 - RNA, 19 nt, Homo sapiens
gggaguuggugugcuauuu

SEQ ID NO: 122446 - RNA, 19 nt, Homo sapiens
ccucauggcucgaaauaag

SEQ ID NO: 122447 - RNA, 19 nt, Homo sapiens
gcuaagagaugugacuaca

SEQ ID NO: 122448 - RNA, 19 nt, Homo sapiens
aaaugauccuuccuacuuu

SEQ ID NO: 122449 - RNA, 19 nt, Homo sapiens
acaacaagguggaugaaau

SEQ ID NO: 122450 - RNA, 19 nt, Homo sapiens
gaaagcugcaauagcgaua

SEQ ID NO: 122451 - RNA, 19 nt, Homo sapiens
gguauugacucugaagaug

SEQ ID NO: 122452 - RNA, 19 nt, Homo sapiens
ccaaugccuuccaauaugu

SEQ ID NO: 122453 - RNA, 19 nt, Homo sapiens
gaagaggugguucagaaga

SEQ ID NO: 122454 - RNA, 19 nt, Homo sapiens
gcagauguggugauacuga

SEQ ID NO: 122455 - RNA, 19 nt, Homo sapiens
ggacaggaagagaguugua

SEQ ID NO: 122456 - RNA, 19 nt, Homo sapiens
uccaauaugugcagaagaa

SEQ ID NO: 122457 - RNA, 19 nt, Homo sapiens
ggacuaggguaaucugacu

SEQ ID NO: 122458 - RNA, 19 nt, Homo sapiens
ggagcugacuuccgcaauc

SEQ ID NO: 122459 - RNA, 19 nt, Homo sapiens
ccaaauccauccugcucuu

SEQ ID NO: 122460 - RNA, 19 nt, Homo sapiens
ugaccaaugccuuccaaua

SEQ ID NO: 122461 - RNA, 19 nt, Homo sapiens
caacaggcaaggcagcuaa

SEQ ID NO: 122462 - RNA, 19 nt, Homo sapiens
gcucaagguucugcugcua

SEQ ID NO: 122463 - RNA, 19 nt, Homo sapiens
ggacaugaccagugaagag

SEQ ID NO: 122464 - RNA, 19 nt, Homo sapiens
uaaguucccuucuauaucc

SEQ ID NO: 122465 - RNA, 19 nt, Homo sapiens
ucacauagguuagauucuc

SEQ ID NO: 122466 - RNA, 19 nt, Homo sapiens
ucccagggcugaugcugua

SEQ ID NO: 122467 - RNA, 19 nt, Homo sapiens
gacaacagauuuccaucag

SEQ ID NO: 122468 - RNA, 19 nt, Homo sapiens
aaacaagcacuggauaauu

SEQ ID NO: 122469 - RNA, 19 nt, Homo sapiens
caacaagguggaugaaauc

SEQ ID NO: 122470 - RNA, 19 nt, Homo sapiens
uaaucugacuucucacuuc

SEQ ID NO: 122471 - RNA, 19 nt, Homo sapiens
ggagaaaacuggggaaaca

SEQ ID NO: 122472 - RNA, 19 nt, Homo sapiens
ggaaugagaaagcccugaa

SEQ ID NO: 122473 - RNA, 19 nt, Homo sapiens
ugaaguauauuuccaucca

SEQ ID NO: 122474 - RNA, 19 nt, Homo sapiens
ucauaagucuuugguacaa

SEQ ID NO: 122475 - RNA, 19 nt, Homo sapiens
gguacaggcuggagauuuu

SEQ ID NO: 122476 - RNA, 19 nt, Homo sapiens
gggaaacaagcacuggaua

SEQ ID NO: 122477 - RNA, 19 nt, Homo sapiens
gaaaacuggcaaacucuua

SEQ ID NO: 122478 - RNA, 19 nt, Homo sapiens
gaaaucucucggcguuuaa

SEQ ID NO: 122479 - RNA, 19 nt, Homo sapiens
uaagcacccuagaggacua

SEQ ID NO: 122480 - RNA, 19 nt, Homo sapiens
acagcaaagguguguauua

SEQ ID NO: 122481 - RNA, 19 nt, Homo sapiens
ugaagaugccuacccauau

SEQ ID NO: 122482 - RNA, 19 nt, Homo sapiens
gaaagaaaggauauguuac

SEQ ID NO: 122483 - RNA, 19 nt, Homo sapiens
cuacuccaauucauaaauc

SEQ ID NO: 122484 - RNA, 19 nt, Homo sapiens
ucacgggacuaguuagcuu

SEQ ID NO: 122485 - RNA, 19 nt, Homo sapiens
gcaauagcgauaaucugaa

SEQ ID NO: 122486 - RNA, 19 nt, Homo sapiens
ggaagcaauauaacaacaa

SEQ ID NO: 122487 - RNA, 19 nt, Homo sapiens
cccagaaccuaguggauug

SEQ ID NO: 122488 - RNA, 19 nt, Homo sapiens
caaucccgauggaauaaau

SEQ ID NO: 122489 - RNA, 19 nt, Homo sapiens
uaaauagcaucuaguacac

SEQ ID NO: 122490 - RNA, 19 nt, Homo sapiens
caauagcgauaaucugaac

SEQ ID NO: 122491 - RNA, 19 nt, Homo sapiens
aaagguguguauuaugaug

SEQ ID NO: 122492 - RNA, 19 nt, Homo sapiens
gaaguauauuuccauccau

SEQ ID NO: 122493 - RNA, 19 nt, Homo sapiens
gauuugucuucccuucuuu

SEQ ID NO: 122494 - RNA, 19 nt, Homo sapiens
ccuaaguucccuucuauau

SEQ ID NO: 122495 - RNA, 19 nt, Homo sapiens
ggcugaugcuguacaggua

SEQ ID NO: 122496 - RNA, 19 nt, Homo sapiens
aguaaugacacccuuuaua

SEQ ID NO: 122497 - RNA, 19 nt, Homo sapiens
ugauuugucuucccuucuu

SEQ ID NO: 122498 - RNA, 19 nt, Homo sapiens
ccgcaaucccgauggaaua

SEQ ID NO: 122499 - RNA, 19 nt, Homo sapiens
aggguaaucugacuucuca

SEQ ID NO: 122500 - RNA, 19 nt, Homo sapiens
gaugacuggacucaaagua

SEQ ID NO: 122501 - RNA, 19 nt, Homo sapiens
ccauccugcucuuccauuu

SEQ ID NO: 122502 - RNA, 19 nt, Homo sapiens
agucuuugguacaaguuua

SEQ ID NO: 122503 - RNA, 19 nt, Homo sapiens
gaaacgaagccagacaaca

SEQ ID NO: 122504 - RNA, 19 nt, Homo sapiens
uaugaugaaagcugcaaua

SEQ ID NO: 122505 - RNA, 19 nt, Homo sapiens
cugaagaugccuacccaua

SEQ ID NO: 122506 - RNA, 19 nt, Homo sapiens
ucuguacccugaggagaua

SEQ ID NO: 122507 - RNA, 19 nt, Homo sapiens
gauccuuccuacuuugcuu

SEQ ID NO: 122508 - RNA, 19 nt, Homo sapiens
ugcaauagcgauaaucuga

SEQ ID NO: 122509 - RNA, 19 nt, Homo sapiens
accaaugccuuccaauaug

SEQ ID NO: 122510 - RNA, 19 nt, Homo sapiens
acaggaagcaauauaacaa

SEQ ID NO: 122511 - RNA, 19 nt, Homo sapiens
gggacuaguuagcuuuaag

SEQ ID NO: 122512 - RNA, 19 nt, Homo sapiens
guaacgaugcacuuuggaa

SEQ ID NO: 122513 - RNA, 19 nt, Homo sapiens
uggauugugugucugagaa

SEQ ID NO: 122514 - RNA, 19 nt, Homo sapiens
ccuaguggauugugugucu

SEQ ID NO: 122515 - RNA, 19 nt, Homo sapiens
gagaaaccauuguggaauu

SEQ ID NO: 122516 - RNA, 19 nt, Homo sapiens
aaacacagcuucacaaugg

SEQ ID NO: 122517 - RNA, 19 nt, Homo sapiens
gagaagaacaugaagauga

SEQ ID NO: 122518 - RNA, 19 nt, Homo sapiens
gauacacacucgaaucauu

SEQ ID NO: 122519 - RNA, 19 nt, Homo sapiens
gggcauggguggcuacgua

SEQ ID NO: 122520 - RNA, 19 nt, Homo sapiens
ggauuaugcuuuccaguau

SEQ ID NO: 122521 - RNA, 19 nt, Homo sapiens
gaauucaucuucagucuac

SEQ ID NO: 122522 - RNA, 19 nt, Homo sapiens
aauauuggcuggugaagaa

SEQ ID NO: 122523 - RNA, 19 nt, Homo sapiens
ggacagauguuccggaaaa

SEQ ID NO: 122524 - RNA, 19 nt, Homo sapiens
gaaagcacagaaucagaua

SEQ ID NO: 122525 - RNA, 19 nt, Homo sapiens
guaaguacaaucccaagua

SEQ ID NO: 122526 - RNA, 19 nt, Homo sapiens
uaaguacaaucccaaguau

SEQ ID NO: 122527 - RNA, 19 nt, Homo sapiens
cagcuacucuaacauuuga

SEQ ID NO: 122528 - RNA, 19 nt, Homo sapiens
gcacagaaucagauaacaa

SEQ ID NO: 122529 - RNA, 19 nt, Homo sapiens
gaacgccuuuggagacaug

SEQ ID NO: 122530 - RNA, 19 nt, Homo sapiens
ggaaggcgaugcacaacag

SEQ ID NO: 122531 - RNA, 19 nt, Homo sapiens
gauuauacggcaugaauga

SEQ ID NO: 122532 - RNA, 19 nt, Homo sapiens
gaacucugcuggccuugag

SEQ ID NO: 122533 - RNA, 19 nt, Homo sapiens
gagaggacgcggucgagua

SEQ ID NO: 122534 - RNA, 19 nt, Homo sapiens
gaagauccgagugugauuu

SEQ ID NO: 122535 - RNA, 19 nt, Homo sapiens
caaguauucuguugcuaau

SEQ ID NO: 122536 - RNA, 19 nt, Homo sapiens
gaaacacagcuucacaaug

SEQ ID NO: 122537 - RNA, 19 nt, Homo sapiens
gcccauuucuguugcuauu

SEQ ID NO: 122538 - RNA, 19 nt, Homo sapiens
ccaaguauucuguugcuaa

SEQ ID NO: 122539 - RNA, 19 nt, Homo sapiens
ggagagcagugugggagaa

SEQ ID NO: 122540 - RNA, 19 nt, Homo sapiens
ccauuucuguugcuauuga

SEQ ID NO: 122541 - RNA, 19 nt, Homo sapiens
uccaguauguucaggauaa

SEQ ID NO: 122542 - RNA, 19 nt, Homo sapiens
ggaaacacagcuucacaau

SEQ ID NO: 122543 - RNA, 19 nt, Homo sapiens
agaagaacaugaagaugau

SEQ ID NO: 122544 - RNA, 19 nt, Homo sapiens
ggaauugccucagcuacuc

SEQ ID NO: 122545 - RNA, 19 nt, Homo sapiens
ggacagggacuggaagaga

SEQ ID NO: 122546 - RNA, 19 nt, Homo sapiens
ggacggugaugaggaagga

SEQ ID NO: 122547 - RNA, 19 nt, Homo sapiens
gguggacggugaugaggaa

SEQ ID NO: 122548 - RNA, 19 nt, Homo sapiens
aguauucuguugcuaauga

SEQ ID NO: 122549 - RNA, 19 nt, Homo sapiens
ggaauccuauccauaugag

SEQ ID NO: 122550 - RNA, 19 nt, Homo sapiens
ugacuccugugaagaauca

SEQ ID NO: 122551 - RNA, 19 nt, Homo sapiens
cggcaugaaugaagaagga

SEQ ID NO: 122552 - RNA, 19 nt, Homo sapiens
ggaauucaucuucagucua

SEQ ID NO: 122553 - RNA, 19 nt, Homo sapiens
cagaagaauccuguaagua

SEQ ID NO: 122554 - RNA, 19 nt, Homo sapiens
caugaccagugaagaauuc

SEQ ID NO: 122555 - RNA, 19 nt, Homo sapiens
ggaauacagggaagggaaa

SEQ ID NO: 122556 - RNA, 19 nt, Homo sapiens
gaacugcacaaucaggaau

SEQ ID NO: 122557 - RNA, 19 nt, Homo sapiens
gaacaugaagaugauugaa

SEQ ID NO: 122558 - RNA, 19 nt, Homo sapiens
acguaaagauggccaaaga

SEQ ID NO: 122559 - RNA, 19 nt, Homo sapiens
gcagugaagacauggauca

SEQ ID NO: 122560 - RNA, 19 nt, Homo sapiens
ucaggcaggugaugaaugg

SEQ ID NO: 122561 - RNA, 19 nt, Homo sapiens
ggagaaaccauuguggaau

SEQ ID NO: 122562 - RNA, 19 nt, Homo sapiens
cuacgugacuccugugaag

SEQ ID NO: 122563 - RNA, 19 nt, Homo sapiens
agacaugaccagugaagaa

SEQ ID NO: 122564 - RNA, 19 nt, Homo sapiens
gggagaagaacaugaagau

SEQ ID NO: 122565 - RNA, 19 nt, Homo sapiens
ggagaaggcccugaugaag

SEQ ID NO: 122566 - RNA, 19 nt, Homo sapiens
agaagaauccuguaaguac

SEQ ID NO: 122567 - RNA, 19 nt, Homo sapiens
gauuaugcuuuccaguaug

SEQ ID NO: 122568 - RNA, 19 nt, Homo sapiens
acacucgaaucauugaaga

SEQ ID NO: 122569 - RNA, 19 nt, Homo sapiens
aguccuuccuguucuauaa

SEQ ID NO: 122570 - RNA, 19 nt, Homo sapiens
cauaugaggcaacagaaga

SEQ ID NO: 122571 - RNA, 19 nt, Homo sapiens
cagauuauacggcaugaau

SEQ ID NO: 122572 - RNA, 19 nt, Homo sapiens
uuggagacaugaccaguga

SEQ ID NO: 122573 - RNA, 19 nt, Homo sapiens
gggaaacacagcuucacaa

SEQ ID NO: 122574 - RNA, 19 nt, Homo sapiens
ggcgaugcacaacagauua

SEQ ID NO: 122575 - RNA, 19 nt, Homo sapiens
gauccgagugugauuugaa

SEQ ID NO: 122576 - RNA, 19 nt, Homo sapiens
agaaaccauuguggaauug

SEQ ID NO: 122577 - RNA, 19 nt, Homo sapiens
gaagaaucagggucagugu

SEQ ID NO: 122578 - RNA, 19 nt, Homo sapiens
ccucagcuacucuaacauu

SEQ ID NO: 122579 - RNA, 19 nt, Homo sapiens
ugaaagcacagaaucagau

SEQ ID NO: 122580 - RNA, 19 nt, Homo sapiens
uauacggcaugaaugaaga

SEQ ID NO: 122581 - RNA, 19 nt, Homo sapiens
gcaaugguggccuaaugga

SEQ ID NO: 122582 - RNA, 19 nt, Homo sapiens
cugcaaugguggccuaaug

SEQ ID NO: 122583 - RNA, 19 nt, Homo sapiens
gaauucaggcaggugauga

SEQ ID NO: 122584 - RNA, 19 nt, Homo sapiens
ugauucacuuacugacuuu

SEQ ID NO: 122585 - RNA, 19 nt, Homo sapiens
gaacagcuggggugaagaa

SEQ ID NO: 122586 - RNA, 19 nt, Homo sapiens
cacagaaucagauaacaau

SEQ ID NO: 122587 - RNA, 19 nt, Homo sapiens
gcaaugaaggcugcaaugg

SEQ ID NO: 122588 - RNA, 19 nt, Homo sapiens
acaugaagaugauugaacu

SEQ ID NO: 122589 - RNA, 19 nt, Homo sapiens
gaagaacaugaagaugauu

SEQ ID NO: 122590 - RNA, 19 nt, Homo sapiens
gagcagugugggagaagaa

SEQ ID NO: 122591 - RNA, 19 nt, Homo sapiens
uugauucacuuacugacuu

SEQ ID NO: 122592 - RNA, 19 nt, Homo sapiens
gugguuggcuacggauuug

SEQ ID NO: 122593 - RNA, 19 nt, Homo sapiens
ggugguuggcuacggauuu

SEQ ID NO: 122594 - RNA, 19 nt, Homo sapiens
gcgcaugcaugggaggaau

SEQ ID NO: 122595 - RNA, 19 nt, Homo sapiens
cggagaaaccauuguggaa

SEQ ID NO: 122596 - RNA, 19 nt, Homo sapiens
acucauccuugcugccuuu

SEQ ID NO: 122597 - RNA, 19 nt, Homo sapiens
ggagaagaacaugaagaug

SEQ ID NO: 122598 - RNA, 19 nt, Homo sapiens
gcgaugcacaacagauuau

SEQ ID NO: 122599 - RNA, 19 nt, Homo sapiens
gggaggaauucaucuucag

SEQ ID NO: 122600 - RNA, 19 nt, Homo sapiens
ccaggaaccucuguuuuau

SEQ ID NO: 122601 - RNA, 19 nt, Homo sapiens
ggagacaugaccagugaag

SEQ ID NO: 122602 - RNA, 19 nt, Homo sapiens
ucuaacauuugaucacagu

SEQ ID NO: 122603 - RNA, 19 nt, Homo sapiens
aguacaaucccaaguauuc

SEQ ID NO: 122604 - RNA, 19 nt, Homo sapiens
aaugguggccuaauggauu

SEQ ID NO: 122605 - RNA, 19 nt, Homo sapiens
caaugaaggcugcaauggu

SEQ ID NO: 122606 - RNA, 19 nt, Homo sapiens
gacaugaccagugaagaau

SEQ ID NO: 122607 - RNA, 19 nt, Homo sapiens
ugccucagcuacucuaaca

SEQ ID NO: 122608 - RNA, 19 nt, Homo sapiens
ggaggaauucaucuucagu

SEQ ID NO: 122609 - RNA, 19 nt, Homo sapiens
gaggcacaguggaccaagu

SEQ ID NO: 122610 - RNA, 19 nt, Homo sapiens
ggauuugaaagcacagaau

SEQ ID NO: 122611 - RNA, 19 nt, Homo sapiens
gcuaaugacaccggcuuug

SEQ ID NO: 122612 - RNA, 19 nt, Homo sapiens
auggaggccuggacucuga

SEQ ID NO: 122613 - RNA, 19 nt, Homo sapiens
gagugugauuugaauucug

SEQ ID NO: 122614 - RNA, 19 nt, Homo sapiens
cggauacacacucgaauca

SEQ ID NO: 122615 - RNA, 19 nt, Homo sapiens
gagaaaccauuguggaauu

SEQ ID NO: 122616 - RNA, 19 nt, Homo sapiens
aaacacagcuucacaaugg

SEQ ID NO: 122617 - RNA, 19 nt, Homo sapiens
gagaagaacaugaagauga

SEQ ID NO: 122618 - RNA, 19 nt, Homo sapiens
gauacacacucgaaucauu

SEQ ID NO: 122619 - RNA, 19 nt, Homo sapiens
gggcauggguggcuacgua

SEQ ID NO: 122620 - RNA, 19 nt, Homo sapiens
ggauuaugcuuuccaguau

SEQ ID NO: 122621 - RNA, 19 nt, Homo sapiens
gaauucaucuucagucuac

SEQ ID NO: 122622 - RNA, 19 nt, Homo sapiens
aauauuggcuggugaagaa

SEQ ID NO: 122623 - RNA, 19 nt, Homo sapiens
ggacagauguuccggaaaa

SEQ ID NO: 122624 - RNA, 19 nt, Homo sapiens
gaaagcacagaaucagaua

SEQ ID NO: 122625 - RNA, 19 nt, Homo sapiens
guaaguacaaucccaagua

SEQ ID NO: 122626 - RNA, 19 nt, Homo sapiens
uaaguacaaucccaaguau

SEQ ID NO: 122627 - RNA, 19 nt, Homo sapiens
cagcuacucuaacauuuga

SEQ ID NO: 122628 - RNA, 19 nt, Homo sapiens
gcacagaaucagauaacaa

SEQ ID NO: 122629 - RNA, 19 nt, Homo sapiens
gaacgccuuuggagacaug

SEQ ID NO: 122630 - RNA, 19 nt, Homo sapiens
ggaaggcgaugcacaacag

SEQ ID NO: 122631 - RNA, 19 nt, Homo sapiens
gauuauacggcaugaauga

SEQ ID NO: 122632 - RNA, 19 nt, Homo sapiens
gagaggacgcggucgagua

SEQ ID NO: 122633 - RNA, 19 nt, Homo sapiens
gaagauccgagugugauuu

SEQ ID NO: 122634 - RNA, 19 nt, Homo sapiens
caaguauucuguugcuaau

SEQ ID NO: 122635 - RNA, 19 nt, Homo sapiens
gaaacacagcuucacaaug

SEQ ID NO: 122636 - RNA, 19 nt, Homo sapiens
gcccauuucuguugcuauu

SEQ ID NO: 122637 - RNA, 19 nt, Homo sapiens
ccaaguauucuguugcuaa

SEQ ID NO: 122638 - RNA, 19 nt, Homo sapiens
ggagagcagugugggagaa

SEQ ID NO: 122639 - RNA, 19 nt, Homo sapiens
ccauuucuguugcuauuga

SEQ ID NO: 122640 - RNA, 19 nt, Homo sapiens
uccaguauguucaggauaa

SEQ ID NO: 122641 - RNA, 19 nt, Homo sapiens
ggaaacacagcuucacaau

SEQ ID NO: 122642 - RNA, 19 nt, Homo sapiens
agaagaacaugaagaugau

SEQ ID NO: 122643 - RNA, 19 nt, Homo sapiens
ggaauugccucagcuacuc

SEQ ID NO: 122644 - RNA, 19 nt, Homo sapiens
ggacagggacuggaagaga

SEQ ID NO: 122645 - RNA, 19 nt, Homo sapiens
ggacggugaugaggaagga

SEQ ID NO: 122646 - RNA, 19 nt, Homo sapiens
gguggacggugaugaggaa

SEQ ID NO: 122647 - RNA, 19 nt, Homo sapiens
aguauucuguugcuaauga

SEQ ID NO: 122648 - RNA, 19 nt, Homo sapiens
ggaauccuauccauaugag

SEQ ID NO: 122649 - RNA, 19 nt, Homo sapiens
ugacuccugugaagaauca

SEQ ID NO: 122650 - RNA, 19 nt, Homo sapiens
cggcaugaaugaagaagga

SEQ ID NO: 122651 - RNA, 19 nt, Homo sapiens
ggaauucaucuucagucua

SEQ ID NO: 122652 - RNA, 19 nt, Homo sapiens
cagaagaauccuguaagua

SEQ ID NO: 122653 - RNA, 19 nt, Homo sapiens
caugaccagugaagaauuc

SEQ ID NO: 122654 - RNA, 19 nt, Homo sapiens
ggaauacagggaagggaaa

SEQ ID NO: 122655 - RNA, 19 nt, Homo sapiens
gaacugcacaaucaggaau

SEQ ID NO: 122656 - RNA, 19 nt, Homo sapiens
gaacaugaagaugauugaa

SEQ ID NO: 122657 - RNA, 19 nt, Homo sapiens
acguaaagauggccaaaga

SEQ ID NO: 122658 - RNA, 19 nt, Homo sapiens
gcagugaagacauggauca

SEQ ID NO: 122659 - RNA, 19 nt, Homo sapiens
ucaggcaggugaugaaugg

SEQ ID NO: 122660 - RNA, 19 nt, Homo sapiens
ggagaaaccauuguggaau

SEQ ID NO: 122661 - RNA, 19 nt, Homo sapiens
cuacgugacuccugugaag

SEQ ID NO: 122662 - RNA, 19 nt, Homo sapiens
agacaugaccagugaagaa

SEQ ID NO: 122663 - RNA, 19 nt, Homo sapiens
gggagaagaacaugaagau

SEQ ID NO: 122664 - RNA, 19 nt, Homo sapiens
ggagaaggcccugaugaag

SEQ ID NO: 122665 - RNA, 19 nt, Homo sapiens
agaagaauccuguaaguac

SEQ ID NO: 122666 - RNA, 19 nt, Homo sapiens
gauuaugcuuuccaguaug

SEQ ID NO: 122667 - RNA, 19 nt, Homo sapiens
acacucgaaucauugaaga

SEQ ID NO: 122668 - RNA, 19 nt, Homo sapiens
aguccuuccuguucuauaa

SEQ ID NO: 122669 - RNA, 19 nt, Homo sapiens
cauaugaggcaacagaaga

SEQ ID NO: 122670 - RNA, 19 nt, Homo sapiens
cagauuauacggcaugaau

SEQ ID NO: 122671 - RNA, 19 nt, Homo sapiens
uuggagacaugaccaguga

SEQ ID NO: 122672 - RNA, 19 nt, Homo sapiens
gggaaacacagcuucacaa

SEQ ID NO: 122673 - RNA, 19 nt, Homo sapiens
ggcgaugcacaacagauua

SEQ ID NO: 122674 - RNA, 19 nt, Homo sapiens
gauccgagugugauuugaa

SEQ ID NO: 122675 - RNA, 19 nt, Homo sapiens
agaaaccauuguggaauug

SEQ ID NO: 122676 - RNA, 19 nt, Homo sapiens
gaagaaucagggucagugu

SEQ ID NO: 122677 - RNA, 19 nt, Homo sapiens
ugaaagcacagaaucagau

SEQ ID NO: 122678 - RNA, 19 nt, Homo sapiens
ccucagcuacucuaacauu

SEQ ID NO: 122679 - RNA, 19 nt, Homo sapiens
uauacggcaugaaugaaga

SEQ ID NO: 122680 - RNA, 19 nt, Homo sapiens
gcaaugguggccuaaugga

SEQ ID NO: 122681 - RNA, 19 nt, Homo sapiens
cugcaaugguggccuaaug

SEQ ID NO: 122682 - RNA, 19 nt, Homo sapiens
gaauucaggcaggugauga

SEQ ID NO: 122683 - RNA, 19 nt, Homo sapiens
ugauucacuuacugacuuu

SEQ ID NO: 122684 - RNA, 19 nt, Homo sapiens
gaacagcuggggugaagaa

SEQ ID NO: 122685 - RNA, 19 nt, Homo sapiens
cacagaaucagauaacaau

SEQ ID NO: 122686 - RNA, 19 nt, Homo sapiens
gcaaugaaggcugcaaugg

SEQ ID NO: 122687 - RNA, 19 nt, Homo sapiens
acaugaagaugauugaacu

SEQ ID NO: 122688 - RNA, 19 nt, Homo sapiens
gaagaacaugaagaugauu

SEQ ID NO: 122689 - RNA, 19 nt, Homo sapiens
gagcagugugggagaagaa

SEQ ID NO: 122690 - RNA, 19 nt, Homo sapiens
uugauucacuuacugacuu

SEQ ID NO: 122691 - RNA, 19 nt, Homo sapiens
gugguuggcuacggauuug

SEQ ID NO: 122692 - RNA, 19 nt, Homo sapiens
ggugguuggcuacggauuu

SEQ ID NO: 122693 - RNA, 19 nt, Homo sapiens
gcgcaugcaugggaggaau

SEQ ID NO: 122694 - RNA, 19 nt, Homo sapiens
cggagaaaccauuguggaa

SEQ ID NO: 122695 - RNA, 19 nt, Homo sapiens
gcgaugcacaacagauuau

SEQ ID NO: 122696 - RNA, 19 nt, Homo sapiens
acucauccuugcugccuuu

SEQ ID NO: 122697 - RNA, 19 nt, Homo sapiens
ggagaagaacaugaagaug

SEQ ID NO: 122698 - RNA, 19 nt, Homo sapiens
gggaggaauucaucuucag

SEQ ID NO: 122699 - RNA, 19 nt, Homo sapiens
ccaggaaccucuguuuuau

SEQ ID NO: 122700 - RNA, 19 nt, Homo sapiens
ggagacaugaccagugaag

SEQ ID NO: 122701 - RNA, 19 nt, Homo sapiens
ucuaacauuugaucacagu

SEQ ID NO: 122702 - RNA, 19 nt, Homo sapiens
ugccucagcuacucuaaca

SEQ ID NO: 122703 - RNA, 19 nt, Homo sapiens
aguacaaucccaaguauuc

SEQ ID NO: 122704 - RNA, 19 nt, Homo sapiens
aaugguggccuaauggauu

SEQ ID NO: 122705 - RNA, 19 nt, Homo sapiens
caaugaaggcugcaauggu

SEQ ID NO: 122706 - RNA, 19 nt, Homo sapiens
gacaugaccagugaagaau

SEQ ID NO: 122707 - RNA, 19 nt, Homo sapiens
ggaggaauucaucuucagu

SEQ ID NO: 122708 - RNA, 19 nt, Homo sapiens
ggauuugaaagcacagaau

SEQ ID NO: 122709 - RNA, 19 nt, Homo sapiens
gcuaaugacaccggcuuug

SEQ ID NO: 122710 - RNA, 19 nt, Homo sapiens
auggaggccuggacucuga

SEQ ID NO: 122711 - RNA, 19 nt, Homo sapiens
gaggcacaguggaccaagu

SEQ ID NO: 122712 - RNA, 19 nt, Homo sapiens
gagugugauuugaauucug

SEQ ID NO: 122713 - RNA, 19 nt, Homo sapiens
cggauacacacucgaauca

SEQ ID NO: 122714 - RNA, 19 nt, Homo sapiens
ugggaggaauucaucuuca

SEQ ID NO: 122715 - RNA, 19 nt, Homo sapiens
aaacauggcuucacaaugg

SEQ ID NO: 122716 - RNA, 19 nt, Homo sapiens
ggaauccuauccauaugua

SEQ ID NO: 122717 - RNA, 19 nt, Homo sapiens
gaaacugaccaaacgcuua

SEQ ID NO: 122718 - RNA, 19 nt, Homo sapiens
agaauucuguugcuaauga

SEQ ID NO: 122719 - RNA, 19 nt, Homo sapiens
ggacagauguuccggaaaa

SEQ ID NO: 122720 - RNA, 19 nt, Homo sapiens
guacagaccugagaauucu

SEQ ID NO: 122721 - RNA, 19 nt, Homo sapiens
uaaaccaguugaaucauug

SEQ ID NO: 122722 - RNA, 19 nt, Homo sapiens
ggagaaggcccugaugaaa

SEQ ID NO: 122723 - RNA, 19 nt, Homo sapiens
gaaacagugugguucuugu

SEQ ID NO: 122724 - RNA, 19 nt, Homo sapiens
ggaauagccuccgcuguuc

SEQ ID NO: 122725 - RNA, 19 nt, Homo sapiens
gaagaauucaggcagauga

SEQ ID NO: 122726 - RNA, 19 nt, Homo sapiens
gggaauagccuccgcuguu

SEQ ID NO: 122727 - RNA, 19 nt, Homo sapiens
ggagcaaauucgaauaaca

SEQ ID NO: 122728 - RNA, 19 nt, Homo sapiens
gaugauggguugcuuucga

SEQ ID NO: 122729 - RNA, 19 nt, Homo sapiens
gaaggagcaaauucgaaua

SEQ ID NO: 122730 - RNA, 19 nt, Homo sapiens
caauggccaugaaugcuuu

SEQ ID NO: 122731 - RNA, 19 nt, Homo sapiens
ccaaacgcuuauuguguaa

SEQ ID NO: 122732 - RNA, 19 nt, Homo sapiens
gaaggcaacacacagaaga

SEQ ID NO: 122733 - RNA, 19 nt, Homo sapiens
accaaacgcuuauugugua

SEQ ID NO: 122734 - RNA, 19 nt, Homo sapiens
uggaugaaaucuguaagua

SEQ ID NO: 122735 - RNA, 19 nt, Homo sapiens
ggaauacagccaagggaaa

SEQ ID NO: 122736 - RNA, 19 nt, Homo sapiens
ugacaugaccaaugaagaa

SEQ ID NO: 122737 - RNA, 19 nt, Homo sapiens
gcaacacacagaagauuau

SEQ ID NO: 122738 - RNA, 19 nt, Homo sapiens
gcuagggccuuccaguaug

SEQ ID NO: 122739 - RNA, 19 nt, Homo sapiens
ggaaacauggcuucacaau

SEQ ID NO: 122740 - RNA, 19 nt, Homo sapiens
gauuauauggcgcgaauga

SEQ ID NO: 122741 - RNA, 19 nt, Homo sapiens
aucaaagacucauugcuua

SEQ ID NO: 122742 - RNA, 19 nt, Homo sapiens
gaccaaacgcuuauugugu

SEQ ID NO: 122743 - RNA, 19 nt, Homo sapiens
gggcucgaauggcuaugua

SEQ ID NO: 122744 - RNA, 19 nt, Homo sapiens
gcggacgucuguaaucuca

SEQ ID NO: 122745 - RNA, 19 nt, Homo sapiens
gaaaggagaaggcccugau

SEQ ID NO: 122746 - RNA, 19 nt, Homo sapiens
gaaacauggcuucacaaug

SEQ ID NO: 122747 - RNA, 19 nt, Homo sapiens
uaucaaagacucauugcuu

SEQ ID NO: 122748 - RNA, 19 nt, Homo sapiens
gauccaaguugagauuuua

SEQ ID NO: 122749 - RNA, 19 nt, Homo sapiens
ggcaacacacagaagauua

SEQ ID NO: 122750 - RNA, 19 nt, Homo sapiens
guuauacacagcuuuauga

SEQ ID NO: 122751 - RNA, 19 nt, Homo sapiens
caaauucgaauaacagcaa

SEQ ID NO: 122752 - RNA, 19 nt, Homo sapiens
gagaaggcccugaugaaag

SEQ ID NO: 122753 - RNA, 19 nt, Homo sapiens
caugaccaaugaagaauuc

SEQ ID NO: 122754 - RNA, 19 nt, Homo sapiens
gaaaccagaaauucaggaa

SEQ ID NO: 122755 - RNA, 19 nt, Homo sapiens
aaaccuggaucaugguguu

SEQ ID NO: 122756 - RNA, 19 nt, Homo sapiens
ugagaauucuguugcuaau

SEQ ID NO: 122757 - RNA, 19 nt, Homo sapiens
caacacacagaagauuaua

SEQ ID NO: 122758 - RNA, 19 nt, Homo sapiens
ucaaagacucauugcuuaa

SEQ ID NO: 122759 - RNA, 19 nt, Homo sapiens
uaaugacacuggcuucaca

SEQ ID NO: 122760 - RNA, 19 nt, Homo sapiens
gaugaaagcagucgcaacu

SEQ ID NO: 122761 - RNA, 19 nt, Homo sapiens
gaacggaggccuggacucu

SEQ ID NO: 122762 - RNA, 19 nt, Homo sapiens
ugacgccagugaagaauca

SEQ ID NO: 122763 - RNA, 19 nt, Homo sapiens
gagccucuguuucuugauc

SEQ ID NO: 122764 - RNA, 19 nt, Homo sapiens
gugagccucuguuucuuga

SEQ ID NO: 122765 - RNA, 19 nt, Homo sapiens
gaggauccaaguugagauu

SEQ ID NO: 122766 - RNA, 19 nt, Homo sapiens
gcagaugauggguugcuuu

SEQ ID NO: 122767 - RNA, 19 nt, Homo sapiens
cauugaggauccaaguuga

SEQ ID NO: 122768 - RNA, 19 nt, Homo sapiens
uguguaagauaaaccaguu

SEQ ID NO: 122769 - RNA, 19 nt, Homo sapiens
ggacuuaaggacagcaugu

SEQ ID NO: 122770 - RNA, 19 nt, Homo sapiens
agauaaaccaguugaauca

SEQ ID NO: 122771 - RNA, 19 nt, Homo sapiens
acacacagaagauuauaug

SEQ ID NO: 122772 - RNA, 19 nt, Homo sapiens
gagcaaauucgaauaacag

SEQ ID NO: 122773 - RNA, 19 nt, Homo sapiens
aagauuauauggcgcgaau

SEQ ID NO: 122774 - RNA, 19 nt, Homo sapiens
gcucgaauggcuauguaaa

SEQ ID NO: 122775 - RNA, 19 nt, Homo sapiens
gacuggugcucuugaagga

SEQ ID NO: 122776 - RNA, 19 nt, Homo sapiens
caaagacucauugcuuaau

SEQ ID NO: 122777 - RNA, 19 nt, Homo sapiens
ugaaggagcaaauucgaau

SEQ ID NO: 122778 - RNA, 19 nt, Homo sapiens
caaagugguaccaguggaa

SEQ ID NO: 122779 - RNA, 19 nt, Homo sapiens
guaaguacagaccugagaa

SEQ ID NO: 122780 - RNA, 19 nt, Homo sapiens
aaacugaccaaacgcuuau

SEQ ID NO: 122781 - RNA, 19 nt, Homo sapiens
gggcccaucuccguugcua

SEQ ID NO: 122782 - RNA, 19 nt, Homo sapiens
acggaggccuggacucuga

SEQ ID NO: 122783 - RNA, 19 nt, Homo sapiens
uccaguaugucaaggagaa

SEQ ID NO: 122784 - RNA, 19 nt, Homo sapiens
gauggauggugaggaggaa

SEQ ID NO: 122785 - RNA, 19 nt, Homo sapiens
ccaaagacaagaacaacca

SEQ ID NO: 122786 - RNA, 19 nt, Homo sapiens
aaggagcaaauucgaauaa

SEQ ID NO: 122787 - RNA, 19 nt, Homo sapiens
agaaggcccugaugaaagc

SEQ ID NO: 122788 - RNA, 19 nt, Homo sapiens
ggggaaauuuuaucuugaa

SEQ ID NO: 122789 - RNA, 19 nt, Homo sapiens
cagcaugucuggggaaauu

SEQ ID NO: 122790 - RNA, 19 nt, Homo sapiens
gggaaacuugucucacuga

SEQ ID NO: 122791 - RNA, 19 nt, Homo sapiens
gaagaaucagaaacagugu

SEQ ID NO: 122792 - RNA, 19 nt, Homo sapiens
acacagcuuuaugauauca

SEQ ID NO: 122793 - RNA, 19 nt, Homo sapiens
ucauugaggauccaaguug

SEQ ID NO: 122794 - RNA, 19 nt, Homo sapiens
gcaaguauuggcucgucaa

SEQ ID NO: 122795 - RNA, 19 nt, Homo sapiens
ccugagaauucuguugcua

SEQ ID NO: 122796 - RNA, 19 nt, Homo sapiens
ucacugagcgagcagaauc

SEQ ID NO: 122797 - RNA, 19 nt, Homo sapiens
ggauccaaguugagauuuu

SEQ ID NO: 122798 - RNA, 19 nt, Homo sapiens
ggagagcagugugggaaaa

SEQ ID NO: 122799 - RNA, 19 nt, Homo sapiens
ggaugaaaucuguaaguac

SEQ ID NO: 122800 - RNA, 19 nt, Homo sapiens
ggcuagggccuuccaguau

SEQ ID NO: 122801 - RNA, 19 nt, Homo sapiens
gcccaucuccguugcuaug

SEQ ID NO: 122802 - RNA, 19 nt, Homo sapiens
gcaaucagggcugcaaugg

SEQ ID NO: 122803 - RNA, 19 nt, Homo sapiens
agaaucugguggacuguuc

SEQ ID NO: 122804 - RNA, 19 nt, Homo sapiens
aagacucauugcuuaauuc

SEQ ID NO: 122805 - RNA, 19 nt, Homo sapiens
guaagauaaaccaguugaa

SEQ ID NO: 122806 - RNA, 19 nt, Homo sapiens
ugaccaaacgcuuauugug

SEQ ID NO: 122807 - RNA, 19 nt, Homo sapiens
cugcaaugguggcuucaug

SEQ ID NO: 122808 - RNA, 19 nt, Homo sapiens
gaauacagccaagggaaac

SEQ ID NO: 122809 - RNA, 19 nt, Homo sapiens
ggaaggcaacacacagaag

SEQ ID NO: 122810 - RNA, 19 nt, Homo sapiens
cuagggccuuccaguaugu

SEQ ID NO: 122811 - RNA, 19 nt, Homo sapiens
aaucagaaacagugugguu

SEQ ID NO: 122812 - RNA, 19 nt, Homo sapiens
ugauaucaaagacucauug

SEQ ID NO: 122813 - RNA, 19 nt, Homo sapiens
aagauaaaccaguugaauc

SEQ ID NO: 122814 - RNA, 19 nt, Homo sapiens
caaguauuggcucgucaaa

SEQ ID NO: 122815 - RNA, 19 nt, Homo sapiens
gcagugagcuggcaagauu

SEQ ID NO: 122816 - RNA, 19 nt, Homo sapiens
ggaaucugcuuaugcaaua

SEQ ID NO: 122817 - RNA, 19 nt, Homo sapiens
ucaaagaggucauaagaau

SEQ ID NO: 122818 - RNA, 19 nt, Homo sapiens
caaaaucgcuucaguuaaa

SEQ ID NO: 122819 - RNA, 19 nt, Homo sapiens
cgaggaagccuauggaaua

SEQ ID NO: 122820 - RNA, 19 nt, Homo sapiens
gaucaaagaggucauaaga

SEQ ID NO: 122821 - RNA, 19 nt, Homo sapiens
gcucuacucucaaugcuuu

SEQ ID NO: 122822 - RNA, 19 nt, Homo sapiens
uaauagacaucgauacuug

SEQ ID NO: 122823 - RNA, 19 nt, Homo sapiens
gaaguaauguuugugguau

SEQ ID NO: 122824 - RNA, 19 nt, Homo sapiens
ggaaggcuacuguuuguuu

SEQ ID NO: 122825 - RNA, 19 nt, Homo sapiens
agacaucgauacuugaauu

SEQ ID NO: 122826 - RNA, 19 nt, Homo sapiens
guagagagauggacaacca

SEQ ID NO: 122827 - RNA, 19 nt, Homo sapiens
caaagguuauucugcauau

SEQ ID NO: 122828 - RNA, 19 nt, Homo sapiens
caaugugucuuugccguua

SEQ ID NO: 122829 - RNA, 19 nt, Homo sapiens
gagacgaaauucagauuag

SEQ ID NO: 122830 - RNA, 19 nt, Homo sapiens
ggaaguaauguuuguggua

SEQ ID NO: 122831 - RNA, 19 nt, Homo sapiens
gcuuugaacugguuaaaca

SEQ ID NO: 122832 - RNA, 19 nt, Homo sapiens
ugacuucagugaccaagaa

SEQ ID NO: 122833 - RNA, 19 nt, Homo sapiens
ucaaacaccaauugcuuua

SEQ ID NO: 122834 - RNA, 19 nt, Homo sapiens
ggguguaacuacuagcuuu

SEQ ID NO: 122835 - RNA, 19 nt, Homo sapiens
caaauggugcuuacccuuu

SEQ ID NO: 122836 - RNA, 19 nt, Homo sapiens
cagauuccguuucuucuau

SEQ ID NO: 122837 - RNA, 19 nt, Homo sapiens
gcagagugaccacguagaa

SEQ ID NO: 122838 - RNA, 19 nt, Homo sapiens
uauauuagcagcccucuga

SEQ ID NO: 122839 - RNA, 19 nt, Homo sapiens
caaaagcacuucuuaccuu

SEQ ID NO: 122840 - RNA, 19 nt, Homo sapiens
caaagaggucauaagaauu

SEQ ID NO: 122841 - RNA, 19 nt, Homo sapiens
gaaauucagauuaggagau

SEQ ID NO: 122842 - RNA, 19 nt, Homo sapiens
gcagauuccguuucuucua

SEQ ID NO: 122843 - RNA, 19 nt, Homo sapiens
agaagcaaaucaugcaguu

SEQ ID NO: 122844 - RNA, 19 nt, Homo sapiens
ccacguagaaggaaggaaa

SEQ ID NO: 122845 - RNA, 19 nt, Homo sapiens
cuuccaaguuucccagaua

SEQ ID NO: 122846 - RNA, 19 nt, Homo sapiens
caucgauacuugaauucuu

SEQ ID NO: 122847 - RNA, 19 nt, Homo sapiens
aaacaggaagcacuccaua

SEQ ID NO: 122848 - RNA, 19 nt, Homo sapiens
guaucuaucggaaggauuu

SEQ ID NO: 122849 - RNA, 19 nt, Homo sapiens
caagaauggccaaccuaaa

SEQ ID NO: 122850 - RNA, 19 nt, Homo sapiens
ggacaaacuccagcacaga

SEQ ID NO: 122851 - RNA, 19 nt, Homo sapiens
ucuaaggccuaguaguauu

SEQ ID NO: 122852 - RNA, 19 nt, Homo sapiens
acaggaagcacuccauauu

SEQ ID NO: 122853 - RNA, 19 nt, Homo sapiens
aaauggugcuuacccuuug

SEQ ID NO: 122854 - RNA, 19 nt, Homo sapiens
ggauuucaaacaccaauug

SEQ ID NO: 122855 - RNA, 19 nt, Homo sapiens
ugagacgaaauucagauua

SEQ ID NO: 122856 - RNA, 19 nt, Homo sapiens
gcaacuaccuacaaaagau

SEQ ID NO: 122857 - RNA, 19 nt, Homo sapiens
aauggaggcucuacucuca

SEQ ID NO: 122858 - RNA, 19 nt, Homo sapiens
acuacuagcuuuagauuac

SEQ ID NO: 122859 - RNA, 19 nt, Homo sapiens
ccgggaaagucuuaauaga

SEQ ID NO: 122860 - RNA, 19 nt, Homo sapiens
cagcagaaguacauauguc

SEQ ID NO: 122861 - RNA, 19 nt, Homo sapiens
ggcaaaaucgcuucaguua

SEQ ID NO: 122862 - RNA, 19 nt, Homo sapiens
gaaggcuacuguuuguuuu

SEQ ID NO: 122863 - RNA, 19 nt, Homo sapiens
cacagaagccugcgaggaa

SEQ ID NO: 122864 - RNA, 19 nt, Homo sapiens
gacaaacuccagcacagaa

SEQ ID NO: 122865 - RNA, 19 nt, Homo sapiens
ugaccaagaagaugaaaug

SEQ ID NO: 122866 - RNA, 19 nt, Homo sapiens
gguguaacuacuagcuuua

SEQ ID NO: 122867 - RNA, 19 nt, Homo sapiens
gaauguucccuucuuguag

SEQ ID NO: 122868 - RNA, 19 nt, Homo sapiens
ucucauaacuggguuugau

SEQ ID NO: 122869 - RNA, 19 nt, Homo sapiens
caggaagcacuccauauug

SEQ ID NO: 122870 - RNA, 19 nt, Homo sapiens
ucaaagguuauucugcaua

SEQ ID NO: 122871 - RNA, 19 nt, Homo sapiens
ggaggaugcugggccuuca

SEQ ID NO: 122872 - RNA, 19 nt, Homo sapiens
ugaagaguuuaaagccauu

SEQ ID NO: 122873 - RNA, 19 nt, Homo sapiens
gcagaucaagagacagcua

SEQ ID NO: 122874 - RNA, 19 nt, Homo sapiens
gaacugguuaaacaagaug

SEQ ID NO: 122875 - RNA, 19 nt, Homo sapiens
acaagaauggccaaccuaa

SEQ ID NO: 122876 - RNA, 19 nt, Homo sapiens
auucuaaggccuaguagua

SEQ ID NO: 122877 - RNA, 19 nt, Homo sapiens
aaucaugcaguucucauaa

SEQ ID NO: 122878 - RNA, 19 nt, Homo sapiens
gauuaucugggaggcauua

SEQ ID NO: 122879 - RNA, 19 nt, Homo sapiens
cagcagauguguggaggau

SEQ ID NO: 122880 - RNA, 19 nt, Homo sapiens
ugcuuuaccugaacaaaug

SEQ ID NO: 122881 - RNA, 19 nt, Homo sapiens
cgccuucuauggaauaaau

SEQ ID NO: 122882 - RNA, 19 nt, Homo sapiens
aauguucccuucuuguaga

SEQ ID NO: 122883 - RNA, 19 nt, Homo sapiens
aaacuccaccgccuucuau

SEQ ID NO: 122884 - RNA, 19 nt, Homo sapiens
ugucuuguacaguuaguua

SEQ ID NO: 122885 - RNA, 19 nt, Homo sapiens
ucauaacuggguuugauaa

SEQ ID NO: 122886 - RNA, 19 nt, Homo sapiens
ucagugaccaagaagauga

SEQ ID NO: 122887 - RNA, 19 nt, Homo sapiens
ugagaaaccagcagaugug

SEQ ID NO: 122888 - RNA, 19 nt, Homo sapiens
agauuccguuucuucuaua

SEQ ID NO: 122889 - RNA, 19 nt, Homo sapiens
aggaagcacuccauauugg

SEQ ID NO: 122890 - RNA, 19 nt, Homo sapiens
ugaacugguuaaacaagau

SEQ ID NO: 122891 - RNA, 19 nt, Homo sapiens
ucauugacuguucguauaa

SEQ ID NO: 122892 - RNA, 19 nt, Homo sapiens
acagcagagugaccacgua

SEQ ID NO: 122893 - RNA, 19 nt, Homo sapiens
ccaauugcuuuaccugaac

SEQ ID NO: 122894 - RNA, 19 nt, Homo sapiens
caaagucagugggacaaac

SEQ ID NO: 122895 - RNA, 19 nt, Homo sapiens
cuaaggccuaguaguauuu

SEQ ID NO: 122896 - RNA, 19 nt, Homo sapiens
uuuguuuccugaagaguuu

SEQ ID NO: 122897 - RNA, 19 nt, Homo sapiens
ccuauuuguuuccugaaga

SEQ ID NO: 122898 - RNA, 19 nt, Homo sapiens
ugugugucuuguacaguua

SEQ ID NO: 122899 - RNA, 19 nt, Homo sapiens
gauuccguuucuucuauau

SEQ ID NO: 122900 - RNA, 19 nt, Homo sapiens
aguaauguuugugguauug

SEQ ID NO: 122901 - RNA, 19 nt, Homo sapiens
ugguucacauucuggauuu

SEQ ID NO: 122902 - RNA, 19 nt, Homo sapiens
gcaaaaucgcuucaguuaa

SEQ ID NO: 122903 - RNA, 19 nt, Homo sapiens
accaauugcuuuaccugaa

SEQ ID NO: 122904 - RNA, 19 nt, Homo sapiens
gugagaaaccagcagaugu

SEQ ID NO: 122905 - RNA, 19 nt, Homo sapiens
gcgaggaagccuauggaau

SEQ ID NO: 122906 - RNA, 19 nt, Homo sapiens
ugacacaagugagaaacca

SEQ ID NO: 122907 - RNA, 19 nt, Homo sapiens
gcaaaucaugcaguucuca

SEQ ID NO: 122908 - RNA, 19 nt, Homo sapiens
uaaaacuggugaaagauuc

SEQ ID NO: 122909 - RNA, 19 nt, Homo sapiens
gacgaaauucagauuagga

SEQ ID NO: 122910 - RNA, 19 nt, Homo sapiens
uaaggccuaguaguauuua

SEQ ID NO: 122911 - RNA, 19 nt, Homo sapiens
gaucaagagacagcuacaa

SEQ ID NO: 122912 - RNA, 19 nt, Homo sapiens
auauuugugugacauguug

SEQ ID NO: 122913 - RNA, 19 nt, Homo sapiens
aaugggaaguaauguuugu

SEQ ID NO: 122914 - RNA, 19 nt, Homo sapiens
aagguuauucugcauauga

SEQ ID NO: 122915 - RNA, 19 nt, Homo sapiens
ggauaaaguuugcuaagua

SEQ ID NO: 122916 - RNA, 19 nt, Homo sapiens
gaagagagcccacuaauuc

SEQ ID NO: 122917 - RNA, 19 nt, Homo sapiens
gaagugaugucuuugauga

SEQ ID NO: 122918 - RNA, 19 nt, Homo sapiens
gaacugaaaucuccuuguu

SEQ ID NO: 122919 - RNA, 19 nt, Homo sapiens
gagaagauguccugaaaga

SEQ ID NO: 122920 - RNA, 19 nt, Homo sapiens
caacugcucuagauuagua

SEQ ID NO: 122921 - RNA, 19 nt, Homo sapiens
gaaguggugucuacuauga

SEQ ID NO: 122922 - RNA, 19 nt, Homo sapiens
ccgaguagcuggaauuaua

SEQ ID NO: 122923 - RNA, 19 nt, Homo sapiens
gaucagaaaugucaauaug

SEQ ID NO: 122924 - RNA, 19 nt, Homo sapiens
gaaagaagcuguggccaau

SEQ ID NO: 122925 - RNA, 19 nt, Homo sapiens
gaaaucuccuuguugcuuu

SEQ ID NO: 122926 - RNA, 19 nt, Homo sapiens
gaagugaaauaucaagguu

SEQ ID NO: 122927 - RNA, 19 nt, Homo sapiens
gcagugagcuuguaauugc

SEQ ID NO: 122928 - RNA, 19 nt, Homo sapiens
caagaaauaugaagcacuu

SEQ ID NO: 122929 - RNA, 19 nt, Homo sapiens
gaaaggguguguuacugaa

SEQ ID NO: 122930 - RNA, 19 nt, Homo sapiens
gcuaaucucucuuuuguua

SEQ ID NO: 122931 - RNA, 19 nt, Homo sapiens
cagagaagauguccugaaa

SEQ ID NO: 122932 - RNA, 19 nt, Homo sapiens
ucauaagacugucauguaa

SEQ ID NO: 122933 - RNA, 19 nt, Homo sapiens
gaaugugaaucauggugua

SEQ ID NO: 122934 - RNA, 19 nt, Homo sapiens
gcaggcagcaggaacuuua

SEQ ID NO: 122935 - RNA, 19 nt, Homo sapiens
ccacauaccauucuuauuc

SEQ ID NO: 122936 - RNA, 19 nt, Homo sapiens
gaaccauccuguacucaga

SEQ ID NO: 122937 - RNA, 19 nt, Homo sapiens
aaagaggauucaacacaua

SEQ ID NO: 122938 - RNA, 19 nt, Homo sapiens
gaucucagcccuaaaccua

SEQ ID NO: 122939 - RNA, 19 nt, Homo sapiens
auacauggcuaucaucaaa

SEQ ID NO: 122940 - RNA, 19 nt, Homo sapiens
gacaagcacuuuggaagaa

SEQ ID NO: 122941 - RNA, 19 nt, Homo sapiens
caaugggaaugcacucaua

SEQ ID NO: 122942 - RNA, 19 nt, Homo sapiens
caacuuuggugaagaagga

SEQ ID NO: 122943 - RNA, 19 nt, Homo sapiens
ccacaacuuuggugaagaa

SEQ ID NO: 122944 - RNA, 19 nt, Homo sapiens
gcaaaucucaggauaaagu

SEQ ID NO: 122945 - RNA, 19 nt, Homo sapiens
aaagaauacuggcuuguga

SEQ ID NO: 122946 - RNA, 19 nt, Homo sapiens
aagaagcuguggccaauaa

SEQ ID NO: 122947 - RNA, 19 nt, Homo sapiens
gaagauguccugaaagaag

SEQ ID NO: 122948 - RNA, 19 nt, Homo sapiens
acacugaacuuccuuaugg

SEQ ID NO: 122949 - RNA, 19 nt, Homo sapiens
cagcaggaacuuuaaauuu

SEQ ID NO: 122950 - RNA, 19 nt, Homo sapiens
guacagaagaggauucaaa

SEQ ID NO: 122951 - RNA, 19 nt, Homo sapiens
caagucaauugaacugaaa

SEQ ID NO: 122952 - RNA, 19 nt, Homo sapiens
aaacauggguucuuagucu

SEQ ID NO: 122953 - RNA, 19 nt, Homo sapiens
caggaaagcuggugucucu

SEQ ID NO: 122954 - RNA, 19 nt, Homo sapiens
gccuaugaaugccuucuua

SEQ ID NO: 122955 - RNA, 19 nt, Homo sapiens
uuacaacugcucuagauua

SEQ ID NO: 122956 - RNA, 19 nt, Homo sapiens
guggauugcucaacugaaa

SEQ ID NO: 122957 - RNA, 19 nt, Homo sapiens
ugaaguagaucauaagacu

SEQ ID NO: 122958 - RNA, 19 nt, Homo sapiens
ccagaaaucuagaggaucu

SEQ ID NO: 122959 - RNA, 19 nt, Homo sapiens
ugacaacggcuuuccagua

SEQ ID NO: 122960 - RNA, 19 nt, Homo sapiens
gaagaaaaccuauggcaaa

SEQ ID NO: 122961 - RNA, 19 nt, Homo sapiens
gcaugcuucuuuauaaaug

SEQ ID NO: 122962 - RNA, 19 nt, Homo sapiens
uaacugagccaaccagaau

SEQ ID NO: 122963 - RNA, 19 nt, Homo sapiens
cagaaguggugucuacuau

SEQ ID NO: 122964 - RNA, 19 nt, Homo sapiens
gagaaaggguguguuacug

SEQ ID NO: 122965 - RNA, 19 nt, Homo sapiens
ccuaaggacucagauugua

SEQ ID NO: 122966 - RNA, 19 nt, Homo sapiens
ggcaagaaauaaaggaaau

SEQ ID NO: 122967 - RNA, 19 nt, Homo sapiens
gacaacggcuuuccaguac

SEQ ID NO: 122968 - RNA, 19 nt, Homo sapiens
cauaauacauggcuaucau

SEQ ID NO: 122969 - RNA, 19 nt, Homo sapiens
ugaacaaugugugggauaa

SEQ ID NO: 122970 - RNA, 19 nt, Homo sapiens
acaaagccauggaucagaa

SEQ ID NO: 122971 - RNA, 19 nt, Homo sapiens
gucaaacccuaaucggaua

SEQ ID NO: 122972 - RNA, 19 nt, Homo sapiens
gaucaccacuggcaucucu

SEQ ID NO: 122973 - RNA, 19 nt, Homo sapiens
gauagaaggaaacauaugu

SEQ ID NO: 122974 - RNA, 19 nt, Homo sapiens
caaagaggaaucuaaacaa

SEQ ID NO: 122975 - RNA, 19 nt, Homo sapiens
agaggaaucuaaacaaaca

SEQ ID NO: 122976 - RNA, 19 nt, Homo sapiens
uaugaagcacuuucucuua

SEQ ID NO: 122977 - RNA, 19 nt, Homo sapiens
cuacagaaguggugucuac

SEQ ID NO: 122978 - RNA, 19 nt, Homo sapiens
agagagaaaggguguguua

SEQ ID NO: 122979 - RNA, 19 nt, Homo sapiens
gaaaaccuauggcaaacaa

SEQ ID NO: 122980 - RNA, 19 nt, Homo sapiens
acacaaagaggaaucuaaa

SEQ ID NO: 122981 - RNA, 19 nt, Homo sapiens
gcagcaggaacuuuaaauu

SEQ ID NO: 122982 - RNA, 19 nt, Homo sapiens
gaaagaauacuggcuugug

SEQ ID NO: 122983 - RNA, 19 nt, Homo sapiens
guacucagaaugugaauca

SEQ ID NO: 122984 - RNA, 19 nt, Homo sapiens
ggaaacaaaggcugcaaug

SEQ ID NO: 122985 - RNA, 19 nt, Homo sapiens
gagcauccuuaccuccaaa

SEQ ID NO: 122986 - RNA, 19 nt, Homo sapiens
gaugaugaaguauugcuaa

SEQ ID NO: 122987 - RNA, 19 nt, Homo sapiens
gacaaguuccaauuucuuu

SEQ ID NO: 122988 - RNA, 19 nt, Homo sapiens
auagagaucucagcccuaa

SEQ ID NO: 122989 - RNA, 19 nt, Homo sapiens
gucuuuagcuaucuguuaa

SEQ ID NO: 122990 - RNA, 19 nt, Homo sapiens
uugcaaaucucaggauaaa

SEQ ID NO: 122991 - RNA, 19 nt, Homo sapiens
ggauauugccugauucugu

SEQ ID NO: 122992 - RNA, 19 nt, Homo sapiens
aaaccuauggcaaacaaua

SEQ ID NO: 122993 - RNA, 19 nt, Homo sapiens
auacagcacuuugacauau

SEQ ID NO: 122994 - RNA, 19 nt, Homo sapiens
ggaacaagaauugcuaaau

SEQ ID NO: 122995 - RNA, 19 nt, Homo sapiens
caagcacuuuggaagaauu

SEQ ID NO: 122996 - RNA, 19 nt, Homo sapiens
gaggauucaacacauauuu

SEQ ID NO: 122997 - RNA, 19 nt, Homo sapiens
uggcacaguugcauaaaga

SEQ ID NO: 122998 - RNA, 19 nt, Homo sapiens
cccaagagguugaggcuau

SEQ ID NO: 122999 - RNA, 19 nt, Homo sapiens
augaagcacuuucucuuaa

SEQ ID NO: 123000 - RNA, 19 nt, Homo sapiens
gaaugaagaagcaguacga

SEQ ID NO: 123001 - RNA, 19 nt, Homo sapiens
auaagacugucauguaaga

SEQ ID NO: 123002 - RNA, 19 nt, Homo sapiens
ccuguaaucccaacacuuu

SEQ ID NO: 123003 - RNA, 19 nt, Homo sapiens
ccuaggcaacuauuaauaa

SEQ ID NO: 123004 - RNA, 19 nt, Homo sapiens
ggaaagcuggugucucuca

SEQ ID NO: 123005 - RNA, 19 nt, Homo sapiens
ggcaaacaauacaaggaaa

SEQ ID NO: 123006 - RNA, 19 nt, Homo sapiens
ccuaugacauuucuacauc

SEQ ID NO: 123007 - RNA, 19 nt, Homo sapiens
aaacguauuucacuaacuc

SEQ ID NO: 123008 - RNA, 19 nt, Homo sapiens
gaccagggccuuuauuugg

SEQ ID NO: 123009 - RNA, 19 nt, Homo sapiens
caacuuugauggaagaaaa

SEQ ID NO: 123010 - RNA, 19 nt, Homo sapiens
gcagagaagauguccugaa

SEQ ID NO: 123011 - RNA, 19 nt, Homo sapiens
ggaaaagaaugaagaagca

SEQ ID NO: 123012 - RNA, 19 nt, Homo sapiens
gcugaaggcauuugaggaa

SEQ ID NO: 123013 - RNA, 19 nt, Homo sapiens
cauggguucuuagucuuua

SEQ ID NO: 123014 - RNA, 19 nt, Homo sapiens
gaaaccccaucucuacuaa

SEQ ID NO: 123015 - RNA, 19 nt, Homo sapiens
gaaagaggccuucaaguug

SEQ ID NO: 123016 - RNA, 19 nt, Homo sapiens
ccucagcucuguccuguua

SEQ ID NO: 123017 - RNA, 19 nt, Homo sapiens
gaacaacgagcacagaauu

SEQ ID NO: 123018 - RNA, 19 nt, Homo sapiens
cgcaguaccuggccacuua

SEQ ID NO: 123019 - RNA, 19 nt, Homo sapiens
guucauaacuguccucaac

SEQ ID NO: 123020 - RNA, 19 nt, Homo sapiens
cagcaugggcagagaaaua

SEQ ID NO: 123021 - RNA, 19 nt, Homo sapiens
gcagaaaccggauaugaag

SEQ ID NO: 123022 - RNA, 19 nt, Homo sapiens
cauacuggauccugaagaa

SEQ ID NO: 123023 - RNA, 19 nt, Homo sapiens
aaagaggccuucaaguugu

SEQ ID NO: 123024 - RNA, 19 nt, Homo sapiens
gcacagaauugcgcaguac

SEQ ID NO: 123025 - RNA, 19 nt, Homo sapiens
caauacagccugaauaaac

SEQ ID NO: 123026 - RNA, 19 nt, Homo sapiens
ggacaucuuugcccacaac

SEQ ID NO: 123027 - RNA, 19 nt, Homo sapiens
ucauaacuguccucaacaa

SEQ ID NO: 123028 - RNA, 19 nt, Homo sapiens
gaauaaaccaagacaagac

SEQ ID NO: 123029 - RNA, 19 nt, Homo sapiens
gugcagaaaccggauauga

SEQ ID NO: 123030 - RNA, 19 nt, Homo sapiens
gauccaggacuucaucaug

SEQ ID NO: 123031 - RNA, 19 nt, Homo sapiens
ggacgucuccgugcaggaa

SEQ ID NO: 123032 - RNA, 19 nt, Homo sapiens
ugaauaaaccaagacaaga

SEQ ID NO: 123033 - RNA, 19 nt, Homo sapiens
gggacgcguucauaacugu

SEQ ID NO: 123034 - RNA, 19 nt, Homo sapiens
gagaaauaaggucugaaga

SEQ ID NO: 123035 - RNA, 19 nt, Homo sapiens
gcagaacaacgagcacaga

SEQ ID NO: 123036 - RNA, 19 nt, Homo sapiens
gcaucaguuucugggauuu

SEQ ID NO: 123037 - RNA, 19 nt, Homo sapiens
ucacagaggaggaguuugg

SEQ ID NO: 123038 - RNA, 19 nt, Homo sapiens
cucaauacagccugaauaa

SEQ ID NO: 123039 - RNA, 19 nt, Homo sapiens
cagaggagucaguaccuuu

SEQ ID NO: 123040 - RNA, 19 nt, Homo sapiens
ucucaauacagccugaaua

SEQ ID NO: 123041 - RNA, 19 nt, Homo sapiens
ccuguggcaucaccaaguu

SEQ ID NO: 123042 - RNA, 19 nt, Homo sapiens
ggcagcggcaggcaacaua

SEQ ID NO: 123043 - RNA, 19 nt, Homo sapiens
ucaucaugcugcagaacaa

SEQ ID NO: 123044 - RNA, 19 nt, Homo sapiens
ccagaggagucaguaccuu

SEQ ID NO: 123045 - RNA, 19 nt, Homo sapiens
ucaauacagccugaauaaa

SEQ ID NO: 123046 - RNA, 19 nt, Homo sapiens
gagacccuguggcgcauca

SEQ ID NO: 123047 - RNA, 19 nt, Homo sapiens
cagccugaauaaaccaaga

SEQ ID NO: 123048 - RNA, 19 nt, Homo sapiens
ccggaaaggugugaucaag

SEQ ID NO: 123049 - RNA, 19 nt, Homo sapiens
agaaauaaggucugaagag

SEQ ID NO: 123050 - RNA, 19 nt, Homo sapiens
cauccucccaaucucaaua

SEQ ID NO: 123051 - RNA, 19 nt, Homo sapiens
agcaauaccuguggcauca

SEQ ID NO: 123052 - RNA, 19 nt, Homo sapiens
cagaacaacgagcacagaa

SEQ ID NO: 123053 - RNA, 19 nt, Homo sapiens
ggauaugggcagagacagu

SEQ ID NO: 123054 - RNA, 19 nt, Homo sapiens
ccaagaaguaccagaaggu

SEQ ID NO: 123055 - RNA, 19 nt, Homo sapiens
cgcaucaguuucugggauu

SEQ ID NO: 123056 - RNA, 19 nt, Homo sapiens
ggaguuuggccagcucuau

SEQ ID NO: 123057 - RNA, 19 nt, Homo sapiens
ugcagaaaccggauaugaa

SEQ ID NO: 123058 - RNA, 19 nt, Homo sapiens
aagaggccuucaaguuguu

SEQ ID NO: 123059 - RNA, 19 nt, Homo sapiens
ggcgccaucucacccauca

SEQ ID NO: 123060 - RNA, 19 nt, Homo sapiens
ggagagaagggcuauuucc

SEQ ID NO: 123061 - RNA, 19 nt, Homo sapiens
gaguuuggccagcucuaug

SEQ ID NO: 123062 - RNA, 19 nt, Homo sapiens
cugaauaaaccaagacaag

SEQ ID NO: 123063 - RNA, 19 nt, Homo sapiens
gggagagaagggcuauuuc

SEQ ID NO: 123064 - RNA, 19 nt, Homo sapiens
gggugacuccauucaguga

SEQ ID NO: 123065 - RNA, 19 nt, Homo sapiens
agagaaauaaggucugaag

SEQ ID NO: 123066 - RNA, 19 nt, Homo sapiens
ccgugaccaucaacaugaa

SEQ ID NO: 123067 - RNA, 19 nt, Homo sapiens
gcaguaccuggccacuuau

SEQ ID NO: 123068 - RNA, 19 nt, Homo sapiens
gaggagucaguaccuuuca

SEQ ID NO: 123069 - RNA, 19 nt, Homo sapiens
gaggagcacuguacauuug

SEQ ID NO: 123070 - RNA, 19 nt, Homo sapiens
cagaaagacuggcuaacua

SEQ ID NO: 123071 - RNA, 19 nt, Homo sapiens
gcagaaaucuacgcaaaug

SEQ ID NO: 123072 - RNA, 19 nt, Homo sapiens
gcagaggacuugauauuuu

SEQ ID NO: 123073 - RNA, 19 nt, Homo sapiens
agacuuaucaccauucuua

SEQ ID NO: 123074 - RNA, 19 nt, Homo sapiens
ggaauaauggcaacagaaa

SEQ ID NO: 123075 - RNA, 19 nt, Homo sapiens
gacaugcaaugaauucaaa

SEQ ID NO: 123076 - RNA, 19 nt, Homo sapiens
caucagcuguggaauaaug

SEQ ID NO: 123077 - RNA, 19 nt, Homo sapiens
ccaggagugugacaaguuu

SEQ ID NO: 123078 - RNA, 19 nt, Homo sapiens
ggagggaguuggcaguuuc

SEQ ID NO: 123079 - RNA, 19 nt, Homo sapiens
gcaacugugggcaauaaua

SEQ ID NO: 123080 - RNA, 19 nt, Homo sapiens
gauacaaccuugccaucga

SEQ ID NO: 123081 - RNA, 19 nt, Homo sapiens
ucaaaucgcccaagugaug

SEQ ID NO: 123082 - RNA, 19 nt, Homo sapiens
ggaucaacaucaagaggaa

SEQ ID NO: 123083 - RNA, 19 nt, Homo sapiens
uuuaagaggugaaagaguu

SEQ ID NO: 123084 - RNA, 19 nt, Homo sapiens
caacagaaagacuggcuaa

SEQ ID NO: 123085 - RNA, 19 nt, Homo sapiens
caggacaccacauauauaa

SEQ ID NO: 123086 - RNA, 19 nt, Homo sapiens
ggaguuggcaguuucaaau

SEQ ID NO: 123087 - RNA, 19 nt, Homo sapiens
gugaagaagugaccugcaa

SEQ ID NO: 123088 - RNA, 19 nt, Homo sapiens
cccaucagcuguggaauaa

SEQ ID NO: 123089 - RNA, 19 nt, Homo sapiens
cagcagaggacuugauauu

SEQ ID NO: 123090 - RNA, 19 nt, Homo sapiens
uggcagaaaucuacgcaaa

SEQ ID NO: 123091 - RNA, 19 nt, Homo sapiens
gcauggcucugccucacaa

SEQ ID NO: 123092 - RNA, 19 nt, Homo sapiens
uagaagcgcaguuuaagaa

SEQ ID NO: 123093 - RNA, 19 nt, Homo sapiens
ccaaggaccaggaguguga

SEQ ID NO: 123094 - RNA, 19 nt, Homo sapiens
ggacaugcaaugaauucaa

SEQ ID NO: 123095 - RNA, 19 nt, Homo sapiens
ugacaaguuuaaccaaugu

SEQ ID NO: 123096 - RNA, 19 nt, Homo sapiens
gacgagaccugcaacaacu

SEQ ID NO: 123097 - RNA, 19 nt, Homo sapiens
caacugugggcaauaauau

SEQ ID NO: 123098 - RNA, 19 nt, Homo sapiens
ccaggacaccacauauaua

SEQ ID NO: 123099 - RNA, 19 nt, Homo sapiens
gcauuuaagaggugaaaga

SEQ ID NO: 123100 - RNA, 19 nt, Homo sapiens
gaacugggguggcuaucaa

SEQ ID NO: 123101 - RNA, 19 nt, Homo sapiens
cagcggaucugcccaagag

SEQ ID NO: 123102 - RNA, 19 nt, Homo sapiens
gugacaaguuuaaccaaug

SEQ ID NO: 123103 - RNA, 19 nt, Homo sapiens
guucagacuuaucaccauu

SEQ ID NO: 123104 - RNA, 19 nt, Homo sapiens
ggacaccacauauauaaac

SEQ ID NO: 123105 - RNA, 19 nt, Homo sapiens
gagaagaugauggcagaaa

SEQ ID NO: 123106 - RNA, 19 nt, Homo sapiens
gggagggaguuggcaguuu

SEQ ID NO: 123107 - RNA, 19 nt, Homo sapiens
gaugauggcagaaaucuac

SEQ ID NO: 123108 - RNA, 19 nt, Homo sapiens
uggcaacugugggcaauaa

SEQ ID NO: 123109 - RNA, 19 nt, Homo sapiens
gaagaugauggcagaaauc

SEQ ID NO: 123110 - RNA, 19 nt, Homo sapiens
ucgcccaagugaugaauaa

SEQ ID NO: 123111 - RNA, 19 nt, Homo sapiens
gggcaauaauauggcauuu

SEQ ID NO: 123112 - RNA, 19 nt, Homo sapiens
gaagcgcaguuuaagaaaa

SEQ ID NO: 123113 - RNA, 19 nt, Homo sapiens
gaagaagugaccugcaaca

SEQ ID NO: 123114 - RNA, 19 nt, Homo sapiens
ccauucuuaugucacuuua

SEQ ID NO: 123115 - RNA, 19 nt, Homo sapiens
ggcaauaauauggcauuua

SEQ ID NO: 123116 - RNA, 19 nt, Homo sapiens
ucacuagaagcgcaguuua

SEQ ID NO: 123117 - RNA, 19 nt, Homo sapiens
cgaggagcacuguacauuu

SEQ ID NO: 123118 - RNA, 19 nt, Homo sapiens
agaagaugauggcagaaau

SEQ ID NO: 123119 - RNA, 19 nt, Homo sapiens
gaccagcaccuauaaggau

SEQ ID NO: 123120 - RNA, 19 nt, Homo sapiens
guacuggauuguccggaau

SEQ ID NO: 123121 - RNA, 19 nt, Homo sapiens
gaaagacuggcuaacuaca

SEQ ID NO: 123122 - RNA, 19 nt, Homo sapiens
gaaagaguucagacuuauc

SEQ ID NO: 123123 - RNA, 19 nt, Homo sapiens
gaaacgaugggaccucagu

SEQ ID NO: 123124 - RNA, 19 nt, Homo sapiens
uaccaggacaccacauaua

SEQ ID NO: 123125 - RNA, 19 nt, Homo sapiens
aauaauggcaacagaaaga

SEQ ID NO: 123126 - RNA, 19 nt, Homo sapiens
gaugggaccucagucuucu

SEQ ID NO: 123127 - RNA, 19 nt, Homo sapiens
caauguggauggugucaac

SEQ ID NO: 123128 - RNA, 19 nt, Homo sapiens
gaucgugaccagcaccuau

SEQ ID NO: 123129 - RNA, 19 nt, Homo sapiens
gggacugaguacuggauug

SEQ ID NO: 123130 - RNA, 19 nt, Homo sapiens
ccaagugaugaauaaagua

SEQ ID NO: 123131 - RNA, 19 nt, Homo sapiens
uaucaccauucuuauguca

SEQ ID NO: 123132 - RNA, 19 nt, Homo sapiens
aaagaguucagacuuauca

SEQ ID NO: 123133 - RNA, 19 nt, Homo sapiens
gguacuggcugcgaguguu

SEQ ID NO: 123134 - RNA, 19 nt, Homo sapiens
gggauccuaugguuaugug

SEQ ID NO: 123135 - RNA, 19 nt, Homo sapiens
cccaagugaugaauaaagu

SEQ ID NO: 123136 - RNA, 19 nt, Homo sapiens
uuaaggccaugucacuaga

SEQ ID NO: 123137 - RNA, 19 nt, Homo sapiens
ggacugaguacuggauugu

SEQ ID NO: 123138 - RNA, 19 nt, Homo sapiens
ggaccucagucuucuucag

SEQ ID NO: 123139 - RNA, 19 nt, Homo sapiens
guggaauaauggcaacaga

SEQ ID NO: 123140 - RNA, 19 nt, Homo sapiens
uuucaaaucgcccaaguga

SEQ ID NO: 123141 - RNA, 19 nt, Homo sapiens
cacuagaagcgcaguuuaa

SEQ ID NO: 123142 - RNA, 19 nt, Homo sapiens
gaauaauggcaacagaaag

SEQ ID NO: 123143 - RNA, 19 nt, Homo sapiens
ugugggacaugcaaugaau

SEQ ID NO: 123144 - RNA, 19 nt, Homo sapiens
cgaguguuccugagaguug

SEQ ID NO: 123145 - RNA, 19 nt, Homo sapiens
gaccaggagugugacaagu

SEQ ID NO: 123146 - RNA, 19 nt, Homo sapiens
caaaucgcccaagugauga

SEQ ID NO: 123147 - RNA, 19 nt, Homo sapiens
ugugacaaguuuaaccaau

SEQ ID NO: 123148 - RNA, 19 nt, Homo sapiens
cagaggacuugauauuuug

SEQ ID NO: 123149 - RNA, 19 nt, Homo sapiens
gaguguuccugagaguuga

SEQ ID NO: 123150 - RNA, 19 nt, Homo sapiens
ugcaaugaauucaaagagu

SEQ ID NO: 123151 - RNA, 19 nt, Homo sapiens
gggaguuggcaguuucaaa

SEQ ID NO: 123152 - RNA, 19 nt, Homo sapiens
agaagugaccugcaacaca

SEQ ID NO: 123153 - RNA, 19 nt, Homo sapiens
ggaccaggagugugacaag

SEQ ID NO: 123154 - RNA, 19 nt, Homo sapiens
ucccaucagcuguggaaua

SEQ ID NO: 123155 - RNA, 19 nt, Homo sapiens
uguggauggugucaacuau

SEQ ID NO: 123156 - RNA, 19 nt, Homo sapiens
ggaugacuuaugacacuug

SEQ ID NO: 123157 - RNA, 19 nt, Homo sapiens
gggaugacuuaugacacuu

SEQ ID NO: 123158 - RNA, 19 nt, Homo sapiens
ugggaugacuuaugacacu

SEQ ID NO: 123159 - RNA, 19 nt, Homo sapiens
cuagaagcgcaguuuaaga

SEQ ID NO: 123160 - RNA, 19 nt, Homo sapiens
caccacauauauaaaccau

SEQ ID NO: 123161 - RNA, 19 nt, Homo sapiens
ggacuggcgcaauguggau

SEQ ID NO: 123162 - RNA, 19 nt, Homo sapiens
ucaccauucuuaugucacu

SEQ ID NO: 123163 - RNA, 19 nt, Homo sapiens
ggguggcuaucaauauugg

SEQ ID NO: 123164 - RNA, 19 nt, Homo sapiens
ucgaggagcacuguacauu

SEQ ID NO: 123165 - RNA, 19 nt, Homo sapiens
ggauuguccggaauucaug

SEQ ID NO: 123166 - RNA, 19 nt, Homo sapiens
guaacgcuggcuccuguga

SEQ ID NO: 123167 - RNA, 19 nt, Homo sapiens
cgaugggaccucagucuuc

SEQ ID NO: 123168 - RNA, 19 nt, Homo sapiens
acaacuaccaggccaagga

SEQ ID NO: 123169 - RNA, 19 nt, Homo sapiens
gaacagaaguuacagaaug

SEQ ID NO: 123170 - RNA, 19 nt, Homo sapiens
ggaauuugcugaagugaaa

SEQ ID NO: 123171 - RNA, 19 nt, Homo sapiens
gggaaacucuggaagaaua

SEQ ID NO: 123172 - RNA, 19 nt, Homo sapiens
gaaccaagccgaaaccaua

SEQ ID NO: 123173 - RNA, 19 nt, Homo sapiens
gaagaacacuccagaggau

SEQ ID NO: 123174 - RNA, 19 nt, Homo sapiens
gaucgauguuucaauauug

SEQ ID NO: 123175 - RNA, 19 nt, Homo sapiens
gaagaaagagcugaacauu

SEQ ID NO: 123176 - RNA, 19 nt, Homo sapiens
caaauacgaugaagaaacu

SEQ ID NO: 123177 - RNA, 19 nt, Homo sapiens
gcagagauaugaggcuuga

SEQ ID NO: 123178 - RNA, 19 nt, Homo sapiens
ggaucgauguuucaauauu

SEQ ID NO: 123179 - RNA, 19 nt, Homo sapiens
ggaggaagcugagcauaag

SEQ ID NO: 123180 - RNA, 19 nt, Homo sapiens
acagagaaccagaaacuua

SEQ ID NO: 123181 - RNA, 19 nt, Homo sapiens
cagaaugacuuugcagaaa

SEQ ID NO: 123182 - RNA, 19 nt, Homo sapiens
gauuucugcuuucuucuuu

SEQ ID NO: 123183 - RNA, 19 nt, Homo sapiens
ugggaucgauguuucaaua

SEQ ID NO: 123184 - RNA, 19 nt, Homo sapiens
caaggaauuugcugaagug

SEQ ID NO: 123185 - RNA, 19 nt, Homo sapiens
ggaagaauacaacaaggaa

SEQ ID NO: 123186 - RNA, 19 nt, Homo sapiens
ggaaguaccugagcuugag

SEQ ID NO: 123187 - RNA, 19 nt, Homo sapiens
ccauagcucuugagaagga

SEQ ID NO: 123188 - RNA, 19 nt, Homo sapiens
ugaagaaacuacugcaaag

SEQ ID NO: 123189 - RNA, 19 nt, Homo sapiens
aaagugagcaguccagaaa

SEQ ID NO: 123190 - RNA, 19 nt, Homo sapiens
augaagaggugaagaaaga

SEQ ID NO: 123191 - RNA, 19 nt, Homo sapiens
ucaaacaacuggaagaaaa

SEQ ID NO: 123192 - RNA, 19 nt, Homo sapiens
aaccauagcucuugagaag

SEQ ID NO: 123193 - RNA, 19 nt, Homo sapiens
gaauaugaacagacacuga

SEQ ID NO: 123194 - RNA, 19 nt, Homo sapiens
gcugaagaguuuccaagga

SEQ ID NO: 123195 - RNA, 19 nt, Homo sapiens
gaucaugacggaccuugaa

SEQ ID NO: 123196 - RNA, 19 nt, Homo sapiens
caacaaggaauuugcugaa

SEQ ID NO: 123197 - RNA, 19 nt, Homo sapiens
ucaaguuccugcagagcua

SEQ ID NO: 123198 - RNA, 19 nt, Homo sapiens
gagagaggcggagaccuua

SEQ ID NO: 123199 - RNA, 19 nt, Homo sapiens
cauggaaacugcccuuauc

SEQ ID NO: 123200 - RNA, 19 nt, Homo sapiens
gaaagugagcaguccagaa

SEQ ID NO: 123201 - RNA, 19 nt, Homo sapiens
ucaccaagcugcgggagaa

SEQ ID NO: 123202 - RNA, 19 nt, Homo sapiens
gagauugaaaugaucauga

SEQ ID NO: 123203 - RNA, 19 nt, Homo sapiens
gccgggaguucaagaagaa

SEQ ID NO: 123204 - RNA, 19 nt, Homo sapiens
aaacagcacacucaaacaa

SEQ ID NO: 123205 - RNA, 19 nt, Homo sapiens
uagggaaacucuggaagaa

SEQ ID NO: 123206 - RNA, 19 nt, Homo sapiens
gaacgucuccuagccaauc

SEQ ID NO: 123207 - RNA, 19 nt, Homo sapiens
gcacaaguuccacgagaau

SEQ ID NO: 123208 - RNA, 19 nt, Homo sapiens
ccagguggauucacugcuu

SEQ ID NO: 123209 - RNA, 19 nt, Homo sapiens
gagcugaacauucugaagu

SEQ ID NO: 123210 - RNA, 19 nt, Homo sapiens
ggaagcgcuuugauuuaca

SEQ ID NO: 123211 - RNA, 19 nt, Homo sapiens
aacagaaguuacagaauga

SEQ ID NO: 123212 - RNA, 19 nt, Homo sapiens
ugagaaggaacagaaguua

SEQ ID NO: 123213 - RNA, 19 nt, Homo sapiens
gaaaccauagcucuugaga

SEQ ID NO: 123214 - RNA, 19 nt, Homo sapiens
aucaagagguuacgauaaa

SEQ ID NO: 123215 - RNA, 19 nt, Homo sapiens
gacagcaacuccagcucaa

SEQ ID NO: 123216 - RNA, 19 nt, Homo sapiens
gcggaacaguuucuauuac

SEQ ID NO: 123217 - RNA, 19 nt, Homo sapiens
caagauauucugguuucua

SEQ ID NO: 123218 - RNA, 19 nt, Homo sapiens
ucccagagcccaucaaaga

SEQ ID NO: 123219 - RNA, 19 nt, Homo sapiens
guucagagccuacaaacag

SEQ ID NO: 123220 - RNA, 19 nt, Homo sapiens
cgacgagauugaaaugauc

SEQ ID NO: 123221 - RNA, 19 nt, Homo sapiens
ccgagaauaugaacagaca

SEQ ID NO: 123222 - RNA, 19 nt, Homo sapiens
gaauacaacaaggaauuug

SEQ ID NO: 123223 - RNA, 19 nt, Homo sapiens
aaacagagaaccagaaacu

SEQ ID NO: 123224 - RNA, 19 nt, Homo sapiens
gcagcuuucuugaaugucu

SEQ ID NO: 123225 - RNA, 19 nt, Homo sapiens
gcuccagccuagaaguuga

SEQ ID NO: 123226 - RNA, 19 nt, Homo sapiens
ugaaacagagaaccagaaa

SEQ ID NO: 123227 - RNA, 19 nt, Homo sapiens
cagcggaacaguuucuauu

SEQ ID NO: 123228 - RNA, 19 nt, Homo sapiens
ucaaaggccaggcugacua

SEQ ID NO: 123229 - RNA, 19 nt, Homo sapiens
cucaauaugucucaagaug

SEQ ID NO: 123230 - RNA, 19 nt, Homo sapiens
caaaggccgacgagauuga

SEQ ID NO: 123231 - RNA, 19 nt, Homo sapiens
gcaaaggccgacgagauug

SEQ ID NO: 123232 - RNA, 19 nt, Homo sapiens
gauaaaagcacuuaaagag

SEQ ID NO: 123233 - RNA, 19 nt, Homo sapiens
acaaggaauuugcugaagu

SEQ ID NO: 123234 - RNA, 19 nt, Homo sapiens
gaacacuccagaggauuug

SEQ ID NO: 123235 - RNA, 19 nt, Homo sapiens
gauauucugguuucuagau

SEQ ID NO: 123236 - RNA, 19 nt, Homo sapiens
ccgacgagauugaaaugau

SEQ ID NO: 123237 - RNA, 19 nt, Homo sapiens
gaagaauacaacaaggaau

SEQ ID NO: 123238 - RNA, 19 nt, Homo sapiens
gagauugaugcacugagua

SEQ ID NO: 123239 - RNA, 19 nt, Homo sapiens
aagauauucugguuucuag

SEQ ID NO: 123240 - RNA, 19 nt, Homo sapiens
uuagcaagauauucugguu

SEQ ID NO: 123241 - RNA, 19 nt, Homo sapiens
ccagccagcggaacaguuu

SEQ ID NO: 123242 - RNA, 19 nt, Homo sapiens
gagcaccgccuggagaaga

SEQ ID NO: 123243 - RNA, 19 nt, Homo sapiens
aaccaaauacgaugaagaa

SEQ ID NO: 123244 - RNA, 19 nt, Homo sapiens
gaaagcugcaggagacaca

SEQ ID NO: 123245 - RNA, 19 nt, Homo sapiens
gaaaauccgagaauaugaa

SEQ ID NO: 123246 - RNA, 19 nt, Homo sapiens
gaagcgcuuugauuuacag

SEQ ID NO: 123247 - RNA, 19 nt, Homo sapiens
gaucccagagcccaucaaa

SEQ ID NO: 123248 - RNA, 19 nt, Homo sapiens
caaaggccaggcugacuau

SEQ ID NO: 123249 - RNA, 19 nt, Homo sapiens
cuacaaacagcccuggaaa

SEQ ID NO: 123250 - RNA, 19 nt, Homo sapiens
ccgaaaccauagcucuuga

SEQ ID NO: 123251 - RNA, 19 nt, Homo sapiens
uggaagcgcuuugauuuac

SEQ ID NO: 123252 - RNA, 19 nt, Homo sapiens
aaucaagagguuacgauaa

SEQ ID NO: 123253 - RNA, 19 nt, Homo sapiens
ugugauuucugcuuucuuc

SEQ ID NO: 123254 - RNA, 19 nt, Homo sapiens
acacggagcugcgguacuc

SEQ ID NO: 123255 - RNA, 19 nt, Homo sapiens
cagguggauucacugcuuu

SEQ ID NO: 123256 - RNA, 19 nt, Homo sapiens
agaggccacugcccuauuc

SEQ ID NO: 123257 - RNA, 19 nt, Homo sapiens
gagcugcaaguccguauca

SEQ ID NO: 123258 - RNA, 19 nt, Homo sapiens
cagaauuauuugaccugaa

SEQ ID NO: 123259 - RNA, 19 nt, Homo sapiens
uggaggaagcugagcauaa

SEQ ID NO: 123260 - RNA, 19 nt, Homo sapiens
ggaacagaaguuacagaau

SEQ ID NO: 123261 - RNA, 19 nt, Homo sapiens
cccaugugauuucugcuuu

SEQ ID NO: 123262 - RNA, 19 nt, Homo sapiens
gacaacaucaagcucuuug

SEQ ID NO: 123263 - RNA, 19 nt, Homo sapiens
uaagggaacagcucucauc

SEQ ID NO: 123264 - RNA, 19 nt, Homo sapiens
ccaaauacgaugaagaaac

SEQ ID NO: 123265 - RNA, 19 nt, Homo sapiens
aaaucaagagguuacgaua

SEQ ID NO: 123266 - RNA, 19 nt, Homo sapiens
gaaccggcaggaugaaagu

SEQ ID NO: 123267 - RNA, 19 nt, Homo sapiens
gauuccagcugcgguuaau

SEQ ID NO: 123268 - RNA, 19 nt, Homo sapiens
cagccuagaaguugaguug

SEQ ID NO: 123269 - RNA, 19 nt, Homo sapiens
gcugaggccuguuauauug

SEQ ID NO: 123270 - RNA, 19 nt, Homo sapiens
gcaagaagcccaagagugu

SEQ ID NO: 123271 - RNA, 19 nt, Homo sapiens
ccagggaagugcucugaua

SEQ ID NO: 123272 - RNA, 19 nt, Homo sapiens
ccacaucaauauugucauu

SEQ ID NO: 123273 - RNA, 19 nt, Homo sapiens
gggagaaguucagaagaua

SEQ ID NO: 123274 - RNA, 19 nt, Homo sapiens
gaaauuuguugguaguguu

SEQ ID NO: 123275 - RNA, 19 nt, Homo sapiens
caagaaagccaaagccauu

SEQ ID NO: 123276 - RNA, 19 nt, Homo sapiens
gcaaaugucaucagaacuu

SEQ ID NO: 123277 - RNA, 19 nt, Homo sapiens
caaaggagcaggcauggaa

SEQ ID NO: 123278 - RNA, 19 nt, Homo sapiens
gaaaauaccccaucauuca

SEQ ID NO: 123279 - RNA, 19 nt, Homo sapiens
gggaagggauauauaagau

SEQ ID NO: 123280 - RNA, 19 nt, Homo sapiens
ggaaggugcuguuauccau

SEQ ID NO: 123281 - RNA, 19 nt, Homo sapiens
uaagcucuaugacuucuuu

SEQ ID NO: 123282 - RNA, 19 nt, Homo sapiens
guacuauucugauuacaca

SEQ ID NO: 123283 - RNA, 19 nt, Homo sapiens
caaaugucaucagaacuuu

SEQ ID NO: 123284 - RNA, 19 nt, Homo sapiens
gaguugcaaucguaaugua

SEQ ID NO: 123285 - RNA, 19 nt, Homo sapiens
guuuagaguugcaaucgua

SEQ ID NO: 123286 - RNA, 19 nt, Homo sapiens
gagcaggcauggaaguguu

SEQ ID NO: 123287 - RNA, 19 nt, Homo sapiens
aaauagugcucgcuuucua

SEQ ID NO: 123288 - RNA, 19 nt, Homo sapiens
uaaaugaggguggugaaua

SEQ ID NO: 123289 - RNA, 19 nt, Homo sapiens
gcaauguggaaacaaauuu

SEQ ID NO: 123290 - RNA, 19 nt, Homo sapiens
ggagaagcagaaauacaua

SEQ ID NO: 123291 - RNA, 19 nt, Homo sapiens
aaaugaggguggugaauau

SEQ ID NO: 123292 - RNA, 19 nt, Homo sapiens
ugacaaagaguagacauuu

SEQ ID NO: 123293 - RNA, 19 nt, Homo sapiens
gaagucagaugugguaacu

SEQ ID NO: 123294 - RNA, 19 nt, Homo sapiens
ggaaauuuguugguagugu

SEQ ID NO: 123295 - RNA, 19 nt, Homo sapiens
ggacaaaucaagcuucagu

SEQ ID NO: 123296 - RNA, 19 nt, Homo sapiens
aaacaaaugccacacauca

SEQ ID NO: 123297 - RNA, 19 nt, Homo sapiens
gaaaagggccuccacaaug

SEQ ID NO: 123298 - RNA, 19 nt, Homo sapiens
ggugggaaauuuguuggua

SEQ ID NO: 123299 - RNA, 19 nt, Homo sapiens
ugccauuacucaauugaua

SEQ ID NO: 123300 - RNA, 19 nt, Homo sapiens
caaucuaaccacaucaaua

SEQ ID NO: 123301 - RNA, 19 nt, Homo sapiens
gacaaagaguagacauuuc

SEQ ID NO: 123302 - RNA, 19 nt, Homo sapiens
ccaaagccauuaaacugau

SEQ ID NO: 123303 - RNA, 19 nt, Homo sapiens
gaaagccaaagccauuaaa

SEQ ID NO: 123304 - RNA, 19 nt, Homo sapiens
gagaauaagucauguuccu

SEQ ID NO: 123305 - RNA, 19 nt, Homo sapiens
ucucacauguuuagaguug

SEQ ID NO: 123306 - RNA, 19 nt, Homo sapiens
ggacugacacccauguuuc

SEQ ID NO: 123307 - RNA, 19 nt, Homo sapiens
acauagagaucauccuuuc

SEQ ID NO: 123308 - RNA, 19 nt, Homo sapiens
ucauggagaagcagaaaua

SEQ ID NO: 123309 - RNA, 19 nt, Homo sapiens
ugucugaucugcuguuugu

SEQ ID NO: 123310 - RNA, 19 nt, Homo sapiens
ccaauuuacuugccauuac

SEQ ID NO: 123311 - RNA, 19 nt, Homo sapiens
gccugucucuuccauauga

SEQ ID NO: 123312 - RNA, 19 nt, Homo sapiens
cagccugucucuuccauau

SEQ ID NO: 123313 - RNA, 19 nt, Homo sapiens
ucaaaugcuuggcuucuca

SEQ ID NO: 123314 - RNA, 19 nt, Homo sapiens
guagacauuucucuuacug

SEQ ID NO: 123315 - RNA, 19 nt, Homo sapiens
gaguagacauuucucuuac

SEQ ID NO: 123316 - RNA, 19 nt, Homo sapiens
gaaguguucugagcagcaa

SEQ ID NO: 123317 - RNA, 19 nt, Homo sapiens
gaucauguaccccaauuua

SEQ ID NO: 123318 - RNA, 19 nt, Homo sapiens
gagagaauaagucauguuc

SEQ ID NO: 123319 - RNA, 19 nt, Homo sapiens
uaacguuagaccacaaaua

SEQ ID NO: 123320 - RNA, 19 nt, Homo sapiens
gcucugauaggccaaguuu

SEQ ID NO: 123321 - RNA, 19 nt, Homo sapiens
ugacugagacgguugcauu

SEQ ID NO: 123322 - RNA, 19 nt, Homo sapiens
ggacucacuauuugauaaa

SEQ ID NO: 123323 - RNA, 19 nt, Homo sapiens
ccucuuagacuucugcuuu

SEQ ID NO: 123324 - RNA, 19 nt, Homo sapiens
gaacuagccaccaacucuu

SEQ ID NO: 123325 - RNA, 19 nt, Homo sapiens
uggagacgcuuaagcucua

SEQ ID NO: 123326 - RNA, 19 nt, Homo sapiens
cuagaaacguuuggaacaa

SEQ ID NO: 123327 - RNA, 19 nt, Homo sapiens
ccaagucuacagagugaua

SEQ ID NO: 123328 - RNA, 19 nt, Homo sapiens
ggaacuagccaccaacucu

SEQ ID NO: 123329 - RNA, 19 nt, Homo sapiens
guagaagagggauaaggua

SEQ ID NO: 123330 - RNA, 19 nt, Homo sapiens
gcaagaaccacaagaaagc

SEQ ID NO: 123331 - RNA, 19 nt, Homo sapiens
acaaugccaugugcaaauu

SEQ ID NO: 123332 - RNA, 19 nt, Homo sapiens
cuucuggacucacuauuug

SEQ ID NO: 123333 - RNA, 19 nt, Homo sapiens
uugcaggucucaacccuuu

SEQ ID NO: 123334 - RNA, 19 nt, Homo sapiens
acaaaucaagcuucaguuu

SEQ ID NO: 123335 - RNA, 19 nt, Homo sapiens
acauuucucuuacugcaaa

SEQ ID NO: 123336 - RNA, 19 nt, Homo sapiens
ccauuaaacugauccuucu

SEQ ID NO: 123337 - RNA, 19 nt, Homo sapiens
uaagucauguuccuucaag

SEQ ID NO: 123338 - RNA, 19 nt, Homo sapiens
gcugugcugugcccaaguu

SEQ ID NO: 123339 - RNA, 19 nt, Homo sapiens
gaugcugacuagugaggaa

SEQ ID NO: 123340 - RNA, 19 nt, Homo sapiens
gcucaguccacguugauuu

SEQ ID NO: 123341 - RNA, 19 nt, Homo sapiens
gccaaagccauuaaacuga

SEQ ID NO: 123342 - RNA, 19 nt, Homo sapiens
ucacaaagcagaaagaaaa

SEQ ID NO: 123343 - RNA, 19 nt, Homo sapiens
uggacucacuauuugauaa

SEQ ID NO: 123344 - RNA, 19 nt, Homo sapiens
caaaucaagcuucaguuuc

SEQ ID NO: 123345 - RNA, 19 nt, Homo sapiens
uccaguagcuugggacaaa

SEQ ID NO: 123346 - RNA, 19 nt, Homo sapiens
cuacagagaaccuggaguu

SEQ ID NO: 123347 - RNA, 19 nt, Homo sapiens
ccauuggccuggugggaaa

SEQ ID NO: 123348 - RNA, 19 nt, Homo sapiens
agucagaugugguaacugu

SEQ ID NO: 123349 - RNA, 19 nt, Homo sapiens
cauccaaucuaaccacauc

SEQ ID NO: 123350 - RNA, 19 nt, Homo sapiens
ccaguaagggaaauagaaa

SEQ ID NO: 123351 - RNA, 19 nt, Homo sapiens
gguggguacuauucugauu

SEQ ID NO: 123352 - RNA, 19 nt, Homo sapiens
gagaagcagaaauacauau

SEQ ID NO: 123353 - RNA, 19 nt, Homo sapiens
guucugagcagcaauuuua

SEQ ID NO: 123354 - RNA, 19 nt, Homo sapiens
ugaauccucucaucuaugc

SEQ ID NO: 123355 - RNA, 19 nt, Homo sapiens
ccugaauccucucaucuau

SEQ ID NO: 123356 - RNA, 19 nt, Homo sapiens
cacaaauagugcucgcuuu

SEQ ID NO: 123357 - RNA, 19 nt, Homo sapiens
gcauagcccagacacagaa

SEQ ID NO: 123358 - RNA, 19 nt, Homo sapiens
agaguguuguugagaauug

SEQ ID NO: 123359 - RNA, 19 nt, Homo sapiens
ccuagaguguuguugagaa

SEQ ID NO: 123360 - RNA, 19 nt, Homo sapiens
uuacuuaccacacgaguga

SEQ ID NO: 123361 - RNA, 19 nt, Homo sapiens
ccacacgagugauggagau

SEQ ID NO: 123362 - RNA, 19 nt, Homo sapiens
acuguuaaauugcugugua

SEQ ID NO: 123363 - RNA, 19 nt, Homo sapiens
agugcucgcuuucuaugua

SEQ ID NO: 123364 - RNA, 19 nt, Homo sapiens
cuaaccacaucaauauugu

SEQ ID NO: 123365 - RNA, 19 nt, Homo sapiens
uaagcccucuuccaucaug

SEQ ID NO: 123366 - RNA, 19 nt, Homo sapiens
ggaagggauauauaagaug

SEQ ID NO: 123367 - RNA, 19 nt, Homo sapiens
uggacacccuacaacguua

SEQ ID NO: 123368 - RNA, 19 nt, Homo sapiens
ugaaugagagaauaaguca

SEQ ID NO: 123369 - RNA, 19 nt, Homo sapiens
gaacuuacuugcauaccaa

SEQ ID NO: 123370 - RNA, 19 nt, Homo sapiens
gaucaaggauguaguaucu

SEQ ID NO: 123371 - RNA, 19 nt, Homo sapiens
gagcaaggaugggucuaua

SEQ ID NO: 123372 - RNA, 19 nt, Homo sapiens
ugauggaucugaagaaauu

SEQ ID NO: 123373 - RNA, 19 nt, Homo sapiens
cuacagugguuuagaaauu

SEQ ID NO: 123374 - RNA, 19 nt, Homo sapiens
gaagcuacaucggcaguaa

SEQ ID NO: 123375 - RNA, 19 nt, Homo sapiens
uggaugguguuacauauua

SEQ ID NO: 123376 - RNA, 19 nt, Homo sapiens
cuagaaacauguaauccua

SEQ ID NO: 123377 - RNA, 19 nt, Homo sapiens
gauguaguaucucauaguu

SEQ ID NO: 123378 - RNA, 19 nt, Homo sapiens
uaucugccgugcaaauuua

SEQ ID NO: 123379 - RNA, 19 nt, Homo sapiens
ucaaacaugucucugugua

SEQ ID NO: 123380 - RNA, 19 nt, Homo sapiens
guauagagccuccauaugu

SEQ ID NO: 123381 - RNA, 19 nt, Homo sapiens
uaaaggagcaucuaucaga

SEQ ID NO: 123382 - RNA, 19 nt, Homo sapiens
aaucauaggugaagacaug

SEQ ID NO: 123383 - RNA, 19 nt, Homo sapiens
gaagacaugggugaacuua

SEQ ID NO: 123384 - RNA, 19 nt, Homo sapiens
gaacuguacggaauauauu

SEQ ID NO: 123385 - RNA, 19 nt, Homo sapiens
gaauaaccaucugaaagug

SEQ ID NO: 123386 - RNA, 19 nt, Homo sapiens
ggacaucgaguggcugaua

SEQ ID NO: 123387 - RNA, 19 nt, Homo sapiens
gccagaaguuugaguauca

SEQ ID NO: 123388 - RNA, 19 nt, Homo sapiens
uaaguguccuccaucaauu

SEQ ID NO: 123389 - RNA, 19 nt, Homo sapiens
ggucuaaauuguguuacua

SEQ ID NO: 123390 - RNA, 19 nt, Homo sapiens
ugucagauauuggcacaua

SEQ ID NO: 123391 - RNA, 19 nt, Homo sapiens
ggaacuguacggaauauau

SEQ ID NO: 123392 - RNA, 19 nt, Homo sapiens
acagaaauauccaugacaa

SEQ ID NO: 123393 - RNA, 19 nt, Homo sapiens
ucaaggauguaguaucuca

SEQ ID NO: 123394 - RNA, 19 nt, Homo sapiens
guuacaggcacuaaaguua

SEQ ID NO: 123395 - RNA, 19 nt, Homo sapiens
ggaaguucaucacgauauc

SEQ ID NO: 123396 - RNA, 19 nt, Homo sapiens
gcucauuggucuuaucauc

SEQ ID NO: 123397 - RNA, 19 nt, Homo sapiens
uuacaacugucagauauug

SEQ ID NO: 123398 - RNA, 19 nt, Homo sapiens
gcaauagcagggauagauu

SEQ ID NO: 123399 - RNA, 19 nt, Homo sapiens
gauagacugcuacagguaa

SEQ ID NO: 123400 - RNA, 19 nt, Homo sapiens
gcaaauaagaagauucauc

SEQ ID NO: 123401 - RNA, 19 nt, Homo sapiens
caaguuaaguguccuccau

SEQ ID NO: 123402 - RNA, 19 nt, Homo sapiens
gacacuaggugcaauagca

SEQ ID NO: 123403 - RNA, 19 nt, Homo sapiens
guuugacacuuauagauug

SEQ ID NO: 123404 - RNA, 19 nt, Homo sapiens
gaucugugguggucuucaa

SEQ ID NO: 123405 - RNA, 19 nt, Homo sapiens
gcuaaaggagcaucuauca

SEQ ID NO: 123406 - RNA, 19 nt, Homo sapiens
agauguagcgcuuugaaua

SEQ ID NO: 123407 - RNA, 19 nt, Homo sapiens
aaggaugggucuauaguau

SEQ ID NO: 123408 - RNA, 19 nt, Homo sapiens
gaagaugugccaccuccaa

SEQ ID NO: 123409 - RNA, 19 nt, Homo sapiens
gaguaaugaucucaaaucu

SEQ ID NO: 123410 - RNA, 19 nt, Homo sapiens
uuacguauguuuguacuug

SEQ ID NO: 123411 - RNA, 19 nt, Homo sapiens
guacagaaauauccaugac

SEQ ID NO: 123412 - RNA, 19 nt, Homo sapiens
gaaaaccuauucuggucua

SEQ ID NO: 123413 - RNA, 19 nt, Homo sapiens
gauauuccaagacucagua

SEQ ID NO: 123414 - RNA, 19 nt, Homo sapiens
guugauggaucugaagaaa

SEQ ID NO: 123415 - RNA, 19 nt, Homo sapiens
gaucucaaaucuggugaug

SEQ ID NO: 123416 - RNA, 19 nt, Homo sapiens
ccagaucaaggauguagua

SEQ ID NO: 123417 - RNA, 19 nt, Homo sapiens
gauguagcgcuuugaauau

SEQ ID NO: 123418 - RNA, 19 nt, Homo sapiens
aaaggaaguucaucacgau

SEQ ID NO: 123419 - RNA, 19 nt, Homo sapiens
ucaaauaaagcuggacuaa

SEQ ID NO: 123420 - RNA, 19 nt, Homo sapiens
caucugguaguucuuguua

SEQ ID NO: 123421 - RNA, 19 nt, Homo sapiens
ucacuuccauuacaguaug

SEQ ID NO: 123422 - RNA, 19 nt, Homo sapiens
ucucaaaucuggugaugca

SEQ ID NO: 123423 - RNA, 19 nt, Homo sapiens
ugaauaaccaucugaaagu

SEQ ID NO: 123424 - RNA, 19 nt, Homo sapiens
gcaggagccauuauaggaa

SEQ ID NO: 123425 - RNA, 19 nt, Homo sapiens
gacuucaucuguuauaucu

SEQ ID NO: 123426 - RNA, 19 nt, Homo sapiens
acauaucagugcaaaguga

SEQ ID NO: 123427 - RNA, 19 nt, Homo sapiens
ugaaaggccgaguacauuu

SEQ ID NO: 123428 - RNA, 19 nt, Homo sapiens
caauagcagggauagauuu

SEQ ID NO: 123429 - RNA, 19 nt, Homo sapiens
caaggaugggucuauagua

SEQ ID NO: 123430 - RNA, 19 nt, Homo sapiens
aaacaugucucuguguagu

SEQ ID NO: 123431 - RNA, 19 nt, Homo sapiens
cugaagaaauuggaaguga

SEQ ID NO: 123432 - RNA, 19 nt, Homo sapiens
gaugacacuaggugcaaua

SEQ ID NO: 123433 - RNA, 19 nt, Homo sapiens
ggauuucgccagaaguuug

SEQ ID NO: 123434 - RNA, 19 nt, Homo sapiens
caucugugcucuccguguu

SEQ ID NO: 123435 - RNA, 19 nt, Homo sapiens
gacaucgaguggcugauau

SEQ ID NO: 123436 - RNA, 19 nt, Homo sapiens
guuagaacauuugcuguca

SEQ ID NO: 123437 - RNA, 19 nt, Homo sapiens
agacaugggugaacuuacu

SEQ ID NO: 123438 - RNA, 19 nt, Homo sapiens
uaucaguaccuaaguaaga

SEQ ID NO: 123439 - RNA, 19 nt, Homo sapiens
gcaaggaugggucuauagu

SEQ ID NO: 123440 - RNA, 19 nt, Homo sapiens
ucauuggucuuaucaucuu

SEQ ID NO: 123441 - RNA, 19 nt, Homo sapiens
ggaugguguuacauauuau

SEQ ID NO: 123442 - RNA, 19 nt, Homo sapiens
ggacuuagcaagcucuuuu

SEQ ID NO: 123443 - RNA, 19 nt, Homo sapiens
ccagccagaucaaggaugu

SEQ ID NO: 123444 - RNA, 19 nt, Homo sapiens
cuucaucuguuauaucugu

SEQ ID NO: 123445 - RNA, 19 nt, Homo sapiens
ccgugcaaauuuacgcuua

SEQ ID NO: 123446 - RNA, 19 nt, Homo sapiens
cugaagagaugauugaaaa

SEQ ID NO: 123447 - RNA, 19 nt, Homo sapiens
gguaauagggacuuagcaa

SEQ ID NO: 123448 - RNA, 19 nt, Homo sapiens
gggugaacuuacuugcaua

SEQ ID NO: 123449 - RNA, 19 nt, Homo sapiens
gaagaaauuggaagugacu

SEQ ID NO: 123450 - RNA, 19 nt, Homo sapiens
cuccugguguugcaaauaa

SEQ ID NO: 123451 - RNA, 19 nt, Homo sapiens
guagcgcuuugaauaugaa

SEQ ID NO: 123452 - RNA, 19 nt, Homo sapiens
guaccuaaguaagauguag

SEQ ID NO: 123453 - RNA, 19 nt, Homo sapiens
uauagagccuccauauguc

SEQ ID NO: 123454 - RNA, 19 nt, Homo sapiens
caaauaaagcuggacuaau

SEQ ID NO: 123455 - RNA, 19 nt, Homo sapiens
ugacuacuauccagaucug

SEQ ID NO: 123456 - RNA, 19 nt, Homo sapiens
uaagguagcugccccuaau

SEQ ID NO: 123457 - RNA, 19 nt, Homo sapiens
gaugugccaccuccaaaga

SEQ ID NO: 123458 - RNA, 19 nt, Homo sapiens
cuccaucaauucuguauuc

SEQ ID NO: 123459 - RNA, 19 nt, Homo sapiens
gaaguuugaguaucacuac

SEQ ID NO: 123460 - RNA, 19 nt, Homo sapiens
guugauacuugaauaacca

SEQ ID NO: 123461 - RNA, 19 nt, Homo sapiens
caucggcaguaaucauuca

SEQ ID NO: 123462 - RNA, 19 nt, Homo sapiens
aaugcccacuucaugguua

SEQ ID NO: 123463 - RNA, 19 nt, Homo sapiens
uugugaaggugauuuauuc

SEQ ID NO: 123464 - RNA, 19 nt, Homo sapiens
guauguuuguacuugguuu

SEQ ID NO: 123465 - RNA, 19 nt, Homo sapiens
gaaaggccgaguacauuuu

SEQ ID NO: 123466 - RNA, 19 nt, Homo sapiens
gaaaucauaggugaagaca

SEQ ID NO: 123467 - RNA, 19 nt, Homo sapiens
uaagauguagcgcuuugaa

SEQ ID NO: 123468 - RNA, 19 nt, Homo sapiens
aguaagauguagcgcuuug

SEQ ID NO: 123469 - RNA, 19 nt, Homo sapiens
gaagauaucagucaacuau

SEQ ID NO: 123470 - RNA, 19 nt, Homo sapiens
gcccacaacuuacaggaua

SEQ ID NO: 123471 - RNA, 19 nt, Homo sapiens
ucaacuaucuucuggauug

SEQ ID NO: 123472 - RNA, 19 nt, Homo sapiens
gccaagagguuccacauca

SEQ ID NO: 123473 - RNA, 19 nt, Homo sapiens
ugagagagccaaggaaaua

SEQ ID NO: 123474 - RNA, 19 nt, Homo sapiens
ugacugaccugcagcuguu

SEQ ID NO: 123475 - RNA, 19 nt, Homo sapiens
agaaggcccugcuuucaga

SEQ ID NO: 123476 - RNA, 19 nt, Homo sapiens
gaguuauucucucagugua

SEQ ID NO: 123477 - RNA, 19 nt, Homo sapiens
gagaauggccuaucuaucc

SEQ ID NO: 123478 - RNA, 19 nt, Homo sapiens
ugaaugagauuuacaaccu

SEQ ID NO: 123479 - RNA, 19 nt, Homo sapiens
gguguagacuguacuccaa

SEQ ID NO: 123480 - RNA, 19 nt, Homo sapiens
gagagaauggccuaucuau

SEQ ID NO: 123481 - RNA, 19 nt, Homo sapiens
ggacgugcuuagagacaga

SEQ ID NO: 123482 - RNA, 19 nt, Homo sapiens
gcaccaugcugaugcugau

SEQ ID NO: 123483 - RNA, 19 nt, Homo sapiens
uggccuaucuauccuauga

SEQ ID NO: 123484 - RNA, 19 nt, Homo sapiens
cagcaggcccuucaucuug

SEQ ID NO: 123485 - RNA, 19 nt, Homo sapiens
aggccuagcccacaacuua

SEQ ID NO: 123486 - RNA, 19 nt, Homo sapiens
gcucuugcuugccgauuau

SEQ ID NO: 123487 - RNA, 19 nt, Homo sapiens
ccgcagauguuguucaagu

SEQ ID NO: 123488 - RNA, 19 nt, Homo sapiens
ggacagcugaaugagauuu

SEQ ID NO: 123489 - RNA, 19 nt, Homo sapiens
ggcaagcauugauggaaga

SEQ ID NO: 123490 - RNA, 19 nt, Homo sapiens
gaagagagaauggccuauc

SEQ ID NO: 123491 - RNA, 19 nt, Homo sapiens
gacagcugaaugagauuua

SEQ ID NO: 123492 - RNA, 19 nt, Homo sapiens
gaaguguaggcaagcauug

SEQ ID NO: 123493 - RNA, 19 nt, Homo sapiens
gauguggcccagcaacaaa

SEQ ID NO: 123494 - RNA, 19 nt, Homo sapiens
gcacaggcuccaccagugu

SEQ ID NO: 123495 - RNA, 19 nt, Homo sapiens
gcacauccagcaggccuuu

SEQ ID NO: 123496 - RNA, 19 nt, Homo sapiens
gcagauguuguucaaguuc

SEQ ID NO: 123497 - RNA, 19 nt, Homo sapiens
gccuaucuauccuaugaga

SEQ ID NO: 123498 - RNA, 19 nt, Homo sapiens
gguaaaggcagagcuggaa

SEQ ID NO: 123499 - RNA, 19 nt, Homo sapiens
caaccguccucuuggucuu

SEQ ID NO: 123500 - RNA, 19 nt, Homo sapiens
ucacggagaccuucaagag

SEQ ID NO: 123501 - RNA, 19 nt, Homo sapiens
aagcauugauggaagaaca

SEQ ID NO: 123502 - RNA, 19 nt, Homo sapiens
ggagaaguguaggcaagca

SEQ ID NO: 123503 - RNA, 19 nt, Homo sapiens
cuggugaaauggauauaga

SEQ ID NO: 123504 - RNA, 19 nt, Homo sapiens
ccaaggaaauaugggagau

SEQ ID NO: 123505 - RNA, 19 nt, Homo sapiens
uaugagagagccaaggaaa

SEQ ID NO: 123506 - RNA, 19 nt, Homo sapiens
agggacagcugaaugagau

SEQ ID NO: 123507 - RNA, 19 nt, Homo sapiens
ccuccaaugugccuucaug

SEQ ID NO: 123508 - RNA, 19 nt, Homo sapiens
aaggaaauaugggagauca

SEQ ID NO: 123509 - RNA, 19 nt, Homo sapiens
uuuacaaccucaaacacaa

SEQ ID NO: 123510 - RNA, 19 nt, Homo sapiens
ggauguggcccagcaacaa

SEQ ID NO: 123511 - RNA, 19 nt, Homo sapiens
ccacagacuggcaggaaug

SEQ ID NO: 123512 - RNA, 19 nt, Homo sapiens
gagagagccaaggaaauau

SEQ ID NO: 123513 - RNA, 19 nt, Homo sapiens
gcaggcccuucaucuugga

SEQ ID NO: 123514 - RNA, 19 nt, Homo sapiens
gaccuucaagagccgaaua

SEQ ID NO: 123515 - RNA, 19 nt, Homo sapiens
gaauggccuaucuauccua

SEQ ID NO: 123516 - RNA, 19 nt, Homo sapiens
guuauucucucaguguauc

SEQ ID NO: 123517 - RNA, 19 nt, Homo sapiens
gagaaggcccugcuuucag

SEQ ID NO: 123518 - RNA, 19 nt, Homo sapiens
ugagaaggcccugcuuuca

SEQ ID NO: 123519 - RNA, 19 nt, Homo sapiens
aagagagaauggccuaucu

SEQ ID NO: 123520 - RNA, 19 nt, Homo sapiens
uggaagaagccaagagguu

SEQ ID NO: 123521 - RNA, 19 nt, Homo sapiens
uaaaggcagagcuggaaga

SEQ ID NO: 123522 - RNA, 19 nt, Homo sapiens
gcuuagagacagaggaugu

SEQ ID NO: 123523 - RNA, 19 nt, Homo sapiens
uggaagaacaggugaaugg

SEQ ID NO: 123524 - RNA, 19 nt, Homo sapiens
gauggaagaacaggugaau

SEQ ID NO: 123525 - RNA, 19 nt, Homo sapiens
ccaagagguuccacaucag

SEQ ID NO: 123526 - RNA, 19 nt, Homo sapiens
gugagaaggcccugcuuuc

SEQ ID NO: 123527 - RNA, 19 nt, Homo sapiens
agucaacuaucuucuggau

SEQ ID NO: 123528 - RNA, 19 nt, Homo sapiens
cuaucuauccuaugagaga

SEQ ID NO: 123529 - RNA, 19 nt, Homo sapiens
cgcagauguuguucaaguu

SEQ ID NO: 123530 - RNA, 19 nt, Homo sapiens
ccagcaggcccuucaucuu

SEQ ID NO: 123531 - RNA, 19 nt, Homo sapiens
agagagaauggccuaucua

SEQ ID NO: 123532 - RNA, 19 nt, Homo sapiens
ggaagaacaggugaauggu

SEQ ID NO: 123533 - RNA, 19 nt, Homo sapiens
ccagcaggccuuugagaag

SEQ ID NO: 123534 - RNA, 19 nt, Homo sapiens
cauugaugcuauugagaag

SEQ ID NO: 123535 - RNA, 19 nt, Homo sapiens
ucgaagauaucagucaacu

SEQ ID NO: 123536 - RNA, 19 nt, Homo sapiens
cgaagauaucagucaacua

SEQ ID NO: 123537 - RNA, 19 nt, Homo sapiens
gaaagcgacccagccaacu

SEQ ID NO: 123538 - RNA, 19 nt, Homo sapiens
cgggauggcaacacuguga

SEQ ID NO: 123539 - RNA, 19 nt, Homo sapiens
cuucuggauugcauugaug

SEQ ID NO: 123540 - RNA, 19 nt, Homo sapiens
gagagccaaggaaauaugg

SEQ ID NO: 123541 - RNA, 19 nt, Homo sapiens
gcaagcauugauggaagaa

SEQ ID NO: 123542 - RNA, 19 nt, Homo sapiens
ucaagagccgaauauccaa

SEQ ID NO: 123543 - RNA, 19 nt, Homo sapiens
gauguuuccuuaaugugua

SEQ ID NO: 123544 - RNA, 19 nt, Homo sapiens
caaggaaacucuuaucacu

SEQ ID NO: 123545 - RNA, 19 nt, Homo sapiens
gaugacagaccaaaguuaa

SEQ ID NO: 123546 - RNA, 19 nt, Homo sapiens
gaaaagaagccauugcuaa

SEQ ID NO: 123547 - RNA, 19 nt, Homo sapiens
gaacaccuccucagaaguc

SEQ ID NO: 123548 - RNA, 19 nt, Homo sapiens
ugacagaaaccuucacuug

SEQ ID NO: 123549 - RNA, 19 nt, Homo sapiens
gacagaaaccuucacuuga

SEQ ID NO: 123550 - RNA, 19 nt, Homo sapiens
aagaagccauugcuaacua

SEQ ID NO: 123551 - RNA, 19 nt, Homo sapiens
ucacuacuauugauucuag

SEQ ID NO: 123552 - RNA, 19 nt, Homo sapiens
uagaggagauucagaagca

SEQ ID NO: 123553 - RNA, 19 nt, Homo sapiens
gaaacucuuaucacuacua

SEQ ID NO: 123554 - RNA, 19 nt, Homo sapiens
ugaccaaauuucuggaaga

SEQ ID NO: 123555 - RNA, 19 nt, Homo sapiens
ggugaucccugccaucucu

SEQ ID NO: 123556 - RNA, 19 nt, Homo sapiens
aaacaagccuccagaaccu

SEQ ID NO: 123557 - RNA, 19 nt, Homo sapiens
ccacaagguguacgauuug

SEQ ID NO: 123558 - RNA, 19 nt, Homo sapiens
gaggugacgcuacugagaa

SEQ ID NO: 123559 - RNA, 19 nt, Homo sapiens
ggaggugacgcuacugaga

SEQ ID NO: 123560 - RNA, 19 nt, Homo sapiens
acucuuaucacuacuauug

SEQ ID NO: 123561 - RNA, 19 nt, Homo sapiens
aggaaacucuuaucacuac

SEQ ID NO: 123562 - RNA, 19 nt, Homo sapiens
ugacgcuacugagaacuuu

SEQ ID NO: 123563 - RNA, 19 nt, Homo sapiens
accacaagguguacgauuu

SEQ ID NO: 123564 - RNA, 19 nt, Homo sapiens
cuacuucaacugacagaaa

SEQ ID NO: 123565 - RNA, 19 nt, Homo sapiens
ggacgaggccgugaaguac

SEQ ID NO: 123566 - RNA, 19 nt, Homo sapiens
gaccaaauuucuggaagag

SEQ ID NO: 123567 - RNA, 19 nt, Homo sapiens
cggacgaggccgugaagua

SEQ ID NO: 123568 - RNA, 19 nt, Homo sapiens
gaggaugucgggcacucua

SEQ ID NO: 123569 - RNA, 19 nt, Homo sapiens
aggaagagccugcuuugga

SEQ ID NO: 123570 - RNA, 19 nt, Homo sapiens
ccagaugacagaccaaagu

SEQ ID NO: 123571 - RNA, 19 nt, Homo sapiens
cuaacuacuucaacugaca

SEQ ID NO: 123572 - RNA, 19 nt, Homo sapiens
gaagucagcgcaggaagag

SEQ ID NO: 123573 - RNA, 19 nt, Homo sapiens
acaagccuccagaaccuua

SEQ ID NO: 123574 - RNA, 19 nt, Homo sapiens
acgaggccgugaaguacua

SEQ ID NO: 123575 - RNA, 19 nt, Homo sapiens
caacugacagaaaccuuca

SEQ ID NO: 123576 - RNA, 19 nt, Homo sapiens
gaaguacuacacccuagag

SEQ ID NO: 123577 - RNA, 19 nt, Homo sapiens
cacaagguguacgauuuga

SEQ ID NO: 123578 - RNA, 19 nt, Homo sapiens
gauucuaguuccaguuggu

SEQ ID NO: 123579 - RNA, 19 nt, Homo sapiens
caagagcaccuggcugauc

SEQ ID NO: 123580 - RNA, 19 nt, Homo sapiens
gucgggcacucuacagaug

SEQ ID NO: 123581 - RNA, 19 nt, Homo sapiens
aaggaaacucuuaucacua

SEQ ID NO: 123582 - RNA, 19 nt, Homo sapiens
cagaugacagaccaaaguu

SEQ ID NO: 123583 - RNA, 19 nt, Homo sapiens
cugagaacuuugaggaugu

SEQ ID NO: 123584 - RNA, 19 nt, Homo sapiens
ggccgucgccuugauguau

SEQ ID NO: 123585 - RNA, 19 nt, Homo sapiens
guuaaacaagccuccagaa

SEQ ID NO: 123586 - RNA, 19 nt, Homo sapiens
agaugacagaccaaaguua

SEQ ID NO: 123587 - RNA, 19 nt, Homo sapiens
auacauggcagaggacuga

SEQ ID NO: 123588 - RNA, 19 nt, Homo sapiens
cuacagaugccagggaaau

SEQ ID NO: 123589 - RNA, 19 nt, Homo sapiens
uccaaaacauucaucauug

SEQ ID NO: 123590 - RNA, 19 nt, Homo sapiens
agccauugcuaacuacuuc

SEQ ID NO: 123591 - RNA, 19 nt, Homo sapiens
aagcacaaccacagcaaga

SEQ ID NO: 123592 - RNA, 19 nt, Homo sapiens
agaagucagcgcaggaaga

SEQ ID NO: 123593 - RNA, 19 nt, Homo sapiens
gccuugauguaucgccuau

SEQ ID NO: 123594 - RNA, 19 nt, Homo sapiens
ugacagaccaaaguuaaac

SEQ ID NO: 123595 - RNA, 19 nt, Homo sapiens
gaaaugcccugcugguuua

SEQ ID NO: 123596 - RNA, 19 nt, Homo sapiens
caagugauaugauguguaa

SEQ ID NO: 123597 - RNA, 19 nt, Homo sapiens
cauaaagagugucauguua

SEQ ID NO: 123598 - RNA, 19 nt, Homo sapiens
ccacagcacugccuuacua

SEQ ID NO: 123599 - RNA, 19 nt, Homo sapiens
ggaaauagugugauuagaa

SEQ ID NO: 123600 - RNA, 19 nt, Homo sapiens
gcagagggcacaaaccuua

SEQ ID NO: 123601 - RNA, 19 nt, Homo sapiens
ggacgagccuucuccuuau

SEQ ID NO: 123602 - RNA, 19 nt, Homo sapiens
ggaaaugcccugcugguuu

SEQ ID NO: 123603 - RNA, 19 nt, Homo sapiens
gaaauagugugauuagaac

SEQ ID NO: 123604 - RNA, 19 nt, Homo sapiens
gcagagcacagaucuuuaa

SEQ ID NO: 123605 - RNA, 19 nt, Homo sapiens
ucaagaccauccugacuaa

SEQ ID NO: 123606 - RNA, 19 nt, Homo sapiens
gcaaguauagcgcauuuga

SEQ ID NO: 123607 - RNA, 19 nt, Homo sapiens
gggcaaguauagcgcauuu

SEQ ID NO: 123608 - RNA, 19 nt, Homo sapiens
ggcacaaaccuuauaauuu

SEQ ID NO: 123609 - RNA, 19 nt, Homo sapiens
gcagugagcugagauugca

SEQ ID NO: 123610 - RNA, 19 nt, Homo sapiens
gauggcugcugaauucaaa

SEQ ID NO: 123611 - RNA, 19 nt, Homo sapiens
gcuaccaucuuccuccuuu

SEQ ID NO: 123612 - RNA, 19 nt, Homo sapiens
gggcacaaaccuuauaauu

SEQ ID NO: 123613 - RNA, 19 nt, Homo sapiens
gcccaugacuucagacaga

SEQ ID NO: 123614 - RNA, 19 nt, Homo sapiens
cacgauggcugcugaauuc

SEQ ID NO: 123615 - RNA, 19 nt, Homo sapiens
ugaccuuccucuucuuuaa

SEQ ID NO: 123616 - RNA, 19 nt, Homo sapiens
gggcuacgcugaccuguac

SEQ ID NO: 123617 - RNA, 19 nt, Homo sapiens
cagaacaacuacagucauc

SEQ ID NO: 123618 - RNA, 19 nt, Homo sapiens
gauggagucagaacaacua

SEQ ID NO: 123619 - RNA, 19 nt, Homo sapiens
ucagacagacuuucucuug

SEQ ID NO: 123620 - RNA, 19 nt, Homo sapiens
gaauaacacguggcacaaa

SEQ ID NO: 123621 - RNA, 19 nt, Homo sapiens
gggcggugcucuacaucuu

SEQ ID NO: 123622 - RNA, 19 nt, Homo sapiens
ccacagcacaucuucuuug

SEQ ID NO: 123623 - RNA, 19 nt, Homo sapiens
ggauagaagcccaugacuu

SEQ ID NO: 123624 - RNA, 19 nt, Homo sapiens
gcuauagaccaguucauug

SEQ ID NO: 123625 - RNA, 19 nt, Homo sapiens
gcaagugauaugaugugua

SEQ ID NO: 123626 - RNA, 19 nt, Homo sapiens
ggucauaggccugaucuuc

SEQ ID NO: 123627 - RNA, 19 nt, Homo sapiens
gcggugcucuacaucuuga

SEQ ID NO: 123628 - RNA, 19 nt, Homo sapiens
gcaggagaauggugugaac

SEQ ID NO: 123629 - RNA, 19 nt, Homo sapiens
gaaaccccgucucuacuaa

SEQ ID NO: 123630 - RNA, 19 nt, Homo sapiens
ccauaaagagugucauguu

SEQ ID NO: 123631 - RNA, 19 nt, Homo sapiens
aauaacacguggcacaaau

SEQ ID NO: 123632 - RNA, 19 nt, Homo sapiens
gaaggaggcacugcuguuc

SEQ ID NO: 123633 - RNA, 19 nt, Homo sapiens
gccaggagaucaagaccau

SEQ ID NO: 123634 - RNA, 19 nt, Homo sapiens
ccucuucuuuaacccuuua

SEQ ID NO: 123635 - RNA, 19 nt, Homo sapiens
cugggaagcucugagauga

SEQ ID NO: 123636 - RNA, 19 nt, Homo sapiens
ucgcagagcacagaucuuu

SEQ ID NO: 123637 - RNA, 19 nt, Homo sapiens
uaaagagugucauguuagc

SEQ ID NO: 123638 - RNA, 19 nt, Homo sapiens
ggcagaggagcaagugaua

SEQ ID NO: 123639 - RNA, 19 nt, Homo sapiens
gagggcacaaaccuuauaa

SEQ ID NO: 123640 - RNA, 19 nt, Homo sapiens
ggagagcgaccugcaguuc

SEQ ID NO: 123641 - RNA, 19 nt, Homo sapiens
ccaggcugcuccagacaug

SEQ ID NO: 123642 - RNA, 19 nt, Homo sapiens
gagcaagugauaugaugug

SEQ ID NO: 123643 - RNA, 19 nt, Homo sapiens
cagaggagcaagugauaug

SEQ ID NO: 123644 - RNA, 19 nt, Homo sapiens
ccacgauggcugcugaauu

SEQ ID NO: 123645 - RNA, 19 nt, Homo sapiens
gcgggauccuugucuuugu

SEQ ID NO: 123646 - RNA, 19 nt, Homo sapiens
agagcgaccugcaguucaa

SEQ ID NO: 123647 - RNA, 19 nt, Homo sapiens
ugacuaacaaacacaguga

SEQ ID NO: 123648 - RNA, 19 nt, Homo sapiens
agaccauccugacuaacaa

SEQ ID NO: 123649 - RNA, 19 nt, Homo sapiens
gccuggaaauagugugauu

SEQ ID NO: 123650 - RNA, 19 nt, Homo sapiens
gguaggacuucggguguuc

SEQ ID NO: 123651 - RNA, 19 nt, Homo sapiens
gaucaagaccauccugacu

SEQ ID NO: 123652 - RNA, 19 nt, Homo sapiens
gcccacagcacaucuucuu

SEQ ID NO: 123653 - RNA, 19 nt, Homo sapiens
gacgagccuucuccuuauc

SEQ ID NO: 123654 - RNA, 19 nt, Homo sapiens
guccugaccuuccucuucu

SEQ ID NO: 123655 - RNA, 19 nt, Homo sapiens
aaaguauguugguggugaa

SEQ ID NO: 123656 - RNA, 19 nt, Homo sapiens
gcagaggagcaagugauau

SEQ ID NO: 123657 - RNA, 19 nt, Homo sapiens
gagauggcgcuugcaguga

SEQ ID NO: 123658 - RNA, 19 nt, Homo sapiens
gacuuucucuuggcagaug

SEQ ID NO: 123659 - RNA, 19 nt, Homo sapiens
gugauaugauguguaaagu

SEQ ID NO: 123660 - RNA, 19 nt, Homo sapiens
cuauagaccaguucauugu

SEQ ID NO: 123661 - RNA, 19 nt, Homo sapiens
gggaaaugcccugcugguu

SEQ ID NO: 123662 - RNA, 19 nt, Homo sapiens
uuagcugagucaccauuug

SEQ ID NO: 123663 - RNA, 19 nt, Homo sapiens
gcccuaggauggcuuuggu

SEQ ID NO: 123664 - RNA, 19 nt, Homo sapiens
gagagcgaccugcaguuca

SEQ ID NO: 123665 - RNA, 19 nt, Homo sapiens
cagaaggcuuuggguagga

SEQ ID NO: 123666 - RNA, 19 nt, Homo sapiens
ugaaggaggcacugcuguu

SEQ ID NO: 123667 - RNA, 19 nt, Homo sapiens
caggauggagucagaacaa

SEQ ID NO: 123668 - RNA, 19 nt, Homo sapiens
aggagcaagugauaugaug

SEQ ID NO: 123669 - RNA, 19 nt, Homo sapiens
gcugcugaauucaaacaag

SEQ ID NO: 123670 - RNA, 19 nt, Homo sapiens
uggcuucggccuggaaaua

SEQ ID NO: 123671 - RNA, 19 nt, Homo sapiens
ggagucagaacaacuacag

SEQ ID NO: 123672 - RNA, 19 nt, Homo sapiens
agagggcacaaaccuuaua

SEQ ID NO: 123673 - RNA, 19 nt, Homo sapiens
ggguaggacuucggguguu

SEQ ID NO: 123674 - RNA, 19 nt, Homo sapiens
uaacaaacacagugaaacc

SEQ ID NO: 123675 - RNA, 19 nt, Homo sapiens
gcugcuggcuguggcuaga

SEQ ID NO: 123676 - RNA, 19 nt, Homo sapiens
ggagcaagugauaugaugu

SEQ ID NO: 123677 - RNA, 19 nt, Homo sapiens
gaggagcaagugauaugau

SEQ ID NO: 123678 - RNA, 19 nt, Homo sapiens
aggaggcacugcuguucaa

SEQ ID NO: 123679 - RNA, 19 nt, Homo sapiens
cacagcacaucuucuuugg

SEQ ID NO: 123680 - RNA, 19 nt, Homo sapiens
uaacacguggcacaaaugg

SEQ ID NO: 123681 - RNA, 19 nt, Homo sapiens
auagaccaguucauugugu

SEQ ID NO: 123682 - RNA, 19 nt, Homo sapiens
ccgcugcuauagaccaguu

SEQ ID NO: 123683 - RNA, 19 nt, Homo sapiens
ggugugaacccgggagaug

SEQ ID NO: 123684 - RNA, 19 nt, Homo sapiens
ggugcgggauccuugucuu

SEQ ID NO: 123685 - RNA, 19 nt, Homo sapiens
gugcgggauccuugucuuu

SEQ ID NO: 123686 - RNA, 19 nt, Homo sapiens
cagcuguaguccugaccuu

SEQ ID NO: 123687 - RNA, 19 nt, Homo sapiens
gaccauccugacuaacaaa

SEQ ID NO: 123688 - RNA, 19 nt, Homo sapiens
ugaauaacacguggcacaa

SEQ ID NO: 123689 - RNA, 19 nt, Homo sapiens
guguguggcucccgugucu

SEQ ID NO: 123690 - RNA, 19 nt, Homo sapiens
uggaaauagugugauuaga

SEQ ID NO: 123691 - RNA, 19 nt, Homo sapiens
gcuucggccuggaaauagu

SEQ ID NO: 123692 - RNA, 19 nt, Homo sapiens
auaaagagugucauguuag

SEQ ID NO: 123693 - RNA, 19 nt, Homo sapiens
guauguugguggugaaagc

SEQ ID NO: 123694 - RNA, 19 nt, Homo sapiens
aagcuaaacgcaccaccaa

SEQ ID NO: 123695 - RNA, 19 nt, Homo sapiens
gcacccaccugcaauaaac

SEQ ID NO: 123696 - RNA, 19 nt, Homo sapiens
uaccaggaauuacuauguu

SEQ ID NO: 123697 - RNA, 19 nt, Homo sapiens
ggaagaagggcuccaccau

SEQ ID NO: 123698 - RNA, 19 nt, Homo sapiens
gaucggaggcaccaucaag

SEQ ID NO: 123699 - RNA, 19 nt, Homo sapiens
uuaccaggaauuacuaugu

SEQ ID NO: 123700 - RNA, 19 nt, Homo sapiens
uugugugccugcuggagua

SEQ ID NO: 123701 - RNA, 19 nt, Homo sapiens
gagcggcaucuaccuacug

SEQ ID NO: 123702 - RNA, 19 nt, Homo sapiens
uuuggugccuacuccauug

SEQ ID NO: 123703 - RNA, 19 nt, Homo sapiens
aaacugugcucaacuauua

SEQ ID NO: 123704 - RNA, 19 nt, Homo sapiens
gaagacaacuggacaggaa

SEQ ID NO: 123705 - RNA, 19 nt, Homo sapiens
ggacuaggaugaacuaaau

SEQ ID NO: 123706 - RNA, 19 nt, Homo sapiens
guacacacaucaucucuuu

SEQ ID NO: 123707 - RNA, 19 nt, Homo sapiens
ggacaggaaucucaccuuu

SEQ ID NO: 123708 - RNA, 19 nt, Homo sapiens
gguuggagguggagaauua

SEQ ID NO: 123709 - RNA, 19 nt, Homo sapiens
gcagaagacugguuuagga

SEQ ID NO: 123710 - RNA, 19 nt, Homo sapiens
uaacuugucucuuccauga

SEQ ID NO: 123711 - RNA, 19 nt, Homo sapiens
ugaaggagguauacacaua

SEQ ID NO: 123712 - RNA, 19 nt, Homo sapiens
ggguaggucugacaaauaa

SEQ ID NO: 123713 - RNA, 19 nt, Homo sapiens
uaagagugcuugucauuau

SEQ ID NO: 123714 - RNA, 19 nt, Homo sapiens
caacugggauaaugaauuc

SEQ ID NO: 123715 - RNA, 19 nt, Homo sapiens
gaagauguguucagcuaug

SEQ ID NO: 123716 - RNA, 19 nt, Homo sapiens
ccauggagcugaacgaauu

SEQ ID NO: 123717 - RNA, 19 nt, Homo sapiens
gccaaaugcucaaauaaug

SEQ ID NO: 123718 - RNA, 19 nt, Homo sapiens
ggaaauaaauguggguugu

SEQ ID NO: 123719 - RNA, 19 nt, Homo sapiens
gcuaugagguggugauguu

SEQ ID NO: 123720 - RNA, 19 nt, Homo sapiens
gaagugggacaauacauuu

SEQ ID NO: 123721 - RNA, 19 nt, Homo sapiens
aaaggaaugucaaagauug

SEQ ID NO: 123722 - RNA, 19 nt, Homo sapiens
gcaagucaacacccuaaua

SEQ ID NO: 123723 - RNA, 19 nt, Homo sapiens
gaauauuggcccuuucuaa

SEQ ID NO: 123724 - RNA, 19 nt, Homo sapiens
caacuucgguaaugaggaa

SEQ ID NO: 123725 - RNA, 19 nt, Homo sapiens
ccacaaauguuuagaacuc

SEQ ID NO: 123726 - RNA, 19 nt, Homo sapiens
gagaucaaauucacacuca

SEQ ID NO: 123727 - RNA, 19 nt, Homo sapiens
gcucaaauaaugcuaauug

SEQ ID NO: 123728 - RNA, 19 nt, Homo sapiens
gaacugggcugugaaugag

SEQ ID NO: 123729 - RNA, 19 nt, Homo sapiens
gcacuucacucugcgauuc

SEQ ID NO: 123730 - RNA, 19 nt, Homo sapiens
ccagauuucuuaaaguuug

SEQ ID NO: 123731 - RNA, 19 nt, Homo sapiens
ccaggaugguuucugcuua

SEQ ID NO: 123732 - RNA, 19 nt, Homo sapiens
cauaauacauguugagagu

SEQ ID NO: 123733 - RNA, 19 nt, Homo sapiens
gcaauuguguuugugaaau

SEQ ID NO: 123734 - RNA, 19 nt, Homo sapiens
gcacuuaguauuuagcauu

SEQ ID NO: 123735 - RNA, 19 nt, Homo sapiens
ggaacugggcugugaauga

SEQ ID NO: 123736 - RNA, 19 nt, Homo sapiens
gaucgcaucugugugacua

SEQ ID NO: 123737 - RNA, 19 nt, Homo sapiens
cuaaggauacuaaccaaua

SEQ ID NO: 123738 - RNA, 19 nt, Homo sapiens
guuuagaacucuucaacuu

SEQ ID NO: 123739 - RNA, 19 nt, Homo sapiens
gcugccaaaugcucaaaua

SEQ ID NO: 123740 - RNA, 19 nt, Homo sapiens
ggaagugggacaauacauu

SEQ ID NO: 123741 - RNA, 19 nt, Homo sapiens
uaaggagucugagaauauu

SEQ ID NO: 123742 - RNA, 19 nt, Homo sapiens
uauaaggagucugagaaua

SEQ ID NO: 123743 - RNA, 19 nt, Homo sapiens
gguaucaauucaucuauuc

SEQ ID NO: 123744 - RNA, 19 nt, Homo sapiens
ggacacacaugccuuugag

SEQ ID NO: 123745 - RNA, 19 nt, Homo sapiens
agagagaucugcccugugu

SEQ ID NO: 123746 - RNA, 19 nt, Homo sapiens
gaacuuaggaauugugaca

SEQ ID NO: 123747 - RNA, 19 nt, Homo sapiens
cagcuagcccuuaugaaua

SEQ ID NO: 123748 - RNA, 19 nt, Homo sapiens
gcagagagcggauacucaa

SEQ ID NO: 123749 - RNA, 19 nt, Homo sapiens
gaaacccuccuaugacuug

SEQ ID NO: 123750 - RNA, 19 nt, Homo sapiens
gcuggaaacccuccuauga

SEQ ID NO: 123751 - RNA, 19 nt, Homo sapiens
gaaucucaccuuucauaaa

SEQ ID NO: 123752 - RNA, 19 nt, Homo sapiens
gaaggguucugcacauucu

SEQ ID NO: 123753 - RNA, 19 nt, Homo sapiens
gaauuuagaaccacacaau

SEQ ID NO: 123754 - RNA, 19 nt, Homo sapiens
acaggaaucucaccuuuca

SEQ ID NO: 123755 - RNA, 19 nt, Homo sapiens
gaugguuucugcuuagaga

SEQ ID NO: 123756 - RNA, 19 nt, Homo sapiens
gcaauaacgccaccaaucu

SEQ ID NO: 123757 - RNA, 19 nt, Homo sapiens
gcgaauauagccuuucuga

SEQ ID NO: 123758 - RNA, 19 nt, Homo sapiens
guauugacaucugagcaua

SEQ ID NO: 123759 - RNA, 19 nt, Homo sapiens
gaggguaggucugacaaau

SEQ ID NO: 123760 - RNA, 19 nt, Homo sapiens
ucaagacaauugcaaguca

SEQ ID NO: 123761 - RNA, 19 nt, Homo sapiens
ccaccaaucugaagcucaa

SEQ ID NO: 123762 - RNA, 19 nt, Homo sapiens
caagaugcguggaaacuac

SEQ ID NO: 123763 - RNA, 19 nt, Homo sapiens
guucugcacauucuuauuu

SEQ ID NO: 123764 - RNA, 19 nt, Homo sapiens
uaauacauguugagagugu

SEQ ID NO: 123765 - RNA, 19 nt, Homo sapiens
aggaguagcuauauauuuc

SEQ ID NO: 123766 - RNA, 19 nt, Homo sapiens
ccaaggaguagcuauauau

SEQ ID NO: 123767 - RNA, 19 nt, Homo sapiens
caacaagaguucgaagaca

SEQ ID NO: 123768 - RNA, 19 nt, Homo sapiens
gaguguuucuccaagguuu

SEQ ID NO: 123769 - RNA, 19 nt, Homo sapiens
gauacuaaccaauaggauu

SEQ ID NO: 123770 - RNA, 19 nt, Homo sapiens
cagauguucuuucuacaga

SEQ ID NO: 123771 - RNA, 19 nt, Homo sapiens
uaacuucccuaagauuaug

SEQ ID NO: 123772 - RNA, 19 nt, Homo sapiens
aaauggaagugggacaaua

SEQ ID NO: 123773 - RNA, 19 nt, Homo sapiens
gaacuuggagacaggcaaa

SEQ ID NO: 123774 - RNA, 19 nt, Homo sapiens
uaacagguacucuaagaau

SEQ ID NO: 123775 - RNA, 19 nt, Homo sapiens
gcacugaggguaggucuga

SEQ ID NO: 123776 - RNA, 19 nt, Homo sapiens
caaaauggaucgcaucugu

SEQ ID NO: 123777 - RNA, 19 nt, Homo sapiens
caagaacaggcuaaggaua

SEQ ID NO: 123778 - RNA, 19 nt, Homo sapiens
ggccagauguucuuucuac

SEQ ID NO: 123779 - RNA, 19 nt, Homo sapiens
gcaccaugaugaggagaaa

SEQ ID NO: 123780 - RNA, 19 nt, Homo sapiens
gaaauaaggagaaaagaga

SEQ ID NO: 123781 - RNA, 19 nt, Homo sapiens
uaaggauacuaaccaauag

SEQ ID NO: 123782 - RNA, 19 nt, Homo sapiens
ugacaguauugacaucuga

SEQ ID NO: 123783 - RNA, 19 nt, Homo sapiens
ggaaucucaccuuucauaa

SEQ ID NO: 123784 - RNA, 19 nt, Homo sapiens
aagagugcuugucauuaua

SEQ ID NO: 123785 - RNA, 19 nt, Homo sapiens
acagaagaauauuggauug

SEQ ID NO: 123786 - RNA, 19 nt, Homo sapiens
uuugugaucuucuucauug

SEQ ID NO: 123787 - RNA, 19 nt, Homo sapiens
ccggaggucuuacuuugaa

SEQ ID NO: 123788 - RNA, 19 nt, Homo sapiens
caccauugcacaucuauuu

SEQ ID NO: 123789 - RNA, 19 nt, Homo sapiens
agagaucugcccuguguua

SEQ ID NO: 123790 - RNA, 19 nt, Homo sapiens
aaaccaaggaguagcuaua

SEQ ID NO: 123791 - RNA, 19 nt, Homo sapiens
agaaggaaaccaaggagua

SEQ ID NO: 123792 - RNA, 19 nt, Homo sapiens
aaacaaagcaucuccaacu

SEQ ID NO: 123793 - RNA, 19 nt, Homo sapiens
caagacaauugcaagucaa

SEQ ID NO: 123794 - RNA, 19 nt, Homo sapiens
ucacaggccugaaacaaaa

SEQ ID NO: 123795 - RNA, 19 nt, Homo sapiens
gcucgaaagagaauaaaga

SEQ ID NO: 123796 - RNA, 19 nt, Homo sapiens
caggcucuguuuauuguuu

SEQ ID NO: 123797 - RNA, 19 nt, Homo sapiens
gagucaggcucuguuuauu

SEQ ID NO: 123798 - RNA, 19 nt, Homo sapiens
gaaacugugaccagaucua

SEQ ID NO: 123799 - RNA, 19 nt, Homo sapiens
gaguuuggcugugcauaau

SEQ ID NO: 123800 - RNA, 19 nt, Homo sapiens
caacuggacaggaaucuca

SEQ ID NO: 123801 - RNA, 19 nt, Homo sapiens
gaucaaauucacacucaau

SEQ ID NO: 123802 - RNA, 19 nt, Homo sapiens
cugauauggucauuuguuu

SEQ ID NO: 123803 - RNA, 19 nt, Homo sapiens
ggaagcuguucgacuauuu

SEQ ID NO: 123804 - RNA, 19 nt, Homo sapiens
cagggaagcuguucgacua

SEQ ID NO: 123805 - RNA, 19 nt, Homo sapiens
acacagaugucuuagaguu

SEQ ID NO: 123806 - RNA, 19 nt, Homo sapiens
cuacacagaugucuuagag

SEQ ID NO: 123807 - RNA, 19 nt, Homo sapiens
ccauaaagcggcacaagug

SEQ ID NO: 123808 - RNA, 19 nt, Homo sapiens
acagaugucuuagaguuug

SEQ ID NO: 123809 - RNA, 19 nt, Homo sapiens
gggaagcuguucgacuauu

SEQ ID NO: 123810 - RNA, 19 nt, Homo sapiens
acacggaggaugaagcuaa

SEQ ID NO: 123811 - RNA, 19 nt, Homo sapiens
cagcuaagccucucuucau

SEQ ID NO: 123812 - RNA, 19 nt, Homo sapiens
gcauggggcucaagauguu

SEQ ID NO: 123813 - RNA, 19 nt, Homo sapiens
gcuaccaugucccagauag

SEQ ID NO: 123814 - RNA, 19 nt, Homo sapiens
gucggaagcuggcauaucg

SEQ ID NO: 123815 - RNA, 19 nt, Homo sapiens
gaagcuguucgacuauuuc

SEQ ID NO: 123816 - RNA, 19 nt, Homo sapiens
ccagauagccaaggaugug

SEQ ID NO: 123817 - RNA, 19 nt, Homo sapiens
cagcuaccaugucccagau

SEQ ID NO: 123818 - RNA, 19 nt, Homo sapiens
cuaagccucucuucaucug

SEQ ID NO: 123819 - RNA, 19 nt, Homo sapiens
gcucugcauucggcuguga

SEQ ID NO: 123820 - RNA, 19 nt, Homo sapiens
ggagggguuuccagguaua

SEQ ID NO: 123821 - RNA, 19 nt, Homo sapiens
cugcggagguggagguuca

SEQ ID NO: 123822 - RNA, 19 nt, Homo sapiens
cagaugucuuagaguuuga

SEQ ID NO: 123823 - RNA, 19 nt, Homo sapiens
ccagagcacgaccaucgaa

SEQ ID NO: 123824 - RNA, 19 nt, Homo sapiens
guucgacuauuucccaaaa

SEQ ID NO: 123825 - RNA, 19 nt, Homo sapiens
guucaggccucagcuaagc

SEQ ID NO: 123826 - RNA, 19 nt, Homo sapiens
cacagaugucuuagaguuu

SEQ ID NO: 123827 - RNA, 19 nt, Homo sapiens
ggagguggagguucaagac

SEQ ID NO: 123828 - RNA, 19 nt, Homo sapiens
gcuaagccucucuucaucu

SEQ ID NO: 123829 - RNA, 19 nt, Homo sapiens
caaugaagauggggagaug

SEQ ID NO: 123830 - RNA, 19 nt, Homo sapiens
ucccgaggccggaaaguga

SEQ ID NO: 123831 - RNA, 19 nt, Homo sapiens
aagugacccuguccagugu

SEQ ID NO: 123832 - RNA, 19 nt, Homo sapiens
gcaugguggugaggacuac

SEQ ID NO: 123833 - RNA, 19 nt, Homo sapiens
gagaccaucuguuuauuua

SEQ ID NO: 123834 - RNA, 19 nt, Homo sapiens
caagaaagauacugagaaa

SEQ ID NO: 123835 - RNA, 19 nt, Homo sapiens
caagaaaguugccaagaaa

SEQ ID NO: 123836 - RNA, 19 nt, Homo sapiens
ugaaugaucucuagaaaga

SEQ ID NO: 123837 - RNA, 19 nt, Homo sapiens
caagaggccucaaagaauu

SEQ ID NO: 123838 - RNA, 19 nt, Homo sapiens
gaggauggauuggacauua

SEQ ID NO: 123839 - RNA, 19 nt, Homo sapiens
caacacgguuucuauaauu

SEQ ID NO: 123840 - RNA, 19 nt, Homo sapiens
gaaagauacugagaaagaa

SEQ ID NO: 123841 - RNA, 19 nt, Homo sapiens
gggcaaggauucagccaua

SEQ ID NO: 123842 - RNA, 19 nt, Homo sapiens
aaagaaggaugcaaagaaa

SEQ ID NO: 123843 - RNA, 19 nt, Homo sapiens
ccaagaaaguugccaagaa

SEQ ID NO: 123844 - RNA, 19 nt, Homo sapiens
ggacaacacgguuucuaua

SEQ ID NO: 123845 - RNA, 19 nt, Homo sapiens
aaacaaaggugaugaaucg

SEQ ID NO: 123846 - RNA, 19 nt, Homo sapiens
uaagaaaggugaagacaag

SEQ ID NO: 123847 - RNA, 19 nt, Homo sapiens
caaagaagaaugcaaagaa

SEQ ID NO: 123848 - RNA, 19 nt, Homo sapiens
gccaugaaaugaaguuaaa

SEQ ID NO: 123849 - RNA, 19 nt, Homo sapiens
caaagaaggaugcaaagaa

SEQ ID NO: 123850 - RNA, 19 nt, Homo sapiens
caaagaaggaugcaaagaa

SEQ ID NO: 123851 - RNA, 19 nt, Homo sapiens
aaagcuagaugcaaagaaa

SEQ ID NO: 123852 - RNA, 19 nt, Homo sapiens
ggagaaaguuaucacaagu

SEQ ID NO: 123853 - RNA, 19 nt, Homo sapiens
ugacagcucuaauuacgaa

SEQ ID NO: 123854 - RNA, 19 nt, Homo sapiens
gaacucagcagagauuuau

SEQ ID NO: 123855 - RNA, 19 nt, Homo sapiens
cacgaaagaugccaagaaa

SEQ ID NO: 123856 - RNA, 19 nt, Homo sapiens
gauguaccguucuuuaaug

SEQ ID NO: 123857 - RNA, 19 nt, Homo sapiens
gcaaggauauagagaaagg

SEQ ID NO: 123858 - RNA, 19 nt, Homo sapiens
caagcugcauccacagaua

SEQ ID NO: 123859 - RNA, 19 nt, Homo sapiens
ugaaagacuugaagaauac

SEQ ID NO: 123860 - RNA, 19 nt, Homo sapiens
cagcagaaauugguaagaa

SEQ ID NO: 123861 - RNA, 19 nt, Homo sapiens
caaccacagucauguuuau

SEQ ID NO: 123862 - RNA, 19 nt, Homo sapiens
uaagaaggaugcaaagaag

SEQ ID NO: 123863 - RNA, 19 nt, Homo sapiens
caaagaagaagggcaagua

SEQ ID NO: 123864 - RNA, 19 nt, Homo sapiens
guacagacagugacucaaa

SEQ ID NO: 123865 - RNA, 19 nt, Homo sapiens
ggagaacucagcagagauu

SEQ ID NO: 123866 - RNA, 19 nt, Homo sapiens
cagcugaauuugugagaaa

SEQ ID NO: 123867 - RNA, 19 nt, Homo sapiens
caaaggaugaugucaagaa

SEQ ID NO: 123868 - RNA, 19 nt, Homo sapiens
gcaaagacucggcaacaga

SEQ ID NO: 123869 - RNA, 19 nt, Homo sapiens
gaucguagacaaccauuau

SEQ ID NO: 123870 - RNA, 19 nt, Homo sapiens
uaaagaaggauacaaagga

SEQ ID NO: 123871 - RNA, 19 nt, Homo sapiens
agaaagauacugagaaaga

SEQ ID NO: 123872 - RNA, 19 nt, Homo sapiens
gagagaccaucuguuuauu

SEQ ID NO: 123873 - RNA, 19 nt, Homo sapiens
gacaacacgguuucuauaa

SEQ ID NO: 123874 - RNA, 19 nt, Homo sapiens
gagccuacaucuuucuuuc

SEQ ID NO: 123875 - RNA, 19 nt, Homo sapiens
ucaaagaaaggcaaggaua

SEQ ID NO: 123876 - RNA, 19 nt, Homo sapiens
ggaguucagugacaugauc

SEQ ID NO: 123877 - RNA, 19 nt, Homo sapiens
uuaaacaccuuguagaaag

SEQ ID NO: 123878 - RNA, 19 nt, Homo sapiens
aaagaaggaugcaaagaag

SEQ ID NO: 123879 - RNA, 19 nt, Homo sapiens
aaagaaggaugcaaagaag

SEQ ID NO: 123880 - RNA, 19 nt, Homo sapiens
gaaagaugccaagaaaguu

SEQ ID NO: 123881 - RNA, 19 nt, Homo sapiens
aaaggaugaugucaagaaa

SEQ ID NO: 123882 - RNA, 19 nt, Homo sapiens
caaagaagggcaaggauuc

SEQ ID NO: 123883 - RNA, 19 nt, Homo sapiens
ggagguacagagaaagaua

SEQ ID NO: 123884 - RNA, 19 nt, Homo sapiens
caaagaaaggcaaggauau

SEQ ID NO: 123885 - RNA, 19 nt, Homo sapiens
guaccguucuuuaaugaga

SEQ ID NO: 123886 - RNA, 19 nt, Homo sapiens
aaacaucuagucaccauaa

SEQ ID NO: 123887 - RNA, 19 nt, Homo sapiens
guggaaagguuacccuaga

SEQ ID NO: 123888 - RNA, 19 nt, Homo sapiens
gaaguuaaacaccuuguag

SEQ ID NO: 123889 - RNA, 19 nt, Homo sapiens
aaugaaggcuuaaagaauc

SEQ ID NO: 123890 - RNA, 19 nt, Homo sapiens
gauaagaagaagcccagua

SEQ ID NO: 123891 - RNA, 19 nt, Homo sapiens
gaagacaagacaacacaga

SEQ ID NO: 123892 - RNA, 19 nt, Homo sapiens
cgaaagaugccaagaaagu

SEQ ID NO: 123893 - RNA, 19 nt, Homo sapiens
cgaaggaugccaagaaaga

SEQ ID NO: 123894 - RNA, 19 nt, Homo sapiens
uaucacaaguggaaagguu

SEQ ID NO: 123895 - RNA, 19 nt, Homo sapiens
aaaaggaggugcaaagaaa

SEQ ID NO: 123896 - RNA, 19 nt, Homo sapiens
ggaaagguuacccuagaaa

SEQ ID NO: 123897 - RNA, 19 nt, Homo sapiens
gaguaaacuuugggccaua

SEQ ID NO: 123898 - RNA, 19 nt, Homo sapiens
caaggagacagauguugua

SEQ ID NO: 123899 - RNA, 19 nt, Homo sapiens
caagaaagagucuaagaag

SEQ ID NO: 123900 - RNA, 19 nt, Homo sapiens
aagaagaagcccaguagua

SEQ ID NO: 123901 - RNA, 19 nt, Homo sapiens
gcaaagacucagcaacaga

SEQ ID NO: 123902 - RNA, 19 nt, Homo sapiens
aaagaaaggcaaggauaua

SEQ ID NO: 123903 - RNA, 19 nt, Homo sapiens
cuaaaucuauggacacaca

SEQ ID NO: 123904 - RNA, 19 nt, Homo sapiens
caaagacucagcaacagaa

SEQ ID NO: 123905 - RNA, 19 nt, Homo sapiens
ugacaugaucucaggcuua

SEQ ID NO: 123906 - RNA, 19 nt, Homo sapiens
acaguuuaaugaaggcuua

SEQ ID NO: 123907 - RNA, 19 nt, Homo sapiens
aaagaagaaugcaaagaag

SEQ ID NO: 123908 - RNA, 19 nt, Homo sapiens
gcaaagaagaaugcaaaga

SEQ ID NO: 123909 - RNA, 19 nt, Homo sapiens
gggcaaagacucagcaaca

SEQ ID NO: 123910 - RNA, 19 nt, Homo sapiens
ugagagaccaucuguuuau

SEQ ID NO: 123911 - RNA, 19 nt, Homo sapiens
cuaagaaggaugcaaagaa

SEQ ID NO: 123912 - RNA, 19 nt, Homo sapiens
agaaagagucuaagaagga

SEQ ID NO: 123913 - RNA, 19 nt, Homo sapiens
guacagagaaagauagcaa

SEQ ID NO: 123914 - RNA, 19 nt, Homo sapiens
caaagacucggcaacagaa

SEQ ID NO: 123915 - RNA, 19 nt, Homo sapiens
cgagguggauucuaaagca

SEQ ID NO: 123916 - RNA, 19 nt, Homo sapiens
aagaggagaucguagacaa

SEQ ID NO: 123917 - RNA, 19 nt, Homo sapiens
gauaauuacauuccaguca

SEQ ID NO: 123918 - RNA, 19 nt, Homo sapiens
aaauauaggagccaugaaa

SEQ ID NO: 123919 - RNA, 19 nt, Homo sapiens
gcaaagaaggaugcaaaga

SEQ ID NO: 123920 - RNA, 19 nt, Homo sapiens
uaagaaggacgccacgaaa

SEQ ID NO: 123921 - RNA, 19 nt, Homo sapiens
aggaugaugucaagaaaga

SEQ ID NO: 123922 - RNA, 19 nt, Homo sapiens
ggauguaccguucuuuaau

SEQ ID NO: 123923 - RNA, 19 nt, Homo sapiens
acacuugucucgcucuguu

SEQ ID NO: 123924 - RNA, 19 nt, Homo sapiens
cuacaucuuucuuucugaa

SEQ ID NO: 123925 - RNA, 19 nt, Homo sapiens
agauaaggauguugaagau

SEQ ID NO: 123926 - RNA, 19 nt, Homo sapiens
gaauuugaaccgaaagaau

SEQ ID NO: 123927 - RNA, 19 nt, Homo sapiens
ucaagaaagagucuaagaa

SEQ ID NO: 123928 - RNA, 19 nt, Homo sapiens
gaaagaugcaaaggagauu

SEQ ID NO: 123929 - RNA, 19 nt, Homo sapiens
ucugagagaccaucuguuu

SEQ ID NO: 123930 - RNA, 19 nt, Homo sapiens
aaaguuaucacaaguggaa

SEQ ID NO: 123931 - RNA, 19 nt, Homo sapiens
gaucaaaaccuucucaaau

SEQ ID NO: 123932 - RNA, 19 nt, Homo sapiens
uauaggagccaugaaauga

SEQ ID NO: 123933 - RNA, 19 nt, Homo sapiens
cgaagaggcugaaucauaa

SEQ ID NO: 123934 - RNA, 19 nt, Homo sapiens
gaacagauuccacucuuua

SEQ ID NO: 123935 - RNA, 19 nt, Homo sapiens
gaacucacauggucuagaa

SEQ ID NO: 123936 - RNA, 19 nt, Homo sapiens
caacugggauggaagauuu

SEQ ID NO: 123937 - RNA, 19 nt, Homo sapiens
ugaaugagcuugucaaugu

SEQ ID NO: 123938 - RNA, 19 nt, Homo sapiens
ugaaagaauuggagugaua

SEQ ID NO: 123939 - RNA, 19 nt, Homo sapiens
guaaaggccuccaaauaga

SEQ ID NO: 123940 - RNA, 19 nt, Homo sapiens
gaccauagaugauacaugu

SEQ ID NO: 123941 - RNA, 19 nt, Homo sapiens
gaaaugggauguuuuguuu

SEQ ID NO: 123942 - RNA, 19 nt, Homo sapiens
ggacauggauaacccuauu

SEQ ID NO: 123943 - RNA, 19 nt, Homo sapiens
ugggagagauggauauuua

SEQ ID NO: 123944 - RNA, 19 nt, Homo sapiens
guacugaguuugauuuguu

SEQ ID NO: 123945 - RNA, 19 nt, Homo sapiens
aaagaaggcuuggagauaa

SEQ ID NO: 123946 - RNA, 19 nt, Homo sapiens
ggacagaaauuguuaaucc

SEQ ID NO: 123947 - RNA, 19 nt, Homo sapiens
agagauaucuacagacuuu

SEQ ID NO: 123948 - RNA, 19 nt, Homo sapiens
ggaagaaggucguggucaa

SEQ ID NO: 123949 - RNA, 19 nt, Homo sapiens
ggauuuaccucugaagaaa

SEQ ID NO: 123950 - RNA, 19 nt, Homo sapiens
ggagaguacuugaagaugu

SEQ ID NO: 123951 - RNA, 19 nt, Homo sapiens
guccuaacguugcaucuua

SEQ ID NO: 123952 - RNA, 19 nt, Homo sapiens
guggagggcuugcaaugua

SEQ ID NO: 123953 - RNA, 19 nt, Homo sapiens
ggaauauucuuuggaguug

SEQ ID NO: 123954 - RNA, 19 nt, Homo sapiens
uuaaaugggucuucuguug

SEQ ID NO: 123955 - RNA, 19 nt, Homo sapiens
gagaacagauuccacucuu

SEQ ID NO: 123956 - RNA, 19 nt, Homo sapiens
gaggauguguguuuauaug

SEQ ID NO: 123957 - RNA, 19 nt, Homo sapiens
gaaguccaaucacccugua

SEQ ID NO: 123958 - RNA, 19 nt, Homo sapiens
uuacuuagacucaaccuua

SEQ ID NO: 123959 - RNA, 19 nt, Homo sapiens
uuacagagauaucuacaga

SEQ ID NO: 123960 - RNA, 19 nt, Homo sapiens
gagugcagcuuuguaguuu

SEQ ID NO: 123961 - RNA, 19 nt, Homo sapiens
cacaaugaguucaggcuua

SEQ ID NO: 123962 - RNA, 19 nt, Homo sapiens
gaucuugcaugucuacaau

SEQ ID NO: 123963 - RNA, 19 nt, Homo sapiens
ccgaagaggcugaaucaua

SEQ ID NO: 123964 - RNA, 19 nt, Homo sapiens
aauagaaucuggaacaguu

SEQ ID NO: 123965 - RNA, 19 nt, Homo sapiens
gaagguuggagaaacaaua

SEQ ID NO: 123966 - RNA, 19 nt, Homo sapiens
gcaguucucuuuguugaug

SEQ ID NO: 123967 - RNA, 19 nt, Homo sapiens
gacagaaugugguaauugu

SEQ ID NO: 123968 - RNA, 19 nt, Homo sapiens
gaaagaauuggagugauaa

SEQ ID NO: 123969 - RNA, 19 nt, Homo sapiens
gacuggaacuggaagauga

SEQ ID NO: 123970 - RNA, 19 nt, Homo sapiens
ggacaagcuagaacucaua

SEQ ID NO: 123971 - RNA, 19 nt, Homo sapiens
gacgugggcuguccuguga

SEQ ID NO: 123972 - RNA, 19 nt, Homo sapiens
ucuacaaucugcucaguuu

SEQ ID NO: 123973 - RNA, 19 nt, Homo sapiens
uaaguuaagugcauugauc

SEQ ID NO: 123974 - RNA, 19 nt, Homo sapiens
gcacgaagacugcuuugug

SEQ ID NO: 123975 - RNA, 19 nt, Homo sapiens
gaggcugaaucauaaauau

SEQ ID NO: 123976 - RNA, 19 nt, Homo sapiens
ccaaucacccuguaauaaa

SEQ ID NO: 123977 - RNA, 19 nt, Homo sapiens
uuagagauguacugaguuu

SEQ ID NO: 123978 - RNA, 19 nt, Homo sapiens
gaaaagaaagcuuaggaua

SEQ ID NO: 123979 - RNA, 19 nt, Homo sapiens
gaccacagcggauguugua

SEQ ID NO: 123980 - RNA, 19 nt, Homo sapiens
ggagagauggauauuuaaa

SEQ ID NO: 123981 - RNA, 19 nt, Homo sapiens
gaauuggagugauaauagu

SEQ ID NO: 123982 - RNA, 19 nt, Homo sapiens
uaagugaaguaguagaaga

SEQ ID NO: 123983 - RNA, 19 nt, Homo sapiens
caaucacccuguaauaaau

SEQ ID NO: 123984 - RNA, 19 nt, Homo sapiens
ccaguacucccauuaaauu

SEQ ID NO: 123985 - RNA, 19 nt, Homo sapiens
aaacauacaguccauaaga

SEQ ID NO: 123986 - RNA, 19 nt, Homo sapiens
aaacuugccuuuaugucaa

SEQ ID NO: 123987 - RNA, 19 nt, Homo sapiens
agaaggcgcuguuugugaa

SEQ ID NO: 123988 - RNA, 19 nt, Homo sapiens
aaaggauguuguagagaua

SEQ ID NO: 123989 - RNA, 19 nt, Homo sapiens
ggacugccacugaauuuau

SEQ ID NO: 123990 - RNA, 19 nt, Homo sapiens
acuaagggcugacgaucua

SEQ ID NO: 123991 - RNA, 19 nt, Homo sapiens
gcagaaaagucaucauaug

SEQ ID NO: 123992 - RNA, 19 nt, Homo sapiens
ugaaugacuuucuaacugu

SEQ ID NO: 123993 - RNA, 19 nt, Homo sapiens
guacauugaugaaguugca

SEQ ID NO: 123994 - RNA, 19 nt, Homo sapiens
gaggacagucuccggaaua

SEQ ID NO: 123995 - RNA, 19 nt, Homo sapiens
cuucaagaaugcagcguua

SEQ ID NO: 123996 - RNA, 19 nt, Homo sapiens
uaacagccauagugugugu

SEQ ID NO: 123997 - RNA, 19 nt, Homo sapiens
gaccaaggauaugaaauca

SEQ ID NO: 123998 - RNA, 19 nt, Homo sapiens
cacgaagacugcuuuguga

SEQ ID NO: 123999 - RNA, 19 nt, Homo sapiens
caacaguaaccugaaauuu

SEQ ID NO: 124000 - RNA, 19 nt, Homo sapiens
gaucaucuuuccauugucu

SEQ ID NO: 124001 - RNA, 19 nt, Homo sapiens
ugagauaaaugagugauuc

SEQ ID NO: 124002 - RNA, 19 nt, Homo sapiens
ggaccaaggauaugaaauc

SEQ ID NO: 124003 - RNA, 19 nt, Homo sapiens
ucagaugccucgauuugga

SEQ ID NO: 124004 - RNA, 19 nt, Homo sapiens
uuacuuagacccaaagaaa

SEQ ID NO: 124005 - RNA, 19 nt, Homo sapiens
ucaccaagaugcccaauac

SEQ ID NO: 124006 - RNA, 19 nt, Homo sapiens
gaaauagaaacagaucuga

SEQ ID NO: 124007 - RNA, 19 nt, Homo sapiens
aaagguucauccagucaua

SEQ ID NO: 124008 - RNA, 19 nt, Homo sapiens
uaccugaagcuuuaaguua

SEQ ID NO: 124009 - RNA, 19 nt, Homo sapiens
ggcaauggaugucuuugug

SEQ ID NO: 124010 - RNA, 19 nt, Homo sapiens
uaucaacaguaaccugaaa

SEQ ID NO: 124011 - RNA, 19 nt, Homo sapiens
caaccacaauccaaaucaa

SEQ ID NO: 124012 - RNA, 19 nt, Homo sapiens
ugaagauuguggcguguuu

SEQ ID NO: 124013 - RNA, 19 nt, Homo sapiens
guggugagaugaugauuag

SEQ ID NO: 124014 - RNA, 19 nt, Homo sapiens
gaugaaagaauuggaguga

SEQ ID NO: 124015 - RNA, 19 nt, Homo sapiens
ggaaaggcaaagaaacuga

SEQ ID NO: 124016 - RNA, 19 nt, Homo sapiens
gaggcugcaucaggauuua

SEQ ID NO: 124017 - RNA, 19 nt, Homo sapiens
ggaaauagaaacagaucug

SEQ ID NO: 124018 - RNA, 19 nt, Homo sapiens
guucauccagucauaauaa

SEQ ID NO: 124019 - RNA, 19 nt, Homo sapiens
gaaacaauagaaucuggaa

SEQ ID NO: 124020 - RNA, 19 nt, Homo sapiens
cauagaagaugaugacacu

SEQ ID NO: 124021 - RNA, 19 nt, Homo sapiens
gggcuguccugugaaagua

SEQ ID NO: 124022 - RNA, 19 nt, Homo sapiens
aaguaaaggccuccaaaua

SEQ ID NO: 124023 - RNA, 19 nt, Homo sapiens
gaaacagacuaaguaaagg

SEQ ID NO: 124024 - RNA, 19 nt, Homo sapiens
aaaggaugccucuguuuaa

SEQ ID NO: 124025 - RNA, 19 nt, Homo sapiens
gaaaggcaaagaaacugaa

SEQ ID NO: 124026 - RNA, 19 nt, Homo sapiens
ccaaggcugugcacgaaga

SEQ ID NO: 124027 - RNA, 19 nt, Homo sapiens
gagaguacuugaagauguc

SEQ ID NO: 124028 - RNA, 19 nt, Homo sapiens
ggucgaacuuccuccuuug

SEQ ID NO: 124029 - RNA, 19 nt, Homo sapiens
acaggaggauguguguuua

SEQ ID NO: 124030 - RNA, 19 nt, Homo sapiens
aaaugugucuucuuuaugg

SEQ ID NO: 124031 - RNA, 19 nt, Homo sapiens
guaccagaguccaacaaug

SEQ ID NO: 124032 - RNA, 19 nt, Homo sapiens
cagaaugugguaauuguaa

SEQ ID NO: 124033 - RNA, 19 nt, Homo sapiens
caacaauccuucuauucua

SEQ ID NO: 124034 - RNA, 19 nt, Homo sapiens
gaacuaggcugagcaaucu

SEQ ID NO: 124035 - RNA, 19 nt, Homo sapiens
ccacauagaugcugaugga

SEQ ID NO: 124036 - RNA, 19 nt, Homo sapiens
ucaaggaccugaaugagaa

SEQ ID NO: 124037 - RNA, 19 nt, Homo sapiens
gaucccaucugcccuauau

SEQ ID NO: 124038 - RNA, 19 nt, Homo sapiens
gaagagacagcccaggaua

SEQ ID NO: 124039 - RNA, 19 nt, Homo sapiens
gauggagccuucccaaguu

SEQ ID NO: 124040 - RNA, 19 nt, Homo sapiens
gcacagagguagucucacu

SEQ ID NO: 124041 - RNA, 19 nt, Homo sapiens
gagaagcucugaagaacuc

SEQ ID NO: 124042 - RNA, 19 nt, Homo sapiens
uaccugagcuaaauaaaga

SEQ ID NO: 124043 - RNA, 19 nt, Homo sapiens
gaacaacuaccugagcuaa

SEQ ID NO: 124044 - RNA, 19 nt, Homo sapiens
agaagcagcuggaugagaa

SEQ ID NO: 124045 - RNA, 19 nt, Homo sapiens
aaaugcagcugcgcucuua

SEQ ID NO: 124046 - RNA, 19 nt, Homo sapiens
gacaagguguuaagugaga

SEQ ID NO: 124047 - RNA, 19 nt, Homo sapiens
caacaagagacacaaguuu

SEQ ID NO: 124048 - RNA, 19 nt, Homo sapiens
cuagucaaccugaauaaua

SEQ ID NO: 124049 - RNA, 19 nt, Homo sapiens
ccuggagccucauguauuu

SEQ ID NO: 124050 - RNA, 19 nt, Homo sapiens
acacaacaauccuucuauu

SEQ ID NO: 124051 - RNA, 19 nt, Homo sapiens
gugagaaggugauuaucuu

SEQ ID NO: 124052 - RNA, 19 nt, Homo sapiens
gaucaaccaugaccagaag

SEQ ID NO: 124053 - RNA, 19 nt, Homo sapiens
gcagggcgaugauuucaag

SEQ ID NO: 124054 - RNA, 19 nt, Homo sapiens
guaaaccaguggcagauca

SEQ ID NO: 124055 - RNA, 19 nt, Homo sapiens
caacccaucugaguuccua

SEQ ID NO: 124056 - RNA, 19 nt, Homo sapiens
aaacccagcugacuucauc

SEQ ID NO: 124057 - RNA, 19 nt, Homo sapiens
ccaaaggccugaagaaucc

SEQ ID NO: 124058 - RNA, 19 nt, Homo sapiens
ggucagagcauguccuuca

SEQ ID NO: 124059 - RNA, 19 nt, Homo sapiens
uaagugagaaggugauuau

SEQ ID NO: 124060 - RNA, 19 nt, Homo sapiens
ucgacaagguguuaaguga

SEQ ID NO: 124061 - RNA, 19 nt, Homo sapiens
guacacaacaauccuucua

SEQ ID NO: 124062 - RNA, 19 nt, Homo sapiens
aaacagggccacauagaug

SEQ ID NO: 124063 - RNA, 19 nt, Homo sapiens
ggucaaggagcacuacaaa

SEQ ID NO: 124064 - RNA, 19 nt, Homo sapiens
cuacagguaugugguggua

SEQ ID NO: 124065 - RNA, 19 nt, Homo sapiens
ggagcuagacacagugauu

SEQ ID NO: 124066 - RNA, 19 nt, Homo sapiens
acaacuaccugagcuaaau

SEQ ID NO: 124067 - RNA, 19 nt, Homo sapiens
gagcuggguuugacacagu

SEQ ID NO: 124068 - RNA, 19 nt, Homo sapiens
caacuaccugagcuaaaua

SEQ ID NO: 124069 - RNA, 19 nt, Homo sapiens
gcugggaggucuuucucuu

SEQ ID NO: 124070 - RNA, 19 nt, Homo sapiens
gagaaggugauuaucuuug

SEQ ID NO: 124071 - RNA, 19 nt, Homo sapiens
ucacagacagccugauuga

SEQ ID NO: 124072 - RNA, 19 nt, Homo sapiens
ggaccugaaugagaaguuc

SEQ ID NO: 124073 - RNA, 19 nt, Homo sapiens
gcuuaagaaccauugauuu

SEQ ID NO: 124074 - RNA, 19 nt, Homo sapiens
ugagcaaucugacccuaug

SEQ ID NO: 124075 - RNA, 19 nt, Homo sapiens
cagcugacuucaucccuau

SEQ ID NO: 124076 - RNA, 19 nt, Homo sapiens
gcugugagcacuuccaaau

SEQ ID NO: 124077 - RNA, 19 nt, Homo sapiens
aagaggagcuagacacagu

SEQ ID NO: 124078 - RNA, 19 nt, Homo sapiens
agaauggccugaaaaguuu

SEQ ID NO: 124079 - RNA, 19 nt, Homo sapiens
ugucugguauucuggguaa

SEQ ID NO: 124080 - RNA, 19 nt, Homo sapiens
ggucaacccaucugaguuc

SEQ ID NO: 124081 - RNA, 19 nt, Homo sapiens
ucauuaacaucgucuugga

SEQ ID NO: 124082 - RNA, 19 nt, Homo sapiens
gaucauuaacaucgucuug

SEQ ID NO: 124083 - RNA, 19 nt, Homo sapiens
ugcagaagauggucaagga

SEQ ID NO: 124084 - RNA, 19 nt, Homo sapiens
gaacugcuuagccuaguca

SEQ ID NO: 124085 - RNA, 19 nt, Homo sapiens
caucuucugucugguauuc

SEQ ID NO: 124086 - RNA, 19 nt, Homo sapiens
gguauguggugguaucagu

SEQ ID NO: 124087 - RNA, 19 nt, Homo sapiens
uccaagaucccuacacuga

SEQ ID NO: 124088 - RNA, 19 nt, Homo sapiens
ugaaacucauagacacuga

SEQ ID NO: 124089 - RNA, 19 nt, Homo sapiens
acaagagacacaaguuuga

SEQ ID NO: 124090 - RNA, 19 nt, Homo sapiens
ggaagagacagcccaggau

SEQ ID NO: 124091 - RNA, 19 nt, Homo sapiens
ccuauguggucuaagauuc

SEQ ID NO: 124092 - RNA, 19 nt, Homo sapiens
uggccuauguggucuaaga

SEQ ID NO: 124093 - RNA, 19 nt, Homo sapiens
ggcguugugucuuuguaaa

SEQ ID NO: 124094 - RNA, 19 nt, Homo sapiens
ggcccgaccucuacaccuu

SEQ ID NO: 124095 - RNA, 19 nt, Homo sapiens
caagagacacaaguuugaa

SEQ ID NO: 124096 - RNA, 19 nt, Homo sapiens
gagcuagacacagugauug

SEQ ID NO: 124097 - RNA, 19 nt, Homo sapiens
agaaggugauuaucuuugg

SEQ ID NO: 124098 - RNA, 19 nt, Homo sapiens
caaggggcguugugucuuu

SEQ ID NO: 124099 - RNA, 19 nt, Homo sapiens
ccucauguauuuggugaug

SEQ ID NO: 124100 - RNA, 19 nt, Homo sapiens
ccacaaccaccaagaacug

SEQ ID NO: 124101 - RNA, 19 nt, Homo sapiens
caucugugccauuugcuuu

SEQ ID NO: 124102 - RNA, 19 nt, Homo sapiens
uggaagagcaugugagcaa

SEQ ID NO: 124103 - RNA, 19 nt, Homo sapiens
ccuucacccucaucaguaa

SEQ ID NO: 124104 - RNA, 19 nt, Homo sapiens
ugagaaggugauuaucuuu

SEQ ID NO: 124105 - RNA, 19 nt, Homo sapiens
aguggcagaucaaccauga

SEQ ID NO: 124106 - RNA, 19 nt, Homo sapiens
gagaagcagcuggaugaga

SEQ ID NO: 124107 - RNA, 19 nt, Homo sapiens
gcugagguccugauaagca

SEQ ID NO: 124108 - RNA, 19 nt, Homo sapiens
ggaggcugagguccugaua

SEQ ID NO: 124109 - RNA, 19 nt, Homo sapiens
cagaauggccugaaaaguu

SEQ ID NO: 124110 - RNA, 19 nt, Homo sapiens
caaggaugagccagcagua

SEQ ID NO: 124111 - RNA, 19 nt, Homo sapiens
gcugucagaugagaagauc

SEQ ID NO: 124112 - RNA, 19 nt, Homo sapiens
ugaacuaggcugagcaauc

SEQ ID NO: 124113 - RNA, 19 nt, Homo sapiens
ugacuggcuucagcaaguu

SEQ ID NO: 124114 - RNA, 19 nt, Homo sapiens
ucugagaagcucugaagaa

SEQ ID NO: 124115 - RNA, 19 nt, Homo sapiens
gcuggccuauguggucuaa

SEQ ID NO: 124116 - RNA, 19 nt, Homo sapiens
ugugagcacuuccaaaugc

SEQ ID NO: 124117 - RNA, 19 nt, Homo sapiens
gguaaucagggccucaaga

SEQ ID NO: 124118 - RNA, 19 nt, Homo sapiens
gcacaacaagagacacaag

SEQ ID NO: 124119 - RNA, 19 nt, Homo sapiens
aggagaagcagcuggauga

SEQ ID NO: 124120 - RNA, 19 nt, Homo sapiens
acaacaauccuucuauucu

SEQ ID NO: 124121 - RNA, 19 nt, Homo sapiens
gguaaaacagggccacaua

SEQ ID NO: 124122 - RNA, 19 nt, Homo sapiens
acagguauguggugguauc

SEQ ID NO: 124123 - RNA, 19 nt, Homo sapiens
gacccuguccaaucuuuga

SEQ ID NO: 124124 - RNA, 19 nt, Homo sapiens
guccuuaggccucugagaa

SEQ ID NO: 124125 - RNA, 19 nt, Homo sapiens
ccugaggccuagacucugu

SEQ ID NO: 124126 - RNA, 19 nt, Homo sapiens
aggcugagguccugauaag

SEQ ID NO: 124127 - RNA, 19 nt, Homo sapiens
ucccuucucuacacucuug

SEQ ID NO: 124128 - RNA, 19 nt, Homo sapiens
ugauggagccuucccaagu

SEQ ID NO: 124129 - RNA, 19 nt, Homo sapiens
gaggagcuagacacaguga

SEQ ID NO: 124130 - RNA, 19 nt, Homo sapiens
gagcuuaagaaccauugau

SEQ ID NO: 124131 - RNA, 19 nt, Homo sapiens
aacaauccuucuauucuag

SEQ ID NO: 124132 - RNA, 19 nt, Homo sapiens
cacaacaauccuucuauuc

SEQ ID NO: 124133 - RNA, 19 nt, Homo sapiens
gaaaugcugugucuucgua

SEQ ID NO: 124134 - RNA, 19 nt, Homo sapiens
ggacagcacuucccugaga

SEQ ID NO: 124135 - RNA, 19 nt, Homo sapiens
gcaaccaucaccagaauua

SEQ ID NO: 124136 - RNA, 19 nt, Homo sapiens
gcaccugccucuacaguug

SEQ ID NO: 124137 - RNA, 19 nt, Homo sapiens
gaagacaccaccauucuga

SEQ ID NO: 124138 - RNA, 19 nt, Homo sapiens
agaaggagcuggacacugu

SEQ ID NO: 124139 - RNA, 19 nt, Homo sapiens
ggccagagcuugaccuuca

SEQ ID NO: 124140 - RNA, 19 nt, Homo sapiens
gaucucagcucacuacaac

SEQ ID NO: 124141 - RNA, 19 nt, Homo sapiens
gcagcuuuauggagauaua

SEQ ID NO: 124142 - RNA, 19 nt, Homo sapiens
gugcugggauuaacaggua

SEQ ID NO: 124143 - RNA, 19 nt, Homo sapiens
gaagaagacaccaccauuc

SEQ ID NO: 124144 - RNA, 19 nt, Homo sapiens
caccacgccuggcuaauuu

SEQ ID NO: 124145 - RNA, 19 nt, Homo sapiens
ccgaguagcugggacuaua

SEQ ID NO: 124146 - RNA, 19 nt, Homo sapiens
ccacauccagccuaacuua

SEQ ID NO: 124147 - RNA, 19 nt, Homo sapiens
ucgaaugacuucuagugua

SEQ ID NO: 124148 - RNA, 19 nt, Homo sapiens
ggagaagauugucaaccuu

SEQ ID NO: 124149 - RNA, 19 nt, Homo sapiens
cgaaugacuucuaguguag

SEQ ID NO: 124150 - RNA, 19 nt, Homo sapiens
gugagaagaugaugcuguu

SEQ ID NO: 124151 - RNA, 19 nt, Homo sapiens
gcacuucgacccuuacaau

SEQ ID NO: 124152 - RNA, 19 nt, Homo sapiens
ggauuugccuucucuaaac

SEQ ID NO: 124153 - RNA, 19 nt, Homo sapiens
ggacucagcccuuguuucu

SEQ ID NO: 124154 - RNA, 19 nt, Homo sapiens
cagccuaacuuacauucuu

SEQ ID NO: 124155 - RNA, 19 nt, Homo sapiens
agaggaagauccagaagga

SEQ ID NO: 124156 - RNA, 19 nt, Homo sapiens
caccauggccagcuaauuu

SEQ ID NO: 124157 - RNA, 19 nt, Homo sapiens
gagaagaugaugcuguuug

SEQ ID NO: 124158 - RNA, 19 nt, Homo sapiens
aagaaacccugcacccauu

SEQ ID NO: 124159 - RNA, 19 nt, Homo sapiens
gaaagcagccuggccaaca

SEQ ID NO: 124160 - RNA, 19 nt, Homo sapiens
ggagcacuaucaggacuuu

SEQ ID NO: 124161 - RNA, 19 nt, Homo sapiens
gggaaguccuggccaagug

SEQ ID NO: 124162 - RNA, 19 nt, Homo sapiens
uaucaggacuuugacaaga

SEQ ID NO: 124163 - RNA, 19 nt, Homo sapiens
ggagugcaguggcaucauc

SEQ ID NO: 124164 - RNA, 19 nt, Homo sapiens
gagcaggauuugacacagu

SEQ ID NO: 124165 - RNA, 19 nt, Homo sapiens
ucauguaccuugugaccaa

SEQ ID NO: 124166 - RNA, 19 nt, Homo sapiens
ccauauaauucaccuucuu

SEQ ID NO: 124167 - RNA, 19 nt, Homo sapiens
gccaagagccugagugaca

SEQ ID NO: 124168 - RNA, 19 nt, Homo sapiens
ggagugcaguggcgugauc

SEQ ID NO: 124169 - RNA, 19 nt, Homo sapiens
agaaugcccucaacaccuu

SEQ ID NO: 124170 - RNA, 19 nt, Homo sapiens
gugcaaccaucaccagaau

SEQ ID NO: 124171 - RNA, 19 nt, Homo sapiens
gcuaaucuacuuucugugu

SEQ ID NO: 124172 - RNA, 19 nt, Homo sapiens
gagacggguuucaccaugu

SEQ ID NO: 124173 - RNA, 19 nt, Homo sapiens
caagcaauccucccacuuc

SEQ ID NO: 124174 - RNA, 19 nt, Homo sapiens
ccuggcaacugcuaaucua

SEQ ID NO: 124175 - RNA, 19 nt, Homo sapiens
caucacgggugcccuguuc

SEQ ID NO: 124176 - RNA, 19 nt, Homo sapiens
uuacaagcaugagucacua

SEQ ID NO: 124177 - RNA, 19 nt, Homo sapiens
ugaagaagacaccaccauu

SEQ ID NO: 124178 - RNA, 19 nt, Homo sapiens
gcgcuucuccaucaauuga

SEQ ID NO: 124179 - RNA, 19 nt, Homo sapiens
ucaagcaccugccucuaca

SEQ ID NO: 124180 - RNA, 19 nt, Homo sapiens
cugcuaaucuacuuucugu

SEQ ID NO: 124181 - RNA, 19 nt, Homo sapiens
ggcaacugcuaaucuacuu

SEQ ID NO: 124182 - RNA, 19 nt, Homo sapiens
ccaagcaccugggauuaca

SEQ ID NO: 124183 - RNA, 19 nt, Homo sapiens
ugaccaagccugagauaca

SEQ ID NO: 124184 - RNA, 19 nt, Homo sapiens
ccuccacccucaucacuga

SEQ ID NO: 124185 - RNA, 19 nt, Homo sapiens
uagcagucccuccacauuu

SEQ ID NO: 124186 - RNA, 19 nt, Homo sapiens
ccaaagugcugggauuaac

SEQ ID NO: 124187 - RNA, 19 nt, Homo sapiens
agacgagguuucacugugu

SEQ ID NO: 124188 - RNA, 19 nt, Homo sapiens
ccaaaguccugggauuaca

SEQ ID NO: 124189 - RNA, 19 nt, Homo sapiens
ccaccacgccuggcuaauu

SEQ ID NO: 124190 - RNA, 19 nt, Homo sapiens
agccuaacuuacauucuua

SEQ ID NO: 124191 - RNA, 19 nt, Homo sapiens
ucacuacgccuggcugauu

SEQ ID NO: 124192 - RNA, 19 nt, Homo sapiens
gauuugccuucucuaaaca

SEQ ID NO: 124193 - RNA, 19 nt, Homo sapiens
cauuugagcccaggaauug

SEQ ID NO: 124194 - RNA, 19 nt, Homo sapiens
ucuacgggcugaccaugaa

SEQ ID NO: 124195 - RNA, 19 nt, Homo sapiens
cacuacgccuggcugauuu

SEQ ID NO: 124196 - RNA, 19 nt, Homo sapiens
uagcagcuuuauggagaua

SEQ ID NO: 124197 - RNA, 19 nt, Homo sapiens
gggacccugucucuacaaa

SEQ ID NO: 124198 - RNA, 19 nt, Homo sapiens
gcagggcgacgauuucaag

SEQ ID NO: 124199 - RNA, 19 nt, Homo sapiens
ucaaacuccugaccucaag

SEQ ID NO: 124200 - RNA, 19 nt, Homo sapiens
uggccaggcuugucucgaa

SEQ ID NO: 124201 - RNA, 19 nt, Homo sapiens
uuacaacccugccaaucuc

SEQ ID NO: 124202 - RNA, 19 nt, Homo sapiens
ggagcuggacacugugauu

SEQ ID NO: 124203 - RNA, 19 nt, Homo sapiens
gaccaagccugagauacag

SEQ ID NO: 124204 - RNA, 19 nt, Homo sapiens
caacugcuaaucuacuuuc

SEQ ID NO: 124205 - RNA, 19 nt, Homo sapiens
gacgagguuucacuguguu

SEQ ID NO: 124206 - RNA, 19 nt, Homo sapiens
gccaccacauccagccuaa

SEQ ID NO: 124207 - RNA, 19 nt, Homo sapiens
ucugggugcucaaggguuu

SEQ ID NO: 124208 - RNA, 19 nt, Homo sapiens
ccucgcagguucaagcaau

SEQ ID NO: 124209 - RNA, 19 nt, Homo sapiens
cccaagaaaugcugugucu

SEQ ID NO: 124210 - RNA, 19 nt, Homo sapiens
gagcuggacacugugauug

SEQ ID NO: 124211 - RNA, 19 nt, Homo sapiens
aaacaguccaggagcacua

SEQ ID NO: 124212 - RNA, 19 nt, Homo sapiens
gcaacugcuaaucuacuuu

SEQ ID NO: 124213 - RNA, 19 nt, Homo sapiens
agacggguuucaccauguu

SEQ ID NO: 124214 - RNA, 19 nt, Homo sapiens
agaagaugaugcuguuugg

SEQ ID NO: 124215 - RNA, 19 nt, Homo sapiens
uugucaaccuugucaauga

SEQ ID NO: 124216 - RNA, 19 nt, Homo sapiens
gggauuaacagguaugaac

SEQ ID NO: 124217 - RNA, 19 nt, Homo sapiens
aagcaauccucccacuuca

SEQ ID NO: 124218 - RNA, 19 nt, Homo sapiens
acucagcccuuguuucucu

SEQ ID NO: 124219 - RNA, 19 nt, Homo sapiens
cuccaucaauugaagaaga

SEQ ID NO: 124220 - RNA, 19 nt, Homo sapiens
gcacaacaagggacacaac

SEQ ID NO: 124221 - RNA, 19 nt, Homo sapiens
gcaccugggauuacaagca

SEQ ID NO: 124222 - RNA, 19 nt, Homo sapiens
aguggcaggucaaccauga

SEQ ID NO: 124223 - RNA, 19 nt, Homo sapiens
caucuuuggagcaggauuu

SEQ ID NO: 124224 - RNA, 19 nt, Homo sapiens
auauauagcagcuuuaugg

SEQ ID NO: 124225 - RNA, 19 nt, Homo sapiens
gcaagaccccaucucaaaa

SEQ ID NO: 124226 - RNA, 19 nt, Homo sapiens
aaagcagccuggccaacau

SEQ ID NO: 124227 - RNA, 19 nt, Homo sapiens
gaucauuugagcccaggaa

SEQ ID NO: 124228 - RNA, 19 nt, Homo sapiens
cggcgcuucuccaucaauu

SEQ ID NO: 124229 - RNA, 19 nt, Homo sapiens
agaaacccugcacccauua

SEQ ID NO: 124230 - RNA, 19 nt, Homo sapiens
caaagugcugggauuaaca

SEQ ID NO: 124231 - RNA, 19 nt, Homo sapiens
cauccagccuaacuuacau

SEQ ID NO: 124232 - RNA, 19 nt, Homo sapiens
cuccugaccucaagugauc

SEQ ID NO: 124233 - RNA, 19 nt, Homo sapiens
gcauaaagcucaaaugaaa

SEQ ID NO: 124234 - RNA, 19 nt, Homo sapiens
ggacagaacucccauuaca

SEQ ID NO: 124235 - RNA, 19 nt, Homo sapiens
gaguuuaccuggcuuauuu

SEQ ID NO: 124236 - RNA, 19 nt, Homo sapiens
gaacucccauuacaacuga

SEQ ID NO: 124237 - RNA, 19 nt, Homo sapiens
gcaauuaaacuuccaaaga

SEQ ID NO: 124238 - RNA, 19 nt, Homo sapiens
ggaaagaugguuaaacauu

SEQ ID NO: 124239 - RNA, 19 nt, Homo sapiens
cagccaagcuuuaaauuau

SEQ ID NO: 124240 - RNA, 19 nt, Homo sapiens
gcauggacauuuagaagaa

SEQ ID NO: 124241 - RNA, 19 nt, Homo sapiens
uaaagggcccaaugaauua

SEQ ID NO: 124242 - RNA, 19 nt, Homo sapiens
guaaggugcuuggaguuua

SEQ ID NO: 124243 - RNA, 19 nt, Homo sapiens
caaucuggaugccucauua

SEQ ID NO: 124244 - RNA, 19 nt, Homo sapiens
gaagagacagagacaagua

SEQ ID NO: 124245 - RNA, 19 nt, Homo sapiens
gaggcaagcugaaauuuua

SEQ ID NO: 124246 - RNA, 19 nt, Homo sapiens
caguaagucucauagguua

SEQ ID NO: 124247 - RNA, 19 nt, Homo sapiens
gaagguagcauucuuugga

SEQ ID NO: 124248 - RNA, 19 nt, Homo sapiens
uaacauuaaugccugcuuu

SEQ ID NO: 124249 - RNA, 19 nt, Homo sapiens
gaaguuaguggaaaucuga

SEQ ID NO: 124250 - RNA, 19 nt, Homo sapiens
caagauuggucucccauau

SEQ ID NO: 124251 - RNA, 19 nt, Homo sapiens
gaauuucaguuauggucua

SEQ ID NO: 124252 - RNA, 19 nt, Homo sapiens
cagaguauauuguugaaga

SEQ ID NO: 124253 - RNA, 19 nt, Homo sapiens
gaugugcuauaaucuguuu

SEQ ID NO: 124254 - RNA, 19 nt, Homo sapiens
uauguagccuuuacuguuu

SEQ ID NO: 124255 - RNA, 19 nt, Homo sapiens
uagcuguacuucuugaaua

SEQ ID NO: 124256 - RNA, 19 nt, Homo sapiens
acaccaaacuacugaauga

SEQ ID NO: 124257 - RNA, 19 nt, Homo sapiens
cauaauagcuacagugcau

SEQ ID NO: 124258 - RNA, 19 nt, Homo sapiens
gagaugaggucaguugugu

SEQ ID NO: 124259 - RNA, 19 nt, Homo sapiens
ccuaguagaucuauauuag

SEQ ID NO: 124260 - RNA, 19 nt, Homo sapiens
cguaagcaguauauuagua

SEQ ID NO: 124261 - RNA, 19 nt, Homo sapiens
ccauggagcuccuugauag

SEQ ID NO: 124262 - RNA, 19 nt, Homo sapiens
cagaaacccucauuguguu

SEQ ID NO: 124263 - RNA, 19 nt, Homo sapiens
gcaagggcaugggaauuga

SEQ ID NO: 124264 - RNA, 19 nt, Homo sapiens
gaugaggucaguuguguuu

SEQ ID NO: 124265 - RNA, 19 nt, Homo sapiens
ggaaggcagagaaaucuaa

SEQ ID NO: 124266 - RNA, 19 nt, Homo sapiens
gacaaguaauuucagugua

SEQ ID NO: 124267 - RNA, 19 nt, Homo sapiens
ccaaacuacugaaugaaga

SEQ ID NO: 124268 - RNA, 19 nt, Homo sapiens
agaaagcuguguuuauaug

SEQ ID NO: 124269 - RNA, 19 nt, Homo sapiens
uuucauagcuguacuucuu

SEQ ID NO: 124270 - RNA, 19 nt, Homo sapiens
aaggaaagaugguuaaaca

SEQ ID NO: 124271 - RNA, 19 nt, Homo sapiens
caccaaauagugugaaaua

SEQ ID NO: 124272 - RNA, 19 nt, Homo sapiens
uuaaagggcccaaugaauu

SEQ ID NO: 124273 - RNA, 19 nt, Homo sapiens
ugaccaaguuucucuucua

SEQ ID NO: 124274 - RNA, 19 nt, Homo sapiens
ccaaguuucucuucuagau

SEQ ID NO: 124275 - RNA, 19 nt, Homo sapiens
ugaauuaccuggauguucu

SEQ ID NO: 124276 - RNA, 19 nt, Homo sapiens
guagcauucuuuggaguua

SEQ ID NO: 124277 - RNA, 19 nt, Homo sapiens
ucccagaacuuagccuuua

SEQ ID NO: 124278 - RNA, 19 nt, Homo sapiens
ccauuaaagucagaaguuu

SEQ ID NO: 124279 - RNA, 19 nt, Homo sapiens
guggaaaucugaacauucu

SEQ ID NO: 124280 - RNA, 19 nt, Homo sapiens
cagcgguucuucaugagua

SEQ ID NO: 124281 - RNA, 19 nt, Homo sapiens
gaccauaauguacugauuu

SEQ ID NO: 124282 - RNA, 19 nt, Homo sapiens
ccagccaagcuuuaaauua

SEQ ID NO: 124283 - RNA, 19 nt, Homo sapiens
agacagagacaaguaauuu

SEQ ID NO: 124284 - RNA, 19 nt, Homo sapiens
gaauuuggaggcuggagua

SEQ ID NO: 124285 - RNA, 19 nt, Homo sapiens
gcaucuugguuauuucuga

SEQ ID NO: 124286 - RNA, 19 nt, Homo sapiens
gagaauguauuugcugaca

SEQ ID NO: 124287 - RNA, 19 nt, Homo sapiens
ggaagaaaguaaggugcuu

SEQ ID NO: 124288 - RNA, 19 nt, Homo sapiens
gaaaagagagaaacacuga

SEQ ID NO: 124289 - RNA, 19 nt, Homo sapiens
cuuggaagcuguuuggaaa

SEQ ID NO: 124290 - RNA, 19 nt, Homo sapiens
gaacguaccggccacuauc

SEQ ID NO: 124291 - RNA, 19 nt, Homo sapiens
guccagaugugcuauaauc

SEQ ID NO: 124292 - RNA, 19 nt, Homo sapiens
ccauuaaacccaagucauu

SEQ ID NO: 124293 - RNA, 19 nt, Homo sapiens
gaauguauuugcugacaac

SEQ ID NO: 124294 - RNA, 19 nt, Homo sapiens
ucagaaacccucauugugu

SEQ ID NO: 124295 - RNA, 19 nt, Homo sapiens
gauggcaauuacuuuggua

SEQ ID NO: 124296 - RNA, 19 nt, Homo sapiens
cccaaacacuuacaccaaa

SEQ ID NO: 124297 - RNA, 19 nt, Homo sapiens
caagaggcaagcugaaauu

SEQ ID NO: 124298 - RNA, 19 nt, Homo sapiens
ggaaacuugccaauaagaa

SEQ ID NO: 124299 - RNA, 19 nt, Homo sapiens
aaagaugucucagguuugu

SEQ ID NO: 124300 - RNA, 19 nt, Homo sapiens
gcccaguacauuuaaauuu

SEQ ID NO: 124301 - RNA, 19 nt, Homo sapiens
uucaaagcauggacauuua

SEQ ID NO: 124302 - RNA, 19 nt, Homo sapiens
gaccaaguuucucuucuag

SEQ ID NO: 124303 - RNA, 19 nt, Homo sapiens
ucucccauaugcagaaaua

SEQ ID NO: 124304 - RNA, 19 nt, Homo sapiens
uaaaucaacuguccaucag

SEQ ID NO: 124305 - RNA, 19 nt, Homo sapiens
caaaugagccugcgaaaau

SEQ ID NO: 124306 - RNA, 19 nt, Homo sapiens
ggacaccauuaccaaaaua

SEQ ID NO: 124307 - RNA, 19 nt, Homo sapiens
uagcuacagugcauaguug

SEQ ID NO: 124308 - RNA, 19 nt, Homo sapiens
aaagaaggaaagaugguua

SEQ ID NO: 124309 - RNA, 19 nt, Homo sapiens
guccguaagcaguauauua

SEQ ID NO: 124310 - RNA, 19 nt, Homo sapiens
gcacauauagacacauaca

SEQ ID NO: 124311 - RNA, 19 nt, Homo sapiens
gcaagaggcaagcugaaau

SEQ ID NO: 124312 - RNA, 19 nt, Homo sapiens
ggagagagaauguauuugc

SEQ ID NO: 124313 - RNA, 19 nt, Homo sapiens
agaaauguguagcugcaaa

SEQ ID NO: 124314 - RNA, 19 nt, Homo sapiens
aaagagagaaacacugaaa

SEQ ID NO: 124315 - RNA, 19 nt, Homo sapiens
uaagauggcaauuacuuug

SEQ ID NO: 124316 - RNA, 19 nt, Homo sapiens
gaaagucagaaucagaaga

SEQ ID NO: 124317 - RNA, 19 nt, Homo sapiens
ugauccagcucgauucuug

SEQ ID NO: 124318 - RNA, 19 nt, Homo sapiens
guagcagaguuaaaucuca

SEQ ID NO: 124319 - RNA, 19 nt, Homo sapiens
aagcauaaagcucaaauga

SEQ ID NO: 124320 - RNA, 19 nt, Homo sapiens
acuccaaggugauguugua

SEQ ID NO: 124321 - RNA, 19 nt, Homo sapiens
gagaaacacugaaaagaag

SEQ ID NO: 124322 - RNA, 19 nt, Homo sapiens
gaaagcauaaagcucaaau

SEQ ID NO: 124323 - RNA, 19 nt, Homo sapiens
cuucggagaugaggaguaa

SEQ ID NO: 124324 - RNA, 19 nt, Homo sapiens
aaacccaagucauuuaaag

SEQ ID NO: 124325 - RNA, 19 nt, Homo sapiens
gaccugaccagcagaguga

SEQ ID NO: 124326 - RNA, 19 nt, Homo sapiens
gaguuaaagcuuccaguga

SEQ ID NO: 124327 - RNA, 19 nt, Homo sapiens
caacuaacgcaaccaagug

SEQ ID NO: 124328 - RNA, 19 nt, Homo sapiens
acauacacccaaacacuua

SEQ ID NO: 124329 - RNA, 19 nt, Homo sapiens
gcagaucuguuuugugguu

SEQ ID NO: 124330 - RNA, 19 nt, Homo sapiens
guaagucucauagguuaaa

SEQ ID NO: 124331 - RNA, 19 nt, Homo sapiens
gccaagcuuuaaauuaugu

SEQ ID NO: 124332 - RNA, 19 nt, Homo sapiens
ugguauacuuccuuacuuu

SEQ ID NO: 124333 - RNA, 19 nt, Homo sapiens
gaaacuaccugcagcugaa

SEQ ID NO: 124334 - RNA, 19 nt, Homo sapiens
gaauggagcucuuucucuu

SEQ ID NO: 124335 - RNA, 19 nt, Homo sapiens
ccacgaaacuacaccauga

SEQ ID NO: 124336 - RNA, 19 nt, Homo sapiens
ggacuucauugacuccuuu

SEQ ID NO: 124337 - RNA, 19 nt, Homo sapiens
caaaggcuauggcguggua

SEQ ID NO: 124338 - RNA, 19 nt, Homo sapiens
gcuaugaagaguaguaaua

SEQ ID NO: 124339 - RNA, 19 nt, Homo sapiens
ccaagaagguggagcacaa

SEQ ID NO: 124340 - RNA, 19 nt, Homo sapiens
gcaccgaaguguucccuau

SEQ ID NO: 124341 - RNA, 19 nt, Homo sapiens
guaauaauagcagcucuua

SEQ ID NO: 124342 - RNA, 19 nt, Homo sapiens
gaagaucagugagcgcuau

SEQ ID NO: 124343 - RNA, 19 nt, Homo sapiens
ggaccaggcugaggaguuc

SEQ ID NO: 124344 - RNA, 19 nt, Homo sapiens
gggaagagaagaaacagaa

SEQ ID NO: 124345 - RNA, 19 nt, Homo sapiens
gaaacuacaccaugagcuu

SEQ ID NO: 124346 - RNA, 19 nt, Homo sapiens
acacggaguucuacuugaa

SEQ ID NO: 124347 - RNA, 19 nt, Homo sapiens
acacagagcagauguacaa

SEQ ID NO: 124348 - RNA, 19 nt, Homo sapiens
caucagcuccauugucuuu

SEQ ID NO: 124349 - RNA, 19 nt, Homo sapiens
gcggaacuguuucggagaa

SEQ ID NO: 124350 - RNA, 19 nt, Homo sapiens
caacacggaguucuacuug

SEQ ID NO: 124351 - RNA, 19 nt, Homo sapiens
aaacagaagcggcucaguu

SEQ ID NO: 124352 - RNA, 19 nt, Homo sapiens
gauguucucuucggugaug

SEQ ID NO: 124353 - RNA, 19 nt, Homo sapiens
guacaacucccucaugaag

SEQ ID NO: 124354 - RNA, 19 nt, Homo sapiens
ccauugcccuucauuggaa

SEQ ID NO: 124355 - RNA, 19 nt, Homo sapiens
aggaaacccuuacauuaug

SEQ ID NO: 124356 - RNA, 19 nt, Homo sapiens
gcucaguucaccuugauaa

SEQ ID NO: 124357 - RNA, 19 nt, Homo sapiens
ggaaagggcagggccaaga

SEQ ID NO: 124358 - RNA, 19 nt, Homo sapiens
gaaccggcagcccaaguuu

SEQ ID NO: 124359 - RNA, 19 nt, Homo sapiens
caagguccaugaggagauu

SEQ ID NO: 124360 - RNA, 19 nt, Homo sapiens
ucggaaagcggaacuguuu

SEQ ID NO: 124361 - RNA, 19 nt, Homo sapiens
uuaagaagagugaugcuuu

SEQ ID NO: 124362 - RNA, 19 nt, Homo sapiens
acaccaaguuucgggauuu

SEQ ID NO: 124363 - RNA, 19 nt, Homo sapiens
ccacgggacuucauugacu

SEQ ID NO: 124364 - RNA, 19 nt, Homo sapiens
acaaagaguuccugucacu

SEQ ID NO: 124365 - RNA, 19 nt, Homo sapiens
gaacacagagcagauguac

SEQ ID NO: 124366 - RNA, 19 nt, Homo sapiens
ggagcucuuucucuucuuc

SEQ ID NO: 124367 - RNA, 19 nt, Homo sapiens
ccacgagauccaaagauuu

SEQ ID NO: 124368 - RNA, 19 nt, Homo sapiens
gggaccgcuuugacuauaa

SEQ ID NO: 124369 - RNA, 19 nt, Homo sapiens
ggaaacccuuacauuaugc

SEQ ID NO: 124370 - RNA, 19 nt, Homo sapiens
acaacucccucaugaagau

SEQ ID NO: 124371 - RNA, 19 nt, Homo sapiens
gaagaguaguaauaauagc

SEQ ID NO: 124372 - RNA, 19 nt, Homo sapiens
gaagagugaugcuuuugug

SEQ ID NO: 124373 - RNA, 19 nt, Homo sapiens
uaagaagagugaugcuuuu

SEQ ID NO: 124374 - RNA, 19 nt, Homo sapiens
gggcagcucuaugagaugu

SEQ ID NO: 124375 - RNA, 19 nt, Homo sapiens
ccagucaccuaaggacauu

SEQ ID NO: 124376 - RNA, 19 nt, Homo sapiens
gacaccaaguuucgggauu

SEQ ID NO: 124377 - RNA, 19 nt, Homo sapiens
ucucuucggugaugaaaca

SEQ ID NO: 124378 - RNA, 19 nt, Homo sapiens
ggaccgcuuugacuauaag

SEQ ID NO: 124379 - RNA, 19 nt, Homo sapiens
cagagcagauguacaacuc

SEQ ID NO: 124380 - RNA, 19 nt, Homo sapiens
gucaucagcuccauugucu

SEQ ID NO: 124381 - RNA, 19 nt, Homo sapiens
uccacgagauccaaagauu

SEQ ID NO: 124382 - RNA, 19 nt, Homo sapiens
gcagcucuaugagauguuc

SEQ ID NO: 124383 - RNA, 19 nt, Homo sapiens
uaagggcaccgaaguguuc

SEQ ID NO: 124384 - RNA, 19 nt, Homo sapiens
ucaccaccgucaugcagaa

SEQ ID NO: 124385 - RNA, 19 nt, Homo sapiens
gcaggauggcggaaaggaa

SEQ ID NO: 124386 - RNA, 19 nt, Homo sapiens
ccaagaugcccuacaugga

SEQ ID NO: 124387 - RNA, 19 nt, Homo sapiens
ugcaagggcuggaggacuu

SEQ ID NO: 124388 - RNA, 19 nt, Homo sapiens
gcugggcucugugcugaga

SEQ ID NO: 124389 - RNA, 19 nt, Homo sapiens
gauguacaacucccucaug

SEQ ID NO: 124390 - RNA, 19 nt, Homo sapiens
acagagugaucggcaagaa

SEQ ID NO: 124391 - RNA, 19 nt, Homo sapiens
gaggagauugacagaguga

SEQ ID NO: 124392 - RNA, 19 nt, Homo sapiens
gcuucuugcugcucaugaa

SEQ ID NO: 124393 - RNA, 19 nt, Homo sapiens
ugacuguaauggucuugau

SEQ ID NO: 124394 - RNA, 19 nt, Homo sapiens
ggagauugacagagugauc

SEQ ID NO: 124395 - RNA, 19 nt, Homo sapiens
gcuagagggaagagaagaa

SEQ ID NO: 124396 - RNA, 19 nt, Homo sapiens
ccucaaguccucccaguca

SEQ ID NO: 124397 - RNA, 19 nt, Homo sapiens
aaagaguuccugucacugu

SEQ ID NO: 124398 - RNA, 19 nt, Homo sapiens
gcggcucaguucaccuuga

SEQ ID NO: 124399 - RNA, 19 nt, Homo sapiens
ccaccgucaugcagaacuu

SEQ ID NO: 124400 - RNA, 19 nt, Homo sapiens
cccagcacuuccugaauga

SEQ ID NO: 124401 - RNA, 19 nt, Homo sapiens
gcacgcuggaucccaauuc

SEQ ID NO: 124402 - RNA, 19 nt, Homo sapiens
gcaugcaggaggaggagaa

SEQ ID NO: 124403 - RNA, 19 nt, Homo sapiens
cuuccgagcugggaugaga

SEQ ID NO: 124404 - RNA, 19 nt, Homo sapiens
aagaguuccugucacuguu

SEQ ID NO: 124405 - RNA, 19 nt, Homo sapiens
ggaagagaagaaacagaag

SEQ ID NO: 124406 - RNA, 19 nt, Homo sapiens
gcagaacuuccgccucaag

SEQ ID NO: 124407 - RNA, 19 nt, Homo sapiens
auguacaacucccucauga

SEQ ID NO: 124408 - RNA, 19 nt, Homo sapiens
gaaagggcagggccaagac

SEQ ID NO: 124409 - RNA, 19 nt, Homo sapiens
gagaaggggcaguuuaaga

SEQ ID NO: 124410 - RNA, 19 nt, Homo sapiens
augaggagauugacagagu

SEQ ID NO: 124411 - RNA, 19 nt, Homo sapiens
ccaacacggaguucuacuu

SEQ ID NO: 124412 - RNA, 19 nt, Homo sapiens
uucauugacuccuuucuca

SEQ ID NO: 124413 - RNA, 19 nt, Homo sapiens
ggggaccgcuuugacuaua

SEQ ID NO: 124414 - RNA, 19 nt, Homo sapiens
gcuauggcgugguauucag

SEQ ID NO: 124415 - RNA, 19 nt, Homo sapiens
gggaugagaggaaggaaac

SEQ ID NO: 124416 - RNA, 19 nt, Homo sapiens
cagcacuuccugaaugaga

SEQ ID NO: 124417 - RNA, 19 nt, Homo sapiens
cuacauggaggcagugauc

SEQ ID NO: 124418 - RNA, 19 nt, Homo sapiens
ugaccacguugaaccucuu

SEQ ID NO: 124419 - RNA, 19 nt, Homo sapiens
acuauaaggacaaagaguu

SEQ ID NO: 124420 - RNA, 19 nt, Homo sapiens
cgcacagucuccaauguca

SEQ ID NO: 124421 - RNA, 19 nt, Homo sapiens
acccuuacauuaugcuaug

SEQ ID NO: 124422 - RNA, 19 nt, Homo sapiens
cggcucaguucaccuugau

SEQ ID NO: 124423 - RNA, 19 nt, Homo sapiens
gcccuucauuggaaacuac

SEQ ID NO: 124424 - RNA, 19 nt, Homo sapiens
ugaacacagagcagaugua

SEQ ID NO: 124425 - RNA, 19 nt, Homo sapiens
gggacuucauugacuccuu

SEQ ID NO: 124426 - RNA, 19 nt, Homo sapiens
aacagaagcggcucaguuc

SEQ ID NO: 124427 - RNA, 19 nt, Homo sapiens
ccaaguuucgggauuucuu

SEQ ID NO: 124428 - RNA, 19 nt, Homo sapiens
ccacggggcagcucuauga

SEQ ID NO: 124429 - RNA, 19 nt, Homo sapiens
cuagagggaagagaagaaa

SEQ ID NO: 124430 - RNA, 19 nt, Homo sapiens
gccgcacagucuccaaugu

SEQ ID NO: 124431 - RNA, 19 nt, Homo sapiens
uaauggucuugaugucugu

SEQ ID NO: 124432 - RNA, 19 nt, Homo sapiens
ggccagaauggagcucuuu

SEQ ID NO: 124433 - RNA, 19 nt, Homo sapiens
gaaacuaccuccagcugaa

SEQ ID NO: 124434 - RNA, 19 nt, Homo sapiens
gaauggagcucuuucucuu

SEQ ID NO: 124435 - RNA, 19 nt, Homo sapiens
ccacgaaacuacaccauga

SEQ ID NO: 124436 - RNA, 19 nt, Homo sapiens
gaacacagagcacauaugu

SEQ ID NO: 124437 - RNA, 19 nt, Homo sapiens
ggaagaggcggguauaaga

SEQ ID NO: 124438 - RNA, 19 nt, Homo sapiens
gcuaugaagaguaguaaua

SEQ ID NO: 124439 - RNA, 19 nt, Homo sapiens
ggaccaagaugcccuacau

SEQ ID NO: 124440 - RNA, 19 nt, Homo sapiens
ccaagaagguggagcacaa

SEQ ID NO: 124441 - RNA, 19 nt, Homo sapiens
gcaccgaaguguucccuau

SEQ ID NO: 124442 - RNA, 19 nt, Homo sapiens
ccacugcccuucauuggaa

SEQ ID NO: 124443 - RNA, 19 nt, Homo sapiens
guaauaauagcagcucuua

SEQ ID NO: 124444 - RNA, 19 nt, Homo sapiens
gaagaggcggguauaagaa

SEQ ID NO: 124445 - RNA, 19 nt, Homo sapiens
guaguugggaggugaaaua

SEQ ID NO: 124446 - RNA, 19 nt, Homo sapiens
ggaccaggcugaggaguuc

SEQ ID NO: 124447 - RNA, 19 nt, Homo sapiens
gaaguucagugagugcuau

SEQ ID NO: 124448 - RNA, 19 nt, Homo sapiens
cagaagaccuccagaugca

SEQ ID NO: 124449 - RNA, 19 nt, Homo sapiens
gggaagagaagaaacagaa

SEQ ID NO: 124450 - RNA, 19 nt, Homo sapiens
gaaacuacaccaugagcuu

SEQ ID NO: 124451 - RNA, 19 nt, Homo sapiens
ugaagaaccugaugaugag

SEQ ID NO: 124452 - RNA, 19 nt, Homo sapiens
acacggaguucuacuugaa

SEQ ID NO: 124453 - RNA, 19 nt, Homo sapiens
gcaaauauuccaaacucuu

SEQ ID NO: 124454 - RNA, 19 nt, Homo sapiens
caucagcuccauugucuuu

SEQ ID NO: 124455 - RNA, 19 nt, Homo sapiens
agggaaaccuuacauuaug

SEQ ID NO: 124456 - RNA, 19 nt, Homo sapiens
gcggaacuguuucggagaa

SEQ ID NO: 124457 - RNA, 19 nt, Homo sapiens
caacacggaguucuacuug

SEQ ID NO: 124458 - RNA, 19 nt, Homo sapiens
gaggugaaauaaggugauu

SEQ ID NO: 124459 - RNA, 19 nt, Homo sapiens
aaacagaagcggcucaguu

SEQ ID NO: 124460 - RNA, 19 nt, Homo sapiens
ggaagaugcgggaaaggaa

SEQ ID NO: 124461 - RNA, 19 nt, Homo sapiens
ggacuucaucgacuccuuu

SEQ ID NO: 124462 - RNA, 19 nt, Homo sapiens
gauguucucuucggugaug

SEQ ID NO: 124463 - RNA, 19 nt, Homo sapiens
guaauuagccaaaguccau

SEQ ID NO: 124464 - RNA, 19 nt, Homo sapiens
gcucaguucaccuugauaa

SEQ ID NO: 124465 - RNA, 19 nt, Homo sapiens
gaaccggcagcccaaguuu

SEQ ID NO: 124466 - RNA, 19 nt, Homo sapiens
caagguccaugaggagauu

SEQ ID NO: 124467 - RNA, 19 nt, Homo sapiens
ucggaaagcggaacuguuu

SEQ ID NO: 124468 - RNA, 19 nt, Homo sapiens
caagcuagguggcauucau

SEQ ID NO: 124469 - RNA, 19 nt, Homo sapiens
uuaagaagagugaugcuuu

SEQ ID NO: 124470 - RNA, 19 nt, Homo sapiens
acaccaaguuucgggauuu

SEQ ID NO: 124471 - RNA, 19 nt, Homo sapiens
acaaagaguuccugucacu

SEQ ID NO: 124472 - RNA, 19 nt, Homo sapiens
ggagcucuuucucuucuuc

SEQ ID NO: 124473 - RNA, 19 nt, Homo sapiens
ccacgagauccaaagauuu

SEQ ID NO: 124474 - RNA, 19 nt, Homo sapiens
uugaagaaccugaugauga

SEQ ID NO: 124475 - RNA, 19 nt, Homo sapiens
caacagaagaccuccagau

SEQ ID NO: 124476 - RNA, 19 nt, Homo sapiens
gggaugagaggaagggaaa

SEQ ID NO: 124477 - RNA, 19 nt, Homo sapiens
cagccacacuuccaucuca

SEQ ID NO: 124478 - RNA, 19 nt, Homo sapiens
guugggaggugaaauaagg

SEQ ID NO: 124479 - RNA, 19 nt, Homo sapiens
caaauauuccaaacucuuc

SEQ ID NO: 124480 - RNA, 19 nt, Homo sapiens
gaagaguaguaauaauagc

SEQ ID NO: 124481 - RNA, 19 nt, Homo sapiens
gaagagugaugcuuuugug

SEQ ID NO: 124482 - RNA, 19 nt, Homo sapiens
uaagaagagugaugcuuuu

SEQ ID NO: 124483 - RNA, 19 nt, Homo sapiens
gggcagcucuaugagaugu

SEQ ID NO: 124484 - RNA, 19 nt, Homo sapiens
ccagucaccuaaggacauu

SEQ ID NO: 124485 - RNA, 19 nt, Homo sapiens
gacaccaaguuucgggauu

SEQ ID NO: 124486 - RNA, 19 nt, Homo sapiens
ucucuucggugaugaaaca

SEQ ID NO: 124487 - RNA, 19 nt, Homo sapiens
gugacuccaucaugaaguu

SEQ ID NO: 124488 - RNA, 19 nt, Homo sapiens
gucaucagcuccauugucu

SEQ ID NO: 124489 - RNA, 19 nt, Homo sapiens
uccacgagauccaaagauu

SEQ ID NO: 124490 - RNA, 19 nt, Homo sapiens
gcagcucuaugagauguuc

SEQ ID NO: 124491 - RNA, 19 nt, Homo sapiens
auaugugacuccaucauga

SEQ ID NO: 124492 - RNA, 19 nt, Homo sapiens
gcugaacacagagcacaua

SEQ ID NO: 124493 - RNA, 19 nt, Homo sapiens
ggaaugcccaaauccacaa

SEQ ID NO: 124494 - RNA, 19 nt, Homo sapiens
uaagggcaccgaaguguuc

SEQ ID NO: 124495 - RNA, 19 nt, Homo sapiens
ugacugugauggucuugau

SEQ ID NO: 124496 - RNA, 19 nt, Homo sapiens
ucaccaccgucaugcagaa

SEQ ID NO: 124497 - RNA, 19 nt, Homo sapiens
gaaguaccacagauuuagu

SEQ ID NO: 124498 - RNA, 19 nt, Homo sapiens
ccaagaugcccuacaugga

SEQ ID NO: 124499 - RNA, 19 nt, Homo sapiens
ugcaagggcuggaggacuu

SEQ ID NO: 124500 - RNA, 19 nt, Homo sapiens
aaccuuacauuaugcuaug

SEQ ID NO: 124501 - RNA, 19 nt, Homo sapiens
gggaaaccuuacauuaugc

SEQ ID NO: 124502 - RNA, 19 nt, Homo sapiens
ccacagcaacaggccuuua

SEQ ID NO: 124503 - RNA, 19 nt, Homo sapiens
gggaccgcuuugacuauga

SEQ ID NO: 124504 - RNA, 19 nt, Homo sapiens
ccugaaguaccacagauuu

SEQ ID NO: 124505 - RNA, 19 nt, Homo sapiens
cuucaguucuacaguuuau

SEQ ID NO: 124506 - RNA, 19 nt, Homo sapiens
aaacccagaccuuuggauu

SEQ ID NO: 124507 - RNA, 19 nt, Homo sapiens
cugaaguaccacagauuua

SEQ ID NO: 124508 - RNA, 19 nt, Homo sapiens
gggaagaugcgggaaagga

SEQ ID NO: 124509 - RNA, 19 nt, Homo sapiens
acagagugaucggcaagaa

SEQ ID NO: 124510 - RNA, 19 nt, Homo sapiens
gaggagauugacagaguga

SEQ ID NO: 124511 - RNA, 19 nt, Homo sapiens
gcuucuugcugcucaugaa

SEQ ID NO: 124512 - RNA, 19 nt, Homo sapiens
ggagauugacagagugauc

SEQ ID NO: 124513 - RNA, 19 nt, Homo sapiens
cacagcaacaggccuuuaa

SEQ ID NO: 124514 - RNA, 19 nt, Homo sapiens
ggaccgcuuugacuaugag

SEQ ID NO: 124515 - RNA, 19 nt, Homo sapiens
gaaaccuuacauuaugcua

SEQ ID NO: 124516 - RNA, 19 nt, Homo sapiens
gcuagagggaagagaagaa

SEQ ID NO: 124517 - RNA, 19 nt, Homo sapiens
ccucaaguccucccaguca

SEQ ID NO: 124518 - RNA, 19 nt, Homo sapiens
caucgacuccuuucucauc

SEQ ID NO: 124519 - RNA, 19 nt, Homo sapiens
acucuucaguucuacaguu

SEQ ID NO: 124520 - RNA, 19 nt, Homo sapiens
gcggcucaguucaccuuga

SEQ ID NO: 124521 - RNA, 19 nt, Homo sapiens
ccaccgucaugcagaacuu

SEQ ID NO: 124522 - RNA, 19 nt, Homo sapiens
gcacgcuggaucccaauuc

SEQ ID NO: 124523 - RNA, 19 nt, Homo sapiens
ugaaguaccacagauuuag

SEQ ID NO: 124524 - RNA, 19 nt, Homo sapiens
cuuccgagcugggaugaga

SEQ ID NO: 124525 - RNA, 19 nt, Homo sapiens
augcaaauauuccaaacuc

SEQ ID NO: 124526 - RNA, 19 nt, Homo sapiens
ggaagagaagaaacagaag

SEQ ID NO: 124527 - RNA, 19 nt, Homo sapiens
gcagaacuuccgccucaag

SEQ ID NO: 124528 - RNA, 19 nt, Homo sapiens
uuccaucucacccuaauaa

SEQ ID NO: 124529 - RNA, 19 nt, Homo sapiens
ggagucgggcuuccucauc

SEQ ID NO: 124530 - RNA, 19 nt, Homo sapiens
cauaugugacuccaucaug

SEQ ID NO: 124531 - RNA, 19 nt, Homo sapiens
gcggaagaggcggguauaa

SEQ ID NO: 124532 - RNA, 19 nt, Homo sapiens
augaggagauugacagagu

SEQ ID NO: 124533 - RNA, 19 nt, Homo sapiens
gaaacuaccuccagcugaa

SEQ ID NO: 124534 - RNA, 19 nt, Homo sapiens
gaauggagcucuuucucuu

SEQ ID NO: 124535 - RNA, 19 nt, Homo sapiens
ccacgaaacuacaccauga

SEQ ID NO: 124536 - RNA, 19 nt, Homo sapiens
gaacacagagcacauaugu

SEQ ID NO: 124537 - RNA, 19 nt, Homo sapiens
ggaagaggcggguauaaga

SEQ ID NO: 124538 - RNA, 19 nt, Homo sapiens
gcuaugaagaguaguaaua

SEQ ID NO: 124539 - RNA, 19 nt, Homo sapiens
ggaccaagaugcccuacau

SEQ ID NO: 124540 - RNA, 19 nt, Homo sapiens
ccaagaagguggagcacaa

SEQ ID NO: 124541 - RNA, 19 nt, Homo sapiens
gcaccgaaguguucccuau

SEQ ID NO: 124542 - RNA, 19 nt, Homo sapiens
ccacugcccuucauuggaa

SEQ ID NO: 124543 - RNA, 19 nt, Homo sapiens
guaauaauagcagcucuua

SEQ ID NO: 124544 - RNA, 19 nt, Homo sapiens
gaagaggcggguauaagaa

SEQ ID NO: 124545 - RNA, 19 nt, Homo sapiens
guaguugggaggugaaaua

SEQ ID NO: 124546 - RNA, 19 nt, Homo sapiens
cagaagaccuccagaugca

SEQ ID NO: 124547 - RNA, 19 nt, Homo sapiens
gggaagagaagaaacagaa

SEQ ID NO: 124548 - RNA, 19 nt, Homo sapiens
gaaacuacaccaugagcuu

SEQ ID NO: 124549 - RNA, 19 nt, Homo sapiens
ugaagaaccugaugaugag

SEQ ID NO: 124550 - RNA, 19 nt, Homo sapiens
acacggaguucuacuugaa

SEQ ID NO: 124551 - RNA, 19 nt, Homo sapiens
gcaaauauuccaaacucuu

SEQ ID NO: 124552 - RNA, 19 nt, Homo sapiens
caucagcuccauugucuuu

SEQ ID NO: 124553 - RNA, 19 nt, Homo sapiens
agggaaaccuuacauuaug

SEQ ID NO: 124554 - RNA, 19 nt, Homo sapiens
gcggaacuguuucggagaa

SEQ ID NO: 124555 - RNA, 19 nt, Homo sapiens
caacacggaguucuacuug

SEQ ID NO: 124556 - RNA, 19 nt, Homo sapiens
gaggugaaauaaggugauu

SEQ ID NO: 124557 - RNA, 19 nt, Homo sapiens
aaacagaagcggcucaguu

SEQ ID NO: 124558 - RNA, 19 nt, Homo sapiens
ggaagaugcgggaaaggaa

SEQ ID NO: 124559 - RNA, 19 nt, Homo sapiens
ggacuucaucgacuccuuu

SEQ ID NO: 124560 - RNA, 19 nt, Homo sapiens
gauguucucuucggugaug

SEQ ID NO: 124561 - RNA, 19 nt, Homo sapiens
guaauuagccaaaguccau

SEQ ID NO: 124562 - RNA, 19 nt, Homo sapiens
gcucaguucaccuugauaa

SEQ ID NO: 124563 - RNA, 19 nt, Homo sapiens
gaaccggcagcccaaguuu

SEQ ID NO: 124564 - RNA, 19 nt, Homo sapiens
caagguccaugaggagauu

SEQ ID NO: 124565 - RNA, 19 nt, Homo sapiens
ucggaaagcggaacuguuu

SEQ ID NO: 124566 - RNA, 19 nt, Homo sapiens
caagcuagguggcauucau

SEQ ID NO: 124567 - RNA, 19 nt, Homo sapiens
uuaagaagagugaugcuuu

SEQ ID NO: 124568 - RNA, 19 nt, Homo sapiens
acaccaaguuucgggauuu

SEQ ID NO: 124569 - RNA, 19 nt, Homo sapiens
acaaagaguuccugucacu

SEQ ID NO: 124570 - RNA, 19 nt, Homo sapiens
ggagcucuuucucuucuuc

SEQ ID NO: 124571 - RNA, 19 nt, Homo sapiens
ccacgagauccaaagauuu

SEQ ID NO: 124572 - RNA, 19 nt, Homo sapiens
uugaagaaccugaugauga

SEQ ID NO: 124573 - RNA, 19 nt, Homo sapiens
caacagaagaccuccagau

SEQ ID NO: 124574 - RNA, 19 nt, Homo sapiens
gggaugagaggaagggaaa

SEQ ID NO: 124575 - RNA, 19 nt, Homo sapiens
cagccacacuuccaucuca

SEQ ID NO: 124576 - RNA, 19 nt, Homo sapiens
guugggaggugaaauaagg

SEQ ID NO: 124577 - RNA, 19 nt, Homo sapiens
caaauauuccaaacucuuc

SEQ ID NO: 124578 - RNA, 19 nt, Homo sapiens
gaagaguaguaauaauagc

SEQ ID NO: 124579 - RNA, 19 nt, Homo sapiens
gaagagugaugcuuuugug

SEQ ID NO: 124580 - RNA, 19 nt, Homo sapiens
uaagaagagugaugcuuuu

SEQ ID NO: 124581 - RNA, 19 nt, Homo sapiens
gggcagcucuaugagaugu

SEQ ID NO: 124582 - RNA, 19 nt, Homo sapiens
ccagucaccuaaggacauu

SEQ ID NO: 124583 - RNA, 19 nt, Homo sapiens
gacaccaaguuucgggauu

SEQ ID NO: 124584 - RNA, 19 nt, Homo sapiens
ucucuucggugaugaaaca

SEQ ID NO: 124585 - RNA, 19 nt, Homo sapiens
gucaucagcuccauugucu

SEQ ID NO: 124586 - RNA, 19 nt, Homo sapiens
uccacgagauccaaagauu

SEQ ID NO: 124587 - RNA, 19 nt, Homo sapiens
gcagcucuaugagauguuc

SEQ ID NO: 124588 - RNA, 19 nt, Homo sapiens
auaugugacuccaucauga

SEQ ID NO: 124589 - RNA, 19 nt, Homo sapiens
gcugaacacagagcacaua

SEQ ID NO: 124590 - RNA, 19 nt, Homo sapiens
ggaaugcccaaauccacaa

SEQ ID NO: 124591 - RNA, 19 nt, Homo sapiens
uaagggcaccgaaguguuc

SEQ ID NO: 124592 - RNA, 19 nt, Homo sapiens
ugacugugauggucuugau

SEQ ID NO: 124593 - RNA, 19 nt, Homo sapiens
ucaccaccgucaugcagaa

SEQ ID NO: 124594 - RNA, 19 nt, Homo sapiens
gaaguaccacagauuuagu

SEQ ID NO: 124595 - RNA, 19 nt, Homo sapiens
ccaagaugcccuacaugga

SEQ ID NO: 124596 - RNA, 19 nt, Homo sapiens
ugcaagggcuggaggacuu

SEQ ID NO: 124597 - RNA, 19 nt, Homo sapiens
aaccuuacauuaugcuaug

SEQ ID NO: 124598 - RNA, 19 nt, Homo sapiens
gggaaaccuuacauuaugc

SEQ ID NO: 124599 - RNA, 19 nt, Homo sapiens
ccacagcaacaggccuuua

SEQ ID NO: 124600 - RNA, 19 nt, Homo sapiens
gggaccgcuuugacuauga

SEQ ID NO: 124601 - RNA, 19 nt, Homo sapiens
ccugaaguaccacagauuu

SEQ ID NO: 124602 - RNA, 19 nt, Homo sapiens
cuucaguucuacaguuuau

SEQ ID NO: 124603 - RNA, 19 nt, Homo sapiens
cugaaguaccacagauuua

SEQ ID NO: 124604 - RNA, 19 nt, Homo sapiens
aaacccagaccuuuggauu

SEQ ID NO: 124605 - RNA, 19 nt, Homo sapiens
gggaagaugcgggaaagga

SEQ ID NO: 124606 - RNA, 19 nt, Homo sapiens
acagagugaucggcaagaa

SEQ ID NO: 124607 - RNA, 19 nt, Homo sapiens
gaggagauugacagaguga

SEQ ID NO: 124608 - RNA, 19 nt, Homo sapiens
gcuucuugcugcucaugaa

SEQ ID NO: 124609 - RNA, 19 nt, Homo sapiens
ggagauugacagagugauc

SEQ ID NO: 124610 - RNA, 19 nt, Homo sapiens
cacagcaacaggccuuuaa

SEQ ID NO: 124611 - RNA, 19 nt, Homo sapiens
ggaccgcuuugacuaugag

SEQ ID NO: 124612 - RNA, 19 nt, Homo sapiens
gaaaccuuacauuaugcua

SEQ ID NO: 124613 - RNA, 19 nt, Homo sapiens
gcuagagggaagagaagaa

SEQ ID NO: 124614 - RNA, 19 nt, Homo sapiens
ccucaaguccucccaguca

SEQ ID NO: 124615 - RNA, 19 nt, Homo sapiens
caucgacuccuuucucauc

SEQ ID NO: 124616 - RNA, 19 nt, Homo sapiens
acucuucaguucuacaguu

SEQ ID NO: 124617 - RNA, 19 nt, Homo sapiens
gcggcucaguucaccuuga

SEQ ID NO: 124618 - RNA, 19 nt, Homo sapiens
ccaccgucaugcagaacuu

SEQ ID NO: 124619 - RNA, 19 nt, Homo sapiens
gcacgcuggaucccaauuc

SEQ ID NO: 124620 - RNA, 19 nt, Homo sapiens
ugaaguaccacagauuuag

SEQ ID NO: 124621 - RNA, 19 nt, Homo sapiens
cuuccgagcugggaugaga

SEQ ID NO: 124622 - RNA, 19 nt, Homo sapiens
ggaagagaagaaacagaag

SEQ ID NO: 124623 - RNA, 19 nt, Homo sapiens
gcagaacuuccgccucaag

SEQ ID NO: 124624 - RNA, 19 nt, Homo sapiens
ggagucgggcuuccucauc

SEQ ID NO: 124625 - RNA, 19 nt, Homo sapiens
augcaaauauuccaaacuc

SEQ ID NO: 124626 - RNA, 19 nt, Homo sapiens
cauaugugacuccaucaug

SEQ ID NO: 124627 - RNA, 19 nt, Homo sapiens
uuccaucucacccuaauaa

SEQ ID NO: 124628 - RNA, 19 nt, Homo sapiens
gcggaagaggcggguauaa

SEQ ID NO: 124629 - RNA, 19 nt, Homo sapiens
caaauccaaagcccaagug

SEQ ID NO: 124630 - RNA, 19 nt, Homo sapiens
augaggagauugacagagu

SEQ ID NO: 124631 - RNA, 19 nt, Homo sapiens
ccaacacggaguucuacuu

SEQ ID NO: 124632 - RNA, 19 nt, Homo sapiens
cuacauggaggcagugauc

SEQ ID NO: 124633 - RNA, 19 nt, Homo sapiens
caacauagauccuuacaua

SEQ ID NO: 124634 - RNA, 19 nt, Homo sapiens
ccaaugugcugcauaaaua

SEQ ID NO: 124635 - RNA, 19 nt, Homo sapiens
ggacagagccugagaaguu

SEQ ID NO: 124636 - RNA, 19 nt, Homo sapiens
gaaugaaacacucagauua

SEQ ID NO: 124637 - RNA, 19 nt, Homo sapiens
gaaacuugcucuagucaga

SEQ ID NO: 124638 - RNA, 19 nt, Homo sapiens
gaaggaaauugauacaguu

SEQ ID NO: 124639 - RNA, 19 nt, Homo sapiens
caccagagaccucaaauua

SEQ ID NO: 124640 - RNA, 19 nt, Homo sapiens
cuucaaaccuuguaaagaa

SEQ ID NO: 124641 - RNA, 19 nt, Homo sapiens
ccaagaagcuuuuaagauu

SEQ ID NO: 124642 - RNA, 19 nt, Homo sapiens
gaaggucgccucaaagaga

SEQ ID NO: 124643 - RNA, 19 nt, Homo sapiens
aaacagugcuagugaaaga

SEQ ID NO: 124644 - RNA, 19 nt, Homo sapiens
ccugagcucugauaacaua

SEQ ID NO: 124645 - RNA, 19 nt, Homo sapiens
gaacaaggacaacauagau

SEQ ID NO: 124646 - RNA, 19 nt, Homo sapiens
gaaaucaaugggauguuua

SEQ ID NO: 124647 - RNA, 19 nt, Homo sapiens
gcucauggcccaaucaauu

SEQ ID NO: 124648 - RNA, 19 nt, Homo sapiens
gaugaagaauggaagagaa

SEQ ID NO: 124649 - RNA, 19 nt, Homo sapiens
gaaggaaaguagugaugga

SEQ ID NO: 124650 - RNA, 19 nt, Homo sapiens
ggagagagauaaggaagga

SEQ ID NO: 124651 - RNA, 19 nt, Homo sapiens
gcucuaacagugacauuua

SEQ ID NO: 124652 - RNA, 19 nt, Homo sapiens
ugaaaucaaugggauguuu

SEQ ID NO: 124653 - RNA, 19 nt, Homo sapiens
caggaaagcuccacacaca

SEQ ID NO: 124654 - RNA, 19 nt, Homo sapiens
ucaaggagauggucccuau

SEQ ID NO: 124655 - RNA, 19 nt, Homo sapiens
gaagagaauacgaucauug

SEQ ID NO: 124656 - RNA, 19 nt, Homo sapiens
cauccaaugugcugcauaa

SEQ ID NO: 124657 - RNA, 19 nt, Homo sapiens
ccacaaagcucugucugau

SEQ ID NO: 124658 - RNA, 19 nt, Homo sapiens
gaacaugaaacuugcucua

SEQ ID NO: 124659 - RNA, 19 nt, Homo sapiens
uauaugaacuggccacuca

SEQ ID NO: 124660 - RNA, 19 nt, Homo sapiens
caagcuauguucuucauca

SEQ ID NO: 124661 - RNA, 19 nt, Homo sapiens
uagaggagaugaccaaauc

SEQ ID NO: 124662 - RNA, 19 nt, Homo sapiens
ccagagaccucaaauuacu

SEQ ID NO: 124663 - RNA, 19 nt, Homo sapiens
gcauggaugugaucacuag

SEQ ID NO: 124664 - RNA, 19 nt, Homo sapiens
gagauggucccuaucauug

SEQ ID NO: 124665 - RNA, 19 nt, Homo sapiens
gagcucugauaacauaauu

SEQ ID NO: 124666 - RNA, 19 nt, Homo sapiens
gagauguguuggugagaaa

SEQ ID NO: 124667 - RNA, 19 nt, Homo sapiens
ggaagagaauacgaucauu

SEQ ID NO: 124668 - RNA, 19 nt, Homo sapiens
gcaccacccaccuaugaua

SEQ ID NO: 124669 - RNA, 19 nt, Homo sapiens
ggaaaguagugauggaucu

SEQ ID NO: 124670 - RNA, 19 nt, Homo sapiens
aguguucucuccuucauua

SEQ ID NO: 124671 - RNA, 19 nt, Homo sapiens
ggagauguguuggugagaa

SEQ ID NO: 124672 - RNA, 19 nt, Homo sapiens
ggagauggucccuaucauu

SEQ ID NO: 124673 - RNA, 19 nt, Homo sapiens
guuauucugucuucacaaa

SEQ ID NO: 124674 - RNA, 19 nt, Homo sapiens
caaauagaacccugaaaug

SEQ ID NO: 124675 - RNA, 19 nt, Homo sapiens
ccuaaggacuucugguuug

SEQ ID NO: 124676 - RNA, 19 nt, Homo sapiens
gaacaccagagaccucaaa

SEQ ID NO: 124677 - RNA, 19 nt, Homo sapiens
gagaaguuccucccugaaa

SEQ ID NO: 124678 - RNA, 19 nt, Homo sapiens
caucgacucucucaacaau

SEQ ID NO: 124679 - RNA, 19 nt, Homo sapiens
uaucacagaucccgacaug

SEQ ID NO: 124680 - RNA, 19 nt, Homo sapiens
gaggacuucuucuaacaga

SEQ ID NO: 124681 - RNA, 19 nt, Homo sapiens
acaaagcucugucugaucu

SEQ ID NO: 124682 - RNA, 19 nt, Homo sapiens
aaauagaacccugaaauga

SEQ ID NO: 124683 - RNA, 19 nt, Homo sapiens
agaaggaaauugauacagu

SEQ ID NO: 124684 - RNA, 19 nt, Homo sapiens
gaccucaaauuacuuuaca

SEQ ID NO: 124685 - RNA, 19 nt, Homo sapiens
gagauaaggaaggaaagua

SEQ ID NO: 124686 - RNA, 19 nt, Homo sapiens
ggaaagcuccacacacaca

SEQ ID NO: 124687 - RNA, 19 nt, Homo sapiens
ucagaguccuucagaacuu

SEQ ID NO: 124688 - RNA, 19 nt, Homo sapiens
cauagauccuuacauauac

SEQ ID NO: 124689 - RNA, 19 nt, Homo sapiens
aaagaacaaggacaacaua

SEQ ID NO: 124690 - RNA, 19 nt, Homo sapiens
aaaagaaggucgccucaaa

SEQ ID NO: 124691 - RNA, 19 nt, Homo sapiens
guucucuccuucauuauau

SEQ ID NO: 124692 - RNA, 19 nt, Homo sapiens
gaacuucuccuucaaaccu

SEQ ID NO: 124693 - RNA, 19 nt, Homo sapiens
ucacagaucccgacaugau

SEQ ID NO: 124694 - RNA, 19 nt, Homo sapiens
acaaauagaacccugaaau

SEQ ID NO: 124695 - RNA, 19 nt, Homo sapiens
gugcagaaggaaauugaua

SEQ ID NO: 124696 - RNA, 19 nt, Homo sapiens
gaaagugcagaaggaaauu

SEQ ID NO: 124697 - RNA, 19 nt, Homo sapiens
uccauuagauccauucguu

SEQ ID NO: 124698 - RNA, 19 nt, Homo sapiens
ggaaguggacccagaaacu

SEQ ID NO: 124699 - RNA, 19 nt, Homo sapiens
gacagagccugagaaguuc

SEQ ID NO: 124700 - RNA, 19 nt, Homo sapiens
ugaaugaaacacucagauu

SEQ ID NO: 124701 - RNA, 19 nt, Homo sapiens
cccaauucuugaagcauua

SEQ ID NO: 124702 - RNA, 19 nt, Homo sapiens
uaagggcuauuggacguuu

SEQ ID NO: 124703 - RNA, 19 nt, Homo sapiens
aauagaacccugaaaugaa

SEQ ID NO: 124704 - RNA, 19 nt, Homo sapiens
ggugaugauuccaagcuau

SEQ ID NO: 124705 - RNA, 19 nt, Homo sapiens
gcaguguucucuccuucau

SEQ ID NO: 124706 - RNA, 19 nt, Homo sapiens
gauugacucucagaauuca

SEQ ID NO: 124707 - RNA, 19 nt, Homo sapiens
uccauucguucucucaaua

SEQ ID NO: 124708 - RNA, 19 nt, Homo sapiens
caugaaacuugcucuaguc

SEQ ID NO: 124709 - RNA, 19 nt, Homo sapiens
uuacauauacacacccuuu

SEQ ID NO: 124710 - RNA, 19 nt, Homo sapiens
gaaaacaccaagaagcuuu

SEQ ID NO: 124711 - RNA, 19 nt, Homo sapiens
agaaaagucugggguauuu

SEQ ID NO: 124712 - RNA, 19 nt, Homo sapiens
agauuuggcuucucugcuu

SEQ ID NO: 124713 - RNA, 19 nt, Homo sapiens
guaaguggagccugauuuc

SEQ ID NO: 124714 - RNA, 19 nt, Homo sapiens
gagguuugcucucgugaac

SEQ ID NO: 124715 - RNA, 19 nt, Homo sapiens
gcagaaagugcagaaggaa

SEQ ID NO: 124716 - RNA, 19 nt, Homo sapiens
gaugauugacucucagaau

SEQ ID NO: 124717 - RNA, 19 nt, Homo sapiens
ucacaaaccggaggccuuu

SEQ ID NO: 124718 - RNA, 19 nt, Homo sapiens
augauugacucucagaauu

SEQ ID NO: 124719 - RNA, 19 nt, Homo sapiens
gaagaauggaagagaauac

SEQ ID NO: 124720 - RNA, 19 nt, Homo sapiens
ccagugggauuuaugaaaa

SEQ ID NO: 124721 - RNA, 19 nt, Homo sapiens
caaugugcugcauaaauaa

SEQ ID NO: 124722 - RNA, 19 nt, Homo sapiens
auagaacccugaaaugaag

SEQ ID NO: 124723 - RNA, 19 nt, Homo sapiens
gaaguggacccagaaacug

SEQ ID NO: 124724 - RNA, 19 nt, Homo sapiens
gcagaaggaaauugauaca

SEQ ID NO: 124725 - RNA, 19 nt, Homo sapiens
gagcaucgacucucucaac

SEQ ID NO: 124726 - RNA, 19 nt, Homo sapiens
gaauggaagagaauacgau

SEQ ID NO: 124727 - RNA, 19 nt, Homo sapiens
gaaacugcauuggcaugag

SEQ ID NO: 124728 - RNA, 19 nt, Homo sapiens
ucaaugggauguuuauucc

SEQ ID NO: 124729 - RNA, 19 nt, Homo sapiens
uggaguaucuugacauggu

SEQ ID NO: 124730 - RNA, 19 nt, Homo sapiens
gauacaguuuuacccaaua

SEQ ID NO: 124731 - RNA, 19 nt, Homo sapiens
gaaaccacgagcaguguuc

SEQ ID NO: 124732 - RNA, 19 nt, Homo sapiens
cuucugguuugcucuuuaa

SEQ ID NO: 124733 - RNA, 19 nt, Homo sapiens
gaaacuaccugcagcugaa

SEQ ID NO: 124734 - RNA, 19 nt, Homo sapiens
gaauggagcucuuucucuu

SEQ ID NO: 124735 - RNA, 19 nt, Homo sapiens
ccacgaaacuacaccauga

SEQ ID NO: 124736 - RNA, 19 nt, Homo sapiens
caacaaggacaccaaguuu

SEQ ID NO: 124737 - RNA, 19 nt, Homo sapiens
acacagaguucuacuugaa

SEQ ID NO: 124738 - RNA, 19 nt, Homo sapiens
ccaagaagguggagcacaa

SEQ ID NO: 124739 - RNA, 19 nt, Homo sapiens
caacacagaguucuacuug

SEQ ID NO: 124740 - RNA, 19 nt, Homo sapiens
guaauaauagcagcucuua

SEQ ID NO: 124741 - RNA, 19 nt, Homo sapiens
gaagaucagugagcgcuau

SEQ ID NO: 124742 - RNA, 19 nt, Homo sapiens
ggaccaggcugaggaguuc

SEQ ID NO: 124743 - RNA, 19 nt, Homo sapiens
gaaacuacaccaugagcuu

SEQ ID NO: 124744 - RNA, 19 nt, Homo sapiens
acacagagcagauguacaa

SEQ ID NO: 124745 - RNA, 19 nt, Homo sapiens
ggaaagcgguacuguuuug

SEQ ID NO: 124746 - RNA, 19 nt, Homo sapiens
cuucagagcugugaugaga

SEQ ID NO: 124747 - RNA, 19 nt, Homo sapiens
gcagaacuuucgcuucaag

SEQ ID NO: 124748 - RNA, 19 nt, Homo sapiens
caucagcuccauugucuuu

SEQ ID NO: 124749 - RNA, 19 nt, Homo sapiens
ggacuucaucgacuccuuu

SEQ ID NO: 124750 - RNA, 19 nt, Homo sapiens
gauguucucuucggugaug

SEQ ID NO: 124751 - RNA, 19 nt, Homo sapiens
guacaacucccucaugaag

SEQ ID NO: 124752 - RNA, 19 nt, Homo sapiens
ccauugcccuucauuggaa

SEQ ID NO: 124753 - RNA, 19 nt, Homo sapiens
gaaccggcagcccaaguuu

SEQ ID NO: 124754 - RNA, 19 nt, Homo sapiens
caagguccaugaggagauu

SEQ ID NO: 124755 - RNA, 19 nt, Homo sapiens
ucggaaagcgguacuguuu

SEQ ID NO: 124756 - RNA, 19 nt, Homo sapiens
gggaacagaagaaacagaa

SEQ ID NO: 124757 - RNA, 19 nt, Homo sapiens
uuaagaagagugaugcuuu

SEQ ID NO: 124758 - RNA, 19 nt, Homo sapiens
ugaagaaccuggugaugac

SEQ ID NO: 124759 - RNA, 19 nt, Homo sapiens
acaccaaguuucgggauuu

SEQ ID NO: 124760 - RNA, 19 nt, Homo sapiens
acaaagaguuccugucacu

SEQ ID NO: 124761 - RNA, 19 nt, Homo sapiens
gaacacagagcagauguac

SEQ ID NO: 124762 - RNA, 19 nt, Homo sapiens
ggagcucuuucucuucuuc

SEQ ID NO: 124763 - RNA, 19 nt, Homo sapiens
ccacgagauccaaagauuu

SEQ ID NO: 124764 - RNA, 19 nt, Homo sapiens
ccaagaugcccuacacaga

SEQ ID NO: 124765 - RNA, 19 nt, Homo sapiens
acaacucccucaugaagau

SEQ ID NO: 124766 - RNA, 19 nt, Homo sapiens
agggaaaccuuacaguaug

SEQ ID NO: 124767 - RNA, 19 nt, Homo sapiens
gaagagugaugcuuuugug

SEQ ID NO: 124768 - RNA, 19 nt, Homo sapiens
uaagaagagugaugcuuuu

SEQ ID NO: 124769 - RNA, 19 nt, Homo sapiens
gauaagaaggggcaguuua

SEQ ID NO: 124770 - RNA, 19 nt, Homo sapiens
gggcagcucuaugagaugu

SEQ ID NO: 124771 - RNA, 19 nt, Homo sapiens
gacaccaaguuucgggauu

SEQ ID NO: 124772 - RNA, 19 nt, Homo sapiens
ucucuucggugaugaaaca

SEQ ID NO: 124773 - RNA, 19 nt, Homo sapiens
cagagcagauguacaacuc

SEQ ID NO: 124774 - RNA, 19 nt, Homo sapiens
gcucaguucaccuugauga

SEQ ID NO: 124775 - RNA, 19 nt, Homo sapiens
ucaccaccaucaugcagaa

SEQ ID NO: 124776 - RNA, 19 nt, Homo sapiens
gucaucagcuccauugucu

SEQ ID NO: 124777 - RNA, 19 nt, Homo sapiens
gacaugaugccgucaagga

SEQ ID NO: 124778 - RNA, 19 nt, Homo sapiens
caguucaccuugaugaugu

SEQ ID NO: 124779 - RNA, 19 nt, Homo sapiens
gggcucaguucaccuugau

SEQ ID NO: 124780 - RNA, 19 nt, Homo sapiens
ucaacaaggacaccaaguu

SEQ ID NO: 124781 - RNA, 19 nt, Homo sapiens
uccacgagauccaaagauu

SEQ ID NO: 124782 - RNA, 19 nt, Homo sapiens
acagaguucuacuugaaga

SEQ ID NO: 124783 - RNA, 19 nt, Homo sapiens
gcagcucuaugagauguuc

SEQ ID NO: 124784 - RNA, 19 nt, Homo sapiens
augcagaacuuucgcuuca

SEQ ID NO: 124785 - RNA, 19 nt, Homo sapiens
ugacugugauggucuugau

SEQ ID NO: 124786 - RNA, 19 nt, Homo sapiens
ugcaagggcuggaggacuu

SEQ ID NO: 124787 - RNA, 19 nt, Homo sapiens
gugaugagaggaagggaaa

SEQ ID NO: 124788 - RNA, 19 nt, Homo sapiens
ccacagcaacaggccuuua

SEQ ID NO: 124789 - RNA, 19 nt, Homo sapiens
gggaccgcuuugacuauga

SEQ ID NO: 124790 - RNA, 19 nt, Homo sapiens
gauguacaacucccucaug

SEQ ID NO: 124791 - RNA, 19 nt, Homo sapiens
ccaccaucaugcagaacuu

SEQ ID NO: 124792 - RNA, 19 nt, Homo sapiens
acagagugaucggcaagaa

SEQ ID NO: 124793 - RNA, 19 nt, Homo sapiens
gaggagauugacagaguga

SEQ ID NO: 124794 - RNA, 19 nt, Homo sapiens
ugaccacccugaaccucuu

SEQ ID NO: 124795 - RNA, 19 nt, Homo sapiens
gggaaaccuuacaguaugc

SEQ ID NO: 124796 - RNA, 19 nt, Homo sapiens
ucaccuugaugauguccuu

SEQ ID NO: 124797 - RNA, 19 nt, Homo sapiens
ggagauugacagagugauc

SEQ ID NO: 124798 - RNA, 19 nt, Homo sapiens
cacagcaacaggccuuuaa

SEQ ID NO: 124799 - RNA, 19 nt, Homo sapiens
ggaccgcuuugacuaugag

SEQ ID NO: 124800 - RNA, 19 nt, Homo sapiens
caucgacuccuuucucauc

SEQ ID NO: 124801 - RNA, 19 nt, Homo sapiens
aaagaguuccugucacugu

SEQ ID NO: 124802 - RNA, 19 nt, Homo sapiens
gcacgcuggaucccaauuc

SEQ ID NO: 124803 - RNA, 19 nt, Homo sapiens
acaguaugcuacaaagagu

SEQ ID NO: 124804 - RNA, 19 nt, Homo sapiens
agagggaacagaagaaaca

SEQ ID NO: 124805 - RNA, 19 nt, Homo sapiens
gcaugcaggaggaggagaa

SEQ ID NO: 124806 - RNA, 19 nt, Homo sapiens
gaaaccuuacaguaugcua

SEQ ID NO: 124807 - RNA, 19 nt, Homo sapiens
aagaguuccugucacuguu

SEQ ID NO: 124808 - RNA, 19 nt, Homo sapiens
ucgacuggcucuucaaagg

SEQ ID NO: 124809 - RNA, 19 nt, Homo sapiens
gugguuagagggaacagaa

SEQ ID NO: 124810 - RNA, 19 nt, Homo sapiens
uugaagaaccuggugauga

SEQ ID NO: 124811 - RNA, 19 nt, Homo sapiens
ggcccuguguucaccauuc

SEQ ID NO: 124812 - RNA, 19 nt, Homo sapiens
gcccuguguucaccauuca

SEQ ID NO: 124813 - RNA, 19 nt, Homo sapiens
gguuagagggaacagaaga

SEQ ID NO: 124814 - RNA, 19 nt, Homo sapiens
augaggagauugacagagu

SEQ ID NO: 124815 - RNA, 19 nt, Homo sapiens
auguacaacucccucauga

SEQ ID NO: 124816 - RNA, 19 nt, Homo sapiens
cuacacagaggcagugauc

SEQ ID NO: 124817 - RNA, 19 nt, Homo sapiens
cgcacagucuccaauguca

SEQ ID NO: 124818 - RNA, 19 nt, Homo sapiens
ugaacacagagcagaugua

SEQ ID NO: 124819 - RNA, 19 nt, Homo sapiens
gcccuucauuggaaacuac

SEQ ID NO: 124820 - RNA, 19 nt, Homo sapiens
guuagagggaacagaagaa

SEQ ID NO: 124821 - RNA, 19 nt, Homo sapiens
ccucagucgccuaaggaua

SEQ ID NO: 124822 - RNA, 19 nt, Homo sapiens
ccaaguuucgggauuucuu

SEQ ID NO: 124823 - RNA, 19 nt, Homo sapiens
ccacggggcagcucuauga

SEQ ID NO: 124824 - RNA, 19 nt, Homo sapiens
ucaguucaccuugaugaug

SEQ ID NO: 124825 - RNA, 19 nt, Homo sapiens
cccacagggucaacaagga

SEQ ID NO: 124826 - RNA, 19 nt, Homo sapiens
gcgcuauggcccuguguuc

SEQ ID NO: 124827 - RNA, 19 nt, Homo sapiens
acuaugaggacaaagaguu

SEQ ID NO: 124828 - RNA, 19 nt, Homo sapiens
gccgcacagucuccaaugu

SEQ ID NO: 124829 - RNA, 19 nt, Homo sapiens
cucagucgccuaaggauau

SEQ ID NO: 124830 - RNA, 19 nt, Homo sapiens
ggccagaauggagcucuuu

SEQ ID NO: 124831 - RNA, 19 nt, Homo sapiens
gggacuucaucgacuccuu

SEQ ID NO: 124832 - RNA, 19 nt, Homo sapiens
ucagcuccauugucuuugg

SEQ ID NO: 124833 - RNA, 19 nt, Homo sapiens
gaagaggccuacucaaauc

SEQ ID NO: 124834 - RNA, 19 nt, Homo sapiens
ucaaaucugcugagaauua

SEQ ID NO: 124835 - RNA, 19 nt, Homo sapiens
ucacaaagcuguacaacca

SEQ ID NO: 124836 - RNA, 19 nt, Homo sapiens
gaucaagaguuccugaaga

SEQ ID NO: 124837 - RNA, 19 nt, Homo sapiens
caaaucugcugagaauuaa

SEQ ID NO: 124838 - RNA, 19 nt, Homo sapiens
uaccaugccuggcuaauuu

SEQ ID NO: 124839 - RNA, 19 nt, Homo sapiens
gcccagccauguauauaua

SEQ ID NO: 124840 - RNA, 19 nt, Homo sapiens
ccaaagugcugauauuaca

SEQ ID NO: 124841 - RNA, 19 nt, Homo sapiens
ggagugcuauggugcaauu

SEQ ID NO: 124842 - RNA, 19 nt, Homo sapiens
gcucuucucuggcuucuug

SEQ ID NO: 124843 - RNA, 19 nt, Homo sapiens
ggagugagauuaucgaaaa

SEQ ID NO: 124844 - RNA, 19 nt, Homo sapiens
ucuaugagauucagagauu

SEQ ID NO: 124845 - RNA, 19 nt, Homo sapiens
caaggacacagaaguauuu

SEQ ID NO: 124846 - RNA, 19 nt, Homo sapiens
ccaaguagcugggauuaca

SEQ ID NO: 124847 - RNA, 19 nt, Homo sapiens
caaauacccucauguugca

SEQ ID NO: 124848 - RNA, 19 nt, Homo sapiens
ugaagaugcugaacuuguu

SEQ ID NO: 124849 - RNA, 19 nt, Homo sapiens
ccugauauguuccuucaaa

SEQ ID NO: 124850 - RNA, 19 nt, Homo sapiens
cuacucaaauccuuucuga

SEQ ID NO: 124851 - RNA, 19 nt, Homo sapiens
cuucaaaucugcugagaau

SEQ ID NO: 124852 - RNA, 19 nt, Homo sapiens
cuaccaagaucaagaguuc

SEQ ID NO: 124853 - RNA, 19 nt, Homo sapiens
uagaagaggccuacucaaa

SEQ ID NO: 124854 - RNA, 19 nt, Homo sapiens
ugcaggaaaucaaugcuua

SEQ ID NO: 124855 - RNA, 19 nt, Homo sapiens
caccacgccuggcuaaauu

SEQ ID NO: 124856 - RNA, 19 nt, Homo sapiens
gcucaaauacccucauguu

SEQ ID NO: 124857 - RNA, 19 nt, Homo sapiens
uagaggagcuucggaaauc

SEQ ID NO: 124858 - RNA, 19 nt, Homo sapiens
ucaaauccuuucugagguu

SEQ ID NO: 124859 - RNA, 19 nt, Homo sapiens
guuccaaagugcugauauu

SEQ ID NO: 124860 - RNA, 19 nt, Homo sapiens
ucuccuagcuccaaauguu

SEQ ID NO: 124861 - RNA, 19 nt, Homo sapiens
cuaccacgcuuggcuaauu

SEQ ID NO: 124862 - RNA, 19 nt, Homo sapiens
gaaaccuucugcagaugga

SEQ ID NO: 124863 - RNA, 19 nt, Homo sapiens
guacaaccaccaccaucua

SEQ ID NO: 124864 - RNA, 19 nt, Homo sapiens
gacccacacuacuuugaaa

SEQ ID NO: 124865 - RNA, 19 nt, Homo sapiens
ggugugaucuuugccaaug

SEQ ID NO: 124866 - RNA, 19 nt, Homo sapiens
gggauauggugugaucuuu

SEQ ID NO: 124867 - RNA, 19 nt, Homo sapiens
gauagaagaggccuacuca

SEQ ID NO: 124868 - RNA, 19 nt, Homo sapiens
ucucuggcuucuugaaaua

SEQ ID NO: 124869 - RNA, 19 nt, Homo sapiens
uggaggagcugguaucaca

SEQ ID NO: 124870 - RNA, 19 nt, Homo sapiens
ccaucuaguuccaaacauu

SEQ ID NO: 124871 - RNA, 19 nt, Homo sapiens
cuucaauccugaccacuuu

SEQ ID NO: 124872 - RNA, 19 nt, Homo sapiens
acacacugcuguagucuuc

SEQ ID NO: 124873 - RNA, 19 nt, Homo sapiens
ccaaagugcugggauuaca

SEQ ID NO: 124874 - RNA, 19 nt, Homo sapiens
cuuccaagaucaagagauu

SEQ ID NO: 124875 - RNA, 19 nt, Homo sapiens
aaacuaagccuugcucugu

SEQ ID NO: 124876 - RNA, 19 nt, Homo sapiens
acuauggacuuaccaauuc

SEQ ID NO: 124877 - RNA, 19 nt, Homo sapiens
gggcacacaggcaaguuua

SEQ ID NO: 124878 - RNA, 19 nt, Homo sapiens
caacaaaacccauaccuau

SEQ ID NO: 124879 - RNA, 19 nt, Homo sapiens
cuccugaacucaagugauu

SEQ ID NO: 124880 - RNA, 19 nt, Homo sapiens
ggagugcaguggcgugauc

SEQ ID NO: 124881 - RNA, 19 nt, Homo sapiens
gauauggugugaucuuugc

SEQ ID NO: 124882 - RNA, 19 nt, Homo sapiens
gggaagcggauuugucuug

SEQ ID NO: 124883 - RNA, 19 nt, Homo sapiens
uggauucccugauauguuc

SEQ ID NO: 124884 - RNA, 19 nt, Homo sapiens
ccuaguagcugggauuaca

SEQ ID NO: 124885 - RNA, 19 nt, Homo sapiens
gauauguuccuucaaaucu

SEQ ID NO: 124886 - RNA, 19 nt, Homo sapiens
guucaugccuguuguagac

SEQ ID NO: 124887 - RNA, 19 nt, Homo sapiens
acacagaggcagucaucua

SEQ ID NO: 124888 - RNA, 19 nt, Homo sapiens
gauagaggagcuucggaaa

SEQ ID NO: 124889 - RNA, 19 nt, Homo sapiens
agaagaggccuacucaaau

SEQ ID NO: 124890 - RNA, 19 nt, Homo sapiens
ucacaggacucuugcuacu

SEQ ID NO: 124891 - RNA, 19 nt, Homo sapiens
ugggaaaccuucugcagau

SEQ ID NO: 124892 - RNA, 19 nt, Homo sapiens
ucaacacgcucucgcucuu

SEQ ID NO: 124893 - RNA, 19 nt, Homo sapiens
ucugguugcuuucauguug

SEQ ID NO: 124894 - RNA, 19 nt, Homo sapiens
gaauauuucccauaaacag

SEQ ID NO: 124895 - RNA, 19 nt, Homo sapiens
caaccaccaccaucuaguu

SEQ ID NO: 124896 - RNA, 19 nt, Homo sapiens
ggaguguggugugggcaaa

SEQ ID NO: 124897 - RNA, 19 nt, Homo sapiens
ccaccauccuccagaacuu

SEQ ID NO: 124898 - RNA, 19 nt, Homo sapiens
caacgcacacagugaauuc

SEQ ID NO: 124899 - RNA, 19 nt, Homo sapiens
caucugcuccaucgucuuu

SEQ ID NO: 124900 - RNA, 19 nt, Homo sapiens
cuucggcgauucucuguga

SEQ ID NO: 124901 - RNA, 19 nt, Homo sapiens
uuucugagguuccgagaga

SEQ ID NO: 124902 - RNA, 19 nt, Homo sapiens
caucuaguuccaaacauuu

SEQ ID NO: 124903 - RNA, 19 nt, Homo sapiens
caccuuagccucccaaagu

SEQ ID NO: 124904 - RNA, 19 nt, Homo sapiens
uaccacgcuuggcuaauuu

SEQ ID NO: 124905 - RNA, 19 nt, Homo sapiens
gaaauccaacgcacacagu

SEQ ID NO: 124906 - RNA, 19 nt, Homo sapiens
agucucagcucccaaguag

SEQ ID NO: 124907 - RNA, 19 nt, Homo sapiens
gaauuguuccucuucuuca

SEQ ID NO: 124908 - RNA, 19 nt, Homo sapiens
ccaaggacacagaaguauu

SEQ ID NO: 124909 - RNA, 19 nt, Homo sapiens
gauucucugugaccacuau

SEQ ID NO: 124910 - RNA, 19 nt, Homo sapiens
ucacucaucagcucuguau

SEQ ID NO: 124911 - RNA, 19 nt, Homo sapiens
ucaccaccauccuccagaa

SEQ ID NO: 124912 - RNA, 19 nt, Homo sapiens
ggauauggugugaucuuug

SEQ ID NO: 124913 - RNA, 19 nt, Homo sapiens
ucccauaaacagaaucaua

SEQ ID NO: 124914 - RNA, 19 nt, Homo sapiens
acacaggcaaguuuacaaa

SEQ ID NO: 124915 - RNA, 19 nt, Homo sapiens
gcacacaggcaaguuuaca

SEQ ID NO: 124916 - RNA, 19 nt, Homo sapiens
gggaaaccuucugcagaug

SEQ ID NO: 124917 - RNA, 19 nt, Homo sapiens
ugucugaggucacauugca

SEQ ID NO: 124918 - RNA, 19 nt, Homo sapiens
gcggauuugucuuggugaa

SEQ ID NO: 124919 - RNA, 19 nt, Homo sapiens
gaagcggauuugucuuggu

SEQ ID NO: 124920 - RNA, 19 nt, Homo sapiens
ggagauugaacaggugauu

SEQ ID NO: 124921 - RNA, 19 nt, Homo sapiens
cugaauauuucccauaaac

SEQ ID NO: 124922 - RNA, 19 nt, Homo sapiens
gagugcaggagugagauua

SEQ ID NO: 124923 - RNA, 19 nt, Homo sapiens
ccaguugucugaggucaca

SEQ ID NO: 124924 - RNA, 19 nt, Homo sapiens
ccaugacccacacuacuuu

SEQ ID NO: 124925 - RNA, 19 nt, Homo sapiens
acaccuaccugcuccacau

SEQ ID NO: 124926 - RNA, 19 nt, Homo sapiens
ccaccucaguguuccaaag

SEQ ID NO: 124927 - RNA, 19 nt, Homo sapiens
caaccucugccuuccaaga

SEQ ID NO: 124928 - RNA, 19 nt, Homo sapiens
ugccucagccucccuagua

SEQ ID NO: 124929 - RNA, 19 nt, Homo sapiens
ggucaugcuguguggagua

SEQ ID NO: 124930 - RNA, 19 nt, Homo sapiens
guucagcgccacccuaaca

SEQ ID NO: 124931 - RNA, 19 nt, Homo sapiens
gcuuuggauucccugauau

SEQ ID NO: 124932 - RNA, 19 nt, Homo sapiens
ugcuuuggauucccugaua

SEQ ID NO: 124933 - RNA, 19 nt, Homo sapiens
gcagugaccugugacguua

SEQ ID NO: 124934 - RNA, 19 nt, Homo sapiens
caacaacccucgggacuuu

SEQ ID NO: 124935 - RNA, 19 nt, Homo sapiens
gggaacccauaacaaauua

SEQ ID NO: 124936 - RNA, 19 nt, Homo sapiens
ggaaggagauccggcguuu

SEQ ID NO: 124937 - RNA, 19 nt, Homo sapiens
gcacaaccauauuaacuuc

SEQ ID NO: 124938 - RNA, 19 nt, Homo sapiens
gauaugaaguggugaagga

SEQ ID NO: 124939 - RNA, 19 nt, Homo sapiens
uaacuucccucacuucugu

SEQ ID NO: 124940 - RNA, 19 nt, Homo sapiens
gaucagcaauuucuuaacu

SEQ ID NO: 124941 - RNA, 19 nt, Homo sapiens
gugaucugcuccauuauuu

SEQ ID NO: 124942 - RNA, 19 nt, Homo sapiens
guaacuacuucaugccuuu

SEQ ID NO: 124943 - RNA, 19 nt, Homo sapiens
gcacaacccugagauaugc

SEQ ID NO: 124944 - RNA, 19 nt, Homo sapiens
gaaaacaucaggauuguaa

SEQ ID NO: 124945 - RNA, 19 nt, Homo sapiens
caagggcacaaccauauua

SEQ ID NO: 124946 - RNA, 19 nt, Homo sapiens
ggaugaagguggaaauuuu

SEQ ID NO: 124947 - RNA, 19 nt, Homo sapiens
ucacuucugugcuacauga

SEQ ID NO: 124948 - RNA, 19 nt, Homo sapiens
gcaaauccuuaaccaaucu

SEQ ID NO: 124949 - RNA, 19 nt, Homo sapiens
ccucgggacuuuauugauu

SEQ ID NO: 124950 - RNA, 19 nt, Homo sapiens
cagcuaaaguccaggaaga

SEQ ID NO: 124951 - RNA, 19 nt, Homo sapiens
gaaggaagcccugauugau

SEQ ID NO: 124952 - RNA, 19 nt, Homo sapiens
ucaugacgcugcggaauuu

SEQ ID NO: 124953 - RNA, 19 nt, Homo sapiens
cauauuaacuucccucacu

SEQ ID NO: 124954 - RNA, 19 nt, Homo sapiens
gcaauaauuuucccacuau

SEQ ID NO: 124955 - RNA, 19 nt, Homo sapiens
ggauccagauaugcaauaa

SEQ ID NO: 124956 - RNA, 19 nt, Homo sapiens
cagcaaauccuuaaccaau

SEQ ID NO: 124957 - RNA, 19 nt, Homo sapiens
uaucagcugugcuucauuc

SEQ ID NO: 124958 - RNA, 19 nt, Homo sapiens
gacguuaaauucagaaacu

SEQ ID NO: 124959 - RNA, 19 nt, Homo sapiens
gaacgugucauuggcagaa

SEQ ID NO: 124960 - RNA, 19 nt, Homo sapiens
gcaauuucuuaacuugaug

SEQ ID NO: 124961 - RNA, 19 nt, Homo sapiens
ucagcaauuucuuaacuug

SEQ ID NO: 124962 - RNA, 19 nt, Homo sapiens
gaugucagcaaauccuuaa

SEQ ID NO: 124963 - RNA, 19 nt, Homo sapiens
uauuaaggaugucagcaaa

SEQ ID NO: 124964 - RNA, 19 nt, Homo sapiens
acccagaggucacagcuaa

SEQ ID NO: 124965 - RNA, 19 nt, Homo sapiens
ggaccguguucaagaggaa

SEQ ID NO: 124966 - RNA, 19 nt, Homo sapiens
gcuaacagaggauuuggaa

SEQ ID NO: 124967 - RNA, 19 nt, Homo sapiens
ugaaggaagcccugauuga

SEQ ID NO: 124968 - RNA, 19 nt, Homo sapiens
gaagagauugaacguguca

SEQ ID NO: 124969 - RNA, 19 nt, Homo sapiens
ugcacgagguccagagaua

SEQ ID NO: 124970 - RNA, 19 nt, Homo sapiens
caagcacaacccugagaua

SEQ ID NO: 124971 - RNA, 19 nt, Homo sapiens
ucaauggauuugcuucugu

SEQ ID NO: 124972 - RNA, 19 nt, Homo sapiens
ccacaugcccuacacagau

SEQ ID NO: 124973 - RNA, 19 nt, Homo sapiens
cauguuugcuucuccuuuc

SEQ ID NO: 124974 - RNA, 19 nt, Homo sapiens
uaaaguccaggaagagauu

SEQ ID NO: 124975 - RNA, 19 nt, Homo sapiens
agucugaauucacuauuga

SEQ ID NO: 124976 - RNA, 19 nt, Homo sapiens
gggcugugcucccugcaau

SEQ ID NO: 124977 - RNA, 19 nt, Homo sapiens
ggagaggaguuuucuggaa

SEQ ID NO: 124978 - RNA, 19 nt, Homo sapiens
gugcuucauuccugucuga

SEQ ID NO: 124979 - RNA, 19 nt, Homo sapiens
ccaacagucugaauucacu

SEQ ID NO: 124980 - RNA, 19 nt, Homo sapiens
acagaacuuuaaccugaaa

SEQ ID NO: 124981 - RNA, 19 nt, Homo sapiens
cggcguuucucccucauga

SEQ ID NO: 124982 - RNA, 19 nt, Homo sapiens
uuaaggaugucagcaaauc

SEQ ID NO: 124983 - RNA, 19 nt, Homo sapiens
gaccugugacguuaaauuc

SEQ ID NO: 124984 - RNA, 19 nt, Homo sapiens
gagauugaacgugucauug

SEQ ID NO: 124985 - RNA, 19 nt, Homo sapiens
aaucacugcagcugacuua

SEQ ID NO: 124986 - RNA, 19 nt, Homo sapiens
gaacuuuaaccugaaaucu

SEQ ID NO: 124987 - RNA, 19 nt, Homo sapiens
cacugcagcugacuuacuu

SEQ ID NO: 124988 - RNA, 19 nt, Homo sapiens
cagucugaauucacuauug

SEQ ID NO: 124989 - RNA, 19 nt, Homo sapiens
gcaaugugaucugcuccau

SEQ ID NO: 124990 - RNA, 19 nt, Homo sapiens
ggugaaggaagcccugauu

SEQ ID NO: 124991 - RNA, 19 nt, Homo sapiens
gaugaagguggaaauuuua

SEQ ID NO: 124992 - RNA, 19 nt, Homo sapiens
ugugcuacaugacaacaaa

SEQ ID NO: 124993 - RNA, 19 nt, Homo sapiens
aaaccaacagucugaauuc

SEQ ID NO: 124994 - RNA, 19 nt, Homo sapiens
cgggaacccauaacaaauu

SEQ ID NO: 124995 - RNA, 19 nt, Homo sapiens
gaaagagauggaaggagau

SEQ ID NO: 124996 - RNA, 19 nt, Homo sapiens
gaauuucccaacccagaga

SEQ ID NO: 124997 - RNA, 19 nt, Homo sapiens
ggugcugcauggauaugaa

SEQ ID NO: 124998 - RNA, 19 nt, Homo sapiens
cacaugcccuacacagaug

SEQ ID NO: 124999 - RNA, 19 nt, Homo sapiens
gaaaguaaaagaacaccaa

SEQ ID NO: 125000 - RNA, 19 nt, Homo sapiens
uacagaacuuuaaccugaa

SEQ ID NO: 125001 - RNA, 19 nt, Homo sapiens
gggcacaaccauauuaacu

SEQ ID NO: 125002 - RNA, 19 nt, Homo sapiens
gcaauggaaagagauggaa

SEQ ID NO: 125003 - RNA, 19 nt, Homo sapiens
ccaagggcacaaccauauu

SEQ ID NO: 125004 - RNA, 19 nt, Homo sapiens
agagauacaucgaccucau

SEQ ID NO: 125005 - RNA, 19 nt, Homo sapiens
gauuggaaauauccuacag

SEQ ID NO: 125006 - RNA, 19 nt, Homo sapiens
aggaagcccugauugaucu

SEQ ID NO: 125007 - RNA, 19 nt, Homo sapiens
gcccuguguucacucugua

SEQ ID NO: 125008 - RNA, 19 nt, Homo sapiens
cuacaugacaacaaagaau

SEQ ID NO: 125009 - RNA, 19 nt, Homo sapiens
ggcacaaccauauuaacuu

SEQ ID NO: 125010 - RNA, 19 nt, Homo sapiens
cccaugcagugaccuguga

SEQ ID NO: 125011 - RNA, 19 nt, Homo sapiens
gcuaaaguccaggaagaga

SEQ ID NO: 125012 - RNA, 19 nt, Homo sapiens
gggacuuuauugauugcuu

SEQ ID NO: 125013 - RNA, 19 nt, Homo sapiens
uaaaagaacaccaagaauc

SEQ ID NO: 125014 - RNA, 19 nt, Homo sapiens
gaacccauaacaaauuacu

SEQ ID NO: 125015 - RNA, 19 nt, Homo sapiens
ugaccugugacguuaaauu

SEQ ID NO: 125016 - RNA, 19 nt, Homo sapiens
aaaccuugcuuuuauggaa

SEQ ID NO: 125017 - RNA, 19 nt, Homo sapiens
ugugcucccugcaauguga

SEQ ID NO: 125018 - RNA, 19 nt, Homo sapiens
ugguggugcugcauggaua

SEQ ID NO: 125019 - RNA, 19 nt, Homo sapiens
uuggaaauauccuacagau

SEQ ID NO: 125020 - RNA, 19 nt, Homo sapiens
gagcauugaggaccguguu

SEQ ID NO: 125021 - RNA, 19 nt, Homo sapiens
gaagguggaaauuuuaaga

SEQ ID NO: 125022 - RNA, 19 nt, Homo sapiens
cccaagggcacaaccauau

SEQ ID NO: 125023 - RNA, 19 nt, Homo sapiens
auucagaaacuaccucauu

SEQ ID NO: 125024 - RNA, 19 nt, Homo sapiens
ugaggaccguguucaagag

SEQ ID NO: 125025 - RNA, 19 nt, Homo sapiens
uucagaaacuaccucauuc

SEQ ID NO: 125026 - RNA, 19 nt, Homo sapiens
ucccagugauuggaaauau

SEQ ID NO: 125027 - RNA, 19 nt, Homo sapiens
gugaaggaagcccugauug

SEQ ID NO: 125028 - RNA, 19 nt, Homo sapiens
gagauacaucgaccucauc

SEQ ID NO: 125029 - RNA, 19 nt, Homo sapiens
cccgggaacccauaacaaa

SEQ ID NO: 125030 - RNA, 19 nt, Homo sapiens
cuacagauagauauuaagg

SEQ ID NO: 125031 - RNA, 19 nt, Homo sapiens
acuuuaaccugaaaucucu

SEQ ID NO: 125032 - RNA, 19 nt, Homo sapiens
uggaugaagguggaaauuu

SEQ ID NO: 125033 - RNA, 19 nt, Homo sapiens
gaaauaugcuacagauaga

SEQ ID NO: 125034 - RNA, 19 nt, Homo sapiens
caucaaaucuucccauuca

SEQ ID NO: 125035 - RNA, 19 nt, Homo sapiens
gcacaaauauaucugcaau

SEQ ID NO: 125036 - RNA, 19 nt, Homo sapiens
ucaggucacugcacaaaua

SEQ ID NO: 125037 - RNA, 19 nt, Homo sapiens
ggaagagauugaucaugua

SEQ ID NO: 125038 - RNA, 19 nt, Homo sapiens
uaaagaaccucaauacuac

SEQ ID NO: 125039 - RNA, 19 nt, Homo sapiens
ggaaggagauccggcguuu

SEQ ID NO: 125040 - RNA, 19 nt, Homo sapiens
gaaguuacauuagggagaa

SEQ ID NO: 125041 - RNA, 19 nt, Homo sapiens
cacuguagcugaucuauuu

SEQ ID NO: 125042 - RNA, 19 nt, Homo sapiens
uaaaggacuuggaaucauu

SEQ ID NO: 125043 - RNA, 19 nt, Homo sapiens
ggaaauaugcuacagauag

SEQ ID NO: 125044 - RNA, 19 nt, Homo sapiens
cccaauaucucaaagaauu

SEQ ID NO: 125045 - RNA, 19 nt, Homo sapiens
gauaagaauggcaacuuua

SEQ ID NO: 125046 - RNA, 19 nt, Homo sapiens
ucacaaacuugcggaauuu

SEQ ID NO: 125047 - RNA, 19 nt, Homo sapiens
gacaaagaauuuccuaauc

SEQ ID NO: 125048 - RNA, 19 nt, Homo sapiens
gaagagauugaucauguaa

SEQ ID NO: 125049 - RNA, 19 nt, Homo sapiens
uaacaauccucgggacuuu

SEQ ID NO: 125050 - RNA, 19 nt, Homo sapiens
ucaaggacauucccacuau

SEQ ID NO: 125051 - RNA, 19 nt, Homo sapiens
gaagaaugcuagcccaucu

SEQ ID NO: 125052 - RNA, 19 nt, Homo sapiens
uaauuucccucuacucauu

SEQ ID NO: 125053 - RNA, 19 nt, Homo sapiens
ccaaagggauuguuucucu

SEQ ID NO: 125054 - RNA, 19 nt, Homo sapiens
ucucugaccucucaucaaa

SEQ ID NO: 125055 - RNA, 19 nt, Homo sapiens
ccacuccucuuccuauuau

SEQ ID NO: 125056 - RNA, 19 nt, Homo sapiens
aggaagcccugauugauaa

SEQ ID NO: 125057 - RNA, 19 nt, Homo sapiens
gaauggcaacuuuaagaaa

SEQ ID NO: 125058 - RNA, 19 nt, Homo sapiens
ccacaugccuuacacugau

SEQ ID NO: 125059 - RNA, 19 nt, Homo sapiens
aaacuugguuggcacugua

SEQ ID NO: 125060 - RNA, 19 nt, Homo sapiens
ggauccaggucugcaauaa

SEQ ID NO: 125061 - RNA, 19 nt, Homo sapiens
ugacuuccgugcuacauga

SEQ ID NO: 125062 - RNA, 19 nt, Homo sapiens
cagcuaaaguccaggaaga

SEQ ID NO: 125063 - RNA, 19 nt, Homo sapiens
gaaggaagcccugauugau

SEQ ID NO: 125064 - RNA, 19 nt, Homo sapiens
cccaggaacucacaacaaa

SEQ ID NO: 125065 - RNA, 19 nt, Homo sapiens
gaucugcuaucaccugcaa

SEQ ID NO: 125066 - RNA, 19 nt, Homo sapiens
agauaagaauggcaacuuu

SEQ ID NO: 125067 - RNA, 19 nt, Homo sapiens
aggaagagauugaucaugu

SEQ ID NO: 125068 - RNA, 19 nt, Homo sapiens
ccugaaaucuguugaugau

SEQ ID NO: 125069 - RNA, 19 nt, Homo sapiens
gcuacaugaugacaaagaa

SEQ ID NO: 125070 - RNA, 19 nt, Homo sapiens
acuauuaugucuucucuga

SEQ ID NO: 125071 - RNA, 19 nt, Homo sapiens
caaagaauuuccuaaucca

SEQ ID NO: 125072 - RNA, 19 nt, Homo sapiens
gcaccacucugagauaugg

SEQ ID NO: 125073 - RNA, 19 nt, Homo sapiens
gcaauaauuucccucuacu

SEQ ID NO: 125074 - RNA, 19 nt, Homo sapiens
gauaugaggcagugaagga

SEQ ID NO: 125075 - RNA, 19 nt, Homo sapiens
cugcaaaucuuucaccaau

SEQ ID NO: 125076 - RNA, 19 nt, Homo sapiens
ggacauucccacuauuaug

SEQ ID NO: 125077 - RNA, 19 nt, Homo sapiens
cauccaaacuccauuaagg

SEQ ID NO: 125078 - RNA, 19 nt, Homo sapiens
gcuaucaccugcaacucuu

SEQ ID NO: 125079 - RNA, 19 nt, Homo sapiens
gcaauuauucauacucugu

SEQ ID NO: 125080 - RNA, 19 nt, Homo sapiens
caaggacauucccacuauu

SEQ ID NO: 125081 - RNA, 19 nt, Homo sapiens
ccucgggacuuuauggauu

SEQ ID NO: 125082 - RNA, 19 nt, Homo sapiens
ccagaaacgauuugauuau

SEQ ID NO: 125083 - RNA, 19 nt, Homo sapiens
cugcauaugcuaauacuuu

SEQ ID NO: 125084 - RNA, 19 nt, Homo sapiens
ccuggccacuuucuagaua

SEQ ID NO: 125085 - RNA, 19 nt, Homo sapiens
gagauacagugaccuuguc

SEQ ID NO: 125086 - RNA, 19 nt, Homo sapiens
ugcacgagauccagagaua

SEQ ID NO: 125087 - RNA, 19 nt, Homo sapiens
acccagaggucacagcuaa

SEQ ID NO: 125088 - RNA, 19 nt, Homo sapiens
ggaccguguucaagaggaa

SEQ ID NO: 125089 - RNA, 19 nt, Homo sapiens
ugaaggaagcccugauuga

SEQ ID NO: 125090 - RNA, 19 nt, Homo sapiens
ggucacugcacaaauauau

SEQ ID NO: 125091 - RNA, 19 nt, Homo sapiens
ggacaucugcaaaucuuuc

SEQ ID NO: 125092 - RNA, 19 nt, Homo sapiens
aaggaagcccugauugaua

SEQ ID NO: 125093 - RNA, 19 nt, Homo sapiens
guuauuaauugcugguuca

SEQ ID NO: 125094 - RNA, 19 nt, Homo sapiens
caagcaccacucugagaua

SEQ ID NO: 125095 - RNA, 19 nt, Homo sapiens
gugacuacuucaugccuuu

SEQ ID NO: 125096 - RNA, 19 nt, Homo sapiens
acaacaagcaccacucuga

SEQ ID NO: 125097 - RNA, 19 nt, Homo sapiens
acaaagaauuuccuaaucc

SEQ ID NO: 125098 - RNA, 19 nt, Homo sapiens
uaaaguccaggaagagauu

SEQ ID NO: 125099 - RNA, 19 nt, Homo sapiens
gcacuguagcugaucuauu

SEQ ID NO: 125100 - RNA, 19 nt, Homo sapiens
gggcugugcucccugcaau

SEQ ID NO: 125101 - RNA, 19 nt, Homo sapiens
ggagaggaguuuucuggaa

SEQ ID NO: 125102 - RNA, 19 nt, Homo sapiens
aaggacaucugcaaaucuu

SEQ ID NO: 125103 - RNA, 19 nt, Homo sapiens
ugucuucucugaccucuca

SEQ ID NO: 125104 - RNA, 19 nt, Homo sapiens
aaggacauucccacuauua

SEQ ID NO: 125105 - RNA, 19 nt, Homo sapiens
auccaggucugcaauaauu

SEQ ID NO: 125106 - RNA, 19 nt, Homo sapiens
acagaacuuuaaccugaaa

SEQ ID NO: 125107 - RNA, 19 nt, Homo sapiens
cgugcuacaugaugacaaa

SEQ ID NO: 125108 - RNA, 19 nt, Homo sapiens
uuaaggacaucugcaaauc

SEQ ID NO: 125109 - RNA, 19 nt, Homo sapiens
gcaguuaccaaagggauug

SEQ ID NO: 125110 - RNA, 19 nt, Homo sapiens
aagaauggcaacuuuaaga

SEQ ID NO: 125111 - RNA, 19 nt, Homo sapiens
cccaagggcacaaccauaa

SEQ ID NO: 125112 - RNA, 19 nt, Homo sapiens
gaccacugauacuaaguuc

SEQ ID NO: 125113 - RNA, 19 nt, Homo sapiens
gugaucugcuccguuguuu

SEQ ID NO: 125114 - RNA, 19 nt, Homo sapiens
uggcaugaaucccauagug

SEQ ID NO: 125115 - RNA, 19 nt, Homo sapiens
guaaaacacagaaaaguga

SEQ ID NO: 125116 - RNA, 19 nt, Homo sapiens
ccacuauuaugucuucucu

SEQ ID NO: 125117 - RNA, 19 nt, Homo sapiens
ccucaauacuacugcaguu

SEQ ID NO: 125118 - RNA, 19 nt, Homo sapiens
gcucuuacacgaaguuaca

SEQ ID NO: 125119 - RNA, 19 nt, Homo sapiens
uccagaaacgauuugauua

SEQ ID NO: 125120 - RNA, 19 nt, Homo sapiens
cuaaaggacuuggaaucau

SEQ ID NO: 125121 - RNA, 19 nt, Homo sapiens
gaacuuuaaccugaaaucu

SEQ ID NO: 125122 - RNA, 19 nt, Homo sapiens
gaugacaaagaauuuccua

SEQ ID NO: 125123 - RNA, 19 nt, Homo sapiens
guucagaaacuaccucauc

SEQ ID NO: 125124 - RNA, 19 nt, Homo sapiens
cucacaaacuugcggaauu

SEQ ID NO: 125125 - RNA, 19 nt, Homo sapiens
gaaagagauggaaggagau

SEQ ID NO: 125126 - RNA, 19 nt, Homo sapiens
aggcuucaauggaaccuuu

SEQ ID NO: 125127 - RNA, 19 nt, Homo sapiens
cuacugcaguuaccaaagg

SEQ ID NO: 125128 - RNA, 19 nt, Homo sapiens
caagggcacaaccauaaug

SEQ ID NO: 125129 - RNA, 19 nt, Homo sapiens
guuaaggacaucugcaaau

SEQ ID NO: 125130 - RNA, 19 nt, Homo sapiens
ucugaccucucaucaaauc

SEQ ID NO: 125131 - RNA, 19 nt, Homo sapiens
acuuuaaccugaaaucugu

SEQ ID NO: 125132 - RNA, 19 nt, Homo sapiens
aagcaccacucugagauau

SEQ ID NO: 125133 - RNA, 19 nt, Homo sapiens
gaaauaugcuacagauaga

SEQ ID NO: 125134 - RNA, 19 nt, Homo sapiens
caucaaaucuucccauuca

SEQ ID NO: 125135 - RNA, 19 nt, Homo sapiens
gcacaaauauaucugcaau

SEQ ID NO: 125136 - RNA, 19 nt, Homo sapiens
ucaggucacugcacaaaua

SEQ ID NO: 125137 - RNA, 19 nt, Homo sapiens
ggaagagauugaucaugua

SEQ ID NO: 125138 - RNA, 19 nt, Homo sapiens
uaaagaaccucaauacuac

SEQ ID NO: 125139 - RNA, 19 nt, Homo sapiens
ggaaggagauccggcguuu

SEQ ID NO: 125140 - RNA, 19 nt, Homo sapiens
gagcuuugauaacaagaua

SEQ ID NO: 125141 - RNA, 19 nt, Homo sapiens
gaaguuacauuagggagaa

SEQ ID NO: 125142 - RNA, 19 nt, Homo sapiens
cacuguagcugaucuauuu

SEQ ID NO: 125143 - RNA, 19 nt, Homo sapiens
uaaaggacuuggaaucauu

SEQ ID NO: 125144 - RNA, 19 nt, Homo sapiens
ggaaauaugcuacagauag

SEQ ID NO: 125145 - RNA, 19 nt, Homo sapiens
cccaauaucucaaagaauu

SEQ ID NO: 125146 - RNA, 19 nt, Homo sapiens
gauaagaauggcaacuuua

SEQ ID NO: 125147 - RNA, 19 nt, Homo sapiens
ucacaaacuugcggaauuu

SEQ ID NO: 125148 - RNA, 19 nt, Homo sapiens
gacaaagaauuuccuaauc

SEQ ID NO: 125149 - RNA, 19 nt, Homo sapiens
gaagagauugaucauguaa

SEQ ID NO: 125150 - RNA, 19 nt, Homo sapiens
uaacaauccucgggacuuu

SEQ ID NO: 125151 - RNA, 19 nt, Homo sapiens
ucaaggacauucccacuau

SEQ ID NO: 125152 - RNA, 19 nt, Homo sapiens
gaagaaugcuagcccaucu

SEQ ID NO: 125153 - RNA, 19 nt, Homo sapiens
uaauuucccucuacucauu

SEQ ID NO: 125154 - RNA, 19 nt, Homo sapiens
ccaaagggauuguuucucu

SEQ ID NO: 125155 - RNA, 19 nt, Homo sapiens
ucucugaccucucaucaaa

SEQ ID NO: 125156 - RNA, 19 nt, Homo sapiens
ccacuccucuuccuauuau

SEQ ID NO: 125157 - RNA, 19 nt, Homo sapiens
aggaagcccugauugauaa

SEQ ID NO: 125158 - RNA, 19 nt, Homo sapiens
gaauggcaacuuuaagaaa

SEQ ID NO: 125159 - RNA, 19 nt, Homo sapiens
ccacaugccuuacacugau

SEQ ID NO: 125160 - RNA, 19 nt, Homo sapiens
aaacuugguuggcacugua

SEQ ID NO: 125161 - RNA, 19 nt, Homo sapiens
ggauccaggucugcaauaa

SEQ ID NO: 125162 - RNA, 19 nt, Homo sapiens
ugacuuccgugcuacauga

SEQ ID NO: 125163 - RNA, 19 nt, Homo sapiens
cagcuaaaguccaggaaga

SEQ ID NO: 125164 - RNA, 19 nt, Homo sapiens
gaaggaagcccugauugau

SEQ ID NO: 125165 - RNA, 19 nt, Homo sapiens
cccaggaacucacaacaaa

SEQ ID NO: 125166 - RNA, 19 nt, Homo sapiens
gaucugcuaucaccugcaa

SEQ ID NO: 125167 - RNA, 19 nt, Homo sapiens
agauaagaauggcaacuuu

SEQ ID NO: 125168 - RNA, 19 nt, Homo sapiens
aggaagagauugaucaugu

SEQ ID NO: 125169 - RNA, 19 nt, Homo sapiens
ccugaaaucuguugaugau

SEQ ID NO: 125170 - RNA, 19 nt, Homo sapiens
gcuacaugaugacaaagaa

SEQ ID NO: 125171 - RNA, 19 nt, Homo sapiens
ccaagagcuuugauaacaa

SEQ ID NO: 125172 - RNA, 19 nt, Homo sapiens
cccaagagcuuugauaaca

SEQ ID NO: 125173 - RNA, 19 nt, Homo sapiens
acuauuaugucuucucuga

SEQ ID NO: 125174 - RNA, 19 nt, Homo sapiens
caaagaauuuccuaaucca

SEQ ID NO: 125175 - RNA, 19 nt, Homo sapiens
gcaccacucugagauaugg

SEQ ID NO: 125176 - RNA, 19 nt, Homo sapiens
gcaauaauuucccucuacu

SEQ ID NO: 125177 - RNA, 19 nt, Homo sapiens
gauaugaggcagugaagga

SEQ ID NO: 125178 - RNA, 19 nt, Homo sapiens
cugcaaaucuuucaccaau

SEQ ID NO: 125179 - RNA, 19 nt, Homo sapiens
ggacauucccacuauuaug

SEQ ID NO: 125180 - RNA, 19 nt, Homo sapiens
caagagcuuugauaacaag

SEQ ID NO: 125181 - RNA, 19 nt, Homo sapiens
cauccaaacuccauuaagg

SEQ ID NO: 125182 - RNA, 19 nt, Homo sapiens
gcuaucaccugcaacucuu

SEQ ID NO: 125183 - RNA, 19 nt, Homo sapiens
gcaauuauucauacucugu

SEQ ID NO: 125184 - RNA, 19 nt, Homo sapiens
caaggacauucccacuauu

SEQ ID NO: 125185 - RNA, 19 nt, Homo sapiens
ccucgggacuuuauggauu

SEQ ID NO: 125186 - RNA, 19 nt, Homo sapiens
ccagaaacgauuugauuau

SEQ ID NO: 125187 - RNA, 19 nt, Homo sapiens
cugcauaugcuaauacuuu

SEQ ID NO: 125188 - RNA, 19 nt, Homo sapiens
ccuggccacuuucuagaua

SEQ ID NO: 125189 - RNA, 19 nt, Homo sapiens
gagauacagugaccuuguc

SEQ ID NO: 125190 - RNA, 19 nt, Homo sapiens
ugcacgagauccagagaua

SEQ ID NO: 125191 - RNA, 19 nt, Homo sapiens
acccagaggucacagcuaa

SEQ ID NO: 125192 - RNA, 19 nt, Homo sapiens
ggaccguguucaagaggaa

SEQ ID NO: 125193 - RNA, 19 nt, Homo sapiens
ugaaggaagcccugauuga

SEQ ID NO: 125194 - RNA, 19 nt, Homo sapiens
ggucacugcacaaauauau

SEQ ID NO: 125195 - RNA, 19 nt, Homo sapiens
ggacaucugcaaaucuuuc

SEQ ID NO: 125196 - RNA, 19 nt, Homo sapiens
aaacuagggcacaaccaua

SEQ ID NO: 125197 - RNA, 19 nt, Homo sapiens
aaggaagcccugauugaua

SEQ ID NO: 125198 - RNA, 19 nt, Homo sapiens
guuauuaauugcugguuca

SEQ ID NO: 125199 - RNA, 19 nt, Homo sapiens
caagcaccacucugagaua

SEQ ID NO: 125200 - RNA, 19 nt, Homo sapiens
gugacuacuucaugccuuu

SEQ ID NO: 125201 - RNA, 19 nt, Homo sapiens
acaacaagcaccacucuga

SEQ ID NO: 125202 - RNA, 19 nt, Homo sapiens
acaaagaauuuccuaaucc

SEQ ID NO: 125203 - RNA, 19 nt, Homo sapiens
uaaaguccaggaagagauu

SEQ ID NO: 125204 - RNA, 19 nt, Homo sapiens
gcacuguagcugaucuauu

SEQ ID NO: 125205 - RNA, 19 nt, Homo sapiens
gggcugugcucccugcaau

SEQ ID NO: 125206 - RNA, 19 nt, Homo sapiens
aaggacaucugcaaaucuu

SEQ ID NO: 125207 - RNA, 19 nt, Homo sapiens
ggagaggaguuuucuggaa

SEQ ID NO: 125208 - RNA, 19 nt, Homo sapiens
ugucuucucugaccucuca

SEQ ID NO: 125209 - RNA, 19 nt, Homo sapiens
aaggacauucccacuauua

SEQ ID NO: 125210 - RNA, 19 nt, Homo sapiens
auccaggucugcaauaauu

SEQ ID NO: 125211 - RNA, 19 nt, Homo sapiens
acagaacuuuaaccugaaa

SEQ ID NO: 125212 - RNA, 19 nt, Homo sapiens
cgugcuacaugaugacaaa

SEQ ID NO: 125213 - RNA, 19 nt, Homo sapiens
gcaguuaccaaagggauug

SEQ ID NO: 125214 - RNA, 19 nt, Homo sapiens
aagaauggcaacuuuaaga

SEQ ID NO: 125215 - RNA, 19 nt, Homo sapiens
gaccacugauacuaaguuc

SEQ ID NO: 125216 - RNA, 19 nt, Homo sapiens
uuaaggacaucugcaaauc

SEQ ID NO: 125217 - RNA, 19 nt, Homo sapiens
gugaucugcuccguuguuu

SEQ ID NO: 125218 - RNA, 19 nt, Homo sapiens
uggcaugaaucccauagug

SEQ ID NO: 125219 - RNA, 19 nt, Homo sapiens
guaaaacacagaaaaguga

SEQ ID NO: 125220 - RNA, 19 nt, Homo sapiens
ccacuauuaugucuucucu

SEQ ID NO: 125221 - RNA, 19 nt, Homo sapiens
ccucaauacuacugcaguu

SEQ ID NO: 125222 - RNA, 19 nt, Homo sapiens
gcucuuacacgaaguuaca

SEQ ID NO: 125223 - RNA, 19 nt, Homo sapiens
uccagaaacgauuugauua

SEQ ID NO: 125224 - RNA, 19 nt, Homo sapiens
cuaaaggacuuggaaucau

SEQ ID NO: 125225 - RNA, 19 nt, Homo sapiens
gaacuuuaaccugaaaucu

SEQ ID NO: 125226 - RNA, 19 nt, Homo sapiens
gaugacaaagaauuuccua

SEQ ID NO: 125227 - RNA, 19 nt, Homo sapiens
guucagaaacuaccucauc

SEQ ID NO: 125228 - RNA, 19 nt, Homo sapiens
cucacaaacuugcggaauu

SEQ ID NO: 125229 - RNA, 19 nt, Homo sapiens
gaaagagauggaaggagau

SEQ ID NO: 125230 - RNA, 19 nt, Homo sapiens
aggcuucaauggaaccuuu

SEQ ID NO: 125231 - RNA, 19 nt, Homo sapiens
cuacugcaguuaccaaagg

SEQ ID NO: 125232 - RNA, 19 nt, Homo sapiens
guuaaggacaucugcaaau

SEQ ID NO: 125233 - RNA, 19 nt, Homo sapiens
gaacaacccucaggacuuu

SEQ ID NO: 125234 - RNA, 19 nt, Homo sapiens
gcagugaccugugacauua

SEQ ID NO: 125235 - RNA, 19 nt, Homo sapiens
guaaauacuucaugccuuu

SEQ ID NO: 125236 - RNA, 19 nt, Homo sapiens
gcacaaccauauuaauuuc

SEQ ID NO: 125237 - RNA, 19 nt, Homo sapiens
ggaaggagauccggcguuu

SEQ ID NO: 125238 - RNA, 19 nt, Homo sapiens
gaacauucgaccuccauua

SEQ ID NO: 125239 - RNA, 19 nt, Homo sapiens
caaccaaccaucugaauuu

SEQ ID NO: 125240 - RNA, 19 nt, Homo sapiens
uaacagaggauuuggaauu

SEQ ID NO: 125241 - RNA, 19 nt, Homo sapiens
ggacaucagcaaauccuua

SEQ ID NO: 125242 - RNA, 19 nt, Homo sapiens
ccucaggacuuuauugauu

SEQ ID NO: 125243 - RNA, 19 nt, Homo sapiens
gaucagcaauuucuuaacu

SEQ ID NO: 125244 - RNA, 19 nt, Homo sapiens
gugaucugcuccauuauuu

SEQ ID NO: 125245 - RNA, 19 nt, Homo sapiens
gcucauacuuaucuaaugu

SEQ ID NO: 125246 - RNA, 19 nt, Homo sapiens
uaaccaaucucucaaaggu

SEQ ID NO: 125247 - RNA, 19 nt, Homo sapiens
gcacaacccugagauaugc

SEQ ID NO: 125248 - RNA, 19 nt, Homo sapiens
caagggcacaaccauauua

SEQ ID NO: 125249 - RNA, 19 nt, Homo sapiens
gggcacaaccauauuaauu

SEQ ID NO: 125250 - RNA, 19 nt, Homo sapiens
cacauaaugcucauacuua

SEQ ID NO: 125251 - RNA, 19 nt, Homo sapiens
ugacuucugugcuacauga

SEQ ID NO: 125252 - RNA, 19 nt, Homo sapiens
gcaaauccuuaaccaaucu

SEQ ID NO: 125253 - RNA, 19 nt, Homo sapiens
gaagaucuagugaacauuc

SEQ ID NO: 125254 - RNA, 19 nt, Homo sapiens
ggaugaagguggcaauuuu

SEQ ID NO: 125255 - RNA, 19 nt, Homo sapiens
cagcuaaaguccaggaaga

SEQ ID NO: 125256 - RNA, 19 nt, Homo sapiens
gaaggaagcccugauugau

SEQ ID NO: 125257 - RNA, 19 nt, Homo sapiens
gugcaaauauaucugcuau

SEQ ID NO: 125258 - RNA, 19 nt, Homo sapiens
ucaugacgcugcggaauuu

SEQ ID NO: 125259 - RNA, 19 nt, Homo sapiens
ggcacaaccauauuaauuu

SEQ ID NO: 125260 - RNA, 19 nt, Homo sapiens
gaagagauugaacguguga

SEQ ID NO: 125261 - RNA, 19 nt, Homo sapiens
auccagaucugcaauaauu

SEQ ID NO: 125262 - RNA, 19 nt, Homo sapiens
uaauuucccugacuucugu

SEQ ID NO: 125263 - RNA, 19 nt, Homo sapiens
cagaggauuuggaauuguu

SEQ ID NO: 125264 - RNA, 19 nt, Homo sapiens
cagcaaauccuuaaccaau

SEQ ID NO: 125265 - RNA, 19 nt, Homo sapiens
guuugacccucaucacuuu

SEQ ID NO: 125266 - RNA, 19 nt, Homo sapiens
ccaucugaauuuacuauug

SEQ ID NO: 125267 - RNA, 19 nt, Homo sapiens
aagaaucaauggacaugaa

SEQ ID NO: 125268 - RNA, 19 nt, Homo sapiens
gcaauggaaagaaauggaa

SEQ ID NO: 125269 - RNA, 19 nt, Homo sapiens
aaccaaccaucugaauuua

SEQ ID NO: 125270 - RNA, 19 nt, Homo sapiens
gaaagaaauggaaggagau

SEQ ID NO: 125271 - RNA, 19 nt, Homo sapiens
acccagaggucacagcuaa

SEQ ID NO: 125272 - RNA, 19 nt, Homo sapiens
ggaccguguucaagaggaa

SEQ ID NO: 125273 - RNA, 19 nt, Homo sapiens
gcuaacagaggauuuggaa

SEQ ID NO: 125274 - RNA, 19 nt, Homo sapiens
ugaaggaagcccugauuga

SEQ ID NO: 125275 - RNA, 19 nt, Homo sapiens
gggaacucacaacaaauua

SEQ ID NO: 125276 - RNA, 19 nt, Homo sapiens
gauaugaagcagugaagga

SEQ ID NO: 125277 - RNA, 19 nt, Homo sapiens
gacaucagcaaauccuuaa

SEQ ID NO: 125278 - RNA, 19 nt, Homo sapiens
gagaguuuccuauguuuca

SEQ ID NO: 125279 - RNA, 19 nt, Homo sapiens
cggagaguuuccuauguuu

SEQ ID NO: 125280 - RNA, 19 nt, Homo sapiens
acacugcaguugacuuguu

SEQ ID NO: 125281 - RNA, 19 nt, Homo sapiens
gcacaaccaaccaucugaa

SEQ ID NO: 125282 - RNA, 19 nt, Homo sapiens
cccgggaacucacaacaaa

SEQ ID NO: 125283 - RNA, 19 nt, Homo sapiens
ugcacgagguccagagaua

SEQ ID NO: 125284 - RNA, 19 nt, Homo sapiens
caagcacaacccugagaua

SEQ ID NO: 125285 - RNA, 19 nt, Homo sapiens
ccacaugcccuacacagau

SEQ ID NO: 125286 - RNA, 19 nt, Homo sapiens
ccaaccaucugaauuuacu

SEQ ID NO: 125287 - RNA, 19 nt, Homo sapiens
cauguuugcuucuccuuuc

SEQ ID NO: 125288 - RNA, 19 nt, Homo sapiens
uaaaguccaggaagagauu

SEQ ID NO: 125289 - RNA, 19 nt, Homo sapiens
gggcugugcucccugcaau

SEQ ID NO: 125290 - RNA, 19 nt, Homo sapiens
ggagaggaguuuucuggaa

SEQ ID NO: 125291 - RNA, 19 nt, Homo sapiens
cugaagaucuagugaacau

SEQ ID NO: 125292 - RNA, 19 nt, Homo sapiens
gugcuucauuccugucuga

SEQ ID NO: 125293 - RNA, 19 nt, Homo sapiens
caccugucaucucacauuu

SEQ ID NO: 125294 - RNA, 19 nt, Homo sapiens
ucaauggauuugccucugu

SEQ ID NO: 125295 - RNA, 19 nt, Homo sapiens
ccacuccaguugucaaugg

SEQ ID NO: 125296 - RNA, 19 nt, Homo sapiens
acagaacuuuaaccugaaa

SEQ ID NO: 125297 - RNA, 19 nt, Homo sapiens
agagauacauugaccuucu

SEQ ID NO: 125298 - RNA, 19 nt, Homo sapiens
gaacaccaagaaucaaugg

SEQ ID NO: 125299 - RNA, 19 nt, Homo sapiens
gaacucacaacaaauuacu

SEQ ID NO: 125300 - RNA, 19 nt, Homo sapiens
uaguggugcugcauggaua

SEQ ID NO: 125301 - RNA, 19 nt, Homo sapiens
ucacauaaugcucauacuu

SEQ ID NO: 125302 - RNA, 19 nt, Homo sapiens
guuucacugugcaaauaua

SEQ ID NO: 125303 - RNA, 19 nt, Homo sapiens
uuaaggacaucagcaaauc

SEQ ID NO: 125304 - RNA, 19 nt, Homo sapiens
aaacacugcaguugacuug

SEQ ID NO: 125305 - RNA, 19 nt, Homo sapiens
cggcguuucucccucauga

SEQ ID NO: 125306 - RNA, 19 nt, Homo sapiens
gaacgugugauuggcagaa

SEQ ID NO: 125307 - RNA, 19 nt, Homo sapiens
gagauugaacgugugauug

SEQ ID NO: 125308 - RNA, 19 nt, Homo sapiens
acggagaguuuccuauguu

SEQ ID NO: 125309 - RNA, 19 nt, Homo sapiens
uaccagcugugcuucauuc

SEQ ID NO: 125310 - RNA, 19 nt, Homo sapiens
gaacuuuaaccugaaaucu

SEQ ID NO: 125311 - RNA, 19 nt, Homo sapiens
cauauuaauuucccugacu

SEQ ID NO: 125312 - RNA, 19 nt, Homo sapiens
gcaaugugaucugcuccau

SEQ ID NO: 125313 - RNA, 19 nt, Homo sapiens
aacagaggauuuggaauug

SEQ ID NO: 125314 - RNA, 19 nt, Homo sapiens
caucuuugcacuaucugua

SEQ ID NO: 125315 - RNA, 19 nt, Homo sapiens
gaagguggcaauuuuaaga

SEQ ID NO: 125316 - RNA, 19 nt, Homo sapiens
ugugcuacaugacaacaaa

SEQ ID NO: 125317 - RNA, 19 nt, Homo sapiens
ggaaaacacugcaguugac

SEQ ID NO: 125318 - RNA, 19 nt, Homo sapiens
auugauugcuuccugauga

SEQ ID NO: 125319 - RNA, 19 nt, Homo sapiens
cgggaacucacaacaaauu

SEQ ID NO: 125320 - RNA, 19 nt, Homo sapiens
gcuauucuccauacucugu

SEQ ID NO: 125321 - RNA, 19 nt, Homo sapiens
uaucugcuauucuccauac

SEQ ID NO: 125322 - RNA, 19 nt, Homo sapiens
gaauuucccaacccagaga

SEQ ID NO: 125323 - RNA, 19 nt, Homo sapiens
ggugcugcauggauaugaa

SEQ ID NO: 125324 - RNA, 19 nt, Homo sapiens
cacaugcccuacacagaug

SEQ ID NO: 125325 - RNA, 19 nt, Homo sapiens
cacugcaguugacuuguuu

SEQ ID NO: 125326 - RNA, 19 nt, Homo sapiens
ugaacaacccucaggacuu

SEQ ID NO: 125327 - RNA, 19 nt, Homo sapiens
uuucucaccugucaucuca

SEQ ID NO: 125328 - RNA, 19 nt, Homo sapiens
uacagaacuuuaaccugaa

SEQ ID NO: 125329 - RNA, 19 nt, Homo sapiens
gaugaagguggcaauuuua

SEQ ID NO: 125330 - RNA, 19 nt, Homo sapiens
ccagagauacauugaccuu

SEQ ID NO: 125331 - RNA, 19 nt, Homo sapiens
guauuaaggacaucagcaa

SEQ ID NO: 125332 - RNA, 19 nt, Homo sapiens
ccaagggcacaaccauauu

SEQ ID NO: 125333 - RNA, 19 nt, Homo sapiens
gcagugaccugugauguua

SEQ ID NO: 125334 - RNA, 19 nt, Homo sapiens
gaacagugcucgggacuuu

SEQ ID NO: 125335 - RNA, 19 nt, Homo sapiens
gaacauccaaccuccauua

SEQ ID NO: 125336 - RNA, 19 nt, Homo sapiens
gaaauauccugcaguuaga

SEQ ID NO: 125337 - RNA, 19 nt, Homo sapiens
gaucagagguuucuuaacu

SEQ ID NO: 125338 - RNA, 19 nt, Homo sapiens
ggauaagaguggcaacuuu

SEQ ID NO: 125339 - RNA, 19 nt, Homo sapiens
ggaaggagauccggcguuu

SEQ ID NO: 125340 - RNA, 19 nt, Homo sapiens
uaacaucccugacuucugu

SEQ ID NO: 125341 - RNA, 19 nt, Homo sapiens
aaugugaucugcucuguua

SEQ ID NO: 125342 - RNA, 19 nt, Homo sapiens
gaagaagggcagauaguuu

SEQ ID NO: 125343 - RNA, 19 nt, Homo sapiens
gauaagaguggcaacuuua

SEQ ID NO: 125344 - RNA, 19 nt, Homo sapiens
ggaaauauccugcaguuag

SEQ ID NO: 125345 - RNA, 19 nt, Homo sapiens
gcucgggacuuuauugauu

SEQ ID NO: 125346 - RNA, 19 nt, Homo sapiens
ggaagagauugaaugugua

SEQ ID NO: 125347 - RNA, 19 nt, Homo sapiens
ggacaugagcaaauccuua

SEQ ID NO: 125348 - RNA, 19 nt, Homo sapiens
gagcaaauccuuaaccaau

SEQ ID NO: 125349 - RNA, 19 nt, Homo sapiens
ccacauaugcuaauaccua

SEQ ID NO: 125350 - RNA, 19 nt, Homo sapiens
gcagaacuuuaaccugaaa

SEQ ID NO: 125351 - RNA, 19 nt, Homo sapiens
cacuguaacugauauguuu

SEQ ID NO: 125352 - RNA, 19 nt, Homo sapiens
gaccugugauguuaaauuc

SEQ ID NO: 125353 - RNA, 19 nt, Homo sapiens
gagauugaauguguaguug

SEQ ID NO: 125354 - RNA, 19 nt, Homo sapiens
gcacaaugacaaagaauuc

SEQ ID NO: 125355 - RNA, 19 nt, Homo sapiens
gagcaccacucugagauau

SEQ ID NO: 125356 - RNA, 19 nt, Homo sapiens
ggauccaggucugcaauaa

SEQ ID NO: 125357 - RNA, 19 nt, Homo sapiens
gcacgaccauaauaacauc

SEQ ID NO: 125358 - RNA, 19 nt, Homo sapiens
cagcuaaaguccaggaaga

SEQ ID NO: 125359 - RNA, 19 nt, Homo sapiens
cauccaaccuccauuaaag

SEQ ID NO: 125360 - RNA, 19 nt, Homo sapiens
ucccugcucucaucgauua

SEQ ID NO: 125361 - RNA, 19 nt, Homo sapiens
gacaugagcaaauccuuaa

SEQ ID NO: 125362 - RNA, 19 nt, Homo sapiens
ccacuccucucccgauuau

SEQ ID NO: 125363 - RNA, 19 nt, Homo sapiens
aggaagagauugaaugugu

SEQ ID NO: 125364 - RNA, 19 nt, Homo sapiens
aagaaucccuggacaugaa

SEQ ID NO: 125365 - RNA, 19 nt, Homo sapiens
uaacaaaggacuuggaauc

SEQ ID NO: 125366 - RNA, 19 nt, Homo sapiens
caccugcaauucucccuua

SEQ ID NO: 125367 - RNA, 19 nt, Homo sapiens
caagggcacgaccauaaua

SEQ ID NO: 125368 - RNA, 19 nt, Homo sapiens
ggauuaguagggaguguua

SEQ ID NO: 125369 - RNA, 19 nt, Homo sapiens
gggacuuuauugauuguuu

SEQ ID NO: 125370 - RNA, 19 nt, Homo sapiens
ucagagguuucuuaacuug

SEQ ID NO: 125371 - RNA, 19 nt, Homo sapiens
ugaaggaggcccugauuga

SEQ ID NO: 125372 - RNA, 19 nt, Homo sapiens
uugggucacuuccuaaaua

SEQ ID NO: 125373 - RNA, 19 nt, Homo sapiens
gcaccacucugagauaugg

SEQ ID NO: 125374 - RNA, 19 nt, Homo sapiens
ggacuuuauugauuguuuc

SEQ ID NO: 125375 - RNA, 19 nt, Homo sapiens
gugaucugcucuguuauuu

SEQ ID NO: 125376 - RNA, 19 nt, Homo sapiens
gcaaugugaucugcucugu

SEQ ID NO: 125377 - RNA, 19 nt, Homo sapiens
gaagugaaagcccgcaguu

SEQ ID NO: 125378 - RNA, 19 nt, Homo sapiens
cccaggaagucauaauaaa

SEQ ID NO: 125379 - RNA, 19 nt, Homo sapiens
ucaugacucugcggaauuu

SEQ ID NO: 125380 - RNA, 19 nt, Homo sapiens
gcccgcaguugucuuacua

SEQ ID NO: 125381 - RNA, 19 nt, Homo sapiens
ggucacuuccuaaauauau

SEQ ID NO: 125382 - RNA, 19 nt, Homo sapiens
caaaggauauugacaucac

SEQ ID NO: 125383 - RNA, 19 nt, Homo sapiens
uaccagcucugcuucauuc

SEQ ID NO: 125384 - RNA, 19 nt, Homo sapiens
gauagccacuguaacugau

SEQ ID NO: 125385 - RNA, 19 nt, Homo sapiens
gguguugcauggauaugaa

SEQ ID NO: 125386 - RNA, 19 nt, Homo sapiens
ugcacgagauccagagaua

SEQ ID NO: 125387 - RNA, 19 nt, Homo sapiens
acccagaggucacagcuaa

SEQ ID NO: 125388 - RNA, 19 nt, Homo sapiens
caaucaacagucugaauuu

SEQ ID NO: 125389 - RNA, 19 nt, Homo sapiens
gaucugcucuguuauuuuc

SEQ ID NO: 125390 - RNA, 19 nt, Homo sapiens
ggaccguguucaagaggaa

SEQ ID NO: 125391 - RNA, 19 nt, Homo sapiens
aaucucagguugacccaaa

SEQ ID NO: 125392 - RNA, 19 nt, Homo sapiens
gaagagauugaauguguag

SEQ ID NO: 125393 - RNA, 19 nt, Homo sapiens
uaauuucccugcucucauc

SEQ ID NO: 125394 - RNA, 19 nt, Homo sapiens
gauaugaagcagugaagga

SEQ ID NO: 125395 - RNA, 19 nt, Homo sapiens
gucaguauguuaucacuag

SEQ ID NO: 125396 - RNA, 19 nt, Homo sapiens
guuugacccuggccacuuu

SEQ ID NO: 125397 - RNA, 19 nt, Homo sapiens
gcugcacaaugacaaagaa

SEQ ID NO: 125398 - RNA, 19 nt, Homo sapiens
auaauaacaucccugacuu

SEQ ID NO: 125399 - RNA, 19 nt, Homo sapiens
gaaggaggcccugauugau

SEQ ID NO: 125400 - RNA, 19 nt, Homo sapiens
gugacuacuucaugccuuu

SEQ ID NO: 125401 - RNA, 19 nt, Homo sapiens
cugcaauucucccuuauca

SEQ ID NO: 125402 - RNA, 19 nt, Homo sapiens
ccugugauguuaaauucaa

SEQ ID NO: 125403 - RNA, 19 nt, Homo sapiens
uaaaguccaggaagagauu

SEQ ID NO: 125404 - RNA, 19 nt, Homo sapiens
uaaaagccuugaagugaaa

SEQ ID NO: 125405 - RNA, 19 nt, Homo sapiens
gggcugugcucccugcaau

SEQ ID NO: 125406 - RNA, 19 nt, Homo sapiens
ggagaggaguuuucuggaa

SEQ ID NO: 125407 - RNA, 19 nt, Homo sapiens
cagguugacccaaaggaua

SEQ ID NO: 125408 - RNA, 19 nt, Homo sapiens
acaaucaacagucugaauu

SEQ ID NO: 125409 - RNA, 19 nt, Homo sapiens
auccaggucugcaauaauu

SEQ ID NO: 125410 - RNA, 19 nt, Homo sapiens
cacauaugcuaauaccuau

SEQ ID NO: 125411 - RNA, 19 nt, Homo sapiens
acaacgagcaccacucuga

SEQ ID NO: 125412 - RNA, 19 nt, Homo sapiens
ugaauuuacuguugaaagc

SEQ ID NO: 125413 - RNA, 19 nt, Homo sapiens
caauccacaucuucccauu

SEQ ID NO: 125414 - RNA, 19 nt, Homo sapiens
aaagcccgcaguugucuua

SEQ ID NO: 125415 - RNA, 19 nt, Homo sapiens
ccuggccacuuucuggaua

SEQ ID NO: 125416 - RNA, 19 nt, Homo sapiens
ucacaugcccuacacagau

SEQ ID NO: 125417 - RNA, 19 nt, Homo sapiens
ucaacagucugaauuuacu

SEQ ID NO: 125418 - RNA, 19 nt, Homo sapiens
cggcguuucugccucauga

SEQ ID NO: 125419 - RNA, 19 nt, Homo sapiens
uuaaggacaugagcaaauc

SEQ ID NO: 125420 - RNA, 19 nt, Homo sapiens
caagaaucccuggacauga

SEQ ID NO: 125421 - RNA, 19 nt, Homo sapiens
auucugagcucuccaugga

SEQ ID NO: 125422 - RNA, 19 nt, Homo sapiens
uccaugaucgauuugauua

SEQ ID NO: 125423 - RNA, 19 nt, Homo sapiens
gagcaucgaggaccguguu

SEQ ID NO: 125424 - RNA, 19 nt, Homo sapiens
guauugaccaccacauaug

SEQ ID NO: 125425 - RNA, 19 nt, Homo sapiens
gaacuuuaaccugaaaucu

SEQ ID NO: 125426 - RNA, 19 nt, Homo sapiens
gaguggcaacuuuaagaaa

SEQ ID NO: 125427 - RNA, 19 nt, Homo sapiens
ucaagaaucccuggacaug

SEQ ID NO: 125428 - RNA, 19 nt, Homo sapiens
agcaaauccuuaaccaauu

SEQ ID NO: 125429 - RNA, 19 nt, Homo sapiens
uuucuugggucacuuccua

SEQ ID NO: 125430 - RNA, 19 nt, Homo sapiens
aagaagggcagauaguuug

SEQ ID NO: 125431 - RNA, 19 nt, Homo sapiens
ugaagaagggcagauaguu

SEQ ID NO: 125432 - RNA, 19 nt, Homo sapiens
acuuuaaccugaaaucuca

SEQ ID NO: 125433 - RNA, 19 nt, Homo sapiens
gaacgacacucaucaccaa

SEQ ID NO: 125434 - RNA, 19 nt, Homo sapiens
gagagcagcuucaaugaug

SEQ ID NO: 125435 - RNA, 19 nt, Homo sapiens
ggagaucgacgacgugaua

SEQ ID NO: 125436 - RNA, 19 nt, Homo sapiens
uggaugagcugcuaacuga

SEQ ID NO: 125437 - RNA, 19 nt, Homo sapiens
gcauggagcucuuccucuu

SEQ ID NO: 125438 - RNA, 19 nt, Homo sapiens
cagaggagcccauuuggua

SEQ ID NO: 125439 - RNA, 19 nt, Homo sapiens
ccacugccgugauucauga

SEQ ID NO: 125440 - RNA, 19 nt, Homo sapiens
gcucuaauguacaauaaag

SEQ ID NO: 125441 - RNA, 19 nt, Homo sapiens
cuacaccacugccgugauu

SEQ ID NO: 125442 - RNA, 19 nt, Homo sapiens
gaugagaaccugcgcauag

SEQ ID NO: 125443 - RNA, 19 nt, Homo sapiens
cauaugacaucccgugaca

SEQ ID NO: 125444 - RNA, 19 nt, Homo sapiens
ugucaucggugcugaagga

SEQ ID NO: 125445 - RNA, 19 nt, Homo sapiens
acaauaaagcaauguggua

SEQ ID NO: 125446 - RNA, 19 nt, Homo sapiens
auaaagcaaugugguaguu

SEQ ID NO: 125447 - RNA, 19 nt, Homo sapiens
gaaggaggagucgggcuuu

SEQ ID NO: 125448 - RNA, 19 nt, Homo sapiens
gacaucccgugacaucgaa

SEQ ID NO: 125449 - RNA, 19 nt, Homo sapiens
gaggcucuaauguacaaua

SEQ ID NO: 125450 - RNA, 19 nt, Homo sapiens
ccugagagcagcuucaaug

SEQ ID NO: 125451 - RNA, 19 nt, Homo sapiens
aggcucuaauguacaauaa

SEQ ID NO: 125452 - RNA, 19 nt, Homo sapiens
cagcuucaaugaugagaac

SEQ ID NO: 125453 - RNA, 19 nt, Homo sapiens
agugguggcugaccuguuc

SEQ ID NO: 125454 - RNA, 19 nt, Homo sapiens
guccagaggagcccauuug

SEQ ID NO: 125455 - RNA, 19 nt, Homo sapiens
agagcagcuucaaugauga

SEQ ID NO: 125456 - RNA, 19 nt, Homo sapiens
uaagggaacgacacucauc

SEQ ID NO: 125457 - RNA, 19 nt, Homo sapiens
accauggugucuuugcuuu

SEQ ID NO: 125458 - RNA, 19 nt, Homo sapiens
ugacaucccgugacaucga

SEQ ID NO: 125459 - RNA, 19 nt, Homo sapiens
ggagcccauuugguaguga

SEQ ID NO: 125460 - RNA, 19 nt, Homo sapiens
ugggcaaccugcugcaugu

SEQ ID NO: 125461 - RNA, 19 nt, Homo sapiens
gaggagcccauuugguagu

SEQ ID NO: 125462 - RNA, 19 nt, Homo sapiens
cugcagcacuucagcuucu

SEQ ID NO: 125463 - RNA, 19 nt, Homo sapiens
uaugacaucccgugacauc

SEQ ID NO: 125464 - RNA, 19 nt, Homo sapiens
ggaggagucgggcuuucug

SEQ ID NO: 125465 - RNA, 19 nt, Homo sapiens
gagcucuuccucuucuuca

SEQ ID NO: 125466 - RNA, 19 nt, Homo sapiens
ccuaagggaacgacacuca

SEQ ID NO: 125467 - RNA, 19 nt, Homo sapiens
ggagcucuuccucuucuuc

SEQ ID NO: 125468 - RNA, 19 nt, Homo sapiens
ugagagcagcuucaaugau

SEQ ID NO: 125469 - RNA, 19 nt, Homo sapiens
uaacugagcacaggaugac

SEQ ID NO: 125470 - RNA, 19 nt, Homo sapiens
gaaauacccugagaucgaa

SEQ ID NO: 125471 - RNA, 19 nt, Homo sapiens
gaagcuccaugaagaaauu

SEQ ID NO: 125472 - RNA, 19 nt, Homo sapiens
gcacaacucugagauaugg

SEQ ID NO: 125473 - RNA, 19 nt, Homo sapiens
gaacacuuccugaaugaaa

SEQ ID NO: 125474 - RNA, 19 nt, Homo sapiens
gaccucagcccuauacaua

SEQ ID NO: 125475 - RNA, 19 nt, Homo sapiens
gauaugggcuccugauucu

SEQ ID NO: 125476 - RNA, 19 nt, Homo sapiens
caaacugauuccuuucuuu

SEQ ID NO: 125477 - RNA, 19 nt, Homo sapiens
ccagaacacuuccugaaug

SEQ ID NO: 125478 - RNA, 19 nt, Homo sapiens
aagagaagcuccaugaaga

SEQ ID NO: 125479 - RNA, 19 nt, Homo sapiens
cagaacacuuccugaauga

SEQ ID NO: 125480 - RNA, 19 nt, Homo sapiens
caaguacagugacuauuuc

SEQ ID NO: 125481 - RNA, 19 nt, Homo sapiens
ucaaguacagugacuauuu

SEQ ID NO: 125482 - RNA, 19 nt, Homo sapiens
gaagagaagcuccaugaag

SEQ ID NO: 125483 - RNA, 19 nt, Homo sapiens
gaaauugacagggugauug

SEQ ID NO: 125484 - RNA, 19 nt, Homo sapiens
ugaagaauauucccaaguc

SEQ ID NO: 125485 - RNA, 19 nt, Homo sapiens
ggcuccagcuuuacaauaa

SEQ ID NO: 125486 - RNA, 19 nt, Homo sapiens
cuacaaugaugagaaguuu

SEQ ID NO: 125487 - RNA, 19 nt, Homo sapiens
cagcacaacucugagauau

SEQ ID NO: 125488 - RNA, 19 nt, Homo sapiens
ccucagcccuauacauauu

SEQ ID NO: 125489 - RNA, 19 nt, Homo sapiens
caguuggaauugaagaaua

SEQ ID NO: 125490 - RNA, 19 nt, Homo sapiens
gaaaguucaaguacaguga

SEQ ID NO: 125491 - RNA, 19 nt, Homo sapiens
guaugacaaccaagaauuu

SEQ ID NO: 125492 - RNA, 19 nt, Homo sapiens
aggcugauguauuuguuua

SEQ ID NO: 125493 - RNA, 19 nt, Homo sapiens
aggaagcgcugcuggacua

SEQ ID NO: 125494 - RNA, 19 nt, Homo sapiens
gaaugaaaauggaaaguuc

SEQ ID NO: 125495 - RNA, 19 nt, Homo sapiens
agaauuuccugauccagaa

SEQ ID NO: 125496 - RNA, 19 nt, Homo sapiens
ugaaauacccugagaucga

SEQ ID NO: 125497 - RNA, 19 nt, Homo sapiens
cauauuggguuuggcugua

SEQ ID NO: 125498 - RNA, 19 nt, Homo sapiens
uucuaaggcugauguauuu

SEQ ID NO: 125499 - RNA, 19 nt, Homo sapiens
gagaagcuccaugaagaaa

SEQ ID NO: 125500 - RNA, 19 nt, Homo sapiens
gaaggagcaccaucaaucu

SEQ ID NO: 125501 - RNA, 19 nt, Homo sapiens
ucaaacugauuccuuucuu

SEQ ID NO: 125502 - RNA, 19 nt, Homo sapiens
gcauggaguuguuucuuuu

SEQ ID NO: 125503 - RNA, 19 nt, Homo sapiens
aaauguggcugaaguaaaa

SEQ ID NO: 125504 - RNA, 19 nt, Homo sapiens
ugacuacaaugaugagaag

SEQ ID NO: 125505 - RNA, 19 nt, Homo sapiens
gaggucaggauuucucaaa

SEQ ID NO: 125506 - RNA, 19 nt, Homo sapiens
cgcauggaguuguuucuuu

SEQ ID NO: 125507 - RNA, 19 nt, Homo sapiens
gcuccugauucucaugaaa

SEQ ID NO: 125508 - RNA, 19 nt, Homo sapiens
ugaaggagcaccaucaauc

SEQ ID NO: 125509 - RNA, 19 nt, Homo sapiens
uaaggcugauguauuuguu

SEQ ID NO: 125510 - RNA, 19 nt, Homo sapiens
uuacaaacucugugucauu

SEQ ID NO: 125511 - RNA, 19 nt, Homo sapiens
cuacacuacuugccuggaa

SEQ ID NO: 125512 - RNA, 19 nt, Homo sapiens
aaacugauuccuuucuuug

SEQ ID NO: 125513 - RNA, 19 nt, Homo sapiens
ggucaggauuucucaaacu

SEQ ID NO: 125514 - RNA, 19 nt, Homo sapiens
guacagugacuauuucaag

SEQ ID NO: 125515 - RNA, 19 nt, Homo sapiens
ggacuacaaggacgaguuc

SEQ ID NO: 125516 - RNA, 19 nt, Homo sapiens
gagauucagcgguucauca

SEQ ID NO: 125517 - RNA, 19 nt, Homo sapiens
ccgaaucccugccaucaag

SEQ ID NO: 125518 - RNA, 19 nt, Homo sapiens
uacaaacucugugucauuc

SEQ ID NO: 125519 - RNA, 19 nt, Homo sapiens
ugaccacccuccggaacua

SEQ ID NO: 125520 - RNA, 19 nt, Homo sapiens
gugacuauuucaagccauu

SEQ ID NO: 125521 - RNA, 19 nt, Homo sapiens
aagaguaugugucugaaag

SEQ ID NO: 125522 - RNA, 19 nt, Homo sapiens
ccaagaauuuccugaucca

SEQ ID NO: 125523 - RNA, 19 nt, Homo sapiens
ucgaagagaagcuccauga

SEQ ID NO: 125524 - RNA, 19 nt, Homo sapiens
gcuacaaggcggugaagga

SEQ ID NO: 125525 - RNA, 19 nt, Homo sapiens
ccacagaaaagucauaaaa

SEQ ID NO: 125526 - RNA, 19 nt, Homo sapiens
gcaagcauuuugacuacaa

SEQ ID NO: 125527 - RNA, 19 nt, Homo sapiens
ggaguuguuucuuuuguug

SEQ ID NO: 125528 - RNA, 19 nt, Homo sapiens
gagauaugggcuccugauu

SEQ ID NO: 125529 - RNA, 19 nt, Homo sapiens
ccagcacaacucugagaua

SEQ ID NO: 125530 - RNA, 19 nt, Homo sapiens
acccugagaucgaagagaa

SEQ ID NO: 125531 - RNA, 19 nt, Homo sapiens
gcuccagcuuuacaauaau

SEQ ID NO: 125532 - RNA, 19 nt, Homo sapiens
caggauuucucaaacugau

SEQ ID NO: 125533 - RNA, 19 nt, Homo sapiens
caaccaagaauuuccugau

SEQ ID NO: 125534 - RNA, 19 nt, Homo sapiens
ugccaacucuggacucugu

SEQ ID NO: 125535 - RNA, 19 nt, Homo sapiens
uccugauucucaugaaaua

SEQ ID NO: 125536 - RNA, 19 nt, Homo sapiens
uaaaagaguaugugucuga

SEQ ID NO: 125537 - RNA, 19 nt, Homo sapiens
caagggcacagucguagug

SEQ ID NO: 125538 - RNA, 19 nt, Homo sapiens
gcaacccgagacaccauuu

SEQ ID NO: 125539 - RNA, 19 nt, Homo sapiens
caugaaauacccugagauc

SEQ ID NO: 125540 - RNA, 19 nt, Homo sapiens
ugauuccuuucuuugcaua

SEQ ID NO: 125541 - RNA, 19 nt, Homo sapiens
ggauuucucaaacugauuc

SEQ ID NO: 125542 - RNA, 19 nt, Homo sapiens
gggaaacagggcaaugaga

SEQ ID NO: 125543 - RNA, 19 nt, Homo sapiens
gcaagagaugcccuacaug

SEQ ID NO: 125544 - RNA, 19 nt, Homo sapiens
cccuauacauauuggguuu

SEQ ID NO: 125545 - RNA, 19 nt, Homo sapiens
gcuguaucccaccacguua

SEQ ID NO: 125546 - RNA, 19 nt, Homo sapiens
cuacaaggcggugaaggaa

SEQ ID NO: 125547 - RNA, 19 nt, Homo sapiens
guucaaguacagugacuau

SEQ ID NO: 125548 - RNA, 19 nt, Homo sapiens
gccagaacacuuccugaau

SEQ ID NO: 125549 - RNA, 19 nt, Homo sapiens
aaccaagaauuuccugauc

SEQ ID NO: 125550 - RNA, 19 nt, Homo sapiens
uaaugagaacuuccaccua

SEQ ID NO: 125551 - RNA, 19 nt, Homo sapiens
gucaggauuucucaaacug

SEQ ID NO: 125552 - RNA, 19 nt, Homo sapiens
aauggaaaguucaaguaca

SEQ ID NO: 125553 - RNA, 19 nt, Homo sapiens
caucaaggauaggcaagag

SEQ ID NO: 125554 - RNA, 19 nt, Homo sapiens
cgaagagaagcuccaugaa

SEQ ID NO: 125555 - RNA, 19 nt, Homo sapiens
ccagcuuucuacacuacuu

SEQ ID NO: 125556 - RNA, 19 nt, Homo sapiens
aagcgcugcuggacuacaa

SEQ ID NO: 125557 - RNA, 19 nt, Homo sapiens
uguaugacaaccaagaauu

SEQ ID NO: 125558 - RNA, 19 nt, Homo sapiens
auaauggaccuaccuggaa

SEQ ID NO: 125559 - RNA, 19 nt, Homo sapiens
gagaacuuccaccuacuca

SEQ ID NO: 125560 - RNA, 19 nt, Homo sapiens
uuucuaaggcugauguauu

SEQ ID NO: 125561 - RNA, 19 nt, Homo sapiens
gaaaauggaaaguucaagu

SEQ ID NO: 125562 - RNA, 19 nt, Homo sapiens
acagagaccaccagcacaa

SEQ ID NO: 125563 - RNA, 19 nt, Homo sapiens
cuccagcuuuacaauaauu

SEQ ID NO: 125564 - RNA, 19 nt, Homo sapiens
ggccgguguucacgcugua

SEQ ID NO: 125565 - RNA, 19 nt, Homo sapiens
agagaugcccuacauggau

SEQ ID NO: 125566 - RNA, 19 nt, Homo sapiens
ucaaggauaggcaagagau

SEQ ID NO: 125567 - RNA, 19 nt, Homo sapiens
agagaagcuccaugaagaa

SEQ ID NO: 125568 - RNA, 19 nt, Homo sapiens
gacuguggccgaccuguuc

SEQ ID NO: 125569 - RNA, 19 nt, Homo sapiens
ccaccacguuacaaacucu

SEQ ID NO: 125570 - RNA, 19 nt, Homo sapiens
ccacagagcuuguucuaug

SEQ ID NO: 125571 - RNA, 19 nt, Homo sapiens
gcauggagcucuuucugua

SEQ ID NO: 125572 - RNA, 19 nt, Homo sapiens
gcucaggucuuggcaauuu

SEQ ID NO: 125573 - RNA, 19 nt, Homo sapiens
ucacuaagcugagcaagga

SEQ ID NO: 125574 - RNA, 19 nt, Homo sapiens
acccuaagcucaagagaua

SEQ ID NO: 125575 - RNA, 19 nt, Homo sapiens
gaaaccugcugcugcuuug

SEQ ID NO: 125576 - RNA, 19 nt, Homo sapiens
ccacucagcucaggucuug

SEQ ID NO: 125577 - RNA, 19 nt, Homo sapiens
gauggaagguccugagaca

SEQ ID NO: 125578 - RNA, 19 nt, Homo sapiens
aaugacaacuuccaaauca

SEQ ID NO: 125579 - RNA, 19 nt, Homo sapiens
gcagauguggcaugucuuu

SEQ ID NO: 125580 - RNA, 19 nt, Homo sapiens
acacauaaccugcucuuug

SEQ ID NO: 125581 - RNA, 19 nt, Homo sapiens
caacgcaucuuccagaacu

SEQ ID NO: 125582 - RNA, 19 nt, Homo sapiens
ggaaaccugcugcugcuuu

SEQ ID NO: 125583 - RNA, 19 nt, Homo sapiens
ggaagguccugagacaguu

SEQ ID NO: 125584 - RNA, 19 nt, Homo sapiens
gccaaucaguccuucaaga

SEQ ID NO: 125585 - RNA, 19 nt, Homo sapiens
gcuccuggcucucgucugu

SEQ ID NO: 125586 - RNA, 19 nt, Homo sapiens
acaguucucuauccagauu

SEQ ID NO: 125587 - RNA, 19 nt, Homo sapiens
ccaaucaguccuucaagaa

SEQ ID NO: 125588 - RNA, 19 nt, Homo sapiens
cacauaaccugcucuuugg

SEQ ID NO: 125589 - RNA, 19 nt, Homo sapiens
gcaauggcaucgccuucuc

SEQ ID NO: 125590 - RNA, 19 nt, Homo sapiens
ugacuucucucacuaagcu

SEQ ID NO: 125591 - RNA, 19 nt, Homo sapiens
cccaagacaugcugacuuc

SEQ ID NO: 125592 - RNA, 19 nt, Homo sapiens
cagcucaggucuuggcaau

SEQ ID NO: 125593 - RNA, 19 nt, Homo sapiens
gcagccgcuucgacuauga

SEQ ID NO: 125594 - RNA, 19 nt, Homo sapiens
gcucaagagauaagggaaa

SEQ ID NO: 125595 - RNA, 19 nt, Homo sapiens
ucaaugacaacuuccaaau

SEQ ID NO: 125596 - RNA, 19 nt, Homo sapiens
ugacaacuuccaaaucaug

SEQ ID NO: 125597 - RNA, 19 nt, Homo sapiens
gcucaguguccaacauuau

SEQ ID NO: 125598 - RNA, 19 nt, Homo sapiens
ggaccagggagaggaguuu

SEQ ID NO: 125599 - RNA, 19 nt, Homo sapiens
gagaaggaggacccacuga

SEQ ID NO: 125600 - RNA, 19 nt, Homo sapiens
ccuuaucaaugacaacuuc

SEQ ID NO: 125601 - RNA, 19 nt, Homo sapiens
gacaacuuccaaaucauga

SEQ ID NO: 125602 - RNA, 19 nt, Homo sapiens
caaugacaacuuccaaauc

SEQ ID NO: 125603 - RNA, 19 nt, Homo sapiens
gcagcgcuuugcagacauc

SEQ ID NO: 125604 - RNA, 19 nt, Homo sapiens
uccuggcacucaugaagua

SEQ ID NO: 125605 - RNA, 19 nt, Homo sapiens
uuauccgccuuaucaauga

SEQ ID NO: 125606 - RNA, 19 nt, Homo sapiens
gaccagggagaggaguuua

SEQ ID NO: 125607 - RNA, 19 nt, Homo sapiens
caagauggcagaggagaag

SEQ ID NO: 125608 - RNA, 19 nt, Homo sapiens
cgaguuguacgacaucuuc

SEQ ID NO: 125609 - RNA, 19 nt, Homo sapiens
aggcagauguggcaugucu

SEQ ID NO: 125610 - RNA, 19 nt, Homo sapiens
ugucugcuccugacccuaa

SEQ ID NO: 125611 - RNA, 19 nt, Homo sapiens
cugcugaugaccacacaua

SEQ ID NO: 125612 - RNA, 19 nt, Homo sapiens
cagcugccuucaccaugga

SEQ ID NO: 125613 - RNA, 19 nt, Homo sapiens
accauuauccgccuuauca

SEQ ID NO: 125614 - RNA, 19 nt, Homo sapiens
gcugacuucucucacuaag

SEQ ID NO: 125615 - RNA, 19 nt, Homo sapiens
uagauucaaaccagucuug

SEQ ID NO: 125616 - RNA, 19 nt, Homo sapiens
cacagagcuuguucuaugg

SEQ ID NO: 125617 - RNA, 19 nt, Homo sapiens
agaggcagauguggcaugu

SEQ ID NO: 125618 - RNA, 19 nt, Homo sapiens
gcauaagcacagccaucuu

SEQ ID NO: 125619 - RNA, 19 nt, Homo sapiens
cugcuuugcucccaagaca

SEQ ID NO: 125620 - RNA, 19 nt, Homo sapiens
auggauacccugcugauga

SEQ ID NO: 125621 - RNA, 19 nt, Homo sapiens
gcuuugcucccaagacaug

SEQ ID NO: 125622 - RNA, 19 nt, Homo sapiens
cgcucaguguccaacauua

SEQ ID NO: 125623 - RNA, 19 nt, Homo sapiens
caagacaugcugacuucuc

SEQ ID NO: 125624 - RNA, 19 nt, Homo sapiens
gcagggcagaggcagaugu

SEQ ID NO: 125625 - RNA, 19 nt, Homo sapiens
gcgcauggagcucuuucug

SEQ ID NO: 125626 - RNA, 19 nt, Homo sapiens
gcgcuuugcagacaucauc

SEQ ID NO: 125627 - RNA, 19 nt, Homo sapiens
ggcagccgcuucgacuaug

SEQ ID NO: 125628 - RNA, 19 nt, Homo sapiens
uuaacaccguccacuacga

SEQ ID NO: 125629 - RNA, 19 nt, Homo sapiens
gacaugcugacuucucuca

SEQ ID NO: 125630 - RNA, 19 nt, Homo sapiens
gucaucacccuccuuaaca

SEQ ID NO: 125631 - RNA, 19 nt, Homo sapiens
augcugacuucucucacua

SEQ ID NO: 125632 - RNA, 19 nt, Homo sapiens
ccacacauaaccugcucuu

SEQ ID NO: 125633 - RNA, 19 nt, Homo sapiens
ccaagauggcagaggagaa

SEQ ID NO: 125634 - RNA, 19 nt, Homo sapiens
gacccuaagcucaagagau

SEQ ID NO: 125635 - RNA, 19 nt, Homo sapiens
aagacaugcugacuucucu

SEQ ID NO: 125636 - RNA, 19 nt, Homo sapiens
gaagguccugagacaguuc

SEQ ID NO: 125637 - RNA, 19 nt, Homo sapiens
gguaccaagcugugaagga

SEQ ID NO: 125638 - RNA, 19 nt, Homo sapiens
gggacuucauccagugcuu

SEQ ID NO: 125639 - RNA, 19 nt, Homo sapiens
caugcugacuucucucacu

SEQ ID NO: 125640 - RNA, 19 nt, Homo sapiens
caaagaagguucacucuga

SEQ ID NO: 125641 - RNA, 19 nt, Homo sapiens
ggacugagcuguuuauuuu

SEQ ID NO: 125642 - RNA, 19 nt, Homo sapiens
gauaauguuuccuuccaua

SEQ ID NO: 125643 - RNA, 19 nt, Homo sapiens
gaugggcucugcuuuauau

SEQ ID NO: 125644 - RNA, 19 nt, Homo sapiens
ugacauaucugcaguucuu

SEQ ID NO: 125645 - RNA, 19 nt, Homo sapiens
gaagaaauaugggaaccuu

SEQ ID NO: 125646 - RNA, 19 nt, Homo sapiens
gaaacaagagacuuuauug

SEQ ID NO: 125647 - RNA, 19 nt, Homo sapiens
gagacuuuauugaugcuua

SEQ ID NO: 125648 - RNA, 19 nt, Homo sapiens
caagaaagaucagaggaau

SEQ ID NO: 125649 - RNA, 19 nt, Homo sapiens
aagcugagccugaaguuua

SEQ ID NO: 125650 - RNA, 19 nt, Homo sapiens
acaccucacugaagcaaua

SEQ ID NO: 125651 - RNA, 19 nt, Homo sapiens
acaagagacuuuauugaug

SEQ ID NO: 125652 - RNA, 19 nt, Homo sapiens
ggaauuugacucagagaaa

SEQ ID NO: 125653 - RNA, 19 nt, Homo sapiens
gagaauggacaguuuaaga

SEQ ID NO: 125654 - RNA, 19 nt, Homo sapiens
gcagaaacaagagacuuua

SEQ ID NO: 125655 - RNA, 19 nt, Homo sapiens
acaaugcaguuuccaauau

SEQ ID NO: 125656 - RNA, 19 nt, Homo sapiens
gaauggacaguuuaagaaa

SEQ ID NO: 125657 - RNA, 19 nt, Homo sapiens
gggaagccuuuaugccuuu

SEQ ID NO: 125658 - RNA, 19 nt, Homo sapiens
ccaugauccugaccaauuu

SEQ ID NO: 125659 - RNA, 19 nt, Homo sapiens
agaaagaucagaggaauuu

SEQ ID NO: 125660 - RNA, 19 nt, Homo sapiens
gcgaugggcucugcuuuau

SEQ ID NO: 125661 - RNA, 19 nt, Homo sapiens
ccagggaagugacaguuga

SEQ ID NO: 125662 - RNA, 19 nt, Homo sapiens
ggccaggacugagcuguuu

SEQ ID NO: 125663 - RNA, 19 nt, Homo sapiens
gcacuaaggaacuuugguu

SEQ ID NO: 125664 - RNA, 19 nt, Homo sapiens
cuuuaugccuuucucaaua

SEQ ID NO: 125665 - RNA, 19 nt, Homo sapiens
caaugucuuuccauggaua

SEQ ID NO: 125666 - RNA, 19 nt, Homo sapiens
gaaauggugagcuuuaagu

SEQ ID NO: 125667 - RNA, 19 nt, Homo sapiens
gagcuuagaggaacgcauu

SEQ ID NO: 125668 - RNA, 19 nt, Homo sapiens
caaaagaaauggugagcuu

SEQ ID NO: 125669 - RNA, 19 nt, Homo sapiens
cagaggaauuugacucaga

SEQ ID NO: 125670 - RNA, 19 nt, Homo sapiens
caugccagcucuacaaugu

SEQ ID NO: 125671 - RNA, 19 nt, Homo sapiens
gaagacauggcacguguuc

SEQ ID NO: 125672 - RNA, 19 nt, Homo sapiens
caaacucucuucagcaacu

SEQ ID NO: 125673 - RNA, 19 nt, Homo sapiens
guuacuagaugaagucaca

SEQ ID NO: 125674 - RNA, 19 nt, Homo sapiens
ggaaggagcaaagaagguu

SEQ ID NO: 125675 - RNA, 19 nt, Homo sapiens
cgagacaacuuccacaacu

SEQ ID NO: 125676 - RNA, 19 nt, Homo sapiens
gacaaacacagaaaggauu

SEQ ID NO: 125677 - RNA, 19 nt, Homo sapiens
uacaaugucuuuccaugga

SEQ ID NO: 125678 - RNA, 19 nt, Homo sapiens
caacaaugcaguuuccaau

SEQ ID NO: 125679 - RNA, 19 nt, Homo sapiens
gcgagaacauaucuuuaag

SEQ ID NO: 125680 - RNA, 19 nt, Homo sapiens
aagaaauggugagcuuuaa

SEQ ID NO: 125681 - RNA, 19 nt, Homo sapiens
gcaguuuccaauaucauuu

SEQ ID NO: 125682 - RNA, 19 nt, Homo sapiens
gaucaacaaugcaguuucc

SEQ ID NO: 125683 - RNA, 19 nt, Homo sapiens
ugacagcacuaaggaacuu

SEQ ID NO: 125684 - RNA, 19 nt, Homo sapiens
ucagauguguugggacaaa

SEQ ID NO: 125685 - RNA, 19 nt, Homo sapiens
cauggcacguguucugaaa

SEQ ID NO: 125686 - RNA, 19 nt, Homo sapiens
aagcugagauugacagagu

SEQ ID NO: 125687 - RNA, 19 nt, Homo sapiens
gaauuugacucagagaaaa

SEQ ID NO: 125688 - RNA, 19 nt, Homo sapiens
caaugcaguuuccaauauc

SEQ ID NO: 125689 - RNA, 19 nt, Homo sapiens
ggagcuuggugacauaucu

SEQ ID NO: 125690 - RNA, 19 nt, Homo sapiens
ucugcucgcugcugacuuu

SEQ ID NO: 125691 - RNA, 19 nt, Homo sapiens
ucacuucccuuaugcaaaa

SEQ ID NO: 125692 - RNA, 19 nt, Homo sapiens
gaaguuacuagaugaaguc

SEQ ID NO: 125693 - RNA, 19 nt, Homo sapiens
agaauggacaguuuaagaa

SEQ ID NO: 125694 - RNA, 19 nt, Homo sapiens
gagaaugggcaacaucauc

SEQ ID NO: 125695 - RNA, 19 nt, Homo sapiens
gagguucagcuguuuguga

SEQ ID NO: 125696 - RNA, 19 nt, Homo sapiens
ccucagguguaauauuguu

SEQ ID NO: 125697 - RNA, 19 nt, Homo sapiens
gaagcugagccugaaguuu

SEQ ID NO: 125698 - RNA, 19 nt, Homo sapiens
gggcaugccucggagaaca

SEQ ID NO: 125699 - RNA, 19 nt, Homo sapiens
guaccaugauccugaccaa

SEQ ID NO: 125700 - RNA, 19 nt, Homo sapiens
gacaguugauaccacuuug

SEQ ID NO: 125701 - RNA, 19 nt, Homo sapiens
gcagcacccuggaccucuu

SEQ ID NO: 125702 - RNA, 19 nt, Homo sapiens
caagaucaacaaugcaguu

SEQ ID NO: 125703 - RNA, 19 nt, Homo sapiens
caaggaaaguaagaagaca

SEQ ID NO: 125704 - RNA, 19 nt, Homo sapiens
gcaaggaaaguaagaagac

SEQ ID NO: 125705 - RNA, 19 nt, Homo sapiens
gagauugacagagugauug

SEQ ID NO: 125706 - RNA, 19 nt, Homo sapiens
cugcugaaguuacuagaug

SEQ ID NO: 125707 - RNA, 19 nt, Homo sapiens
acuaaggaacuuugguuua

SEQ ID NO: 125708 - RNA, 19 nt, Homo sapiens
ccacauggaccaaaacuuu

SEQ ID NO: 125709 - RNA, 19 nt, Homo sapiens
aaagaucagaggaauuuga

SEQ ID NO: 125710 - RNA, 19 nt, Homo sapiens
ggugacauaucugcaguuc

SEQ ID NO: 125711 - RNA, 19 nt, Homo sapiens
ucuggagaauggacaguuu

SEQ ID NO: 125712 - RNA, 19 nt, Homo sapiens
gaugcuuaccuuaaagaaa

SEQ ID NO: 125713 - RNA, 19 nt, Homo sapiens
aaagaagagcuuagaggaa

SEQ ID NO: 125714 - RNA, 19 nt, Homo sapiens
ggauaauguuuccuuccau

SEQ ID NO: 125715 - RNA, 19 nt, Homo sapiens
ucaagaaagaucagaggaa

SEQ ID NO: 125716 - RNA, 19 nt, Homo sapiens
uuccucagguguaauauug

SEQ ID NO: 125717 - RNA, 19 nt, Homo sapiens
gagacaacuuccacaacuc

SEQ ID NO: 125718 - RNA, 19 nt, Homo sapiens
aagaagcccuuauccacau

SEQ ID NO: 125719 - RNA, 19 nt, Homo sapiens
ccaaaucccagcucuacug

SEQ ID NO: 125720 - RNA, 19 nt, Homo sapiens
uaucugcaguucuuauuac

SEQ ID NO: 125721 - RNA, 19 nt, Homo sapiens
gcccaaggguaccaugauc

SEQ ID NO: 125722 - RNA, 19 nt, Homo sapiens
ugaaguuacuagaugaagu

SEQ ID NO: 125723 - RNA, 19 nt, Homo sapiens
gaauuagccuugggaaaau

SEQ ID NO: 125724 - RNA, 19 nt, Homo sapiens
uuucuucacuucccuuaug

SEQ ID NO: 125725 - RNA, 19 nt, Homo sapiens
cauucaauccggaccauuu

SEQ ID NO: 125726 - RNA, 19 nt, Homo sapiens
ugcgagaacauaucuuuaa

SEQ ID NO: 125727 - RNA, 19 nt, Homo sapiens
ugacaguugauaccacuuu

SEQ ID NO: 125728 - RNA, 19 nt, Homo sapiens
uccaugaggugcagagaau

SEQ ID NO: 125729 - RNA, 19 nt, Homo sapiens
cuacaccaaugcugucauc

SEQ ID NO: 125730 - RNA, 19 nt, Homo sapiens
ucggagaacgcuuugagua

SEQ ID NO: 125731 - RNA, 19 nt, Homo sapiens
gcagagaaugggcaacauc

SEQ ID NO: 125732 - RNA, 19 nt, Homo sapiens
caccaaugcugucauccau

SEQ ID NO: 125733 - RNA, 19 nt, Homo sapiens
gagaacgcuuugaguacca

SEQ ID NO: 125734 - RNA, 19 nt, Homo sapiens
agagaaaacuagauccaaa

SEQ ID NO: 125735 - RNA, 19 nt, Homo sapiens
gaaaggggcaaggaaagua

SEQ ID NO: 125736 - RNA, 19 nt, Homo sapiens
caaguggccaggcauggaa

SEQ ID NO: 125737 - RNA, 19 nt, Homo sapiens
ugacaaacacagaaaggau

SEQ ID NO: 125738 - RNA, 19 nt, Homo sapiens
gucuuuccauggauaauga

SEQ ID NO: 125739 - RNA, 19 nt, Homo sapiens
gcucuacaaugucuuucca

SEQ ID NO: 125740 - RNA, 19 nt, Homo sapiens
caacauagauccuuacaua

SEQ ID NO: 125741 - RNA, 19 nt, Homo sapiens
gaauagaacucugaaauga

SEQ ID NO: 125742 - RNA, 19 nt, Homo sapiens
ccaauggacugcauaaaua

SEQ ID NO: 125743 - RNA, 19 nt, Homo sapiens
ggacagagccugagaaguu

SEQ ID NO: 125744 - RNA, 19 nt, Homo sapiens
gaaagaaagucgccucgaa

SEQ ID NO: 125745 - RNA, 19 nt, Homo sapiens
gaaugaaacgcucagauua

SEQ ID NO: 125746 - RNA, 19 nt, Homo sapiens
gaaacuugcucuaaucaga

SEQ ID NO: 125747 - RNA, 19 nt, Homo sapiens
gaaagucgccucgaagaua

SEQ ID NO: 125748 - RNA, 19 nt, Homo sapiens
gaacugaagcucuuauuau

SEQ ID NO: 125749 - RNA, 19 nt, Homo sapiens
gaaaguuaauccacuguga

SEQ ID NO: 125750 - RNA, 19 nt, Homo sapiens
ggagaaaucuauagaacug

SEQ ID NO: 125751 - RNA, 19 nt, Homo sapiens
gcacauagcccagcaaaga

SEQ ID NO: 125752 - RNA, 19 nt, Homo sapiens
uaaaggaggugaccaaauc

SEQ ID NO: 125753 - RNA, 19 nt, Homo sapiens
ggaaauugaugcaguuuua

SEQ ID NO: 125754 - RNA, 19 nt, Homo sapiens
caccagagaccucaaauua

SEQ ID NO: 125755 - RNA, 19 nt, Homo sapiens
gaagaacaaggacaacaua

SEQ ID NO: 125756 - RNA, 19 nt, Homo sapiens
gaagugagcugagauugca

SEQ ID NO: 125757 - RNA, 19 nt, Homo sapiens
cuucaaaccuuguaaagaa

SEQ ID NO: 125758 - RNA, 19 nt, Homo sapiens
ccaagaagcuuuuaagauu

SEQ ID NO: 125759 - RNA, 19 nt, Homo sapiens
aaacagugcuagugaaaga

SEQ ID NO: 125760 - RNA, 19 nt, Homo sapiens
ggagagagauaaguaagga

SEQ ID NO: 125761 - RNA, 19 nt, Homo sapiens
gaacaaggacaacauagau

SEQ ID NO: 125762 - RNA, 19 nt, Homo sapiens
ggacucgccuguaaucuca

SEQ ID NO: 125763 - RNA, 19 nt, Homo sapiens
ggaggaaauugaugcaguu

SEQ ID NO: 125764 - RNA, 19 nt, Homo sapiens
ugucagaacuagaauuuga

SEQ ID NO: 125765 - RNA, 19 nt, Homo sapiens
cuauagaacugaaugagaa

SEQ ID NO: 125766 - RNA, 19 nt, Homo sapiens
gaaugagaaccaacaagua

SEQ ID NO: 125767 - RNA, 19 nt, Homo sapiens
ucaaggagauggucccuau

SEQ ID NO: 125768 - RNA, 19 nt, Homo sapiens
gaagagauuacgaucauug

SEQ ID NO: 125769 - RNA, 19 nt, Homo sapiens
cagcccaucuccuuucaua

SEQ ID NO: 125770 - RNA, 19 nt, Homo sapiens
guaaguggagccugaauuu

SEQ ID NO: 125771 - RNA, 19 nt, Homo sapiens
ggaaagcuccaugcacaua

SEQ ID NO: 125772 - RNA, 19 nt, Homo sapiens
gcucacgccuguaauccua

SEQ ID NO: 125773 - RNA, 19 nt, Homo sapiens
caauaacagucuuuccauu

SEQ ID NO: 125774 - RNA, 19 nt, Homo sapiens
gaacaugaaacuugcucua

SEQ ID NO: 125775 - RNA, 19 nt, Homo sapiens
ucgaugcaaugaacacuua

SEQ ID NO: 125776 - RNA, 19 nt, Homo sapiens
ugacuuugcccauuguuua

SEQ ID NO: 125777 - RNA, 19 nt, Homo sapiens
ccagagaccucaaauuacu

SEQ ID NO: 125778 - RNA, 19 nt, Homo sapiens
gaacaucgacucucucaac

SEQ ID NO: 125779 - RNA, 19 nt, Homo sapiens
gcauggaugugaucacuag

SEQ ID NO: 125780 - RNA, 19 nt, Homo sapiens
gagauggucccuaucauug

SEQ ID NO: 125781 - RNA, 19 nt, Homo sapiens
gcaagaagaacaaggacaa

SEQ ID NO: 125782 - RNA, 19 nt, Homo sapiens
gaaacugagucccacaaag

SEQ ID NO: 125783 - RNA, 19 nt, Homo sapiens
gagauguguuggugagaaa

SEQ ID NO: 125784 - RNA, 19 nt, Homo sapiens
uaucacagauccugacaug

SEQ ID NO: 125785 - RNA, 19 nt, Homo sapiens
gcaccacccaccuaugaua

SEQ ID NO: 125786 - RNA, 19 nt, Homo sapiens
aguguucucuccuucauua

SEQ ID NO: 125787 - RNA, 19 nt, Homo sapiens
ggagauguguuggugagaa

SEQ ID NO: 125788 - RNA, 19 nt, Homo sapiens
ggagauggucccuaucauu

SEQ ID NO: 125789 - RNA, 19 nt, Homo sapiens
guuauucugucuucacaaa

SEQ ID NO: 125790 - RNA, 19 nt, Homo sapiens
ccuaaggacuucugcuuug

SEQ ID NO: 125791 - RNA, 19 nt, Homo sapiens
gaaagauucagcaagaaga

SEQ ID NO: 125792 - RNA, 19 nt, Homo sapiens
gcucguggcccaaucaauu

SEQ ID NO: 125793 - RNA, 19 nt, Homo sapiens
gaugaagaauggaagagau

SEQ ID NO: 125794 - RNA, 19 nt, Homo sapiens
ggaggcggauguugaagug

SEQ ID NO: 125795 - RNA, 19 nt, Homo sapiens
caaauuagcuaggcauggu

SEQ ID NO: 125796 - RNA, 19 nt, Homo sapiens
gaacaccagagaccucaaa

SEQ ID NO: 125797 - RNA, 19 nt, Homo sapiens
gagaaguuccucccugaaa

SEQ ID NO: 125798 - RNA, 19 nt, Homo sapiens
gauggaguaucuugacaug

SEQ ID NO: 125799 - RNA, 19 nt, Homo sapiens
caucgacucucucaacaau

SEQ ID NO: 125800 - RNA, 19 nt, Homo sapiens
ggucaggaguucaagacaa

SEQ ID NO: 125801 - RNA, 19 nt, Homo sapiens
agaaaucugugccugagaa

SEQ ID NO: 125802 - RNA, 19 nt, Homo sapiens
cccaauucuugaaguauua

SEQ ID NO: 125803 - RNA, 19 nt, Homo sapiens
ucaauaauuuccuccacaa

SEQ ID NO: 125804 - RNA, 19 nt, Homo sapiens
gcacaucauuuggagugaa

SEQ ID NO: 125805 - RNA, 19 nt, Homo sapiens
caugaaacuugcucuaauc

SEQ ID NO: 125806 - RNA, 19 nt, Homo sapiens
ugaaugaaacgcucagauu

SEQ ID NO: 125807 - RNA, 19 nt, Homo sapiens
gaaaagugccaucucuaua

SEQ ID NO: 125808 - RNA, 19 nt, Homo sapiens
gcccaucuccuuucauauu

SEQ ID NO: 125809 - RNA, 19 nt, Homo sapiens
uguaugaacuggccacuca

SEQ ID NO: 125810 - RNA, 19 nt, Homo sapiens
ucacagauccugacaugau

SEQ ID NO: 125811 - RNA, 19 nt, Homo sapiens
guuaauccacugugacuuu

SEQ ID NO: 125812 - RNA, 19 nt, Homo sapiens
gaugcuuuccugcacauua

SEQ ID NO: 125813 - RNA, 19 nt, Homo sapiens
ucucuggaguauucuauaa

SEQ ID NO: 125814 - RNA, 19 nt, Homo sapiens
ucagaguccuucagaacuu

SEQ ID NO: 125815 - RNA, 19 nt, Homo sapiens
cauagauccuuacauauac

SEQ ID NO: 125816 - RNA, 19 nt, Homo sapiens
gaaguuccucccugaaaga

SEQ ID NO: 125817 - RNA, 19 nt, Homo sapiens
acaaagcucuguccgaucu

SEQ ID NO: 125818 - RNA, 19 nt, Homo sapiens
ccaagagaaguuacaaauu

SEQ ID NO: 125819 - RNA, 19 nt, Homo sapiens
caucccaauucuugaagua

SEQ ID NO: 125820 - RNA, 19 nt, Homo sapiens
ggaagagauuacgaucauu

SEQ ID NO: 125821 - RNA, 19 nt, Homo sapiens
caauggacugcauaaauaa

SEQ ID NO: 125822 - RNA, 19 nt, Homo sapiens
agacaagccuggccuacau

SEQ ID NO: 125823 - RNA, 19 nt, Homo sapiens
gagaaccaacaaguaaaua

SEQ ID NO: 125824 - RNA, 19 nt, Homo sapiens
aaugagaaccaacaaguaa

SEQ ID NO: 125825 - RNA, 19 nt, Homo sapiens
cagaggagagagauaagua

SEQ ID NO: 125826 - RNA, 19 nt, Homo sapiens
gaacuucuccuucaaaccu

SEQ ID NO: 125827 - RNA, 19 nt, Homo sapiens
ccaacugucucgaugcaau

SEQ ID NO: 125828 - RNA, 19 nt, Homo sapiens
cagcaaagagcaacacaga

SEQ ID NO: 125829 - RNA, 19 nt, Homo sapiens
gcaggagaaucacuugaac

SEQ ID NO: 125830 - RNA, 19 nt, Homo sapiens
gaaaccccaucucuacuaa

SEQ ID NO: 125831 - RNA, 19 nt, Homo sapiens
uuugauggcucuaacaaug

SEQ ID NO: 125832 - RNA, 19 nt, Homo sapiens
gggauucuguacaugcauu

SEQ ID NO: 125833 - RNA, 19 nt, Homo sapiens
gugaauagaacucugaaau

SEQ ID NO: 125834 - RNA, 19 nt, Homo sapiens
gcucagauuauucccaauu

SEQ ID NO: 125835 - RNA, 19 nt, Homo sapiens
uggaagagauuacgaucau

SEQ ID NO: 125836 - RNA, 19 nt, Homo sapiens
agaacugaagcucuuauua

SEQ ID NO: 125837 - RNA, 19 nt, Homo sapiens
ugaauagaacucugaaaug

SEQ ID NO: 125838 - RNA, 19 nt, Homo sapiens
ggaaguggacccagaaacu

SEQ ID NO: 125839 - RNA, 19 nt, Homo sapiens
gagcaacacagagcugaaa

SEQ ID NO: 125840 - RNA, 19 nt, Homo sapiens
cagcauagauccuuacaua

SEQ ID NO: 125841 - RNA, 19 nt, Homo sapiens
gaacagugcuagugaaaga

SEQ ID NO: 125842 - RNA, 19 nt, Homo sapiens
caccagagauuucaacuua

SEQ ID NO: 125843 - RNA, 19 nt, Homo sapiens
caagaaagauguugaaauc

SEQ ID NO: 125844 - RNA, 19 nt, Homo sapiens
gaacacaguugaagaagga

SEQ ID NO: 125845 - RNA, 19 nt, Homo sapiens
gcauagauccuuacauaua

SEQ ID NO: 125846 - RNA, 19 nt, Homo sapiens
gaaugaaacacucagauua

SEQ ID NO: 125847 - RNA, 19 nt, Homo sapiens
gaaacuugcucuaaucaga

SEQ ID NO: 125848 - RNA, 19 nt, Homo sapiens
ggacagagccugaggaguu

SEQ ID NO: 125849 - RNA, 19 nt, Homo sapiens
cuucaaaccuuguaaagaa

SEQ ID NO: 125850 - RNA, 19 nt, Homo sapiens
gaaggaaaguggcgaugga

SEQ ID NO: 125851 - RNA, 19 nt, Homo sapiens
ugagaggacuugcaagaaa

SEQ ID NO: 125852 - RNA, 19 nt, Homo sapiens
gcacuaagaaguuccuaaa

SEQ ID NO: 125853 - RNA, 19 nt, Homo sapiens
gaugaagaauggaagagaa

SEQ ID NO: 125854 - RNA, 19 nt, Homo sapiens
gaaauaaagaugggcuuaa

SEQ ID NO: 125855 - RNA, 19 nt, Homo sapiens
ccacaaagcucugucugau

SEQ ID NO: 125856 - RNA, 19 nt, Homo sapiens
gaacaugaaacuugcucua

SEQ ID NO: 125857 - RNA, 19 nt, Homo sapiens
uauaugaacuggccacuca

SEQ ID NO: 125858 - RNA, 19 nt, Homo sapiens
gcaaacagcccagcaaaca

SEQ ID NO: 125859 - RNA, 19 nt, Homo sapiens
ggagauguauuggugagaa

SEQ ID NO: 125860 - RNA, 19 nt, Homo sapiens
ccacaccucugccuuuguu

SEQ ID NO: 125861 - RNA, 19 nt, Homo sapiens
gaacaucgacucucucaac

SEQ ID NO: 125862 - RNA, 19 nt, Homo sapiens
gaaauuagacacgcaagga

SEQ ID NO: 125863 - RNA, 19 nt, Homo sapiens
gaaacugagucccacaaag

SEQ ID NO: 125864 - RNA, 19 nt, Homo sapiens
uuaaaugucucucuguuuc

SEQ ID NO: 125865 - RNA, 19 nt, Homo sapiens
gaagaaggacagcauagau

SEQ ID NO: 125866 - RNA, 19 nt, Homo sapiens
gcaagaaagauguugaaau

SEQ ID NO: 125867 - RNA, 19 nt, Homo sapiens
ggagagcacuaagaaguuc

SEQ ID NO: 125868 - RNA, 19 nt, Homo sapiens
guuauucugucuucacaaa

SEQ ID NO: 125869 - RNA, 19 nt, Homo sapiens
gcaaggacuucuucaacca

SEQ ID NO: 125870 - RNA, 19 nt, Homo sapiens
gaaagguucaguaagaaga

SEQ ID NO: 125871 - RNA, 19 nt, Homo sapiens
caucgacucucucaacaau

SEQ ID NO: 125872 - RNA, 19 nt, Homo sapiens
ggaagagaauacggucauu

SEQ ID NO: 125873 - RNA, 19 nt, Homo sapiens
cagggucucuggaaauuug

SEQ ID NO: 125874 - RNA, 19 nt, Homo sapiens
acaaagcucugucugaucu

SEQ ID NO: 125875 - RNA, 19 nt, Homo sapiens
gcacaucauuuggagugaa

SEQ ID NO: 125876 - RNA, 19 nt, Homo sapiens
gagauguauuggugagaaa

SEQ ID NO: 125877 - RNA, 19 nt, Homo sapiens
ccagagauuucaacuuagu

SEQ ID NO: 125878 - RNA, 19 nt, Homo sapiens
caugaaacuugcucuaauc

SEQ ID NO: 125879 - RNA, 19 nt, Homo sapiens
gagaggacuugcaagaaag

SEQ ID NO: 125880 - RNA, 19 nt, Homo sapiens
guucuuuccuucacuuuau

SEQ ID NO: 125881 - RNA, 19 nt, Homo sapiens
gcucgcagcccagucaaua

SEQ ID NO: 125882 - RNA, 19 nt, Homo sapiens
ugacacagagugcuauaaa

SEQ ID NO: 125883 - RNA, 19 nt, Homo sapiens
ucagaguccuucagaacuu

SEQ ID NO: 125884 - RNA, 19 nt, Homo sapiens
cauagauccuuacauauac

SEQ ID NO: 125885 - RNA, 19 nt, Homo sapiens
cuuaugcucuucaccauga

SEQ ID NO: 125886 - RNA, 19 nt, Homo sapiens
gaaaccaccagcaguguuc

SEQ ID NO: 125887 - RNA, 19 nt, Homo sapiens
aaagguggauucaagagau

SEQ ID NO: 125888 - RNA, 19 nt, Homo sapiens
gaacuucuccuucaaaccu

SEQ ID NO: 125889 - RNA, 19 nt, Homo sapiens
gaagagaauacggucauug

SEQ ID NO: 125890 - RNA, 19 nt, Homo sapiens
gaucagaacagugcuagug

SEQ ID NO: 125891 - RNA, 19 nt, Homo sapiens
cuaaguggagaaugaguua

SEQ ID NO: 125892 - RNA, 19 nt, Homo sapiens
uaagaagaaggacagcaua

SEQ ID NO: 125893 - RNA, 19 nt, Homo sapiens
ggagauugaugcaguuuug

SEQ ID NO: 125894 - RNA, 19 nt, Homo sapiens
ucacaaaucgaaggucuuu

SEQ ID NO: 125895 - RNA, 19 nt, Homo sapiens
ucagaacagugcuagugaa

SEQ ID NO: 125896 - RNA, 19 nt, Homo sapiens
ugaaugaaacacucagauu

SEQ ID NO: 125897 - RNA, 19 nt, Homo sapiens
acaugaaacuugcucuaau

SEQ ID NO: 125898 - RNA, 19 nt, Homo sapiens
gagguuugcucucaugaac

SEQ ID NO: 125899 - RNA, 19 nt, Homo sapiens
ugaaauaaagaugggcuua

SEQ ID NO: 125900 - RNA, 19 nt, Homo sapiens
uuacauauacacacccuuu

SEQ ID NO: 125901 - RNA, 19 nt, Homo sapiens
ggacuugcaagaaagaugu

SEQ ID NO: 125902 - RNA, 19 nt, Homo sapiens
ucccagaauucgaaagaaa

SEQ ID NO: 125903 - RNA, 19 nt, Homo sapiens
caaaagcaccgacuagauu

SEQ ID NO: 125904 - RNA, 19 nt, Homo sapiens
cuaaggauuucuacuuugg

SEQ ID NO: 125905 - RNA, 19 nt, Homo sapiens
gaggaguuccgcccugaaa

SEQ ID NO: 125906 - RNA, 19 nt, Homo sapiens
gacagagccugaggaguuc

SEQ ID NO: 125907 - RNA, 19 nt, Homo sapiens
gaagaaaagucgccucaac

SEQ ID NO: 125908 - RNA, 19 nt, Homo sapiens
aaacacagauccccuugaa

SEQ ID NO: 125909 - RNA, 19 nt, Homo sapiens
gucagggucucuggaaauu

SEQ ID NO: 125910 - RNA, 19 nt, Homo sapiens
aacccuaaguggagaauga

SEQ ID NO: 125911 - RNA, 19 nt, Homo sapiens
aaaggagauugaugcaguu

SEQ ID NO: 125912 - RNA, 19 nt, Homo sapiens
gaagaauggaagagaauac

SEQ ID NO: 125913 - RNA, 19 nt, Homo sapiens
ccagugggauuuaugaaaa

SEQ ID NO: 125914 - RNA, 19 nt, Homo sapiens
ucuaaggauuucuacuuug

SEQ ID NO: 125915 - RNA, 19 nt, Homo sapiens
aaggaagacucacagaaca

SEQ ID NO: 125916 - RNA, 19 nt, Homo sapiens
gcccacaccucugccuuug

SEQ ID NO: 125917 - RNA, 19 nt, Homo sapiens
ggaccucaucccaaauuug

SEQ ID NO: 125918 - RNA, 19 nt, Homo sapiens
acagaacacaguugaagaa

SEQ ID NO: 125919 - RNA, 19 nt, Homo sapiens
gguuugcucucaugaacau

SEQ ID NO: 125920 - RNA, 19 nt, Homo sapiens
gaaacugcauuggcaugag

SEQ ID NO: 125921 - RNA, 19 nt, Homo sapiens
gaugauugacucccagaau

SEQ ID NO: 125922 - RNA, 19 nt, Homo sapiens
gggaacguaugaaggucaa

SEQ ID NO: 125923 - RNA, 19 nt, Homo sapiens
ccagaacaccagagauuuc

SEQ ID NO: 125924 - RNA, 19 nt, Homo sapiens
guaagaagaaggacagcau

SEQ ID NO: 125925 - RNA, 19 nt, Homo sapiens
ugguggugauuccaacuua

SEQ ID NO: 125926 - RNA, 19 nt, Homo sapiens
gcagcccagucaauaaucu

SEQ ID NO: 125927 - RNA, 19 nt, Homo sapiens
augauugacucccagaauu

SEQ ID NO: 125928 - RNA, 19 nt, Homo sapiens
cagaacagugcuagugaaa

SEQ ID NO: 125929 - RNA, 19 nt, Homo sapiens
uaaucagaguccuucagaa

SEQ ID NO: 125930 - RNA, 19 nt, Homo sapiens
ggacccagaaacugcauug

SEQ ID NO: 125931 - RNA, 19 nt, Homo sapiens
gauuccaacuuaugcucuu

SEQ ID NO: 125932 - RNA, 19 nt, Homo sapiens
gugcuccucuaucuauaug

SEQ ID NO: 125933 - RNA, 19 nt, Homo sapiens
gaacaccagagauuucaac

SEQ ID NO: 125934 - RNA, 19 nt, Homo sapiens
gguggugauuccaacuuau

SEQ ID NO: 125935 - RNA, 19 nt, Homo sapiens
uggaguaccuugacauggu

SEQ ID NO: 125936 - RNA, 19 nt, Homo sapiens
gauccauuauuucucucaa

SEQ ID NO: 125937 - RNA, 19 nt, Homo sapiens
cagcagcacucagcuaaaa

SEQ ID NO: 125938 - RNA, 19 nt, Homo sapiens
ugaaacacucagauuauuc

SEQ ID NO: 125939 - RNA, 19 nt, Homo sapiens
aaacagcagcacucagcua

SEQ ID NO: 125940 - RNA, 19 nt, Homo sapiens
ggaagaggcauuuggauuu

SEQ ID NO: 125941 - RNA, 19 nt, Homo sapiens
caaagucaaucgauucuga

SEQ ID NO: 125942 - RNA, 19 nt, Homo sapiens
ggaaacaauuugccaugaa

SEQ ID NO: 125943 - RNA, 19 nt, Homo sapiens
ccaagugccuguccucauu

SEQ ID NO: 125944 - RNA, 19 nt, Homo sapiens
uaaauaaucugcacuucca

SEQ ID NO: 125945 - RNA, 19 nt, Homo sapiens
cgucacagcuguaaauugu

SEQ ID NO: 125946 - RNA, 19 nt, Homo sapiens
ucaaagcccuccagcaguu

SEQ ID NO: 125947 - RNA, 19 nt, Homo sapiens
ggaaugccuuucaccagaa

SEQ ID NO: 125948 - RNA, 19 nt, Homo sapiens
gaggaaggcucaacuacag

SEQ ID NO: 125949 - RNA, 19 nt, Homo sapiens
cagcacgucuccuugauga

SEQ ID NO: 125950 - RNA, 19 nt, Homo sapiens
caggaucaauuguaucuug

SEQ ID NO: 125951 - RNA, 19 nt, Homo sapiens
gaaacaauuugccaugaac

SEQ ID NO: 125952 - RNA, 19 nt, Homo sapiens
gcacacagaccaagugauc

SEQ ID NO: 125953 - RNA, 19 nt, Homo sapiens
gggaaacaauuugccauga

SEQ ID NO: 125954 - RNA, 19 nt, Homo sapiens
gagugaugcuggacaaaug

SEQ ID NO: 125955 - RNA, 19 nt, Homo sapiens
uaaauugugugcuuaaugc

SEQ ID NO: 125956 - RNA, 19 nt, Homo sapiens
gcuguaaauugugugcuua

SEQ ID NO: 125957 - RNA, 19 nt, Homo sapiens
gcucguggcucuggaaugu

SEQ ID NO: 125958 - RNA, 19 nt, Homo sapiens
gagaagaucaagaggaaga

SEQ ID NO: 125959 - RNA, 19 nt, Homo sapiens
ggacaauccucccaugacu

SEQ ID NO: 125960 - RNA, 19 nt, Homo sapiens
uggcuugucuguuccuaua

SEQ ID NO: 125961 - RNA, 19 nt, Homo sapiens
gugcugagguggacacguu

SEQ ID NO: 125962 - RNA, 19 nt, Homo sapiens
uggagaagaucaagaggaa

SEQ ID NO: 125963 - RNA, 19 nt, Homo sapiens
ccaccuguaucucuuguug

SEQ ID NO: 125964 - RNA, 19 nt, Homo sapiens
gaagaggcauuuggauuuu

SEQ ID NO: 125965 - RNA, 19 nt, Homo sapiens
acaauccucccaugacuua

SEQ ID NO: 125966 - RNA, 19 nt, Homo sapiens
cauccaaagucaaucgauu

SEQ ID NO: 125967 - RNA, 19 nt, Homo sapiens
ggacagggguggucagaga

SEQ ID NO: 125968 - RNA, 19 nt, Homo sapiens
uccauuaucucaaguaaca

SEQ ID NO: 125969 - RNA, 19 nt, Homo sapiens
gaagacaaggaccagcuuu

SEQ ID NO: 125970 - RNA, 19 nt, Homo sapiens
guggagacauucccaagug

SEQ ID NO: 125971 - RNA, 19 nt, Homo sapiens
ggacccacuuucucucuca

SEQ ID NO: 125972 - RNA, 19 nt, Homo sapiens
ccucguggcuuggauagaa

SEQ ID NO: 125973 - RNA, 19 nt, Homo sapiens
gacccgaaaucccaugguu

SEQ ID NO: 125974 - RNA, 19 nt, Homo sapiens
ucuaugacccugacuauau

SEQ ID NO: 125975 - RNA, 19 nt, Homo sapiens
uacaacggauucagaaaug

SEQ ID NO: 125976 - RNA, 19 nt, Homo sapiens
gcuugucuguuccuauauu

SEQ ID NO: 125977 - RNA, 19 nt, Homo sapiens
gaaugugucuggacuugcu

SEQ ID NO: 125978 - RNA, 19 nt, Homo sapiens
ggaauccaccugcgucuca

SEQ ID NO: 125979 - RNA, 19 nt, Homo sapiens
ggaauucucaguccuacau

SEQ ID NO: 125980 - RNA, 19 nt, Homo sapiens
ucaaggcaguucagcucua

SEQ ID NO: 125981 - RNA, 19 nt, Homo sapiens
aaucgauucugaacucuga

SEQ ID NO: 125982 - RNA, 19 nt, Homo sapiens
ggaaggcucaacuacagaa

SEQ ID NO: 125983 - RNA, 19 nt, Homo sapiens
guaaauugugugcuuaaug

SEQ ID NO: 125984 - RNA, 19 nt, Homo sapiens
gagcuacaacggauucaga

SEQ ID NO: 125985 - RNA, 19 nt, Homo sapiens
ggaacugcaucgggaaaca

SEQ ID NO: 125986 - RNA, 19 nt, Homo sapiens
guggacacguucauguuug

SEQ ID NO: 125987 - RNA, 19 nt, Homo sapiens
gguggacacguucauguuu

SEQ ID NO: 125988 - RNA, 19 nt, Homo sapiens
gaaugccuuucaccagaau

SEQ ID NO: 125989 - RNA, 19 nt, Homo sapiens
ugaaugggcagacaugguu

SEQ ID NO: 125990 - RNA, 19 nt, Homo sapiens
ccaccuguuucuuuguuug

SEQ ID NO: 125991 - RNA, 19 nt, Homo sapiens
gagaaugggagcaucuugu

SEQ ID NO: 125992 - RNA, 19 nt, Homo sapiens
cuaugacccugacuauaug

SEQ ID NO: 125993 - RNA, 19 nt, Homo sapiens
aagaaccugcucuccauua

SEQ ID NO: 125994 - RNA, 19 nt, Homo sapiens
ggagaaaagcugaguguug

SEQ ID NO: 125995 - RNA, 19 nt, Homo sapiens
gaccaagugauccaacuga

SEQ ID NO: 125996 - RNA, 19 nt, Homo sapiens
ggagaucagacccgaaauc

SEQ ID NO: 125997 - RNA, 19 nt, Homo sapiens
gucaaucgauucugaacuc

SEQ ID NO: 125998 - RNA, 19 nt, Homo sapiens
ucucaccaccuguuucuuu

SEQ ID NO: 125999 - RNA, 19 nt, Homo sapiens
cgacuuguguugaaaucca

SEQ ID NO: 126000 - RNA, 19 nt, Homo sapiens
gaacugcaucgggaaacaa

SEQ ID NO: 126001 - RNA, 19 nt, Homo sapiens
cgaaaucccaugguuccua

SEQ ID NO: 126002 - RNA, 19 nt, Homo sapiens
gcagacuccugggugaugu

SEQ ID NO: 126003 - RNA, 19 nt, Homo sapiens
cuugucuguuccuauauua

SEQ ID NO: 126004 - RNA, 19 nt, Homo sapiens
caccaccuguuucuuuguu

SEQ ID NO: 126005 - RNA, 19 nt, Homo sapiens
agaaccugcucuccauuau

SEQ ID NO: 126006 - RNA, 19 nt, Homo sapiens
cuacaacggauucagaaau

SEQ ID NO: 126007 - RNA, 19 nt, Homo sapiens
acaccaccaugugcauuaa

SEQ ID NO: 126008 - RNA, 19 nt, Homo sapiens
ggagaaugggagcaucuug

SEQ ID NO: 126009 - RNA, 19 nt, Homo sapiens
gaauucucaguccuacaua

SEQ ID NO: 126010 - RNA, 19 nt, Homo sapiens
ccacccaccucccaaacuc

SEQ ID NO: 126011 - RNA, 19 nt, Homo sapiens
agacaaggaccagcuuuga

SEQ ID NO: 126012 - RNA, 19 nt, Homo sapiens
gcacgacuuguguugaaau

SEQ ID NO: 126013 - RNA, 19 nt, Homo sapiens
acauacaggccauuaguga

SEQ ID NO: 126014 - RNA, 19 nt, Homo sapiens
gcucuaugacccugacuau

SEQ ID NO: 126015 - RNA, 19 nt, Homo sapiens
gaaccugcucuccauuauc

SEQ ID NO: 126016 - RNA, 19 nt, Homo sapiens
ucuccauuaucucaaguaa

SEQ ID NO: 126017 - RNA, 19 nt, Homo sapiens
uggaaugugucuggacuug

SEQ ID NO: 126018 - RNA, 19 nt, Homo sapiens
cuacccaccuguaucucuu

SEQ ID NO: 126019 - RNA, 19 nt, Homo sapiens
uugcacgacuuguguugaa

SEQ ID NO: 126020 - RNA, 19 nt, Homo sapiens
guccuccucuccauuuaug

SEQ ID NO: 126021 - RNA, 19 nt, Homo sapiens
ucaagaggaagaggcauuu

SEQ ID NO: 126022 - RNA, 19 nt, Homo sapiens
cugccuggcuugucuguuc

SEQ ID NO: 126023 - RNA, 19 nt, Homo sapiens
ucaaguaacagagcagaug

SEQ ID NO: 126024 - RNA, 19 nt, Homo sapiens
aaccugcucuccauuaucu

SEQ ID NO: 126025 - RNA, 19 nt, Homo sapiens
ucaggaggaucaaggaacu

SEQ ID NO: 126026 - RNA, 19 nt, Homo sapiens
ucuaugcucuggccacaca

SEQ ID NO: 126027 - RNA, 19 nt, Homo sapiens
uggacacguucauguuuga

SEQ ID NO: 126028 - RNA, 19 nt, Homo sapiens
gaaugggagcaucuuguca

SEQ ID NO: 126029 - RNA, 19 nt, Homo sapiens
gagguggacacguucaugu

SEQ ID NO: 126030 - RNA, 19 nt, Homo sapiens
uucacagccuccauccuua

SEQ ID NO: 126031 - RNA, 19 nt, Homo sapiens
cugcaucgggaaacaauuu

SEQ ID NO: 126032 - RNA, 19 nt, Homo sapiens
uacaccaccaugugcauua

SEQ ID NO: 126033 - RNA, 19 nt, Homo sapiens
caaggcaguucagcucuac

SEQ ID NO: 126034 - RNA, 19 nt, Homo sapiens
aaaagaaccugcucuccau

SEQ ID NO: 126035 - RNA, 19 nt, Homo sapiens
ccuucucucucucaccuuu

SEQ ID NO: 126036 - RNA, 19 nt, Homo sapiens
gaggcucccuaacccuugu

SEQ ID NO: 126037 - RNA, 19 nt, Homo sapiens
ggugaugucucuggaaucc

SEQ ID NO: 126038 - RNA, 19 nt, Homo sapiens
uuuauggccuucaccacaa

SEQ ID NO: 126039 - RNA, 19 nt, Homo sapiens
gcauuuggauuuucuggau

SEQ ID NO: 126040 - RNA, 19 nt, Homo sapiens
ucacugaagucaagaaaua

SEQ ID NO: 126041 - RNA, 19 nt, Homo sapiens
gaagcagacucucuuguaa

SEQ ID NO: 126042 - RNA, 19 nt, Homo sapiens
ggaaguagcucugaugaga

SEQ ID NO: 126043 - RNA, 19 nt, Homo sapiens
ucaggaggcuuguaguuua

SEQ ID NO: 126044 - RNA, 19 nt, Homo sapiens
gcccugagauucaugguua

SEQ ID NO: 126045 - RNA, 19 nt, Homo sapiens
ggaaguaggcauuaccaua

SEQ ID NO: 126046 - RNA, 19 nt, Homo sapiens
cagcaagccugucaccuuu

SEQ ID NO: 126047 - RNA, 19 nt, Homo sapiens
ugacuuaucugaccaugug

SEQ ID NO: 126048 - RNA, 19 nt, Homo sapiens
gggcugaaguggacacauu

SEQ ID NO: 126049 - RNA, 19 nt, Homo sapiens
gaagugcaccuuuggaaga

SEQ ID NO: 126050 - RNA, 19 nt, Homo sapiens
aaacuuacauuccaaccuu

SEQ ID NO: 126051 - RNA, 19 nt, Homo sapiens
gaaguaggcauuaccauag

SEQ ID NO: 126052 - RNA, 19 nt, Homo sapiens
cuaaggcuauggacaaauu

SEQ ID NO: 126053 - RNA, 19 nt, Homo sapiens
gagauguguuucuuuguug

SEQ ID NO: 126054 - RNA, 19 nt, Homo sapiens
gcagaaacuuacauuccaa

SEQ ID NO: 126055 - RNA, 19 nt, Homo sapiens
cgagaaacuucauuuaucu

SEQ ID NO: 126056 - RNA, 19 nt, Homo sapiens
ggacaagugggaagagaaa

SEQ ID NO: 126057 - RNA, 19 nt, Homo sapiens
ugagauguguuucuuuguu

SEQ ID NO: 126058 - RNA, 19 nt, Homo sapiens
gaggguaaguccuuugaca

SEQ ID NO: 126059 - RNA, 19 nt, Homo sapiens
acaccuggcuuucauuaug

SEQ ID NO: 126060 - RNA, 19 nt, Homo sapiens
caaauagaagaauggcuua

SEQ ID NO: 126061 - RNA, 19 nt, Homo sapiens
gcaagccugucaccuuugu

SEQ ID NO: 126062 - RNA, 19 nt, Homo sapiens
ggagaggccugcugguucu

SEQ ID NO: 126063 - RNA, 19 nt, Homo sapiens
gaacguuggcuaaggcuau

SEQ ID NO: 126064 - RNA, 19 nt, Homo sapiens
ucgagaaacuucauuuauc

SEQ ID NO: 126065 - RNA, 19 nt, Homo sapiens
uaucaugcauguauucuag

SEQ ID NO: 126066 - RNA, 19 nt, Homo sapiens
ugaagcagacucucuugua

SEQ ID NO: 126067 - RNA, 19 nt, Homo sapiens
ucacugagauguguuucuu

SEQ ID NO: 126068 - RNA, 19 nt, Homo sapiens
uucuagagcucauucauuu

SEQ ID NO: 126069 - RNA, 19 nt, Homo sapiens
agaggacagugcuauguaa

SEQ ID NO: 126070 - RNA, 19 nt, Homo sapiens
gcaccagcaucguuguaga

SEQ ID NO: 126071 - RNA, 19 nt, Homo sapiens
gaucuuggucuuaggcuuu

SEQ ID NO: 126072 - RNA, 19 nt, Homo sapiens
gcgcugaacacacucauga

SEQ ID NO: 126073 - RNA, 19 nt, Homo sapiens
gcucacaccuggcuuucau

SEQ ID NO: 126074 - RNA, 19 nt, Homo sapiens
agccugaucucuaugcaua

SEQ ID NO: 126075 - RNA, 19 nt, Homo sapiens
ggacagcagcuacuaccuu

SEQ ID NO: 126076 - RNA, 19 nt, Homo sapiens
guaaguccuuugacaucuu

SEQ ID NO: 126077 - RNA, 19 nt, Homo sapiens
gagaaggugcggaagaaga

SEQ ID NO: 126078 - RNA, 19 nt, Homo sapiens
gaaguagcucugaugagaa

SEQ ID NO: 126079 - RNA, 19 nt, Homo sapiens
cgccaucccuuugccuuua

SEQ ID NO: 126080 - RNA, 19 nt, Homo sapiens
gagaggagguccgcgagau

SEQ ID NO: 126081 - RNA, 19 nt, Homo sapiens
gggcugaucuuggucuuag

SEQ ID NO: 126082 - RNA, 19 nt, Homo sapiens
ucacaccuggcuuucauua

SEQ ID NO: 126083 - RNA, 19 nt, Homo sapiens
guucgagaaacuucauuua

SEQ ID NO: 126084 - RNA, 19 nt, Homo sapiens
gaagggaaguaggcauuac

SEQ ID NO: 126085 - RNA, 19 nt, Homo sapiens
guccugcgcuccaagaaug

SEQ ID NO: 126086 - RNA, 19 nt, Homo sapiens
ccuauaauuggcaaacuua

SEQ ID NO: 126087 - RNA, 19 nt, Homo sapiens
ucagcgaucucacucuguu

SEQ ID NO: 126088 - RNA, 19 nt, Homo sapiens
uuaccuaaaugaagacugu

SEQ ID NO: 126089 - RNA, 19 nt, Homo sapiens
gaagucaagaaauauggaa

SEQ ID NO: 126090 - RNA, 19 nt, Homo sapiens
ggucuuaggcuuucucaag

SEQ ID NO: 126091 - RNA, 19 nt, Homo sapiens
guguguguguuuagaauau

SEQ ID NO: 126092 - RNA, 19 nt, Homo sapiens
gaugagaaggugcggaaga

SEQ ID NO: 126093 - RNA, 19 nt, Homo sapiens
acugagauguguuucuuug

SEQ ID NO: 126094 - RNA, 19 nt, Homo sapiens
gcucauucauuuauucaac

SEQ ID NO: 126095 - RNA, 19 nt, Homo sapiens
ggaggcuuguaguuuagaa

SEQ ID NO: 126096 - RNA, 19 nt, Homo sapiens
ccacugagaaugcauccaa

SEQ ID NO: 126097 - RNA, 19 nt, Homo sapiens
ccaguaccauaaugacuuc

SEQ ID NO: 126098 - RNA, 19 nt, Homo sapiens
gaacuuugugugugugugu

SEQ ID NO: 126099 - RNA, 19 nt, Homo sapiens
ccucacggcugcccaucaa

SEQ ID NO: 126100 - RNA, 19 nt, Homo sapiens
agaaagcucgggaggguaa

SEQ ID NO: 126101 - RNA, 19 nt, Homo sapiens
guaucaugcuggacaagug

SEQ ID NO: 126102 - RNA, 19 nt, Homo sapiens
ucacugagucuacacguau

SEQ ID NO: 126103 - RNA, 19 nt, Homo sapiens
ccuuagagacucauaguga

SEQ ID NO: 126104 - RNA, 19 nt, Homo sapiens
cuagagcucauucauuuau

SEQ ID NO: 126105 - RNA, 19 nt, Homo sapiens
caaccauggugcccagcuu

SEQ ID NO: 126106 - RNA, 19 nt, Homo sapiens
gaggacagugcuauguaaa

SEQ ID NO: 126107 - RNA, 19 nt, Homo sapiens
gagcaccagcaucguugua

SEQ ID NO: 126108 - RNA, 19 nt, Homo sapiens
gguaaguccuuugacaucu

SEQ ID NO: 126109 - RNA, 19 nt, Homo sapiens
ugauguguaugacuucuuc

SEQ ID NO: 126110 - RNA, 19 nt, Homo sapiens
uggaauaugguaucacuga

SEQ ID NO: 126111 - RNA, 19 nt, Homo sapiens
ggaggcgaacguuggcuaa

SEQ ID NO: 126112 - RNA, 19 nt, Homo sapiens
aaguagcucugaugagaau

SEQ ID NO: 126113 - RNA, 19 nt, Homo sapiens
ggcuaaggcuauggacaaa

SEQ ID NO: 126114 - RNA, 19 nt, Homo sapiens
uaaguccuuugacaucuuc

SEQ ID NO: 126115 - RNA, 19 nt, Homo sapiens
gaggccugcugguucuuga

SEQ ID NO: 126116 - RNA, 19 nt, Homo sapiens
aaccaucacugaagucaag

SEQ ID NO: 126117 - RNA, 19 nt, Homo sapiens
uagaggacagugcuaugua

SEQ ID NO: 126118 - RNA, 19 nt, Homo sapiens
gacaugcccucgagaucca

SEQ ID NO: 126119 - RNA, 19 nt, Homo sapiens
uaucugaccaugugcauca

SEQ ID NO: 126120 - RNA, 19 nt, Homo sapiens
cagacucucuuguaaccau

SEQ ID NO: 126121 - RNA, 19 nt, Homo sapiens
caggaggcuuguaguuuag

SEQ ID NO: 126122 - RNA, 19 nt, Homo sapiens
ugaucucuaugcauaucua

SEQ ID NO: 126123 - RNA, 19 nt, Homo sapiens
gaagccugaucucuaugca

SEQ ID NO: 126124 - RNA, 19 nt, Homo sapiens
ucagcaagccugucaccuu

SEQ ID NO: 126125 - RNA, 19 nt, Homo sapiens
gggaugaucugggcaaaau

SEQ ID NO: 126126 - RNA, 19 nt, Homo sapiens
ggaggcaccuggacuuccu

SEQ ID NO: 126127 - RNA, 19 nt, Homo sapiens
ucuaugagccugacuaugc

SEQ ID NO: 126128 - RNA, 19 nt, Homo sapiens
uauggaauaugguaucacu

SEQ ID NO: 126129 - RNA, 19 nt, Homo sapiens
agagcucauucauuuauuc

SEQ ID NO: 126130 - RNA, 19 nt, Homo sapiens
uagaagggaaguaggcauu

SEQ ID NO: 126131 - RNA, 19 nt, Homo sapiens
gcagcaguuugccaugagu

SEQ ID NO: 126132 - RNA, 19 nt, Homo sapiens
agugguaucuccugguuuc

SEQ ID NO: 126133 - RNA, 19 nt, Homo sapiens
gugagcacaaggaaaguuu

SEQ ID NO: 126134 - RNA, 19 nt, Homo sapiens
gagcucauucauuuauuca

SEQ ID NO: 126135 - RNA, 19 nt, Homo sapiens
gguaucuccugguuucucu

SEQ ID NO: 126136 - RNA, 19 nt, Homo sapiens
ggaaaguuuugcccugaga

SEQ ID NO: 126137 - RNA, 19 nt, Homo sapiens
aaguaggcauuaccauaga

SEQ ID NO: 126138 - RNA, 19 nt, Homo sapiens
agaagggaaguaggcauua

SEQ ID NO: 126139 - RNA, 19 nt, Homo sapiens
gggaggguaaguccuuuga

SEQ ID NO: 126140 - RNA, 19 nt, Homo sapiens
gaaagcagcuacugaagaa

SEQ ID NO: 126141 - RNA, 19 nt, Homo sapiens
guacaacaaugcuuugaua

SEQ ID NO: 126142 - RNA, 19 nt, Homo sapiens
gcacuuagauccagaaauc

SEQ ID NO: 126143 - RNA, 19 nt, Homo sapiens
guaauggacucaaguuaaa

SEQ ID NO: 126144 - RNA, 19 nt, Homo sapiens
gaaacugcauuauuuguug

SEQ ID NO: 126145 - RNA, 19 nt, Homo sapiens
ggacucaaguuaaaguauu

SEQ ID NO: 126146 - RNA, 19 nt, Homo sapiens
cuaaaugacuugcagauga

SEQ ID NO: 126147 - RNA, 19 nt, Homo sapiens
aaacgacacuuucaucaaa

SEQ ID NO: 126148 - RNA, 19 nt, Homo sapiens
uaaggugacucgaguguuu

SEQ ID NO: 126149 - RNA, 19 nt, Homo sapiens
gaagcuggguauuuaacua

SEQ ID NO: 126150 - RNA, 19 nt, Homo sapiens
auacauggcuggaauaaga

SEQ ID NO: 126151 - RNA, 19 nt, Homo sapiens
ugaaugaccugccaguauu

SEQ ID NO: 126152 - RNA, 19 nt, Homo sapiens
ggaaggcaauccuauuugu

SEQ ID NO: 126153 - RNA, 19 nt, Homo sapiens
gacaaagacuaccuucuau

SEQ ID NO: 126154 - RNA, 19 nt, Homo sapiens
guuugaagcuggguauuua

SEQ ID NO: 126155 - RNA, 19 nt, Homo sapiens
uaaaugacuugcagaugaa

SEQ ID NO: 126156 - RNA, 19 nt, Homo sapiens
gaaagcacauauucuaaac

SEQ ID NO: 126157 - RNA, 19 nt, Homo sapiens
ugaaacauguggaguguau

SEQ ID NO: 126158 - RNA, 19 nt, Homo sapiens
ggaauuaggagaaggcaaa

SEQ ID NO: 126159 - RNA, 19 nt, Homo sapiens
caaagacuaccuucuauug

SEQ ID NO: 126160 - RNA, 19 nt, Homo sapiens
uaaggaggauuucacuuug

SEQ ID NO: 126161 - RNA, 19 nt, Homo sapiens
ggacagcuaaggaggauuu

SEQ ID NO: 126162 - RNA, 19 nt, Homo sapiens
gaagggauguauucuuucu

SEQ ID NO: 126163 - RNA, 19 nt, Homo sapiens
aagacuaccuucuauugua

SEQ ID NO: 126164 - RNA, 19 nt, Homo sapiens
gcacauauucuaaacaauc

SEQ ID NO: 126165 - RNA, 19 nt, Homo sapiens
gggcugugcucugcaauuu

SEQ ID NO: 126166 - RNA, 19 nt, Homo sapiens
aaacauguggaguguauua

SEQ ID NO: 126167 - RNA, 19 nt, Homo sapiens
ucuaggagcacaauaauuu

SEQ ID NO: 126168 - RNA, 19 nt, Homo sapiens
gacacuagaugauauuaca

SEQ ID NO: 126169 - RNA, 19 nt, Homo sapiens
ggaauaagaggacacuaga

SEQ ID NO: 126170 - RNA, 19 nt, Homo sapiens
agacaaagacuaccuucua

SEQ ID NO: 126171 - RNA, 19 nt, Homo sapiens
gaacccagaagcaaugaaa

SEQ ID NO: 126172 - RNA, 19 nt, Homo sapiens
gaaugaccugccaguauua

SEQ ID NO: 126173 - RNA, 19 nt, Homo sapiens
caccagugcuugcuuguga

SEQ ID NO: 126174 - RNA, 19 nt, Homo sapiens
gcuacaauauguccuggaa

SEQ ID NO: 126175 - RNA, 19 nt, Homo sapiens
agacuaccuucuauuguaa

SEQ ID NO: 126176 - RNA, 19 nt, Homo sapiens
gcaaaucaaaggaaacaug

SEQ ID NO: 126177 - RNA, 19 nt, Homo sapiens
guuaucagcucuaugucaa

SEQ ID NO: 126178 - RNA, 19 nt, Homo sapiens
cuaaggaggauuucacuuu

SEQ ID NO: 126179 - RNA, 19 nt, Homo sapiens
gaauacauggcuggaauaa

SEQ ID NO: 126180 - RNA, 19 nt, Homo sapiens
uacaauauguccuggaaga

SEQ ID NO: 126181 - RNA, 19 nt, Homo sapiens
uaaaacugccugacaauua

SEQ ID NO: 126182 - RNA, 19 nt, Homo sapiens
gugaauacauggcuggaau

SEQ ID NO: 126183 - RNA, 19 nt, Homo sapiens
gcagggccaugccuugaau

SEQ ID NO: 126184 - RNA, 19 nt, Homo sapiens
cagagcaaaucaaaggaaa

SEQ ID NO: 126185 - RNA, 19 nt, Homo sapiens
agccagggauugaaguuua

SEQ ID NO: 126186 - RNA, 19 nt, Homo sapiens
caagcuaaauguccaccuu

SEQ ID NO: 126187 - RNA, 19 nt, Homo sapiens
gaccuccagucuccucuaa

SEQ ID NO: 126188 - RNA, 19 nt, Homo sapiens
aaacauaaacgacacuuuc

SEQ ID NO: 126189 - RNA, 19 nt, Homo sapiens
ugacucgaguguuuaaaug

SEQ ID NO: 126190 - RNA, 19 nt, Homo sapiens
ugauucugaugcuuucuua

SEQ ID NO: 126191 - RNA, 19 nt, Homo sapiens
cuaaggaaacugcuuuauu

SEQ ID NO: 126192 - RNA, 19 nt, Homo sapiens
gcuugugaaucuuaacauu

SEQ ID NO: 126193 - RNA, 19 nt, Homo sapiens
ggauggaaauaccacugaa

SEQ ID NO: 126194 - RNA, 19 nt, Homo sapiens
uaucagcucuaugucaauu

SEQ ID NO: 126195 - RNA, 19 nt, Homo sapiens
gaccacaucuuugauuugg

SEQ ID NO: 126196 - RNA, 19 nt, Homo sapiens
ugaaccaccucuagagaau

SEQ ID NO: 126197 - RNA, 19 nt, Homo sapiens
gauagcaucauagcucuuu

SEQ ID NO: 126198 - RNA, 19 nt, Homo sapiens
ugacagaagggauguauuc

SEQ ID NO: 126199 - RNA, 19 nt, Homo sapiens
uguauuaagugcagcuuga

SEQ ID NO: 126200 - RNA, 19 nt, Homo sapiens
auucagggcuuuaaacaug

SEQ ID NO: 126201 - RNA, 19 nt, Homo sapiens
gaagauuguucgcuaucca

SEQ ID NO: 126202 - RNA, 19 nt, Homo sapiens
ccgaaaagauagcaucaua

SEQ ID NO: 126203 - RNA, 19 nt, Homo sapiens
gaaggcaauccuauuuguu

SEQ ID NO: 126204 - RNA, 19 nt, Homo sapiens
gcgacuuucuggaguuuau

SEQ ID NO: 126205 - RNA, 19 nt, Homo sapiens
aaacaaucuugacaacuuc

SEQ ID NO: 126206 - RNA, 19 nt, Homo sapiens
uaagugcagcuugacauua

SEQ ID NO: 126207 - RNA, 19 nt, Homo sapiens
cuucgggugugaucauaua

SEQ ID NO: 126208 - RNA, 19 nt, Homo sapiens
ggauuucacuuugcaccuu

SEQ ID NO: 126209 - RNA, 19 nt, Homo sapiens
acacagaaagcacauauuc

SEQ ID NO: 126210 - RNA, 19 nt, Homo sapiens
gaaggcauuugggcacaga

SEQ ID NO: 126211 - RNA, 19 nt, Homo sapiens
agaggacacuagaugauau

SEQ ID NO: 126212 - RNA, 19 nt, Homo sapiens
aauauguccuggaagauug

SEQ ID NO: 126213 - RNA, 19 nt, Homo sapiens
uguaauggacucaaguuaa

SEQ ID NO: 126214 - RNA, 19 nt, Homo sapiens
ggauguauucuuucugcua

SEQ ID NO: 126215 - RNA, 19 nt, Homo sapiens
gcaaacuaaugggaaaaua

SEQ ID NO: 126216 - RNA, 19 nt, Homo sapiens
ucagcucuaugucaauuga

SEQ ID NO: 126217 - RNA, 19 nt, Homo sapiens
guguuuaaaugccugugua

SEQ ID NO: 126218 - RNA, 19 nt, Homo sapiens
caauauguccuggaagauu

SEQ ID NO: 126219 - RNA, 19 nt, Homo sapiens
ggaaagcaucucagaacug

SEQ ID NO: 126220 - RNA, 19 nt, Homo sapiens
ugaguuaucagcucuaugu

SEQ ID NO: 126221 - RNA, 19 nt, Homo sapiens
aagugcagcuugacauuau

SEQ ID NO: 126222 - RNA, 19 nt, Homo sapiens
gcugugcucugcaauuugg

SEQ ID NO: 126223 - RNA, 19 nt, Homo sapiens
gcucuuuacccacaguuaa

SEQ ID NO: 126224 - RNA, 19 nt, Homo sapiens
gaucagccugcgcauguuu

SEQ ID NO: 126225 - RNA, 19 nt, Homo sapiens
gagcaaaucaaaggaaaca

SEQ ID NO: 126226 - RNA, 19 nt, Homo sapiens
cuagugaaacugcauuauu

SEQ ID NO: 126227 - RNA, 19 nt, Homo sapiens
gaucccgucuccgaagaaa

SEQ ID NO: 126228 - RNA, 19 nt, Homo sapiens
ugaaagcagcuacugaaga

SEQ ID NO: 126229 - RNA, 19 nt, Homo sapiens
gggaaagcaucucagaacu

SEQ ID NO: 126230 - RNA, 19 nt, Homo sapiens
ucaagcaauucgacaaagu

SEQ ID NO: 126231 - RNA, 19 nt, Homo sapiens
gaucgggagcuacaauaug

SEQ ID NO: 126232 - RNA, 19 nt, Homo sapiens
ggacgguuccuacaacauc

SEQ ID NO: 126233 - RNA, 19 nt, Homo sapiens
cauguggaguguauuaagu

SEQ ID NO: 126234 - RNA, 19 nt, Homo sapiens
guucaggacugcgcacaau

SEQ ID NO: 126235 - RNA, 19 nt, Homo sapiens
gcuaccgagugauguuuga

SEQ ID NO: 126236 - RNA, 19 nt, Homo sapiens
uaaacgacacuuucaucaa

SEQ ID NO: 126237 - RNA, 19 nt, Homo sapiens
caacuucuucuauauccaa

SEQ ID NO: 126238 - RNA, 19 nt, Homo sapiens
gccagggauugaaguuuau

SEQ ID NO: 126239 - RNA, 19 nt, Homo sapiens
ggaagacaaagacuaccuu

SEQ ID NO: 126240 - RNA, 19 nt, Homo sapiens
gaagcaagcuacaugagua

SEQ ID NO: 126241 - RNA, 19 nt, Homo sapiens
gcaagaagauccaccacua

SEQ ID NO: 126242 - RNA, 19 nt, Homo sapiens
caacaggucuagagaaaug

SEQ ID NO: 126243 - RNA, 19 nt, Homo sapiens
gcuggaagcuucucucuga

SEQ ID NO: 126244 - RNA, 19 nt, Homo sapiens
acucagagcuuucuucuau

SEQ ID NO: 126245 - RNA, 19 nt, Homo sapiens
cuagagaaaugauaccuuu

SEQ ID NO: 126246 - RNA, 19 nt, Homo sapiens
gaaauggccuccgaacugu

SEQ ID NO: 126247 - RNA, 19 nt, Homo sapiens
gaugaugccugccuugaga

SEQ ID NO: 126248 - RNA, 19 nt, Homo sapiens
cgaguaacauggcaucuug

SEQ ID NO: 126249 - RNA, 19 nt, Homo sapiens
gaucuuggcucacuacaac

SEQ ID NO: 126250 - RNA, 19 nt, Homo sapiens
uaacauggcaucuugcaaa

SEQ ID NO: 126251 - RNA, 19 nt, Homo sapiens
cugaguagcugggauuaua

SEQ ID NO: 126252 - RNA, 19 nt, Homo sapiens
caggaugucuuuaauguag

SEQ ID NO: 126253 - RNA, 19 nt, Homo sapiens
uacaacaggucuagagaaa

SEQ ID NO: 126254 - RNA, 19 nt, Homo sapiens
gcaacaugcuucaguuucu

SEQ ID NO: 126255 - RNA, 19 nt, Homo sapiens
ccauuuguaucauagcaua

SEQ ID NO: 126256 - RNA, 19 nt, Homo sapiens
ucaacgugaucacuauuaa

SEQ ID NO: 126257 - RNA, 19 nt, Homo sapiens
agacggcguuucaccauuu

SEQ ID NO: 126258 - RNA, 19 nt, Homo sapiens
gugagcagcugugaccaua

SEQ ID NO: 126259 - RNA, 19 nt, Homo sapiens
gcacauggacccugacauc

SEQ ID NO: 126260 - RNA, 19 nt, Homo sapiens
gcuacaggcaggagaguua

SEQ ID NO: 126261 - RNA, 19 nt, Homo sapiens
gagaaguccugaguacaga

SEQ ID NO: 126262 - RNA, 19 nt, Homo sapiens
gcucagaacacuaccauuc

SEQ ID NO: 126263 - RNA, 19 nt, Homo sapiens
ggaguucuauugcaucucu

SEQ ID NO: 126264 - RNA, 19 nt, Homo sapiens
ucacacacuuugacuuaga

SEQ ID NO: 126265 - RNA, 19 nt, Homo sapiens
ugacucagcuuggccaaug

SEQ ID NO: 126266 - RNA, 19 nt, Homo sapiens
ccggcuaguuucuguauuu

SEQ ID NO: 126267 - RNA, 19 nt, Homo sapiens
acacuuaucccacauccua

SEQ ID NO: 126268 - RNA, 19 nt, Homo sapiens
ggccagaggaguucuauug

SEQ ID NO: 126269 - RNA, 19 nt, Homo sapiens
guacuucaccuucgucaug

SEQ ID NO: 126270 - RNA, 19 nt, Homo sapiens
gucaggaugucuuuaaugu

SEQ ID NO: 126271 - RNA, 19 nt, Homo sapiens
caaacucggugcccugcaa

SEQ ID NO: 126272 - RNA, 19 nt, Homo sapiens
gcagugcaguggugugauc

SEQ ID NO: 126273 - RNA, 19 nt, Homo sapiens
caacuugguuugggagaug

SEQ ID NO: 126274 - RNA, 19 nt, Homo sapiens
gcaacuggcugggcaacau

SEQ ID NO: 126275 - RNA, 19 nt, Homo sapiens
acacuugacguuuacauuu

SEQ ID NO: 126276 - RNA, 19 nt, Homo sapiens
gcucagaccuuuacauccu

SEQ ID NO: 126277 - RNA, 19 nt, Homo sapiens
ccacuccuccuccugauuu

SEQ ID NO: 126278 - RNA, 19 nt, Homo sapiens
gagacggcguuucaccauu

SEQ ID NO: 126279 - RNA, 19 nt, Homo sapiens
cggcaccauuuguaucaua

SEQ ID NO: 126280 - RNA, 19 nt, Homo sapiens
gaaaccaucaguagagaca

SEQ ID NO: 126281 - RNA, 19 nt, Homo sapiens
ccaaugaaaccaucaguag

SEQ ID NO: 126282 - RNA, 19 nt, Homo sapiens
ucuccaaacuucucaacuu

SEQ ID NO: 126283 - RNA, 19 nt, Homo sapiens
ucagugaggugaagcucuu

SEQ ID NO: 126284 - RNA, 19 nt, Homo sapiens
gagaguuauucauggaguu

SEQ ID NO: 126285 - RNA, 19 nt, Homo sapiens
gcuugaaggaucuuaauga

SEQ ID NO: 126286 - RNA, 19 nt, Homo sapiens
cuccaaacuucucaacuuu

SEQ ID NO: 126287 - RNA, 19 nt, Homo sapiens
gaacucagagcuuucuucu

SEQ ID NO: 126288 - RNA, 19 nt, Homo sapiens
ccagucaggaugucuuuaa

SEQ ID NO: 126289 - RNA, 19 nt, Homo sapiens
cacaggaaguccagaggaa

SEQ ID NO: 126290 - RNA, 19 nt, Homo sapiens
aggcuuaucauucucuuua

SEQ ID NO: 126291 - RNA, 19 nt, Homo sapiens
aaacuagacuuugggcaau

SEQ ID NO: 126292 - RNA, 19 nt, Homo sapiens
ugugaugccucugaaauau

SEQ ID NO: 126293 - RNA, 19 nt, Homo sapiens
ccaaaguucugggauuaca

SEQ ID NO: 126294 - RNA, 19 nt, Homo sapiens
caccacacccggcuaguuu

SEQ ID NO: 126295 - RNA, 19 nt, Homo sapiens
acagugucauccaacauaa

SEQ ID NO: 126296 - RNA, 19 nt, Homo sapiens
gacuauacccugaagaugu

SEQ ID NO: 126297 - RNA, 19 nt, Homo sapiens
gaagcacccagaagcuauu

SEQ ID NO: 126298 - RNA, 19 nt, Homo sapiens
caggagaguuauucaugga

SEQ ID NO: 126299 - RNA, 19 nt, Homo sapiens
agaaauggccuccgaacug

SEQ ID NO: 126300 - RNA, 19 nt, Homo sapiens
cuagaacagugucauccaa

SEQ ID NO: 126301 - RNA, 19 nt, Homo sapiens
cagaggaguucuauugcau

SEQ ID NO: 126302 - RNA, 19 nt, Homo sapiens
caaguacugucucacuagu

SEQ ID NO: 126303 - RNA, 19 nt, Homo sapiens
ucagguugguucaugaaga

SEQ ID NO: 126304 - RNA, 19 nt, Homo sapiens
ugaugccucugaaauaugu

SEQ ID NO: 126305 - RNA, 19 nt, Homo sapiens
ggaugucuuuaauguagga

SEQ ID NO: 126306 - RNA, 19 nt, Homo sapiens
caacgugaucacuauuaaa

SEQ ID NO: 126307 - RNA, 19 nt, Homo sapiens
cauggcaucuugcaaacau

SEQ ID NO: 126308 - RNA, 19 nt, Homo sapiens
gaggaguucuauugcaucu

SEQ ID NO: 126309 - RNA, 19 nt, Homo sapiens
ccagaggaguucuauugca

SEQ ID NO: 126310 - RNA, 19 nt, Homo sapiens
ucucaacuuugccagcuuu

SEQ ID NO: 126311 - RNA, 19 nt, Homo sapiens
ucacacacuugacguuuac

SEQ ID NO: 126312 - RNA, 19 nt, Homo sapiens
gugcuuaauugccgugugu

SEQ ID NO: 126313 - RNA, 19 nt, Homo sapiens
cuucugcuauuacaucuug

SEQ ID NO: 126314 - RNA, 19 nt, Homo sapiens
ucaaggacacacagagaaa

SEQ ID NO: 126315 - RNA, 19 nt, Homo sapiens
ggucagagcaaagcaugaa

SEQ ID NO: 126316 - RNA, 19 nt, Homo sapiens
gagcagcugugaccauagc

SEQ ID NO: 126317 - RNA, 19 nt, Homo sapiens
uugcaucucucaccuguuc

SEQ ID NO: 126318 - RNA, 19 nt, Homo sapiens
ugcaagagcugucugaaaa

SEQ ID NO: 126319 - RNA, 19 nt, Homo sapiens
caaugaaaccaucaguaga

SEQ ID NO: 126320 - RNA, 19 nt, Homo sapiens
gugcaagagcugucugaaa

SEQ ID NO: 126321 - RNA, 19 nt, Homo sapiens
gauacaacaggucuagaga

SEQ ID NO: 126322 - RNA, 19 nt, Homo sapiens
cauccugucuucaaagucu

SEQ ID NO: 126323 - RNA, 19 nt, Homo sapiens
gaacagugucauccaacau

SEQ ID NO: 126324 - RNA, 19 nt, Homo sapiens
uaaaauaccaucucucaga

SEQ ID NO: 126325 - RNA, 19 nt, Homo sapiens
caacaugcuucaguuucug

SEQ ID NO: 126326 - RNA, 19 nt, Homo sapiens
gggcaacaugcuucaguuu

SEQ ID NO: 126327 - RNA, 19 nt, Homo sapiens
gcuauuacaucuuguucac

SEQ ID NO: 126328 - RNA, 19 nt, Homo sapiens
gaccuccaauucccuaagu

SEQ ID NO: 126329 - RNA, 19 nt, Homo sapiens
ucucugcguuucucuucua

SEQ ID NO: 126330 - RNA, 19 nt, Homo sapiens
gugcaguggugugaucuug

SEQ ID NO: 126331 - RNA, 19 nt, Homo sapiens
cauuccaagugcuuaauug

SEQ ID NO: 126332 - RNA, 19 nt, Homo sapiens
caccuugcccagcuaauuu

SEQ ID NO: 126333 - RNA, 19 nt, Homo sapiens
gccgaacccuccucucaca

SEQ ID NO: 126334 - RNA, 19 nt, Homo sapiens
ccucagcuaugcaggacaa

SEQ ID NO: 126335 - RNA, 19 nt, Homo sapiens
gagaugaugccugccuuga

SEQ ID NO: 126336 - RNA, 19 nt, Homo sapiens
gaguaucugugggcaacuu

SEQ ID NO: 126337 - RNA, 19 nt, Homo sapiens
cagcuuggccaaugcagaa

SEQ ID NO: 126338 - RNA, 19 nt, Homo sapiens
uccaaguacugucucacua

SEQ ID NO: 126339 - RNA, 19 nt, Homo sapiens
ccacauuccaagugcuuaa

SEQ ID NO: 126340 - RNA, 19 nt, Homo sapiens
gcagagauaucuuguaaau

SEQ ID NO: 126341 - RNA, 19 nt, Homo sapiens
guaaaugacuugguucuuc

SEQ ID NO: 126342 - RNA, 19 nt, Homo sapiens
ggcuaaaccuguaccauuu

SEQ ID NO: 126343 - RNA, 19 nt, Homo sapiens
gaaguguucaccacgauua

SEQ ID NO: 126344 - RNA, 19 nt, Homo sapiens
caguaaagcugacauauac

SEQ ID NO: 126345 - RNA, 19 nt, Homo sapiens
cugcagagauaucuuguaa

SEQ ID NO: 126346 - RNA, 19 nt, Homo sapiens
ucaauaugcuggagaacuu

SEQ ID NO: 126347 - RNA, 19 nt, Homo sapiens
gaacuucuacugggaauug

SEQ ID NO: 126348 - RNA, 19 nt, Homo sapiens
gauguggcccuucucuuua

SEQ ID NO: 126349 - RNA, 19 nt, Homo sapiens
acaagaacaucaccuacuu

SEQ ID NO: 126350 - RNA, 19 nt, Homo sapiens
gaauugagacagaaaggaa

SEQ ID NO: 126351 - RNA, 19 nt, Homo sapiens
gcccagcgauucauugaug

SEQ ID NO: 126352 - RNA, 19 nt, Homo sapiens
ccaagacacuggugcaagu

SEQ ID NO: 126353 - RNA, 19 nt, Homo sapiens
ccagaaguauggcccgauu

SEQ ID NO: 126354 - RNA, 19 nt, Homo sapiens
agaaguauggcccgauuua

SEQ ID NO: 126355 - RNA, 19 nt, Homo sapiens
ggaagcaacccagcaguga

SEQ ID NO: 126356 - RNA, 19 nt, Homo sapiens
guccaucacuaacgucauu

SEQ ID NO: 126357 - RNA, 19 nt, Homo sapiens
gacaauggcuggcuaaacc

SEQ ID NO: 126358 - RNA, 19 nt, Homo sapiens
gaugaccuguuccgcuuug

SEQ ID NO: 126359 - RNA, 19 nt, Homo sapiens
ucgccuaucaccaguauua

SEQ ID NO: 126360 - RNA, 19 nt, Homo sapiens
ggagucgguuuaugucauc

SEQ ID NO: 126361 - RNA, 19 nt, Homo sapiens
uccagaauuuccagaagua

SEQ ID NO: 126362 - RNA, 19 nt, Homo sapiens
gcucaguccuggucaaagg

SEQ ID NO: 126363 - RNA, 19 nt, Homo sapiens
gcaacguggagucgguuua

SEQ ID NO: 126364 - RNA, 19 nt, Homo sapiens
ggaguccuguugaagaagu

SEQ ID NO: 126365 - RNA, 19 nt, Homo sapiens
ucaccaguauuaccagaga

SEQ ID NO: 126366 - RNA, 19 nt, Homo sapiens
ggucgccuaucaccaguau

SEQ ID NO: 126367 - RNA, 19 nt, Homo sapiens
gggagaagcucggcaacgu

SEQ ID NO: 126368 - RNA, 19 nt, Homo sapiens
ccaucuuccucaucaauau

SEQ ID NO: 126369 - RNA, 19 nt, Homo sapiens
ugacuugguucuucgagau

SEQ ID NO: 126370 - RNA, 19 nt, Homo sapiens
ccgugacccugcagagaua

SEQ ID NO: 126371 - RNA, 19 nt, Homo sapiens
ggaccaagaccuggaagga

SEQ ID NO: 126372 - RNA, 19 nt, Homo sapiens
ggagacgggcacacacaaa

SEQ ID NO: 126373 - RNA, 19 nt, Homo sapiens
gagcaaagacaagaacauc

SEQ ID NO: 126374 - RNA, 19 nt, Homo sapiens
gcggaucgcugagcuagag

SEQ ID NO: 126375 - RNA, 19 nt, Homo sapiens
agauguggcccuucucuuu

SEQ ID NO: 126376 - RNA, 19 nt, Homo sapiens
ucaucaauaugcuggagaa

SEQ ID NO: 126377 - RNA, 19 nt, Homo sapiens
ggacgugauuuucaguaaa

SEQ ID NO: 126378 - RNA, 19 nt, Homo sapiens
gccgagagcccaccuucuu

SEQ ID NO: 126379 - RNA, 19 nt, Homo sapiens
caugauuccugccaagaca

SEQ ID NO: 126380 - RNA, 19 nt, Homo sapiens
ucuucgagauuacaugauu

SEQ ID NO: 126381 - RNA, 19 nt, Homo sapiens
agacagaaaggaaguguuc

SEQ ID NO: 126382 - RNA, 19 nt, Homo sapiens
uggcuaaaccuguaccauu

SEQ ID NO: 126383 - RNA, 19 nt, Homo sapiens
caucaaggagacacuaaga

SEQ ID NO: 126384 - RNA, 19 nt, Homo sapiens
cccgauggcugagcaaaga

SEQ ID NO: 126385 - RNA, 19 nt, Homo sapiens
caaggagacacuaagacuu

SEQ ID NO: 126386 - RNA, 19 nt, Homo sapiens
ccucaaagccagcaucaag

SEQ ID NO: 126387 - RNA, 19 nt, Homo sapiens
caucaaggccaacgucaca

SEQ ID NO: 126388 - RNA, 19 nt, Homo sapiens
gcacaggcgcaucaagaag

SEQ ID NO: 126389 - RNA, 19 nt, Homo sapiens
caacguggagucgguuuau

SEQ ID NO: 126390 - RNA, 19 nt, Homo sapiens
guccagaauuuccagaagu

SEQ ID NO: 126391 - RNA, 19 nt, Homo sapiens
gaagcaacccagcagugau

SEQ ID NO: 126392 - RNA, 19 nt, Homo sapiens
gcaaagacaagaacaucac

SEQ ID NO: 126393 - RNA, 19 nt, Homo sapiens
gcaaguggccaucuaugcu

SEQ ID NO: 126394 - RNA, 19 nt, Homo sapiens
ggaaguguucaccacgauu

SEQ ID NO: 126395 - RNA, 19 nt, Homo sapiens
ggaauugagacagaaagga

SEQ ID NO: 126396 - RNA, 19 nt, Homo sapiens
gaaaagcccaucuccuuca

SEQ ID NO: 126397 - RNA, 19 nt, Homo sapiens
ucuuguaaaugacuugguu

SEQ ID NO: 126398 - RNA, 19 nt, Homo sapiens
acauucaaccucauucuga

SEQ ID NO: 126399 - RNA, 19 nt, Homo sapiens
ucaaagccagcaucaagga

SEQ ID NO: 126400 - RNA, 19 nt, Homo sapiens
acagcaagauguccuucga

SEQ ID NO: 126401 - RNA, 19 nt, Homo sapiens
caacccagcagugaucaga

SEQ ID NO: 126402 - RNA, 19 nt, Homo sapiens
gaccaucuuccucaucaau

SEQ ID NO: 126403 - RNA, 19 nt, Homo sapiens
ucagucgucugucccaagu

SEQ ID NO: 126404 - RNA, 19 nt, Homo sapiens
caagaacaucaccuacuuc

SEQ ID NO: 126405 - RNA, 19 nt, Homo sapiens
gacaagaacaucaccuacu

SEQ ID NO: 126406 - RNA, 19 nt, Homo sapiens
agacauggccacgaugcua

SEQ ID NO: 126407 - RNA, 19 nt, Homo sapiens
acauauacacccagaacuu

SEQ ID NO: 126408 - RNA, 19 nt, Homo sapiens
gccuuugaguccaucacua

SEQ ID NO: 126409 - RNA, 19 nt, Homo sapiens
cauucaaccucauucugau

SEQ ID NO: 126410 - RNA, 19 nt, Homo sapiens
gcaccacauucaaccucau

SEQ ID NO: 126411 - RNA, 19 nt, Homo sapiens
guucuucgagauuacauga

SEQ ID NO: 126412 - RNA, 19 nt, Homo sapiens
cacacaaaguccaccuuca

SEQ ID NO: 126413 - RNA, 19 nt, Homo sapiens
ccuuugaguccaucacuaa

SEQ ID NO: 126414 - RNA, 19 nt, Homo sapiens
caaaguccaccuucaccau

SEQ ID NO: 126415 - RNA, 19 nt, Homo sapiens
acaauaaacagcugaacca

SEQ ID NO: 126416 - RNA, 19 nt, Homo sapiens
gcuaaaccuguaccauuuc

SEQ ID NO: 126417 - RNA, 19 nt, Homo sapiens
gagacgggcacacacaaag

SEQ ID NO: 126418 - RNA, 19 nt, Homo sapiens
aaggagacacuaagacuuc

SEQ ID NO: 126419 - RNA, 19 nt, Homo sapiens
cauauacacccagaacuuc

SEQ ID NO: 126420 - RNA, 19 nt, Homo sapiens
gggacgugauuuucaguaa

SEQ ID NO: 126421 - RNA, 19 nt, Homo sapiens
cuaaaccuguaccauuucu

SEQ ID NO: 126422 - RNA, 19 nt, Homo sapiens
cuccagaggccaccaagaa

SEQ ID NO: 126423 - RNA, 19 nt, Homo sapiens
ucccaaguccugcuccuuu

SEQ ID NO: 126424 - RNA, 19 nt, Homo sapiens
ucaccuacuuccggaacuu

SEQ ID NO: 126425 - RNA, 19 nt, Homo sapiens
gagauaucuuguaaaugac

SEQ ID NO: 126426 - RNA, 19 nt, Homo sapiens
uucaccauguccagaauuu

SEQ ID NO: 126427 - RNA, 19 nt, Homo sapiens
ugucaucgacccugaagau

SEQ ID NO: 126428 - RNA, 19 nt, Homo sapiens
ucgcugagcuagagaugac

SEQ ID NO: 126429 - RNA, 19 nt, Homo sapiens
aagacaagaacaucaccua

SEQ ID NO: 126430 - RNA, 19 nt, Homo sapiens
ugacauauacacccagaac

SEQ ID NO: 126431 - RNA, 19 nt, Homo sapiens
gaaguauggcccgauuuac

SEQ ID NO: 126432 - RNA, 19 nt, Homo sapiens
ccuguuggaugcagugucu

SEQ ID NO: 126433 - RNA, 19 nt, Homo sapiens
gagacaauaaacagcugaa

SEQ ID NO: 126434 - RNA, 19 nt, Homo sapiens
cagguugaauggguucuca

SEQ ID NO: 126435 - RNA, 19 nt, Homo sapiens
cagaauuuccagaaguaug

SEQ ID NO: 126436 - RNA, 19 nt, Homo sapiens
ucaaggagacacuaagacu

SEQ ID NO: 126437 - RNA, 19 nt, Homo sapiens
auguggcccuucucuuuaa

SEQ ID NO: 126438 - RNA, 19 nt, Homo sapiens
cagaggccaccaagaacuu

SEQ ID NO: 126439 - RNA, 19 nt, Homo sapiens
cccaaguccugcuccuuuc

SEQ ID NO: 126440 - RNA, 19 nt, Homo sapiens
ggacagugcugcccuuuga

SEQ ID NO: 126441 - RNA, 19 nt, Homo sapiens
cgacaacuguauccagaaa

SEQ ID NO: 126442 - RNA, 19 nt, Homo sapiens
agaagaaggugcugcagaa

SEQ ID NO: 126443 - RNA, 19 nt, Homo sapiens
gagcaggcauggugugugu

SEQ ID NO: 126444 - RNA, 19 nt, Homo sapiens
ggagggagcaggguuauga

SEQ ID NO: 126445 - RNA, 19 nt, Homo sapiens
gcccugagcucucugaaag

SEQ ID NO: 126446 - RNA, 19 nt, Homo sapiens
gaauggcacucagggcaaa

SEQ ID NO: 126447 - RNA, 19 nt, Homo sapiens
gucuacagcuucauauuga

SEQ ID NO: 126448 - RNA, 19 nt, Homo sapiens
uggcggagcuccuguugaa

SEQ ID NO: 126449 - RNA, 19 nt, Homo sapiens
cauagaagccagcaacuug

SEQ ID NO: 126450 - RNA, 19 nt, Homo sapiens
cuucagagccaucaacuaa

SEQ ID NO: 126451 - RNA, 19 nt, Homo sapiens
uaaagauggucuacagcuu

SEQ ID NO: 126452 - RNA, 19 nt, Homo sapiens
ucagagccaucaacuaauc

SEQ ID NO: 126453 - RNA, 19 nt, Homo sapiens
gcucagacuuggugcuuca

SEQ ID NO: 126454 - RNA, 19 nt, Homo sapiens
ggucuacagcuucauauug

SEQ ID NO: 126455 - RNA, 19 nt, Homo sapiens
ccacgugcccuuuggcuuu

SEQ ID NO: 126456 - RNA, 19 nt, Homo sapiens
ggacauuggugcgcguguu

SEQ ID NO: 126457 - RNA, 19 nt, Homo sapiens
gaaaguugucgcccuggaa

SEQ ID NO: 126458 - RNA, 19 nt, Homo sapiens
gauggucuacagcuucaua

SEQ ID NO: 126459 - RNA, 19 nt, Homo sapiens
gcggaacugucgccagaug

SEQ ID NO: 126460 - RNA, 19 nt, Homo sapiens
ggaagaucuugcugaccuu

SEQ ID NO: 126461 - RNA, 19 nt, Homo sapiens
guguuucccuugcugauga

SEQ ID NO: 126462 - RNA, 19 nt, Homo sapiens
gaaaaucuaucaggaacug

SEQ ID NO: 126463 - RNA, 19 nt, Homo sapiens
ccugagcucucugaaaguu

SEQ ID NO: 126464 - RNA, 19 nt, Homo sapiens
acauaaagauggucuacag

SEQ ID NO: 126465 - RNA, 19 nt, Homo sapiens
caucuuccacuacaccaua

SEQ ID NO: 126466 - RNA, 19 nt, Homo sapiens
caacaucgugggcacaaau

SEQ ID NO: 126467 - RNA, 19 nt, Homo sapiens
ccaacgcugugcagagguu

SEQ ID NO: 126468 - RNA, 19 nt, Homo sapiens
ccaagaggacauaaagaug

SEQ ID NO: 126469 - RNA, 19 nt, Homo sapiens
ggaccugcaccuggaagua

SEQ ID NO: 126470 - RNA, 19 nt, Homo sapiens
gcggagcuccuguugaaug

SEQ ID NO: 126471 - RNA, 19 nt, Homo sapiens
caucaaggccaacucuaug

SEQ ID NO: 126472 - RNA, 19 nt, Homo sapiens
gcaggcaugguguguguga

SEQ ID NO: 126473 - RNA, 19 nt, Homo sapiens
ugagcucucugaaaguugu

SEQ ID NO: 126474 - RNA, 19 nt, Homo sapiens
caaauguggcguguucuug

SEQ ID NO: 126475 - RNA, 19 nt, Homo sapiens
ccaccagccucccuuucug

SEQ ID NO: 126476 - RNA, 19 nt, Homo sapiens
cagacuuggugcuucagaa

SEQ ID NO: 126477 - RNA, 19 nt, Homo sapiens
gaggucauguucaaaucca

SEQ ID NO: 126478 - RNA, 19 nt, Homo sapiens
uggagacacuaacccaaga

SEQ ID NO: 126479 - RNA, 19 nt, Homo sapiens
ggacauaaagauggucuac

SEQ ID NO: 126480 - RNA, 19 nt, Homo sapiens
uaacccaagaggacauaaa

SEQ ID NO: 126481 - RNA, 19 nt, Homo sapiens
ccaucaaggccaacucuau

SEQ ID NO: 126482 - RNA, 19 nt, Homo sapiens
ggcguguucuugcugaaug

SEQ ID NO: 126483 - RNA, 19 nt, Homo sapiens
gguccugcaggguagaaua

SEQ ID NO: 126484 - RNA, 19 nt, Homo sapiens
gaucccagcaucucagagu

SEQ ID NO: 126485 - RNA, 19 nt, Homo sapiens
aagauggucuacagcuuca

SEQ ID NO: 126486 - RNA, 19 nt, Homo sapiens
gcggcugaauccagaagug

SEQ ID NO: 126487 - RNA, 19 nt, Homo sapiens
augcaagggugcugugguu

SEQ ID NO: 126488 - RNA, 19 nt, Homo sapiens
acuuggugcuucagaacua

SEQ ID NO: 126489 - RNA, 19 nt, Homo sapiens
caaggccaacucuauggaa

SEQ ID NO: 126490 - RNA, 19 nt, Homo sapiens
gagcucagacuuggugcuu

SEQ ID NO: 126491 - RNA, 19 nt, Homo sapiens
cccaagaggacauaaagau

SEQ ID NO: 126492 - RNA, 19 nt, Homo sapiens
guccugcaggguagaauaa

SEQ ID NO: 126493 - RNA, 19 nt, Homo sapiens
gcaagggugcugugguuuu

SEQ ID NO: 126494 - RNA, 19 nt, Homo sapiens
gggcacagcuggggaagau

SEQ ID NO: 126495 - RNA, 19 nt, Homo sapiens
ggccugggacugcaucuuc

SEQ ID NO: 126496 - RNA, 19 nt, Homo sapiens
caagggugcugugguuuug

SEQ ID NO: 126497 - RNA, 19 nt, Homo sapiens
guacggcgacaacuguauc

SEQ ID NO: 126498 - RNA, 19 nt, Homo sapiens
acaugucccuguuccucuu

SEQ ID NO: 126499 - RNA, 19 nt, Homo sapiens
aagaggacauaaagauggu

SEQ ID NO: 126500 - RNA, 19 nt, Homo sapiens
gcagccagcaucagugaac

SEQ ID NO: 126501 - RNA, 19 nt, Homo sapiens
ccauagaagccagcaacuu

SEQ ID NO: 126502 - RNA, 19 nt, Homo sapiens
ggccaacucuauggaacuc

SEQ ID NO: 126503 - RNA, 19 nt, Homo sapiens
uguggaaggagcacuuuga

SEQ ID NO: 126504 - RNA, 19 nt, Homo sapiens
uggaggucauguucaaauc

SEQ ID NO: 126505 - RNA, 19 nt, Homo sapiens
cccagcaucuuccacuaca

SEQ ID NO: 126506 - RNA, 19 nt, Homo sapiens
ucagaguccagucaaguuc

SEQ ID NO: 126507 - RNA, 19 nt, Homo sapiens
cggaggacguggagaagcu

SEQ ID NO: 126508 - RNA, 19 nt, Homo sapiens
gacaacaucgugggcacaa

SEQ ID NO: 126509 - RNA, 19 nt, Homo sapiens
agagauggcuuccuuguuu

SEQ ID NO: 126510 - RNA, 19 nt, Homo sapiens
cauagaagccagcaacuua

SEQ ID NO: 126511 - RNA, 19 nt, Homo sapiens
gagauggcuuccuuguuua

SEQ ID NO: 126512 - RNA, 19 nt, Homo sapiens
ggaaauacuuagguaauca

SEQ ID NO: 126513 - RNA, 19 nt, Homo sapiens
uggcagagcuccuguugaa

SEQ ID NO: 126514 - RNA, 19 nt, Homo sapiens
ucacuuauccugacacauu

SEQ ID NO: 126515 - RNA, 19 nt, Homo sapiens
agaagaaggugcugcagaa

SEQ ID NO: 126516 - RNA, 19 nt, Homo sapiens
gggcacagcuggagacgau

SEQ ID NO: 126517 - RNA, 19 nt, Homo sapiens
ugacaacuguauccagaaa

SEQ ID NO: 126518 - RNA, 19 nt, Homo sapiens
ggagggagcaggguuauga

SEQ ID NO: 126519 - RNA, 19 nt, Homo sapiens
gcccugagcucucugaaag

SEQ ID NO: 126520 - RNA, 19 nt, Homo sapiens
uugccaggcuugucaaaua

SEQ ID NO: 126521 - RNA, 19 nt, Homo sapiens
ccucagagauggcuuccuu

SEQ ID NO: 126522 - RNA, 19 nt, Homo sapiens
gucuacagcuucauauuga

SEQ ID NO: 126523 - RNA, 19 nt, Homo sapiens
ccagguguguucaguaguu

SEQ ID NO: 126524 - RNA, 19 nt, Homo sapiens
ucagagcgauuaacuaguc

SEQ ID NO: 126525 - RNA, 19 nt, Homo sapiens
uaaagauggucuacagcuu

SEQ ID NO: 126526 - RNA, 19 nt, Homo sapiens
gccagcaacuuagcucuuu

SEQ ID NO: 126527 - RNA, 19 nt, Homo sapiens
gcacagggaggcugcaguu

SEQ ID NO: 126528 - RNA, 19 nt, Homo sapiens
gcgauuaacuagucuugca

SEQ ID NO: 126529 - RNA, 19 nt, Homo sapiens
gggaaauacuuagguaauc

SEQ ID NO: 126530 - RNA, 19 nt, Homo sapiens
gcucagacuuggugcuuca

SEQ ID NO: 126531 - RNA, 19 nt, Homo sapiens
gcguuucccuugcugauga

SEQ ID NO: 126532 - RNA, 19 nt, Homo sapiens
ggucuacagcuucauauug

SEQ ID NO: 126533 - RNA, 19 nt, Homo sapiens
ccacgugcccuuuggcuuu

SEQ ID NO: 126534 - RNA, 19 nt, Homo sapiens
caaccgcccucaacacuac

SEQ ID NO: 126535 - RNA, 19 nt, Homo sapiens
ccugguagcugaugaggau

SEQ ID NO: 126536 - RNA, 19 nt, Homo sapiens
ccaaggccgugcagagguu

SEQ ID NO: 126537 - RNA, 19 nt, Homo sapiens
gaacgugcccagccacauc

SEQ ID NO: 126538 - RNA, 19 nt, Homo sapiens
ccaacaaggacucagauga

SEQ ID NO: 126539 - RNA, 19 nt, Homo sapiens
ggacauugguacagguuuu

SEQ ID NO: 126540 - RNA, 19 nt, Homo sapiens
caacaggagagacaggauu

SEQ ID NO: 126541 - RNA, 19 nt, Homo sapiens
gauggucuacagcuucaua

SEQ ID NO: 126542 - RNA, 19 nt, Homo sapiens
uaacucaagaggacauaaa

SEQ ID NO: 126543 - RNA, 19 nt, Homo sapiens
ccagccacaucaucuuuau

SEQ ID NO: 126544 - RNA, 19 nt, Homo sapiens
ccagccagcuccugcacaa

SEQ ID NO: 126545 - RNA, 19 nt, Homo sapiens
ccugagcucucugaaaguu

SEQ ID NO: 126546 - RNA, 19 nt, Homo sapiens
acauaaagauggucuacag

SEQ ID NO: 126547 - RNA, 19 nt, Homo sapiens
gacccaagguguggaagga

SEQ ID NO: 126548 - RNA, 19 nt, Homo sapiens
caucuuccacuacaccaua

SEQ ID NO: 126549 - RNA, 19 nt, Homo sapiens
caacaucgugggcacaaau

SEQ ID NO: 126550 - RNA, 19 nt, Homo sapiens
gcggaacugucacuagaag

SEQ ID NO: 126551 - RNA, 19 nt, Homo sapiens
gaaaguugucacccuggaa

SEQ ID NO: 126552 - RNA, 19 nt, Homo sapiens
gggugugguuccagaaaug

SEQ ID NO: 126553 - RNA, 19 nt, Homo sapiens
caucaaggccaacucuaug

SEQ ID NO: 126554 - RNA, 19 nt, Homo sapiens
augcaagggugcugugauu

SEQ ID NO: 126555 - RNA, 19 nt, Homo sapiens
gcuccaggcuccucaugag

SEQ ID NO: 126556 - RNA, 19 nt, Homo sapiens
aggcggaacugucacuaga

SEQ ID NO: 126557 - RNA, 19 nt, Homo sapiens
cacuuauccugacacauuu

SEQ ID NO: 126558 - RNA, 19 nt, Homo sapiens
uggagacacuaacucaaga

SEQ ID NO: 126559 - RNA, 19 nt, Homo sapiens
ggagauggaagagucaugu

SEQ ID NO: 126560 - RNA, 19 nt, Homo sapiens
ugagcucucugaaaguugu

SEQ ID NO: 126561 - RNA, 19 nt, Homo sapiens
ucaagaggacauaaagaug

SEQ ID NO: 126562 - RNA, 19 nt, Homo sapiens
caaauguggcguguucuug

SEQ ID NO: 126563 - RNA, 19 nt, Homo sapiens
cagcaugggaaaggaauaa

SEQ ID NO: 126564 - RNA, 19 nt, Homo sapiens
ggcguguucuuguugaaug

SEQ ID NO: 126565 - RNA, 19 nt, Homo sapiens
uggagaaggucccgaggau

SEQ ID NO: 126566 - RNA, 19 nt, Homo sapiens
gcaagggugcugugauuuu

SEQ ID NO: 126567 - RNA, 19 nt, Homo sapiens
cuggacagcuugacucuac

SEQ ID NO: 126568 - RNA, 19 nt, Homo sapiens
cagacuuggugcuucagaa

SEQ ID NO: 126569 - RNA, 19 nt, Homo sapiens
gaggucauguucaaaucca

SEQ ID NO: 126570 - RNA, 19 nt, Homo sapiens
gcccagccacaucaucuuu

SEQ ID NO: 126571 - RNA, 19 nt, Homo sapiens
gcuccuagcccagcagaga

SEQ ID NO: 126572 - RNA, 19 nt, Homo sapiens
gccagcuccugcacaaaug

SEQ ID NO: 126573 - RNA, 19 nt, Homo sapiens
cgacagcguuucccuugcu

SEQ ID NO: 126574 - RNA, 19 nt, Homo sapiens
gagcgauuaacuagucuug

SEQ ID NO: 126575 - RNA, 19 nt, Homo sapiens
ccacgcaugguguguguga

SEQ ID NO: 126576 - RNA, 19 nt, Homo sapiens
ggacauaaagauggucuac

SEQ ID NO: 126577 - RNA, 19 nt, Homo sapiens
ccaucaaggccaacucuau

SEQ ID NO: 126578 - RNA, 19 nt, Homo sapiens
guugaaggcggaacuguca

SEQ ID NO: 126579 - RNA, 19 nt, Homo sapiens
gcagcaugggaaaggaaua

SEQ ID NO: 126580 - RNA, 19 nt, Homo sapiens
gaugaggaucagagcguuu

SEQ ID NO: 126581 - RNA, 19 nt, Homo sapiens
gaucccagcaucucagagu

SEQ ID NO: 126582 - RNA, 19 nt, Homo sapiens
ccauccaacuccucuaguc

SEQ ID NO: 126583 - RNA, 19 nt, Homo sapiens
aagauggucuacagcuuca

SEQ ID NO: 126584 - RNA, 19 nt, Homo sapiens
gaaggcggaacugucacua

SEQ ID NO: 126585 - RNA, 19 nt, Homo sapiens
acuuggugcuucagaacua

SEQ ID NO: 126586 - RNA, 19 nt, Homo sapiens
caaggccaacucuauggaa

SEQ ID NO: 126587 - RNA, 19 nt, Homo sapiens
gugcacagaccucagagau

SEQ ID NO: 126588 - RNA, 19 nt, Homo sapiens
guucaagcagcgaguguug

SEQ ID NO: 126589 - RNA, 19 nt, Homo sapiens
aauguggcguguucuuguu

SEQ ID NO: 126590 - RNA, 19 nt, Homo sapiens
gagcucagacuuggugcuu

SEQ ID NO: 126591 - RNA, 19 nt, Homo sapiens
caagggugcugugauuuug

SEQ ID NO: 126592 - RNA, 19 nt, Homo sapiens
gggcuugccaggcuuguca

SEQ ID NO: 126593 - RNA, 19 nt, Homo sapiens
caugggauccuaaaauaaa

SEQ ID NO: 126594 - RNA, 19 nt, Homo sapiens
ucauuccucugguugauac

SEQ ID NO: 126595 - RNA, 19 nt, Homo sapiens
gauccugcaggguagacua

SEQ ID NO: 126596 - RNA, 19 nt, Homo sapiens
auacuuagguaaucauucc

SEQ ID NO: 126597 - RNA, 19 nt, Homo sapiens
gcugucaggagauggaaga

SEQ ID NO: 126598 - RNA, 19 nt, Homo sapiens
gcacagcuggagacgaucu

SEQ ID NO: 126599 - RNA, 19 nt, Homo sapiens
uuucagagcgauuaacuag

SEQ ID NO: 126600 - RNA, 19 nt, Homo sapiens
ggccugggacugcaucuuc

SEQ ID NO: 126601 - RNA, 19 nt, Homo sapiens
cagagauggcuuccuuguu

SEQ ID NO: 126602 - RNA, 19 nt, Homo sapiens
cggaggauguggagaagcu

SEQ ID NO: 126603 - RNA, 19 nt, Homo sapiens
ugccaggcuugucaaauag

SEQ ID NO: 126604 - RNA, 19 nt, Homo sapiens
guggagacacuaacucaag

SEQ ID NO: 126605 - RNA, 19 nt, Homo sapiens
ucagagauggcuuccuugu

SEQ ID NO: 126606 - RNA, 19 nt, Homo sapiens
ccauagaagccagcaacuu

SEQ ID NO: 126607 - RNA, 19 nt, Homo sapiens
aagaggacauaaagauggu

SEQ ID NO: 126608 - RNA, 19 nt, Homo sapiens
ucgcaaugccgccuuguuc

SEQ ID NO: 126609 - RNA, 19 nt, Homo sapiens
gaaaugaucugcugaauaa

SEQ ID NO: 126610 - RNA, 19 nt, Homo sapiens
caacacagauuuagagaua

SEQ ID NO: 126611 - RNA, 19 nt, Homo sapiens
ccaaggaggugcuuauuaa

SEQ ID NO: 126612 - RNA, 19 nt, Homo sapiens
gcacagaaguuaucaucaa

SEQ ID NO: 126613 - RNA, 19 nt, Homo sapiens
ggaccucgcuccuguauag

SEQ ID NO: 126614 - RNA, 19 nt, Homo sapiens
gaagaucauuugucaggaa

SEQ ID NO: 126615 - RNA, 19 nt, Homo sapiens
gaacucagauaauggcaau

SEQ ID NO: 126616 - RNA, 19 nt, Homo sapiens
ggaaaucaguacauugugu

SEQ ID NO: 126617 - RNA, 19 nt, Homo sapiens
uacccuagcuuauuuguuu

SEQ ID NO: 126618 - RNA, 19 nt, Homo sapiens
gaaguuaucaucaaucugu

SEQ ID NO: 126619 - RNA, 19 nt, Homo sapiens
ggacaagggcacagaaguu

SEQ ID NO: 126620 - RNA, 19 nt, Homo sapiens
gacaagggcacagaaguua

SEQ ID NO: 126621 - RNA, 19 nt, Homo sapiens
cagagcugcuuucagauaa

SEQ ID NO: 126622 - RNA, 19 nt, Homo sapiens
ccagugaugugcauaaaca

SEQ ID NO: 126623 - RNA, 19 nt, Homo sapiens
cgaaaugaucugcugaaua

SEQ ID NO: 126624 - RNA, 19 nt, Homo sapiens
gcacaccaacuaucaguga

SEQ ID NO: 126625 - RNA, 19 nt, Homo sapiens
auucagagcugcuuucaga

SEQ ID NO: 126626 - RNA, 19 nt, Homo sapiens
uaaccaaugucaucuccuu

SEQ ID NO: 126627 - RNA, 19 nt, Homo sapiens
agacauggccauaugcaua

SEQ ID NO: 126628 - RNA, 19 nt, Homo sapiens
aagaugaacucagauaaug

SEQ ID NO: 126629 - RNA, 19 nt, Homo sapiens
uggagaagaucauuuguca

SEQ ID NO: 126630 - RNA, 19 nt, Homo sapiens
gccaaggaggugcuuauua

SEQ ID NO: 126631 - RNA, 19 nt, Homo sapiens
caccaagacuacagugauu

SEQ ID NO: 126632 - RNA, 19 nt, Homo sapiens
gcacaauccucaggugaag

SEQ ID NO: 126633 - RNA, 19 nt, Homo sapiens
gacauggccauaugcauaa

SEQ ID NO: 126634 - RNA, 19 nt, Homo sapiens
guggcucucuugcugcuua

SEQ ID NO: 126635 - RNA, 19 nt, Homo sapiens
ucagagcugcuuucagaua

SEQ ID NO: 126636 - RNA, 19 nt, Homo sapiens
caagaugaacucagauaau

SEQ ID NO: 126637 - RNA, 19 nt, Homo sapiens
cuacuccacugcugucuau

SEQ ID NO: 126638 - RNA, 19 nt, Homo sapiens
gaucagaagcuggagaaga

SEQ ID NO: 126639 - RNA, 19 nt, Homo sapiens
ucagauaaccacauucuca

SEQ ID NO: 126640 - RNA, 19 nt, Homo sapiens
gcuuucagauaaccacauu

SEQ ID NO: 126641 - RNA, 19 nt, Homo sapiens
aagccaagaugaacucaga

SEQ ID NO: 126642 - RNA, 19 nt, Homo sapiens
uagacaaccugagcaaaga

SEQ ID NO: 126643 - RNA, 19 nt, Homo sapiens
uucaauaccuccuacaaga

SEQ ID NO: 126644 - RNA, 19 nt, Homo sapiens
cagaaguuaucaucaaucu

SEQ ID NO: 126645 - RNA, 19 nt, Homo sapiens
acgaggagauugaccagaa

SEQ ID NO: 126646 - RNA, 19 nt, Homo sapiens
ccaagaugaacucagauaa

SEQ ID NO: 126647 - RNA, 19 nt, Homo sapiens
gcaccaagacuacagugau

SEQ ID NO: 126648 - RNA, 19 nt, Homo sapiens
caucuauucuguucguaug

SEQ ID NO: 126649 - RNA, 19 nt, Homo sapiens
gccaagaugaacucagaua

SEQ ID NO: 126650 - RNA, 19 nt, Homo sapiens
acacagauuuagagauaca

SEQ ID NO: 126651 - RNA, 19 nt, Homo sapiens
ccauaugcauaacaacuuc

SEQ ID NO: 126652 - RNA, 19 nt, Homo sapiens
cacagaaguuaucaucaau

SEQ ID NO: 126653 - RNA, 19 nt, Homo sapiens
caggaaaucaguacauugu

SEQ ID NO: 126654 - RNA, 19 nt, Homo sapiens
ccacaacacagauuuagag

SEQ ID NO: 126655 - RNA, 19 nt, Homo sapiens
gacccugaguugaauguca

SEQ ID NO: 126656 - RNA, 19 nt, Homo sapiens
guccauagacaucuccuuu

SEQ ID NO: 126657 - RNA, 19 nt, Homo sapiens
gucaggaaaucaguacauu

SEQ ID NO: 126658 - RNA, 19 nt, Homo sapiens
gcucaucucaccgucagua

SEQ ID NO: 126659 - RNA, 19 nt, Homo sapiens
caauaccuccuacaagaau

SEQ ID NO: 126660 - RNA, 19 nt, Homo sapiens
gcauaacaacuucuucaag

SEQ ID NO: 126661 - RNA, 19 nt, Homo sapiens
aacccacucugccuucuuu

SEQ ID NO: 126662 - RNA, 19 nt, Homo sapiens
guucaugccugagcguuuc

SEQ ID NO: 126663 - RNA, 19 nt, Homo sapiens
ugaagaagaagcucuacga

SEQ ID NO: 126664 - RNA, 19 nt, Homo sapiens
ccaacaaccguaaggguau

SEQ ID NO: 126665 - RNA, 19 nt, Homo sapiens
ccaagguggucuuucugau

SEQ ID NO: 126666 - RNA, 19 nt, Homo sapiens
gcaccagccggaucaguuc

SEQ ID NO: 126667 - RNA, 19 nt, Homo sapiens
caacuaucagugaccguaa

SEQ ID NO: 126668 - RNA, 19 nt, Homo sapiens
ccaaugucaucuccuugau

SEQ ID NO: 126669 - RNA, 19 nt, Homo sapiens
gggcacagaaguuaucauc

SEQ ID NO: 126670 - RNA, 19 nt, Homo sapiens
cgaggagauugaccagaau

SEQ ID NO: 126671 - RNA, 19 nt, Homo sapiens
gcccagaucaagauucaga

SEQ ID NO: 126672 - RNA, 19 nt, Homo sapiens
ucugaucgacucuuucaaa

SEQ ID NO: 126673 - RNA, 19 nt, Homo sapiens
caccgucaguaagcuauuu

SEQ ID NO: 126674 - RNA, 19 nt, Homo sapiens
gaagcucuacgaggagauu

SEQ ID NO: 126675 - RNA, 19 nt, Homo sapiens
ucaauaccuccuacaagaa

SEQ ID NO: 126676 - RNA, 19 nt, Homo sapiens
aagaucauuugucaggaaa

SEQ ID NO: 126677 - RNA, 19 nt, Homo sapiens
caacaaccguaaggguauc

SEQ ID NO: 126678 - RNA, 19 nt, Homo sapiens
aucagaagcuggagaagau

SEQ ID NO: 126679 - RNA, 19 nt, Homo sapiens
ucaaggauggcgaucagaa

SEQ ID NO: 126680 - RNA, 19 nt, Homo sapiens
ccaacaugcuggacacacu

SEQ ID NO: 126681 - RNA, 19 nt, Homo sapiens
gcgaucagaagcuggagaa

SEQ ID NO: 126682 - RNA, 19 nt, Homo sapiens
guucaaggauggcgaucag

SEQ ID NO: 126683 - RNA, 19 nt, Homo sapiens
aauggcaacucuagacauc

SEQ ID NO: 126684 - RNA, 19 nt, Homo sapiens
ugccacagcucuucuacuc

SEQ ID NO: 126685 - RNA, 19 nt, Homo sapiens
gcaccuaaaggcuguaacu

SEQ ID NO: 126686 - RNA, 19 nt, Homo sapiens
ccugagcguuucuugaauc

SEQ ID NO: 126687 - RNA, 19 nt, Homo sapiens
gggcgcugcaucacaauga

SEQ ID NO: 126688 - RNA, 19 nt, Homo sapiens
caagggcacagaaguuauc

SEQ ID NO: 126689 - RNA, 19 nt, Homo sapiens
cguaugggcaccaagacua

SEQ ID NO: 126690 - RNA, 19 nt, Homo sapiens
caaauggcaacucuagaca

SEQ ID NO: 126691 - RNA, 19 nt, Homo sapiens
caagguggucuuucugauc

SEQ ID NO: 126692 - RNA, 19 nt, Homo sapiens
gagaaauuccggagugacu

SEQ ID NO: 126693 - RNA, 19 nt, Homo sapiens
ugaguugaaugucauacag

SEQ ID NO: 126694 - RNA, 19 nt, Homo sapiens
aaugucaucuccuugaucu

SEQ ID NO: 126695 - RNA, 19 nt, Homo sapiens
ccauagacaucuccuuucc

SEQ ID NO: 126696 - RNA, 19 nt, Homo sapiens
ucaguacauugugugauau

SEQ ID NO: 126697 - RNA, 19 nt, Homo sapiens
ugcuuacccuagcuuauuu

SEQ ID NO: 126698 - RNA, 19 nt, Homo sapiens
gugaugugcauaaacaguu

SEQ ID NO: 126699 - RNA, 19 nt, Homo sapiens
gccauaugcauaacaacuu

SEQ ID NO: 126700 - RNA, 19 nt, Homo sapiens
ggccucaaauggcaacucu

SEQ ID NO: 126701 - RNA, 19 nt, Homo sapiens
ggagauugaccagaaugug

SEQ ID NO: 126702 - RNA, 19 nt, Homo sapiens
uggcccagaucaagauuca

SEQ ID NO: 126703 - RNA, 19 nt, Homo sapiens
gaagcuggagaagaucauu

SEQ ID NO: 126704 - RNA, 19 nt, Homo sapiens
aguugaaugucauacagaa

SEQ ID NO: 126705 - RNA, 19 nt, Homo sapiens
caucuccuuuccugucuuc

SEQ ID NO: 126706 - RNA, 19 nt, Homo sapiens
ggcugaggguagcaccuaa

SEQ ID NO: 126707 - RNA, 19 nt, Homo sapiens
ccaagacuacagugauugu

SEQ ID NO: 126708 - RNA, 19 nt, Homo sapiens
ccucaaauggcaacucuag

SEQ ID NO: 126709 - RNA, 19 nt, Homo sapiens
gaagaaaccguauccauaa

SEQ ID NO: 126710 - RNA, 19 nt, Homo sapiens
gagaaaggcaucauauuua

SEQ ID NO: 126711 - RNA, 19 nt, Homo sapiens
ccugagagauuuaacauua

SEQ ID NO: 126712 - RNA, 19 nt, Homo sapiens
ggacaaacauuauccugaa

SEQ ID NO: 126713 - RNA, 19 nt, Homo sapiens
caaagaauguuccuuauag

SEQ ID NO: 126714 - RNA, 19 nt, Homo sapiens
ggagaaaugcuuagaaauu

SEQ ID NO: 126715 - RNA, 19 nt, Homo sapiens
ccacuuuacuuguguuaua

SEQ ID NO: 126716 - RNA, 19 nt, Homo sapiens
gaaccaggcuacaagagaa

SEQ ID NO: 126717 - RNA, 19 nt, Homo sapiens
gagaaaugcuuagaaauuc

SEQ ID NO: 126718 - RNA, 19 nt, Homo sapiens
gcaaagaauguuccuuaua

SEQ ID NO: 126719 - RNA, 19 nt, Homo sapiens
gcaaagcacccuaauguug

SEQ ID NO: 126720 - RNA, 19 nt, Homo sapiens
ggaagaauguauggacuuu

SEQ ID NO: 126721 - RNA, 19 nt, Homo sapiens
uagccuggguuaaguauua

SEQ ID NO: 126722 - RNA, 19 nt, Homo sapiens
ugacauugauuugcucuua

SEQ ID NO: 126723 - RNA, 19 nt, Homo sapiens
ggauaggccuucauuaaca

SEQ ID NO: 126724 - RNA, 19 nt, Homo sapiens
aaacacaucuggacagguu

SEQ ID NO: 126725 - RNA, 19 nt, Homo sapiens
gaaaccguauccauaaaga

SEQ ID NO: 126726 - RNA, 19 nt, Homo sapiens
gaaaguacaucgccauggu

SEQ ID NO: 126727 - RNA, 19 nt, Homo sapiens
gcaaagccuuagaagauga

SEQ ID NO: 126728 - RNA, 19 nt, Homo sapiens
uaaaggaaauccagacugu

SEQ ID NO: 126729 - RNA, 19 nt, Homo sapiens
gaaagaugccauagaaguu

SEQ ID NO: 126730 - RNA, 19 nt, Homo sapiens
ggagaggaaacacucauua

SEQ ID NO: 126731 - RNA, 19 nt, Homo sapiens
ugaagaaaccguauccaua

SEQ ID NO: 126732 - RNA, 19 nt, Homo sapiens
gagcauuucucaucaguag

SEQ ID NO: 126733 - RNA, 19 nt, Homo sapiens
gcgcaaagccuuagaagau

SEQ ID NO: 126734 - RNA, 19 nt, Homo sapiens
ccaaugaauuuacucuuga

SEQ ID NO: 126735 - RNA, 19 nt, Homo sapiens
ugagaaaggcaucauauuu

SEQ ID NO: 126736 - RNA, 19 nt, Homo sapiens
agagauaacuguaaaugug

SEQ ID NO: 126737 - RNA, 19 nt, Homo sapiens
gaagaagaacuuauccuau

SEQ ID NO: 126738 - RNA, 19 nt, Homo sapiens
acaggaaggugaagaagaa

SEQ ID NO: 126739 - RNA, 19 nt, Homo sapiens
aaccagacaucuucuuuaa

SEQ ID NO: 126740 - RNA, 19 nt, Homo sapiens
gaggaaacacucauuauca

SEQ ID NO: 126741 - RNA, 19 nt, Homo sapiens
ccaauuaauuccuguuugu

SEQ ID NO: 126742 - RNA, 19 nt, Homo sapiens
gaaauagucggugaagaaa

SEQ ID NO: 126743 - RNA, 19 nt, Homo sapiens
agaagucugucaaggauuu

SEQ ID NO: 126744 - RNA, 19 nt, Homo sapiens
cgaaagugcuaucgugguu

SEQ ID NO: 126745 - RNA, 19 nt, Homo sapiens
acaguuaccugagagauuu

SEQ ID NO: 126746 - RNA, 19 nt, Homo sapiens
uggaggaggugaccaauga

SEQ ID NO: 126747 - RNA, 19 nt, Homo sapiens
uaaagaacguggucagagu

SEQ ID NO: 126748 - RNA, 19 nt, Homo sapiens
caaagcacccuaauguuga

SEQ ID NO: 126749 - RNA, 19 nt, Homo sapiens
aagagaaacuggaagaaug

SEQ ID NO: 126750 - RNA, 19 nt, Homo sapiens
aaacaccacuuuacuugug

SEQ ID NO: 126751 - RNA, 19 nt, Homo sapiens
agagagacauaaagauuga

SEQ ID NO: 126752 - RNA, 19 nt, Homo sapiens
gauaggccuucauuaacaa

SEQ ID NO: 126753 - RNA, 19 nt, Homo sapiens
gaagagaaacuggaagaau

SEQ ID NO: 126754 - RNA, 19 nt, Homo sapiens
ccaaacaccacuuuacuug

SEQ ID NO: 126755 - RNA, 19 nt, Homo sapiens
gaacguggucagaguagaa

SEQ ID NO: 126756 - RNA, 19 nt, Homo sapiens
ccaaugggcucaaacuucu

SEQ ID NO: 126757 - RNA, 19 nt, Homo sapiens
gagagagacauaaagauug

SEQ ID NO: 126758 - RNA, 19 nt, Homo sapiens
aagaagaacuuauccuauc

SEQ ID NO: 126759 - RNA, 19 nt, Homo sapiens
ugaacccgauacauuauaa

SEQ ID NO: 126760 - RNA, 19 nt, Homo sapiens
ggcaacagaucaguaaaga

SEQ ID NO: 126761 - RNA, 19 nt, Homo sapiens
uugcuuagcucaauuagug

SEQ ID NO: 126762 - RNA, 19 nt, Homo sapiens
guaauagccuggguuaagu

SEQ ID NO: 126763 - RNA, 19 nt, Homo sapiens
uaccuacucuggagcauuu

SEQ ID NO: 126764 - RNA, 19 nt, Homo sapiens
gcacccagaugagacuaaa

SEQ ID NO: 126765 - RNA, 19 nt, Homo sapiens
aaagugcuaucgugguuaa

SEQ ID NO: 126766 - RNA, 19 nt, Homo sapiens
gaggaucccuuuggacgaa

SEQ ID NO: 126767 - RNA, 19 nt, Homo sapiens
agaaauagucggugaagaa

SEQ ID NO: 126768 - RNA, 19 nt, Homo sapiens
aaggaaauccagacuguua

SEQ ID NO: 126769 - RNA, 19 nt, Homo sapiens
caccaugucugucucuuug

SEQ ID NO: 126770 - RNA, 19 nt, Homo sapiens
gaaacguggugaccugaca

SEQ ID NO: 126771 - RNA, 19 nt, Homo sapiens
uuugaaagaugccauagaa

SEQ ID NO: 126772 - RNA, 19 nt, Homo sapiens
caacagaucaguaaagaac

SEQ ID NO: 126773 - RNA, 19 nt, Homo sapiens
aagcagaggccaagaguuu

SEQ ID NO: 126774 - RNA, 19 nt, Homo sapiens
cuuagaagaugauguaauc

SEQ ID NO: 126775 - RNA, 19 nt, Homo sapiens
ugagagagacauaaagauu

SEQ ID NO: 126776 - RNA, 19 nt, Homo sapiens
ggacuuugccacugaguug

SEQ ID NO: 126777 - RNA, 19 nt, Homo sapiens
ugaagaagaacuuauccua

SEQ ID NO: 126778 - RNA, 19 nt, Homo sapiens
ggaaauccagacuguuauu

SEQ ID NO: 126779 - RNA, 19 nt, Homo sapiens
guggugaccugacaagaga

SEQ ID NO: 126780 - RNA, 19 nt, Homo sapiens
ugagaagucugucaaggau

SEQ ID NO: 126781 - RNA, 19 nt, Homo sapiens
caaaccagacaucuucuuu

SEQ ID NO: 126782 - RNA, 19 nt, Homo sapiens
acucgacccuucuuuauga

SEQ ID NO: 126783 - RNA, 19 nt, Homo sapiens
gagauaacuguaaauguga

SEQ ID NO: 126784 - RNA, 19 nt, Homo sapiens
ggcaagcucuccucaucaa

SEQ ID NO: 126785 - RNA, 19 nt, Homo sapiens
uacuacagcuucagugauu

SEQ ID NO: 126786 - RNA, 19 nt, Homo sapiens
gacccuugcugugaauuaa

SEQ ID NO: 126787 - RNA, 19 nt, Homo sapiens
guauggacuuugccacuga

SEQ ID NO: 126788 - RNA, 19 nt, Homo sapiens
caacucgacccuucuuuau

SEQ ID NO: 126789 - RNA, 19 nt, Homo sapiens
ccacuugccugugcuacaa

SEQ ID NO: 126790 - RNA, 19 nt, Homo sapiens
agagaaggcuggucaguac

SEQ ID NO: 126791 - RNA, 19 nt, Homo sapiens
gaaggugaagaagaacuua

SEQ ID NO: 126792 - RNA, 19 nt, Homo sapiens
aaaccagacaucuucuuua

SEQ ID NO: 126793 - RNA, 19 nt, Homo sapiens
caucaaaccagacaucuuc

SEQ ID NO: 126794 - RNA, 19 nt, Homo sapiens
gagaggaaacacucauuau

SEQ ID NO: 126795 - RNA, 19 nt, Homo sapiens
cauagucuuuggagaaaug

SEQ ID NO: 126796 - RNA, 19 nt, Homo sapiens
guaguucacauacaaauca

SEQ ID NO: 126797 - RNA, 19 nt, Homo sapiens
cccaaugaauuuacucuug

SEQ ID NO: 126798 - RNA, 19 nt, Homo sapiens
gaaacuggaagaauguaug

SEQ ID NO: 126799 - RNA, 19 nt, Homo sapiens
gaaagugcuaucgugguua

SEQ ID NO: 126800 - RNA, 19 nt, Homo sapiens
uguauguggucauggauaa

SEQ ID NO: 126801 - RNA, 19 nt, Homo sapiens
agaagaacuuauccuauca

SEQ ID NO: 126802 - RNA, 19 nt, Homo sapiens
uguguuaccuguagauuca

SEQ ID NO: 126803 - RNA, 19 nt, Homo sapiens
gggcagaaacacucaaguu

SEQ ID NO: 126804 - RNA, 19 nt, Homo sapiens
gcagaggccaagaguuuga

SEQ ID NO: 126805 - RNA, 19 nt, Homo sapiens
caagcuaggugcuauuggu

SEQ ID NO: 126806 - RNA, 19 nt, Homo sapiens
gcauuucucaucaguaguu

SEQ ID NO: 126807 - RNA, 19 nt, Homo sapiens
guugagagcauacagaaga

SEQ ID NO: 126808 - RNA, 19 nt, Homo sapiens
caagagauaacuguaaaug

SEQ ID NO: 126809 - RNA, 19 nt, Homo sapiens
gaagaaaccguauccauaa

SEQ ID NO: 126810 - RNA, 19 nt, Homo sapiens
gagaaaggcaucauauuua

SEQ ID NO: 126811 - RNA, 19 nt, Homo sapiens
ccugagagauuuaacauua

SEQ ID NO: 126812 - RNA, 19 nt, Homo sapiens
ggacaaacauuauccugaa

SEQ ID NO: 126813 - RNA, 19 nt, Homo sapiens
caaagaauguuccuuauag

SEQ ID NO: 126814 - RNA, 19 nt, Homo sapiens
ggagaaaugcuuagaaauu

SEQ ID NO: 126815 - RNA, 19 nt, Homo sapiens
ccacuuuacuuguguuaua

SEQ ID NO: 126816 - RNA, 19 nt, Homo sapiens
gaaccaggcuacaagagaa

SEQ ID NO: 126817 - RNA, 19 nt, Homo sapiens
gagaaaugcuuagaaauuc

SEQ ID NO: 126818 - RNA, 19 nt, Homo sapiens
gcaaagaauguuccuuaua

SEQ ID NO: 126819 - RNA, 19 nt, Homo sapiens
gcaaagcacccuaauguug

SEQ ID NO: 126820 - RNA, 19 nt, Homo sapiens
ggaagaauguauggacuuu

SEQ ID NO: 126821 - RNA, 19 nt, Homo sapiens
uagccuggguuaaguauua

SEQ ID NO: 126822 - RNA, 19 nt, Homo sapiens
gaaacccuguggugaaauu

SEQ ID NO: 126823 - RNA, 19 nt, Homo sapiens
ugacauugauuugcucuua

SEQ ID NO: 126824 - RNA, 19 nt, Homo sapiens
ggauaggccuucauuaaca

SEQ ID NO: 126825 - RNA, 19 nt, Homo sapiens
aaacacaucuggacagguu

SEQ ID NO: 126826 - RNA, 19 nt, Homo sapiens
gaaaccguauccauaaaga

SEQ ID NO: 126827 - RNA, 19 nt, Homo sapiens
gaaaguacaucgccauggu

SEQ ID NO: 126828 - RNA, 19 nt, Homo sapiens
gcaaagccuuagaagauga

SEQ ID NO: 126829 - RNA, 19 nt, Homo sapiens
uaaaggaaauccagacugu

SEQ ID NO: 126830 - RNA, 19 nt, Homo sapiens
gaaagaugccauagaaguu

SEQ ID NO: 126831 - RNA, 19 nt, Homo sapiens
ggagaggaaacacucauua

SEQ ID NO: 126832 - RNA, 19 nt, Homo sapiens
ugaagaaaccguauccaua

SEQ ID NO: 126833 - RNA, 19 nt, Homo sapiens
gagcauuucucaucaguag

SEQ ID NO: 126834 - RNA, 19 nt, Homo sapiens
gcgcaaagccuuagaagau

SEQ ID NO: 126835 - RNA, 19 nt, Homo sapiens
ccaaugaauuuacucuuga

SEQ ID NO: 126836 - RNA, 19 nt, Homo sapiens
ugagaaaggcaucauauuu

SEQ ID NO: 126837 - RNA, 19 nt, Homo sapiens
agagauaacuguaaaugug

SEQ ID NO: 126838 - RNA, 19 nt, Homo sapiens
gaagaagaacuuauccuau

SEQ ID NO: 126839 - RNA, 19 nt, Homo sapiens
acaggaaggugaagaagaa

SEQ ID NO: 126840 - RNA, 19 nt, Homo sapiens
aaccagacaucuucuuuaa

SEQ ID NO: 126841 - RNA, 19 nt, Homo sapiens
gaggaaacacucauuauca

SEQ ID NO: 126842 - RNA, 19 nt, Homo sapiens
ccaauuaauuccuguuugu

SEQ ID NO: 126843 - RNA, 19 nt, Homo sapiens
gaaauagucggugaagaaa

SEQ ID NO: 126844 - RNA, 19 nt, Homo sapiens
agaagucugucaaggauuu

SEQ ID NO: 126845 - RNA, 19 nt, Homo sapiens
cgaaagugcuaucgugguu

SEQ ID NO: 126846 - RNA, 19 nt, Homo sapiens
acaguuaccugagagauuu

SEQ ID NO: 126847 - RNA, 19 nt, Homo sapiens
uggaggaggugaccaauga

SEQ ID NO: 126848 - RNA, 19 nt, Homo sapiens
ggaaaucccuguggacucu

SEQ ID NO: 126849 - RNA, 19 nt, Homo sapiens
uaaagaacguggucagagu

SEQ ID NO: 126850 - RNA, 19 nt, Homo sapiens
caaagcacccuaauguuga

SEQ ID NO: 126851 - RNA, 19 nt, Homo sapiens
ccagaaauuuggaguguuc

SEQ ID NO: 126852 - RNA, 19 nt, Homo sapiens
aagagaaacuggaagaaug

SEQ ID NO: 126853 - RNA, 19 nt, Homo sapiens
aaacaccacuuuacuugug

SEQ ID NO: 126854 - RNA, 19 nt, Homo sapiens
agagagacauaaagauuga

SEQ ID NO: 126855 - RNA, 19 nt, Homo sapiens
gauaggccuucauuaacaa

SEQ ID NO: 126856 - RNA, 19 nt, Homo sapiens
cagaaacccuguggugaaa

SEQ ID NO: 126857 - RNA, 19 nt, Homo sapiens
gaagagaaacuggaagaau

SEQ ID NO: 126858 - RNA, 19 nt, Homo sapiens
ccaaacaccacuuuacuug

SEQ ID NO: 126859 - RNA, 19 nt, Homo sapiens
gaacguggucagaguagaa

SEQ ID NO: 126860 - RNA, 19 nt, Homo sapiens
ccaaugggcucaaacuucu

SEQ ID NO: 126861 - RNA, 19 nt, Homo sapiens
aagaagaacuuauccuauc

SEQ ID NO: 126862 - RNA, 19 nt, Homo sapiens
gagagagacauaaagauug

SEQ ID NO: 126863 - RNA, 19 nt, Homo sapiens
ugaacccgauacauuauaa

SEQ ID NO: 126864 - RNA, 19 nt, Homo sapiens
ggcaacagaucaguaaaga

SEQ ID NO: 126865 - RNA, 19 nt, Homo sapiens
uugcuuagcucaauuagug

SEQ ID NO: 126866 - RNA, 19 nt, Homo sapiens
guaauagccuggguuaagu

SEQ ID NO: 126867 - RNA, 19 nt, Homo sapiens
uaccuacucuggagcauuu

SEQ ID NO: 126868 - RNA, 19 nt, Homo sapiens
gcacccagaugagacuaaa

SEQ ID NO: 126869 - RNA, 19 nt, Homo sapiens
aaagugcuaucgugguuaa

SEQ ID NO: 126870 - RNA, 19 nt, Homo sapiens
gaggaucccuuuggacgaa

SEQ ID NO: 126871 - RNA, 19 nt, Homo sapiens
agaaauagucggugaagaa

SEQ ID NO: 126872 - RNA, 19 nt, Homo sapiens
aaggaaauccagacuguua

SEQ ID NO: 126873 - RNA, 19 nt, Homo sapiens
caccaugucugucucuuug

SEQ ID NO: 126874 - RNA, 19 nt, Homo sapiens
gaaacguggugaccugaca

SEQ ID NO: 126875 - RNA, 19 nt, Homo sapiens
uuugaaagaugccauagaa

SEQ ID NO: 126876 - RNA, 19 nt, Homo sapiens
caacagaucaguaaagaac

SEQ ID NO: 126877 - RNA, 19 nt, Homo sapiens
aagcagaggccaagaguuu

SEQ ID NO: 126878 - RNA, 19 nt, Homo sapiens
cuuagaagaugauguaauc

SEQ ID NO: 126879 - RNA, 19 nt, Homo sapiens
ugagagagacauaaagauu

SEQ ID NO: 126880 - RNA, 19 nt, Homo sapiens
ggacuuugccacugaguug

SEQ ID NO: 126881 - RNA, 19 nt, Homo sapiens
ugaagaagaacuuauccua

SEQ ID NO: 126882 - RNA, 19 nt, Homo sapiens
ggaaauccagacuguuauu

SEQ ID NO: 126883 - RNA, 19 nt, Homo sapiens
guggugaccugacaagaga

SEQ ID NO: 126884 - RNA, 19 nt, Homo sapiens
ugagaagucugucaaggau

SEQ ID NO: 126885 - RNA, 19 nt, Homo sapiens
caaaccagacaucuucuuu

SEQ ID NO: 126886 - RNA, 19 nt, Homo sapiens
acucgacccuucuuuauga

SEQ ID NO: 126887 - RNA, 19 nt, Homo sapiens
gagauaacuguaaauguga

SEQ ID NO: 126888 - RNA, 19 nt, Homo sapiens
ggcaagcucuccucaucaa

SEQ ID NO: 126889 - RNA, 19 nt, Homo sapiens
uacuacagcuucagugauu

SEQ ID NO: 126890 - RNA, 19 nt, Homo sapiens
gacccuugcugugaauuaa

SEQ ID NO: 126891 - RNA, 19 nt, Homo sapiens
guauggacuuugccacuga

SEQ ID NO: 126892 - RNA, 19 nt, Homo sapiens
caacucgacccuucuuuau

SEQ ID NO: 126893 - RNA, 19 nt, Homo sapiens
gcacacacaaagcaacauu

SEQ ID NO: 126894 - RNA, 19 nt, Homo sapiens
ccacuugccugugcuacaa

SEQ ID NO: 126895 - RNA, 19 nt, Homo sapiens
agagaaggcuggucaguac

SEQ ID NO: 126896 - RNA, 19 nt, Homo sapiens
gaaggugaagaagaacuua

SEQ ID NO: 126897 - RNA, 19 nt, Homo sapiens
aaaccagacaucuucuuua

SEQ ID NO: 126898 - RNA, 19 nt, Homo sapiens
caucaaaccagacaucuuc

SEQ ID NO: 126899 - RNA, 19 nt, Homo sapiens
gagaggaaacacucauuau

SEQ ID NO: 126900 - RNA, 19 nt, Homo sapiens
cauagucuuuggagaaaug

SEQ ID NO: 126901 - RNA, 19 nt, Homo sapiens
guaguucacauacaaauca

SEQ ID NO: 126902 - RNA, 19 nt, Homo sapiens
cccaaugaauuuacucuug

SEQ ID NO: 126903 - RNA, 19 nt, Homo sapiens
gaaacuggaagaauguaug

SEQ ID NO: 126904 - RNA, 19 nt, Homo sapiens
gaaagugcuaucgugguua

SEQ ID NO: 126905 - RNA, 19 nt, Homo sapiens
gaaauucagccuguggauu

SEQ ID NO: 126906 - RNA, 19 nt, Homo sapiens
uguauguggucauggauaa

SEQ ID NO: 126907 - RNA, 19 nt, Homo sapiens
uguguuaccuguagauuca

SEQ ID NO: 126908 - RNA, 19 nt, Homo sapiens
gggcagaaacacucaaguu

SEQ ID NO: 126909 - RNA, 19 nt, Homo sapiens
gaucaaggacgacaacuua

SEQ ID NO: 126910 - RNA, 19 nt, Homo sapiens
gauugaggcuuaauucuga

SEQ ID NO: 126911 - RNA, 19 nt, Homo sapiens
ggagggacaugauggacua

SEQ ID NO: 126912 - RNA, 19 nt, Homo sapiens
cgagaucgcuggcagagaa

SEQ ID NO: 126913 - RNA, 19 nt, Homo sapiens
gcacugagaccacagcaaa

SEQ ID NO: 126914 - RNA, 19 nt, Homo sapiens
guaccucaguuucuccuuu

SEQ ID NO: 126915 - RNA, 19 nt, Homo sapiens
gcagaggauugaggcuuaa

SEQ ID NO: 126916 - RNA, 19 nt, Homo sapiens
gaccugagccacuuaccua

SEQ ID NO: 126917 - RNA, 19 nt, Homo sapiens
uaccucaguuucuccuuua

SEQ ID NO: 126918 - RNA, 19 nt, Homo sapiens
ccuacaagcuggugucuag

SEQ ID NO: 126919 - RNA, 19 nt, Homo sapiens
gaugcagccuuuccaagug

SEQ ID NO: 126920 - RNA, 19 nt, Homo sapiens
gaaagggguugucaagaga

SEQ ID NO: 126921 - RNA, 19 nt, Homo sapiens
ccacugguccauccaaauu

SEQ ID NO: 126922 - RNA, 19 nt, Homo sapiens
ugcagaggauugaggcuua

SEQ ID NO: 126923 - RNA, 19 nt, Homo sapiens
ggagaggccacaugaguuc

SEQ ID NO: 126924 - RNA, 19 nt, Homo sapiens
gcagugucauccucaagau

SEQ ID NO: 126925 - RNA, 19 nt, Homo sapiens
caagaggaccauugaggaa

SEQ ID NO: 126926 - RNA, 19 nt, Homo sapiens
ggaaagggguugucaagag

SEQ ID NO: 126927 - RNA, 19 nt, Homo sapiens
caaggacgacaacuuaaug

SEQ ID NO: 126928 - RNA, 19 nt, Homo sapiens
ccugcagcaucaucuguua

SEQ ID NO: 126929 - RNA, 19 nt, Homo sapiens
ggauugaggcuuaauucug

SEQ ID NO: 126930 - RNA, 19 nt, Homo sapiens
gaggauugaggcuuaauuc

SEQ ID NO: 126931 - RNA, 19 nt, Homo sapiens
cggcugcccuugcucaaug

SEQ ID NO: 126932 - RNA, 19 nt, Homo sapiens
ggagcuagaccacgaacug

SEQ ID NO: 126933 - RNA, 19 nt, Homo sapiens
gggaucacaucguggagau

SEQ ID NO: 126934 - RNA, 19 nt, Homo sapiens
ugaagcaggccauagagaa

SEQ ID NO: 126935 - RNA, 19 nt, Homo sapiens
ggaaagcccacaagaagcu

SEQ ID NO: 126936 - RNA, 19 nt, Homo sapiens
ucagugcucggcagucaua

SEQ ID NO: 126937 - RNA, 19 nt, Homo sapiens
gaagcaggccauagagaag

SEQ ID NO: 126938 - RNA, 19 nt, Homo sapiens
gggagaggccacaugaguu

SEQ ID NO: 126939 - RNA, 19 nt, Homo sapiens
ggacgugauucccuuucuc

SEQ ID NO: 126940 - RNA, 19 nt, Homo sapiens
caacuuaaugccugccuau

SEQ ID NO: 126941 - RNA, 19 nt, Homo sapiens
cucaguuucuccuuuauug

SEQ ID NO: 126942 - RNA, 19 nt, Homo sapiens
caugaguucuggccugauc

SEQ ID NO: 126943 - RNA, 19 nt, Homo sapiens
ugaggaagccauggucaaa

SEQ ID NO: 126944 - RNA, 19 nt, Homo sapiens
auucugagcuggcccuuuc

SEQ ID NO: 126945 - RNA, 19 nt, Homo sapiens
ccaaauuguggacgugauu

SEQ ID NO: 126946 - RNA, 19 nt, Homo sapiens
ucaaggacgacaacuuaau

SEQ ID NO: 126947 - RNA, 19 nt, Homo sapiens
caagaugcagccuuuccaa

SEQ ID NO: 126948 - RNA, 19 nt, Homo sapiens
acaagcuggugucuaggaa

SEQ ID NO: 126949 - RNA, 19 nt, Homo sapiens
ccucagugcucggcaguca

SEQ ID NO: 126950 - RNA, 19 nt, Homo sapiens
ugagggcacagucaucauu

SEQ ID NO: 126951 - RNA, 19 nt, Homo sapiens
ggaagggcacgugcacaug

SEQ ID NO: 126952 - RNA, 19 nt, Homo sapiens
gggacaugauggacuacau

SEQ ID NO: 126953 - RNA, 19 nt, Homo sapiens
cugagccacuuaccuacaa

SEQ ID NO: 126954 - RNA, 19 nt, Homo sapiens
gagagucaaagccggaugu

SEQ ID NO: 126955 - RNA, 19 nt, Homo sapiens
ugacccaggaguucuguga

SEQ ID NO: 126956 - RNA, 19 nt, Homo sapiens
cuggaaagcccacaagaag

SEQ ID NO: 126957 - RNA, 19 nt, Homo sapiens
gacgugauucccuuucuca

SEQ ID NO: 126958 - RNA, 19 nt, Homo sapiens
aagaugugguggugcugaa

SEQ ID NO: 126959 - RNA, 19 nt, Homo sapiens
acuacucccugcucuggaa

SEQ ID NO: 126960 - RNA, 19 nt, Homo sapiens
agcccgaccucccaaucua

SEQ ID NO: 126961 - RNA, 19 nt, Homo sapiens
gcucccagcacucaaccaa

SEQ ID NO: 126962 - RNA, 19 nt, Homo sapiens
gagggcacagucaucauuc

SEQ ID NO: 126963 - RNA, 19 nt, Homo sapiens
cuuuauugcuccuguacga

SEQ ID NO: 126964 - RNA, 19 nt, Homo sapiens
ccauagagaagagggauca

SEQ ID NO: 126965 - RNA, 19 nt, Homo sapiens
guauccaggagguguuaaa

SEQ ID NO: 126966 - RNA, 19 nt, Homo sapiens
gcagcugacccaggaguuc

SEQ ID NO: 126967 - RNA, 19 nt, Homo sapiens
ggaggagcuagaccacgaa

SEQ ID NO: 126968 - RNA, 19 nt, Homo sapiens
ggcugaagcaggccauaga

SEQ ID NO: 126969 - RNA, 19 nt, Homo sapiens
gccugccuauuacaaaugu

SEQ ID NO: 126970 - RNA, 19 nt, Homo sapiens
cuccucaccugcagcauca

SEQ ID NO: 126971 - RNA, 19 nt, Homo sapiens
ucuggaaagcccacaagaa

SEQ ID NO: 126972 - RNA, 19 nt, Homo sapiens
gcccuuuccagccaauaaa

SEQ ID NO: 126973 - RNA, 19 nt, Homo sapiens
ggcccuuuccagccaauaa

SEQ ID NO: 126974 - RNA, 19 nt, Homo sapiens
cccaucugcuccucccauu

SEQ ID NO: 126975 - RNA, 19 nt, Homo sapiens
caagaucaaggacgacaac

SEQ ID NO: 126976 - RNA, 19 nt, Homo sapiens
gaacagugcucaugcuaaa

SEQ ID NO: 126977 - RNA, 19 nt, Homo sapiens
ggguaaagaugaagcaaua

SEQ ID NO: 126978 - RNA, 19 nt, Homo sapiens
gcacagaaaugcaugcaau

SEQ ID NO: 126979 - RNA, 19 nt, Homo sapiens
gguauuugcuaacaucaua

SEQ ID NO: 126980 - RNA, 19 nt, Homo sapiens
caacaguucugggugaaua

SEQ ID NO: 126981 - RNA, 19 nt, Homo sapiens
gaaaugcaugcaauacuua

SEQ ID NO: 126982 - RNA, 19 nt, Homo sapiens
caagaaguauggcaagauu

SEQ ID NO: 126983 - RNA, 19 nt, Homo sapiens
gggcauguuucaaaguuua

SEQ ID NO: 126984 - RNA, 19 nt, Homo sapiens
gaggaagauuugaggaaua

SEQ ID NO: 126985 - RNA, 19 nt, Homo sapiens
aaaugucccugcuuaauaa

SEQ ID NO: 126986 - RNA, 19 nt, Homo sapiens
caagcuaaaugaugguuaa

SEQ ID NO: 126987 - RNA, 19 nt, Homo sapiens
gauuugaacuccuaggaaa

SEQ ID NO: 126988 - RNA, 19 nt, Homo sapiens
caaaguguauuaccugaga

SEQ ID NO: 126989 - RNA, 19 nt, Homo sapiens
caaacaacuucuaagacua

SEQ ID NO: 126990 - RNA, 19 nt, Homo sapiens
gugcauuggucgccgauua

SEQ ID NO: 126991 - RNA, 19 nt, Homo sapiens
gaugagcucugugaugaaa

SEQ ID NO: 126992 - RNA, 19 nt, Homo sapiens
ugaauaugcuuuacccaaa

SEQ ID NO: 126993 - RNA, 19 nt, Homo sapiens
uagaugagcucugugauga

SEQ ID NO: 126994 - RNA, 19 nt, Homo sapiens
uaauucacgucuugucaua

SEQ ID NO: 126995 - RNA, 19 nt, Homo sapiens
uaucaggccucccaugaaa

SEQ ID NO: 126996 - RNA, 19 nt, Homo sapiens
gaagauucaagucaguuua

SEQ ID NO: 126997 - RNA, 19 nt, Homo sapiens
ugaugaagcuggacaacaa

SEQ ID NO: 126998 - RNA, 19 nt, Homo sapiens
gcuaaaugaugguuaaagu

SEQ ID NO: 126999 - RNA, 19 nt, Homo sapiens
gaaguuggguuccuuugag

SEQ ID NO: 127000 - RNA, 19 nt, Homo sapiens
gacaauccauuuacuguag

SEQ ID NO: 127001 - RNA, 19 nt, Homo sapiens
gugcagauuuccuuuguga

SEQ ID NO: 127002 - RNA, 19 nt, Homo sapiens
gaauagaugagcucuguga

SEQ ID NO: 127003 - RNA, 19 nt, Homo sapiens
guaauuugccucagucauu

SEQ ID NO: 127004 - RNA, 19 nt, Homo sapiens
ggaggaagauuugaggaau

SEQ ID NO: 127005 - RNA, 19 nt, Homo sapiens
agaaaugcaugcaauacuu

SEQ ID NO: 127006 - RNA, 19 nt, Homo sapiens
gcuaccacauucacuguuu

SEQ ID NO: 127007 - RNA, 19 nt, Homo sapiens
aaaguuuagucacagcuua

SEQ ID NO: 127008 - RNA, 19 nt, Homo sapiens
uaauuugccucagucauuu

SEQ ID NO: 127009 - RNA, 19 nt, Homo sapiens
gcauuaggguaaagaugaa

SEQ ID NO: 127010 - RNA, 19 nt, Homo sapiens
ucaaacaacuucuaagacu

SEQ ID NO: 127011 - RNA, 19 nt, Homo sapiens
caaugagccuguugagaug

SEQ ID NO: 127012 - RNA, 19 nt, Homo sapiens
caacugcauuuggcucuuu

SEQ ID NO: 127013 - RNA, 19 nt, Homo sapiens
uaauguggauucucuacaa

SEQ ID NO: 127014 - RNA, 19 nt, Homo sapiens
acagcgaacugaacaaaug

SEQ ID NO: 127015 - RNA, 19 nt, Homo sapiens
ugaaagaggccacgucgaa

SEQ ID NO: 127016 - RNA, 19 nt, Homo sapiens
guaucugccucguguugua

SEQ ID NO: 127017 - RNA, 19 nt, Homo sapiens
ucucucugcugugaaauua

SEQ ID NO: 127018 - RNA, 19 nt, Homo sapiens
gauuucccaugccauaauu

SEQ ID NO: 127019 - RNA, 19 nt, Homo sapiens
caaacagucuaauguggau

SEQ ID NO: 127020 - RNA, 19 nt, Homo sapiens
uuaaaugggacaaguguaa

SEQ ID NO: 127021 - RNA, 19 nt, Homo sapiens
caacuucuaagacuaguga

SEQ ID NO: 127022 - RNA, 19 nt, Homo sapiens
cacaaugaaugaccuacaa

SEQ ID NO: 127023 - RNA, 19 nt, Homo sapiens
ggaacagugcucaugcuaa

SEQ ID NO: 127024 - RNA, 19 nt, Homo sapiens
uguggauucucuacaauuu

SEQ ID NO: 127025 - RNA, 19 nt, Homo sapiens
ugacauuuaucaccagaau

SEQ ID NO: 127026 - RNA, 19 nt, Homo sapiens
gugcagggcauguuucaaa

SEQ ID NO: 127027 - RNA, 19 nt, Homo sapiens
acaagagccucaacaccaa

SEQ ID NO: 127028 - RNA, 19 nt, Homo sapiens
aaacaaugaugagcacguu

SEQ ID NO: 127029 - RNA, 19 nt, Homo sapiens
gaugguuuauuugugcaua

SEQ ID NO: 127030 - RNA, 19 nt, Homo sapiens
cagggcauguuucaaaguu

SEQ ID NO: 127031 - RNA, 19 nt, Homo sapiens
acaaugagccuguugagau

SEQ ID NO: 127032 - RNA, 19 nt, Homo sapiens
acagugcucaugcuaaaua

SEQ ID NO: 127033 - RNA, 19 nt, Homo sapiens
ggcauuaggguaaagauga

SEQ ID NO: 127034 - RNA, 19 nt, Homo sapiens
gcagauuuccuuugugaca

SEQ ID NO: 127035 - RNA, 19 nt, Homo sapiens
ucucugcugugaaauuauu

SEQ ID NO: 127036 - RNA, 19 nt, Homo sapiens
aggguucacugcugguuua

SEQ ID NO: 127037 - RNA, 19 nt, Homo sapiens
guacagcgaacugaacaaa

SEQ ID NO: 127038 - RNA, 19 nt, Homo sapiens
gaaggccuaucgcgacuac

SEQ ID NO: 127039 - RNA, 19 nt, Homo sapiens
gggagccuguucugucuug

SEQ ID NO: 127040 - RNA, 19 nt, Homo sapiens
uggaguaccacaagaagua

SEQ ID NO: 127041 - RNA, 19 nt, Homo sapiens
caaaggaacagugcucaug

SEQ ID NO: 127042 - RNA, 19 nt, Homo sapiens
gggaugaagcugugaacuu

SEQ ID NO: 127043 - RNA, 19 nt, Homo sapiens
aaacauucagugugacuuu

SEQ ID NO: 127044 - RNA, 19 nt, Homo sapiens
ugucuugcaucuuccauga

SEQ ID NO: 127045 - RNA, 19 nt, Homo sapiens
ggugguauuugcuaacauc

SEQ ID NO: 127046 - RNA, 19 nt, Homo sapiens
ggaaacgacagcaaacagu

SEQ ID NO: 127047 - RNA, 19 nt, Homo sapiens
gcaugaaguuggguuccuu

SEQ ID NO: 127048 - RNA, 19 nt, Homo sapiens
cuagguauaugcuuucucu

SEQ ID NO: 127049 - RNA, 19 nt, Homo sapiens
ugacaauccauuuacugua

SEQ ID NO: 127050 - RNA, 19 nt, Homo sapiens
guaauacugacaauccauu

SEQ ID NO: 127051 - RNA, 19 nt, Homo sapiens
aacaaaagcuucuuaagga

SEQ ID NO: 127052 - RNA, 19 nt, Homo sapiens
ugagcucugugaugaaaga

SEQ ID NO: 127053 - RNA, 19 nt, Homo sapiens
caaaaucaaugaggucuug

SEQ ID NO: 127054 - RNA, 19 nt, Homo sapiens
caucucaucuacccuccuu

SEQ ID NO: 127055 - RNA, 19 nt, Homo sapiens
gaccuacaacagcuaaauu

SEQ ID NO: 127056 - RNA, 19 nt, Homo sapiens
gugauuccuuuauggcauu

SEQ ID NO: 127057 - RNA, 19 nt, Homo sapiens
uaauguaagccaagcuaaa

SEQ ID NO: 127058 - RNA, 19 nt, Homo sapiens
gggauccagugaagacaau

SEQ ID NO: 127059 - RNA, 19 nt, Homo sapiens
gauccagugaagacaauuu

SEQ ID NO: 127060 - RNA, 19 nt, Homo sapiens
caacucggacucuugacaa

SEQ ID NO: 127061 - RNA, 19 nt, Homo sapiens
aggaagauuugaggaauau

SEQ ID NO: 127062 - RNA, 19 nt, Homo sapiens
auucacgucuugucauauu

SEQ ID NO: 127063 - RNA, 19 nt, Homo sapiens
uguguggguucuaauggua

SEQ ID NO: 127064 - RNA, 19 nt, Homo sapiens
aaacaacuucuaagacuag

SEQ ID NO: 127065 - RNA, 19 nt, Homo sapiens
guuaucaggccucccauga

SEQ ID NO: 127066 - RNA, 19 nt, Homo sapiens
aauggucguuugaaaguau

SEQ ID NO: 127067 - RNA, 19 nt, Homo sapiens
gaaaaugucccugcuuaau

SEQ ID NO: 127068 - RNA, 19 nt, Homo sapiens
uaacaucauauccaacuca

SEQ ID NO: 127069 - RNA, 19 nt, Homo sapiens
aacguuggcuucaggagaa

SEQ ID NO: 127070 - RNA, 19 nt, Homo sapiens
gggaggaagauuugaggaa

SEQ ID NO: 127071 - RNA, 19 nt, Homo sapiens
guaaagcaugcaaaaguua

SEQ ID NO: 127072 - RNA, 19 nt, Homo sapiens
aacauucagugugacuuua

SEQ ID NO: 127073 - RNA, 19 nt, Homo sapiens
gccagcagcaucucaucua

SEQ ID NO: 127074 - RNA, 19 nt, Homo sapiens
uagaggaccuuaaaauugu

SEQ ID NO: 127075 - RNA, 19 nt, Homo sapiens
ucaggccucccaugaaauu

SEQ ID NO: 127076 - RNA, 19 nt, Homo sapiens
gagaagagcugaagaguaa

SEQ ID NO: 127077 - RNA, 19 nt, Homo sapiens
ccacaucucugaucacuua

SEQ ID NO: 127078 - RNA, 19 nt, Homo sapiens
ucacuuagauucccuauuu

SEQ ID NO: 127079 - RNA, 19 nt, Homo sapiens
ggacuuauuugucaucuuu

SEQ ID NO: 127080 - RNA, 19 nt, Homo sapiens
gcagagaucuucaccaaca

SEQ ID NO: 127081 - RNA, 19 nt, Homo sapiens
cccaagggcuggaauguua

SEQ ID NO: 127082 - RNA, 19 nt, Homo sapiens
agacguaucucuguaaauu

SEQ ID NO: 127083 - RNA, 19 nt, Homo sapiens
ggaauguuaucuacaguau

SEQ ID NO: 127084 - RNA, 19 nt, Homo sapiens
uaagauuccuguuggguaa

SEQ ID NO: 127085 - RNA, 19 nt, Homo sapiens
gaaaugacccgcaaucucu

SEQ ID NO: 127086 - RNA, 19 nt, Homo sapiens
ggaaauacggcuucaucua

SEQ ID NO: 127087 - RNA, 19 nt, Homo sapiens
ggaguguuguguugacuuu

SEQ ID NO: 127088 - RNA, 19 nt, Homo sapiens
gaaguguacauaugaguuu

SEQ ID NO: 127089 - RNA, 19 nt, Homo sapiens
cagcuuaucuaacauguca

SEQ ID NO: 127090 - RNA, 19 nt, Homo sapiens
caaccgaacuccucuuugg

SEQ ID NO: 127091 - RNA, 19 nt, Homo sapiens
gaaauacggcuucaucuac

SEQ ID NO: 127092 - RNA, 19 nt, Homo sapiens
cugaugagcuugaauguuc

SEQ ID NO: 127093 - RNA, 19 nt, Homo sapiens
guucaaaccugagacuuau

SEQ ID NO: 127094 - RNA, 19 nt, Homo sapiens
ggguugcucugaagacuuu

SEQ ID NO: 127095 - RNA, 19 nt, Homo sapiens
gaaaucugaugagcuugaa

SEQ ID NO: 127096 - RNA, 19 nt, Homo sapiens
aaauggaccuccuacaaug

SEQ ID NO: 127097 - RNA, 19 nt, Homo sapiens
ggaaaucugaugagcuuga

SEQ ID NO: 127098 - RNA, 19 nt, Homo sapiens
aaauacaucggguguguua

SEQ ID NO: 127099 - RNA, 19 nt, Homo sapiens
gcaaucaagacaacaaguu

SEQ ID NO: 127100 - RNA, 19 nt, Homo sapiens
uuaaauggauaccagauuc

SEQ ID NO: 127101 - RNA, 19 nt, Homo sapiens
ggaacaacuuaaauacauc

SEQ ID NO: 127102 - RNA, 19 nt, Homo sapiens
ggaucuggcugccucucua

SEQ ID NO: 127103 - RNA, 19 nt, Homo sapiens
uggcagagaucuucaccaa

SEQ ID NO: 127104 - RNA, 19 nt, Homo sapiens
acucaccaguuuaguauuu

SEQ ID NO: 127105 - RNA, 19 nt, Homo sapiens
uaaauggaccuccuacaau

SEQ ID NO: 127106 - RNA, 19 nt, Homo sapiens
gcacuaaagcaaucuucaa

SEQ ID NO: 127107 - RNA, 19 nt, Homo sapiens
uacaucggguguguuauua

SEQ ID NO: 127108 - RNA, 19 nt, Homo sapiens
caagagcaaucaagacaac

SEQ ID NO: 127109 - RNA, 19 nt, Homo sapiens
ccaacaaggaagaauuuaa

SEQ ID NO: 127110 - RNA, 19 nt, Homo sapiens
gcugaagaguaaggguuua

SEQ ID NO: 127111 - RNA, 19 nt, Homo sapiens
gcagccacaucucugauca

SEQ ID NO: 127112 - RNA, 19 nt, Homo sapiens
ggaaguguacauaugaguu

SEQ ID NO: 127113 - RNA, 19 nt, Homo sapiens
cgagaagagcugaagagua

SEQ ID NO: 127114 - RNA, 19 nt, Homo sapiens
gaucuucaccaacaaggaa

SEQ ID NO: 127115 - RNA, 19 nt, Homo sapiens
gagagcggcuggacaugca

SEQ ID NO: 127116 - RNA, 19 nt, Homo sapiens
ggaaaugacccgcaaucuc

SEQ ID NO: 127117 - RNA, 19 nt, Homo sapiens
acugagaacugucacucua

SEQ ID NO: 127118 - RNA, 19 nt, Homo sapiens
cuaaauggaccuccuacaa

SEQ ID NO: 127119 - RNA, 19 nt, Homo sapiens
gaacauucgcgccaagauc

SEQ ID NO: 127120 - RNA, 19 nt, Homo sapiens
uaccuggacuuauuuguca

SEQ ID NO: 127121 - RNA, 19 nt, Homo sapiens
gaagguacuuuucugguau

SEQ ID NO: 127122 - RNA, 19 nt, Homo sapiens
ggagacccuucgacugaau

SEQ ID NO: 127123 - RNA, 19 nt, Homo sapiens
uuaaauacaucgggugugu

SEQ ID NO: 127124 - RNA, 19 nt, Homo sapiens
ggacaugcaggcacuaaag

SEQ ID NO: 127125 - RNA, 19 nt, Homo sapiens
auaaaucuguguuguccaa

SEQ ID NO: 127126 - RNA, 19 nt, Homo sapiens
gggcuggaauguuaucuac

SEQ ID NO: 127127 - RNA, 19 nt, Homo sapiens
ggaaaauugauccaaguua

SEQ ID NO: 127128 - RNA, 19 nt, Homo sapiens
aaauacggcuucaucuaca

SEQ ID NO: 127129 - RNA, 19 nt, Homo sapiens
cugcaagauucacccauuu

SEQ ID NO: 127130 - RNA, 19 nt, Homo sapiens
gcagaugaagcgcaggaaa

SEQ ID NO: 127131 - RNA, 19 nt, Homo sapiens
caccaacaaggaagaauuu

SEQ ID NO: 127132 - RNA, 19 nt, Homo sapiens
gcuuaucuaacaugucaua

SEQ ID NO: 127133 - RNA, 19 nt, Homo sapiens
agggaaagaugaaccugaa

SEQ ID NO: 127134 - RNA, 19 nt, Homo sapiens
uuuaaggaguguuguguug

SEQ ID NO: 127135 - RNA, 19 nt, Homo sapiens
gcauccagguucagcuuca

SEQ ID NO: 127136 - RNA, 19 nt, Homo sapiens
gcuggaauguuaucuacag

SEQ ID NO: 127137 - RNA, 19 nt, Homo sapiens
uaggagcuguguaggcaaa

SEQ ID NO: 127138 - RNA, 19 nt, Homo sapiens
caaguuggacauggaaauu

SEQ ID NO: 127139 - RNA, 19 nt, Homo sapiens
gcaagagcaaucaagacaa

SEQ ID NO: 127140 - RNA, 19 nt, Homo sapiens
agaugaagcgcaggaaaua

SEQ ID NO: 127141 - RNA, 19 nt, Homo sapiens
ucuaaccucuccagcuuau

SEQ ID NO: 127142 - RNA, 19 nt, Homo sapiens
acucuaaccucuccagcuu

SEQ ID NO: 127143 - RNA, 19 nt, Homo sapiens
uauuggaaguguacauaug

SEQ ID NO: 127144 - RNA, 19 nt, Homo sapiens
ccugcaagauucacccauu

SEQ ID NO: 127145 - RNA, 19 nt, Homo sapiens
ucaaaccugagacuuauug

SEQ ID NO: 127146 - RNA, 19 nt, Homo sapiens
gcaguugugcccucccauu

SEQ ID NO: 127147 - RNA, 19 nt, Homo sapiens
caucggguguguuauuaag

SEQ ID NO: 127148 - RNA, 19 nt, Homo sapiens
ugacuauacuaccacaauc

SEQ ID NO: 127149 - RNA, 19 nt, Homo sapiens
guguuguguugacuuuaua

SEQ ID NO: 127150 - RNA, 19 nt, Homo sapiens
ggggaaaucugaugagcuu

SEQ ID NO: 127151 - RNA, 19 nt, Homo sapiens
cuacaagacgcaucuguuc

SEQ ID NO: 127152 - RNA, 19 nt, Homo sapiens
ggacaaucucccugcaaga

SEQ ID NO: 127153 - RNA, 19 nt, Homo sapiens
gaaaagguaacacugagaa

SEQ ID NO: 127154 - RNA, 19 nt, Homo sapiens
gaucuggcugccucucuaa

SEQ ID NO: 127155 - RNA, 19 nt, Homo sapiens
gcacaagcagcgcaagaag

SEQ ID NO: 127156 - RNA, 19 nt, Homo sapiens
ugaagguacuuuucuggua

SEQ ID NO: 127157 - RNA, 19 nt, Homo sapiens
uguucaaaccugagacuua

SEQ ID NO: 127158 - RNA, 19 nt, Homo sapiens
ggaaagaugaaccugaaaa

SEQ ID NO: 127159 - RNA, 19 nt, Homo sapiens
aaaccagucccaccgugua

SEQ ID NO: 127160 - RNA, 19 nt, Homo sapiens
acuggcagcuucuaaaugg

SEQ ID NO: 127161 - RNA, 19 nt, Homo sapiens
guggaggccuucgaggaaa

SEQ ID NO: 127162 - RNA, 19 nt, Homo sapiens
augccuaccuggacuuauu

SEQ ID NO: 127163 - RNA, 19 nt, Homo sapiens
ggagcuguguaggcaaaga

SEQ ID NO: 127164 - RNA, 19 nt, Homo sapiens
ucaccaacaaggaagaauu

SEQ ID NO: 127165 - RNA, 19 nt, Homo sapiens
auacaucggguguguuauu

SEQ ID NO: 127166 - RNA, 19 nt, Homo sapiens
cagaugaagcgcaggaaau

SEQ ID NO: 127167 - RNA, 19 nt, Homo sapiens
gaggaaaugacccgcaauc

SEQ ID NO: 127168 - RNA, 19 nt, Homo sapiens
gggaaaccuugcagauggu

SEQ ID NO: 127169 - RNA, 19 nt, Homo sapiens
gcgcaucgagcagaacauu

SEQ ID NO: 127170 - RNA, 19 nt, Homo sapiens
guaucucuguaaauucuuc

SEQ ID NO: 127171 - RNA, 19 nt, Homo sapiens
guucagcuucauuccauuu

SEQ ID NO: 127172 - RNA, 19 nt, Homo sapiens
gaagagcugaagaguaagg

SEQ ID NO: 127173 - RNA, 19 nt, Homo sapiens
aaccugagacuuauuggaa

SEQ ID NO: 127174 - RNA, 19 nt, Homo sapiens
ggaaaccuugcagauggua

SEQ ID NO: 127175 - RNA, 19 nt, Homo sapiens
gcacgacuccucgcacaag

SEQ ID NO: 127176 - RNA, 19 nt, Homo sapiens
gagaagagcugaagaguaa

SEQ ID NO: 127177 - RNA, 19 nt, Homo sapiens
ccacaucucugaucacuua

SEQ ID NO: 127178 - RNA, 19 nt, Homo sapiens
ucacuuagauucccuauuu

SEQ ID NO: 127179 - RNA, 19 nt, Homo sapiens
ggacuuauuugucaucuuu

SEQ ID NO: 127180 - RNA, 19 nt, Homo sapiens
gaacaaacgguuaaagauu

SEQ ID NO: 127181 - RNA, 19 nt, Homo sapiens
gcagagaucuucaccaaca

SEQ ID NO: 127182 - RNA, 19 nt, Homo sapiens
cccaagggcuggaauguua

SEQ ID NO: 127183 - RNA, 19 nt, Homo sapiens
agacguaucucuguaaauu

SEQ ID NO: 127184 - RNA, 19 nt, Homo sapiens
ggaauguuaucuacaguau

SEQ ID NO: 127185 - RNA, 19 nt, Homo sapiens
uaagauuccuguuggguaa

SEQ ID NO: 127186 - RNA, 19 nt, Homo sapiens
gaaaugacccgcaaucucu

SEQ ID NO: 127187 - RNA, 19 nt, Homo sapiens
ggaaauacggcuucaucua

SEQ ID NO: 127188 - RNA, 19 nt, Homo sapiens
ggaguguuguguugacuuu

SEQ ID NO: 127189 - RNA, 19 nt, Homo sapiens
gaaguguacauaugaguuu

SEQ ID NO: 127190 - RNA, 19 nt, Homo sapiens
cagcuuaucuaacauguca

SEQ ID NO: 127191 - RNA, 19 nt, Homo sapiens
caaccgaacuccucuuugg

SEQ ID NO: 127192 - RNA, 19 nt, Homo sapiens
gaaauacggcuucaucuac

SEQ ID NO: 127193 - RNA, 19 nt, Homo sapiens
cugaugagcuugaauguuc

SEQ ID NO: 127194 - RNA, 19 nt, Homo sapiens
guucaaaccugagacuuau

SEQ ID NO: 127195 - RNA, 19 nt, Homo sapiens
ggguugcucugaagacuuu

SEQ ID NO: 127196 - RNA, 19 nt, Homo sapiens
ggaaauggaaagccaguga

SEQ ID NO: 127197 - RNA, 19 nt, Homo sapiens
gaaaucugaugagcuugaa

SEQ ID NO: 127198 - RNA, 19 nt, Homo sapiens
aaauggaccuccuacaaug

SEQ ID NO: 127199 - RNA, 19 nt, Homo sapiens
ggaacaaacgguuaaagau

SEQ ID NO: 127200 - RNA, 19 nt, Homo sapiens
ggaaaucugaugagcuuga

SEQ ID NO: 127201 - RNA, 19 nt, Homo sapiens
aaauacaucggguguguua

SEQ ID NO: 127202 - RNA, 19 nt, Homo sapiens
gcaaucaagacaacaaguu

SEQ ID NO: 127203 - RNA, 19 nt, Homo sapiens
uuaaauggauaccagauuc

SEQ ID NO: 127204 - RNA, 19 nt, Homo sapiens
ggaacaacuuaaauacauc

SEQ ID NO: 127205 - RNA, 19 nt, Homo sapiens
ggaucuggcugccucucua

SEQ ID NO: 127206 - RNA, 19 nt, Homo sapiens
gaacuaauugucugaccaa

SEQ ID NO: 127207 - RNA, 19 nt, Homo sapiens
uggcagagaucuucaccaa

SEQ ID NO: 127208 - RNA, 19 nt, Homo sapiens
acucaccaguuuaguauuu

SEQ ID NO: 127209 - RNA, 19 nt, Homo sapiens
uaaauggaccuccuacaau

SEQ ID NO: 127210 - RNA, 19 nt, Homo sapiens
gcacuaaagcaaucuucaa

SEQ ID NO: 127211 - RNA, 19 nt, Homo sapiens
uacaucggguguguuauua

SEQ ID NO: 127212 - RNA, 19 nt, Homo sapiens
caagagcaaucaagacaac

SEQ ID NO: 127213 - RNA, 19 nt, Homo sapiens
ccaacaaggaagaauuuaa

SEQ ID NO: 127214 - RNA, 19 nt, Homo sapiens
gcugaagaguaaggguuua

SEQ ID NO: 127215 - RNA, 19 nt, Homo sapiens
gcagccacaucucugauca

SEQ ID NO: 127216 - RNA, 19 nt, Homo sapiens
gaaauggaaagccagugaa

SEQ ID NO: 127217 - RNA, 19 nt, Homo sapiens
ggaaguguacauaugaguu

SEQ ID NO: 127218 - RNA, 19 nt, Homo sapiens
cgagaagagcugaagagua

SEQ ID NO: 127219 - RNA, 19 nt, Homo sapiens
gaucuucaccaacaaggaa

SEQ ID NO: 127220 - RNA, 19 nt, Homo sapiens
gagagcggcuggacaugca

SEQ ID NO: 127221 - RNA, 19 nt, Homo sapiens
ggaaaugacccgcaaucuc

SEQ ID NO: 127222 - RNA, 19 nt, Homo sapiens
acugagaacugucacucua

SEQ ID NO: 127223 - RNA, 19 nt, Homo sapiens
cuaaauggaccuccuacaa

SEQ ID NO: 127224 - RNA, 19 nt, Homo sapiens
gaacauucgcgccaagauc

SEQ ID NO: 127225 - RNA, 19 nt, Homo sapiens
uaccuggacuuauuuguca

SEQ ID NO: 127226 - RNA, 19 nt, Homo sapiens
gaagguacuuuucugguau

SEQ ID NO: 127227 - RNA, 19 nt, Homo sapiens
ggagacccuucgacugaau

SEQ ID NO: 127228 - RNA, 19 nt, Homo sapiens
uuaaauacaucgggugugu

SEQ ID NO: 127229 - RNA, 19 nt, Homo sapiens
ggacaugcaggcacuaaag

SEQ ID NO: 127230 - RNA, 19 nt, Homo sapiens
gaacuuugggugaacuaau

SEQ ID NO: 127231 - RNA, 19 nt, Homo sapiens
auaaaucuguguuguccaa

SEQ ID NO: 127232 - RNA, 19 nt, Homo sapiens
gggcuggaauguuaucuac

SEQ ID NO: 127233 - RNA, 19 nt, Homo sapiens
ggaaaauugauccaaguua

SEQ ID NO: 127234 - RNA, 19 nt, Homo sapiens
cugcaagauucacccauuu

SEQ ID NO: 127235 - RNA, 19 nt, Homo sapiens
gcagaugaagcgcaggaaa

SEQ ID NO: 127236 - RNA, 19 nt, Homo sapiens
caccaacaaggaagaauuu

SEQ ID NO: 127237 - RNA, 19 nt, Homo sapiens
gggagggauuccaaagaga

SEQ ID NO: 127238 - RNA, 19 nt, Homo sapiens
aaauacggcuucaucuaca

SEQ ID NO: 127239 - RNA, 19 nt, Homo sapiens
gcuuaucuaacaugucaua

SEQ ID NO: 127240 - RNA, 19 nt, Homo sapiens
agggaaagaugaaccugaa

SEQ ID NO: 127241 - RNA, 19 nt, Homo sapiens
uuuaaggaguguuguguug

SEQ ID NO: 127242 - RNA, 19 nt, Homo sapiens
gcauccagguucagcuuca

SEQ ID NO: 127243 - RNA, 19 nt, Homo sapiens
gcuggaauguuaucuacag

SEQ ID NO: 127244 - RNA, 19 nt, Homo sapiens
gagcucagcacaccuugga

SEQ ID NO: 127245 - RNA, 19 nt, Homo sapiens
ggcccaauccgcaauuaaa

SEQ ID NO: 127246 - RNA, 19 nt, Homo sapiens
gcgcggaacaaacgguuaa

SEQ ID NO: 127247 - RNA, 19 nt, Homo sapiens
uaggagcuguguaggcaaa

SEQ ID NO: 127248 - RNA, 19 nt, Homo sapiens
agaugaagcgcaggaaaua

SEQ ID NO: 127249 - RNA, 19 nt, Homo sapiens
caaguuggacauggaaauu

SEQ ID NO: 127250 - RNA, 19 nt, Homo sapiens
gcaagagcaaucaagacaa

SEQ ID NO: 127251 - RNA, 19 nt, Homo sapiens
aagaugaacuuugggugaa

SEQ ID NO: 127252 - RNA, 19 nt, Homo sapiens
aauccgcaauuaaagauga

SEQ ID NO: 127253 - RNA, 19 nt, Homo sapiens
ucuaaccucuccagcuuau

SEQ ID NO: 127254 - RNA, 19 nt, Homo sapiens
acucuaaccucuccagcuu

SEQ ID NO: 127255 - RNA, 19 nt, Homo sapiens
uauuggaaguguacauaug

SEQ ID NO: 127256 - RNA, 19 nt, Homo sapiens
ccugcaagauucacccauu

SEQ ID NO: 127257 - RNA, 19 nt, Homo sapiens
ucaaaccugagacuuauug

SEQ ID NO: 127258 - RNA, 19 nt, Homo sapiens
caucggguguguuauuaag

SEQ ID NO: 127259 - RNA, 19 nt, Homo sapiens
cuacaagacgcaucuguuc

SEQ ID NO: 127260 - RNA, 19 nt, Homo sapiens
ugacuauacuaccacaauc

SEQ ID NO: 127261 - RNA, 19 nt, Homo sapiens
guguuguguugacuuuaua

SEQ ID NO: 127262 - RNA, 19 nt, Homo sapiens
cggaacaaacgguuaaaga

SEQ ID NO: 127263 - RNA, 19 nt, Homo sapiens
ggggaaaucugaugagcuu

SEQ ID NO: 127264 - RNA, 19 nt, Homo sapiens
ggacaaucucccugcaaga

SEQ ID NO: 127265 - RNA, 19 nt, Homo sapiens
gaucuggcugccucucuaa

SEQ ID NO: 127266 - RNA, 19 nt, Homo sapiens
gaaaagguaacacugagaa

SEQ ID NO: 127267 - RNA, 19 nt, Homo sapiens
gcacaagcagcgcaagaag

SEQ ID NO: 127268 - RNA, 19 nt, Homo sapiens
ugaagguacuuuucuggua

SEQ ID NO: 127269 - RNA, 19 nt, Homo sapiens
uguucaaaccugagacuua

SEQ ID NO: 127270 - RNA, 19 nt, Homo sapiens
aacuuugggugaacuaauu

SEQ ID NO: 127271 - RNA, 19 nt, Homo sapiens
ggaaagaugaaccugaaaa

SEQ ID NO: 127272 - RNA, 19 nt, Homo sapiens
aaaccagucccaccgugua

SEQ ID NO: 127273 - RNA, 19 nt, Homo sapiens
acuggcagcuucuaaaugg

SEQ ID NO: 127274 - RNA, 19 nt, Homo sapiens
guggaggccuucgaggaaa

SEQ ID NO: 127275 - RNA, 19 nt, Homo sapiens
augccuaccuggacuuauu

SEQ ID NO: 127276 - RNA, 19 nt, Homo sapiens
ggaagaagcugauugauga

SEQ ID NO: 127277 - RNA, 19 nt, Homo sapiens
ggacauggcucaacucuuc

SEQ ID NO: 127278 - RNA, 19 nt, Homo sapiens
gcaacucccucucagcuaa

SEQ ID NO: 127279 - RNA, 19 nt, Homo sapiens
ggaacgacauggagcuaug

SEQ ID NO: 127280 - RNA, 19 nt, Homo sapiens
caaggcugauccagaagua

SEQ ID NO: 127281 - RNA, 19 nt, Homo sapiens
gaugagaagcucgaagaua

SEQ ID NO: 127282 - RNA, 19 nt, Homo sapiens
guccuuggguagaauauaa

SEQ ID NO: 127283 - RNA, 19 nt, Homo sapiens
ucgcaaggcugauccagaa

SEQ ID NO: 127284 - RNA, 19 nt, Homo sapiens
caauguggauguccuacuu

SEQ ID NO: 127285 - RNA, 19 nt, Homo sapiens
cagcugcgcuucuucuuuc

SEQ ID NO: 127286 - RNA, 19 nt, Homo sapiens
uggcucaacucuucuacua

SEQ ID NO: 127287 - RNA, 19 nt, Homo sapiens
ggugauugaugacuuuaug

SEQ ID NO: 127288 - RNA, 19 nt, Homo sapiens
augagaagcucgaagauau

SEQ ID NO: 127289 - RNA, 19 nt, Homo sapiens
cgucagauccaucggguua

SEQ ID NO: 127290 - RNA, 19 nt, Homo sapiens
gggaagaagcugauugaug

SEQ ID NO: 127291 - RNA, 19 nt, Homo sapiens
ugaggugauugaugacuuu

SEQ ID NO: 127292 - RNA, 19 nt, Homo sapiens
gaaagugggccugcaguuc

SEQ ID NO: 127293 - RNA, 19 nt, Homo sapiens
caacucuucuacuacuuug

SEQ ID NO: 127294 - RNA, 19 nt, Homo sapiens
gcucaacucuucuacuacu

SEQ ID NO: 127295 - RNA, 19 nt, Homo sapiens
gaagcugauugaugagaag

SEQ ID NO: 127296 - RNA, 19 nt, Homo sapiens
gcacacacccugagcuuuu

SEQ ID NO: 127297 - RNA, 19 nt, Homo sapiens
caaggacuuugcccacaug

SEQ ID NO: 127298 - RNA, 19 nt, Homo sapiens
agaaacagccagccugcua

SEQ ID NO: 127299 - RNA, 19 nt, Homo sapiens
ccaagaacacccaguuugu

SEQ ID NO: 127300 - RNA, 19 nt, Homo sapiens
gcuacauccuguucgagaa

SEQ ID NO: 127301 - RNA, 19 nt, Homo sapiens
auacggaugcuuucaauga

SEQ ID NO: 127302 - RNA, 19 nt, Homo sapiens
acucagcacucgacccaaa

SEQ ID NO: 127303 - RNA, 19 nt, Homo sapiens
gcuguucguucaaggcuau

SEQ ID NO: 127304 - RNA, 19 nt, Homo sapiens
caaaggacccugagaucca

SEQ ID NO: 127305 - RNA, 19 nt, Homo sapiens
gcugccaugucucagauga

SEQ ID NO: 127306 - RNA, 19 nt, Homo sapiens
cuacuacuuugccuuggaa

SEQ ID NO: 127307 - RNA, 19 nt, Homo sapiens
ggagauuccacgucuagga

SEQ ID NO: 127308 - RNA, 19 nt, Homo sapiens
ggccucagaugcacgugaa

SEQ ID NO: 127309 - RNA, 19 nt, Homo sapiens
ucaaggcuaugcccugcaa

SEQ ID NO: 127310 - RNA, 19 nt, Homo sapiens
cacaaacucccggaucaua

SEQ ID NO: 127311 - RNA, 19 nt, Homo sapiens
caaacucccggaucauaga

SEQ ID NO: 127312 - RNA, 19 nt, Homo sapiens
ccacaugccguugcucaaa

SEQ ID NO: 127313 - RNA, 19 nt, Homo sapiens
agaagcugauugaugagaa

SEQ ID NO: 127314 - RNA, 19 nt, Homo sapiens
gaggagauuccacgucuag

SEQ ID NO: 127315 - RNA, 19 nt, Homo sapiens
ggaagcuauuugcuacauc

SEQ ID NO: 127316 - RNA, 19 nt, Homo sapiens
cuauacggaugcuuucaau

SEQ ID NO: 127317 - RNA, 19 nt, Homo sapiens
ggacagcugcgcuucuucu

SEQ ID NO: 127318 - RNA, 19 nt, Homo sapiens
ucucugagccugaaagcuu

SEQ ID NO: 127319 - RNA, 19 nt, Homo sapiens
caagaacacccaguuugug

SEQ ID NO: 127320 - RNA, 19 nt, Homo sapiens
uuccagaacucacucuaug

SEQ ID NO: 127321 - RNA, 19 nt, Homo sapiens
uaggacagcugcgcuucuu

SEQ ID NO: 127322 - RNA, 19 nt, Homo sapiens
cuacuuagggccucagaug

SEQ ID NO: 127323 - RNA, 19 nt, Homo sapiens
uguaccaccucucaaagga

SEQ ID NO: 127324 - RNA, 19 nt, Homo sapiens
ucagauccaucggguuaau

SEQ ID NO: 127325 - RNA, 19 nt, Homo sapiens
ucaacucuucuacuacuuu

SEQ ID NO: 127326 - RNA, 19 nt, Homo sapiens
agacagugcugagcugagu

SEQ ID NO: 127327 - RNA, 19 nt, Homo sapiens
cccacaaacucccggauca

SEQ ID NO: 127328 - RNA, 19 nt, Homo sapiens
ggaagcagcgcucuauacg

SEQ ID NO: 127329 - RNA, 19 nt, Homo sapiens
acauggagcuauggaagga

SEQ ID NO: 127330 - RNA, 19 nt, Homo sapiens
gaaaaggaaauugaaguug

SEQ ID NO: 127331 - RNA, 19 nt, Homo sapiens
gcaaggcugauccagaagu

SEQ ID NO: 127332 - RNA, 19 nt, Homo sapiens
aguuacaggugcuuuacaa

SEQ ID NO: 127333 - RNA, 19 nt, Homo sapiens
gcggaagcagcgcucuaua

SEQ ID NO: 127334 - RNA, 19 nt, Homo sapiens
caggauccagcacccauuu

SEQ ID NO: 127335 - RNA, 19 nt, Homo sapiens
ugguuggaaugccaucuuu

SEQ ID NO: 127336 - RNA, 19 nt, Homo sapiens
ccaaguacgguccaaugug

SEQ ID NO: 127337 - RNA, 19 nt, Homo sapiens
gggucuagcuggccuuugc

SEQ ID NO: 127338 - RNA, 19 nt, Homo sapiens
agagggaaaguacccagua

SEQ ID NO: 127339 - RNA, 19 nt, Homo sapiens
ucuuucagcuguucguuca

SEQ ID NO: 127340 - RNA, 19 nt, Homo sapiens
acaaggacuuugcccacau

SEQ ID NO: 127341 - RNA, 19 nt, Homo sapiens
cuacauccuguucgagaaa

SEQ ID NO: 127342 - RNA, 19 nt, Homo sapiens
caacucccucucagcuaaa

SEQ ID NO: 127343 - RNA, 19 nt, Homo sapiens
cccaagaacacccaguuug

SEQ ID NO: 127344 - RNA, 19 nt, Homo sapiens
ggccaaguacgguccaaug

SEQ ID NO: 127345 - RNA, 19 nt, Homo sapiens
ugacaugggcccuguacca

SEQ ID NO: 127346 - RNA, 19 nt, Homo sapiens
gagaagcucgaagauaugg

SEQ ID NO: 127347 - RNA, 19 nt, Homo sapiens
gaggugauugaugacuuua

SEQ ID NO: 127348 - RNA, 19 nt, Homo sapiens
cauccaacacgcugacaug

SEQ ID NO: 127349 - RNA, 19 nt, Homo sapiens
auaccuggaugguuggaau

SEQ ID NO: 127350 - RNA, 19 nt, Homo sapiens
agaggagauuccacgucua

SEQ ID NO: 127351 - RNA, 19 nt, Homo sapiens
cacaugccguugcucaaag

SEQ ID NO: 127352 - RNA, 19 nt, Homo sapiens
ugagaagcucgaagauaug

SEQ ID NO: 127353 - RNA, 19 nt, Homo sapiens
gccaaguacgguccaaugu

SEQ ID NO: 127354 - RNA, 19 nt, Homo sapiens
gaacgacauggagcuaugg

SEQ ID NO: 127355 - RNA, 19 nt, Homo sapiens
cagcacgaccugaccuaug

SEQ ID NO: 127356 - RNA, 19 nt, Homo sapiens
cagaugaggagggagagaa

SEQ ID NO: 127357 - RNA, 19 nt, Homo sapiens
uggaagcuauuugcuacau

SEQ ID NO: 127358 - RNA, 19 nt, Homo sapiens
gaaagagacugucaucauc

SEQ ID NO: 127359 - RNA, 19 nt, Homo sapiens
ggugaagccuuauuuguuu

SEQ ID NO: 127360 - RNA, 19 nt, Homo sapiens
gguuuacgguuucuuauaa

SEQ ID NO: 127361 - RNA, 19 nt, Homo sapiens
gagcaucaaccuacaguuu

SEQ ID NO: 127362 - RNA, 19 nt, Homo sapiens
gauagaaccaccauaguga

SEQ ID NO: 127363 - RNA, 19 nt, Homo sapiens
ggaaagagacugucaucau

SEQ ID NO: 127364 - RNA, 19 nt, Homo sapiens
gaccagauguuugcauuug

SEQ ID NO: 127365 - RNA, 19 nt, Homo sapiens
ccauacacauucuuagauu

SEQ ID NO: 127366 - RNA, 19 nt, Homo sapiens
gagcuugaauugcaaaugg

SEQ ID NO: 127367 - RNA, 19 nt, Homo sapiens
agacagcacuccacucaga

SEQ ID NO: 127368 - RNA, 19 nt, Homo sapiens
gaaccaccauagugaagug

SEQ ID NO: 127369 - RNA, 19 nt, Homo sapiens
gcccagauccuaacacauu

SEQ ID NO: 127370 - RNA, 19 nt, Homo sapiens
caucauagggauaagauuu

SEQ ID NO: 127371 - RNA, 19 nt, Homo sapiens
caaagcauaagcucaguaa

SEQ ID NO: 127372 - RNA, 19 nt, Homo sapiens
gauaugaugcucaggagaa

SEQ ID NO: 127373 - RNA, 19 nt, Homo sapiens
ggacagugcgcaccgugua

SEQ ID NO: 127374 - RNA, 19 nt, Homo sapiens
uggcagagcuugaauugca

SEQ ID NO: 127375 - RNA, 19 nt, Homo sapiens
gcacuccacucagagauca

SEQ ID NO: 127376 - RNA, 19 nt, Homo sapiens
gaggacagcccgagaagga

SEQ ID NO: 127377 - RNA, 19 nt, Homo sapiens
ggauagaaccaccauagug

SEQ ID NO: 127378 - RNA, 19 nt, Homo sapiens
ugaaggcgguggucaagga

SEQ ID NO: 127379 - RNA, 19 nt, Homo sapiens
gggaccagauguuugcauu

SEQ ID NO: 127380 - RNA, 19 nt, Homo sapiens
ucaugugggugacuauauu

SEQ ID NO: 127381 - RNA, 19 nt, Homo sapiens
uggcuaagcauuuaucaaa

SEQ ID NO: 127382 - RNA, 19 nt, Homo sapiens
caucaucacccuuucauuc

SEQ ID NO: 127383 - RNA, 19 nt, Homo sapiens
gggugaagccuuauuuguu

SEQ ID NO: 127384 - RNA, 19 nt, Homo sapiens
gcauguaagcucuuugaga

SEQ ID NO: 127385 - RNA, 19 nt, Homo sapiens
ugaccaaacuggauagaac

SEQ ID NO: 127386 - RNA, 19 nt, Homo sapiens
ucccagagccaaauucuuu

SEQ ID NO: 127387 - RNA, 19 nt, Homo sapiens
caacguagucugcgaccuu

SEQ ID NO: 127388 - RNA, 19 nt, Homo sapiens
cauugaugcugcuggcuaa

SEQ ID NO: 127389 - RNA, 19 nt, Homo sapiens
ugaccaaugugugaaguau

SEQ ID NO: 127390 - RNA, 19 nt, Homo sapiens
ugggaaaugugacagaguu

SEQ ID NO: 127391 - RNA, 19 nt, Homo sapiens
cauacacauucuuagauug

SEQ ID NO: 127392 - RNA, 19 nt, Homo sapiens
ugacccagacccucaagua

SEQ ID NO: 127393 - RNA, 19 nt, Homo sapiens
gcacaagaccaagguauac

SEQ ID NO: 127394 - RNA, 19 nt, Homo sapiens
ggcacaagaccaagguaua

SEQ ID NO: 127395 - RNA, 19 nt, Homo sapiens
ucaaggaagugcuaagacu

SEQ ID NO: 127396 - RNA, 19 nt, Homo sapiens
ccaccauagugaaguguga

SEQ ID NO: 127397 - RNA, 19 nt, Homo sapiens
gcugugggcucgguguuug

SEQ ID NO: 127398 - RNA, 19 nt, Homo sapiens
gcuaagcauuuaucaaagc

SEQ ID NO: 127399 - RNA, 19 nt, Homo sapiens
ccagacagcacuccacuca

SEQ ID NO: 127400 - RNA, 19 nt, Homo sapiens
ggaccagauguuugcauuu

SEQ ID NO: 127401 - RNA, 19 nt, Homo sapiens
agaccaagguauacaucuu

SEQ ID NO: 127402 - RNA, 19 nt, Homo sapiens
gacagauagucccauggaa

SEQ ID NO: 127403 - RNA, 19 nt, Homo sapiens
ccauguggcagaagggaua

SEQ ID NO: 127404 - RNA, 19 nt, Homo sapiens
acagauagucccauggaaa

SEQ ID NO: 127405 - RNA, 19 nt, Homo sapiens
caugugggugacuauauua

SEQ ID NO: 127406 - RNA, 19 nt, Homo sapiens
ggcaaaggcuccgcagucu

SEQ ID NO: 127407 - RNA, 19 nt, Homo sapiens
ugaaaggagcaucaaccua

SEQ ID NO: 127408 - RNA, 19 nt, Homo sapiens
ggucaaggaagugcuaaga

SEQ ID NO: 127409 - RNA, 19 nt, Homo sapiens
ucucuugggcucuguauga

SEQ ID NO: 127410 - RNA, 19 nt, Homo sapiens
gcucucuggccacuauuaa

SEQ ID NO: 127411 - RNA, 19 nt, Homo sapiens
gaccaagguauacaucuuc

SEQ ID NO: 127412 - RNA, 19 nt, Homo sapiens
ugugguaccuggaaauucu

SEQ ID NO: 127413 - RNA, 19 nt, Homo sapiens
caggaagccaggugagaaa

SEQ ID NO: 127414 - RNA, 19 nt, Homo sapiens
cccagauccuaacacauuu

SEQ ID NO: 127415 - RNA, 19 nt, Homo sapiens
uggauggccugaggaaaga

SEQ ID NO: 127416 - RNA, 19 nt, Homo sapiens
aaaauacgcuggucacucu

SEQ ID NO: 127417 - RNA, 19 nt, Homo sapiens
ucuuauaacucuccuuugc

SEQ ID NO: 127418 - RNA, 19 nt, Homo sapiens
aaucugcccuagccugguu

SEQ ID NO: 127419 - RNA, 19 nt, Homo sapiens
caccauacacauucuuaga

SEQ ID NO: 127420 - RNA, 19 nt, Homo sapiens
caucacccuuucauucauc

SEQ ID NO: 127421 - RNA, 19 nt, Homo sapiens
aaaggagcaucaaccuaca

SEQ ID NO: 127422 - RNA, 19 nt, Homo sapiens
ggcaagcgcagcuguaugg

SEQ ID NO: 127423 - RNA, 19 nt, Homo sapiens
gaccuugugcggcgucuga

SEQ ID NO: 127424 - RNA, 19 nt, Homo sapiens
aaagagacugucaucauca

SEQ ID NO: 127425 - RNA, 19 nt, Homo sapiens
ggcuaagcauuuaucaaag

SEQ ID NO: 127426 - RNA, 19 nt, Homo sapiens
gcagagcuugaauugcaaa

SEQ ID NO: 127427 - RNA, 19 nt, Homo sapiens
uugcaucucuucccuuugg

SEQ ID NO: 127428 - RNA, 19 nt, Homo sapiens
gaaggcgguggucaaggaa

SEQ ID NO: 127429 - RNA, 19 nt, Homo sapiens
cagauagucccauggaaag

SEQ ID NO: 127430 - RNA, 19 nt, Homo sapiens
ggcagagcuugaauugcaa

SEQ ID NO: 127431 - RNA, 19 nt, Homo sapiens
ucucuucccuuuggcuuug

SEQ ID NO: 127432 - RNA, 19 nt, Homo sapiens
ucaaagcauaagcucagua

SEQ ID NO: 127433 - RNA, 19 nt, Homo sapiens
cuaagcauuuaucaaagca

SEQ ID NO: 127434 - RNA, 19 nt, Homo sapiens
ucaaguacgccuccagagu

SEQ ID NO: 127435 - RNA, 19 nt, Homo sapiens
ccugguuuacgguuucuua

SEQ ID NO: 127436 - RNA, 19 nt, Homo sapiens
ccggaacccugaacaacgu

SEQ ID NO: 127437 - RNA, 19 nt, Homo sapiens
ucaggaagccaggugagaa

SEQ ID NO: 127438 - RNA, 19 nt, Homo sapiens
guauacaucuuccccuaau

SEQ ID NO: 127439 - RNA, 19 nt, Homo sapiens
guacgccuccagaguguuc

SEQ ID NO: 127440 - RNA, 19 nt, Homo sapiens
aagcauaagcucaguaacu

SEQ ID NO: 127441 - RNA, 19 nt, Homo sapiens
agauucaacugccucucuu

SEQ ID NO: 127442 - RNA, 19 nt, Homo sapiens
gcuuggcccuucugaucau

SEQ ID NO: 127443 - RNA, 19 nt, Homo sapiens
gaaggcgaagaauggcaaa

SEQ ID NO: 127444 - RNA, 19 nt, Homo sapiens
aggaagugcuaagacugua

SEQ ID NO: 127445 - RNA, 19 nt, Homo sapiens
gaaaugugacagaguugcu

SEQ ID NO: 127446 - RNA, 19 nt, Homo sapiens
ccagauguuugcauuugcu

SEQ ID NO: 127447 - RNA, 19 nt, Homo sapiens
uaacucuccuuugcucucu

SEQ ID NO: 127448 - RNA, 19 nt, Homo sapiens
gucaccauacacauucuua

SEQ ID NO: 127449 - RNA, 19 nt, Homo sapiens
gauucaacugccucucuuu

SEQ ID NO: 127450 - RNA, 19 nt, Homo sapiens
caagaccaagguauacauc

SEQ ID NO: 127451 - RNA, 19 nt, Homo sapiens
ucauucaucauagggauaa

SEQ ID NO: 127452 - RNA, 19 nt, Homo sapiens
ccacccauuugcaucucuu

SEQ ID NO: 127453 - RNA, 19 nt, Homo sapiens
uagccugguuuacgguuuc

SEQ ID NO: 127454 - RNA, 19 nt, Homo sapiens
uaaugccuaucugaccaaa

SEQ ID NO: 127455 - RNA, 19 nt, Homo sapiens
cagaggcagccaugaggaa

SEQ ID NO: 127456 - RNA, 19 nt, Homo sapiens
gcuuuggcccagauccuaa

SEQ ID NO: 127457 - RNA, 19 nt, Homo sapiens
ccuggcagagcuugaauug

SEQ ID NO: 127458 - RNA, 19 nt, Homo sapiens
gcucaaggaucuaaauuua

SEQ ID NO: 127459 - RNA, 19 nt, Homo sapiens
ggaaucaacuuaucucaaa

SEQ ID NO: 127460 - RNA, 19 nt, Homo sapiens
uaacauagcccacuuuaaa

SEQ ID NO: 127461 - RNA, 19 nt, Homo sapiens
gagagaaucugccuccuuu

SEQ ID NO: 127462 - RNA, 19 nt, Homo sapiens
gcuaaagacugcucaugua

SEQ ID NO: 127463 - RNA, 19 nt, Homo sapiens
gaaaggaaaucagaaguca

SEQ ID NO: 127464 - RNA, 19 nt, Homo sapiens
ggaauaaucgaacaucuaa

SEQ ID NO: 127465 - RNA, 19 nt, Homo sapiens
ccaaauaaguucaggguau

SEQ ID NO: 127466 - RNA, 19 nt, Homo sapiens
cagcauacauccucaacua

SEQ ID NO: 127467 - RNA, 19 nt, Homo sapiens
caccaugccuggcuaauuu

SEQ ID NO: 127468 - RNA, 19 nt, Homo sapiens
ccacuaugcuucguuuaua

SEQ ID NO: 127469 - RNA, 19 nt, Homo sapiens
gaagggaguugcauacgau

SEQ ID NO: 127470 - RNA, 19 nt, Homo sapiens
gcucauguaucuugaucua

SEQ ID NO: 127471 - RNA, 19 nt, Homo sapiens
agacuuagaccuccuauaa

SEQ ID NO: 127472 - RNA, 19 nt, Homo sapiens
gaagucaacucaaugaaaa

SEQ ID NO: 127473 - RNA, 19 nt, Homo sapiens
gaaaaguccuccauacauu

SEQ ID NO: 127474 - RNA, 19 nt, Homo sapiens
cagcauguuucuauaauug

SEQ ID NO: 127475 - RNA, 19 nt, Homo sapiens
ucuaaagccuugaauaaga

SEQ ID NO: 127476 - RNA, 19 nt, Homo sapiens
caucuaaagccuugaauaa

SEQ ID NO: 127477 - RNA, 19 nt, Homo sapiens
gagaaucugccuccuuuaa

SEQ ID NO: 127478 - RNA, 19 nt, Homo sapiens
ggacaucagguguguguuu

SEQ ID NO: 127479 - RNA, 19 nt, Homo sapiens
gaaaucagaagucaacuca

SEQ ID NO: 127480 - RNA, 19 nt, Homo sapiens
gaaguauggaccuguauuu

SEQ ID NO: 127481 - RNA, 19 nt, Homo sapiens
gcaaggaacgaauauaugu

SEQ ID NO: 127482 - RNA, 19 nt, Homo sapiens
gaucgcuacuuacaggaua

SEQ ID NO: 127483 - RNA, 19 nt, Homo sapiens
uagaacgccuggacuuuaa

SEQ ID NO: 127484 - RNA, 19 nt, Homo sapiens
guagaacgccuggacuuua

SEQ ID NO: 127485 - RNA, 19 nt, Homo sapiens
gaaguuccuuggugaaaca

SEQ ID NO: 127486 - RNA, 19 nt, Homo sapiens
ggaccuguauuuaguuuua

SEQ ID NO: 127487 - RNA, 19 nt, Homo sapiens
gaacucugguuuuaagaua

SEQ ID NO: 127488 - RNA, 19 nt, Homo sapiens
ggaagggaguugcauacga

SEQ ID NO: 127489 - RNA, 19 nt, Homo sapiens
ccagugagauacuuggaaa

SEQ ID NO: 127490 - RNA, 19 nt, Homo sapiens
guaauuggcagauucuaaa

SEQ ID NO: 127491 - RNA, 19 nt, Homo sapiens
gcacagcuguaugcagauu

SEQ ID NO: 127492 - RNA, 19 nt, Homo sapiens
caauuagggauguuuguua

SEQ ID NO: 127493 - RNA, 19 nt, Homo sapiens
gaccauauuugauaagagu

SEQ ID NO: 127494 - RNA, 19 nt, Homo sapiens
caaaggcauucgaagagaa

SEQ ID NO: 127495 - RNA, 19 nt, Homo sapiens
ccaggaccauauuugauaa

SEQ ID NO: 127496 - RNA, 19 nt, Homo sapiens
ucaucgcucuugccaaaua

SEQ ID NO: 127497 - RNA, 19 nt, Homo sapiens
ucucauugauggauacuuu

SEQ ID NO: 127498 - RNA, 19 nt, Homo sapiens
guauggaccuguauuuagu

SEQ ID NO: 127499 - RNA, 19 nt, Homo sapiens
acucagaaauggagauauu

SEQ ID NO: 127500 - RNA, 19 nt, Homo sapiens
ucaaagacuuaaagacuca

SEQ ID NO: 127501 - RNA, 19 nt, Homo sapiens
aaucagaagucaacucaau

SEQ ID NO: 127502 - RNA, 19 nt, Homo sapiens
ugagaaguauggaccugua

SEQ ID NO: 127503 - RNA, 19 nt, Homo sapiens
gaacaucuaaagccuugaa

SEQ ID NO: 127504 - RNA, 19 nt, Homo sapiens
guauucaaaucuuggacua

SEQ ID NO: 127505 - RNA, 19 nt, Homo sapiens
ccacaaaggcauucgaaga

SEQ ID NO: 127506 - RNA, 19 nt, Homo sapiens
gauggagucucgcucuguu

SEQ ID NO: 127507 - RNA, 19 nt, Homo sapiens
acucaucgcucuugccaaa

SEQ ID NO: 127508 - RNA, 19 nt, Homo sapiens
gaccacggcuucacagagu

SEQ ID NO: 127509 - RNA, 19 nt, Homo sapiens
guuguucccugcuuccuuu

SEQ ID NO: 127510 - RNA, 19 nt, Homo sapiens
gggaauaaucgaacaucua

SEQ ID NO: 127511 - RNA, 19 nt, Homo sapiens
gaaucugccuccuuuaacu

SEQ ID NO: 127512 - RNA, 19 nt, Homo sapiens
ucuacaaggucacauuuau

SEQ ID NO: 127513 - RNA, 19 nt, Homo sapiens
gauccaggaccauauuuga

SEQ ID NO: 127514 - RNA, 19 nt, Homo sapiens
cauacauccucaacuacua

SEQ ID NO: 127515 - RNA, 19 nt, Homo sapiens
cuggaagacucauguuaaa

SEQ ID NO: 127516 - RNA, 19 nt, Homo sapiens
gguccacuaugcuucguuu

SEQ ID NO: 127517 - RNA, 19 nt, Homo sapiens
agacucauguuaaacucua

SEQ ID NO: 127518 - RNA, 19 nt, Homo sapiens
gaagacucauguuaaacuc

SEQ ID NO: 127519 - RNA, 19 nt, Homo sapiens
ccaaagugcugggauuaca

SEQ ID NO: 127520 - RNA, 19 nt, Homo sapiens
aaagacugcucauguaucu

SEQ ID NO: 127521 - RNA, 19 nt, Homo sapiens
uaagagauccaggaccaua

SEQ ID NO: 127522 - RNA, 19 nt, Homo sapiens
gguaauuggcagauucuaa

SEQ ID NO: 127523 - RNA, 19 nt, Homo sapiens
cgaagagaaugaaguguac

SEQ ID NO: 127524 - RNA, 19 nt, Homo sapiens
ggaacgaauauaugugauu

SEQ ID NO: 127525 - RNA, 19 nt, Homo sapiens
cuucacagaguguuauuua

SEQ ID NO: 127526 - RNA, 19 nt, Homo sapiens
cagggaugcuuauuggauu

SEQ ID NO: 127527 - RNA, 19 nt, Homo sapiens
gaucagugaacucugguuu

SEQ ID NO: 127528 - RNA, 19 nt, Homo sapiens
uggcuaggcuggucuugaa

SEQ ID NO: 127529 - RNA, 19 nt, Homo sapiens
gauggaaggguagggaaua

SEQ ID NO: 127530 - RNA, 19 nt, Homo sapiens
acuuagaccuccuauaaug

SEQ ID NO: 127531 - RNA, 19 nt, Homo sapiens
ggaagacucauguuaaacu

SEQ ID NO: 127532 - RNA, 19 nt, Homo sapiens
gggccuaacuauaugagau

SEQ ID NO: 127533 - RNA, 19 nt, Homo sapiens
ucagugaacucugguuuua

SEQ ID NO: 127534 - RNA, 19 nt, Homo sapiens
gggaaaaguuugccuaugu

SEQ ID NO: 127535 - RNA, 19 nt, Homo sapiens
ggccagaacuccucagacu

SEQ ID NO: 127536 - RNA, 19 nt, Homo sapiens
ucuccaaacuuuacuagau

SEQ ID NO: 127537 - RNA, 19 nt, Homo sapiens
ggaaaggaaaucagaaguc

SEQ ID NO: 127538 - RNA, 19 nt, Homo sapiens
aggaauacuuugagaguug

SEQ ID NO: 127539 - RNA, 19 nt, Homo sapiens
caagacauuuacuuaccuu

SEQ ID NO: 127540 - RNA, 19 nt, Homo sapiens
ggauguuuguuacuacuca

SEQ ID NO: 127541 - RNA, 19 nt, Homo sapiens
uaauccugaucgcuacuua

SEQ ID NO: 127542 - RNA, 19 nt, Homo sapiens
uuagggauguuuguuacua

SEQ ID NO: 127543 - RNA, 19 nt, Homo sapiens
uaacugaaugguucuauca

SEQ ID NO: 127544 - RNA, 19 nt, Homo sapiens
uauaugagauggcugaaaa

SEQ ID NO: 127545 - RNA, 19 nt, Homo sapiens
agaacccaguuauccguua

SEQ ID NO: 127546 - RNA, 19 nt, Homo sapiens
gcagggaugcuuauuggau

SEQ ID NO: 127547 - RNA, 19 nt, Homo sapiens
uaggcaagacauuuacuua

SEQ ID NO: 127548 - RNA, 19 nt, Homo sapiens
uaugggaaauuaagagauc

SEQ ID NO: 127549 - RNA, 19 nt, Homo sapiens
gaaauggagauauuauagg

SEQ ID NO: 127550 - RNA, 19 nt, Homo sapiens
ggaaggguagggaauaauc

SEQ ID NO: 127551 - RNA, 19 nt, Homo sapiens
ugacauucuccaaacuuua

SEQ ID NO: 127552 - RNA, 19 nt, Homo sapiens
aauaccacaucgucuguuu

SEQ ID NO: 127553 - RNA, 19 nt, Homo sapiens
gaacccaguuauccguuac

SEQ ID NO: 127554 - RNA, 19 nt, Homo sapiens
gaauuugaucucauugaug

SEQ ID NO: 127555 - RNA, 19 nt, Homo sapiens
ccagaacuccucagacugu

SEQ ID NO: 127556 - RNA, 19 nt, Homo sapiens
ucagaagucaacucaauga

SEQ ID NO: 127557 - RNA, 19 nt, Homo sapiens
gacauuuacuuaccuucug

SEQ ID NO: 127558 - RNA, 19 nt, Homo sapiens
gcaagaagcuccugaugga

SEQ ID NO: 127559 - RNA, 19 nt, Homo sapiens
gcaaagagaagaauuagaa

SEQ ID NO: 127560 - RNA, 19 nt, Homo sapiens
gaaggaagguguuuaugau

SEQ ID NO: 127561 - RNA, 19 nt, Homo sapiens
ggagaagaguccucaauga

SEQ ID NO: 127562 - RNA, 19 nt, Homo sapiens
gaagcaaagagaagaauua

SEQ ID NO: 127563 - RNA, 19 nt, Homo sapiens
ggaagaggauguugaagau

SEQ ID NO: 127564 - RNA, 19 nt, Homo sapiens
caaaggacauuacagauca

SEQ ID NO: 127565 - RNA, 19 nt, Homo sapiens
caacagaccuaagaaauag

SEQ ID NO: 127566 - RNA, 19 nt, Homo sapiens
gcaaagaaacguuuaagga

SEQ ID NO: 127567 - RNA, 19 nt, Homo sapiens
gaaguggacuaaggauuaa

SEQ ID NO: 127568 - RNA, 19 nt, Homo sapiens
gaaagacuccagaaagaaa

SEQ ID NO: 127569 - RNA, 19 nt, Homo sapiens
caugaaauauccuacauug

SEQ ID NO: 127570 - RNA, 19 nt, Homo sapiens
uaaguaggaugucaacuga

SEQ ID NO: 127571 - RNA, 19 nt, Homo sapiens
gaaauauccuacauugcaa

SEQ ID NO: 127572 - RNA, 19 nt, Homo sapiens
cacaagaaauucaugauug

SEQ ID NO: 127573 - RNA, 19 nt, Homo sapiens
ugaaguggacuaaggauua

SEQ ID NO: 127574 - RNA, 19 nt, Homo sapiens
caauggaacucgcucagaa

SEQ ID NO: 127575 - RNA, 19 nt, Homo sapiens
gacaggcucucuuguauuc

SEQ ID NO: 127576 - RNA, 19 nt, Homo sapiens
guacaaagccaaauugauc

SEQ ID NO: 127577 - RNA, 19 nt, Homo sapiens
gcccaguggugauaauaua

SEQ ID NO: 127578 - RNA, 19 nt, Homo sapiens
aagaaagacuccagaaaga

SEQ ID NO: 127579 - RNA, 19 nt, Homo sapiens
gaagagggaacuaagcauu

SEQ ID NO: 127580 - RNA, 19 nt, Homo sapiens
ucaacagaccuaagaaaua

SEQ ID NO: 127581 - RNA, 19 nt, Homo sapiens
gugcagauguguuuaguuc

SEQ ID NO: 127582 - RNA, 19 nt, Homo sapiens
gaucgggauugaugaaguu

SEQ ID NO: 127583 - RNA, 19 nt, Homo sapiens
agacgacugugaugacuuu

SEQ ID NO: 127584 - RNA, 19 nt, Homo sapiens
cagaggccuucuccaguua

SEQ ID NO: 127585 - RNA, 19 nt, Homo sapiens
gcaaaggacauuacagauc

SEQ ID NO: 127586 - RNA, 19 nt, Homo sapiens
ucacaggccucauccaaca

SEQ ID NO: 127587 - RNA, 19 nt, Homo sapiens
ucagaggccuucuccaguu

SEQ ID NO: 127588 - RNA, 19 nt, Homo sapiens
caaagaaacguuuaaggau

SEQ ID NO: 127589 - RNA, 19 nt, Homo sapiens
cacaaacuguuaugccuuu

SEQ ID NO: 127590 - RNA, 19 nt, Homo sapiens
ccaaauugaucgggauuga

SEQ ID NO: 127591 - RNA, 19 nt, Homo sapiens
caagaaagacuccagaaag

SEQ ID NO: 127592 - RNA, 19 nt, Homo sapiens
gacuaaggauuaaguagga

SEQ ID NO: 127593 - RNA, 19 nt, Homo sapiens
agacagagcucuccaucca

SEQ ID NO: 127594 - RNA, 19 nt, Homo sapiens
caacagugauccauuuggu

SEQ ID NO: 127595 - RNA, 19 nt, Homo sapiens
acagagcucuccauccaaa

SEQ ID NO: 127596 - RNA, 19 nt, Homo sapiens
ggaagguguuuaugaugug

SEQ ID NO: 127597 - RNA, 19 nt, Homo sapiens
gaucaacagaccuaagaaa

SEQ ID NO: 127598 - RNA, 19 nt, Homo sapiens
gaaggaagggaaucacaga

SEQ ID NO: 127599 - RNA, 19 nt, Homo sapiens
ugaaauauccuacauugca

SEQ ID NO: 127600 - RNA, 19 nt, Homo sapiens
ccacaagaaauucaugauu

SEQ ID NO: 127601 - RNA, 19 nt, Homo sapiens
gaucacaggccucauccaa

SEQ ID NO: 127602 - RNA, 19 nt, Homo sapiens
gaaaugugcagcucagagu

SEQ ID NO: 127603 - RNA, 19 nt, Homo sapiens
caacugagacagaacuuca

SEQ ID NO: 127604 - RNA, 19 nt, Homo sapiens
ccagugauccuaccacaga

SEQ ID NO: 127605 - RNA, 19 nt, Homo sapiens
gauaagcagugugaacaag

SEQ ID NO: 127606 - RNA, 19 nt, Homo sapiens
gggaggagucuuucucuug

SEQ ID NO: 127607 - RNA, 19 nt, Homo sapiens
ccaagaaagacuccagaaa

SEQ ID NO: 127608 - RNA, 19 nt, Homo sapiens
guuuaaggauuuccagaug

SEQ ID NO: 127609 - RNA, 19 nt, Homo sapiens
agaaggaagguguuuauga

SEQ ID NO: 127610 - RNA, 19 nt, Homo sapiens
caaguuaugucaagauucc

SEQ ID NO: 127611 - RNA, 19 nt, Homo sapiens
gcgcagaucaacagaccua

SEQ ID NO: 127612 - RNA, 19 nt, Homo sapiens
ggcaaccaauggcagauau

SEQ ID NO: 127613 - RNA, 19 nt, Homo sapiens
ugucaagauuccaugauga

SEQ ID NO: 127614 - RNA, 19 nt, Homo sapiens
gcucagaagagggaacuaa

SEQ ID NO: 127615 - RNA, 19 nt, Homo sapiens
aaagaaggaagguguuuau

SEQ ID NO: 127616 - RNA, 19 nt, Homo sapiens
acagauuuguggccauaaa

SEQ ID NO: 127617 - RNA, 19 nt, Homo sapiens
gugaagccacuuugauaaa

SEQ ID NO: 127618 - RNA, 19 nt, Homo sapiens
ccuaagaaauagcaucgau

SEQ ID NO: 127619 - RNA, 19 nt, Homo sapiens
caaaggagaacacaaacag

SEQ ID NO: 127620 - RNA, 19 nt, Homo sapiens
gaaacucaagggcguuguu

SEQ ID NO: 127621 - RNA, 19 nt, Homo sapiens
cagaucaacagaccuaaga

SEQ ID NO: 127622 - RNA, 19 nt, Homo sapiens
aguaggaugucaacugaga

SEQ ID NO: 127623 - RNA, 19 nt, Homo sapiens
acgacaggcucucuuguau

SEQ ID NO: 127624 - RNA, 19 nt, Homo sapiens
acaggccgguagcuagaua

SEQ ID NO: 127625 - RNA, 19 nt, Homo sapiens
gaagggaggagucuuucuc

SEQ ID NO: 127626 - RNA, 19 nt, Homo sapiens
accaguacauuguguuuga

SEQ ID NO: 127627 - RNA, 19 nt, Homo sapiens
gaauugaagcaaagagaag

SEQ ID NO: 127628 - RNA, 19 nt, Homo sapiens
aagauccuguguaccagua

SEQ ID NO: 127629 - RNA, 19 nt, Homo sapiens
ggauaagcagugugaacaa

SEQ ID NO: 127630 - RNA, 19 nt, Homo sapiens
acaagaaauucaugauugc

SEQ ID NO: 127631 - RNA, 19 nt, Homo sapiens
aggaagguguuuaugaugu

SEQ ID NO: 127632 - RNA, 19 nt, Homo sapiens
cgacaggcucucuuguauu

SEQ ID NO: 127633 - RNA, 19 nt, Homo sapiens
ggagcccaguggugauaau

SEQ ID NO: 127634 - RNA, 19 nt, Homo sapiens
uuugacaucucccaguuga

SEQ ID NO: 127635 - RNA, 19 nt, Homo sapiens
aaagagguuuaaaggugaa

SEQ ID NO: 127636 - RNA, 19 nt, Homo sapiens
gaaaaccagcgccaagaaa

SEQ ID NO: 127637 - RNA, 19 nt, Homo sapiens
caggcucucuuguauucuu

SEQ ID NO: 127638 - RNA, 19 nt, Homo sapiens
gaggagucuuucucuugga

SEQ ID NO: 127639 - RNA, 19 nt, Homo sapiens
ugacaucucccaguugaau

SEQ ID NO: 127640 - RNA, 19 nt, Homo sapiens
uggaagaggauguugaaga

SEQ ID NO: 127641 - RNA, 19 nt, Homo sapiens
aagagggaacuaagcauuu

SEQ ID NO: 127642 - RNA, 19 nt, Homo sapiens
cacgacaggcucucuugua

SEQ ID NO: 127643 - RNA, 19 nt, Homo sapiens
ccacaggccgguagcuaga

SEQ ID NO: 127644 - RNA, 19 nt, Homo sapiens
gagcccaguggugauaaua

SEQ ID NO: 127645 - RNA, 19 nt, Homo sapiens
cgacaagcccaggcagaaa

SEQ ID NO: 127646 - RNA, 19 nt, Homo sapiens
aaggagaacacaaacagaa

SEQ ID NO: 127647 - RNA, 19 nt, Homo sapiens
aaauugaucgggauugaug

SEQ ID NO: 127648 - RNA, 19 nt, Homo sapiens
uuucggcacugcugcugua

SEQ ID NO: 127649 - RNA, 19 nt, Homo sapiens
agaaagacuccagaaagaa

SEQ ID NO: 127650 - RNA, 19 nt, Homo sapiens
ugaauugaagcaaagagaa

SEQ ID NO: 127651 - RNA, 19 nt, Homo sapiens
ggcugaaccuguuauucug

SEQ ID NO: 127652 - RNA, 19 nt, Homo sapiens
auccaacagugauccauuu

SEQ ID NO: 127653 - RNA, 19 nt, Homo sapiens
gaacacaaacagaaaaucu

SEQ ID NO: 127654 - RNA, 19 nt, Homo sapiens
guuuaguucuguaccuuuc

SEQ ID NO: 127655 - RNA, 19 nt, Homo sapiens
gagugcagauguguuuagu

SEQ ID NO: 127656 - RNA, 19 nt, Homo sapiens
guaccagacaauauuggaa

SEQ ID NO: 127657 - RNA, 19 nt, Homo sapiens
caagcuguguaccagacaa

SEQ ID NO: 127658 - RNA, 19 nt, Homo sapiens
gcaacaggcugaaccauua

SEQ ID NO: 127659 - RNA, 19 nt, Homo sapiens
gaaccagccuucacccuuu

SEQ ID NO: 127660 - RNA, 19 nt, Homo sapiens
gcaaagauauccuguuagu

SEQ ID NO: 127661 - RNA, 19 nt, Homo sapiens
cguauuaucuguugccuua

SEQ ID NO: 127662 - RNA, 19 nt, Homo sapiens
aagcaaagauauccuguua

SEQ ID NO: 127663 - RNA, 19 nt, Homo sapiens
ggaagaacauuauucaucu

SEQ ID NO: 127664 - RNA, 19 nt, Homo sapiens
gaucaaggaugugaaagaa

SEQ ID NO: 127665 - RNA, 19 nt, Homo sapiens
gcaaagcaguugagaaugg

SEQ ID NO: 127666 - RNA, 19 nt, Homo sapiens
gaacauccaguaaauaaga

SEQ ID NO: 127667 - RNA, 19 nt, Homo sapiens
cagagaauuuccuaaagua

SEQ ID NO: 127668 - RNA, 19 nt, Homo sapiens
ccaaggacaucuccaguga

SEQ ID NO: 127669 - RNA, 19 nt, Homo sapiens
gcaugaacauccaguaaau

SEQ ID NO: 127670 - RNA, 19 nt, Homo sapiens
ccuaaacucucuagcuuaa

SEQ ID NO: 127671 - RNA, 19 nt, Homo sapiens
caacuacaacuucuccuua

SEQ ID NO: 127672 - RNA, 19 nt, Homo sapiens
gguuaaagcuaaacugaau

SEQ ID NO: 127673 - RNA, 19 nt, Homo sapiens
caacagaaagcaaagauau

SEQ ID NO: 127674 - RNA, 19 nt, Homo sapiens
auaaagagaucaaggaugu

SEQ ID NO: 127675 - RNA, 19 nt, Homo sapiens
uagcuucucuucuuucuga

SEQ ID NO: 127676 - RNA, 19 nt, Homo sapiens
ucaaggaugugaaagaaau

SEQ ID NO: 127677 - RNA, 19 nt, Homo sapiens
gaccaucaguuacagagaa

SEQ ID NO: 127678 - RNA, 19 nt, Homo sapiens
caaaggaucugggucaaca

SEQ ID NO: 127679 - RNA, 19 nt, Homo sapiens
gaucuaaacucugaaaucg

SEQ ID NO: 127680 - RNA, 19 nt, Homo sapiens
ccacaucccuucauaucau

SEQ ID NO: 127681 - RNA, 19 nt, Homo sapiens
caaguuucccugccaguua

SEQ ID NO: 127682 - RNA, 19 nt, Homo sapiens
cuaaauaguccaacagaaa

SEQ ID NO: 127683 - RNA, 19 nt, Homo sapiens
caaccuguaucuucugaga

SEQ ID NO: 127684 - RNA, 19 nt, Homo sapiens
gaacggcuucucugucaaa

SEQ ID NO: 127685 - RNA, 19 nt, Homo sapiens
aaacugaaaucggguguug

SEQ ID NO: 127686 - RNA, 19 nt, Homo sapiens
gagcaugaacauccaguaa

SEQ ID NO: 127687 - RNA, 19 nt, Homo sapiens
uuuggaaucuaaccacuua

SEQ ID NO: 127688 - RNA, 19 nt, Homo sapiens
aagcuaaacugaaucuaug

SEQ ID NO: 127689 - RNA, 19 nt, Homo sapiens
ugagugccuuugccaguua

SEQ ID NO: 127690 - RNA, 19 nt, Homo sapiens
gaaaucgacaccaaucaga

SEQ ID NO: 127691 - RNA, 19 nt, Homo sapiens
ggacaacacaaacaaagga

SEQ ID NO: 127692 - RNA, 19 nt, Homo sapiens
ccaagacucuaugaugaaa

SEQ ID NO: 127693 - RNA, 19 nt, Homo sapiens
caaaggcgauggcguaaaa

SEQ ID NO: 127694 - RNA, 19 nt, Homo sapiens
gagguuauguuuauuugag

SEQ ID NO: 127695 - RNA, 19 nt, Homo sapiens
cagcaaagcaguugagaau

SEQ ID NO: 127696 - RNA, 19 nt, Homo sapiens
ugagaaaacugggguaaua

SEQ ID NO: 127697 - RNA, 19 nt, Homo sapiens
gaaacaagugcaaccaaug

SEQ ID NO: 127698 - RNA, 19 nt, Homo sapiens
caucuuuggucuucaauca

SEQ ID NO: 127699 - RNA, 19 nt, Homo sapiens
gggaagaacauuauucauc

SEQ ID NO: 127700 - RNA, 19 nt, Homo sapiens
gggagguuauguuuauuug

SEQ ID NO: 127701 - RNA, 19 nt, Homo sapiens
uaaacucucuagcuuaagu

SEQ ID NO: 127702 - RNA, 19 nt, Homo sapiens
uaccaaaucuacugacaau

SEQ ID NO: 127703 - RNA, 19 nt, Homo sapiens
caugaugacuuugaugcua

SEQ ID NO: 127704 - RNA, 19 nt, Homo sapiens
cuacuuuggucagcaauuu

SEQ ID NO: 127705 - RNA, 19 nt, Homo sapiens
ccuaaagguuauaguagaa

SEQ ID NO: 127706 - RNA, 19 nt, Homo sapiens
gaaaggcccugaaaagaca

SEQ ID NO: 127707 - RNA, 19 nt, Homo sapiens
gcugauagccagacacguu

SEQ ID NO: 127708 - RNA, 19 nt, Homo sapiens
caaaguaccaaaccaggaa

SEQ ID NO: 127709 - RNA, 19 nt, Homo sapiens
gaauggugauguugacuac

SEQ ID NO: 127710 - RNA, 19 nt, Homo sapiens
ggaucugggucaacauuuc

SEQ ID NO: 127711 - RNA, 19 nt, Homo sapiens
gagccaagacucuaugaug

SEQ ID NO: 127712 - RNA, 19 nt, Homo sapiens
ugccaugucuaacgaagua

SEQ ID NO: 127713 - RNA, 19 nt, Homo sapiens
gaaucuaaccacuuaagga

SEQ ID NO: 127714 - RNA, 19 nt, Homo sapiens
cugaaucuauggcuuuaaa

SEQ ID NO: 127715 - RNA, 19 nt, Homo sapiens
ugugggagguuauguuuau

SEQ ID NO: 127716 - RNA, 19 nt, Homo sapiens
acagagaauuuccuaaagu

SEQ ID NO: 127717 - RNA, 19 nt, Homo sapiens
aaacugaaucuauggcuuu

SEQ ID NO: 127718 - RNA, 19 nt, Homo sapiens
ccaguuauuucaacagcaa

SEQ ID NO: 127719 - RNA, 19 nt, Homo sapiens
ugaccaaacuaacaaacug

SEQ ID NO: 127720 - RNA, 19 nt, Homo sapiens
gcugaaccauuaguuguug

SEQ ID NO: 127721 - RNA, 19 nt, Homo sapiens
gagaaggccagcaucaguu

SEQ ID NO: 127722 - RNA, 19 nt, Homo sapiens
gaagaacauuauucaucuc

SEQ ID NO: 127723 - RNA, 19 nt, Homo sapiens
gagggaagaacauuauuca

SEQ ID NO: 127724 - RNA, 19 nt, Homo sapiens
acaccaaucagaauucuuu

SEQ ID NO: 127725 - RNA, 19 nt, Homo sapiens
gguaauagagcaugaacau

SEQ ID NO: 127726 - RNA, 19 nt, Homo sapiens
gccaccacaucccuucaua

SEQ ID NO: 127727 - RNA, 19 nt, Homo sapiens
agaaacaagugcaaccaau

SEQ ID NO: 127728 - RNA, 19 nt, Homo sapiens
ggaugugaaagaaauguuu

SEQ ID NO: 127729 - RNA, 19 nt, Homo sapiens
ggagugaggcccuaaggau

SEQ ID NO: 127730 - RNA, 19 nt, Homo sapiens
uaguggaucuaaacucuga

SEQ ID NO: 127731 - RNA, 19 nt, Homo sapiens
ggagaaggccagcaucagu

SEQ ID NO: 127732 - RNA, 19 nt, Homo sapiens
uuccagcuuugacguauua

SEQ ID NO: 127733 - RNA, 19 nt, Homo sapiens
gccaaugacuugcuugcau

SEQ ID NO: 127734 - RNA, 19 nt, Homo sapiens
agaaagagaauucgaguag

SEQ ID NO: 127735 - RNA, 19 nt, Homo sapiens
gauucuagaugaccaaacu

SEQ ID NO: 127736 - RNA, 19 nt, Homo sapiens
agccaagacucuaugauga

SEQ ID NO: 127737 - RNA, 19 nt, Homo sapiens
gcaaaugagggaagaacau

SEQ ID NO: 127738 - RNA, 19 nt, Homo sapiens
caaaucuacugacaaugca

SEQ ID NO: 127739 - RNA, 19 nt, Homo sapiens
aaagccagcucccagacaa

SEQ ID NO: 127740 - RNA, 19 nt, Homo sapiens
caaaagcacccucaaagaa

SEQ ID NO: 127741 - RNA, 19 nt, Homo sapiens
gauagcuucucuucuuucu

SEQ ID NO: 127742 - RNA, 19 nt, Homo sapiens
ccuggaaccuucuagaaca

SEQ ID NO: 127743 - RNA, 19 nt, Homo sapiens
guacaaguccagcuguuuc

SEQ ID NO: 127744 - RNA, 19 nt, Homo sapiens
gaaguagaaacaagugcaa

SEQ ID NO: 127745 - RNA, 19 nt, Homo sapiens
gauagaggaagccagcaaa

SEQ ID NO: 127746 - RNA, 19 nt, Homo sapiens
gaucagaagaaagagaauu

SEQ ID NO: 127747 - RNA, 19 nt, Homo sapiens
ggucaacauuucccuuucu

SEQ ID NO: 127748 - RNA, 19 nt, Homo sapiens
caucaguuacagagaauuu

SEQ ID NO: 127749 - RNA, 19 nt, Homo sapiens
gaaauccuuuugccuaaau

SEQ ID NO: 127750 - RNA, 19 nt, Homo sapiens
cagcaucuuuggucuucaa

SEQ ID NO: 127751 - RNA, 19 nt, Homo sapiens
ccaacagaaagcaaagaua

SEQ ID NO: 127752 - RNA, 19 nt, Homo sapiens
ccuaaauaguccaacagaa

SEQ ID NO: 127753 - RNA, 19 nt, Homo sapiens
gagugaggcccuaaggauu

SEQ ID NO: 127754 - RNA, 19 nt, Homo sapiens
ugaugaaacuaaagggaau

SEQ ID NO: 127755 - RNA, 19 nt, Homo sapiens
caacuucuccuuagacacu

SEQ ID NO: 127756 - RNA, 19 nt, Homo sapiens
cacaucccuucauaucaua

SEQ ID NO: 127757 - RNA, 19 nt, Homo sapiens
cuacugacaaugcauuuga

SEQ ID NO: 127758 - RNA, 19 nt, Homo sapiens
gcagauaacuggaaguaaa

SEQ ID NO: 127759 - RNA, 19 nt, Homo sapiens
gcuaucagcuguauguuaa

SEQ ID NO: 127760 - RNA, 19 nt, Homo sapiens
ugagaaugcuuuaguguuu

SEQ ID NO: 127761 - RNA, 19 nt, Homo sapiens
ggaauuacaccuuuaaaga

SEQ ID NO: 127762 - RNA, 19 nt, Homo sapiens
gcaggaagcacuugaguuu

SEQ ID NO: 127763 - RNA, 19 nt, Homo sapiens
aaacugagcugaagaugga

SEQ ID NO: 127764 - RNA, 19 nt, Homo sapiens
caaggaagguauuauguau

SEQ ID NO: 127765 - RNA, 19 nt, Homo sapiens
aaacagugcuuauuacaug

SEQ ID NO: 127766 - RNA, 19 nt, Homo sapiens
gaacagaacauacucaucu

SEQ ID NO: 127767 - RNA, 19 nt, Homo sapiens
aagcauaguucuuccauaa

SEQ ID NO: 127768 - RNA, 19 nt, Homo sapiens
gaaggguggcuauguguua

SEQ ID NO: 127769 - RNA, 19 nt, Homo sapiens
gaaccacguuuacuguuau

SEQ ID NO: 127770 - RNA, 19 nt, Homo sapiens
gaacuaagggaaacacuug

SEQ ID NO: 127771 - RNA, 19 nt, Homo sapiens
gaagaaauccauguuauag

SEQ ID NO: 127772 - RNA, 19 nt, Homo sapiens
gaauagagccauaguucaa

SEQ ID NO: 127773 - RNA, 19 nt, Homo sapiens
gaaaacaccccucagaaua

SEQ ID NO: 127774 - RNA, 19 nt, Homo sapiens
ggcauagagucaccuguua

SEQ ID NO: 127775 - RNA, 19 nt, Homo sapiens
gaaaggacaauacaagaug

SEQ ID NO: 127776 - RNA, 19 nt, Homo sapiens
gaaagagaacuaagggaaa

SEQ ID NO: 127777 - RNA, 19 nt, Homo sapiens
gauggaagacuguauuuga

SEQ ID NO: 127778 - RNA, 19 nt, Homo sapiens
ugccagagcucaagagaaa

SEQ ID NO: 127779 - RNA, 19 nt, Homo sapiens
gacaaacucucucuaacug

SEQ ID NO: 127780 - RNA, 19 nt, Homo sapiens
gaacauacucaucuucaug

SEQ ID NO: 127781 - RNA, 19 nt, Homo sapiens
gcaggcauguaaauauuug

SEQ ID NO: 127782 - RNA, 19 nt, Homo sapiens
gcauagaggauucuugaaa

SEQ ID NO: 127783 - RNA, 19 nt, Homo sapiens
ggacucgcauuucgacuug

SEQ ID NO: 127784 - RNA, 19 nt, Homo sapiens
caagagugauuuucuguua

SEQ ID NO: 127785 - RNA, 19 nt, Homo sapiens
gggaaacacuugagaagca

SEQ ID NO: 127786 - RNA, 19 nt, Homo sapiens
agaaccacguuuacuguua

SEQ ID NO: 127787 - RNA, 19 nt, Homo sapiens
cggcaaacagugcuuauua

SEQ ID NO: 127788 - RNA, 19 nt, Homo sapiens
gaccugagaauguuuguaa

SEQ ID NO: 127789 - RNA, 19 nt, Homo sapiens
ccagagaccugagaauguu

SEQ ID NO: 127790 - RNA, 19 nt, Homo sapiens
gaaaguugccauagauaau

SEQ ID NO: 127791 - RNA, 19 nt, Homo sapiens
ucucaugucuccugggaua

SEQ ID NO: 127792 - RNA, 19 nt, Homo sapiens
ugaaugagaucuuaagcau

SEQ ID NO: 127793 - RNA, 19 nt, Homo sapiens
caacaacccaaugaaauaa

SEQ ID NO: 127794 - RNA, 19 nt, Homo sapiens
ggaaugaacgaaugaacuu

SEQ ID NO: 127795 - RNA, 19 nt, Homo sapiens
agaauuauguccuccagaa

SEQ ID NO: 127796 - RNA, 19 nt, Homo sapiens
aauaagaccuagcuuuguu

SEQ ID NO: 127797 - RNA, 19 nt, Homo sapiens
gagccugguuucaauguga

SEQ ID NO: 127798 - RNA, 19 nt, Homo sapiens
gcaguuggcuauggaacaa

SEQ ID NO: 127799 - RNA, 19 nt, Homo sapiens
ucgagacucuucugacuaa

SEQ ID NO: 127800 - RNA, 19 nt, Homo sapiens
guacaaguaucaaaguucu

SEQ ID NO: 127801 - RNA, 19 nt, Homo sapiens
gaaacggcgugaacaagca

SEQ ID NO: 127802 - RNA, 19 nt, Homo sapiens
gcaaacucaucuccaggaa

SEQ ID NO: 127803 - RNA, 19 nt, Homo sapiens
uauagauacucuggcauua

SEQ ID NO: 127804 - RNA, 19 nt, Homo sapiens
acaacaacccaaugaaaua

SEQ ID NO: 127805 - RNA, 19 nt, Homo sapiens
ggagaggacucgcauuucg

SEQ ID NO: 127806 - RNA, 19 nt, Homo sapiens
uaugguagccuaguuauuu

SEQ ID NO: 127807 - RNA, 19 nt, Homo sapiens
ggagucacaguauuaauga

SEQ ID NO: 127808 - RNA, 19 nt, Homo sapiens
uaaaggcaggucugaauaa

SEQ ID NO: 127809 - RNA, 19 nt, Homo sapiens
gagaagaaggcaaagagaa

SEQ ID NO: 127810 - RNA, 19 nt, Homo sapiens
ucgagacccucuacaauga

SEQ ID NO: 127811 - RNA, 19 nt, Homo sapiens
gugaaccgcugcaaacuca

SEQ ID NO: 127812 - RNA, 19 nt, Homo sapiens
gcaauacuggaacauaauu

SEQ ID NO: 127813 - RNA, 19 nt, Homo sapiens
uaucuggaauuacaccuuu

SEQ ID NO: 127814 - RNA, 19 nt, Homo sapiens
gcugagugauaaaguuaaa

SEQ ID NO: 127815 - RNA, 19 nt, Homo sapiens
ugaauaagaccuagcuuug

SEQ ID NO: 127816 - RNA, 19 nt, Homo sapiens
ccaaacugguagugguaua

SEQ ID NO: 127817 - RNA, 19 nt, Homo sapiens
gggcauagaggauucuuga

SEQ ID NO: 127818 - RNA, 19 nt, Homo sapiens
aggaagcacuugaguuuga

SEQ ID NO: 127819 - RNA, 19 nt, Homo sapiens
guugaaaguugccauagau

SEQ ID NO: 127820 - RNA, 19 nt, Homo sapiens
gccuacaacuuacauaugu

SEQ ID NO: 127821 - RNA, 19 nt, Homo sapiens
gcgcugagugauaaaguua

SEQ ID NO: 127822 - RNA, 19 nt, Homo sapiens
gacaacaacccaaugaaau

SEQ ID NO: 127823 - RNA, 19 nt, Homo sapiens
ggacaauuguauacagagu

SEQ ID NO: 127824 - RNA, 19 nt, Homo sapiens
cagaacagaugcugaaagg

SEQ ID NO: 127825 - RNA, 19 nt, Homo sapiens
gagaaugcuuuaguguuug

SEQ ID NO: 127826 - RNA, 19 nt, Homo sapiens
gaaaguuacaguauguguu

SEQ ID NO: 127827 - RNA, 19 nt, Homo sapiens
ccuguuauguggauuaaau

SEQ ID NO: 127828 - RNA, 19 nt, Homo sapiens
ugacaacaacccaaugaaa

SEQ ID NO: 127829 - RNA, 19 nt, Homo sapiens
caucauaaugcaagaauug

SEQ ID NO: 127830 - RNA, 19 nt, Homo sapiens
uugcaauacuggaacauaa

SEQ ID NO: 127831 - RNA, 19 nt, Homo sapiens
gcauuacgcuucuauaccu

SEQ ID NO: 127832 - RNA, 19 nt, Homo sapiens
acccagacuuacagaauua

SEQ ID NO: 127833 - RNA, 19 nt, Homo sapiens
aaacuacugucauguacug

SEQ ID NO: 127834 - RNA, 19 nt, Homo sapiens
caagauggaagacuguauu

SEQ ID NO: 127835 - RNA, 19 nt, Homo sapiens
cagguugguuuggaaauuu

SEQ ID NO: 127836 - RNA, 19 nt, Homo sapiens
uugcauaucuggaauuaca

SEQ ID NO: 127837 - RNA, 19 nt, Homo sapiens
gcaaacagugcuuauuaca

SEQ ID NO: 127838 - RNA, 19 nt, Homo sapiens
gaauaagaccuagcuuugu

SEQ ID NO: 127839 - RNA, 19 nt, Homo sapiens
gagaagcaguuggcuaugg

SEQ ID NO: 127840 - RNA, 19 nt, Homo sapiens
ugaaaguugccauagauaa

SEQ ID NO: 127841 - RNA, 19 nt, Homo sapiens
gagacagccuugacaaacu

SEQ ID NO: 127842 - RNA, 19 nt, Homo sapiens
ggaaacccguguacucaac

SEQ ID NO: 127843 - RNA, 19 nt, Homo sapiens
guaguagaaucagccauug

SEQ ID NO: 127844 - RNA, 19 nt, Homo sapiens
guacggucacuauacauuu

SEQ ID NO: 127845 - RNA, 19 nt, Homo sapiens
gacaauacaagauggaaga

SEQ ID NO: 127846 - RNA, 19 nt, Homo sapiens
uaagcauaguucuuccaua

SEQ ID NO: 127847 - RNA, 19 nt, Homo sapiens
gaaaccagcaagaacacuu

SEQ ID NO: 127848 - RNA, 19 nt, Homo sapiens
guugaagaaauccauguua

SEQ ID NO: 127849 - RNA, 19 nt, Homo sapiens
ggaagacuguauuugaaaa

SEQ ID NO: 127850 - RNA, 19 nt, Homo sapiens
cacguuuacuguuauugua

SEQ ID NO: 127851 - RNA, 19 nt, Homo sapiens
uacaaagggagcauuauuu

SEQ ID NO: 127852 - RNA, 19 nt, Homo sapiens
agaagaaggcaaagagaaa

SEQ ID NO: 127853 - RNA, 19 nt, Homo sapiens
gaauuacaccuuuaaagac

SEQ ID NO: 127854 - RNA, 19 nt, Homo sapiens
gaaguaaagcggcaaacag

SEQ ID NO: 127855 - RNA, 19 nt, Homo sapiens
uuaagcaucuggugacauc

SEQ ID NO: 127856 - RNA, 19 nt, Homo sapiens
acaaggaagguauuaugua

SEQ ID NO: 127857 - RNA, 19 nt, Homo sapiens
gaacuuugcagucagacau

SEQ ID NO: 127858 - RNA, 19 nt, Homo sapiens
gcagauaacuggaaguaaa

SEQ ID NO: 127859 - RNA, 19 nt, Homo sapiens
gcuaucagcuguauguuaa

SEQ ID NO: 127860 - RNA, 19 nt, Homo sapiens
ugagaaugcuuuaguguuu

SEQ ID NO: 127861 - RNA, 19 nt, Homo sapiens
ggaauuacaccuuuaaaga

SEQ ID NO: 127862 - RNA, 19 nt, Homo sapiens
gcaggaagcacuugaguuu

SEQ ID NO: 127863 - RNA, 19 nt, Homo sapiens
aaacugagcugaagaugga

SEQ ID NO: 127864 - RNA, 19 nt, Homo sapiens
caaggaagguauuauguau

SEQ ID NO: 127865 - RNA, 19 nt, Homo sapiens
guugagacaucaguuauua

SEQ ID NO: 127866 - RNA, 19 nt, Homo sapiens
aaacagugcuuauuacaug

SEQ ID NO: 127867 - RNA, 19 nt, Homo sapiens
gaacagaacauacucaucu

SEQ ID NO: 127868 - RNA, 19 nt, Homo sapiens
aagcauaguucuuccauaa

SEQ ID NO: 127869 - RNA, 19 nt, Homo sapiens
gaaggguggcuauguguua

SEQ ID NO: 127870 - RNA, 19 nt, Homo sapiens
gaaccacguuuacuguuau

SEQ ID NO: 127871 - RNA, 19 nt, Homo sapiens
gaacuaagggaaacacuug

SEQ ID NO: 127872 - RNA, 19 nt, Homo sapiens
gcaacuaucaugccaguaa

SEQ ID NO: 127873 - RNA, 19 nt, Homo sapiens
gaagaaauccauguuauag

SEQ ID NO: 127874 - RNA, 19 nt, Homo sapiens
gaauagagccauaguucaa

SEQ ID NO: 127875 - RNA, 19 nt, Homo sapiens
gaaaacaccccucagaaua

SEQ ID NO: 127876 - RNA, 19 nt, Homo sapiens
ggacugagagcucuucuga

SEQ ID NO: 127877 - RNA, 19 nt, Homo sapiens
ggcauagagucaccuguua

SEQ ID NO: 127878 - RNA, 19 nt, Homo sapiens
gaaaggacaauacaagaug

SEQ ID NO: 127879 - RNA, 19 nt, Homo sapiens
gaaagagaacuaagggaaa

SEQ ID NO: 127880 - RNA, 19 nt, Homo sapiens
gauggaagacuguauuuga

SEQ ID NO: 127881 - RNA, 19 nt, Homo sapiens
ugccagagcucaagagaaa

SEQ ID NO: 127882 - RNA, 19 nt, Homo sapiens
gacaaacucucucuaacug

SEQ ID NO: 127883 - RNA, 19 nt, Homo sapiens
gaacauacucaucuucaug

SEQ ID NO: 127884 - RNA, 19 nt, Homo sapiens
gcaggcauguaaauauuug

SEQ ID NO: 127885 - RNA, 19 nt, Homo sapiens
gcauagaggauucuugaaa

SEQ ID NO: 127886 - RNA, 19 nt, Homo sapiens
ggacucgcauuucgacuug

SEQ ID NO: 127887 - RNA, 19 nt, Homo sapiens
caagagugauuuucuguua

SEQ ID NO: 127888 - RNA, 19 nt, Homo sapiens
gggaaacacuugagaagca

SEQ ID NO: 127889 - RNA, 19 nt, Homo sapiens
agaaccacguuuacuguua

SEQ ID NO: 127890 - RNA, 19 nt, Homo sapiens
cggcaaacagugcuuauua

SEQ ID NO: 127891 - RNA, 19 nt, Homo sapiens
gaccugagaauguuuguaa

SEQ ID NO: 127892 - RNA, 19 nt, Homo sapiens
ccagagaccugagaauguu

SEQ ID NO: 127893 - RNA, 19 nt, Homo sapiens
gaaaguugccauagauaau

SEQ ID NO: 127894 - RNA, 19 nt, Homo sapiens
agacaucaguuauuaagga

SEQ ID NO: 127895 - RNA, 19 nt, Homo sapiens
ucucaugucuccugggaua

SEQ ID NO: 127896 - RNA, 19 nt, Homo sapiens
ugaaugagaucuuaagcau

SEQ ID NO: 127897 - RNA, 19 nt, Homo sapiens
caacaacccaaugaaauaa

SEQ ID NO: 127898 - RNA, 19 nt, Homo sapiens
ggaaugaacgaaugaacuu

SEQ ID NO: 127899 - RNA, 19 nt, Homo sapiens
agaauuauguccuccagaa

SEQ ID NO: 127900 - RNA, 19 nt, Homo sapiens
aauaagaccuagcuuuguu

SEQ ID NO: 127901 - RNA, 19 nt, Homo sapiens
gagccugguuucaauguga

SEQ ID NO: 127902 - RNA, 19 nt, Homo sapiens
gcaguuggcuauggaacaa

SEQ ID NO: 127903 - RNA, 19 nt, Homo sapiens
ucgagacucuucugacuaa

SEQ ID NO: 127904 - RNA, 19 nt, Homo sapiens
gggcuuaucaccaaaugua

SEQ ID NO: 127905 - RNA, 19 nt, Homo sapiens
guacaaguaucaaaguucu

SEQ ID NO: 127906 - RNA, 19 nt, Homo sapiens
gaaacggcgugaacaagca

SEQ ID NO: 127907 - RNA, 19 nt, Homo sapiens
gcaaacucaucuccaggaa

SEQ ID NO: 127908 - RNA, 19 nt, Homo sapiens
uauagauacucuggcauua

SEQ ID NO: 127909 - RNA, 19 nt, Homo sapiens
acaacaacccaaugaaaua

SEQ ID NO: 127910 - RNA, 19 nt, Homo sapiens
ggagaggacucgcauuucg

SEQ ID NO: 127911 - RNA, 19 nt, Homo sapiens
gaacuuccuuuuaugauga

SEQ ID NO: 127912 - RNA, 19 nt, Homo sapiens
uaugguagccuaguuauuu

SEQ ID NO: 127913 - RNA, 19 nt, Homo sapiens
ggagucacaguauuaauga

SEQ ID NO: 127914 - RNA, 19 nt, Homo sapiens
uaaaggcaggucugaauaa

SEQ ID NO: 127915 - RNA, 19 nt, Homo sapiens
gagaagaaggcaaagagaa

SEQ ID NO: 127916 - RNA, 19 nt, Homo sapiens
ucgagacccucuacaauga

SEQ ID NO: 127917 - RNA, 19 nt, Homo sapiens
gugaaccgcugcaaacuca

SEQ ID NO: 127918 - RNA, 19 nt, Homo sapiens
gcaauacuggaacauaauu

SEQ ID NO: 127919 - RNA, 19 nt, Homo sapiens
uaucuggaauuacaccuuu

SEQ ID NO: 127920 - RNA, 19 nt, Homo sapiens
gcugagugauaaaguuaaa

SEQ ID NO: 127921 - RNA, 19 nt, Homo sapiens
ugaauaagaccuagcuuug

SEQ ID NO: 127922 - RNA, 19 nt, Homo sapiens
ccaaacugguagugguaua

SEQ ID NO: 127923 - RNA, 19 nt, Homo sapiens
gggcauagaggauucuuga

SEQ ID NO: 127924 - RNA, 19 nt, Homo sapiens
aggaagcacuugaguuuga

SEQ ID NO: 127925 - RNA, 19 nt, Homo sapiens
guugaaaguugccauagau

SEQ ID NO: 127926 - RNA, 19 nt, Homo sapiens
gccuacaacuuacauaugu

SEQ ID NO: 127927 - RNA, 19 nt, Homo sapiens
gcgcugagugauaaaguua

SEQ ID NO: 127928 - RNA, 19 nt, Homo sapiens
gacaacaacccaaugaaau

SEQ ID NO: 127929 - RNA, 19 nt, Homo sapiens
ggacaauuguauacagagu

SEQ ID NO: 127930 - RNA, 19 nt, Homo sapiens
cagaacagaugcugaaagg

SEQ ID NO: 127931 - RNA, 19 nt, Homo sapiens
gagaaugcuuuaguguuug

SEQ ID NO: 127932 - RNA, 19 nt, Homo sapiens
gaaaguuacaguauguguu

SEQ ID NO: 127933 - RNA, 19 nt, Homo sapiens
ccuguuauguggauuaaau

SEQ ID NO: 127934 - RNA, 19 nt, Homo sapiens
ugacaacaacccaaugaaa

SEQ ID NO: 127935 - RNA, 19 nt, Homo sapiens
caucauaaugcaagaauug

SEQ ID NO: 127936 - RNA, 19 nt, Homo sapiens
uugcaauacuggaacauaa

SEQ ID NO: 127937 - RNA, 19 nt, Homo sapiens
gcauuacgcuucuauaccu

SEQ ID NO: 127938 - RNA, 19 nt, Homo sapiens
acccagacuuacagaauua

SEQ ID NO: 127939 - RNA, 19 nt, Homo sapiens
aaacuacugucauguacug

SEQ ID NO: 127940 - RNA, 19 nt, Homo sapiens
caagauggaagacuguauu

SEQ ID NO: 127941 - RNA, 19 nt, Homo sapiens
cagguugguuuggaaauuu

SEQ ID NO: 127942 - RNA, 19 nt, Homo sapiens
uugcauaucuggaauuaca

SEQ ID NO: 127943 - RNA, 19 nt, Homo sapiens
gcaaacagugcuuauuaca

SEQ ID NO: 127944 - RNA, 19 nt, Homo sapiens
gaauaagaccuagcuuugu

SEQ ID NO: 127945 - RNA, 19 nt, Homo sapiens
gagaagcaguuggcuaugg

SEQ ID NO: 127946 - RNA, 19 nt, Homo sapiens
ugaaaguugccauagauaa

SEQ ID NO: 127947 - RNA, 19 nt, Homo sapiens
gagacagccuugacaaacu

SEQ ID NO: 127948 - RNA, 19 nt, Homo sapiens
ggaaacccguguacucaac

SEQ ID NO: 127949 - RNA, 19 nt, Homo sapiens
guaguagaaucagccauug

SEQ ID NO: 127950 - RNA, 19 nt, Homo sapiens
guacggucacuauacauuu

SEQ ID NO: 127951 - RNA, 19 nt, Homo sapiens
gacaauacaagauggaaga

SEQ ID NO: 127952 - RNA, 19 nt, Homo sapiens
gaaucccgguccaucagaa

SEQ ID NO: 127953 - RNA, 19 nt, Homo sapiens
ggagaaggccuggcaguca

SEQ ID NO: 127954 - RNA, 19 nt, Homo sapiens
uaagcauaguucuuccaua

SEQ ID NO: 127955 - RNA, 19 nt, Homo sapiens
gaaaccagcaagaacacuu

SEQ ID NO: 127956 - RNA, 19 nt, Homo sapiens
guugaagaaauccauguua

SEQ ID NO: 127957 - RNA, 19 nt, Homo sapiens
ggaagacuguauuugaaaa

SEQ ID NO: 127958 - RNA, 19 nt, Homo sapiens
gcagauaacuggaaguaaa

SEQ ID NO: 127959 - RNA, 19 nt, Homo sapiens
gcuaucagcuguauguuaa

SEQ ID NO: 127960 - RNA, 19 nt, Homo sapiens
ugagaaugcuuuaguguuu

SEQ ID NO: 127961 - RNA, 19 nt, Homo sapiens
ggaauuacaccuuuaaaga

SEQ ID NO: 127962 - RNA, 19 nt, Homo sapiens
gcaggaagcacuugaguuu

SEQ ID NO: 127963 - RNA, 19 nt, Homo sapiens
aaacugagcugaagaugga

SEQ ID NO: 127964 - RNA, 19 nt, Homo sapiens
caaggaagguauuauguau

SEQ ID NO: 127965 - RNA, 19 nt, Homo sapiens
aaacagugcuuauuacaug

SEQ ID NO: 127966 - RNA, 19 nt, Homo sapiens
gaacagaacauacucaucu

SEQ ID NO: 127967 - RNA, 19 nt, Homo sapiens
aagcauaguucuuccauaa

SEQ ID NO: 127968 - RNA, 19 nt, Homo sapiens
gaaggguggcuauguguua

SEQ ID NO: 127969 - RNA, 19 nt, Homo sapiens
gaaccacguuuacuguuau

SEQ ID NO: 127970 - RNA, 19 nt, Homo sapiens
gaacuaagggaaacacuug

SEQ ID NO: 127971 - RNA, 19 nt, Homo sapiens
gcaacuaucaugccaguaa

SEQ ID NO: 127972 - RNA, 19 nt, Homo sapiens
gaagaaauccauguuauag

SEQ ID NO: 127973 - RNA, 19 nt, Homo sapiens
gaauagagccauaguucaa

SEQ ID NO: 127974 - RNA, 19 nt, Homo sapiens
gaaaacaccccucagaaua

SEQ ID NO: 127975 - RNA, 19 nt, Homo sapiens
ggcauagagucaccuguua

SEQ ID NO: 127976 - RNA, 19 nt, Homo sapiens
gaaaggacaauacaagaug

SEQ ID NO: 127977 - RNA, 19 nt, Homo sapiens
gaaagagaacuaagggaaa

SEQ ID NO: 127978 - RNA, 19 nt, Homo sapiens
gauggaagacuguauuuga

SEQ ID NO: 127979 - RNA, 19 nt, Homo sapiens
ugccagagcucaagagaaa

SEQ ID NO: 127980 - RNA, 19 nt, Homo sapiens
gacaaacucucucuaacug

SEQ ID NO: 127981 - RNA, 19 nt, Homo sapiens
gaacauacucaucuucaug

SEQ ID NO: 127982 - RNA, 19 nt, Homo sapiens
gcaggcauguaaauauuug

SEQ ID NO: 127983 - RNA, 19 nt, Homo sapiens
gcauagaggauucuugaaa

SEQ ID NO: 127984 - RNA, 19 nt, Homo sapiens
ggacucgcauuucgacuug

SEQ ID NO: 127985 - RNA, 19 nt, Homo sapiens
caagagugauuuucuguua

SEQ ID NO: 127986 - RNA, 19 nt, Homo sapiens
gggaaacacuugagaagca

SEQ ID NO: 127987 - RNA, 19 nt, Homo sapiens
agaaccacguuuacuguua

SEQ ID NO: 127988 - RNA, 19 nt, Homo sapiens
cggcaaacagugcuuauua

SEQ ID NO: 127989 - RNA, 19 nt, Homo sapiens
gaccugagaauguuuguaa

SEQ ID NO: 127990 - RNA, 19 nt, Homo sapiens
ccagagaccugagaauguu

SEQ ID NO: 127991 - RNA, 19 nt, Homo sapiens
gaaaguugccauagauaau

SEQ ID NO: 127992 - RNA, 19 nt, Homo sapiens
ucucaugucuccugggaua

SEQ ID NO: 127993 - RNA, 19 nt, Homo sapiens
ugaaugagaucuuaagcau

SEQ ID NO: 127994 - RNA, 19 nt, Homo sapiens
caacaacccaaugaaauaa

SEQ ID NO: 127995 - RNA, 19 nt, Homo sapiens
ggaaugaacgaaugaacuu

SEQ ID NO: 127996 - RNA, 19 nt, Homo sapiens
agaauuauguccuccagaa

SEQ ID NO: 127997 - RNA, 19 nt, Homo sapiens
aauaagaccuagcuuuguu

SEQ ID NO: 127998 - RNA, 19 nt, Homo sapiens
gagccugguuucaauguga

SEQ ID NO: 127999 - RNA, 19 nt, Homo sapiens
gcaguuggcuauggaacaa

SEQ ID NO: 128000 - RNA, 19 nt, Homo sapiens
ucgagacucuucugacuaa

SEQ ID NO: 128001 - RNA, 19 nt, Homo sapiens
guacaaguaucaaaguucu

SEQ ID NO: 128002 - RNA, 19 nt, Homo sapiens
gaaacggcgugaacaagca

SEQ ID NO: 128003 - RNA, 19 nt, Homo sapiens
gcaaacucaucuccaggaa

SEQ ID NO: 128004 - RNA, 19 nt, Homo sapiens
uauagauacucuggcauua

SEQ ID NO: 128005 - RNA, 19 nt, Homo sapiens
acaacaacccaaugaaaua

SEQ ID NO: 128006 - RNA, 19 nt, Homo sapiens
ggagaggacucgcauuucg

SEQ ID NO: 128007 - RNA, 19 nt, Homo sapiens
uaugguagccuaguuauuu

SEQ ID NO: 128008 - RNA, 19 nt, Homo sapiens
ggagucacaguauuaauga

SEQ ID NO: 128009 - RNA, 19 nt, Homo sapiens
uaaaggcaggucugaauaa

SEQ ID NO: 128010 - RNA, 19 nt, Homo sapiens
gagaagaaggcaaagagaa

SEQ ID NO: 128011 - RNA, 19 nt, Homo sapiens
ucgagacccucuacaauga

SEQ ID NO: 128012 - RNA, 19 nt, Homo sapiens
gugaaccgcugcaaacuca

SEQ ID NO: 128013 - RNA, 19 nt, Homo sapiens
gcaauacuggaacauaauu

SEQ ID NO: 128014 - RNA, 19 nt, Homo sapiens
uaucuggaauuacaccuuu

SEQ ID NO: 128015 - RNA, 19 nt, Homo sapiens
gcugagugauaaaguuaaa

SEQ ID NO: 128016 - RNA, 19 nt, Homo sapiens
ugaauaagaccuagcuuug

SEQ ID NO: 128017 - RNA, 19 nt, Homo sapiens
ccaaacugguagugguaua

SEQ ID NO: 128018 - RNA, 19 nt, Homo sapiens
gggcauagaggauucuuga

SEQ ID NO: 128019 - RNA, 19 nt, Homo sapiens
aggaagcacuugaguuuga

SEQ ID NO: 128020 - RNA, 19 nt, Homo sapiens
guugaaaguugccauagau

SEQ ID NO: 128021 - RNA, 19 nt, Homo sapiens
gccuacaacuuacauaugu

SEQ ID NO: 128022 - RNA, 19 nt, Homo sapiens
gcgcugagugauaaaguua

SEQ ID NO: 128023 - RNA, 19 nt, Homo sapiens
gacaacaacccaaugaaau

SEQ ID NO: 128024 - RNA, 19 nt, Homo sapiens
ggacaauuguauacagagu

SEQ ID NO: 128025 - RNA, 19 nt, Homo sapiens
cagaacagaugcugaaagg

SEQ ID NO: 128026 - RNA, 19 nt, Homo sapiens
gagaaugcuuuaguguuug

SEQ ID NO: 128027 - RNA, 19 nt, Homo sapiens
gaaaguuacaguauguguu

SEQ ID NO: 128028 - RNA, 19 nt, Homo sapiens
ccuguuauguggauuaaau

SEQ ID NO: 128029 - RNA, 19 nt, Homo sapiens
ugacaacaacccaaugaaa

SEQ ID NO: 128030 - RNA, 19 nt, Homo sapiens
caucauaaugcaagaauug

SEQ ID NO: 128031 - RNA, 19 nt, Homo sapiens
uugcaauacuggaacauaa

SEQ ID NO: 128032 - RNA, 19 nt, Homo sapiens
gcauuacgcuucuauaccu

SEQ ID NO: 128033 - RNA, 19 nt, Homo sapiens
acccagacuuacagaauua

SEQ ID NO: 128034 - RNA, 19 nt, Homo sapiens
aaacuacugucauguacug

SEQ ID NO: 128035 - RNA, 19 nt, Homo sapiens
caagauggaagacuguauu

SEQ ID NO: 128036 - RNA, 19 nt, Homo sapiens
cagguugguuuggaaauuu

SEQ ID NO: 128037 - RNA, 19 nt, Homo sapiens
uugcauaucuggaauuaca

SEQ ID NO: 128038 - RNA, 19 nt, Homo sapiens
gcaaacagugcuuauuaca

SEQ ID NO: 128039 - RNA, 19 nt, Homo sapiens
gaauaagaccuagcuuugu

SEQ ID NO: 128040 - RNA, 19 nt, Homo sapiens
gagaagcaguuggcuaugg

SEQ ID NO: 128041 - RNA, 19 nt, Homo sapiens
ugaaaguugccauagauaa

SEQ ID NO: 128042 - RNA, 19 nt, Homo sapiens
gagacagccuugacaaacu

SEQ ID NO: 128043 - RNA, 19 nt, Homo sapiens
ggaaacccguguacucaac

SEQ ID NO: 128044 - RNA, 19 nt, Homo sapiens
guaguagaaucagccauug

SEQ ID NO: 128045 - RNA, 19 nt, Homo sapiens
guacggucacuauacauuu

SEQ ID NO: 128046 - RNA, 19 nt, Homo sapiens
gacaauacaagauggaaga

SEQ ID NO: 128047 - RNA, 19 nt, Homo sapiens
uaagcauaguucuuccaua

SEQ ID NO: 128048 - RNA, 19 nt, Homo sapiens
gaaaccagcaagaacacuu

SEQ ID NO: 128049 - RNA, 19 nt, Homo sapiens
guugaagaaauccauguua

SEQ ID NO: 128050 - RNA, 19 nt, Homo sapiens
ggaagacuguauuugaaaa

SEQ ID NO: 128051 - RNA, 19 nt, Homo sapiens
gaauucaagugucgaugag

SEQ ID NO: 128052 - RNA, 19 nt, Homo sapiens
caacuaucaugccaguaau

SEQ ID NO: 128053 - RNA, 19 nt, Homo sapiens
cacguuuacuguuauugua

SEQ ID NO: 128054 - RNA, 19 nt, Homo sapiens
uacaaagggagcauuauuu

SEQ ID NO: 128055 - RNA, 19 nt, Homo sapiens
agaagaaggcaaagagaaa

SEQ ID NO: 128056 - RNA, 19 nt, Homo sapiens
uagaagccaugagcaacua

SEQ ID NO: 128057 - RNA, 19 nt, Homo sapiens
gaauuacaccuuuaaagac

SEQ ID NO: 128058 - RNA, 19 nt, Homo sapiens
gaacaaagcggauuuccaa

SEQ ID NO: 128059 - RNA, 19 nt, Homo sapiens
gaacaacuuucuaacaaac

SEQ ID NO: 128060 - RNA, 19 nt, Homo sapiens
gauaagaguucuggagaug

SEQ ID NO: 128061 - RNA, 19 nt, Homo sapiens
gaacuuuguuggcugaauc

SEQ ID NO: 128062 - RNA, 19 nt, Homo sapiens
gagcgagccuuugcugauu

SEQ ID NO: 128063 - RNA, 19 nt, Homo sapiens
acgcguaccugcuguauau

SEQ ID NO: 128064 - RNA, 19 nt, Homo sapiens
ggauaagaguucuggagau

SEQ ID NO: 128065 - RNA, 19 nt, Homo sapiens
ggagauggcagcuuauugg

SEQ ID NO: 128066 - RNA, 19 nt, Homo sapiens
gaucaacccacagaacaaa

SEQ ID NO: 128067 - RNA, 19 nt, Homo sapiens
gguagugucugucauuucg

SEQ ID NO: 128068 - RNA, 19 nt, Homo sapiens
gauuugacacuuacugcua

SEQ ID NO: 128069 - RNA, 19 nt, Homo sapiens
ugaauuuccuggauaagag

SEQ ID NO: 128070 - RNA, 19 nt, Homo sapiens
gcaccauccugcaccuugu

SEQ ID NO: 128071 - RNA, 19 nt, Homo sapiens
cagccucugccuuucauua

SEQ ID NO: 128072 - RNA, 19 nt, Homo sapiens
ccucugccuuucauuaaau

SEQ ID NO: 128073 - RNA, 19 nt, Homo sapiens
uaauccagccucugccuuu

SEQ ID NO: 128074 - RNA, 19 nt, Homo sapiens
gacggguccuccaagaguu

SEQ ID NO: 128075 - RNA, 19 nt, Homo sapiens
gccucugccuuucauuaaa

SEQ ID NO: 128076 - RNA, 19 nt, Homo sapiens
ucuuugaauuuccuggaua

SEQ ID NO: 128077 - RNA, 19 nt, Homo sapiens
cuuugaauuuccuggauaa

SEQ ID NO: 128078 - RNA, 19 nt, Homo sapiens
ccacagaacaaagcggauu

SEQ ID NO: 128079 - RNA, 19 nt, Homo sapiens
gcagcuuauuggacacaug

SEQ ID NO: 128080 - RNA, 19 nt, Homo sapiens
gcaccuuguugucaugaac

SEQ ID NO: 128081 - RNA, 19 nt, Homo sapiens
gggcgcugcaguucgguua

SEQ ID NO: 128082 - RNA, 19 nt, Homo sapiens
cagaucaacccacagaaca

SEQ ID NO: 128083 - RNA, 19 nt, Homo sapiens
ggagaaaagcccagaguuc

SEQ ID NO: 128084 - RNA, 19 nt, Homo sapiens
uucuggagauggcagcuua

SEQ ID NO: 128085 - RNA, 19 nt, Homo sapiens
guaggagacuaaaagaaug

SEQ ID NO: 128086 - RNA, 19 nt, Homo sapiens
cgacggguccuccaagagu

SEQ ID NO: 128087 - RNA, 19 nt, Homo sapiens
gagaaaagcccagaguuca

SEQ ID NO: 128088 - RNA, 19 nt, Homo sapiens
uaccuugcgugcaguuaug

SEQ ID NO: 128089 - RNA, 19 nt, Homo sapiens
gagauggcagcuuauugga

SEQ ID NO: 128090 - RNA, 19 nt, Homo sapiens
ucuucagauuugacacuua

SEQ ID NO: 128091 - RNA, 19 nt, Homo sapiens
ucauuucgcgguucuuaga

SEQ ID NO: 128092 - RNA, 19 nt, Homo sapiens
auacagaucaacccacaga

SEQ ID NO: 128093 - RNA, 19 nt, Homo sapiens
gcgguuugccugagaauac

SEQ ID NO: 128094 - RNA, 19 nt, Homo sapiens
guaccuugcgugcaguuau

SEQ ID NO: 128095 - RNA, 19 nt, Homo sapiens
ucucgggcuucaucucuug

SEQ ID NO: 128096 - RNA, 19 nt, Homo sapiens
cggcgucgguagugucugu

SEQ ID NO: 128097 - RNA, 19 nt, Homo sapiens
ggacgcguaccugcuguau

SEQ ID NO: 128098 - RNA, 19 nt, Homo sapiens
cuucagauuugacacuuac

SEQ ID NO: 128099 - RNA, 19 nt, Homo sapiens
uuauuggacacauggauuu

SEQ ID NO: 128100 - RNA, 19 nt, Homo sapiens
ucgguagugucugucauuu

SEQ ID NO: 128101 - RNA, 19 nt, Homo sapiens
ugucauuucgcgguucuua

SEQ ID NO: 128102 - RNA, 19 nt, Homo sapiens
cacagaacaaagcggauuu

SEQ ID NO: 128103 - RNA, 19 nt, Homo sapiens
gucgacggguccuccaaga

SEQ ID NO: 128104 - RNA, 19 nt, Homo sapiens
ccuagcgguuugccugaga

SEQ ID NO: 128105 - RNA, 19 nt, Homo sapiens
uuacugcuagcucugcuuu

SEQ ID NO: 128106 - RNA, 19 nt, Homo sapiens
gaauuuccuggauaagagu

SEQ ID NO: 128107 - RNA, 19 nt, Homo sapiens
gacgcguaccugcuguaua

SEQ ID NO: 128108 - RNA, 19 nt, Homo sapiens
cuaaaagaauguucacucu

SEQ ID NO: 128109 - RNA, 19 nt, Homo sapiens
cacaagaucuguaauguua

SEQ ID NO: 128110 - RNA, 19 nt, Homo sapiens
uaacuugccuucagaauuu

SEQ ID NO: 128111 - RNA, 19 nt, Homo sapiens
gaagaguucugcaaucgua

SEQ ID NO: 128112 - RNA, 19 nt, Homo sapiens
caauugugcucuucauuua

SEQ ID NO: 128113 - RNA, 19 nt, Homo sapiens
uaacacaggguacaaauua

SEQ ID NO: 128114 - RNA, 19 nt, Homo sapiens
gcauagagauuuguucgua

SEQ ID NO: 128115 - RNA, 19 nt, Homo sapiens
gagaugaaccacauuauaa

SEQ ID NO: 128116 - RNA, 19 nt, Homo sapiens
gaagaaagcuuugugaaaa

SEQ ID NO: 128117 - RNA, 19 nt, Homo sapiens
ggaggaauauagaaugaaa

SEQ ID NO: 128118 - RNA, 19 nt, Homo sapiens
ggucagauauugaagaguu

SEQ ID NO: 128119 - RNA, 19 nt, Homo sapiens
ccaauucagucucuucuaa

SEQ ID NO: 128120 - RNA, 19 nt, Homo sapiens
ucagaaaccuaccacagua

SEQ ID NO: 128121 - RNA, 19 nt, Homo sapiens
uagaacaacuugcagaauu

SEQ ID NO: 128122 - RNA, 19 nt, Homo sapiens
gcaauugugcucuucauuu

SEQ ID NO: 128123 - RNA, 19 nt, Homo sapiens
guacuguuguggaauauga

SEQ ID NO: 128124 - RNA, 19 nt, Homo sapiens
aauaaaggauucaccauga

SEQ ID NO: 128125 - RNA, 19 nt, Homo sapiens
guacaaaugugaagaaagc

SEQ ID NO: 128126 - RNA, 19 nt, Homo sapiens
caaagaagaguuaagaaga

SEQ ID NO: 128127 - RNA, 19 nt, Homo sapiens
gaaauggucagauugaugu

SEQ ID NO: 128128 - RNA, 19 nt, Homo sapiens
uguaccagguggcauauua

SEQ ID NO: 128129 - RNA, 19 nt, Homo sapiens
gaaucgagauguccauagu

SEQ ID NO: 128130 - RNA, 19 nt, Homo sapiens
gaaaagagaaggaaaguga

SEQ ID NO: 128131 - RNA, 19 nt, Homo sapiens
guaauaacguacaaaugug

SEQ ID NO: 128132 - RNA, 19 nt, Homo sapiens
ccagagauacuacaauauu

SEQ ID NO: 128133 - RNA, 19 nt, Homo sapiens
gaaaaucucuaacuuccaa

SEQ ID NO: 128134 - RNA, 19 nt, Homo sapiens
agacuuaucugcauauugg

SEQ ID NO: 128135 - RNA, 19 nt, Homo sapiens
ggcagucaauggucagaua

SEQ ID NO: 128136 - RNA, 19 nt, Homo sapiens
gacugaaucuuccuuuguu

SEQ ID NO: 128137 - RNA, 19 nt, Homo sapiens
aaagagagaugaaccacau

SEQ ID NO: 128138 - RNA, 19 nt, Homo sapiens
gagagugauuccuuuccua

SEQ ID NO: 128139 - RNA, 19 nt, Homo sapiens
aaacuaacuugccuucaga

SEQ ID NO: 128140 - RNA, 19 nt, Homo sapiens
gaagaagauaugugaagaa

SEQ ID NO: 128141 - RNA, 19 nt, Homo sapiens
gauaagggaggaauauaga

SEQ ID NO: 128142 - RNA, 19 nt, Homo sapiens
guaagaaagcauagagauu

SEQ ID NO: 128143 - RNA, 19 nt, Homo sapiens
ugaagaaagcuuugugaaa

SEQ ID NO: 128144 - RNA, 19 nt, Homo sapiens
uaagauguguuaggaaugu

SEQ ID NO: 128145 - RNA, 19 nt, Homo sapiens
ugaagaagauaugugaaga

SEQ ID NO: 128146 - RNA, 19 nt, Homo sapiens
caagaaaaguugaagaaga

SEQ ID NO: 128147 - RNA, 19 nt, Homo sapiens
gagauuuguucguauuuag

SEQ ID NO: 128148 - RNA, 19 nt, Homo sapiens
ccaaauaaaggaaguggaa

SEQ ID NO: 128149 - RNA, 19 nt, Homo sapiens
gagaaggacucagugaucu

SEQ ID NO: 128150 - RNA, 19 nt, Homo sapiens
agaaugggaucacgaggaa

SEQ ID NO: 128151 - RNA, 19 nt, Homo sapiens
agaacaacuugcagaauug

SEQ ID NO: 128152 - RNA, 19 nt, Homo sapiens
cauuuaggaugcuuucauu

SEQ ID NO: 128153 - RNA, 19 nt, Homo sapiens
uaaaugcaauugugcucuu

SEQ ID NO: 128154 - RNA, 19 nt, Homo sapiens
gacuguuccuaguuucuua

SEQ ID NO: 128155 - RNA, 19 nt, Homo sapiens
caaacagccuuauaucacu

SEQ ID NO: 128156 - RNA, 19 nt, Homo sapiens
ucagugaucugccuuaagg

SEQ ID NO: 128157 - RNA, 19 nt, Homo sapiens
guccacagcagucgaauuu

SEQ ID NO: 128158 - RNA, 19 nt, Homo sapiens
acagugaacauucugauuu

SEQ ID NO: 128159 - RNA, 19 nt, Homo sapiens
caaaauugcuaaagagaga

SEQ ID NO: 128160 - RNA, 19 nt, Homo sapiens
gaaagcauagagauuuguu

SEQ ID NO: 128161 - RNA, 19 nt, Homo sapiens
gaacaacuugcagaauuga

SEQ ID NO: 128162 - RNA, 19 nt, Homo sapiens
ccaugggcuugcugacuua

SEQ ID NO: 128163 - RNA, 19 nt, Homo sapiens
agagaugaaccacauuaua

SEQ ID NO: 128164 - RNA, 19 nt, Homo sapiens
uuauuuggcucgacuucua

SEQ ID NO: 128165 - RNA, 19 nt, Homo sapiens
ccagguggcauauuauuug

SEQ ID NO: 128166 - RNA, 19 nt, Homo sapiens
caaaugugaagaaagcuuu

SEQ ID NO: 128167 - RNA, 19 nt, Homo sapiens
cgagauguccauagucaaa

SEQ ID NO: 128168 - RNA, 19 nt, Homo sapiens
ggaaccacuucagguacua

SEQ ID NO: 128169 - RNA, 19 nt, Homo sapiens
gcaaccaucuccuucucau

SEQ ID NO: 128170 - RNA, 19 nt, Homo sapiens
aauacgaaauggucagauu

SEQ ID NO: 128171 - RNA, 19 nt, Homo sapiens
auccagagauacuacaaua

SEQ ID NO: 128172 - RNA, 19 nt, Homo sapiens
ucccgaggauacuguaaua

SEQ ID NO: 128173 - RNA, 19 nt, Homo sapiens
gaaaauuccuggcgagaag

SEQ ID NO: 128174 - RNA, 19 nt, Homo sapiens
aagaaagcauagagauuug

SEQ ID NO: 128175 - RNA, 19 nt, Homo sapiens
guacugugaauaaugauga

SEQ ID NO: 128176 - RNA, 19 nt, Homo sapiens
agagagaugaaccacauua

SEQ ID NO: 128177 - RNA, 19 nt, Homo sapiens
uaucugggcacacguguuu

SEQ ID NO: 128178 - RNA, 19 nt, Homo sapiens
ccaccugaaugcagaggaa

SEQ ID NO: 128179 - RNA, 19 nt, Homo sapiens
uaaaggauucaccaugauu

SEQ ID NO: 128180 - RNA, 19 nt, Homo sapiens
ccagagugcagagaaauuu

SEQ ID NO: 128181 - RNA, 19 nt, Homo sapiens
guaaggcauuuucaucuuu

SEQ ID NO: 128182 - RNA, 19 nt, Homo sapiens
cauagagauuuguucguau

SEQ ID NO: 128183 - RNA, 19 nt, Homo sapiens
ugacuuagccaaagaagag

SEQ ID NO: 128184 - RNA, 19 nt, Homo sapiens
gaaacaaccccaaauaaag

SEQ ID NO: 128185 - RNA, 19 nt, Homo sapiens
gaaauacgaaauggucaga

SEQ ID NO: 128186 - RNA, 19 nt, Homo sapiens
ucgguacuguuguggaaua

SEQ ID NO: 128187 - RNA, 19 nt, Homo sapiens
gaaaauagaacaacuugca

SEQ ID NO: 128188 - RNA, 19 nt, Homo sapiens
ccaaagaagaguuaagaag

SEQ ID NO: 128189 - RNA, 19 nt, Homo sapiens
ccaggacaaccaagcauuu

SEQ ID NO: 128190 - RNA, 19 nt, Homo sapiens
caguaaauguuccaacuac

SEQ ID NO: 128191 - RNA, 19 nt, Homo sapiens
guaugcauguaauaaagga

SEQ ID NO: 128192 - RNA, 19 nt, Homo sapiens
aaagaaaucaugcccuaau

SEQ ID NO: 128193 - RNA, 19 nt, Homo sapiens
ccacaagaucuguaauguu

SEQ ID NO: 128194 - RNA, 19 nt, Homo sapiens
gcucaagcaacacggagua

SEQ ID NO: 128195 - RNA, 19 nt, Homo sapiens
guaacacaggguacaaauu

SEQ ID NO: 128196 - RNA, 19 nt, Homo sapiens
guccauagucaaauuugua

SEQ ID NO: 128197 - RNA, 19 nt, Homo sapiens
caaccaagcauuuucauga

SEQ ID NO: 128198 - RNA, 19 nt, Homo sapiens
ccacagcagucgaauuuug

SEQ ID NO: 128199 - RNA, 19 nt, Homo sapiens
aaagagaaggaaagugauu

SEQ ID NO: 128200 - RNA, 19 nt, Homo sapiens
gguaaaacaugcuggugaa

SEQ ID NO: 128201 - RNA, 19 nt, Homo sapiens
gagagaugaaccacauuau

SEQ ID NO: 128202 - RNA, 19 nt, Homo sapiens
gcacaccuacaccucuuga

SEQ ID NO: 128203 - RNA, 19 nt, Homo sapiens
acacggaguacaccuguuu

SEQ ID NO: 128204 - RNA, 19 nt, Homo sapiens
cagagugcagagaaauuua

SEQ ID NO: 128205 - RNA, 19 nt, Homo sapiens
cgaaauggucagauugaug

SEQ ID NO: 128206 - RNA, 19 nt, Homo sapiens
ugucuucuuugacuuaaug

SEQ ID NO: 128207 - RNA, 19 nt, Homo sapiens
gaugaaccacauuauaaag

SEQ ID NO: 128208 - RNA, 19 nt, Homo sapiens
uaaauguuccaacuacaga

SEQ ID NO: 128209 - RNA, 19 nt, Homo sapiens
gcucauugcuggcaucauu

SEQ ID NO: 128210 - RNA, 19 nt, Homo sapiens
gaaacuggccuucgccuuu

SEQ ID NO: 128211 - RNA, 19 nt, Homo sapiens
ugaaugacauccacaagaa

SEQ ID NO: 128212 - RNA, 19 nt, Homo sapiens
ggaaugccuuucgcaauaa

SEQ ID NO: 128213 - RNA, 19 nt, Homo sapiens
ucacuugcuuccuuacuua

SEQ ID NO: 128214 - RNA, 19 nt, Homo sapiens
gagccaaucucacauucaa

SEQ ID NO: 128215 - RNA, 19 nt, Homo sapiens
ggagauaucaucaagguau

SEQ ID NO: 128216 - RNA, 19 nt, Homo sapiens
aggaaugccuuucgcaaua

SEQ ID NO: 128217 - RNA, 19 nt, Homo sapiens
ccauggaacugacggcuuu

SEQ ID NO: 128218 - RNA, 19 nt, Homo sapiens
gcacugguguugaaugaca

SEQ ID NO: 128219 - RNA, 19 nt, Homo sapiens
gcagugaacagaauaacaa

SEQ ID NO: 128220 - RNA, 19 nt, Homo sapiens
caaagcagcuggagagacu

SEQ ID NO: 128221 - RNA, 19 nt, Homo sapiens
gaaggaggcuuugccaucu

SEQ ID NO: 128222 - RNA, 19 nt, Homo sapiens
gagcacaagugggaucuga

SEQ ID NO: 128223 - RNA, 19 nt, Homo sapiens
uggugaagaugcaauauuu

SEQ ID NO: 128224 - RNA, 19 nt, Homo sapiens
gcccagagcucaagaacca

SEQ ID NO: 128225 - RNA, 19 nt, Homo sapiens
cagcaacgccuucaacuga

SEQ ID NO: 128226 - RNA, 19 nt, Homo sapiens
gcacaucgccaauaagaag

SEQ ID NO: 128227 - RNA, 19 nt, Homo sapiens
cuugaugucugaagcguua

SEQ ID NO: 128228 - RNA, 19 nt, Homo sapiens
uaagccauaucgacuguuu

SEQ ID NO: 128229 - RNA, 19 nt, Homo sapiens
ggaaaacaguaacuaaaga

SEQ ID NO: 128230 - RNA, 19 nt, Homo sapiens
gaagagcagugaggaugau

SEQ ID NO: 128231 - RNA, 19 nt, Homo sapiens
cgucagacacuuucuauga

SEQ ID NO: 128232 - RNA, 19 nt, Homo sapiens
gaacagugugccugacauu

SEQ ID NO: 128233 - RNA, 19 nt, Homo sapiens
caacagcaacaaugccuuu

SEQ ID NO: 128234 - RNA, 19 nt, Homo sapiens
ccuagcaacuccaccauug

SEQ ID NO: 128235 - RNA, 19 nt, Homo sapiens
ccagcaauaguucauaaua

SEQ ID NO: 128236 - RNA, 19 nt, Homo sapiens
gaagauugccuugguaaag

SEQ ID NO: 128237 - RNA, 19 nt, Homo sapiens
ggaugaaccugugacuguu

SEQ ID NO: 128238 - RNA, 19 nt, Homo sapiens
cuggugagauuauuucuga

SEQ ID NO: 128239 - RNA, 19 nt, Homo sapiens
cagauucgcccaacgauga

SEQ ID NO: 128240 - RNA, 19 nt, Homo sapiens
ugaaaggccuuccaaacag

SEQ ID NO: 128241 - RNA, 19 nt, Homo sapiens
cugcaucucugucccauga

SEQ ID NO: 128242 - RNA, 19 nt, Homo sapiens
uguacgagcucuuaagugu

SEQ ID NO: 128243 - RNA, 19 nt, Homo sapiens
ucaaaggucuccaccacau

SEQ ID NO: 128244 - RNA, 19 nt, Homo sapiens
gcagugaggaugaugucua

SEQ ID NO: 128245 - RNA, 19 nt, Homo sapiens
gcaacagccagcucaugua

SEQ ID NO: 128246 - RNA, 19 nt, Homo sapiens
uacgagcucuuaaguguug

SEQ ID NO: 128247 - RNA, 19 nt, Homo sapiens
uuaaucugcuguuuaccua

SEQ ID NO: 128248 - RNA, 19 nt, Homo sapiens
ccacaaccaccaccaagaa

SEQ ID NO: 128249 - RNA, 19 nt, Homo sapiens
uauacagccucaaauuguu

SEQ ID NO: 128250 - RNA, 19 nt, Homo sapiens
ccaucacccugcagaauau

SEQ ID NO: 128251 - RNA, 19 nt, Homo sapiens
caacagccagcucauguau

SEQ ID NO: 128252 - RNA, 19 nt, Homo sapiens
gaccauuccuggcuaugug

SEQ ID NO: 128253 - RNA, 19 nt, Homo sapiens
aaguagagcuucacaacau

SEQ ID NO: 128254 - RNA, 19 nt, Homo sapiens
gugagauuauuucugauga

SEQ ID NO: 128255 - RNA, 19 nt, Homo sapiens
gggaggagugccagcaaua

SEQ ID NO: 128256 - RNA, 19 nt, Homo sapiens
gagaacucuucgcuucauu

SEQ ID NO: 128257 - RNA, 19 nt, Homo sapiens
ccaagaacaugaccccaua

SEQ ID NO: 128258 - RNA, 19 nt, Homo sapiens
ccacgaguauccacaccaa

SEQ ID NO: 128259 - RNA, 19 nt, Homo sapiens
gaagcuggcaccacaguuc

SEQ ID NO: 128260 - RNA, 19 nt, Homo sapiens
uaacagacuauuugacaug

SEQ ID NO: 128261 - RNA, 19 nt, Homo sapiens
cugauaagggugugcauua

SEQ ID NO: 128262 - RNA, 19 nt, Homo sapiens
gaauaacaacagcaacaau

SEQ ID NO: 128263 - RNA, 19 nt, Homo sapiens
gagcaugacuuuucuugau

SEQ ID NO: 128264 - RNA, 19 nt, Homo sapiens
gaagaccaagggacaguau

SEQ ID NO: 128265 - RNA, 19 nt, Homo sapiens
gaggaaccaugaaugaacu

SEQ ID NO: 128266 - RNA, 19 nt, Homo sapiens
uaucaucuuugcagacgaa

SEQ ID NO: 128267 - RNA, 19 nt, Homo sapiens
ggaauggaccaacaacaca

SEQ ID NO: 128268 - RNA, 19 nt, Homo sapiens
aaacuggccuucgccuuug

SEQ ID NO: 128269 - RNA, 19 nt, Homo sapiens
guggagauaucaucaaggu

SEQ ID NO: 128270 - RNA, 19 nt, Homo sapiens
gaaaccauuuugagcauga

SEQ ID NO: 128271 - RNA, 19 nt, Homo sapiens
gggaauugcuuugcuaaaa

SEQ ID NO: 128272 - RNA, 19 nt, Homo sapiens
cggcacugguguugaauga

SEQ ID NO: 128273 - RNA, 19 nt, Homo sapiens
gagugaccauuccaacaga

SEQ ID NO: 128274 - RNA, 19 nt, Homo sapiens
gcacacagagcagcuacuu

SEQ ID NO: 128275 - RNA, 19 nt, Homo sapiens
gaaugccuuucgcaauaau

SEQ ID NO: 128276 - RNA, 19 nt, Homo sapiens
aagauugccuugguaaaga

SEQ ID NO: 128277 - RNA, 19 nt, Homo sapiens
cccuagagccugacuuuaa

SEQ ID NO: 128278 - RNA, 19 nt, Homo sapiens
caaacacgaguauuucaug

SEQ ID NO: 128279 - RNA, 19 nt, Homo sapiens
gguggugaauaacagacua

SEQ ID NO: 128280 - RNA, 19 nt, Homo sapiens
acagagcagcuacuucuaa

SEQ ID NO: 128281 - RNA, 19 nt, Homo sapiens
ccuaaugguuuaaauucug

SEQ ID NO: 128282 - RNA, 19 nt, Homo sapiens
gaugcucuuuccucacuug

SEQ ID NO: 128283 - RNA, 19 nt, Homo sapiens
gagaaguccuggguacagu

SEQ ID NO: 128284 - RNA, 19 nt, Homo sapiens
gaagaucccgucagacacu

SEQ ID NO: 128285 - RNA, 19 nt, Homo sapiens
gugaagaucccgucagaca

SEQ ID NO: 128286 - RNA, 19 nt, Homo sapiens
gcugcucccugaaccagaa

SEQ ID NO: 128287 - RNA, 19 nt, Homo sapiens
gaugaaccugugacuguuu

SEQ ID NO: 128288 - RNA, 19 nt, Homo sapiens
accaaccacugauguguuu

SEQ ID NO: 128289 - RNA, 19 nt, Homo sapiens
gaggaaugccuuucgcaau

SEQ ID NO: 128290 - RNA, 19 nt, Homo sapiens
gcucuuaaguguugauucc

SEQ ID NO: 128291 - RNA, 19 nt, Homo sapiens
ggucaccuccucccuaugu

SEQ ID NO: 128292 - RNA, 19 nt, Homo sapiens
ccaggagagugcccucaga

SEQ ID NO: 128293 - RNA, 19 nt, Homo sapiens
ugucggcaccuacaguuua

SEQ ID NO: 128294 - RNA, 19 nt, Homo sapiens
ccagagcucaagaaccaua

SEQ ID NO: 128295 - RNA, 19 nt, Homo sapiens
uagugccgguggugaauaa

SEQ ID NO: 128296 - RNA, 19 nt, Homo sapiens
cagagcagcuacuucuaag

SEQ ID NO: 128297 - RNA, 19 nt, Homo sapiens
ugccagcaauaguucauaa

SEQ ID NO: 128298 - RNA, 19 nt, Homo sapiens
ccuaacagcuuuugguuug

SEQ ID NO: 128299 - RNA, 19 nt, Homo sapiens
gcaaacacgaguauuucau

SEQ ID NO: 128300 - RNA, 19 nt, Homo sapiens
acagccagcucauguaugg

SEQ ID NO: 128301 - RNA, 19 nt, Homo sapiens
gagcucaagaaccauauug

SEQ ID NO: 128302 - RNA, 19 nt, Homo sapiens
gaugaccauuccuggcuau

SEQ ID NO: 128303 - RNA, 19 nt, Homo sapiens
aaaggaauaucacgguuuu

SEQ ID NO: 128304 - RNA, 19 nt, Homo sapiens
gugucuagcugcaggaugu

SEQ ID NO: 128305 - RNA, 19 nt, Homo sapiens
ccaccgcccuucacaguac

SEQ ID NO: 128306 - RNA, 19 nt, Homo sapiens
ccuagagccugacuuuaag

SEQ ID NO: 128307 - RNA, 19 nt, Homo sapiens
cacaguuccuggccagauu

SEQ ID NO: 128308 - RNA, 19 nt, Homo sapiens
ugacauucaugguguagag

SEQ ID NO: 128309 - RNA, 19 nt, Homo sapiens
ugaaagagauugacuauga

SEQ ID NO: 128310 - RNA, 19 nt, Homo sapiens
gaaagugccucaucugaau

SEQ ID NO: 128311 - RNA, 19 nt, Homo sapiens
gaccauggaugauuuaaau

SEQ ID NO: 128312 - RNA, 19 nt, Homo sapiens
ugaaagcccugccuuguga

SEQ ID NO: 128313 - RNA, 19 nt, Homo sapiens
gcuguaaccucuguaagua

SEQ ID NO: 128314 - RNA, 19 nt, Homo sapiens
gaagacaaguuagaauuca

SEQ ID NO: 128315 - RNA, 19 nt, Homo sapiens
gggaggagguuaugaagga

SEQ ID NO: 128316 - RNA, 19 nt, Homo sapiens
gcucaucgauuccacauca

SEQ ID NO: 128317 - RNA, 19 nt, Homo sapiens
ucaaugauguuuccugcua

SEQ ID NO: 128318 - RNA, 19 nt, Homo sapiens
gaaagagauugacuaugau

SEQ ID NO: 128319 - RNA, 19 nt, Homo sapiens
guacauugcugccacauac

SEQ ID NO: 128320 - RNA, 19 nt, Homo sapiens
agaaauauccggagaaguu

SEQ ID NO: 128321 - RNA, 19 nt, Homo sapiens
ugagauagggcuccgauua

SEQ ID NO: 128322 - RNA, 19 nt, Homo sapiens
ggugauaccucaacaaacu

SEQ ID NO: 128323 - RNA, 19 nt, Homo sapiens
ugaguaaagugguacauau

SEQ ID NO: 128324 - RNA, 19 nt, Homo sapiens
ggauugacccuguuccuaa

SEQ ID NO: 128325 - RNA, 19 nt, Homo sapiens
ggucacugcuuaaaugaga

SEQ ID NO: 128326 - RNA, 19 nt, Homo sapiens
gaaaaucuaucucgaagug

SEQ ID NO: 128327 - RNA, 19 nt, Homo sapiens
gaagaccauggaugauuua

SEQ ID NO: 128328 - RNA, 19 nt, Homo sapiens
agaagaccauggaugauuu

SEQ ID NO: 128329 - RNA, 19 nt, Homo sapiens
ggaggagucuuugacaguu

SEQ ID NO: 128330 - RNA, 19 nt, Homo sapiens
gcuaugguacuucgaauuu

SEQ ID NO: 128331 - RNA, 19 nt, Homo sapiens
cuacgaagcugccuuucug

SEQ ID NO: 128332 - RNA, 19 nt, Homo sapiens
ccucaaggauuuagagaug

SEQ ID NO: 128333 - RNA, 19 nt, Homo sapiens
gaauccaucuucucaacau

SEQ ID NO: 128334 - RNA, 19 nt, Homo sapiens
guaaagugguacauaugga

SEQ ID NO: 128335 - RNA, 19 nt, Homo sapiens
gaugaaagagauugacuau

SEQ ID NO: 128336 - RNA, 19 nt, Homo sapiens
gagcugaggccgauucuuc

SEQ ID NO: 128337 - RNA, 19 nt, Homo sapiens
cgagauggcuaaauauguc

SEQ ID NO: 128338 - RNA, 19 nt, Homo sapiens
ugagacuggucacugcuua

SEQ ID NO: 128339 - RNA, 19 nt, Homo sapiens
ggucagugauguccuaaag

SEQ ID NO: 128340 - RNA, 19 nt, Homo sapiens
gagauagggcuccgauuau

SEQ ID NO: 128341 - RNA, 19 nt, Homo sapiens
gauguggugugucucaaug

SEQ ID NO: 128342 - RNA, 19 nt, Homo sapiens
ugacuuguguuucccuuug

SEQ ID NO: 128343 - RNA, 19 nt, Homo sapiens
caaucaagaucacccacaa

SEQ ID NO: 128344 - RNA, 19 nt, Homo sapiens
acaguaggcuggauucuag

SEQ ID NO: 128345 - RNA, 19 nt, Homo sapiens
gaaugaagaacaagcuaug

SEQ ID NO: 128346 - RNA, 19 nt, Homo sapiens
cagaagacaaguuagaauu

SEQ ID NO: 128347 - RNA, 19 nt, Homo sapiens
caauuucuuuggcuucuug

SEQ ID NO: 128348 - RNA, 19 nt, Homo sapiens
caauugagaugggccaaau

SEQ ID NO: 128349 - RNA, 19 nt, Homo sapiens
aaaggucagugauguccua

SEQ ID NO: 128350 - RNA, 19 nt, Homo sapiens
agagaugaguaaaguggua

SEQ ID NO: 128351 - RNA, 19 nt, Homo sapiens
ugaccgggcugcauugugu

SEQ ID NO: 128352 - RNA, 19 nt, Homo sapiens
cgaccagugugccaugaaa

SEQ ID NO: 128353 - RNA, 19 nt, Homo sapiens
ccaagcaacggaaguacua

SEQ ID NO: 128354 - RNA, 19 nt, Homo sapiens
cagacgcccuguacaauca

SEQ ID NO: 128355 - RNA, 19 nt, Homo sapiens
ugaagaacaagcuauggua

SEQ ID NO: 128356 - RNA, 19 nt, Homo sapiens
gccagaagaccauggauga

SEQ ID NO: 128357 - RNA, 19 nt, Homo sapiens
gcauuggucuuggcaaaca

SEQ ID NO: 128358 - RNA, 19 nt, Homo sapiens
gcucugagaucaccuucca

SEQ ID NO: 128359 - RNA, 19 nt, Homo sapiens
agaccuaagugacaagaga

SEQ ID NO: 128360 - RNA, 19 nt, Homo sapiens
gaggagucuuugacaguug

SEQ ID NO: 128361 - RNA, 19 nt, Homo sapiens
agauagggcuccgauuauu

SEQ ID NO: 128362 - RNA, 19 nt, Homo sapiens
ccacccacuucucgucuuu

SEQ ID NO: 128363 - RNA, 19 nt, Homo sapiens
agacaaaugugacaaaaga

SEQ ID NO: 128364 - RNA, 19 nt, Homo sapiens
ggcuaaauauguccaagga

SEQ ID NO: 128365 - RNA, 19 nt, Homo sapiens
aaacaucccuagcaugcau

SEQ ID NO: 128366 - RNA, 19 nt, Homo sapiens
gaaggcaucgcagugcuaa

SEQ ID NO: 128367 - RNA, 19 nt, Homo sapiens
gaauuugccacaucugaau

SEQ ID NO: 128368 - RNA, 19 nt, Homo sapiens
gcucagaaguggacaaaau

SEQ ID NO: 128369 - RNA, 19 nt, Homo sapiens
auaccaagcucaagaaugc

SEQ ID NO: 128370 - RNA, 19 nt, Homo sapiens
gaaguucaacagcagaaug

SEQ ID NO: 128371 - RNA, 19 nt, Homo sapiens
agaacaagcuaugguacuu

SEQ ID NO: 128372 - RNA, 19 nt, Homo sapiens
aagcaggccuacccucuga

SEQ ID NO: 128373 - RNA, 19 nt, Homo sapiens
ugaaagugccucaucugaa

SEQ ID NO: 128374 - RNA, 19 nt, Homo sapiens
ugagcaaccugucccuaga

SEQ ID NO: 128375 - RNA, 19 nt, Homo sapiens
caaaagauguggugugucu

SEQ ID NO: 128376 - RNA, 19 nt, Homo sapiens
caugcaaauugacguagaa

SEQ ID NO: 128377 - RNA, 19 nt, Homo sapiens
auagacagauggccaagga

SEQ ID NO: 128378 - RNA, 19 nt, Homo sapiens
cagaagaccauggaugauu

SEQ ID NO: 128379 - RNA, 19 nt, Homo sapiens
aagcauuggucuuggcaaa

SEQ ID NO: 128380 - RNA, 19 nt, Homo sapiens
gccaagugcucugagauca

SEQ ID NO: 128381 - RNA, 19 nt, Homo sapiens
auggcgagauggcuaaaua

SEQ ID NO: 128382 - RNA, 19 nt, Homo sapiens
uaaauuugagcaccucuga

SEQ ID NO: 128383 - RNA, 19 nt, Homo sapiens
gaucacauccugccuccau

SEQ ID NO: 128384 - RNA, 19 nt, Homo sapiens
gcagacgcccuguacaauc

SEQ ID NO: 128385 - RNA, 19 nt, Homo sapiens
gaaauauccggagaaguuc

SEQ ID NO: 128386 - RNA, 19 nt, Homo sapiens
guacgacacggacagaaau

SEQ ID NO: 128387 - RNA, 19 nt, Homo sapiens
caagaucacccacaagaac

SEQ ID NO: 128388 - RNA, 19 nt, Homo sapiens
gaacaagcuaugguacuuc

SEQ ID NO: 128389 - RNA, 19 nt, Homo sapiens
gaguaaagugguacauaug

SEQ ID NO: 128390 - RNA, 19 nt, Homo sapiens
gauagggcuccgauuauuc

SEQ ID NO: 128391 - RNA, 19 nt, Homo sapiens
ccacuucucgucuuuguca

SEQ ID NO: 128392 - RNA, 19 nt, Homo sapiens
caagagacuggaagugguu

SEQ ID NO: 128393 - RNA, 19 nt, Homo sapiens
gagaugccauuggguacga

SEQ ID NO: 128394 - RNA, 19 nt, Homo sapiens
gagagaaauauccggagaa

SEQ ID NO: 128395 - RNA, 19 nt, Homo sapiens
gaucuggcucgaugccuaa

SEQ ID NO: 128396 - RNA, 19 nt, Homo sapiens
ugaugcgaguggcugaaua

SEQ ID NO: 128397 - RNA, 19 nt, Homo sapiens
gagcaaccugucccuagaa

SEQ ID NO: 128398 - RNA, 19 nt, Homo sapiens
ggagaugaugaaagagauu

SEQ ID NO: 128399 - RNA, 19 nt, Homo sapiens
gcgagauggcuaaauaugu

SEQ ID NO: 128400 - RNA, 19 nt, Homo sapiens
gcuuaaaugagacaaaugu

SEQ ID NO: 128401 - RNA, 19 nt, Homo sapiens
acuggucacugcuuaaaug

SEQ ID NO: 128402 - RNA, 19 nt, Homo sapiens
uggcguggaugccucuauu

SEQ ID NO: 128403 - RNA, 19 nt, Homo sapiens
uggauaauguucccagaca

SEQ ID NO: 128404 - RNA, 19 nt, Homo sapiens
ccaugcaaauugacguaga

SEQ ID NO: 128405 - RNA, 19 nt, Homo sapiens
ccacaucaugcgagagaaa

SEQ ID NO: 128406 - RNA, 19 nt, Homo sapiens
ucagugauguccuaaagcu

SEQ ID NO: 128407 - RNA, 19 nt, Homo sapiens
gguccaagcaacggaagua

SEQ ID NO: 128408 - RNA, 19 nt, Homo sapiens
cuaauaagccccagugauu

SEQ ID NO: 128409 - RNA, 19 nt, Homo sapiens
gaaagacaaucaacaguga

SEQ ID NO: 128410 - RNA, 19 nt, Homo sapiens
gaaauggguuaaugcauaa

SEQ ID NO: 128411 - RNA, 19 nt, Homo sapiens
gaagugauacugcauauuu

SEQ ID NO: 128412 - RNA, 19 nt, Homo sapiens
ggaagugguuuaacaguuu

SEQ ID NO: 128413 - RNA, 19 nt, Homo sapiens
gaacacauaugcuggaaau

SEQ ID NO: 128414 - RNA, 19 nt, Homo sapiens
gcaagaagcuacaugaauc

SEQ ID NO: 128415 - RNA, 19 nt, Homo sapiens
gcacacagauuccacauca

SEQ ID NO: 128416 - RNA, 19 nt, Homo sapiens
gcacagaaaucauguugga

SEQ ID NO: 128417 - RNA, 19 nt, Homo sapiens
aaacaaugcuugagagaaa

SEQ ID NO: 128418 - RNA, 19 nt, Homo sapiens
ccagagaaauucaacagua

SEQ ID NO: 128419 - RNA, 19 nt, Homo sapiens
caagugaguugcccauuaa

SEQ ID NO: 128420 - RNA, 19 nt, Homo sapiens
aaucaaagcucaauagaug

SEQ ID NO: 128421 - RNA, 19 nt, Homo sapiens
agaaauggguuaaugcaua

SEQ ID NO: 128422 - RNA, 19 nt, Homo sapiens
ggaauaauccuguguuguu

SEQ ID NO: 128423 - RNA, 19 nt, Homo sapiens
uaaaugugcuucucaucua

SEQ ID NO: 128424 - RNA, 19 nt, Homo sapiens
ggaaguaaaugauuguauc

SEQ ID NO: 128425 - RNA, 19 nt, Homo sapiens
gaagaaagcagaaguuuac

SEQ ID NO: 128426 - RNA, 19 nt, Homo sapiens
gaauaauccuguguuguuu

SEQ ID NO: 128427 - RNA, 19 nt, Homo sapiens
gagaacgaauuuacagaaa

SEQ ID NO: 128428 - RNA, 19 nt, Homo sapiens
gaaauugacuaugaucaug

SEQ ID NO: 128429 - RNA, 19 nt, Homo sapiens
gaagguaacugcccaacca

SEQ ID NO: 128430 - RNA, 19 nt, Homo sapiens
gcaacaaguuuccucauuc

SEQ ID NO: 128431 - RNA, 19 nt, Homo sapiens
ccacaccaauaacgaaaua

SEQ ID NO: 128432 - RNA, 19 nt, Homo sapiens
uaacaaaccugccuauugc

SEQ ID NO: 128433 - RNA, 19 nt, Homo sapiens
uggaagaaauugacuauga

SEQ ID NO: 128434 - RNA, 19 nt, Homo sapiens
uaaacuaugugccuaauca

SEQ ID NO: 128435 - RNA, 19 nt, Homo sapiens
ggaagaaauugacuaugau

SEQ ID NO: 128436 - RNA, 19 nt, Homo sapiens
ugacaaagaugagaaagga

SEQ ID NO: 128437 - RNA, 19 nt, Homo sapiens
ucacugaacuuaauccaau

SEQ ID NO: 128438 - RNA, 19 nt, Homo sapiens
gagcagucuuguaauauug

SEQ ID NO: 128439 - RNA, 19 nt, Homo sapiens
gugaguugcccauuaauua

SEQ ID NO: 128440 - RNA, 19 nt, Homo sapiens
caaacaaagugauugacaa

SEQ ID NO: 128441 - RNA, 19 nt, Homo sapiens
ccacaaaacuguuaaaugu

SEQ ID NO: 128442 - RNA, 19 nt, Homo sapiens
gaggaagaccugaggauaa

SEQ ID NO: 128443 - RNA, 19 nt, Homo sapiens
gaaacgugauucucagugu

SEQ ID NO: 128444 - RNA, 19 nt, Homo sapiens
gaguuuauguuucgccuuu

SEQ ID NO: 128445 - RNA, 19 nt, Homo sapiens
ugaaggaaguaaaugauug

SEQ ID NO: 128446 - RNA, 19 nt, Homo sapiens
gcagauugcuauacguuuc

SEQ ID NO: 128447 - RNA, 19 nt, Homo sapiens
ugacaggacugcauugugu

SEQ ID NO: 128448 - RNA, 19 nt, Homo sapiens
gcaccucccucuugcauca

SEQ ID NO: 128449 - RNA, 19 nt, Homo sapiens
ggaugucacugaacuuaau

SEQ ID NO: 128450 - RNA, 19 nt, Homo sapiens
gcaagucucugccaaugca

SEQ ID NO: 128451 - RNA, 19 nt, Homo sapiens
acaaagugauugacaagaa

SEQ ID NO: 128452 - RNA, 19 nt, Homo sapiens
guaauggugugcuugcaaa

SEQ ID NO: 128453 - RNA, 19 nt, Homo sapiens
gagcaagucucugccaaug

SEQ ID NO: 128454 - RNA, 19 nt, Homo sapiens
aauagaaugugauggagua

SEQ ID NO: 128455 - RNA, 19 nt, Homo sapiens
aaguuuaccugaagugaua

SEQ ID NO: 128456 - RNA, 19 nt, Homo sapiens
uaaauggguaccuguaaua

SEQ ID NO: 128457 - RNA, 19 nt, Homo sapiens
gaggauaagcuugaguuua

SEQ ID NO: 128458 - RNA, 19 nt, Homo sapiens
ucugagcagucuuguaaua

SEQ ID NO: 128459 - RNA, 19 nt, Homo sapiens
cucaauagaugauuucuug

SEQ ID NO: 128460 - RNA, 19 nt, Homo sapiens
aaacaucucucuggaagga

SEQ ID NO: 128461 - RNA, 19 nt, Homo sapiens
caaagugauugacaagaau

SEQ ID NO: 128462 - RNA, 19 nt, Homo sapiens
gcaaguacacaguccauga

SEQ ID NO: 128463 - RNA, 19 nt, Homo sapiens
gaaaugauggaagaaauug

SEQ ID NO: 128464 - RNA, 19 nt, Homo sapiens
gaaaauaucaucagucaga

SEQ ID NO: 128465 - RNA, 19 nt, Homo sapiens
cuacuccacucccaucuuu

SEQ ID NO: 128466 - RNA, 19 nt, Homo sapiens
auggguaccuguaauaaua

SEQ ID NO: 128467 - RNA, 19 nt, Homo sapiens
gaucauaauugcagauugc

SEQ ID NO: 128468 - RNA, 19 nt, Homo sapiens
ccucagcccuucggaauuu

SEQ ID NO: 128469 - RNA, 19 nt, Homo sapiens
ggagaacgaauuuacagaa

SEQ ID NO: 128470 - RNA, 19 nt, Homo sapiens
aaacaaggagaacgaauuu

SEQ ID NO: 128471 - RNA, 19 nt, Homo sapiens
ugccugaacugcaugauuu

SEQ ID NO: 128472 - RNA, 19 nt, Homo sapiens
gaaaacauguuacuugaca

SEQ ID NO: 128473 - RNA, 19 nt, Homo sapiens
ugagagaaauggguuaaug

SEQ ID NO: 128474 - RNA, 19 nt, Homo sapiens
ugagcagucuuguaauauu

SEQ ID NO: 128475 - RNA, 19 nt, Homo sapiens
cagccuagaucacuguuga

SEQ ID NO: 128476 - RNA, 19 nt, Homo sapiens
guauaauccugaagggaaa

SEQ ID NO: 128477 - RNA, 19 nt, Homo sapiens
ugaagaaagcagaaguuua

SEQ ID NO: 128478 - RNA, 19 nt, Homo sapiens
guggaaguuugaagucaua

SEQ ID NO: 128479 - RNA, 19 nt, Homo sapiens
gggaggagguuacgaaggu

SEQ ID NO: 128480 - RNA, 19 nt, Homo sapiens
cagaucacacugcauaaua

SEQ ID NO: 128481 - RNA, 19 nt, Homo sapiens
caacaaguuuccucauucu

SEQ ID NO: 128482 - RNA, 19 nt, Homo sapiens
ggaaacaacagccuagauc

SEQ ID NO: 128483 - RNA, 19 nt, Homo sapiens
agaucacacugcauaauaa

SEQ ID NO: 128484 - RNA, 19 nt, Homo sapiens
gaacuacuucuccugcaaa

SEQ ID NO: 128485 - RNA, 19 nt, Homo sapiens
gaaacaacagccuagauca

SEQ ID NO: 128486 - RNA, 19 nt, Homo sapiens
acgaagcacuaaucaguaa

SEQ ID NO: 128487 - RNA, 19 nt, Homo sapiens
ggaaggaauugcuauuuug

SEQ ID NO: 128488 - RNA, 19 nt, Homo sapiens
gcuauacguuucccuuuua

SEQ ID NO: 128489 - RNA, 19 nt, Homo sapiens
gaaaccgaagcaaggaaua

SEQ ID NO: 128490 - RNA, 19 nt, Homo sapiens
ggaaggagccauggagaug

SEQ ID NO: 128491 - RNA, 19 nt, Homo sapiens
gcauuguggagcaaauuua

SEQ ID NO: 128492 - RNA, 19 nt, Homo sapiens
gaaauaccaugggaaacgu

SEQ ID NO: 128493 - RNA, 19 nt, Homo sapiens
aagcagaaguuuaccugaa

SEQ ID NO: 128494 - RNA, 19 nt, Homo sapiens
ucacagaugccaaagaguu

SEQ ID NO: 128495 - RNA, 19 nt, Homo sapiens
gaaugugacuguggaccuu

SEQ ID NO: 128496 - RNA, 19 nt, Homo sapiens
ggguuccugugauuaauuu

SEQ ID NO: 128497 - RNA, 19 nt, Homo sapiens
acagucaagugugguaaua

SEQ ID NO: 128498 - RNA, 19 nt, Homo sapiens
gugcaugcauucccauaga

SEQ ID NO: 128499 - RNA, 19 nt, Homo sapiens
acgaagccaucgacgaaua

SEQ ID NO: 128500 - RNA, 19 nt, Homo sapiens
cagagaaauucaacaguag

SEQ ID NO: 128501 - RNA, 19 nt, Homo sapiens
ugacaacgauuccacuucu

SEQ ID NO: 128502 - RNA, 19 nt, Homo sapiens
ucagucagaugaugcaugu

SEQ ID NO: 128503 - RNA, 19 nt, Homo sapiens
cuagaucacuguugaaggu

SEQ ID NO: 128504 - RNA, 19 nt, Homo sapiens
cgaaucaugcaugcaauua

SEQ ID NO: 128505 - RNA, 19 nt, Homo sapiens
ugacuacaauaccuugcua

SEQ ID NO: 128506 - RNA, 19 nt, Homo sapiens
guguaucagugaccuauga

SEQ ID NO: 128507 - RNA, 19 nt, Homo sapiens
ucagugugauuccaauuau

SEQ ID NO: 128508 - RNA, 19 nt, Homo sapiens
uuaacaaaccugccuauug

SEQ ID NO: 128509 - RNA, 19 nt, Homo sapiens
gaacuuauuucucagcuuu

SEQ ID NO: 128510 - RNA, 19 nt, Homo sapiens
gaccuaagcuuauauguga

SEQ ID NO: 128511 - RNA, 19 nt, Homo sapiens
gaaagacaaucaacaguga

SEQ ID NO: 128512 - RNA, 19 nt, Homo sapiens
gcaagaagcuacaugaauc

SEQ ID NO: 128513 - RNA, 19 nt, Homo sapiens
gcacacagauuccacauca

SEQ ID NO: 128514 - RNA, 19 nt, Homo sapiens
gcacagaaaucauguugga

SEQ ID NO: 128515 - RNA, 19 nt, Homo sapiens
ccagagaaauucaacagua

SEQ ID NO: 128516 - RNA, 19 nt, Homo sapiens
gauuagguguggagaauaa

SEQ ID NO: 128517 - RNA, 19 nt, Homo sapiens
uaaaugugcuucucaucua

SEQ ID NO: 128518 - RNA, 19 nt, Homo sapiens
gaacaagaccaacagugua

SEQ ID NO: 128519 - RNA, 19 nt, Homo sapiens
gagaacgaauuuacagaaa

SEQ ID NO: 128520 - RNA, 19 nt, Homo sapiens
gaaauugacuaugaucaug

SEQ ID NO: 128521 - RNA, 19 nt, Homo sapiens
gaagguaacugcccaacca

SEQ ID NO: 128522 - RNA, 19 nt, Homo sapiens
gcaacaaguuuccucauuc

SEQ ID NO: 128523 - RNA, 19 nt, Homo sapiens
ugauuuagcucuugaaugu

SEQ ID NO: 128524 - RNA, 19 nt, Homo sapiens
uaacaaaccugccuauugc

SEQ ID NO: 128525 - RNA, 19 nt, Homo sapiens
uggaagaaauugacuauga

SEQ ID NO: 128526 - RNA, 19 nt, Homo sapiens
ggacauagccaaaagcuua

SEQ ID NO: 128527 - RNA, 19 nt, Homo sapiens
ggaagaaauugacuaugau

SEQ ID NO: 128528 - RNA, 19 nt, Homo sapiens
gcaaugauuuagcucuuga

SEQ ID NO: 128529 - RNA, 19 nt, Homo sapiens
ugacaaagaugagaaagga

SEQ ID NO: 128530 - RNA, 19 nt, Homo sapiens
ucacugaacuuaauccaau

SEQ ID NO: 128531 - RNA, 19 nt, Homo sapiens
caaacaaagugauugacaa

SEQ ID NO: 128532 - RNA, 19 nt, Homo sapiens
ccacaaaacuguuaaaugu

SEQ ID NO: 128533 - RNA, 19 nt, Homo sapiens
gaggaagaccugaggauaa

SEQ ID NO: 128534 - RNA, 19 nt, Homo sapiens
cagaguaguugauaugcua

SEQ ID NO: 128535 - RNA, 19 nt, Homo sapiens
gaguuuauguuucgccuuu

SEQ ID NO: 128536 - RNA, 19 nt, Homo sapiens
uauaauagaggaccgaaua

SEQ ID NO: 128537 - RNA, 19 nt, Homo sapiens
ugacaggacugcauugugu

SEQ ID NO: 128538 - RNA, 19 nt, Homo sapiens
gcaccucccucuugcauca

SEQ ID NO: 128539 - RNA, 19 nt, Homo sapiens
ggaugucacugaacuuaau

SEQ ID NO: 128540 - RNA, 19 nt, Homo sapiens
gcaagucucugccaaugca

SEQ ID NO: 128541 - RNA, 19 nt, Homo sapiens
acaaagugauugacaagaa

SEQ ID NO: 128542 - RNA, 19 nt, Homo sapiens
guaauggugugcuugcaaa

SEQ ID NO: 128543 - RNA, 19 nt, Homo sapiens
gagcaagucucugccaaug

SEQ ID NO: 128544 - RNA, 19 nt, Homo sapiens
aauagaaugugauggagua

SEQ ID NO: 128545 - RNA, 19 nt, Homo sapiens
gaggauaagcuugaguuua

SEQ ID NO: 128546 - RNA, 19 nt, Homo sapiens
cauuuaggcuguagacauu

SEQ ID NO: 128547 - RNA, 19 nt, Homo sapiens
gcacagugaguacagagua

SEQ ID NO: 128548 - RNA, 19 nt, Homo sapiens
aaacaucucucuggaagga

SEQ ID NO: 128549 - RNA, 19 nt, Homo sapiens
caaagugauugacaagaau

SEQ ID NO: 128550 - RNA, 19 nt, Homo sapiens
gcaaguacacaguccauga

SEQ ID NO: 128551 - RNA, 19 nt, Homo sapiens
gaaaugauggaagaaauug

SEQ ID NO: 128552 - RNA, 19 nt, Homo sapiens
gaaaauaucaucagucaga

SEQ ID NO: 128553 - RNA, 19 nt, Homo sapiens
ggagaacgaauuuacagaa

SEQ ID NO: 128554 - RNA, 19 nt, Homo sapiens
aaacaaggagaacgaauuu

SEQ ID NO: 128555 - RNA, 19 nt, Homo sapiens
ccucagcccuucggaauuu

SEQ ID NO: 128556 - RNA, 19 nt, Homo sapiens
auaagaagcuggauuaggu

SEQ ID NO: 128557 - RNA, 19 nt, Homo sapiens
auagaggaccgaauaaaua

SEQ ID NO: 128558 - RNA, 19 nt, Homo sapiens
uauauacccuuggcaauga

SEQ ID NO: 128559 - RNA, 19 nt, Homo sapiens
ugucagagccacuacauuu

SEQ ID NO: 128560 - RNA, 19 nt, Homo sapiens
guggaaguuugaagucaua

SEQ ID NO: 128561 - RNA, 19 nt, Homo sapiens
gggaggagguuacgaaggu

SEQ ID NO: 128562 - RNA, 19 nt, Homo sapiens
cagaucacacugcauaaua

SEQ ID NO: 128563 - RNA, 19 nt, Homo sapiens
guauaauccugaagggaaa

SEQ ID NO: 128564 - RNA, 19 nt, Homo sapiens
caacaaguuuccucauucu

SEQ ID NO: 128565 - RNA, 19 nt, Homo sapiens
guacagaguaguugauaug

SEQ ID NO: 128566 - RNA, 19 nt, Homo sapiens
agaucacacugcauaauaa

SEQ ID NO: 128567 - RNA, 19 nt, Homo sapiens
gaacuacuucuccugcaaa

SEQ ID NO: 128568 - RNA, 19 nt, Homo sapiens
ccagaaugagguauuauuu

SEQ ID NO: 128569 - RNA, 19 nt, Homo sapiens
ggaaggaauugcuauuuug

SEQ ID NO: 128570 - RNA, 19 nt, Homo sapiens
gccaaaagcuuaguauaaa

SEQ ID NO: 128571 - RNA, 19 nt, Homo sapiens
uaagggagaccucuuugaa

SEQ ID NO: 128572 - RNA, 19 nt, Homo sapiens
uagaggaccgaauaaauaa

SEQ ID NO: 128573 - RNA, 19 nt, Homo sapiens
ggaaggagccauggagaug

SEQ ID NO: 128574 - RNA, 19 nt, Homo sapiens
gaaaugaugauaagaagcu

SEQ ID NO: 128575 - RNA, 19 nt, Homo sapiens
ggugaaaugaugauaagaa

SEQ ID NO: 128576 - RNA, 19 nt, Homo sapiens
cagagcacauuauuagaau

SEQ ID NO: 128577 - RNA, 19 nt, Homo sapiens
ucacagaugccaaagaguu

SEQ ID NO: 128578 - RNA, 19 nt, Homo sapiens
gaaugugacuguggaccuu

SEQ ID NO: 128579 - RNA, 19 nt, Homo sapiens
ugugcuagccuaaguauaa

SEQ ID NO: 128580 - RNA, 19 nt, Homo sapiens
acgaagccaucgacgaaua

SEQ ID NO: 128581 - RNA, 19 nt, Homo sapiens
cagagaaauucaacaguag

SEQ ID NO: 128582 - RNA, 19 nt, Homo sapiens
ugacaacgauuccacuucu

SEQ ID NO: 128583 - RNA, 19 nt, Homo sapiens
ucagucagaugaugcaugu

SEQ ID NO: 128584 - RNA, 19 nt, Homo sapiens
ggaguagacacaugaacaa

SEQ ID NO: 128585 - RNA, 19 nt, Homo sapiens
uuaacaaaccugccuauug

SEQ ID NO: 128586 - RNA, 19 nt, Homo sapiens
gaaaggacauagccaaaag

SEQ ID NO: 128587 - RNA, 19 nt, Homo sapiens
ucagagcacauuauuagaa

SEQ ID NO: 128588 - RNA, 19 nt, Homo sapiens
aaacagcacagaaaucaug

SEQ ID NO: 128589 - RNA, 19 nt, Homo sapiens
gaucacacugcauaauaaa

SEQ ID NO: 128590 - RNA, 19 nt, Homo sapiens
aaaauaacgugaaggauga

SEQ ID NO: 128591 - RNA, 19 nt, Homo sapiens
ggagaauaaauacuacuug

SEQ ID NO: 128592 - RNA, 19 nt, Homo sapiens
aaaugcagaccuaagcuua

SEQ ID NO: 128593 - RNA, 19 nt, Homo sapiens
gaaaugcagaccuaagcuu

SEQ ID NO: 128594 - RNA, 19 nt, Homo sapiens
gcuagccuaaguauaaaua

SEQ ID NO: 128595 - RNA, 19 nt, Homo sapiens
gaagaauuccaugguaaug

SEQ ID NO: 128596 - RNA, 19 nt, Homo sapiens
aaaugugcuucucaucuaa

SEQ ID NO: 128597 - RNA, 19 nt, Homo sapiens
aaggaacacugaugucaug

SEQ ID NO: 128598 - RNA, 19 nt, Homo sapiens
gugaaaugaugauaagaag

SEQ ID NO: 128599 - RNA, 19 nt, Homo sapiens
guagacacaugaacaagac

SEQ ID NO: 128600 - RNA, 19 nt, Homo sapiens
gauaugcuaugucaaucuc

SEQ ID NO: 128601 - RNA, 19 nt, Homo sapiens
gagaaauucaacaguagaa

SEQ ID NO: 128602 - RNA, 19 nt, Homo sapiens
gaaaacagcacagaaauca

SEQ ID NO: 128603 - RNA, 19 nt, Homo sapiens
ugucagaucacacugcaua

SEQ ID NO: 128604 - RNA, 19 nt, Homo sapiens
ugacuaugaucaugaugga

SEQ ID NO: 128605 - RNA, 19 nt, Homo sapiens
uugaagaauuccaugguaa

SEQ ID NO: 128606 - RNA, 19 nt, Homo sapiens
gauggaagaaauugacuau

SEQ ID NO: 128607 - RNA, 19 nt, Homo sapiens
ggucugagaaugaauaaag

SEQ ID NO: 128608 - RNA, 19 nt, Homo sapiens
agaaauagaaugugaugga

SEQ ID NO: 128609 - RNA, 19 nt, Homo sapiens
gaacaacuauuucuccauu

SEQ ID NO: 128610 - RNA, 19 nt, Homo sapiens
gcacaaaguucccucugua

SEQ ID NO: 128611 - RNA, 19 nt, Homo sapiens
gaacuugucaugcaguaua

SEQ ID NO: 128612 - RNA, 19 nt, Homo sapiens
uaaauacacuguccacgaa

SEQ ID NO: 128613 - RNA, 19 nt, Homo sapiens
gaauauuccuccaagaaga

SEQ ID NO: 128614 - RNA, 19 nt, Homo sapiens
caaacaagcugcugccaau

SEQ ID NO: 128615 - RNA, 19 nt, Homo sapiens
gaauuuaccuugaauacag

SEQ ID NO: 128616 - RNA, 19 nt, Homo sapiens
ccacagagcugaggccuau

SEQ ID NO: 128617 - RNA, 19 nt, Homo sapiens
gagaaacugggauuuauuu

SEQ ID NO: 128618 - RNA, 19 nt, Homo sapiens
ccacaggccuugagcagaa

SEQ ID NO: 128619 - RNA, 19 nt, Homo sapiens
gagcugaggccuauauuga

SEQ ID NO: 128620 - RNA, 19 nt, Homo sapiens
cauacacacucuucucuaa

SEQ ID NO: 128621 - RNA, 19 nt, Homo sapiens
gcacacacacacacacaua

SEQ ID NO: 128622 - RNA, 19 nt, Homo sapiens
ccgcaaaugugaauuauca

SEQ ID NO: 128623 - RNA, 19 nt, Homo sapiens
cagcgcagauacuaauaua

SEQ ID NO: 128624 - RNA, 19 nt, Homo sapiens
caccuuagaugugguauuu

SEQ ID NO: 128625 - RNA, 19 nt, Homo sapiens
gaaccaagcgcccaugaug

SEQ ID NO: 128626 - RNA, 19 nt, Homo sapiens
ggagauggauugcauuguc

SEQ ID NO: 128627 - RNA, 19 nt, Homo sapiens
ugaaggauguugugugcua

SEQ ID NO: 128628 - RNA, 19 nt, Homo sapiens
aaagaugccuugacugaau

SEQ ID NO: 128629 - RNA, 19 nt, Homo sapiens
gugggagccucaaacaaua

SEQ ID NO: 128630 - RNA, 19 nt, Homo sapiens
ggauguugccuaaggaaua

SEQ ID NO: 128631 - RNA, 19 nt, Homo sapiens
caauuuaugugcacacuca

SEQ ID NO: 128632 - RNA, 19 nt, Homo sapiens
aaucaaauauggcugagaa

SEQ ID NO: 128633 - RNA, 19 nt, Homo sapiens
gaucuugucucaucuucug

SEQ ID NO: 128634 - RNA, 19 nt, Homo sapiens
gagaaagcaagaaacuaua

SEQ ID NO: 128635 - RNA, 19 nt, Homo sapiens
acucagagaccacaucuua

SEQ ID NO: 128636 - RNA, 19 nt, Homo sapiens
gggaauaaaccgcgaagaa

SEQ ID NO: 128637 - RNA, 19 nt, Homo sapiens
gcagaaaggcuguggaaag

SEQ ID NO: 128638 - RNA, 19 nt, Homo sapiens
caagagagaaagcaagaaa

SEQ ID NO: 128639 - RNA, 19 nt, Homo sapiens
gcaggaagggugucacuga

SEQ ID NO: 128640 - RNA, 19 nt, Homo sapiens
gauacugaaucaaauaugg

SEQ ID NO: 128641 - RNA, 19 nt, Homo sapiens
gauuagcuaugaugucuuc

SEQ ID NO: 128642 - RNA, 19 nt, Homo sapiens
ggagaaacugggauuuauu

SEQ ID NO: 128643 - RNA, 19 nt, Homo sapiens
gaaggaagagccguucaaa

SEQ ID NO: 128644 - RNA, 19 nt, Homo sapiens
gaaacuccacgaccacauu

SEQ ID NO: 128645 - RNA, 19 nt, Homo sapiens
agccaggacuucugaauuu

SEQ ID NO: 128646 - RNA, 19 nt, Homo sapiens
gccaggacuucugaauuua

SEQ ID NO: 128647 - RNA, 19 nt, Homo sapiens
caacagcgcagauacuaau

SEQ ID NO: 128648 - RNA, 19 nt, Homo sapiens
ggagauagacagcuuugga

SEQ ID NO: 128649 - RNA, 19 nt, Homo sapiens
gaacuccuccgucaagugu

SEQ ID NO: 128650 - RNA, 19 nt, Homo sapiens
gagacaaggagaaagaauu

SEQ ID NO: 128651 - RNA, 19 nt, Homo sapiens
gagauggauugcauuguca

SEQ ID NO: 128652 - RNA, 19 nt, Homo sapiens
gaagcaagcaccagcugaa

SEQ ID NO: 128653 - RNA, 19 nt, Homo sapiens
ccagaagucuccugaaagg

SEQ ID NO: 128654 - RNA, 19 nt, Homo sapiens
gcggagaaacugggauuua

SEQ ID NO: 128655 - RNA, 19 nt, Homo sapiens
gaacaagcugugguacuuu

SEQ ID NO: 128656 - RNA, 19 nt, Homo sapiens
caaacaauaugacccacau

SEQ ID NO: 128657 - RNA, 19 nt, Homo sapiens
gaccaacuccagaaauauu

SEQ ID NO: 128658 - RNA, 19 nt, Homo sapiens
acaggaggauguugccuaa

SEQ ID NO: 128659 - RNA, 19 nt, Homo sapiens
gcugugguacuuugaauuu

SEQ ID NO: 128660 - RNA, 19 nt, Homo sapiens
agaacaagcugugguacuu

SEQ ID NO: 128661 - RNA, 19 nt, Homo sapiens
ccucuuuccucccaaguaa

SEQ ID NO: 128662 - RNA, 19 nt, Homo sapiens
cacaugagccgauuagcua

SEQ ID NO: 128663 - RNA, 19 nt, Homo sapiens
cggagaaacugggauuuau

SEQ ID NO: 128664 - RNA, 19 nt, Homo sapiens
gcacacucacacacaauuu

SEQ ID NO: 128665 - RNA, 19 nt, Homo sapiens
gcagccauguugcacgauu

SEQ ID NO: 128666 - RNA, 19 nt, Homo sapiens
gcgaacuugucaugcagua

SEQ ID NO: 128667 - RNA, 19 nt, Homo sapiens
uugaccaacuccagaaaua

SEQ ID NO: 128668 - RNA, 19 nt, Homo sapiens
ccuuagaugugguauuuau

SEQ ID NO: 128669 - RNA, 19 nt, Homo sapiens
gcgcagauacuaauauaca

SEQ ID NO: 128670 - RNA, 19 nt, Homo sapiens
ggaggauguugccuaagga

SEQ ID NO: 128671 - RNA, 19 nt, Homo sapiens
ggugggagccucaaacaau

SEQ ID NO: 128672 - RNA, 19 nt, Homo sapiens
cagaauauuccuccaagaa

SEQ ID NO: 128673 - RNA, 19 nt, Homo sapiens
ggaauaaaccgcgaagaag

SEQ ID NO: 128674 - RNA, 19 nt, Homo sapiens
gugucuacauguuugcuua

SEQ ID NO: 128675 - RNA, 19 nt, Homo sapiens
cagccauguugcacgauua

SEQ ID NO: 128676 - RNA, 19 nt, Homo sapiens
caacuucugccauaucaug

SEQ ID NO: 128677 - RNA, 19 nt, Homo sapiens
aaacuauaaugcacacuca

SEQ ID NO: 128678 - RNA, 19 nt, Homo sapiens
agagaaagcaagaaacuau

SEQ ID NO: 128679 - RNA, 19 nt, Homo sapiens
gagccaggacuucugaauu

SEQ ID NO: 128680 - RNA, 19 nt, Homo sapiens
guucauguuucgccucuau

SEQ ID NO: 128681 - RNA, 19 nt, Homo sapiens
aaauauggcugagaagcaa

SEQ ID NO: 128682 - RNA, 19 nt, Homo sapiens
gcuaugaugucuucaagcu

SEQ ID NO: 128683 - RNA, 19 nt, Homo sapiens
gaaauucugcguucaagac

SEQ ID NO: 128684 - RNA, 19 nt, Homo sapiens
acauugaguuggaguguga

SEQ ID NO: 128685 - RNA, 19 nt, Homo sapiens
gauguugccuaaggaauag

SEQ ID NO: 128686 - RNA, 19 nt, Homo sapiens
gaaaggcuuacaucgcaaa

SEQ ID NO: 128687 - RNA, 19 nt, Homo sapiens
ucccagaagucuccugaaa

SEQ ID NO: 128688 - RNA, 19 nt, Homo sapiens
gcauugccauucucaacau

SEQ ID NO: 128689 - RNA, 19 nt, Homo sapiens
ugaagaacaagcuguggua

SEQ ID NO: 128690 - RNA, 19 nt, Homo sapiens
ggagggagccagcaacagu

SEQ ID NO: 128691 - RNA, 19 nt, Homo sapiens
gauaaaagaugccuugacu

SEQ ID NO: 128692 - RNA, 19 nt, Homo sapiens
gcauagcacaccuuagaug

SEQ ID NO: 128693 - RNA, 19 nt, Homo sapiens
gagagaaagcaagaaacua

SEQ ID NO: 128694 - RNA, 19 nt, Homo sapiens
gcugaggccuauauugaag

SEQ ID NO: 128695 - RNA, 19 nt, Homo sapiens
gcagauacuaauauacaga

SEQ ID NO: 128696 - RNA, 19 nt, Homo sapiens
ugccauacauucuguuuca

SEQ ID NO: 128697 - RNA, 19 nt, Homo sapiens
ggagggagacaaggagaaa

SEQ ID NO: 128698 - RNA, 19 nt, Homo sapiens
ggacaggccaggugagaag

SEQ ID NO: 128699 - RNA, 19 nt, Homo sapiens
gaugacguuucaccgcaaa

SEQ ID NO: 128700 - RNA, 19 nt, Homo sapiens
gcagcaaccuccacauucc

SEQ ID NO: 128701 - RNA, 19 nt, Homo sapiens
cauacagcaucaugaacaa

SEQ ID NO: 128702 - RNA, 19 nt, Homo sapiens
ggacggcuuugugucucua

SEQ ID NO: 128703 - RNA, 19 nt, Homo sapiens
cagaagaauuugaccaacu

SEQ ID NO: 128704 - RNA, 19 nt, Homo sapiens
ggugggcacuuguuauuuu

SEQ ID NO: 128705 - RNA, 19 nt, Homo sapiens
ggauugcauugucaaccaa

SEQ ID NO: 128706 - RNA, 19 nt, Homo sapiens
cagaaaggcuguggaaagc

SEQ ID NO: 128707 - RNA, 19 nt, Homo sapiens
cagagccagugccaacaaa

SEQ ID NO: 128708 - RNA, 19 nt, Homo sapiens
gcaucaugaacaacuauuu

SEQ ID NO: 128709 - RNA, 19 nt, Homo sapiens
gcugucauauauugaaguu

SEQ ID NO: 128710 - RNA, 19 nt, Homo sapiens
gcagagagcagggauguag

SEQ ID NO: 128711 - RNA, 19 nt, Homo sapiens
ggaagcaaacgcugaagau

SEQ ID NO: 128712 - RNA, 19 nt, Homo sapiens
ggccucaucuucaucaaca

SEQ ID NO: 128713 - RNA, 19 nt, Homo sapiens
cgacagcgacaccagguuu

SEQ ID NO: 128714 - RNA, 19 nt, Homo sapiens
gcacgucucccuguuuguu

SEQ ID NO: 128715 - RNA, 19 nt, Homo sapiens
caguggcugucauauauug

SEQ ID NO: 128716 - RNA, 19 nt, Homo sapiens
agaggagccuggcaaguuc

SEQ ID NO: 128717 - RNA, 19 nt, Homo sapiens
ugaggaaggccaagcagaa

SEQ ID NO: 128718 - RNA, 19 nt, Homo sapiens
guuggacguugccugcuuu

SEQ ID NO: 128719 - RNA, 19 nt, Homo sapiens
ccgcacgucucccuguuug

SEQ ID NO: 128720 - RNA, 19 nt, Homo sapiens
agcaaacgcugaagaucuu

SEQ ID NO: 128721 - RNA, 19 nt, Homo sapiens
gagguggagcugcccagua

SEQ ID NO: 128722 - RNA, 19 nt, Homo sapiens
cccaagaucgugcagauga

SEQ ID NO: 128723 - RNA, 19 nt, Homo sapiens
agguggagcugcccaguau

SEQ ID NO: 128724 - RNA, 19 nt, Homo sapiens
gaagcuggcagugcagaga

SEQ ID NO: 128725 - RNA, 19 nt, Homo sapiens
gaagcaaacgcugaagauc

SEQ ID NO: 128726 - RNA, 19 nt, Homo sapiens
aagaggagccuggcaaguu

SEQ ID NO: 128727 - RNA, 19 nt, Homo sapiens
ggagcugcccaguauugaa

SEQ ID NO: 128728 - RNA, 19 nt, Homo sapiens
gagcugcccaguauugaag

SEQ ID NO: 128729 - RNA, 19 nt, Homo sapiens
gggaagcaaacgcugaaga

SEQ ID NO: 128730 - RNA, 19 nt, Homo sapiens
gcccuaaggugcacaugcu

SEQ ID NO: 128731 - RNA, 19 nt, Homo sapiens
guggagcugcccaguauug

SEQ ID NO: 128732 - RNA, 19 nt, Homo sapiens
gaagaggagccuggcaagu

SEQ ID NO: 128733 - RNA, 19 nt, Homo sapiens
gaacccucaucaggucuuc

SEQ ID NO: 128734 - RNA, 19 nt, Homo sapiens
uguacaugcugcugaagga

SEQ ID NO: 128735 - RNA, 19 nt, Homo sapiens
ucaccaagcccaccuucug

SEQ ID NO: 128736 - RNA, 19 nt, Homo sapiens
gcaccuccacccagacugu

SEQ ID NO: 128737 - RNA, 19 nt, Homo sapiens
cgucugcaauuucaugucu

SEQ ID NO: 128738 - RNA, 19 nt, Homo sapiens
ugugcgacgucugcaauuu

SEQ ID NO: 128739 - RNA, 19 nt, Homo sapiens
cgacgucugcaauuucaug

SEQ ID NO: 128740 - RNA, 19 nt, Homo sapiens
cgacgacgcggugagaaga

SEQ ID NO: 128741 - RNA, 19 nt, Homo sapiens
ugcgaggucugcaggaaga

SEQ ID NO: 128742 - RNA, 19 nt, Homo sapiens
ggcuguacaugcugcugaa

SEQ ID NO: 128743 - RNA, 19 nt, Homo sapiens
gcaaacgcugaagaucuuu

SEQ ID NO: 128744 - RNA, 19 nt, Homo sapiens
gagccuggcaaguucacaa

SEQ ID NO: 128745 - RNA, 19 nt, Homo sapiens
ccaagaucgugcagaugag

SEQ ID NO: 128746 - RNA, 19 nt, Homo sapiens
aaacgcugaagaucuuuga

SEQ ID NO: 128747 - RNA, 19 nt, Homo sapiens
aagcaaacgcugaagaucu

SEQ ID NO: 128748 - RNA, 19 nt, Homo sapiens
gaggaaggccaagcagaag

SEQ ID NO: 128749 - RNA, 19 nt, Homo sapiens
ggugagaagaagccaguuc

SEQ ID NO: 128750 - RNA, 19 nt, Homo sapiens
gcagaagaucagucacucu

SEQ ID NO: 128751 - RNA, 19 nt, Homo sapiens
ucgugcagaugaguaacua

SEQ ID NO: 128752 - RNA, 19 nt, Homo sapiens
ccugcuggaugcccacgaa

SEQ ID NO: 128753 - RNA, 19 nt, Homo sapiens
ucagcaagacgcagagcuu

SEQ ID NO: 128754 - RNA, 19 nt, Homo sapiens
gcucccgccagccuuguuu

SEQ ID NO: 128755 - RNA, 19 nt, Homo sapiens
ggauugcccaggguuccua

SEQ ID NO: 128756 - RNA, 19 nt, Homo sapiens
guauugaaggccucaucuu

SEQ ID NO: 128757 - RNA, 19 nt, Homo sapiens
ugcgacgucugcaauuuca

SEQ ID NO: 128758 - RNA, 19 nt, Homo sapiens
gggcacagggaaugaccuu

SEQ ID NO: 128759 - RNA, 19 nt, Homo sapiens
ggagugaacuaaacaauau

SEQ ID NO: 128760 - RNA, 19 nt, Homo sapiens
ggaaagaacuaucuacagu

SEQ ID NO: 128761 - RNA, 19 nt, Homo sapiens
ggacacaguucugggauuu

SEQ ID NO: 128762 - RNA, 19 nt, Homo sapiens
ucaaugugcuccuucauaa

SEQ ID NO: 128763 - RNA, 19 nt, Homo sapiens
gaaaagaaauuguccagaa

SEQ ID NO: 128764 - RNA, 19 nt, Homo sapiens
gcuacaaccucuuccauga

SEQ ID NO: 128765 - RNA, 19 nt, Homo sapiens
gaaacaagacgcuccagaa

SEQ ID NO: 128766 - RNA, 19 nt, Homo sapiens
caacagaccuuugacuauc

SEQ ID NO: 128767 - RNA, 19 nt, Homo sapiens
acaagacgcuccagaauca

SEQ ID NO: 128768 - RNA, 19 nt, Homo sapiens
ggucuggcauuauaaagaa

SEQ ID NO: 128769 - RNA, 19 nt, Homo sapiens
acacagaggucauccacaa

SEQ ID NO: 128770 - RNA, 19 nt, Homo sapiens
gauaauugaggcuaaguaa

SEQ ID NO: 128771 - RNA, 19 nt, Homo sapiens
ggaggauaauugaggcuaa

SEQ ID NO: 128772 - RNA, 19 nt, Homo sapiens
gagagaggcaucuacaauu

SEQ ID NO: 128773 - RNA, 19 nt, Homo sapiens
ccagggacccagacaguua

SEQ ID NO: 128774 - RNA, 19 nt, Homo sapiens
gaagaaaggacagcucaga

SEQ ID NO: 128775 - RNA, 19 nt, Homo sapiens
gaaacuggagugaacuaaa

SEQ ID NO: 128776 - RNA, 19 nt, Homo sapiens
gaaucaaugugcuccuuca

SEQ ID NO: 128777 - RNA, 19 nt, Homo sapiens
gaaaauggaggauaauuga

SEQ ID NO: 128778 - RNA, 19 nt, Homo sapiens
ccacaacuauggccaugga

SEQ ID NO: 128779 - RNA, 19 nt, Homo sapiens
gcgcagacgugauugucaa

SEQ ID NO: 128780 - RNA, 19 nt, Homo sapiens
guggcugacugaaagguua

SEQ ID NO: 128781 - RNA, 19 nt, Homo sapiens
gaggcuaaguaaccugauu

SEQ ID NO: 128782 - RNA, 19 nt, Homo sapiens
ugaaaucccucuaccuucu

SEQ ID NO: 128783 - RNA, 19 nt, Homo sapiens
agagaggcaucuacaauuc

SEQ ID NO: 128784 - RNA, 19 nt, Homo sapiens
acugaaagguuaacugaga

SEQ ID NO: 128785 - RNA, 19 nt, Homo sapiens
acagagggcuggaaacaag

SEQ ID NO: 128786 - RNA, 19 nt, Homo sapiens
ggagaauccuggaagaaaa

SEQ ID NO: 128787 - RNA, 19 nt, Homo sapiens
gcuucucccucacuucuuu

SEQ ID NO: 128788 - RNA, 19 nt, Homo sapiens
uggauauguucccagauua

SEQ ID NO: 128789 - RNA, 19 nt, Homo sapiens
ggacagagggcuggaaaca

SEQ ID NO: 128790 - RNA, 19 nt, Homo sapiens
gggagaauccuggaagaaa

SEQ ID NO: 128791 - RNA, 19 nt, Homo sapiens
cugaagaaugcaagaauua

SEQ ID NO: 128792 - RNA, 19 nt, Homo sapiens
ggaggcagccaagcucuuu

SEQ ID NO: 128793 - RNA, 19 nt, Homo sapiens
agagaaagccacaaaguca

SEQ ID NO: 128794 - RNA, 19 nt, Homo sapiens
aaacuggagugaacuaaac

SEQ ID NO: 128795 - RNA, 19 nt, Homo sapiens
ugacugaaagguuaacuga

SEQ ID NO: 128796 - RNA, 19 nt, Homo sapiens
gagagaaagccacaaaguc

SEQ ID NO: 128797 - RNA, 19 nt, Homo sapiens
ccucacuucuuuccucaaa

SEQ ID NO: 128798 - RNA, 19 nt, Homo sapiens
gccaacagaccuuugacua

SEQ ID NO: 128799 - RNA, 19 nt, Homo sapiens
ggauaauugaggcuaagua

SEQ ID NO: 128800 - RNA, 19 nt, Homo sapiens
agaaaggacagcucagaaa

SEQ ID NO: 128801 - RNA, 19 nt, Homo sapiens
cagaggucauccacaacua

SEQ ID NO: 128802 - RNA, 19 nt, Homo sapiens
ccaacagaccuuugacuau

SEQ ID NO: 128803 - RNA, 19 nt, Homo sapiens
gaaaggacagcucagaaaa

SEQ ID NO: 128804 - RNA, 19 nt, Homo sapiens
aaacaagacgcuccagaau

SEQ ID NO: 128805 - RNA, 19 nt, Homo sapiens
ggagggaaagaacuaucua

SEQ ID NO: 128806 - RNA, 19 nt, Homo sapiens
ggugagagaaagccacaaa

SEQ ID NO: 128807 - RNA, 19 nt, Homo sapiens
aaagaagcaugaggugaga

SEQ ID NO: 128808 - RNA, 19 nt, Homo sapiens
ggaaacuggagugaacuaa

SEQ ID NO: 128809 - RNA, 19 nt, Homo sapiens
acugaagaaugcaagaauu

SEQ ID NO: 128810 - RNA, 19 nt, Homo sapiens
ccagacaguuacucuugga

SEQ ID NO: 128811 - RNA, 19 nt, Homo sapiens
ggagccaacagaccuuuga

SEQ ID NO: 128812 - RNA, 19 nt, Homo sapiens
uggagugaacuaaacaaua

SEQ ID NO: 128813 - RNA, 19 nt, Homo sapiens
agaaggcgcagacgugauu

SEQ ID NO: 128814 - RNA, 19 nt, Homo sapiens
guucccagauuacggcuau

SEQ ID NO: 128815 - RNA, 19 nt, Homo sapiens
uugaggagguggcaagaga

SEQ ID NO: 128816 - RNA, 19 nt, Homo sapiens
cacagaaaauggaggauaa

SEQ ID NO: 128817 - RNA, 19 nt, Homo sapiens
gcacuggaccuucaaacac

SEQ ID NO: 128818 - RNA, 19 nt, Homo sapiens
gauuggagcaggagucauc

SEQ ID NO: 128819 - RNA, 19 nt, Homo sapiens
gaggauaauugaggcuaag

SEQ ID NO: 128820 - RNA, 19 nt, Homo sapiens
aaagaaauuguccagaaug

SEQ ID NO: 128821 - RNA, 19 nt, Homo sapiens
gggaaacuggagugaacua

SEQ ID NO: 128822 - RNA, 19 nt, Homo sapiens
gccuaauucuggagggaaa

SEQ ID NO: 128823 - RNA, 19 nt, Homo sapiens
gcuacgggcucaccaucca

SEQ ID NO: 128824 - RNA, 19 nt, Homo sapiens
gacuggagcccacacugaa

SEQ ID NO: 128825 - RNA, 19 nt, Homo sapiens
agagagaggcaucuacaau

SEQ ID NO: 128826 - RNA, 19 nt, Homo sapiens
ugagagaaagccacaaagu

SEQ ID NO: 128827 - RNA, 19 nt, Homo sapiens
cacuggaccuucaaacaca

SEQ ID NO: 128828 - RNA, 19 nt, Homo sapiens
gcuagaaagagaacagcuu

SEQ ID NO: 128829 - RNA, 19 nt, Homo sapiens
ccacacaagccuaauucug

SEQ ID NO: 128830 - RNA, 19 nt, Homo sapiens
ccagagagaggcaucuaca

SEQ ID NO: 128831 - RNA, 19 nt, Homo sapiens
agauucggcuagaaagaga

SEQ ID NO: 128832 - RNA, 19 nt, Homo sapiens
gagcccacacugaagaaug

SEQ ID NO: 128833 - RNA, 19 nt, Homo sapiens
aaccugggccuguuccuaa

SEQ ID NO: 128834 - RNA, 19 nt, Homo sapiens
ggacagcucagaaaaucaa

SEQ ID NO: 128835 - RNA, 19 nt, Homo sapiens
gaaggguucagcccaacau

SEQ ID NO: 128836 - RNA, 19 nt, Homo sapiens
gaggucauccacaacuaug

SEQ ID NO: 128837 - RNA, 19 nt, Homo sapiens
gggaaagaacuaucuacag

SEQ ID NO: 128838 - RNA, 19 nt, Homo sapiens
cuacaaccucuuccaugaa

SEQ ID NO: 128839 - RNA, 19 nt, Homo sapiens
aggcuaaguaaccugauua

SEQ ID NO: 128840 - RNA, 19 nt, Homo sapiens
gggucuggcauuauaaaga

SEQ ID NO: 128841 - RNA, 19 nt, Homo sapiens
gcggacagagggcuggaaa

SEQ ID NO: 128842 - RNA, 19 nt, Homo sapiens
cucugggucuggcauuaua

SEQ ID NO: 128843 - RNA, 19 nt, Homo sapiens
agacuggagcccacacuga

SEQ ID NO: 128844 - RNA, 19 nt, Homo sapiens
ggacccagacaguuacucu

SEQ ID NO: 128845 - RNA, 19 nt, Homo sapiens
cagacgugauugucaacug

SEQ ID NO: 128846 - RNA, 19 nt, Homo sapiens
aagaaaggacagcucagaa

SEQ ID NO: 128847 - RNA, 19 nt, Homo sapiens
ccucugaagacuccaguga

SEQ ID NO: 128848 - RNA, 19 nt, Homo sapiens
aagaaauuguccagaaugc

SEQ ID NO: 128849 - RNA, 19 nt, Homo sapiens
ggauauguucccagauuac

SEQ ID NO: 128850 - RNA, 19 nt, Homo sapiens
ucugaaaaguccugcaaaa

SEQ ID NO: 128851 - RNA, 19 nt, Homo sapiens
aagcaugaggugagagaaa

SEQ ID NO: 128852 - RNA, 19 nt, Homo sapiens
gacagagggcuggaaacaa

SEQ ID NO: 128853 - RNA, 19 nt, Homo sapiens
gccaccaucccaccucuga

SEQ ID NO: 128854 - RNA, 19 nt, Homo sapiens
ccagauucggcuagaaaga

SEQ ID NO: 128855 - RNA, 19 nt, Homo sapiens
acugaaaucccucuaccuu

SEQ ID NO: 128856 - RNA, 19 nt, Homo sapiens
ucugaagacuccagugacu

SEQ ID NO: 128857 - RNA, 19 nt, Homo sapiens
aagaauuauuggugaacga

SEQ ID NO: 128858 - RNA, 19 nt, Homo sapiens
ugcaagaauuauuggugaa

SEQ ID NO: 128859 - RNA, 19 nt, Homo sapiens
gaacagcaaugccaaauuu

SEQ ID NO: 128860 - RNA, 19 nt, Homo sapiens
gaaagacgguguuugguuu

SEQ ID NO: 128861 - RNA, 19 nt, Homo sapiens
ggaaagaccagauaagaaa

SEQ ID NO: 128862 - RNA, 19 nt, Homo sapiens
ggaccaggguggaggaaua

SEQ ID NO: 128863 - RNA, 19 nt, Homo sapiens
gaagaugagauuaagguua

SEQ ID NO: 128864 - RNA, 19 nt, Homo sapiens
uaagaaaccugcccuuugu

SEQ ID NO: 128865 - RNA, 19 nt, Homo sapiens
caagaaggcacacauuuga

SEQ ID NO: 128866 - RNA, 19 nt, Homo sapiens
cgugaaagcugguggaaug

SEQ ID NO: 128867 - RNA, 19 nt, Homo sapiens
agacaaggaugaccaggaa

SEQ ID NO: 128868 - RNA, 19 nt, Homo sapiens
gcaugcaucuuagaaauag

SEQ ID NO: 128869 - RNA, 19 nt, Homo sapiens
gcacacauuugagaagaug

SEQ ID NO: 128870 - RNA, 19 nt, Homo sapiens
gcaugcaucugugagcuuu

SEQ ID NO: 128871 - RNA, 19 nt, Homo sapiens
ggacaugagacaccacauu

SEQ ID NO: 128872 - RNA, 19 nt, Homo sapiens
gauaagaaaccugcccuuu

SEQ ID NO: 128873 - RNA, 19 nt, Homo sapiens
aagggaaacuagagacuaa

SEQ ID NO: 128874 - RNA, 19 nt, Homo sapiens
caacaccugugggagagua

SEQ ID NO: 128875 - RNA, 19 nt, Homo sapiens
gagaaaaccucagucauug

SEQ ID NO: 128876 - RNA, 19 nt, Homo sapiens
gaagggaaacuagagacua

SEQ ID NO: 128877 - RNA, 19 nt, Homo sapiens
gaaugcgaauugugcagaa

SEQ ID NO: 128878 - RNA, 19 nt, Homo sapiens
gagucaacaugccaaagaa

SEQ ID NO: 128879 - RNA, 19 nt, Homo sapiens
ggagucaacaugccaaaga

SEQ ID NO: 128880 - RNA, 19 nt, Homo sapiens
gcagaaacacccacauaca

SEQ ID NO: 128881 - RNA, 19 nt, Homo sapiens
ggagaaaaccucagucauu

SEQ ID NO: 128882 - RNA, 19 nt, Homo sapiens
gagauuaagguuaggagaa

SEQ ID NO: 128883 - RNA, 19 nt, Homo sapiens
aagaugagauuaagguuag

SEQ ID NO: 128884 - RNA, 19 nt, Homo sapiens
uagcagaauuugccaagau

SEQ ID NO: 128885 - RNA, 19 nt, Homo sapiens
gaggacuucuggcaugaga

SEQ ID NO: 128886 - RNA, 19 nt, Homo sapiens
ggaacagcaaugccaaauu

SEQ ID NO: 128887 - RNA, 19 nt, Homo sapiens
gugcagaaacacccacaua

SEQ ID NO: 128888 - RNA, 19 nt, Homo sapiens
agacgaaacuccagaacag

SEQ ID NO: 128889 - RNA, 19 nt, Homo sapiens
gagaagaugagauuaaggu

SEQ ID NO: 128890 - RNA, 19 nt, Homo sapiens
gaaacagcuucagcccaaa

SEQ ID NO: 128891 - RNA, 19 nt, Homo sapiens
caagugcucuguccuuugc

SEQ ID NO: 128892 - RNA, 19 nt, Homo sapiens
aagcaugcaucuuagaaau

SEQ ID NO: 128893 - RNA, 19 nt, Homo sapiens
agauuaagguuaggagaaa

SEQ ID NO: 128894 - RNA, 19 nt, Homo sapiens
gaaggcacacauuugagaa

SEQ ID NO: 128895 - RNA, 19 nt, Homo sapiens
guccuugucuauggucuua

SEQ ID NO: 128896 - RNA, 19 nt, Homo sapiens
ggaugucauuugaggauca

SEQ ID NO: 128897 - RNA, 19 nt, Homo sapiens
ccaaagaagagaaagacaa

SEQ ID NO: 128898 - RNA, 19 nt, Homo sapiens
ugugagcuuuagaucauua

SEQ ID NO: 128899 - RNA, 19 nt, Homo sapiens
ugccuuacauuuccauauu

SEQ ID NO: 128900 - RNA, 19 nt, Homo sapiens
ugaguuuccugucuagaga

SEQ ID NO: 128901 - RNA, 19 nt, Homo sapiens
guugaaagcuuggaaagac

SEQ ID NO: 128902 - RNA, 19 nt, Homo sapiens
aaacaagaaggcacacauu

SEQ ID NO: 128903 - RNA, 19 nt, Homo sapiens
gccuuacauuuccauauuu

SEQ ID NO: 128904 - RNA, 19 nt, Homo sapiens
ugaaagacgguguuugguu

SEQ ID NO: 128905 - RNA, 19 nt, Homo sapiens
ccagaggguucaccuaguc

SEQ ID NO: 128906 - RNA, 19 nt, Homo sapiens
gggaggacuucuggcauga

SEQ ID NO: 128907 - RNA, 19 nt, Homo sapiens
acaagaaggcacacauuug

SEQ ID NO: 128908 - RNA, 19 nt, Homo sapiens
caaagaagagaaagacaag

SEQ ID NO: 128909 - RNA, 19 nt, Homo sapiens
ucugugagcuuuagaucau

SEQ ID NO: 128910 - RNA, 19 nt, Homo sapiens
uggcacagccucacacuug

SEQ ID NO: 128911 - RNA, 19 nt, Homo sapiens
gacaugagacaccacauuc

SEQ ID NO: 128912 - RNA, 19 nt, Homo sapiens
agaaauagccccucaauuc

SEQ ID NO: 128913 - RNA, 19 nt, Homo sapiens
gagucuaacuguuccaaac

SEQ ID NO: 128914 - RNA, 19 nt, Homo sapiens
gacaccacauuccauuugu

SEQ ID NO: 128915 - RNA, 19 nt, Homo sapiens
gaugaggcacccaugagaa

SEQ ID NO: 128916 - RNA, 19 nt, Homo sapiens
caccugacguccuugucua

SEQ ID NO: 128917 - RNA, 19 nt, Homo sapiens
gagggagggcuguuauuuc

SEQ ID NO: 128918 - RNA, 19 nt, Homo sapiens
ggcacagccucacacuuga

SEQ ID NO: 128919 - RNA, 19 nt, Homo sapiens
gcacagccucacacuugaa

SEQ ID NO: 128920 - RNA, 19 nt, Homo sapiens
gagacaccacauuccauuu

SEQ ID NO: 128921 - RNA, 19 nt, Homo sapiens
ucaacaugccaaagaauga

SEQ ID NO: 128922 - RNA, 19 nt, Homo sapiens
caggagacaccaaagaaga

SEQ ID NO: 128923 - RNA, 19 nt, Homo sapiens
gaaacuagagacuaaagcu

SEQ ID NO: 128924 - RNA, 19 nt, Homo sapiens
cugguuggaugucauuuga

SEQ ID NO: 128925 - RNA, 19 nt, Homo sapiens
cugcagaaauccagaagca

SEQ ID NO: 128926 - RNA, 19 nt, Homo sapiens
auaagaaaccugcccuuug

SEQ ID NO: 128927 - RNA, 19 nt, Homo sapiens
ccugaucaguugguauaaa

SEQ ID NO: 128928 - RNA, 19 nt, Homo sapiens
gccagagaguugaaagcuu

SEQ ID NO: 128929 - RNA, 19 nt, Homo sapiens
gcugguggaaugcgaauug

SEQ ID NO: 128930 - RNA, 19 nt, Homo sapiens
aguaagaacuaagggaaug

SEQ ID NO: 128931 - RNA, 19 nt, Homo sapiens
ugagacaccacauuccauu

SEQ ID NO: 128932 - RNA, 19 nt, Homo sapiens
gaggugccauuagcagaau

SEQ ID NO: 128933 - RNA, 19 nt, Homo sapiens
uggaaagaccagauaagaa

SEQ ID NO: 128934 - RNA, 19 nt, Homo sapiens
ggacuucuggcaugagauc

SEQ ID NO: 128935 - RNA, 19 nt, Homo sapiens
cauuugagaagaugagauu

SEQ ID NO: 128936 - RNA, 19 nt, Homo sapiens
acagagagaaccagcaguu

SEQ ID NO: 128937 - RNA, 19 nt, Homo sapiens
gguauuucccugacagaga

SEQ ID NO: 128938 - RNA, 19 nt, Homo sapiens
uaagggaagccggcaugua

SEQ ID NO: 128939 - RNA, 19 nt, Homo sapiens
agacaccacauuccauuug

SEQ ID NO: 128940 - RNA, 19 nt, Homo sapiens
aacaagaaggcacacauuu

SEQ ID NO: 128941 - RNA, 19 nt, Homo sapiens
caguuucgcccaaauccua

SEQ ID NO: 128942 - RNA, 19 nt, Homo sapiens
agagggagggcuguuauuu

SEQ ID NO: 128943 - RNA, 19 nt, Homo sapiens
uccagaagcauccuuaaug

SEQ ID NO: 128944 - RNA, 19 nt, Homo sapiens
uuagaugaguuuccugucu

SEQ ID NO: 128945 - RNA, 19 nt, Homo sapiens
ccuugucuauggucuuaaa

SEQ ID NO: 128946 - RNA, 19 nt, Homo sapiens
ggagucugguuggauguca

SEQ ID NO: 128947 - RNA, 19 nt, Homo sapiens
gagagaaccagcaguuucg

SEQ ID NO: 128948 - RNA, 19 nt, Homo sapiens
ccacugaugagucuaacug

SEQ ID NO: 128949 - RNA, 19 nt, Homo sapiens
ccaccuaaacccacugugu

SEQ ID NO: 128950 - RNA, 19 nt, Homo sapiens
gaaagaccagauaagaaac

SEQ ID NO: 128951 - RNA, 19 nt, Homo sapiens
caccuaaacccacuguguu

SEQ ID NO: 128952 - RNA, 19 nt, Homo sapiens
ggagacaccaaagaagaga

SEQ ID NO: 128953 - RNA, 19 nt, Homo sapiens
uaaacccacuguguucauc

SEQ ID NO: 128954 - RNA, 19 nt, Homo sapiens
guguuugguuucccaucua

SEQ ID NO: 128955 - RNA, 19 nt, Homo sapiens
gguguuugguuucccaucu

SEQ ID NO: 128956 - RNA, 19 nt, Homo sapiens
agaaggcacacauuugaga

SEQ ID NO: 128957 - RNA, 19 nt, Homo sapiens
aagagaaagacaaggauga

SEQ ID NO: 128958 - RNA, 19 nt, Homo sapiens
gccagaggguucaccuagu

SEQ ID NO: 128959 - RNA, 19 nt, Homo sapiens
gaaaucaucugcaagaaau

SEQ ID NO: 128960 - RNA, 19 nt, Homo sapiens
gcagaugguuuccacauuu

SEQ ID NO: 128961 - RNA, 19 nt, Homo sapiens
gaacagaucuuuuacuuug

SEQ ID NO: 128962 - RNA, 19 nt, Homo sapiens
gaacauguccuaauucuuc

SEQ ID NO: 128963 - RNA, 19 nt, Homo sapiens
ugagaagcauguaauguua

SEQ ID NO: 128964 - RNA, 19 nt, Homo sapiens
gaagaaaugccgugagaaa

SEQ ID NO: 128965 - RNA, 19 nt, Homo sapiens
gagggaacauguccuaauu

SEQ ID NO: 128966 - RNA, 19 nt, Homo sapiens
ugacacaguuguaggguua

SEQ ID NO: 128967 - RNA, 19 nt, Homo sapiens
ccagaacgcuuauuugaau

SEQ ID NO: 128968 - RNA, 19 nt, Homo sapiens
gaaucgauguccaggauaa

SEQ ID NO: 128969 - RNA, 19 nt, Homo sapiens
caaaguacaacaccaauaa

SEQ ID NO: 128970 - RNA, 19 nt, Homo sapiens
gaacagguuuggaaaugau

SEQ ID NO: 128971 - RNA, 19 nt, Homo sapiens
gcacgggacaccuccauua

SEQ ID NO: 128972 - RNA, 19 nt, Homo sapiens
caagaaacguuagcaaaug

SEQ ID NO: 128973 - RNA, 19 nt, Homo sapiens
caacugaauuucucaaaca

SEQ ID NO: 128974 - RNA, 19 nt, Homo sapiens
gaaauacgaagccagauug

SEQ ID NO: 128975 - RNA, 19 nt, Homo sapiens
gaauggaguuggcgauuuc

SEQ ID NO: 128976 - RNA, 19 nt, Homo sapiens
gaacauggagccgaccuua

SEQ ID NO: 128977 - RNA, 19 nt, Homo sapiens
guaccuugcuucuuacuga

SEQ ID NO: 128978 - RNA, 19 nt, Homo sapiens
uccaguaccuugcuucuua

SEQ ID NO: 128979 - RNA, 19 nt, Homo sapiens
aauaaacuguugcucguua

SEQ ID NO: 128980 - RNA, 19 nt, Homo sapiens
gaagaacccacuccaaguu

SEQ ID NO: 128981 - RNA, 19 nt, Homo sapiens
gagaaucgauguccaggau

SEQ ID NO: 128982 - RNA, 19 nt, Homo sapiens
ggacaucuccaacaaguau

SEQ ID NO: 128983 - RNA, 19 nt, Homo sapiens
ggugaggcgugacaguuua

SEQ ID NO: 128984 - RNA, 19 nt, Homo sapiens
caguaaacauggagaaauu

SEQ ID NO: 128985 - RNA, 19 nt, Homo sapiens
gaucaagccuaaagauaca

SEQ ID NO: 128986 - RNA, 19 nt, Homo sapiens
gcaagaaacguuagcaaau

SEQ ID NO: 128987 - RNA, 19 nt, Homo sapiens
cagaugguuuccacauuua

SEQ ID NO: 128988 - RNA, 19 nt, Homo sapiens
caaaugaucccacgucaau

SEQ ID NO: 128989 - RNA, 19 nt, Homo sapiens
auacuacaguugcucauua

SEQ ID NO: 128990 - RNA, 19 nt, Homo sapiens
gaagacuccuuugugauga

SEQ ID NO: 128991 - RNA, 19 nt, Homo sapiens
ggaacagguuuggaaauga

SEQ ID NO: 128992 - RNA, 19 nt, Homo sapiens
caacuaugauguuaaccaa

SEQ ID NO: 128993 - RNA, 19 nt, Homo sapiens
ccaaagauuucauaagaag

SEQ ID NO: 128994 - RNA, 19 nt, Homo sapiens
gcaaauguauccgcuguca

SEQ ID NO: 128995 - RNA, 19 nt, Homo sapiens
ggaagcaacugaauuucuc

SEQ ID NO: 128996 - RNA, 19 nt, Homo sapiens
guagaagguugacacaguu

SEQ ID NO: 128997 - RNA, 19 nt, Homo sapiens
gauggucauugcaguuuaa

SEQ ID NO: 128998 - RNA, 19 nt, Homo sapiens
gcaaaguacaacaccaaua

SEQ ID NO: 128999 - RNA, 19 nt, Homo sapiens
ggaagacuccuuugugaug

SEQ ID NO: 129000 - RNA, 19 nt, Homo sapiens
caacaggcacuuaguagaa

SEQ ID NO: 129001 - RNA, 19 nt, Homo sapiens
gguagaagguugacacagu

SEQ ID NO: 129002 - RNA, 19 nt, Homo sapiens
gaagaggguguguuugaaa

SEQ ID NO: 129003 - RNA, 19 nt, Homo sapiens
ccacgucgauaccuugaaa

SEQ ID NO: 129004 - RNA, 19 nt, Homo sapiens
gagcagaacagaucuuuua

SEQ ID NO: 129005 - RNA, 19 nt, Homo sapiens
ggauggucauugcaguuua

SEQ ID NO: 129006 - RNA, 19 nt, Homo sapiens
acacaucguugcugaaaga

SEQ ID NO: 129007 - RNA, 19 nt, Homo sapiens
guuugucgcuccugagaua

SEQ ID NO: 129008 - RNA, 19 nt, Homo sapiens
gugaagaaaugccgugaga

SEQ ID NO: 129009 - RNA, 19 nt, Homo sapiens
gaaggcauccucuguguuc

SEQ ID NO: 129010 - RNA, 19 nt, Homo sapiens
gcacguagcaggucuccuu

SEQ ID NO: 129011 - RNA, 19 nt, Homo sapiens
ggucaaggauccaaagaag

SEQ ID NO: 129012 - RNA, 19 nt, Homo sapiens
gucgauaccuugaaauuuc

SEQ ID NO: 129013 - RNA, 19 nt, Homo sapiens
gccaaagauuucauaagaa

SEQ ID NO: 129014 - RNA, 19 nt, Homo sapiens
agccaaagauuucauaaga

SEQ ID NO: 129015 - RNA, 19 nt, Homo sapiens
caugaaaccuacacacugu

SEQ ID NO: 129016 - RNA, 19 nt, Homo sapiens
gaucaguguuguugcucua

SEQ ID NO: 129017 - RNA, 19 nt, Homo sapiens
gcaagacuucgaaaggaua

SEQ ID NO: 129018 - RNA, 19 nt, Homo sapiens
cgacaaggacggacacauu

SEQ ID NO: 129019 - RNA, 19 nt, Homo sapiens
gauccugguuucauaacuu

SEQ ID NO: 129020 - RNA, 19 nt, Homo sapiens
ggcagaagaucuugcuaga

SEQ ID NO: 129021 - RNA, 19 nt, Homo sapiens
cgagcuguuugacuucuua

SEQ ID NO: 129022 - RNA, 19 nt, Homo sapiens
aaacguggaugauuacuac

SEQ ID NO: 129023 - RNA, 19 nt, Homo sapiens
uguagaaucucucaagugu

SEQ ID NO: 129024 - RNA, 19 nt, Homo sapiens
gaacaucaagaaccgagaa

SEQ ID NO: 129025 - RNA, 19 nt, Homo sapiens
acagagaccuauguaagaa

SEQ ID NO: 129026 - RNA, 19 nt, Homo sapiens
cagaagaggguguguuuga

SEQ ID NO: 129027 - RNA, 19 nt, Homo sapiens
gaggcgaguuuggauauga

SEQ ID NO: 129028 - RNA, 19 nt, Homo sapiens
acaauccguucgcuugaua

SEQ ID NO: 129029 - RNA, 19 nt, Homo sapiens
gaagguugacacaguugua

SEQ ID NO: 129030 - RNA, 19 nt, Homo sapiens
gcaacagcggcaccucuua

SEQ ID NO: 129031 - RNA, 19 nt, Homo sapiens
auacgaagccagauuguuu

SEQ ID NO: 129032 - RNA, 19 nt, Homo sapiens
gugaggagccgcagcauga

SEQ ID NO: 129033 - RNA, 19 nt, Homo sapiens
gcugcuggcugugggaaua

SEQ ID NO: 129034 - RNA, 19 nt, Homo sapiens
gcgaugauacucuggauga

SEQ ID NO: 129035 - RNA, 19 nt, Homo sapiens
agaggaagcaacugaauuu

SEQ ID NO: 129036 - RNA, 19 nt, Homo sapiens
gggaacauguccuaauucu

SEQ ID NO: 129037 - RNA, 19 nt, Homo sapiens
gagaucaacaucaugcaaa

SEQ ID NO: 129038 - RNA, 19 nt, Homo sapiens
caaaggacaugaagguacu

SEQ ID NO: 129039 - RNA, 19 nt, Homo sapiens
ugaaagagauuaggaacag

SEQ ID NO: 129040 - RNA, 19 nt, Homo sapiens
ccuaugagauccagcugaa

SEQ ID NO: 129041 - RNA, 19 nt, Homo sapiens
uagaagagcccuaugagau

SEQ ID NO: 129042 - RNA, 19 nt, Homo sapiens
ugaauggaguuggcgauuu

SEQ ID NO: 129043 - RNA, 19 nt, Homo sapiens
gcuguaacgugaacaucaa

SEQ ID NO: 129044 - RNA, 19 nt, Homo sapiens
ggagaaauucaagaaguuu

SEQ ID NO: 129045 - RNA, 19 nt, Homo sapiens
caaagaagagaaugacaau

SEQ ID NO: 129046 - RNA, 19 nt, Homo sapiens
gaagaggaagcaacugaau

SEQ ID NO: 129047 - RNA, 19 nt, Homo sapiens
ccagugcccuagccaaaga

SEQ ID NO: 129048 - RNA, 19 nt, Homo sapiens
gcaacugaauuucucaaac

SEQ ID NO: 129049 - RNA, 19 nt, Homo sapiens
gagaagcauguaauguuaa

SEQ ID NO: 129050 - RNA, 19 nt, Homo sapiens
uuccucagcuuaucucuuu

SEQ ID NO: 129051 - RNA, 19 nt, Homo sapiens
cgaaaucaucugcaagaaa

SEQ ID NO: 129052 - RNA, 19 nt, Homo sapiens
gaagucccuugucccaguu

SEQ ID NO: 129053 - RNA, 19 nt, Homo sapiens
gaaaaccacccuuguagaa

SEQ ID NO: 129054 - RNA, 19 nt, Homo sapiens
ugacguggcucaaguuacu

SEQ ID NO: 129055 - RNA, 19 nt, Homo sapiens
gaaguuugcagcccggaaa

SEQ ID NO: 129056 - RNA, 19 nt, Homo sapiens
agagaccuauguaagaauu

SEQ ID NO: 129057 - RNA, 19 nt, Homo sapiens
guuguugucuuuagucuag

SEQ ID NO: 129058 - RNA, 19 nt, Homo sapiens
aaaccacccuuguagaauc

SEQ ID NO: 129059 - RNA, 19 nt, Homo sapiens
gaacauuccuggauuaagg

SEQ ID NO: 129060 - RNA, 19 nt, Homo sapiens
gaaucaagcucaucgacuu

SEQ ID NO: 129061 - RNA, 19 nt, Homo sapiens
gcaaguagccuccgagaug

SEQ ID NO: 129062 - RNA, 19 nt, Homo sapiens
ggaggaccauuaugagaug

SEQ ID NO: 129063 - RNA, 19 nt, Homo sapiens
ccacgcgucugaaggagua

SEQ ID NO: 129064 - RNA, 19 nt, Homo sapiens
cagccaaguucaucaagaa

SEQ ID NO: 129065 - RNA, 19 nt, Homo sapiens
cagagauugugaacuauga

SEQ ID NO: 129066 - RNA, 19 nt, Homo sapiens
gcagccaaguucaucaaga

SEQ ID NO: 129067 - RNA, 19 nt, Homo sapiens
gaggaguacuucagcaaca

SEQ ID NO: 129068 - RNA, 19 nt, Homo sapiens
ggacguggaggaccauuau

SEQ ID NO: 129069 - RNA, 19 nt, Homo sapiens
ggacggggcugcuucucua

SEQ ID NO: 129070 - RNA, 19 nt, Homo sapiens
ggaguacgcagccaaguuc

SEQ ID NO: 129071 - RNA, 19 nt, Homo sapiens
caacagcuacgccgacuuc

SEQ ID NO: 129072 - RNA, 19 nt, Homo sapiens
gagccaggcccguaaguuc

SEQ ID NO: 129073 - RNA, 19 nt, Homo sapiens
gaucccaagcggagaauga

SEQ ID NO: 129074 - RNA, 19 nt, Homo sapiens
guaguugcacggacaauuc

SEQ ID NO: 129075 - RNA, 19 nt, Homo sapiens
uucacuaccugcacucuaa

SEQ ID NO: 129076 - RNA, 19 nt, Homo sapiens
ucaugcugcuggacaagaa

SEQ ID NO: 129077 - RNA, 19 nt, Homo sapiens
caacaucucagccgugaac

SEQ ID NO: 129078 - RNA, 19 nt, Homo sapiens
ccccagagauugugaacua

SEQ ID NO: 129079 - RNA, 19 nt, Homo sapiens
gaaggaguacaccaucaag

SEQ ID NO: 129080 - RNA, 19 nt, Homo sapiens
ccacccaguuccucaagca

SEQ ID NO: 129081 - RNA, 19 nt, Homo sapiens
gcggggagcucuuugacuu

SEQ ID NO: 129082 - RNA, 19 nt, Homo sapiens
ucaagucgcacuccagcuu

SEQ ID NO: 129083 - RNA, 19 nt, Homo sapiens
gccggcugcucgucaaaga

SEQ ID NO: 129084 - RNA, 19 nt, Homo sapiens
aggagacgcucaccaacau

SEQ ID NO: 129085 - RNA, 19 nt, Homo sapiens
ucucagccgugaacuacga

SEQ ID NO: 129086 - RNA, 19 nt, Homo sapiens
ugaaggaguacaccaucaa

SEQ ID NO: 129087 - RNA, 19 nt, Homo sapiens
guacgcagccaaguucauc

SEQ ID NO: 129088 - RNA, 19 nt, Homo sapiens
ggagccaggcccguaaguu

SEQ ID NO: 129089 - RNA, 19 nt, Homo sapiens
ccagagauugugaacuaug

SEQ ID NO: 129090 - RNA, 19 nt, Homo sapiens
gguaguugcacggacaauu

SEQ ID NO: 129091 - RNA, 19 nt, Homo sapiens
aaagaucccaagcggagaa

SEQ ID NO: 129092 - RNA, 19 nt, Homo sapiens
guggaggaccauuaugaga

SEQ ID NO: 129093 - RNA, 19 nt, Homo sapiens
cuaagcgcaucgcacacuu

SEQ ID NO: 129094 - RNA, 19 nt, Homo sapiens
cacgacaucuucgagaaca

SEQ ID NO: 129095 - RNA, 19 nt, Homo sapiens
cugaaggaguacaccauca

SEQ ID NO: 129096 - RNA, 19 nt, Homo sapiens
ucgcacacuuugaccugaa

SEQ ID NO: 129097 - RNA, 19 nt, Homo sapiens
uaagcgcaucgcacacuuu

SEQ ID NO: 129098 - RNA, 19 nt, Homo sapiens
gaacauccugcgggagauc

SEQ ID NO: 129099 - RNA, 19 nt, Homo sapiens
cgaaugcagcccugguuca

SEQ ID NO: 129100 - RNA, 19 nt, Homo sapiens
caggagacgcucaccaaca

SEQ ID NO: 129101 - RNA, 19 nt, Homo sapiens
cggcaucgcgcacaagauc

SEQ ID NO: 129102 - RNA, 19 nt, Homo sapiens
gugcccaacccacgaauca

SEQ ID NO: 129103 - RNA, 19 nt, Homo sapiens
gcgcaucgcacacuuugac

SEQ ID NO: 129104 - RNA, 19 nt, Homo sapiens
gcacgacaucuucgagaac

SEQ ID NO: 129105 - RNA, 19 nt, Homo sapiens
acgcuggccuucaccuuca

SEQ ID NO: 129106 - RNA, 19 nt, Homo sapiens
ugcacgacaucuucgagaa

SEQ ID NO: 129107 - RNA, 19 nt, Homo sapiens
aggagaaggaggccuggua

SEQ ID NO: 129108 - RNA, 19 nt, Homo sapiens
caucucagccgugaacuac

SEQ ID NO: 129109 - RNA, 19 nt, Homo sapiens
gcaagcagaugguuaaauu

SEQ ID NO: 129110 - RNA, 19 nt, Homo sapiens
gaaggaagagcuacuguua

SEQ ID NO: 129111 - RNA, 19 nt, Homo sapiens
ccaaacgacucacuccuua

SEQ ID NO: 129112 - RNA, 19 nt, Homo sapiens
gucaggagcucaaagaaua

SEQ ID NO: 129113 - RNA, 19 nt, Homo sapiens
uaaccaggauacaagauua

SEQ ID NO: 129114 - RNA, 19 nt, Homo sapiens
ccaaacaguccaagucuua

SEQ ID NO: 129115 - RNA, 19 nt, Homo sapiens
gagaggagaagaaauauug

SEQ ID NO: 129116 - RNA, 19 nt, Homo sapiens
gaucugagcacaccaaaug

SEQ ID NO: 129117 - RNA, 19 nt, Homo sapiens
ggagccaacucuaagacua

SEQ ID NO: 129118 - RNA, 19 nt, Homo sapiens
gaucuuaggacaucaacua

SEQ ID NO: 129119 - RNA, 19 nt, Homo sapiens
gguagcaucugaaauuuua

SEQ ID NO: 129120 - RNA, 19 nt, Homo sapiens
aaagaaagccacacuuauu

SEQ ID NO: 129121 - RNA, 19 nt, Homo sapiens
caugagaggagaagaaaua

SEQ ID NO: 129122 - RNA, 19 nt, Homo sapiens
gaaggaggagccaauguuu

SEQ ID NO: 129123 - RNA, 19 nt, Homo sapiens
gcuguugggucauuuggua

SEQ ID NO: 129124 - RNA, 19 nt, Homo sapiens
aagcagagcuaaagggaaa

SEQ ID NO: 129125 - RNA, 19 nt, Homo sapiens
ucaaaggacuucaagaaag

SEQ ID NO: 129126 - RNA, 19 nt, Homo sapiens
uaaauuugcugccaacauc

SEQ ID NO: 129127 - RNA, 19 nt, Homo sapiens
gcaagaaggagaagaggaa

SEQ ID NO: 129128 - RNA, 19 nt, Homo sapiens
agagagagcuuuacaucau

SEQ ID NO: 129129 - RNA, 19 nt, Homo sapiens
gcuguaagaccuuucuaua

SEQ ID NO: 129130 - RNA, 19 nt, Homo sapiens
ccacagcuauauaagcaaa

SEQ ID NO: 129131 - RNA, 19 nt, Homo sapiens
uagaagguguugugagaaa

SEQ ID NO: 129132 - RNA, 19 nt, Homo sapiens
gcaagcaagcagaugguua

SEQ ID NO: 129133 - RNA, 19 nt, Homo sapiens
cuucagacaugcaucagua

SEQ ID NO: 129134 - RNA, 19 nt, Homo sapiens
uagggaagcuggagucgaa

SEQ ID NO: 129135 - RNA, 19 nt, Homo sapiens
caaaggacuucaagaaagg

SEQ ID NO: 129136 - RNA, 19 nt, Homo sapiens
caagcaagcagaugguuaa

SEQ ID NO: 129137 - RNA, 19 nt, Homo sapiens
caugugagccauucaaauu

SEQ ID NO: 129138 - RNA, 19 nt, Homo sapiens
ggcggaagauuaugcuaaa

SEQ ID NO: 129139 - RNA, 19 nt, Homo sapiens
gauacaagauuagacaaca

SEQ ID NO: 129140 - RNA, 19 nt, Homo sapiens
caguauagguucguuuaaa

SEQ ID NO: 129141 - RNA, 19 nt, Homo sapiens
gaagaggaaggaagagcua

SEQ ID NO: 129142 - RNA, 19 nt, Homo sapiens
gcacuagaauaaauuugca

SEQ ID NO: 129143 - RNA, 19 nt, Homo sapiens
gagagagcuuuacaucaug

SEQ ID NO: 129144 - RNA, 19 nt, Homo sapiens
ggaagauuaugcuaaagag

SEQ ID NO: 129145 - RNA, 19 nt, Homo sapiens
guuagagacuugacaauac

SEQ ID NO: 129146 - RNA, 19 nt, Homo sapiens
gaauaaacaguucccaugu

SEQ ID NO: 129147 - RNA, 19 nt, Homo sapiens
auaaacaguucccauguga

SEQ ID NO: 129148 - RNA, 19 nt, Homo sapiens
uguagaagguguugugaga

SEQ ID NO: 129149 - RNA, 19 nt, Homo sapiens
gcuaacagagagagcuuua

SEQ ID NO: 129150 - RNA, 19 nt, Homo sapiens
guccaagucuuacgauaug

SEQ ID NO: 129151 - RNA, 19 nt, Homo sapiens
gguuagagacuugacaaua

SEQ ID NO: 129152 - RNA, 19 nt, Homo sapiens
gaaaagcuguugggucauu

SEQ ID NO: 129153 - RNA, 19 nt, Homo sapiens
gaaguuauggaagaaauug

SEQ ID NO: 129154 - RNA, 19 nt, Homo sapiens
ccacgaaguuauggaagaa

SEQ ID NO: 129155 - RNA, 19 nt, Homo sapiens
gaagauuuaugugaucagu

SEQ ID NO: 129156 - RNA, 19 nt, Homo sapiens
acagcaagacguugaguua

SEQ ID NO: 129157 - RNA, 19 nt, Homo sapiens
aaagcuaaacuacugguua

SEQ ID NO: 129158 - RNA, 19 nt, Homo sapiens
gcucaaagaauacaugauc

SEQ ID NO: 129159 - RNA, 19 nt, Homo sapiens
caacagagucauugaucuu

SEQ ID NO: 129160 - RNA, 19 nt, Homo sapiens
guacacagcaagacguuga

SEQ ID NO: 129161 - RNA, 19 nt, Homo sapiens
gggaaacagugcuucuuag

SEQ ID NO: 129162 - RNA, 19 nt, Homo sapiens
gcaaggcccuaaaauauca

SEQ ID NO: 129163 - RNA, 19 nt, Homo sapiens
gaaagccacacuuauucuu

SEQ ID NO: 129164 - RNA, 19 nt, Homo sapiens
aaauauccauuggcuguaa

SEQ ID NO: 129165 - RNA, 19 nt, Homo sapiens
ccgagaaacuuuaauuaac

SEQ ID NO: 129166 - RNA, 19 nt, Homo sapiens
cagguagcaucugaaauuu

SEQ ID NO: 129167 - RNA, 19 nt, Homo sapiens
cuccuuaaauucacacuuu

SEQ ID NO: 129168 - RNA, 19 nt, Homo sapiens
guucagaagauuuauguga

SEQ ID NO: 129169 - RNA, 19 nt, Homo sapiens
gcaagacguugaguuacau

SEQ ID NO: 129170 - RNA, 19 nt, Homo sapiens
guuagaaaguauucagugu

SEQ ID NO: 129171 - RNA, 19 nt, Homo sapiens
gccuagaaauuauguaaag

SEQ ID NO: 129172 - RNA, 19 nt, Homo sapiens
gaagagcuacuguuaacca

SEQ ID NO: 129173 - RNA, 19 nt, Homo sapiens
aagaauacaugauccucaa

SEQ ID NO: 129174 - RNA, 19 nt, Homo sapiens
agaauauugugaagcauug

SEQ ID NO: 129175 - RNA, 19 nt, Homo sapiens
ggaaauccaaacuccuaaa

SEQ ID NO: 129176 - RNA, 19 nt, Homo sapiens
ugaguuacauguucagaag

SEQ ID NO: 129177 - RNA, 19 nt, Homo sapiens
aaacgacucacuccuuaaa

SEQ ID NO: 129178 - RNA, 19 nt, Homo sapiens
uaccaugccugacccaaga

SEQ ID NO: 129179 - RNA, 19 nt, Homo sapiens
ggaaggaagagcuacuguu

SEQ ID NO: 129180 - RNA, 19 nt, Homo sapiens
gacguugaguuacauguuc

SEQ ID NO: 129181 - RNA, 19 nt, Homo sapiens
gaaacagugcuucuuaguc

SEQ ID NO: 129182 - RNA, 19 nt, Homo sapiens
acgacucacuccuuaaauu

SEQ ID NO: 129183 - RNA, 19 nt, Homo sapiens
uaacagagagagcuuuaca

SEQ ID NO: 129184 - RNA, 19 nt, Homo sapiens
ggaaacagugcuucuuagu

SEQ ID NO: 129185 - RNA, 19 nt, Homo sapiens
gugcaagaguucauacaag

SEQ ID NO: 129186 - RNA, 19 nt, Homo sapiens
auucacacuuugccacuua

SEQ ID NO: 129187 - RNA, 19 nt, Homo sapiens
guaagaccuuucuauacca

SEQ ID NO: 129188 - RNA, 19 nt, Homo sapiens
ucagaagauuuaugugauc

SEQ ID NO: 129189 - RNA, 19 nt, Homo sapiens
agacaugcaucaguaggaa

SEQ ID NO: 129190 - RNA, 19 nt, Homo sapiens
uuucugggauugcauaaug

SEQ ID NO: 129191 - RNA, 19 nt, Homo sapiens
gaagauuaugcuaaagaga

SEQ ID NO: 129192 - RNA, 19 nt, Homo sapiens
gcagaugguuaaauuugcu

SEQ ID NO: 129193 - RNA, 19 nt, Homo sapiens
ggcauaucauggaaaauua

SEQ ID NO: 129194 - RNA, 19 nt, Homo sapiens
gcuaaagagagauauggaa

SEQ ID NO: 129195 - RNA, 19 nt, Homo sapiens
aauaaacaguucccaugug

SEQ ID NO: 129196 - RNA, 19 nt, Homo sapiens
ugacaccaugguacaaaua

SEQ ID NO: 129197 - RNA, 19 nt, Homo sapiens
gagcauuguggauguagaa

SEQ ID NO: 129198 - RNA, 19 nt, Homo sapiens
uaauuggcauaucauggaa

SEQ ID NO: 129199 - RNA, 19 nt, Homo sapiens
gagcuuuacaucauggaaa

SEQ ID NO: 129200 - RNA, 19 nt, Homo sapiens
uuagagacuugacaauaca

SEQ ID NO: 129201 - RNA, 19 nt, Homo sapiens
ccacgcagcgcaagaguca

SEQ ID NO: 129202 - RNA, 19 nt, Homo sapiens
gagcggaagacucuaauac

SEQ ID NO: 129203 - RNA, 19 nt, Homo sapiens
ugaaggaggagccaauguu

SEQ ID NO: 129204 - RNA, 19 nt, Homo sapiens
cagaagauuuaugugauca

SEQ ID NO: 129205 - RNA, 19 nt, Homo sapiens
guucauacaagcagagcua

SEQ ID NO: 129206 - RNA, 19 nt, Homo sapiens
ugagaaaagugaaucagaa

SEQ ID NO: 129207 - RNA, 19 nt, Homo sapiens
aagcagaugguuaaauuug

SEQ ID NO: 129208 - RNA, 19 nt, Homo sapiens
acaguaaacguuaagaguu

SEQ ID NO: 129209 - RNA, 19 nt, Homo sapiens
cuacagaucuccaaugaaa

SEQ ID NO: 129210 - RNA, 19 nt, Homo sapiens
gcuacaagcuggagaauga

SEQ ID NO: 129211 - RNA, 19 nt, Homo sapiens
ggaaacagcuauguggaaa

SEQ ID NO: 129212 - RNA, 19 nt, Homo sapiens
ggaguuggaucucucagaa

SEQ ID NO: 129213 - RNA, 19 nt, Homo sapiens
gagcaggaauucugaaauc

SEQ ID NO: 129214 - RNA, 19 nt, Homo sapiens
gaucucaucuacaacuuug

SEQ ID NO: 129215 - RNA, 19 nt, Homo sapiens
gagcaggcauggucucuuc

SEQ ID NO: 129216 - RNA, 19 nt, Homo sapiens
ccacacaccucuccuugga

SEQ ID NO: 129217 - RNA, 19 nt, Homo sapiens
cagccaagcucuaugucua

SEQ ID NO: 129218 - RNA, 19 nt, Homo sapiens
ggaauaacccucccacaca

SEQ ID NO: 129219 - RNA, 19 nt, Homo sapiens
ucaaugagcucugcacugu

SEQ ID NO: 129220 - RNA, 19 nt, Homo sapiens
gaucagggccauuaggaaa

SEQ ID NO: 129221 - RNA, 19 nt, Homo sapiens
gggauaacauuuggaggaa

SEQ ID NO: 129222 - RNA, 19 nt, Homo sapiens
ggcauggucucuucuacuu

SEQ ID NO: 129223 - RNA, 19 nt, Homo sapiens
agacggacauuuccucuuc

SEQ ID NO: 129224 - RNA, 19 nt, Homo sapiens
aaacaaaggacgcauagug

SEQ ID NO: 129225 - RNA, 19 nt, Homo sapiens
cacuacagaucuccaauga

SEQ ID NO: 129226 - RNA, 19 nt, Homo sapiens
ggacgaagaggaagaagca

SEQ ID NO: 129227 - RNA, 19 nt, Homo sapiens
caggaugccuuccgagaug

SEQ ID NO: 129228 - RNA, 19 nt, Homo sapiens
gcucugcacuguucucaag

SEQ ID NO: 129229 - RNA, 19 nt, Homo sapiens
cauagugucaccaucguua

SEQ ID NO: 129230 - RNA, 19 nt, Homo sapiens
gaaccuggcaaacagauca

SEQ ID NO: 129231 - RNA, 19 nt, Homo sapiens
gagguuaacaggcgcauug

SEQ ID NO: 129232 - RNA, 19 nt, Homo sapiens
caucguuacugucagaaga

SEQ ID NO: 129233 - RNA, 19 nt, Homo sapiens
ggaggaggaggaagaagaa

SEQ ID NO: 129234 - RNA, 19 nt, Homo sapiens
ggaugaugaugacgaagau

SEQ ID NO: 129235 - RNA, 19 nt, Homo sapiens
gaagggauggacuaagcua

SEQ ID NO: 129236 - RNA, 19 nt, Homo sapiens
ggucagugcaugagaagaa

SEQ ID NO: 129237 - RNA, 19 nt, Homo sapiens
gaaccuggaaccuggcaaa

SEQ ID NO: 129238 - RNA, 19 nt, Homo sapiens
gcugccaccucacagauga

SEQ ID NO: 129239 - RNA, 19 nt, Homo sapiens
augagaagcuguucgaaga

SEQ ID NO: 129240 - RNA, 19 nt, Homo sapiens
gaaggugggaagcagauga

SEQ ID NO: 129241 - RNA, 19 nt, Homo sapiens
aaaggucagugcaugagaa

SEQ ID NO: 129242 - RNA, 19 nt, Homo sapiens
gcuagagauugaagcuuug

SEQ ID NO: 129243 - RNA, 19 nt, Homo sapiens
ggaagaaagcccugugucu

SEQ ID NO: 129244 - RNA, 19 nt, Homo sapiens
aaugagcccucugggaaua

SEQ ID NO: 129245 - RNA, 19 nt, Homo sapiens
gcccuucaccacugucuua

SEQ ID NO: 129246 - RNA, 19 nt, Homo sapiens
ucuuugagcuagagauuga

SEQ ID NO: 129247 - RNA, 19 nt, Homo sapiens
gaagaagcagcagcaggua

SEQ ID NO: 129248 - RNA, 19 nt, Homo sapiens
ggugagggcccuaguggaa

SEQ ID NO: 129249 - RNA, 19 nt, Homo sapiens
gcgacuaugugagcugaaa

SEQ ID NO: 129250 - RNA, 19 nt, Homo sapiens
ggaaggagaagaagcaaac

SEQ ID NO: 129251 - RNA, 19 nt, Homo sapiens
gagaagcuguucgaagagu

SEQ ID NO: 129252 - RNA, 19 nt, Homo sapiens
caaaggacgcauaguguca

SEQ ID NO: 129253 - RNA, 19 nt, Homo sapiens
acuaucagauccuguguug

SEQ ID NO: 129254 - RNA, 19 nt, Homo sapiens
ggagcgacgucaccucgau

SEQ ID NO: 129255 - RNA, 19 nt, Homo sapiens
aaugagcucugcacuguuc

SEQ ID NO: 129256 - RNA, 19 nt, Homo sapiens
gaagaagcaaacaggauca

SEQ ID NO: 129257 - RNA, 19 nt, Homo sapiens
gagaagaagcaaacaggau

SEQ ID NO: 129258 - RNA, 19 nt, Homo sapiens
ucaccacugucuuagagaa

SEQ ID NO: 129259 - RNA, 19 nt, Homo sapiens
gcuggaugaugaugacgaa

SEQ ID NO: 129260 - RNA, 19 nt, Homo sapiens
ugaaagcaauggagaacag

SEQ ID NO: 129261 - RNA, 19 nt, Homo sapiens
acaaugcgauccagaagag

SEQ ID NO: 129262 - RNA, 19 nt, Homo sapiens
ugaggagagugaugaggaa

SEQ ID NO: 129263 - RNA, 19 nt, Homo sapiens
ggcggcagauccagcguuu

SEQ ID NO: 129264 - RNA, 19 nt, Homo sapiens
gcagcaacgugcccacucu

SEQ ID NO: 129265 - RNA, 19 nt, Homo sapiens
gugggaagcagaugacuga

SEQ ID NO: 129266 - RNA, 19 nt, Homo sapiens
ggagagugaugaggaagag

SEQ ID NO: 129267 - RNA, 19 nt, Homo sapiens
ugagacagaugacgaagac

SEQ ID NO: 129268 - RNA, 19 nt, Homo sapiens
ucaggaggaugaugaagag

SEQ ID NO: 129269 - RNA, 19 nt, Homo sapiens
aguuggaucucucagaauu

SEQ ID NO: 129270 - RNA, 19 nt, Homo sapiens
gggauggacuaagcuaauc

SEQ ID NO: 129271 - RNA, 19 nt, Homo sapiens
gcaggagggucaggaggau

SEQ ID NO: 129272 - RNA, 19 nt, Homo sapiens
aaacagcuauguggaaagg

SEQ ID NO: 129273 - RNA, 19 nt, Homo sapiens
cgaagacgaugaggagagu

SEQ ID NO: 129274 - RNA, 19 nt, Homo sapiens
gaggucaucuccaaauacg

SEQ ID NO: 129275 - RNA, 19 nt, Homo sapiens
ccucacagaugacuauagg

SEQ ID NO: 129276 - RNA, 19 nt, Homo sapiens
ucaccucgaucucaucuac

SEQ ID NO: 129277 - RNA, 19 nt, Homo sapiens
ccugauaccuucccugacu

SEQ ID NO: 129278 - RNA, 19 nt, Homo sapiens
caacgugcccacucucugu

SEQ ID NO: 129279 - RNA, 19 nt, Homo sapiens
guucgaagaguuccuugaa

SEQ ID NO: 129280 - RNA, 19 nt, Homo sapiens
gcaggcauggucucuucua

SEQ ID NO: 129281 - RNA, 19 nt, Homo sapiens
ugagggcccuaguggaaug

SEQ ID NO: 129282 - RNA, 19 nt, Homo sapiens
caccaucguuacugucaga

SEQ ID NO: 129283 - RNA, 19 nt, Homo sapiens
gcaaaacaaaggacgcaua

SEQ ID NO: 129284 - RNA, 19 nt, Homo sapiens
agaagcagcagcagguaaa

SEQ ID NO: 129285 - RNA, 19 nt, Homo sapiens
ggaggaggaucuggaacag

SEQ ID NO: 129286 - RNA, 19 nt, Homo sapiens
ggaggaggccacagauucu

SEQ ID NO: 129287 - RNA, 19 nt, Homo sapiens
gugaggagggcgagagaaa

SEQ ID NO: 129288 - RNA, 19 nt, Homo sapiens
guucugggauaacauuugg

SEQ ID NO: 129289 - RNA, 19 nt, Homo sapiens
guaaagauggagacaagag

SEQ ID NO: 129290 - RNA, 19 nt, Homo sapiens
ggaggacgaagaggaagaa

SEQ ID NO: 129291 - RNA, 19 nt, Homo sapiens
gaggaggaggccacagauu

SEQ ID NO: 129292 - RNA, 19 nt, Homo sapiens
gaaaaggaguuggaucucu

SEQ ID NO: 129293 - RNA, 19 nt, Homo sapiens
guggucccauuccucuaua

SEQ ID NO: 129294 - RNA, 19 nt, Homo sapiens
gaagcuguucgaagaguuc

SEQ ID NO: 129295 - RNA, 19 nt, Homo sapiens
ccagagcugagacagauga

SEQ ID NO: 129296 - RNA, 19 nt, Homo sapiens
cccgaagccuccuuggauu

SEQ ID NO: 129297 - RNA, 19 nt, Homo sapiens
cguugacccugcacuauca

SEQ ID NO: 129298 - RNA, 19 nt, Homo sapiens
aagaaagcccugugucuca

SEQ ID NO: 129299 - RNA, 19 nt, Homo sapiens
ggaggaggaggaggaagaa

SEQ ID NO: 129300 - RNA, 19 nt, Homo sapiens
ccaccucacagaugacuau

SEQ ID NO: 129301 - RNA, 19 nt, Homo sapiens
aagcugauccgccucuuug

SEQ ID NO: 129302 - RNA, 19 nt, Homo sapiens
ggaucagggccauuaggaa

SEQ ID NO: 129303 - RNA, 19 nt, Homo sapiens
ggaggaggaagaagaagag

SEQ ID NO: 129304 - RNA, 19 nt, Homo sapiens
gcaagaaaugcuacaagcu

SEQ ID NO: 129305 - RNA, 19 nt, Homo sapiens
gcaaaggucagugcaugag

SEQ ID NO: 129306 - RNA, 19 nt, Homo sapiens
ccuggaaccuggcaaacag

SEQ ID NO: 129307 - RNA, 19 nt, Homo sapiens
cuccagagcugagacagau

SEQ ID NO: 129308 - RNA, 19 nt, Homo sapiens
gguggucccauuccucuau

SEQ ID NO: 129309 - RNA, 19 nt, Homo sapiens
ggaaacauuuguaucagua

SEQ ID NO: 129310 - RNA, 19 nt, Homo sapiens
guauugagcuuugcauuua

SEQ ID NO: 129311 - RNA, 19 nt, Homo sapiens
gagaagagacugauaaauu

SEQ ID NO: 129312 - RNA, 19 nt, Homo sapiens
ggugguaucuugucuguuu

SEQ ID NO: 129313 - RNA, 19 nt, Homo sapiens
gcaaauuacugacuuucaa

SEQ ID NO: 129314 - RNA, 19 nt, Homo sapiens
gugcaucgcuuuagaagaa

SEQ ID NO: 129315 - RNA, 19 nt, Homo sapiens
gauaucaguuccauguaua

SEQ ID NO: 129316 - RNA, 19 nt, Homo sapiens
gauaucaguugccuguaua

SEQ ID NO: 129317 - RNA, 19 nt, Homo sapiens
gauaucaguugccuguaua

SEQ ID NO: 129318 - RNA, 19 nt, Homo sapiens
gauaucaguugccuguaua

SEQ ID NO: 129319 - RNA, 19 nt, Homo sapiens
gauaucaguugccuguaua

SEQ ID NO: 129320 - RNA, 19 nt, Homo sapiens
gauaucaguugccuguaua

SEQ ID NO: 129321 - RNA, 19 nt, Homo sapiens
ggauuuguuucguuuguua

SEQ ID NO: 129322 - RNA, 19 nt, Homo sapiens
gaagaaguuuggcaguauu

SEQ ID NO: 129323 - RNA, 19 nt, Homo sapiens
gauaguaggaucacagaua

SEQ ID NO: 129324 - RNA, 19 nt, Homo sapiens
gcauguuguuucuagauua

SEQ ID NO: 129325 - RNA, 19 nt, Homo sapiens
gauauuaagucccuuucaa

SEQ ID NO: 129326 - RNA, 19 nt, Homo sapiens
ggauaucaguuccauguau

SEQ ID NO: 129327 - RNA, 19 nt, Homo sapiens
gaagaggcauguuguuucu

SEQ ID NO: 129328 - RNA, 19 nt, Homo sapiens
agaagagacugauaaauuc

SEQ ID NO: 129329 - RNA, 19 nt, Homo sapiens
gucaguugcuuguauauaa

SEQ ID NO: 129330 - RNA, 19 nt, Homo sapiens
gaugucaguugcuuguaua

SEQ ID NO: 129331 - RNA, 19 nt, Homo sapiens
gauaugaccuuaaggaaaa

SEQ ID NO: 129332 - RNA, 19 nt, Homo sapiens
gcauuucacuucuccaaga

SEQ ID NO: 129333 - RNA, 19 nt, Homo sapiens
ggauaucaguugccuguau

SEQ ID NO: 129334 - RNA, 19 nt, Homo sapiens
ggauaucaguugccuguau

SEQ ID NO: 129335 - RNA, 19 nt, Homo sapiens
ggauaucaguugccuguau

SEQ ID NO: 129336 - RNA, 19 nt, Homo sapiens
ggauaucaguugccuguau

SEQ ID NO: 129337 - RNA, 19 nt, Homo sapiens
ggauaucaguugccuguau

SEQ ID NO: 129338 - RNA, 19 nt, Homo sapiens
caagaaggcuuuauuacac

SEQ ID NO: 129339 - RNA, 19 nt, Homo sapiens
gaacugguguguccaaagg

SEQ ID NO: 129340 - RNA, 19 nt, Homo sapiens
gaaauugaaagcaccauga

SEQ ID NO: 129341 - RNA, 19 nt, Homo sapiens
caguggaacucaauguaua

SEQ ID NO: 129342 - RNA, 19 nt, Homo sapiens
uaaauuccguuguuacuca

SEQ ID NO: 129343 - RNA, 19 nt, Homo sapiens
gaacuggugauguaaagaa

SEQ ID NO: 129344 - RNA, 19 nt, Homo sapiens
caaauaaucgagacugaaa

SEQ ID NO: 129345 - RNA, 19 nt, Homo sapiens
ccucucagcuaucuaguuu

SEQ ID NO: 129346 - RNA, 19 nt, Homo sapiens
gauacugucuuugcauaaa

SEQ ID NO: 129347 - RNA, 19 nt, Homo sapiens
guauauaaccuucucaaug

SEQ ID NO: 129348 - RNA, 19 nt, Homo sapiens
gaaguuuggcaguauuuaa

SEQ ID NO: 129349 - RNA, 19 nt, Homo sapiens
uagaagaaguuuggcagua

SEQ ID NO: 129350 - RNA, 19 nt, Homo sapiens
gagcaaaggagaaaucugu

SEQ ID NO: 129351 - RNA, 19 nt, Homo sapiens
ggaugucaguugcuuguau

SEQ ID NO: 129352 - RNA, 19 nt, Homo sapiens
gaagauauuaagucccuuu

SEQ ID NO: 129353 - RNA, 19 nt, Homo sapiens
ucuuagaacuggugaugua

SEQ ID NO: 129354 - RNA, 19 nt, Homo sapiens
uuaugucacucaaagguua

SEQ ID NO: 129355 - RNA, 19 nt, Homo sapiens
gcagccacguccuuuggua

SEQ ID NO: 129356 - RNA, 19 nt, Homo sapiens
gaaggauacagucuuuaaa

SEQ ID NO: 129357 - RNA, 19 nt, Homo sapiens
ggauauaauacccuucuaa

SEQ ID NO: 129358 - RNA, 19 nt, Homo sapiens
guagcaaugggauauaaua

SEQ ID NO: 129359 - RNA, 19 nt, Homo sapiens
gaauggaaguagcuguaug

SEQ ID NO: 129360 - RNA, 19 nt, Homo sapiens
gaacacaagcauuucacuu

SEQ ID NO: 129361 - RNA, 19 nt, Homo sapiens
ccacguccuuugguaguua

SEQ ID NO: 129362 - RNA, 19 nt, Homo sapiens
ggaugaaacugagauugga

SEQ ID NO: 129363 - RNA, 19 nt, Homo sapiens
cgaaggauacagucuuuaa

SEQ ID NO: 129364 - RNA, 19 nt, Homo sapiens
gccaagccguggaauggua

SEQ ID NO: 129365 - RNA, 19 nt, Homo sapiens
gagcuuugcauuuaugauu

SEQ ID NO: 129366 - RNA, 19 nt, Homo sapiens
ucaguugccuguauauaau

SEQ ID NO: 129367 - RNA, 19 nt, Homo sapiens
ucaguugccuguauauaau

SEQ ID NO: 129368 - RNA, 19 nt, Homo sapiens
ucaguugccuguauauaau

SEQ ID NO: 129369 - RNA, 19 nt, Homo sapiens
ucaguugccuguauauaau

SEQ ID NO: 129370 - RNA, 19 nt, Homo sapiens
ucaguugccuguauauaau

SEQ ID NO: 129371 - RNA, 19 nt, Homo sapiens
cuuaauggcuguaugugaa

SEQ ID NO: 129372 - RNA, 19 nt, Homo sapiens
caugggaaguugcugguuu

SEQ ID NO: 129373 - RNA, 19 nt, Homo sapiens
ccagagaagagacugauaa

SEQ ID NO: 129374 - RNA, 19 nt, Homo sapiens
ucaggucacugcuggauau

SEQ ID NO: 129375 - RNA, 19 nt, Homo sapiens
cagauacauuuccauggua

SEQ ID NO: 129376 - RNA, 19 nt, Homo sapiens
ccaagaaggcuuuauuaca

SEQ ID NO: 129377 - RNA, 19 nt, Homo sapiens
cggaguaucugaaaggaau

SEQ ID NO: 129378 - RNA, 19 nt, Homo sapiens
ggaaguugcugguuuugaa

SEQ ID NO: 129379 - RNA, 19 nt, Homo sapiens
gaucacagauacauuucca

SEQ ID NO: 129380 - RNA, 19 nt, Homo sapiens
cguggagacucuaaguuaa

SEQ ID NO: 129381 - RNA, 19 nt, Homo sapiens
ucaauggcuucuucccuaa

SEQ ID NO: 129382 - RNA, 19 nt, Homo sapiens
caccaugucugcugcaaau

SEQ ID NO: 129383 - RNA, 19 nt, Homo sapiens
ccuacauucuaaagaguua

SEQ ID NO: 129384 - RNA, 19 nt, Homo sapiens
ggauacagucuuuaaacuu

SEQ ID NO: 129385 - RNA, 19 nt, Homo sapiens
ccaagacaaacuaaacuuu

SEQ ID NO: 129386 - RNA, 19 nt, Homo sapiens
aaucgagacugaaagaaug

SEQ ID NO: 129387 - RNA, 19 nt, Homo sapiens
gaaacuguucuucauuaga

SEQ ID NO: 129388 - RNA, 19 nt, Homo sapiens
gaccgaagcauacaaaugg

SEQ ID NO: 129389 - RNA, 19 nt, Homo sapiens
gcuauggauuuguuucguu

SEQ ID NO: 129390 - RNA, 19 nt, Homo sapiens
agaguaagguaaagaagau

SEQ ID NO: 129391 - RNA, 19 nt, Homo sapiens
ccaugacuuuguccauuaa

SEQ ID NO: 129392 - RNA, 19 nt, Homo sapiens
uauuacaccucagaaauug

SEQ ID NO: 129393 - RNA, 19 nt, Homo sapiens
ccacuggggucuaugauuu

SEQ ID NO: 129394 - RNA, 19 nt, Homo sapiens
gggaaacauuuguaucagu

SEQ ID NO: 129395 - RNA, 19 nt, Homo sapiens
ucagcuaucuaguuucaug

SEQ ID NO: 129396 - RNA, 19 nt, Homo sapiens
agaagaaguuuggcaguau

SEQ ID NO: 129397 - RNA, 19 nt, Homo sapiens
ggaccgaagcauacaaaug

SEQ ID NO: 129398 - RNA, 19 nt, Homo sapiens
ccagagcccuuuugcuaua

SEQ ID NO: 129399 - RNA, 19 nt, Homo sapiens
gaaaugcuaaacuuaaugg

SEQ ID NO: 129400 - RNA, 19 nt, Homo sapiens
caaacaguccaaucaguga

SEQ ID NO: 129401 - RNA, 19 nt, Homo sapiens
cugauaaauuccguuguua

SEQ ID NO: 129402 - RNA, 19 nt, Homo sapiens
uacaaauggugguaucuug

SEQ ID NO: 129403 - RNA, 19 nt, Homo sapiens
accaugacuuuguccauua

SEQ ID NO: 129404 - RNA, 19 nt, Homo sapiens
guaguguccucauuuuaua

SEQ ID NO: 129405 - RNA, 19 nt, Homo sapiens
cagaagaggcauguuguuu

SEQ ID NO: 129406 - RNA, 19 nt, Homo sapiens
gggauaguaguuaggauaa

SEQ ID NO: 129407 - RNA, 19 nt, Homo sapiens
ucaguuccauguauacaau

SEQ ID NO: 129408 - RNA, 19 nt, Homo sapiens
gaaagaagugaagauaauc

SEQ ID NO: 129409 - RNA, 19 nt, Homo sapiens
gaaauaugcuucugccuau

SEQ ID NO: 129410 - RNA, 19 nt, Homo sapiens
guauugagcuuugcauuua

SEQ ID NO: 129411 - RNA, 19 nt, Homo sapiens
uacauaagcuucucaauga

SEQ ID NO: 129412 - RNA, 19 nt, Homo sapiens
ggugguaucuugucuguuu

SEQ ID NO: 129413 - RNA, 19 nt, Homo sapiens
gauaguagaaucacagaua

SEQ ID NO: 129414 - RNA, 19 nt, Homo sapiens
gauaucaguugccuguaua

SEQ ID NO: 129415 - RNA, 19 nt, Homo sapiens
gaaauugaaagcacuauga

SEQ ID NO: 129416 - RNA, 19 nt, Homo sapiens
caguggaacucaauauaua

SEQ ID NO: 129417 - RNA, 19 nt, Homo sapiens
gugcaucacuuuagaagaa

SEQ ID NO: 129418 - RNA, 19 nt, Homo sapiens
gaaacucuguuguuacuca

SEQ ID NO: 129419 - RNA, 19 nt, Homo sapiens
ggacuaauccaaacacuga

SEQ ID NO: 129420 - RNA, 19 nt, Homo sapiens
gcaaaggagcuauguugua

SEQ ID NO: 129421 - RNA, 19 nt, Homo sapiens
uagauuagcuggugucuuc

SEQ ID NO: 129422 - RNA, 19 nt, Homo sapiens
gagcugaaguugugccaaa

SEQ ID NO: 129423 - RNA, 19 nt, Homo sapiens
cuaaagagcuacuucuaau

SEQ ID NO: 129424 - RNA, 19 nt, Homo sapiens
gggcaaugcuuaaaucugu

SEQ ID NO: 129425 - RNA, 19 nt, Homo sapiens
gaacuggugauauaaagaa

SEQ ID NO: 129426 - RNA, 19 nt, Homo sapiens
gcuagaauccacacauaua

SEQ ID NO: 129427 - RNA, 19 nt, Homo sapiens
gaugacuacuucaaggaua

SEQ ID NO: 129428 - RNA, 19 nt, Homo sapiens
gagcaaaggagcuauguug

SEQ ID NO: 129429 - RNA, 19 nt, Homo sapiens
ggauaucaguugccuguau

SEQ ID NO: 129430 - RNA, 19 nt, Homo sapiens
cagauaaauuuccauggua

SEQ ID NO: 129431 - RNA, 19 nt, Homo sapiens
gagaaacucuguuguuacu

SEQ ID NO: 129432 - RNA, 19 nt, Homo sapiens
gaacugguguguccaaagg

SEQ ID NO: 129433 - RNA, 19 nt, Homo sapiens
ggaugaaacugagauuaga

SEQ ID NO: 129434 - RNA, 19 nt, Homo sapiens
guacauaagcuucucaaug

SEQ ID NO: 129435 - RNA, 19 nt, Homo sapiens
gagagagucuuuuaacuuu

SEQ ID NO: 129436 - RNA, 19 nt, Homo sapiens
aaacuuggcuguaugucaa

SEQ ID NO: 129437 - RNA, 19 nt, Homo sapiens
cugagaaacucuguuguua

SEQ ID NO: 129438 - RNA, 19 nt, Homo sapiens
caagagggcuuuauuacac

SEQ ID NO: 129439 - RNA, 19 nt, Homo sapiens
acaaacagcuagagcauca

SEQ ID NO: 129440 - RNA, 19 nt, Homo sapiens
gcuguuaacuaccacugua

SEQ ID NO: 129441 - RNA, 19 nt, Homo sapiens
caaaggagcuauguuguac

SEQ ID NO: 129442 - RNA, 19 nt, Homo sapiens
caaccacgaugaauccuau

SEQ ID NO: 129443 - RNA, 19 nt, Homo sapiens
gaagcuucuuugcuagaua

SEQ ID NO: 129444 - RNA, 19 nt, Homo sapiens
uagcuagaauccacacaua

SEQ ID NO: 129445 - RNA, 19 nt, Homo sapiens
gcuauaacauucugacaca

SEQ ID NO: 129446 - RNA, 19 nt, Homo sapiens
gaaugaaaguagcuguaug

SEQ ID NO: 129447 - RNA, 19 nt, Homo sapiens
ccacacauauauauccuau

SEQ ID NO: 129448 - RNA, 19 nt, Homo sapiens
ugaaagcacuaugaauuug

SEQ ID NO: 129449 - RNA, 19 nt, Homo sapiens
gaaacugguucuguguuga

SEQ ID NO: 129450 - RNA, 19 nt, Homo sapiens
guaaaucacacucaaacuu

SEQ ID NO: 129451 - RNA, 19 nt, Homo sapiens
gcuaaaagguuuccacuau

SEQ ID NO: 129452 - RNA, 19 nt, Homo sapiens
gcuauggauuuguuucauu

SEQ ID NO: 129453 - RNA, 19 nt, Homo sapiens
gaacaguacaguauuuaca

SEQ ID NO: 129454 - RNA, 19 nt, Homo sapiens
aaacugagauuagaagcuu

SEQ ID NO: 129455 - RNA, 19 nt, Homo sapiens
guagcaaugggauauaaua

SEQ ID NO: 129456 - RNA, 19 nt, Homo sapiens
uuaagaaugugcuagaguu

SEQ ID NO: 129457 - RNA, 19 nt, Homo sapiens
ggaaauggcccacaaaaga

SEQ ID NO: 129458 - RNA, 19 nt, Homo sapiens
gaauugauguuaggaugga

SEQ ID NO: 129459 - RNA, 19 nt, Homo sapiens
caucaugucuacugcaaau

SEQ ID NO: 129460 - RNA, 19 nt, Homo sapiens
caauaugaccuuaaggaaa

SEQ ID NO: 129461 - RNA, 19 nt, Homo sapiens
agaaugugcuagaguuaaa

SEQ ID NO: 129462 - RNA, 19 nt, Homo sapiens
gagcuuugcauuuaugauu

SEQ ID NO: 129463 - RNA, 19 nt, Homo sapiens
uacaaacggugguaucuug

SEQ ID NO: 129464 - RNA, 19 nt, Homo sapiens
ucaguugccuguauauaau

SEQ ID NO: 129465 - RNA, 19 nt, Homo sapiens
gagucaaaguaguuaguuu

SEQ ID NO: 129466 - RNA, 19 nt, Homo sapiens
caugggaaguugcugguuu

SEQ ID NO: 129467 - RNA, 19 nt, Homo sapiens
uccuagaacuggugauaua

SEQ ID NO: 129468 - RNA, 19 nt, Homo sapiens
ccuccuggcuuaucuaguu

SEQ ID NO: 129469 - RNA, 19 nt, Homo sapiens
gaaguugugccaaaugaau

SEQ ID NO: 129470 - RNA, 19 nt, Homo sapiens
ucagugacuucuucccuaa

SEQ ID NO: 129471 - RNA, 19 nt, Homo sapiens
ggaaguugcugguuuugaa

SEQ ID NO: 129472 - RNA, 19 nt, Homo sapiens
uaagaaugugcuagaguua

SEQ ID NO: 129473 - RNA, 19 nt, Homo sapiens
gcaaugggauauaauaccu

SEQ ID NO: 129474 - RNA, 19 nt, Homo sapiens
ccaagacaaacuaaacuuu

SEQ ID NO: 129475 - RNA, 19 nt, Homo sapiens
gguucuguguugaaauaua

SEQ ID NO: 129476 - RNA, 19 nt, Homo sapiens
ccagagaacagacugagaa

SEQ ID NO: 129477 - RNA, 19 nt, Homo sapiens
caccacaguuucagaaugu

SEQ ID NO: 129478 - RNA, 19 nt, Homo sapiens
gaacgguagcaaugggaua

SEQ ID NO: 129479 - RNA, 19 nt, Homo sapiens
ugugaacaguacaguauuu

SEQ ID NO: 129480 - RNA, 19 nt, Homo sapiens
gagaacagacugagaaacu

SEQ ID NO: 129481 - RNA, 19 nt, Homo sapiens
ugaauccuauaacucagua

SEQ ID NO: 129482 - RNA, 19 nt, Homo sapiens
gagcuacuucuaauuauuc

SEQ ID NO: 129483 - RNA, 19 nt, Homo sapiens
uauuacaccucagaaauug

SEQ ID NO: 129484 - RNA, 19 nt, Homo sapiens
uagggucuauaauuccuua

SEQ ID NO: 129485 - RNA, 19 nt, Homo sapiens
ggucugaauacaaacauuu

SEQ ID NO: 129486 - RNA, 19 nt, Homo sapiens
cugguucuguguugaaaua

SEQ ID NO: 129487 - RNA, 19 nt, Homo sapiens
uggcuuaucuaguuacaug

SEQ ID NO: 129488 - RNA, 19 nt, Homo sapiens
gaagucgggcaaugcuuaa

SEQ ID NO: 129489 - RNA, 19 nt, Homo sapiens
ggucaucacuggauaucag

SEQ ID NO: 129490 - RNA, 19 nt, Homo sapiens
uuaaaucuccagcuuacua

SEQ ID NO: 129491 - RNA, 19 nt, Homo sapiens
gaaagcacuaugaauuugu

SEQ ID NO: 129492 - RNA, 19 nt, Homo sapiens
cagaagagucaaaguaguu

SEQ ID NO: 129493 - RNA, 19 nt, Homo sapiens
uaacuaccacuguaaugaa

SEQ ID NO: 129494 - RNA, 19 nt, Homo sapiens
gcagccacguccuuugguu

SEQ ID NO: 129495 - RNA, 19 nt, Homo sapiens
gcaaugcuuaaaucuguuu

SEQ ID NO: 129496 - RNA, 19 nt, Homo sapiens
ccaccacaguuucagaaug

SEQ ID NO: 129497 - RNA, 19 nt, Homo sapiens
gaaagaagugaagauaauc

SEQ ID NO: 129498 - RNA, 19 nt, Homo sapiens
gugaaagaagugaagauaa

SEQ ID NO: 129499 - RNA, 19 nt, Homo sapiens
gauacugucuuugcauaca

SEQ ID NO: 129500 - RNA, 19 nt, Homo sapiens
gugcuagaguuaaaaguua

SEQ ID NO: 129501 - RNA, 19 nt, Homo sapiens
cgaugaauccuauaacuca

SEQ ID NO: 129502 - RNA, 19 nt, Homo sapiens
uccaaacacugaaacuuau

SEQ ID NO: 129503 - RNA, 19 nt, Homo sapiens
acagauaaauuuccauggu

SEQ ID NO: 129504 - RNA, 19 nt, Homo sapiens
gcagaagauaguagaauca

SEQ ID NO: 129505 - RNA, 19 nt, Homo sapiens
cugauacugucuuugcaua

SEQ ID NO: 129506 - RNA, 19 nt, Homo sapiens
uaaaauauguccagaagag

SEQ ID NO: 129507 - RNA, 19 nt, Homo sapiens
uaucugaagggaauuguuu

SEQ ID NO: 129508 - RNA, 19 nt, Homo sapiens
ucuaaagagcuacuucuaa

SEQ ID NO: 129509 - RNA, 19 nt, Homo sapiens
ggacauagauaaagaagau

SEQ ID NO: 129510 - RNA, 19 nt, Homo sapiens
gaaagcauaugcaaugaau

SEQ ID NO: 129511 - RNA, 19 nt, Homo sapiens
ggagaaagcauaugcaaug

SEQ ID NO: 129512 - RNA, 19 nt, Homo sapiens
caacaugucuccaaggaau

SEQ ID NO: 129513 - RNA, 19 nt, Homo sapiens
ggaaauggacauagauaaa

SEQ ID NO: 129514 - RNA, 19 nt, Homo sapiens
gugcuaagauuaaacacua

SEQ ID NO: 129515 - RNA, 19 nt, Homo sapiens
gaauuugauuggcucauuu

SEQ ID NO: 129516 - RNA, 19 nt, Homo sapiens
gauaaucuuuccucaguau

SEQ ID NO: 129517 - RNA, 19 nt, Homo sapiens
gauaucaacuggagcaauc

SEQ ID NO: 129518 - RNA, 19 nt, Homo sapiens
ggaaagacaccgucaagga

SEQ ID NO: 129519 - RNA, 19 nt, Homo sapiens
ggaauuugauuggcucauu

SEQ ID NO: 129520 - RNA, 19 nt, Homo sapiens
gagaaagcauaugcaauga

SEQ ID NO: 129521 - RNA, 19 nt, Homo sapiens
gcagggcucucccaaguuc

SEQ ID NO: 129522 - RNA, 19 nt, Homo sapiens
ggagaagggagaaagcaua

SEQ ID NO: 129523 - RNA, 19 nt, Homo sapiens
auaaggaccuggagaauuc

SEQ ID NO: 129524 - RNA, 19 nt, Homo sapiens
ggagaauucagaugaguuu

SEQ ID NO: 129525 - RNA, 19 nt, Homo sapiens
gaaagacaccgucaaggau

SEQ ID NO: 129526 - RNA, 19 nt, Homo sapiens
acacggagauccucaaaca

SEQ ID NO: 129527 - RNA, 19 nt, Homo sapiens
ggauuuacaaccagauaua

SEQ ID NO: 129528 - RNA, 19 nt, Homo sapiens
ggagcuaccuauccuuugu

SEQ ID NO: 129529 - RNA, 19 nt, Homo sapiens
ggccucaggugcuguauug

SEQ ID NO: 129530 - RNA, 19 nt, Homo sapiens
gagcaagaaugagaggaaa

SEQ ID NO: 129531 - RNA, 19 nt, Homo sapiens
aaacaccgccugaaacuga

SEQ ID NO: 129532 - RNA, 19 nt, Homo sapiens
gaggaaauggacauagaua

SEQ ID NO: 129533 - RNA, 19 nt, Homo sapiens
gaauggagcaagaaugaga

SEQ ID NO: 129534 - RNA, 19 nt, Homo sapiens
gggaguaccugugccagaa

SEQ ID NO: 129535 - RNA, 19 nt, Homo sapiens
gaaauggacauagauaaag

SEQ ID NO: 129536 - RNA, 19 nt, Homo sapiens
cagaauggagcaagaauga

SEQ ID NO: 129537 - RNA, 19 nt, Homo sapiens
guccacaucuaccuacgua

SEQ ID NO: 129538 - RNA, 19 nt, Homo sapiens
gcguugggcauguuuguua

SEQ ID NO: 129539 - RNA, 19 nt, Homo sapiens
ugaggaggcuucaugagau

SEQ ID NO: 129540 - RNA, 19 nt, Homo sapiens
ucacuccucuacuguaaug

SEQ ID NO: 129541 - RNA, 19 nt, Homo sapiens
ggagagagcgagcgagcaa

SEQ ID NO: 129542 - RNA, 19 nt, Homo sapiens
gcucgcaucauccuacuuu

SEQ ID NO: 129543 - RNA, 19 nt, Homo sapiens
gcugaaacaccgccugaaa

SEQ ID NO: 129544 - RNA, 19 nt, Homo sapiens
gcaugucccucacucucaa

SEQ ID NO: 129545 - RNA, 19 nt, Homo sapiens
aacaacagcugcaccaugu

SEQ ID NO: 129546 - RNA, 19 nt, Homo sapiens
gcucaucucagccacauug

SEQ ID NO: 129547 - RNA, 19 nt, Homo sapiens
gcaggagaccuaccacuca

SEQ ID NO: 129548 - RNA, 19 nt, Homo sapiens
gugcaggugcuaagauuaa

SEQ ID NO: 129549 - RNA, 19 nt, Homo sapiens
gagaagggagaaagcauau

SEQ ID NO: 129550 - RNA, 19 nt, Homo sapiens
uugagggaguugcuucuua

SEQ ID NO: 129551 - RNA, 19 nt, Homo sapiens
gcaaagcacggagagcaaa

SEQ ID NO: 129552 - RNA, 19 nt, Homo sapiens
acucagcaguucaucgaua

SEQ ID NO: 129553 - RNA, 19 nt, Homo sapiens
uugauuggcucauuucaga

SEQ ID NO: 129554 - RNA, 19 nt, Homo sapiens
gugcagguguuuggguaua

SEQ ID NO: 129555 - RNA, 19 nt, Homo sapiens
gaggaggcuuugaccaugu

SEQ ID NO: 129556 - RNA, 19 nt, Homo sapiens
ggacuuuacggcugaguau

SEQ ID NO: 129557 - RNA, 19 nt, Homo sapiens
gggcauguuuguuauuucu

SEQ ID NO: 129558 - RNA, 19 nt, Homo sapiens
gccuugagcuauaucaugu

SEQ ID NO: 129559 - RNA, 19 nt, Homo sapiens
gcaaucaaggucacagaga

SEQ ID NO: 129560 - RNA, 19 nt, Homo sapiens
ggagcaagaaugagaggaa

SEQ ID NO: 129561 - RNA, 19 nt, Homo sapiens
guucaucgauaccaucauc

SEQ ID NO: 129562 - RNA, 19 nt, Homo sapiens
uggaggaaauggacauaga

SEQ ID NO: 129563 - RNA, 19 nt, Homo sapiens
gacaggaagucagggaaug

SEQ ID NO: 129564 - RNA, 19 nt, Homo sapiens
gguauagccugagguucaa

SEQ ID NO: 129565 - RNA, 19 nt, Homo sapiens
ggguauagccugagguuca

SEQ ID NO: 129566 - RNA, 19 nt, Homo sapiens
gcgagcaguucaucagcuu

SEQ ID NO: 129567 - RNA, 19 nt, Homo sapiens
cgucaaggauuuacaacca

SEQ ID NO: 129568 - RNA, 19 nt, Homo sapiens
gaagggagaaagcauaugc

SEQ ID NO: 129569 - RNA, 19 nt, Homo sapiens
cucaguaucugcaagagaa

SEQ ID NO: 129570 - RNA, 19 nt, Homo sapiens
gaggaggcuucaugagauc

SEQ ID NO: 129571 - RNA, 19 nt, Homo sapiens
gcaucauccuacuuuguug

SEQ ID NO: 129572 - RNA, 19 nt, Homo sapiens
gcacccaccugcucaucuc

SEQ ID NO: 129573 - RNA, 19 nt, Homo sapiens
ugagggaguugcuucuuag

SEQ ID NO: 129574 - RNA, 19 nt, Homo sapiens
caacacggagauccucaaa

SEQ ID NO: 129575 - RNA, 19 nt, Homo sapiens
ucacggacauccagaucau

SEQ ID NO: 129576 - RNA, 19 nt, Homo sapiens
ccaaugugccgaggaguuu

SEQ ID NO: 129577 - RNA, 19 nt, Homo sapiens
ugagcuauaucaugugcaa

SEQ ID NO: 129578 - RNA, 19 nt, Homo sapiens
cuaccuauccuuuguggaa

SEQ ID NO: 129579 - RNA, 19 nt, Homo sapiens
caacugacacugccauuuu

SEQ ID NO: 129580 - RNA, 19 nt, Homo sapiens
uauacucacucugucauga

SEQ ID NO: 129581 - RNA, 19 nt, Homo sapiens
ucgagacgguccacaucua

SEQ ID NO: 129582 - RNA, 19 nt, Homo sapiens
gagcaguucaucagcuuug

SEQ ID NO: 129583 - RNA, 19 nt, Homo sapiens
cgccaaagacggacauuga

SEQ ID NO: 129584 - RNA, 19 nt, Homo sapiens
ucucagacgugcagguguu

SEQ ID NO: 129585 - RNA, 19 nt, Homo sapiens
agucacuccucuacuguaa

SEQ ID NO: 129586 - RNA, 19 nt, Homo sapiens
aagacaccgucaaggauuu

SEQ ID NO: 129587 - RNA, 19 nt, Homo sapiens
ugcuacaacuggacucuuu

SEQ ID NO: 129588 - RNA, 19 nt, Homo sapiens
gaagauccgucuccaaaac

SEQ ID NO: 129589 - RNA, 19 nt, Homo sapiens
cuagagagaggacaauuca

SEQ ID NO: 129590 - RNA, 19 nt, Homo sapiens
agagcaaacugcaccuuca

SEQ ID NO: 129591 - RNA, 19 nt, Homo sapiens
aaagacaccgucaaggauu

SEQ ID NO: 129592 - RNA, 19 nt, Homo sapiens
ccaagaggcaguucuacau

SEQ ID NO: 129593 - RNA, 19 nt, Homo sapiens
gcuccucuacuuccuguuu

SEQ ID NO: 129594 - RNA, 19 nt, Homo sapiens
gagcggagcgagcaguuca

SEQ ID NO: 129595 - RNA, 19 nt, Homo sapiens
uauaaggaccuggagaauu

SEQ ID NO: 129596 - RNA, 19 nt, Homo sapiens
caugagauccagauaucaa

SEQ ID NO: 129597 - RNA, 19 nt, Homo sapiens
ggaggaaauggacauagau

SEQ ID NO: 129598 - RNA, 19 nt, Homo sapiens
agcaugaacuggagguuug

SEQ ID NO: 129599 - RNA, 19 nt, Homo sapiens
ggacuuguucuccuguaug

SEQ ID NO: 129600 - RNA, 19 nt, Homo sapiens
cagucggccuugagcuaua

SEQ ID NO: 129601 - RNA, 19 nt, Homo sapiens
cuucaaggucuucagauaa

SEQ ID NO: 129602 - RNA, 19 nt, Homo sapiens
gagcaaacugcaccuucaa

SEQ ID NO: 129603 - RNA, 19 nt, Homo sapiens
ggaggcagagggaguagug

SEQ ID NO: 129604 - RNA, 19 nt, Homo sapiens
gaacuggagguuuguugag

SEQ ID NO: 129605 - RNA, 19 nt, Homo sapiens
caaacagucggaccagaug

SEQ ID NO: 129606 - RNA, 19 nt, Homo sapiens
cagugaugcuccucuuguu

SEQ ID NO: 129607 - RNA, 19 nt, Homo sapiens
aagaggcaguucuacauca

SEQ ID NO: 129608 - RNA, 19 nt, Homo sapiens
cagugucgcugccaaugug

SEQ ID NO: 129609 - RNA, 19 nt, Homo sapiens
gcauuuagcuaguuagaga

SEQ ID NO: 129610 - RNA, 19 nt, Homo sapiens
ggagaaagguggucacagu

SEQ ID NO: 129611 - RNA, 19 nt, Homo sapiens
gacaacaacuaucaccaaa

SEQ ID NO: 129612 - RNA, 19 nt, Homo sapiens
gcacagcaguggccaucuu

SEQ ID NO: 129613 - RNA, 19 nt, Homo sapiens
ucaacuacgugcacuacua

SEQ ID NO: 129614 - RNA, 19 nt, Homo sapiens
gguccaagcucccaauauc

SEQ ID NO: 129615 - RNA, 19 nt, Homo sapiens
ggagaugugugucaacuac

SEQ ID NO: 129616 - RNA, 19 nt, Homo sapiens
gggugccgcuuaaacauuu

SEQ ID NO: 129617 - RNA, 19 nt, Homo sapiens
ccaauaaagcucacacuug

SEQ ID NO: 129618 - RNA, 19 nt, Homo sapiens
ccaggcauuuagcuaguua

SEQ ID NO: 129619 - RNA, 19 nt, Homo sapiens
ggcaccacauuaucaagua

SEQ ID NO: 129620 - RNA, 19 nt, Homo sapiens
gcacguacaacacggaaga

SEQ ID NO: 129621 - RNA, 19 nt, Homo sapiens
ugaaggcccuguacagcuu

SEQ ID NO: 129622 - RNA, 19 nt, Homo sapiens
gggaagcccugacaacaac

SEQ ID NO: 129623 - RNA, 19 nt, Homo sapiens
gagacucgccugggaaauu

SEQ ID NO: 129624 - RNA, 19 nt, Homo sapiens
ccacaacccacuggugaua

SEQ ID NO: 129625 - RNA, 19 nt, Homo sapiens
caggagauccgcauguuga

SEQ ID NO: 129626 - RNA, 19 nt, Homo sapiens
caacaacuaucaccaaaag

SEQ ID NO: 129627 - RNA, 19 nt, Homo sapiens
gagauccgcauguugaaga

SEQ ID NO: 129628 - RNA, 19 nt, Homo sapiens
ccucucagcuccacacaca

SEQ ID NO: 129629 - RNA, 19 nt, Homo sapiens
gaccaggcauuuagcuagu

SEQ ID NO: 129630 - RNA, 19 nt, Homo sapiens
cugaguggcucguguuuca

SEQ ID NO: 129631 - RNA, 19 nt, Homo sapiens
ucacuuuucucaucuguaa

SEQ ID NO: 129632 - RNA, 19 nt, Homo sapiens
ccugggaaauugcuccauu

SEQ ID NO: 129633 - RNA, 19 nt, Homo sapiens
agacucgccugggaaauug

SEQ ID NO: 129634 - RNA, 19 nt, Homo sapiens
gaaccaggacaaucacuac

SEQ ID NO: 129635 - RNA, 19 nt, Homo sapiens
ccaaggauuaccucauuga

SEQ ID NO: 129636 - RNA, 19 nt, Homo sapiens
ugacaacaacuaucaccaa

SEQ ID NO: 129637 - RNA, 19 nt, Homo sapiens
gaggagaugugugucaacu

SEQ ID NO: 129638 - RNA, 19 nt, Homo sapiens
gagcucucauggaauguca

SEQ ID NO: 129639 - RNA, 19 nt, Homo sapiens
ucaacagguucaacaacga

SEQ ID NO: 129640 - RNA, 19 nt, Homo sapiens
ccucaggcauccgcuugua

SEQ ID NO: 129641 - RNA, 19 nt, Homo sapiens
gcacuguccacuuggucua

SEQ ID NO: 129642 - RNA, 19 nt, Homo sapiens
cccaggaggccauccauuu

SEQ ID NO: 129643 - RNA, 19 nt, Homo sapiens
ggaggcaggaccaggcauu

SEQ ID NO: 129644 - RNA, 19 nt, Homo sapiens
cuggagcucucauggaaug

SEQ ID NO: 129645 - RNA, 19 nt, Homo sapiens
gcaccacauuaucaaguac

SEQ ID NO: 129646 - RNA, 19 nt, Homo sapiens
cccuggagcucucauggaa

SEQ ID NO: 129647 - RNA, 19 nt, Homo sapiens
acaacccacuggugauaga

SEQ ID NO: 129648 - RNA, 19 nt, Homo sapiens
gaaggccugacccugcuuu

SEQ ID NO: 129649 - RNA, 19 nt, Homo sapiens
cuaaugagccaauaaagcu

SEQ ID NO: 129650 - RNA, 19 nt, Homo sapiens
gaagcccugacaacaacua

SEQ ID NO: 129651 - RNA, 19 nt, Homo sapiens
ccaggguccuccagauauc

SEQ ID NO: 129652 - RNA, 19 nt, Homo sapiens
gguccaggguccuccagau

SEQ ID NO: 129653 - RNA, 19 nt, Homo sapiens
guacuggugcuacauuaag

SEQ ID NO: 129654 - RNA, 19 nt, Homo sapiens
ggagucagggcugugcuuu

SEQ ID NO: 129655 - RNA, 19 nt, Homo sapiens
ccaggaggccauccauuuc

SEQ ID NO: 129656 - RNA, 19 nt, Homo sapiens
ugggugcccuguugaccua

SEQ ID NO: 129657 - RNA, 19 nt, Homo sapiens
guccaggguccuccagaua

SEQ ID NO: 129658 - RNA, 19 nt, Homo sapiens
caaggcuggcguccuguuu

SEQ ID NO: 129659 - RNA, 19 nt, Homo sapiens
gccaauaaagcucacacuu

SEQ ID NO: 129660 - RNA, 19 nt, Homo sapiens
gcccugacaacaacuauca

SEQ ID NO: 129661 - RNA, 19 nt, Homo sapiens
gagguccaagcucccaaua

SEQ ID NO: 129662 - RNA, 19 nt, Homo sapiens
acguacuggugcuacauua

SEQ ID NO: 129663 - RNA, 19 nt, Homo sapiens
gcuaaugagccaauaaagc

SEQ ID NO: 129664 - RNA, 19 nt, Homo sapiens
caaccgcgacguacugaag

SEQ ID NO: 129665 - RNA, 19 nt, Homo sapiens
aaccggaguugcccucaga

SEQ ID NO: 129666 - RNA, 19 nt, Homo sapiens
caacuacgugcacuacuac

SEQ ID NO: 129667 - RNA, 19 nt, Homo sapiens
ucucauggaaugucagcua

SEQ ID NO: 129668 - RNA, 19 nt, Homo sapiens
ucacuacagcccucacuuc

SEQ ID NO: 129669 - RNA, 19 nt, Homo sapiens
ugaaccaggacaaucacua

SEQ ID NO: 129670 - RNA, 19 nt, Homo sapiens
ggugauagaaggacgaaac

SEQ ID NO: 129671 - RNA, 19 nt, Homo sapiens
gccaggagaccacguacug

SEQ ID NO: 129672 - RNA, 19 nt, Homo sapiens
gaccguggcgagcuugaga

SEQ ID NO: 129673 - RNA, 19 nt, Homo sapiens
ggcaggaccaggcauuuag

SEQ ID NO: 129674 - RNA, 19 nt, Homo sapiens
gaggcaggaccaggcauuu

SEQ ID NO: 129675 - RNA, 19 nt, Homo sapiens
gguccaauccagccuucuu

SEQ ID NO: 129676 - RNA, 19 nt, Homo sapiens
guacuuccaccucaucaac

SEQ ID NO: 129677 - RNA, 19 nt, Homo sapiens
gaucgugaaccaggacaau

SEQ ID NO: 129678 - RNA, 19 nt, Homo sapiens
gcccugcgacuccaagaug

SEQ ID NO: 129679 - RNA, 19 nt, Homo sapiens
cccaaggauuaccucauug

SEQ ID NO: 129680 - RNA, 19 nt, Homo sapiens
agacgaggcggcaaagauc

SEQ ID NO: 129681 - RNA, 19 nt, Homo sapiens
guccgugucucagcaguuc

SEQ ID NO: 129682 - RNA, 19 nt, Homo sapiens
uggaggagaugugugucaa

SEQ ID NO: 129683 - RNA, 19 nt, Homo sapiens
ccuccgggauccacaucuu

SEQ ID NO: 129684 - RNA, 19 nt, Homo sapiens
gguguacacgccagugaug

SEQ ID NO: 129685 - RNA, 19 nt, Homo sapiens
ggaaguucacuaccacaac

SEQ ID NO: 129686 - RNA, 19 nt, Homo sapiens
gaaacccgaccgccucaac

SEQ ID NO: 129687 - RNA, 19 nt, Homo sapiens
acauuaaggagcuuccaaa

SEQ ID NO: 129688 - RNA, 19 nt, Homo sapiens
caaaagacgaggcggcaaa

SEQ ID NO: 129689 - RNA, 19 nt, Homo sapiens
ccaaggucaucuccacacu

SEQ ID NO: 129690 - RNA, 19 nt, Homo sapiens
cagcaguucaccucuguuc

SEQ ID NO: 129691 - RNA, 19 nt, Homo sapiens
uccaggagauccgcauguu

SEQ ID NO: 129692 - RNA, 19 nt, Homo sapiens
gggagugggagaucgugaa

SEQ ID NO: 129693 - RNA, 19 nt, Homo sapiens
gaauuauuagcaccagcuu

SEQ ID NO: 129694 - RNA, 19 nt, Homo sapiens
uagagacucgccugggaaa

SEQ ID NO: 129695 - RNA, 19 nt, Homo sapiens
aggcaggaccaggcauuua

SEQ ID NO: 129696 - RNA, 19 nt, Homo sapiens
ccaggagauccgcauguug

SEQ ID NO: 129697 - RNA, 19 nt, Homo sapiens
ccccaaggauuaccucauu

SEQ ID NO: 129698 - RNA, 19 nt, Homo sapiens
ccagccaggagaccacgua

SEQ ID NO: 129699 - RNA, 19 nt, Homo sapiens
auuccugaguaaacagaua

SEQ ID NO: 129700 - RNA, 19 nt, Homo sapiens
cugggaaauugcuccauuc

SEQ ID NO: 129701 - RNA, 19 nt, Homo sapiens
caaggaagaugccaugaaa

SEQ ID NO: 129702 - RNA, 19 nt, Homo sapiens
ggacagaggcugaguuuga

SEQ ID NO: 129703 - RNA, 19 nt, Homo sapiens
caugaaagcuuacaucaac

SEQ ID NO: 129704 - RNA, 19 nt, Homo sapiens
caacaaaguagaagagcua

SEQ ID NO: 129705 - RNA, 19 nt, Homo sapiens
auacggcucuaacagauua

SEQ ID NO: 129706 - RNA, 19 nt, Homo sapiens
gauaugagagacuggauuu

SEQ ID NO: 129707 - RNA, 19 nt, Homo sapiens
ugacuuuccuugaguaguu

SEQ ID NO: 129708 - RNA, 19 nt, Homo sapiens
gaagaugccaugaaagcuu

SEQ ID NO: 129709 - RNA, 19 nt, Homo sapiens
aagaugccaugaaagcuua

SEQ ID NO: 129710 - RNA, 19 nt, Homo sapiens
caagugggaugccuggaau

SEQ ID NO: 129711 - RNA, 19 nt, Homo sapiens
aagcuuacaucaacaaagu

SEQ ID NO: 129712 - RNA, 19 nt, Homo sapiens
ugaaagggacuuccaagga

SEQ ID NO: 129713 - RNA, 19 nt, Homo sapiens
ccauacggcucuaacagau

SEQ ID NO: 129714 - RNA, 19 nt, Homo sapiens
gagagacuggauuugguua

SEQ ID NO: 129715 - RNA, 19 nt, Homo sapiens
gaaagcuuacaucaacaaa

SEQ ID NO: 129716 - RNA, 19 nt, Homo sapiens
ugccauguguuuauccuaa

SEQ ID NO: 129717 - RNA, 19 nt, Homo sapiens
caaaguagaagagcuaaag

SEQ ID NO: 129718 - RNA, 19 nt, Homo sapiens
caacugugggcgacauaaa

SEQ ID NO: 129719 - RNA, 19 nt, Homo sapiens
guucaucuauggccacuac

SEQ ID NO: 129720 - RNA, 19 nt, Homo sapiens
ccaaggaagaugccaugaa

SEQ ID NO: 129721 - RNA, 19 nt, Homo sapiens
uuaggcaccuuaagaccaa

SEQ ID NO: 129722 - RNA, 19 nt, Homo sapiens
gacagaggcugaguuugag

SEQ ID NO: 129723 - RNA, 19 nt, Homo sapiens
ggauaugagagacuggauu

SEQ ID NO: 129724 - RNA, 19 nt, Homo sapiens
uuacugacuuuccuugagu

SEQ ID NO: 129725 - RNA, 19 nt, Homo sapiens
cuaaaacgauuacugacuu

SEQ ID NO: 129726 - RNA, 19 nt, Homo sapiens
gacuggauuugguuacugu

SEQ ID NO: 129727 - RNA, 19 nt, Homo sapiens
caucuauggccacuacaaa

SEQ ID NO: 129728 - RNA, 19 nt, Homo sapiens
acucaaggcugcucaccau

SEQ ID NO: 129729 - RNA, 19 nt, Homo sapiens
aguagaagagcuaaagaaa

SEQ ID NO: 129730 - RNA, 19 nt, Homo sapiens
gaaagcugcagaggagguu

SEQ ID NO: 129731 - RNA, 19 nt, Homo sapiens
ccaagugggaugccuggaa

SEQ ID NO: 129732 - RNA, 19 nt, Homo sapiens
gcaacugugggcgacauaa

SEQ ID NO: 129733 - RNA, 19 nt, Homo sapiens
gacuuuccuugaguaguuu

SEQ ID NO: 129734 - RNA, 19 nt, Homo sapiens
guuacugugccauguguuu

SEQ ID NO: 129735 - RNA, 19 nt, Homo sapiens
gagacuggauuugguuacu

SEQ ID NO: 129736 - RNA, 19 nt, Homo sapiens
ugaaagcuuacaucaacaa

SEQ ID NO: 129737 - RNA, 19 nt, Homo sapiens
ccaugaaagcuuacaucaa

SEQ ID NO: 129738 - RNA, 19 nt, Homo sapiens
gccaugaaagcuuacauca

SEQ ID NO: 129739 - RNA, 19 nt, Homo sapiens
guagaagagcuaaagaaaa

SEQ ID NO: 129740 - RNA, 19 nt, Homo sapiens
gauuacugacuuuccuuga

SEQ ID NO: 129741 - RNA, 19 nt, Homo sapiens
uuacugugccauguguuua

SEQ ID NO: 129742 - RNA, 19 nt, Homo sapiens
ugagagacuggauuugguu

SEQ ID NO: 129743 - RNA, 19 nt, Homo sapiens
acugugggcgacauaaaua

SEQ ID NO: 129744 - RNA, 19 nt, Homo sapiens
gggcuaaaacgauuacuga

SEQ ID NO: 129745 - RNA, 19 nt, Homo sapiens
uaccguggauggugggaau

SEQ ID NO: 129746 - RNA, 19 nt, Homo sapiens
uauccuaaacugagacaau

SEQ ID NO: 129747 - RNA, 19 nt, Homo sapiens
gaugaggagaugcuguuca

SEQ ID NO: 129748 - RNA, 19 nt, Homo sapiens
ugggacagaggcugaguuu

SEQ ID NO: 129749 - RNA, 19 nt, Homo sapiens
caaggcugcucaccauacg

SEQ ID NO: 129750 - RNA, 19 nt, Homo sapiens
caguuaaaccagcuacuca

SEQ ID NO: 129751 - RNA, 19 nt, Homo sapiens
aaaguagaagagcuaaaga

SEQ ID NO: 129752 - RNA, 19 nt, Homo sapiens
caucaacaaaguagaagag

SEQ ID NO: 129753 - RNA, 19 nt, Homo sapiens
aaguagaagagcuaaagaa

SEQ ID NO: 129754 - RNA, 19 nt, Homo sapiens
gcucaugucuguuaauaaa

SEQ ID NO: 129755 - RNA, 19 nt, Homo sapiens
gcagaggacuugauguuca

SEQ ID NO: 129756 - RNA, 19 nt, Homo sapiens
ggaaacagcagacuuuaga

SEQ ID NO: 129757 - RNA, 19 nt, Homo sapiens
caacaagccuccagagauc

SEQ ID NO: 129758 - RNA, 19 nt, Homo sapiens
ggaagaaggcccuggauga

SEQ ID NO: 129759 - RNA, 19 nt, Homo sapiens
gaagagacccacaugaaga

SEQ ID NO: 129760 - RNA, 19 nt, Homo sapiens
ggaggaaacagcagacuuu

SEQ ID NO: 129761 - RNA, 19 nt, Homo sapiens
guccagggcuucagauauu

SEQ ID NO: 129762 - RNA, 19 nt, Homo sapiens
ggaugcagcuguggaaaug

SEQ ID NO: 129763 - RNA, 19 nt, Homo sapiens
gggaaaauaucacuuugua

SEQ ID NO: 129764 - RNA, 19 nt, Homo sapiens
ggaggcagcagcuauuauu

SEQ ID NO: 129765 - RNA, 19 nt, Homo sapiens
gaaggagcagucuaucuuu

SEQ ID NO: 129766 - RNA, 19 nt, Homo sapiens
caagggaguucuucaagca

SEQ ID NO: 129767 - RNA, 19 nt, Homo sapiens
gugcucaugucuguuaaua

SEQ ID NO: 129768 - RNA, 19 nt, Homo sapiens
gagacgcuguugcaaauuc

SEQ ID NO: 129769 - RNA, 19 nt, Homo sapiens
cgaugcagcugacaccauu

SEQ ID NO: 129770 - RNA, 19 nt, Homo sapiens
aagaagagcugcggaagga

SEQ ID NO: 129771 - RNA, 19 nt, Homo sapiens
ggaaagcacaaacuucugu

SEQ ID NO: 129772 - RNA, 19 nt, Homo sapiens
gaaagcacaaacuucugua

SEQ ID NO: 129773 - RNA, 19 nt, Homo sapiens
gcacgaauuuuaaaacaug

SEQ ID NO: 129774 - RNA, 19 nt, Homo sapiens
caaaauacgugcucaucaa

SEQ ID NO: 129775 - RNA, 19 nt, Homo sapiens
uaggagacuuguacaguug

SEQ ID NO: 129776 - RNA, 19 nt, Homo sapiens
gauguacccucgcccuuca

SEQ ID NO: 129777 - RNA, 19 nt, Homo sapiens
ggaagagacccacaugaag

SEQ ID NO: 129778 - RNA, 19 nt, Homo sapiens
gaggaaacagcagacuuua

SEQ ID NO: 129779 - RNA, 19 nt, Homo sapiens
uugaggagcuggagcaaga

SEQ ID NO: 129780 - RNA, 19 nt, Homo sapiens
ggaggaggcagcagcuauu

SEQ ID NO: 129781 - RNA, 19 nt, Homo sapiens
cgacugggcucuguacaca

SEQ ID NO: 129782 - RNA, 19 nt, Homo sapiens
gaggaggcagcagcuauua

SEQ ID NO: 129783 - RNA, 19 nt, Homo sapiens
gaaaugaagcggauuaacc

SEQ ID NO: 129784 - RNA, 19 nt, Homo sapiens
uggcuaagguggcagaguu

SEQ ID NO: 129785 - RNA, 19 nt, Homo sapiens
ugaaggagcagucuaucuu

SEQ ID NO: 129786 - RNA, 19 nt, Homo sapiens
gaaacagcagacuuuagaa

SEQ ID NO: 129787 - RNA, 19 nt, Homo sapiens
acugggcucuguacacaua

SEQ ID NO: 129788 - RNA, 19 nt, Homo sapiens
ccaagaggcgguugaagga

SEQ ID NO: 129789 - RNA, 19 nt, Homo sapiens
gcagcugacaccauugaaa

SEQ ID NO: 129790 - RNA, 19 nt, Homo sapiens
gaagaaggcccuggaugag

SEQ ID NO: 129791 - RNA, 19 nt, Homo sapiens
auaggagacuuguacaguu

SEQ ID NO: 129792 - RNA, 19 nt, Homo sapiens
guggaaaugaagcggauua

SEQ ID NO: 129793 - RNA, 19 nt, Homo sapiens
cagcagcguggaagacaua

SEQ ID NO: 129794 - RNA, 19 nt, Homo sapiens
gauaggagacuuguacagu

SEQ ID NO: 129795 - RNA, 19 nt, Homo sapiens
aagcugcucugccaaaaua

SEQ ID NO: 129796 - RNA, 19 nt, Homo sapiens
uugagacgcuguugcaaau

SEQ ID NO: 129797 - RNA, 19 nt, Homo sapiens
gugccacccuucucaacuu

SEQ ID NO: 129798 - RNA, 19 nt, Homo sapiens
ggaggaagagacccacaug

SEQ ID NO: 129799 - RNA, 19 nt, Homo sapiens
uggagcugcuggcggcuua

SEQ ID NO: 129800 - RNA, 19 nt, Homo sapiens
gaggaagagacccacauga

SEQ ID NO: 129801 - RNA, 19 nt, Homo sapiens
ggagcagucuaucuuuggu

SEQ ID NO: 129802 - RNA, 19 nt, Homo sapiens
ggauuaaccgagagcaguu

SEQ ID NO: 129803 - RNA, 19 nt, Homo sapiens
ggaggaguuugcccaaucg

SEQ ID NO: 129804 - RNA, 19 nt, Homo sapiens
aaggagcagucuaucuuug

SEQ ID NO: 129805 - RNA, 19 nt, Homo sapiens
uaacgggucgugcucaugu

SEQ ID NO: 129806 - RNA, 19 nt, Homo sapiens
gggagcaggccaagaagga

SEQ ID NO: 129807 - RNA, 19 nt, Homo sapiens
ggagcuuucgggacacuuu

SEQ ID NO: 129808 - RNA, 19 nt, Homo sapiens
gggcgaagaugugccugau

SEQ ID NO: 129809 - RNA, 19 nt, Homo sapiens
guugagacgcuguugcaaa

SEQ ID NO: 129810 - RNA, 19 nt, Homo sapiens
acaacaagccuccagagau

SEQ ID NO: 129811 - RNA, 19 nt, Homo sapiens
gaggaggaguuugcccaau

SEQ ID NO: 129812 - RNA, 19 nt, Homo sapiens
ccucaagcuugcagcauca

SEQ ID NO: 129813 - RNA, 19 nt, Homo sapiens
aggaagagacccacaugaa

SEQ ID NO: 129814 - RNA, 19 nt, Homo sapiens
ucacguuuaguaacuguuu

SEQ ID NO: 129815 - RNA, 19 nt, Homo sapiens
cagaggacuugauguucau

SEQ ID NO: 129816 - RNA, 19 nt, Homo sapiens
gcgggcagcugugauguac

SEQ ID NO: 129817 - RNA, 19 nt, Homo sapiens
gucgugcucaugucuguua

SEQ ID NO: 129818 - RNA, 19 nt, Homo sapiens
ucaagcagcaggaaagagu

SEQ ID NO: 129819 - RNA, 19 nt, Homo sapiens
cuucgaggguggugauuag

SEQ ID NO: 129820 - RNA, 19 nt, Homo sapiens
gaggcagcagcuauuauug

SEQ ID NO: 129821 - RNA, 19 nt, Homo sapiens
gguugaaggagcagucuau

SEQ ID NO: 129822 - RNA, 19 nt, Homo sapiens
ggcaccaccuaccagaaga

SEQ ID NO: 129823 - RNA, 19 nt, Homo sapiens
ucaacugggugggcgaaga

SEQ ID NO: 129824 - RNA, 19 nt, Homo sapiens
aaagcacaaacuucuguaa

SEQ ID NO: 129825 - RNA, 19 nt, Homo sapiens
cugacaccauugaaacuga

SEQ ID NO: 129826 - RNA, 19 nt, Homo sapiens
aauacgugcucaucaacug

SEQ ID NO: 129827 - RNA, 19 nt, Homo sapiens
caacugggugggcgaagau

SEQ ID NO: 129828 - RNA, 19 nt, Homo sapiens
guccagauuguagcucuua

SEQ ID NO: 129829 - RNA, 19 nt, Homo sapiens
cccugucgcugagcagaua

SEQ ID NO: 129830 - RNA, 19 nt, Homo sapiens
agaaccagaaggugaugua

SEQ ID NO: 129831 - RNA, 19 nt, Homo sapiens
aaacagcagacuuuagaag

SEQ ID NO: 129832 - RNA, 19 nt, Homo sapiens
uaagguggcagaguucuuc

SEQ ID NO: 129833 - RNA, 19 nt, Homo sapiens
ggggagcucuggugggaaa

SEQ ID NO: 129834 - RNA, 19 nt, Homo sapiens
guugauaggagacuuguac

SEQ ID NO: 129835 - RNA, 19 nt, Homo sapiens
gcgagaccacccagaagga

SEQ ID NO: 129836 - RNA, 19 nt, Homo sapiens
agacccacaugaagaaguc

SEQ ID NO: 129837 - RNA, 19 nt, Homo sapiens
aagagacccacaugaagaa

SEQ ID NO: 129838 - RNA, 19 nt, Homo sapiens
ucugggagcaggccaagaa

SEQ ID NO: 129839 - RNA, 19 nt, Homo sapiens
aggaggaguuugcccaauc

SEQ ID NO: 129840 - RNA, 19 nt, Homo sapiens
cugcagaggacuugauguu

SEQ ID NO: 129841 - RNA, 19 nt, Homo sapiens
gcuugcagcaucaggagaa

SEQ ID NO: 129842 - RNA, 19 nt, Homo sapiens
ggagcaggccaagaaggaa

SEQ ID NO: 129843 - RNA, 19 nt, Homo sapiens
augcagcuguggaaaugaa

SEQ ID NO: 129844 - RNA, 19 nt, Homo sapiens
gggucgugcucaugucugu

SEQ ID NO: 129845 - RNA, 19 nt, Homo sapiens
gcuucgaggguggugauua

SEQ ID NO: 129846 - RNA, 19 nt, Homo sapiens
cagacccaguuccagaaga

SEQ ID NO: 129847 - RNA, 19 nt, Homo sapiens
gggcaccaccuaccagaag

SEQ ID NO: 129848 - RNA, 19 nt, Homo sapiens
ccaccucuuuuccuaguuu

SEQ ID NO: 129849 - RNA, 19 nt, Homo sapiens
ccagagaucgacaucacau

SEQ ID NO: 129850 - RNA, 19 nt, Homo sapiens
ugccacccuucucaacuuu

SEQ ID NO: 129851 - RNA, 19 nt, Homo sapiens
ggaaaugaagcggauuaac

SEQ ID NO: 129852 - RNA, 19 nt, Homo sapiens
cccaacuccuuccucuuug

SEQ ID NO: 129853 - RNA, 19 nt, Homo sapiens
aaucacaggaggaggaguu

SEQ ID NO: 129854 - RNA, 19 nt, Homo sapiens
gcagggcucuguacacaua

SEQ ID NO: 129855 - RNA, 19 nt, Homo sapiens
gcucaugucuguuaauaaa

SEQ ID NO: 129856 - RNA, 19 nt, Homo sapiens
gcagaggacuugauguuca

SEQ ID NO: 129857 - RNA, 19 nt, Homo sapiens
ggaaacagcagacuuuaga

SEQ ID NO: 129858 - RNA, 19 nt, Homo sapiens
caacaagccuccagagauc

SEQ ID NO: 129859 - RNA, 19 nt, Homo sapiens
ggaagaaggcccuggauga

SEQ ID NO: 129860 - RNA, 19 nt, Homo sapiens
gaagagacccacaugaaga

SEQ ID NO: 129861 - RNA, 19 nt, Homo sapiens
ggaggaaacagcagacuuu

SEQ ID NO: 129862 - RNA, 19 nt, Homo sapiens
guccagggcuucagauauu

SEQ ID NO: 129863 - RNA, 19 nt, Homo sapiens
ggaugcagcuguggaaaug

SEQ ID NO: 129864 - RNA, 19 nt, Homo sapiens
gggaaaauaucacuuugua

SEQ ID NO: 129865 - RNA, 19 nt, Homo sapiens
ggaggcagcagcuauuauu

SEQ ID NO: 129866 - RNA, 19 nt, Homo sapiens
gaaggagcagucuaucuuu

SEQ ID NO: 129867 - RNA, 19 nt, Homo sapiens
caagggaguucuucaagca

SEQ ID NO: 129868 - RNA, 19 nt, Homo sapiens
gugcucaugucuguuaaua

SEQ ID NO: 129869 - RNA, 19 nt, Homo sapiens
gagacgcuguugcaaauuc

SEQ ID NO: 129870 - RNA, 19 nt, Homo sapiens
cgaugcagcugacaccauu

SEQ ID NO: 129871 - RNA, 19 nt, Homo sapiens
aagaagagcugcggaagga

SEQ ID NO: 129872 - RNA, 19 nt, Homo sapiens
ggaaggugcccaucugguu

SEQ ID NO: 129873 - RNA, 19 nt, Homo sapiens
ggaaagcacaaacuucugu

SEQ ID NO: 129874 - RNA, 19 nt, Homo sapiens
gaaagcacaaacuucugua

SEQ ID NO: 129875 - RNA, 19 nt, Homo sapiens
gcacgaauuuuaaaacaug

SEQ ID NO: 129876 - RNA, 19 nt, Homo sapiens
caaaauacgugcucaucaa

SEQ ID NO: 129877 - RNA, 19 nt, Homo sapiens
uaggagacuuguacaguug

SEQ ID NO: 129878 - RNA, 19 nt, Homo sapiens
gauguacccucgcccuuca

SEQ ID NO: 129879 - RNA, 19 nt, Homo sapiens
ggaagagacccacaugaag

SEQ ID NO: 129880 - RNA, 19 nt, Homo sapiens
gaggaaacagcagacuuua

SEQ ID NO: 129881 - RNA, 19 nt, Homo sapiens
uugaggagcuggagcaaga

SEQ ID NO: 129882 - RNA, 19 nt, Homo sapiens
ggaggaggcagcagcuauu

SEQ ID NO: 129883 - RNA, 19 nt, Homo sapiens
gaggaggcagcagcuauua

SEQ ID NO: 129884 - RNA, 19 nt, Homo sapiens
gaaaugaagcggauuaacc

SEQ ID NO: 129885 - RNA, 19 nt, Homo sapiens
uggcuaagguggcagaguu

SEQ ID NO: 129886 - RNA, 19 nt, Homo sapiens
ugaaggagcagucuaucuu

SEQ ID NO: 129887 - RNA, 19 nt, Homo sapiens
gaaacagcagacuuuagaa

SEQ ID NO: 129888 - RNA, 19 nt, Homo sapiens
ccaagaggcgguugaagga

SEQ ID NO: 129889 - RNA, 19 nt, Homo sapiens
gcagcugacaccauugaaa

SEQ ID NO: 129890 - RNA, 19 nt, Homo sapiens
gaagaaggcccuggaugag

SEQ ID NO: 129891 - RNA, 19 nt, Homo sapiens
auaggagacuuguacaguu

SEQ ID NO: 129892 - RNA, 19 nt, Homo sapiens
ggccacagcacaaaggaaa

SEQ ID NO: 129893 - RNA, 19 nt, Homo sapiens
guggaaaugaagcggauua

SEQ ID NO: 129894 - RNA, 19 nt, Homo sapiens
cagcagcguggaagacaua

SEQ ID NO: 129895 - RNA, 19 nt, Homo sapiens
gauaggagacuuguacagu

SEQ ID NO: 129896 - RNA, 19 nt, Homo sapiens
aagcugcucugccaaaaua

SEQ ID NO: 129897 - RNA, 19 nt, Homo sapiens
uugagacgcuguugcaaau

SEQ ID NO: 129898 - RNA, 19 nt, Homo sapiens
gugccacccuucucaacuu

SEQ ID NO: 129899 - RNA, 19 nt, Homo sapiens
ggaggaagagacccacaug

SEQ ID NO: 129900 - RNA, 19 nt, Homo sapiens
gaggaagagacccacauga

SEQ ID NO: 129901 - RNA, 19 nt, Homo sapiens
ugaggaaacugaggcaaag

SEQ ID NO: 129902 - RNA, 19 nt, Homo sapiens
ggagcagucuaucuuuggu

SEQ ID NO: 129903 - RNA, 19 nt, Homo sapiens
ggauuaaccgagagcaguu

SEQ ID NO: 129904 - RNA, 19 nt, Homo sapiens
ggaggaguuugcccaaucg

SEQ ID NO: 129905 - RNA, 19 nt, Homo sapiens
aaggagcagucuaucuuug

SEQ ID NO: 129906 - RNA, 19 nt, Homo sapiens
uaacgggucgugcucaugu

SEQ ID NO: 129907 - RNA, 19 nt, Homo sapiens
gggagcaggccaagaagga

SEQ ID NO: 129908 - RNA, 19 nt, Homo sapiens
gggcgaagaugugccugau

SEQ ID NO: 129909 - RNA, 19 nt, Homo sapiens
ggagcuuucgggacacuuu

SEQ ID NO: 129910 - RNA, 19 nt, Homo sapiens
guugagacgcuguugcaaa

SEQ ID NO: 129911 - RNA, 19 nt, Homo sapiens
acaacaagccuccagagau

SEQ ID NO: 129912 - RNA, 19 nt, Homo sapiens
gaggaggaguuugcccaau

SEQ ID NO: 129913 - RNA, 19 nt, Homo sapiens
aggaagagacccacaugaa

SEQ ID NO: 129914 - RNA, 19 nt, Homo sapiens
ccucaagcuugcagcauca

SEQ ID NO: 129915 - RNA, 19 nt, Homo sapiens
ucacguuuaguaacuguuu

SEQ ID NO: 129916 - RNA, 19 nt, Homo sapiens
cagaggacuugauguucau

SEQ ID NO: 129917 - RNA, 19 nt, Homo sapiens
gcgggcagcugugauguac

SEQ ID NO: 129918 - RNA, 19 nt, Homo sapiens
gucgugcucaugucuguua

SEQ ID NO: 129919 - RNA, 19 nt, Homo sapiens
gggcuggagugagguggaa

SEQ ID NO: 129920 - RNA, 19 nt, Homo sapiens
ucaagcagcaggaaagagu

SEQ ID NO: 129921 - RNA, 19 nt, Homo sapiens
cuucgaggguggugauuag

SEQ ID NO: 129922 - RNA, 19 nt, Homo sapiens
gaggcagcagcuauuauug

SEQ ID NO: 129923 - RNA, 19 nt, Homo sapiens
gguugaaggagcagucuau

SEQ ID NO: 129924 - RNA, 19 nt, Homo sapiens
ggcaccaccuaccagaaga

SEQ ID NO: 129925 - RNA, 19 nt, Homo sapiens
ucaacugggugggcgaaga

SEQ ID NO: 129926 - RNA, 19 nt, Homo sapiens
aaagcacaaacuucuguaa

SEQ ID NO: 129927 - RNA, 19 nt, Homo sapiens
cugacaccauugaaacuga

SEQ ID NO: 129928 - RNA, 19 nt, Homo sapiens
guccagauuguagcucuua

SEQ ID NO: 129929 - RNA, 19 nt, Homo sapiens
cugcagggcucuguacaca

SEQ ID NO: 129930 - RNA, 19 nt, Homo sapiens
cccugucgcugagcagaua

SEQ ID NO: 129931 - RNA, 19 nt, Homo sapiens
aaacagcagacuuuagaag

SEQ ID NO: 129932 - RNA, 19 nt, Homo sapiens
uaagguggcagaguucuuc

SEQ ID NO: 129933 - RNA, 19 nt, Homo sapiens
caacugggugggcgaagau

SEQ ID NO: 129934 - RNA, 19 nt, Homo sapiens
aauacgugcucaucaacug

SEQ ID NO: 129935 - RNA, 19 nt, Homo sapiens
agaaccagaaggugaugua

SEQ ID NO: 129936 - RNA, 19 nt, Homo sapiens
ggggagcucuggugggaaa

SEQ ID NO: 129937 - RNA, 19 nt, Homo sapiens
guugauaggagacuuguac

SEQ ID NO: 129938 - RNA, 19 nt, Homo sapiens
gcgagaccacccagaagga

SEQ ID NO: 129939 - RNA, 19 nt, Homo sapiens
agacccacaugaagaaguc

SEQ ID NO: 129940 - RNA, 19 nt, Homo sapiens
aagagacccacaugaagaa

SEQ ID NO: 129941 - RNA, 19 nt, Homo sapiens
ucugggagcaggccaagaa

SEQ ID NO: 129942 - RNA, 19 nt, Homo sapiens
aggaggaguuugcccaauc

SEQ ID NO: 129943 - RNA, 19 nt, Homo sapiens
cugcagaggacuugauguu

SEQ ID NO: 129944 - RNA, 19 nt, Homo sapiens
ggagcaggccaagaaggaa

SEQ ID NO: 129945 - RNA, 19 nt, Homo sapiens
augcagcuguggaaaugaa

SEQ ID NO: 129946 - RNA, 19 nt, Homo sapiens
gcuugcagcaucaggagaa

SEQ ID NO: 129947 - RNA, 19 nt, Homo sapiens
gggucgugcucaugucugu

SEQ ID NO: 129948 - RNA, 19 nt, Homo sapiens
gcuucgaggguggugauua

SEQ ID NO: 129949 - RNA, 19 nt, Homo sapiens
cagacccaguuccagaaga

SEQ ID NO: 129950 - RNA, 19 nt, Homo sapiens
gggcaccaccuaccagaag

SEQ ID NO: 129951 - RNA, 19 nt, Homo sapiens
ccgcgaagugacucccuua

SEQ ID NO: 129952 - RNA, 19 nt, Homo sapiens
ccaccucuuuuccuaguuu

SEQ ID NO: 129953 - RNA, 19 nt, Homo sapiens
ccagagaucgacaucacau

SEQ ID NO: 129954 - RNA, 19 nt, Homo sapiens
gccaggagcugucccacua

SEQ ID NO: 129955 - RNA, 19 nt, Homo sapiens
uuaacacgauccugaauaa

SEQ ID NO: 129956 - RNA, 19 nt, Homo sapiens
gcagaaggaugagaaauac

SEQ ID NO: 129957 - RNA, 19 nt, Homo sapiens
gauccugaauaaaucuuga

SEQ ID NO: 129958 - RNA, 19 nt, Homo sapiens
gcucaaggagaaccagaua

SEQ ID NO: 129959 - RNA, 19 nt, Homo sapiens
cagcugaucuugcccuauc

SEQ ID NO: 129960 - RNA, 19 nt, Homo sapiens
gcuccuagauuugcagguu

SEQ ID NO: 129961 - RNA, 19 nt, Homo sapiens
acacgauccugaauaaauc

SEQ ID NO: 129962 - RNA, 19 nt, Homo sapiens
guuaacacgauccugaaua

SEQ ID NO: 129963 - RNA, 19 nt, Homo sapiens
gacgugauaaugcagauaa

SEQ ID NO: 129964 - RNA, 19 nt, Homo sapiens
gcccuucgccucuccauga

SEQ ID NO: 129965 - RNA, 19 nt, Homo sapiens
cggaggagcagaaggauga

SEQ ID NO: 129966 - RNA, 19 nt, Homo sapiens
ccagggacgugauaaugca

SEQ ID NO: 129967 - RNA, 19 nt, Homo sapiens
cugaauaaaucuugagaac

SEQ ID NO: 129968 - RNA, 19 nt, Homo sapiens
ucaaggagaaccagauauc

SEQ ID NO: 129969 - RNA, 19 nt, Homo sapiens
agcagaaggaugagaaaua

SEQ ID NO: 129970 - RNA, 19 nt, Homo sapiens
ucaugaagaaggcaagaaa

SEQ ID NO: 129971 - RNA, 19 nt, Homo sapiens
ucucagaagaggaacuuaa

SEQ ID NO: 129972 - RNA, 19 nt, Homo sapiens
ggaccagcaagcccaaaga

SEQ ID NO: 129973 - RNA, 19 nt, Homo sapiens
ggagcagaaggaugagaaa

SEQ ID NO: 129974 - RNA, 19 nt, Homo sapiens
gggcagacacucguccaaa

SEQ ID NO: 129975 - RNA, 19 nt, Homo sapiens
ggccagcugucuccugaag

SEQ ID NO: 129976 - RNA, 19 nt, Homo sapiens
ggcagacacucguccaaac

SEQ ID NO: 129977 - RNA, 19 nt, Homo sapiens
ggacgugauaaugcagaua

SEQ ID NO: 129978 - RNA, 19 nt, Homo sapiens
uaacacgauccugaauaaa

SEQ ID NO: 129979 - RNA, 19 nt, Homo sapiens
gauacugugguucgagcua

SEQ ID NO: 129980 - RNA, 19 nt, Homo sapiens
gagcagaaggaugagaaau

SEQ ID NO: 129981 - RNA, 19 nt, Homo sapiens
gaccuuugacccucgaaga

SEQ ID NO: 129982 - RNA, 19 nt, Homo sapiens
aacacgauccugaauaaau

SEQ ID NO: 129983 - RNA, 19 nt, Homo sapiens
cccagccaaucaugaagaa

SEQ ID NO: 129984 - RNA, 19 nt, Homo sapiens
agaaggaugagaaauacug

SEQ ID NO: 129985 - RNA, 19 nt, Homo sapiens
agauuugcagguucugaua

SEQ ID NO: 129986 - RNA, 19 nt, Homo sapiens
gaacccgacccagcugauc

SEQ ID NO: 129987 - RNA, 19 nt, Homo sapiens
guucggcgauguggaguac

SEQ ID NO: 129988 - RNA, 19 nt, Homo sapiens
gggacgugauaaugcagau

SEQ ID NO: 129989 - RNA, 19 nt, Homo sapiens
ggaggaacauuuacucuuu

SEQ ID NO: 129990 - RNA, 19 nt, Homo sapiens
ggaagguacuuuaaaugua

SEQ ID NO: 129991 - RNA, 19 nt, Homo sapiens
gaagauauccucaacuauu

SEQ ID NO: 129992 - RNA, 19 nt, Homo sapiens
gacaguauaugcccuauuu

SEQ ID NO: 129993 - RNA, 19 nt, Homo sapiens
guucagaucugcucuauau

SEQ ID NO: 129994 - RNA, 19 nt, Homo sapiens
gaucugaaaugaagacuga

SEQ ID NO: 129995 - RNA, 19 nt, Homo sapiens
gcagaauacuuaaagaaga

SEQ ID NO: 129996 - RNA, 19 nt, Homo sapiens
gagcugagaucgugcuauu

SEQ ID NO: 129997 - RNA, 19 nt, Homo sapiens
gaucuaaggcacaauauuu

SEQ ID NO: 129998 - RNA, 19 nt, Homo sapiens
gaagguacuuuaaauguag

SEQ ID NO: 129999 - RNA, 19 nt, Homo sapiens
agacaugacuguuccuaua

SEQ ID NO: 130000 - RNA, 19 nt, Homo sapiens
cagcacauguucaucuuua

SEQ ID NO: 130001 - RNA, 19 nt, Homo sapiens
aaagauggcagaauacuua

SEQ ID NO: 130002 - RNA, 19 nt, Homo sapiens
guagugagcugucauugug

SEQ ID NO: 130003 - RNA, 19 nt, Homo sapiens
gaauaaugguguaaugguu

SEQ ID NO: 130004 - RNA, 19 nt, Homo sapiens
gaugaaaacugccagaaua

SEQ ID NO: 130005 - RNA, 19 nt, Homo sapiens
aaagacagguagccauaua

SEQ ID NO: 130006 - RNA, 19 nt, Homo sapiens
gagugugacuucuuaauau

SEQ ID NO: 130007 - RNA, 19 nt, Homo sapiens
gauaaugccaccugaagua

SEQ ID NO: 130008 - RNA, 19 nt, Homo sapiens
ggauagcaauggauacuga

SEQ ID NO: 130009 - RNA, 19 nt, Homo sapiens
gaacauacacaccaagaga

SEQ ID NO: 130010 - RNA, 19 nt, Homo sapiens
agaagaagauguuguugaa

SEQ ID NO: 130011 - RNA, 19 nt, Homo sapiens
ggaagagucuaauaguaau

SEQ ID NO: 130012 - RNA, 19 nt, Homo sapiens
aagaagauauccucaacua

SEQ ID NO: 130013 - RNA, 19 nt, Homo sapiens
gcaacgagaugaauguauc

SEQ ID NO: 130014 - RNA, 19 nt, Homo sapiens
cauauaaggcuucucauaa

SEQ ID NO: 130015 - RNA, 19 nt, Homo sapiens
gcuacuagaucugaaauga

SEQ ID NO: 130016 - RNA, 19 nt, Homo sapiens
gaaaggagaaguauauaag

SEQ ID NO: 130017 - RNA, 19 nt, Homo sapiens
gcaaacuucccucauguaa

SEQ ID NO: 130018 - RNA, 19 nt, Homo sapiens
gcagacaggagcuauauug

SEQ ID NO: 130019 - RNA, 19 nt, Homo sapiens
gaagccaaauuaugugugu

SEQ ID NO: 130020 - RNA, 19 nt, Homo sapiens
gaaaugaagacugauaaga

SEQ ID NO: 130021 - RNA, 19 nt, Homo sapiens
cauagaaacggaagcuuua

SEQ ID NO: 130022 - RNA, 19 nt, Homo sapiens
ccagaaaggagaaguauau

SEQ ID NO: 130023 - RNA, 19 nt, Homo sapiens
gagaaggaagagucuaaua

SEQ ID NO: 130024 - RNA, 19 nt, Homo sapiens
aguauaaacuggccuuaaa

SEQ ID NO: 130025 - RNA, 19 nt, Homo sapiens
cuuuaugccuuucuucuua

SEQ ID NO: 130026 - RNA, 19 nt, Homo sapiens
gauagcaucugugaaguuc

SEQ ID NO: 130027 - RNA, 19 nt, Homo sapiens
gagacaagaggaucaauug

SEQ ID NO: 130028 - RNA, 19 nt, Homo sapiens
aaggaagagucuaauagua

SEQ ID NO: 130029 - RNA, 19 nt, Homo sapiens
gaacauuuacucuuuccaa

SEQ ID NO: 130030 - RNA, 19 nt, Homo sapiens
gaagauaccucauuuuggu

SEQ ID NO: 130031 - RNA, 19 nt, Homo sapiens
gaaggaagagucuaauagu

SEQ ID NO: 130032 - RNA, 19 nt, Homo sapiens
guaaggaagguacuuuaaa

SEQ ID NO: 130033 - RNA, 19 nt, Homo sapiens
ggugaaaccuggccucuac

SEQ ID NO: 130034 - RNA, 19 nt, Homo sapiens
ucagaucugcucuauauuu

SEQ ID NO: 130035 - RNA, 19 nt, Homo sapiens
uaaagaagauauccucaac

SEQ ID NO: 130036 - RNA, 19 nt, Homo sapiens
gaaauagcaacgagaugaa

SEQ ID NO: 130037 - RNA, 19 nt, Homo sapiens
guaaauaagaggagaagga

SEQ ID NO: 130038 - RNA, 19 nt, Homo sapiens
gauugucccuaaugugaaa

SEQ ID NO: 130039 - RNA, 19 nt, Homo sapiens
gagaagggauuagagaagu

SEQ ID NO: 130040 - RNA, 19 nt, Homo sapiens
guauauaaggcacagauaa

SEQ ID NO: 130041 - RNA, 19 nt, Homo sapiens
cagaucugcucuauauuug

SEQ ID NO: 130042 - RNA, 19 nt, Homo sapiens
aaacuucccucauguaagg

SEQ ID NO: 130043 - RNA, 19 nt, Homo sapiens
gaaacuggcaagauuaaca

SEQ ID NO: 130044 - RNA, 19 nt, Homo sapiens
uaacauauaaggcuucuca

SEQ ID NO: 130045 - RNA, 19 nt, Homo sapiens
gaaaacugccagaauauaa

SEQ ID NO: 130046 - RNA, 19 nt, Homo sapiens
ccacaucacuuccugaaaa

SEQ ID NO: 130047 - RNA, 19 nt, Homo sapiens
gauacagugucucaguuug

SEQ ID NO: 130048 - RNA, 19 nt, Homo sapiens
gugaugacuuguaacugua

SEQ ID NO: 130049 - RNA, 19 nt, Homo sapiens
uaaggcuucucauaacauu

SEQ ID NO: 130050 - RNA, 19 nt, Homo sapiens
caggugugaugacuuguaa

SEQ ID NO: 130051 - RNA, 19 nt, Homo sapiens
ugaaccgccuccagaaauu

SEQ ID NO: 130052 - RNA, 19 nt, Homo sapiens
gaggaacauuuacucuuuc

SEQ ID NO: 130053 - RNA, 19 nt, Homo sapiens
guggacagguuguucaguu

SEQ ID NO: 130054 - RNA, 19 nt, Homo sapiens
ggucuacuuuaaucagaaa

SEQ ID NO: 130055 - RNA, 19 nt, Homo sapiens
uuugagauauccaagagua

SEQ ID NO: 130056 - RNA, 19 nt, Homo sapiens
aaaccuggccucuaccuaa

SEQ ID NO: 130057 - RNA, 19 nt, Homo sapiens
gcaauggucaagacuaugu

SEQ ID NO: 130058 - RNA, 19 nt, Homo sapiens
gaagggauuagagaaguaa

SEQ ID NO: 130059 - RNA, 19 nt, Homo sapiens
ccacuauccuccaguaugg

SEQ ID NO: 130060 - RNA, 19 nt, Homo sapiens
gaaauuaaggucuauucca

SEQ ID NO: 130061 - RNA, 19 nt, Homo sapiens
gaagacugauaagacauuc

SEQ ID NO: 130062 - RNA, 19 nt, Homo sapiens
uagacgauauugccuaugu

SEQ ID NO: 130063 - RNA, 19 nt, Homo sapiens
gaagcaggaggaucacuug

SEQ ID NO: 130064 - RNA, 19 nt, Homo sapiens
aggaagagucuaauaguaa

SEQ ID NO: 130065 - RNA, 19 nt, Homo sapiens
uaaccagucuauuaaaggu

SEQ ID NO: 130066 - RNA, 19 nt, Homo sapiens
uaagcuccgagaagaauua

SEQ ID NO: 130067 - RNA, 19 nt, Homo sapiens
gugaugagauugaccuuac

SEQ ID NO: 130068 - RNA, 19 nt, Homo sapiens
aagcaauggucaagacuau

SEQ ID NO: 130069 - RNA, 19 nt, Homo sapiens
cacccaaaguugaaauuau

SEQ ID NO: 130070 - RNA, 19 nt, Homo sapiens
gaagccauuaguagacaua

SEQ ID NO: 130071 - RNA, 19 nt, Homo sapiens
agaagggauuagagaagua

SEQ ID NO: 130072 - RNA, 19 nt, Homo sapiens
ugagauauccaagaguaua

SEQ ID NO: 130073 - RNA, 19 nt, Homo sapiens
ucacagaguuauugauggu

SEQ ID NO: 130074 - RNA, 19 nt, Homo sapiens
cagcaccacugaucuuaca

SEQ ID NO: 130075 - RNA, 19 nt, Homo sapiens
uuacugaacugguuaagcu

SEQ ID NO: 130076 - RNA, 19 nt, Homo sapiens
gcaccuauagucccagcua

SEQ ID NO: 130077 - RNA, 19 nt, Homo sapiens
ugugaugacuuguaacugu

SEQ ID NO: 130078 - RNA, 19 nt, Homo sapiens
uaaauaagaggagaaggaa

SEQ ID NO: 130079 - RNA, 19 nt, Homo sapiens
agagugugacuucuuaaua

SEQ ID NO: 130080 - RNA, 19 nt, Homo sapiens
aaugaagacugauaagaca

SEQ ID NO: 130081 - RNA, 19 nt, Homo sapiens
uauaaggcuucucauaaca

SEQ ID NO: 130082 - RNA, 19 nt, Homo sapiens
caaaacagaacccauaaaa

SEQ ID NO: 130083 - RNA, 19 nt, Homo sapiens
gacuguuccuauacuagua

SEQ ID NO: 130084 - RNA, 19 nt, Homo sapiens
aggaaaagauggcagaaua

SEQ ID NO: 130085 - RNA, 19 nt, Homo sapiens
ugauuuguguucgcuauuu

SEQ ID NO: 130086 - RNA, 19 nt, Homo sapiens
gaagaagauguuguugaaa

SEQ ID NO: 130087 - RNA, 19 nt, Homo sapiens
caacacuucgucucagaaa

SEQ ID NO: 130088 - RNA, 19 nt, Homo sapiens
gaucugcucuauauuugac

SEQ ID NO: 130089 - RNA, 19 nt, Homo sapiens
gauucuggcucaauuauua

SEQ ID NO: 130090 - RNA, 19 nt, Homo sapiens
gagguuauauuaucgguua

SEQ ID NO: 130091 - RNA, 19 nt, Homo sapiens
ucaccuaccucaauucuua

SEQ ID NO: 130092 - RNA, 19 nt, Homo sapiens
gaagucagaugaaggcuuu

SEQ ID NO: 130093 - RNA, 19 nt, Homo sapiens
gaagaaagauggcauucau

SEQ ID NO: 130094 - RNA, 19 nt, Homo sapiens
gaacgagcauugaauacaa

SEQ ID NO: 130095 - RNA, 19 nt, Homo sapiens
gcaaagaccauccaaugua

SEQ ID NO: 130096 - RNA, 19 nt, Homo sapiens
caacaggccucaaaccaaa

SEQ ID NO: 130097 - RNA, 19 nt, Homo sapiens
caaccaagcucucuucaug

SEQ ID NO: 130098 - RNA, 19 nt, Homo sapiens
gcauggauauugaguuuga

SEQ ID NO: 130099 - RNA, 19 nt, Homo sapiens
gauagaagcacccuaaaug

SEQ ID NO: 130100 - RNA, 19 nt, Homo sapiens
ggaagcaacuuacggauac

SEQ ID NO: 130101 - RNA, 19 nt, Homo sapiens
gcauaccaauuacccauaa

SEQ ID NO: 130102 - RNA, 19 nt, Homo sapiens
gaagacacaacaucucuaa

SEQ ID NO: 130103 - RNA, 19 nt, Homo sapiens
ggaagauccugaagcaguu

SEQ ID NO: 130104 - RNA, 19 nt, Homo sapiens
gugaacaaauggcaaguuu

SEQ ID NO: 130105 - RNA, 19 nt, Homo sapiens
gcagcgauauuauuccauu

SEQ ID NO: 130106 - RNA, 19 nt, Homo sapiens
gaauggaugaggugaauuu

SEQ ID NO: 130107 - RNA, 19 nt, Homo sapiens
gacaagaacaucccaauug

SEQ ID NO: 130108 - RNA, 19 nt, Homo sapiens
gaaaggaagucaguacagu

SEQ ID NO: 130109 - RNA, 19 nt, Homo sapiens
caucaggaauugucaaaug

SEQ ID NO: 130110 - RNA, 19 nt, Homo sapiens
acaagaacaucccaauuga

SEQ ID NO: 130111 - RNA, 19 nt, Homo sapiens
caagaacucuaaccagugu

SEQ ID NO: 130112 - RNA, 19 nt, Homo sapiens
caaagaccauccaauguag

SEQ ID NO: 130113 - RNA, 19 nt, Homo sapiens
gacacaacaucucuaaguu

SEQ ID NO: 130114 - RNA, 19 nt, Homo sapiens
gcaagcagcgauauuauuc

SEQ ID NO: 130115 - RNA, 19 nt, Homo sapiens
caagaaguaucaaaguuag

SEQ ID NO: 130116 - RNA, 19 nt, Homo sapiens
ggaagcagcaacuuucaaa

SEQ ID NO: 130117 - RNA, 19 nt, Homo sapiens
aagcauggauauugaguuu

SEQ ID NO: 130118 - RNA, 19 nt, Homo sapiens
ggagaauagucuuagaugu

SEQ ID NO: 130119 - RNA, 19 nt, Homo sapiens
ucacugcaaugucaaaguu

SEQ ID NO: 130120 - RNA, 19 nt, Homo sapiens
gaauauagagguugaugga

SEQ ID NO: 130121 - RNA, 19 nt, Homo sapiens
ugaauuggaugaagaaugg

SEQ ID NO: 130122 - RNA, 19 nt, Homo sapiens
caucaggaccacucaguua

SEQ ID NO: 130123 - RNA, 19 nt, Homo sapiens
ggaagaagucagucaguga

SEQ ID NO: 130124 - RNA, 19 nt, Homo sapiens
gaaagccugugcccacugu

SEQ ID NO: 130125 - RNA, 19 nt, Homo sapiens
ggacaagaacaucccaauu

SEQ ID NO: 130126 - RNA, 19 nt, Homo sapiens
gagaauagucuuagaugug

SEQ ID NO: 130127 - RNA, 19 nt, Homo sapiens
cagacuaacugcaucauca

SEQ ID NO: 130128 - RNA, 19 nt, Homo sapiens
gaagcagaagucagaauuu

SEQ ID NO: 130129 - RNA, 19 nt, Homo sapiens
uaaaugagccgccaauugg

SEQ ID NO: 130130 - RNA, 19 nt, Homo sapiens
gaaaauuacugcuuacauc

SEQ ID NO: 130131 - RNA, 19 nt, Homo sapiens
ggucauuccuagugauuau

SEQ ID NO: 130132 - RNA, 19 nt, Homo sapiens
caacaagaccugacuccaa

SEQ ID NO: 130133 - RNA, 19 nt, Homo sapiens
cgucugaggugcgacuuua

SEQ ID NO: 130134 - RNA, 19 nt, Homo sapiens
gaaguggucaauucaagaa

SEQ ID NO: 130135 - RNA, 19 nt, Homo sapiens
guugauggacuaucuuaua

SEQ ID NO: 130136 - RNA, 19 nt, Homo sapiens
caacagggaacgagcauug

SEQ ID NO: 130137 - RNA, 19 nt, Homo sapiens
aagggaacauucaaacuuu

SEQ ID NO: 130138 - RNA, 19 nt, Homo sapiens
gaugaagaauggagaugug

SEQ ID NO: 130139 - RNA, 19 nt, Homo sapiens
caaccuguaugccuaugaa

SEQ ID NO: 130140 - RNA, 19 nt, Homo sapiens
ucacaggcaucaggaauug

SEQ ID NO: 130141 - RNA, 19 nt, Homo sapiens
gaacuuugcagcauaccaa

SEQ ID NO: 130142 - RNA, 19 nt, Homo sapiens
acacaacaucucuaaguua

SEQ ID NO: 130143 - RNA, 19 nt, Homo sapiens
agaaugaucuagaugaauc

SEQ ID NO: 130144 - RNA, 19 nt, Homo sapiens
gaugaaggcuuuuaucaau

SEQ ID NO: 130145 - RNA, 19 nt, Homo sapiens
ggagauucuggcucaauua

SEQ ID NO: 130146 - RNA, 19 nt, Homo sapiens
uaacaaugccggagaagga

SEQ ID NO: 130147 - RNA, 19 nt, Homo sapiens
ucacaggacuggagaaagg

SEQ ID NO: 130148 - RNA, 19 nt, Homo sapiens
uugcuuaucuccaauguga

SEQ ID NO: 130149 - RNA, 19 nt, Homo sapiens
gaggagagccacaaaccaa

SEQ ID NO: 130150 - RNA, 19 nt, Homo sapiens
gcaacaggccucaaaccaa

SEQ ID NO: 130151 - RNA, 19 nt, Homo sapiens
caaaauggcuaaugaccaa

SEQ ID NO: 130152 - RNA, 19 nt, Homo sapiens
gauccaucaugaagaaaug

SEQ ID NO: 130153 - RNA, 19 nt, Homo sapiens
uggaaacacuggagccaaa

SEQ ID NO: 130154 - RNA, 19 nt, Homo sapiens
gaacgucucccuggaagug

SEQ ID NO: 130155 - RNA, 19 nt, Homo sapiens
gauggacuaucuuauaaac

SEQ ID NO: 130156 - RNA, 19 nt, Homo sapiens
ggauucagccaauguguau

SEQ ID NO: 130157 - RNA, 19 nt, Homo sapiens
gaagucagucagugaguga

SEQ ID NO: 130158 - RNA, 19 nt, Homo sapiens
gcuagaaagugcccaguac

SEQ ID NO: 130159 - RNA, 19 nt, Homo sapiens
ugacccaguugauuauuau

SEQ ID NO: 130160 - RNA, 19 nt, Homo sapiens
cagcgcgcaucuucaagua

SEQ ID NO: 130161 - RNA, 19 nt, Homo sapiens
gaugacaguggaauguaua

SEQ ID NO: 130162 - RNA, 19 nt, Homo sapiens
aaaugggucucugcugaua

SEQ ID NO: 130163 - RNA, 19 nt, Homo sapiens
ucauggagauggagguuau

SEQ ID NO: 130164 - RNA, 19 nt, Homo sapiens
aaucauggaucucaaccuu

SEQ ID NO: 130165 - RNA, 19 nt, Homo sapiens
gcacaugccaccacguaug

SEQ ID NO: 130166 - RNA, 19 nt, Homo sapiens
ggugcgagguuauauuauc

SEQ ID NO: 130167 - RNA, 19 nt, Homo sapiens
guggugcgagguuauauua

SEQ ID NO: 130168 - RNA, 19 nt, Homo sapiens
agagaaugaucuagaugaa

SEQ ID NO: 130169 - RNA, 19 nt, Homo sapiens
cgucucuacugaugauaua

SEQ ID NO: 130170 - RNA, 19 nt, Homo sapiens
uauagagguugauggacua

SEQ ID NO: 130171 - RNA, 19 nt, Homo sapiens
guaaccgguuuucaaauua

SEQ ID NO: 130172 - RNA, 19 nt, Homo sapiens
uaugaaagcauggauauug

SEQ ID NO: 130173 - RNA, 19 nt, Homo sapiens
acacagugcuacucaagug

SEQ ID NO: 130174 - RNA, 19 nt, Homo sapiens
ggaacacccugacaaaaug

SEQ ID NO: 130175 - RNA, 19 nt, Homo sapiens
ggaguuccucuuuaugaaa

SEQ ID NO: 130176 - RNA, 19 nt, Homo sapiens
guggucaauucaagaagua

SEQ ID NO: 130177 - RNA, 19 nt, Homo sapiens
ggagauguggucauuccua

SEQ ID NO: 130178 - RNA, 19 nt, Homo sapiens
gaauguacagucucuggaa

SEQ ID NO: 130179 - RNA, 19 nt, Homo sapiens
cugcagagcucacagucuu

SEQ ID NO: 130180 - RNA, 19 nt, Homo sapiens
guccuggaauguuguguuu

SEQ ID NO: 130181 - RNA, 19 nt, Homo sapiens
ugagggacuuuaccaaugu

SEQ ID NO: 130182 - RNA, 19 nt, Homo sapiens
cagcuuugcuaauccuuug

SEQ ID NO: 130183 - RNA, 19 nt, Homo sapiens
cuaaaugagccgccaauug

SEQ ID NO: 130184 - RNA, 19 nt, Homo sapiens
ugaauucucggucauggua

SEQ ID NO: 130185 - RNA, 19 nt, Homo sapiens
cagaagccauguacaccuu

SEQ ID NO: 130186 - RNA, 19 nt, Homo sapiens
gauuaugaguucccuaaac

SEQ ID NO: 130187 - RNA, 19 nt, Homo sapiens
ggagguuauuggccaguug

SEQ ID NO: 130188 - RNA, 19 nt, Homo sapiens
ggugauaggcuuacucauc

SEQ ID NO: 130189 - RNA, 19 nt, Homo sapiens
uggagaagcuggagaauga

SEQ ID NO: 130190 - RNA, 19 nt, Homo sapiens
ccagggaggucuuaaacaa

SEQ ID NO: 130191 - RNA, 19 nt, Homo sapiens
agaagucccugcagaugua

SEQ ID NO: 130192 - RNA, 19 nt, Homo sapiens
uagagaggcucaaagaaga

SEQ ID NO: 130193 - RNA, 19 nt, Homo sapiens
ccaaggccaugaugcgaaa

SEQ ID NO: 130194 - RNA, 19 nt, Homo sapiens
ugaaagacacccuggagaa

SEQ ID NO: 130195 - RNA, 19 nt, Homo sapiens
ggucuuaaacaagguauuu

SEQ ID NO: 130196 - RNA, 19 nt, Homo sapiens
ccaaagacuccauccagaa

SEQ ID NO: 130197 - RNA, 19 nt, Homo sapiens
gaacuucgucagcuucauc

SEQ ID NO: 130198 - RNA, 19 nt, Homo sapiens
gagcuuccgcggugucauu

SEQ ID NO: 130199 - RNA, 19 nt, Homo sapiens
cugcagauguacuuagaga

SEQ ID NO: 130200 - RNA, 19 nt, Homo sapiens
guacuuagagaggcucaaa

SEQ ID NO: 130201 - RNA, 19 nt, Homo sapiens
gggucgcugugaugaaauu

SEQ ID NO: 130202 - RNA, 19 nt, Homo sapiens
gaaagacacccuggagaac

SEQ ID NO: 130203 - RNA, 19 nt, Homo sapiens
caaagacuccauccagaag

SEQ ID NO: 130204 - RNA, 19 nt, Homo sapiens
uuagagaggcucaaagaag

SEQ ID NO: 130205 - RNA, 19 nt, Homo sapiens
ggaggucuuaaacaaggua

SEQ ID NO: 130206 - RNA, 19 nt, Homo sapiens
gagaggcucaaagaagaaa

SEQ ID NO: 130207 - RNA, 19 nt, Homo sapiens
ucagcuucaucuccaaaga

SEQ ID NO: 130208 - RNA, 19 nt, Homo sapiens
gugcuggucuccgccauca

SEQ ID NO: 130209 - RNA, 19 nt, Homo sapiens
cagaagucccugcagaugu

SEQ ID NO: 130210 - RNA, 19 nt, Homo sapiens
ccagaagucccugcagaug

SEQ ID NO: 130211 - RNA, 19 nt, Homo sapiens
gccuggaccugacggagau

SEQ ID NO: 130212 - RNA, 19 nt, Homo sapiens
gcgaugcggacgugcagaa

SEQ ID NO: 130213 - RNA, 19 nt, Homo sapiens
gagaagcuggagaaugaca

SEQ ID NO: 130214 - RNA, 19 nt, Homo sapiens
ugguggcccugaccuguga

SEQ ID NO: 130215 - RNA, 19 nt, Homo sapiens
gaagcuggagaaugacaag

SEQ ID NO: 130216 - RNA, 19 nt, Homo sapiens
guacugcauaggacucaau

SEQ ID NO: 130217 - RNA, 19 nt, Homo sapiens
ggaccugacggagaugugu

SEQ ID NO: 130218 - RNA, 19 nt, Homo sapiens
aaagacacccuggagaaca

SEQ ID NO: 130219 - RNA, 19 nt, Homo sapiens
augcggacgugcagaacuu

SEQ ID NO: 130220 - RNA, 19 nt, Homo sapiens
gagcuguggcugcgguugu

SEQ ID NO: 130221 - RNA, 19 nt, Homo sapiens
gcucaaagaugcagagaaa

SEQ ID NO: 130222 - RNA, 19 nt, Homo sapiens
ccagagacaugcuuacaua

SEQ ID NO: 130223 - RNA, 19 nt, Homo sapiens
gcagggaagucaacauuug

SEQ ID NO: 130224 - RNA, 19 nt, Homo sapiens
caacuucgauuaucuucaa

SEQ ID NO: 130225 - RNA, 19 nt, Homo sapiens
gagcuacacucauugaaau

SEQ ID NO: 130226 - RNA, 19 nt, Homo sapiens
aaaggaaucccuagaauaa

SEQ ID NO: 130227 - RNA, 19 nt, Homo sapiens
ugaauuggauggaaucauu

SEQ ID NO: 130228 - RNA, 19 nt, Homo sapiens
gagacagaguggacaauuu

SEQ ID NO: 130229 - RNA, 19 nt, Homo sapiens
gagacaugcuuacauagaa

SEQ ID NO: 130230 - RNA, 19 nt, Homo sapiens
caaaggagacuuaauuuca

SEQ ID NO: 130231 - RNA, 19 nt, Homo sapiens
uggcaugacuggaugaaua

SEQ ID NO: 130232 - RNA, 19 nt, Homo sapiens
ggacucaucuuaguucugu

SEQ ID NO: 130233 - RNA, 19 nt, Homo sapiens
guagaugguuccaguauca

SEQ ID NO: 130234 - RNA, 19 nt, Homo sapiens
gggaagaaaugaagagcaa

SEQ ID NO: 130235 - RNA, 19 nt, Homo sapiens
gaacuuacaaugucucaga

SEQ ID NO: 130236 - RNA, 19 nt, Homo sapiens
gagacacacuuaacuacuu

SEQ ID NO: 130237 - RNA, 19 nt, Homo sapiens
gguaguguguccuguguaa

SEQ ID NO: 130238 - RNA, 19 nt, Homo sapiens
guuaaggugugcaguguuu

SEQ ID NO: 130239 - RNA, 19 nt, Homo sapiens
agacacacuuaacuacuua

SEQ ID NO: 130240 - RNA, 19 nt, Homo sapiens
uaaaggaaucccuagaaua

SEQ ID NO: 130241 - RNA, 19 nt, Homo sapiens
ggaauguucuucagaugau

SEQ ID NO: 130242 - RNA, 19 nt, Homo sapiens
ucaaaguacucaagaugaa

SEQ ID NO: 130243 - RNA, 19 nt, Homo sapiens
gaacuacaguggagcuaca

SEQ ID NO: 130244 - RNA, 19 nt, Homo sapiens
ggauguuaaugaagacuuu

SEQ ID NO: 130245 - RNA, 19 nt, Homo sapiens
agacagaguggacaauuua

SEQ ID NO: 130246 - RNA, 19 nt, Homo sapiens
cagagaaaccuguauuauu

SEQ ID NO: 130247 - RNA, 19 nt, Homo sapiens
ggagacauauuucagugau

SEQ ID NO: 130248 - RNA, 19 nt, Homo sapiens
gaagucaacauuugugaau

SEQ ID NO: 130249 - RNA, 19 nt, Homo sapiens
cuacuuaucucuaaaccau

SEQ ID NO: 130250 - RNA, 19 nt, Homo sapiens
ucucauagcaggaaaugua

SEQ ID NO: 130251 - RNA, 19 nt, Homo sapiens
gaaucugaaugcaugaaug

SEQ ID NO: 130252 - RNA, 19 nt, Homo sapiens
gcaaaggagacuuaauuuc

SEQ ID NO: 130253 - RNA, 19 nt, Homo sapiens
gcagagaaaccuguauuau

SEQ ID NO: 130254 - RNA, 19 nt, Homo sapiens
ugaauggacucaucuuagu

SEQ ID NO: 130255 - RNA, 19 nt, Homo sapiens
caaaguggaauuaaaggaa

SEQ ID NO: 130256 - RNA, 19 nt, Homo sapiens
gaaagcuggcuccugcaua

SEQ ID NO: 130257 - RNA, 19 nt, Homo sapiens
gauggaaucauuuaucuuc

SEQ ID NO: 130258 - RNA, 19 nt, Homo sapiens
ggagcuacacucauugaaa

SEQ ID NO: 130259 - RNA, 19 nt, Homo sapiens
cagcuugccucucugaaug

SEQ ID NO: 130260 - RNA, 19 nt, Homo sapiens
ccaucuaugugaauauuug

SEQ ID NO: 130261 - RNA, 19 nt, Homo sapiens
gcuagaaagcauccauuaa

SEQ ID NO: 130262 - RNA, 19 nt, Homo sapiens
ucuacugucuggauuaauu

SEQ ID NO: 130263 - RNA, 19 nt, Homo sapiens
gacauuauuucucauagca

SEQ ID NO: 130264 - RNA, 19 nt, Homo sapiens
cuagaaagcauccauuaau

SEQ ID NO: 130265 - RNA, 19 nt, Homo sapiens
gaagacagaggcuagaaag

SEQ ID NO: 130266 - RNA, 19 nt, Homo sapiens
uuaaaggaaucccuagaau

SEQ ID NO: 130267 - RNA, 19 nt, Homo sapiens
ggaaucauuuaucuucaag

SEQ ID NO: 130268 - RNA, 19 nt, Homo sapiens
guugcaaaguggaauuaaa

SEQ ID NO: 130269 - RNA, 19 nt, Homo sapiens
guaguuugcuuugcuuugu

SEQ ID NO: 130270 - RNA, 19 nt, Homo sapiens
caaacacugugauuacucu

SEQ ID NO: 130271 - RNA, 19 nt, Homo sapiens
ccacaagacuaaggaaugg

SEQ ID NO: 130272 - RNA, 19 nt, Homo sapiens
ccaaaugguuccagauacu

SEQ ID NO: 130273 - RNA, 19 nt, Homo sapiens
aaagcuggcuccugcauag

SEQ ID NO: 130274 - RNA, 19 nt, Homo sapiens
gaauuggauggaaucauuu

SEQ ID NO: 130275 - RNA, 19 nt, Homo sapiens
ugugauuacucuuugcuuu

SEQ ID NO: 130276 - RNA, 19 nt, Homo sapiens
acacugugauuacucuuug

SEQ ID NO: 130277 - RNA, 19 nt, Homo sapiens
gagacauauuucagugauu

SEQ ID NO: 130278 - RNA, 19 nt, Homo sapiens
gaauggacucaucuuaguu

SEQ ID NO: 130279 - RNA, 19 nt, Homo sapiens
gcaaaguggaauuaaagga

SEQ ID NO: 130280 - RNA, 19 nt, Homo sapiens
aaaccaacuucgauuaucu

SEQ ID NO: 130281 - RNA, 19 nt, Homo sapiens
cuggaugaauaaccaauuu

SEQ ID NO: 130282 - RNA, 19 nt, Homo sapiens
gacagaggcuagaaagcau

SEQ ID NO: 130283 - RNA, 19 nt, Homo sapiens
gggaauguucuucagauga

SEQ ID NO: 130284 - RNA, 19 nt, Homo sapiens
ggcuagaaagcauccauua

SEQ ID NO: 130285 - RNA, 19 nt, Homo sapiens
ccagcuuccuucugucauu

SEQ ID NO: 130286 - RNA, 19 nt, Homo sapiens
caggaaauguagagguaga

SEQ ID NO: 130287 - RNA, 19 nt, Homo sapiens
ccugaacgauggucuuuua

SEQ ID NO: 130288 - RNA, 19 nt, Homo sapiens
ucuaaaccaucuaugugaa

SEQ ID NO: 130289 - RNA, 19 nt, Homo sapiens
acacuuaacuacuuaucuc

SEQ ID NO: 130290 - RNA, 19 nt, Homo sapiens
ggaagucaacauuugugaa

SEQ ID NO: 130291 - RNA, 19 nt, Homo sapiens
ccagauacuucagcuuugu

SEQ ID NO: 130292 - RNA, 19 nt, Homo sapiens
uaucaagacuggcaugacu

SEQ ID NO: 130293 - RNA, 19 nt, Homo sapiens
uaaacugucucauuauacg

SEQ ID NO: 130294 - RNA, 19 nt, Homo sapiens
uguaauauauccugaaagc

SEQ ID NO: 130295 - RNA, 19 nt, Homo sapiens
acucuuugcuuuguaguuu

SEQ ID NO: 130296 - RNA, 19 nt, Homo sapiens
ugaacgaucuguguauagu

SEQ ID NO: 130297 - RNA, 19 nt, Homo sapiens
uugcaaaggagacuuaauu

SEQ ID NO: 130298 - RNA, 19 nt, Homo sapiens
gacaugcuuacauagaaua

SEQ ID NO: 130299 - RNA, 19 nt, Homo sapiens
ggcaugacuggaugaauaa

SEQ ID NO: 130300 - RNA, 19 nt, Homo sapiens
gauuacucuuugcuuugua

SEQ ID NO: 130301 - RNA, 19 nt, Homo sapiens
agcaggaaauguagaggua

SEQ ID NO: 130302 - RNA, 19 nt, Homo sapiens
gaaaaccaacuucgauuau

SEQ ID NO: 130303 - RNA, 19 nt, Homo sapiens
ucaagccacuccagagaca

SEQ ID NO: 130304 - RNA, 19 nt, Homo sapiens
guucaaaguacucaagaug

SEQ ID NO: 130305 - RNA, 19 nt, Homo sapiens
ggugcaauguucaaaguac

SEQ ID NO: 130306 - RNA, 19 nt, Homo sapiens
gccaaaugguuccagauac

SEQ ID NO: 130307 - RNA, 19 nt, Homo sapiens
gccagauggugcaauguuc

SEQ ID NO: 130308 - RNA, 19 nt, Homo sapiens
agaggugccuaucuuaaca

SEQ ID NO: 130309 - RNA, 19 nt, Homo sapiens
agacaugcuuacauagaau

SEQ ID NO: 130310 - RNA, 19 nt, Homo sapiens
cagaguggacaauuuauca

SEQ ID NO: 130311 - RNA, 19 nt, Homo sapiens
aacgaucuguguauaguga

SEQ ID NO: 130312 - RNA, 19 nt, Homo sapiens
gugggaauguucuucagau

SEQ ID NO: 130313 - RNA, 19 nt, Homo sapiens
gaagagucauuuucaccuu

SEQ ID NO: 130314 - RNA, 19 nt, Homo sapiens
cuacugucuggauuaauua

SEQ ID NO: 130315 - RNA, 19 nt, Homo sapiens
ucucuacugucuggauuaa

SEQ ID NO: 130316 - RNA, 19 nt, Homo sapiens
caacauuugugaauauccu

SEQ ID NO: 130317 - RNA, 19 nt, Homo sapiens
gguagaugguuccaguauc

SEQ ID NO: 130318 - RNA, 19 nt, Homo sapiens
guaucuucguaacuucaua

SEQ ID NO: 130319 - RNA, 19 nt, Homo sapiens
cacuggauguuaaugaaga

SEQ ID NO: 130320 - RNA, 19 nt, Homo sapiens
cauuuuaaguggagacaua

SEQ ID NO: 130321 - RNA, 19 nt, Homo sapiens
guaauuacaucucagcuuu

SEQ ID NO: 130322 - RNA, 19 nt, Homo sapiens
gauguuaacugagcuacua

SEQ ID NO: 130323 - RNA, 19 nt, Homo sapiens
agaaucagcugaaggaauu

SEQ ID NO: 130324 - RNA, 19 nt, Homo sapiens
gguaaagccucauuugaau

SEQ ID NO: 130325 - RNA, 19 nt, Homo sapiens
guaugagucuucuguaauu

SEQ ID NO: 130326 - RNA, 19 nt, Homo sapiens
uaacugagcuacuagagau

SEQ ID NO: 130327 - RNA, 19 nt, Homo sapiens
caacagagaggcuuauuug

SEQ ID NO: 130328 - RNA, 19 nt, Homo sapiens
gaguaugagucuucuguaa

SEQ ID NO: 130329 - RNA, 19 nt, Homo sapiens
ugaagaagcucuccuacau

SEQ ID NO: 130330 - RNA, 19 nt, Homo sapiens
guaauucauugagcaguua

SEQ ID NO: 130331 - RNA, 19 nt, Homo sapiens
ggacugaaccagaugauug

SEQ ID NO: 130332 - RNA, 19 nt, Homo sapiens
uuacccacaugacuuauua

SEQ ID NO: 130333 - RNA, 19 nt, Homo sapiens
caacaagcuuaccagagua

SEQ ID NO: 130334 - RNA, 19 nt, Homo sapiens
gacuuuaucuguccaagaa

SEQ ID NO: 130335 - RNA, 19 nt, Homo sapiens
ccacaugacuuauuaugca

SEQ ID NO: 130336 - RNA, 19 nt, Homo sapiens
gcccagaaguuccugauga

SEQ ID NO: 130337 - RNA, 19 nt, Homo sapiens
gaagcuuucuguugauguu

SEQ ID NO: 130338 - RNA, 19 nt, Homo sapiens
caauaucucuguaguugga

SEQ ID NO: 130339 - RNA, 19 nt, Homo sapiens
gaagagcucaggaauugaa

SEQ ID NO: 130340 - RNA, 19 nt, Homo sapiens
agaaugagaucaccaaagu

SEQ ID NO: 130341 - RNA, 19 nt, Homo sapiens
uacuugggcugaauauuua

SEQ ID NO: 130342 - RNA, 19 nt, Homo sapiens
ugagggagcuucacuugga

SEQ ID NO: 130343 - RNA, 19 nt, Homo sapiens
gcuagauacuggaaaccua

SEQ ID NO: 130344 - RNA, 19 nt, Homo sapiens
gaaugaagaagcucuccua

SEQ ID NO: 130345 - RNA, 19 nt, Homo sapiens
gcuacuagagauauucuua

SEQ ID NO: 130346 - RNA, 19 nt, Homo sapiens
gaaaggacugaauaauuug

SEQ ID NO: 130347 - RNA, 19 nt, Homo sapiens
ggcugaauauuuaguguaa

SEQ ID NO: 130348 - RNA, 19 nt, Homo sapiens
aaacacuagcucuguauua

SEQ ID NO: 130349 - RNA, 19 nt, Homo sapiens
gccaaacacuagcucugua

SEQ ID NO: 130350 - RNA, 19 nt, Homo sapiens
acaacaagcuuaccagagu

SEQ ID NO: 130351 - RNA, 19 nt, Homo sapiens
agaugaggcuucugggaua

SEQ ID NO: 130352 - RNA, 19 nt, Homo sapiens
uuacuugggcugaauauuu

SEQ ID NO: 130353 - RNA, 19 nt, Homo sapiens
aaagccaaauuuccaguuu

SEQ ID NO: 130354 - RNA, 19 nt, Homo sapiens
ggcaaaaucuuguuaaugu

SEQ ID NO: 130355 - RNA, 19 nt, Homo sapiens
aacaauaucucuguaguug

SEQ ID NO: 130356 - RNA, 19 nt, Homo sapiens
ucaauggacugaaccagau

SEQ ID NO: 130357 - RNA, 19 nt, Homo sapiens
gauaaagucaaaugccaaa

SEQ ID NO: 130358 - RNA, 19 nt, Homo sapiens
ggacaaagugccaaaggau

SEQ ID NO: 130359 - RNA, 19 nt, Homo sapiens
aacacuagcucuguauuaa

SEQ ID NO: 130360 - RNA, 19 nt, Homo sapiens
aagccaaauuuccaguuua

SEQ ID NO: 130361 - RNA, 19 nt, Homo sapiens
gagcuucacuuggacaaca

SEQ ID NO: 130362 - RNA, 19 nt, Homo sapiens
ccaagaaucagcugaagga

SEQ ID NO: 130363 - RNA, 19 nt, Homo sapiens
cagagaggcuuauuugacu

SEQ ID NO: 130364 - RNA, 19 nt, Homo sapiens
gguccaguguucugauuug

SEQ ID NO: 130365 - RNA, 19 nt, Homo sapiens
guggcaaauucccggauua

SEQ ID NO: 130366 - RNA, 19 nt, Homo sapiens
uaacugcaauguggauguu

SEQ ID NO: 130367 - RNA, 19 nt, Homo sapiens
ccauucaacucggaaacua

SEQ ID NO: 130368 - RNA, 19 nt, Homo sapiens
ugaugcagcuagccugaaa

SEQ ID NO: 130369 - RNA, 19 nt, Homo sapiens
gcaaauucccggauuaaaa

SEQ ID NO: 130370 - RNA, 19 nt, Homo sapiens
caacaauaucucuguaguu

SEQ ID NO: 130371 - RNA, 19 nt, Homo sapiens
gcaccaauccgcugaagag

SEQ ID NO: 130372 - RNA, 19 nt, Homo sapiens
gaaccuucacgcauugauu

SEQ ID NO: 130373 - RNA, 19 nt, Homo sapiens
agccaaauuuccaguuuaa

SEQ ID NO: 130374 - RNA, 19 nt, Homo sapiens
gcauaaagccaaauuucca

SEQ ID NO: 130375 - RNA, 19 nt, Homo sapiens
cugaaaggacugaauaauu

SEQ ID NO: 130376 - RNA, 19 nt, Homo sapiens
ugaauucaauacaggcuau

SEQ ID NO: 130377 - RNA, 19 nt, Homo sapiens
guaguuggaucaagugacu

SEQ ID NO: 130378 - RNA, 19 nt, Homo sapiens
cugaaggaauugccagaaa

SEQ ID NO: 130379 - RNA, 19 nt, Homo sapiens
gcaacccgguccaguacug

SEQ ID NO: 130380 - RNA, 19 nt, Homo sapiens
gaagaagcucuccuacauc

SEQ ID NO: 130381 - RNA, 19 nt, Homo sapiens
gggcuccuguggcaaauuc

SEQ ID NO: 130382 - RNA, 19 nt, Homo sapiens
caucucugcuguugacaau

SEQ ID NO: 130383 - RNA, 19 nt, Homo sapiens
gagaggcuuauuugacuuu

SEQ ID NO: 130384 - RNA, 19 nt, Homo sapiens
gcuggaccguuucaacaga

SEQ ID NO: 130385 - RNA, 19 nt, Homo sapiens
cacuagcucuguauuaauc

SEQ ID NO: 130386 - RNA, 19 nt, Homo sapiens
uaacugugcuauggaguag

SEQ ID NO: 130387 - RNA, 19 nt, Homo sapiens
ggucuuccuccuucccuua

SEQ ID NO: 130388 - RNA, 19 nt, Homo sapiens
ucauagaacugggcaccaa

SEQ ID NO: 130389 - RNA, 19 nt, Homo sapiens
ccaaauuuccaguuuaagu

SEQ ID NO: 130390 - RNA, 19 nt, Homo sapiens
acucggaaacuauaaguaa

SEQ ID NO: 130391 - RNA, 19 nt, Homo sapiens
uuacggaauuacaucuuga

SEQ ID NO: 130392 - RNA, 19 nt, Homo sapiens
cagcauuccucaaggucuu

SEQ ID NO: 130393 - RNA, 19 nt, Homo sapiens
uuaagaaccugaagaaccu

SEQ ID NO: 130394 - RNA, 19 nt, Homo sapiens
ugguaaagccucauuugaa

SEQ ID NO: 130395 - RNA, 19 nt, Homo sapiens
ccacaccugcaaacucuuu

SEQ ID NO: 130396 - RNA, 19 nt, Homo sapiens
ucagcaacccgguccagua

SEQ ID NO: 130397 - RNA, 19 nt, Homo sapiens
auaaguacauccagguugu

SEQ ID NO: 130398 - RNA, 19 nt, Homo sapiens
cggaaacuauaaguaauuc

SEQ ID NO: 130399 - RNA, 19 nt, Homo sapiens
gaauaauuuggcuaaguug

SEQ ID NO: 130400 - RNA, 19 nt, Homo sapiens
ugacacaacucugcuagac

SEQ ID NO: 130401 - RNA, 19 nt, Homo sapiens
gggcugaauauuuagugua

SEQ ID NO: 130402 - RNA, 19 nt, Homo sapiens
uaaagucaaaugccaaaca

SEQ ID NO: 130403 - RNA, 19 nt, Homo sapiens
uguaauucauugagcaguu

SEQ ID NO: 130404 - RNA, 19 nt, Homo sapiens
aauuacaucucagcuuuga

SEQ ID NO: 130405 - RNA, 19 nt, Homo sapiens
ucaacagagaggcuuauuu

SEQ ID NO: 130406 - RNA, 19 nt, Homo sapiens
acaacaauaucucuguagu

SEQ ID NO: 130407 - RNA, 19 nt, Homo sapiens
gcauaaguacauccagguu

SEQ ID NO: 130408 - RNA, 19 nt, Homo sapiens
cuucacgcauugauucuug

SEQ ID NO: 130409 - RNA, 19 nt, Homo sapiens
agucaaaugccaaacacua

SEQ ID NO: 130410 - RNA, 19 nt, Homo sapiens
gccaacacgccucaucuga

SEQ ID NO: 130411 - RNA, 19 nt, Homo sapiens
gagaaugagaucaccaaag

SEQ ID NO: 130412 - RNA, 19 nt, Homo sapiens
gggauaggcccagaaguuc

SEQ ID NO: 130413 - RNA, 19 nt, Homo sapiens
aggcuuauuugacuuuaug

SEQ ID NO: 130414 - RNA, 19 nt, Homo sapiens
ccaaacacuagcucuguau

SEQ ID NO: 130415 - RNA, 19 nt, Homo sapiens
ggaaaccuaacugcaaugu

SEQ ID NO: 130416 - RNA, 19 nt, Homo sapiens
cuagauacuggaaaccuaa

SEQ ID NO: 130417 - RNA, 19 nt, Homo sapiens
uggcagagcauaaguacau

SEQ ID NO: 130418 - RNA, 19 nt, Homo sapiens
ugaaggaauugccagaaaa

SEQ ID NO: 130419 - RNA, 19 nt, Homo sapiens
gaggcuuauuugacuuuau

SEQ ID NO: 130420 - RNA, 19 nt, Homo sapiens
caaacacuagcucuguauu

SEQ ID NO: 130421 - RNA, 19 nt, Homo sapiens
gauguuaacugagcuacua

SEQ ID NO: 130422 - RNA, 19 nt, Homo sapiens
agaaucagcugaaggaauu

SEQ ID NO: 130423 - RNA, 19 nt, Homo sapiens
gguaaagccucauuugaau

SEQ ID NO: 130424 - RNA, 19 nt, Homo sapiens
guaugagucuucuguaauu

SEQ ID NO: 130425 - RNA, 19 nt, Homo sapiens
uaacugagcuacuagagau

SEQ ID NO: 130426 - RNA, 19 nt, Homo sapiens
caacagagaggcuuauuug

SEQ ID NO: 130427 - RNA, 19 nt, Homo sapiens
gaguaugagucuucuguaa

SEQ ID NO: 130428 - RNA, 19 nt, Homo sapiens
ugaagaagcucuccuacau

SEQ ID NO: 130429 - RNA, 19 nt, Homo sapiens
guaauucauugagcaguua

SEQ ID NO: 130430 - RNA, 19 nt, Homo sapiens
ggacugaaccagaugauug

SEQ ID NO: 130431 - RNA, 19 nt, Homo sapiens
gaagcccacuaucucauuu

SEQ ID NO: 130432 - RNA, 19 nt, Homo sapiens
uuacccacaugacuuauua

SEQ ID NO: 130433 - RNA, 19 nt, Homo sapiens
caacaagcuuaccagagua

SEQ ID NO: 130434 - RNA, 19 nt, Homo sapiens
gacuuuaucuguccaagaa

SEQ ID NO: 130435 - RNA, 19 nt, Homo sapiens
ccacaugacuuauuaugca

SEQ ID NO: 130436 - RNA, 19 nt, Homo sapiens
gcccagaaguuccugauga

SEQ ID NO: 130437 - RNA, 19 nt, Homo sapiens
gaagcuuucuguugauguu

SEQ ID NO: 130438 - RNA, 19 nt, Homo sapiens
caauaucucuguaguugga

SEQ ID NO: 130439 - RNA, 19 nt, Homo sapiens
gaagagcucaggaauugaa

SEQ ID NO: 130440 - RNA, 19 nt, Homo sapiens
agaaugagaucaccaaagu

SEQ ID NO: 130441 - RNA, 19 nt, Homo sapiens
gaagagaagcccacuaucu

SEQ ID NO: 130442 - RNA, 19 nt, Homo sapiens
ugagggagcuucacuugga

SEQ ID NO: 130443 - RNA, 19 nt, Homo sapiens
gcuagauacuggaaaccua

SEQ ID NO: 130444 - RNA, 19 nt, Homo sapiens
gaaugaagaagcucuccua

SEQ ID NO: 130445 - RNA, 19 nt, Homo sapiens
gcuacuagagauauucuua

SEQ ID NO: 130446 - RNA, 19 nt, Homo sapiens
gaaaggacugaauaauuug

SEQ ID NO: 130447 - RNA, 19 nt, Homo sapiens
aaacacuagcucuguauua

SEQ ID NO: 130448 - RNA, 19 nt, Homo sapiens
gccaaacacuagcucugua

SEQ ID NO: 130449 - RNA, 19 nt, Homo sapiens
acaacaagcuuaccagagu

SEQ ID NO: 130450 - RNA, 19 nt, Homo sapiens
agaugaggcuucugggaua

SEQ ID NO: 130451 - RNA, 19 nt, Homo sapiens
aaagccaaauuuccaguuu

SEQ ID NO: 130452 - RNA, 19 nt, Homo sapiens
ggcaaaaucuuguuaaugu

SEQ ID NO: 130453 - RNA, 19 nt, Homo sapiens
aacaauaucucuguaguug

SEQ ID NO: 130454 - RNA, 19 nt, Homo sapiens
ucaauggacugaaccagau

SEQ ID NO: 130455 - RNA, 19 nt, Homo sapiens
gauaaagucaaaugccaaa

SEQ ID NO: 130456 - RNA, 19 nt, Homo sapiens
ggacaaagugccaaaggau

SEQ ID NO: 130457 - RNA, 19 nt, Homo sapiens
aacacuagcucuguauuaa

SEQ ID NO: 130458 - RNA, 19 nt, Homo sapiens
aagccaaauuuccaguuua

SEQ ID NO: 130459 - RNA, 19 nt, Homo sapiens
gagcuucacuuggacaaca

SEQ ID NO: 130460 - RNA, 19 nt, Homo sapiens
ccaagaaucagcugaagga

SEQ ID NO: 130461 - RNA, 19 nt, Homo sapiens
cagagaggcuuauuugacu

SEQ ID NO: 130462 - RNA, 19 nt, Homo sapiens
gguccaguguucugauuug

SEQ ID NO: 130463 - RNA, 19 nt, Homo sapiens
cagaagagaagcccacuau

SEQ ID NO: 130464 - RNA, 19 nt, Homo sapiens
uaacugcaauguggauguu

SEQ ID NO: 130465 - RNA, 19 nt, Homo sapiens
ccauucaacucggaaacua

SEQ ID NO: 130466 - RNA, 19 nt, Homo sapiens
ugaugcagcuagccugaaa

SEQ ID NO: 130467 - RNA, 19 nt, Homo sapiens
caacaauaucucuguaguu

SEQ ID NO: 130468 - RNA, 19 nt, Homo sapiens
gcaccaauccgcugaagag

SEQ ID NO: 130469 - RNA, 19 nt, Homo sapiens
gaaccuucacgcauugauu

SEQ ID NO: 130470 - RNA, 19 nt, Homo sapiens
agccaaauuuccaguuuaa

SEQ ID NO: 130471 - RNA, 19 nt, Homo sapiens
gcauaaagccaaauuucca

SEQ ID NO: 130472 - RNA, 19 nt, Homo sapiens
cugaaaggacugaauaauu

SEQ ID NO: 130473 - RNA, 19 nt, Homo sapiens
ugaauucaauacaggcuau

SEQ ID NO: 130474 - RNA, 19 nt, Homo sapiens
guaguuggaucaagugacu

SEQ ID NO: 130475 - RNA, 19 nt, Homo sapiens
cugaaggaauugccagaaa

SEQ ID NO: 130476 - RNA, 19 nt, Homo sapiens
gcaacccgguccaguacug

SEQ ID NO: 130477 - RNA, 19 nt, Homo sapiens
gaagaagcucuccuacauc

SEQ ID NO: 130478 - RNA, 19 nt, Homo sapiens
cccacuaucucauuuaauc

SEQ ID NO: 130479 - RNA, 19 nt, Homo sapiens
gcuggaccguuucaacaga

SEQ ID NO: 130480 - RNA, 19 nt, Homo sapiens
caucucugcuguugacaau

SEQ ID NO: 130481 - RNA, 19 nt, Homo sapiens
gagaggcuuauuugacuuu

SEQ ID NO: 130482 - RNA, 19 nt, Homo sapiens
cacuagcucuguauuaauc

SEQ ID NO: 130483 - RNA, 19 nt, Homo sapiens
ggucuuccuccuucccuua

SEQ ID NO: 130484 - RNA, 19 nt, Homo sapiens
ucauagaacugggcaccaa

SEQ ID NO: 130485 - RNA, 19 nt, Homo sapiens
ccaaauuuccaguuuaagu

SEQ ID NO: 130486 - RNA, 19 nt, Homo sapiens
acucggaaacuauaaguaa

SEQ ID NO: 130487 - RNA, 19 nt, Homo sapiens
uuacggaauuacaucuuga

SEQ ID NO: 130488 - RNA, 19 nt, Homo sapiens
cagcauuccucaaggucuu

SEQ ID NO: 130489 - RNA, 19 nt, Homo sapiens
uuaagaaccugaagaaccu

SEQ ID NO: 130490 - RNA, 19 nt, Homo sapiens
ugguaaagccucauuugaa

SEQ ID NO: 130491 - RNA, 19 nt, Homo sapiens
ucagcaacccgguccagua

SEQ ID NO: 130492 - RNA, 19 nt, Homo sapiens
auaaguacauccagguugu

SEQ ID NO: 130493 - RNA, 19 nt, Homo sapiens
cggaaacuauaaguaauuc

SEQ ID NO: 130494 - RNA, 19 nt, Homo sapiens
gaauaauuuggcuaaguug

SEQ ID NO: 130495 - RNA, 19 nt, Homo sapiens
ugacacaacucugcuagac

SEQ ID NO: 130496 - RNA, 19 nt, Homo sapiens
uaaagucaaaugccaaaca

SEQ ID NO: 130497 - RNA, 19 nt, Homo sapiens
uguaauucauugagcaguu

SEQ ID NO: 130498 - RNA, 19 nt, Homo sapiens
ucaacagagaggcuuauuu

SEQ ID NO: 130499 - RNA, 19 nt, Homo sapiens
acaacaauaucucuguagu

SEQ ID NO: 130500 - RNA, 19 nt, Homo sapiens
gcauaaguacauccagguu

SEQ ID NO: 130501 - RNA, 19 nt, Homo sapiens
cuucacgcauugauucuug

SEQ ID NO: 130502 - RNA, 19 nt, Homo sapiens
agucaaaugccaaacacua

SEQ ID NO: 130503 - RNA, 19 nt, Homo sapiens
gggauaggcccagaaguuc

SEQ ID NO: 130504 - RNA, 19 nt, Homo sapiens
gccaacacgccucaucuga

SEQ ID NO: 130505 - RNA, 19 nt, Homo sapiens
aggcuuauuugacuuuaug

SEQ ID NO: 130506 - RNA, 19 nt, Homo sapiens
gagaaugagaucaccaaag

SEQ ID NO: 130507 - RNA, 19 nt, Homo sapiens
ccaaacacuagcucuguau

SEQ ID NO: 130508 - RNA, 19 nt, Homo sapiens
ggaaaccuaacugcaaugu

SEQ ID NO: 130509 - RNA, 19 nt, Homo sapiens
cuagauacuggaaaccuaa

SEQ ID NO: 130510 - RNA, 19 nt, Homo sapiens
uggcagagcauaaguacau

SEQ ID NO: 130511 - RNA, 19 nt, Homo sapiens
gaggcuuauuugacuuuau

SEQ ID NO: 130512 - RNA, 19 nt, Homo sapiens
ugaaggaauugccagaaaa

SEQ ID NO: 130513 - RNA, 19 nt, Homo sapiens
caaacacuagcucuguauu

SEQ ID NO: 130514 - RNA, 19 nt, Homo sapiens
auacagccauccaccuuca

SEQ ID NO: 130515 - RNA, 19 nt, Homo sapiens
gaugaggcuucugggauag

SEQ ID NO: 130516 - RNA, 19 nt, Homo sapiens
gacugaauaauuuggcuaa

SEQ ID NO: 130517 - RNA, 19 nt, Homo sapiens
uggacaaagugccaaagga

SEQ ID NO: 130518 - RNA, 19 nt, Homo sapiens
agucuucuguaauucauug

SEQ ID NO: 130519 - RNA, 19 nt, Homo sapiens
cuggaaaccuaacugcaau

SEQ ID NO: 130520 - RNA, 19 nt, Homo sapiens
aaagcuagauacuggaaac

SEQ ID NO: 130521 - RNA, 19 nt, Homo sapiens
gauguuaacugagcuacua

SEQ ID NO: 130522 - RNA, 19 nt, Homo sapiens
gguaaagccucauuugaau

SEQ ID NO: 130523 - RNA, 19 nt, Homo sapiens
guaugagucuucuguaauu

SEQ ID NO: 130524 - RNA, 19 nt, Homo sapiens
uaacugagcuacuagagau

SEQ ID NO: 130525 - RNA, 19 nt, Homo sapiens
caacagagaggcuuauuug

SEQ ID NO: 130526 - RNA, 19 nt, Homo sapiens
gaguaugagucuucuguaa

SEQ ID NO: 130527 - RNA, 19 nt, Homo sapiens
ugaagaagcucuccuacau

SEQ ID NO: 130528 - RNA, 19 nt, Homo sapiens
guaauucauugagcaguua

SEQ ID NO: 130529 - RNA, 19 nt, Homo sapiens
uuacccacaugacuuauua

SEQ ID NO: 130530 - RNA, 19 nt, Homo sapiens
caacaagcuuaccagagua

SEQ ID NO: 130531 - RNA, 19 nt, Homo sapiens
ccacaugacuuauuaugca

SEQ ID NO: 130532 - RNA, 19 nt, Homo sapiens
gcccagaaguuccugauga

SEQ ID NO: 130533 - RNA, 19 nt, Homo sapiens
gaagcuuucuguugauguu

SEQ ID NO: 130534 - RNA, 19 nt, Homo sapiens
caauaucucuguaguugga

SEQ ID NO: 130535 - RNA, 19 nt, Homo sapiens
gaagagcucaggaauugaa

SEQ ID NO: 130536 - RNA, 19 nt, Homo sapiens
ugagggagcuucacuugga

SEQ ID NO: 130537 - RNA, 19 nt, Homo sapiens
gcuagauacuggaaaccua

SEQ ID NO: 130538 - RNA, 19 nt, Homo sapiens
gaaugaagaagcucuccua

SEQ ID NO: 130539 - RNA, 19 nt, Homo sapiens
gcuacuagagauauucuua

SEQ ID NO: 130540 - RNA, 19 nt, Homo sapiens
gaaaggacugaauaauuug

SEQ ID NO: 130541 - RNA, 19 nt, Homo sapiens
aaacacuagcucuguauua

SEQ ID NO: 130542 - RNA, 19 nt, Homo sapiens
gccaaacacuagcucugua

SEQ ID NO: 130543 - RNA, 19 nt, Homo sapiens
acaacaagcuuaccagagu

SEQ ID NO: 130544 - RNA, 19 nt, Homo sapiens
agaugaggcuucugggaua

SEQ ID NO: 130545 - RNA, 19 nt, Homo sapiens
aaagccaaauuuccaguuu

SEQ ID NO: 130546 - RNA, 19 nt, Homo sapiens
ggcaaaaucuuguuaaugu

SEQ ID NO: 130547 - RNA, 19 nt, Homo sapiens
aacaauaucucuguaguug

SEQ ID NO: 130548 - RNA, 19 nt, Homo sapiens
gauaaagucaaaugccaaa

SEQ ID NO: 130549 - RNA, 19 nt, Homo sapiens
aacacuagcucuguauuaa

SEQ ID NO: 130550 - RNA, 19 nt, Homo sapiens
ccaguguucugauuuggaa

SEQ ID NO: 130551 - RNA, 19 nt, Homo sapiens
aagccaaauuuccaguuua

SEQ ID NO: 130552 - RNA, 19 nt, Homo sapiens
gagcuucacuuggacaaca

SEQ ID NO: 130553 - RNA, 19 nt, Homo sapiens
cagagaggcuuauuugacu

SEQ ID NO: 130554 - RNA, 19 nt, Homo sapiens
gguccaguguucugauuug

SEQ ID NO: 130555 - RNA, 19 nt, Homo sapiens
uaacugcaauguggauguu

SEQ ID NO: 130556 - RNA, 19 nt, Homo sapiens
ccauucaacucggaaacua

SEQ ID NO: 130557 - RNA, 19 nt, Homo sapiens
ugaugcagcuagccugaaa

SEQ ID NO: 130558 - RNA, 19 nt, Homo sapiens
caacaauaucucuguaguu

SEQ ID NO: 130559 - RNA, 19 nt, Homo sapiens
gcaccaauccgcugaagag

SEQ ID NO: 130560 - RNA, 19 nt, Homo sapiens
agccaaauuuccaguuuaa

SEQ ID NO: 130561 - RNA, 19 nt, Homo sapiens
gcauaaagccaaauuucca

SEQ ID NO: 130562 - RNA, 19 nt, Homo sapiens
cugaaaggacugaauaauu

SEQ ID NO: 130563 - RNA, 19 nt, Homo sapiens
ugaauucaauacaggcuau

SEQ ID NO: 130564 - RNA, 19 nt, Homo sapiens
guaguuggaucaagugacu

SEQ ID NO: 130565 - RNA, 19 nt, Homo sapiens
gcaacccgguccaguacug

SEQ ID NO: 130566 - RNA, 19 nt, Homo sapiens
gaagaagcucuccuacauc

SEQ ID NO: 130567 - RNA, 19 nt, Homo sapiens
gcuggaccguuucaacaga

SEQ ID NO: 130568 - RNA, 19 nt, Homo sapiens
caucucugcuguugacaau

SEQ ID NO: 130569 - RNA, 19 nt, Homo sapiens
gagaggcuuauuugacuuu

SEQ ID NO: 130570 - RNA, 19 nt, Homo sapiens
cacuagcucuguauuaauc

SEQ ID NO: 130571 - RNA, 19 nt, Homo sapiens
ggucuuccuccuucccuua

SEQ ID NO: 130572 - RNA, 19 nt, Homo sapiens
ccaaauuuccaguuuaagu

SEQ ID NO: 130573 - RNA, 19 nt, Homo sapiens
acucggaaacuauaaguaa

SEQ ID NO: 130574 - RNA, 19 nt, Homo sapiens
uuacggaauuacaucuuga

SEQ ID NO: 130575 - RNA, 19 nt, Homo sapiens
cagcauuccucaaggucuu

SEQ ID NO: 130576 - RNA, 19 nt, Homo sapiens
ugguaaagccucauuugaa

SEQ ID NO: 130577 - RNA, 19 nt, Homo sapiens
ucagcaacccgguccagua

SEQ ID NO: 130578 - RNA, 19 nt, Homo sapiens
auaaguacauccagguugu

SEQ ID NO: 130579 - RNA, 19 nt, Homo sapiens
cggaaacuauaaguaauuc

SEQ ID NO: 130580 - RNA, 19 nt, Homo sapiens
gaauaauuuggcuaaguug

SEQ ID NO: 130581 - RNA, 19 nt, Homo sapiens
uaaagucaaaugccaaaca

SEQ ID NO: 130582 - RNA, 19 nt, Homo sapiens
uguaauucauugagcaguu

SEQ ID NO: 130583 - RNA, 19 nt, Homo sapiens
ucaacagagaggcuuauuu

SEQ ID NO: 130584 - RNA, 19 nt, Homo sapiens
acaacaauaucucuguagu

SEQ ID NO: 130585 - RNA, 19 nt, Homo sapiens
gcauaaguacauccagguu

SEQ ID NO: 130586 - RNA, 19 nt, Homo sapiens
agucaaaugccaaacacua

SEQ ID NO: 130587 - RNA, 19 nt, Homo sapiens
gggauaggcccagaaguuc

SEQ ID NO: 130588 - RNA, 19 nt, Homo sapiens
aggcuuauuugacuuuaug

SEQ ID NO: 130589 - RNA, 19 nt, Homo sapiens
gccaacacgccucaucuga

SEQ ID NO: 130590 - RNA, 19 nt, Homo sapiens
ccaaacacuagcucuguau

SEQ ID NO: 130591 - RNA, 19 nt, Homo sapiens
ggaaaccuaacugcaaugu

SEQ ID NO: 130592 - RNA, 19 nt, Homo sapiens
cuagauacuggaaaccuaa

SEQ ID NO: 130593 - RNA, 19 nt, Homo sapiens
uggcagagcauaaguacau

SEQ ID NO: 130594 - RNA, 19 nt, Homo sapiens
gaggcuuauuugacuuuau

SEQ ID NO: 130595 - RNA, 19 nt, Homo sapiens
gaugaggcuucugggauag

SEQ ID NO: 130596 - RNA, 19 nt, Homo sapiens
caaacacuagcucuguauu

SEQ ID NO: 130597 - RNA, 19 nt, Homo sapiens
auacagccauccaccuuca

SEQ ID NO: 130598 - RNA, 19 nt, Homo sapiens
gacugaauaauuuggcuaa

SEQ ID NO: 130599 - RNA, 19 nt, Homo sapiens
agucuucuguaauucauug

SEQ ID NO: 130600 - RNA, 19 nt, Homo sapiens
uuccugggcuggaccguuu

SEQ ID NO: 130601 - RNA, 19 nt, Homo sapiens
cuggaaaccuaacugcaau

SEQ ID NO: 130602 - RNA, 19 nt, Homo sapiens
aaagcuagauacuggaaac

SEQ ID NO: 130603 - RNA, 19 nt, Homo sapiens
guacauccagguugucuac

SEQ ID NO: 130604 - RNA, 19 nt, Homo sapiens
gggcuggaccguuucaaca

SEQ ID NO: 130605 - RNA, 19 nt, Homo sapiens
gcucaggaauugaaaaugg

SEQ ID NO: 130606 - RNA, 19 nt, Homo sapiens
gugguccaguguucugauu

SEQ ID NO: 130607 - RNA, 19 nt, Homo sapiens
cuuacggaauuacaucuug

SEQ ID NO: 130608 - RNA, 19 nt, Homo sapiens
uaaagccaaauuuccaguu

SEQ ID NO: 130609 - RNA, 19 nt, Homo sapiens
ucaagaaagcccucauuuu

SEQ ID NO: 130610 - RNA, 19 nt, Homo sapiens
ucucugcuguugacaaugg

SEQ ID NO: 130611 - RNA, 19 nt, Homo sapiens
aaguugggauugaguuuca

SEQ ID NO: 130612 - RNA, 19 nt, Homo sapiens
caacucggaaacuauaagu

SEQ ID NO: 130613 - RNA, 19 nt, Homo sapiens
cugaauaauuuggcuaagu

SEQ ID NO: 130614 - RNA, 19 nt, Homo sapiens
aaagucaaaugccaaacac

SEQ ID NO: 130615 - RNA, 19 nt, Homo sapiens
auucaacucggaaacuaua

SEQ ID NO: 130616 - RNA, 19 nt, Homo sapiens
ccacuaucauccuccuucu

SEQ ID NO: 130617 - RNA, 19 nt, Homo sapiens
agaggcuuauuugacuuua

SEQ ID NO: 130618 - RNA, 19 nt, Homo sapiens
gcuaaguugggauugaguu

SEQ ID NO: 130619 - RNA, 19 nt, Homo sapiens
gaaaccuaacugcaaugug

SEQ ID NO: 130620 - RNA, 19 nt, Homo sapiens
cucaagaaagcccucauuu

SEQ ID NO: 130621 - RNA, 19 nt, Homo sapiens
gauguuaacugagcuacua

SEQ ID NO: 130622 - RNA, 19 nt, Homo sapiens
gguaaagccucauuugaau

SEQ ID NO: 130623 - RNA, 19 nt, Homo sapiens
guaugagucuucuguaauu

SEQ ID NO: 130624 - RNA, 19 nt, Homo sapiens
uaacugagcuacuagagau

SEQ ID NO: 130625 - RNA, 19 nt, Homo sapiens
caacagagaggcuuauuug

SEQ ID NO: 130626 - RNA, 19 nt, Homo sapiens
gaguaugagucuucuguaa

SEQ ID NO: 130627 - RNA, 19 nt, Homo sapiens
guaauucauugagcaguua

SEQ ID NO: 130628 - RNA, 19 nt, Homo sapiens
uuacccacaugacuuauua

SEQ ID NO: 130629 - RNA, 19 nt, Homo sapiens
caacaagcuuaccagagua

SEQ ID NO: 130630 - RNA, 19 nt, Homo sapiens
ccacaugacuuauuaugca

SEQ ID NO: 130631 - RNA, 19 nt, Homo sapiens
gcccagaaguuccugauga

SEQ ID NO: 130632 - RNA, 19 nt, Homo sapiens
gaagcuuucuguugauguu

SEQ ID NO: 130633 - RNA, 19 nt, Homo sapiens
caauaucucuguaguugga

SEQ ID NO: 130634 - RNA, 19 nt, Homo sapiens
ugagggagcuucacuugga

SEQ ID NO: 130635 - RNA, 19 nt, Homo sapiens
gcuagauacuggaaaccua

SEQ ID NO: 130636 - RNA, 19 nt, Homo sapiens
gcuacuagagauauucuua

SEQ ID NO: 130637 - RNA, 19 nt, Homo sapiens
gaaaggacugaauaauuug

SEQ ID NO: 130638 - RNA, 19 nt, Homo sapiens
aaacacuagcucuguauua

SEQ ID NO: 130639 - RNA, 19 nt, Homo sapiens
gccaaacacuagcucugua

SEQ ID NO: 130640 - RNA, 19 nt, Homo sapiens
acaacaagcuuaccagagu

SEQ ID NO: 130641 - RNA, 19 nt, Homo sapiens
agaugaggcuucugggaua

SEQ ID NO: 130642 - RNA, 19 nt, Homo sapiens
aaagccaaauuuccaguuu

SEQ ID NO: 130643 - RNA, 19 nt, Homo sapiens
ggcaaaaucuuguuaaugu

SEQ ID NO: 130644 - RNA, 19 nt, Homo sapiens
aacaauaucucuguaguug

SEQ ID NO: 130645 - RNA, 19 nt, Homo sapiens
gauaaagucaaaugccaaa

SEQ ID NO: 130646 - RNA, 19 nt, Homo sapiens
aacacuagcucuguauuaa

SEQ ID NO: 130647 - RNA, 19 nt, Homo sapiens
aagccaaauuuccaguuua

SEQ ID NO: 130648 - RNA, 19 nt, Homo sapiens
gagcuucacuuggacaaca

SEQ ID NO: 130649 - RNA, 19 nt, Homo sapiens
cagagaggcuuauuugacu

SEQ ID NO: 130650 - RNA, 19 nt, Homo sapiens
gguccaguguucugauuug

SEQ ID NO: 130651 - RNA, 19 nt, Homo sapiens
uaacugcaauguggauguu

SEQ ID NO: 130652 - RNA, 19 nt, Homo sapiens
ccauucaacucggaaacua

SEQ ID NO: 130653 - RNA, 19 nt, Homo sapiens
ugaugcagcuagccugaaa

SEQ ID NO: 130654 - RNA, 19 nt, Homo sapiens
caacaauaucucuguaguu

SEQ ID NO: 130655 - RNA, 19 nt, Homo sapiens
agccaaauuuccaguuuaa

SEQ ID NO: 130656 - RNA, 19 nt, Homo sapiens
gcauaaagccaaauuucca

SEQ ID NO: 130657 - RNA, 19 nt, Homo sapiens
cugaaaggacugaauaauu

SEQ ID NO: 130658 - RNA, 19 nt, Homo sapiens
ugaauucaauacaggcuau

SEQ ID NO: 130659 - RNA, 19 nt, Homo sapiens
guaguuggaucaagugacu

SEQ ID NO: 130660 - RNA, 19 nt, Homo sapiens
gcaacccgguccaguacug

SEQ ID NO: 130661 - RNA, 19 nt, Homo sapiens
gcuggaccguuucaacaga

SEQ ID NO: 130662 - RNA, 19 nt, Homo sapiens
caucucugcuguugacaau

SEQ ID NO: 130663 - RNA, 19 nt, Homo sapiens
gagaggcuuauuugacuuu

SEQ ID NO: 130664 - RNA, 19 nt, Homo sapiens
cacuagcucuguauuaauc

SEQ ID NO: 130665 - RNA, 19 nt, Homo sapiens
ggucuuccuccuucccuua

SEQ ID NO: 130666 - RNA, 19 nt, Homo sapiens
ccaaauuuccaguuuaagu

SEQ ID NO: 130667 - RNA, 19 nt, Homo sapiens
acucggaaacuauaaguaa

SEQ ID NO: 130668 - RNA, 19 nt, Homo sapiens
uuacggaauuacaucuuga

SEQ ID NO: 130669 - RNA, 19 nt, Homo sapiens
ugguaaagccucauuugaa

SEQ ID NO: 130670 - RNA, 19 nt, Homo sapiens
ucagcaacccgguccagua

SEQ ID NO: 130671 - RNA, 19 nt, Homo sapiens
auaaguacauccagguugu

SEQ ID NO: 130672 - RNA, 19 nt, Homo sapiens
cggaaacuauaaguaauuc

SEQ ID NO: 130673 - RNA, 19 nt, Homo sapiens
gaauaauuuggcuaaguug

SEQ ID NO: 130674 - RNA, 19 nt, Homo sapiens
uaaagucaaaugccaaaca

SEQ ID NO: 130675 - RNA, 19 nt, Homo sapiens
uguaauucauugagcaguu

SEQ ID NO: 130676 - RNA, 19 nt, Homo sapiens
ucaacagagaggcuuauuu

SEQ ID NO: 130677 - RNA, 19 nt, Homo sapiens
acaacaauaucucuguagu

SEQ ID NO: 130678 - RNA, 19 nt, Homo sapiens
gcauaaguacauccagguu

SEQ ID NO: 130679 - RNA, 19 nt, Homo sapiens
agucaaaugccaaacacua

SEQ ID NO: 130680 - RNA, 19 nt, Homo sapiens
gggauaggcccagaaguuc

SEQ ID NO: 130681 - RNA, 19 nt, Homo sapiens
aggcuuauuugacuuuaug

SEQ ID NO: 130682 - RNA, 19 nt, Homo sapiens
gccaacacgccucaucuga

SEQ ID NO: 130683 - RNA, 19 nt, Homo sapiens
ccaaacacuagcucuguau

SEQ ID NO: 130684 - RNA, 19 nt, Homo sapiens
ggaaaccuaacugcaaugu

SEQ ID NO: 130685 - RNA, 19 nt, Homo sapiens
cuagauacuggaaaccuaa

SEQ ID NO: 130686 - RNA, 19 nt, Homo sapiens
gaggcuuauuugacuuuau

SEQ ID NO: 130687 - RNA, 19 nt, Homo sapiens
uggcagagcauaaguacau

SEQ ID NO: 130688 - RNA, 19 nt, Homo sapiens
caaacacuagcucuguauu

SEQ ID NO: 130689 - RNA, 19 nt, Homo sapiens
auacagccauccaccuuca

SEQ ID NO: 130690 - RNA, 19 nt, Homo sapiens
gaugaggcuucugggauag

SEQ ID NO: 130691 - RNA, 19 nt, Homo sapiens
gacugaauaauuuggcuaa

SEQ ID NO: 130692 - RNA, 19 nt, Homo sapiens
uuccugggcuggaccguuu

SEQ ID NO: 130693 - RNA, 19 nt, Homo sapiens
agucuucuguaauucauug

SEQ ID NO: 130694 - RNA, 19 nt, Homo sapiens
cuggaaaccuaacugcaau

SEQ ID NO: 130695 - RNA, 19 nt, Homo sapiens
aaagcuagauacuggaaac

SEQ ID NO: 130696 - RNA, 19 nt, Homo sapiens
gggcuggaccguuucaaca

SEQ ID NO: 130697 - RNA, 19 nt, Homo sapiens
guacauccagguugucuac

SEQ ID NO: 130698 - RNA, 19 nt, Homo sapiens
gugguccaguguucugauu

SEQ ID NO: 130699 - RNA, 19 nt, Homo sapiens
cuuacggaauuacaucuug

SEQ ID NO: 130700 - RNA, 19 nt, Homo sapiens
uaaagccaaauuuccaguu

SEQ ID NO: 130701 - RNA, 19 nt, Homo sapiens
ucaagaaagcccucauuuu

SEQ ID NO: 130702 - RNA, 19 nt, Homo sapiens
ucucugcuguugacaaugg

SEQ ID NO: 130703 - RNA, 19 nt, Homo sapiens
aaguugggauugaguuuca

SEQ ID NO: 130704 - RNA, 19 nt, Homo sapiens
caacucggaaacuauaagu

SEQ ID NO: 130705 - RNA, 19 nt, Homo sapiens
cugaauaauuuggcuaagu

SEQ ID NO: 130706 - RNA, 19 nt, Homo sapiens
agaggcuuauuugacuuua

SEQ ID NO: 130707 - RNA, 19 nt, Homo sapiens
aaagucaaaugccaaacac

SEQ ID NO: 130708 - RNA, 19 nt, Homo sapiens
auucaacucggaaacuaua

SEQ ID NO: 130709 - RNA, 19 nt, Homo sapiens
ccacuaucauccuccuucu

SEQ ID NO: 130710 - RNA, 19 nt, Homo sapiens
gcuaaguugggauugaguu

SEQ ID NO: 130711 - RNA, 19 nt, Homo sapiens
gaaaccuaacugcaaugug

SEQ ID NO: 130712 - RNA, 19 nt, Homo sapiens
cucaagaaagcccucauuu

SEQ ID NO: 130713 - RNA, 19 nt, Homo sapiens
cuaaguugggauugaguuu

SEQ ID NO: 130714 - RNA, 19 nt, Homo sapiens
agagaggcuuauuugacuu

SEQ ID NO: 130715 - RNA, 19 nt, Homo sapiens
gcaaaaucuuguuaauguc

SEQ ID NO: 130716 - RNA, 19 nt, Homo sapiens
acuuuaugcuagaagauga

SEQ ID NO: 130717 - RNA, 19 nt, Homo sapiens
acagagaggcuuauuugac

SEQ ID NO: 130718 - RNA, 19 nt, Homo sapiens
ugagucuucuguaauucau

SEQ ID NO: 130719 - RNA, 19 nt, Homo sapiens
uacgugcgcucugccauuc

SEQ ID NO: 130720 - RNA, 19 nt, Homo sapiens
gccugaaaggacugaauaa

SEQ ID NO: 130721 - RNA, 19 nt, Homo sapiens
gauguuaacugagcuacua

SEQ ID NO: 130722 - RNA, 19 nt, Homo sapiens
gguaaagccucauuugaau

SEQ ID NO: 130723 - RNA, 19 nt, Homo sapiens
guaugagucuucuguaauu

SEQ ID NO: 130724 - RNA, 19 nt, Homo sapiens
uaacugagcuacuagagau

SEQ ID NO: 130725 - RNA, 19 nt, Homo sapiens
caacagagaggcuuauuug

SEQ ID NO: 130726 - RNA, 19 nt, Homo sapiens
gaguaugagucuucuguaa

SEQ ID NO: 130727 - RNA, 19 nt, Homo sapiens
guaauucauugagcaguua

SEQ ID NO: 130728 - RNA, 19 nt, Homo sapiens
uuacccacaugacuuauua

SEQ ID NO: 130729 - RNA, 19 nt, Homo sapiens
ccacaugacuuauuaugca

SEQ ID NO: 130730 - RNA, 19 nt, Homo sapiens
gcccagaaguuccugauga

SEQ ID NO: 130731 - RNA, 19 nt, Homo sapiens
gaagcuuucuguugauguu

SEQ ID NO: 130732 - RNA, 19 nt, Homo sapiens
caauaucucuguaguugga

SEQ ID NO: 130733 - RNA, 19 nt, Homo sapiens
gcuagauacuggaaaccua

SEQ ID NO: 130734 - RNA, 19 nt, Homo sapiens
gcuacuagagauauucuua

SEQ ID NO: 130735 - RNA, 19 nt, Homo sapiens
aaacacuagcucuguauua

SEQ ID NO: 130736 - RNA, 19 nt, Homo sapiens
gccaaacacuagcucugua

SEQ ID NO: 130737 - RNA, 19 nt, Homo sapiens
agaugaggcuucugggaua

SEQ ID NO: 130738 - RNA, 19 nt, Homo sapiens
aaagccaaauuuccaguuu

SEQ ID NO: 130739 - RNA, 19 nt, Homo sapiens
ggcaaaaucuuguuaaugu

SEQ ID NO: 130740 - RNA, 19 nt, Homo sapiens
aacaauaucucuguaguug

SEQ ID NO: 130741 - RNA, 19 nt, Homo sapiens
gauaaagucaaaugccaaa

SEQ ID NO: 130742 - RNA, 19 nt, Homo sapiens
ggacaaagugccaaaggau

SEQ ID NO: 130743 - RNA, 19 nt, Homo sapiens
aacacuagcucuguauuaa

SEQ ID NO: 130744 - RNA, 19 nt, Homo sapiens
aagccaaauuuccaguuua

SEQ ID NO: 130745 - RNA, 19 nt, Homo sapiens
cagagaggcuuauuugacu

SEQ ID NO: 130746 - RNA, 19 nt, Homo sapiens
cacguugucuaccuucaua

SEQ ID NO: 130747 - RNA, 19 nt, Homo sapiens
gguccaguguucugauuug

SEQ ID NO: 130748 - RNA, 19 nt, Homo sapiens
uaacugcaauguggauguu

SEQ ID NO: 130749 - RNA, 19 nt, Homo sapiens
ccauucaacucggaaacua

SEQ ID NO: 130750 - RNA, 19 nt, Homo sapiens
caacaauaucucuguaguu

SEQ ID NO: 130751 - RNA, 19 nt, Homo sapiens
agccaaauuuccaguuuaa

SEQ ID NO: 130752 - RNA, 19 nt, Homo sapiens
gcauaaagccaaauuucca

SEQ ID NO: 130753 - RNA, 19 nt, Homo sapiens
ugaauucaauacaggcuau

SEQ ID NO: 130754 - RNA, 19 nt, Homo sapiens
guaguuggaucaagugacu

SEQ ID NO: 130755 - RNA, 19 nt, Homo sapiens
gcaacccgguccaguacug

SEQ ID NO: 130756 - RNA, 19 nt, Homo sapiens
gcuggaccguuucaacaga

SEQ ID NO: 130757 - RNA, 19 nt, Homo sapiens
gagaggcuuauuugacuuu

SEQ ID NO: 130758 - RNA, 19 nt, Homo sapiens
cacuagcucuguauuaauc

SEQ ID NO: 130759 - RNA, 19 nt, Homo sapiens
ccaaauuuccaguuuaagu

SEQ ID NO: 130760 - RNA, 19 nt, Homo sapiens
acucggaaacuauaaguaa

SEQ ID NO: 130761 - RNA, 19 nt, Homo sapiens
uuaagaaccugaagaaccu

SEQ ID NO: 130762 - RNA, 19 nt, Homo sapiens
ugguaaagccucauuugaa

SEQ ID NO: 130763 - RNA, 19 nt, Homo sapiens
ucagcaacccgguccagua

SEQ ID NO: 130764 - RNA, 19 nt, Homo sapiens
cggaaacuauaaguaauuc

SEQ ID NO: 130765 - RNA, 19 nt, Homo sapiens
ugacacaacucugcuagac

SEQ ID NO: 130766 - RNA, 19 nt, Homo sapiens
uaaagucaaaugccaaaca

SEQ ID NO: 130767 - RNA, 19 nt, Homo sapiens
uguaauucauugagcaguu

SEQ ID NO: 130768 - RNA, 19 nt, Homo sapiens
ucaacagagaggcuuauuu

SEQ ID NO: 130769 - RNA, 19 nt, Homo sapiens
acaacaauaucucuguagu

SEQ ID NO: 130770 - RNA, 19 nt, Homo sapiens
agucaaaugccaaacacua

SEQ ID NO: 130771 - RNA, 19 nt, Homo sapiens
aggcuuauuugacuuuaug

SEQ ID NO: 130772 - RNA, 19 nt, Homo sapiens
gggauaggcccagaaguuc

SEQ ID NO: 130773 - RNA, 19 nt, Homo sapiens
ccaaacacuagcucuguau

SEQ ID NO: 130774 - RNA, 19 nt, Homo sapiens
gaggcuuauuugacuuuau

SEQ ID NO: 130775 - RNA, 19 nt, Homo sapiens
ggaaaccuaacugcaaugu

SEQ ID NO: 130776 - RNA, 19 nt, Homo sapiens
cuagauacuggaaaccuaa

SEQ ID NO: 130777 - RNA, 19 nt, Homo sapiens
caaacacuagcucuguauu

SEQ ID NO: 130778 - RNA, 19 nt, Homo sapiens
gaugaggcuucugggauag

SEQ ID NO: 130779 - RNA, 19 nt, Homo sapiens
auacagccauccaccuuca

SEQ ID NO: 130780 - RNA, 19 nt, Homo sapiens
uggacaaagugccaaagga

SEQ ID NO: 130781 - RNA, 19 nt, Homo sapiens
agucuucuguaauucauug

SEQ ID NO: 130782 - RNA, 19 nt, Homo sapiens
gggcuggaccguuucaaca

SEQ ID NO: 130783 - RNA, 19 nt, Homo sapiens
cuggaaaccuaacugcaau

SEQ ID NO: 130784 - RNA, 19 nt, Homo sapiens
aaagcuagauacuggaaac

SEQ ID NO: 130785 - RNA, 19 nt, Homo sapiens
uuccugggcuggaccguuu

SEQ ID NO: 130786 - RNA, 19 nt, Homo sapiens
gugguccaguguucugauu

SEQ ID NO: 130787 - RNA, 19 nt, Homo sapiens
uaaagccaaauuuccaguu

SEQ ID NO: 130788 - RNA, 19 nt, Homo sapiens
ucaagaaagcccucauuuu

SEQ ID NO: 130789 - RNA, 19 nt, Homo sapiens
gaaccuucacguugucuac

SEQ ID NO: 130790 - RNA, 19 nt, Homo sapiens
caacucggaaacuauaagu

SEQ ID NO: 130791 - RNA, 19 nt, Homo sapiens
agaggcuuauuugacuuua

SEQ ID NO: 130792 - RNA, 19 nt, Homo sapiens
aaagucaaaugccaaacac

SEQ ID NO: 130793 - RNA, 19 nt, Homo sapiens
ccacuaucauccuccuucu

SEQ ID NO: 130794 - RNA, 19 nt, Homo sapiens
auucaacucggaaacuaua

SEQ ID NO: 130795 - RNA, 19 nt, Homo sapiens
gaaaccuaacugcaaugug

SEQ ID NO: 130796 - RNA, 19 nt, Homo sapiens
cucaagaaagcccucauuu

SEQ ID NO: 130797 - RNA, 19 nt, Homo sapiens
gcaaaaucuuguuaauguc

SEQ ID NO: 130798 - RNA, 19 nt, Homo sapiens
agagaggcuuauuugacuu

SEQ ID NO: 130799 - RNA, 19 nt, Homo sapiens
acuuuaugcuagaagauga

SEQ ID NO: 130800 - RNA, 19 nt, Homo sapiens
acagagaggcuuauuugac

SEQ ID NO: 130801 - RNA, 19 nt, Homo sapiens
ugagucuucuguaauucau

SEQ ID NO: 130802 - RNA, 19 nt, Homo sapiens
uacgugcgcucugccauuc

SEQ ID NO: 130803 - RNA, 19 nt, Homo sapiens
aagauggagacuuuaagaa

SEQ ID NO: 130804 - RNA, 19 nt, Homo sapiens
acaaagugccaaaggaucu

SEQ ID NO: 130805 - RNA, 19 nt, Homo sapiens
cugguaaagccucauuuga

SEQ ID NO: 130806 - RNA, 19 nt, Homo sapiens
ucucaagaaagcccucauu

SEQ ID NO: 130807 - RNA, 19 nt, Homo sapiens
cuacgugcgcucugccauu

SEQ ID NO: 130808 - RNA, 19 nt, Homo sapiens
gauguuaacugagcuacua

SEQ ID NO: 130809 - RNA, 19 nt, Homo sapiens
gguaaagccucauuugaau

SEQ ID NO: 130810 - RNA, 19 nt, Homo sapiens
guaugagucuucuguaauu

SEQ ID NO: 130811 - RNA, 19 nt, Homo sapiens
uaacugagcuacuagagau

SEQ ID NO: 130812 - RNA, 19 nt, Homo sapiens
caacagagaggcuuauuug

SEQ ID NO: 130813 - RNA, 19 nt, Homo sapiens
gaguaugagucuucuguaa

SEQ ID NO: 130814 - RNA, 19 nt, Homo sapiens
guaauucauugagcaguua

SEQ ID NO: 130815 - RNA, 19 nt, Homo sapiens
uuacccacaugacuuauua

SEQ ID NO: 130816 - RNA, 19 nt, Homo sapiens
ccacaugacuuauuaugca

SEQ ID NO: 130817 - RNA, 19 nt, Homo sapiens
gcccagaaguuccugauga

SEQ ID NO: 130818 - RNA, 19 nt, Homo sapiens
gaagcuuucuguugauguu

SEQ ID NO: 130819 - RNA, 19 nt, Homo sapiens
caauaucucuguaguugga

SEQ ID NO: 130820 - RNA, 19 nt, Homo sapiens
gcuagauacuggaaaccua

SEQ ID NO: 130821 - RNA, 19 nt, Homo sapiens
gcuacuagagauauucuua

SEQ ID NO: 130822 - RNA, 19 nt, Homo sapiens
aaacacuagcucuguauua

SEQ ID NO: 130823 - RNA, 19 nt, Homo sapiens
gccaaacacuagcucugua

SEQ ID NO: 130824 - RNA, 19 nt, Homo sapiens
agaugaggcuucugggaua

SEQ ID NO: 130825 - RNA, 19 nt, Homo sapiens
aaagccaaauuuccaguuu

SEQ ID NO: 130826 - RNA, 19 nt, Homo sapiens
ggcaaaaucuuguuaaugu

SEQ ID NO: 130827 - RNA, 19 nt, Homo sapiens
aacaauaucucuguaguug

SEQ ID NO: 130828 - RNA, 19 nt, Homo sapiens
gauaaagucaaaugccaaa

SEQ ID NO: 130829 - RNA, 19 nt, Homo sapiens
aacacuagcucuguauuaa

SEQ ID NO: 130830 - RNA, 19 nt, Homo sapiens
aagccaaauuuccaguuua

SEQ ID NO: 130831 - RNA, 19 nt, Homo sapiens
cagagaggcuuauuugacu

SEQ ID NO: 130832 - RNA, 19 nt, Homo sapiens
gguccaguguucugauuug

SEQ ID NO: 130833 - RNA, 19 nt, Homo sapiens
uaacugcaauguggauguu

SEQ ID NO: 130834 - RNA, 19 nt, Homo sapiens
ccauucaacucggaaacua

SEQ ID NO: 130835 - RNA, 19 nt, Homo sapiens
caacaauaucucuguaguu

SEQ ID NO: 130836 - RNA, 19 nt, Homo sapiens
agccaaauuuccaguuuaa

SEQ ID NO: 130837 - RNA, 19 nt, Homo sapiens
gcauaaagccaaauuucca

SEQ ID NO: 130838 - RNA, 19 nt, Homo sapiens
ugaauucaauacaggcuau

SEQ ID NO: 130839 - RNA, 19 nt, Homo sapiens
guaguuggaucaagugacu

SEQ ID NO: 130840 - RNA, 19 nt, Homo sapiens
gcaacccgguccaguacug

SEQ ID NO: 130841 - RNA, 19 nt, Homo sapiens
uggguugucuaccuucaua

SEQ ID NO: 130842 - RNA, 19 nt, Homo sapiens
gcuggaccguuucaacaga

SEQ ID NO: 130843 - RNA, 19 nt, Homo sapiens
gagaggcuuauuugacuuu

SEQ ID NO: 130844 - RNA, 19 nt, Homo sapiens
cacuagcucuguauuaauc

SEQ ID NO: 130845 - RNA, 19 nt, Homo sapiens
ccaaauuuccaguuuaagu

SEQ ID NO: 130846 - RNA, 19 nt, Homo sapiens
acucggaaacuauaaguaa

SEQ ID NO: 130847 - RNA, 19 nt, Homo sapiens
gauuuggguugucuaccuu

SEQ ID NO: 130848 - RNA, 19 nt, Homo sapiens
ugguaaagccucauuugaa

SEQ ID NO: 130849 - RNA, 19 nt, Homo sapiens
ucagcaacccgguccagua

SEQ ID NO: 130850 - RNA, 19 nt, Homo sapiens
cggaaacuauaaguaauuc

SEQ ID NO: 130851 - RNA, 19 nt, Homo sapiens
ucaacagagaggcuuauuu

SEQ ID NO: 130852 - RNA, 19 nt, Homo sapiens
uaaagucaaaugccaaaca

SEQ ID NO: 130853 - RNA, 19 nt, Homo sapiens
uguaauucauugagcaguu

SEQ ID NO: 130854 - RNA, 19 nt, Homo sapiens
acaacaauaucucuguagu

SEQ ID NO: 130855 - RNA, 19 nt, Homo sapiens
agucaaaugccaaacacua

SEQ ID NO: 130856 - RNA, 19 nt, Homo sapiens
aggcuuauuugacuuuaug

SEQ ID NO: 130857 - RNA, 19 nt, Homo sapiens
gggauaggcccagaaguuc

SEQ ID NO: 130858 - RNA, 19 nt, Homo sapiens
ccaaacacuagcucuguau

SEQ ID NO: 130859 - RNA, 19 nt, Homo sapiens
ggaaaccuaacugcaaugu

SEQ ID NO: 130860 - RNA, 19 nt, Homo sapiens
cuagauacuggaaaccuaa

SEQ ID NO: 130861 - RNA, 19 nt, Homo sapiens
gaggcuuauuugacuuuau

SEQ ID NO: 130862 - RNA, 19 nt, Homo sapiens
caaacacuagcucuguauu

SEQ ID NO: 130863 - RNA, 19 nt, Homo sapiens
gaugaggcuucugggauag

SEQ ID NO: 130864 - RNA, 19 nt, Homo sapiens
auacagccauccaccuuca

SEQ ID NO: 130865 - RNA, 19 nt, Homo sapiens
agucuucuguaauucauug

SEQ ID NO: 130866 - RNA, 19 nt, Homo sapiens
gggcuggaccguuucaaca

SEQ ID NO: 130867 - RNA, 19 nt, Homo sapiens
cuggaaaccuaacugcaau

SEQ ID NO: 130868 - RNA, 19 nt, Homo sapiens
aaagcuagauacuggaaac

SEQ ID NO: 130869 - RNA, 19 nt, Homo sapiens
uuccugggcuggaccguuu

SEQ ID NO: 130870 - RNA, 19 nt, Homo sapiens
gugguccaguguucugauu

SEQ ID NO: 130871 - RNA, 19 nt, Homo sapiens
uaaagccaaauuuccaguu

SEQ ID NO: 130872 - RNA, 19 nt, Homo sapiens
ucaagaaagcccucauuuu

SEQ ID NO: 130873 - RNA, 19 nt, Homo sapiens
caacucggaaacuauaagu

SEQ ID NO: 130874 - RNA, 19 nt, Homo sapiens
aaagucaaaugccaaacac

SEQ ID NO: 130875 - RNA, 19 nt, Homo sapiens
ccacuaucauccuccuucu

SEQ ID NO: 130876 - RNA, 19 nt, Homo sapiens
agaggcuuauuugacuuua

SEQ ID NO: 130877 - RNA, 19 nt, Homo sapiens
auucaacucggaaacuaua

SEQ ID NO: 130878 - RNA, 19 nt, Homo sapiens
gaaaccuaacugcaaugug

SEQ ID NO: 130879 - RNA, 19 nt, Homo sapiens
cucaagaaagcccucauuu

SEQ ID NO: 130880 - RNA, 19 nt, Homo sapiens
agagaggcuuauuugacuu

SEQ ID NO: 130881 - RNA, 19 nt, Homo sapiens
gcaaaaucuuguuaauguc

SEQ ID NO: 130882 - RNA, 19 nt, Homo sapiens
acuuuaugcuagaagauga

SEQ ID NO: 130883 - RNA, 19 nt, Homo sapiens
acagagaggcuuauuugac

SEQ ID NO: 130884 - RNA, 19 nt, Homo sapiens
ugagucuucuguaauucau

SEQ ID NO: 130885 - RNA, 19 nt, Homo sapiens
uacgugcgcucugccauuc

SEQ ID NO: 130886 - RNA, 19 nt, Homo sapiens
cugguaaagccucauuuga

SEQ ID NO: 130887 - RNA, 19 nt, Homo sapiens
ucucaagaaagcccucauu

SEQ ID NO: 130888 - RNA, 19 nt, Homo sapiens
cuacgugcgcucugccauu

SEQ ID NO: 130889 - RNA, 19 nt, Homo sapiens
guucugauuuggguugucu

SEQ ID NO: 130890 - RNA, 19 nt, Homo sapiens
gcuaaugccuuucaucuug

SEQ ID NO: 130891 - RNA, 19 nt, Homo sapiens
gcagcaagauugucauuga

SEQ ID NO: 130892 - RNA, 19 nt, Homo sapiens
acacauaacuucuuacuag

SEQ ID NO: 130893 - RNA, 19 nt, Homo sapiens
gaaaggcuguaguauguau

SEQ ID NO: 130894 - RNA, 19 nt, Homo sapiens
gugaaaggcuguaguaugu

SEQ ID NO: 130895 - RNA, 19 nt, Homo sapiens
guaggcaucuaaagaauau

SEQ ID NO: 130896 - RNA, 19 nt, Homo sapiens
agaauaagcuggacaccaa

SEQ ID NO: 130897 - RNA, 19 nt, Homo sapiens
ccaaaugggugcagugaug

SEQ ID NO: 130898 - RNA, 19 nt, Homo sapiens
gcgaggcuccuguuuaaua

SEQ ID NO: 130899 - RNA, 19 nt, Homo sapiens
caacgcaguucauguacaa

SEQ ID NO: 130900 - RNA, 19 nt, Homo sapiens
uauaaagccucaaaucuuc

SEQ ID NO: 130901 - RNA, 19 nt, Homo sapiens
ucguuuagcugaauaauga

SEQ ID NO: 130902 - RNA, 19 nt, Homo sapiens
gcaagaaacgggacgacua

SEQ ID NO: 130903 - RNA, 19 nt, Homo sapiens
gaacaucuggcccaaguga

SEQ ID NO: 130904 - RNA, 19 nt, Homo sapiens
gaaacgggacgacuauuug

SEQ ID NO: 130905 - RNA, 19 nt, Homo sapiens
gaaggacagcagagaauaa

SEQ ID NO: 130906 - RNA, 19 nt, Homo sapiens
ccucaaaucuuccuuacug

SEQ ID NO: 130907 - RNA, 19 nt, Homo sapiens
gcacagagaagcaaagauc

SEQ ID NO: 130908 - RNA, 19 nt, Homo sapiens
gugaguggauugugagaaa

SEQ ID NO: 130909 - RNA, 19 nt, Homo sapiens
gaauauaaagccucaaauc

SEQ ID NO: 130910 - RNA, 19 nt, Homo sapiens
ggaaauucauaccgaagug

SEQ ID NO: 130911 - RNA, 19 nt, Homo sapiens
gcgcuaagcucaucaucca

SEQ ID NO: 130912 - RNA, 19 nt, Homo sapiens
gaacuauugcuuuaggauu

SEQ ID NO: 130913 - RNA, 19 nt, Homo sapiens
cugcgaggcuccuguuuaa

SEQ ID NO: 130914 - RNA, 19 nt, Homo sapiens
gaaucuacauguguuugaa

SEQ ID NO: 130915 - RNA, 19 nt, Homo sapiens
gaugugaaaggcuguagua

SEQ ID NO: 130916 - RNA, 19 nt, Homo sapiens
ugaaugccaucaugaacaa

SEQ ID NO: 130917 - RNA, 19 nt, Homo sapiens
gaagcaaagauccaaauuc

SEQ ID NO: 130918 - RNA, 19 nt, Homo sapiens
ggacgacuauuuggaaugg

SEQ ID NO: 130919 - RNA, 19 nt, Homo sapiens
guauguaugucgccuuguu

SEQ ID NO: 130920 - RNA, 19 nt, Homo sapiens
acagggugguggcacauua

SEQ ID NO: 130921 - RNA, 19 nt, Homo sapiens
ugacagacgaggaguguaa

SEQ ID NO: 130922 - RNA, 19 nt, Homo sapiens
acacugaucugaacaucug

SEQ ID NO: 130923 - RNA, 19 nt, Homo sapiens
ucuaggguauucuguaauu

SEQ ID NO: 130924 - RNA, 19 nt, Homo sapiens
gcucuuccauuucguuuag

SEQ ID NO: 130925 - RNA, 19 nt, Homo sapiens
uggaauggccagaguauuu

SEQ ID NO: 130926 - RNA, 19 nt, Homo sapiens
cuacauguguuugaacuau

SEQ ID NO: 130927 - RNA, 19 nt, Homo sapiens
aaaguaggcaucuaaagaa

SEQ ID NO: 130928 - RNA, 19 nt, Homo sapiens
ucuaagagguugcuaaugc

SEQ ID NO: 130929 - RNA, 19 nt, Homo sapiens
gugcagugaugacguguug

SEQ ID NO: 130930 - RNA, 19 nt, Homo sapiens
caagaaacgggacgacuau

SEQ ID NO: 130931 - RNA, 19 nt, Homo sapiens
ggagcugaaugccaucaug

SEQ ID NO: 130932 - RNA, 19 nt, Homo sapiens
uaacugaaccaggaauauu

SEQ ID NO: 130933 - RNA, 19 nt, Homo sapiens
cgaggcuccuguuuaauau

SEQ ID NO: 130934 - RNA, 19 nt, Homo sapiens
ggagaaggacagcagagaa

SEQ ID NO: 130935 - RNA, 19 nt, Homo sapiens
acaaugggaugccaaaugg

SEQ ID NO: 130936 - RNA, 19 nt, Homo sapiens
ucuguaauuuggcuccuua

SEQ ID NO: 130937 - RNA, 19 nt, Homo sapiens
cagccucucuucacugcua

SEQ ID NO: 130938 - RNA, 19 nt, Homo sapiens
gagaaggacagcagagaau

SEQ ID NO: 130939 - RNA, 19 nt, Homo sapiens
caguagcauugaaguguuu

SEQ ID NO: 130940 - RNA, 19 nt, Homo sapiens
gagcaucagcugucuguca

SEQ ID NO: 130941 - RNA, 19 nt, Homo sapiens
gcugcgaggcuccuguuua

SEQ ID NO: 130942 - RNA, 19 nt, Homo sapiens
auaaugaguuguuccuaga

SEQ ID NO: 130943 - RNA, 19 nt, Homo sapiens
gacgaggaguguaacugaa

SEQ ID NO: 130944 - RNA, 19 nt, Homo sapiens
gcauauagugcccuuggaa

SEQ ID NO: 130945 - RNA, 19 nt, Homo sapiens
ggaaucuacauguguuuga

SEQ ID NO: 130946 - RNA, 19 nt, Homo sapiens
caucuugaaguuacacaua

SEQ ID NO: 130947 - RNA, 19 nt, Homo sapiens
aaaauuaggccucaaauga

SEQ ID NO: 130948 - RNA, 19 nt, Homo sapiens
gcuggaaggacaaauaaau

SEQ ID NO: 130949 - RNA, 19 nt, Homo sapiens
agaaacgggacgacuauuu

SEQ ID NO: 130950 - RNA, 19 nt, Homo sapiens
cagccugucucuccuuguu

SEQ ID NO: 130951 - RNA, 19 nt, Homo sapiens
cuaaugccuuucaucuuga

SEQ ID NO: 130952 - RNA, 19 nt, Homo sapiens
agagguugcuaaugccuuu

SEQ ID NO: 130953 - RNA, 19 nt, Homo sapiens
gagaagcaaagauccaaau

SEQ ID NO: 130954 - RNA, 19 nt, Homo sapiens
gagcugaaugccaucauga

SEQ ID NO: 130955 - RNA, 19 nt, Homo sapiens
gcgccugcaucgugaauuc

SEQ ID NO: 130956 - RNA, 19 nt, Homo sapiens
ucucuucacugcuacaugu

SEQ ID NO: 130957 - RNA, 19 nt, Homo sapiens
gaugacguguugccuugga

SEQ ID NO: 130958 - RNA, 19 nt, Homo sapiens
aagcaaagauccaaauucc

SEQ ID NO: 130959 - RNA, 19 nt, Homo sapiens
ccaagugaagcauggcaua

SEQ ID NO: 130960 - RNA, 19 nt, Homo sapiens
gcaacuggagagaaaauua

SEQ ID NO: 130961 - RNA, 19 nt, Homo sapiens
gacaguagcauugaagugu

SEQ ID NO: 130962 - RNA, 19 nt, Homo sapiens
cuggaaggacaaauaaaua

SEQ ID NO: 130963 - RNA, 19 nt, Homo sapiens
uauuaaacaugcucaguac

SEQ ID NO: 130964 - RNA, 19 nt, Homo sapiens
gaauaaugaguuguuccua

SEQ ID NO: 130965 - RNA, 19 nt, Homo sapiens
gugcuggaaggacaaauaa

SEQ ID NO: 130966 - RNA, 19 nt, Homo sapiens
acauguguuugaacuauug

SEQ ID NO: 130967 - RNA, 19 nt, Homo sapiens
ugaaugcgcuaagcucauc

SEQ ID NO: 130968 - RNA, 19 nt, Homo sapiens
acaagcaucaccuuccuaa

SEQ ID NO: 130969 - RNA, 19 nt, Homo sapiens
uaauugugguuguguucuu

SEQ ID NO: 130970 - RNA, 19 nt, Homo sapiens
gacauuccggaaauucaua

SEQ ID NO: 130971 - RNA, 19 nt, Homo sapiens
caucauccaggcagguaua

SEQ ID NO: 130972 - RNA, 19 nt, Homo sapiens
gaauaagcuggacaccaaa

SEQ ID NO: 130973 - RNA, 19 nt, Homo sapiens
auucuaggguauucuguaa

SEQ ID NO: 130974 - RNA, 19 nt, Homo sapiens
caguaccuguguugagaaa

SEQ ID NO: 130975 - RNA, 19 nt, Homo sapiens
cugcagcacuguugguguu

SEQ ID NO: 130976 - RNA, 19 nt, Homo sapiens
ggacgagcagacacacuga

SEQ ID NO: 130977 - RNA, 19 nt, Homo sapiens
cuuguucccuuguaaugaa

SEQ ID NO: 130978 - RNA, 19 nt, Homo sapiens
aagcaucaccuuccuaauc

SEQ ID NO: 130979 - RNA, 19 nt, Homo sapiens
gaguggauugugagaaauu

SEQ ID NO: 130980 - RNA, 19 nt, Homo sapiens
agcaucaccuuccuaauca

SEQ ID NO: 130981 - RNA, 19 nt, Homo sapiens
acaguagcauugaaguguu

SEQ ID NO: 130982 - RNA, 19 nt, Homo sapiens
gugguuguguucuuaaugg

SEQ ID NO: 130983 - RNA, 19 nt, Homo sapiens
aauugugguuguguucuua

SEQ ID NO: 130984 - RNA, 19 nt, Homo sapiens
uccagaagauugggauuau

SEQ ID NO: 130985 - RNA, 19 nt, Homo sapiens
caaaagcuucagugaguua

SEQ ID NO: 130986 - RNA, 19 nt, Homo sapiens
gauaaauaccaugauagug

SEQ ID NO: 130987 - RNA, 19 nt, Homo sapiens
uuucacgucugauaaauac

SEQ ID NO: 130988 - RNA, 19 nt, Homo sapiens
gcugaauaaugaguuguuc

SEQ ID NO: 130989 - RNA, 19 nt, Homo sapiens
agacgaggaguguaacuga

SEQ ID NO: 130990 - RNA, 19 nt, Homo sapiens
gcauagaccuggugacuga

SEQ ID NO: 130991 - RNA, 19 nt, Homo sapiens
gaacuccgcucgcucagaa

SEQ ID NO: 130992 - RNA, 19 nt, Homo sapiens
gaaauaugaagaccuguua

SEQ ID NO: 130993 - RNA, 19 nt, Homo sapiens
gcaaguuuguggaggaaua

SEQ ID NO: 130994 - RNA, 19 nt, Homo sapiens
ccaagucucucugugaaua

SEQ ID NO: 130995 - RNA, 19 nt, Homo sapiens
uaaggaggcugaugauuuc

SEQ ID NO: 130996 - RNA, 19 nt, Homo sapiens
gaaacgaaacccacuuuga

SEQ ID NO: 130997 - RNA, 19 nt, Homo sapiens
ugacaucaauuacuugcua

SEQ ID NO: 130998 - RNA, 19 nt, Homo sapiens
ggagcuaaguuucauguuc

SEQ ID NO: 130999 - RNA, 19 nt, Homo sapiens
ccacagaggcuaugcuaaa

SEQ ID NO: 131000 - RNA, 19 nt, Homo sapiens
gcacacgggucacgaugga

SEQ ID NO: 131001 - RNA, 19 nt, Homo sapiens
ggaaagacuucaggaucaa

SEQ ID NO: 131002 - RNA, 19 nt, Homo sapiens
ucaagcggaucauaaagaa

SEQ ID NO: 131003 - RNA, 19 nt, Homo sapiens
ucagguacuuugugaguuu

SEQ ID NO: 131004 - RNA, 19 nt, Homo sapiens
ccaggaggauguuuaagga

SEQ ID NO: 131005 - RNA, 19 nt, Homo sapiens
uuaaggaggcugaugauuu

SEQ ID NO: 131006 - RNA, 19 nt, Homo sapiens
gcagaagaacaugcaaaua

SEQ ID NO: 131007 - RNA, 19 nt, Homo sapiens
ucacugcccucagcaauga

SEQ ID NO: 131008 - RNA, 19 nt, Homo sapiens
ucaccaaggagaacuauaa

SEQ ID NO: 131009 - RNA, 19 nt, Homo sapiens
cagaagaacaugcaaauag

SEQ ID NO: 131010 - RNA, 19 nt, Homo sapiens
ggcaaggacuuccggauca

SEQ ID NO: 131011 - RNA, 19 nt, Homo sapiens
ccaggaaguuugaugugaa

SEQ ID NO: 131012 - RNA, 19 nt, Homo sapiens
gcaaggaggcaggcuauga

SEQ ID NO: 131013 - RNA, 19 nt, Homo sapiens
ccaaugacacggaaaguga

SEQ ID NO: 131014 - RNA, 19 nt, Homo sapiens
ggcaggaggugcugaagga

SEQ ID NO: 131015 - RNA, 19 nt, Homo sapiens
cggaaagugacaucaauua

SEQ ID NO: 131016 - RNA, 19 nt, Homo sapiens
gcaaugaagccuacaagca

SEQ ID NO: 131017 - RNA, 19 nt, Homo sapiens
acaagucgaugcuggagaa

SEQ ID NO: 131018 - RNA, 19 nt, Homo sapiens
cgaaauacguggaacucau

SEQ ID NO: 131019 - RNA, 19 nt, Homo sapiens
ggacauggucggcuuagau

SEQ ID NO: 131020 - RNA, 19 nt, Homo sapiens
ugaugaagauggcccuuga

SEQ ID NO: 131021 - RNA, 19 nt, Homo sapiens
ccacgucccggaaauauga

SEQ ID NO: 131022 - RNA, 19 nt, Homo sapiens
gaaagugacaucaauuacu

SEQ ID NO: 131023 - RNA, 19 nt, Homo sapiens
ggaggcugaugauuucuuc

SEQ ID NO: 131024 - RNA, 19 nt, Homo sapiens
caccaucccuggagcaaga

SEQ ID NO: 131025 - RNA, 19 nt, Homo sapiens
ggaaauaugaagaccuguu

SEQ ID NO: 131026 - RNA, 19 nt, Homo sapiens
gaaggacauggucggcuua

SEQ ID NO: 131027 - RNA, 19 nt, Homo sapiens
ccaagcaccugcacagucu

SEQ ID NO: 131028 - RNA, 19 nt, Homo sapiens
gcaccaccgugaacuugga

SEQ ID NO: 131029 - RNA, 19 nt, Homo sapiens
gguccaacaucuaugacuu

SEQ ID NO: 131030 - RNA, 19 nt, Homo sapiens
gacaucaauuacuugcuaa

SEQ ID NO: 131031 - RNA, 19 nt, Homo sapiens
ucagcuaccucgucgauca

SEQ ID NO: 131032 - RNA, 19 nt, Homo sapiens
gagcaugacaucaacuuuc

SEQ ID NO: 131033 - RNA, 19 nt, Homo sapiens
gcaaggacuuccggaucaa

SEQ ID NO: 131034 - RNA, 19 nt, Homo sapiens
gaaauacguggaacucauc

SEQ ID NO: 131035 - RNA, 19 nt, Homo sapiens
gcaccagugugacaucuac

SEQ ID NO: 131036 - RNA, 19 nt, Homo sapiens
aaacgaaacccacuuugau

SEQ ID NO: 131037 - RNA, 19 nt, Homo sapiens
agccagaucugacgaaugu

SEQ ID NO: 131038 - RNA, 19 nt, Homo sapiens
gccaggaaguuugauguga

SEQ ID NO: 131039 - RNA, 19 nt, Homo sapiens
gaacuacaacaccaacauc

SEQ ID NO: 131040 - RNA, 19 nt, Homo sapiens
aggaaagacuucaggauca

SEQ ID NO: 131041 - RNA, 19 nt, Homo sapiens
ggacuucuacaacaggaaa

SEQ ID NO: 131042 - RNA, 19 nt, Homo sapiens
uuccaaaugugacaccaua

SEQ ID NO: 131043 - RNA, 19 nt, Homo sapiens
acaccaacaucaccacaga

SEQ ID NO: 131044 - RNA, 19 nt, Homo sapiens
ucaacuuucugaugaagau

SEQ ID NO: 131045 - RNA, 19 nt, Homo sapiens
gagccauccuccaguuuua

SEQ ID NO: 131046 - RNA, 19 nt, Homo sapiens
caacaucaccgcggagaau

SEQ ID NO: 131047 - RNA, 19 nt, Homo sapiens
gcagaacaccacuaucaag

SEQ ID NO: 131048 - RNA, 19 nt, Homo sapiens
ccacagagaccagcaagau

SEQ ID NO: 131049 - RNA, 19 nt, Homo sapiens
uacaucagguacuuuguga

SEQ ID NO: 131050 - RNA, 19 nt, Homo sapiens
caccauacaucagguacuu

SEQ ID NO: 131051 - RNA, 19 nt, Homo sapiens
ggaaagugacaucaauuac

SEQ ID NO: 131052 - RNA, 19 nt, Homo sapiens
uggaacaccucuaccaaca

SEQ ID NO: 131053 - RNA, 19 nt, Homo sapiens
caggacggcuucacagaca

SEQ ID NO: 131054 - RNA, 19 nt, Homo sapiens
ccaaccacacccugaagua

SEQ ID NO: 131055 - RNA, 19 nt, Homo sapiens
cggcuuagaugcccuggau

SEQ ID NO: 131056 - RNA, 19 nt, Homo sapiens
ccacauccaguauuucaug

SEQ ID NO: 131057 - RNA, 19 nt, Homo sapiens
caucccaggugguguggaa

SEQ ID NO: 131058 - RNA, 19 nt, Homo sapiens
ggucuccacuccugaacau

SEQ ID NO: 131059 - RNA, 19 nt, Homo sapiens
uccaguauuucaugcagua

SEQ ID NO: 131060 - RNA, 19 nt, Homo sapiens
uggcuaagcggcagcagua

SEQ ID NO: 131061 - RNA, 19 nt, Homo sapiens
caacuacccggagggcaua

SEQ ID NO: 131062 - RNA, 19 nt, Homo sapiens
ucagguacuuugucagcuu

SEQ ID NO: 131063 - RNA, 19 nt, Homo sapiens
gcucaauggcuauguagau

SEQ ID NO: 131064 - RNA, 19 nt, Homo sapiens
gcuugggacuucuacaaca

SEQ ID NO: 131065 - RNA, 19 nt, Homo sapiens
uugacaagaucgccuuuau

SEQ ID NO: 131066 - RNA, 19 nt, Homo sapiens
caacuucgacuggugguau

SEQ ID NO: 131067 - RNA, 19 nt, Homo sapiens
cacggaaagugacaucaau

SEQ ID NO: 131068 - RNA, 19 nt, Homo sapiens
ccucggccauguugagcua

SEQ ID NO: 131069 - RNA, 19 nt, Homo sapiens
caguggcgcuggaggguau

SEQ ID NO: 131070 - RNA, 19 nt, Homo sapiens
cgacgagcaugacaucaac

SEQ ID NO: 131071 - RNA, 19 nt, Homo sapiens
ccagaucugacgaauguga

SEQ ID NO: 131072 - RNA, 19 nt, Homo sapiens
acagagaccagcaagauuc

SEQ ID NO: 131073 - RNA, 19 nt, Homo sapiens
gaggccaacuggaacuaca

SEQ ID NO: 131074 - RNA, 19 nt, Homo sapiens
gcaguuccaguuccaugaa

SEQ ID NO: 131075 - RNA, 19 nt, Homo sapiens
ccaaggagaacuauaacca

SEQ ID NO: 131076 - RNA, 19 nt, Homo sapiens
gcgacgagcaugacaucaa

SEQ ID NO: 131077 - RNA, 19 nt, Homo sapiens
agaagaacaugcaaauagc

SEQ ID NO: 131078 - RNA, 19 nt, Homo sapiens
ggaacuacaacaccaacau

SEQ ID NO: 131079 - RNA, 19 nt, Homo sapiens
ggaacgccacgcacauguu

SEQ ID NO: 131080 - RNA, 19 nt, Homo sapiens
gacaagaucgccuuuaucc

SEQ ID NO: 131081 - RNA, 19 nt, Homo sapiens
caauggcuauguagaugca

SEQ ID NO: 131082 - RNA, 19 nt, Homo sapiens
gcacccaggccaggaaguu

SEQ ID NO: 131083 - RNA, 19 nt, Homo sapiens
uacaucagguacuuuguca

SEQ ID NO: 131084 - RNA, 19 nt, Homo sapiens
caugacaucaacuuucuga

SEQ ID NO: 131085 - RNA, 19 nt, Homo sapiens
gagagccauccuccaguuu

SEQ ID NO: 131086 - RNA, 19 nt, Homo sapiens
acccagaucucaccaacau

SEQ ID NO: 131087 - RNA, 19 nt, Homo sapiens
ccuguuacccgaaacgaaa

SEQ ID NO: 131088 - RNA, 19 nt, Homo sapiens
gggaucuguccuccuguua

SEQ ID NO: 131089 - RNA, 19 nt, Homo sapiens
ugggccacauccaguauuu

SEQ ID NO: 131090 - RNA, 19 nt, Homo sapiens
gaacuccgcucgcucagaa

SEQ ID NO: 131091 - RNA, 19 nt, Homo sapiens
gaaauaugaagaccuguua

SEQ ID NO: 131092 - RNA, 19 nt, Homo sapiens
gcaaguuuguggaggaaua

SEQ ID NO: 131093 - RNA, 19 nt, Homo sapiens
gcccaaaccuggugacuga

SEQ ID NO: 131094 - RNA, 19 nt, Homo sapiens
ccaagucucucugugaaua

SEQ ID NO: 131095 - RNA, 19 nt, Homo sapiens
uaaggaggcugaugauuuc

SEQ ID NO: 131096 - RNA, 19 nt, Homo sapiens
ccacagaggcuaugcuaaa

SEQ ID NO: 131097 - RNA, 19 nt, Homo sapiens
ucaagcggaucauaaagaa

SEQ ID NO: 131098 - RNA, 19 nt, Homo sapiens
ccaggaggauguuuaagga

SEQ ID NO: 131099 - RNA, 19 nt, Homo sapiens
uuaaggaggcugaugauuu

SEQ ID NO: 131100 - RNA, 19 nt, Homo sapiens
gcagaagaacaugcaaaua

SEQ ID NO: 131101 - RNA, 19 nt, Homo sapiens
ucaccaaggagaacuauaa

SEQ ID NO: 131102 - RNA, 19 nt, Homo sapiens
cagaagaacaugcaaauag

SEQ ID NO: 131103 - RNA, 19 nt, Homo sapiens
ggcaaggacuuccggauca

SEQ ID NO: 131104 - RNA, 19 nt, Homo sapiens
ccaggaaguuugaugugaa

SEQ ID NO: 131105 - RNA, 19 nt, Homo sapiens
acaagucgaugcuggagaa

SEQ ID NO: 131106 - RNA, 19 nt, Homo sapiens
cgaaauacguggaacucau

SEQ ID NO: 131107 - RNA, 19 nt, Homo sapiens
ugaugaagauggcccuuga

SEQ ID NO: 131108 - RNA, 19 nt, Homo sapiens
ccacgucccggaaauauga

SEQ ID NO: 131109 - RNA, 19 nt, Homo sapiens
ggaggcugaugauuucuuc

SEQ ID NO: 131110 - RNA, 19 nt, Homo sapiens
caccaucccuggagcaaga

SEQ ID NO: 131111 - RNA, 19 nt, Homo sapiens
ggaaauaugaagaccuguu

SEQ ID NO: 131112 - RNA, 19 nt, Homo sapiens
ccaagcaccugcacagucu

SEQ ID NO: 131113 - RNA, 19 nt, Homo sapiens
gcaccaccgugaacuugga

SEQ ID NO: 131114 - RNA, 19 nt, Homo sapiens
gguccaacaucuaugacuu

SEQ ID NO: 131115 - RNA, 19 nt, Homo sapiens
caaaccuggugacugauga

SEQ ID NO: 131116 - RNA, 19 nt, Homo sapiens
ucagcuaccucgucgauca

SEQ ID NO: 131117 - RNA, 19 nt, Homo sapiens
gagcaugacaucaacuuuc

SEQ ID NO: 131118 - RNA, 19 nt, Homo sapiens
gcaaggacuuccggaucaa

SEQ ID NO: 131119 - RNA, 19 nt, Homo sapiens
gaaauacguggaacucauc

SEQ ID NO: 131120 - RNA, 19 nt, Homo sapiens
agccagaucugacgaaugu

SEQ ID NO: 131121 - RNA, 19 nt, Homo sapiens
gccaggaaguuugauguga

SEQ ID NO: 131122 - RNA, 19 nt, Homo sapiens
gaacuacaacaccaacauc

SEQ ID NO: 131123 - RNA, 19 nt, Homo sapiens
acaccaacaucaccacaga

SEQ ID NO: 131124 - RNA, 19 nt, Homo sapiens
ucaacuuucugaugaagau

SEQ ID NO: 131125 - RNA, 19 nt, Homo sapiens
gagccauccuccaguuuua

SEQ ID NO: 131126 - RNA, 19 nt, Homo sapiens
gcagaacaccacuaucaag

SEQ ID NO: 131127 - RNA, 19 nt, Homo sapiens
ccacagagaccagcaagau

SEQ ID NO: 131128 - RNA, 19 nt, Homo sapiens
ccaaccacacccugaagua

SEQ ID NO: 131129 - RNA, 19 nt, Homo sapiens
ccacauccaguauuucaug

SEQ ID NO: 131130 - RNA, 19 nt, Homo sapiens
caucccaggugguguggaa

SEQ ID NO: 131131 - RNA, 19 nt, Homo sapiens
uccaguauuucaugcagua

SEQ ID NO: 131132 - RNA, 19 nt, Homo sapiens
ucagguacuuugucagcuu

SEQ ID NO: 131133 - RNA, 19 nt, Homo sapiens
gcucaauggcuauguagau

SEQ ID NO: 131134 - RNA, 19 nt, Homo sapiens
uugacaagaucgccuuuau

SEQ ID NO: 131135 - RNA, 19 nt, Homo sapiens
ccucggccauguugagcua

SEQ ID NO: 131136 - RNA, 19 nt, Homo sapiens
caguggcgcuggaggguau

SEQ ID NO: 131137 - RNA, 19 nt, Homo sapiens
cgacgagcaugacaucaac

SEQ ID NO: 131138 - RNA, 19 nt, Homo sapiens
ccagaucugacgaauguga

SEQ ID NO: 131139 - RNA, 19 nt, Homo sapiens
acagagaccagcaagauuc

SEQ ID NO: 131140 - RNA, 19 nt, Homo sapiens
gaggccaacuggaacuaca

SEQ ID NO: 131141 - RNA, 19 nt, Homo sapiens
ccaaggagaacuauaacca

SEQ ID NO: 131142 - RNA, 19 nt, Homo sapiens
gcgacgagcaugacaucaa

SEQ ID NO: 131143 - RNA, 19 nt, Homo sapiens
agaagaacaugcaaauagc

SEQ ID NO: 131144 - RNA, 19 nt, Homo sapiens
ggaacuacaacaccaacau

SEQ ID NO: 131145 - RNA, 19 nt, Homo sapiens
gacaagaucgccuuuaucc

SEQ ID NO: 131146 - RNA, 19 nt, Homo sapiens
caauggcuauguagaugca

SEQ ID NO: 131147 - RNA, 19 nt, Homo sapiens
gcacccaggccaggaaguu

SEQ ID NO: 131148 - RNA, 19 nt, Homo sapiens
uacaucagguacuuuguca

SEQ ID NO: 131149 - RNA, 19 nt, Homo sapiens
caugacaucaacuuucuga

SEQ ID NO: 131150 - RNA, 19 nt, Homo sapiens
gagagccauccuccaguuu

SEQ ID NO: 131151 - RNA, 19 nt, Homo sapiens
ugggccacauccaguauuu

SEQ ID NO: 131152 - RNA, 19 nt, Homo sapiens
cuaucaagcggaucauaaa

SEQ ID NO: 131153 - RNA, 19 nt, Homo sapiens
cagcaaguuuguggaggaa

SEQ ID NO: 131154 - RNA, 19 nt, Homo sapiens
gugaaccaguugcagaaca

SEQ ID NO: 131155 - RNA, 19 nt, Homo sapiens
gaagcaucaccaaggagaa

SEQ ID NO: 131156 - RNA, 19 nt, Homo sapiens
ggccacauccaguauuuca

SEQ ID NO: 131157 - RNA, 19 nt, Homo sapiens
cuccaagucucucugugaa

SEQ ID NO: 131158 - RNA, 19 nt, Homo sapiens
caugcaguacaaagacuua

SEQ ID NO: 131159 - RNA, 19 nt, Homo sapiens
uugcagaacaccacuauca

SEQ ID NO: 131160 - RNA, 19 nt, Homo sapiens
gaagccaugcagcugauca

SEQ ID NO: 131161 - RNA, 19 nt, Homo sapiens
cacagaggcuaugcuaaag

SEQ ID NO: 131162 - RNA, 19 nt, Homo sapiens
gccagcggcucuucagcau

SEQ ID NO: 131163 - RNA, 19 nt, Homo sapiens
caucauccaguuccaguuc

SEQ ID NO: 131164 - RNA, 19 nt, Homo sapiens
aaaugggccacauccagua

SEQ ID NO: 131165 - RNA, 19 nt, Homo sapiens
caccacagaggcuaugcua

SEQ ID NO: 131166 - RNA, 19 nt, Homo sapiens
ccggcucaauggcuaugua

SEQ ID NO: 131167 - RNA, 19 nt, Homo sapiens
ggaggaguacaacaagauc

SEQ ID NO: 131168 - RNA, 19 nt, Homo sapiens
acuaucaagcggaucauaa

SEQ ID NO: 131169 - RNA, 19 nt, Homo sapiens
gcaucaccaaggagaacua

SEQ ID NO: 131170 - RNA, 19 nt, Homo sapiens
gugcuagcccucucagugu

SEQ ID NO: 131171 - RNA, 19 nt, Homo sapiens
ggacaccacagaggcuaug

SEQ ID NO: 131172 - RNA, 19 nt, Homo sapiens
cacagagaccagcaagauu

SEQ ID NO: 131173 - RNA, 19 nt, Homo sapiens
ugacaagaucgccuuuauc

SEQ ID NO: 131174 - RNA, 19 nt, Homo sapiens
ggacgugcuagcccucuca

SEQ ID NO: 131175 - RNA, 19 nt, Homo sapiens
cucaauggcuauguagaug

SEQ ID NO: 131176 - RNA, 19 nt, Homo sapiens
ccaaaccuggugacugaug

SEQ ID NO: 131177 - RNA, 19 nt, Homo sapiens
gugggcagcugaggacaca

SEQ ID NO: 131178 - RNA, 19 nt, Homo sapiens
cggaagccaugcagcugau

SEQ ID NO: 131179 - RNA, 19 nt, Homo sapiens
aauaugaagaccuguuaug

SEQ ID NO: 131180 - RNA, 19 nt, Homo sapiens
aguuugaugugaaccaguu

SEQ ID NO: 131181 - RNA, 19 nt, Homo sapiens
caggaaguuugaugugaac

SEQ ID NO: 131182 - RNA, 19 nt, Homo sapiens
ucagcuucaucauccaguu

SEQ ID NO: 131183 - RNA, 19 nt, Homo sapiens
cgagcaugacaucaacuuu

SEQ ID NO: 131184 - RNA, 19 nt, Homo sapiens
aguauuucaugcaguacaa

SEQ ID NO: 131185 - RNA, 19 nt, Homo sapiens
guccaacaucuaugacuug

SEQ ID NO: 131186 - RNA, 19 nt, Homo sapiens
ggccacgucccggaaauau

SEQ ID NO: 131187 - RNA, 19 nt, Homo sapiens
gggccaaguuccacauucc

SEQ ID NO: 131188 - RNA, 19 nt, Homo sapiens
uggaggguauuugauggaa

SEQ ID NO: 131189 - RNA, 19 nt, Homo sapiens
ugaagauggcccuugacaa

SEQ ID NO: 131190 - RNA, 19 nt, Homo sapiens
ggaagaggcugcugagaaa

SEQ ID NO: 131191 - RNA, 19 nt, Homo sapiens
gaacaacugccaagaauaa

SEQ ID NO: 131192 - RNA, 19 nt, Homo sapiens
ggaaggacaucuacaauca

SEQ ID NO: 131193 - RNA, 19 nt, Homo sapiens
ggacaucucugcccucuuc

SEQ ID NO: 131194 - RNA, 19 nt, Homo sapiens
ucacaaagaucaugaaagu

SEQ ID NO: 131195 - RNA, 19 nt, Homo sapiens
gaaauaugaagaccuguua

SEQ ID NO: 131196 - RNA, 19 nt, Homo sapiens
gcaggaagccuccaaggua

SEQ ID NO: 131197 - RNA, 19 nt, Homo sapiens
gaagcaagaugugaaagaa

SEQ ID NO: 131198 - RNA, 19 nt, Homo sapiens
gcaaguuuguggaggaaua

SEQ ID NO: 131199 - RNA, 19 nt, Homo sapiens
gaaggccucugacauuuau

SEQ ID NO: 131200 - RNA, 19 nt, Homo sapiens
ggaagaggcugagacauuc

SEQ ID NO: 131201 - RNA, 19 nt, Homo sapiens
gcccaaaccuggugacuga

SEQ ID NO: 131202 - RNA, 19 nt, Homo sapiens
uaaggaggcugaugauuuc

SEQ ID NO: 131203 - RNA, 19 nt, Homo sapiens
ggucccaguucaugauuua

SEQ ID NO: 131204 - RNA, 19 nt, Homo sapiens
gggaaggccucugacauuu

SEQ ID NO: 131205 - RNA, 19 nt, Homo sapiens
gaacuccgaugacuucuac

SEQ ID NO: 131206 - RNA, 19 nt, Homo sapiens
gagccaagaucgcaccauu

SEQ ID NO: 131207 - RNA, 19 nt, Homo sapiens
gaaagaagcccagguuaca

SEQ ID NO: 131208 - RNA, 19 nt, Homo sapiens
ggaaggccucugacauuua

SEQ ID NO: 131209 - RNA, 19 nt, Homo sapiens
ccacagaggcuaugcuaaa

SEQ ID NO: 131210 - RNA, 19 nt, Homo sapiens
ggacugcagugcccaagga

SEQ ID NO: 131211 - RNA, 19 nt, Homo sapiens
ggccagagguccuaaagau

SEQ ID NO: 131212 - RNA, 19 nt, Homo sapiens
caggaagccuccaagguaa

SEQ ID NO: 131213 - RNA, 19 nt, Homo sapiens
ucaagcggaucauaaagaa

SEQ ID NO: 131214 - RNA, 19 nt, Homo sapiens
ucaauuuccugaugcauau

SEQ ID NO: 131215 - RNA, 19 nt, Homo sapiens
ggacagggaaggccucuga

SEQ ID NO: 131216 - RNA, 19 nt, Homo sapiens
ucaagacacugagauauuc

SEQ ID NO: 131217 - RNA, 19 nt, Homo sapiens
ccaggaggauguuuaagga

SEQ ID NO: 131218 - RNA, 19 nt, Homo sapiens
uuaaggaggcugaugauuu

SEQ ID NO: 131219 - RNA, 19 nt, Homo sapiens
gcagaagaacaugcaaaua

SEQ ID NO: 131220 - RNA, 19 nt, Homo sapiens
ccgaugacuucuacaauga

SEQ ID NO: 131221 - RNA, 19 nt, Homo sapiens
ucaccaaggagaacuauaa

SEQ ID NO: 131222 - RNA, 19 nt, Homo sapiens
cagaagaacaugcaaauag

SEQ ID NO: 131223 - RNA, 19 nt, Homo sapiens
gcgcggaagugaccacaga

SEQ ID NO: 131224 - RNA, 19 nt, Homo sapiens
cagaggaugucacaaagau

SEQ ID NO: 131225 - RNA, 19 nt, Homo sapiens
ggcaaggacuuccggauca

SEQ ID NO: 131226 - RNA, 19 nt, Homo sapiens
ccaggaaguuugaugugaa

SEQ ID NO: 131227 - RNA, 19 nt, Homo sapiens
ugaccuggcuggugacaga

SEQ ID NO: 131228 - RNA, 19 nt, Homo sapiens
agucugaggugucuacaaa

SEQ ID NO: 131229 - RNA, 19 nt, Homo sapiens
aagaacaacugccaagaau

SEQ ID NO: 131230 - RNA, 19 nt, Homo sapiens
gacuucagcuguuccuuug

SEQ ID NO: 131231 - RNA, 19 nt, Homo sapiens
caaaugucuucaugaccua

SEQ ID NO: 131232 - RNA, 19 nt, Homo sapiens
ggaagcaagaugugaaaga

SEQ ID NO: 131233 - RNA, 19 nt, Homo sapiens
acaagucgaugcuggagaa

SEQ ID NO: 131234 - RNA, 19 nt, Homo sapiens
cgaaauacguggaacucau

SEQ ID NO: 131235 - RNA, 19 nt, Homo sapiens
ggcgagagguggaguguca

SEQ ID NO: 131236 - RNA, 19 nt, Homo sapiens
gcacuguggcucugcauga

SEQ ID NO: 131237 - RNA, 19 nt, Homo sapiens
gaaccucuccaucaucuuc

SEQ ID NO: 131238 - RNA, 19 nt, Homo sapiens
ugaugaagauggcccuuga

SEQ ID NO: 131239 - RNA, 19 nt, Homo sapiens
ccacgucccggaaauauga

SEQ ID NO: 131240 - RNA, 19 nt, Homo sapiens
cagaggaugaggucaauuu

SEQ ID NO: 131241 - RNA, 19 nt, Homo sapiens
gcaccaccuucgagcacua

SEQ ID NO: 131242 - RNA, 19 nt, Homo sapiens
ggaggcugaugauuucuuc

SEQ ID NO: 131243 - RNA, 19 nt, Homo sapiens
caccaucccuggagcaaga

SEQ ID NO: 131244 - RNA, 19 nt, Homo sapiens
ggaaauaugaagaccuguu

SEQ ID NO: 131245 - RNA, 19 nt, Homo sapiens
gcagguacuuccucagucu

SEQ ID NO: 131246 - RNA, 19 nt, Homo sapiens
acaagaaccucuccaucau

SEQ ID NO: 131247 - RNA, 19 nt, Homo sapiens
caacugccaagaauaaaga

SEQ ID NO: 131248 - RNA, 19 nt, Homo sapiens
ccaagcaccugcacagucu

SEQ ID NO: 131249 - RNA, 19 nt, Homo sapiens
gcaccaccgugaacuugga

SEQ ID NO: 131250 - RNA, 19 nt, Homo sapiens
gguccaacaucuaugacuu

SEQ ID NO: 131251 - RNA, 19 nt, Homo sapiens
caaaccuggugacugauga

SEQ ID NO: 131252 - RNA, 19 nt, Homo sapiens
gcaccagugugacaucuac

SEQ ID NO: 131253 - RNA, 19 nt, Homo sapiens
ucagcuaccucgucgauca

SEQ ID NO: 131254 - RNA, 19 nt, Homo sapiens
gagcaugacaucaacuuuc

SEQ ID NO: 131255 - RNA, 19 nt, Homo sapiens
gcaaggacuuccggaucaa

SEQ ID NO: 131256 - RNA, 19 nt, Homo sapiens
gaaauacguggaacucauc

SEQ ID NO: 131257 - RNA, 19 nt, Homo sapiens
ucacucagaggaagacuuu

SEQ ID NO: 131258 - RNA, 19 nt, Homo sapiens
gaugacuucuacaaugaga

SEQ ID NO: 131259 - RNA, 19 nt, Homo sapiens
agccagaucugacgaaugu

SEQ ID NO: 131260 - RNA, 19 nt, Homo sapiens
gccaggaaguuugauguga

SEQ ID NO: 131261 - RNA, 19 nt, Homo sapiens
cuugguuguucaucaauua

SEQ ID NO: 131262 - RNA, 19 nt, Homo sapiens
gaggaugucacaaagauca

SEQ ID NO: 131263 - RNA, 19 nt, Homo sapiens
gaacuacaacaccaacauc

SEQ ID NO: 131264 - RNA, 19 nt, Homo sapiens
cuacaaaugucuucaugac

SEQ ID NO: 131265 - RNA, 19 nt, Homo sapiens
aaagaacaacugccaagaa

SEQ ID NO: 131266 - RNA, 19 nt, Homo sapiens
uggaagaggcugagacauu

SEQ ID NO: 131267 - RNA, 19 nt, Homo sapiens
ggaauuucugcucugguua

SEQ ID NO: 131268 - RNA, 19 nt, Homo sapiens
ugaggucaauuuccugaug

SEQ ID NO: 131269 - RNA, 19 nt, Homo sapiens
cggauacccuggagcaaga

SEQ ID NO: 131270 - RNA, 19 nt, Homo sapiens
acaccaacaucaccacaga

SEQ ID NO: 131271 - RNA, 19 nt, Homo sapiens
ccacagagaccagcaagau

SEQ ID NO: 131272 - RNA, 19 nt, Homo sapiens
ggagaggucccaguucaug

SEQ ID NO: 131273 - RNA, 19 nt, Homo sapiens
ucaacuuucugaugaagau

SEQ ID NO: 131274 - RNA, 19 nt, Homo sapiens
gagccauccuccaguuuua

SEQ ID NO: 131275 - RNA, 19 nt, Homo sapiens
gcagaacaccacuaucaag

SEQ ID NO: 131276 - RNA, 19 nt, Homo sapiens
caacccagccuuugaagag

SEQ ID NO: 131277 - RNA, 19 nt, Homo sapiens
gagaacacguuggcucagu

SEQ ID NO: 131278 - RNA, 19 nt, Homo sapiens
ucaaggacccggaugugaa

SEQ ID NO: 131279 - RNA, 19 nt, Homo sapiens
uacaagaaccucuccauca

SEQ ID NO: 131280 - RNA, 19 nt, Homo sapiens
cggaagaggcugcugagaa

SEQ ID NO: 131281 - RNA, 19 nt, Homo sapiens
ggacgccgaacuccgauga

SEQ ID NO: 131282 - RNA, 19 nt, Homo sapiens
ccaaccacacccugaagua

SEQ ID NO: 131283 - RNA, 19 nt, Homo sapiens
caaagugacauuccugagu

SEQ ID NO: 131284 - RNA, 19 nt, Homo sapiens
cuucaugaccuacuucaaa

SEQ ID NO: 131285 - RNA, 19 nt, Homo sapiens
ucugaggugucuacaaaug

SEQ ID NO: 131286 - RNA, 19 nt, Homo sapiens
caucccaggugguguggaa

SEQ ID NO: 131287 - RNA, 19 nt, Homo sapiens
agcaagaugugaaagaaga

SEQ ID NO: 131288 - RNA, 19 nt, Homo sapiens
gcccaccuguuuaaaguca

SEQ ID NO: 131289 - RNA, 19 nt, Homo sapiens
ccacauccaguauuucaug

SEQ ID NO: 131290 - RNA, 19 nt, Homo sapiens
gggagaggguuuagaaaua

SEQ ID NO: 131291 - RNA, 19 nt, Homo sapiens
gaagaaacagcaugaaauu

SEQ ID NO: 131292 - RNA, 19 nt, Homo sapiens
gagaagcgcuacccucauu

SEQ ID NO: 131293 - RNA, 19 nt, Homo sapiens
gaaaucaaaugggaagaaa

SEQ ID NO: 131294 - RNA, 19 nt, Homo sapiens
gaagaaaccaccagugauu

SEQ ID NO: 131295 - RNA, 19 nt, Homo sapiens
gaacauccauuccuugagu

SEQ ID NO: 131296 - RNA, 19 nt, Homo sapiens
gcccacaacucucuuagua

SEQ ID NO: 131297 - RNA, 19 nt, Homo sapiens
gcgcuacccucauuaaauu

SEQ ID NO: 131298 - RNA, 19 nt, Homo sapiens
gaacgagugugaugugugu

SEQ ID NO: 131299 - RNA, 19 nt, Homo sapiens
caacaugguuccuuucuuc

SEQ ID NO: 131300 - RNA, 19 nt, Homo sapiens
ucaaggaccugcauuuguu

SEQ ID NO: 131301 - RNA, 19 nt, Homo sapiens
caacuuggcuacagcuaug

SEQ ID NO: 131302 - RNA, 19 nt, Homo sapiens
agauagaccugacaauuug

SEQ ID NO: 131303 - RNA, 19 nt, Homo sapiens
gaagaucuuugacauaggu

SEQ ID NO: 131304 - RNA, 19 nt, Homo sapiens
ggaagaaacagcaugaaau

SEQ ID NO: 131305 - RNA, 19 nt, Homo sapiens
gcacacauguaaccucugu

SEQ ID NO: 131306 - RNA, 19 nt, Homo sapiens
uaacaaacccaacuaaagu

SEQ ID NO: 131307 - RNA, 19 nt, Homo sapiens
gaaaggaauagaaagcaaa

SEQ ID NO: 131308 - RNA, 19 nt, Homo sapiens
ccacaacucucuuaguagu

SEQ ID NO: 131309 - RNA, 19 nt, Homo sapiens
cuaaggaaauuaagucugu

SEQ ID NO: 131310 - RNA, 19 nt, Homo sapiens
cuagggugcucaugccuua

SEQ ID NO: 131311 - RNA, 19 nt, Homo sapiens
ccgcuuugcuugcuuguuu

SEQ ID NO: 131312 - RNA, 19 nt, Homo sapiens
caacugcaguguuuaugau

SEQ ID NO: 131313 - RNA, 19 nt, Homo sapiens
ggaauagaaagcaaagaaa

SEQ ID NO: 131314 - RNA, 19 nt, Homo sapiens
ggagggagaggguuuagaa

SEQ ID NO: 131315 - RNA, 19 nt, Homo sapiens
caagagauacacagaagaa

SEQ ID NO: 131316 - RNA, 19 nt, Homo sapiens
uuguguggcuccauuauua

SEQ ID NO: 131317 - RNA, 19 nt, Homo sapiens
ggaaggguuugauaaagca

SEQ ID NO: 131318 - RNA, 19 nt, Homo sapiens
guucugacgcugacaauaa

SEQ ID NO: 131319 - RNA, 19 nt, Homo sapiens
ggagaggguuuagaaauac

SEQ ID NO: 131320 - RNA, 19 nt, Homo sapiens
ugacaauccucccuucuuc

SEQ ID NO: 131321 - RNA, 19 nt, Homo sapiens
ggccauagauuucucacau

SEQ ID NO: 131322 - RNA, 19 nt, Homo sapiens
ccuuagaucucgcgaagaa

SEQ ID NO: 131323 - RNA, 19 nt, Homo sapiens
gaagcgcuacccucauuaa

SEQ ID NO: 131324 - RNA, 19 nt, Homo sapiens
gaacacugguggcuuuggu

SEQ ID NO: 131325 - RNA, 19 nt, Homo sapiens
aagauagaccugacaauuu

SEQ ID NO: 131326 - RNA, 19 nt, Homo sapiens
ugggugcucuguaaauuaa

SEQ ID NO: 131327 - RNA, 19 nt, Homo sapiens
ugauuaagccuccuccuuu

SEQ ID NO: 131328 - RNA, 19 nt, Homo sapiens
aaagauagaccugacaauu

SEQ ID NO: 131329 - RNA, 19 nt, Homo sapiens
cagaagaugcuuagcugua

SEQ ID NO: 131330 - RNA, 19 nt, Homo sapiens
gggaagaaacagcaugaaa

SEQ ID NO: 131331 - RNA, 19 nt, Homo sapiens
ccauagauuucucacauca

SEQ ID NO: 131332 - RNA, 19 nt, Homo sapiens
agaaaagacugaaagagua

SEQ ID NO: 131333 - RNA, 19 nt, Homo sapiens
guuuagaaauaccagcaua

SEQ ID NO: 131334 - RNA, 19 nt, Homo sapiens
ugaaauugccaaccuuaaa

SEQ ID NO: 131335 - RNA, 19 nt, Homo sapiens
gacaaagccugacuuaacg

SEQ ID NO: 131336 - RNA, 19 nt, Homo sapiens
gaaauaccagcauaauaag

SEQ ID NO: 131337 - RNA, 19 nt, Homo sapiens
gacaauaaaggaacuaauc

SEQ ID NO: 131338 - RNA, 19 nt, Homo sapiens
gcaugaaauugccaaccuu

SEQ ID NO: 131339 - RNA, 19 nt, Homo sapiens
gaagguuugcugagaagaa

SEQ ID NO: 131340 - RNA, 19 nt, Homo sapiens
gaaacugucugugauagcu

SEQ ID NO: 131341 - RNA, 19 nt, Homo sapiens
gaagaaaggaauagaaagc

SEQ ID NO: 131342 - RNA, 19 nt, Homo sapiens
gaagauaaggagaaaagua

SEQ ID NO: 131343 - RNA, 19 nt, Homo sapiens
cugaaagaguagaagauaa

SEQ ID NO: 131344 - RNA, 19 nt, Homo sapiens
cauguaaccucugugauuc

SEQ ID NO: 131345 - RNA, 19 nt, Homo sapiens
agacaaagccugacuuaac

SEQ ID NO: 131346 - RNA, 19 nt, Homo sapiens
ccagaacucuaccuucagu

SEQ ID NO: 131347 - RNA, 19 nt, Homo sapiens
gacgauccgacucugauua

SEQ ID NO: 131348 - RNA, 19 nt, Homo sapiens
caaggaccugcauuuguua

SEQ ID NO: 131349 - RNA, 19 nt, Homo sapiens
gaaacuuugccggcuauaa

SEQ ID NO: 131350 - RNA, 19 nt, Homo sapiens
gaagaugcuuagcuguagu

SEQ ID NO: 131351 - RNA, 19 nt, Homo sapiens
ugggaacacugguggcuuu

SEQ ID NO: 131352 - RNA, 19 nt, Homo sapiens
uaugaagguuugcugagaa

SEQ ID NO: 131353 - RNA, 19 nt, Homo sapiens
gcaccgguaccauuuguug

SEQ ID NO: 131354 - RNA, 19 nt, Homo sapiens
ggcagaacauccauuccuu

SEQ ID NO: 131355 - RNA, 19 nt, Homo sapiens
ggaagaaaccaccagugau

SEQ ID NO: 131356 - RNA, 19 nt, Homo sapiens
cuaccucuaccuucaaaua

SEQ ID NO: 131357 - RNA, 19 nt, Homo sapiens
acagagacaaggaaaguaa

SEQ ID NO: 131358 - RNA, 19 nt, Homo sapiens
uguacaacaugguuccuuu

SEQ ID NO: 131359 - RNA, 19 nt, Homo sapiens
gaaauugccaaccuuaaaa

SEQ ID NO: 131360 - RNA, 19 nt, Homo sapiens
caugaaauugccaaccuua

SEQ ID NO: 131361 - RNA, 19 nt, Homo sapiens
gggaaacugucugugauag

SEQ ID NO: 131362 - RNA, 19 nt, Homo sapiens
gcgcuucuaaggaaauuaa

SEQ ID NO: 131363 - RNA, 19 nt, Homo sapiens
gaacccagccgcaguuugc

SEQ ID NO: 131364 - RNA, 19 nt, Homo sapiens
agaaaggaauagaaagcaa

SEQ ID NO: 131365 - RNA, 19 nt, Homo sapiens
cuacagcuaugccaucgau

SEQ ID NO: 131366 - RNA, 19 nt, Homo sapiens
cauacgagauugccugucu

SEQ ID NO: 131367 - RNA, 19 nt, Homo sapiens
ggagggagggagaggguuu

SEQ ID NO: 131368 - RNA, 19 nt, Homo sapiens
cuacagggccauagauuuc

SEQ ID NO: 131369 - RNA, 19 nt, Homo sapiens
agagcucucccaauuauaa

SEQ ID NO: 131370 - RNA, 19 nt, Homo sapiens
uaaccucugugauucuugu

SEQ ID NO: 131371 - RNA, 19 nt, Homo sapiens
cggaagaaaccaccaguga

SEQ ID NO: 131372 - RNA, 19 nt, Homo sapiens
gauuaagccuccuccuuuu

SEQ ID NO: 131373 - RNA, 19 nt, Homo sapiens
uuagacaaagccugacuua

SEQ ID NO: 131374 - RNA, 19 nt, Homo sapiens
aaacccaacuaaagugcuu

SEQ ID NO: 131375 - RNA, 19 nt, Homo sapiens
uugaagaucuuugacauag

SEQ ID NO: 131376 - RNA, 19 nt, Homo sapiens
gaucugccaguuucaguug

SEQ ID NO: 131377 - RNA, 19 nt, Homo sapiens
gcugggaaacugucuguga

SEQ ID NO: 131378 - RNA, 19 nt, Homo sapiens
aaacuuugccggcuauaau

SEQ ID NO: 131379 - RNA, 19 nt, Homo sapiens
guugaagaucuuugacaua

SEQ ID NO: 131380 - RNA, 19 nt, Homo sapiens
cuucauuccuuuacugaug

SEQ ID NO: 131381 - RNA, 19 nt, Homo sapiens
gugauagcuuggaugacua

SEQ ID NO: 131382 - RNA, 19 nt, Homo sapiens
cagaacauccauuccuuga

SEQ ID NO: 131383 - RNA, 19 nt, Homo sapiens
gaguagaagauaaggagaa

SEQ ID NO: 131384 - RNA, 19 nt, Homo sapiens
acauguaaccucugugauu

SEQ ID NO: 131385 - RNA, 19 nt, Homo sapiens
ggaacuaauccucacuguu

SEQ ID NO: 131386 - RNA, 19 nt, Homo sapiens
ccaucgaucugccaguuuc

SEQ ID NO: 131387 - RNA, 19 nt, Homo sapiens
gccugucucuccagaaguu

SEQ ID NO: 131388 - RNA, 19 nt, Homo sapiens
cgugagcuguggccaagaa

SEQ ID NO: 131389 - RNA, 19 nt, Homo sapiens
gcaagagauacacagaaga

SEQ ID NO: 131390 - RNA, 19 nt, Homo sapiens
ugaaugagaugaacgauga

SEQ ID NO: 131391 - RNA, 19 nt, Homo sapiens
gaagaucgagagacaguua

SEQ ID NO: 131392 - RNA, 19 nt, Homo sapiens
gcaggaggcuacagauauu

SEQ ID NO: 131393 - RNA, 19 nt, Homo sapiens
gaaagaaggagaaagaguu

SEQ ID NO: 131394 - RNA, 19 nt, Homo sapiens
agaagucacucaagauuaa

SEQ ID NO: 131395 - RNA, 19 nt, Homo sapiens
gcucaugccucgucucauu

SEQ ID NO: 131396 - RNA, 19 nt, Homo sapiens
gaagaagucacucaagauu

SEQ ID NO: 131397 - RNA, 19 nt, Homo sapiens
gaagagcaccagaaaggua

SEQ ID NO: 131398 - RNA, 19 nt, Homo sapiens
ggacagugcugccaaggau

SEQ ID NO: 131399 - RNA, 19 nt, Homo sapiens
gcagagagcaccauugaug

SEQ ID NO: 131400 - RNA, 19 nt, Homo sapiens
ucgagaagcucaaggauga

SEQ ID NO: 131401 - RNA, 19 nt, Homo sapiens
uaaaagagcuggagaaaca

SEQ ID NO: 131402 - RNA, 19 nt, Homo sapiens
gaacuaaagcagcgucuga

SEQ ID NO: 131403 - RNA, 19 nt, Homo sapiens
gagagacaguuauuaagga

SEQ ID NO: 131404 - RNA, 19 nt, Homo sapiens
gaaacgggcagaagacaaa

SEQ ID NO: 131405 - RNA, 19 nt, Homo sapiens
gaacugauacaacugcaaa

SEQ ID NO: 131406 - RNA, 19 nt, Homo sapiens
ccaaggccaucaaguacua

SEQ ID NO: 131407 - RNA, 19 nt, Homo sapiens
gaagacaaagcaaagcuaa

SEQ ID NO: 131408 - RNA, 19 nt, Homo sapiens
gcaaguggcucagcuuaag

SEQ ID NO: 131409 - RNA, 19 nt, Homo sapiens
caugagcgcuccuuggauu

SEQ ID NO: 131410 - RNA, 19 nt, Homo sapiens
cgagcucacuacugacuua

SEQ ID NO: 131411 - RNA, 19 nt, Homo sapiens
acaaggagauggcugaaga

SEQ ID NO: 131412 - RNA, 19 nt, Homo sapiens
ugaagggcauggcaucuuu

SEQ ID NO: 131413 - RNA, 19 nt, Homo sapiens
gcacaaggaucagcuggau

SEQ ID NO: 131414 - RNA, 19 nt, Homo sapiens
cuaggcagcugaucgcuuu

SEQ ID NO: 131415 - RNA, 19 nt, Homo sapiens
aaagugaccuucucaugug

SEQ ID NO: 131416 - RNA, 19 nt, Homo sapiens
gaagauggagcagauacua

SEQ ID NO: 131417 - RNA, 19 nt, Homo sapiens
gagagaagagcaccagaaa

SEQ ID NO: 131418 - RNA, 19 nt, Homo sapiens
uugcaaagcuaucccauga

SEQ ID NO: 131419 - RNA, 19 nt, Homo sapiens
gaagagaagggcucagaug

SEQ ID NO: 131420 - RNA, 19 nt, Homo sapiens
gagaagagcaccagaaagg

SEQ ID NO: 131421 - RNA, 19 nt, Homo sapiens
ggacuucaccccuugauua

SEQ ID NO: 131422 - RNA, 19 nt, Homo sapiens
gcaaagugaccuucucaug

SEQ ID NO: 131423 - RNA, 19 nt, Homo sapiens
ggaugagacugucaaugug

SEQ ID NO: 131424 - RNA, 19 nt, Homo sapiens
gcaaaggaacgcuauaugg

SEQ ID NO: 131425 - RNA, 19 nt, Homo sapiens
gacaguguauucaagaguu

SEQ ID NO: 131426 - RNA, 19 nt, Homo sapiens
caaagugaccuucucaugu

SEQ ID NO: 131427 - RNA, 19 nt, Homo sapiens
ucaccaaggccaucaagua

SEQ ID NO: 131428 - RNA, 19 nt, Homo sapiens
uggacgagcucacuacuga

SEQ ID NO: 131429 - RNA, 19 nt, Homo sapiens
gcugaucgcuuugaagugu

SEQ ID NO: 131430 - RNA, 19 nt, Homo sapiens
gaucgagagacaguuauua

SEQ ID NO: 131431 - RNA, 19 nt, Homo sapiens
gcaguguggauguguauaa

SEQ ID NO: 131432 - RNA, 19 nt, Homo sapiens
ccagagaccuuugacuuca

SEQ ID NO: 131433 - RNA, 19 nt, Homo sapiens
caaaggaacgcuauaugga

SEQ ID NO: 131434 - RNA, 19 nt, Homo sapiens
guguagaggugauuggaaa

SEQ ID NO: 131435 - RNA, 19 nt, Homo sapiens
uggcauugcuggugaagaa

SEQ ID NO: 131436 - RNA, 19 nt, Homo sapiens
gcagagaaggcagaacuaa

SEQ ID NO: 131437 - RNA, 19 nt, Homo sapiens
guacuuggcuugcuuugcu

SEQ ID NO: 131438 - RNA, 19 nt, Homo sapiens
gcagugacauccgccaguu

SEQ ID NO: 131439 - RNA, 19 nt, Homo sapiens
ggaagcaggcccaggagaa

SEQ ID NO: 131440 - RNA, 19 nt, Homo sapiens
acgaugagcugcaggagaa

SEQ ID NO: 131441 - RNA, 19 nt, Homo sapiens
gaaccaagagcuggaaguu

SEQ ID NO: 131442 - RNA, 19 nt, Homo sapiens
cuggagcgcuguaucguaa

SEQ ID NO: 131443 - RNA, 19 nt, Homo sapiens
gaaacuucaugcagugaca

SEQ ID NO: 131444 - RNA, 19 nt, Homo sapiens
cuagagacccugagacuga

SEQ ID NO: 131445 - RNA, 19 nt, Homo sapiens
gaaacuagagacccugaga

SEQ ID NO: 131446 - RNA, 19 nt, Homo sapiens
gaaagaguuugaggagaca

SEQ ID NO: 131447 - RNA, 19 nt, Homo sapiens
gaacuaagugagaacuguu

SEQ ID NO: 131448 - RNA, 19 nt, Homo sapiens
gacccugaguccagaguuu

SEQ ID NO: 131449 - RNA, 19 nt, Homo sapiens
gcaacauccucaucaguac

SEQ ID NO: 131450 - RNA, 19 nt, Homo sapiens
ccaaggcaauugagaugga

SEQ ID NO: 131451 - RNA, 19 nt, Homo sapiens
aaacguggguuaagcucuu

SEQ ID NO: 131452 - RNA, 19 nt, Homo sapiens
ucauugaacugcugcacaa

SEQ ID NO: 131453 - RNA, 19 nt, Homo sapiens
gaugagagacccuuauuuu

SEQ ID NO: 131454 - RNA, 19 nt, Homo sapiens
agacaguuauuaaggaguu

SEQ ID NO: 131455 - RNA, 19 nt, Homo sapiens
gaaugcacgugagacagaa

SEQ ID NO: 131456 - RNA, 19 nt, Homo sapiens
aggcugagauugaagagaa

SEQ ID NO: 131457 - RNA, 19 nt, Homo sapiens
gcccuacucacaugaauuu

SEQ ID NO: 131458 - RNA, 19 nt, Homo sapiens
caaaaguccucaaaagaga

SEQ ID NO: 131459 - RNA, 19 nt, Homo sapiens
ccacugacuuugccaccuu

SEQ ID NO: 131460 - RNA, 19 nt, Homo sapiens
ggagcgcuguaucguaaga

SEQ ID NO: 131461 - RNA, 19 nt, Homo sapiens
uuaaggaguugaagaaguc

SEQ ID NO: 131462 - RNA, 19 nt, Homo sapiens
guguggauguguauaagaa

SEQ ID NO: 131463 - RNA, 19 nt, Homo sapiens
gccauaauuuguuguucaa

SEQ ID NO: 131464 - RNA, 19 nt, Homo sapiens
ccagguauuugaagaugga

SEQ ID NO: 131465 - RNA, 19 nt, Homo sapiens
aaagaaggagaaagaguuu

SEQ ID NO: 131466 - RNA, 19 nt, Homo sapiens
uggaggaacuggcuuucaa

SEQ ID NO: 131467 - RNA, 19 nt, Homo sapiens
gggcaggaggcuacagaua

SEQ ID NO: 131468 - RNA, 19 nt, Homo sapiens
cuacucacaugaauuugga

SEQ ID NO: 131469 - RNA, 19 nt, Homo sapiens
gagcaugcccucucucagu

SEQ ID NO: 131470 - RNA, 19 nt, Homo sapiens
ggagacgguugcagacuac

SEQ ID NO: 131471 - RNA, 19 nt, Homo sapiens
gaaccugaaucuggaagag

SEQ ID NO: 131472 - RNA, 19 nt, Homo sapiens
ugacagaucggaaccugaa

SEQ ID NO: 131473 - RNA, 19 nt, Homo sapiens
ggaggaacuggcuuucaaa

SEQ ID NO: 131474 - RNA, 19 nt, Homo sapiens
acaaggaucagcuggauga

SEQ ID NO: 131475 - RNA, 19 nt, Homo sapiens
gaucuuucuuccucagaga

SEQ ID NO: 131476 - RNA, 19 nt, Homo sapiens
gggcagaagacaaagcaaa

SEQ ID NO: 131477 - RNA, 19 nt, Homo sapiens
gcaaauggguaggcgugau

SEQ ID NO: 131478 - RNA, 19 nt, Homo sapiens
ucucccagcuccagcauga

SEQ ID NO: 131479 - RNA, 19 nt, Homo sapiens
aagaagucacucaagauua

SEQ ID NO: 131480 - RNA, 19 nt, Homo sapiens
ggcaggaggcuacagauau

SEQ ID NO: 131481 - RNA, 19 nt, Homo sapiens
gaaagugggcagccuguac

SEQ ID NO: 131482 - RNA, 19 nt, Homo sapiens
gagcuaagccaggcagaga

SEQ ID NO: 131483 - RNA, 19 nt, Homo sapiens
accaagagcuggaaguugu

SEQ ID NO: 131484 - RNA, 19 nt, Homo sapiens
caagcaggauucugugucu

SEQ ID NO: 131485 - RNA, 19 nt, Homo sapiens
caagcgagcagaucuaugg

SEQ ID NO: 131486 - RNA, 19 nt, Homo sapiens
cagagaagcaggagcaugu

SEQ ID NO: 131487 - RNA, 19 nt, Homo sapiens
gcaccgacagcccgaaaga

SEQ ID NO: 131488 - RNA, 19 nt, Homo sapiens
caaauggguaggcgugauu

SEQ ID NO: 131489 - RNA, 19 nt, Homo sapiens
gcaccagaaagguagauga

SEQ ID NO: 131490 - RNA, 19 nt, Homo sapiens
ugaaugagaugaacgauga

SEQ ID NO: 131491 - RNA, 19 nt, Homo sapiens
gaagaucgagagacaguua

SEQ ID NO: 131492 - RNA, 19 nt, Homo sapiens
gcaggaggcuacagauauu

SEQ ID NO: 131493 - RNA, 19 nt, Homo sapiens
gaaagaaggagaaagaguu

SEQ ID NO: 131494 - RNA, 19 nt, Homo sapiens
agaagucacucaagauuaa

SEQ ID NO: 131495 - RNA, 19 nt, Homo sapiens
gcucaugccucgucucauu

SEQ ID NO: 131496 - RNA, 19 nt, Homo sapiens
gaagaagucacucaagauu

SEQ ID NO: 131497 - RNA, 19 nt, Homo sapiens
ggacagugcugccaaggau

SEQ ID NO: 131498 - RNA, 19 nt, Homo sapiens
gcagagagcaccauugaug

SEQ ID NO: 131499 - RNA, 19 nt, Homo sapiens
ucgagaagcucaaggauga

SEQ ID NO: 131500 - RNA, 19 nt, Homo sapiens
uaaaagagcuggagaaaca

SEQ ID NO: 131501 - RNA, 19 nt, Homo sapiens
gaacuaaagcagcgucuga

SEQ ID NO: 131502 - RNA, 19 nt, Homo sapiens
gagagacaguuauuaagga

SEQ ID NO: 131503 - RNA, 19 nt, Homo sapiens
gaaacgggcagaagacaaa

SEQ ID NO: 131504 - RNA, 19 nt, Homo sapiens
ccaaggccaucaaguacua

SEQ ID NO: 131505 - RNA, 19 nt, Homo sapiens
gaagacaaagcaaagcuaa

SEQ ID NO: 131506 - RNA, 19 nt, Homo sapiens
gcaaguggcucagcuuaag

SEQ ID NO: 131507 - RNA, 19 nt, Homo sapiens
caugagcgcuccuuggauu

SEQ ID NO: 131508 - RNA, 19 nt, Homo sapiens
cgagcucacuacugacuua

SEQ ID NO: 131509 - RNA, 19 nt, Homo sapiens
acaaggagauggcugaaga

SEQ ID NO: 131510 - RNA, 19 nt, Homo sapiens
gcacaaggaucagcuggau

SEQ ID NO: 131511 - RNA, 19 nt, Homo sapiens
aaagugaccuucucaugug

SEQ ID NO: 131512 - RNA, 19 nt, Homo sapiens
uugcaaagcuaucccauga

SEQ ID NO: 131513 - RNA, 19 nt, Homo sapiens
gaagagaagggcucagaug

SEQ ID NO: 131514 - RNA, 19 nt, Homo sapiens
ggacuucaccccuugauua

SEQ ID NO: 131515 - RNA, 19 nt, Homo sapiens
gcaaagugaccuucucaug

SEQ ID NO: 131516 - RNA, 19 nt, Homo sapiens
ggaugagacugucaaugug

SEQ ID NO: 131517 - RNA, 19 nt, Homo sapiens
gcaaaggaacgcuauaugg

SEQ ID NO: 131518 - RNA, 19 nt, Homo sapiens
caaagugaccuucucaugu

SEQ ID NO: 131519 - RNA, 19 nt, Homo sapiens
ucaccaaggccaucaagua

SEQ ID NO: 131520 - RNA, 19 nt, Homo sapiens
uggacgagcucacuacuga

SEQ ID NO: 131521 - RNA, 19 nt, Homo sapiens
gaucgagagacaguuauua

SEQ ID NO: 131522 - RNA, 19 nt, Homo sapiens
gcaguguggauguguauaa

SEQ ID NO: 131523 - RNA, 19 nt, Homo sapiens
ccagagaccuuugacuuca

SEQ ID NO: 131524 - RNA, 19 nt, Homo sapiens
caaaggaacgcuauaugga

SEQ ID NO: 131525 - RNA, 19 nt, Homo sapiens
uggcauugcuggugaagaa

SEQ ID NO: 131526 - RNA, 19 nt, Homo sapiens
gcagagaaggcagaacuaa

SEQ ID NO: 131527 - RNA, 19 nt, Homo sapiens
gcagugacauccgccaguu

SEQ ID NO: 131528 - RNA, 19 nt, Homo sapiens
ggaagcaggcccaggagaa

SEQ ID NO: 131529 - RNA, 19 nt, Homo sapiens
acgaugagcugcaggagaa

SEQ ID NO: 131530 - RNA, 19 nt, Homo sapiens
gaaccaagagcuggaaguu

SEQ ID NO: 131531 - RNA, 19 nt, Homo sapiens
cuagagacccugagacuga

SEQ ID NO: 131532 - RNA, 19 nt, Homo sapiens
cuggagcgcuguaucguaa

SEQ ID NO: 131533 - RNA, 19 nt, Homo sapiens
gaaacuagagacccugaga

SEQ ID NO: 131534 - RNA, 19 nt, Homo sapiens
gaaacuucaugcagugaca

SEQ ID NO: 131535 - RNA, 19 nt, Homo sapiens
gaaagaguuugaggagaca

SEQ ID NO: 131536 - RNA, 19 nt, Homo sapiens
gaacuaagugagaacuguu

SEQ ID NO: 131537 - RNA, 19 nt, Homo sapiens
gcaacauccucaucaguac

SEQ ID NO: 131538 - RNA, 19 nt, Homo sapiens
ccaaggcaauugagaugga

SEQ ID NO: 131539 - RNA, 19 nt, Homo sapiens
aaacguggguuaagcucuu

SEQ ID NO: 131540 - RNA, 19 nt, Homo sapiens
ucauugaacugcugcacaa

SEQ ID NO: 131541 - RNA, 19 nt, Homo sapiens
agacaguuauuaaggaguu

SEQ ID NO: 131542 - RNA, 19 nt, Homo sapiens
gaaugcacgugagacagaa

SEQ ID NO: 131543 - RNA, 19 nt, Homo sapiens
aggcugagauugaagagaa

SEQ ID NO: 131544 - RNA, 19 nt, Homo sapiens
ccacugacuuugccaccuu

SEQ ID NO: 131545 - RNA, 19 nt, Homo sapiens
ggagcgcuguaucguaaga

SEQ ID NO: 131546 - RNA, 19 nt, Homo sapiens
uuaaggaguugaagaaguc

SEQ ID NO: 131547 - RNA, 19 nt, Homo sapiens
guguggauguguauaagaa

SEQ ID NO: 131548 - RNA, 19 nt, Homo sapiens
gccauaauuuguuguucaa

SEQ ID NO: 131549 - RNA, 19 nt, Homo sapiens
aaagaaggagaaagaguuu

SEQ ID NO: 131550 - RNA, 19 nt, Homo sapiens
uggaggaacuggcuuucaa

SEQ ID NO: 131551 - RNA, 19 nt, Homo sapiens
gggcaggaggcuacagaua

SEQ ID NO: 131552 - RNA, 19 nt, Homo sapiens
gagcaugcccucucucagu

SEQ ID NO: 131553 - RNA, 19 nt, Homo sapiens
ggagacgguugcagacuac

SEQ ID NO: 131554 - RNA, 19 nt, Homo sapiens
gaaccugaaucuggaagag

SEQ ID NO: 131555 - RNA, 19 nt, Homo sapiens
ugacagaucggaaccugaa

SEQ ID NO: 131556 - RNA, 19 nt, Homo sapiens
ggaggaacuggcuuucaaa

SEQ ID NO: 131557 - RNA, 19 nt, Homo sapiens
acaaggaucagcuggauga

SEQ ID NO: 131558 - RNA, 19 nt, Homo sapiens
gggcagaagacaaagcaaa

SEQ ID NO: 131559 - RNA, 19 nt, Homo sapiens
gaucuuucuuccucagaga

SEQ ID NO: 131560 - RNA, 19 nt, Homo sapiens
ucucccagcuccagcauga

SEQ ID NO: 131561 - RNA, 19 nt, Homo sapiens
aagaagucacucaagauua

SEQ ID NO: 131562 - RNA, 19 nt, Homo sapiens
ggcaggaggcuacagauau

SEQ ID NO: 131563 - RNA, 19 nt, Homo sapiens
gaaagugggcagccuguac

SEQ ID NO: 131564 - RNA, 19 nt, Homo sapiens
gagcuaagccaggcagaga

SEQ ID NO: 131565 - RNA, 19 nt, Homo sapiens
accaagagcuggaaguugu

SEQ ID NO: 131566 - RNA, 19 nt, Homo sapiens
gcaccgacagcccgaaaga

SEQ ID NO: 131567 - RNA, 19 nt, Homo sapiens
caagcgagcagaucuaugg

SEQ ID NO: 131568 - RNA, 19 nt, Homo sapiens
cagagaagcaggagcaugu

SEQ ID NO: 131569 - RNA, 19 nt, Homo sapiens
gcugaaggccuggguuuga

SEQ ID NO: 131570 - RNA, 19 nt, Homo sapiens
uggaagcgaugaaugagau

SEQ ID NO: 131571 - RNA, 19 nt, Homo sapiens
gcauccaccuugccgaaca

SEQ ID NO: 131572 - RNA, 19 nt, Homo sapiens
ggagaaugcacgugagaca

SEQ ID NO: 131573 - RNA, 19 nt, Homo sapiens
gcucacuacugacuuagag

SEQ ID NO: 131574 - RNA, 19 nt, Homo sapiens
ugauacugcugaugccauu

SEQ ID NO: 131575 - RNA, 19 nt, Homo sapiens
guagaaacguggguuaagc

SEQ ID NO: 131576 - RNA, 19 nt, Homo sapiens
cagagaaggcagaacuaaa

SEQ ID NO: 131577 - RNA, 19 nt, Homo sapiens
ccucugccauaauuuguug

SEQ ID NO: 131578 - RNA, 19 nt, Homo sapiens
cagcugcacuggccuuugg

SEQ ID NO: 131579 - RNA, 19 nt, Homo sapiens
ugaacuaagugagaacugu

SEQ ID NO: 131580 - RNA, 19 nt, Homo sapiens
ucaaguuugcugagacuaa

SEQ ID NO: 131581 - RNA, 19 nt, Homo sapiens
gaagaaccaagagcuggaa

SEQ ID NO: 131582 - RNA, 19 nt, Homo sapiens
acagucgccucaucuccua

SEQ ID NO: 131583 - RNA, 19 nt, Homo sapiens
gcacacacacgcacguagu

SEQ ID NO: 131584 - RNA, 19 nt, Homo sapiens
caagggagcccagaugaag

SEQ ID NO: 131585 - RNA, 19 nt, Homo sapiens
uggaggagauggcugauac

SEQ ID NO: 131586 - RNA, 19 nt, Homo sapiens
agaaggagaaagaguuuga

SEQ ID NO: 131587 - RNA, 19 nt, Homo sapiens
caaggaggcgagaaaggaa

SEQ ID NO: 131588 - RNA, 19 nt, Homo sapiens
aggaggcgcuggaggcaaa

SEQ ID NO: 131589 - RNA, 19 nt, Homo sapiens
uggaugagacugucaaugu

SEQ ID NO: 131590 - RNA, 19 nt, Homo sapiens
gaagucaccuuguaaguaa

SEQ ID NO: 131591 - RNA, 19 nt, Homo sapiens
ggaaaggguuugaugaaua

SEQ ID NO: 131592 - RNA, 19 nt, Homo sapiens
guagagggcuguuuacaua

SEQ ID NO: 131593 - RNA, 19 nt, Homo sapiens
caacagaagucaccuugua

SEQ ID NO: 131594 - RNA, 19 nt, Homo sapiens
guacaaacauccauccuuu

SEQ ID NO: 131595 - RNA, 19 nt, Homo sapiens
uaacuugucuccaugauuu

SEQ ID NO: 131596 - RNA, 19 nt, Homo sapiens
ggaaagagggcuuggaaua

SEQ ID NO: 131597 - RNA, 19 nt, Homo sapiens
guaaaugcaugguauugua

SEQ ID NO: 131598 - RNA, 19 nt, Homo sapiens
gauccacaguuaccaauua

SEQ ID NO: 131599 - RNA, 19 nt, Homo sapiens
caacuggucugucaacgua

SEQ ID NO: 131600 - RNA, 19 nt, Homo sapiens
gcauuagcguuucucauua

SEQ ID NO: 131601 - RNA, 19 nt, Homo sapiens
gcaaagacuugaaggcauu

SEQ ID NO: 131602 - RNA, 19 nt, Homo sapiens
gaauagacaguccauauaa

SEQ ID NO: 131603 - RNA, 19 nt, Homo sapiens
gaaaguggauguguagcua

SEQ ID NO: 131604 - RNA, 19 nt, Homo sapiens
acacagagguaaaguaauu

SEQ ID NO: 131605 - RNA, 19 nt, Homo sapiens
gaccagacauucuaauuau

SEQ ID NO: 131606 - RNA, 19 nt, Homo sapiens
ggaccagacauucuaauua

SEQ ID NO: 131607 - RNA, 19 nt, Homo sapiens
gaagaaagccaagaaggua

SEQ ID NO: 131608 - RNA, 19 nt, Homo sapiens
gcaaagcccuuggaaaugu

SEQ ID NO: 131609 - RNA, 19 nt, Homo sapiens
gaaaggguuugaugaauag

SEQ ID NO: 131610 - RNA, 19 nt, Homo sapiens
gagcaaguccucacugaua

SEQ ID NO: 131611 - RNA, 19 nt, Homo sapiens
gaaagagggcuuggaauaa

SEQ ID NO: 131612 - RNA, 19 nt, Homo sapiens
gaacagcauugugaucaaa

SEQ ID NO: 131613 - RNA, 19 nt, Homo sapiens
gggcugggcugaacaacua

SEQ ID NO: 131614 - RNA, 19 nt, Homo sapiens
gaaccaacaaucuucaaua

SEQ ID NO: 131615 - RNA, 19 nt, Homo sapiens
gcagaagaauaauguaguu

SEQ ID NO: 131616 - RNA, 19 nt, Homo sapiens
gagaguaaaugcaugguau

SEQ ID NO: 131617 - RNA, 19 nt, Homo sapiens
gacauuggcuaucauuuga

SEQ ID NO: 131618 - RNA, 19 nt, Homo sapiens
ccaacaaucuucaauaaca

SEQ ID NO: 131619 - RNA, 19 nt, Homo sapiens
gauaagacauccaggaaca

SEQ ID NO: 131620 - RNA, 19 nt, Homo sapiens
gaacuuuagccaccuauuu

SEQ ID NO: 131621 - RNA, 19 nt, Homo sapiens
uaguacaucuuccaucuua

SEQ ID NO: 131622 - RNA, 19 nt, Homo sapiens
gguaauuucuccugucauu

SEQ ID NO: 131623 - RNA, 19 nt, Homo sapiens
aaagggauuugaacaagua

SEQ ID NO: 131624 - RNA, 19 nt, Homo sapiens
cagcagaucuuuacaagca

SEQ ID NO: 131625 - RNA, 19 nt, Homo sapiens
caagauguguguaauguca

SEQ ID NO: 131626 - RNA, 19 nt, Homo sapiens
gaucauuucuuaaggaaca

SEQ ID NO: 131627 - RNA, 19 nt, Homo sapiens
ccauuaaacuuguacagaa

SEQ ID NO: 131628 - RNA, 19 nt, Homo sapiens
ccaauucuguguuugcuuu

SEQ ID NO: 131629 - RNA, 19 nt, Homo sapiens
aaagagggcuuggaauaaa

SEQ ID NO: 131630 - RNA, 19 nt, Homo sapiens
auaaucagcugaagagaaa

SEQ ID NO: 131631 - RNA, 19 nt, Homo sapiens
caaauggaauggaggaaga

SEQ ID NO: 131632 - RNA, 19 nt, Homo sapiens
gcaauucaaugagggcuuu

SEQ ID NO: 131633 - RNA, 19 nt, Homo sapiens
aagaaagaguggaacaaua

SEQ ID NO: 131634 - RNA, 19 nt, Homo sapiens
cacacuagcucucugagua

SEQ ID NO: 131635 - RNA, 19 nt, Homo sapiens
guauuuggccauuugauua

SEQ ID NO: 131636 - RNA, 19 nt, Homo sapiens
gaccgaugaccaauaauua

SEQ ID NO: 131637 - RNA, 19 nt, Homo sapiens
ucacauuucuuaacucguu

SEQ ID NO: 131638 - RNA, 19 nt, Homo sapiens
caaaaugucuccaauguau

SEQ ID NO: 131639 - RNA, 19 nt, Homo sapiens
uagcagauaugaagauuuc

SEQ ID NO: 131640 - RNA, 19 nt, Homo sapiens
cagcaguuauugaucauuu

SEQ ID NO: 131641 - RNA, 19 nt, Homo sapiens
gaauaugggaguaagauga

SEQ ID NO: 131642 - RNA, 19 nt, Homo sapiens
ccaaauuucucauucuuca

SEQ ID NO: 131643 - RNA, 19 nt, Homo sapiens
gcacucaaguuccauugug

SEQ ID NO: 131644 - RNA, 19 nt, Homo sapiens
ucuauugaaugccuuguua

SEQ ID NO: 131645 - RNA, 19 nt, Homo sapiens
gaauaguuauagccagaaa

SEQ ID NO: 131646 - RNA, 19 nt, Homo sapiens
ccacaucuccuggcucuua

SEQ ID NO: 131647 - RNA, 19 nt, Homo sapiens
gaaaggcacagcauucgaa

SEQ ID NO: 131648 - RNA, 19 nt, Homo sapiens
gaguucaaaugcauuacua

SEQ ID NO: 131649 - RNA, 19 nt, Homo sapiens
uacaagcaguuuccuuaua

SEQ ID NO: 131650 - RNA, 19 nt, Homo sapiens
gagaacaggaugccuauau

SEQ ID NO: 131651 - RNA, 19 nt, Homo sapiens
caagagcccugguccuaug

SEQ ID NO: 131652 - RNA, 19 nt, Homo sapiens
uaaagaagccagauuguag

SEQ ID NO: 131653 - RNA, 19 nt, Homo sapiens
gcacuguacagaauacuuu

SEQ ID NO: 131654 - RNA, 19 nt, Homo sapiens
ccaguuugcuauggaaaua

SEQ ID NO: 131655 - RNA, 19 nt, Homo sapiens
ccaaucacccugcacauuu

SEQ ID NO: 131656 - RNA, 19 nt, Homo sapiens
ccuggaggcugucccuuua

SEQ ID NO: 131657 - RNA, 19 nt, Homo sapiens
ugaagccaaugaucccuua

SEQ ID NO: 131658 - RNA, 19 nt, Homo sapiens
gacauuugcuuaauugaca

SEQ ID NO: 131659 - RNA, 19 nt, Homo sapiens
caaguuccauuguguuaau

SEQ ID NO: 131660 - RNA, 19 nt, Homo sapiens
ggauuucucuuuacuaagg

SEQ ID NO: 131661 - RNA, 19 nt, Homo sapiens
ggaaaauacugcagacauu

SEQ ID NO: 131662 - RNA, 19 nt, Homo sapiens
uauuugcccugucuaauuu

SEQ ID NO: 131663 - RNA, 19 nt, Homo sapiens
gcccgaaguuccaauuuga

SEQ ID NO: 131664 - RNA, 19 nt, Homo sapiens
guaugguccuguaauauau

SEQ ID NO: 131665 - RNA, 19 nt, Homo sapiens
aguaagagguuaugccaaa

SEQ ID NO: 131666 - RNA, 19 nt, Homo sapiens
gcaugccaauucuguguuu

SEQ ID NO: 131667 - RNA, 19 nt, Homo sapiens
gagaauagacagaauugga

SEQ ID NO: 131668 - RNA, 19 nt, Homo sapiens
gaaaaugaaugccgaguca

SEQ ID NO: 131669 - RNA, 19 nt, Homo sapiens
ccuuauagcucauguaucu

SEQ ID NO: 131670 - RNA, 19 nt, Homo sapiens
cugaagggcuuuggcuuua

SEQ ID NO: 131671 - RNA, 19 nt, Homo sapiens
ggaguaagaugagcuagag

SEQ ID NO: 131672 - RNA, 19 nt, Homo sapiens
ggaacagcauugugaucaa

SEQ ID NO: 131673 - RNA, 19 nt, Homo sapiens
guauacaacuaaugcaugu

SEQ ID NO: 131674 - RNA, 19 nt, Homo sapiens
aaugaucccuuaugacuug

SEQ ID NO: 131675 - RNA, 19 nt, Homo sapiens
guacugaaaugcaaagacu

SEQ ID NO: 131676 - RNA, 19 nt, Homo sapiens
gugcaaagcccuuggaaau

SEQ ID NO: 131677 - RNA, 19 nt, Homo sapiens
ugaauagacaguccauaua

SEQ ID NO: 131678 - RNA, 19 nt, Homo sapiens
ugggacugaugauaaauua

SEQ ID NO: 131679 - RNA, 19 nt, Homo sapiens
gcucugaugaggacaauuu

SEQ ID NO: 131680 - RNA, 19 nt, Homo sapiens
gaaaggauagccauuagca

SEQ ID NO: 131681 - RNA, 19 nt, Homo sapiens
gaacaacuaacuucauaag

SEQ ID NO: 131682 - RNA, 19 nt, Homo sapiens
uaaauuggcccacuuucaa

SEQ ID NO: 131683 - RNA, 19 nt, Homo sapiens
gauaauaguuuggaguaag

SEQ ID NO: 131684 - RNA, 19 nt, Homo sapiens
agagggcuguuuacauaua

SEQ ID NO: 131685 - RNA, 19 nt, Homo sapiens
caaguaaagucagcaaaca

SEQ ID NO: 131686 - RNA, 19 nt, Homo sapiens
agagacauuugcuuaauug

SEQ ID NO: 131687 - RNA, 19 nt, Homo sapiens
gggaguaauugcuuaaagu

SEQ ID NO: 131688 - RNA, 19 nt, Homo sapiens
gcaaggaacccugagauuc

SEQ ID NO: 131689 - RNA, 19 nt, Homo sapiens
caccuugugucaucucaua

SEQ ID NO: 131690 - RNA, 19 nt, Homo sapiens
gaacaaggcuccuauguag

SEQ ID NO: 131691 - RNA, 19 nt, Homo sapiens
gacaagaguucucauguua

SEQ ID NO: 131692 - RNA, 19 nt, Homo sapiens
ggaaugagcugaaggugaa

SEQ ID NO: 131693 - RNA, 19 nt, Homo sapiens
gcaaggaccugcuguuuau

SEQ ID NO: 131694 - RNA, 19 nt, Homo sapiens
gggaggaugugaauuguua

SEQ ID NO: 131695 - RNA, 19 nt, Homo sapiens
gaaggaaacuuugaagaga

SEQ ID NO: 131696 - RNA, 19 nt, Homo sapiens
acacagagauggaacauga

SEQ ID NO: 131697 - RNA, 19 nt, Homo sapiens
ugacauaccuugauaaugg

SEQ ID NO: 131698 - RNA, 19 nt, Homo sapiens
ccaaagcucuggucaguga

SEQ ID NO: 131699 - RNA, 19 nt, Homo sapiens
ggaaaccuuuaccaacuua

SEQ ID NO: 131700 - RNA, 19 nt, Homo sapiens
caagaguucucauguuaaa

SEQ ID NO: 131701 - RNA, 19 nt, Homo sapiens
ggaugugaauuguuaguuu

SEQ ID NO: 131702 - RNA, 19 nt, Homo sapiens
gcaaagaccccaacacuua

SEQ ID NO: 131703 - RNA, 19 nt, Homo sapiens
ucaaagaggugggcaugua

SEQ ID NO: 131704 - RNA, 19 nt, Homo sapiens
uggcaaaccuacaguauga

SEQ ID NO: 131705 - RNA, 19 nt, Homo sapiens
gaaaaugccuuuaacuugu

SEQ ID NO: 131706 - RNA, 19 nt, Homo sapiens
agagauugcucgagacuuu

SEQ ID NO: 131707 - RNA, 19 nt, Homo sapiens
gcauuguggucuuucagua

SEQ ID NO: 131708 - RNA, 19 nt, Homo sapiens
gaaugaauaugcccucagu

SEQ ID NO: 131709 - RNA, 19 nt, Homo sapiens
acaaauuggucuucucaaa

SEQ ID NO: 131710 - RNA, 19 nt, Homo sapiens
gagaguuuccuggauauua

SEQ ID NO: 131711 - RNA, 19 nt, Homo sapiens
gcagggcccucuacuaucu

SEQ ID NO: 131712 - RNA, 19 nt, Homo sapiens
caucgacggugacuugauu

SEQ ID NO: 131713 - RNA, 19 nt, Homo sapiens
gaagaucugcuaccaggaa

SEQ ID NO: 131714 - RNA, 19 nt, Homo sapiens
cauagagacuugggaauga

SEQ ID NO: 131715 - RNA, 19 nt, Homo sapiens
caucucggcucguaucuug

SEQ ID NO: 131716 - RNA, 19 nt, Homo sapiens
aaauuggucuucucaaaug

SEQ ID NO: 131717 - RNA, 19 nt, Homo sapiens
ugauaaugguguuguguuu

SEQ ID NO: 131718 - RNA, 19 nt, Homo sapiens
gaugucaaguuccuauaug

SEQ ID NO: 131719 - RNA, 19 nt, Homo sapiens
gcacagcaaugguguaucc

SEQ ID NO: 131720 - RNA, 19 nt, Homo sapiens
gaugugaauuguuaguuuc

SEQ ID NO: 131721 - RNA, 19 nt, Homo sapiens
agacaagaguucucauguu

SEQ ID NO: 131722 - RNA, 19 nt, Homo sapiens
acacuuuggugcucucuuu

SEQ ID NO: 131723 - RNA, 19 nt, Homo sapiens
ucaaucaccuaucacaaug

SEQ ID NO: 131724 - RNA, 19 nt, Homo sapiens
gaaaaggaauucaauaagg

SEQ ID NO: 131725 - RNA, 19 nt, Homo sapiens
ucagagaccggcauuauug

SEQ ID NO: 131726 - RNA, 19 nt, Homo sapiens
cgagagcauugacaucauu

SEQ ID NO: 131727 - RNA, 19 nt, Homo sapiens
gacggugacuugauugaga

SEQ ID NO: 131728 - RNA, 19 nt, Homo sapiens
ggaaggaaacuuugaagag

SEQ ID NO: 131729 - RNA, 19 nt, Homo sapiens
gaccugcuguuuaucuuga

SEQ ID NO: 131730 - RNA, 19 nt, Homo sapiens
gaugagugcuguggaaauc

SEQ ID NO: 131731 - RNA, 19 nt, Homo sapiens
ucaaggaagugaacuacau

SEQ ID NO: 131732 - RNA, 19 nt, Homo sapiens
gagcugaaggugaaacauu

SEQ ID NO: 131733 - RNA, 19 nt, Homo sapiens
ccacggcucucugguaaug

SEQ ID NO: 131734 - RNA, 19 nt, Homo sapiens
gagaggagguagaagaaac

SEQ ID NO: 131735 - RNA, 19 nt, Homo sapiens
gggcauguaugggaagauu

SEQ ID NO: 131736 - RNA, 19 nt, Homo sapiens
guggaaaucuuggaugaug

SEQ ID NO: 131737 - RNA, 19 nt, Homo sapiens
ggaagugaacuacaugugu

SEQ ID NO: 131738 - RNA, 19 nt, Homo sapiens
gcacccagcccaccguauu

SEQ ID NO: 131739 - RNA, 19 nt, Homo sapiens
ugacuuaccaggcaucaaa

SEQ ID NO: 131740 - RNA, 19 nt, Homo sapiens
ugaacaaggcuccuaugua

SEQ ID NO: 131741 - RNA, 19 nt, Homo sapiens
ucucaaggaucuccgugua

SEQ ID NO: 131742 - RNA, 19 nt, Homo sapiens
uuaccagucucacaugauu

SEQ ID NO: 131743 - RNA, 19 nt, Homo sapiens
gcaaugguguauccugaag

SEQ ID NO: 131744 - RNA, 19 nt, Homo sapiens
caaauuggucuucucaaau

SEQ ID NO: 131745 - RNA, 19 nt, Homo sapiens
ucaaggaucuccguguaga

SEQ ID NO: 131746 - RNA, 19 nt, Homo sapiens
ggagaaggaggaacagaug

SEQ ID NO: 131747 - RNA, 19 nt, Homo sapiens
agaaucgacucaauaaagu

SEQ ID NO: 131748 - RNA, 19 nt, Homo sapiens
gccuuuaacuuguuugugu

SEQ ID NO: 131749 - RNA, 19 nt, Homo sapiens
gaagguucuuugcggauca

SEQ ID NO: 131750 - RNA, 19 nt, Homo sapiens
gccaagcaccuacuauuug

SEQ ID NO: 131751 - RNA, 19 nt, Homo sapiens
gugacuugauugagaguuu

SEQ ID NO: 131752 - RNA, 19 nt, Homo sapiens
gacuuaaaccuguugauug

SEQ ID NO: 131753 - RNA, 19 nt, Homo sapiens
agaagaaaccgaacugaug

SEQ ID NO: 131754 - RNA, 19 nt, Homo sapiens
aaucuuggaugaugacaau

SEQ ID NO: 131755 - RNA, 19 nt, Homo sapiens
ggugggaggaugugaauug

SEQ ID NO: 131756 - RNA, 19 nt, Homo sapiens
gaagaaggugggaggaugu

SEQ ID NO: 131757 - RNA, 19 nt, Homo sapiens
aaacugccuucuucggaaa

SEQ ID NO: 131758 - RNA, 19 nt, Homo sapiens
cagaaucgacucaauaaag

SEQ ID NO: 131759 - RNA, 19 nt, Homo sapiens
caaggaagaucugcuacca

SEQ ID NO: 131760 - RNA, 19 nt, Homo sapiens
caauagcacccucaccauu

SEQ ID NO: 131761 - RNA, 19 nt, Homo sapiens
cacuagaucgcgauaauaa

SEQ ID NO: 131762 - RNA, 19 nt, Homo sapiens
gugaauuguuaguuucuga

SEQ ID NO: 131763 - RNA, 19 nt, Homo sapiens
gcccauggaaggaaacuuu

SEQ ID NO: 131764 - RNA, 19 nt, Homo sapiens
gagagcauugacaucauua

SEQ ID NO: 131765 - RNA, 19 nt, Homo sapiens
acucuaugguggaauuuaa

SEQ ID NO: 131766 - RNA, 19 nt, Homo sapiens
uagcagcaaccacaaauug

SEQ ID NO: 131767 - RNA, 19 nt, Homo sapiens
gaguagccauuaccuccuu

SEQ ID NO: 131768 - RNA, 19 nt, Homo sapiens
gaacucaaggccuucaaca

SEQ ID NO: 131769 - RNA, 19 nt, Homo sapiens
gaaggugggaggaugugaa

SEQ ID NO: 131770 - RNA, 19 nt, Homo sapiens
gagcuaacucggauccauu

SEQ ID NO: 131771 - RNA, 19 nt, Homo sapiens
gcagaaucgacucaauaaa

SEQ ID NO: 131772 - RNA, 19 nt, Homo sapiens
ggacaucucggcucguauc

SEQ ID NO: 131773 - RNA, 19 nt, Homo sapiens
aagcaaagcacgauugugu

SEQ ID NO: 131774 - RNA, 19 nt, Homo sapiens
gauuccagccaucaccuua

SEQ ID NO: 131775 - RNA, 19 nt, Homo sapiens
caagcagggucgcauugug

SEQ ID NO: 131776 - RNA, 19 nt, Homo sapiens
ucucaaaugucaaccucaa

SEQ ID NO: 131777 - RNA, 19 nt, Homo sapiens
aguguggccuccugcaaua

SEQ ID NO: 131778 - RNA, 19 nt, Homo sapiens
ggagcugcaugucauugau

SEQ ID NO: 131779 - RNA, 19 nt, Homo sapiens
auugagaguuuccuggaua

SEQ ID NO: 131780 - RNA, 19 nt, Homo sapiens
ugccacggcucucugguaa

SEQ ID NO: 131781 - RNA, 19 nt, Homo sapiens
agaaggacgugcgcacuga

SEQ ID NO: 131782 - RNA, 19 nt, Homo sapiens
gagguuggucucucaagaa

SEQ ID NO: 131783 - RNA, 19 nt, Homo sapiens
gaucauccggaauggaauu

SEQ ID NO: 131784 - RNA, 19 nt, Homo sapiens
caacuuaggacccauuguc

SEQ ID NO: 131785 - RNA, 19 nt, Homo sapiens
acaaucgaguggacccuaa

SEQ ID NO: 131786 - RNA, 19 nt, Homo sapiens
ggagcuaacucggauccau

SEQ ID NO: 131787 - RNA, 19 nt, Homo sapiens
gcacaguuccccucuauga

SEQ ID NO: 131788 - RNA, 19 nt, Homo sapiens
ccacaaauuggucuucuca

SEQ ID NO: 131789 - RNA, 19 nt, Homo sapiens
uggaugaucagcagacuuu

SEQ ID NO: 131790 - RNA, 19 nt, Homo sapiens
ucacugggcugaaguuuaa

SEQ ID NO: 131791 - RNA, 19 nt, Homo sapiens
gcagagggaucaagcaguu

SEQ ID NO: 131792 - RNA, 19 nt, Homo sapiens
caacuaggcugcaagacuu

SEQ ID NO: 131793 - RNA, 19 nt, Homo sapiens
ucaguucgcuuaaugaauu

SEQ ID NO: 131794 - RNA, 19 nt, Homo sapiens
caacgcagcuuguuucagu

SEQ ID NO: 131795 - RNA, 19 nt, Homo sapiens
cagagguggugauuuguua

SEQ ID NO: 131796 - RNA, 19 nt, Homo sapiens
aagcagagguggugauuug

SEQ ID NO: 131797 - RNA, 19 nt, Homo sapiens
cagaagaccuccgagauug

SEQ ID NO: 131798 - RNA, 19 nt, Homo sapiens
gaacauggacggcaaagag

SEQ ID NO: 131799 - RNA, 19 nt, Homo sapiens
gauggaaacucagggaaga

SEQ ID NO: 131800 - RNA, 19 nt, Homo sapiens
gaacaacuaggcugcaaga

SEQ ID NO: 131801 - RNA, 19 nt, Homo sapiens
ggacaaacccaccuucauc

SEQ ID NO: 131802 - RNA, 19 nt, Homo sapiens
ccaaaaguauccaagguua

SEQ ID NO: 131803 - RNA, 19 nt, Homo sapiens
ggacuugccuccagagacu

SEQ ID NO: 131804 - RNA, 19 nt, Homo sapiens
gaagaccuccgagauugua

SEQ ID NO: 131805 - RNA, 19 nt, Homo sapiens
cagggaagaugauguguca

SEQ ID NO: 131806 - RNA, 19 nt, Homo sapiens
aagguuaucuuggaacuaa

SEQ ID NO: 131807 - RNA, 19 nt, Homo sapiens
gagagacacuaaagaaggu

SEQ ID NO: 131808 - RNA, 19 nt, Homo sapiens
gauaucaugcucuggaauu

SEQ ID NO: 131809 - RNA, 19 nt, Homo sapiens
gaugaugugucagcucuau

SEQ ID NO: 131810 - RNA, 19 nt, Homo sapiens
gcuccaagcugguuugaac

SEQ ID NO: 131811 - RNA, 19 nt, Homo sapiens
gagauaucaugcucuggaa

SEQ ID NO: 131812 - RNA, 19 nt, Homo sapiens
ccagaagaccuccgagauu

SEQ ID NO: 131813 - RNA, 19 nt, Homo sapiens
gagcaucacugggcugaag

SEQ ID NO: 131814 - RNA, 19 nt, Homo sapiens
ggcaucaguucgcuuaaug

SEQ ID NO: 131815 - RNA, 19 nt, Homo sapiens
ggaacgugauccugcugaa

SEQ ID NO: 131816 - RNA, 19 nt, Homo sapiens
ugcacacucuggauucuua

SEQ ID NO: 131817 - RNA, 19 nt, Homo sapiens
cgcgauggcucccaagaaa

SEQ ID NO: 131818 - RNA, 19 nt, Homo sapiens
gaagagcgagauccgaguu

SEQ ID NO: 131819 - RNA, 19 nt, Homo sapiens
gauuugugcucuuuugaua

SEQ ID NO: 131820 - RNA, 19 nt, Homo sapiens
agagcgagauccgaguuua

SEQ ID NO: 131821 - RNA, 19 nt, Homo sapiens
caaacccaccuucaucaaa

SEQ ID NO: 131822 - RNA, 19 nt, Homo sapiens
gaccuccgagauuguauua

SEQ ID NO: 131823 - RNA, 19 nt, Homo sapiens
agagacugcuccagaguug

SEQ ID NO: 131824 - RNA, 19 nt, Homo sapiens
aaacccaccuucaucaaag

SEQ ID NO: 131825 - RNA, 19 nt, Homo sapiens
gcagagguggugauuuguu

SEQ ID NO: 131826 - RNA, 19 nt, Homo sapiens
aaguuuaacccucucaaua

SEQ ID NO: 131827 - RNA, 19 nt, Homo sapiens
ccacagauccugccaccau

SEQ ID NO: 131828 - RNA, 19 nt, Homo sapiens
gcaagcagagguggugauu

SEQ ID NO: 131829 - RNA, 19 nt, Homo sapiens
gaaguuuaacccucucaau

SEQ ID NO: 131830 - RNA, 19 nt, Homo sapiens
gcucagacaccaucaacau

SEQ ID NO: 131831 - RNA, 19 nt, Homo sapiens
gacaaacccaccuucauca

SEQ ID NO: 131832 - RNA, 19 nt, Homo sapiens
ugaggacgaucgacguguu

SEQ ID NO: 131833 - RNA, 19 nt, Homo sapiens
gccgauacccagauccuaa

SEQ ID NO: 131834 - RNA, 19 nt, Homo sapiens
ggccacagccuccguagau

SEQ ID NO: 131835 - RNA, 19 nt, Homo sapiens
ggcaacauucuacgaguuu

SEQ ID NO: 131836 - RNA, 19 nt, Homo sapiens
gggaacaacuaggcugcaa

SEQ ID NO: 131837 - RNA, 19 nt, Homo sapiens
ggaaacucagggaagauga

SEQ ID NO: 131838 - RNA, 19 nt, Homo sapiens
cguguucgauggaaacuca

SEQ ID NO: 131839 - RNA, 19 nt, Homo sapiens
gauacccagauccuaauuu

SEQ ID NO: 131840 - RNA, 19 nt, Homo sapiens
gcuuuggaaucucagaaug

SEQ ID NO: 131841 - RNA, 19 nt, Homo sapiens
ggaacuaaaugacuuuucu

SEQ ID NO: 131842 - RNA, 19 nt, Homo sapiens
gagguggugauuuguuaaa

SEQ ID NO: 131843 - RNA, 19 nt, Homo sapiens
gaacccaugcugugauugg

SEQ ID NO: 131844 - RNA, 19 nt, Homo sapiens
ugacgcauguggcccugaa

SEQ ID NO: 131845 - RNA, 19 nt, Homo sapiens
auacccagauccuaauuuc

SEQ ID NO: 131846 - RNA, 19 nt, Homo sapiens
ccuccaugaucuucgcaua

SEQ ID NO: 131847 - RNA, 19 nt, Homo sapiens
ucuggauucuuaccggaua

SEQ ID NO: 131848 - RNA, 19 nt, Homo sapiens
gcagaagaugugacucaga

SEQ ID NO: 131849 - RNA, 19 nt, Homo sapiens
ucaauggagggaacaacua

SEQ ID NO: 131850 - RNA, 19 nt, Homo sapiens
gguccuagcagaagaugug

SEQ ID NO: 131851 - RNA, 19 nt, Homo sapiens
gaaacucagggaagaugau

SEQ ID NO: 131852 - RNA, 19 nt, Homo sapiens
aaaagaaagugacgcaugu

SEQ ID NO: 131853 - RNA, 19 nt, Homo sapiens
ggauucuuaccggauauua

SEQ ID NO: 131854 - RNA, 19 nt, Homo sapiens
gggaucaagcaguuauuug

SEQ ID NO: 131855 - RNA, 19 nt, Homo sapiens
gaaggugugggccagacaa

SEQ ID NO: 131856 - RNA, 19 nt, Homo sapiens
caucaguucgcuuaaugaa

SEQ ID NO: 131857 - RNA, 19 nt, Homo sapiens
gcaucaguucgcuuaauga

SEQ ID NO: 131858 - RNA, 19 nt, Homo sapiens
ucagcucuaugacccagaa

SEQ ID NO: 131859 - RNA, 19 nt, Homo sapiens
ugaugugucagcucuauga

SEQ ID NO: 131860 - RNA, 19 nt, Homo sapiens
cugaacccaugcugugauu

SEQ ID NO: 131861 - RNA, 19 nt, Homo sapiens
uagcagaagaugugacuca

SEQ ID NO: 131862 - RNA, 19 nt, Homo sapiens
uccaugaucuucgcauaga

SEQ ID NO: 131863 - RNA, 19 nt, Homo sapiens
cccaagaaacgcccagaaa

SEQ ID NO: 131864 - RNA, 19 nt, Homo sapiens
cugggacacuuuuauguua

SEQ ID NO: 131865 - RNA, 19 nt, Homo sapiens
ccaagaaacgcccagaaac

SEQ ID NO: 131866 - RNA, 19 nt, Homo sapiens
cccagauccuaauuucaaa

SEQ ID NO: 131867 - RNA, 19 nt, Homo sapiens
cuggaugugucugcuagua

SEQ ID NO: 131868 - RNA, 19 nt, Homo sapiens
ggacccuccaccagcauaa

SEQ ID NO: 131869 - RNA, 19 nt, Homo sapiens
gcgggaaguuggcuuagcu

SEQ ID NO: 131870 - RNA, 19 nt, Homo sapiens
gguggugauuuguuaaagg

SEQ ID NO: 131871 - RNA, 19 nt, Homo sapiens
ccacagccuccguagauca

SEQ ID NO: 131872 - RNA, 19 nt, Homo sapiens
uuaacccucucaauaccaa

SEQ ID NO: 131873 - RNA, 19 nt, Homo sapiens
gcaccucacacccaucaag

SEQ ID NO: 131874 - RNA, 19 nt, Homo sapiens
gcgccagguuagagggaaa

SEQ ID NO: 131875 - RNA, 19 nt, Homo sapiens
uaaaggcaacauucuacga

SEQ ID NO: 131876 - RNA, 19 nt, Homo sapiens
ucucaauaccaaccaguuu

SEQ ID NO: 131877 - RNA, 19 nt, Homo sapiens
ccacacaugggaucaaguc

SEQ ID NO: 131878 - RNA, 19 nt, Homo sapiens
ccaggacacggaagugaga

SEQ ID NO: 131879 - RNA, 19 nt, Homo sapiens
aggcaacauucuacgaguu

SEQ ID NO: 131880 - RNA, 19 nt, Homo sapiens
ggugguagcagagggauca

SEQ ID NO: 131881 - RNA, 19 nt, Homo sapiens
ucuuggaacuaaaugacuu

SEQ ID NO: 131882 - RNA, 19 nt, Homo sapiens
gaagccaggacacggaagu

SEQ ID NO: 131883 - RNA, 19 nt, Homo sapiens
ucuaugacccagaaucuuc

SEQ ID NO: 131884 - RNA, 19 nt, Homo sapiens
caagaaacgcccagaaacc

SEQ ID NO: 131885 - RNA, 19 nt, Homo sapiens
auaucaugcucuggaauuu

SEQ ID NO: 131886 - RNA, 19 nt, Homo sapiens
uguuaaugcucuggacuug

SEQ ID NO: 131887 - RNA, 19 nt, Homo sapiens
gcucuaugacccagaaucu

SEQ ID NO: 131888 - RNA, 19 nt, Homo sapiens
caauggagggaacaacuag

SEQ ID NO: 131889 - RNA, 19 nt, Homo sapiens
ggagcuggagggagcauca

SEQ ID NO: 131890 - RNA, 19 nt, Homo sapiens
ggaaggagaugguggauua

SEQ ID NO: 131891 - RNA, 19 nt, Homo sapiens
ggaaagagcuggguuaauu

SEQ ID NO: 131892 - RNA, 19 nt, Homo sapiens
ucaaaggacugcaggcuua

SEQ ID NO: 131893 - RNA, 19 nt, Homo sapiens
gcagauucauucaacuuua

SEQ ID NO: 131894 - RNA, 19 nt, Homo sapiens
gcuaaaggguuccaacaaa

SEQ ID NO: 131895 - RNA, 19 nt, Homo sapiens
caaagcggcuggccugauu

SEQ ID NO: 131896 - RNA, 19 nt, Homo sapiens
gcaagugaauuccgaagga

SEQ ID NO: 131897 - RNA, 19 nt, Homo sapiens
ucacgcaacuugaaauuau

SEQ ID NO: 131898 - RNA, 19 nt, Homo sapiens
uaggaaagccucacugaua

SEQ ID NO: 131899 - RNA, 19 nt, Homo sapiens
caucagaagugguaggaaa

SEQ ID NO: 131900 - RNA, 19 nt, Homo sapiens
gaagccagcugcaggaauc

SEQ ID NO: 131901 - RNA, 19 nt, Homo sapiens
aagccucacugauauauuu

SEQ ID NO: 131902 - RNA, 19 nt, Homo sapiens
acaaauggcuauuggugaa

SEQ ID NO: 131903 - RNA, 19 nt, Homo sapiens
guggcuaaaugccuaauaa

SEQ ID NO: 131904 - RNA, 19 nt, Homo sapiens
ggaaagccucacugauaua

SEQ ID NO: 131905 - RNA, 19 nt, Homo sapiens
gcacagccaucaggauuca

SEQ ID NO: 131906 - RNA, 19 nt, Homo sapiens
guuaauugguggagugaaa

SEQ ID NO: 131907 - RNA, 19 nt, Homo sapiens
gaaagagcuggguuaauug

SEQ ID NO: 131908 - RNA, 19 nt, Homo sapiens
gcuaaaugccuaauaaaca

SEQ ID NO: 131909 - RNA, 19 nt, Homo sapiens
uaucuguggucuucaaauu

SEQ ID NO: 131910 - RNA, 19 nt, Homo sapiens
gcagucaucagaaguggua

SEQ ID NO: 131911 - RNA, 19 nt, Homo sapiens
cuuaguaucucaucaacaa

SEQ ID NO: 131912 - RNA, 19 nt, Homo sapiens
gagcagagagggaguagga

SEQ ID NO: 131913 - RNA, 19 nt, Homo sapiens
caaagugaaugaagcucuu

SEQ ID NO: 131914 - RNA, 19 nt, Homo sapiens
ggaguggaguuugcagauu

SEQ ID NO: 131915 - RNA, 19 nt, Homo sapiens
acauauggcugcacguuga

SEQ ID NO: 131916 - RNA, 19 nt, Homo sapiens
gaaagccucacugauauau

SEQ ID NO: 131917 - RNA, 19 nt, Homo sapiens
gguggaaucugcccaugug

SEQ ID NO: 131918 - RNA, 19 nt, Homo sapiens
gaguggaguuugcagauuc

SEQ ID NO: 131919 - RNA, 19 nt, Homo sapiens
caacaaggaagacauaugg

SEQ ID NO: 131920 - RNA, 19 nt, Homo sapiens
uaggauguauggagucaaa

SEQ ID NO: 131921 - RNA, 19 nt, Homo sapiens
gcauucaucugcccugagu

SEQ ID NO: 131922 - RNA, 19 nt, Homo sapiens
uggauuacguggccaacua

SEQ ID NO: 131923 - RNA, 19 nt, Homo sapiens
aggaaagccucacugauau

SEQ ID NO: 131924 - RNA, 19 nt, Homo sapiens
cggcuggccugauuccuuu

SEQ ID NO: 131925 - RNA, 19 nt, Homo sapiens
ggacagagagcaagucacu

SEQ ID NO: 131926 - RNA, 19 nt, Homo sapiens
caucaggauucagggcuua

SEQ ID NO: 131927 - RNA, 19 nt, Homo sapiens
cuaaaggguuccaacaaag

SEQ ID NO: 131928 - RNA, 19 nt, Homo sapiens
ggaguuugcagauucauuc

SEQ ID NO: 131929 - RNA, 19 nt, Homo sapiens
ccagggaagugccagugaa

SEQ ID NO: 131930 - RNA, 19 nt, Homo sapiens
ggaacuaccaaaggcauuu

SEQ ID NO: 131931 - RNA, 19 nt, Homo sapiens
ggccugauuccuuucuuua

SEQ ID NO: 131932 - RNA, 19 nt, Homo sapiens
cacgcaacuugaaauuaua

SEQ ID NO: 131933 - RNA, 19 nt, Homo sapiens
ucccaugucuuucuccaaa

SEQ ID NO: 131934 - RNA, 19 nt, Homo sapiens
ccacugggcagaagauuuc

SEQ ID NO: 131935 - RNA, 19 nt, Homo sapiens
agacuuaacgggagccuuu

SEQ ID NO: 131936 - RNA, 19 nt, Homo sapiens
gcaacaaggaagacauaug

SEQ ID NO: 131937 - RNA, 19 nt, Homo sapiens
caacaugcugcuccuuuga

SEQ ID NO: 131938 - RNA, 19 nt, Homo sapiens
ccugauuccuuucuuuaug

SEQ ID NO: 131939 - RNA, 19 nt, Homo sapiens
gguaggaaagccucacuga

SEQ ID NO: 131940 - RNA, 19 nt, Homo sapiens
acaacaugcugcuccuuug

SEQ ID NO: 131941 - RNA, 19 nt, Homo sapiens
ccagggcaaucaauguuca

SEQ ID NO: 131942 - RNA, 19 nt, Homo sapiens
ccagcugucccaugaguuu

SEQ ID NO: 131943 - RNA, 19 nt, Homo sapiens
aauuauaucuguggucuuc

SEQ ID NO: 131944 - RNA, 19 nt, Homo sapiens
ggccauagcuuuuauucau

SEQ ID NO: 131945 - RNA, 19 nt, Homo sapiens
ugaaaucuguguggaaguc

SEQ ID NO: 131946 - RNA, 19 nt, Homo sapiens
aggaagcccuggagagaga

SEQ ID NO: 131947 - RNA, 19 nt, Homo sapiens
gcuggagacugugaugaug

SEQ ID NO: 131948 - RNA, 19 nt, Homo sapiens
ucugaaaacuggaauaaga

SEQ ID NO: 131949 - RNA, 19 nt, Homo sapiens
caugaacgcaagugaauuc

SEQ ID NO: 131950 - RNA, 19 nt, Homo sapiens
gaaugagaaagcuggagaa

SEQ ID NO: 131951 - RNA, 19 nt, Homo sapiens
ucuguggucuucaaauugu

SEQ ID NO: 131952 - RNA, 19 nt, Homo sapiens
gauuuugucugcuuaguau

SEQ ID NO: 131953 - RNA, 19 nt, Homo sapiens
uaaaagccauccccucaga

SEQ ID NO: 131954 - RNA, 19 nt, Homo sapiens
cuaccggcauuggcagaua

SEQ ID NO: 131955 - RNA, 19 nt, Homo sapiens
caacuuuaauccccacaaa

SEQ ID NO: 131956 - RNA, 19 nt, Homo sapiens
gcacagccccuacuucuuc

SEQ ID NO: 131957 - RNA, 19 nt, Homo sapiens
ggagugauccagggaagug

SEQ ID NO: 131958 - RNA, 19 nt, Homo sapiens
aaauggcuauuggugaauu

SEQ ID NO: 131959 - RNA, 19 nt, Homo sapiens
gagagaggacagagagcaa

SEQ ID NO: 131960 - RNA, 19 nt, Homo sapiens
aagaauaaacagugccaaa

SEQ ID NO: 131961 - RNA, 19 nt, Homo sapiens
caacaaagugaaugaagcu

SEQ ID NO: 131962 - RNA, 19 nt, Homo sapiens
aagcacagccaucaggauu

SEQ ID NO: 131963 - RNA, 19 nt, Homo sapiens
ugaauggaguggaguuugc

SEQ ID NO: 131964 - RNA, 19 nt, Homo sapiens
cacaacaugcugcuccuuu

SEQ ID NO: 131965 - RNA, 19 nt, Homo sapiens
gaaggagagggaaggagau

SEQ ID NO: 131966 - RNA, 19 nt, Homo sapiens
uaaaggguuccaacaaagu

SEQ ID NO: 131967 - RNA, 19 nt, Homo sapiens
aaagagaacagacuuaacg

SEQ ID NO: 131968 - RNA, 19 nt, Homo sapiens
caacuacauggaaggcauu

SEQ ID NO: 131969 - RNA, 19 nt, Homo sapiens
uuauaucuguggucuucaa

SEQ ID NO: 131970 - RNA, 19 nt, Homo sapiens
ucaauguucacgcaacuug

SEQ ID NO: 131971 - RNA, 19 nt, Homo sapiens
aaacuggaauaagaagcaa

SEQ ID NO: 131972 - RNA, 19 nt, Homo sapiens
ccugggaacacaucaaaga

SEQ ID NO: 131973 - RNA, 19 nt, Homo sapiens
uugacaaucucuuagaagu

SEQ ID NO: 131974 - RNA, 19 nt, Homo sapiens
ggagagggaaggagauggu

SEQ ID NO: 131975 - RNA, 19 nt, Homo sapiens
uuacguggccaacuacaug

SEQ ID NO: 131976 - RNA, 19 nt, Homo sapiens
gaagcacagccaucaggau

SEQ ID NO: 131977 - RNA, 19 nt, Homo sapiens
gaggacagagagcaaguca

SEQ ID NO: 131978 - RNA, 19 nt, Homo sapiens
gagagggaguaggagugaa

SEQ ID NO: 131979 - RNA, 19 nt, Homo sapiens
ggccugggaacacaucaaa

SEQ ID NO: 131980 - RNA, 19 nt, Homo sapiens
gaagaugcuggaacuacca

SEQ ID NO: 131981 - RNA, 19 nt, Homo sapiens
ucaggagccagacacguuu

SEQ ID NO: 131982 - RNA, 19 nt, Homo sapiens
cugcaacaaggaagacaua

SEQ ID NO: 131983 - RNA, 19 nt, Homo sapiens
uggccugauuccuuucuuu

SEQ ID NO: 131984 - RNA, 19 nt, Homo sapiens
uugguggagugaaauuaaa

SEQ ID NO: 131985 - RNA, 19 nt, Homo sapiens
guggaaagagcuggguuaa

SEQ ID NO: 131986 - RNA, 19 nt, Homo sapiens
guaggaaagccucacugau

SEQ ID NO: 131987 - RNA, 19 nt, Homo sapiens
ucauggaacucagcugucu

SEQ ID NO: 131988 - RNA, 19 nt, Homo sapiens
gauguauggagucaaagga

SEQ ID NO: 131989 - RNA, 19 nt, Homo sapiens
ucacacaggccgcuaucau

SEQ ID NO: 131990 - RNA, 19 nt, Homo sapiens
gaagagagaagacauauuc

SEQ ID NO: 131991 - RNA, 19 nt, Homo sapiens
gaagacauauucuacacuu

SEQ ID NO: 131992 - RNA, 19 nt, Homo sapiens
ugacagaaauggauucgaa

SEQ ID NO: 131993 - RNA, 19 nt, Homo sapiens
gaaauggauucgaaauauc

SEQ ID NO: 131994 - RNA, 19 nt, Homo sapiens
uaaaugcucucuccuaaag

SEQ ID NO: 131995 - RNA, 19 nt, Homo sapiens
aaacagaaaugugcgauau

SEQ ID NO: 131996 - RNA, 19 nt, Homo sapiens
gcaaccagguggaauguca

SEQ ID NO: 131997 - RNA, 19 nt, Homo sapiens
gcaggcagcuggagaugau

SEQ ID NO: 131998 - RNA, 19 nt, Homo sapiens
ggaaugucauccuuacuuc

SEQ ID NO: 131999 - RNA, 19 nt, Homo sapiens
guguaaagaugcaggauug

SEQ ID NO: 132000 - RNA, 19 nt, Homo sapiens
gguuaaaucucuccugcuu

SEQ ID NO: 132001 - RNA, 19 nt, Homo sapiens
acacaucgccucugguuaa

SEQ ID NO: 132002 - RNA, 19 nt, Homo sapiens
ggacacaucgccucugguu

SEQ ID NO: 132003 - RNA, 19 nt, Homo sapiens
gagcagcgcaucagacaga

SEQ ID NO: 132004 - RNA, 19 nt, Homo sapiens
cagaaauggauucgaaaua

SEQ ID NO: 132005 - RNA, 19 nt, Homo sapiens
guggagaaguguaaagaug

SEQ ID NO: 132006 - RNA, 19 nt, Homo sapiens
uagauggccuaaacagaaa

SEQ ID NO: 132007 - RNA, 19 nt, Homo sapiens
agagaaaacugcuggauuu

SEQ ID NO: 132008 - RNA, 19 nt, Homo sapiens
gugaggaagugaucccaaa

SEQ ID NO: 132009 - RNA, 19 nt, Homo sapiens
gacagaacgugcagguguu

SEQ ID NO: 132010 - RNA, 19 nt, Homo sapiens
gcugaaugauggucacuuc

SEQ ID NO: 132011 - RNA, 19 nt, Homo sapiens
ggagaaguguaaagaugca

SEQ ID NO: 132012 - RNA, 19 nt, Homo sapiens
auuaaaugcucucuccuaa

SEQ ID NO: 132013 - RNA, 19 nt, Homo sapiens
gagaugaaagccauagaug

SEQ ID NO: 132014 - RNA, 19 nt, Homo sapiens
uauguugaccucuaccuua

SEQ ID NO: 132015 - RNA, 19 nt, Homo sapiens
gcagauggcagugugaaga

SEQ ID NO: 132016 - RNA, 19 nt, Homo sapiens
caucgccucugguuaaauc

SEQ ID NO: 132017 - RNA, 19 nt, Homo sapiens
gaagugaucccaaaagaug

SEQ ID NO: 132018 - RNA, 19 nt, Homo sapiens
uggauuauguugaccucua

SEQ ID NO: 132019 - RNA, 19 nt, Homo sapiens
gcuggugacuggacacauc

SEQ ID NO: 132020 - RNA, 19 nt, Homo sapiens
cgaaauaucagugugugaa

SEQ ID NO: 132021 - RNA, 19 nt, Homo sapiens
ggagaugaaagccauagau

SEQ ID NO: 132022 - RNA, 19 nt, Homo sapiens
guugaccucuaccuuauuc

SEQ ID NO: 132023 - RNA, 19 nt, Homo sapiens
gacauauucuacacuucaa

SEQ ID NO: 132024 - RNA, 19 nt, Homo sapiens
ucagcaagcuacagcaaag

SEQ ID NO: 132025 - RNA, 19 nt, Homo sapiens
auagauggccuaaacagaa

SEQ ID NO: 132026 - RNA, 19 nt, Homo sapiens
uaaacagaaaugugcgaua

SEQ ID NO: 132027 - RNA, 19 nt, Homo sapiens
caaagcccauuggccagaa

SEQ ID NO: 132028 - RNA, 19 nt, Homo sapiens
gaacgugcagguguuugaa

SEQ ID NO: 132029 - RNA, 19 nt, Homo sapiens
gguggaaugucauccuuac

SEQ ID NO: 132030 - RNA, 19 nt, Homo sapiens
cauauugauucugcucauu

SEQ ID NO: 132031 - RNA, 19 nt, Homo sapiens
ggacuggccauccgaagca

SEQ ID NO: 132032 - RNA, 19 nt, Homo sapiens
gaaauaucagugugugaag

SEQ ID NO: 132033 - RNA, 19 nt, Homo sapiens
ggauuauguugaccucuac

SEQ ID NO: 132034 - RNA, 19 nt, Homo sapiens
agacauauucuacacuuca

SEQ ID NO: 132035 - RNA, 19 nt, Homo sapiens
ugauucugcucauuuauac

SEQ ID NO: 132036 - RNA, 19 nt, Homo sapiens
ggagaugauccucaacaag

SEQ ID NO: 132037 - RNA, 19 nt, Homo sapiens
gcagagguuccuaaaagua

SEQ ID NO: 132038 - RNA, 19 nt, Homo sapiens
gaccucuaccuuauucauu

SEQ ID NO: 132039 - RNA, 19 nt, Homo sapiens
gacagaaauggauucgaaa

SEQ ID NO: 132040 - RNA, 19 nt, Homo sapiens
uaacauggagggcauugca

SEQ ID NO: 132041 - RNA, 19 nt, Homo sapiens
cuuuagaggccaccaaauu

SEQ ID NO: 132042 - RNA, 19 nt, Homo sapiens
guguuugaauuccaguuga

SEQ ID NO: 132043 - RNA, 19 nt, Homo sapiens
gaaugucauccuuacuuca

SEQ ID NO: 132044 - RNA, 19 nt, Homo sapiens
cagguggaaugucauccuu

SEQ ID NO: 132045 - RNA, 19 nt, Homo sapiens
uggagaugauccucaacaa

SEQ ID NO: 132046 - RNA, 19 nt, Homo sapiens
gaauuccaguugacuucag

SEQ ID NO: 132047 - RNA, 19 nt, Homo sapiens
accucuaccuuauucauuu

SEQ ID NO: 132048 - RNA, 19 nt, Homo sapiens
gcuagugacagaaauggau

SEQ ID NO: 132049 - RNA, 19 nt, Homo sapiens
cacaucgccucugguuaaa

SEQ ID NO: 132050 - RNA, 19 nt, Homo sapiens
cgauauuugacccuugaua

SEQ ID NO: 132051 - RNA, 19 nt, Homo sapiens
aaugcucucuccuaaagau

SEQ ID NO: 132052 - RNA, 19 nt, Homo sapiens
cauagauggccuaaacaga

SEQ ID NO: 132053 - RNA, 19 nt, Homo sapiens
uuaaaugcucucuccuaaa

SEQ ID NO: 132054 - RNA, 19 nt, Homo sapiens
aauuaaaugcucucuccua

SEQ ID NO: 132055 - RNA, 19 nt, Homo sapiens
uggccaagagcuacaauga

SEQ ID NO: 132056 - RNA, 19 nt, Homo sapiens
uggaaugucauccuuacuu

SEQ ID NO: 132057 - RNA, 19 nt, Homo sapiens
uuuagaggccaccaaauug

SEQ ID NO: 132058 - RNA, 19 nt, Homo sapiens
auucuacacuucaaagcuu

SEQ ID NO: 132059 - RNA, 19 nt, Homo sapiens
gugaagagagaagacauau

SEQ ID NO: 132060 - RNA, 19 nt, Homo sapiens
ugcgauauuugacccuuga

SEQ ID NO: 132061 - RNA, 19 nt, Homo sapiens
ugugaagagagaagacaua

SEQ ID NO: 132062 - RNA, 19 nt, Homo sapiens
gacacaucgccucugguua

SEQ ID NO: 132063 - RNA, 19 nt, Homo sapiens
ccugggauuuggcaccuau

SEQ ID NO: 132064 - RNA, 19 nt, Homo sapiens
ccauauugauucugcucau

SEQ ID NO: 132065 - RNA, 19 nt, Homo sapiens
acgugcagguguuugaauu

SEQ ID NO: 132066 - RNA, 19 nt, Homo sapiens
gggaucccaccgagaagaa

SEQ ID NO: 132067 - RNA, 19 nt, Homo sapiens
gaugcaggauuggccaagu

SEQ ID NO: 132068 - RNA, 19 nt, Homo sapiens
cccaaaagaugaaaaugga

SEQ ID NO: 132069 - RNA, 19 nt, Homo sapiens
aaagccaggugaggaagug

SEQ ID NO: 132070 - RNA, 19 nt, Homo sapiens
ugaagagagaagacauauu

SEQ ID NO: 132071 - RNA, 19 nt, Homo sapiens
gguguuugaauuccaguug

SEQ ID NO: 132072 - RNA, 19 nt, Homo sapiens
uguaaagccaggugaggaa

SEQ ID NO: 132073 - RNA, 19 nt, Homo sapiens
gcucucuccuaaagauucu

SEQ ID NO: 132074 - RNA, 19 nt, Homo sapiens
cuaugcgccugcagagguu

SEQ ID NO: 132075 - RNA, 19 nt, Homo sapiens
uuggaaaggucacugaaaa

SEQ ID NO: 132076 - RNA, 19 nt, Homo sapiens
ccaggcuagugacagaaau

SEQ ID NO: 132077 - RNA, 19 nt, Homo sapiens
aaagcccauuggccagaaa

SEQ ID NO: 132078 - RNA, 19 nt, Homo sapiens
acagaaauggauucgaaau

SEQ ID NO: 132079 - RNA, 19 nt, Homo sapiens
aaaagacauuguucugguu

SEQ ID NO: 132080 - RNA, 19 nt, Homo sapiens
agaacgugcagguguuuga

SEQ ID NO: 132081 - RNA, 19 nt, Homo sapiens
aguacaagccugucugcaa

SEQ ID NO: 132082 - RNA, 19 nt, Homo sapiens
cugcagagguuccuaaaag

SEQ ID NO: 132083 - RNA, 19 nt, Homo sapiens
gaagagagaagacauauuc

SEQ ID NO: 132084 - RNA, 19 nt, Homo sapiens
gaagacauauucuacacuu

SEQ ID NO: 132085 - RNA, 19 nt, Homo sapiens
gcacauguuuacaauaaug

SEQ ID NO: 132086 - RNA, 19 nt, Homo sapiens
ugacagaaauggauucgaa

SEQ ID NO: 132087 - RNA, 19 nt, Homo sapiens
uaaaugcucucuccuaaag

SEQ ID NO: 132088 - RNA, 19 nt, Homo sapiens
aaacagaaaugugcgauau

SEQ ID NO: 132089 - RNA, 19 nt, Homo sapiens
gcaaccagguggaauguca

SEQ ID NO: 132090 - RNA, 19 nt, Homo sapiens
ggacuauguugaccucuau

SEQ ID NO: 132091 - RNA, 19 nt, Homo sapiens
gaagccggguuccaccaua

SEQ ID NO: 132092 - RNA, 19 nt, Homo sapiens
cugcacauguuuacaauaa

SEQ ID NO: 132093 - RNA, 19 nt, Homo sapiens
ggaaugucauccuuacuuc

SEQ ID NO: 132094 - RNA, 19 nt, Homo sapiens
cuaaagaaacuucaccuaa

SEQ ID NO: 132095 - RNA, 19 nt, Homo sapiens
guguaaagaugcaggauug

SEQ ID NO: 132096 - RNA, 19 nt, Homo sapiens
gguuaaaucucuccugcuu

SEQ ID NO: 132097 - RNA, 19 nt, Homo sapiens
acacaucgccucugguuaa

SEQ ID NO: 132098 - RNA, 19 nt, Homo sapiens
ggacacaucgccucugguu

SEQ ID NO: 132099 - RNA, 19 nt, Homo sapiens
gagcagcgcaucagacaga

SEQ ID NO: 132100 - RNA, 19 nt, Homo sapiens
uauguugaccucuaucuua

SEQ ID NO: 132101 - RNA, 19 nt, Homo sapiens
cagaaauggauucgaaaua

SEQ ID NO: 132102 - RNA, 19 nt, Homo sapiens
uagauggccuaaacagaaa

SEQ ID NO: 132103 - RNA, 19 nt, Homo sapiens
agagaaaacugcuggauuu

SEQ ID NO: 132104 - RNA, 19 nt, Homo sapiens
gugaggaagugaucccaaa

SEQ ID NO: 132105 - RNA, 19 nt, Homo sapiens
gacagaacgugcagguguu

SEQ ID NO: 132106 - RNA, 19 nt, Homo sapiens
agaaauggauucgaaauac

SEQ ID NO: 132107 - RNA, 19 nt, Homo sapiens
gcugaaugauggucacuuc

SEQ ID NO: 132108 - RNA, 19 nt, Homo sapiens
ggagaaguguaaagaugca

SEQ ID NO: 132109 - RNA, 19 nt, Homo sapiens
auuaaaugcucucuccuaa

SEQ ID NO: 132110 - RNA, 19 nt, Homo sapiens
gagaugaaagccauagaug

SEQ ID NO: 132111 - RNA, 19 nt, Homo sapiens
gggaucccaucgagaagaa

SEQ ID NO: 132112 - RNA, 19 nt, Homo sapiens
gcagauggcagugugaaga

SEQ ID NO: 132113 - RNA, 19 nt, Homo sapiens
caucgccucugguuaaauc

SEQ ID NO: 132114 - RNA, 19 nt, Homo sapiens
gaagugaucccaaaagaug

SEQ ID NO: 132115 - RNA, 19 nt, Homo sapiens
gaaauaccagugugugaag

SEQ ID NO: 132116 - RNA, 19 nt, Homo sapiens
guugaccucuaucuuauuc

SEQ ID NO: 132117 - RNA, 19 nt, Homo sapiens
ucuagaggccgucaaauug

SEQ ID NO: 132118 - RNA, 19 nt, Homo sapiens
gggaggccauggagaagug

SEQ ID NO: 132119 - RNA, 19 nt, Homo sapiens
gcuggugacuggacacauc

SEQ ID NO: 132120 - RNA, 19 nt, Homo sapiens
gaaauggauucgaaauacc

SEQ ID NO: 132121 - RNA, 19 nt, Homo sapiens
ggagaugaaagccauagau

SEQ ID NO: 132122 - RNA, 19 nt, Homo sapiens
gacauauucuacacuucaa

SEQ ID NO: 132123 - RNA, 19 nt, Homo sapiens
auagauggccuaaacagaa

SEQ ID NO: 132124 - RNA, 19 nt, Homo sapiens
cgaaauaccagugugugaa

SEQ ID NO: 132125 - RNA, 19 nt, Homo sapiens
aaugcucucuccuaaagaa

SEQ ID NO: 132126 - RNA, 19 nt, Homo sapiens
uaaacagaaaugugcgaua

SEQ ID NO: 132127 - RNA, 19 nt, Homo sapiens
gaacgugcagguguuugaa

SEQ ID NO: 132128 - RNA, 19 nt, Homo sapiens
gguggaaugucauccuuac

SEQ ID NO: 132129 - RNA, 19 nt, Homo sapiens
ggacuggccauccgaagca

SEQ ID NO: 132130 - RNA, 19 nt, Homo sapiens
uaaccaggccagugacaga

SEQ ID NO: 132131 - RNA, 19 nt, Homo sapiens
agacauauucuacacuuca

SEQ ID NO: 132132 - RNA, 19 nt, Homo sapiens
ggagaugauccucaacaag

SEQ ID NO: 132133 - RNA, 19 nt, Homo sapiens
gcagagguuccuaaaagua

SEQ ID NO: 132134 - RNA, 19 nt, Homo sapiens
gacagaaauggauucgaaa

SEQ ID NO: 132135 - RNA, 19 nt, Homo sapiens
uaacauggagggcauugca

SEQ ID NO: 132136 - RNA, 19 nt, Homo sapiens
ccauauugauucugcacau

SEQ ID NO: 132137 - RNA, 19 nt, Homo sapiens
guguuugaauuccaguuga

SEQ ID NO: 132138 - RNA, 19 nt, Homo sapiens
gaaugucauccuuacuuca

SEQ ID NO: 132139 - RNA, 19 nt, Homo sapiens
cagguggaaugucauccuu

SEQ ID NO: 132140 - RNA, 19 nt, Homo sapiens
uggagaugauccucaacaa

SEQ ID NO: 132141 - RNA, 19 nt, Homo sapiens
ccaggccagugacagaaau

SEQ ID NO: 132142 - RNA, 19 nt, Homo sapiens
uggacuauguugaccucua

SEQ ID NO: 132143 - RNA, 19 nt, Homo sapiens
gaauuccaguugacuucag

SEQ ID NO: 132144 - RNA, 19 nt, Homo sapiens
auggagaaguguaaagaug

SEQ ID NO: 132145 - RNA, 19 nt, Homo sapiens
ugaccucuaucuuauucau

SEQ ID NO: 132146 - RNA, 19 nt, Homo sapiens
cacaucgccucugguuaaa

SEQ ID NO: 132147 - RNA, 19 nt, Homo sapiens
cgauauuugacccuugaua

SEQ ID NO: 132148 - RNA, 19 nt, Homo sapiens
cauauugauucugcacaug

SEQ ID NO: 132149 - RNA, 19 nt, Homo sapiens
ccuaaagaaacuucaccua

SEQ ID NO: 132150 - RNA, 19 nt, Homo sapiens
cauagauggccuaaacaga

SEQ ID NO: 132151 - RNA, 19 nt, Homo sapiens
uauugauucugcacauguu

SEQ ID NO: 132152 - RNA, 19 nt, Homo sapiens
uuaaaugcucucuccuaaa

SEQ ID NO: 132153 - RNA, 19 nt, Homo sapiens
aauuaaaugcucucuccua

SEQ ID NO: 132154 - RNA, 19 nt, Homo sapiens
uggccaagagcuacaauga

SEQ ID NO: 132155 - RNA, 19 nt, Homo sapiens
uggaaugucauccuuacuu

SEQ ID NO: 132156 - RNA, 19 nt, Homo sapiens
auucuacacuucaaagcuu

SEQ ID NO: 132157 - RNA, 19 nt, Homo sapiens
gugaagagagaagacauau

SEQ ID NO: 132158 - RNA, 19 nt, Homo sapiens
cggaaaagaaagacaauaa

SEQ ID NO: 132159 - RNA, 19 nt, Homo sapiens
ugcgauauuugacccuuga

SEQ ID NO: 132160 - RNA, 19 nt, Homo sapiens
ugugaagagagaagacaua

SEQ ID NO: 132161 - RNA, 19 nt, Homo sapiens
gacacaucgccucugguua

SEQ ID NO: 132162 - RNA, 19 nt, Homo sapiens
ccugggauuuggcaccuau

SEQ ID NO: 132163 - RNA, 19 nt, Homo sapiens
acgugcagguguuugaauu

SEQ ID NO: 132164 - RNA, 19 nt, Homo sapiens
gaugcaggauuggccaagu

SEQ ID NO: 132165 - RNA, 19 nt, Homo sapiens
ccauggagaaguguaaaga

SEQ ID NO: 132166 - RNA, 19 nt, Homo sapiens
cccaaaagaugaaaaugga

SEQ ID NO: 132167 - RNA, 19 nt, Homo sapiens
aaagccaggugaggaagug

SEQ ID NO: 132168 - RNA, 19 nt, Homo sapiens
ugaagagagaagacauauu

SEQ ID NO: 132169 - RNA, 19 nt, Homo sapiens
ccagugacagaaauggauu

SEQ ID NO: 132170 - RNA, 19 nt, Homo sapiens
gguguuugaauuccaguug

SEQ ID NO: 132171 - RNA, 19 nt, Homo sapiens
aagccggguuccaccauau

SEQ ID NO: 132172 - RNA, 19 nt, Homo sapiens
uguaaagccaggugaggaa

SEQ ID NO: 132173 - RNA, 19 nt, Homo sapiens
gcucucuccuaaagaaacu

SEQ ID NO: 132174 - RNA, 19 nt, Homo sapiens
cuaugcgccugcagagguu

SEQ ID NO: 132175 - RNA, 19 nt, Homo sapiens
auguugaccucuaucuuau

SEQ ID NO: 132176 - RNA, 19 nt, Homo sapiens
uuggaaaggucacugaaaa

SEQ ID NO: 132177 - RNA, 19 nt, Homo sapiens
acagaaauggauucgaaau

SEQ ID NO: 132178 - RNA, 19 nt, Homo sapiens
aaaagacauuguucugguu

SEQ ID NO: 132179 - RNA, 19 nt, Homo sapiens
aaucuucaauuggacuaug

SEQ ID NO: 132180 - RNA, 19 nt, Homo sapiens
agaacgugcagguguuuga

SEQ ID NO: 132181 - RNA, 19 nt, Homo sapiens
aguacaagccugucugcaa

SEQ ID NO: 132182 - RNA, 19 nt, Homo sapiens
cugcagagguuccuaaaag

SEQ ID NO: 132183 - RNA, 19 nt, Homo sapiens
gaaggaagcuguguugaaa

SEQ ID NO: 132184 - RNA, 19 nt, Homo sapiens
ggagauagaugacuuugca

SEQ ID NO: 132185 - RNA, 19 nt, Homo sapiens
ggaaagaggugaaaaugaa

SEQ ID NO: 132186 - RNA, 19 nt, Homo sapiens
cgaaaggguuaaucauauu

SEQ ID NO: 132187 - RNA, 19 nt, Homo sapiens
gaagaaggaagcuguguug

SEQ ID NO: 132188 - RNA, 19 nt, Homo sapiens
gaaacacaauaccuacaau

SEQ ID NO: 132189 - RNA, 19 nt, Homo sapiens
ccgaaaggguuaaucauau

SEQ ID NO: 132190 - RNA, 19 nt, Homo sapiens
gaaccaaauugcacugaag

SEQ ID NO: 132191 - RNA, 19 nt, Homo sapiens
gaaauaccuuuguaguuac

SEQ ID NO: 132192 - RNA, 19 nt, Homo sapiens
ucaauggguuccagugauu

SEQ ID NO: 132193 - RNA, 19 nt, Homo sapiens
caauaugacuuuggaggaa

SEQ ID NO: 132194 - RNA, 19 nt, Homo sapiens
gccgaaaggguuaaucaua

SEQ ID NO: 132195 - RNA, 19 nt, Homo sapiens
cacaauaccuacaauaaac

SEQ ID NO: 132196 - RNA, 19 nt, Homo sapiens
ggacgaggacgacgacaga

SEQ ID NO: 132197 - RNA, 19 nt, Homo sapiens
gaaccaugcaggaaggaaa

SEQ ID NO: 132198 - RNA, 19 nt, Homo sapiens
ccaaauugcacugaaguuu

SEQ ID NO: 132199 - RNA, 19 nt, Homo sapiens
gaugcaaggauuacagaaa

SEQ ID NO: 132200 - RNA, 19 nt, Homo sapiens
gaucaauggguuccaguga

SEQ ID NO: 132201 - RNA, 19 nt, Homo sapiens
guuuauaugcccucaagua

SEQ ID NO: 132202 - RNA, 19 nt, Homo sapiens
guuuaagugugcagccaua

SEQ ID NO: 132203 - RNA, 19 nt, Homo sapiens
gauccugccuuaagucaac

SEQ ID NO: 132204 - RNA, 19 nt, Homo sapiens
gggaugcccuggaggaagu

SEQ ID NO: 132205 - RNA, 19 nt, Homo sapiens
ccgaaaggauggauaaggu

SEQ ID NO: 132206 - RNA, 19 nt, Homo sapiens
agccauaguuuggguauuu

SEQ ID NO: 132207 - RNA, 19 nt, Homo sapiens
cuacacugaugcaaggauu

SEQ ID NO: 132208 - RNA, 19 nt, Homo sapiens
uauaugcccucaaguaaaa

SEQ ID NO: 132209 - RNA, 19 nt, Homo sapiens
gcccggagauagaugacuu

SEQ ID NO: 132210 - RNA, 19 nt, Homo sapiens
guaguuacucaagcaguua

SEQ ID NO: 132211 - RNA, 19 nt, Homo sapiens
ugaaccaaauugcacugaa

SEQ ID NO: 132212 - RNA, 19 nt, Homo sapiens
ugaaacacaauaccuacaa

SEQ ID NO: 132213 - RNA, 19 nt, Homo sapiens
uaagugugcagccauaguu

SEQ ID NO: 132214 - RNA, 19 nt, Homo sapiens
ggaaagucgcuacauggau

SEQ ID NO: 132215 - RNA, 19 nt, Homo sapiens
ggacgacgacagagaugug

SEQ ID NO: 132216 - RNA, 19 nt, Homo sapiens
ccgauaacgugguguugug

SEQ ID NO: 132217 - RNA, 19 nt, Homo sapiens
agaaggaagcuguguugaa

SEQ ID NO: 132218 - RNA, 19 nt, Homo sapiens
gcagauggaaagaggugaa

SEQ ID NO: 132219 - RNA, 19 nt, Homo sapiens
uguaguuacucaagcaguu

SEQ ID NO: 132220 - RNA, 19 nt, Homo sapiens
gggaaagucgcuacaugga

SEQ ID NO: 132221 - RNA, 19 nt, Homo sapiens
uuagaaugguugaguuaca

SEQ ID NO: 132222 - RNA, 19 nt, Homo sapiens
auagaugacuuugcagaug

SEQ ID NO: 132223 - RNA, 19 nt, Homo sapiens
gauagaugacuuugcagau

SEQ ID NO: 132224 - RNA, 19 nt, Homo sapiens
gagcagaagaccgaaagga

SEQ ID NO: 132225 - RNA, 19 nt, Homo sapiens
ccgggaaagucgcuacaug

SEQ ID NO: 132226 - RNA, 19 nt, Homo sapiens
acaaagaaccaugcaggaa

SEQ ID NO: 132227 - RNA, 19 nt, Homo sapiens
guuacucccuacacugaug

SEQ ID NO: 132228 - RNA, 19 nt, Homo sapiens
agaccgaaaggauggauaa

SEQ ID NO: 132229 - RNA, 19 nt, Homo sapiens
uuuauaugcccucaaguaa

SEQ ID NO: 132230 - RNA, 19 nt, Homo sapiens
gcaguuugcaauaugacuu

SEQ ID NO: 132231 - RNA, 19 nt, Homo sapiens
cggccaagcugcucaacgu

SEQ ID NO: 132232 - RNA, 19 nt, Homo sapiens
ggagagcagaagaccgaaa

SEQ ID NO: 132233 - RNA, 19 nt, Homo sapiens
uagaaugguugaguuacau

SEQ ID NO: 132234 - RNA, 19 nt, Homo sapiens
ggaaggaaaacuauguauu

SEQ ID NO: 132235 - RNA, 19 nt, Homo sapiens
ggagcgagcgagcaagcaa

SEQ ID NO: 132236 - RNA, 19 nt, Homo sapiens
caauggguuccagugauua

SEQ ID NO: 132237 - RNA, 19 nt, Homo sapiens
caaauugcacugaaguuuu

SEQ ID NO: 132238 - RNA, 19 nt, Homo sapiens
uuauaugcccucaaguaaa

SEQ ID NO: 132239 - RNA, 19 nt, Homo sapiens
caaggauuacagaaacuga

SEQ ID NO: 132240 - RNA, 19 nt, Homo sapiens
gagagcagaagaccgaaag

SEQ ID NO: 132241 - RNA, 19 nt, Homo sapiens
cgagaacgacaucaacauc

SEQ ID NO: 132242 - RNA, 19 nt, Homo sapiens
ugaagaaggaagcuguguu

SEQ ID NO: 132243 - RNA, 19 nt, Homo sapiens
ccaaggggcugagugaguu

SEQ ID NO: 132244 - RNA, 19 nt, Homo sapiens
gcaaggauuacagaaacug

SEQ ID NO: 132245 - RNA, 19 nt, Homo sapiens
gagauguggcucugcagau

SEQ ID NO: 132246 - RNA, 19 nt, Homo sapiens
gguaugaauaauugcauca

SEQ ID NO: 132247 - RNA, 19 nt, Homo sapiens
gucgcuacauggaucaaug

SEQ ID NO: 132248 - RNA, 19 nt, Homo sapiens
gcgagaacgacaucaacau

SEQ ID NO: 132249 - RNA, 19 nt, Homo sapiens
gcagccauaguuuggguau

SEQ ID NO: 132250 - RNA, 19 nt, Homo sapiens
cuacaauaaacugguauga

SEQ ID NO: 132251 - RNA, 19 nt, Homo sapiens
caguuugcaauaugacuuu

SEQ ID NO: 132252 - RNA, 19 nt, Homo sapiens
gugagugagugcagaaagc

SEQ ID NO: 132253 - RNA, 19 nt, Homo sapiens
ggguuccagugauuaaucu

SEQ ID NO: 132254 - RNA, 19 nt, Homo sapiens
cgaggacgacgacagagau

SEQ ID NO: 132255 - RNA, 19 nt, Homo sapiens
agauguggcucugcagauc

SEQ ID NO: 132256 - RNA, 19 nt, Homo sapiens
gcaggaaggaaaacuaugu

SEQ ID NO: 132257 - RNA, 19 nt, Homo sapiens
augcaaggauuacagaaac

SEQ ID NO: 132258 - RNA, 19 nt, Homo sapiens
auaugacuuuggaggaauu

SEQ ID NO: 132259 - RNA, 19 nt, Homo sapiens
ggaaaggucucagcuugua

SEQ ID NO: 132260 - RNA, 19 nt, Homo sapiens
ggucucagcuuguauauag

SEQ ID NO: 132261 - RNA, 19 nt, Homo sapiens
gcacugagcguaucauguu

SEQ ID NO: 132262 - RNA, 19 nt, Homo sapiens
gcaccaagcaugaacaauu

SEQ ID NO: 132263 - RNA, 19 nt, Homo sapiens
gaaagcagcgcaugaagga

SEQ ID NO: 132264 - RNA, 19 nt, Homo sapiens
gagcguaucauguuaaaga

SEQ ID NO: 132265 - RNA, 19 nt, Homo sapiens
agaaagaacaggagaauga

SEQ ID NO: 132266 - RNA, 19 nt, Homo sapiens
gauggcagcugagucauug

SEQ ID NO: 132267 - RNA, 19 nt, Homo sapiens
caccaagcaugaacaauug

SEQ ID NO: 132268 - RNA, 19 nt, Homo sapiens
gaaaugaagaggaagaauc

SEQ ID NO: 132269 - RNA, 19 nt, Homo sapiens
uuacugucccuaucuauua

SEQ ID NO: 132270 - RNA, 19 nt, Homo sapiens
gaaagaacaggagaaugaa

SEQ ID NO: 132271 - RNA, 19 nt, Homo sapiens
gaggagagaguguucaaga

SEQ ID NO: 132272 - RNA, 19 nt, Homo sapiens
ccaaugaugugacccucaa

SEQ ID NO: 132273 - RNA, 19 nt, Homo sapiens
gucauugccuuucuccuuu

SEQ ID NO: 132274 - RNA, 19 nt, Homo sapiens
cagcuuguauauagagauu

SEQ ID NO: 132275 - RNA, 19 nt, Homo sapiens
gaacggcucaagcaggaaa

SEQ ID NO: 132276 - RNA, 19 nt, Homo sapiens
ggagaaagaacaggagaau

SEQ ID NO: 132277 - RNA, 19 nt, Homo sapiens
ggaaacagaguggucauuc

SEQ ID NO: 132278 - RNA, 19 nt, Homo sapiens
gcuggaaccugaggagaga

SEQ ID NO: 132279 - RNA, 19 nt, Homo sapiens
ucccagaaguggcuacuga

SEQ ID NO: 132280 - RNA, 19 nt, Homo sapiens
cuacccaccuuucccagaa

SEQ ID NO: 132281 - RNA, 19 nt, Homo sapiens
ggaagaggaggaagaccaa

SEQ ID NO: 132282 - RNA, 19 nt, Homo sapiens
ggagagaguguucaagaag

SEQ ID NO: 132283 - RNA, 19 nt, Homo sapiens
agaaguggcuacugacuac

SEQ ID NO: 132284 - RNA, 19 nt, Homo sapiens
gaaacagaguggucauucc

SEQ ID NO: 132285 - RNA, 19 nt, Homo sapiens
aaaggucucagcuuguaua

SEQ ID NO: 132286 - RNA, 19 nt, Homo sapiens
acaggagaaugaaaggaaa

SEQ ID NO: 132287 - RNA, 19 nt, Homo sapiens
ggagagagagagacuuaag

SEQ ID NO: 132288 - RNA, 19 nt, Homo sapiens
gguaugaggaccugcaaga

SEQ ID NO: 132289 - RNA, 19 nt, Homo sapiens
gcuuguauauagagauugu

SEQ ID NO: 132290 - RNA, 19 nt, Homo sapiens
gcuacugacuacccucuca

SEQ ID NO: 132291 - RNA, 19 nt, Homo sapiens
gaaucugcaccaagcauga

SEQ ID NO: 132292 - RNA, 19 nt, Homo sapiens
gagguccugucuucagaug

SEQ ID NO: 132293 - RNA, 19 nt, Homo sapiens
gucccuaucuauuaaagug

SEQ ID NO: 132294 - RNA, 19 nt, Homo sapiens
gaacaggagaaugaaagga

SEQ ID NO: 132295 - RNA, 19 nt, Homo sapiens
gcaugaaggagaaagaaca

SEQ ID NO: 132296 - RNA, 19 nt, Homo sapiens
aaaugaagaggaagaauca

SEQ ID NO: 132297 - RNA, 19 nt, Homo sapiens
gagcucugauugaccgaau

SEQ ID NO: 132298 - RNA, 19 nt, Homo sapiens
cgacagagccaaaaucaga

SEQ ID NO: 132299 - RNA, 19 nt, Homo sapiens
cagaaguggcuacugacua

SEQ ID NO: 132300 - RNA, 19 nt, Homo sapiens
gaaaggucucagcuuguau

SEQ ID NO: 132301 - RNA, 19 nt, Homo sapiens
agagaguguucaagaagga

SEQ ID NO: 132302 - RNA, 19 nt, Homo sapiens
aggagagaguguucaagaa

SEQ ID NO: 132303 - RNA, 19 nt, Homo sapiens
gaaaguggcacagcuagcu

SEQ ID NO: 132304 - RNA, 19 nt, Homo sapiens
cacugagcguaucauguua

SEQ ID NO: 132305 - RNA, 19 nt, Homo sapiens
uacugucccuaucuauuaa

SEQ ID NO: 132306 - RNA, 19 nt, Homo sapiens
cagcugagucauugccuuu

SEQ ID NO: 132307 - RNA, 19 nt, Homo sapiens
guucaagaaggaaguguau

SEQ ID NO: 132308 - RNA, 19 nt, Homo sapiens
uuauuacugucccuaucua

SEQ ID NO: 132309 - RNA, 19 nt, Homo sapiens
gagagagagagacuuaagu

SEQ ID NO: 132310 - RNA, 19 nt, Homo sapiens
ugauccaacugcagagaug

SEQ ID NO: 132311 - RNA, 19 nt, Homo sapiens
agggagagagagagacuua

SEQ ID NO: 132312 - RNA, 19 nt, Homo sapiens
agagauggcagcugaguca

SEQ ID NO: 132313 - RNA, 19 nt, Homo sapiens
ucaagaaggaaguguaucu

SEQ ID NO: 132314 - RNA, 19 nt, Homo sapiens
ucacuagugccaaugaugu

SEQ ID NO: 132315 - RNA, 19 nt, Homo sapiens
aaagaacaggagaaugaaa

SEQ ID NO: 132316 - RNA, 19 nt, Homo sapiens
ggaaaugaagaggaagaau

SEQ ID NO: 132317 - RNA, 19 nt, Homo sapiens
gggaaggcuuggaguagac

SEQ ID NO: 132318 - RNA, 19 nt, Homo sapiens
cugagcguaucauguuaaa

SEQ ID NO: 132319 - RNA, 19 nt, Homo sapiens
agaaugaacggcucaagca

SEQ ID NO: 132320 - RNA, 19 nt, Homo sapiens
gagaaagaacaggagaaug

SEQ ID NO: 132321 - RNA, 19 nt, Homo sapiens
gacccucaaucccacauac

SEQ ID NO: 132322 - RNA, 19 nt, Homo sapiens
gggccacacuacccaccuu

SEQ ID NO: 132323 - RNA, 19 nt, Homo sapiens
gcugagucauugccuuucu

SEQ ID NO: 132324 - RNA, 19 nt, Homo sapiens
gcgcaugaaggagaaagaa

SEQ ID NO: 132325 - RNA, 19 nt, Homo sapiens
caagggagaaccaggaaac

SEQ ID NO: 132326 - RNA, 19 nt, Homo sapiens
gaggaagaccaagggagaa

SEQ ID NO: 132327 - RNA, 19 nt, Homo sapiens
gaaccugaggagagagugu

SEQ ID NO: 132328 - RNA, 19 nt, Homo sapiens
cuaaggcacugagcguauc

SEQ ID NO: 132329 - RNA, 19 nt, Homo sapiens
ggagcuggaagccugguau

SEQ ID NO: 132330 - RNA, 19 nt, Homo sapiens
ucauugccuuucuccuuug

SEQ ID NO: 132331 - RNA, 19 nt, Homo sapiens
gcagagauggcagcugagu

SEQ ID NO: 132332 - RNA, 19 nt, Homo sapiens
gaaccaggaaacggaaaca

SEQ ID NO: 132333 - RNA, 19 nt, Homo sapiens
gaagaccaagggagaacca

SEQ ID NO: 132334 - RNA, 19 nt, Homo sapiens
gagaaccaggaaacggaaa

SEQ ID NO: 132335 - RNA, 19 nt, Homo sapiens
aaaggaaaggucucagcuu

SEQ ID NO: 132336 - RNA, 19 nt, Homo sapiens
uacaucaccacaccugaaa

SEQ ID NO: 132337 - RNA, 19 nt, Homo sapiens
aacaggagaaugaaaggaa

SEQ ID NO: 132338 - RNA, 19 nt, Homo sapiens
gagcuggaagccugguaug

SEQ ID NO: 132339 - RNA, 19 nt, Homo sapiens
aaggaaaguggcacagcua

SEQ ID NO: 132340 - RNA, 19 nt, Homo sapiens
gaagaaagguggcaaauac

SEQ ID NO: 132341 - RNA, 19 nt, Homo sapiens
gagcugagaucacgccauu

SEQ ID NO: 132342 - RNA, 19 nt, Homo sapiens
gaagaacacccuccucauu

SEQ ID NO: 132343 - RNA, 19 nt, Homo sapiens
ucacuccucucauuucuaa

SEQ ID NO: 132344 - RNA, 19 nt, Homo sapiens
caaauacaguguucaguuc

SEQ ID NO: 132345 - RNA, 19 nt, Homo sapiens
gcaaauacaguguucaguu

SEQ ID NO: 132346 - RNA, 19 nt, Homo sapiens
gaccaucagugccuuuauu

SEQ ID NO: 132347 - RNA, 19 nt, Homo sapiens
guugggaaaucaucucuaa

SEQ ID NO: 132348 - RNA, 19 nt, Homo sapiens
gacucugucucaaauauaa

SEQ ID NO: 132349 - RNA, 19 nt, Homo sapiens
acacacaccuguacucuuc

SEQ ID NO: 132350 - RNA, 19 nt, Homo sapiens
cgacguguaugguguauuc

SEQ ID NO: 132351 - RNA, 19 nt, Homo sapiens
ucacaacuaugacaucuca

SEQ ID NO: 132352 - RNA, 19 nt, Homo sapiens
uaugguguauuccaguuua

SEQ ID NO: 132353 - RNA, 19 nt, Homo sapiens
gggaauuccucuaugacaa

SEQ ID NO: 132354 - RNA, 19 nt, Homo sapiens
gccugucucucauaaagua

SEQ ID NO: 132355 - RNA, 19 nt, Homo sapiens
gaagaagaaagguggcaaa

SEQ ID NO: 132356 - RNA, 19 nt, Homo sapiens
gucaggagaucgagacuau

SEQ ID NO: 132357 - RNA, 19 nt, Homo sapiens
gggaaaucaucucuaaauc

SEQ ID NO: 132358 - RNA, 19 nt, Homo sapiens
ggugggaguugggauaauu

SEQ ID NO: 132359 - RNA, 19 nt, Homo sapiens
gcucucaaauggcaaaugg

SEQ ID NO: 132360 - RNA, 19 nt, Homo sapiens
gcagucacuccucucauuu

SEQ ID NO: 132361 - RNA, 19 nt, Homo sapiens
caaguugcccgacguguau

SEQ ID NO: 132362 - RNA, 19 nt, Homo sapiens
gcgagauguugcccucaaa

SEQ ID NO: 132363 - RNA, 19 nt, Homo sapiens
gacaggcaacuaugaacua

SEQ ID NO: 132364 - RNA, 19 nt, Homo sapiens
ccagagguauucccagaca

SEQ ID NO: 132365 - RNA, 19 nt, Homo sapiens
ggaauuccucuaugacaau

SEQ ID NO: 132366 - RNA, 19 nt, Homo sapiens
gaaaauggcacaacuuuac

SEQ ID NO: 132367 - RNA, 19 nt, Homo sapiens
acauucagcuggaguuugu

SEQ ID NO: 132368 - RNA, 19 nt, Homo sapiens
acaagccuaucacccagua

SEQ ID NO: 132369 - RNA, 19 nt, Homo sapiens
cgacauuggugacccucuu

SEQ ID NO: 132370 - RNA, 19 nt, Homo sapiens
gccagcgccuucuccauga

SEQ ID NO: 132371 - RNA, 19 nt, Homo sapiens
cagccugucucucauaaag

SEQ ID NO: 132372 - RNA, 19 nt, Homo sapiens
agaagaaagguggcaaaua

SEQ ID NO: 132373 - RNA, 19 nt, Homo sapiens
ggagaaaacggcugucauu

SEQ ID NO: 132374 - RNA, 19 nt, Homo sapiens
ggaaaauggcacaacuuua

SEQ ID NO: 132375 - RNA, 19 nt, Homo sapiens
gaaagguggcaaauacagu

SEQ ID NO: 132376 - RNA, 19 nt, Homo sapiens
aagaacacccuccucauug

SEQ ID NO: 132377 - RNA, 19 nt, Homo sapiens
ucauugaccaucacaacua

SEQ ID NO: 132378 - RNA, 19 nt, Homo sapiens
ucgagacuauccuggcuaa

SEQ ID NO: 132379 - RNA, 19 nt, Homo sapiens
ucaaguugcccgacgugua

SEQ ID NO: 132380 - RNA, 19 nt, Homo sapiens
ugcagucacuccucucauu

SEQ ID NO: 132381 - RNA, 19 nt, Homo sapiens
ggaaaucaucucuaaaucc

SEQ ID NO: 132382 - RNA, 19 nt, Homo sapiens
gagacuauccuggcuaaca

SEQ ID NO: 132383 - RNA, 19 nt, Homo sapiens
cauugaccaucacaacuau

SEQ ID NO: 132384 - RNA, 19 nt, Homo sapiens
gagaccaucagugccuuua

SEQ ID NO: 132385 - RNA, 19 nt, Homo sapiens
gaauuccucuaugacaauc

SEQ ID NO: 132386 - RNA, 19 nt, Homo sapiens
ccagacaggcaacuaugaa

SEQ ID NO: 132387 - RNA, 19 nt, Homo sapiens
gguggcaaauacaguguuc

SEQ ID NO: 132388 - RNA, 19 nt, Homo sapiens
uccagcagcucucaaaugg

SEQ ID NO: 132389 - RNA, 19 nt, Homo sapiens
ggaagaacacccuccucau

SEQ ID NO: 132390 - RNA, 19 nt, Homo sapiens
ugggaaaucaucucuaaau

SEQ ID NO: 132391 - RNA, 19 nt, Homo sapiens
caucacaacuaugacaucu

SEQ ID NO: 132392 - RNA, 19 nt, Homo sapiens
ugaaggagaaggagaaguc

SEQ ID NO: 132393 - RNA, 19 nt, Homo sapiens
gcuggaguuuguccgcauu

SEQ ID NO: 132394 - RNA, 19 nt, Homo sapiens
cccaaugccuacacuguca

SEQ ID NO: 132395 - RNA, 19 nt, Homo sapiens
gcaggaggaggaagaugga

SEQ ID NO: 132396 - RNA, 19 nt, Homo sapiens
gcagugagugcgggauuga

SEQ ID NO: 132397 - RNA, 19 nt, Homo sapiens
gcaccuguagucccagcua

SEQ ID NO: 132398 - RNA, 19 nt, Homo sapiens
cuaaaucccauccucuuuc

SEQ ID NO: 132399 - RNA, 19 nt, Homo sapiens
gcaggagaaaggcaugaau

SEQ ID NO: 132400 - RNA, 19 nt, Homo sapiens
ccuguaaucccagcacuuu

SEQ ID NO: 132401 - RNA, 19 nt, Homo sapiens
ggcacaacuuuaccucugu

SEQ ID NO: 132402 - RNA, 19 nt, Homo sapiens
uuauuaggauuggugguuu

SEQ ID NO: 132403 - RNA, 19 nt, Homo sapiens
guacucuuccacucaggua

SEQ ID NO: 132404 - RNA, 19 nt, Homo sapiens
gaugguggccgauccugau

SEQ ID NO: 132405 - RNA, 19 nt, Homo sapiens
uaaaucccauccucuuucg

SEQ ID NO: 132406 - RNA, 19 nt, Homo sapiens
gggaaaauggcacaacuuu

SEQ ID NO: 132407 - RNA, 19 nt, Homo sapiens
cccagccugucucucauaa

SEQ ID NO: 132408 - RNA, 19 nt, Homo sapiens
caacucagcagugcagaag

SEQ ID NO: 132409 - RNA, 19 nt, Homo sapiens
gcggcucccucgacuucuu

SEQ ID NO: 132410 - RNA, 19 nt, Homo sapiens
gaguuuguccgcauugauc

SEQ ID NO: 132411 - RNA, 19 nt, Homo sapiens
ucuaaaucccauccucuuu

SEQ ID NO: 132412 - RNA, 19 nt, Homo sapiens
acacugagaaccugcugaa

SEQ ID NO: 132413 - RNA, 19 nt, Homo sapiens
uucgagagcugggcaguga

SEQ ID NO: 132414 - RNA, 19 nt, Homo sapiens
uguaugguguauuccaguu

SEQ ID NO: 132415 - RNA, 19 nt, Homo sapiens
gcagcucucaaauggcaaa

SEQ ID NO: 132416 - RNA, 19 nt, Homo sapiens
gggccugugucccaucauc

SEQ ID NO: 132417 - RNA, 19 nt, Homo sapiens
ccuuagugcugcuggacaa

SEQ ID NO: 132418 - RNA, 19 nt, Homo sapiens
gaccaucacaacuaugaca

SEQ ID NO: 132419 - RNA, 19 nt, Homo sapiens
ggcagugagugcgggauug

SEQ ID NO: 132420 - RNA, 19 nt, Homo sapiens
ggagaccaucagugccuuu

SEQ ID NO: 132421 - RNA, 19 nt, Homo sapiens
guaaaacccugucucuacu

SEQ ID NO: 132422 - RNA, 19 nt, Homo sapiens
cauucaagaccgcugauga

SEQ ID NO: 132423 - RNA, 19 nt, Homo sapiens
ugagugcgggauugaguuu

SEQ ID NO: 132424 - RNA, 19 nt, Homo sapiens
ggagaaaggcaugaaucca

SEQ ID NO: 132425 - RNA, 19 nt, Homo sapiens
guuauuaggauuggugguu

SEQ ID NO: 132426 - RNA, 19 nt, Homo sapiens
aauacaguguucaguucaa

SEQ ID NO: 132427 - RNA, 19 nt, Homo sapiens
aaccaucguugggaaauca

SEQ ID NO: 132428 - RNA, 19 nt, Homo sapiens
agaacacccuccucauugc

SEQ ID NO: 132429 - RNA, 19 nt, Homo sapiens
gcugagaucacgccauugc

SEQ ID NO: 132430 - RNA, 19 nt, Homo sapiens
caacguggagaccaucagu

SEQ ID NO: 132431 - RNA, 19 nt, Homo sapiens
gguaaaacccugucucuac

SEQ ID NO: 132432 - RNA, 19 nt, Homo sapiens
agugcgggauugaguuuga

SEQ ID NO: 132433 - RNA, 19 nt, Homo sapiens
caggagaaaggcaugaauc

SEQ ID NO: 132434 - RNA, 19 nt, Homo sapiens
uggaggcagugugcuggua

SEQ ID NO: 132435 - RNA, 19 nt, Homo sapiens
gauuggugguuuuguuuug

SEQ ID NO: 132436 - RNA, 19 nt, Homo sapiens
acaggcaacuaugaacuag

SEQ ID NO: 132437 - RNA, 19 nt, Homo sapiens
cuucagcgacuccuucuuc

SEQ ID NO: 132438 - RNA, 19 nt, Homo sapiens
caucagugccuuuauugac

SEQ ID NO: 132439 - RNA, 19 nt, Homo sapiens
acaacuaugacaucucaga

SEQ ID NO: 132440 - RNA, 19 nt, Homo sapiens
ccacagcgcccacuucuuu

SEQ ID NO: 132441 - RNA, 19 nt, Homo sapiens
gauaaccagcuuuggauua

SEQ ID NO: 132442 - RNA, 19 nt, Homo sapiens
ggccaggaccggauacuua

SEQ ID NO: 132443 - RNA, 19 nt, Homo sapiens
ggagauaaccagcuuugga

SEQ ID NO: 132444 - RNA, 19 nt, Homo sapiens
uagggacggucaugacuuu

SEQ ID NO: 132445 - RNA, 19 nt, Homo sapiens
gagauaaccagcuuuggau

SEQ ID NO: 132446 - RNA, 19 nt, Homo sapiens
ucacauaauccucuucuuc

SEQ ID NO: 132447 - RNA, 19 nt, Homo sapiens
gcaugcaacauuccuguga

SEQ ID NO: 132448 - RNA, 19 nt, Homo sapiens
gagagcuuccucauucaaa

SEQ ID NO: 132449 - RNA, 19 nt, Homo sapiens
ggacaucugaggagcuguu

SEQ ID NO: 132450 - RNA, 19 nt, Homo sapiens
cacauaauccucuucuuca

SEQ ID NO: 132451 - RNA, 19 nt, Homo sapiens
gcgcccacuucuuugaguu

SEQ ID NO: 132452 - RNA, 19 nt, Homo sapiens
gagugagggccuggagaua

SEQ ID NO: 132453 - RNA, 19 nt, Homo sapiens
gccaggaccggauacuuau

SEQ ID NO: 132454 - RNA, 19 nt, Homo sapiens
gugagggccuggagauaac

SEQ ID NO: 132455 - RNA, 19 nt, Homo sapiens
caagauagggacggucaug

SEQ ID NO: 132456 - RNA, 19 nt, Homo sapiens
gaucacauaauccucuucu

SEQ ID NO: 132457 - RNA, 19 nt, Homo sapiens
uccuggagcuggacacgaa

SEQ ID NO: 132458 - RNA, 19 nt, Homo sapiens
gauuaucccgcaugcaaca

SEQ ID NO: 132459 - RNA, 19 nt, Homo sapiens
ggauccagggcaucuguga

SEQ ID NO: 132460 - RNA, 19 nt, Homo sapiens
aagagagcuuccucauuca

SEQ ID NO: 132461 - RNA, 19 nt, Homo sapiens
cauaauccucuucuucauc

SEQ ID NO: 132462 - RNA, 19 nt, Homo sapiens
gugaucacauaauccucuu

SEQ ID NO: 132463 - RNA, 19 nt, Homo sapiens
caugcaacauuccugugau

SEQ ID NO: 132464 - RNA, 19 nt, Homo sapiens
gagcuggacacgaauuugc

SEQ ID NO: 132465 - RNA, 19 nt, Homo sapiens
acauaauccucuucuucau

SEQ ID NO: 132466 - RNA, 19 nt, Homo sapiens
agugagggccuggagauaa

SEQ ID NO: 132467 - RNA, 19 nt, Homo sapiens
gauagggacggucaugacu

SEQ ID NO: 132468 - RNA, 19 nt, Homo sapiens
uuggaguccuggcagauug

SEQ ID NO: 132469 - RNA, 19 nt, Homo sapiens
uaaccagcuuuggauuauc

SEQ ID NO: 132470 - RNA, 19 nt, Homo sapiens
gauccagggcaucugugaa

SEQ ID NO: 132471 - RNA, 19 nt, Homo sapiens
ggagcuggacacgaauuug

SEQ ID NO: 132472 - RNA, 19 nt, Homo sapiens
ccagcgcacggacaucuga

SEQ ID NO: 132473 - RNA, 19 nt, Homo sapiens
ccucuucuucauccucaua

SEQ ID NO: 132474 - RNA, 19 nt, Homo sapiens
ggagggauccagggcaucu

SEQ ID NO: 132475 - RNA, 19 nt, Homo sapiens
gaaaggagauguaagauuc

SEQ ID NO: 132476 - RNA, 19 nt, Homo sapiens
gaagaaugcugaacugaaa

SEQ ID NO: 132477 - RNA, 19 nt, Homo sapiens
ggaaagaaaucccauaaca

SEQ ID NO: 132478 - RNA, 19 nt, Homo sapiens
ggaaagagccacauuagaa

SEQ ID NO: 132479 - RNA, 19 nt, Homo sapiens
uaaagaaacuguccgagaa

SEQ ID NO: 132480 - RNA, 19 nt, Homo sapiens
gaaagucuguagucuuaaa

SEQ ID NO: 132481 - RNA, 19 nt, Homo sapiens
uaagauggaucaagcaauu

SEQ ID NO: 132482 - RNA, 19 nt, Homo sapiens
gaagaggaauuuaaguuuc

SEQ ID NO: 132483 - RNA, 19 nt, Homo sapiens
uaaauaggaugcacaauca

SEQ ID NO: 132484 - RNA, 19 nt, Homo sapiens
uaagggagcuucugauaau

SEQ ID NO: 132485 - RNA, 19 nt, Homo sapiens
gaaauaccaccacauauga

SEQ ID NO: 132486 - RNA, 19 nt, Homo sapiens
gauguuaccuggauauaga

SEQ ID NO: 132487 - RNA, 19 nt, Homo sapiens
cgaaagcucucauuguuga

SEQ ID NO: 132488 - RNA, 19 nt, Homo sapiens
gaagaacaccugaacugua

SEQ ID NO: 132489 - RNA, 19 nt, Homo sapiens
gcagcaguauuuauaguaa

SEQ ID NO: 132490 - RNA, 19 nt, Homo sapiens
cauuagaacugaugaugua

SEQ ID NO: 132491 - RNA, 19 nt, Homo sapiens
cuacauggguugacuuaaa

SEQ ID NO: 132492 - RNA, 19 nt, Homo sapiens
gaauuuaaguuuccaccaa

SEQ ID NO: 132493 - RNA, 19 nt, Homo sapiens
gcagagaaguaaaggaaug

SEQ ID NO: 132494 - RNA, 19 nt, Homo sapiens
caccugaacuguaccauuu

SEQ ID NO: 132495 - RNA, 19 nt, Homo sapiens
ccaagcagcaguauuuaua

SEQ ID NO: 132496 - RNA, 19 nt, Homo sapiens
gaaagaaaucccauaacaa

SEQ ID NO: 132497 - RNA, 19 nt, Homo sapiens
gaaaucccauaacaaacaa

SEQ ID NO: 132498 - RNA, 19 nt, Homo sapiens
gaaacuguccgagaagaua

SEQ ID NO: 132499 - RNA, 19 nt, Homo sapiens
augaaagucuguagucuua

SEQ ID NO: 132500 - RNA, 19 nt, Homo sapiens
acacaagacucaaggaaga

SEQ ID NO: 132501 - RNA, 19 nt, Homo sapiens
ggaaagauuuaagaaagga

SEQ ID NO: 132502 - RNA, 19 nt, Homo sapiens
cagaaagccucaugagaga

SEQ ID NO: 132503 - RNA, 19 nt, Homo sapiens
gauguggucugaagcuauu

SEQ ID NO: 132504 - RNA, 19 nt, Homo sapiens
ccgagaagauaaugcauuu

SEQ ID NO: 132505 - RNA, 19 nt, Homo sapiens
uaagaaaggagauguaaga

SEQ ID NO: 132506 - RNA, 19 nt, Homo sapiens
cguaagcuauuaaugcuaa

SEQ ID NO: 132507 - RNA, 19 nt, Homo sapiens
gaaccaaaauugacuguga

SEQ ID NO: 132508 - RNA, 19 nt, Homo sapiens
gaaagccucaugagagaaa

SEQ ID NO: 132509 - RNA, 19 nt, Homo sapiens
uaagggacaugucaaguuc

SEQ ID NO: 132510 - RNA, 19 nt, Homo sapiens
ggaugaauuugaugggaaa

SEQ ID NO: 132511 - RNA, 19 nt, Homo sapiens
ggagaggaauucacuaugc

SEQ ID NO: 132512 - RNA, 19 nt, Homo sapiens
caucuuggcuaccuuccua

SEQ ID NO: 132513 - RNA, 19 nt, Homo sapiens
ggaugggucuggcaauuuc

SEQ ID NO: 132514 - RNA, 19 nt, Homo sapiens
ucacagcacucagguaaug

SEQ ID NO: 132515 - RNA, 19 nt, Homo sapiens
ccaaggcaccggaugguua

SEQ ID NO: 132516 - RNA, 19 nt, Homo sapiens
ggauuuggcuuugguggaa

SEQ ID NO: 132517 - RNA, 19 nt, Homo sapiens
gaaagggaaacacuacuau

SEQ ID NO: 132518 - RNA, 19 nt, Homo sapiens
caccaguucucauguguuu

SEQ ID NO: 132519 - RNA, 19 nt, Homo sapiens
ggacaccaguucucaugug

SEQ ID NO: 132520 - RNA, 19 nt, Homo sapiens
uggaguagauauaguugua

SEQ ID NO: 132521 - RNA, 19 nt, Homo sapiens
gaacacauggugcccagaa

SEQ ID NO: 132522 - RNA, 19 nt, Homo sapiens
gaauuugaugggaaaguua

SEQ ID NO: 132523 - RNA, 19 nt, Homo sapiens
gagcaguacuuuauacaac

SEQ ID NO: 132524 - RNA, 19 nt, Homo sapiens
gugauaacuuggagcagua

SEQ ID NO: 132525 - RNA, 19 nt, Homo sapiens
ggaccuagguacugacaag

SEQ ID NO: 132526 - RNA, 19 nt, Homo sapiens
ugaacaacaucaagcaguu

SEQ ID NO: 132527 - RNA, 19 nt, Homo sapiens
ugaaauaccaccacauaug

SEQ ID NO: 132528 - RNA, 19 nt, Homo sapiens
gggaaacacuacuaugaag

SEQ ID NO: 132529 - RNA, 19 nt, Homo sapiens
uaaaggccauguggauauu

SEQ ID NO: 132530 - RNA, 19 nt, Homo sapiens
cacaagaccuggugcuaau

SEQ ID NO: 132531 - RNA, 19 nt, Homo sapiens
gggaaaggcuuggaaagag

SEQ ID NO: 132532 - RNA, 19 nt, Homo sapiens
gaacaacaucaagcaguuu

SEQ ID NO: 132533 - RNA, 19 nt, Homo sapiens
guacaacgagaugcaguua

SEQ ID NO: 132534 - RNA, 19 nt, Homo sapiens
gcaguacuuuauacaacaa

SEQ ID NO: 132535 - RNA, 19 nt, Homo sapiens
uccgaaagcucucauuguu

SEQ ID NO: 132536 - RNA, 19 nt, Homo sapiens
ggaauucacuaugcaugau

SEQ ID NO: 132537 - RNA, 19 nt, Homo sapiens
ccuagguacugacaaguuu

SEQ ID NO: 132538 - RNA, 19 nt, Homo sapiens
agaguuggcugcccuugaa

SEQ ID NO: 132539 - RNA, 19 nt, Homo sapiens
caaggaggaggaccugaua

SEQ ID NO: 132540 - RNA, 19 nt, Homo sapiens
cuggaaagcugaacuuauc

SEQ ID NO: 132541 - RNA, 19 nt, Homo sapiens
gaacauaagauggaucaag

SEQ ID NO: 132542 - RNA, 19 nt, Homo sapiens
gcacaggugacacaaacaa

SEQ ID NO: 132543 - RNA, 19 nt, Homo sapiens
gaaauuuaacuucggugaa

SEQ ID NO: 132544 - RNA, 19 nt, Homo sapiens
uagagcuacuaaaggauua

SEQ ID NO: 132545 - RNA, 19 nt, Homo sapiens
ggucagauggucuuuguug

SEQ ID NO: 132546 - RNA, 19 nt, Homo sapiens
aagcugaacuuaucucaag

SEQ ID NO: 132547 - RNA, 19 nt, Homo sapiens
gaauucacuaugcaugaua

SEQ ID NO: 132548 - RNA, 19 nt, Homo sapiens
gagaggaauucacuaugca

SEQ ID NO: 132549 - RNA, 19 nt, Homo sapiens
guagauauaguuguaggua

SEQ ID NO: 132550 - RNA, 19 nt, Homo sapiens
gggaucagcucucuguuuu

SEQ ID NO: 132551 - RNA, 19 nt, Homo sapiens
gcuacuaaaggauuaauga

SEQ ID NO: 132552 - RNA, 19 nt, Homo sapiens
uggcauggguguagagcua

SEQ ID NO: 132553 - RNA, 19 nt, Homo sapiens
gagauguggucugaagcua

SEQ ID NO: 132554 - RNA, 19 nt, Homo sapiens
gaaagagccacauuagaac

SEQ ID NO: 132555 - RNA, 19 nt, Homo sapiens
guacugacaaguuuggauu

SEQ ID NO: 132556 - RNA, 19 nt, Homo sapiens
gcaggccucuuuggaccua

SEQ ID NO: 132557 - RNA, 19 nt, Homo sapiens
ggaauggcauggguguaga

SEQ ID NO: 132558 - RNA, 19 nt, Homo sapiens
gaugaacccauaugacaga

SEQ ID NO: 132559 - RNA, 19 nt, Homo sapiens
uaacguaagcuauuaaugc

SEQ ID NO: 132560 - RNA, 19 nt, Homo sapiens
ugaauuugaugggaaaguu

SEQ ID NO: 132561 - RNA, 19 nt, Homo sapiens
gcugcuagaggaauugaua

SEQ ID NO: 132562 - RNA, 19 nt, Homo sapiens
gcaaucaaggaacauaaga

SEQ ID NO: 132563 - RNA, 19 nt, Homo sapiens
gaaucuaucccauugaucu

SEQ ID NO: 132564 - RNA, 19 nt, Homo sapiens
caggaaagaaaucccauaa

SEQ ID NO: 132565 - RNA, 19 nt, Homo sapiens
ugucaaagcagagaaguaa

SEQ ID NO: 132566 - RNA, 19 nt, Homo sapiens
cugaugggcuucuuucuca

SEQ ID NO: 132567 - RNA, 19 nt, Homo sapiens
gugaagaggaauuuaaguu

SEQ ID NO: 132568 - RNA, 19 nt, Homo sapiens
cugaacaaauggcagauga

SEQ ID NO: 132569 - RNA, 19 nt, Homo sapiens
aagaacaccugaacuguac

SEQ ID NO: 132570 - RNA, 19 nt, Homo sapiens
gacuucaggugauuguuug

SEQ ID NO: 132571 - RNA, 19 nt, Homo sapiens
ggauauagauaagggacau

SEQ ID NO: 132572 - RNA, 19 nt, Homo sapiens
cagauggucuuuguuguca

SEQ ID NO: 132573 - RNA, 19 nt, Homo sapiens
aaaguuaccuacggucaga

SEQ ID NO: 132574 - RNA, 19 nt, Homo sapiens
uaacacaagacucaaggaa

SEQ ID NO: 132575 - RNA, 19 nt, Homo sapiens
gaacgcagcuugucuagga

SEQ ID NO: 132576 - RNA, 19 nt, Homo sapiens
guauugaggucauuuguua

SEQ ID NO: 132577 - RNA, 19 nt, Homo sapiens
gcaaguaaauacagcaauu

SEQ ID NO: 132578 - RNA, 19 nt, Homo sapiens
gcaaauacuugguguuaga

SEQ ID NO: 132579 - RNA, 19 nt, Homo sapiens
gaggaucauuuguuuguua

SEQ ID NO: 132580 - RNA, 19 nt, Homo sapiens
caaacaagcuaauauggaa

SEQ ID NO: 132581 - RNA, 19 nt, Homo sapiens
gaacguggaugccauuugu

SEQ ID NO: 132582 - RNA, 19 nt, Homo sapiens
ucaagucacuguagcuuua

SEQ ID NO: 132583 - RNA, 19 nt, Homo sapiens
guacauaacugcacaaggu

SEQ ID NO: 132584 - RNA, 19 nt, Homo sapiens
acaaaugucuugaagcaua

SEQ ID NO: 132585 - RNA, 19 nt, Homo sapiens
ggaaaccacauguaacuua

SEQ ID NO: 132586 - RNA, 19 nt, Homo sapiens
gaagagcgagggcagauua

SEQ ID NO: 132587 - RNA, 19 nt, Homo sapiens
gcacuugaauguugaaugu

SEQ ID NO: 132588 - RNA, 19 nt, Homo sapiens
caacaaaugucuugaagca

SEQ ID NO: 132589 - RNA, 19 nt, Homo sapiens
ggaaaucccuugagcuuag

SEQ ID NO: 132590 - RNA, 19 nt, Homo sapiens
gaaaguaguuuggguggaa

SEQ ID NO: 132591 - RNA, 19 nt, Homo sapiens
acauugagcuuacucguua

SEQ ID NO: 132592 - RNA, 19 nt, Homo sapiens
uaaacuggcuuacuauaga

SEQ ID NO: 132593 - RNA, 19 nt, Homo sapiens
gaaaugaaaggaacaauca

SEQ ID NO: 132594 - RNA, 19 nt, Homo sapiens
caagaggacuggacauuuc

SEQ ID NO: 132595 - RNA, 19 nt, Homo sapiens
gauuuaaacuugcugaaug

SEQ ID NO: 132596 - RNA, 19 nt, Homo sapiens
gaacauuguccaccacuaa

SEQ ID NO: 132597 - RNA, 19 nt, Homo sapiens
uuaaaggucugauaacuug

SEQ ID NO: 132598 - RNA, 19 nt, Homo sapiens
gaugugaaguguccagauu

SEQ ID NO: 132599 - RNA, 19 nt, Homo sapiens
gaggaaagauuggauuaga

SEQ ID NO: 132600 - RNA, 19 nt, Homo sapiens
gaaauacgaugacauucca

SEQ ID NO: 132601 - RNA, 19 nt, Homo sapiens
caacuguccuccacauauu

SEQ ID NO: 132602 - RNA, 19 nt, Homo sapiens
cacuguagcuuuaguaauu

SEQ ID NO: 132603 - RNA, 19 nt, Homo sapiens
ggccaaagaugaacauugu

SEQ ID NO: 132604 - RNA, 19 nt, Homo sapiens
cacgacagauuucuagaua

SEQ ID NO: 132605 - RNA, 19 nt, Homo sapiens
ggauauggaggaaauuaua

SEQ ID NO: 132606 - RNA, 19 nt, Homo sapiens
ucacacagguuggaaauau

SEQ ID NO: 132607 - RNA, 19 nt, Homo sapiens
gaaggugguuugaagacuu

SEQ ID NO: 132608 - RNA, 19 nt, Homo sapiens
gagaaauuaucaugggaaa

SEQ ID NO: 132609 - RNA, 19 nt, Homo sapiens
caacagugauggauaugga

SEQ ID NO: 132610 - RNA, 19 nt, Homo sapiens
cuauauuccuccucauuua

SEQ ID NO: 132611 - RNA, 19 nt, Homo sapiens
gaacaggaagaauuaaaug

SEQ ID NO: 132612 - RNA, 19 nt, Homo sapiens
gaaaccacauguaacuuag

SEQ ID NO: 132613 - RNA, 19 nt, Homo sapiens
gaaauuaucaugggaaaca

SEQ ID NO: 132614 - RNA, 19 nt, Homo sapiens
gcgaagaggccuagguuaa

SEQ ID NO: 132615 - RNA, 19 nt, Homo sapiens
guaugaacaggaagaauua

SEQ ID NO: 132616 - RNA, 19 nt, Homo sapiens
gaagaggccuagguuaaca

SEQ ID NO: 132617 - RNA, 19 nt, Homo sapiens
ggagaaaucccaccacauc

SEQ ID NO: 132618 - RNA, 19 nt, Homo sapiens
ccuuaaacuuccaaucuua

SEQ ID NO: 132619 - RNA, 19 nt, Homo sapiens
gcagcaggcuuuauuuuaa

SEQ ID NO: 132620 - RNA, 19 nt, Homo sapiens
gaaggccaguguuaggaaa

SEQ ID NO: 132621 - RNA, 19 nt, Homo sapiens
gcauagguuuccauuguau

SEQ ID NO: 132622 - RNA, 19 nt, Homo sapiens
gacugaggaucauuuguuu

SEQ ID NO: 132623 - RNA, 19 nt, Homo sapiens
aaacauggcuuaugaacac

SEQ ID NO: 132624 - RNA, 19 nt, Homo sapiens
gcugcuagcuuuauguaau

SEQ ID NO: 132625 - RNA, 19 nt, Homo sapiens
ugauacaacuuaacaggaa

SEQ ID NO: 132626 - RNA, 19 nt, Homo sapiens
uaacuuagccagacuauac

SEQ ID NO: 132627 - RNA, 19 nt, Homo sapiens
gcaagaggacuggacauuu

SEQ ID NO: 132628 - RNA, 19 nt, Homo sapiens
ugagucagauuuauucaga

SEQ ID NO: 132629 - RNA, 19 nt, Homo sapiens
gcacauugcaauccucaaa

SEQ ID NO: 132630 - RNA, 19 nt, Homo sapiens
gaugcuggcucgugauuuc

SEQ ID NO: 132631 - RNA, 19 nt, Homo sapiens
gcaacacugggauuaauuu

SEQ ID NO: 132632 - RNA, 19 nt, Homo sapiens
ucaaacaugugguuaucuu

SEQ ID NO: 132633 - RNA, 19 nt, Homo sapiens
gguaugaacaggaagaauu

SEQ ID NO: 132634 - RNA, 19 nt, Homo sapiens
guacugugccuuuaacuau

SEQ ID NO: 132635 - RNA, 19 nt, Homo sapiens
uuacaacagugauggauau

SEQ ID NO: 132636 - RNA, 19 nt, Homo sapiens
gaagugccgucuugguuag

SEQ ID NO: 132637 - RNA, 19 nt, Homo sapiens
guacagaucuacgaagaag

SEQ ID NO: 132638 - RNA, 19 nt, Homo sapiens
uuaagugccugccauaaau

SEQ ID NO: 132639 - RNA, 19 nt, Homo sapiens
gguuaucuuuguuguauug

SEQ ID NO: 132640 - RNA, 19 nt, Homo sapiens
caacuuaacaggaaucauc

SEQ ID NO: 132641 - RNA, 19 nt, Homo sapiens
ggaguucuagcaaagauaa

SEQ ID NO: 132642 - RNA, 19 nt, Homo sapiens
caaaugucuugaagcauau

SEQ ID NO: 132643 - RNA, 19 nt, Homo sapiens
guagaauagucgaacaaga

SEQ ID NO: 132644 - RNA, 19 nt, Homo sapiens
caacaacuguccuccacau

SEQ ID NO: 132645 - RNA, 19 nt, Homo sapiens
ugagaaauacgaugacauu

SEQ ID NO: 132646 - RNA, 19 nt, Homo sapiens
ugacaaaucagaugaagau

SEQ ID NO: 132647 - RNA, 19 nt, Homo sapiens
uuagggcccuggaugauuu

SEQ ID NO: 132648 - RNA, 19 nt, Homo sapiens
ucaaagcacuguuuucaaa

SEQ ID NO: 132649 - RNA, 19 nt, Homo sapiens
aaacaucacacagaaagua

SEQ ID NO: 132650 - RNA, 19 nt, Homo sapiens
gaucggauguuggauaugg

SEQ ID NO: 132651 - RNA, 19 nt, Homo sapiens
gaaggaaaauggaagguau

SEQ ID NO: 132652 - RNA, 19 nt, Homo sapiens
gaucguggacggagugauu

SEQ ID NO: 132653 - RNA, 19 nt, Homo sapiens
gaaccgagaagcuacuaga

SEQ ID NO: 132654 - RNA, 19 nt, Homo sapiens
gugguuaucuuuguuguau

SEQ ID NO: 132655 - RNA, 19 nt, Homo sapiens
caauuccucuuucaacguu

SEQ ID NO: 132656 - RNA, 19 nt, Homo sapiens
augaugaggugauguauga

SEQ ID NO: 132657 - RNA, 19 nt, Homo sapiens
uaacugagccugcuuugca

SEQ ID NO: 132658 - RNA, 19 nt, Homo sapiens
ucuaagaguagcagauuua

SEQ ID NO: 132659 - RNA, 19 nt, Homo sapiens
gaagaagccagaaaauuuu

SEQ ID NO: 132660 - RNA, 19 nt, Homo sapiens
ggaggcaacacugggauua

SEQ ID NO: 132661 - RNA, 19 nt, Homo sapiens
aacgaaagcugagugcaua

SEQ ID NO: 132662 - RNA, 19 nt, Homo sapiens
ggagagcacgggaagugua

SEQ ID NO: 132663 - RNA, 19 nt, Homo sapiens
aaaugugggcauacuauua

SEQ ID NO: 132664 - RNA, 19 nt, Homo sapiens
cgaagaagccagaaaauuu

SEQ ID NO: 132665 - RNA, 19 nt, Homo sapiens
gcuauauuccuccucauuu

SEQ ID NO: 132666 - RNA, 19 nt, Homo sapiens
cgacaggacuaaguaggaa

SEQ ID NO: 132667 - RNA, 19 nt, Homo sapiens
cgacagauuucuagauacu

SEQ ID NO: 132668 - RNA, 19 nt, Homo sapiens
uuacugaacuugggcuaaa

SEQ ID NO: 132669 - RNA, 19 nt, Homo sapiens
gaagaauauguacaucgua

SEQ ID NO: 132670 - RNA, 19 nt, Homo sapiens
gccaagugauauugaagaa

SEQ ID NO: 132671 - RNA, 19 nt, Homo sapiens
cagcaaagggcgcuauauu

SEQ ID NO: 132672 - RNA, 19 nt, Homo sapiens
gccuagaccugaacucuuc

SEQ ID NO: 132673 - RNA, 19 nt, Homo sapiens
cauaaucagugacuuguac

SEQ ID NO: 132674 - RNA, 19 nt, Homo sapiens
ccguaugcgugaaauuaua

SEQ ID NO: 132675 - RNA, 19 nt, Homo sapiens
gaaagugcaugcaggaaua

SEQ ID NO: 132676 - RNA, 19 nt, Homo sapiens
gcaaauacuugguguuaga

SEQ ID NO: 132677 - RNA, 19 nt, Homo sapiens
caaacaagcuaauauggaa

SEQ ID NO: 132678 - RNA, 19 nt, Homo sapiens
gaacguggaugccauuugu

SEQ ID NO: 132679 - RNA, 19 nt, Homo sapiens
ggaaaccacauguaacuua

SEQ ID NO: 132680 - RNA, 19 nt, Homo sapiens
gaagagcgagggcagauua

SEQ ID NO: 132681 - RNA, 19 nt, Homo sapiens
ggaaaucccuugagcuuag

SEQ ID NO: 132682 - RNA, 19 nt, Homo sapiens
gaaaguaguuuggguggaa

SEQ ID NO: 132683 - RNA, 19 nt, Homo sapiens
acauugagcuuacucguua

SEQ ID NO: 132684 - RNA, 19 nt, Homo sapiens
gaaaugaaaggaacaauca

SEQ ID NO: 132685 - RNA, 19 nt, Homo sapiens
caagaggacuggacauuuc

SEQ ID NO: 132686 - RNA, 19 nt, Homo sapiens
gaggaaagauuggauuaga

SEQ ID NO: 132687 - RNA, 19 nt, Homo sapiens
gaaauacgaugacauucca

SEQ ID NO: 132688 - RNA, 19 nt, Homo sapiens
caacuguccuccacauauu

SEQ ID NO: 132689 - RNA, 19 nt, Homo sapiens
ggauauggaggaaauuaua

SEQ ID NO: 132690 - RNA, 19 nt, Homo sapiens
gaccaacccuccugaugaa

SEQ ID NO: 132691 - RNA, 19 nt, Homo sapiens
gagaaauuaucaugggaaa

SEQ ID NO: 132692 - RNA, 19 nt, Homo sapiens
caacagugauggauaugga

SEQ ID NO: 132693 - RNA, 19 nt, Homo sapiens
cuauauuccuccucauuua

SEQ ID NO: 132694 - RNA, 19 nt, Homo sapiens
gaaaccacauguaacuuag

SEQ ID NO: 132695 - RNA, 19 nt, Homo sapiens
gaaauuaucaugggaaaca

SEQ ID NO: 132696 - RNA, 19 nt, Homo sapiens
gcgaagaggccuagguuaa

SEQ ID NO: 132697 - RNA, 19 nt, Homo sapiens
gaagaggccuagguuaaca

SEQ ID NO: 132698 - RNA, 19 nt, Homo sapiens
ggagaaaucccaccacauc

SEQ ID NO: 132699 - RNA, 19 nt, Homo sapiens
gaaggccaguguuaggaaa

SEQ ID NO: 132700 - RNA, 19 nt, Homo sapiens
aaacauggcuuaugaacac

SEQ ID NO: 132701 - RNA, 19 nt, Homo sapiens
uaacuuagccagacuauac

SEQ ID NO: 132702 - RNA, 19 nt, Homo sapiens
gcaagaggacuggacauuu

SEQ ID NO: 132703 - RNA, 19 nt, Homo sapiens
ugagucagauuuauucaga

SEQ ID NO: 132704 - RNA, 19 nt, Homo sapiens
aaccauaacucaugcagaa

SEQ ID NO: 132705 - RNA, 19 nt, Homo sapiens
gaugcuggcucgugauuuc

SEQ ID NO: 132706 - RNA, 19 nt, Homo sapiens
gcaacacugggauuaauuu

SEQ ID NO: 132707 - RNA, 19 nt, Homo sapiens
uuacaacagugauggauau

SEQ ID NO: 132708 - RNA, 19 nt, Homo sapiens
gaagugccgucuugguuag

SEQ ID NO: 132709 - RNA, 19 nt, Homo sapiens
guacagaucuacgaagaag

SEQ ID NO: 132710 - RNA, 19 nt, Homo sapiens
ggaguucuagcaaagauaa

SEQ ID NO: 132711 - RNA, 19 nt, Homo sapiens
guagaauagucgaacaaga

SEQ ID NO: 132712 - RNA, 19 nt, Homo sapiens
caacaacuguccuccacau

SEQ ID NO: 132713 - RNA, 19 nt, Homo sapiens
ugagaaauacgaugacauu

SEQ ID NO: 132714 - RNA, 19 nt, Homo sapiens
ugacaaaucagaugaagau

SEQ ID NO: 132715 - RNA, 19 nt, Homo sapiens
ggaauggagauuucaguga

SEQ ID NO: 132716 - RNA, 19 nt, Homo sapiens
aaacaucacacagaaagua

SEQ ID NO: 132717 - RNA, 19 nt, Homo sapiens
gaucggauguuggauaugg

SEQ ID NO: 132718 - RNA, 19 nt, Homo sapiens
gaaggaaaauggaagguau

SEQ ID NO: 132719 - RNA, 19 nt, Homo sapiens
gaucguggacggagugauu

SEQ ID NO: 132720 - RNA, 19 nt, Homo sapiens
gaaccgagaagcuacuaga

SEQ ID NO: 132721 - RNA, 19 nt, Homo sapiens
uaacugagccugcuuugca

SEQ ID NO: 132722 - RNA, 19 nt, Homo sapiens
ucuaagaguagcagauuua

SEQ ID NO: 132723 - RNA, 19 nt, Homo sapiens
gaagaagccagaaaauuuu

SEQ ID NO: 132724 - RNA, 19 nt, Homo sapiens
ggaggcaacacugggauua

SEQ ID NO: 132725 - RNA, 19 nt, Homo sapiens
ggagagcacgggaagugua

SEQ ID NO: 132726 - RNA, 19 nt, Homo sapiens
aacgaaagcugagugcaua

SEQ ID NO: 132727 - RNA, 19 nt, Homo sapiens
ugugugaacuggucuguga

SEQ ID NO: 132728 - RNA, 19 nt, Homo sapiens
cgaagaagccagaaaauuu

SEQ ID NO: 132729 - RNA, 19 nt, Homo sapiens
gcuauauuccuccucauuu

SEQ ID NO: 132730 - RNA, 19 nt, Homo sapiens
cgacaggacuaaguaggaa

SEQ ID NO: 132731 - RNA, 19 nt, Homo sapiens
gaagaauauguacaucgua

SEQ ID NO: 132732 - RNA, 19 nt, Homo sapiens
gccaagugauauugaagaa

SEQ ID NO: 132733 - RNA, 19 nt, Homo sapiens
cagcaaagggcgcuauauu

SEQ ID NO: 132734 - RNA, 19 nt, Homo sapiens
gccuagaccugaacucuuc

SEQ ID NO: 132735 - RNA, 19 nt, Homo sapiens
cgaccaacccuccugauga

SEQ ID NO: 132736 - RNA, 19 nt, Homo sapiens
uagaaaacauggcuuauga

SEQ ID NO: 132737 - RNA, 19 nt, Homo sapiens
cuggcaaccucauucuuua

SEQ ID NO: 132738 - RNA, 19 nt, Homo sapiens
gguguuagaugaagcugau

SEQ ID NO: 132739 - RNA, 19 nt, Homo sapiens
gagagaggaagaagaguga

SEQ ID NO: 132740 - RNA, 19 nt, Homo sapiens
cagcagcccuguucagaag

SEQ ID NO: 132741 - RNA, 19 nt, Homo sapiens
caguacagaucuacgaaga

SEQ ID NO: 132742 - RNA, 19 nt, Homo sapiens
gaaaucccuugagcuuaga

SEQ ID NO: 132743 - RNA, 19 nt, Homo sapiens
gccagagacuaccgacaaa

SEQ ID NO: 132744 - RNA, 19 nt, Homo sapiens
cgagagaguuggcaguaca

SEQ ID NO: 132745 - RNA, 19 nt, Homo sapiens
gcaguuugcuggccuagac

SEQ ID NO: 132746 - RNA, 19 nt, Homo sapiens
gcucgugauuucuuagaug

SEQ ID NO: 132747 - RNA, 19 nt, Homo sapiens
gcuggcucgugauuucuua

SEQ ID NO: 132748 - RNA, 19 nt, Homo sapiens
gauggaaagaggaaagauu

SEQ ID NO: 132749 - RNA, 19 nt, Homo sapiens
guugagaugggagaaauua

SEQ ID NO: 132750 - RNA, 19 nt, Homo sapiens
cuccacauauugaaaguuu

SEQ ID NO: 132751 - RNA, 19 nt, Homo sapiens
gaagaaaugaaaggaacaa

SEQ ID NO: 132752 - RNA, 19 nt, Homo sapiens
caagaagaaaugaaaggaa

SEQ ID NO: 132753 - RNA, 19 nt, Homo sapiens
gguggaagaaucagacaaa

SEQ ID NO: 132754 - RNA, 19 nt, Homo sapiens
gaaagaggaaagauuggau

SEQ ID NO: 132755 - RNA, 19 nt, Homo sapiens
gagaagcuacuagagguuu

SEQ ID NO: 132756 - RNA, 19 nt, Homo sapiens
gaaggaucaugcucaucug

SEQ ID NO: 132757 - RNA, 19 nt, Homo sapiens
ccaaacaagcuaauaugga

SEQ ID NO: 132758 - RNA, 19 nt, Homo sapiens
agaagugccgucuugguua

SEQ ID NO: 132759 - RNA, 19 nt, Homo sapiens
caaccucauucuuuaacga

SEQ ID NO: 132760 - RNA, 19 nt, Homo sapiens
gcugaucggauguuggaua

SEQ ID NO: 132761 - RNA, 19 nt, Homo sapiens
cagauuuaguggaggguuu

SEQ ID NO: 132762 - RNA, 19 nt, Homo sapiens
ugaagaauauguacaucgu

SEQ ID NO: 132763 - RNA, 19 nt, Homo sapiens
uuuaguggcuacagcagua

SEQ ID NO: 132764 - RNA, 19 nt, Homo sapiens
ggacgucuaguggauauga

SEQ ID NO: 132765 - RNA, 19 nt, Homo sapiens
gagaugggagaaauuauca

SEQ ID NO: 132766 - RNA, 19 nt, Homo sapiens
gaaacagucgcugguguga

SEQ ID NO: 132767 - RNA, 19 nt, Homo sapiens
ggaacaaacacucgcuuag

SEQ ID NO: 132768 - RNA, 19 nt, Homo sapiens
gaagacaaccauaacucau

SEQ ID NO: 132769 - RNA, 19 nt, Homo sapiens
caagaacucgcaguacauu

SEQ ID NO: 132770 - RNA, 19 nt, Homo sapiens
ugauggauauggaggaaau

SEQ ID NO: 132771 - RNA, 19 nt, Homo sapiens
agaauagucgaacaagaua

SEQ ID NO: 132772 - RNA, 19 nt, Homo sapiens
uagaauagucgaacaagau

SEQ ID NO: 132773 - RNA, 19 nt, Homo sapiens
ggaaagaggaaagauugga

SEQ ID NO: 132774 - RNA, 19 nt, Homo sapiens
aagcaugcuauuccuauua

SEQ ID NO: 132775 - RNA, 19 nt, Homo sapiens
gcaaguagcugcugaauau

SEQ ID NO: 132776 - RNA, 19 nt, Homo sapiens
gcagauagaaugcuugaua

SEQ ID NO: 132777 - RNA, 19 nt, Homo sapiens
cacaagagguggaaacaua

SEQ ID NO: 132778 - RNA, 19 nt, Homo sapiens
gugaugagcuuaccagaaa

SEQ ID NO: 132779 - RNA, 19 nt, Homo sapiens
gcaaaugucauggauguua

SEQ ID NO: 132780 - RNA, 19 nt, Homo sapiens
gcaaggaaauuacaguuag

SEQ ID NO: 132781 - RNA, 19 nt, Homo sapiens
gaagagaucaugagugaga

SEQ ID NO: 132782 - RNA, 19 nt, Homo sapiens
caaccuaccuuguccuuga

SEQ ID NO: 132783 - RNA, 19 nt, Homo sapiens
uaaggaagauuguggauca

SEQ ID NO: 132784 - RNA, 19 nt, Homo sapiens
gaagauuguggaucaaaua

SEQ ID NO: 132785 - RNA, 19 nt, Homo sapiens
ggagagagguguggaaauc

SEQ ID NO: 132786 - RNA, 19 nt, Homo sapiens
cgaagccaguucuaaauuu

SEQ ID NO: 132787 - RNA, 19 nt, Homo sapiens
gcaugucgcuugaagucua

SEQ ID NO: 132788 - RNA, 19 nt, Homo sapiens
gagcgugacuggguucuaa

SEQ ID NO: 132789 - RNA, 19 nt, Homo sapiens
uggaagagaucaugaguga

SEQ ID NO: 132790 - RNA, 19 nt, Homo sapiens
gcagggcccuuaucuggaa

SEQ ID NO: 132791 - RNA, 19 nt, Homo sapiens
gauuguggaucaaauaaga

SEQ ID NO: 132792 - RNA, 19 nt, Homo sapiens
gcucagggauggccaguug

SEQ ID NO: 132793 - RNA, 19 nt, Homo sapiens
uugaugagcugccuaaauu

SEQ ID NO: 132794 - RNA, 19 nt, Homo sapiens
cuacauuccugaaacaauu

SEQ ID NO: 132795 - RNA, 19 nt, Homo sapiens
ccacaacauucuucagauu

SEQ ID NO: 132796 - RNA, 19 nt, Homo sapiens
ggaaaucuguauugcaaca

SEQ ID NO: 132797 - RNA, 19 nt, Homo sapiens
gcgaugggccuauuuguuu

SEQ ID NO: 132798 - RNA, 19 nt, Homo sapiens
gaggaggcaugaaggauga

SEQ ID NO: 132799 - RNA, 19 nt, Homo sapiens
ggaugugugucaugacgua

SEQ ID NO: 132800 - RNA, 19 nt, Homo sapiens
caacagggacuuaccagaa

SEQ ID NO: 132801 - RNA, 19 nt, Homo sapiens
guggaaaucuguauugcaa

SEQ ID NO: 132802 - RNA, 19 nt, Homo sapiens
ccaaauaugcacaauggua

SEQ ID NO: 132803 - RNA, 19 nt, Homo sapiens
aaacauuggugcacuugaa

SEQ ID NO: 132804 - RNA, 19 nt, Homo sapiens
aaugggagcuuuggaagua

SEQ ID NO: 132805 - RNA, 19 nt, Homo sapiens
ggaagauuguggaucaaau

SEQ ID NO: 132806 - RNA, 19 nt, Homo sapiens
agaagaagcaaggaaauua

SEQ ID NO: 132807 - RNA, 19 nt, Homo sapiens
caagacagaauuucacuga

SEQ ID NO: 132808 - RNA, 19 nt, Homo sapiens
gugacuggguucuaaauga

SEQ ID NO: 132809 - RNA, 19 nt, Homo sapiens
ugagugagaaggagaauaa

SEQ ID NO: 132810 - RNA, 19 nt, Homo sapiens
cagauagaaugcuugauau

SEQ ID NO: 132811 - RNA, 19 nt, Homo sapiens
caaaugucauggauguuau

SEQ ID NO: 132812 - RNA, 19 nt, Homo sapiens
gaaguggaaucuugaugag

SEQ ID NO: 132813 - RNA, 19 nt, Homo sapiens
uguggaagaugugaaauuu

SEQ ID NO: 132814 - RNA, 19 nt, Homo sapiens
caaggaaauuacaguuaga

SEQ ID NO: 132815 - RNA, 19 nt, Homo sapiens
ugacuggguucuaaaugaa

SEQ ID NO: 132816 - RNA, 19 nt, Homo sapiens
caucagccauuccuagaga

SEQ ID NO: 132817 - RNA, 19 nt, Homo sapiens
gggaaaacauugucuuauu

SEQ ID NO: 132818 - RNA, 19 nt, Homo sapiens
guggaaacauacagaagaa

SEQ ID NO: 132819 - RNA, 19 nt, Homo sapiens
uggaagaugugaaauuugu

SEQ ID NO: 132820 - RNA, 19 nt, Homo sapiens
gcccuuaucuggaaagaag

SEQ ID NO: 132821 - RNA, 19 nt, Homo sapiens
caaaagggguggauuuaau

SEQ ID NO: 132822 - RNA, 19 nt, Homo sapiens
gaagccaguucuaaauuuu

SEQ ID NO: 132823 - RNA, 19 nt, Homo sapiens
gaugagcugccuaaauuug

SEQ ID NO: 132824 - RNA, 19 nt, Homo sapiens
caaauaugcacaaugguau

SEQ ID NO: 132825 - RNA, 19 nt, Homo sapiens
aagaagaugugaugagcuu

SEQ ID NO: 132826 - RNA, 19 nt, Homo sapiens
gcucuaaguggauuggaua

SEQ ID NO: 132827 - RNA, 19 nt, Homo sapiens
uuacagugcugcaaauuac

SEQ ID NO: 132828 - RNA, 19 nt, Homo sapiens
ugagcgaccuuaucucugu

SEQ ID NO: 132829 - RNA, 19 nt, Homo sapiens
gaagaugugaaauuuguca

SEQ ID NO: 132830 - RNA, 19 nt, Homo sapiens
caugggaauugcagaaaug

SEQ ID NO: 132831 - RNA, 19 nt, Homo sapiens
ucaauuaugacuacccuaa

SEQ ID NO: 132832 - RNA, 19 nt, Homo sapiens
gagaagaacaaccuaccuu

SEQ ID NO: 132833 - RNA, 19 nt, Homo sapiens
ucacugaacccacugcuau

SEQ ID NO: 132834 - RNA, 19 nt, Homo sapiens
gcaauacggaaguaauguu

SEQ ID NO: 132835 - RNA, 19 nt, Homo sapiens
augcauggccuuccaauaa

SEQ ID NO: 132836 - RNA, 19 nt, Homo sapiens
gaaaaugcaggcaguguuu

SEQ ID NO: 132837 - RNA, 19 nt, Homo sapiens
cugcaccuaugauugguua

SEQ ID NO: 132838 - RNA, 19 nt, Homo sapiens
gaagccaauuucccugcaa

SEQ ID NO: 132839 - RNA, 19 nt, Homo sapiens
gaagaagcaaggaaauuac

SEQ ID NO: 132840 - RNA, 19 nt, Homo sapiens
gcaaaccacaacauucuuc

SEQ ID NO: 132841 - RNA, 19 nt, Homo sapiens
ccugauaggcaaacucuaa

SEQ ID NO: 132842 - RNA, 19 nt, Homo sapiens
cugcaaaugucauggaugu

SEQ ID NO: 132843 - RNA, 19 nt, Homo sapiens
caagugagcgaccuuaucu

SEQ ID NO: 132844 - RNA, 19 nt, Homo sapiens
gagcaugucgcuugaaguc

SEQ ID NO: 132845 - RNA, 19 nt, Homo sapiens
uaagaaacaugggaauugc

SEQ ID NO: 132846 - RNA, 19 nt, Homo sapiens
ucagaaugguguuuacagu

SEQ ID NO: 132847 - RNA, 19 nt, Homo sapiens
ugaagcuaaucaagcaauu

SEQ ID NO: 132848 - RNA, 19 nt, Homo sapiens
gauaggcaaacucuaaugu

SEQ ID NO: 132849 - RNA, 19 nt, Homo sapiens
ggaccacaaauacgugauu

SEQ ID NO: 132850 - RNA, 19 nt, Homo sapiens
gguggaaacauacagaaga

SEQ ID NO: 132851 - RNA, 19 nt, Homo sapiens
ugcauggccuuccaauaaa

SEQ ID NO: 132852 - RNA, 19 nt, Homo sapiens
gcaagugagcgaccuuauc

SEQ ID NO: 132853 - RNA, 19 nt, Homo sapiens
gauagaaugcuugauaugg

SEQ ID NO: 132854 - RNA, 19 nt, Homo sapiens
ggggagaaauuaguuaaaa

SEQ ID NO: 132855 - RNA, 19 nt, Homo sapiens
gcccgaagccaguucuaaa

SEQ ID NO: 132856 - RNA, 19 nt, Homo sapiens
ggauauuucucuacauucc

SEQ ID NO: 132857 - RNA, 19 nt, Homo sapiens
cagcauacacuuucuuuac

SEQ ID NO: 132858 - RNA, 19 nt, Homo sapiens
ggcuagauguggaagaugu

SEQ ID NO: 132859 - RNA, 19 nt, Homo sapiens
gaaggagaauaaaaccauu

SEQ ID NO: 132860 - RNA, 19 nt, Homo sapiens
uauaaacauuggugcacuu

SEQ ID NO: 132861 - RNA, 19 nt, Homo sapiens
cuaaguggauuggauaugg

SEQ ID NO: 132862 - RNA, 19 nt, Homo sapiens
gcagugcagcaguaauuau

SEQ ID NO: 132863 - RNA, 19 nt, Homo sapiens
uuaagaaacaugggaauug

SEQ ID NO: 132864 - RNA, 19 nt, Homo sapiens
ggguggauuuaauaccuuu

SEQ ID NO: 132865 - RNA, 19 nt, Homo sapiens
acacuuucuuuacaccuaa

SEQ ID NO: 132866 - RNA, 19 nt, Homo sapiens
aaacuuauucgucuaaugg

SEQ ID NO: 132867 - RNA, 19 nt, Homo sapiens
ugaugaagcagauagaaug

SEQ ID NO: 132868 - RNA, 19 nt, Homo sapiens
cgaugggccuauuuguuug

SEQ ID NO: 132869 - RNA, 19 nt, Homo sapiens
ugucauggauguuauugca

SEQ ID NO: 132870 - RNA, 19 nt, Homo sapiens
cagaagaagcaaggaaauu

SEQ ID NO: 132871 - RNA, 19 nt, Homo sapiens
ccaacaggauauucccaau

SEQ ID NO: 132872 - RNA, 19 nt, Homo sapiens
gcagcugcaccuaugauug

SEQ ID NO: 132873 - RNA, 19 nt, Homo sapiens
gaaaagcuccuauucugau

SEQ ID NO: 132874 - RNA, 19 nt, Homo sapiens
agaaguggaaucuugauga

SEQ ID NO: 132875 - RNA, 19 nt, Homo sapiens
cugaagagcuuauuacuua

SEQ ID NO: 132876 - RNA, 19 nt, Homo sapiens
guacagaaguucaugaauu

SEQ ID NO: 132877 - RNA, 19 nt, Homo sapiens
agaacaagcucaucuauuu

SEQ ID NO: 132878 - RNA, 19 nt, Homo sapiens
ccugagagcuguuaacuuu

SEQ ID NO: 132879 - RNA, 19 nt, Homo sapiens
gcagaaacccuaugagauu

SEQ ID NO: 132880 - RNA, 19 nt, Homo sapiens
ggaaugcucuucucuuugu

SEQ ID NO: 132881 - RNA, 19 nt, Homo sapiens
ggaaaugaguuugaagauu

SEQ ID NO: 132882 - RNA, 19 nt, Homo sapiens
gaaacucacuaguaauguu

SEQ ID NO: 132883 - RNA, 19 nt, Homo sapiens
gcuguuaacuuucaugcua

SEQ ID NO: 132884 - RNA, 19 nt, Homo sapiens
gaacccaagccucauauuu

SEQ ID NO: 132885 - RNA, 19 nt, Homo sapiens
caucaucgcucccaaagga

SEQ ID NO: 132886 - RNA, 19 nt, Homo sapiens
cagaaacccuaugagauua

SEQ ID NO: 132887 - RNA, 19 nt, Homo sapiens
uagcaaagguugaucaugu

SEQ ID NO: 132888 - RNA, 19 nt, Homo sapiens
ugagaaaccuuaacaagca

SEQ ID NO: 132889 - RNA, 19 nt, Homo sapiens
gaagaaggacaauauacaa

SEQ ID NO: 132890 - RNA, 19 nt, Homo sapiens
gaacaucgaaaucguguau

SEQ ID NO: 132891 - RNA, 19 nt, Homo sapiens
gugagugaauucagauaua

SEQ ID NO: 132892 - RNA, 19 nt, Homo sapiens
gaggagagcauucccauug

SEQ ID NO: 132893 - RNA, 19 nt, Homo sapiens
ggaaagagcagucuaucau

SEQ ID NO: 132894 - RNA, 19 nt, Homo sapiens
gaaaagccaucuccuauuc

SEQ ID NO: 132895 - RNA, 19 nt, Homo sapiens
agagaacccuguuauaaug

SEQ ID NO: 132896 - RNA, 19 nt, Homo sapiens
ggagugagaugaaucaaaa

SEQ ID NO: 132897 - RNA, 19 nt, Homo sapiens
ggaguagguuuaccagaga

SEQ ID NO: 132898 - RNA, 19 nt, Homo sapiens
acauaugccuccaguagua

SEQ ID NO: 132899 - RNA, 19 nt, Homo sapiens
aaagagcagucuaucauug

SEQ ID NO: 132900 - RNA, 19 nt, Homo sapiens
gaaagagcagucuaucauu

SEQ ID NO: 132901 - RNA, 19 nt, Homo sapiens
gaaaggaguagcaaagguu

SEQ ID NO: 132902 - RNA, 19 nt, Homo sapiens
caaaggaucuaagaaucaa

SEQ ID NO: 132903 - RNA, 19 nt, Homo sapiens
gcagugucauugagcagua

SEQ ID NO: 132904 - RNA, 19 nt, Homo sapiens
guucaugaauucccauuug

SEQ ID NO: 132905 - RNA, 19 nt, Homo sapiens
gaacaagcucaucuauuug

SEQ ID NO: 132906 - RNA, 19 nt, Homo sapiens
caaaauaagucccgcauau

SEQ ID NO: 132907 - RNA, 19 nt, Homo sapiens
aaucugggauguacuguuu

SEQ ID NO: 132908 - RNA, 19 nt, Homo sapiens
gaugaagguugcugggauu

SEQ ID NO: 132909 - RNA, 19 nt, Homo sapiens
caaagcgugucccauagaa

SEQ ID NO: 132910 - RNA, 19 nt, Homo sapiens
cuacaggucagucaaauuu

SEQ ID NO: 132911 - RNA, 19 nt, Homo sapiens
uaaucuaccuugcagugua

SEQ ID NO: 132912 - RNA, 19 nt, Homo sapiens
guauggcacuugaugugua

SEQ ID NO: 132913 - RNA, 19 nt, Homo sapiens
cgaagugccuuaugcuaug

SEQ ID NO: 132914 - RNA, 19 nt, Homo sapiens
gaaccaauuuacgagauga

SEQ ID NO: 132915 - RNA, 19 nt, Homo sapiens
gcacagauuugcauuucag

SEQ ID NO: 132916 - RNA, 19 nt, Homo sapiens
gaaggacaauauacaagca

SEQ ID NO: 132917 - RNA, 19 nt, Homo sapiens
caagaauuguuaccuguca

SEQ ID NO: 132918 - RNA, 19 nt, Homo sapiens
cacacugucucaucuagua

SEQ ID NO: 132919 - RNA, 19 nt, Homo sapiens
gggaggaguugauaugcaa

SEQ ID NO: 132920 - RNA, 19 nt, Homo sapiens
guaacucuuucuuuccuuu

SEQ ID NO: 132921 - RNA, 19 nt, Homo sapiens
gcuaugagaccauucagaa

SEQ ID NO: 132922 - RNA, 19 nt, Homo sapiens
uagcaguucuggagcuuaa

SEQ ID NO: 132923 - RNA, 19 nt, Homo sapiens
gagagcagauuucuauggu

SEQ ID NO: 132924 - RNA, 19 nt, Homo sapiens
guaguaguauggcacuuga

SEQ ID NO: 132925 - RNA, 19 nt, Homo sapiens
uagaagaugagaaaccuua

SEQ ID NO: 132926 - RNA, 19 nt, Homo sapiens
acauagcccuaacuccuua

SEQ ID NO: 132927 - RNA, 19 nt, Homo sapiens
ggacaaaggaaucaauuac

SEQ ID NO: 132928 - RNA, 19 nt, Homo sapiens
uaacuuucaugcuacagaa

SEQ ID NO: 132929 - RNA, 19 nt, Homo sapiens
gaagugccuuaugcuauga

SEQ ID NO: 132930 - RNA, 19 nt, Homo sapiens
uaaugaggcuugaugauac

SEQ ID NO: 132931 - RNA, 19 nt, Homo sapiens
ggaaccaauuuacgagaug

SEQ ID NO: 132932 - RNA, 19 nt, Homo sapiens
gaagguugcugggauuaag

SEQ ID NO: 132933 - RNA, 19 nt, Homo sapiens
cgaggaaucaacaauagua

SEQ ID NO: 132934 - RNA, 19 nt, Homo sapiens
agaccuaucuccaucguau

SEQ ID NO: 132935 - RNA, 19 nt, Homo sapiens
uacagaaguucaugaauuc

SEQ ID NO: 132936 - RNA, 19 nt, Homo sapiens
caauuuacgagaugacaua

SEQ ID NO: 132937 - RNA, 19 nt, Homo sapiens
aguaugaccaccacuauua

SEQ ID NO: 132938 - RNA, 19 nt, Homo sapiens
gcugagaggcccugugaaa

SEQ ID NO: 132939 - RNA, 19 nt, Homo sapiens
cuuaacaacuguagcaaga

SEQ ID NO: 132940 - RNA, 19 nt, Homo sapiens
ugagagcuguuaacuuuca

SEQ ID NO: 132941 - RNA, 19 nt, Homo sapiens
gcaaguuacugcugcuuac

SEQ ID NO: 132942 - RNA, 19 nt, Homo sapiens
ugacgugagugaauucaga

SEQ ID NO: 132943 - RNA, 19 nt, Homo sapiens
uuggaacuaugaagacuua

SEQ ID NO: 132944 - RNA, 19 nt, Homo sapiens
agauauaacucaagcuugu

SEQ ID NO: 132945 - RNA, 19 nt, Homo sapiens
caaaggaaucaauuacuug

SEQ ID NO: 132946 - RNA, 19 nt, Homo sapiens
gcagaugcuuuacagucaa

SEQ ID NO: 132947 - RNA, 19 nt, Homo sapiens
caacaauaguaacucuuuc

SEQ ID NO: 132948 - RNA, 19 nt, Homo sapiens
gccuguauguggcagaaua

SEQ ID NO: 132949 - RNA, 19 nt, Homo sapiens
gcuucuauauucaugcuaa

SEQ ID NO: 132950 - RNA, 19 nt, Homo sapiens
auaaaccagucgaucauuu

SEQ ID NO: 132951 - RNA, 19 nt, Homo sapiens
ggaugaggcagauaaguug

SEQ ID NO: 132952 - RNA, 19 nt, Homo sapiens
ggcuagaccugaagaagga

SEQ ID NO: 132953 - RNA, 19 nt, Homo sapiens
guuugaagauuacuguuug

SEQ ID NO: 132954 - RNA, 19 nt, Homo sapiens
caaggaagcuucaaaacau

SEQ ID NO: 132955 - RNA, 19 nt, Homo sapiens
gcuugucaaugauuucaaa

SEQ ID NO: 132956 - RNA, 19 nt, Homo sapiens
cagauaaguugcugucaca

SEQ ID NO: 132957 - RNA, 19 nt, Homo sapiens
gaaacgggaguuacugaug

SEQ ID NO: 132958 - RNA, 19 nt, Homo sapiens
ggugggagagggaauuuaa

SEQ ID NO: 132959 - RNA, 19 nt, Homo sapiens
ggcagaugcuuuacaguca

SEQ ID NO: 132960 - RNA, 19 nt, Homo sapiens
uggcaaagcgugucccaua

SEQ ID NO: 132961 - RNA, 19 nt, Homo sapiens
cuaaagacuggguuacaua

SEQ ID NO: 132962 - RNA, 19 nt, Homo sapiens
cuucugggcugaguagaua

SEQ ID NO: 132963 - RNA, 19 nt, Homo sapiens
acuuagagcucagacauuu

SEQ ID NO: 132964 - RNA, 19 nt, Homo sapiens
cagcgagccuguagaagau

SEQ ID NO: 132965 - RNA, 19 nt, Homo sapiens
gcugggaacagaaauuaaa

SEQ ID NO: 132966 - RNA, 19 nt, Homo sapiens
ucuccaggcuucagauaaa

SEQ ID NO: 132967 - RNA, 19 nt, Homo sapiens
ugaagggaguaacccagua

SEQ ID NO: 132968 - RNA, 19 nt, Homo sapiens
gaauucccauuugcagaaa

SEQ ID NO: 132969 - RNA, 19 nt, Homo sapiens
gagcggugccuaccucauu

SEQ ID NO: 132970 - RNA, 19 nt, Homo sapiens
gcaaagcgugucccauaga

SEQ ID NO: 132971 - RNA, 19 nt, Homo sapiens
cagagaacccuguuauaau

SEQ ID NO: 132972 - RNA, 19 nt, Homo sapiens
uaaugggucuguccaguca

SEQ ID NO: 132973 - RNA, 19 nt, Homo sapiens
gcaggaacaucgaaaucgu

SEQ ID NO: 132974 - RNA, 19 nt, Homo sapiens
aaaguacacugccucaaca

SEQ ID NO: 132975 - RNA, 19 nt, Homo sapiens
gaaguuagcugugcacaua

SEQ ID NO: 132976 - RNA, 19 nt, Homo sapiens
ccacaaagcuuuacuggaa

SEQ ID NO: 132977 - RNA, 19 nt, Homo sapiens
ggagaaaucugacagcauu

SEQ ID NO: 132978 - RNA, 19 nt, Homo sapiens
gcacaaugcuuuuaacuua

SEQ ID NO: 132979 - RNA, 19 nt, Homo sapiens
ucaguuggcucuuguaaua

SEQ ID NO: 132980 - RNA, 19 nt, Homo sapiens
gaaugaagcugaaucuaau

SEQ ID NO: 132981 - RNA, 19 nt, Homo sapiens
gacaguggcucuugaagua

SEQ ID NO: 132982 - RNA, 19 nt, Homo sapiens
gcagauaugcuauuuagua

SEQ ID NO: 132983 - RNA, 19 nt, Homo sapiens
gauaaugugugucgucuuu

SEQ ID NO: 132984 - RNA, 19 nt, Homo sapiens
ggaaauaaguuuggaauag

SEQ ID NO: 132985 - RNA, 19 nt, Homo sapiens
gagaaacucuugaugaaug

SEQ ID NO: 132986 - RNA, 19 nt, Homo sapiens
ugaauaaccuugagaagaa

SEQ ID NO: 132987 - RNA, 19 nt, Homo sapiens
gcaauuuaguggccuauaa

SEQ ID NO: 132988 - RNA, 19 nt, Homo sapiens
guacagguguccuuuguuu

SEQ ID NO: 132989 - RNA, 19 nt, Homo sapiens
gagacuaucaggauuauua

SEQ ID NO: 132990 - RNA, 19 nt, Homo sapiens
gcaggcagcucaccuaaug

SEQ ID NO: 132991 - RNA, 19 nt, Homo sapiens
ggaauuaggcugugauaaa

SEQ ID NO: 132992 - RNA, 19 nt, Homo sapiens
gagaaaugcuuccaguaaa

SEQ ID NO: 132993 - RNA, 19 nt, Homo sapiens
ggagguaaagcaagaauua

SEQ ID NO: 132994 - RNA, 19 nt, Homo sapiens
gagaguacguuaaguaaau

SEQ ID NO: 132995 - RNA, 19 nt, Homo sapiens
gaacccaaguuauauguau

SEQ ID NO: 132996 - RNA, 19 nt, Homo sapiens
cuagauggcucaauaugua

SEQ ID NO: 132997 - RNA, 19 nt, Homo sapiens
gagcaaaucuccagaguac

SEQ ID NO: 132998 - RNA, 19 nt, Homo sapiens
gagauuauaugaagcaguu

SEQ ID NO: 132999 - RNA, 19 nt, Homo sapiens
gcaagaaucucagcaggaa

SEQ ID NO: 133000 - RNA, 19 nt, Homo sapiens
aaacagaucuuaacuuugg

SEQ ID NO: 133001 - RNA, 19 nt, Homo sapiens
gaacuggagugaugcaaau

SEQ ID NO: 133002 - RNA, 19 nt, Homo sapiens
gcaaccaucuucuaaacaa

SEQ ID NO: 133003 - RNA, 19 nt, Homo sapiens
ggaccuaguuucuucugua

SEQ ID NO: 133004 - RNA, 19 nt, Homo sapiens
agacaaccguucacuguua

SEQ ID NO: 133005 - RNA, 19 nt, Homo sapiens
ccacacaggucuacacuug

SEQ ID NO: 133006 - RNA, 19 nt, Homo sapiens
ucagaggacuugugacuuu

SEQ ID NO: 133007 - RNA, 19 nt, Homo sapiens
caaucaaacuccacucuuu

SEQ ID NO: 133008 - RNA, 19 nt, Homo sapiens
gcaaagaacagacacauuc

SEQ ID NO: 133009 - RNA, 19 nt, Homo sapiens
gaagccaacugaagaugaa

SEQ ID NO: 133010 - RNA, 19 nt, Homo sapiens
ccaguuaguucaccucuuu

SEQ ID NO: 133011 - RNA, 19 nt, Homo sapiens
gaacuacagucugcauuug

SEQ ID NO: 133012 - RNA, 19 nt, Homo sapiens
ggacuggcaggaacaauua

SEQ ID NO: 133013 - RNA, 19 nt, Homo sapiens
caaacacugucauuaugua

SEQ ID NO: 133014 - RNA, 19 nt, Homo sapiens
gaugagagguggcguaaag

SEQ ID NO: 133015 - RNA, 19 nt, Homo sapiens
gaaaaucuguggaaagaaa

SEQ ID NO: 133016 - RNA, 19 nt, Homo sapiens
gcagaaaaguggccaauuu

SEQ ID NO: 133017 - RNA, 19 nt, Homo sapiens
ugugaaagcagucaaauua

SEQ ID NO: 133018 - RNA, 19 nt, Homo sapiens
gacaggagcucaagaugga

SEQ ID NO: 133019 - RNA, 19 nt, Homo sapiens
ggacagugauaaugaugaa

SEQ ID NO: 133020 - RNA, 19 nt, Homo sapiens
ggaauuggaucaaaacuuu

SEQ ID NO: 133021 - RNA, 19 nt, Homo sapiens
gaaaauaaaucccgaaaag

SEQ ID NO: 133022 - RNA, 19 nt, Homo sapiens
ggagaucacuugcucuugu

SEQ ID NO: 133023 - RNA, 19 nt, Homo sapiens
guaauguacuguugacuug

SEQ ID NO: 133024 - RNA, 19 nt, Homo sapiens
uaucaaagaugccuaaagu

SEQ ID NO: 133025 - RNA, 19 nt, Homo sapiens
ggagaaaucuaguaaugag

SEQ ID NO: 133026 - RNA, 19 nt, Homo sapiens
ugaagcagcucauguacuu

SEQ ID NO: 133027 - RNA, 19 nt, Homo sapiens
agaaggaguugagauaaua

SEQ ID NO: 133028 - RNA, 19 nt, Homo sapiens
gaaguucuaccuaauugua

SEQ ID NO: 133029 - RNA, 19 nt, Homo sapiens
caucaaugcuuauuucuuc

SEQ ID NO: 133030 - RNA, 19 nt, Homo sapiens
gaugcaaacucucucugua

SEQ ID NO: 133031 - RNA, 19 nt, Homo sapiens
uggauuggcuggaugaaua

SEQ ID NO: 133032 - RNA, 19 nt, Homo sapiens
gcacuuugccacuuucaua

SEQ ID NO: 133033 - RNA, 19 nt, Homo sapiens
ggaaacaucagaaccacua

SEQ ID NO: 133034 - RNA, 19 nt, Homo sapiens
gagaauaucacaucaaaca

SEQ ID NO: 133035 - RNA, 19 nt, Homo sapiens
gucaauuccugucucauua

SEQ ID NO: 133036 - RNA, 19 nt, Homo sapiens
ccacaucaaugcuuauuuc

SEQ ID NO: 133037 - RNA, 19 nt, Homo sapiens
gcagucaaauuaaguagau

SEQ ID NO: 133038 - RNA, 19 nt, Homo sapiens
gggccauucucaacaaaua

SEQ ID NO: 133039 - RNA, 19 nt, Homo sapiens
gaaauucaggaaaccuuua

SEQ ID NO: 133040 - RNA, 19 nt, Homo sapiens
uuaguaaucugacacauga

SEQ ID NO: 133041 - RNA, 19 nt, Homo sapiens
ggauggagcagaugucuuu

SEQ ID NO: 133042 - RNA, 19 nt, Homo sapiens
uaucaucccuugcagcuuu

SEQ ID NO: 133043 - RNA, 19 nt, Homo sapiens
gcauuuaguucacuuagau

SEQ ID NO: 133044 - RNA, 19 nt, Homo sapiens
gaaguaaaucugagacauu

SEQ ID NO: 133045 - RNA, 19 nt, Homo sapiens
ggaggugacugcagccauu

SEQ ID NO: 133046 - RNA, 19 nt, Homo sapiens
ucaaacagcuuuaaacacu

SEQ ID NO: 133047 - RNA, 19 nt, Homo sapiens
gcugauggauauuuaaguu

SEQ ID NO: 133048 - RNA, 19 nt, Homo sapiens
gaagcugaaucuaaucaug

SEQ ID NO: 133049 - RNA, 19 nt, Homo sapiens
gcagacaauucauuuagau

SEQ ID NO: 133050 - RNA, 19 nt, Homo sapiens
gcauuuaccugccaugaca

SEQ ID NO: 133051 - RNA, 19 nt, Homo sapiens
gguagaugaugauauagaa

SEQ ID NO: 133052 - RNA, 19 nt, Homo sapiens
ugaagaggcuuuggcagua

SEQ ID NO: 133053 - RNA, 19 nt, Homo sapiens
ccaaagcaauaaaguguau

SEQ ID NO: 133054 - RNA, 19 nt, Homo sapiens
ggagaaagccgagacagaa

SEQ ID NO: 133055 - RNA, 19 nt, Homo sapiens
gcagugcuccuuauuuauu

SEQ ID NO: 133056 - RNA, 19 nt, Homo sapiens
gaaaugaagggcugguaaa

SEQ ID NO: 133057 - RNA, 19 nt, Homo sapiens
uggcauauaucauguaaga

SEQ ID NO: 133058 - RNA, 19 nt, Homo sapiens
ggaaguggccaacagauau

SEQ ID NO: 133059 - RNA, 19 nt, Homo sapiens
cagcuggucuuucaacuga

SEQ ID NO: 133060 - RNA, 19 nt, Homo sapiens
gacugauacucauauguua

SEQ ID NO: 133061 - RNA, 19 nt, Homo sapiens
caucugaguucaucuucua

SEQ ID NO: 133062 - RNA, 19 nt, Homo sapiens
gagcuugcccggauuaauu

SEQ ID NO: 133063 - RNA, 19 nt, Homo sapiens
gagaucacuugcucuugua

SEQ ID NO: 133064 - RNA, 19 nt, Homo sapiens
gggcaacgauuaucuugga

SEQ ID NO: 133065 - RNA, 19 nt, Homo sapiens
uacaaacacuccuuucaaa

SEQ ID NO: 133066 - RNA, 19 nt, Homo sapiens
gagcauggcauauuggauu

SEQ ID NO: 133067 - RNA, 19 nt, Homo sapiens
ugagguaugucuugagaaa

SEQ ID NO: 133068 - RNA, 19 nt, Homo sapiens
ccacuucuuccaucuauua

SEQ ID NO: 133069 - RNA, 19 nt, Homo sapiens
caacucugguccaauacua

SEQ ID NO: 133070 - RNA, 19 nt, Homo sapiens
caacugugcuuuucauuuu

SEQ ID NO: 133071 - RNA, 19 nt, Homo sapiens
agacgucagugauaaauga

SEQ ID NO: 133072 - RNA, 19 nt, Homo sapiens
gaaguggccaacagauaua

SEQ ID NO: 133073 - RNA, 19 nt, Homo sapiens
gguggcaauucaagaguua

SEQ ID NO: 133074 - RNA, 19 nt, Homo sapiens
gcaaauagaaacugcauag

SEQ ID NO: 133075 - RNA, 19 nt, Homo sapiens
gaaagccgcuaauacguuu

SEQ ID NO: 133076 - RNA, 19 nt, Homo sapiens
gcacguggcuuggauauug

SEQ ID NO: 133077 - RNA, 19 nt, Homo sapiens
gacauuaggucguguauug

SEQ ID NO: 133078 - RNA, 19 nt, Homo sapiens
gaauugaucccaaaguuaa

SEQ ID NO: 133079 - RNA, 19 nt, Homo sapiens
gcagaugcguuacguuuau

SEQ ID NO: 133080 - RNA, 19 nt, Homo sapiens
uuaaaggcauccaaagaua

SEQ ID NO: 133081 - RNA, 19 nt, Homo sapiens
cagcagcgauuacgcauga

SEQ ID NO: 133082 - RNA, 19 nt, Homo sapiens
ggucacagcuaaucaucaa

SEQ ID NO: 133083 - RNA, 19 nt, Homo sapiens
gcuuugguguucuuuaaua

SEQ ID NO: 133084 - RNA, 19 nt, Homo sapiens
ggccaaggcuaguuuguug

SEQ ID NO: 133085 - RNA, 19 nt, Homo sapiens
aaagauaagccacauauug

SEQ ID NO: 133086 - RNA, 19 nt, Homo sapiens
ucaagcagauaaacucaaa

SEQ ID NO: 133087 - RNA, 19 nt, Homo sapiens
gcgcagggcgacaauauuu

SEQ ID NO: 133088 - RNA, 19 nt, Homo sapiens
cgaauugaucccaaaguua

SEQ ID NO: 133089 - RNA, 19 nt, Homo sapiens
gcaauuaccaacagacguu

SEQ ID NO: 133090 - RNA, 19 nt, Homo sapiens
ggucaccauuugcaguaua

SEQ ID NO: 133091 - RNA, 19 nt, Homo sapiens
uaaaggcauccaaagauaa

SEQ ID NO: 133092 - RNA, 19 nt, Homo sapiens
aagcuuugguguucuuuaa

SEQ ID NO: 133093 - RNA, 19 nt, Homo sapiens
ccgaauugaucccaaaguu

SEQ ID NO: 133094 - RNA, 19 nt, Homo sapiens
caacugcgccaacugauca

SEQ ID NO: 133095 - RNA, 19 nt, Homo sapiens
guacaggacgaauggguaa

SEQ ID NO: 133096 - RNA, 19 nt, Homo sapiens
caagaaguccgacccguau

SEQ ID NO: 133097 - RNA, 19 nt, Homo sapiens
caagaacucgccaugcaaa

SEQ ID NO: 133098 - RNA, 19 nt, Homo sapiens
gcuacaagcgcaauuugaa

SEQ ID NO: 133099 - RNA, 19 nt, Homo sapiens
gugcagaugcguuacguuu

SEQ ID NO: 133100 - RNA, 19 nt, Homo sapiens
ucaaaagggucacagcuaa

SEQ ID NO: 133101 - RNA, 19 nt, Homo sapiens
gaguaagccacauaucaaa

SEQ ID NO: 133102 - RNA, 19 nt, Homo sapiens
gaacgcacaguuaccacaa

SEQ ID NO: 133103 - RNA, 19 nt, Homo sapiens
ugaagcagacgcuauguug

SEQ ID NO: 133104 - RNA, 19 nt, Homo sapiens
cgaguaagccacauaucaa

SEQ ID NO: 133105 - RNA, 19 nt, Homo sapiens
gacaguaccgguuguugaa

SEQ ID NO: 133106 - RNA, 19 nt, Homo sapiens
gcagcgugcagaugcguua

SEQ ID NO: 133107 - RNA, 19 nt, Homo sapiens
gcuuaaaggcauccaaaga

SEQ ID NO: 133108 - RNA, 19 nt, Homo sapiens
guguuaaacuuggguaaug

SEQ ID NO: 133109 - RNA, 19 nt, Homo sapiens
ugauucaacuagcccguaa

SEQ ID NO: 133110 - RNA, 19 nt, Homo sapiens
gacgcuauguugucagaug

SEQ ID NO: 133111 - RNA, 19 nt, Homo sapiens
gaacucgccaugcaaacga

SEQ ID NO: 133112 - RNA, 19 nt, Homo sapiens
gucaagaacucgccaugca

SEQ ID NO: 133113 - RNA, 19 nt, Homo sapiens
ugauuugaaacgcgaauua

SEQ ID NO: 133114 - RNA, 19 nt, Homo sapiens
ucaacuagcccguaauaag

SEQ ID NO: 133115 - RNA, 19 nt, Homo sapiens
cuaaacaagucaaccaaac

SEQ ID NO: 133116 - RNA, 19 nt, Homo sapiens
caacucaggcgaagacagu

SEQ ID NO: 133117 - RNA, 19 nt, Homo sapiens
ugaaagccgcuaauacguu

SEQ ID NO: 133118 - RNA, 19 nt, Homo sapiens
gguaaugaccaugauauuc

SEQ ID NO: 133119 - RNA, 19 nt, Homo sapiens
gcuagugugaugaguauug

SEQ ID NO: 133120 - RNA, 19 nt, Homo sapiens
gcuaaacaagucaaccaaa

SEQ ID NO: 133121 - RNA, 19 nt, Homo sapiens
guaaugaccaugauauucg

SEQ ID NO: 133122 - RNA, 19 nt, Homo sapiens
aaacuuggguaaugaccau

SEQ ID NO: 133123 - RNA, 19 nt, Homo sapiens
guuccaacuugcuaaacaa

SEQ ID NO: 133124 - RNA, 19 nt, Homo sapiens
gcuuggauauugaagaucu

SEQ ID NO: 133125 - RNA, 19 nt, Homo sapiens
ugcguuacguuuauucaaa

SEQ ID NO: 133126 - RNA, 19 nt, Homo sapiens
uuaguggcuugguuaauau

SEQ ID NO: 133127 - RNA, 19 nt, Homo sapiens
caacuagcccguaauaagc

SEQ ID NO: 133128 - RNA, 19 nt, Homo sapiens
ugacaguuugcaagcauua

SEQ ID NO: 133129 - RNA, 19 nt, Homo sapiens
aagauaagccacauauugu

SEQ ID NO: 133130 - RNA, 19 nt, Homo sapiens
cguugaagcacaagacuuu

SEQ ID NO: 133131 - RNA, 19 nt, Homo sapiens
cauucaagcugcuguuugg

SEQ ID NO: 133132 - RNA, 19 nt, Homo sapiens
cagcugaccagaaagaaau

SEQ ID NO: 133133 - RNA, 19 nt, Homo sapiens
gguuccaacuugcuaaaca

SEQ ID NO: 133134 - RNA, 19 nt, Homo sapiens
uugaagaucuaccauuagu

SEQ ID NO: 133135 - RNA, 19 nt, Homo sapiens
ccaacagacguucaacuug

SEQ ID NO: 133136 - RNA, 19 nt, Homo sapiens
cagacgcuauguugucaga

SEQ ID NO: 133137 - RNA, 19 nt, Homo sapiens
gaagacaguaccgguuguu

SEQ ID NO: 133138 - RNA, 19 nt, Homo sapiens
cgaauuaggggaugauuuu

SEQ ID NO: 133139 - RNA, 19 nt, Homo sapiens
agcauuagcagcgcaauua

SEQ ID NO: 133140 - RNA, 19 nt, Homo sapiens
ugaacggcgugacaguuug

SEQ ID NO: 133141 - RNA, 19 nt, Homo sapiens
ggugaaagccgcuaauacg

SEQ ID NO: 133142 - RNA, 19 nt, Homo sapiens
gguguucuuuaauacgauu

SEQ ID NO: 133143 - RNA, 19 nt, Homo sapiens
gaagcagacgcuauguugu

SEQ ID NO: 133144 - RNA, 19 nt, Homo sapiens
aaacuuaauggcuugcaaa

SEQ ID NO: 133145 - RNA, 19 nt, Homo sapiens
acgcagugguuccaacuug

SEQ ID NO: 133146 - RNA, 19 nt, Homo sapiens
ccgaguaagccacauauca

SEQ ID NO: 133147 - RNA, 19 nt, Homo sapiens
gaccaugauauucgugauu

SEQ ID NO: 133148 - RNA, 19 nt, Homo sapiens
ugaccagaaagaaauguaa

SEQ ID NO: 133149 - RNA, 19 nt, Homo sapiens
gaugaacggcgugacaguu

SEQ ID NO: 133150 - RNA, 19 nt, Homo sapiens
uagccgaauugaucccaaa

SEQ ID NO: 133151 - RNA, 19 nt, Homo sapiens
cgaagacaguaccgguugu

SEQ ID NO: 133152 - RNA, 19 nt, Homo sapiens
accaugauauucgugauuu

SEQ ID NO: 133153 - RNA, 19 nt, Homo sapiens
cagaugcguuacguuuauu

SEQ ID NO: 133154 - RNA, 19 nt, Homo sapiens
gcagcgcaauuaccaacag

SEQ ID NO: 133155 - RNA, 19 nt, Homo sapiens
agacaguaccgguuguuga

SEQ ID NO: 133156 - RNA, 19 nt, Homo sapiens
ggguaaugaccaugauauu

SEQ ID NO: 133157 - RNA, 19 nt, Homo sapiens
acaguuaccacaacggaaa

SEQ ID NO: 133158 - RNA, 19 nt, Homo sapiens
uggcuuggauauugaagau

SEQ ID NO: 133159 - RNA, 19 nt, Homo sapiens
caaggcuaguuuguugauu

SEQ ID NO: 133160 - RNA, 19 nt, Homo sapiens
uguuaaacuuggguaauga

SEQ ID NO: 133161 - RNA, 19 nt, Homo sapiens
gaacguugaagcacaagac

SEQ ID NO: 133162 - RNA, 19 nt, Homo sapiens
aaggcuaguuuguugauuc

SEQ ID NO: 133163 - RNA, 19 nt, Homo sapiens
ugaaaagccuaagaagaaa

SEQ ID NO: 133164 - RNA, 19 nt, Homo sapiens
caugauauucgugauuuga

SEQ ID NO: 133165 - RNA, 19 nt, Homo sapiens
agucgugaacgcacaguua

SEQ ID NO: 133166 - RNA, 19 nt, Homo sapiens
caagcuuugguguucuuua

SEQ ID NO: 133167 - RNA, 19 nt, Homo sapiens
gaccagaaagaaauguaau

SEQ ID NO: 133168 - RNA, 19 nt, Homo sapiens
cgaugaagcagacgcuaug

SEQ ID NO: 133169 - RNA, 19 nt, Homo sapiens
cuuaaaggcauccaaagau

SEQ ID NO: 133170 - RNA, 19 nt, Homo sapiens
gcaacugcgccaacugauc

SEQ ID NO: 133171 - RNA, 19 nt, Homo sapiens
ccaugauauucgugauuug

SEQ ID NO: 133172 - RNA, 19 nt, Homo sapiens
gcccaaacacccauucaag

SEQ ID NO: 133173 - RNA, 19 nt, Homo sapiens
ccggaacguugaagcacaa

SEQ ID NO: 133174 - RNA, 19 nt, Homo sapiens
gcaaugacaagcgacaagu

SEQ ID NO: 133175 - RNA, 19 nt, Homo sapiens
gcacugagcuggacaauca

SEQ ID NO: 133176 - RNA, 19 nt, Homo sapiens
caacacagaucacccagua

SEQ ID NO: 133177 - RNA, 19 nt, Homo sapiens
gagaagaucuaaacccaaa

SEQ ID NO: 133178 - RNA, 19 nt, Homo sapiens
ggaaggaccgggacaaaua

SEQ ID NO: 133179 - RNA, 19 nt, Homo sapiens
ggaugaagaugaugugaaa

SEQ ID NO: 133180 - RNA, 19 nt, Homo sapiens
ggaauaaagugaagucuag

SEQ ID NO: 133181 - RNA, 19 nt, Homo sapiens
gcaaagauccaguuguuaa

SEQ ID NO: 133182 - RNA, 19 nt, Homo sapiens
gcagagacaucgcugacua

SEQ ID NO: 133183 - RNA, 19 nt, Homo sapiens
guugggagcucauaucuaa

SEQ ID NO: 133184 - RNA, 19 nt, Homo sapiens
agacaucgcugacuauuga

SEQ ID NO: 133185 - RNA, 19 nt, Homo sapiens
ggaguuugguuguugcuua

SEQ ID NO: 133186 - RNA, 19 nt, Homo sapiens
caacuaagcuaagcaaaca

SEQ ID NO: 133187 - RNA, 19 nt, Homo sapiens
gaacgugccuaccgagaug

SEQ ID NO: 133188 - RNA, 19 nt, Homo sapiens
gcaaagagaugcugaacac

SEQ ID NO: 133189 - RNA, 19 nt, Homo sapiens
gcagaaagguugugauugc

SEQ ID NO: 133190 - RNA, 19 nt, Homo sapiens
gaagaucuaaacccaaaua

SEQ ID NO: 133191 - RNA, 19 nt, Homo sapiens
cggauucucuuauuaguaa

SEQ ID NO: 133192 - RNA, 19 nt, Homo sapiens
uaagguggaugaugaagaa

SEQ ID NO: 133193 - RNA, 19 nt, Homo sapiens
uagcaaagauccaguuguu

SEQ ID NO: 133194 - RNA, 19 nt, Homo sapiens
gaucugcuguccuuugauu

SEQ ID NO: 133195 - RNA, 19 nt, Homo sapiens
gcagauucauuuaacagaa

SEQ ID NO: 133196 - RNA, 19 nt, Homo sapiens
gcaguggguucuuccguaa

SEQ ID NO: 133197 - RNA, 19 nt, Homo sapiens
caaaggaaccugagacaga

SEQ ID NO: 133198 - RNA, 19 nt, Homo sapiens
gaauacaugcgugaaguua

SEQ ID NO: 133199 - RNA, 19 nt, Homo sapiens
ucaaugaucugcuguccuu

SEQ ID NO: 133200 - RNA, 19 nt, Homo sapiens
agaagaauuuccagacuuu

SEQ ID NO: 133201 - RNA, 19 nt, Homo sapiens
gaaauacuguacacaaagg

SEQ ID NO: 133202 - RNA, 19 nt, Homo sapiens
gacaggaucuggaaagaca

SEQ ID NO: 133203 - RNA, 19 nt, Homo sapiens
ggaaagacaacacagauca

SEQ ID NO: 133204 - RNA, 19 nt, Homo sapiens
ccaaauagacggcgaaauc

SEQ ID NO: 133205 - RNA, 19 nt, Homo sapiens
ugaaggauguggaucaaga

SEQ ID NO: 133206 - RNA, 19 nt, Homo sapiens
gugcucaucuaaaguguuu

SEQ ID NO: 133207 - RNA, 19 nt, Homo sapiens
ggaccuugcugaauuugug

SEQ ID NO: 133208 - RNA, 19 nt, Homo sapiens
gaccugauguuccagaguu

SEQ ID NO: 133209 - RNA, 19 nt, Homo sapiens
gggaugaugcccaaugaua

SEQ ID NO: 133210 - RNA, 19 nt, Homo sapiens
aagcugagauggauucuau

SEQ ID NO: 133211 - RNA, 19 nt, Homo sapiens
aaaccgagaucgagacaga

SEQ ID NO: 133212 - RNA, 19 nt, Homo sapiens
ggacugcacuagcccugaa

SEQ ID NO: 133213 - RNA, 19 nt, Homo sapiens
ggaagaagcaugccuuugg

SEQ ID NO: 133214 - RNA, 19 nt, Homo sapiens
ucaagagacuggagaagau

SEQ ID NO: 133215 - RNA, 19 nt, Homo sapiens
gaaaguugcuguggauguc

SEQ ID NO: 133216 - RNA, 19 nt, Homo sapiens
cugaaacagucaucaagua

SEQ ID NO: 133217 - RNA, 19 nt, Homo sapiens
gggagagccugcccaucua

SEQ ID NO: 133218 - RNA, 19 nt, Homo sapiens
ggaagaacuugccaaacuc

SEQ ID NO: 133219 - RNA, 19 nt, Homo sapiens
aagcagauguuaggcauaa

SEQ ID NO: 133220 - RNA, 19 nt, Homo sapiens
gauccuguaugaaagaaug

SEQ ID NO: 133221 - RNA, 19 nt, Homo sapiens
gcacaugagaggacaauuc

SEQ ID NO: 133222 - RNA, 19 nt, Homo sapiens
gaacgaaaccgagauagag

SEQ ID NO: 133223 - RNA, 19 nt, Homo sapiens
cccaaugccuggagaauau

SEQ ID NO: 133224 - RNA, 19 nt, Homo sapiens
gaagaugaugugaaaguug

SEQ ID NO: 133225 - RNA, 19 nt, Homo sapiens
caacucgacucucauuucu

SEQ ID NO: 133226 - RNA, 19 nt, Homo sapiens
gcaaacagaagaagcaaca

SEQ ID NO: 133227 - RNA, 19 nt, Homo sapiens
gauguuccagaguuaauua

SEQ ID NO: 133228 - RNA, 19 nt, Homo sapiens
cuugugagauccuguauga

SEQ ID NO: 133229 - RNA, 19 nt, Homo sapiens
uggaaauacuguacacaaa

SEQ ID NO: 133230 - RNA, 19 nt, Homo sapiens
gaugaugcccaaugauauu

SEQ ID NO: 133231 - RNA, 19 nt, Homo sapiens
cuggauagauggcgggaua

SEQ ID NO: 133232 - RNA, 19 nt, Homo sapiens
aaagugaagucuagauauc

SEQ ID NO: 133233 - RNA, 19 nt, Homo sapiens
ggagaggaauaaagugaag

SEQ ID NO: 133234 - RNA, 19 nt, Homo sapiens
cggaagaacuugccaaacu

SEQ ID NO: 133235 - RNA, 19 nt, Homo sapiens
gaugggauguugcuuagag

SEQ ID NO: 133236 - RNA, 19 nt, Homo sapiens
gagacaggaucuggaaaga

SEQ ID NO: 133237 - RNA, 19 nt, Homo sapiens
gcaagcgccucacccgaau

SEQ ID NO: 133238 - RNA, 19 nt, Homo sapiens
gcaguuugguugcuuugug

SEQ ID NO: 133239 - RNA, 19 nt, Homo sapiens
gaaggaccgggacaaauau

SEQ ID NO: 133240 - RNA, 19 nt, Homo sapiens
cuacugugcucaucuaaag

SEQ ID NO: 133241 - RNA, 19 nt, Homo sapiens
ggaacgaaaccgagauaga

SEQ ID NO: 133242 - RNA, 19 nt, Homo sapiens
guaaugcugccaagaaaga

SEQ ID NO: 133243 - RNA, 19 nt, Homo sapiens
acagauugcugccaacaug

SEQ ID NO: 133244 - RNA, 19 nt, Homo sapiens
agacuggcauucucccuaa

SEQ ID NO: 133245 - RNA, 19 nt, Homo sapiens
guacaaccgcuaugaggaa

SEQ ID NO: 133246 - RNA, 19 nt, Homo sapiens
ggacaauucacacugaugu

SEQ ID NO: 133247 - RNA, 19 nt, Homo sapiens
gcacuagcccugaaacagu

SEQ ID NO: 133248 - RNA, 19 nt, Homo sapiens
ccagaagaguggcagcuau

SEQ ID NO: 133249 - RNA, 19 nt, Homo sapiens
ugaagaagaugaggaccuu

SEQ ID NO: 133250 - RNA, 19 nt, Homo sapiens
ggagagcggaaucuggaua

SEQ ID NO: 133251 - RNA, 19 nt, Homo sapiens
ggaccauguuggaugaaga

SEQ ID NO: 133252 - RNA, 19 nt, Homo sapiens
caaagauccaguuguuaaa

SEQ ID NO: 133253 - RNA, 19 nt, Homo sapiens
caacagacagccagaaugg

SEQ ID NO: 133254 - RNA, 19 nt, Homo sapiens
ucuauaggcccaaggauaa

SEQ ID NO: 133255 - RNA, 19 nt, Homo sapiens
ggaaauacuguacacaaag

SEQ ID NO: 133256 - RNA, 19 nt, Homo sapiens
gaugugcucuuuggauugu

SEQ ID NO: 133257 - RNA, 19 nt, Homo sapiens
cagaggaguuugguuguug

SEQ ID NO: 133258 - RNA, 19 nt, Homo sapiens
cagaagagcccaccauugg

SEQ ID NO: 133259 - RNA, 19 nt, Homo sapiens
aaaccuggcuuuggcaaga

SEQ ID NO: 133260 - RNA, 19 nt, Homo sapiens
gaugcagacccgaaucuuu

SEQ ID NO: 133261 - RNA, 19 nt, Homo sapiens
uaauuauccucccagugua

SEQ ID NO: 133262 - RNA, 19 nt, Homo sapiens
caucccaggucgaacauau

SEQ ID NO: 133263 - RNA, 19 nt, Homo sapiens
caugacagaugggauguug

SEQ ID NO: 133264 - RNA, 19 nt, Homo sapiens
gggcuacaccauucgauuu

SEQ ID NO: 133265 - RNA, 19 nt, Homo sapiens
ggaugaugcccaaugauau

SEQ ID NO: 133266 - RNA, 19 nt, Homo sapiens
gacaugagccccauuaaaa

SEQ ID NO: 133267 - RNA, 19 nt, Homo sapiens
ucccuaagguggaugauga

SEQ ID NO: 133268 - RNA, 19 nt, Homo sapiens
ccagagaagugggagauca

SEQ ID NO: 133269 - RNA, 19 nt, Homo sapiens
uaaggcuucucucgucaaa

SEQ ID NO: 133270 - RNA, 19 nt, Homo sapiens
ggucaggaagaaauugaua

SEQ ID NO: 133271 - RNA, 19 nt, Homo sapiens
ccaugggacucaacaaaca

SEQ ID NO: 133272 - RNA, 19 nt, Homo sapiens
ugaagaugaugugaaaguu

SEQ ID NO: 133273 - RNA, 19 nt, Homo sapiens
gaauuugugaucagucuug

SEQ ID NO: 133274 - RNA, 19 nt, Homo sapiens
gcaaaaugcucaucauguc

SEQ ID NO: 133275 - RNA, 19 nt, Homo sapiens
gaacauggaucaaauaaga

SEQ ID NO: 133276 - RNA, 19 nt, Homo sapiens
gaaacaagcauuaccauaa

SEQ ID NO: 133277 - RNA, 19 nt, Homo sapiens
gaaagcaacugggcuauau

SEQ ID NO: 133278 - RNA, 19 nt, Homo sapiens
gaaacaagguugagcaugu

SEQ ID NO: 133279 - RNA, 19 nt, Homo sapiens
gcauggaccucaagaauga

SEQ ID NO: 133280 - RNA, 19 nt, Homo sapiens
gcaaauaucucaugaagcu

SEQ ID NO: 133281 - RNA, 19 nt, Homo sapiens
aaaccucucucaagauuua

SEQ ID NO: 133282 - RNA, 19 nt, Homo sapiens
gaacguaugcugaacauga

SEQ ID NO: 133283 - RNA, 19 nt, Homo sapiens
guaaaccucucucaagauu

SEQ ID NO: 133284 - RNA, 19 nt, Homo sapiens
ggaacaggaucaugauuug

SEQ ID NO: 133285 - RNA, 19 nt, Homo sapiens
cagaagaaguggauuuaaa

SEQ ID NO: 133286 - RNA, 19 nt, Homo sapiens
gagccaacuugaaggauua

SEQ ID NO: 133287 - RNA, 19 nt, Homo sapiens
ggaagauucucaccacuga

SEQ ID NO: 133288 - RNA, 19 nt, Homo sapiens
ccaagaaaguccaaucuga

SEQ ID NO: 133289 - RNA, 19 nt, Homo sapiens
gcaagcgacucuagaauca

SEQ ID NO: 133290 - RNA, 19 nt, Homo sapiens
gagagacaguggagccuua

SEQ ID NO: 133291 - RNA, 19 nt, Homo sapiens
ggauuaaacugcaaauauc

SEQ ID NO: 133292 - RNA, 19 nt, Homo sapiens
gaugcuaucuguaccauug

SEQ ID NO: 133293 - RNA, 19 nt, Homo sapiens
uuagagagcuugaugcauu

SEQ ID NO: 133294 - RNA, 19 nt, Homo sapiens
caaauuggcucaguucgaa

SEQ ID NO: 133295 - RNA, 19 nt, Homo sapiens
uaauauggcuacacuaaga

SEQ ID NO: 133296 - RNA, 19 nt, Homo sapiens
gaucuguggugaugaauau

SEQ ID NO: 133297 - RNA, 19 nt, Homo sapiens
ccagagacuuuguuaacua

SEQ ID NO: 133298 - RNA, 19 nt, Homo sapiens
gaagaagacacuugaauca

SEQ ID NO: 133299 - RNA, 19 nt, Homo sapiens
gaucacaacaggagcuuua

SEQ ID NO: 133300 - RNA, 19 nt, Homo sapiens
caaacaaccugcuaucauc

SEQ ID NO: 133301 - RNA, 19 nt, Homo sapiens
guaaugcacuuauccacaa

SEQ ID NO: 133302 - RNA, 19 nt, Homo sapiens
gaacaccauugcaugaaau

SEQ ID NO: 133303 - RNA, 19 nt, Homo sapiens
gugaagaaguuccagcuuu

SEQ ID NO: 133304 - RNA, 19 nt, Homo sapiens
guagaugacuggauuaaac

SEQ ID NO: 133305 - RNA, 19 nt, Homo sapiens
uagaauggguggagaagaa

SEQ ID NO: 133306 - RNA, 19 nt, Homo sapiens
gagcaugucucaauugaac

SEQ ID NO: 133307 - RNA, 19 nt, Homo sapiens
ugaaggagauuuaccaaca

SEQ ID NO: 133308 - RNA, 19 nt, Homo sapiens
ggacuuacccaguucaaga

SEQ ID NO: 133309 - RNA, 19 nt, Homo sapiens
ggagccaacuugaaggauu

SEQ ID NO: 133310 - RNA, 19 nt, Homo sapiens
ccacaaauauugcugaaac

SEQ ID NO: 133311 - RNA, 19 nt, Homo sapiens
aaacaucauucaagagcua

SEQ ID NO: 133312 - RNA, 19 nt, Homo sapiens
acaacaauaugaccaacua

SEQ ID NO: 133313 - RNA, 19 nt, Homo sapiens
aaucaugggugacguuaaa

SEQ ID NO: 133314 - RNA, 19 nt, Homo sapiens
ccacaaaucaucuguuaau

SEQ ID NO: 133315 - RNA, 19 nt, Homo sapiens
gagaacauggaucaaauaa

SEQ ID NO: 133316 - RNA, 19 nt, Homo sapiens
uagagagcuugaugcauua

SEQ ID NO: 133317 - RNA, 19 nt, Homo sapiens
gaagacugcauucagauga

SEQ ID NO: 133318 - RNA, 19 nt, Homo sapiens
ggauacagcguucgauuug

SEQ ID NO: 133319 - RNA, 19 nt, Homo sapiens
agaagacacuugaaucaug

SEQ ID NO: 133320 - RNA, 19 nt, Homo sapiens
gaagcagaacacacucuua

SEQ ID NO: 133321 - RNA, 19 nt, Homo sapiens
gaagaaggauaaggaugau

SEQ ID NO: 133322 - RNA, 19 nt, Homo sapiens
gguggaagguuauaauuac

SEQ ID NO: 133323 - RNA, 19 nt, Homo sapiens
cgaggaaucagucauguaa

SEQ ID NO: 133324 - RNA, 19 nt, Homo sapiens
caucuuggcucucaaagca

SEQ ID NO: 133325 - RNA, 19 nt, Homo sapiens
gcuuguagaugacuggauu

SEQ ID NO: 133326 - RNA, 19 nt, Homo sapiens
gaagaaguggauuuaaaug

SEQ ID NO: 133327 - RNA, 19 nt, Homo sapiens
ggaaagcaacugggcuaua

SEQ ID NO: 133328 - RNA, 19 nt, Homo sapiens
cgaacaccauugcaugaaa

SEQ ID NO: 133329 - RNA, 19 nt, Homo sapiens
ggauaaggaugaugauggu

SEQ ID NO: 133330 - RNA, 19 nt, Homo sapiens
cuauggaacuggcuacuug

SEQ ID NO: 133331 - RNA, 19 nt, Homo sapiens
uuacccaucucccuucuuu

SEQ ID NO: 133332 - RNA, 19 nt, Homo sapiens
caucgaggcucuacuuaag

SEQ ID NO: 133333 - RNA, 19 nt, Homo sapiens
gcauucagaugacccacuu

SEQ ID NO: 133334 - RNA, 19 nt, Homo sapiens
gugaagaaauuugaaagug

SEQ ID NO: 133335 - RNA, 19 nt, Homo sapiens
ggcagaaauucauguguga

SEQ ID NO: 133336 - RNA, 19 nt, Homo sapiens
aaaggcaugcuauguguua

SEQ ID NO: 133337 - RNA, 19 nt, Homo sapiens
uaaaugaacguaugcugaa

SEQ ID NO: 133338 - RNA, 19 nt, Homo sapiens
ccagaagauuguuuguuga

SEQ ID NO: 133339 - RNA, 19 nt, Homo sapiens
aggaaucagucauguaauu

SEQ ID NO: 133340 - RNA, 19 nt, Homo sapiens
gagaguuacugccugugaa

SEQ ID NO: 133341 - RNA, 19 nt, Homo sapiens
ggacuaguagcaacauuga

SEQ ID NO: 133342 - RNA, 19 nt, Homo sapiens
acaccggacuuacaaagaa

SEQ ID NO: 133343 - RNA, 19 nt, Homo sapiens
uccagaagauuguuuguug

SEQ ID NO: 133344 - RNA, 19 nt, Homo sapiens
caacuauucuaccguaugg

SEQ ID NO: 133345 - RNA, 19 nt, Homo sapiens
uaaggaaaccaagcauaua

SEQ ID NO: 133346 - RNA, 19 nt, Homo sapiens
gaagaaggaaggagagaca

SEQ ID NO: 133347 - RNA, 19 nt, Homo sapiens
gagcuuuauugcagaaaug

SEQ ID NO: 133348 - RNA, 19 nt, Homo sapiens
caagaaaggaagaacaaga

SEQ ID NO: 133349 - RNA, 19 nt, Homo sapiens
gcacuuauccacaaaucau

SEQ ID NO: 133350 - RNA, 19 nt, Homo sapiens
gugauguuguucaggcuua

SEQ ID NO: 133351 - RNA, 19 nt, Homo sapiens
gaagcaggcauucgaggaa

SEQ ID NO: 133352 - RNA, 19 nt, Homo sapiens
aaguaaaccucucucaaga

SEQ ID NO: 133353 - RNA, 19 nt, Homo sapiens
agacaacuguaccaucuug

SEQ ID NO: 133354 - RNA, 19 nt, Homo sapiens
ucagacaacuguaccaucu

SEQ ID NO: 133355 - RNA, 19 nt, Homo sapiens
guagccaagacaugaauua

SEQ ID NO: 133356 - RNA, 19 nt, Homo sapiens
ugaauaugguccagaaaca

SEQ ID NO: 133357 - RNA, 19 nt, Homo sapiens
uagaugacuuuauccagaa

SEQ ID NO: 133358 - RNA, 19 nt, Homo sapiens
uggaauccuuggacuagua

SEQ ID NO: 133359 - RNA, 19 nt, Homo sapiens
ggaagaacaagaagugcaa

SEQ ID NO: 133360 - RNA, 19 nt, Homo sapiens
ggaccgaggagccaacuug

SEQ ID NO: 133361 - RNA, 19 nt, Homo sapiens
uuuccuggcuuucguuuaa

SEQ ID NO: 133362 - RNA, 19 nt, Homo sapiens
caggauaugugcagguguu

SEQ ID NO: 133363 - RNA, 19 nt, Homo sapiens
gaaauucaugugugagguu

SEQ ID NO: 133364 - RNA, 19 nt, Homo sapiens
cgagaacauggaucaaaua

SEQ ID NO: 133365 - RNA, 19 nt, Homo sapiens
cagagacuuuguuaacuau

SEQ ID NO: 133366 - RNA, 19 nt, Homo sapiens
ugaaacaagcauuaccaua

SEQ ID NO: 133367 - RNA, 19 nt, Homo sapiens
ugaugaauaugguccagaa

SEQ ID NO: 133368 - RNA, 19 nt, Homo sapiens
agaagaaggauaaggauga

SEQ ID NO: 133369 - RNA, 19 nt, Homo sapiens
caaaguaaaccucucucaa

SEQ ID NO: 133370 - RNA, 19 nt, Homo sapiens
aguggagccuuacaaagua

SEQ ID NO: 133371 - RNA, 19 nt, Homo sapiens
cagcugggcagaaggauuu

SEQ ID NO: 133372 - RNA, 19 nt, Homo sapiens
gugguucauuguaguuuaa

SEQ ID NO: 133373 - RNA, 19 nt, Homo sapiens
agauugugcuuguagauga

SEQ ID NO: 133374 - RNA, 19 nt, Homo sapiens
ucacugcucacaacaauau

SEQ ID NO: 133375 - RNA, 19 nt, Homo sapiens
gcaaauaucucaugaagcu

SEQ ID NO: 133376 - RNA, 19 nt, Homo sapiens
gaacguaugcugaacauga

SEQ ID NO: 133377 - RNA, 19 nt, Homo sapiens
gaaagcggcugggcuauau

SEQ ID NO: 133378 - RNA, 19 nt, Homo sapiens
ccaagaaaguccaaucuga

SEQ ID NO: 133379 - RNA, 19 nt, Homo sapiens
ggauuaaacugcaaauauc

SEQ ID NO: 133380 - RNA, 19 nt, Homo sapiens
guacccaucucccuucuuu

SEQ ID NO: 133381 - RNA, 19 nt, Homo sapiens
uaauauggcuacacuaaga

SEQ ID NO: 133382 - RNA, 19 nt, Homo sapiens
caaacaaccugcuaucauc

SEQ ID NO: 133383 - RNA, 19 nt, Homo sapiens
guagaugacuggauuaaac

SEQ ID NO: 133384 - RNA, 19 nt, Homo sapiens
uagaauggguggagaagaa

SEQ ID NO: 133385 - RNA, 19 nt, Homo sapiens
cuauggaacuggcuacuuu

SEQ ID NO: 133386 - RNA, 19 nt, Homo sapiens
ggagguggcggcuauuaaa

SEQ ID NO: 133387 - RNA, 19 nt, Homo sapiens
ggaaagcggcugggcuaua

SEQ ID NO: 133388 - RNA, 19 nt, Homo sapiens
gcuuguagaugacuggauu

SEQ ID NO: 133389 - RNA, 19 nt, Homo sapiens
aaaggcaugcuauguguua

SEQ ID NO: 133390 - RNA, 19 nt, Homo sapiens
uaaaugaacguaugcugaa

SEQ ID NO: 133391 - RNA, 19 nt, Homo sapiens
ccagaagauuguuuguuga

SEQ ID NO: 133392 - RNA, 19 nt, Homo sapiens
uccagaagauuguuuguug

SEQ ID NO: 133393 - RNA, 19 nt, Homo sapiens
uaaggaaaccaagcauaua

SEQ ID NO: 133394 - RNA, 19 nt, Homo sapiens
uuuccuggcuuucguuuaa

SEQ ID NO: 133395 - RNA, 19 nt, Homo sapiens
gugguucauuguaguuuaa

SEQ ID NO: 133396 - RNA, 19 nt, Homo sapiens
ccagagccuuucaucaaug

SEQ ID NO: 133397 - RNA, 19 nt, Homo sapiens
agauugugcuuguagauga

SEQ ID NO: 133398 - RNA, 19 nt, Homo sapiens
gaaaccaagcauauagaug

SEQ ID NO: 133399 - RNA, 19 nt, Homo sapiens
gccuuuaaauaacuuggua

SEQ ID NO: 133400 - RNA, 19 nt, Homo sapiens
gacaauggaagcggauaua

SEQ ID NO: 133401 - RNA, 19 nt, Homo sapiens
gcugguaucaaccuuauga

SEQ ID NO: 133402 - RNA, 19 nt, Homo sapiens
ggcuuugguuguugaagua

SEQ ID NO: 133403 - RNA, 19 nt, Homo sapiens
ccaucucccuucuuuguau

SEQ ID NO: 133404 - RNA, 19 nt, Homo sapiens
ccaaaguucagcucaaaga

SEQ ID NO: 133405 - RNA, 19 nt, Homo sapiens
gaagaagcagagauacguu

SEQ ID NO: 133406 - RNA, 19 nt, Homo sapiens
ggaaaccaagcauauagau

SEQ ID NO: 133407 - RNA, 19 nt, Homo sapiens
gaggagguggcggcuauua

SEQ ID NO: 133408 - RNA, 19 nt, Homo sapiens
caagaaaguccaaucugau

SEQ ID NO: 133409 - RNA, 19 nt, Homo sapiens
gaccagauaauaauuugga

SEQ ID NO: 133410 - RNA, 19 nt, Homo sapiens
aagaggagguggcggcuau

SEQ ID NO: 133411 - RNA, 19 nt, Homo sapiens
ggcuauauccaucgaaauu

SEQ ID NO: 133412 - RNA, 19 nt, Homo sapiens
cauggaggcuuugguuguu

SEQ ID NO: 133413 - RNA, 19 nt, Homo sapiens
gagcacaaaagacuuaaua

SEQ ID NO: 133414 - RNA, 19 nt, Homo sapiens
uggagaagaagcagagaua

SEQ ID NO: 133415 - RNA, 19 nt, Homo sapiens
uuaaggaaaccaagcauau

SEQ ID NO: 133416 - RNA, 19 nt, Homo sapiens
aauggaagcggauauagaa

SEQ ID NO: 133417 - RNA, 19 nt, Homo sapiens
ccaaacaaccugcuaucau

SEQ ID NO: 133418 - RNA, 19 nt, Homo sapiens
cugcaaauaucucaugaag

SEQ ID NO: 133419 - RNA, 19 nt, Homo sapiens
cuuaauauggcuacacuaa

SEQ ID NO: 133420 - RNA, 19 nt, Homo sapiens
uuacagugguggaggcuau

SEQ ID NO: 133421 - RNA, 19 nt, Homo sapiens
caauggaagcggauauaga

SEQ ID NO: 133422 - RNA, 19 nt, Homo sapiens
gcacaaaagacuuaauaug

SEQ ID NO: 133423 - RNA, 19 nt, Homo sapiens
gaaggggagguucuaguua

SEQ ID NO: 133424 - RNA, 19 nt, Homo sapiens
gcuauauccaucgaaauuu

SEQ ID NO: 133425 - RNA, 19 nt, Homo sapiens
ucacguagcccuuuuauca

SEQ ID NO: 133426 - RNA, 19 nt, Homo sapiens
ugugguucauuguaguuua

SEQ ID NO: 133427 - RNA, 19 nt, Homo sapiens
cccauucugugguucauug

SEQ ID NO: 133428 - RNA, 19 nt, Homo sapiens
uggaccagauaauaauuug

SEQ ID NO: 133429 - RNA, 19 nt, Homo sapiens
gaccugggaagccaaaguu

SEQ ID NO: 133430 - RNA, 19 nt, Homo sapiens
guagccaagacaugaagua

SEQ ID NO: 133431 - RNA, 19 nt, Homo sapiens
uaaccaaacaaccugcuau

SEQ ID NO: 133432 - RNA, 19 nt, Homo sapiens
gggagguucuaguuacagu

SEQ ID NO: 133433 - RNA, 19 nt, Homo sapiens
aaacugcaaauaucucaug

SEQ ID NO: 133434 - RNA, 19 nt, Homo sapiens
caucucccuucuuuguauu

SEQ ID NO: 133435 - RNA, 19 nt, Homo sapiens
uaugucaguuccugugugu

SEQ ID NO: 133436 - RNA, 19 nt, Homo sapiens
cucccaagauggcccgaua

SEQ ID NO: 133437 - RNA, 19 nt, Homo sapiens
uccagagccuuucaucaau

SEQ ID NO: 133438 - RNA, 19 nt, Homo sapiens
gcagauugugcuuguagau

SEQ ID NO: 133439 - RNA, 19 nt, Homo sapiens
aaguucagcucaaagagau

SEQ ID NO: 133440 - RNA, 19 nt, Homo sapiens
aaaguucagcucaaagaga

SEQ ID NO: 133441 - RNA, 19 nt, Homo sapiens
ggcuuucguuuaauacaau

SEQ ID NO: 133442 - RNA, 19 nt, Homo sapiens
ugcuauguguuacguguuu

SEQ ID NO: 133443 - RNA, 19 nt, Homo sapiens
gauuggcaguacacgguau

SEQ ID NO: 133444 - RNA, 19 nt, Homo sapiens
ugaagcugcugccuguauc

SEQ ID NO: 133445 - RNA, 19 nt, Homo sapiens
ugacuggauuaaacugcaa

SEQ ID NO: 133446 - RNA, 19 nt, Homo sapiens
gacaugaaguacccaucuc

SEQ ID NO: 133447 - RNA, 19 nt, Homo sapiens
gacuuaauauggcuacacu

SEQ ID NO: 133448 - RNA, 19 nt, Homo sapiens
gggcagauugugcuuguag

SEQ ID NO: 133449 - RNA, 19 nt, Homo sapiens
aagaaaguccaaucugaug

SEQ ID NO: 133450 - RNA, 19 nt, Homo sapiens
agccaaaguucagcucaaa

SEQ ID NO: 133451 - RNA, 19 nt, Homo sapiens
uggcuuucguuuaauacaa

SEQ ID NO: 133452 - RNA, 19 nt, Homo sapiens
aaacaaccugcuaucauca

SEQ ID NO: 133453 - RNA, 19 nt, Homo sapiens
guaaccaaacaaccugcua

SEQ ID NO: 133454 - RNA, 19 nt, Homo sapiens
cgagccaucucugcuaaag

SEQ ID NO: 133455 - RNA, 19 nt, Homo sapiens
guucagcucaaagagauuu

SEQ ID NO: 133456 - RNA, 19 nt, Homo sapiens
cauauagaugcauuaguga

SEQ ID NO: 133457 - RNA, 19 nt, Homo sapiens
ugggcuauauccaucgaaa

SEQ ID NO: 133458 - RNA, 19 nt, Homo sapiens
gaagcugcugccuguauca

SEQ ID NO: 133459 - RNA, 19 nt, Homo sapiens
cgacaauggaagcggauau

SEQ ID NO: 133460 - RNA, 19 nt, Homo sapiens
cugcugguaucaaccuuau

SEQ ID NO: 133461 - RNA, 19 nt, Homo sapiens
aagaagcagagauacguuu

SEQ ID NO: 133462 - RNA, 19 nt, Homo sapiens
aaggaaaccaagcauauag

SEQ ID NO: 133463 - RNA, 19 nt, Homo sapiens
uuccagagccuuucaucaa

SEQ ID NO: 133464 - RNA, 19 nt, Homo sapiens
gcugcugguaucaaccuua

SEQ ID NO: 133465 - RNA, 19 nt, Homo sapiens
ccauggaggcuuugguugu

SEQ ID NO: 133466 - RNA, 19 nt, Homo sapiens
ggcagauugugcuuguaga

SEQ ID NO: 133467 - RNA, 19 nt, Homo sapiens
aagauuguuuguugacaca

SEQ ID NO: 133468 - RNA, 19 nt, Homo sapiens
ggauauggugcagguguug

SEQ ID NO: 133469 - RNA, 19 nt, Homo sapiens
gagaagaagcagagauacg

SEQ ID NO: 133470 - RNA, 19 nt, Homo sapiens
uccuggcuuucguuuaaua

SEQ ID NO: 133471 - RNA, 19 nt, Homo sapiens
uggaggcuuugguuguuga

SEQ ID NO: 133472 - RNA, 19 nt, Homo sapiens
aagccaaaguucagcucaa

SEQ ID NO: 133473 - RNA, 19 nt, Homo sapiens
cucgagccaucucugcuaa

SEQ ID NO: 133474 - RNA, 19 nt, Homo sapiens
uuucacccauucugugguu

SEQ ID NO: 133475 - RNA, 19 nt, Homo sapiens
gaauggaagucuauaauga

SEQ ID NO: 133476 - RNA, 19 nt, Homo sapiens
ggaagaagaugcugauuuc

SEQ ID NO: 133477 - RNA, 19 nt, Homo sapiens
gcaaagagguccaguaucu

SEQ ID NO: 133478 - RNA, 19 nt, Homo sapiens
gaaaguaccugugaaggaa

SEQ ID NO: 133479 - RNA, 19 nt, Homo sapiens
gauaugggcuuugcugaua

SEQ ID NO: 133480 - RNA, 19 nt, Homo sapiens
gaugaaggauaaagaagua

SEQ ID NO: 133481 - RNA, 19 nt, Homo sapiens
gcuaagaagucaaagcuaa

SEQ ID NO: 133482 - RNA, 19 nt, Homo sapiens
ggaagucuauaaugaguuu

SEQ ID NO: 133483 - RNA, 19 nt, Homo sapiens
caagaaacgucagacuuua

SEQ ID NO: 133484 - RNA, 19 nt, Homo sapiens
ggacagagaugaggaggaa

SEQ ID NO: 133485 - RNA, 19 nt, Homo sapiens
gaagccaucugaagaagaa

SEQ ID NO: 133486 - RNA, 19 nt, Homo sapiens
gaauuggguucuucaguuu

SEQ ID NO: 133487 - RNA, 19 nt, Homo sapiens
gagccaagccgauaaagua

SEQ ID NO: 133488 - RNA, 19 nt, Homo sapiens
cgagagaacuggccuauca

SEQ ID NO: 133489 - RNA, 19 nt, Homo sapiens
gaagaagagcauuguauuu

SEQ ID NO: 133490 - RNA, 19 nt, Homo sapiens
acacauggaugaaacagua

SEQ ID NO: 133491 - RNA, 19 nt, Homo sapiens
gcaauggacuucaacagau

SEQ ID NO: 133492 - RNA, 19 nt, Homo sapiens
uaagagagcugcaguacuc

SEQ ID NO: 133493 - RNA, 19 nt, Homo sapiens
gaggaagccuuucuggauu

SEQ ID NO: 133494 - RNA, 19 nt, Homo sapiens
caacacauauauucacaga

SEQ ID NO: 133495 - RNA, 19 nt, Homo sapiens
caacaagucauaacagaaa

SEQ ID NO: 133496 - RNA, 19 nt, Homo sapiens
ggccaaagaugaagaggaa

SEQ ID NO: 133497 - RNA, 19 nt, Homo sapiens
gaaacaacccaccaaagaa

SEQ ID NO: 133498 - RNA, 19 nt, Homo sapiens
gauagaaucuuggauaugg

SEQ ID NO: 133499 - RNA, 19 nt, Homo sapiens
gcacuuagguaccauaugc

SEQ ID NO: 133500 - RNA, 19 nt, Homo sapiens
gagcaacagugaaguggaa

SEQ ID NO: 133501 - RNA, 19 nt, Homo sapiens
gguaucaacuuacauaaag

SEQ ID NO: 133502 - RNA, 19 nt, Homo sapiens
ggugaagcuuugcuaauuu

SEQ ID NO: 133503 - RNA, 19 nt, Homo sapiens
aaacacugccuuugucuua

SEQ ID NO: 133504 - RNA, 19 nt, Homo sapiens
gaauaugcccugucucuug

SEQ ID NO: 133505 - RNA, 19 nt, Homo sapiens
gaagcggcauaauguguuu

SEQ ID NO: 133506 - RNA, 19 nt, Homo sapiens
caaguuaccuauaccugaa

SEQ ID NO: 133507 - RNA, 19 nt, Homo sapiens
gaagaauggaagucuauaa

SEQ ID NO: 133508 - RNA, 19 nt, Homo sapiens
gcagaacuaugaaaagaua

SEQ ID NO: 133509 - RNA, 19 nt, Homo sapiens
ccaagaaacgucagacuuu

SEQ ID NO: 133510 - RNA, 19 nt, Homo sapiens
agaagacgaugaagaagaa

SEQ ID NO: 133511 - RNA, 19 nt, Homo sapiens
gagaggaucaacaacauaa

SEQ ID NO: 133512 - RNA, 19 nt, Homo sapiens
caacuuacauaaagcaaag

SEQ ID NO: 133513 - RNA, 19 nt, Homo sapiens
ccaagccgauaaaguaauu

SEQ ID NO: 133514 - RNA, 19 nt, Homo sapiens
caugaaugcuguuauugaa

SEQ ID NO: 133515 - RNA, 19 nt, Homo sapiens
gaggguggaugauaccauu

SEQ ID NO: 133516 - RNA, 19 nt, Homo sapiens
agucaaagcuaaauacuuc

SEQ ID NO: 133517 - RNA, 19 nt, Homo sapiens
gaccaaaguugcagaagca

SEQ ID NO: 133518 - RNA, 19 nt, Homo sapiens
aagaagaaauggaagagaa

SEQ ID NO: 133519 - RNA, 19 nt, Homo sapiens
gaccagcccugagaaagaa

SEQ ID NO: 133520 - RNA, 19 nt, Homo sapiens
gaagagaagccaacaagag

SEQ ID NO: 133521 - RNA, 19 nt, Homo sapiens
cauguguucuguuagauuu

SEQ ID NO: 133522 - RNA, 19 nt, Homo sapiens
gagaaaacauuacagaaga

SEQ ID NO: 133523 - RNA, 19 nt, Homo sapiens
ggcauaauguguuuggauu

SEQ ID NO: 133524 - RNA, 19 nt, Homo sapiens
gaacugccagguacaaaga

SEQ ID NO: 133525 - RNA, 19 nt, Homo sapiens
auaaugaguuuguccguaa

SEQ ID NO: 133526 - RNA, 19 nt, Homo sapiens
caacacaaacuaaaucugu

SEQ ID NO: 133527 - RNA, 19 nt, Homo sapiens
agaaaucccugucuugcuu

SEQ ID NO: 133528 - RNA, 19 nt, Homo sapiens
ucaggaagaggacaaauuu

SEQ ID NO: 133529 - RNA, 19 nt, Homo sapiens
gaagaagaagagcauugua

SEQ ID NO: 133530 - RNA, 19 nt, Homo sapiens
ucaaagagacuaugaugga

SEQ ID NO: 133531 - RNA, 19 nt, Homo sapiens
cagcauguguucuguuaga

SEQ ID NO: 133532 - RNA, 19 nt, Homo sapiens
gaucgaggguggaugauac

SEQ ID NO: 133533 - RNA, 19 nt, Homo sapiens
ugacgaaguggaagaauuu

SEQ ID NO: 133534 - RNA, 19 nt, Homo sapiens
guacaaagaggauggugaa

SEQ ID NO: 133535 - RNA, 19 nt, Homo sapiens
uaagugauaccaagaagaa

SEQ ID NO: 133536 - RNA, 19 nt, Homo sapiens
ggagugaugaugaugauga

SEQ ID NO: 133537 - RNA, 19 nt, Homo sapiens
agaagaagacgaugaagaa

SEQ ID NO: 133538 - RNA, 19 nt, Homo sapiens
gagccuacuucaaugagaa

SEQ ID NO: 133539 - RNA, 19 nt, Homo sapiens
ggaagcaacugaagaaacc

SEQ ID NO: 133540 - RNA, 19 nt, Homo sapiens
uaagugugcuguauuccuu

SEQ ID NO: 133541 - RNA, 19 nt, Homo sapiens
ggaugaagagcugguguua

SEQ ID NO: 133542 - RNA, 19 nt, Homo sapiens
gagaaaagacugaaagaaa

SEQ ID NO: 133543 - RNA, 19 nt, Homo sapiens
ugaggaagaugaugacaca

SEQ ID NO: 133544 - RNA, 19 nt, Homo sapiens
ggaagaagaagaagacgau

SEQ ID NO: 133545 - RNA, 19 nt, Homo sapiens
guaaggagccaagccgaua

SEQ ID NO: 133546 - RNA, 19 nt, Homo sapiens
cuaccgaccuccaaauguu

SEQ ID NO: 133547 - RNA, 19 nt, Homo sapiens
ggauuggcuuugcaaggua

SEQ ID NO: 133548 - RNA, 19 nt, Homo sapiens
ggaccagcccugagaaaga

SEQ ID NO: 133549 - RNA, 19 nt, Homo sapiens
gaaaucccugucuugcuua

SEQ ID NO: 133550 - RNA, 19 nt, Homo sapiens
guucagcaguggccacaaa

SEQ ID NO: 133551 - RNA, 19 nt, Homo sapiens
gcacagacaggauaaugau

SEQ ID NO: 133552 - RNA, 19 nt, Homo sapiens
gcagaaacaacccaccaaa

SEQ ID NO: 133553 - RNA, 19 nt, Homo sapiens
gaagaaaguaccugugaag

SEQ ID NO: 133554 - RNA, 19 nt, Homo sapiens
caaagaggauggugaagcu

SEQ ID NO: 133555 - RNA, 19 nt, Homo sapiens
gagaugaggaggaagaaga

SEQ ID NO: 133556 - RNA, 19 nt, Homo sapiens
agaaacaacccaccaaaga

SEQ ID NO: 133557 - RNA, 19 nt, Homo sapiens
ugacugagauacagaagca

SEQ ID NO: 133558 - RNA, 19 nt, Homo sapiens
gaggaugccaacacauaua

SEQ ID NO: 133559 - RNA, 19 nt, Homo sapiens
aagcaaaggccaaagauga

SEQ ID NO: 133560 - RNA, 19 nt, Homo sapiens
gaugugagcaaguuaccua

SEQ ID NO: 133561 - RNA, 19 nt, Homo sapiens
gagaagaauggaagucuau

SEQ ID NO: 133562 - RNA, 19 nt, Homo sapiens
ugagaagaauggaagucua

SEQ ID NO: 133563 - RNA, 19 nt, Homo sapiens
gguguuacaucugcuaaga

SEQ ID NO: 133564 - RNA, 19 nt, Homo sapiens
ggugguaucaacuuacaua

SEQ ID NO: 133565 - RNA, 19 nt, Homo sapiens
gaauuuagagccuacuuca

SEQ ID NO: 133566 - RNA, 19 nt, Homo sapiens
uaccaugaaugcuguuauu

SEQ ID NO: 133567 - RNA, 19 nt, Homo sapiens
ucccagauccagauaaaua

SEQ ID NO: 133568 - RNA, 19 nt, Homo sapiens
ugaugaugaugauggauuu

SEQ ID NO: 133569 - RNA, 19 nt, Homo sapiens
gaagaggacaaauuugaca

SEQ ID NO: 133570 - RNA, 19 nt, Homo sapiens
cacaggugguaucaacuua

SEQ ID NO: 133571 - RNA, 19 nt, Homo sapiens
ggccacaaaugcagaaauc

SEQ ID NO: 133572 - RNA, 19 nt, Homo sapiens
gcaccacgcguaagauuuc

SEQ ID NO: 133573 - RNA, 19 nt, Homo sapiens
gaagcagaccauuggauug

SEQ ID NO: 133574 - RNA, 19 nt, Homo sapiens
acuuauagauguccagaaa

SEQ ID NO: 133575 - RNA, 19 nt, Homo sapiens
ugaagcagauccuguauuu

SEQ ID NO: 133576 - RNA, 19 nt, Homo sapiens
caacuucucugacaaccua

SEQ ID NO: 133577 - RNA, 19 nt, Homo sapiens
ggacggagcugaagaccau

SEQ ID NO: 133578 - RNA, 19 nt, Homo sapiens
gaagaacacauaacuaaga

SEQ ID NO: 133579 - RNA, 19 nt, Homo sapiens
ggaaggcucugguggagaa

SEQ ID NO: 133580 - RNA, 19 nt, Homo sapiens
gcacagcuauagguccuua

SEQ ID NO: 133581 - RNA, 19 nt, Homo sapiens
aaagagagcugccucagau

SEQ ID NO: 133582 - RNA, 19 nt, Homo sapiens
gaagauggccuacuuggau

SEQ ID NO: 133583 - RNA, 19 nt, Homo sapiens
gaauccagcugugcacuuu

SEQ ID NO: 133584 - RNA, 19 nt, Homo sapiens
gcagaaccuuuguguaaau

SEQ ID NO: 133585 - RNA, 19 nt, Homo sapiens
gaagaagcgugaagaagag

SEQ ID NO: 133586 - RNA, 19 nt, Homo sapiens
ccacagcccugccuggauu

SEQ ID NO: 133587 - RNA, 19 nt, Homo sapiens
gaaccuuuguguaaaugaa

SEQ ID NO: 133588 - RNA, 19 nt, Homo sapiens
aaagugugcuguugguuaa

SEQ ID NO: 133589 - RNA, 19 nt, Homo sapiens
gcaggaagaagaagaaaga

SEQ ID NO: 133590 - RNA, 19 nt, Homo sapiens
gcuauagguccuuaaauaa

SEQ ID NO: 133591 - RNA, 19 nt, Homo sapiens
cggcagaaccuuuguguaa

SEQ ID NO: 133592 - RNA, 19 nt, Homo sapiens
gcagagcuguaccggguuu

SEQ ID NO: 133593 - RNA, 19 nt, Homo sapiens
aaagguccauggcuaauga

SEQ ID NO: 133594 - RNA, 19 nt, Homo sapiens
ucucuggucucaauuuaaa

SEQ ID NO: 133595 - RNA, 19 nt, Homo sapiens
ggcguuagcucccguagga

SEQ ID NO: 133596 - RNA, 19 nt, Homo sapiens
gaagcaggcacgagaagaa

SEQ ID NO: 133597 - RNA, 19 nt, Homo sapiens
agcuauagguccuuaaaua

SEQ ID NO: 133598 - RNA, 19 nt, Homo sapiens
gggaucaacuucucugaca

SEQ ID NO: 133599 - RNA, 19 nt, Homo sapiens
gaaauucguggcugugcua

SEQ ID NO: 133600 - RNA, 19 nt, Homo sapiens
gcaagagugggauauuuga

SEQ ID NO: 133601 - RNA, 19 nt, Homo sapiens
ggcagaaccuuuguguaaa

SEQ ID NO: 133602 - RNA, 19 nt, Homo sapiens
ccaagaaccugauguaccu

SEQ ID NO: 133603 - RNA, 19 nt, Homo sapiens
guccauggcuaaugaaaca

SEQ ID NO: 133604 - RNA, 19 nt, Homo sapiens
gcaccucccucccucucaa

SEQ ID NO: 133605 - RNA, 19 nt, Homo sapiens
agaagaagcgugaagaaga

SEQ ID NO: 133606 - RNA, 19 nt, Homo sapiens
guggagaaccugugcauga

SEQ ID NO: 133607 - RNA, 19 nt, Homo sapiens
aggaagaacacauaacuaa

SEQ ID NO: 133608 - RNA, 19 nt, Homo sapiens
gaagaagaagaaagagaga

SEQ ID NO: 133609 - RNA, 19 nt, Homo sapiens
gaacagaagaagcgugaag

SEQ ID NO: 133610 - RNA, 19 nt, Homo sapiens
gaggaagaacacauaacua

SEQ ID NO: 133611 - RNA, 19 nt, Homo sapiens
gaaagaugaaucccugugu

SEQ ID NO: 133612 - RNA, 19 nt, Homo sapiens
gaagguuggugccauccau

SEQ ID NO: 133613 - RNA, 19 nt, Homo sapiens
gugcagcgauacugugaga

SEQ ID NO: 133614 - RNA, 19 nt, Homo sapiens
caucaacgacuuucucuuc

SEQ ID NO: 133615 - RNA, 19 nt, Homo sapiens
gaagaccaucaacgacuuu

SEQ ID NO: 133616 - RNA, 19 nt, Homo sapiens
uggcaagagugggauauuu

SEQ ID NO: 133617 - RNA, 19 nt, Homo sapiens
cgagagugaugaggagaaa

SEQ ID NO: 133618 - RNA, 19 nt, Homo sapiens
ggaggaagcagcgagaaga

SEQ ID NO: 133619 - RNA, 19 nt, Homo sapiens
gaacuggccccuuacauga

SEQ ID NO: 133620 - RNA, 19 nt, Homo sapiens
agaaggcccugcucccuau

SEQ ID NO: 133621 - RNA, 19 nt, Homo sapiens
ugaagaccaucaacgacuu

SEQ ID NO: 133622 - RNA, 19 nt, Homo sapiens
ugauguaccugaagcagau

SEQ ID NO: 133623 - RNA, 19 nt, Homo sapiens
gcagaguggaugaggauga

SEQ ID NO: 133624 - RNA, 19 nt, Homo sapiens
uuacucaguuugugcagaa

SEQ ID NO: 133625 - RNA, 19 nt, Homo sapiens
gaauucacguuccagaaaa

SEQ ID NO: 133626 - RNA, 19 nt, Homo sapiens
guacggagcaguguucuca

SEQ ID NO: 133627 - RNA, 19 nt, Homo sapiens
ggaggaagaacacauaacu

SEQ ID NO: 133628 - RNA, 19 nt, Homo sapiens
aggaugaccuggaggaaga

SEQ ID NO: 133629 - RNA, 19 nt, Homo sapiens
aggagaagauggccuacuu

SEQ ID NO: 133630 - RNA, 19 nt, Homo sapiens
ggccuggguuacucaguuu

SEQ ID NO: 133631 - RNA, 19 nt, Homo sapiens
gcucucaacaugacuauag

SEQ ID NO: 133632 - RNA, 19 nt, Homo sapiens
acucucuggucucaauuua

SEQ ID NO: 133633 - RNA, 19 nt, Homo sapiens
ggaucaacuucucugacaa

SEQ ID NO: 133634 - RNA, 19 nt, Homo sapiens
ggaagaacacauaacuaag

SEQ ID NO: 133635 - RNA, 19 nt, Homo sapiens
ggagagaggccaggugaca

SEQ ID NO: 133636 - RNA, 19 nt, Homo sapiens
ggcaagagugggauauuug

SEQ ID NO: 133637 - RNA, 19 nt, Homo sapiens
ucacugaugcccagauguu

SEQ ID NO: 133638 - RNA, 19 nt, Homo sapiens
gcaggaggaaagucacuga

SEQ ID NO: 133639 - RNA, 19 nt, Homo sapiens
ggagaagauggccuacuug

SEQ ID NO: 133640 - RNA, 19 nt, Homo sapiens
agagcugccucagaugaua

SEQ ID NO: 133641 - RNA, 19 nt, Homo sapiens
cgaccagcuucuccacuga

SEQ ID NO: 133642 - RNA, 19 nt, Homo sapiens
ugcaguacguggagcgaua

SEQ ID NO: 133643 - RNA, 19 nt, Homo sapiens
gcaggcacgagaagaagaa

SEQ ID NO: 133644 - RNA, 19 nt, Homo sapiens
gagcagaguggaugaggau

SEQ ID NO: 133645 - RNA, 19 nt, Homo sapiens
gggugcagcucaaguaugc

SEQ ID NO: 133646 - RNA, 19 nt, Homo sapiens
gcacgacuccuugaaacug

SEQ ID NO: 133647 - RNA, 19 nt, Homo sapiens
uggagaaccugugcaugaa

SEQ ID NO: 133648 - RNA, 19 nt, Homo sapiens
gcagcgggaucuccaacca

SEQ ID NO: 133649 - RNA, 19 nt, Homo sapiens
ccaugcagccggugucuga

SEQ ID NO: 133650 - RNA, 19 nt, Homo sapiens
uggcagaggugaaggacau

SEQ ID NO: 133651 - RNA, 19 nt, Homo sapiens
ggaggaggcaggagaagca

SEQ ID NO: 133652 - RNA, 19 nt, Homo sapiens
gaggaagcagcgagaagaa

SEQ ID NO: 133653 - RNA, 19 nt, Homo sapiens
gaugaaucccugugucugu

SEQ ID NO: 133654 - RNA, 19 nt, Homo sapiens
gcacugggaaguccuuaag

SEQ ID NO: 133655 - RNA, 19 nt, Homo sapiens
ccguuaggcucucaacaug

SEQ ID NO: 133656 - RNA, 19 nt, Homo sapiens
ucaggcaccagaaggauuu

SEQ ID NO: 133657 - RNA, 19 nt, Homo sapiens
gaggcacgacuccuugaaa

SEQ ID NO: 133658 - RNA, 19 nt, Homo sapiens
gccaguuccuccaagucua

SEQ ID NO: 133659 - RNA, 19 nt, Homo sapiens
gcaaagguccauggcuaau

SEQ ID NO: 133660 - RNA, 19 nt, Homo sapiens
gaagaagaaagagagaauc

SEQ ID NO: 133661 - RNA, 19 nt, Homo sapiens
ggaggaaagaugagugaag

SEQ ID NO: 133662 - RNA, 19 nt, Homo sapiens
guggucagcugggaucuuc

SEQ ID NO: 133663 - RNA, 19 nt, Homo sapiens
gcccuggacugcucacucu

SEQ ID NO: 133664 - RNA, 19 nt, Homo sapiens
gaagggcagacuggugaaa

SEQ ID NO: 133665 - RNA, 19 nt, Homo sapiens
gggauccuguuacaaaggu

SEQ ID NO: 133666 - RNA, 19 nt, Homo sapiens
uguucaaggugcagcgaua

SEQ ID NO: 133667 - RNA, 19 nt, Homo sapiens
cagaaccuuuguguaaaug

SEQ ID NO: 133668 - RNA, 19 nt, Homo sapiens
gcaaacugggcgucuguuc

SEQ ID NO: 133669 - RNA, 19 nt, Homo sapiens
agucacuccuucaguagaa

SEQ ID NO: 133670 - RNA, 19 nt, Homo sapiens
gcaugaaggccgucaacca

SEQ ID NO: 133671 - RNA, 19 nt, Homo sapiens
cagcgauacugugagaaga

SEQ ID NO: 133672 - RNA, 19 nt, Homo sapiens
ugagcgcggugguggaguu

SEQ ID NO: 133673 - RNA, 19 nt, Homo sapiens
gcagcgauacugugagaag

SEQ ID NO: 133674 - RNA, 19 nt, Homo sapiens
gaggcaggaagaagaagaa

SEQ ID NO: 133675 - RNA, 19 nt, Homo sapiens
ugaagcagauccuguauuu

SEQ ID NO: 133676 - RNA, 19 nt, Homo sapiens
caacuucucugacaaccua

SEQ ID NO: 133677 - RNA, 19 nt, Homo sapiens
ggacggagcugaagaccau

SEQ ID NO: 133678 - RNA, 19 nt, Homo sapiens
gaagaacacauaacuaaga

SEQ ID NO: 133679 - RNA, 19 nt, Homo sapiens
ggaaggcucugguggagaa

SEQ ID NO: 133680 - RNA, 19 nt, Homo sapiens
aaagagagcugccucagau

SEQ ID NO: 133681 - RNA, 19 nt, Homo sapiens
gaagauggccuacuuggau

SEQ ID NO: 133682 - RNA, 19 nt, Homo sapiens
gaauccagcugugcacuuu

SEQ ID NO: 133683 - RNA, 19 nt, Homo sapiens
gcagaaccuuuguguaaau

SEQ ID NO: 133684 - RNA, 19 nt, Homo sapiens
gaagaagcgugaagaagag

SEQ ID NO: 133685 - RNA, 19 nt, Homo sapiens
ccacagcccugccuggauu

SEQ ID NO: 133686 - RNA, 19 nt, Homo sapiens
gaaccuuuguguaaaugaa

SEQ ID NO: 133687 - RNA, 19 nt, Homo sapiens
aaagugugcuguugguuaa

SEQ ID NO: 133688 - RNA, 19 nt, Homo sapiens
gcaggaagaagaagaaaga

SEQ ID NO: 133689 - RNA, 19 nt, Homo sapiens
cggcagaaccuuuguguaa

SEQ ID NO: 133690 - RNA, 19 nt, Homo sapiens
gcagagcuguaccggguuu

SEQ ID NO: 133691 - RNA, 19 nt, Homo sapiens
cuacagguccuuaaauaaa

SEQ ID NO: 133692 - RNA, 19 nt, Homo sapiens
gaagcaggcaugagaagaa

SEQ ID NO: 133693 - RNA, 19 nt, Homo sapiens
aaagguccauggcuaauga

SEQ ID NO: 133694 - RNA, 19 nt, Homo sapiens
ccauuaggcucucaacaug

SEQ ID NO: 133695 - RNA, 19 nt, Homo sapiens
ucucuggucucaauuuaaa

SEQ ID NO: 133696 - RNA, 19 nt, Homo sapiens
ggcguuagcucccguagga

SEQ ID NO: 133697 - RNA, 19 nt, Homo sapiens
gggaucaacuucucugaca

SEQ ID NO: 133698 - RNA, 19 nt, Homo sapiens
gaaauucguggcugugcua

SEQ ID NO: 133699 - RNA, 19 nt, Homo sapiens
ggcagaaccuuuguguaaa

SEQ ID NO: 133700 - RNA, 19 nt, Homo sapiens
gcacagcuacagguccuua

SEQ ID NO: 133701 - RNA, 19 nt, Homo sapiens
ccaagaaccugauguaccu

SEQ ID NO: 133702 - RNA, 19 nt, Homo sapiens
guccauggcuaaugaaaca

SEQ ID NO: 133703 - RNA, 19 nt, Homo sapiens
gcuacagguccuuaaauaa

SEQ ID NO: 133704 - RNA, 19 nt, Homo sapiens
gcaccucccucccucucaa

SEQ ID NO: 133705 - RNA, 19 nt, Homo sapiens
agaagaagcgugaagaaga

SEQ ID NO: 133706 - RNA, 19 nt, Homo sapiens
guggagaaccugugcauga

SEQ ID NO: 133707 - RNA, 19 nt, Homo sapiens
aggaagaacacauaacuaa

SEQ ID NO: 133708 - RNA, 19 nt, Homo sapiens
gaagaagaagaaagagaga

SEQ ID NO: 133709 - RNA, 19 nt, Homo sapiens
gaacagaagaagcgugaag

SEQ ID NO: 133710 - RNA, 19 nt, Homo sapiens
gaggaagaacacauaacua

SEQ ID NO: 133711 - RNA, 19 nt, Homo sapiens
gaaagaugaaucccugugu

SEQ ID NO: 133712 - RNA, 19 nt, Homo sapiens
gaagguuggugccauccau

SEQ ID NO: 133713 - RNA, 19 nt, Homo sapiens
gugcagcgauacugugaga

SEQ ID NO: 133714 - RNA, 19 nt, Homo sapiens
caucaacgacuuucucuuc

SEQ ID NO: 133715 - RNA, 19 nt, Homo sapiens
gaagaccaucaacgacuuu

SEQ ID NO: 133716 - RNA, 19 nt, Homo sapiens
cagagaagcaggcaugaga

SEQ ID NO: 133717 - RNA, 19 nt, Homo sapiens
cgagagugaugaggagaaa

SEQ ID NO: 133718 - RNA, 19 nt, Homo sapiens
ggaggaagcagcgagaaga

SEQ ID NO: 133719 - RNA, 19 nt, Homo sapiens
gaacuggccccuuacauga

SEQ ID NO: 133720 - RNA, 19 nt, Homo sapiens
agaaggcccugcucccuau

SEQ ID NO: 133721 - RNA, 19 nt, Homo sapiens
ugaagaccaucaacgacuu

SEQ ID NO: 133722 - RNA, 19 nt, Homo sapiens
ugauguaccugaagcagau

SEQ ID NO: 133723 - RNA, 19 nt, Homo sapiens
gcagaguggaugaggauga

SEQ ID NO: 133724 - RNA, 19 nt, Homo sapiens
uuacucaguuugugcagaa

SEQ ID NO: 133725 - RNA, 19 nt, Homo sapiens
gcaagauugggauauuuga

SEQ ID NO: 133726 - RNA, 19 nt, Homo sapiens
gaauucacguuccagaaaa

SEQ ID NO: 133727 - RNA, 19 nt, Homo sapiens
guacggagcaguguucuca

SEQ ID NO: 133728 - RNA, 19 nt, Homo sapiens
ggaggaagaacacauaacu

SEQ ID NO: 133729 - RNA, 19 nt, Homo sapiens
aggaugaccuggaggaaga

SEQ ID NO: 133730 - RNA, 19 nt, Homo sapiens
agcuacagguccuuaaaua

SEQ ID NO: 133731 - RNA, 19 nt, Homo sapiens
aggagaagauggccuacuu

SEQ ID NO: 133732 - RNA, 19 nt, Homo sapiens
ggccuggguuacucaguuu

SEQ ID NO: 133733 - RNA, 19 nt, Homo sapiens
gcucucaacaugacuauag

SEQ ID NO: 133734 - RNA, 19 nt, Homo sapiens
gcaggcaugagaagaagaa

SEQ ID NO: 133735 - RNA, 19 nt, Homo sapiens
acucucuggucucaauuua

SEQ ID NO: 133736 - RNA, 19 nt, Homo sapiens
ggaucaacuucucugacaa

SEQ ID NO: 133737 - RNA, 19 nt, Homo sapiens
ggaagaacacauaacuaag

SEQ ID NO: 133738 - RNA, 19 nt, Homo sapiens
uggcaagauugggauauuu

SEQ ID NO: 133739 - RNA, 19 nt, Homo sapiens
ggagagaggccaggugaca

SEQ ID NO: 133740 - RNA, 19 nt, Homo sapiens
ucacugaugcccagauguu

SEQ ID NO: 133741 - RNA, 19 nt, Homo sapiens
gcaggaggaaagucacuga

SEQ ID NO: 133742 - RNA, 19 nt, Homo sapiens
ggagaagauggccuacuug

SEQ ID NO: 133743 - RNA, 19 nt, Homo sapiens
cgaccagcuucuccacuga

SEQ ID NO: 133744 - RNA, 19 nt, Homo sapiens
ugcaguacguggagcgaua

SEQ ID NO: 133745 - RNA, 19 nt, Homo sapiens
gagcagaguggaugaggau

SEQ ID NO: 133746 - RNA, 19 nt, Homo sapiens
gggugcagcucaaguaugc

SEQ ID NO: 133747 - RNA, 19 nt, Homo sapiens
gcacgacuccuugaaacug

SEQ ID NO: 133748 - RNA, 19 nt, Homo sapiens
uggagaaccugugcaugaa

SEQ ID NO: 133749 - RNA, 19 nt, Homo sapiens
gcagcgggaucuccaacca

SEQ ID NO: 133750 - RNA, 19 nt, Homo sapiens
ccaugcagccggugucuga

SEQ ID NO: 133751 - RNA, 19 nt, Homo sapiens
uggcagaggugaaggacau

SEQ ID NO: 133752 - RNA, 19 nt, Homo sapiens
ggaggaggcaggagaagca

SEQ ID NO: 133753 - RNA, 19 nt, Homo sapiens
gaggaagcagcgagaagaa

SEQ ID NO: 133754 - RNA, 19 nt, Homo sapiens
gaugaaucccugugucugu

SEQ ID NO: 133755 - RNA, 19 nt, Homo sapiens
gcacugggaaguccuuaag

SEQ ID NO: 133756 - RNA, 19 nt, Homo sapiens
uuuggaggcuggcaagauu

SEQ ID NO: 133757 - RNA, 19 nt, Homo sapiens
ucaggcaccagaaggauuu

SEQ ID NO: 133758 - RNA, 19 nt, Homo sapiens
gaggcacgacuccuugaaa

SEQ ID NO: 133759 - RNA, 19 nt, Homo sapiens
gccaguuccuccaagucua

SEQ ID NO: 133760 - RNA, 19 nt, Homo sapiens
gaagaagaaagagagaauc

SEQ ID NO: 133761 - RNA, 19 nt, Homo sapiens
gcaaagguccauggcuaau

SEQ ID NO: 133762 - RNA, 19 nt, Homo sapiens
ggaggaaagaugagugaag

SEQ ID NO: 133763 - RNA, 19 nt, Homo sapiens
ggacgaggugggucgcauu

SEQ ID NO: 133764 - RNA, 19 nt, Homo sapiens
guggucagcugggaucuuc

SEQ ID NO: 133765 - RNA, 19 nt, Homo sapiens
gaaggauuuugccagcaua

SEQ ID NO: 133766 - RNA, 19 nt, Homo sapiens
gcuuucagcguacgaauuc

SEQ ID NO: 133767 - RNA, 19 nt, Homo sapiens
ggcaagauugggauauuug

SEQ ID NO: 133768 - RNA, 19 nt, Homo sapiens
gcccuggacugcucacucu

SEQ ID NO: 133769 - RNA, 19 nt, Homo sapiens
gggauccuguuacaaaggu

SEQ ID NO: 133770 - RNA, 19 nt, Homo sapiens
uguucaaggugcagcgaua

SEQ ID NO: 133771 - RNA, 19 nt, Homo sapiens
cagaaccuuuguguaaaug

SEQ ID NO: 133772 - RNA, 19 nt, Homo sapiens
gcaaacugggcgucuguuc

SEQ ID NO: 133773 - RNA, 19 nt, Homo sapiens
gaagggcagacuggugaaa

SEQ ID NO: 133774 - RNA, 19 nt, Homo sapiens
gccauuaggcucucaacau

SEQ ID NO: 133775 - RNA, 19 nt, Homo sapiens
ugaagcagauccuguauuu

SEQ ID NO: 133776 - RNA, 19 nt, Homo sapiens
caacuucucugacaaccua

SEQ ID NO: 133777 - RNA, 19 nt, Homo sapiens
ggacggagcugaagaccau

SEQ ID NO: 133778 - RNA, 19 nt, Homo sapiens
gaagaacacauaacuaaga

SEQ ID NO: 133779 - RNA, 19 nt, Homo sapiens
ggaaggcucugguggagaa

SEQ ID NO: 133780 - RNA, 19 nt, Homo sapiens
aaagagagcugccucagau

SEQ ID NO: 133781 - RNA, 19 nt, Homo sapiens
gaagauggccuacuuggau

SEQ ID NO: 133782 - RNA, 19 nt, Homo sapiens
gaauccagcugugcacuuu

SEQ ID NO: 133783 - RNA, 19 nt, Homo sapiens
gcagaaccuuuguguaaau

SEQ ID NO: 133784 - RNA, 19 nt, Homo sapiens
gaagaagcgugaagaagag

SEQ ID NO: 133785 - RNA, 19 nt, Homo sapiens
ccacagcccugccuggauu

SEQ ID NO: 133786 - RNA, 19 nt, Homo sapiens
gaaccuuuguguaaaugaa

SEQ ID NO: 133787 - RNA, 19 nt, Homo sapiens
aaagugugcuguugguuaa

SEQ ID NO: 133788 - RNA, 19 nt, Homo sapiens
gcaggaagaagaagaaaga

SEQ ID NO: 133789 - RNA, 19 nt, Homo sapiens
cggcagaaccuuuguguaa

SEQ ID NO: 133790 - RNA, 19 nt, Homo sapiens
gcagagcuguaccggguuu

SEQ ID NO: 133791 - RNA, 19 nt, Homo sapiens
cuacagguccuuaaauaaa

SEQ ID NO: 133792 - RNA, 19 nt, Homo sapiens
aaagguccauggcuaauga

SEQ ID NO: 133793 - RNA, 19 nt, Homo sapiens
gcagagaagcagagaagaa

SEQ ID NO: 133794 - RNA, 19 nt, Homo sapiens
ccauuaggcucucaacaug

SEQ ID NO: 133795 - RNA, 19 nt, Homo sapiens
ucucuggucucaauuuaaa

SEQ ID NO: 133796 - RNA, 19 nt, Homo sapiens
ggcguuagcucccguagga

SEQ ID NO: 133797 - RNA, 19 nt, Homo sapiens
gggaucaacuucucugaca

SEQ ID NO: 133798 - RNA, 19 nt, Homo sapiens
gaaauucguggcugugcua

SEQ ID NO: 133799 - RNA, 19 nt, Homo sapiens
ggcagaaccuuuguguaaa

SEQ ID NO: 133800 - RNA, 19 nt, Homo sapiens
gcacagcuacagguccuua

SEQ ID NO: 133801 - RNA, 19 nt, Homo sapiens
ccaagaaccugauguaccu

SEQ ID NO: 133802 - RNA, 19 nt, Homo sapiens
gagaagcagagaagaagaa

SEQ ID NO: 133803 - RNA, 19 nt, Homo sapiens
guccauggcuaaugaaaca

SEQ ID NO: 133804 - RNA, 19 nt, Homo sapiens
gcuacagguccuuaaauaa

SEQ ID NO: 133805 - RNA, 19 nt, Homo sapiens
gcaccucccucccucucaa

SEQ ID NO: 133806 - RNA, 19 nt, Homo sapiens
gcaacgugcuguggccaaa

SEQ ID NO: 133807 - RNA, 19 nt, Homo sapiens
gcaccaggccuuccucugu

SEQ ID NO: 133808 - RNA, 19 nt, Homo sapiens
agaagaagcgugaagaaga

SEQ ID NO: 133809 - RNA, 19 nt, Homo sapiens
guggagaaccugugcauga

SEQ ID NO: 133810 - RNA, 19 nt, Homo sapiens
aggaagaacacauaacuaa

SEQ ID NO: 133811 - RNA, 19 nt, Homo sapiens
gaagaagaagaaagagaga

SEQ ID NO: 133812 - RNA, 19 nt, Homo sapiens
gaacagaagaagcgugaag

SEQ ID NO: 133813 - RNA, 19 nt, Homo sapiens
gaggaagaacacauaacua

SEQ ID NO: 133814 - RNA, 19 nt, Homo sapiens
gaaagaugaaucccugugu

SEQ ID NO: 133815 - RNA, 19 nt, Homo sapiens
gaagguuggugccauccau

SEQ ID NO: 133816 - RNA, 19 nt, Homo sapiens
gugcagcgauacugugaga

SEQ ID NO: 133817 - RNA, 19 nt, Homo sapiens
caucaacgacuuucucuuc

SEQ ID NO: 133818 - RNA, 19 nt, Homo sapiens
gaagaccaucaacgacuuu

SEQ ID NO: 133819 - RNA, 19 nt, Homo sapiens
cgagagugaugaggagaaa

SEQ ID NO: 133820 - RNA, 19 nt, Homo sapiens
ggaggaagcagcgagaaga

SEQ ID NO: 133821 - RNA, 19 nt, Homo sapiens
gaacuggccccuuacauga

SEQ ID NO: 133822 - RNA, 19 nt, Homo sapiens
agaaggcccugcucccuau

SEQ ID NO: 133823 - RNA, 19 nt, Homo sapiens
ugaagaccaucaacgacuu

SEQ ID NO: 133824 - RNA, 19 nt, Homo sapiens
ugauguaccugaagcagau

SEQ ID NO: 133825 - RNA, 19 nt, Homo sapiens
uuacucaguuugugcagaa

SEQ ID NO: 133826 - RNA, 19 nt, Homo sapiens
gcaagauugggauauuuga

SEQ ID NO: 133827 - RNA, 19 nt, Homo sapiens
gaauucacguuccagaaaa

SEQ ID NO: 133828 - RNA, 19 nt, Homo sapiens
guacggagcaguguucuca

SEQ ID NO: 133829 - RNA, 19 nt, Homo sapiens
ggaggaagaacacauaacu

SEQ ID NO: 133830 - RNA, 19 nt, Homo sapiens
aggaugaccuggaggaaga

SEQ ID NO: 133831 - RNA, 19 nt, Homo sapiens
agcuacagguccuuaaaua

SEQ ID NO: 133832 - RNA, 19 nt, Homo sapiens
aggagaagauggccuacuu

SEQ ID NO: 133833 - RNA, 19 nt, Homo sapiens
gaugucuuccucuccuuua

SEQ ID NO: 133834 - RNA, 19 nt, Homo sapiens
ggccuggguuacucaguuu

SEQ ID NO: 133835 - RNA, 19 nt, Homo sapiens
gcucucaacaugacuauag

SEQ ID NO: 133836 - RNA, 19 nt, Homo sapiens
acucucuggucucaauuua

SEQ ID NO: 133837 - RNA, 19 nt, Homo sapiens
ggaucaacuucucugacaa

SEQ ID NO: 133838 - RNA, 19 nt, Homo sapiens
ggaagaacacauaacuaag

SEQ ID NO: 133839 - RNA, 19 nt, Homo sapiens
uggcaagauugggauauuu

SEQ ID NO: 133840 - RNA, 19 nt, Homo sapiens
ggagagaggccaggugaca

SEQ ID NO: 133841 - RNA, 19 nt, Homo sapiens
ucacugaugcccagauguu

SEQ ID NO: 133842 - RNA, 19 nt, Homo sapiens
gcaggaggaaagucacuga

SEQ ID NO: 133843 - RNA, 19 nt, Homo sapiens
ggagaagauggccuacuug

SEQ ID NO: 133844 - RNA, 19 nt, Homo sapiens
cgaccagcuucuccacuga

SEQ ID NO: 133845 - RNA, 19 nt, Homo sapiens
ugcaguacguggagcgaua

SEQ ID NO: 133846 - RNA, 19 nt, Homo sapiens
gggugcagcucaaguaugc

SEQ ID NO: 133847 - RNA, 19 nt, Homo sapiens
gcacgacuccuugaaacug

SEQ ID NO: 133848 - RNA, 19 nt, Homo sapiens
uggagaaccugugcaugaa

SEQ ID NO: 133849 - RNA, 19 nt, Homo sapiens
gcagcgggaucuccaacca

SEQ ID NO: 133850 - RNA, 19 nt, Homo sapiens
ccaugcagccggugucuga

SEQ ID NO: 133851 - RNA, 19 nt, Homo sapiens
uggcagaggugaaggacau

SEQ ID NO: 133852 - RNA, 19 nt, Homo sapiens
ggaggaggcaggagaagca

SEQ ID NO: 133853 - RNA, 19 nt, Homo sapiens
gaggaagcagcgagaagaa

SEQ ID NO: 133854 - RNA, 19 nt, Homo sapiens
gaugaaucccugugucugu

SEQ ID NO: 133855 - RNA, 19 nt, Homo sapiens
gcacugggaaguccuuaag

SEQ ID NO: 133856 - RNA, 19 nt, Homo sapiens
uuuggaggcuggcaagauu

SEQ ID NO: 133857 - RNA, 19 nt, Homo sapiens
ucaggcaccagaaggauuu

SEQ ID NO: 133858 - RNA, 19 nt, Homo sapiens
gaggcacgacuccuugaaa

SEQ ID NO: 133859 - RNA, 19 nt, Homo sapiens
gccaguuccuccaagucua

SEQ ID NO: 133860 - RNA, 19 nt, Homo sapiens
gcaaagguccauggcuaau

SEQ ID NO: 133861 - RNA, 19 nt, Homo sapiens
gaagaagaaagagagaauc

SEQ ID NO: 133862 - RNA, 19 nt, Homo sapiens
ggaggaaagaugagugaag

SEQ ID NO: 133863 - RNA, 19 nt, Homo sapiens
ggacgaggugggucgcauu

SEQ ID NO: 133864 - RNA, 19 nt, Homo sapiens
guggucagcugggaucuuc

SEQ ID NO: 133865 - RNA, 19 nt, Homo sapiens
gugcagaaggucaguccua

SEQ ID NO: 133866 - RNA, 19 nt, Homo sapiens
gaaggauuuugccagcaua

SEQ ID NO: 133867 - RNA, 19 nt, Homo sapiens
ggcaagauugggauauuug

SEQ ID NO: 133868 - RNA, 19 nt, Homo sapiens
gcccuggacugcucacucu

SEQ ID NO: 133869 - RNA, 19 nt, Homo sapiens
gggauccuguuacaaaggu

SEQ ID NO: 133870 - RNA, 19 nt, Homo sapiens
gaagggcagacuggugaaa

SEQ ID NO: 133871 - RNA, 19 nt, Homo sapiens
uguucaaggugcagcgaua

SEQ ID NO: 133872 - RNA, 19 nt, Homo sapiens
cagaaccuuuguguaaaug

SEQ ID NO: 133873 - RNA, 19 nt, Homo sapiens
gcaaacugggcgucuguuc

SEQ ID NO: 133874 - RNA, 19 nt, Homo sapiens
gccauuaggcucucaacau

SEQ ID NO: 133875 - RNA, 19 nt, Homo sapiens
aaacagaaaugcaggauaa

SEQ ID NO: 133876 - RNA, 19 nt, Homo sapiens
cagcagcuaucucgaauua

SEQ ID NO: 133877 - RNA, 19 nt, Homo sapiens
gaugagauuugcccacaua

SEQ ID NO: 133878 - RNA, 19 nt, Homo sapiens
ugaauuaccuggcugcuuu

SEQ ID NO: 133879 - RNA, 19 nt, Homo sapiens
gaauaaagcgugaaguuga

SEQ ID NO: 133880 - RNA, 19 nt, Homo sapiens
gaacaguuauccagauuca

SEQ ID NO: 133881 - RNA, 19 nt, Homo sapiens
gagaucagauuuaaagguu

SEQ ID NO: 133882 - RNA, 19 nt, Homo sapiens
gaagaaacuugguauugau

SEQ ID NO: 133883 - RNA, 19 nt, Homo sapiens
agacagagaucagauuuaa

SEQ ID NO: 133884 - RNA, 19 nt, Homo sapiens
aaggauagguuuacagaua

SEQ ID NO: 133885 - RNA, 19 nt, Homo sapiens
gcagcuaucucgaauuaug

SEQ ID NO: 133886 - RNA, 19 nt, Homo sapiens
ggaaaaugcuucagacuuu

SEQ ID NO: 133887 - RNA, 19 nt, Homo sapiens
gaugaagccuguaagagaa

SEQ ID NO: 133888 - RNA, 19 nt, Homo sapiens
gcagagacgucuuugacaa

SEQ ID NO: 133889 - RNA, 19 nt, Homo sapiens
cuaaugagguccuaucuau

SEQ ID NO: 133890 - RNA, 19 nt, Homo sapiens
ugaagaaacuugguauuga

SEQ ID NO: 133891 - RNA, 19 nt, Homo sapiens
gggcauuacuuaacuguga

SEQ ID NO: 133892 - RNA, 19 nt, Homo sapiens
ggaaguugguuacuccauu

SEQ ID NO: 133893 - RNA, 19 nt, Homo sapiens
cugaaugggugcuuuauaa

SEQ ID NO: 133894 - RNA, 19 nt, Homo sapiens
gcuuaucagugcuggauua

SEQ ID NO: 133895 - RNA, 19 nt, Homo sapiens
ggugacagcuauuaguaaa

SEQ ID NO: 133896 - RNA, 19 nt, Homo sapiens
gagaguugcugaugagaug

SEQ ID NO: 133897 - RNA, 19 nt, Homo sapiens
ccacauagauggagaucau

SEQ ID NO: 133898 - RNA, 19 nt, Homo sapiens
gagaguggcugcaaugagu

SEQ ID NO: 133899 - RNA, 19 nt, Homo sapiens
caacaaaugcuaugcuuau

SEQ ID NO: 133900 - RNA, 19 nt, Homo sapiens
uaacaccuauccugagauu

SEQ ID NO: 133901 - RNA, 19 nt, Homo sapiens
ggagcguuaugguguaaua

SEQ ID NO: 133902 - RNA, 19 nt, Homo sapiens
ccagcuuucuuccuuaaua

SEQ ID NO: 133903 - RNA, 19 nt, Homo sapiens
gaacagggcauuacuuaac

SEQ ID NO: 133904 - RNA, 19 nt, Homo sapiens
aaugagguccuaucuauua

SEQ ID NO: 133905 - RNA, 19 nt, Homo sapiens
gacuacaacuguucuaaug

SEQ ID NO: 133906 - RNA, 19 nt, Homo sapiens
gagaauaaagcgugaaguu

SEQ ID NO: 133907 - RNA, 19 nt, Homo sapiens
gaaguugguuacuccauuc

SEQ ID NO: 133908 - RNA, 19 nt, Homo sapiens
gcagccagcuuucuuccuu

SEQ ID NO: 133909 - RNA, 19 nt, Homo sapiens
caaggaauauucacaguac

SEQ ID NO: 133910 - RNA, 19 nt, Homo sapiens
gcagguggcacauuuagaa

SEQ ID NO: 133911 - RNA, 19 nt, Homo sapiens
gcagcaauucgaacaguua

SEQ ID NO: 133912 - RNA, 19 nt, Homo sapiens
cgaauuauggacagauuua

SEQ ID NO: 133913 - RNA, 19 nt, Homo sapiens
acacagagaaagcuuauaa

SEQ ID NO: 133914 - RNA, 19 nt, Homo sapiens
ugaaguuggugacauuaaa

SEQ ID NO: 133915 - RNA, 19 nt, Homo sapiens
gaaaaugcuucagacuuua

SEQ ID NO: 133916 - RNA, 19 nt, Homo sapiens
gacacuggcuacagauauu

SEQ ID NO: 133917 - RNA, 19 nt, Homo sapiens
gagaaggaguugcgagcuu

SEQ ID NO: 133918 - RNA, 19 nt, Homo sapiens
gcagggacuauuauauuaa

SEQ ID NO: 133919 - RNA, 19 nt, Homo sapiens
gaauacaaggauagguuua

SEQ ID NO: 133920 - RNA, 19 nt, Homo sapiens
ugugaaauguuacaacuug

SEQ ID NO: 133921 - RNA, 19 nt, Homo sapiens
gaauggagcaauuggaaga

SEQ ID NO: 133922 - RNA, 19 nt, Homo sapiens
ugaaggaaguuguaagaca

SEQ ID NO: 133923 - RNA, 19 nt, Homo sapiens
ggaauacaaggauagguuu

SEQ ID NO: 133924 - RNA, 19 nt, Homo sapiens
aaugggugcuuuauaauga

SEQ ID NO: 133925 - RNA, 19 nt, Homo sapiens
uuaccuggcugcuuuaaau

SEQ ID NO: 133926 - RNA, 19 nt, Homo sapiens
cuacaauccucgaaucaga

SEQ ID NO: 133927 - RNA, 19 nt, Homo sapiens
ggauagguuuacagauauu

SEQ ID NO: 133928 - RNA, 19 nt, Homo sapiens
agcagggacuauuauauua

SEQ ID NO: 133929 - RNA, 19 nt, Homo sapiens
uuacaagcagggacuauua

SEQ ID NO: 133930 - RNA, 19 nt, Homo sapiens
caagaaagccgcagaugag

SEQ ID NO: 133931 - RNA, 19 nt, Homo sapiens
guugagaucuucuauacuc

SEQ ID NO: 133932 - RNA, 19 nt, Homo sapiens
caugaucguuguaauuguu

SEQ ID NO: 133933 - RNA, 19 nt, Homo sapiens
gaaugggugcuuuauaaug

SEQ ID NO: 133934 - RNA, 19 nt, Homo sapiens
gugaagaucggucuaaaga

SEQ ID NO: 133935 - RNA, 19 nt, Homo sapiens
gaugagagcccuggaacuu

SEQ ID NO: 133936 - RNA, 19 nt, Homo sapiens
cagcuuucuuccuuaauaa

SEQ ID NO: 133937 - RNA, 19 nt, Homo sapiens
gcgugaaguugaugauuug

SEQ ID NO: 133938 - RNA, 19 nt, Homo sapiens
ugagauggaugugauguug

SEQ ID NO: 133939 - RNA, 19 nt, Homo sapiens
ggaguacaugcgaucauua

SEQ ID NO: 133940 - RNA, 19 nt, Homo sapiens
cagaggcacugacuucaau

SEQ ID NO: 133941 - RNA, 19 nt, Homo sapiens
agagacgucuuugacaaua

SEQ ID NO: 133942 - RNA, 19 nt, Homo sapiens
acaguuauccagauucaua

SEQ ID NO: 133943 - RNA, 19 nt, Homo sapiens
guacacauccuguugagau

SEQ ID NO: 133944 - RNA, 19 nt, Homo sapiens
ugacacugcugaacgucua

SEQ ID NO: 133945 - RNA, 19 nt, Homo sapiens
ccaagaaagccgcagauga

SEQ ID NO: 133946 - RNA, 19 nt, Homo sapiens
gcauuaauccguucaccaa

SEQ ID NO: 133947 - RNA, 19 nt, Homo sapiens
gaguugugcucuucacguu

SEQ ID NO: 133948 - RNA, 19 nt, Homo sapiens
ggagauagagagcgagaga

SEQ ID NO: 133949 - RNA, 19 nt, Homo sapiens
uaagacagagaucagauuu

SEQ ID NO: 133950 - RNA, 19 nt, Homo sapiens
aaacuucaauccaaggaau

SEQ ID NO: 133951 - RNA, 19 nt, Homo sapiens
ggacacuggcuacagauau

SEQ ID NO: 133952 - RNA, 19 nt, Homo sapiens
gagauuugcccacauagau

SEQ ID NO: 133953 - RNA, 19 nt, Homo sapiens
gcagaugaggccaagauga

SEQ ID NO: 133954 - RNA, 19 nt, Homo sapiens
agagggagaucuucuucuu

SEQ ID NO: 133955 - RNA, 19 nt, Homo sapiens
gaacgugauagaggagaua

SEQ ID NO: 133956 - RNA, 19 nt, Homo sapiens
cgaaacagaaggucuacaa

SEQ ID NO: 133957 - RNA, 19 nt, Homo sapiens
uaugagcgcuacucuagau

SEQ ID NO: 133958 - RNA, 19 nt, Homo sapiens
auggagaucugacugaauu

SEQ ID NO: 133959 - RNA, 19 nt, Homo sapiens
ccaaggaauauucacagua

SEQ ID NO: 133960 - RNA, 19 nt, Homo sapiens
uuuaggaucaguuguguua

SEQ ID NO: 133961 - RNA, 19 nt, Homo sapiens
ggucuacaauccucgaauc

SEQ ID NO: 133962 - RNA, 19 nt, Homo sapiens
ugaugaagccuguaagaga

SEQ ID NO: 133963 - RNA, 19 nt, Homo sapiens
ucauaugugugaagaggaa

SEQ ID NO: 133964 - RNA, 19 nt, Homo sapiens
uaacuguccucuccuaacu

SEQ ID NO: 133965 - RNA, 19 nt, Homo sapiens
ugauaacuguccucuccua

SEQ ID NO: 133966 - RNA, 19 nt, Homo sapiens
gaguguggcucagagaguu

SEQ ID NO: 133967 - RNA, 19 nt, Homo sapiens
ggguagacaucaguccuuu

SEQ ID NO: 133968 - RNA, 19 nt, Homo sapiens
gggaauacaaggauagguu

SEQ ID NO: 133969 - RNA, 19 nt, Homo sapiens
caaaugcuaugcuuaucag

SEQ ID NO: 133970 - RNA, 19 nt, Homo sapiens
caacuugugcuuauguaga

SEQ ID NO: 133971 - RNA, 19 nt, Homo sapiens
uuaugcagguggcacauuu

SEQ ID NO: 133972 - RNA, 19 nt, Homo sapiens
aagcagggacuauuauauu

SEQ ID NO: 133973 - RNA, 19 nt, Homo sapiens
gaauuaccuggcugcuuua

SEQ ID NO: 133974 - RNA, 19 nt, Homo sapiens
cgagagagggagaaagaaa

SEQ ID NO: 133975 - RNA, 19 nt, Homo sapiens
gaaauaagguucaugcaau

SEQ ID NO: 133976 - RNA, 19 nt, Homo sapiens
ggacccaacuggaacauuu

SEQ ID NO: 133977 - RNA, 19 nt, Homo sapiens
uagaagaacucaucaggaa

SEQ ID NO: 133978 - RNA, 19 nt, Homo sapiens
gauuaugcuucuuggauua

SEQ ID NO: 133979 - RNA, 19 nt, Homo sapiens
gaagauggauguuuugaaa

SEQ ID NO: 133980 - RNA, 19 nt, Homo sapiens
gagcagucauuaaauuuga

SEQ ID NO: 133981 - RNA, 19 nt, Homo sapiens
ugagaaaggucaccaagga

SEQ ID NO: 133982 - RNA, 19 nt, Homo sapiens
ggagaggaaguacuuauuu

SEQ ID NO: 133983 - RNA, 19 nt, Homo sapiens
gagcagcauuucuuucuau

SEQ ID NO: 133984 - RNA, 19 nt, Homo sapiens
uagaagaacucgcaaaucu

SEQ ID NO: 133985 - RNA, 19 nt, Homo sapiens
gcaauucagugugauguga

SEQ ID NO: 133986 - RNA, 19 nt, Homo sapiens
gaagaacucaucaggaaga

SEQ ID NO: 133987 - RNA, 19 nt, Homo sapiens
gagaggaaguacuuauuuc

SEQ ID NO: 133988 - RNA, 19 nt, Homo sapiens
gaaaugauuggcagaauuc

SEQ ID NO: 133989 - RNA, 19 nt, Homo sapiens
gaucaaaguugcaggacau

SEQ ID NO: 133990 - RNA, 19 nt, Homo sapiens
ggaaauaagguucaugcaa

SEQ ID NO: 133991 - RNA, 19 nt, Homo sapiens
guaaaggaaugacaacucu

SEQ ID NO: 133992 - RNA, 19 nt, Homo sapiens
gaacucaucaggaagacaa

SEQ ID NO: 133993 - RNA, 19 nt, Homo sapiens
ggagcagcauuucuuucua

SEQ ID NO: 133994 - RNA, 19 nt, Homo sapiens
agaaaugauuggcagaauu

SEQ ID NO: 133995 - RNA, 19 nt, Homo sapiens
gcgaugcuaccaccuaaua

SEQ ID NO: 133996 - RNA, 19 nt, Homo sapiens
ggaauucaacgaccugaga

SEQ ID NO: 133997 - RNA, 19 nt, Homo sapiens
ggaaugacaacucuucugu

SEQ ID NO: 133998 - RNA, 19 nt, Homo sapiens
gcagcauuucuuucuauua

SEQ ID NO: 133999 - RNA, 19 nt, Homo sapiens
gagggauccugauaugguu

SEQ ID NO: 134000 - RNA, 19 nt, Homo sapiens
gaugugagggauccugaua

SEQ ID NO: 134001 - RNA, 19 nt, Homo sapiens
ggaaaaguggcauucauua

SEQ ID NO: 134002 - RNA, 19 nt, Homo sapiens
cagcauuucuuucuauuac

SEQ ID NO: 134003 - RNA, 19 nt, Homo sapiens
guaaauauggaaugcgauu

SEQ ID NO: 134004 - RNA, 19 nt, Homo sapiens
acagaaaggagcagcauuu

SEQ ID NO: 134005 - RNA, 19 nt, Homo sapiens
gaaagcuaccgcagaacaa

SEQ ID NO: 134006 - RNA, 19 nt, Homo sapiens
ggagcagucauuaaauuug

SEQ ID NO: 134007 - RNA, 19 nt, Homo sapiens
ugauuaugcuucuuggauu

SEQ ID NO: 134008 - RNA, 19 nt, Homo sapiens
gaaaagggaauagaaauga

SEQ ID NO: 134009 - RNA, 19 nt, Homo sapiens
gcagugggacaccauagaa

SEQ ID NO: 134010 - RNA, 19 nt, Homo sapiens
ggacauccuaauauuguga

SEQ ID NO: 134011 - RNA, 19 nt, Homo sapiens
cugaagcuuugcaaucuaa

SEQ ID NO: 134012 - RNA, 19 nt, Homo sapiens
gcacagccuucgugacacu

SEQ ID NO: 134013 - RNA, 19 nt, Homo sapiens
caaauuucuucucaaacug

SEQ ID NO: 134014 - RNA, 19 nt, Homo sapiens
uuugaaagcuaccgcagaa

SEQ ID NO: 134015 - RNA, 19 nt, Homo sapiens
caacuggaacauuugagaa

SEQ ID NO: 134016 - RNA, 19 nt, Homo sapiens
ggagguacuggccuuggua

SEQ ID NO: 134017 - RNA, 19 nt, Homo sapiens
aaaguggcauucauuacug

SEQ ID NO: 134018 - RNA, 19 nt, Homo sapiens
gaauucaacgaccugagaa

SEQ ID NO: 134019 - RNA, 19 nt, Homo sapiens
ugugagggauccugauaug

SEQ ID NO: 134020 - RNA, 19 nt, Homo sapiens
aagcgaugcuaccaccuaa

SEQ ID NO: 134021 - RNA, 19 nt, Homo sapiens
guagugauuaugcuucuug

SEQ ID NO: 134022 - RNA, 19 nt, Homo sapiens
gcgauucaaugugauucaa

SEQ ID NO: 134023 - RNA, 19 nt, Homo sapiens
gggaauagaaaugaaacaa

SEQ ID NO: 134024 - RNA, 19 nt, Homo sapiens
ucuggagacucaacaugaa

SEQ ID NO: 134025 - RNA, 19 nt, Homo sapiens
ccuaauaguuuucaaggaa

SEQ ID NO: 134026 - RNA, 19 nt, Homo sapiens
gaagacaaaagguuccuaa

SEQ ID NO: 134027 - RNA, 19 nt, Homo sapiens
auggagcagucauuaaauu

SEQ ID NO: 134028 - RNA, 19 nt, Homo sapiens
gacaaaagguuccuaagac

SEQ ID NO: 134029 - RNA, 19 nt, Homo sapiens
uggaacauuugagaaagaa

SEQ ID NO: 134030 - RNA, 19 nt, Homo sapiens
accaagugcuucugccaaa

SEQ ID NO: 134031 - RNA, 19 nt, Homo sapiens
aaacaaugcagcagggaau

SEQ ID NO: 134032 - RNA, 19 nt, Homo sapiens
caccauagaagaacucauc

SEQ ID NO: 134033 - RNA, 19 nt, Homo sapiens
ggagcagugggacaccaua

SEQ ID NO: 134034 - RNA, 19 nt, Homo sapiens
gcuuugcaaucuaaauucu

SEQ ID NO: 134035 - RNA, 19 nt, Homo sapiens
cuggaacauuugagaaaga

SEQ ID NO: 134036 - RNA, 19 nt, Homo sapiens
ccaacuggaacauuugaga

SEQ ID NO: 134037 - RNA, 19 nt, Homo sapiens
cacugaagcuuugcaaucu

SEQ ID NO: 134038 - RNA, 19 nt, Homo sapiens
aaaggaaugacaacucuuc

SEQ ID NO: 134039 - RNA, 19 nt, Homo sapiens
gguaaaggaaugacaacuc

SEQ ID NO: 134040 - RNA, 19 nt, Homo sapiens
gagguacuggccuugguaa

SEQ ID NO: 134041 - RNA, 19 nt, Homo sapiens
gaagcuuugcaaucuaaau

SEQ ID NO: 134042 - RNA, 19 nt, Homo sapiens
uggagcagucauuaaauuu

SEQ ID NO: 134043 - RNA, 19 nt, Homo sapiens
aaaucuugcugcuuuccuu

SEQ ID NO: 134044 - RNA, 19 nt, Homo sapiens
ugaaagcuaccgcagaaca

SEQ ID NO: 134045 - RNA, 19 nt, Homo sapiens
acacugaagcuuugcaauc

SEQ ID NO: 134046 - RNA, 19 nt, Homo sapiens
gccggaagauggauguuuu

SEQ ID NO: 134047 - RNA, 19 nt, Homo sapiens
gugauuaugcuucuuggau

SEQ ID NO: 134048 - RNA, 19 nt, Homo sapiens
guagaagaacucgcaaauc

SEQ ID NO: 134049 - RNA, 19 nt, Homo sapiens
aagaaaugauuggcagaau

SEQ ID NO: 134050 - RNA, 19 nt, Homo sapiens
aaagaaaugauuggcagaa

SEQ ID NO: 134051 - RNA, 19 nt, Homo sapiens
ugccaaagcagguguggaa

SEQ ID NO: 134052 - RNA, 19 nt, Homo sapiens
aaagcgaugcuaccaccua

SEQ ID NO: 134053 - RNA, 19 nt, Homo sapiens
gaugcuaccaccuaauagu

SEQ ID NO: 134054 - RNA, 19 nt, Homo sapiens
gcuuuccuuuguagugauu

SEQ ID NO: 134055 - RNA, 19 nt, Homo sapiens
gcacagaaaggagcagcau

SEQ ID NO: 134056 - RNA, 19 nt, Homo sapiens
cuucgugacacuagaaauu

SEQ ID NO: 134057 - RNA, 19 nt, Homo sapiens
ggaaaaccauaacugacau

SEQ ID NO: 134058 - RNA, 19 nt, Homo sapiens
cuaauuaaagcacagaaag

SEQ ID NO: 134059 - RNA, 19 nt, Homo sapiens
cacuuuggccuucaucuug

SEQ ID NO: 134060 - RNA, 19 nt, Homo sapiens
ccacuuuggccuucaucuu

SEQ ID NO: 134061 - RNA, 19 nt, Homo sapiens
gggagguacuggccuuggu

SEQ ID NO: 134062 - RNA, 19 nt, Homo sapiens
uggcacagccuucgugaca

SEQ ID NO: 134063 - RNA, 19 nt, Homo sapiens
gaaaaccauaacugacaua

SEQ ID NO: 134064 - RNA, 19 nt, Homo sapiens
gcuaccaccuaauaguuuu

SEQ ID NO: 134065 - RNA, 19 nt, Homo sapiens
ugagggauccugauauggu

SEQ ID NO: 134066 - RNA, 19 nt, Homo sapiens
cgucuggacccaacuggaa

SEQ ID NO: 134067 - RNA, 19 nt, Homo sapiens
acugaagcuuugcaaucua

SEQ ID NO: 134068 - RNA, 19 nt, Homo sapiens
ucucucaucuuuugacuau

SEQ ID NO: 134069 - RNA, 19 nt, Homo sapiens
gaggaaguacuuauuucag

SEQ ID NO: 134070 - RNA, 19 nt, Homo sapiens
agaggaaguacuuauuuca

SEQ ID NO: 134071 - RNA, 19 nt, Homo sapiens
uguagaagaacucgcaaau

SEQ ID NO: 134072 - RNA, 19 nt, Homo sapiens
uucaugcaauucaguguga

SEQ ID NO: 134073 - RNA, 19 nt, Homo sapiens
aaacuggaaauaagguuca

SEQ ID NO: 134074 - RNA, 19 nt, Homo sapiens
gugggacaccauagaagaa

SEQ ID NO: 134075 - RNA, 19 nt, Homo sapiens
ggcaagagcugaugagguu

SEQ ID NO: 134076 - RNA, 19 nt, Homo sapiens
ggacaucccagaagugguu

SEQ ID NO: 134077 - RNA, 19 nt, Homo sapiens
cuacagggaauugcuauua

SEQ ID NO: 134078 - RNA, 19 nt, Homo sapiens
ggaagacucugggcauucu

SEQ ID NO: 134079 - RNA, 19 nt, Homo sapiens
ggagaacgucgcuauggaa

SEQ ID NO: 134080 - RNA, 19 nt, Homo sapiens
ucaauuuccuuuccucauc

SEQ ID NO: 134081 - RNA, 19 nt, Homo sapiens
gaacgucgcuauggaaccu

SEQ ID NO: 134082 - RNA, 19 nt, Homo sapiens
aaacauggccugcuauugc

SEQ ID NO: 134083 - RNA, 19 nt, Homo sapiens
gcauucugcugcugagcuu

SEQ ID NO: 134084 - RNA, 19 nt, Homo sapiens
cagcggacaucccagaagu

SEQ ID NO: 134085 - RNA, 19 nt, Homo sapiens
gagcuacagggaauugcua

SEQ ID NO: 134086 - RNA, 19 nt, Homo sapiens
aaauuugcuuugagagcua

SEQ ID NO: 134087 - RNA, 19 nt, Homo sapiens
uguaccuucugcucaauuu

SEQ ID NO: 134088 - RNA, 19 nt, Homo sapiens
uuugagagcuacagggaau

SEQ ID NO: 134089 - RNA, 19 nt, Homo sapiens
cagaauaccagcgugcauu

SEQ ID NO: 134090 - RNA, 19 nt, Homo sapiens
cauccaggcucaaggaaaa

SEQ ID NO: 134091 - RNA, 19 nt, Homo sapiens
ucccagaagugguuguuuc

SEQ ID NO: 134092 - RNA, 19 nt, Homo sapiens
gcaggagaacgucgcuaug

SEQ ID NO: 134093 - RNA, 19 nt, Homo sapiens
gcauccaggcucaaggaaa

SEQ ID NO: 134094 - RNA, 19 nt, Homo sapiens
cuagcuagaggaucuguga

SEQ ID NO: 134095 - RNA, 19 nt, Homo sapiens
aaauaaaugccuugguaca

SEQ ID NO: 134096 - RNA, 19 nt, Homo sapiens
aggagaacgucgcuaugga

SEQ ID NO: 134097 - RNA, 19 nt, Homo sapiens
aauaaaugccuugguacaa

SEQ ID NO: 134098 - RNA, 19 nt, Homo sapiens
uacagggaauugcuauuac

SEQ ID NO: 134099 - RNA, 19 nt, Homo sapiens
gcagauugcagcggacauc

SEQ ID NO: 134100 - RNA, 19 nt, Homo sapiens
gggaagacucugggcauuc

SEQ ID NO: 134101 - RNA, 19 nt, Homo sapiens
gcuauggaaccugcaucua

SEQ ID NO: 134102 - RNA, 19 nt, Homo sapiens
agaauaccagcgugcauug

SEQ ID NO: 134103 - RNA, 19 nt, Homo sapiens
acagggaauugcuauuacu

SEQ ID NO: 134104 - RNA, 19 nt, Homo sapiens
cugccuagcuagaggaucu

SEQ ID NO: 134105 - RNA, 19 nt, Homo sapiens
cgccauccuugcugccauu

SEQ ID NO: 134106 - RNA, 19 nt, Homo sapiens
gcagaauaccagcgugcau

SEQ ID NO: 134107 - RNA, 19 nt, Homo sapiens
cauccuugcugccauucuc

SEQ ID NO: 134108 - RNA, 19 nt, Homo sapiens
ggcaagagcugaugagguu

SEQ ID NO: 134109 - RNA, 19 nt, Homo sapiens
ggacaucccagaagugguu

SEQ ID NO: 134110 - RNA, 19 nt, Homo sapiens
cuacagggaauugcuauua

SEQ ID NO: 134111 - RNA, 19 nt, Homo sapiens
ggaagacucugggcauucu

SEQ ID NO: 134112 - RNA, 19 nt, Homo sapiens
ggagaacgucgcuauggaa

SEQ ID NO: 134113 - RNA, 19 nt, Homo sapiens
ucaauuuccuuuccucauc

SEQ ID NO: 134114 - RNA, 19 nt, Homo sapiens
gaacgucgcuauggaaccu

SEQ ID NO: 134115 - RNA, 19 nt, Homo sapiens
gcauucugcugcugagcuu

SEQ ID NO: 134116 - RNA, 19 nt, Homo sapiens
cagcggacaucccagaagu

SEQ ID NO: 134117 - RNA, 19 nt, Homo sapiens
gagcuacagggaauugcua

SEQ ID NO: 134118 - RNA, 19 nt, Homo sapiens
aaauuugcuuugagagcua

SEQ ID NO: 134119 - RNA, 19 nt, Homo sapiens
uguaccuucugcucaauuu

SEQ ID NO: 134120 - RNA, 19 nt, Homo sapiens
aaacauggacugcuauugc

SEQ ID NO: 134121 - RNA, 19 nt, Homo sapiens
uuugagagcuacagggaau

SEQ ID NO: 134122 - RNA, 19 nt, Homo sapiens
cagaauaccagcgugcauu

SEQ ID NO: 134123 - RNA, 19 nt, Homo sapiens
cauccaggcucaaggaaaa

SEQ ID NO: 134124 - RNA, 19 nt, Homo sapiens
ucccagaagugguuguuuc

SEQ ID NO: 134125 - RNA, 19 nt, Homo sapiens
caauuuccuuuccucaucu

SEQ ID NO: 134126 - RNA, 19 nt, Homo sapiens
gcaggagaacgucgcuaug

SEQ ID NO: 134127 - RNA, 19 nt, Homo sapiens
gcauccaggcucaaggaaa

SEQ ID NO: 134128 - RNA, 19 nt, Homo sapiens
caaauaaaugccuuguuac

SEQ ID NO: 134129 - RNA, 19 nt, Homo sapiens
cuagcuagaggaucuguga

SEQ ID NO: 134130 - RNA, 19 nt, Homo sapiens
aggagaacgucgcuaugga

SEQ ID NO: 134131 - RNA, 19 nt, Homo sapiens
uacagggaauugcuauuac

SEQ ID NO: 134132 - RNA, 19 nt, Homo sapiens
gcagauugcagcggacauc

SEQ ID NO: 134133 - RNA, 19 nt, Homo sapiens
gggaagacucugggcauuc

SEQ ID NO: 134134 - RNA, 19 nt, Homo sapiens
gcuauggaaccugcaucua

SEQ ID NO: 134135 - RNA, 19 nt, Homo sapiens
agaauaccagcgugcauug

SEQ ID NO: 134136 - RNA, 19 nt, Homo sapiens
ccuuuccucaucucaaaua

SEQ ID NO: 134137 - RNA, 19 nt, Homo sapiens
uuccuuuccucaucucaaa

SEQ ID NO: 134138 - RNA, 19 nt, Homo sapiens
acagggaauugcuauuacu

SEQ ID NO: 134139 - RNA, 19 nt, Homo sapiens
cugccuagcuagaggaucu

SEQ ID NO: 134140 - RNA, 19 nt, Homo sapiens
aacauggacugcuauugca

SEQ ID NO: 134141 - RNA, 19 nt, Homo sapiens
cgccauccuugcugccauu

SEQ ID NO: 134142 - RNA, 19 nt, Homo sapiens
gcagaauaccagcgugcau

SEQ ID NO: 134143 - RNA, 19 nt, Homo sapiens
cauccuugcugccauucuc

SEQ ID NO: 134144 - RNA, 19 nt, Homo sapiens
ggacauaucuauuuccuuu

SEQ ID NO: 134145 - RNA, 19 nt, Homo sapiens
gaccaggacauaucuauuu

SEQ ID NO: 134146 - RNA, 19 nt, Homo sapiens
guugggaacugccucauug

SEQ ID NO: 134147 - RNA, 19 nt, Homo sapiens
gauaaaagcucugcucuuc

SEQ ID NO: 134148 - RNA, 19 nt, Homo sapiens
gcucugcucuucagguuuc

SEQ ID NO: 134149 - RNA, 19 nt, Homo sapiens
gguguuagcuucacaugcu

SEQ ID NO: 134150 - RNA, 19 nt, Homo sapiens
cuuaacaucuuucuugauc

SEQ ID NO: 134151 - RNA, 19 nt, Homo sapiens
gcugcacgcgugucgauua

SEQ ID NO: 134152 - RNA, 19 nt, Homo sapiens
uaauuugcuuugagagcua

SEQ ID NO: 134153 - RNA, 19 nt, Homo sapiens
gccagaagaccaggacaua

SEQ ID NO: 134154 - RNA, 19 nt, Homo sapiens
uuugagagcuacaggaaau

SEQ ID NO: 134155 - RNA, 19 nt, Homo sapiens
gguuguuucuccuauacuu

SEQ ID NO: 134156 - RNA, 19 nt, Homo sapiens
gagcucauaauuugcuuug

SEQ ID NO: 134157 - RNA, 19 nt, Homo sapiens
cagaagaccaggacauauc

SEQ ID NO: 134158 - RNA, 19 nt, Homo sapiens
guccuuaacaucuuucuug

SEQ ID NO: 134159 - RNA, 19 nt, Homo sapiens
gaagaccaggacauaucua

SEQ ID NO: 134160 - RNA, 19 nt, Homo sapiens
caucaucggugguguuagc

SEQ ID NO: 134161 - RNA, 19 nt, Homo sapiens
gcacgcgugucgauuaacg

SEQ ID NO: 134162 - RNA, 19 nt, Homo sapiens
cugcacgcgugucgauuaa

SEQ ID NO: 134163 - RNA, 19 nt, Homo sapiens
caucuuucuugauccuaaa

SEQ ID NO: 134164 - RNA, 19 nt, Homo sapiens
gccaucaucggugguguua

SEQ ID NO: 134165 - RNA, 19 nt, Homo sapiens
ggcauggucugcucuugca

SEQ ID NO: 134166 - RNA, 19 nt, Homo sapiens
uaacaucuuucuugauccu

SEQ ID NO: 134167 - RNA, 19 nt, Homo sapiens
aaugguuguuucuccuaua

SEQ ID NO: 134168 - RNA, 19 nt, Homo sapiens
cugccuagcuugaggaucu

SEQ ID NO: 134169 - RNA, 19 nt, Homo sapiens
acaucuuucuugauccuaa

SEQ ID NO: 134170 - RNA, 19 nt, Homo sapiens
aagcucugcucuucagguu

SEQ ID NO: 134171 - RNA, 19 nt, Homo sapiens
cuacaggaaaugguuguuu

SEQ ID NO: 134172 - RNA, 19 nt, Homo sapiens
ccucgcugcuauucucuug

SEQ ID NO: 134173 - RNA, 19 nt, Homo sapiens
uccuauacuuuguccuuaa

SEQ ID NO: 134174 - RNA, 19 nt, Homo sapiens
gcuuugagagcuacaggaa

SEQ ID NO: 134175 - RNA, 19 nt, Homo sapiens
gagcuugcagaauagagaa

SEQ ID NO: 134176 - RNA, 19 nt, Homo sapiens
aaaugguuguuucuccuau

SEQ ID NO: 134177 - RNA, 19 nt, Homo sapiens
ccagaagaccaggacauau

SEQ ID NO: 134178 - RNA, 19 nt, Homo sapiens
cuccuauacuuuguccuua

SEQ ID NO: 134179 - RNA, 19 nt, Homo sapiens
gcgugucgauuaacguucu

SEQ ID NO: 134180 - RNA, 19 nt, Homo sapiens
uaaaagcucugcucuucag

SEQ ID NO: 134181 - RNA, 19 nt, Homo sapiens
acauaucuauuuccuuugc

SEQ ID NO: 134182 - RNA, 19 nt, Homo sapiens
uuaacguucugcuguccaa

SEQ ID NO: 134183 - RNA, 19 nt, Homo sapiens
uccuuaacaucuuucuuga

SEQ ID NO: 134184 - RNA, 19 nt, Homo sapiens
gcucuugcagauuaguauu

SEQ ID NO: 134185 - RNA, 19 nt, Homo sapiens
ccuccucgcugcuauucuc

SEQ ID NO: 134186 - RNA, 19 nt, Homo sapiens
ucauugguggugugaguuu

SEQ ID NO: 134187 - RNA, 19 nt, Homo sapiens
accaggacauaucuauuuc

SEQ ID NO: 134188 - RNA, 19 nt, Homo sapiens
ucgcugagcuuccuagaua

SEQ ID NO: 134189 - RNA, 19 nt, Homo sapiens
ggaccuugcuaucuccuuu

SEQ ID NO: 134190 - RNA, 19 nt, Homo sapiens
ccaaagcagugcaagauuc

SEQ ID NO: 134191 - RNA, 19 nt, Homo sapiens
cuaaauuucucucuccaaa

SEQ ID NO: 134192 - RNA, 19 nt, Homo sapiens
ccuugugucuuucuaaauu

SEQ ID NO: 134193 - RNA, 19 nt, Homo sapiens
gcaagagccaccugcuauu

SEQ ID NO: 134194 - RNA, 19 nt, Homo sapiens
aauggacucucugcucuua

SEQ ID NO: 134195 - RNA, 19 nt, Homo sapiens
cuguguaccuugugucuuu

SEQ ID NO: 134196 - RNA, 19 nt, Homo sapiens
ggcaagagccaccugcuau

SEQ ID NO: 134197 - RNA, 19 nt, Homo sapiens
caagagccaccugcuauug

SEQ ID NO: 134198 - RNA, 19 nt, Homo sapiens
uaccuugugucuuucuaaa

SEQ ID NO: 134199 - RNA, 19 nt, Homo sapiens
caaagcagugcaagauuca

SEQ ID NO: 134200 - RNA, 19 nt, Homo sapiens
gcaagauucaguucaaggu

SEQ ID NO: 134201 - RNA, 19 nt, Homo sapiens
ugagcuuccuagauagaaa

SEQ ID NO: 134202 - RNA, 19 nt, Homo sapiens
uggacucucugcucuuaga

SEQ ID NO: 134203 - RNA, 19 nt, Homo sapiens
guaccuugugucuuucuaa

SEQ ID NO: 134204 - RNA, 19 nt, Homo sapiens
ggaagacaaccaggaccuu

SEQ ID NO: 134205 - RNA, 19 nt, Homo sapiens
caaccaggaccuugcuauc

SEQ ID NO: 134206 - RNA, 19 nt, Homo sapiens
gcagugcaagauucaguuc

SEQ ID NO: 134207 - RNA, 19 nt, Homo sapiens
aaaccaaagcagugcaaga

SEQ ID NO: 134208 - RNA, 19 nt, Homo sapiens
cuuccuagauagaaaccaa

SEQ ID NO: 134209 - RNA, 19 nt, Homo sapiens
agugcaagauucaguucaa

SEQ ID NO: 134210 - RNA, 19 nt, Homo sapiens
gcugagcuuccuagauaga

SEQ ID NO: 134211 - RNA, 19 nt, Homo sapiens
cuagauagaaaccaaagca

SEQ ID NO: 134212 - RNA, 19 nt, Homo sapiens
gagcugaugaggcuacaac

SEQ ID NO: 134213 - RNA, 19 nt, Homo sapiens
cgccauccuugcugccauu

SEQ ID NO: 134214 - RNA, 19 nt, Homo sapiens
cauccuugcugccauucuc

SEQ ID NO: 134215 - RNA, 19 nt, Homo sapiens
gugcaagauucaguucaag

SEQ ID NO: 134216 - RNA, 19 nt, Homo sapiens
ggacucucugcucuuagaa

SEQ ID NO: 134217 - RNA, 19 nt, Homo sapiens
gaugcaagcucaagucuua

SEQ ID NO: 134218 - RNA, 19 nt, Homo sapiens
gaaggaaacugucgugugu

SEQ ID NO: 134219 - RNA, 19 nt, Homo sapiens
gagaacagagagaaauaua

SEQ ID NO: 134220 - RNA, 19 nt, Homo sapiens
ggacuuugccgucuccuuu

SEQ ID NO: 134221 - RNA, 19 nt, Homo sapiens
gcacugucauggguauuaa

SEQ ID NO: 134222 - RNA, 19 nt, Homo sapiens
uaugggaccugcacuguca

SEQ ID NO: 134223 - RNA, 19 nt, Homo sapiens
caacagaauauuccuaugg

SEQ ID NO: 134224 - RNA, 19 nt, Homo sapiens
ugcagaagguccuguuauu

SEQ ID NO: 134225 - RNA, 19 nt, Homo sapiens
cagaagguccuguuauuca

SEQ ID NO: 134226 - RNA, 19 nt, Homo sapiens
caacuuuguuuccucaucu

SEQ ID NO: 134227 - RNA, 19 nt, Homo sapiens
gcagaagguccuguuauuc

SEQ ID NO: 134228 - RNA, 19 nt, Homo sapiens
gaugagaacagagagaaau

SEQ ID NO: 134229 - RNA, 19 nt, Homo sapiens
auacauugccaucaacuuu

SEQ ID NO: 134230 - RNA, 19 nt, Homo sapiens
uuuaugaccuagaaggaaa

SEQ ID NO: 134231 - RNA, 19 nt, Homo sapiens
agaagguccuguuauucaa

SEQ ID NO: 134232 - RNA, 19 nt, Homo sapiens
caucucaaauaaaguccuu

SEQ ID NO: 134233 - RNA, 19 nt, Homo sapiens
gguauuaaccacagauucu

SEQ ID NO: 134234 - RNA, 19 nt, Homo sapiens
ucccauacauugccaucaa

SEQ ID NO: 134235 - RNA, 19 nt, Homo sapiens
ggaugagaacagagagaaa

SEQ ID NO: 134236 - RNA, 19 nt, Homo sapiens
gggcaaaugaccaggacuu

SEQ ID NO: 134237 - RNA, 19 nt, Homo sapiens
gggaugagaacagagagaa

SEQ ID NO: 134238 - RNA, 19 nt, Homo sapiens
ucaacagaauauuccuaug

SEQ ID NO: 134239 - RNA, 19 nt, Homo sapiens
ugaccuagaaggaaacugu

SEQ ID NO: 134240 - RNA, 19 nt, Homo sapiens
ggcaaaugaccaggacuuu

SEQ ID NO: 134241 - RNA, 19 nt, Homo sapiens
acauugccaucaacuuugu

SEQ ID NO: 134242 - RNA, 19 nt, Homo sapiens
ucaacaagggcuuucacuu

SEQ ID NO: 134243 - RNA, 19 nt, Homo sapiens
uuccucaucucaaauaaag

SEQ ID NO: 134244 - RNA, 19 nt, Homo sapiens
ucaacuuuguuuccucauc

SEQ ID NO: 134245 - RNA, 19 nt, Homo sapiens
ccagcgacccuagccauga

SEQ ID NO: 134246 - RNA, 19 nt, Homo sapiens
ugagaacagagagaaauau

SEQ ID NO: 134247 - RNA, 19 nt, Homo sapiens
ugagggaugagaacagaga

SEQ ID NO: 134248 - RNA, 19 nt, Homo sapiens
cauccucacugcuguucuc

SEQ ID NO: 134249 - RNA, 19 nt, Homo sapiens
gaggaugcaagcucaaguc

SEQ ID NO: 134250 - RNA, 19 nt, Homo sapiens
guuuccucaucucaaauaa

SEQ ID NO: 134251 - RNA, 19 nt, Homo sapiens
gaagguccuguuauucaac

SEQ ID NO: 134252 - RNA, 19 nt, Homo sapiens
cagcgacccuagccaugag

SEQ ID NO: 134253 - RNA, 19 nt, Homo sapiens
ugucgugugucccauacau

SEQ ID NO: 134254 - RNA, 19 nt, Homo sapiens
acuccaagcugaggaugau

SEQ ID NO: 134255 - RNA, 19 nt, Homo sapiens
ggaugcaagcucaagucuu

SEQ ID NO: 134256 - RNA, 19 nt, Homo sapiens
cagaagaaaugacgcagaa

SEQ ID NO: 134257 - RNA, 19 nt, Homo sapiens
gcuguuuacucucugcuua

SEQ ID NO: 134258 - RNA, 19 nt, Homo sapiens
gagauggccucagguggua

SEQ ID NO: 134259 - RNA, 19 nt, Homo sapiens
caugagaacuuccuaccuu

SEQ ID NO: 134260 - RNA, 19 nt, Homo sapiens
ggagugaccagaagaaaug

SEQ ID NO: 134261 - RNA, 19 nt, Homo sapiens
ggagggcaaugucucuauu

SEQ ID NO: 134262 - RNA, 19 nt, Homo sapiens
ggccucaggugguaacuuu

SEQ ID NO: 134263 - RNA, 19 nt, Homo sapiens
gaaaugacgcagaagugaa

SEQ ID NO: 134264 - RNA, 19 nt, Homo sapiens
gaagaaaugacgcagaagu

SEQ ID NO: 134265 - RNA, 19 nt, Homo sapiens
ccugaaauccugaguguug

SEQ ID NO: 134266 - RNA, 19 nt, Homo sapiens
uuuacucucugcuuacuuu

SEQ ID NO: 134267 - RNA, 19 nt, Homo sapiens
cagcucagccuccaaagga

SEQ ID NO: 134268 - RNA, 19 nt, Homo sapiens
gcaagugagcugggaguga

SEQ ID NO: 134269 - RNA, 19 nt, Homo sapiens
aaaugacgcagaagugaaa

SEQ ID NO: 134270 - RNA, 19 nt, Homo sapiens
aaauucaaggcaccuguua

SEQ ID NO: 134271 - RNA, 19 nt, Homo sapiens
ggccaagugcugcaaguga

SEQ ID NO: 134272 - RNA, 19 nt, Homo sapiens
ugacgcagaagugaaauga

SEQ ID NO: 134273 - RNA, 19 nt, Homo sapiens
agaaaugacgcagaaguga

SEQ ID NO: 134274 - RNA, 19 nt, Homo sapiens
gggagugaccagaagaaau

SEQ ID NO: 134275 - RNA, 19 nt, Homo sapiens
cuuccuaccuucugcuguu

SEQ ID NO: 134276 - RNA, 19 nt, Homo sapiens
acgcagaagugaaaugaac

SEQ ID NO: 134277 - RNA, 19 nt, Homo sapiens
gagggcaaugucucuauuc

SEQ ID NO: 134278 - RNA, 19 nt, Homo sapiens
aagaaaugacgcagaagug

SEQ ID NO: 134279 - RNA, 19 nt, Homo sapiens
uuccugaaauccugagugu

SEQ ID NO: 134280 - RNA, 19 nt, Homo sapiens
cgacauguaaaccaaauua

SEQ ID NO: 134281 - RNA, 19 nt, Homo sapiens
ccuagaagguauaaacaaa

SEQ ID NO: 134282 - RNA, 19 nt, Homo sapiens
aaacuaugguguccaaaga

SEQ ID NO: 134283 - RNA, 19 nt, Homo sapiens
gguauaggcgauccuguua

SEQ ID NO: 134284 - RNA, 19 nt, Homo sapiens
ccuguuaccugccuuaaga

SEQ ID NO: 134285 - RNA, 19 nt, Homo sapiens
ggaacaaaaugcugcaaaa

SEQ ID NO: 134286 - RNA, 19 nt, Homo sapiens
cauaugucauccagucuuu

SEQ ID NO: 134287 - RNA, 19 nt, Homo sapiens
ggucuuguaucuccucuuc

SEQ ID NO: 134288 - RNA, 19 nt, Homo sapiens
acuaugguguccaaagaua

SEQ ID NO: 134289 - RNA, 19 nt, Homo sapiens
gaagguauaaacaaauugg

SEQ ID NO: 134290 - RNA, 19 nt, Homo sapiens
ucucguuccucuucauauu

SEQ ID NO: 134291 - RNA, 19 nt, Homo sapiens
ccaugagggucuuguaucu

SEQ ID NO: 134292 - RNA, 19 nt, Homo sapiens
ucagagacgugcgacaugu

SEQ ID NO: 134293 - RNA, 19 nt, Homo sapiens
ccuuaagaguggagccaua

SEQ ID NO: 134294 - RNA, 19 nt, Homo sapiens
gccaugaggaggccaagaa

SEQ ID NO: 134295 - RNA, 19 nt, Homo sapiens
uaagaguggagccauaugu

SEQ ID NO: 134296 - RNA, 19 nt, Homo sapiens
gauccuguuaccugccuua

SEQ ID NO: 134297 - RNA, 19 nt, Homo sapiens
agagacgugcgacauguaa

SEQ ID NO: 134298 - RNA, 19 nt, Homo sapiens
uaaacuaugguguccaaag

SEQ ID NO: 134299 - RNA, 19 nt, Homo sapiens
cagagacgugcgacaugua

SEQ ID NO: 134300 - RNA, 19 nt, Homo sapiens
auuaaacuaugguguccaa

SEQ ID NO: 134301 - RNA, 19 nt, Homo sapiens
cgugcgacauguaaaccaa

SEQ ID NO: 134302 - RNA, 19 nt, Homo sapiens
caucagccaugagggucuu

SEQ ID NO: 134303 - RNA, 19 nt, Homo sapiens
uguaucuccucuucucguu

SEQ ID NO: 134304 - RNA, 19 nt, Homo sapiens
gagacgugcgacauguaaa

SEQ ID NO: 134305 - RNA, 19 nt, Homo sapiens
gugaagcucccagccauca

SEQ ID NO: 134306 - RNA, 19 nt, Homo sapiens
caucagagacgugcgacau

SEQ ID NO: 134307 - RNA, 19 nt, Homo sapiens
ugaugcggauucagaaagg

SEQ ID NO: 134308 - RNA, 19 nt, Homo sapiens
gaguggagccauaugucau

SEQ ID NO: 134309 - RNA, 19 nt, Homo sapiens
ggaauuggaggaccgauuu

SEQ ID NO: 134310 - RNA, 19 nt, Homo sapiens
auaaagagauucacacaca

SEQ ID NO: 134311 - RNA, 19 nt, Homo sapiens
gaggagagccggaucaauc

SEQ ID NO: 134312 - RNA, 19 nt, Homo sapiens
ccacacagcagcagcauga

SEQ ID NO: 134313 - RNA, 19 nt, Homo sapiens
gcccucaacuuccgagaaa

SEQ ID NO: 134314 - RNA, 19 nt, Homo sapiens
uuaagaaagugcaugaaga

SEQ ID NO: 134315 - RNA, 19 nt, Homo sapiens
gagaucgcguuccuuaaga

SEQ ID NO: 134316 - RNA, 19 nt, Homo sapiens
ggaagaagcagagaacaau

SEQ ID NO: 134317 - RNA, 19 nt, Homo sapiens
guucugagguccauaccaa

SEQ ID NO: 134318 - RNA, 19 nt, Homo sapiens
gagagaaacaauaaagaga

SEQ ID NO: 134319 - RNA, 19 nt, Homo sapiens
gaagagaggagaggagaga

SEQ ID NO: 134320 - RNA, 19 nt, Homo sapiens
gaaaccagcccugagcaaa

SEQ ID NO: 134321 - RNA, 19 nt, Homo sapiens
agcaggagaugauggaaua

SEQ ID NO: 134322 - RNA, 19 nt, Homo sapiens
gaagaagcagagaacaauu

SEQ ID NO: 134323 - RNA, 19 nt, Homo sapiens
gaagauggcccuggaugug

SEQ ID NO: 134324 - RNA, 19 nt, Homo sapiens
uaaagagauucacacacaa

SEQ ID NO: 134325 - RNA, 19 nt, Homo sapiens
gacaccagauccaguccua

SEQ ID NO: 134326 - RNA, 19 nt, Homo sapiens
ggagaucgcguuccuuaag

SEQ ID NO: 134327 - RNA, 19 nt, Homo sapiens
ggagagaaacaauaaagag

SEQ ID NO: 134328 - RNA, 19 nt, Homo sapiens
ggugggagcaggagauuga

SEQ ID NO: 134329 - RNA, 19 nt, Homo sapiens
ggacguggaugcagcuacu

SEQ ID NO: 134330 - RNA, 19 nt, Homo sapiens
gagagaaagugggugagau

SEQ ID NO: 134331 - RNA, 19 nt, Homo sapiens
gcaugaagugcucuaaaga

SEQ ID NO: 134332 - RNA, 19 nt, Homo sapiens
ccaagaagacggugaugau

SEQ ID NO: 134333 - RNA, 19 nt, Homo sapiens
gaaggaagaagcagagaac

SEQ ID NO: 134334 - RNA, 19 nt, Homo sapiens
gaucaagaccaucgagaca

SEQ ID NO: 134335 - RNA, 19 nt, Homo sapiens
agagcaggguguugggaua

SEQ ID NO: 134336 - RNA, 19 nt, Homo sapiens
gaccucaggccuacgcuuu

SEQ ID NO: 134337 - RNA, 19 nt, Homo sapiens
caggcgagcugcuggacuu

SEQ ID NO: 134338 - RNA, 19 nt, Homo sapiens
aagaagcagagaacaauuu

SEQ ID NO: 134339 - RNA, 19 nt, Homo sapiens
ugggugagaugcuggagaa

SEQ ID NO: 134340 - RNA, 19 nt, Homo sapiens
gcugaggagugguacaagu

SEQ ID NO: 134341 - RNA, 19 nt, Homo sapiens
gaccuacucugcccucaac

SEQ ID NO: 134342 - RNA, 19 nt, Homo sapiens
ugaggcagaugcgggaauu

SEQ ID NO: 134343 - RNA, 19 nt, Homo sapiens
caaucuacauggagaaggu

SEQ ID NO: 134344 - RNA, 19 nt, Homo sapiens
gaccuggagcgcagaauug

SEQ ID NO: 134345 - RNA, 19 nt, Homo sapiens
gcaggaggagauucaguug

SEQ ID NO: 134346 - RNA, 19 nt, Homo sapiens
ggagagaaagugggugaga

SEQ ID NO: 134347 - RNA, 19 nt, Homo sapiens
agagaaagccaggcaggua

SEQ ID NO: 134348 - RNA, 19 nt, Homo sapiens
caucgcggcuaagaacauu

SEQ ID NO: 134349 - RNA, 19 nt, Homo sapiens
aagaggagauccgugaguu

SEQ ID NO: 134350 - RNA, 19 nt, Homo sapiens
gaagaggagauccgugagu

SEQ ID NO: 134351 - RNA, 19 nt, Homo sapiens
caauaaagagauucacaca

SEQ ID NO: 134352 - RNA, 19 nt, Homo sapiens
gugagaugcuggagaagag

SEQ ID NO: 134353 - RNA, 19 nt, Homo sapiens
agguggaggugcucacuaa

SEQ ID NO: 134354 - RNA, 19 nt, Homo sapiens
ggaaauccggcaccucaag

SEQ ID NO: 134355 - RNA, 19 nt, Homo sapiens
gcacuaacgauucccugau

SEQ ID NO: 134356 - RNA, 19 nt, Homo sapiens
uaagaaagugcaugaagag

SEQ ID NO: 134357 - RNA, 19 nt, Homo sapiens
agcaggagauugagaagga

SEQ ID NO: 134358 - RNA, 19 nt, Homo sapiens
cacuaacgauucccugaug

SEQ ID NO: 134359 - RNA, 19 nt, Homo sapiens
ggauauccgggcucaguau

SEQ ID NO: 134360 - RNA, 19 nt, Homo sapiens
aggcucagcuucaggaaca

SEQ ID NO: 134361 - RNA, 19 nt, Homo sapiens
ucaaugaccguucgccaau

SEQ ID NO: 134362 - RNA, 19 nt, Homo sapiens
ggagaggagagccggauca

SEQ ID NO: 134363 - RNA, 19 nt, Homo sapiens
ggaauaccgacaccagauc

SEQ ID NO: 134364 - RNA, 19 nt, Homo sapiens
gaucgcguuccuuaagaaa

SEQ ID NO: 134365 - RNA, 19 nt, Homo sapiens
gggagcaggagauugagaa

SEQ ID NO: 134366 - RNA, 19 nt, Homo sapiens
cgcuuuggcucuggagaua

SEQ ID NO: 134367 - RNA, 19 nt, Homo sapiens
gaauuggaggaccgauuug

SEQ ID NO: 134368 - RNA, 19 nt, Homo sapiens
ucaagggcacuaacgauuc

SEQ ID NO: 134369 - RNA, 19 nt, Homo sapiens
gggauauccgggcucagua

SEQ ID NO: 134370 - RNA, 19 nt, Homo sapiens
agauugagaaggagagaaa

SEQ ID NO: 134371 - RNA, 19 nt, Homo sapiens
gaaagcaggggcuacaaga

SEQ ID NO: 134372 - RNA, 19 nt, Homo sapiens
cagccucaguccuccaaau

SEQ ID NO: 134373 - RNA, 19 nt, Homo sapiens
gaccaucgcggcuaagaac

SEQ ID NO: 134374 - RNA, 19 nt, Homo sapiens
ucgcguuccuuaagaaagu

SEQ ID NO: 134375 - RNA, 19 nt, Homo sapiens
ggugagaugcuggagaaga

SEQ ID NO: 134376 - RNA, 19 nt, Homo sapiens
ggcccuggauguggagauu

SEQ ID NO: 134377 - RNA, 19 nt, Homo sapiens
caagggcacuaacgauucc

SEQ ID NO: 134378 - RNA, 19 nt, Homo sapiens
ccaagcaggagaugaugga

SEQ ID NO: 134379 - RNA, 19 nt, Homo sapiens
caagaagacggugaugauc

SEQ ID NO: 134380 - RNA, 19 nt, Homo sapiens
gggaauuggaggaccgauu

SEQ ID NO: 134381 - RNA, 19 nt, Homo sapiens
guccuacaccugcgagauu

SEQ ID NO: 134382 - RNA, 19 nt, Homo sapiens
guacaagucgaagguguca

SEQ ID NO: 134383 - RNA, 19 nt, Homo sapiens
gagauggacaugucuaagc

SEQ ID NO: 134384 - RNA, 19 nt, Homo sapiens
agaagcagagaacaauuug

SEQ ID NO: 134385 - RNA, 19 nt, Homo sapiens
guucgccaaucuacaugga

SEQ ID NO: 134386 - RNA, 19 nt, Homo sapiens
agagaaagugggugagaug

SEQ ID NO: 134387 - RNA, 19 nt, Homo sapiens
gagaggagagccggaucaa

SEQ ID NO: 134388 - RNA, 19 nt, Homo sapiens
uccggcaccucaaggauga

SEQ ID NO: 134389 - RNA, 19 nt, Homo sapiens
ggaggugggagcaggagau

SEQ ID NO: 134390 - RNA, 19 nt, Homo sapiens
gcccaggguggacuuagaa

SEQ ID NO: 134391 - RNA, 19 nt, Homo sapiens
ugaaggaagaagcagagaa

SEQ ID NO: 134392 - RNA, 19 nt, Homo sapiens
acuaacgauucccugauga

SEQ ID NO: 134393 - RNA, 19 nt, Homo sapiens
acaagucgaaggugucaga

SEQ ID NO: 134394 - RNA, 19 nt, Homo sapiens
agaucgcguuccuuaagaa

SEQ ID NO: 134395 - RNA, 19 nt, Homo sapiens
gagaggagagaggcagaga

SEQ ID NO: 134396 - RNA, 19 nt, Homo sapiens
ugaccuggagcgcagaauu

SEQ ID NO: 134397 - RNA, 19 nt, Homo sapiens
gcaggguguugggauacug

SEQ ID NO: 134398 - RNA, 19 nt, Homo sapiens
gauauccgggcucaguaug

SEQ ID NO: 134399 - RNA, 19 nt, Homo sapiens
caaugaccguucgccaauc

SEQ ID NO: 134400 - RNA, 19 nt, Homo sapiens
gagaccaucgcggcuaaga

SEQ ID NO: 134401 - RNA, 19 nt, Homo sapiens
gaggugggagcaggagauu

SEQ ID NO: 134402 - RNA, 19 nt, Homo sapiens
gcgagcugcuggacuucuc

SEQ ID NO: 134403 - RNA, 19 nt, Homo sapiens
cccguggucucuuacuuuc

SEQ ID NO: 134404 - RNA, 19 nt, Homo sapiens
ugagguccauaccaagaag

SEQ ID NO: 134405 - RNA, 19 nt, Homo sapiens
cuacucugcccucaacuuc

SEQ ID NO: 134406 - RNA, 19 nt, Homo sapiens
ugaagauggcccuggaugu

SEQ ID NO: 134407 - RNA, 19 nt, Homo sapiens
uggaggugcucacuaacca

SEQ ID NO: 134408 - RNA, 19 nt, Homo sapiens
aaaccagcccugagcaaag

SEQ ID NO: 134409 - RNA, 19 nt, Homo sapiens
gacuccaucucuacaaaua

SEQ ID NO: 134410 - RNA, 19 nt, Homo sapiens
gcaacaaagucccgagcaa

SEQ ID NO: 134411 - RNA, 19 nt, Homo sapiens
gcgacuccaucucuacaaa

SEQ ID NO: 134412 - RNA, 19 nt, Homo sapiens
ggaggugggugcuuguagu

SEQ ID NO: 134413 - RNA, 19 nt, Homo sapiens
gcaucugguuggucuuuau

SEQ ID NO: 134414 - RNA, 19 nt, Homo sapiens
gcagugaguugugauugca

SEQ ID NO: 134415 - RNA, 19 nt, Homo sapiens
cauuggaucucaggaguug

SEQ ID NO: 134416 - RNA, 19 nt, Homo sapiens
cuccaucucuacaaauaaa

SEQ ID NO: 134417 - RNA, 19 nt, Homo sapiens
uuauugagcaccuacuaua

SEQ ID NO: 134418 - RNA, 19 nt, Homo sapiens
caacaaagucccgagcaau

SEQ ID NO: 134419 - RNA, 19 nt, Homo sapiens
gaucagcaugggccacgua

SEQ ID NO: 134420 - RNA, 19 nt, Homo sapiens
gcaccuacuauaugcagaa

SEQ ID NO: 134421 - RNA, 19 nt, Homo sapiens
caaagucccgagcaaugaa

SEQ ID NO: 134422 - RNA, 19 nt, Homo sapiens
gaggugggaggaugacuug

SEQ ID NO: 134423 - RNA, 19 nt, Homo sapiens
uagcgcgacuccaucucua

SEQ ID NO: 134424 - RNA, 19 nt, Homo sapiens
ggugggaggaugacuugaa

SEQ ID NO: 134425 - RNA, 19 nt, Homo sapiens
ccacguagcgcgacuccau

SEQ ID NO: 134426 - RNA, 19 nt, Homo sapiens
ucugguuggucuuuauuga

SEQ ID NO: 134427 - RNA, 19 nt, Homo sapiens
acaaagucccgagcaauga

SEQ ID NO: 134428 - RNA, 19 nt, Homo sapiens
cgaggugggaggaucauug

SEQ ID NO: 134429 - RNA, 19 nt, Homo sapiens
gaggugggugcuuguaguu

SEQ ID NO: 134430 - RNA, 19 nt, Homo sapiens
ugcuacagcugucggagaa

SEQ ID NO: 134431 - RNA, 19 nt, Homo sapiens
ucaccgagcgcuugaugug

SEQ ID NO: 134432 - RNA, 19 nt, Homo sapiens
ggcugaggcugcagugagu

SEQ ID NO: 134433 - RNA, 19 nt, Homo sapiens
uggcgucggugcagcugaa

SEQ ID NO: 134434 - RNA, 19 nt, Homo sapiens
ggucuuuauugagcaccua

SEQ ID NO: 134435 - RNA, 19 nt, Homo sapiens
gugggaggaugacuugaac

SEQ ID NO: 134436 - RNA, 19 nt, Homo sapiens
ggugggaggaucauuggau

SEQ ID NO: 134437 - RNA, 19 nt, Homo sapiens
aacaaagucccgagcaaug

SEQ ID NO: 134438 - RNA, 19 nt, Homo sapiens
caucugguuggucuuuauu

SEQ ID NO: 134439 - RNA, 19 nt, Homo sapiens
uauugagcaccuacuauau

SEQ ID NO: 134440 - RNA, 19 nt, Homo sapiens
gaagaucuguccagcauca

SEQ ID NO: 134441 - RNA, 19 nt, Homo sapiens
gaaacccugucucuacuaa

SEQ ID NO: 134442 - RNA, 19 nt, Homo sapiens
gaaaugggcauacaacaau

SEQ ID NO: 134443 - RNA, 19 nt, Homo sapiens
gagcaaggccugugacauu

SEQ ID NO: 134444 - RNA, 19 nt, Homo sapiens
ccaggcagcugaaagaaga

SEQ ID NO: 134445 - RNA, 19 nt, Homo sapiens
gagcuuaucuagucaggau

SEQ ID NO: 134446 - RNA, 19 nt, Homo sapiens
ugauauagcugcaccaaca

SEQ ID NO: 134447 - RNA, 19 nt, Homo sapiens
cauaugauguucucuguuc

SEQ ID NO: 134448 - RNA, 19 nt, Homo sapiens
ccaagaguccuuugaugua

SEQ ID NO: 134449 - RNA, 19 nt, Homo sapiens
ggagguacagcuuggauuu

SEQ ID NO: 134450 - RNA, 19 nt, Homo sapiens
uaaagaagacggagacugu

SEQ ID NO: 134451 - RNA, 19 nt, Homo sapiens
gcaccauaguggaugauga

SEQ ID NO: 134452 - RNA, 19 nt, Homo sapiens
gggcaggguugaaguggaa

SEQ ID NO: 134453 - RNA, 19 nt, Homo sapiens
ggcgagauccggacucuaa

SEQ ID NO: 134454 - RNA, 19 nt, Homo sapiens
gcucuguggcguuguguua

SEQ ID NO: 134455 - RNA, 19 nt, Homo sapiens
gaacugggacauaaagaag

SEQ ID NO: 134456 - RNA, 19 nt, Homo sapiens
uagagcaccuuccagagaa

SEQ ID NO: 134457 - RNA, 19 nt, Homo sapiens
ucauuugacuaccuaugua

SEQ ID NO: 134458 - RNA, 19 nt, Homo sapiens
ccagacaggaucccacaua

SEQ ID NO: 134459 - RNA, 19 nt, Homo sapiens
auacuaaguuuguggcauu

SEQ ID NO: 134460 - RNA, 19 nt, Homo sapiens
ggaugaugacgauuacuuu

SEQ ID NO: 134461 - RNA, 19 nt, Homo sapiens
ggagguggaugcaguagac

SEQ ID NO: 134462 - RNA, 19 nt, Homo sapiens
caagaguccuuugauguag

SEQ ID NO: 134463 - RNA, 19 nt, Homo sapiens
gaagcucuguggcguugug

SEQ ID NO: 134464 - RNA, 19 nt, Homo sapiens
aagaagaucuguccagcau

SEQ ID NO: 134465 - RNA, 19 nt, Homo sapiens
cauaguggaugaugacgau

SEQ ID NO: 134466 - RNA, 19 nt, Homo sapiens
gggcauacaacaauucaga

SEQ ID NO: 134467 - RNA, 19 nt, Homo sapiens
gccuugaacugggacauaa

SEQ ID NO: 134468 - RNA, 19 nt, Homo sapiens
ggguugaaguggaagaaug

SEQ ID NO: 134469 - RNA, 19 nt, Homo sapiens
gacauucuggccauugaua

SEQ ID NO: 134470 - RNA, 19 nt, Homo sapiens
guaaugagaaaugggcaua

SEQ ID NO: 134471 - RNA, 19 nt, Homo sapiens
gcaggagaauggcaugaac

SEQ ID NO: 134472 - RNA, 19 nt, Homo sapiens
uauuccaggucucaacaua

SEQ ID NO: 134473 - RNA, 19 nt, Homo sapiens
gcaucauccuccuaucaga

SEQ ID NO: 134474 - RNA, 19 nt, Homo sapiens
caauucagauggagguaca

SEQ ID NO: 134475 - RNA, 19 nt, Homo sapiens
auacaacaauucagaugga

SEQ ID NO: 134476 - RNA, 19 nt, Homo sapiens
ggugaaacccugucucuac

SEQ ID NO: 134477 - RNA, 19 nt, Homo sapiens
uaucccgccuccucuaauu

SEQ ID NO: 134478 - RNA, 19 nt, Homo sapiens
gacaggaucccacauagca

SEQ ID NO: 134479 - RNA, 19 nt, Homo sapiens
caacaggugcuugaccaaa

SEQ ID NO: 134480 - RNA, 19 nt, Homo sapiens
gcucaggaacuacgucaga

SEQ ID NO: 134481 - RNA, 19 nt, Homo sapiens
gcauacaacaauucagaug

SEQ ID NO: 134482 - RNA, 19 nt, Homo sapiens
cgccuccucuaauuacaua

SEQ ID NO: 134483 - RNA, 19 nt, Homo sapiens
cagacaggaucccacauag

SEQ ID NO: 134484 - RNA, 19 nt, Homo sapiens
acgcagagcuugcauucuc

SEQ ID NO: 134485 - RNA, 19 nt, Homo sapiens
cuaccuauguacuacucua

SEQ ID NO: 134486 - RNA, 19 nt, Homo sapiens
gugacauucuggccauuga

SEQ ID NO: 134487 - RNA, 19 nt, Homo sapiens
aaaugggcauacaacaauu

SEQ ID NO: 134488 - RNA, 19 nt, Homo sapiens
ugucuaccuuccaauacua

SEQ ID NO: 134489 - RNA, 19 nt, Homo sapiens
ucgaagaccugaggagcaa

SEQ ID NO: 134490 - RNA, 19 nt, Homo sapiens
agaaaugggcauacaacaa

SEQ ID NO: 134491 - RNA, 19 nt, Homo sapiens
ucgagaccauccuggcuaa

SEQ ID NO: 134492 - RNA, 19 nt, Homo sapiens
gauguucucuguucaaaag

SEQ ID NO: 134493 - RNA, 19 nt, Homo sapiens
cuucaggacuucugccaau

SEQ ID NO: 134494 - RNA, 19 nt, Homo sapiens
uuacugcacugagggagaa

SEQ ID NO: 134495 - RNA, 19 nt, Homo sapiens
gugaaacccugucucuacu

SEQ ID NO: 134496 - RNA, 19 nt, Homo sapiens
gaugacgauuacuuucugu

SEQ ID NO: 134497 - RNA, 19 nt, Homo sapiens
ucaggacuucugccaauuu

SEQ ID NO: 134498 - RNA, 19 nt, Homo sapiens
gcuuaucuagucaggauuu

SEQ ID NO: 134499 - RNA, 19 nt, Homo sapiens
guccuuugauguagaugaa

SEQ ID NO: 134500 - RNA, 19 nt, Homo sapiens
gcaguagacacggguauca

SEQ ID NO: 134501 - RNA, 19 nt, Homo sapiens
gaugaugacgauuacuuuc

SEQ ID NO: 134502 - RNA, 19 nt, Homo sapiens
gagaaaugggcauacaaca

SEQ ID NO: 134503 - RNA, 19 nt, Homo sapiens
cgggaagugugccaaggaa

SEQ ID NO: 134504 - RNA, 19 nt, Homo sapiens
ugaacugggacauaaagaa

SEQ ID NO: 134505 - RNA, 19 nt, Homo sapiens
gcaggaagaguccaaagcu

SEQ ID NO: 134506 - RNA, 19 nt, Homo sapiens
acaggugcuugaccaaaga

SEQ ID NO: 134507 - RNA, 19 nt, Homo sapiens
uaguggaugaugacgauua

SEQ ID NO: 134508 - RNA, 19 nt, Homo sapiens
aaaguaauuggcagugauu

SEQ ID NO: 134509 - RNA, 19 nt, Homo sapiens
caauaucccgccuccucua

SEQ ID NO: 134510 - RNA, 19 nt, Homo sapiens
uauagcugcaccaacaaua

SEQ ID NO: 134511 - RNA, 19 nt, Homo sapiens
ggacuucugccaauuuuga

SEQ ID NO: 134512 - RNA, 19 nt, Homo sapiens
ugaugacgauuacuuucug

SEQ ID NO: 134513 - RNA, 19 nt, Homo sapiens
gucaggagaucgagaccau

SEQ ID NO: 134514 - RNA, 19 nt, Homo sapiens
uuagagcaccuuccagaga

SEQ ID NO: 134515 - RNA, 19 nt, Homo sapiens
ucuguggcguuguguuauu

SEQ ID NO: 134516 - RNA, 19 nt, Homo sapiens
cagcaucauccuccuauca

SEQ ID NO: 134517 - RNA, 19 nt, Homo sapiens
caaaaguaauuggcaguga

SEQ ID NO: 134518 - RNA, 19 nt, Homo sapiens
caaggccugugacauucug

SEQ ID NO: 134519 - RNA, 19 nt, Homo sapiens
acccucagccucaucauuu

SEQ ID NO: 134520 - RNA, 19 nt, Homo sapiens
caaagcaggaagaguccaa

SEQ ID NO: 134521 - RNA, 19 nt, Homo sapiens
ucccaagaguccuuugaug

SEQ ID NO: 134522 - RNA, 19 nt, Homo sapiens
gauauagcugcaccaacaa

SEQ ID NO: 134523 - RNA, 19 nt, Homo sapiens
auacgccguuccaccaauu

SEQ ID NO: 134524 - RNA, 19 nt, Homo sapiens
gaagcuauuccaggucuca

SEQ ID NO: 134525 - RNA, 19 nt, Homo sapiens
uaagcgagccagacaggau

SEQ ID NO: 134526 - RNA, 19 nt, Homo sapiens
acacggguaucagcagaga

SEQ ID NO: 134527 - RNA, 19 nt, Homo sapiens
aaugagaaaugggcauaca

SEQ ID NO: 134528 - RNA, 19 nt, Homo sapiens
cccaccagcuucaggacuu

SEQ ID NO: 134529 - RNA, 19 nt, Homo sapiens
ugaaacccugucucuacua

SEQ ID NO: 134530 - RNA, 19 nt, Homo sapiens
gagaccauccuggcuaaca

SEQ ID NO: 134531 - RNA, 19 nt, Homo sapiens
gaucgugaagucaggagau

SEQ ID NO: 134532 - RNA, 19 nt, Homo sapiens
gguugaaguggaagaaugu

SEQ ID NO: 134533 - RNA, 19 nt, Homo sapiens
aagaguccuuugauguaga

SEQ ID NO: 134534 - RNA, 19 nt, Homo sapiens
cccaagaguccuuugaugu

SEQ ID NO: 134535 - RNA, 19 nt, Homo sapiens
ucagauggagguacagcuu

SEQ ID NO: 134536 - RNA, 19 nt, Homo sapiens
cauacgccguuccaccaau

SEQ ID NO: 134537 - RNA, 19 nt, Homo sapiens
agacgcagagcuugcauuc

SEQ ID NO: 134538 - RNA, 19 nt, Homo sapiens
uaucuagucaggauuugga

SEQ ID NO: 134539 - RNA, 19 nt, Homo sapiens
caacuacagccgcgaacag

SEQ ID NO: 134540 - RNA, 19 nt, Homo sapiens
gaaccuggaucacauaaua

SEQ ID NO: 134541 - RNA, 19 nt, Homo sapiens
gcacggagcugacggaaga

SEQ ID NO: 134542 - RNA, 19 nt, Homo sapiens
gaacagcuaucacguugaa

SEQ ID NO: 134543 - RNA, 19 nt, Homo sapiens
ggugagcgaucauuuauuu

SEQ ID NO: 134544 - RNA, 19 nt, Homo sapiens
ggaacaagauggaagagaa

SEQ ID NO: 134545 - RNA, 19 nt, Homo sapiens
gauucaaccugauacauuu

SEQ ID NO: 134546 - RNA, 19 nt, Homo sapiens
gaacauacaaggacauuca

SEQ ID NO: 134547 - RNA, 19 nt, Homo sapiens
caccugaccugcugaauug

SEQ ID NO: 134548 - RNA, 19 nt, Homo sapiens
gaaguggacugggaguauu

SEQ ID NO: 134549 - RNA, 19 nt, Homo sapiens
cagccugaaucauuucuua

SEQ ID NO: 134550 - RNA, 19 nt, Homo sapiens
ggacauucacugcugauuu

SEQ ID NO: 134551 - RNA, 19 nt, Homo sapiens
ccaaguagcugggauuaca

SEQ ID NO: 134552 - RNA, 19 nt, Homo sapiens
gagcaagucuggcuaucug

SEQ ID NO: 134553 - RNA, 19 nt, Homo sapiens
guagauggaguuucacuuu

SEQ ID NO: 134554 - RNA, 19 nt, Homo sapiens
ggacagcugcuuaucaaga

SEQ ID NO: 134555 - RNA, 19 nt, Homo sapiens
caaaagaggugucaugcuu

SEQ ID NO: 134556 - RNA, 19 nt, Homo sapiens
cacauugucugccauaaga

SEQ ID NO: 134557 - RNA, 19 nt, Homo sapiens
gaucugaacagcaguaauc

SEQ ID NO: 134558 - RNA, 19 nt, Homo sapiens
gcaccugaccugcugaauu

SEQ ID NO: 134559 - RNA, 19 nt, Homo sapiens
ugacauggacagcugcuua

SEQ ID NO: 134560 - RNA, 19 nt, Homo sapiens
gaagcagccugugcggaaa

SEQ ID NO: 134561 - RNA, 19 nt, Homo sapiens
ccagagggcuugaggacau

SEQ ID NO: 134562 - RNA, 19 nt, Homo sapiens
gaaguuggccaccuugcuu

SEQ ID NO: 134563 - RNA, 19 nt, Homo sapiens
ggaaacacgcggaucugaa

SEQ ID NO: 134564 - RNA, 19 nt, Homo sapiens
caccagggccagcuaauuu

SEQ ID NO: 134565 - RNA, 19 nt, Homo sapiens
gacauucacugcugauuuu

SEQ ID NO: 134566 - RNA, 19 nt, Homo sapiens
gaaacgccagugacacgua

SEQ ID NO: 134567 - RNA, 19 nt, Homo sapiens
gcaauuaaggaacaagaug

SEQ ID NO: 134568 - RNA, 19 nt, Homo sapiens
gaaaagaaacgcaccauca

SEQ ID NO: 134569 - RNA, 19 nt, Homo sapiens
gauuacagagggcucauuu

SEQ ID NO: 134570 - RNA, 19 nt, Homo sapiens
gaaggaaacacgcggaucu

SEQ ID NO: 134571 - RNA, 19 nt, Homo sapiens
ugucacaguuucaggcuuu

SEQ ID NO: 134572 - RNA, 19 nt, Homo sapiens
ccugcugaauuguuuauaa

SEQ ID NO: 134573 - RNA, 19 nt, Homo sapiens
ccaaagugcugggauuaca

SEQ ID NO: 134574 - RNA, 19 nt, Homo sapiens
gcugaggaauucuucuguu

SEQ ID NO: 134575 - RNA, 19 nt, Homo sapiens
gcugaauuguuuauaaugg

SEQ ID NO: 134576 - RNA, 19 nt, Homo sapiens
ccaaagugcugggaugaca

SEQ ID NO: 134577 - RNA, 19 nt, Homo sapiens
ccugauacauuuacauagu

SEQ ID NO: 134578 - RNA, 19 nt, Homo sapiens
acuaucaucucggaucaua

SEQ ID NO: 134579 - RNA, 19 nt, Homo sapiens
ggucagcguuacuaucauc

SEQ ID NO: 134580 - RNA, 19 nt, Homo sapiens
gcgcccagccugaaucauu

SEQ ID NO: 134581 - RNA, 19 nt, Homo sapiens
gaacaagauggaagagaag

SEQ ID NO: 134582 - RNA, 19 nt, Homo sapiens
ggaagcaauuaaggaacaa

SEQ ID NO: 134583 - RNA, 19 nt, Homo sapiens
aaagaaacgcaccaucauu

SEQ ID NO: 134584 - RNA, 19 nt, Homo sapiens
gccugaaucauuucuuaua

SEQ ID NO: 134585 - RNA, 19 nt, Homo sapiens
gaaacacgcggaucugaac

SEQ ID NO: 134586 - RNA, 19 nt, Homo sapiens
gaucauauggagcucaugu

SEQ ID NO: 134587 - RNA, 19 nt, Homo sapiens
gaggaauucuucuguucuc

SEQ ID NO: 134588 - RNA, 19 nt, Homo sapiens
ccgaguagcugggauuaca

SEQ ID NO: 134589 - RNA, 19 nt, Homo sapiens
gggcagcuccauccucuug

SEQ ID NO: 134590 - RNA, 19 nt, Homo sapiens
ucaguagggauaagaauug

SEQ ID NO: 134591 - RNA, 19 nt, Homo sapiens
gguggaagcaauuaaggaa

SEQ ID NO: 134592 - RNA, 19 nt, Homo sapiens
aaacgcaccaucauuccua

SEQ ID NO: 134593 - RNA, 19 nt, Homo sapiens
gagcgaucauuuauuucau

SEQ ID NO: 134594 - RNA, 19 nt, Homo sapiens
uggguuugcucauguaaug

SEQ ID NO: 134595 - RNA, 19 nt, Homo sapiens
ucucugggcugaggaauuc

SEQ ID NO: 134596 - RNA, 19 nt, Homo sapiens
uggcugaccuccugcacaa

SEQ ID NO: 134597 - RNA, 19 nt, Homo sapiens
acagagggcucauuuucua

SEQ ID NO: 134598 - RNA, 19 nt, Homo sapiens
gcagcuccauccucuugau

SEQ ID NO: 134599 - RNA, 19 nt, Homo sapiens
cgcccagccugaaucauuu

SEQ ID NO: 134600 - RNA, 19 nt, Homo sapiens
ugauucaaccugauacauu

SEQ ID NO: 134601 - RNA, 19 nt, Homo sapiens
auacucaaauggugucaug

SEQ ID NO: 134602 - RNA, 19 nt, Homo sapiens
uaaggaacaagauggaaga

SEQ ID NO: 134603 - RNA, 19 nt, Homo sapiens
uuucugaauuguuggguuu

SEQ ID NO: 134604 - RNA, 19 nt, Homo sapiens
gcacauugucugccauaag

SEQ ID NO: 134605 - RNA, 19 nt, Homo sapiens
uggaagcaauuaaggaaca

SEQ ID NO: 134606 - RNA, 19 nt, Homo sapiens
uaucaucucggaucauaug

SEQ ID NO: 134607 - RNA, 19 nt, Homo sapiens
uggccaggcuguucucgaa

SEQ ID NO: 134608 - RNA, 19 nt, Homo sapiens
aagaaacgcaccaucauuc

SEQ ID NO: 134609 - RNA, 19 nt, Homo sapiens
guacaauggcagcuacuuc

SEQ ID NO: 134610 - RNA, 19 nt, Homo sapiens
gcaccuggaaccuggauca

SEQ ID NO: 134611 - RNA, 19 nt, Homo sapiens
gcuccauccucuugaucuu

SEQ ID NO: 134612 - RNA, 19 nt, Homo sapiens
gugaguaccuggucauacg

SEQ ID NO: 134613 - RNA, 19 nt, Homo sapiens
ugccucagccucccaagua

SEQ ID NO: 134614 - RNA, 19 nt, Homo sapiens
gagaaguggacugggagua

SEQ ID NO: 134615 - RNA, 19 nt, Homo sapiens
gacagcugcuuaucaagac

SEQ ID NO: 134616 - RNA, 19 nt, Homo sapiens
uuacuaucaucucggauca

SEQ ID NO: 134617 - RNA, 19 nt, Homo sapiens
ugagcgaucauuuauuuca

SEQ ID NO: 134618 - RNA, 19 nt, Homo sapiens
cugaccugcugaauuguuu

SEQ ID NO: 134619 - RNA, 19 nt, Homo sapiens
gaugcaaucuuggcucacu

SEQ ID NO: 134620 - RNA, 19 nt, Homo sapiens
cugaggaauucuucuguuc

SEQ ID NO: 134621 - RNA, 19 nt, Homo sapiens
ccugaaucauuucuuauac

SEQ ID NO: 134622 - RNA, 19 nt, Homo sapiens
ccuggaaccuggaucacau

SEQ ID NO: 134623 - RNA, 19 nt, Homo sapiens
guagaaacuggaagcuguu

SEQ ID NO: 134624 - RNA, 19 nt, Homo sapiens
cgauguuuauacuccguaa

SEQ ID NO: 134625 - RNA, 19 nt, Homo sapiens
cuacacugguggaagcaau

SEQ ID NO: 134626 - RNA, 19 nt, Homo sapiens
gcaccaucauuccuacacu

SEQ ID NO: 134627 - RNA, 19 nt, Homo sapiens
auggacagcugcuuaucaa

SEQ ID NO: 134628 - RNA, 19 nt, Homo sapiens
gacauggacagcugcuuau

SEQ ID NO: 134629 - RNA, 19 nt, Homo sapiens
gcguuggguuugcucaugu

SEQ ID NO: 134630 - RNA, 19 nt, Homo sapiens
uaucaagacacuccaucaa

SEQ ID NO: 134631 - RNA, 19 nt, Homo sapiens
ccaccagggccagcuaauu

SEQ ID NO: 134632 - RNA, 19 nt, Homo sapiens
guagggauaagaauugucu

SEQ ID NO: 134633 - RNA, 19 nt, Homo sapiens
cugauacauuuacauagug

SEQ ID NO: 134634 - RNA, 19 nt, Homo sapiens
cggagcugacggaagauua

SEQ ID NO: 134635 - RNA, 19 nt, Homo sapiens
gcacaacgucagccagaac

SEQ ID NO: 134636 - RNA, 19 nt, Homo sapiens
cguuggaugucugugagua

SEQ ID NO: 134637 - RNA, 19 nt, Homo sapiens
caccucagccucccaaagu

SEQ ID NO: 134638 - RNA, 19 nt, Homo sapiens
uggucaggcuggucucaaa

SEQ ID NO: 134639 - RNA, 19 nt, Homo sapiens
gaaacuggaagcuguucag

SEQ ID NO: 134640 - RNA, 19 nt, Homo sapiens
gaaauuaacuuacccugua

SEQ ID NO: 134641 - RNA, 19 nt, Homo sapiens
gaagguaguucaagaaaug

SEQ ID NO: 134642 - RNA, 19 nt, Homo sapiens
guugagcgcuucauugaua

SEQ ID NO: 134643 - RNA, 19 nt, Homo sapiens
ucagugaugugccuaaaua

SEQ ID NO: 134644 - RNA, 19 nt, Homo sapiens
cuagaggccuuuaguuaua

SEQ ID NO: 134645 - RNA, 19 nt, Homo sapiens
ccagugaacauaauucuua

SEQ ID NO: 134646 - RNA, 19 nt, Homo sapiens
uaacuuacccuguauauca

SEQ ID NO: 134647 - RNA, 19 nt, Homo sapiens
ggucauauguuugcuugua

SEQ ID NO: 134648 - RNA, 19 nt, Homo sapiens
gcuuaagggucauauguuu

SEQ ID NO: 134649 - RNA, 19 nt, Homo sapiens
uuaaguaagucucaaggua

SEQ ID NO: 134650 - RNA, 19 nt, Homo sapiens
ccagaugacugaacuuugu

SEQ ID NO: 134651 - RNA, 19 nt, Homo sapiens
aaaggaaucuagccaguga

SEQ ID NO: 134652 - RNA, 19 nt, Homo sapiens
ggacuaugcuuuucucaaa

SEQ ID NO: 134653 - RNA, 19 nt, Homo sapiens
ggaagguaguucaagaaau

SEQ ID NO: 134654 - RNA, 19 nt, Homo sapiens
guaagaguguuuauacagu

SEQ ID NO: 134655 - RNA, 19 nt, Homo sapiens
guacaugggacuaugcuuu

SEQ ID NO: 134656 - RNA, 19 nt, Homo sapiens
aaaggaagguaguucaaga

SEQ ID NO: 134657 - RNA, 19 nt, Homo sapiens
aggauuggcucccaucuuu

SEQ ID NO: 134658 - RNA, 19 nt, Homo sapiens
gggagauccuuguguuuau

SEQ ID NO: 134659 - RNA, 19 nt, Homo sapiens
gaacagacccagaaaucca

SEQ ID NO: 134660 - RNA, 19 nt, Homo sapiens
ggacaagccugggccaaag

SEQ ID NO: 134661 - RNA, 19 nt, Homo sapiens
gaaaugaagagcuguugau

SEQ ID NO: 134662 - RNA, 19 nt, Homo sapiens
gaagcuaacagcaguuuca

SEQ ID NO: 134663 - RNA, 19 nt, Homo sapiens
gcauucuucugaucacuga

SEQ ID NO: 134664 - RNA, 19 nt, Homo sapiens
aaacagcuaugagaggauu

SEQ ID NO: 134665 - RNA, 19 nt, Homo sapiens
caucuugaaucgacuggaa

SEQ ID NO: 134666 - RNA, 19 nt, Homo sapiens
gucuagaggccuuuaguua

SEQ ID NO: 134667 - RNA, 19 nt, Homo sapiens
guggagucauuucugauuu

SEQ ID NO: 134668 - RNA, 19 nt, Homo sapiens
cccauuaacugcuuccuau

SEQ ID NO: 134669 - RNA, 19 nt, Homo sapiens
ugaagaaacagcuaugaga

SEQ ID NO: 134670 - RNA, 19 nt, Homo sapiens
ggaagaauaauuugguauc

SEQ ID NO: 134671 - RNA, 19 nt, Homo sapiens
gaaugaacaaagaccaauu

SEQ ID NO: 134672 - RNA, 19 nt, Homo sapiens
ugaugugccuaaauaaguu

SEQ ID NO: 134673 - RNA, 19 nt, Homo sapiens
ugaucucccuuuccuauau

SEQ ID NO: 134674 - RNA, 19 nt, Homo sapiens
cauuaacugcuuccuauaa

SEQ ID NO: 134675 - RNA, 19 nt, Homo sapiens
uagaggccuuuaguuauaa

SEQ ID NO: 134676 - RNA, 19 nt, Homo sapiens
gaaucuagccagugaacau

SEQ ID NO: 134677 - RNA, 19 nt, Homo sapiens
gaucucccuuuccuauaug

SEQ ID NO: 134678 - RNA, 19 nt, Homo sapiens
acaguacacuucaguuauc

SEQ ID NO: 134679 - RNA, 19 nt, Homo sapiens
auacaguacacuucaguua

SEQ ID NO: 134680 - RNA, 19 nt, Homo sapiens
ggagucauuucugauuuca

SEQ ID NO: 134681 - RNA, 19 nt, Homo sapiens
gaagaauaauuugguaucc

SEQ ID NO: 134682 - RNA, 19 nt, Homo sapiens
ggagauccuuguguuuauc

SEQ ID NO: 134683 - RNA, 19 nt, Homo sapiens
ucauuuguguggagucauu

SEQ ID NO: 134684 - RNA, 19 nt, Homo sapiens
agcauuaccucuuuggaaa

SEQ ID NO: 134685 - RNA, 19 nt, Homo sapiens
gauacaagccaguucaucu

SEQ ID NO: 134686 - RNA, 19 nt, Homo sapiens
guacacuucaguuaucuug

SEQ ID NO: 134687 - RNA, 19 nt, Homo sapiens
gaucucagcauuaccucuu

SEQ ID NO: 134688 - RNA, 19 nt, Homo sapiens
gcguugagcgcuucauuga

SEQ ID NO: 134689 - RNA, 19 nt, Homo sapiens
acacuucaguuaucuugau

SEQ ID NO: 134690 - RNA, 19 nt, Homo sapiens
gagaaugaacaaagaccaa

SEQ ID NO: 134691 - RNA, 19 nt, Homo sapiens
gaugugccuaaauaaguua

SEQ ID NO: 134692 - RNA, 19 nt, Homo sapiens
gcugaggccuguuuuguga

SEQ ID NO: 134693 - RNA, 19 nt, Homo sapiens
uaguguagauuccauuuac

SEQ ID NO: 134694 - RNA, 19 nt, Homo sapiens
agaggugcaugccuaaugu

SEQ ID NO: 134695 - RNA, 19 nt, Homo sapiens
gacccacaguugcagcauu

SEQ ID NO: 134696 - RNA, 19 nt, Homo sapiens
cagcauuaccucuuuggaa

SEQ ID NO: 134697 - RNA, 19 nt, Homo sapiens
ccuauaugaugauuugcuu

SEQ ID NO: 134698 - RNA, 19 nt, Homo sapiens
acccacaguugcagcauuu

SEQ ID NO: 134699 - RNA, 19 nt, Homo sapiens
uugaugggaugauugaaga

SEQ ID NO: 134700 - RNA, 19 nt, Homo sapiens
cuucugaucacugaaauaa

SEQ ID NO: 134701 - RNA, 19 nt, Homo sapiens
caagaaaugaagagcuguu

SEQ ID NO: 134702 - RNA, 19 nt, Homo sapiens
ucuagaggccuuuaguuau

SEQ ID NO: 134703 - RNA, 19 nt, Homo sapiens
uguguggagucauuucuga

SEQ ID NO: 134704 - RNA, 19 nt, Homo sapiens
gaugggaugauugaagaaa

SEQ ID NO: 134705 - RNA, 19 nt, Homo sapiens
ccagaaauccaagccaguu

SEQ ID NO: 134706 - RNA, 19 nt, Homo sapiens
gugaugugccuaaauaagu

SEQ ID NO: 134707 - RNA, 19 nt, Homo sapiens
ccacaaggaagaaauuaac

SEQ ID NO: 134708 - RNA, 19 nt, Homo sapiens
gccacaaggaagaaauuaa

SEQ ID NO: 134709 - RNA, 19 nt, Homo sapiens
caucugagaaugaacaaag

SEQ ID NO: 134710 - RNA, 19 nt, Homo sapiens
guauccuuaucuaguguuu

SEQ ID NO: 134711 - RNA, 19 nt, Homo sapiens
gucauauguuugcuuguau

SEQ ID NO: 134712 - RNA, 19 nt, Homo sapiens
uagauuccauuuacugcau

SEQ ID NO: 134713 - RNA, 19 nt, Homo sapiens
gguagaggugcaugccuaa

SEQ ID NO: 134714 - RNA, 19 nt, Homo sapiens
auccuuaucuaguguuuga

SEQ ID NO: 134715 - RNA, 19 nt, Homo sapiens
agaaguaggggaagaauaa

SEQ ID NO: 134716 - RNA, 19 nt, Homo sapiens
cagaaauccaagccaguuu

SEQ ID NO: 134717 - RNA, 19 nt, Homo sapiens
gggaagaauaauuugguau

SEQ ID NO: 134718 - RNA, 19 nt, Homo sapiens
ggggaagaauaauuuggua

SEQ ID NO: 134719 - RNA, 19 nt, Homo sapiens
gaaaaggaagguaguucaa

SEQ ID NO: 134720 - RNA, 19 nt, Homo sapiens
ucaucgagguagagacuca

SEQ ID NO: 134721 - RNA, 19 nt, Homo sapiens
uuacugcauucuucugauc

SEQ ID NO: 134722 - RNA, 19 nt, Homo sapiens
cagaagcuaacagcaguuu

SEQ ID NO: 134723 - RNA, 19 nt, Homo sapiens
caccagaugacugaacuuu

SEQ ID NO: 134724 - RNA, 19 nt, Homo sapiens
ggggagauccuuguguuua

SEQ ID NO: 134725 - RNA, 19 nt, Homo sapiens
ccauuaacugcuuccuaua

SEQ ID NO: 134726 - RNA, 19 nt, Homo sapiens
auaauugacaggcgaaaga

SEQ ID NO: 134727 - RNA, 19 nt, Homo sapiens
gaggauuggcucccaucuu

SEQ ID NO: 134728 - RNA, 19 nt, Homo sapiens
uggaacagacccagaaauc

SEQ ID NO: 134729 - RNA, 19 nt, Homo sapiens
gggagaagugcauggacaa

SEQ ID NO: 134730 - RNA, 19 nt, Homo sapiens
guuaguguagauuccauuu

SEQ ID NO: 134731 - RNA, 19 nt, Homo sapiens
gagagucuagaggccuuua

SEQ ID NO: 134732 - RNA, 19 nt, Homo sapiens
uggagucauuucugauuuc

SEQ ID NO: 134733 - RNA, 19 nt, Homo sapiens
uccauuuacugcauucuuc

SEQ ID NO: 134734 - RNA, 19 nt, Homo sapiens
gagauccuuguguuuauca

SEQ ID NO: 134735 - RNA, 19 nt, Homo sapiens
ugggaugauugaagaaaca

SEQ ID NO: 134736 - RNA, 19 nt, Homo sapiens
uagaggugcaugccuaaug

SEQ ID NO: 134737 - RNA, 19 nt, Homo sapiens
aaucuagccagugaacaua

SEQ ID NO: 134738 - RNA, 19 nt, Homo sapiens
uacaguacacuucaguuau

SEQ ID NO: 134739 - RNA, 19 nt, Homo sapiens
aagcuuaagggucauaugu

SEQ ID NO: 134740 - RNA, 19 nt, Homo sapiens
gaaugacucugauaaguua

SEQ ID NO: 134741 - RNA, 19 nt, Homo sapiens
gaacuagaaguacguguua

SEQ ID NO: 134742 - RNA, 19 nt, Homo sapiens
gaaauacgagggcaaguuu

SEQ ID NO: 134743 - RNA, 19 nt, Homo sapiens
gcggagaauucuuagcaua

SEQ ID NO: 134744 - RNA, 19 nt, Homo sapiens
gcagagaacauucaugaug

SEQ ID NO: 134745 - RNA, 19 nt, Homo sapiens
gcaagcagcuguuuaugac

SEQ ID NO: 134746 - RNA, 19 nt, Homo sapiens
gaaagauacagaaagguuu

SEQ ID NO: 134747 - RNA, 19 nt, Homo sapiens
ggagggcggagaauucuua

SEQ ID NO: 134748 - RNA, 19 nt, Homo sapiens
ugucauaugugaacuagaa

SEQ ID NO: 134749 - RNA, 19 nt, Homo sapiens
gacccuagcuauaugcauu

SEQ ID NO: 134750 - RNA, 19 nt, Homo sapiens
uguaaaugcuccuagagua

SEQ ID NO: 134751 - RNA, 19 nt, Homo sapiens
uagcauacauucagacguu

SEQ ID NO: 134752 - RNA, 19 nt, Homo sapiens
gaauggacucugugcuuua

SEQ ID NO: 134753 - RNA, 19 nt, Homo sapiens
ggaagcaggagguggauuu

SEQ ID NO: 134754 - RNA, 19 nt, Homo sapiens
cagaacaguuuaagaagug

SEQ ID NO: 134755 - RNA, 19 nt, Homo sapiens
gagagaacaauaaaucuga

SEQ ID NO: 134756 - RNA, 19 nt, Homo sapiens
acagaaagguuugggauug

SEQ ID NO: 134757 - RNA, 19 nt, Homo sapiens
uggaguaucugaucuugaa

SEQ ID NO: 134758 - RNA, 19 nt, Homo sapiens
ugaaagcugucauucugaa

SEQ ID NO: 134759 - RNA, 19 nt, Homo sapiens
gagagccagucuucauuug

SEQ ID NO: 134760 - RNA, 19 nt, Homo sapiens
ugaauggacucugugcuuu

SEQ ID NO: 134761 - RNA, 19 nt, Homo sapiens
gagccagucuucauuugga

SEQ ID NO: 134762 - RNA, 19 nt, Homo sapiens
gcgauguacucauagaaga

SEQ ID NO: 134763 - RNA, 19 nt, Homo sapiens
ugacccagcaucugaguua

SEQ ID NO: 134764 - RNA, 19 nt, Homo sapiens
ucacgacgaugcagaagug

SEQ ID NO: 134765 - RNA, 19 nt, Homo sapiens
uaaaugcuccuagaguaua

SEQ ID NO: 134766 - RNA, 19 nt, Homo sapiens
ccacugcuucuuuguauaa

SEQ ID NO: 134767 - RNA, 19 nt, Homo sapiens
ccuauuugaugaugaacua

SEQ ID NO: 134768 - RNA, 19 nt, Homo sapiens
agaagugugugaucucuga

SEQ ID NO: 134769 - RNA, 19 nt, Homo sapiens
ggagaauucuuagcauaca

SEQ ID NO: 134770 - RNA, 19 nt, Homo sapiens
uuuaagaaguggugacauu

SEQ ID NO: 134771 - RNA, 19 nt, Homo sapiens
guuaaaaguugaccaauga

SEQ ID NO: 134772 - RNA, 19 nt, Homo sapiens
ccaaagcaaccaggaauuu

SEQ ID NO: 134773 - RNA, 19 nt, Homo sapiens
cggauaaucuggagcuuuc

SEQ ID NO: 134774 - RNA, 19 nt, Homo sapiens
gaagucaucugugaaagcu

SEQ ID NO: 134775 - RNA, 19 nt, Homo sapiens
acucauagaagaccaauuu

SEQ ID NO: 134776 - RNA, 19 nt, Homo sapiens
caagguggcuucgagaaca

SEQ ID NO: 134777 - RNA, 19 nt, Homo sapiens
gauaaguuacagcuucuaa

SEQ ID NO: 134778 - RNA, 19 nt, Homo sapiens
caauuucucugcacacaag

SEQ ID NO: 134779 - RNA, 19 nt, Homo sapiens
ugugaaagcugucauucug

SEQ ID NO: 134780 - RNA, 19 nt, Homo sapiens
uaugacagccuacuucuug

SEQ ID NO: 134781 - RNA, 19 nt, Homo sapiens
gguccuauuugaugaugaa

SEQ ID NO: 134782 - RNA, 19 nt, Homo sapiens
gagaacaagaagagaauug

SEQ ID NO: 134783 - RNA, 19 nt, Homo sapiens
ucagugaacauacuaauuc

SEQ ID NO: 134784 - RNA, 19 nt, Homo sapiens
guaaaugcuccuagaguau

SEQ ID NO: 134785 - RNA, 19 nt, Homo sapiens
ggaagugauguauguuauu

SEQ ID NO: 134786 - RNA, 19 nt, Homo sapiens
gauggaguaucugaucuug

SEQ ID NO: 134787 - RNA, 19 nt, Homo sapiens
cauguugauuuccuaugua

SEQ ID NO: 134788 - RNA, 19 nt, Homo sapiens
gcacacaagaggcuacguu

SEQ ID NO: 134789 - RNA, 19 nt, Homo sapiens
uuucagaacuguuaaaggu

SEQ ID NO: 134790 - RNA, 19 nt, Homo sapiens
cccgacaucucccggauaa

SEQ ID NO: 134791 - RNA, 19 nt, Homo sapiens
ugaaagauacagaaagguu

SEQ ID NO: 134792 - RNA, 19 nt, Homo sapiens
ucgcagaaaugccagauag

SEQ ID NO: 134793 - RNA, 19 nt, Homo sapiens
ccuuggcgauguacucaua

SEQ ID NO: 134794 - RNA, 19 nt, Homo sapiens
ugaaugacucugauaaguu

SEQ ID NO: 134795 - RNA, 19 nt, Homo sapiens
cagguacucuuuaaacagu

SEQ ID NO: 134796 - RNA, 19 nt, Homo sapiens
gccaccagguacucuuuaa

SEQ ID NO: 134797 - RNA, 19 nt, Homo sapiens
ucagugcccucgcagaaau

SEQ ID NO: 134798 - RNA, 19 nt, Homo sapiens
ucgagaguuugcauucaua

SEQ ID NO: 134799 - RNA, 19 nt, Homo sapiens
gcagaagugugugaucucu

SEQ ID NO: 134800 - RNA, 19 nt, Homo sapiens
cacagaagaucacgacgau

SEQ ID NO: 134801 - RNA, 19 nt, Homo sapiens
uuacauagaaagagucuga

SEQ ID NO: 134802 - RNA, 19 nt, Homo sapiens
guagagagccagucuucau

SEQ ID NO: 134803 - RNA, 19 nt, Homo sapiens
ugaaugaccugacuuuuag

SEQ ID NO: 134804 - RNA, 19 nt, Homo sapiens
acagaacaguuuaagaagu

SEQ ID NO: 134805 - RNA, 19 nt, Homo sapiens
gaugucauaugugaacuag

SEQ ID NO: 134806 - RNA, 19 nt, Homo sapiens
ggucagugcccucgcagaa

SEQ ID NO: 134807 - RNA, 19 nt, Homo sapiens
uggaagugauguauguuau

SEQ ID NO: 134808 - RNA, 19 nt, Homo sapiens
cauaugugaacuagaagua

SEQ ID NO: 134809 - RNA, 19 nt, Homo sapiens
gaguuugcauucauagaca

SEQ ID NO: 134810 - RNA, 19 nt, Homo sapiens
gaguuagguuccagcaugu

SEQ ID NO: 134811 - RNA, 19 nt, Homo sapiens
aaaguugaccaaugaaaug

SEQ ID NO: 134812 - RNA, 19 nt, Homo sapiens
ccugaaagauacagaaagg

SEQ ID NO: 134813 - RNA, 19 nt, Homo sapiens
gagaauugacucugucuac

SEQ ID NO: 134814 - RNA, 19 nt, Homo sapiens
cagaaagguuugggauugu

SEQ ID NO: 134815 - RNA, 19 nt, Homo sapiens
gaugauggaguaucugauc

SEQ ID NO: 134816 - RNA, 19 nt, Homo sapiens
ugcagcagcucaucagaga

SEQ ID NO: 134817 - RNA, 19 nt, Homo sapiens
cgacaucucccggauaauc

SEQ ID NO: 134818 - RNA, 19 nt, Homo sapiens
uagagaaguugaugcugau

SEQ ID NO: 134819 - RNA, 19 nt, Homo sapiens
aaggucauaugcacguuaa

SEQ ID NO: 134820 - RNA, 19 nt, Homo sapiens
gcugcaaacuccagaucau

SEQ ID NO: 134821 - RNA, 19 nt, Homo sapiens
guugauuuccuauguauuc

SEQ ID NO: 134822 - RNA, 19 nt, Homo sapiens
gaaaaugaacuguaaaugc

SEQ ID NO: 134823 - RNA, 19 nt, Homo sapiens
guugaccaaugaaaugaau

SEQ ID NO: 134824 - RNA, 19 nt, Homo sapiens
caaaucugaaugacucuga

SEQ ID NO: 134825 - RNA, 19 nt, Homo sapiens
uaaguuacagcuucuaagu

SEQ ID NO: 134826 - RNA, 19 nt, Homo sapiens
gcacauguugauuuccuau

SEQ ID NO: 134827 - RNA, 19 nt, Homo sapiens
ucuagcacauguugauuuc

SEQ ID NO: 134828 - RNA, 19 nt, Homo sapiens
gacugaaaaugaacuguaa

SEQ ID NO: 134829 - RNA, 19 nt, Homo sapiens
gagaauucuuagcauacau

SEQ ID NO: 134830 - RNA, 19 nt, Homo sapiens
gccgagagaacaauaaauc

SEQ ID NO: 134831 - RNA, 19 nt, Homo sapiens
aggcagagaacauucauga

SEQ ID NO: 134832 - RNA, 19 nt, Homo sapiens
ugacauuagucuggagaga

SEQ ID NO: 134833 - RNA, 19 nt, Homo sapiens
ggagcugccugagccacaa

SEQ ID NO: 134834 - RNA, 19 nt, Homo sapiens
ggacggccaguucgaguuc

SEQ ID NO: 134835 - RNA, 19 nt, Homo sapiens
gcuugggacccuagcuaua

SEQ ID NO: 134836 - RNA, 19 nt, Homo sapiens
cugaaugacucugauaagu

SEQ ID NO: 134837 - RNA, 19 nt, Homo sapiens
uccaggcgguccuauuuga

SEQ ID NO: 134838 - RNA, 19 nt, Homo sapiens
ccuggucuuucgagaguuu

SEQ ID NO: 134839 - RNA, 19 nt, Homo sapiens
ucauugaguuauacgugaa

SEQ ID NO: 134840 - RNA, 19 nt, Homo sapiens
gauggaagcuuuaauauug

SEQ ID NO: 134841 - RNA, 19 nt, Homo sapiens
gaacacagcucuuuaacau

SEQ ID NO: 134842 - RNA, 19 nt, Homo sapiens
gaacauugccuuucuaauu

SEQ ID NO: 134843 - RNA, 19 nt, Homo sapiens
ugaaagauauggcuucuaa

SEQ ID NO: 134844 - RNA, 19 nt, Homo sapiens
caaauaagcacuccuuuaa

SEQ ID NO: 134845 - RNA, 19 nt, Homo sapiens
gaagaaaacuggcaauaaa

SEQ ID NO: 134846 - RNA, 19 nt, Homo sapiens
gcaaauaagcacuccuuua

SEQ ID NO: 134847 - RNA, 19 nt, Homo sapiens
caaauuccauagcucaaua

SEQ ID NO: 134848 - RNA, 19 nt, Homo sapiens
caaaugaugugcagcaaga

SEQ ID NO: 134849 - RNA, 19 nt, Homo sapiens
caagagaguucacaggauu

SEQ ID NO: 134850 - RNA, 19 nt, Homo sapiens
caagauagcugcuguacag

SEQ ID NO: 134851 - RNA, 19 nt, Homo sapiens
caacagccauuuaggcaaa

SEQ ID NO: 134852 - RNA, 19 nt, Homo sapiens
caacaagaacuuccuagua

SEQ ID NO: 134853 - RNA, 19 nt, Homo sapiens
gaaggagucucaugcuuuc

SEQ ID NO: 134854 - RNA, 19 nt, Homo sapiens
aacaagaacuuccuaguaa

SEQ ID NO: 134855 - RNA, 19 nt, Homo sapiens
gauagcugcuguacaguuu

SEQ ID NO: 134856 - RNA, 19 nt, Homo sapiens
ggaaaagccuugaagcaua

SEQ ID NO: 134857 - RNA, 19 nt, Homo sapiens
gggcagcgccgauuuaauu

SEQ ID NO: 134858 - RNA, 19 nt, Homo sapiens
gccauuuccuucacuguua

SEQ ID NO: 134859 - RNA, 19 nt, Homo sapiens
gguagaugcuggaguaaga

SEQ ID NO: 134860 - RNA, 19 nt, Homo sapiens
gcacauccaccaacaggua

SEQ ID NO: 134861 - RNA, 19 nt, Homo sapiens
ggaaagaggagauaaugug

SEQ ID NO: 134862 - RNA, 19 nt, Homo sapiens
gcucuaauguugggaauug

SEQ ID NO: 134863 - RNA, 19 nt, Homo sapiens
ccuacuaaauguacagaua

SEQ ID NO: 134864 - RNA, 19 nt, Homo sapiens
gacauugcauuucugauug

SEQ ID NO: 134865 - RNA, 19 nt, Homo sapiens
agaaacauccgcuauauga

SEQ ID NO: 134866 - RNA, 19 nt, Homo sapiens
gcagcaagaccuguuauaa

SEQ ID NO: 134867 - RNA, 19 nt, Homo sapiens
gaaaagggauccccaaagu

SEQ ID NO: 134868 - RNA, 19 nt, Homo sapiens
gaaaggagaccuguaucaa

SEQ ID NO: 134869 - RNA, 19 nt, Homo sapiens
uggaugaccugaaagauau

SEQ ID NO: 134870 - RNA, 19 nt, Homo sapiens
ucagaaacauccgcuauau

SEQ ID NO: 134871 - RNA, 19 nt, Homo sapiens
ccaaagugguggugguauu

SEQ ID NO: 134872 - RNA, 19 nt, Homo sapiens
ggaaagagaaagcagaugu

SEQ ID NO: 134873 - RNA, 19 nt, Homo sapiens
caagaccuguuauaacuca

SEQ ID NO: 134874 - RNA, 19 nt, Homo sapiens
uaaagcagacauugcauuu

SEQ ID NO: 134875 - RNA, 19 nt, Homo sapiens
ccaaguggauauuuucuua

SEQ ID NO: 134876 - RNA, 19 nt, Homo sapiens
uaaaugaacacagcucuuu

SEQ ID NO: 134877 - RNA, 19 nt, Homo sapiens
guacagauaugcaaauucc

SEQ ID NO: 134878 - RNA, 19 nt, Homo sapiens
ccauugcuaucacauguuu

SEQ ID NO: 134879 - RNA, 19 nt, Homo sapiens
aauaagcacuccuuuaaag

SEQ ID NO: 134880 - RNA, 19 nt, Homo sapiens
caagaacuuccuaguaauu

SEQ ID NO: 134881 - RNA, 19 nt, Homo sapiens
gaacagaaggaccacaugu

SEQ ID NO: 134882 - RNA, 19 nt, Homo sapiens
ggauuagaaccaauuguuu

SEQ ID NO: 134883 - RNA, 19 nt, Homo sapiens
aacauugccuuucuaauug

SEQ ID NO: 134884 - RNA, 19 nt, Homo sapiens
gcugugcacucaugaacaa

SEQ ID NO: 134885 - RNA, 19 nt, Homo sapiens
auaauggcuucuucucuua

SEQ ID NO: 134886 - RNA, 19 nt, Homo sapiens
aauaauggcuucuucucuu

SEQ ID NO: 134887 - RNA, 19 nt, Homo sapiens
cacgguagaugcuggagua

SEQ ID NO: 134888 - RNA, 19 nt, Homo sapiens
gagcaggauugccagguau

SEQ ID NO: 134889 - RNA, 19 nt, Homo sapiens
cgaaggagucucaugcuuu

SEQ ID NO: 134890 - RNA, 19 nt, Homo sapiens
gaaucacuaucuucucugu

SEQ ID NO: 134891 - RNA, 19 nt, Homo sapiens
gcauacugcucagaaauuc

SEQ ID NO: 134892 - RNA, 19 nt, Homo sapiens
aaaaguggcucuaauguug

SEQ ID NO: 134893 - RNA, 19 nt, Homo sapiens
cacaguaacuaaaggcaaa

SEQ ID NO: 134894 - RNA, 19 nt, Homo sapiens
gauccaguguguaaauugu

SEQ ID NO: 134895 - RNA, 19 nt, Homo sapiens
gaaauguguuuggcccuau

SEQ ID NO: 134896 - RNA, 19 nt, Homo sapiens
ggacaucaggaaagagaaa

SEQ ID NO: 134897 - RNA, 19 nt, Homo sapiens
uguccuagcugucaucaga

SEQ ID NO: 134898 - RNA, 19 nt, Homo sapiens
ccaauggcauccagucuca

SEQ ID NO: 134899 - RNA, 19 nt, Homo sapiens
gaauaagagagcaggauug

SEQ ID NO: 134900 - RNA, 19 nt, Homo sapiens
cagaagcugugcacucaug

SEQ ID NO: 134901 - RNA, 19 nt, Homo sapiens
gcagcgccgauuuaauuua

SEQ ID NO: 134902 - RNA, 19 nt, Homo sapiens
aaucauggcucuuagaaac

SEQ ID NO: 134903 - RNA, 19 nt, Homo sapiens
gaugggcaguccuaugaug

SEQ ID NO: 134904 - RNA, 19 nt, Homo sapiens
gcuguacaguuuacuuaug

SEQ ID NO: 134905 - RNA, 19 nt, Homo sapiens
ccacaugcccaacugguuu

SEQ ID NO: 134906 - RNA, 19 nt, Homo sapiens
gaaccaauuguuucugaug

SEQ ID NO: 134907 - RNA, 19 nt, Homo sapiens
cagaugggcaguccuauga

SEQ ID NO: 134908 - RNA, 19 nt, Homo sapiens
aaaggagaccuguaucaaa

SEQ ID NO: 134909 - RNA, 19 nt, Homo sapiens
uaaccaugccuacuaaaug

SEQ ID NO: 134910 - RNA, 19 nt, Homo sapiens
guucuaaccaugccuacua

SEQ ID NO: 134911 - RNA, 19 nt, Homo sapiens
caaagagaauguccuagcu

SEQ ID NO: 134912 - RNA, 19 nt, Homo sapiens
agaguuuggugucaaugua

SEQ ID NO: 134913 - RNA, 19 nt, Homo sapiens
uagccuaccuggucgagaa

SEQ ID NO: 134914 - RNA, 19 nt, Homo sapiens
cuuagaaacucaggaaaga

SEQ ID NO: 134915 - RNA, 19 nt, Homo sapiens
gacuauagcaccaaagaga

SEQ ID NO: 134916 - RNA, 19 nt, Homo sapiens
gcaauaaaacugcuaguga

SEQ ID NO: 134917 - RNA, 19 nt, Homo sapiens
gagaauguccuagcuguca

SEQ ID NO: 134918 - RNA, 19 nt, Homo sapiens
agacauugcauuucugauu

SEQ ID NO: 134919 - RNA, 19 nt, Homo sapiens
guaaagcagacauugcauu

SEQ ID NO: 134920 - RNA, 19 nt, Homo sapiens
uagauggucugcuucuuuc

SEQ ID NO: 134921 - RNA, 19 nt, Homo sapiens
gauuagaaccaauuguuuc

SEQ ID NO: 134922 - RNA, 19 nt, Homo sapiens
caaagugguggugguauuu

SEQ ID NO: 134923 - RNA, 19 nt, Homo sapiens
gaaaacacccgagaagaaa

SEQ ID NO: 134924 - RNA, 19 nt, Homo sapiens
ggagaccuguaucaaacug

SEQ ID NO: 134925 - RNA, 19 nt, Homo sapiens
gggauccaguguguaaauu

SEQ ID NO: 134926 - RNA, 19 nt, Homo sapiens
ccaagccuaucccugaaga

SEQ ID NO: 134927 - RNA, 19 nt, Homo sapiens
aagcagacauugcauuucu

SEQ ID NO: 134928 - RNA, 19 nt, Homo sapiens
caaaugcuuucuagauggu

SEQ ID NO: 134929 - RNA, 19 nt, Homo sapiens
aaggcugucugucggaaua

SEQ ID NO: 134930 - RNA, 19 nt, Homo sapiens
cauccagucucaaaugcuu

SEQ ID NO: 134931 - RNA, 19 nt, Homo sapiens
agagcaggauugccaggua

SEQ ID NO: 134932 - RNA, 19 nt, Homo sapiens
guaugucaacagccauuua

SEQ ID NO: 134933 - RNA, 19 nt, Homo sapiens
uagaaucccagcaauaaug

SEQ ID NO: 134934 - RNA, 19 nt, Homo sapiens
gaggaauucucuguguaug

SEQ ID NO: 134935 - RNA, 19 nt, Homo sapiens
acaagaacuuccuaguaau

SEQ ID NO: 134936 - RNA, 19 nt, Homo sapiens
ccucaugcuugaauuuguu

SEQ ID NO: 134937 - RNA, 19 nt, Homo sapiens
cuagauggucugcuucuuu

SEQ ID NO: 134938 - RNA, 19 nt, Homo sapiens
agaaaacuauuccucagua

SEQ ID NO: 134939 - RNA, 19 nt, Homo sapiens
aaccaugccuacuaaaugu

SEQ ID NO: 134940 - RNA, 19 nt, Homo sapiens
cucaagagcugguuuguua

SEQ ID NO: 134941 - RNA, 19 nt, Homo sapiens
ggaaguaaccaaacaagaa

SEQ ID NO: 134942 - RNA, 19 nt, Homo sapiens
gaaacuugcuggauaugau

SEQ ID NO: 134943 - RNA, 19 nt, Homo sapiens
gaucugggcucccugacuu

SEQ ID NO: 134944 - RNA, 19 nt, Homo sapiens
aagaagaccucaugagaga

SEQ ID NO: 134945 - RNA, 19 nt, Homo sapiens
agagcugguuuguuaauua

SEQ ID NO: 134946 - RNA, 19 nt, Homo sapiens
gagcugguuuguuaauuau

SEQ ID NO: 134947 - RNA, 19 nt, Homo sapiens
gugacaggcuccacuuuga

SEQ ID NO: 134948 - RNA, 19 nt, Homo sapiens
gcugguuuguuaauuauug

SEQ ID NO: 134949 - RNA, 19 nt, Homo sapiens
cuuggaaacuugcuggaua

SEQ ID NO: 134950 - RNA, 19 nt, Homo sapiens
uaaccaauaccaugaaguu

SEQ ID NO: 134951 - RNA, 19 nt, Homo sapiens
guaaagaaucuguaaccaa

SEQ ID NO: 134952 - RNA, 19 nt, Homo sapiens
gaaguaaccaaacaagaag

SEQ ID NO: 134953 - RNA, 19 nt, Homo sapiens
caaacaagaagaccucaug

SEQ ID NO: 134954 - RNA, 19 nt, Homo sapiens
ggaagugaucgcuguguga

SEQ ID NO: 134955 - RNA, 19 nt, Homo sapiens
gcacgaugguccuacacau

SEQ ID NO: 134956 - RNA, 19 nt, Homo sapiens
acaagaagaccucaugaga

SEQ ID NO: 134957 - RNA, 19 nt, Homo sapiens
gguguuggaugucaaugau

SEQ ID NO: 134958 - RNA, 19 nt, Homo sapiens
gaagugaucgcugugugaa

SEQ ID NO: 134959 - RNA, 19 nt, Homo sapiens
ggaugucaaugaugauuuu

SEQ ID NO: 134960 - RNA, 19 nt, Homo sapiens
ggaagccaguacagaucuu

SEQ ID NO: 134961 - RNA, 19 nt, Homo sapiens
ggaaacuugcuggauauga

SEQ ID NO: 134962 - RNA, 19 nt, Homo sapiens
ggccugcacugcccaaagu

SEQ ID NO: 134963 - RNA, 19 nt, Homo sapiens
guuagacuuugccauuguu

SEQ ID NO: 134964 - RNA, 19 nt, Homo sapiens
caagagcugguuuguuaau

SEQ ID NO: 134965 - RNA, 19 nt, Homo sapiens
gagcgagugagcagcgaua

SEQ ID NO: 134966 - RNA, 19 nt, Homo sapiens
uguuggaugucaaugauga

SEQ ID NO: 134967 - RNA, 19 nt, Homo sapiens
aagaaucuguaaccaauac

SEQ ID NO: 134968 - RNA, 19 nt, Homo sapiens
aaacaagaagaccucauga

SEQ ID NO: 134969 - RNA, 19 nt, Homo sapiens
ccaggaagccaguacagau

SEQ ID NO: 134970 - RNA, 19 nt, Homo sapiens
gaagccaguacagaucuuu

SEQ ID NO: 134971 - RNA, 19 nt, Homo sapiens
cuggagcccuucccugaga

SEQ ID NO: 134972 - RNA, 19 nt, Homo sapiens
cuacacauuccagacauuu

SEQ ID NO: 134973 - RNA, 19 nt, Homo sapiens
uuggaaacuugcuggauau

SEQ ID NO: 134974 - RNA, 19 nt, Homo sapiens
ucaguuccauggccaagag

SEQ ID NO: 134975 - RNA, 19 nt, Homo sapiens
cugaggaaguaaccaaaca

SEQ ID NO: 134976 - RNA, 19 nt, Homo sapiens
ccuacacauuccagacauu

SEQ ID NO: 134977 - RNA, 19 nt, Homo sapiens
aagagcugguuuguuaauu

SEQ ID NO: 134978 - RNA, 19 nt, Homo sapiens
ucaagagcugguuuguuaa

SEQ ID NO: 134979 - RNA, 19 nt, Homo sapiens
gaggaaguaaccaaacaag

SEQ ID NO: 134980 - RNA, 19 nt, Homo sapiens
cccgaaggcucuccaucga

SEQ ID NO: 134981 - RNA, 19 nt, Homo sapiens
ccagcacgaugguccuaca

SEQ ID NO: 134982 - RNA, 19 nt, Homo sapiens
uguuagacuuugccauugu

SEQ ID NO: 134983 - RNA, 19 nt, Homo sapiens
agugaucgcugugugaauc

SEQ ID NO: 134984 - RNA, 19 nt, Homo sapiens
gugcugguguuggauguca

SEQ ID NO: 134985 - RNA, 19 nt, Homo sapiens
ccaguacagaucuuugaga

SEQ ID NO: 134986 - RNA, 19 nt, Homo sapiens
gccauuguuuucuuuugua

SEQ ID NO: 134987 - RNA, 19 nt, Homo sapiens
uugaggcucugaugaacau

SEQ ID NO: 134988 - RNA, 19 nt, Homo sapiens
ccacuuugaggcucugaug

SEQ ID NO: 134989 - RNA, 19 nt, Homo sapiens
cacgaugguccuacacauu

SEQ ID NO: 134990 - RNA, 19 nt, Homo sapiens
cgagcacccuucaguucca

SEQ ID NO: 134991 - RNA, 19 nt, Homo sapiens
aaacuugcuggauaugaug

SEQ ID NO: 134992 - RNA, 19 nt, Homo sapiens
ucuguaaccaauaccauga

SEQ ID NO: 134993 - RNA, 19 nt, Homo sapiens
gcucucggcggaagugauc

SEQ ID NO: 134994 - RNA, 19 nt, Homo sapiens
gcccuucccugagaaacuc

SEQ ID NO: 134995 - RNA, 19 nt, Homo sapiens
caacgaagcuccacuuuga

SEQ ID NO: 134996 - RNA, 19 nt, Homo sapiens
gaauugagcuggccuaucu

SEQ ID NO: 134997 - RNA, 19 nt, Homo sapiens
cucaagagcugguuuguua

SEQ ID NO: 134998 - RNA, 19 nt, Homo sapiens
ggaaguaaccaaacaagaa

SEQ ID NO: 134999 - RNA, 19 nt, Homo sapiens
gaaacuugcuggauaugau

SEQ ID NO: 135000 - RNA, 19 nt, Homo sapiens
gaucugggcucccugacuu

SEQ ID NO: 135001 - RNA, 19 nt, Homo sapiens
aagaagaccucaugagaga

SEQ ID NO: 135002 - RNA, 19 nt, Homo sapiens
agagcugguuuguuaauua

SEQ ID NO: 135003 - RNA, 19 nt, Homo sapiens
gagcugguuuguuaauuau

SEQ ID NO: 135004 - RNA, 19 nt, Homo sapiens
gguaacauccucaagcaaa

SEQ ID NO: 135005 - RNA, 19 nt, Homo sapiens
gcugguuuguuaauuauug

SEQ ID NO: 135006 - RNA, 19 nt, Homo sapiens
acagguauaucuuugcaaa

SEQ ID NO: 135007 - RNA, 19 nt, Homo sapiens
cuuggaaacuugcuggaua

SEQ ID NO: 135008 - RNA, 19 nt, Homo sapiens
uaaccaauaccaugaaguu

SEQ ID NO: 135009 - RNA, 19 nt, Homo sapiens
guaaagaaucuguaaccaa

SEQ ID NO: 135010 - RNA, 19 nt, Homo sapiens
uaucaggacuggcauucuu

SEQ ID NO: 135011 - RNA, 19 nt, Homo sapiens
guaacauccucaagcaaau

SEQ ID NO: 135012 - RNA, 19 nt, Homo sapiens
gaaguaaccaaacaagaag

SEQ ID NO: 135013 - RNA, 19 nt, Homo sapiens
ggaagugaucgcuguguga

SEQ ID NO: 135014 - RNA, 19 nt, Homo sapiens
caaacaagaagaccucaug

SEQ ID NO: 135015 - RNA, 19 nt, Homo sapiens
gcacgaugguccuacacau

SEQ ID NO: 135016 - RNA, 19 nt, Homo sapiens
acaagaagaccucaugaga

SEQ ID NO: 135017 - RNA, 19 nt, Homo sapiens
gguguuggaugucaaugau

SEQ ID NO: 135018 - RNA, 19 nt, Homo sapiens
gaagugaucgcugugugaa

SEQ ID NO: 135019 - RNA, 19 nt, Homo sapiens
ggaugucaaugaugauuuu

SEQ ID NO: 135020 - RNA, 19 nt, Homo sapiens
ggaagccaguacagaucuu

SEQ ID NO: 135021 - RNA, 19 nt, Homo sapiens
cacauuacauggcuucauc

SEQ ID NO: 135022 - RNA, 19 nt, Homo sapiens
ggaggaggagaaaggaauu

SEQ ID NO: 135023 - RNA, 19 nt, Homo sapiens
ggaaacuugcuggauauga

SEQ ID NO: 135024 - RNA, 19 nt, Homo sapiens
ggccugcacugcccaaagu

SEQ ID NO: 135025 - RNA, 19 nt, Homo sapiens
gagagcacccauucaggaa

SEQ ID NO: 135026 - RNA, 19 nt, Homo sapiens
gaaggcaacauugguaaca

SEQ ID NO: 135027 - RNA, 19 nt, Homo sapiens
gagcacccauucaggaaac

SEQ ID NO: 135028 - RNA, 19 nt, Homo sapiens
guuagacuuugccauuguu

SEQ ID NO: 135029 - RNA, 19 nt, Homo sapiens
caagagcugguuuguuaau

SEQ ID NO: 135030 - RNA, 19 nt, Homo sapiens
gagcgagugagcagcgaua

SEQ ID NO: 135031 - RNA, 19 nt, Homo sapiens
ugacagguauaucuuugca

SEQ ID NO: 135032 - RNA, 19 nt, Homo sapiens
uguuggaugucaaugauga

SEQ ID NO: 135033 - RNA, 19 nt, Homo sapiens
aagaaucuguaaccaauac

SEQ ID NO: 135034 - RNA, 19 nt, Homo sapiens
aaacaagaagaccucauga

SEQ ID NO: 135035 - RNA, 19 nt, Homo sapiens
ccaggaagccaguacagau

SEQ ID NO: 135036 - RNA, 19 nt, Homo sapiens
gacaacgaagcuccacuuu

SEQ ID NO: 135037 - RNA, 19 nt, Homo sapiens
gacaucgaguggcauaucu

SEQ ID NO: 135038 - RNA, 19 nt, Homo sapiens
gaagccaguacagaucuuu

SEQ ID NO: 135039 - RNA, 19 nt, Homo sapiens
gggaggaggagaaaggaau

SEQ ID NO: 135040 - RNA, 19 nt, Homo sapiens
ucgaguggcauaucuauca

SEQ ID NO: 135041 - RNA, 19 nt, Homo sapiens
agugacagguauaucuuug

SEQ ID NO: 135042 - RNA, 19 nt, Homo sapiens
cuggagcccuucccugaga

SEQ ID NO: 135043 - RNA, 19 nt, Homo sapiens
cuacacauuccagacauuu

SEQ ID NO: 135044 - RNA, 19 nt, Homo sapiens
uuggaaacuugcuggauau

SEQ ID NO: 135045 - RNA, 19 nt, Homo sapiens
cugaggaaguaaccaaaca

SEQ ID NO: 135046 - RNA, 19 nt, Homo sapiens
ccuacacauuccagacauu

SEQ ID NO: 135047 - RNA, 19 nt, Homo sapiens
ucaguuccauggccaagag

SEQ ID NO: 135048 - RNA, 19 nt, Homo sapiens
aagagcugguuuguuaauu

SEQ ID NO: 135049 - RNA, 19 nt, Homo sapiens
ucaagagcugguuuguuaa

SEQ ID NO: 135050 - RNA, 19 nt, Homo sapiens
gaggaaguaaccaaacaag

SEQ ID NO: 135051 - RNA, 19 nt, Homo sapiens
ccagguuuguuugaagaga

SEQ ID NO: 135052 - RNA, 19 nt, Homo sapiens
ccagcacgaugguccuaca

SEQ ID NO: 135053 - RNA, 19 nt, Homo sapiens
cccgaaggcucuccaucga

SEQ ID NO: 135054 - RNA, 19 nt, Homo sapiens
agacaacgaagcuccacuu

SEQ ID NO: 135055 - RNA, 19 nt, Homo sapiens
ccagccggaucacauuaca

SEQ ID NO: 135056 - RNA, 19 nt, Homo sapiens
caagcaaaucagaaugaga

SEQ ID NO: 135057 - RNA, 19 nt, Homo sapiens
caucgaguggcauaucuau

SEQ ID NO: 135058 - RNA, 19 nt, Homo sapiens
uguuagacuuugccauugu

SEQ ID NO: 135059 - RNA, 19 nt, Homo sapiens
agugaucgcugugugaauc

SEQ ID NO: 135060 - RNA, 19 nt, Homo sapiens
gugcugguguuggauguca

SEQ ID NO: 135061 - RNA, 19 nt, Homo sapiens
acaacgaagcuccacuuug

SEQ ID NO: 135062 - RNA, 19 nt, Homo sapiens
ucaagcaaaucagaaugag

SEQ ID NO: 135063 - RNA, 19 nt, Homo sapiens
ccaguacagaucuuugaga

SEQ ID NO: 135064 - RNA, 19 nt, Homo sapiens
gccauuguuuucuuuugua

SEQ ID NO: 135065 - RNA, 19 nt, Homo sapiens
uugaggcucugaugaacau

SEQ ID NO: 135066 - RNA, 19 nt, Homo sapiens
ccacuuugaggcucugaug

SEQ ID NO: 135067 - RNA, 19 nt, Homo sapiens
uguguacagugacagguau

SEQ ID NO: 135068 - RNA, 19 nt, Homo sapiens
cacgaugguccuacacauu

SEQ ID NO: 135069 - RNA, 19 nt, Homo sapiens
ucgaaggcaacauugguaa

SEQ ID NO: 135070 - RNA, 19 nt, Homo sapiens
gaggaggagaaaggaauug

SEQ ID NO: 135071 - RNA, 19 nt, Homo sapiens
ggaauugagcuggccuauc

SEQ ID NO: 135072 - RNA, 19 nt, Homo sapiens
cgagcacccuucaguucca

SEQ ID NO: 135073 - RNA, 19 nt, Homo sapiens
aaacuugcuggauaugaug

SEQ ID NO: 135074 - RNA, 19 nt, Homo sapiens
ucuguaaccaauaccauga

SEQ ID NO: 135075 - RNA, 19 nt, Homo sapiens
gcagcugcauggccaacac

SEQ ID NO: 135076 - RNA, 19 nt, Homo sapiens
ccagggaggaggagaaagg

SEQ ID NO: 135077 - RNA, 19 nt, Homo sapiens
ggacuggcauucuuuucuc

SEQ ID NO: 135078 - RNA, 19 nt, Homo sapiens
gcucucggcggaagugauc

SEQ ID NO: 135079 - RNA, 19 nt, Homo sapiens
cagugacagguauaucuuu

SEQ ID NO: 135080 - RNA, 19 nt, Homo sapiens
aggcaacauugguaacauc

SEQ ID NO: 135081 - RNA, 19 nt, Homo sapiens
gcccuucccugagaaacuc

SEQ ID NO: 135082 - RNA, 19 nt, Homo sapiens
caacgaagcuccacuuuga

SEQ ID NO: 135083 - RNA, 19 nt, Homo sapiens
gaauugagcuggccuaucu

SEQ ID NO: 135084 - RNA, 19 nt, Homo sapiens
cucaagagcugguuuguua

SEQ ID NO: 135085 - RNA, 19 nt, Homo sapiens
ggaaguaaccaaacaagaa

SEQ ID NO: 135086 - RNA, 19 nt, Homo sapiens
gaaacuugcuggauaugau

SEQ ID NO: 135087 - RNA, 19 nt, Homo sapiens
guagcaacauggcagaaua

SEQ ID NO: 135088 - RNA, 19 nt, Homo sapiens
gaucugggcucccugacuu

SEQ ID NO: 135089 - RNA, 19 nt, Homo sapiens
aagaagaccucaugagaga

SEQ ID NO: 135090 - RNA, 19 nt, Homo sapiens
agagcugguuuguuaauua

SEQ ID NO: 135091 - RNA, 19 nt, Homo sapiens
gagcugguuuguuaauuau

SEQ ID NO: 135092 - RNA, 19 nt, Homo sapiens
gcacguagcuacagaaccu

SEQ ID NO: 135093 - RNA, 19 nt, Homo sapiens
ggaaaguccacguuuguga

SEQ ID NO: 135094 - RNA, 19 nt, Homo sapiens
gaaaguccacguuugugaa

SEQ ID NO: 135095 - RNA, 19 nt, Homo sapiens
caacauugcugugggaaag

SEQ ID NO: 135096 - RNA, 19 nt, Homo sapiens
gcugguuuguuaauuauug

SEQ ID NO: 135097 - RNA, 19 nt, Homo sapiens
acagguauaucuuugcaaa

SEQ ID NO: 135098 - RNA, 19 nt, Homo sapiens
cuuggaaacuugcuggaua

SEQ ID NO: 135099 - RNA, 19 nt, Homo sapiens
uaaccaauaccaugaaguu

SEQ ID NO: 135100 - RNA, 19 nt, Homo sapiens
guaaagaaucuguaaccaa

SEQ ID NO: 135101 - RNA, 19 nt, Homo sapiens
uaucaggacuggcauucuu

SEQ ID NO: 135102 - RNA, 19 nt, Homo sapiens
gaaguaaccaaacaagaag

SEQ ID NO: 135103 - RNA, 19 nt, Homo sapiens
caaacaagaagaccucaug

SEQ ID NO: 135104 - RNA, 19 nt, Homo sapiens
gcacgaugguccuacacau

SEQ ID NO: 135105 - RNA, 19 nt, Homo sapiens
ggaagugaucgcuguguga

SEQ ID NO: 135106 - RNA, 19 nt, Homo sapiens
acaagaagaccucaugaga

SEQ ID NO: 135107 - RNA, 19 nt, Homo sapiens
gguguuggaugucaaugau

SEQ ID NO: 135108 - RNA, 19 nt, Homo sapiens
gaagugaucgcugugugaa

SEQ ID NO: 135109 - RNA, 19 nt, Homo sapiens
caacauggcagaauaucca

SEQ ID NO: 135110 - RNA, 19 nt, Homo sapiens
ggaugucaaugaugauuuu

SEQ ID NO: 135111 - RNA, 19 nt, Homo sapiens
ggaagccaguacagaucuu

SEQ ID NO: 135112 - RNA, 19 nt, Homo sapiens
cacauuacauggcuucauc

SEQ ID NO: 135113 - RNA, 19 nt, Homo sapiens
ggaggaggagaaaggaauu

SEQ ID NO: 135114 - RNA, 19 nt, Homo sapiens
ggaaacuugcuggauauga

SEQ ID NO: 135115 - RNA, 19 nt, Homo sapiens
guuagacuuugccauuguu

SEQ ID NO: 135116 - RNA, 19 nt, Homo sapiens
caagagcugguuuguuaau

SEQ ID NO: 135117 - RNA, 19 nt, Homo sapiens
gagcgagugagcagcgaua

SEQ ID NO: 135118 - RNA, 19 nt, Homo sapiens
ugacagguauaucuuugca

SEQ ID NO: 135119 - RNA, 19 nt, Homo sapiens
uguuggaugucaaugauga

SEQ ID NO: 135120 - RNA, 19 nt, Homo sapiens
aagaaucuguaaccaauac

SEQ ID NO: 135121 - RNA, 19 nt, Homo sapiens
aaacaagaagaccucauga

SEQ ID NO: 135122 - RNA, 19 nt, Homo sapiens
ccaggaagccaguacagau

SEQ ID NO: 135123 - RNA, 19 nt, Homo sapiens
gacaacgaagcuccacuuu

SEQ ID NO: 135124 - RNA, 19 nt, Homo sapiens
gacaucgaguggcauaucu

SEQ ID NO: 135125 - RNA, 19 nt, Homo sapiens
gaagccaguacagaucuuu

SEQ ID NO: 135126 - RNA, 19 nt, Homo sapiens
cagaaccuguagcaacaug

SEQ ID NO: 135127 - RNA, 19 nt, Homo sapiens
guccacguuugugaaguua

SEQ ID NO: 135128 - RNA, 19 nt, Homo sapiens
gggaggaggagaaaggaau

SEQ ID NO: 135129 - RNA, 19 nt, Homo sapiens
ucgaguggcauaucuauca

SEQ ID NO: 135130 - RNA, 19 nt, Homo sapiens
cacgaaaacuuacccagaa

SEQ ID NO: 135131 - RNA, 19 nt, Homo sapiens
agugacagguauaucuuug

SEQ ID NO: 135132 - RNA, 19 nt, Homo sapiens
cuggagcccuucccugaga

SEQ ID NO: 135133 - RNA, 19 nt, Homo sapiens
cuacacauuccagacauuu

SEQ ID NO: 135134 - RNA, 19 nt, Homo sapiens
uuggaaacuugcuggauau

SEQ ID NO: 135135 - RNA, 19 nt, Homo sapiens
cugaggaaguaaccaaaca

SEQ ID NO: 135136 - RNA, 19 nt, Homo sapiens
ucaguuccauggccaagag

SEQ ID NO: 135137 - RNA, 19 nt, Homo sapiens
ccuacacauuccagacauu

SEQ ID NO: 135138 - RNA, 19 nt, Homo sapiens
aagagcugguuuguuaauu

SEQ ID NO: 135139 - RNA, 19 nt, Homo sapiens
ccacguuugugaaguuacu

SEQ ID NO: 135140 - RNA, 19 nt, Homo sapiens
ucaagagcugguuuguuaa

SEQ ID NO: 135141 - RNA, 19 nt, Homo sapiens
gaggaaguaaccaaacaag

SEQ ID NO: 135142 - RNA, 19 nt, Homo sapiens
ccagguuuguuugaagaga

SEQ ID NO: 135143 - RNA, 19 nt, Homo sapiens
cccgaaggcucuccaucga

SEQ ID NO: 135144 - RNA, 19 nt, Homo sapiens
ccagcacgaugguccuaca

SEQ ID NO: 135145 - RNA, 19 nt, Homo sapiens
uagcaacauggcagaauau

SEQ ID NO: 135146 - RNA, 19 nt, Homo sapiens
agacaacgaagcuccacuu

SEQ ID NO: 135147 - RNA, 19 nt, Homo sapiens
ccagccggaucacauuaca

SEQ ID NO: 135148 - RNA, 19 nt, Homo sapiens
caucgaguggcauaucuau

SEQ ID NO: 135149 - RNA, 19 nt, Homo sapiens
uguuagacuuugccauugu

SEQ ID NO: 135150 - RNA, 19 nt, Homo sapiens
gugcugguguuggauguca

SEQ ID NO: 135151 - RNA, 19 nt, Homo sapiens
acaacgaagcuccacuuug

SEQ ID NO: 135152 - RNA, 19 nt, Homo sapiens
aguccacguuugugaaguu

SEQ ID NO: 135153 - RNA, 19 nt, Homo sapiens
ccaguacagaucuuugaga

SEQ ID NO: 135154 - RNA, 19 nt, Homo sapiens
agugaucgcugugugaauc

SEQ ID NO: 135155 - RNA, 19 nt, Homo sapiens
gccauuguuuucuuuugua

SEQ ID NO: 135156 - RNA, 19 nt, Homo sapiens
uugaggcucugaugaacau

SEQ ID NO: 135157 - RNA, 19 nt, Homo sapiens
ccacuuugaggcucugaug

SEQ ID NO: 135158 - RNA, 19 nt, Homo sapiens
uguguacagugacagguau

SEQ ID NO: 135159 - RNA, 19 nt, Homo sapiens
cacgaugguccuacacauu

SEQ ID NO: 135160 - RNA, 19 nt, Homo sapiens
gaggaggagaaaggaauug

SEQ ID NO: 135161 - RNA, 19 nt, Homo sapiens
cgagcacccuucaguucca

SEQ ID NO: 135162 - RNA, 19 nt, Homo sapiens
ggaauugagcuggccuauc

SEQ ID NO: 135163 - RNA, 19 nt, Homo sapiens
aaacuugcuggauaugaug

SEQ ID NO: 135164 - RNA, 19 nt, Homo sapiens
ucuguaaccaauaccauga

SEQ ID NO: 135165 - RNA, 19 nt, Homo sapiens
gcucucggcggaagugauc

SEQ ID NO: 135166 - RNA, 19 nt, Homo sapiens
gcagcugcauggccaacac

SEQ ID NO: 135167 - RNA, 19 nt, Homo sapiens
ccagggaggaggagaaagg

SEQ ID NO: 135168 - RNA, 19 nt, Homo sapiens
ggacuggcauucuuuucuc

SEQ ID NO: 135169 - RNA, 19 nt, Homo sapiens
cagugacagguauaucuuu

SEQ ID NO: 135170 - RNA, 19 nt, Homo sapiens
gcccuucccugagaaacuc

SEQ ID NO: 135171 - RNA, 19 nt, Homo sapiens
caacgaagcuccacuuuga

SEQ ID NO: 135172 - RNA, 19 nt, Homo sapiens
gaauugagcuggccuaucu

SEQ ID NO: 135173 - RNA, 19 nt, Homo sapiens
cucaagagcugguuuguua

SEQ ID NO: 135174 - RNA, 19 nt, Homo sapiens
ggaaguaaccaaacaagaa

SEQ ID NO: 135175 - RNA, 19 nt, Homo sapiens
gaaacuugcuggauaugau

SEQ ID NO: 135176 - RNA, 19 nt, Homo sapiens
gaucugggcucccugacuu

SEQ ID NO: 135177 - RNA, 19 nt, Homo sapiens
aagaagaccucaugagaga

SEQ ID NO: 135178 - RNA, 19 nt, Homo sapiens
agagcugguuuguuaauua

SEQ ID NO: 135179 - RNA, 19 nt, Homo sapiens
gagcugguuuguuaauuau

SEQ ID NO: 135180 - RNA, 19 nt, Homo sapiens
gcugguuuguuaauuauug

SEQ ID NO: 135181 - RNA, 19 nt, Homo sapiens
acagguauaucuuugcaaa

SEQ ID NO: 135182 - RNA, 19 nt, Homo sapiens
cuuggaaacuugcuggaua

SEQ ID NO: 135183 - RNA, 19 nt, Homo sapiens
uaaccaauaccaugaaguu

SEQ ID NO: 135184 - RNA, 19 nt, Homo sapiens
guaaagaaucuguaaccaa

SEQ ID NO: 135185 - RNA, 19 nt, Homo sapiens
uaucaggacuggcauucuu

SEQ ID NO: 135186 - RNA, 19 nt, Homo sapiens
gaaguaaccaaacaagaag

SEQ ID NO: 135187 - RNA, 19 nt, Homo sapiens
ggaagugaucgcuguguga

SEQ ID NO: 135188 - RNA, 19 nt, Homo sapiens
caaacaagaagaccucaug

SEQ ID NO: 135189 - RNA, 19 nt, Homo sapiens
gcacgaugguccuacacau

SEQ ID NO: 135190 - RNA, 19 nt, Homo sapiens
acaagaagaccucaugaga

SEQ ID NO: 135191 - RNA, 19 nt, Homo sapiens
gguguuggaugucaaugau

SEQ ID NO: 135192 - RNA, 19 nt, Homo sapiens
gaagugaucgcugugugaa

SEQ ID NO: 135193 - RNA, 19 nt, Homo sapiens
ggaugucaaugaugauuuu

SEQ ID NO: 135194 - RNA, 19 nt, Homo sapiens
ggaagccaguacagaucuu

SEQ ID NO: 135195 - RNA, 19 nt, Homo sapiens
cacauuacauggcuucauc

SEQ ID NO: 135196 - RNA, 19 nt, Homo sapiens
ggaggaggagaaaggaauu

SEQ ID NO: 135197 - RNA, 19 nt, Homo sapiens
ggaaacuugcuggauauga

SEQ ID NO: 135198 - RNA, 19 nt, Homo sapiens
ggccugcacugcccaaagu

SEQ ID NO: 135199 - RNA, 19 nt, Homo sapiens
guuagacuuugccauuguu

SEQ ID NO: 135200 - RNA, 19 nt, Homo sapiens
caagagcugguuuguuaau

SEQ ID NO: 135201 - RNA, 19 nt, Homo sapiens
gagcgagugagcagcgaua

SEQ ID NO: 135202 - RNA, 19 nt, Homo sapiens
ugacagguauaucuuugca

SEQ ID NO: 135203 - RNA, 19 nt, Homo sapiens
uguuggaugucaaugauga

SEQ ID NO: 135204 - RNA, 19 nt, Homo sapiens
aagaaucuguaaccaauac

SEQ ID NO: 135205 - RNA, 19 nt, Homo sapiens
aaacaagaagaccucauga

SEQ ID NO: 135206 - RNA, 19 nt, Homo sapiens
ccaggaagccaguacagau

SEQ ID NO: 135207 - RNA, 19 nt, Homo sapiens
gacaacgaagcuccacuuu

SEQ ID NO: 135208 - RNA, 19 nt, Homo sapiens
gacaucgaguggcauaucu

SEQ ID NO: 135209 - RNA, 19 nt, Homo sapiens
gaagccaguacagaucuuu

SEQ ID NO: 135210 - RNA, 19 nt, Homo sapiens
gggaggaggagaaaggaau

SEQ ID NO: 135211 - RNA, 19 nt, Homo sapiens
ucgaguggcauaucuauca

SEQ ID NO: 135212 - RNA, 19 nt, Homo sapiens
agugacagguauaucuuug

SEQ ID NO: 135213 - RNA, 19 nt, Homo sapiens
cuggagcccuucccugaga

SEQ ID NO: 135214 - RNA, 19 nt, Homo sapiens
cuacacauuccagacauuu

SEQ ID NO: 135215 - RNA, 19 nt, Homo sapiens
uuggaaacuugcuggauau

SEQ ID NO: 135216 - RNA, 19 nt, Homo sapiens
ucaguuccauggccaagag

SEQ ID NO: 135217 - RNA, 19 nt, Homo sapiens
cugaggaaguaaccaaaca

SEQ ID NO: 135218 - RNA, 19 nt, Homo sapiens
ccuacacauuccagacauu

SEQ ID NO: 135219 - RNA, 19 nt, Homo sapiens
aagagcugguuuguuaauu

SEQ ID NO: 135220 - RNA, 19 nt, Homo sapiens
ucaagagcugguuuguuaa

SEQ ID NO: 135221 - RNA, 19 nt, Homo sapiens
gaggaaguaaccaaacaag

SEQ ID NO: 135222 - RNA, 19 nt, Homo sapiens
cccgaaggcucuccaucga

SEQ ID NO: 135223 - RNA, 19 nt, Homo sapiens
ccagguuuguuugaagaga

SEQ ID NO: 135224 - RNA, 19 nt, Homo sapiens
ccagcacgaugguccuaca

SEQ ID NO: 135225 - RNA, 19 nt, Homo sapiens
agacaacgaagcuccacuu

SEQ ID NO: 135226 - RNA, 19 nt, Homo sapiens
ccagccggaucacauuaca

SEQ ID NO: 135227 - RNA, 19 nt, Homo sapiens
caucgaguggcauaucuau

SEQ ID NO: 135228 - RNA, 19 nt, Homo sapiens
uguuagacuuugccauugu

SEQ ID NO: 135229 - RNA, 19 nt, Homo sapiens
agugaucgcugugugaauc

SEQ ID NO: 135230 - RNA, 19 nt, Homo sapiens
gugcugguguuggauguca

SEQ ID NO: 135231 - RNA, 19 nt, Homo sapiens
acaacgaagcuccacuuug

SEQ ID NO: 135232 - RNA, 19 nt, Homo sapiens
ccaguacagaucuuugaga

SEQ ID NO: 135233 - RNA, 19 nt, Homo sapiens
gccauuguuuucuuuugua

SEQ ID NO: 135234 - RNA, 19 nt, Homo sapiens
cacgaugguccuacacauu

SEQ ID NO: 135235 - RNA, 19 nt, Homo sapiens
uugaggcucugaugaacau

SEQ ID NO: 135236 - RNA, 19 nt, Homo sapiens
ccacuuugaggcucugaug

SEQ ID NO: 135237 - RNA, 19 nt, Homo sapiens
uguguacagugacagguau

SEQ ID NO: 135238 - RNA, 19 nt, Homo sapiens
gaggaggagaaaggaauug

SEQ ID NO: 135239 - RNA, 19 nt, Homo sapiens
aaacuugcuggauaugaug

SEQ ID NO: 135240 - RNA, 19 nt, Homo sapiens
ggaauugagcuggccuauc

SEQ ID NO: 135241 - RNA, 19 nt, Homo sapiens
cgagcacccuucaguucca

SEQ ID NO: 135242 - RNA, 19 nt, Homo sapiens
gcucucggcggaagugauc

SEQ ID NO: 135243 - RNA, 19 nt, Homo sapiens
ucuguaaccaauaccauga

SEQ ID NO: 135244 - RNA, 19 nt, Homo sapiens
gcagcugcauggccaacac

SEQ ID NO: 135245 - RNA, 19 nt, Homo sapiens
ccagggaggaggagaaagg

SEQ ID NO: 135246 - RNA, 19 nt, Homo sapiens
ggacuggcauucuuuucuc

SEQ ID NO: 135247 - RNA, 19 nt, Homo sapiens
cagugacagguauaucuuu

SEQ ID NO: 135248 - RNA, 19 nt, Homo sapiens
gcccuucccugagaaacuc

SEQ ID NO: 135249 - RNA, 19 nt, Homo sapiens
cucaagagcugguuuguua

SEQ ID NO: 135250 - RNA, 19 nt, Homo sapiens
ggaaguaaccaaacaagaa

SEQ ID NO: 135251 - RNA, 19 nt, Homo sapiens
gaaacuugcuggauaugau

SEQ ID NO: 135252 - RNA, 19 nt, Homo sapiens
guagcaacauggcagaaua

SEQ ID NO: 135253 - RNA, 19 nt, Homo sapiens
gaucugggcucccugacuu

SEQ ID NO: 135254 - RNA, 19 nt, Homo sapiens
aagaagaccucaugagaga

SEQ ID NO: 135255 - RNA, 19 nt, Homo sapiens
agagcugguuuguuaauua

SEQ ID NO: 135256 - RNA, 19 nt, Homo sapiens
gagcugguuuguuaauuau

SEQ ID NO: 135257 - RNA, 19 nt, Homo sapiens
gcacguagcuacagaaccu

SEQ ID NO: 135258 - RNA, 19 nt, Homo sapiens
ggaaaguccacguuuguga

SEQ ID NO: 135259 - RNA, 19 nt, Homo sapiens
gaaaguccacguuugugaa

SEQ ID NO: 135260 - RNA, 19 nt, Homo sapiens
gugacaggcuccacuuuga

SEQ ID NO: 135261 - RNA, 19 nt, Homo sapiens
caacauugcugugggaaag

SEQ ID NO: 135262 - RNA, 19 nt, Homo sapiens
gcugguuuguuaauuauug

SEQ ID NO: 135263 - RNA, 19 nt, Homo sapiens
cuuggaaacuugcuggaua

SEQ ID NO: 135264 - RNA, 19 nt, Homo sapiens
uaaccaauaccaugaaguu

SEQ ID NO: 135265 - RNA, 19 nt, Homo sapiens
guaaagaaucuguaaccaa

SEQ ID NO: 135266 - RNA, 19 nt, Homo sapiens
gaaguaaccaaacaagaag

SEQ ID NO: 135267 - RNA, 19 nt, Homo sapiens
ggaagugaucgcuguguga

SEQ ID NO: 135268 - RNA, 19 nt, Homo sapiens
caaacaagaagaccucaug

SEQ ID NO: 135269 - RNA, 19 nt, Homo sapiens
gcacgaugguccuacacau

SEQ ID NO: 135270 - RNA, 19 nt, Homo sapiens
acaagaagaccucaugaga

SEQ ID NO: 135271 - RNA, 19 nt, Homo sapiens
gguguuggaugucaaugau

SEQ ID NO: 135272 - RNA, 19 nt, Homo sapiens
gaagugaucgcugugugaa

SEQ ID NO: 135273 - RNA, 19 nt, Homo sapiens
caacauggcagaauaucca

SEQ ID NO: 135274 - RNA, 19 nt, Homo sapiens
ggaugucaaugaugauuuu

SEQ ID NO: 135275 - RNA, 19 nt, Homo sapiens
ggaagccaguacagaucuu

SEQ ID NO: 135276 - RNA, 19 nt, Homo sapiens
ggaaacuugcuggauauga

SEQ ID NO: 135277 - RNA, 19 nt, Homo sapiens
guuagacuuugccauuguu

SEQ ID NO: 135278 - RNA, 19 nt, Homo sapiens
caagagcugguuuguuaau

SEQ ID NO: 135279 - RNA, 19 nt, Homo sapiens
gagcgagugagcagcgaua

SEQ ID NO: 135280 - RNA, 19 nt, Homo sapiens
uguuggaugucaaugauga

SEQ ID NO: 135281 - RNA, 19 nt, Homo sapiens
aagaaucuguaaccaauac

SEQ ID NO: 135282 - RNA, 19 nt, Homo sapiens
aaacaagaagaccucauga

SEQ ID NO: 135283 - RNA, 19 nt, Homo sapiens
ccaggaagccaguacagau

SEQ ID NO: 135284 - RNA, 19 nt, Homo sapiens
gaagccaguacagaucuuu

SEQ ID NO: 135285 - RNA, 19 nt, Homo sapiens
cagaaccuguagcaacaug

SEQ ID NO: 135286 - RNA, 19 nt, Homo sapiens
guccacguuugugaaguua

SEQ ID NO: 135287 - RNA, 19 nt, Homo sapiens
cacgaaaacuuacccagaa

SEQ ID NO: 135288 - RNA, 19 nt, Homo sapiens
cuggagcccuucccugaga

SEQ ID NO: 135289 - RNA, 19 nt, Homo sapiens
cuacacauuccagacauuu

SEQ ID NO: 135290 - RNA, 19 nt, Homo sapiens
uuggaaacuugcuggauau

SEQ ID NO: 135291 - RNA, 19 nt, Homo sapiens
ucaguuccauggccaagag

SEQ ID NO: 135292 - RNA, 19 nt, Homo sapiens
cugaggaaguaaccaaaca

SEQ ID NO: 135293 - RNA, 19 nt, Homo sapiens
ccuacacauuccagacauu

SEQ ID NO: 135294 - RNA, 19 nt, Homo sapiens
aagagcugguuuguuaauu

SEQ ID NO: 135295 - RNA, 19 nt, Homo sapiens
ccacguuugugaaguuacu

SEQ ID NO: 135296 - RNA, 19 nt, Homo sapiens
ucaagagcugguuuguuaa

SEQ ID NO: 135297 - RNA, 19 nt, Homo sapiens
cccgaaggcucuccaucga

SEQ ID NO: 135298 - RNA, 19 nt, Homo sapiens
gaggaaguaaccaaacaag

SEQ ID NO: 135299 - RNA, 19 nt, Homo sapiens
ccagcacgaugguccuaca

SEQ ID NO: 135300 - RNA, 19 nt, Homo sapiens
uagcaacauggcagaauau

SEQ ID NO: 135301 - RNA, 19 nt, Homo sapiens
uguuagacuuugccauugu

SEQ ID NO: 135302 - RNA, 19 nt, Homo sapiens
aguccacguuugugaaguu

SEQ ID NO: 135303 - RNA, 19 nt, Homo sapiens
agugaucgcugugugaauc

SEQ ID NO: 135304 - RNA, 19 nt, Homo sapiens
gugcugguguuggauguca

SEQ ID NO: 135305 - RNA, 19 nt, Homo sapiens
ccaguacagaucuuugaga

SEQ ID NO: 135306 - RNA, 19 nt, Homo sapiens
gccauuguuuucuuuugua

SEQ ID NO: 135307 - RNA, 19 nt, Homo sapiens
uugaggcucugaugaacau

SEQ ID NO: 135308 - RNA, 19 nt, Homo sapiens
ccacuuugaggcucugaug

SEQ ID NO: 135309 - RNA, 19 nt, Homo sapiens
cacgaugguccuacacauu

SEQ ID NO: 135310 - RNA, 19 nt, Homo sapiens
cgagcacccuucaguucca

SEQ ID NO: 135311 - RNA, 19 nt, Homo sapiens
aaacuugcuggauaugaug

SEQ ID NO: 135312 - RNA, 19 nt, Homo sapiens
ucuguaaccaauaccauga

SEQ ID NO: 135313 - RNA, 19 nt, Homo sapiens
gcucucggcggaagugauc

SEQ ID NO: 135314 - RNA, 19 nt, Homo sapiens
gcccuucccugagaaacuc

SEQ ID NO: 135315 - RNA, 19 nt, Homo sapiens
gagcacaggugucuagaaa

SEQ ID NO: 135316 - RNA, 19 nt, Homo sapiens
caauuuaccuguauuagga

SEQ ID NO: 135317 - RNA, 19 nt, Homo sapiens
gaguagaguucaucuuuau

SEQ ID NO: 135318 - RNA, 19 nt, Homo sapiens
cgaguagaguucaucuuua

SEQ ID NO: 135319 - RNA, 19 nt, Homo sapiens
ggagacaauuuaccuguau

SEQ ID NO: 135320 - RNA, 19 nt, Homo sapiens
ggccaagacuccaccuaua

SEQ ID NO: 135321 - RNA, 19 nt, Homo sapiens
ggagagagcccagcacuug

SEQ ID NO: 135322 - RNA, 19 nt, Homo sapiens
gcacaggugucuagaaacu

SEQ ID NO: 135323 - RNA, 19 nt, Homo sapiens
gaacaaguaucagaucaac

SEQ ID NO: 135324 - RNA, 19 nt, Homo sapiens
ucaguuuccucaucuguaa

SEQ ID NO: 135325 - RNA, 19 nt, Homo sapiens
guccagcacugccguauug

SEQ ID NO: 135326 - RNA, 19 nt, Homo sapiens
acaggugucuagaaacuuu

SEQ ID NO: 135327 - RNA, 19 nt, Homo sapiens
ucacgcaccugcucugguu

SEQ ID NO: 135328 - RNA, 19 nt, Homo sapiens
gccaagacuccaccuauaa

SEQ ID NO: 135329 - RNA, 19 nt, Homo sapiens
uagauggcgucaccaauga

SEQ ID NO: 135330 - RNA, 19 nt, Homo sapiens
ccagucaccuuuacuaguc

SEQ ID NO: 135331 - RNA, 19 nt, Homo sapiens
gccagagacugcaaauuca

SEQ ID NO: 135332 - RNA, 19 nt, Homo sapiens
gagacaauuuaccuguauu

SEQ ID NO: 135333 - RNA, 19 nt, Homo sapiens
ggucaagggcuacuucuuc

SEQ ID NO: 135334 - RNA, 19 nt, Homo sapiens
gaaaccugguaccugaaga

SEQ ID NO: 135335 - RNA, 19 nt, Homo sapiens
ccgaguagaguucaucuuu

SEQ ID NO: 135336 - RNA, 19 nt, Homo sapiens
ucaagggaauuccgagugu

SEQ ID NO: 135337 - RNA, 19 nt, Homo sapiens
ugacagaaccgcaucucaa

SEQ ID NO: 135338 - RNA, 19 nt, Homo sapiens
ccuaggguguuguguagaa

SEQ ID NO: 135339 - RNA, 19 nt, Homo sapiens
gacuuuagccgguugagaa

SEQ ID NO: 135340 - RNA, 19 nt, Homo sapiens
gugaacaaguaucagauca

SEQ ID NO: 135341 - RNA, 19 nt, Homo sapiens
gcaggaagcccaaggucau

SEQ ID NO: 135342 - RNA, 19 nt, Homo sapiens
acacgucucucccugacuu

SEQ ID NO: 135343 - RNA, 19 nt, Homo sapiens
caucugccaugaccacuuc

SEQ ID NO: 135344 - RNA, 19 nt, Homo sapiens
gugaaacuauuuggcaaga

SEQ ID NO: 135345 - RNA, 19 nt, Homo sapiens
gggcucugcuucccgauuc

SEQ ID NO: 135346 - RNA, 19 nt, Homo sapiens
ccauugacaucugccauga

SEQ ID NO: 135347 - RNA, 19 nt, Homo sapiens
uggagacaauuuaccugua

SEQ ID NO: 135348 - RNA, 19 nt, Homo sapiens
gagccucaguuuccucauc

SEQ ID NO: 135349 - RNA, 19 nt, Homo sapiens
gcuaugccgucuccaccuu

SEQ ID NO: 135350 - RNA, 19 nt, Homo sapiens
ccugggagguggacugguu

SEQ ID NO: 135351 - RNA, 19 nt, Homo sapiens
ugauugacuucuucuggaa

SEQ ID NO: 135352 - RNA, 19 nt, Homo sapiens
cuacgugauugacuucuuc

SEQ ID NO: 135353 - RNA, 19 nt, Homo sapiens
cgccagagacugcaaauuc

SEQ ID NO: 135354 - RNA, 19 nt, Homo sapiens
gcccagcucuauaccuugu

SEQ ID NO: 135355 - RNA, 19 nt, Homo sapiens
ugaagaccauugacaucug

SEQ ID NO: 135356 - RNA, 19 nt, Homo sapiens
caccugcucugguuugcaa

SEQ ID NO: 135357 - RNA, 19 nt, Homo sapiens
gcuguggcuuucaggugua

SEQ ID NO: 135358 - RNA, 19 nt, Homo sapiens
ucauuaggcugcauuuacu

SEQ ID NO: 135359 - RNA, 19 nt, Homo sapiens
gaucaagcaggcauuugga

SEQ ID NO: 135360 - RNA, 19 nt, Homo sapiens
ccgcccagcucuauaccuu

SEQ ID NO: 135361 - RNA, 19 nt, Homo sapiens
cuagauggcgucaccaaug

SEQ ID NO: 135362 - RNA, 19 nt, Homo sapiens
ccucaucccuaggguguug

SEQ ID NO: 135363 - RNA, 19 nt, Homo sapiens
gacccagucaccuuuacua

SEQ ID NO: 135364 - RNA, 19 nt, Homo sapiens
ccaucuacgugauugacuu

SEQ ID NO: 135365 - RNA, 19 nt, Homo sapiens
gggccaagacuccaccuau

SEQ ID NO: 135366 - RNA, 19 nt, Homo sapiens
guauugccuuucagcucua

SEQ ID NO: 135367 - RNA, 19 nt, Homo sapiens
cuucugcugugaaacuauu

SEQ ID NO: 135368 - RNA, 19 nt, Homo sapiens
ggaucaagcaggcauuugg

SEQ ID NO: 135369 - RNA, 19 nt, Homo sapiens
acagacggauuuucucuaa

SEQ ID NO: 135370 - RNA, 19 nt, Homo sapiens
gacagaaccgcaucucaag

SEQ ID NO: 135371 - RNA, 19 nt, Homo sapiens
gcuuucaugucguuuccuu

SEQ ID NO: 135372 - RNA, 19 nt, Homo sapiens
uaggcugcauuuacucuug

SEQ ID NO: 135373 - RNA, 19 nt, Homo sapiens
uaaucacgcucuguuccuu

SEQ ID NO: 135374 - RNA, 19 nt, Homo sapiens
gcugcagggucuguacuug

SEQ ID NO: 135375 - RNA, 19 nt, Homo sapiens
ucacaggcaauuucuuuua

SEQ ID NO: 135376 - RNA, 19 nt, Homo sapiens
gaaggaucaagcaggcauu

SEQ ID NO: 135377 - RNA, 19 nt, Homo sapiens
ggagcacaggugucuagaa

SEQ ID NO: 135378 - RNA, 19 nt, Homo sapiens
guccuuuggagacaauuua

SEQ ID NO: 135379 - RNA, 19 nt, Homo sapiens
gguguccaguaccuaauca

SEQ ID NO: 135380 - RNA, 19 nt, Homo sapiens
gcuacacucugcccacacu

SEQ ID NO: 135381 - RNA, 19 nt, Homo sapiens
gcucggcucucggacaucu

SEQ ID NO: 135382 - RNA, 19 nt, Homo sapiens
guucccuucugcugugaaa

SEQ ID NO: 135383 - RNA, 19 nt, Homo sapiens
caccuuuacuaguccuuug

SEQ ID NO: 135384 - RNA, 19 nt, Homo sapiens
gcaggccaucuacgugauu

SEQ ID NO: 135385 - RNA, 19 nt, Homo sapiens
ccaccaucaucuucgacaa

SEQ ID NO: 135386 - RNA, 19 nt, Homo sapiens
gaggugugcgcaggacuuu

SEQ ID NO: 135387 - RNA, 19 nt, Homo sapiens
cgcccacccucucgaaaga

SEQ ID NO: 135388 - RNA, 19 nt, Homo sapiens
ggugugcgcaggacuuuag

SEQ ID NO: 135389 - RNA, 19 nt, Homo sapiens
caacccaacauucccaaag

SEQ ID NO: 135390 - RNA, 19 nt, Homo sapiens
ucaagcuguucuucaaugg

SEQ ID NO: 135391 - RNA, 19 nt, Homo sapiens
ggacaucugggccaagacu

SEQ ID NO: 135392 - RNA, 19 nt, Homo sapiens
ggacaucgucaccggacau

SEQ ID NO: 135393 - RNA, 19 nt, Homo sapiens
aaacuuccccuguucaaaa

SEQ ID NO: 135394 - RNA, 19 nt, Homo sapiens
gcuucccgauucccuguga

SEQ ID NO: 135395 - RNA, 19 nt, Homo sapiens
gcgcguuauccauguauug

SEQ ID NO: 135396 - RNA, 19 nt, Homo sapiens
gacuucuucuggaacgaaa

SEQ ID NO: 135397 - RNA, 19 nt, Homo sapiens
acuucaagcuguucuucaa

SEQ ID NO: 135398 - RNA, 19 nt, Homo sapiens
cucccugacuucugccaua

SEQ ID NO: 135399 - RNA, 19 nt, Homo sapiens
ccugcugccuggaaucuuc

SEQ ID NO: 135400 - RNA, 19 nt, Homo sapiens
gugucuggcugccuuaucu

SEQ ID NO: 135401 - RNA, 19 nt, Homo sapiens
gguguuguguagaacucuu

SEQ ID NO: 135402 - RNA, 19 nt, Homo sapiens
ucccuaggguguuguguag

SEQ ID NO: 135403 - RNA, 19 nt, Homo sapiens
gucauuaggcugcauuuac

SEQ ID NO: 135404 - RNA, 19 nt, Homo sapiens
uucaagcuguucuucaaug

SEQ ID NO: 135405 - RNA, 19 nt, Homo sapiens
auucacaggcaauuucuuu

SEQ ID NO: 135406 - RNA, 19 nt, Homo sapiens
ggacuuuagccgguugaga

SEQ ID NO: 135407 - RNA, 19 nt, Homo sapiens
guuucuacccggcuacgua

SEQ ID NO: 135408 - RNA, 19 nt, Homo sapiens
gcaacccaacauucccaaa

SEQ ID NO: 135409 - RNA, 19 nt, Homo sapiens
ggugggcuacuacaucuuc

SEQ ID NO: 135410 - RNA, 19 nt, Homo sapiens
ugaacaaguaucagaucaa

SEQ ID NO: 135411 - RNA, 19 nt, Homo sapiens
ucggacaucugggccaaga

SEQ ID NO: 135412 - RNA, 19 nt, Homo sapiens
caucgucuacuacuucauc

SEQ ID NO: 135413 - RNA, 19 nt, Homo sapiens
gagcgucaucuuccuacug

SEQ ID NO: 135414 - RNA, 19 nt, Homo sapiens
cacccucucgaaagaauuu

SEQ ID NO: 135415 - RNA, 19 nt, Homo sapiens
aaagaaaccucauccuaua

SEQ ID NO: 135416 - RNA, 19 nt, Homo sapiens
gaaagaaaccucauccuau

SEQ ID NO: 135417 - RNA, 19 nt, Homo sapiens
ggaagcaucugucuuguca

SEQ ID NO: 135418 - RNA, 19 nt, Homo sapiens
gagcugaguucauggcuuu

SEQ ID NO: 135419 - RNA, 19 nt, Homo sapiens
caacacaucugcacugcuu

SEQ ID NO: 135420 - RNA, 19 nt, Homo sapiens
ccagaaggaugaauacuug

SEQ ID NO: 135421 - RNA, 19 nt, Homo sapiens
gaaaccucauccuauauuu

SEQ ID NO: 135422 - RNA, 19 nt, Homo sapiens
ggcauuagcucucauagga

SEQ ID NO: 135423 - RNA, 19 nt, Homo sapiens
gcaugaaucuucccuguca

SEQ ID NO: 135424 - RNA, 19 nt, Homo sapiens
gaaccacccuacccauuug

SEQ ID NO: 135425 - RNA, 19 nt, Homo sapiens
gggauuaucugucauucaa

SEQ ID NO: 135426 - RNA, 19 nt, Homo sapiens
gcaagucauuguccucuga

SEQ ID NO: 135427 - RNA, 19 nt, Homo sapiens
agaacuaucugaagacaaa

SEQ ID NO: 135428 - RNA, 19 nt, Homo sapiens
gagaaggaauugcgucaug

SEQ ID NO: 135429 - RNA, 19 nt, Homo sapiens
gaaagaaugugggauuugg

SEQ ID NO: 135430 - RNA, 19 nt, Homo sapiens
gaaaugaggcagagcucua

SEQ ID NO: 135431 - RNA, 19 nt, Homo sapiens
gcacaggcaucgagucauc

SEQ ID NO: 135432 - RNA, 19 nt, Homo sapiens
acgcaaagcuugguuguuu

SEQ ID NO: 135433 - RNA, 19 nt, Homo sapiens
gagaaaggcaugaaucuuc

SEQ ID NO: 135434 - RNA, 19 nt, Homo sapiens
guccuucccuggcuuguua

SEQ ID NO: 135435 - RNA, 19 nt, Homo sapiens
ugaggcagcuggagaaguu

SEQ ID NO: 135436 - RNA, 19 nt, Homo sapiens
uuacaaagcaugugaauuc

SEQ ID NO: 135437 - RNA, 19 nt, Homo sapiens
ggaaccacccuacccauuu

SEQ ID NO: 135438 - RNA, 19 nt, Homo sapiens
gauuaucugucauucaaga

SEQ ID NO: 135439 - RNA, 19 nt, Homo sapiens
gcaguuuccucaucuguca

SEQ ID NO: 135440 - RNA, 19 nt, Homo sapiens
ggaauugcgucauguaagg

SEQ ID NO: 135441 - RNA, 19 nt, Homo sapiens
guugagcacuggucacauu

SEQ ID NO: 135442 - RNA, 19 nt, Homo sapiens
gcagguuguugucaucuga

SEQ ID NO: 135443 - RNA, 19 nt, Homo sapiens
gaaucacacccuccgguua

SEQ ID NO: 135444 - RNA, 19 nt, Homo sapiens
gaaggaauugcgucaugua

SEQ ID NO: 135445 - RNA, 19 nt, Homo sapiens
ggaaguggacaccaagaaa

SEQ ID NO: 135446 - RNA, 19 nt, Homo sapiens
ucacaucgcuacagacaag

SEQ ID NO: 135447 - RNA, 19 nt, Homo sapiens
guggagaacuaucugaaga

SEQ ID NO: 135448 - RNA, 19 nt, Homo sapiens
uacaagccgugguucuuua

SEQ ID NO: 135449 - RNA, 19 nt, Homo sapiens
gcaugugaauucuggcauu

SEQ ID NO: 135450 - RNA, 19 nt, Homo sapiens
gagcacuggucacauugaa

SEQ ID NO: 135451 - RNA, 19 nt, Homo sapiens
guugaaagggauaguaaua

SEQ ID NO: 135452 - RNA, 19 nt, Homo sapiens
caugugaauucuggcauua

SEQ ID NO: 135453 - RNA, 19 nt, Homo sapiens
ggaguccacccucauguuu

SEQ ID NO: 135454 - RNA, 19 nt, Homo sapiens
cauugaaggugcuggguaa

SEQ ID NO: 135455 - RNA, 19 nt, Homo sapiens
ggaguacauucccuugaga

SEQ ID NO: 135456 - RNA, 19 nt, Homo sapiens
gagagggccuggaguacau

SEQ ID NO: 135457 - RNA, 19 nt, Homo sapiens
cggaaagccucauuugugu

SEQ ID NO: 135458 - RNA, 19 nt, Homo sapiens
uuaagcauguggagaacua

SEQ ID NO: 135459 - RNA, 19 nt, Homo sapiens
aagcaucugucuugucauu

SEQ ID NO: 135460 - RNA, 19 nt, Homo sapiens
gaacucauuagcuguguga

SEQ ID NO: 135461 - RNA, 19 nt, Homo sapiens
agaaagaaaccucauccua

SEQ ID NO: 135462 - RNA, 19 nt, Homo sapiens
guaagggaagcuggaauua

SEQ ID NO: 135463 - RNA, 19 nt, Homo sapiens
ggagaacuaucugaagaca

SEQ ID NO: 135464 - RNA, 19 nt, Homo sapiens
caucaucccugccaagaag

SEQ ID NO: 135465 - RNA, 19 nt, Homo sapiens
ggccgcugcuucuguuuaa

SEQ ID NO: 135466 - RNA, 19 nt, Homo sapiens
gagcugcaguuuccucauc

SEQ ID NO: 135467 - RNA, 19 nt, Homo sapiens
gcaaagcuugguuguuuau

SEQ ID NO: 135468 - RNA, 19 nt, Homo sapiens
gauggugccucccaagauc

SEQ ID NO: 135469 - RNA, 19 nt, Homo sapiens
gaaagaaagaaaccucauc

SEQ ID NO: 135470 - RNA, 19 nt, Homo sapiens
gcacucagaaggcaaagga

SEQ ID NO: 135471 - RNA, 19 nt, Homo sapiens
gcaacucuaucuuaagaac

SEQ ID NO: 135472 - RNA, 19 nt, Homo sapiens
caaccacucaucccucuuu

SEQ ID NO: 135473 - RNA, 19 nt, Homo sapiens
aaacugaugauucuacuug

SEQ ID NO: 135474 - RNA, 19 nt, Homo sapiens
gaaaagagcaucgacuuga

SEQ ID NO: 135475 - RNA, 19 nt, Homo sapiens
gaccugggcucauucuucu

SEQ ID NO: 135476 - RNA, 19 nt, Homo sapiens
ggcaguguaugguguguga

SEQ ID NO: 135477 - RNA, 19 nt, Homo sapiens
uaauuucagugccuuacaa

SEQ ID NO: 135478 - RNA, 19 nt, Homo sapiens
ggaaguacaagaagacaca

SEQ ID NO: 135479 - RNA, 19 nt, Homo sapiens
ggaaagaaugugggauuug

SEQ ID NO: 135480 - RNA, 19 nt, Homo sapiens
uuuccuagauccacacuuu

SEQ ID NO: 135481 - RNA, 19 nt, Homo sapiens
gaacccuucugauugucuu

SEQ ID NO: 135482 - RNA, 19 nt, Homo sapiens
aagggaagcuggaauuaag

SEQ ID NO: 135483 - RNA, 19 nt, Homo sapiens
cgcaaagcuugguuguuua

SEQ ID NO: 135484 - RNA, 19 nt, Homo sapiens
ggaaggagcaggguagcaa

SEQ ID NO: 135485 - RNA, 19 nt, Homo sapiens
ccgggucucuucauuaguu

SEQ ID NO: 135486 - RNA, 19 nt, Homo sapiens
ccaguggaauggaaagaau

SEQ ID NO: 135487 - RNA, 19 nt, Homo sapiens
caucuucccuucacucaag

SEQ ID NO: 135488 - RNA, 19 nt, Homo sapiens
aggcagagcucuacaucga

SEQ ID NO: 135489 - RNA, 19 nt, Homo sapiens
ucagaauuguagccaguuu

SEQ ID NO: 135490 - RNA, 19 nt, Homo sapiens
ugcuguagaugaaugguua

SEQ ID NO: 135491 - RNA, 19 nt, Homo sapiens
ugaaaaggcuccacauuag

SEQ ID NO: 135492 - RNA, 19 nt, Homo sapiens
uaagggaagcuggaauuaa

SEQ ID NO: 135493 - RNA, 19 nt, Homo sapiens
gcucagagaaaguuccauu

SEQ ID NO: 135494 - RNA, 19 nt, Homo sapiens
ggaccugggcucauucuuc

SEQ ID NO: 135495 - RNA, 19 nt, Homo sapiens
gcaugaagguuuucuuuag

SEQ ID NO: 135496 - RNA, 19 nt, Homo sapiens
guggaaaguaucagaguaa

SEQ ID NO: 135497 - RNA, 19 nt, Homo sapiens
cagggaagcaucugucuug

SEQ ID NO: 135498 - RNA, 19 nt, Homo sapiens
uggaaagaaugugggauuu

SEQ ID NO: 135499 - RNA, 19 nt, Homo sapiens
guacaagaagacacacaaa

SEQ ID NO: 135500 - RNA, 19 nt, Homo sapiens
acucagaccuguucuaugc

SEQ ID NO: 135501 - RNA, 19 nt, Homo sapiens
aaggaugaauacuuggaua

SEQ ID NO: 135502 - RNA, 19 nt, Homo sapiens
ggccagcucccaucucauu

SEQ ID NO: 135503 - RNA, 19 nt, Homo sapiens
caucgacauuggagcauau

SEQ ID NO: 135504 - RNA, 19 nt, Homo sapiens
caagaucucccuccugaag

SEQ ID NO: 135505 - RNA, 19 nt, Homo sapiens
ggagaaaggcaugaaucuu

SEQ ID NO: 135506 - RNA, 19 nt, Homo sapiens
ccagagcccugaguuucuu

SEQ ID NO: 135507 - RNA, 19 nt, Homo sapiens
guagaugaaugguuaacac

SEQ ID NO: 135508 - RNA, 19 nt, Homo sapiens
ccacggaaagccucauuug

SEQ ID NO: 135509 - RNA, 19 nt, Homo sapiens
ggacaccaagaaacagauu

SEQ ID NO: 135510 - RNA, 19 nt, Homo sapiens
agacaagaccucccuggaa

SEQ ID NO: 135511 - RNA, 19 nt, Homo sapiens
uguggaaaguaucagagua

SEQ ID NO: 135512 - RNA, 19 nt, Homo sapiens
ugaaggugcuggguaagug

SEQ ID NO: 135513 - RNA, 19 nt, Homo sapiens
gaggaguucugggagaugu

SEQ ID NO: 135514 - RNA, 19 nt, Homo sapiens
gcaugaggcagcuggagaa

SEQ ID NO: 135515 - RNA, 19 nt, Homo sapiens
gcaauucgauguuuaagua

SEQ ID NO: 135516 - RNA, 19 nt, Homo sapiens
gaacugagaagguaagaaa

SEQ ID NO: 135517 - RNA, 19 nt, Homo sapiens
ucauugcucuggagaauua

SEQ ID NO: 135518 - RNA, 19 nt, Homo sapiens
uaacuacucugggacaaua

SEQ ID NO: 135519 - RNA, 19 nt, Homo sapiens
gaaccaugccuucauaauu

SEQ ID NO: 135520 - RNA, 19 nt, Homo sapiens
aaacugaacugagaaggua

SEQ ID NO: 135521 - RNA, 19 nt, Homo sapiens
gaugaugccuuaaaacuua

SEQ ID NO: 135522 - RNA, 19 nt, Homo sapiens
caaggaaccuccacaagga

SEQ ID NO: 135523 - RNA, 19 nt, Homo sapiens
ccacauacccuucaacuga

SEQ ID NO: 135524 - RNA, 19 nt, Homo sapiens
ggccacacaugguuuauuu

SEQ ID NO: 135525 - RNA, 19 nt, Homo sapiens
cggcacaucuucauucuuu

SEQ ID NO: 135526 - RNA, 19 nt, Homo sapiens
ccacuacucuucucucuau

SEQ ID NO: 135527 - RNA, 19 nt, Homo sapiens
gaaaucaucaauugaggua

SEQ ID NO: 135528 - RNA, 19 nt, Homo sapiens
caaccagaauuagcaaaua

SEQ ID NO: 135529 - RNA, 19 nt, Homo sapiens
ugagaagaaucgaccuuua

SEQ ID NO: 135530 - RNA, 19 nt, Homo sapiens
gcaggcagaucacuugaga

SEQ ID NO: 135531 - RNA, 19 nt, Homo sapiens
ugacaaggaucaugcaaga

SEQ ID NO: 135532 - RNA, 19 nt, Homo sapiens
gcaguucuguuuauaagga

SEQ ID NO: 135533 - RNA, 19 nt, Homo sapiens
gagaagaaucgaccuuuaa

SEQ ID NO: 135534 - RNA, 19 nt, Homo sapiens
auaaugaugugacugcuua

SEQ ID NO: 135535 - RNA, 19 nt, Homo sapiens
uaccagaaaucaucaauug

SEQ ID NO: 135536 - RNA, 19 nt, Homo sapiens
gacauggucuggauaguug

SEQ ID NO: 135537 - RNA, 19 nt, Homo sapiens
gcgagcagguucucauuga

SEQ ID NO: 135538 - RNA, 19 nt, Homo sapiens
gcaaauaggauccaacaca

SEQ ID NO: 135539 - RNA, 19 nt, Homo sapiens
ugaaugaaguagagagaaa

SEQ ID NO: 135540 - RNA, 19 nt, Homo sapiens
aagcugagauggaagaauu

SEQ ID NO: 135541 - RNA, 19 nt, Homo sapiens
ggggaaagcuggaguauug

SEQ ID NO: 135542 - RNA, 19 nt, Homo sapiens
uagggaagcuguuggagaa

SEQ ID NO: 135543 - RNA, 19 nt, Homo sapiens
ugaguauguuucugucuua

SEQ ID NO: 135544 - RNA, 19 nt, Homo sapiens
gaaguccagugaugggaaa

SEQ ID NO: 135545 - RNA, 19 nt, Homo sapiens
gaaaggcauuaaguacaaa

SEQ ID NO: 135546 - RNA, 19 nt, Homo sapiens
gaccacaaccucuucagua

SEQ ID NO: 135547 - RNA, 19 nt, Homo sapiens
gagcagguucucauugaua

SEQ ID NO: 135548 - RNA, 19 nt, Homo sapiens
ggccucgccugcacaaaua

SEQ ID NO: 135549 - RNA, 19 nt, Homo sapiens
ccaaacacuuaaagcaauu

SEQ ID NO: 135550 - RNA, 19 nt, Homo sapiens
uagcaagucucagguguuu

SEQ ID NO: 135551 - RNA, 19 nt, Homo sapiens
cggagaaacugaacugaga

SEQ ID NO: 135552 - RNA, 19 nt, Homo sapiens
agaaaggcauuaaguacaa

SEQ ID NO: 135553 - RNA, 19 nt, Homo sapiens
ggacuguuaggaugcauua

SEQ ID NO: 135554 - RNA, 19 nt, Homo sapiens
cuauggagcuagcuuuaaa

SEQ ID NO: 135555 - RNA, 19 nt, Homo sapiens
ugacaugaauccagcaaau

SEQ ID NO: 135556 - RNA, 19 nt, Homo sapiens
gcuccauacugcugagaua

SEQ ID NO: 135557 - RNA, 19 nt, Homo sapiens
ccagagguuuguagauaaa

SEQ ID NO: 135558 - RNA, 19 nt, Homo sapiens
aaacagaagacauugcuaa

SEQ ID NO: 135559 - RNA, 19 nt, Homo sapiens
gccaaacacuuaaagcaau

SEQ ID NO: 135560 - RNA, 19 nt, Homo sapiens
gaagguguuuucuaguuua

SEQ ID NO: 135561 - RNA, 19 nt, Homo sapiens
ggcauuaaguacaaauuug

SEQ ID NO: 135562 - RNA, 19 nt, Homo sapiens
guucaaggcugcagugagu

SEQ ID NO: 135563 - RNA, 19 nt, Homo sapiens
gaacagugaaugccaaaca

SEQ ID NO: 135564 - RNA, 19 nt, Homo sapiens
caaagcagauugcaagacu

SEQ ID NO: 135565 - RNA, 19 nt, Homo sapiens
aaucaagggugaagguaaa

SEQ ID NO: 135566 - RNA, 19 nt, Homo sapiens
caaauaaaguagacauggu

SEQ ID NO: 135567 - RNA, 19 nt, Homo sapiens
gcagaaagaaguacaggau

SEQ ID NO: 135568 - RNA, 19 nt, Homo sapiens
uaugagacauucuugcuau

SEQ ID NO: 135569 - RNA, 19 nt, Homo sapiens
cacaaccucuucaguagaa

SEQ ID NO: 135570 - RNA, 19 nt, Homo sapiens
ucagauauuuccagagaau

SEQ ID NO: 135571 - RNA, 19 nt, Homo sapiens
agaaagaaguacaggauag

SEQ ID NO: 135572 - RNA, 19 nt, Homo sapiens
aaccaugccuucauaauuc

SEQ ID NO: 135573 - RNA, 19 nt, Homo sapiens
ggagaaaggcauuaaguac

SEQ ID NO: 135574 - RNA, 19 nt, Homo sapiens
caacaaggagcaguaugua

SEQ ID NO: 135575 - RNA, 19 nt, Homo sapiens
ggauaggaagagcauaaua

SEQ ID NO: 135576 - RNA, 19 nt, Homo sapiens
gcaggaaaaccaauuauaa

SEQ ID NO: 135577 - RNA, 19 nt, Homo sapiens
guugccaccuuguuuguaa

SEQ ID NO: 135578 - RNA, 19 nt, Homo sapiens
ucagauaccauuuaugaga

SEQ ID NO: 135579 - RNA, 19 nt, Homo sapiens
gagaaaggcauuaaguaca

SEQ ID NO: 135580 - RNA, 19 nt, Homo sapiens
ggccaccgcucaggaauga

SEQ ID NO: 135581 - RNA, 19 nt, Homo sapiens
caauugagguacggagaaa

SEQ ID NO: 135582 - RNA, 19 nt, Homo sapiens
gcagauugcaagacugaaa

SEQ ID NO: 135583 - RNA, 19 nt, Homo sapiens
uaauugagcccacgaguuc

SEQ ID NO: 135584 - RNA, 19 nt, Homo sapiens
agaaaugaaugaaguagag

SEQ ID NO: 135585 - RNA, 19 nt, Homo sapiens
acacaugguuuauuugaag

SEQ ID NO: 135586 - RNA, 19 nt, Homo sapiens
ccacacaugguuuauuuga

SEQ ID NO: 135587 - RNA, 19 nt, Homo sapiens
ggucauaccagaaaucauc

SEQ ID NO: 135588 - RNA, 19 nt, Homo sapiens
gguggcaguucuguuuaua

SEQ ID NO: 135589 - RNA, 19 nt, Homo sapiens
gaacaaccagaauuagcaa

SEQ ID NO: 135590 - RNA, 19 nt, Homo sapiens
guauuugccucuggaaaga

SEQ ID NO: 135591 - RNA, 19 nt, Homo sapiens
gacaugaauccagcaaaua

SEQ ID NO: 135592 - RNA, 19 nt, Homo sapiens
ucagaugccuuugagaaau

SEQ ID NO: 135593 - RNA, 19 nt, Homo sapiens
caaaggguugcauguagua

SEQ ID NO: 135594 - RNA, 19 nt, Homo sapiens
aagucuagaugaugccuua

SEQ ID NO: 135595 - RNA, 19 nt, Homo sapiens
cuguuaggaugcauuauaa

SEQ ID NO: 135596 - RNA, 19 nt, Homo sapiens
ugaagauugugauggugua

SEQ ID NO: 135597 - RNA, 19 nt, Homo sapiens
ccaaaggguugcauguagu

SEQ ID NO: 135598 - RNA, 19 nt, Homo sapiens
ccaauuauaaguucaagug

SEQ ID NO: 135599 - RNA, 19 nt, Homo sapiens
gaucaugcaagacuuugaa

SEQ ID NO: 135600 - RNA, 19 nt, Homo sapiens
caauuucgcgccaaacuug

SEQ ID NO: 135601 - RNA, 19 nt, Homo sapiens
uaacuuauugccagauuug

SEQ ID NO: 135602 - RNA, 19 nt, Homo sapiens
gggugaagguaaaauaaua

SEQ ID NO: 135603 - RNA, 19 nt, Homo sapiens
gagauggaagaauuaauug

SEQ ID NO: 135604 - RNA, 19 nt, Homo sapiens
cagaugccuuugagaaaug

SEQ ID NO: 135605 - RNA, 19 nt, Homo sapiens
gauaacaagcuccauacug

SEQ ID NO: 135606 - RNA, 19 nt, Homo sapiens
guauguuucugucuuagau

SEQ ID NO: 135607 - RNA, 19 nt, Homo sapiens
cagcagagaacucaaggaa

SEQ ID NO: 135608 - RNA, 19 nt, Homo sapiens
gauaggaagagcauaauac

SEQ ID NO: 135609 - RNA, 19 nt, Homo sapiens
acuaagugcuucuccaaga

SEQ ID NO: 135610 - RNA, 19 nt, Homo sapiens
gaaaugacuaaguuaugug

SEQ ID NO: 135611 - RNA, 19 nt, Homo sapiens
caggauaggaagagcauaa

SEQ ID NO: 135612 - RNA, 19 nt, Homo sapiens
cagaaagaaguacaggaua

SEQ ID NO: 135613 - RNA, 19 nt, Homo sapiens
guagcaggauauucugaug

SEQ ID NO: 135614 - RNA, 19 nt, Homo sapiens
caggccaucuuaaacuauu

SEQ ID NO: 135615 - RNA, 19 nt, Homo sapiens
gcaaggacauugaauauua

SEQ ID NO: 135616 - RNA, 19 nt, Homo sapiens
ggacggacuuuauaagaug

SEQ ID NO: 135617 - RNA, 19 nt, Homo sapiens
ggaccaagcugucauuaac

SEQ ID NO: 135618 - RNA, 19 nt, Homo sapiens
uggcauggcugcacuguaa

SEQ ID NO: 135619 - RNA, 19 nt, Homo sapiens
ggccauaaauuccgaaauc

SEQ ID NO: 135620 - RNA, 19 nt, Homo sapiens
aggaauugcugcaggauuu

SEQ ID NO: 135621 - RNA, 19 nt, Homo sapiens
gggcaucgaugggcugauu

SEQ ID NO: 135622 - RNA, 19 nt, Homo sapiens
uaacagguauggauuuaac

SEQ ID NO: 135623 - RNA, 19 nt, Homo sapiens
gaacuggaggcccuucuga

SEQ ID NO: 135624 - RNA, 19 nt, Homo sapiens
gagaugagcguuucuaugc

SEQ ID NO: 135625 - RNA, 19 nt, Homo sapiens
caaggacauugaauauuag

SEQ ID NO: 135626 - RNA, 19 nt, Homo sapiens
gguauggauuuaacaguca

SEQ ID NO: 135627 - RNA, 19 nt, Homo sapiens
ugagaguucugggccauaa

SEQ ID NO: 135628 - RNA, 19 nt, Homo sapiens
uggaggcccuucugaaaga

SEQ ID NO: 135629 - RNA, 19 nt, Homo sapiens
ccaguguggucaaagaguu

SEQ ID NO: 135630 - RNA, 19 nt, Homo sapiens
ggagaugagcguuucuaug

SEQ ID NO: 135631 - RNA, 19 nt, Homo sapiens
cgggaagccugaucuggaa

SEQ ID NO: 135632 - RNA, 19 nt, Homo sapiens
ggaagaacaagaccucagu

SEQ ID NO: 135633 - RNA, 19 nt, Homo sapiens
aggccaagcucacagaaga

SEQ ID NO: 135634 - RNA, 19 nt, Homo sapiens
uaggaagugugacuccaaa

SEQ ID NO: 135635 - RNA, 19 nt, Homo sapiens
ucaaagaguugggcaucga

SEQ ID NO: 135636 - RNA, 19 nt, Homo sapiens
ggccagauuucaagacucu

SEQ ID NO: 135637 - RNA, 19 nt, Homo sapiens
caaggccgaguucccauaa

SEQ ID NO: 135638 - RNA, 19 nt, Homo sapiens
cgggauuuaucaacucaaa

SEQ ID NO: 135639 - RNA, 19 nt, Homo sapiens
gaccucaccagccaggaua

SEQ ID NO: 135640 - RNA, 19 nt, Homo sapiens
cgaaauccaguaggaauug

SEQ ID NO: 135641 - RNA, 19 nt, Homo sapiens
uaaauuccgaaauccagua

SEQ ID NO: 135642 - RNA, 19 nt, Homo sapiens
gggaggaggacuucucuuc

SEQ ID NO: 135643 - RNA, 19 nt, Homo sapiens
cuuuguggcuggaucauga

SEQ ID NO: 135644 - RNA, 19 nt, Homo sapiens
aggccgaguucccauaauu

SEQ ID NO: 135645 - RNA, 19 nt, Homo sapiens
ccgacuaccugguggugaa

SEQ ID NO: 135646 - RNA, 19 nt, Homo sapiens
agucacagaugccauugga

SEQ ID NO: 135647 - RNA, 19 nt, Homo sapiens
guugagauaggaaguguga

SEQ ID NO: 135648 - RNA, 19 nt, Homo sapiens
uauaagaugggcuuugguu

SEQ ID NO: 135649 - RNA, 19 nt, Homo sapiens
cggcaguccuggugaagau

SEQ ID NO: 135650 - RNA, 19 nt, Homo sapiens
cauugaauauuaggaggaa

SEQ ID NO: 135651 - RNA, 19 nt, Homo sapiens
ucgaugggcugauuguuac

SEQ ID NO: 135652 - RNA, 19 nt, Homo sapiens
gaggaccaagcugucauua

SEQ ID NO: 135653 - RNA, 19 nt, Homo sapiens
uggacggacuuuauaagau

SEQ ID NO: 135654 - RNA, 19 nt, Homo sapiens
ccaaggccgaguucccaua

SEQ ID NO: 135655 - RNA, 19 nt, Homo sapiens
ggaagccccuccgggauuu

SEQ ID NO: 135656 - RNA, 19 nt, Homo sapiens
guggacggacuuuauaaga

SEQ ID NO: 135657 - RNA, 19 nt, Homo sapiens
acacggcccucaccuucug

SEQ ID NO: 135658 - RNA, 19 nt, Homo sapiens
cauuaacagguauggauuu

SEQ ID NO: 135659 - RNA, 19 nt, Homo sapiens
gaaauccaguaggaauugc

SEQ ID NO: 135660 - RNA, 19 nt, Homo sapiens
aggaggacauugccagugu

SEQ ID NO: 135661 - RNA, 19 nt, Homo sapiens
ccacgggagaugagcguuu

SEQ ID NO: 135662 - RNA, 19 nt, Homo sapiens
uaagaugggcuuugguuuu

SEQ ID NO: 135663 - RNA, 19 nt, Homo sapiens
gaauugcugcaggauuuga

SEQ ID NO: 135664 - RNA, 19 nt, Homo sapiens
ggaauugcugcaggauuug

SEQ ID NO: 135665 - RNA, 19 nt, Homo sapiens
uugcaaggacauugaauau

SEQ ID NO: 135666 - RNA, 19 nt, Homo sapiens
aaaccauucgggagaugua

SEQ ID NO: 135667 - RNA, 19 nt, Homo sapiens
gggagaugagcguuucuau

SEQ ID NO: 135668 - RNA, 19 nt, Homo sapiens
ggcccaggaugcugugauc

SEQ ID NO: 135669 - RNA, 19 nt, Homo sapiens
ccgaaauccaguaggaauu

SEQ ID NO: 135670 - RNA, 19 nt, Homo sapiens
aggacgcgcuggagaagau

SEQ ID NO: 135671 - RNA, 19 nt, Homo sapiens
ggccgaguucccauaauug

SEQ ID NO: 135672 - RNA, 19 nt, Homo sapiens
acucugacaugcuggaagu

SEQ ID NO: 135673 - RNA, 19 nt, Homo sapiens
ucaaaccauucgggagaug

SEQ ID NO: 135674 - RNA, 19 nt, Homo sapiens
gaagcaggccaagcucaca

SEQ ID NO: 135675 - RNA, 19 nt, Homo sapiens
gaccaagcugucauuaaca

SEQ ID NO: 135676 - RNA, 19 nt, Homo sapiens
cuugcaaggacauugaaua

SEQ ID NO: 135677 - RNA, 19 nt, Homo sapiens
ccacgggccagauuucaag

SEQ ID NO: 135678 - RNA, 19 nt, Homo sapiens
gcccugcgcucugaaacag

SEQ ID NO: 135679 - RNA, 19 nt, Homo sapiens
caagcucacagaagaugga

SEQ ID NO: 135680 - RNA, 19 nt, Homo sapiens
ucauuaacagguauggauu

SEQ ID NO: 135681 - RNA, 19 nt, Homo sapiens
acuggaggcccuucugaaa

SEQ ID NO: 135682 - RNA, 19 nt, Homo sapiens
ugacaugcuggaagugaga

SEQ ID NO: 135683 - RNA, 19 nt, Homo sapiens
aggaucaaccgcaggcuuu

SEQ ID NO: 135684 - RNA, 19 nt, Homo sapiens
aucgaugggcugauuguua

SEQ ID NO: 135685 - RNA, 19 nt, Homo sapiens
gcggaggacuacgcagaag

SEQ ID NO: 135686 - RNA, 19 nt, Homo sapiens
gcaggccaagcucacagaa

SEQ ID NO: 135687 - RNA, 19 nt, Homo sapiens
gucauuaacagguauggau

SEQ ID NO: 135688 - RNA, 19 nt, Homo sapiens
uuuauaagaugggcuuugg

SEQ ID NO: 135689 - RNA, 19 nt, Homo sapiens
ggauccaucagucuugcaa

SEQ ID NO: 135690 - RNA, 19 nt, Homo sapiens
ggaacuggaggcccuucug

SEQ ID NO: 135691 - RNA, 19 nt, Homo sapiens
cgggagauguaugcacuca

SEQ ID NO: 135692 - RNA, 19 nt, Homo sapiens
cacgggagaugagcguuuc

SEQ ID NO: 135693 - RNA, 19 nt, Homo sapiens
ucaccagccaggauaagga

SEQ ID NO: 135694 - RNA, 19 nt, Homo sapiens
gcguggagacaccugcaaa

SEQ ID NO: 135695 - RNA, 19 nt, Homo sapiens
gacaugaucuucuuccauu

SEQ ID NO: 135696 - RNA, 19 nt, Homo sapiens
gagaauuacugcaaguuug

SEQ ID NO: 135697 - RNA, 19 nt, Homo sapiens
gaugguaucugaaguccuu

SEQ ID NO: 135698 - RNA, 19 nt, Homo sapiens
caacacagcccaggaguuu

SEQ ID NO: 135699 - RNA, 19 nt, Homo sapiens
cgacuacgcuguuuacauc

SEQ ID NO: 135700 - RNA, 19 nt, Homo sapiens
gcacugggaugaucauucu

SEQ ID NO: 135701 - RNA, 19 nt, Homo sapiens
uaaaguggacgccuucuaa

SEQ ID NO: 135702 - RNA, 19 nt, Homo sapiens
gcaagucaaugccaugauc

SEQ ID NO: 135703 - RNA, 19 nt, Homo sapiens
gcuuguggcugaaaccuuu

SEQ ID NO: 135704 - RNA, 19 nt, Homo sapiens
cuacgucucuagaauaaga

SEQ ID NO: 135705 - RNA, 19 nt, Homo sapiens
caacacacaggccaucuuu

SEQ ID NO: 135706 - RNA, 19 nt, Homo sapiens
caacaugguggacguauug

SEQ ID NO: 135707 - RNA, 19 nt, Homo sapiens
cauccaaccucaucaguuc

SEQ ID NO: 135708 - RNA, 19 nt, Homo sapiens
aggaagaccucaucaagug

SEQ ID NO: 135709 - RNA, 19 nt, Homo sapiens
ucaaugccaugaucgagaa

SEQ ID NO: 135710 - RNA, 19 nt, Homo sapiens
cuuaccagcugcaccauuu

SEQ ID NO: 135711 - RNA, 19 nt, Homo sapiens
ccacauacuugggcgaguu

SEQ ID NO: 135712 - RNA, 19 nt, Homo sapiens
cagcuacgucucuagaaua

SEQ ID NO: 135713 - RNA, 19 nt, Homo sapiens
ccaaugagaauuacugcaa

SEQ ID NO: 135714 - RNA, 19 nt, Homo sapiens
cgggagaacgggaucaaua

SEQ ID NO: 135715 - RNA, 19 nt, Homo sapiens
acccagaguccguguauua

SEQ ID NO: 135716 - RNA, 19 nt, Homo sapiens
caagugcacugggaugauc

SEQ ID NO: 135717 - RNA, 19 nt, Homo sapiens
gagaacgggaucaauagga

SEQ ID NO: 135718 - RNA, 19 nt, Homo sapiens
ucagcuacgucucuagaau

SEQ ID NO: 135719 - RNA, 19 nt, Homo sapiens
guggacgccuucuaagaug

SEQ ID NO: 135720 - RNA, 19 nt, Homo sapiens
guaaaguggacgccuucua

SEQ ID NO: 135721 - RNA, 19 nt, Homo sapiens
ugagaauuacugcaaguuu

SEQ ID NO: 135722 - RNA, 19 nt, Homo sapiens
cagaguccguguauuacug

SEQ ID NO: 135723 - RNA, 19 nt, Homo sapiens
acacagcccaggaguuuga

SEQ ID NO: 135724 - RNA, 19 nt, Homo sapiens
gaagcuggaaccacuguca

SEQ ID NO: 135725 - RNA, 19 nt, Homo sapiens
gcacaacaugguggacgua

SEQ ID NO: 135726 - RNA, 19 nt, Homo sapiens
caacccagaguccguguau

SEQ ID NO: 135727 - RNA, 19 nt, Homo sapiens
gggagaacgggaucaauag

SEQ ID NO: 135728 - RNA, 19 nt, Homo sapiens
caaccgcggugugaauuac

SEQ ID NO: 135729 - RNA, 19 nt, Homo sapiens
agaacgggaucaauaggau

SEQ ID NO: 135730 - RNA, 19 nt, Homo sapiens
ugauggagcagaacacaga

SEQ ID NO: 135731 - RNA, 19 nt, Homo sapiens
ggucagcuacgucucuaga

SEQ ID NO: 135732 - RNA, 19 nt, Homo sapiens
agaauuacugcaaguuuga

SEQ ID NO: 135733 - RNA, 19 nt, Homo sapiens
agcuacgucucuagaauaa

SEQ ID NO: 135734 - RNA, 19 nt, Homo sapiens
ucaaccgcggugugaauua

SEQ ID NO: 135735 - RNA, 19 nt, Homo sapiens
acaacaugguggacguauu

SEQ ID NO: 135736 - RNA, 19 nt, Homo sapiens
uaaagcacagcucgacguu

SEQ ID NO: 135737 - RNA, 19 nt, Homo sapiens
ugaaaccuuugcccagaag

SEQ ID NO: 135738 - RNA, 19 nt, Homo sapiens
ucucuagaauaagauggua

SEQ ID NO: 135739 - RNA, 19 nt, Homo sapiens
cugaaaccuuugcccagaa

SEQ ID NO: 135740 - RNA, 19 nt, Homo sapiens
gggccgacuacgcuguuua

SEQ ID NO: 135741 - RNA, 19 nt, Homo sapiens
guguuuagucccgcacuua

SEQ ID NO: 135742 - RNA, 19 nt, Homo sapiens
gguaucugaaguccuuaaa

SEQ ID NO: 135743 - RNA, 19 nt, Homo sapiens
ugagaagaacgaggacuga

SEQ ID NO: 135744 - RNA, 19 nt, Homo sapiens
gagaucaacaacccagagu

SEQ ID NO: 135745 - RNA, 19 nt, Homo sapiens
agauggugauggagcagaa

SEQ ID NO: 135746 - RNA, 19 nt, Homo sapiens
aaugagaauuacugcaagu

SEQ ID NO: 135747 - RNA, 19 nt, Homo sapiens
ggagaacgggaucaauagg

SEQ ID NO: 135748 - RNA, 19 nt, Homo sapiens
ugagaccauucgcuaccuu

SEQ ID NO: 135749 - RNA, 19 nt, Homo sapiens
cgacaugaucuucuuccau

SEQ ID NO: 135750 - RNA, 19 nt, Homo sapiens
ggacgccuucuaagaugau

SEQ ID NO: 135751 - RNA, 19 nt, Homo sapiens
gcaccauuuuccugggaua

SEQ ID NO: 135752 - RNA, 19 nt, Homo sapiens
acacacaggccaucuuugc

SEQ ID NO: 135753 - RNA, 19 nt, Homo sapiens
ucaauaggaucggaaaccu

SEQ ID NO: 135754 - RNA, 19 nt, Homo sapiens
cagcaagucaaugccauga

SEQ ID NO: 135755 - RNA, 19 nt, Homo sapiens
cuucuuccauuccuacaag

SEQ ID NO: 135756 - RNA, 19 nt, Homo sapiens
uggacgccuucuaagauga

SEQ ID NO: 135757 - RNA, 19 nt, Homo sapiens
gcuggugcccaaugagaau

SEQ ID NO: 135758 - RNA, 19 nt, Homo sapiens
gacaugaucuucuuccauu

SEQ ID NO: 135759 - RNA, 19 nt, Homo sapiens
gagaauuacugcaaguuug

SEQ ID NO: 135760 - RNA, 19 nt, Homo sapiens
gaugguaucugaaguccuu

SEQ ID NO: 135761 - RNA, 19 nt, Homo sapiens
uaaaguggacgccuucuaa

SEQ ID NO: 135762 - RNA, 19 nt, Homo sapiens
gcaagucaaugccaugauc

SEQ ID NO: 135763 - RNA, 19 nt, Homo sapiens
gcuuguggcugaaaccuuu

SEQ ID NO: 135764 - RNA, 19 nt, Homo sapiens
cuacgucucuagaauaaga

SEQ ID NO: 135765 - RNA, 19 nt, Homo sapiens
caacaugguggacguauug

SEQ ID NO: 135766 - RNA, 19 nt, Homo sapiens
cauccaaccucaucaguuc

SEQ ID NO: 135767 - RNA, 19 nt, Homo sapiens
aggaagaccucaucaagug

SEQ ID NO: 135768 - RNA, 19 nt, Homo sapiens
ucaaugccaugaucgagaa

SEQ ID NO: 135769 - RNA, 19 nt, Homo sapiens
cuuaccagcugcaccauuu

SEQ ID NO: 135770 - RNA, 19 nt, Homo sapiens
ccacauacuugggcgaguu

SEQ ID NO: 135771 - RNA, 19 nt, Homo sapiens
cagcuacgucucuagaaua

SEQ ID NO: 135772 - RNA, 19 nt, Homo sapiens
ccaaugagaauuacugcaa

SEQ ID NO: 135773 - RNA, 19 nt, Homo sapiens
cgggagaacgggaucaaua

SEQ ID NO: 135774 - RNA, 19 nt, Homo sapiens
acccagaguccguguauua

SEQ ID NO: 135775 - RNA, 19 nt, Homo sapiens
gagaacgggaucaauagga

SEQ ID NO: 135776 - RNA, 19 nt, Homo sapiens
ucagcuacgucucuagaau

SEQ ID NO: 135777 - RNA, 19 nt, Homo sapiens
guggacgccuucuaagaug

SEQ ID NO: 135778 - RNA, 19 nt, Homo sapiens
guaaaguggacgccuucua

SEQ ID NO: 135779 - RNA, 19 nt, Homo sapiens
ugagaauuacugcaaguuu

SEQ ID NO: 135780 - RNA, 19 nt, Homo sapiens
cagaguccguguauuacug

SEQ ID NO: 135781 - RNA, 19 nt, Homo sapiens
gaagcuggaaccacuguca

SEQ ID NO: 135782 - RNA, 19 nt, Homo sapiens
gcacaacaugguggacgua

SEQ ID NO: 135783 - RNA, 19 nt, Homo sapiens
caacccagaguccguguau

SEQ ID NO: 135784 - RNA, 19 nt, Homo sapiens
gggagaacgggaucaauag

SEQ ID NO: 135785 - RNA, 19 nt, Homo sapiens
caaccgcggugugaauuac

SEQ ID NO: 135786 - RNA, 19 nt, Homo sapiens
agaacgggaucaauaggau

SEQ ID NO: 135787 - RNA, 19 nt, Homo sapiens
ugauggagcagaacacaga

SEQ ID NO: 135788 - RNA, 19 nt, Homo sapiens
ggucagcuacgucucuaga

SEQ ID NO: 135789 - RNA, 19 nt, Homo sapiens
agaauuacugcaaguuuga

SEQ ID NO: 135790 - RNA, 19 nt, Homo sapiens
agcuacgucucuagaauaa

SEQ ID NO: 135791 - RNA, 19 nt, Homo sapiens
ucaaccgcggugugaauua

SEQ ID NO: 135792 - RNA, 19 nt, Homo sapiens
acaacaugguggacguauu

SEQ ID NO: 135793 - RNA, 19 nt, Homo sapiens
uaaagcacagcucgacguu

SEQ ID NO: 135794 - RNA, 19 nt, Homo sapiens
ugaaaccuuugcccagaag

SEQ ID NO: 135795 - RNA, 19 nt, Homo sapiens
ucucuagaauaagauggua

SEQ ID NO: 135796 - RNA, 19 nt, Homo sapiens
cugaaaccuuugcccagaa

SEQ ID NO: 135797 - RNA, 19 nt, Homo sapiens
guguuuagucccgcacuua

SEQ ID NO: 135798 - RNA, 19 nt, Homo sapiens
gguaucugaaguccuuaaa

SEQ ID NO: 135799 - RNA, 19 nt, Homo sapiens
ugagaagaacgaggacuga

SEQ ID NO: 135800 - RNA, 19 nt, Homo sapiens
gagaucaacaacccagagu

SEQ ID NO: 135801 - RNA, 19 nt, Homo sapiens
agauggugauggagcagaa

SEQ ID NO: 135802 - RNA, 19 nt, Homo sapiens
aaugagaauuacugcaagu

SEQ ID NO: 135803 - RNA, 19 nt, Homo sapiens
ggagaacgggaucaauagg

SEQ ID NO: 135804 - RNA, 19 nt, Homo sapiens
ugagaccauucgcuaccuu

SEQ ID NO: 135805 - RNA, 19 nt, Homo sapiens
cgacaugaucuucuuccau

SEQ ID NO: 135806 - RNA, 19 nt, Homo sapiens
ggacgccuucuaagaugau

SEQ ID NO: 135807 - RNA, 19 nt, Homo sapiens
cagcaagucaaugccauga

SEQ ID NO: 135808 - RNA, 19 nt, Homo sapiens
gcaccauuuuccugggaua

SEQ ID NO: 135809 - RNA, 19 nt, Homo sapiens
ucaauaggaucggaaaccu

SEQ ID NO: 135810 - RNA, 19 nt, Homo sapiens
cuucuuccauuccuacaag

SEQ ID NO: 135811 - RNA, 19 nt, Homo sapiens
uggacgccuucuaagauga

SEQ ID NO: 135812 - RNA, 19 nt, Homo sapiens
gcuggugcccaaugagaau

SEQ ID NO: 135813 - RNA, 19 nt, Homo sapiens
gacaugaucuucuuccauu

SEQ ID NO: 135814 - RNA, 19 nt, Homo sapiens
gagaauuacugcaaguuug

SEQ ID NO: 135815 - RNA, 19 nt, Homo sapiens
gaugguaucugaaguccuu

SEQ ID NO: 135816 - RNA, 19 nt, Homo sapiens
uaaaguggacgccuucuaa

SEQ ID NO: 135817 - RNA, 19 nt, Homo sapiens
gcaagucaaugccaugauc

SEQ ID NO: 135818 - RNA, 19 nt, Homo sapiens
gcuuguggcugaaaccuuu

SEQ ID NO: 135819 - RNA, 19 nt, Homo sapiens
cuacgucucuagaauaaga

SEQ ID NO: 135820 - RNA, 19 nt, Homo sapiens
caacaugguggacguauug

SEQ ID NO: 135821 - RNA, 19 nt, Homo sapiens
cauccaaccucaucaguuc

SEQ ID NO: 135822 - RNA, 19 nt, Homo sapiens
aggaagaccucaucaagug

SEQ ID NO: 135823 - RNA, 19 nt, Homo sapiens
ucaaugccaugaucgagaa

SEQ ID NO: 135824 - RNA, 19 nt, Homo sapiens
cuuaccagcugcaccauuu

SEQ ID NO: 135825 - RNA, 19 nt, Homo sapiens
ccacauacuugggcgaguu

SEQ ID NO: 135826 - RNA, 19 nt, Homo sapiens
cagcuacgucucuagaaua

SEQ ID NO: 135827 - RNA, 19 nt, Homo sapiens
ccaaugagaauuacugcaa

SEQ ID NO: 135828 - RNA, 19 nt, Homo sapiens
cgggagaacgggaucaaua

SEQ ID NO: 135829 - RNA, 19 nt, Homo sapiens
acccagaguccguguauua

SEQ ID NO: 135830 - RNA, 19 nt, Homo sapiens
gagaacgggaucaauagga

SEQ ID NO: 135831 - RNA, 19 nt, Homo sapiens
ucagcuacgucucuagaau

SEQ ID NO: 135832 - RNA, 19 nt, Homo sapiens
guggacgccuucuaagaug

SEQ ID NO: 135833 - RNA, 19 nt, Homo sapiens
guaaaguggacgccuucua

SEQ ID NO: 135834 - RNA, 19 nt, Homo sapiens
ugagaauuacugcaaguuu

SEQ ID NO: 135835 - RNA, 19 nt, Homo sapiens
cagaguccguguauuacug

SEQ ID NO: 135836 - RNA, 19 nt, Homo sapiens
gaagcuggaaccacuguca

SEQ ID NO: 135837 - RNA, 19 nt, Homo sapiens
gcacaacaugguggacgua

SEQ ID NO: 135838 - RNA, 19 nt, Homo sapiens
caacccagaguccguguau

SEQ ID NO: 135839 - RNA, 19 nt, Homo sapiens
gggagaacgggaucaauag

SEQ ID NO: 135840 - RNA, 19 nt, Homo sapiens
caaccgcggugugaauuac

SEQ ID NO: 135841 - RNA, 19 nt, Homo sapiens
agaacgggaucaauaggau

SEQ ID NO: 135842 - RNA, 19 nt, Homo sapiens
ugauggagcagaacacaga

SEQ ID NO: 135843 - RNA, 19 nt, Homo sapiens
ggucagcuacgucucuaga

SEQ ID NO: 135844 - RNA, 19 nt, Homo sapiens
agaauuacugcaaguuuga

SEQ ID NO: 135845 - RNA, 19 nt, Homo sapiens
agcuacgucucuagaauaa

SEQ ID NO: 135846 - RNA, 19 nt, Homo sapiens
ucaaccgcggugugaauua

SEQ ID NO: 135847 - RNA, 19 nt, Homo sapiens
acaacaugguggacguauu

SEQ ID NO: 135848 - RNA, 19 nt, Homo sapiens
uaaagcacagcucgacguu

SEQ ID NO: 135849 - RNA, 19 nt, Homo sapiens
ugaaaccuuugcccagaag

SEQ ID NO: 135850 - RNA, 19 nt, Homo sapiens
ucucuagaauaagauggua

SEQ ID NO: 135851 - RNA, 19 nt, Homo sapiens
cugaaaccuuugcccagaa

SEQ ID NO: 135852 - RNA, 19 nt, Homo sapiens
guguuuagucccgcacuua

SEQ ID NO: 135853 - RNA, 19 nt, Homo sapiens
gguaucugaaguccuuaaa

SEQ ID NO: 135854 - RNA, 19 nt, Homo sapiens
ugagaagaacgaggacuga

SEQ ID NO: 135855 - RNA, 19 nt, Homo sapiens
gagaucaacaacccagagu

SEQ ID NO: 135856 - RNA, 19 nt, Homo sapiens
agauggugauggagcagaa

SEQ ID NO: 135857 - RNA, 19 nt, Homo sapiens
aaugagaauuacugcaagu

SEQ ID NO: 135858 - RNA, 19 nt, Homo sapiens
ggagaacgggaucaauagg

SEQ ID NO: 135859 - RNA, 19 nt, Homo sapiens
ugagaccauucgcuaccuu

SEQ ID NO: 135860 - RNA, 19 nt, Homo sapiens
cgacaugaucuucuuccau

SEQ ID NO: 135861 - RNA, 19 nt, Homo sapiens
ggacgccuucuaagaugau

SEQ ID NO: 135862 - RNA, 19 nt, Homo sapiens
cagcaagucaaugccauga

SEQ ID NO: 135863 - RNA, 19 nt, Homo sapiens
gcaccauuuuccugggaua

SEQ ID NO: 135864 - RNA, 19 nt, Homo sapiens
ucaauaggaucggaaaccu

SEQ ID NO: 135865 - RNA, 19 nt, Homo sapiens
cuucuuccauuccuacaag

SEQ ID NO: 135866 - RNA, 19 nt, Homo sapiens
uggacgccuucuaagauga

SEQ ID NO: 135867 - RNA, 19 nt, Homo sapiens
gcuggugcccaaugagaau

SEQ ID NO: 135868 - RNA, 19 nt, Homo sapiens
gagggaagaugucucagua

SEQ ID NO: 135869 - RNA, 19 nt, Homo sapiens
ggacacccaucccaaguuu

SEQ ID NO: 135870 - RNA, 19 nt, Homo sapiens
gaacucaggaacaaacauu

SEQ ID NO: 135871 - RNA, 19 nt, Homo sapiens
guuagccucuugcguauug

SEQ ID NO: 135872 - RNA, 19 nt, Homo sapiens
gaccugagcuggaggaacu

SEQ ID NO: 135873 - RNA, 19 nt, Homo sapiens
ccacaaccacauguauuua

SEQ ID NO: 135874 - RNA, 19 nt, Homo sapiens
caucaagguuuacuucaag

SEQ ID NO: 135875 - RNA, 19 nt, Homo sapiens
cgacguugccuuuagacua

SEQ ID NO: 135876 - RNA, 19 nt, Homo sapiens
ggccagggcuucgugaaug

SEQ ID NO: 135877 - RNA, 19 nt, Homo sapiens
gacguugccuuuagacuac

SEQ ID NO: 135878 - RNA, 19 nt, Homo sapiens
ucccagaaccucagcauuu

SEQ ID NO: 135879 - RNA, 19 nt, Homo sapiens
gcagggcugugucccagau

SEQ ID NO: 135880 - RNA, 19 nt, Homo sapiens
gccagggcuucgugaauga

SEQ ID NO: 135881 - RNA, 19 nt, Homo sapiens
ucaucaagguuuacuucaa

SEQ ID NO: 135882 - RNA, 19 nt, Homo sapiens
gcagauuggagacaccauu

SEQ ID NO: 135883 - RNA, 19 nt, Homo sapiens
ucaccuggcugagcaguuc

SEQ ID NO: 135884 - RNA, 19 nt, Homo sapiens
uggaggaacucaggaacaa

SEQ ID NO: 135885 - RNA, 19 nt, Homo sapiens
gaacucccacaaccacaug

SEQ ID NO: 135886 - RNA, 19 nt, Homo sapiens
ggucaucaagguuuacuuc

SEQ ID NO: 135887 - RNA, 19 nt, Homo sapiens
ccucuugcguauuggcuuu

SEQ ID NO: 135888 - RNA, 19 nt, Homo sapiens
ccucgacguugccuuuaga

SEQ ID NO: 135889 - RNA, 19 nt, Homo sapiens
uguacagucugcucaugaa

SEQ ID NO: 135890 - RNA, 19 nt, Homo sapiens
ccucucggcucgaauugau

SEQ ID NO: 135891 - RNA, 19 nt, Homo sapiens
ugaccucgacguugccuuu

SEQ ID NO: 135892 - RNA, 19 nt, Homo sapiens
caaccacauguauuuauuc

SEQ ID NO: 135893 - RNA, 19 nt, Homo sapiens
cccacaaccacauguauuu

SEQ ID NO: 135894 - RNA, 19 nt, Homo sapiens
cuggagagcaugcagauug

SEQ ID NO: 135895 - RNA, 19 nt, Homo sapiens
guguuagccucuugcguau

SEQ ID NO: 135896 - RNA, 19 nt, Homo sapiens
uuagacuacaguuguguua

SEQ ID NO: 135897 - RNA, 19 nt, Homo sapiens
gaccauagucgggauguca

SEQ ID NO: 135898 - RNA, 19 nt, Homo sapiens
ggagggaagaugucucagu

SEQ ID NO: 135899 - RNA, 19 nt, Homo sapiens
agcagugccucuugucuga

SEQ ID NO: 135900 - RNA, 19 nt, Homo sapiens
cccagaaccucagcauuuc

SEQ ID NO: 135901 - RNA, 19 nt, Homo sapiens
ccaaccagaccgagaagga

SEQ ID NO: 135902 - RNA, 19 nt, Homo sapiens
ccuaucaucaggacaguga

SEQ ID NO: 135903 - RNA, 19 nt, Homo sapiens
cggcucgaauugauggaaa

SEQ ID NO: 135904 - RNA, 19 nt, Homo sapiens
cacaaccacauguauuuau

SEQ ID NO: 135905 - RNA, 19 nt, Homo sapiens
ggaggaacucaggaacaaa

SEQ ID NO: 135906 - RNA, 19 nt, Homo sapiens
acacauggcaggcccaaag

SEQ ID NO: 135907 - RNA, 19 nt, Homo sapiens
cccgugcccuggugaauca

SEQ ID NO: 135908 - RNA, 19 nt, Homo sapiens
gcgcugcuucgucuucuga

SEQ ID NO: 135909 - RNA, 19 nt, Homo sapiens
gaggaacucaggaacaaac

SEQ ID NO: 135910 - RNA, 19 nt, Homo sapiens
gaccucgacguugccuuua

SEQ ID NO: 135911 - RNA, 19 nt, Homo sapiens
uaucagugaccucgacguu

SEQ ID NO: 135912 - RNA, 19 nt, Homo sapiens
gauggcagaacucccacaa

SEQ ID NO: 135913 - RNA, 19 nt, Homo sapiens
ugacgcugcaugagacauu

SEQ ID NO: 135914 - RNA, 19 nt, Homo sapiens
ggagcgcugcuucgucuuc

SEQ ID NO: 135915 - RNA, 19 nt, Homo sapiens
cagauuggagacaccauug

SEQ ID NO: 135916 - RNA, 19 nt, Homo sapiens
cugcaccgccucaggguuu

SEQ ID NO: 135917 - RNA, 19 nt, Homo sapiens
ugaagucugugggcaugau

SEQ ID NO: 135918 - RNA, 19 nt, Homo sapiens
cagcccauccaaacacuga

SEQ ID NO: 135919 - RNA, 19 nt, Homo sapiens
gacgcugcaugagacauug

SEQ ID NO: 135920 - RNA, 19 nt, Homo sapiens
ggacccugaugaccacacu

SEQ ID NO: 135921 - RNA, 19 nt, Homo sapiens
agacuacaguuguguuagc

SEQ ID NO: 135922 - RNA, 19 nt, Homo sapiens
cuaccucucggcucgaauu

SEQ ID NO: 135923 - RNA, 19 nt, Homo sapiens
caccugacgcugcaugaga

SEQ ID NO: 135924 - RNA, 19 nt, Homo sapiens
gcucaucgaccgggagauc

SEQ ID NO: 135925 - RNA, 19 nt, Homo sapiens
gagacauugacaccagaaa

SEQ ID NO: 135926 - RNA, 19 nt, Homo sapiens
cuccagcgaugaugacaag

SEQ ID NO: 135927 - RNA, 19 nt, Homo sapiens
cgagagcccggacaucaag

SEQ ID NO: 135928 - RNA, 19 nt, Homo sapiens
gaugauccgggaccaccuu

SEQ ID NO: 135929 - RNA, 19 nt, Homo sapiens
gagcgcugcuucgucuucu

SEQ ID NO: 135930 - RNA, 19 nt, Homo sapiens
gagggaagaugucucagua

SEQ ID NO: 135931 - RNA, 19 nt, Homo sapiens
ggacacccaucccaaguuu

SEQ ID NO: 135932 - RNA, 19 nt, Homo sapiens
gaacucaggaacaaacauu

SEQ ID NO: 135933 - RNA, 19 nt, Homo sapiens
guuagccucuugcguauug

SEQ ID NO: 135934 - RNA, 19 nt, Homo sapiens
gaccugagcuggaggaacu

SEQ ID NO: 135935 - RNA, 19 nt, Homo sapiens
ccacaaccacauguauuua

SEQ ID NO: 135936 - RNA, 19 nt, Homo sapiens
caucaagguuuacuucaag

SEQ ID NO: 135937 - RNA, 19 nt, Homo sapiens
cgacguugccuuuagacua

SEQ ID NO: 135938 - RNA, 19 nt, Homo sapiens
ggccagggcuucgugaaug

SEQ ID NO: 135939 - RNA, 19 nt, Homo sapiens
gacguugccuuuagacuac

SEQ ID NO: 135940 - RNA, 19 nt, Homo sapiens
ucccagaaccucagcauuu

SEQ ID NO: 135941 - RNA, 19 nt, Homo sapiens
gcagggcugugucccagau

SEQ ID NO: 135942 - RNA, 19 nt, Homo sapiens
gccagggcuucgugaauga

SEQ ID NO: 135943 - RNA, 19 nt, Homo sapiens
ucaucaagguuuacuucaa

SEQ ID NO: 135944 - RNA, 19 nt, Homo sapiens
gcagauuggagacaccauu

SEQ ID NO: 135945 - RNA, 19 nt, Homo sapiens
ggucugccauccugaacug

SEQ ID NO: 135946 - RNA, 19 nt, Homo sapiens
ucaccuggcugagcaguuc

SEQ ID NO: 135947 - RNA, 19 nt, Homo sapiens
gcugacaguugggccauau

SEQ ID NO: 135948 - RNA, 19 nt, Homo sapiens
uggaggaacucaggaacaa

SEQ ID NO: 135949 - RNA, 19 nt, Homo sapiens
gaacucccacaaccacaug

SEQ ID NO: 135950 - RNA, 19 nt, Homo sapiens
ggucaucaagguuuacuuc

SEQ ID NO: 135951 - RNA, 19 nt, Homo sapiens
ccucuugcguauuggcuuu

SEQ ID NO: 135952 - RNA, 19 nt, Homo sapiens
ccucgacguugccuuuaga

SEQ ID NO: 135953 - RNA, 19 nt, Homo sapiens
uguacagucugcucaugaa

SEQ ID NO: 135954 - RNA, 19 nt, Homo sapiens
ccucucggcucgaauugau

SEQ ID NO: 135955 - RNA, 19 nt, Homo sapiens
ugaccucgacguugccuuu

SEQ ID NO: 135956 - RNA, 19 nt, Homo sapiens
caaccacauguauuuauuc

SEQ ID NO: 135957 - RNA, 19 nt, Homo sapiens
cccacaaccacauguauuu

SEQ ID NO: 135958 - RNA, 19 nt, Homo sapiens
cuggagagcaugcagauug

SEQ ID NO: 135959 - RNA, 19 nt, Homo sapiens
guguuagccucuugcguau

SEQ ID NO: 135960 - RNA, 19 nt, Homo sapiens
uuagacuacaguuguguua

SEQ ID NO: 135961 - RNA, 19 nt, Homo sapiens
gaccauagucgggauguca

SEQ ID NO: 135962 - RNA, 19 nt, Homo sapiens
ggagggaagaugucucagu

SEQ ID NO: 135963 - RNA, 19 nt, Homo sapiens
agcagugccucuugucuga

SEQ ID NO: 135964 - RNA, 19 nt, Homo sapiens
cccagaaccucagcauuuc

SEQ ID NO: 135965 - RNA, 19 nt, Homo sapiens
ccaaccagaccgagaagga

SEQ ID NO: 135966 - RNA, 19 nt, Homo sapiens
ccuaucaucaggacaguga

SEQ ID NO: 135967 - RNA, 19 nt, Homo sapiens
cggcucgaauugauggaaa

SEQ ID NO: 135968 - RNA, 19 nt, Homo sapiens
cacaaccacauguauuuau

SEQ ID NO: 135969 - RNA, 19 nt, Homo sapiens
ggaggaacucaggaacaaa

SEQ ID NO: 135970 - RNA, 19 nt, Homo sapiens
acacauggcaggcccaaag

SEQ ID NO: 135971 - RNA, 19 nt, Homo sapiens
cccgugcccuggugaauca

SEQ ID NO: 135972 - RNA, 19 nt, Homo sapiens
gcgcugcuucgucuucuga

SEQ ID NO: 135973 - RNA, 19 nt, Homo sapiens
gaggaacucaggaacaaac

SEQ ID NO: 135974 - RNA, 19 nt, Homo sapiens
gaccucgacguugccuuua

SEQ ID NO: 135975 - RNA, 19 nt, Homo sapiens
uaucagugaccucgacguu

SEQ ID NO: 135976 - RNA, 19 nt, Homo sapiens
gauggcagaacucccacaa

SEQ ID NO: 135977 - RNA, 19 nt, Homo sapiens
ugacgcugcaugagacauu

SEQ ID NO: 135978 - RNA, 19 nt, Homo sapiens
ggagcgcugcuucgucuuc

SEQ ID NO: 135979 - RNA, 19 nt, Homo sapiens
cagauuggagacaccauug

SEQ ID NO: 135980 - RNA, 19 nt, Homo sapiens
cugcaccgccucaggguuu

SEQ ID NO: 135981 - RNA, 19 nt, Homo sapiens
ugaagucugugggcaugau

SEQ ID NO: 135982 - RNA, 19 nt, Homo sapiens
cagcccauccaaacacuga

SEQ ID NO: 135983 - RNA, 19 nt, Homo sapiens
gacgcugcaugagacauug

SEQ ID NO: 135984 - RNA, 19 nt, Homo sapiens
ggacccugaugaccacacu

SEQ ID NO: 135985 - RNA, 19 nt, Homo sapiens
agacuacaguuguguuagc

SEQ ID NO: 135986 - RNA, 19 nt, Homo sapiens
caccugacgcugcaugaga

SEQ ID NO: 135987 - RNA, 19 nt, Homo sapiens
cuaccucucggcucgaauu

SEQ ID NO: 135988 - RNA, 19 nt, Homo sapiens
cgagagcccggacaucaag

SEQ ID NO: 135989 - RNA, 19 nt, Homo sapiens
gagacauugacaccagaaa

SEQ ID NO: 135990 - RNA, 19 nt, Homo sapiens
gaugauccgggaccaccuu

SEQ ID NO: 135991 - RNA, 19 nt, Homo sapiens
gcucaucgaccgggagauc

SEQ ID NO: 135992 - RNA, 19 nt, Homo sapiens
cuccagcgaugaugacaag

SEQ ID NO: 135993 - RNA, 19 nt, Homo sapiens
gagcgcugcuucgucuucu

SEQ ID NO: 135994 - RNA, 19 nt, Homo sapiens
ggacuuaacuuguuuggua

SEQ ID NO: 135995 - RNA, 19 nt, Homo sapiens
gaaaggacaucacagguaa

SEQ ID NO: 135996 - RNA, 19 nt, Homo sapiens
gaacuucaaucccaucauu

SEQ ID NO: 135997 - RNA, 19 nt, Homo sapiens
caucaugccugacuaauuu

SEQ ID NO: 135998 - RNA, 19 nt, Homo sapiens
ggaaauaguaccuucaaua

SEQ ID NO: 135999 - RNA, 19 nt, Homo sapiens
ggaaagauguagaaagaug

SEQ ID NO: 136000 - RNA, 19 nt, Homo sapiens
gaucaaagcuagaaaauga

SEQ ID NO: 136001 - RNA, 19 nt, Homo sapiens
guacacagauaccuugaaa

SEQ ID NO: 136002 - RNA, 19 nt, Homo sapiens
gaaggacccugcgaacuuu

SEQ ID NO: 136003 - RNA, 19 nt, Homo sapiens
caacugacauauagcauug

SEQ ID NO: 136004 - RNA, 19 nt, Homo sapiens
ggagacagccucuuacuug

SEQ ID NO: 136005 - RNA, 19 nt, Homo sapiens
gaaaggaagagcuaauaaa

SEQ ID NO: 136006 - RNA, 19 nt, Homo sapiens
gcaaguccaucccaacuga

SEQ ID NO: 136007 - RNA, 19 nt, Homo sapiens
uugcuaaacugaugacuua

SEQ ID NO: 136008 - RNA, 19 nt, Homo sapiens
gaagggaauugcucagaga

SEQ ID NO: 136009 - RNA, 19 nt, Homo sapiens
aaaggcaucuacacaauuu

SEQ ID NO: 136010 - RNA, 19 nt, Homo sapiens
gaaccucaacugacauaua

SEQ ID NO: 136011 - RNA, 19 nt, Homo sapiens
ccgcagaccuugugauauu

SEQ ID NO: 136012 - RNA, 19 nt, Homo sapiens
aagaagagaugagaaauga

SEQ ID NO: 136013 - RNA, 19 nt, Homo sapiens
gaacaguuuuggcauaaua

SEQ ID NO: 136014 - RNA, 19 nt, Homo sapiens
gaagagaugagaaaugaug

SEQ ID NO: 136015 - RNA, 19 nt, Homo sapiens
gaaauaguaccuucaauac

SEQ ID NO: 136016 - RNA, 19 nt, Homo sapiens
guagaaagaugcuagaaaa

SEQ ID NO: 136017 - RNA, 19 nt, Homo sapiens
gaagagcacugaucguacu

SEQ ID NO: 136018 - RNA, 19 nt, Homo sapiens
agaaacgccuggagaauau

SEQ ID NO: 136019 - RNA, 19 nt, Homo sapiens
uugcagagauaaaccaaua

SEQ ID NO: 136020 - RNA, 19 nt, Homo sapiens
gagaauauuugggaugaga

SEQ ID NO: 136021 - RNA, 19 nt, Homo sapiens
ggaagaaacgccuggagaa

SEQ ID NO: 136022 - RNA, 19 nt, Homo sapiens
caaagcaguuacuaauaug

SEQ ID NO: 136023 - RNA, 19 nt, Homo sapiens
gagaguuugcuuacacuua

SEQ ID NO: 136024 - RNA, 19 nt, Homo sapiens
gcagagauaaaccaauaaa

SEQ ID NO: 136025 - RNA, 19 nt, Homo sapiens
ucaccucucuguaguuuau

SEQ ID NO: 136026 - RNA, 19 nt, Homo sapiens
agggaaagauguagaaaga

SEQ ID NO: 136027 - RNA, 19 nt, Homo sapiens
gcagacgcccgaauucaaa

SEQ ID NO: 136028 - RNA, 19 nt, Homo sapiens
gcaauaugaauuccaagaa

SEQ ID NO: 136029 - RNA, 19 nt, Homo sapiens
ccguacaucugcaauauga

SEQ ID NO: 136030 - RNA, 19 nt, Homo sapiens
cuugcaaucuucuacuuua

SEQ ID NO: 136031 - RNA, 19 nt, Homo sapiens
aggaagagcuaauaaaucu

SEQ ID NO: 136032 - RNA, 19 nt, Homo sapiens
ugaaagaagagaugagaaa

SEQ ID NO: 136033 - RNA, 19 nt, Homo sapiens
gagagggaaucgaccguau

SEQ ID NO: 136034 - RNA, 19 nt, Homo sapiens
uaucaaaucuggguaucuu

SEQ ID NO: 136035 - RNA, 19 nt, Homo sapiens
ggacaucacagguaaacug

SEQ ID NO: 136036 - RNA, 19 nt, Homo sapiens
acucuccaauguucuauua

SEQ ID NO: 136037 - RNA, 19 nt, Homo sapiens
caggcaggauucuuaauga

SEQ ID NO: 136038 - RNA, 19 nt, Homo sapiens
gaugagacaccacuguauu

SEQ ID NO: 136039 - RNA, 19 nt, Homo sapiens
cagaagagcacugaucgua

SEQ ID NO: 136040 - RNA, 19 nt, Homo sapiens
ccgagucuguucuggcuua

SEQ ID NO: 136041 - RNA, 19 nt, Homo sapiens
gaaagaagagaugagaaau

SEQ ID NO: 136042 - RNA, 19 nt, Homo sapiens
ccacaaggaauaaaugaga

SEQ ID NO: 136043 - RNA, 19 nt, Homo sapiens
gaagaaacgccuggagaau

SEQ ID NO: 136044 - RNA, 19 nt, Homo sapiens
ggguacaguuggcuaggua

SEQ ID NO: 136045 - RNA, 19 nt, Homo sapiens
uuaaaggcaucuacacaau

SEQ ID NO: 136046 - RNA, 19 nt, Homo sapiens
ccacuuagggaaagaugua

SEQ ID NO: 136047 - RNA, 19 nt, Homo sapiens
agaguggcauucugcauuu

SEQ ID NO: 136048 - RNA, 19 nt, Homo sapiens
ggagugcaguggugugauc

SEQ ID NO: 136049 - RNA, 19 nt, Homo sapiens
agucuguucuggcuuauaa

SEQ ID NO: 136050 - RNA, 19 nt, Homo sapiens
ccaaagugcugggauuaca

SEQ ID NO: 136051 - RNA, 19 nt, Homo sapiens
ugaaaggaagagcuaauaa

SEQ ID NO: 136052 - RNA, 19 nt, Homo sapiens
gucauucucuggccaauuc

SEQ ID NO: 136053 - RNA, 19 nt, Homo sapiens
gcaggauucuuaaugaaaa

SEQ ID NO: 136054 - RNA, 19 nt, Homo sapiens
aagaaacgccuggagaaua

SEQ ID NO: 136055 - RNA, 19 nt, Homo sapiens
agaaaggacaucacaggua

SEQ ID NO: 136056 - RNA, 19 nt, Homo sapiens
ugaaggacccugcgaacuu

SEQ ID NO: 136057 - RNA, 19 nt, Homo sapiens
aaucaccucucuguaguuu

SEQ ID NO: 136058 - RNA, 19 nt, Homo sapiens
ggauuuccuucuaacaugu

SEQ ID NO: 136059 - RNA, 19 nt, Homo sapiens
gcauuucuguggcuuccaa

SEQ ID NO: 136060 - RNA, 19 nt, Homo sapiens
gaugagaaaugaugaaaag

SEQ ID NO: 136061 - RNA, 19 nt, Homo sapiens
gcaaucuucuacuuuaagg

SEQ ID NO: 136062 - RNA, 19 nt, Homo sapiens
caucacagguaaacugaag

SEQ ID NO: 136063 - RNA, 19 nt, Homo sapiens
gagaaaugaugaaaagguu

SEQ ID NO: 136064 - RNA, 19 nt, Homo sapiens
uuuaagguuugcagagaua

SEQ ID NO: 136065 - RNA, 19 nt, Homo sapiens
ggucagcuuuuguuguuua

SEQ ID NO: 136066 - RNA, 19 nt, Homo sapiens
ggucaaaguuuaggguaca

SEQ ID NO: 136067 - RNA, 19 nt, Homo sapiens
gguacaggaugaggagaaa

SEQ ID NO: 136068 - RNA, 19 nt, Homo sapiens
gagaugagaaaugaugaaa

SEQ ID NO: 136069 - RNA, 19 nt, Homo sapiens
guacaucugcaauaugaau

SEQ ID NO: 136070 - RNA, 19 nt, Homo sapiens
caccguacaucugcaauau

SEQ ID NO: 136071 - RNA, 19 nt, Homo sapiens
uaauaugccuagcacaagu

SEQ ID NO: 136072 - RNA, 19 nt, Homo sapiens
gccaucuaaugcuuguuua

SEQ ID NO: 136073 - RNA, 19 nt, Homo sapiens
gaauugcucagagaaggua

SEQ ID NO: 136074 - RNA, 19 nt, Homo sapiens
uaaaggcaucuacacaauu

SEQ ID NO: 136075 - RNA, 19 nt, Homo sapiens
uagccuggauuuccuucua

SEQ ID NO: 136076 - RNA, 19 nt, Homo sapiens
gggaugagacaccacugua

SEQ ID NO: 136077 - RNA, 19 nt, Homo sapiens
cagcggcuuugaagaagaa

SEQ ID NO: 136078 - RNA, 19 nt, Homo sapiens
acacuuacgcugccaugua

SEQ ID NO: 136079 - RNA, 19 nt, Homo sapiens
gagauaaaccaauaaaucc

SEQ ID NO: 136080 - RNA, 19 nt, Homo sapiens
ccuaguagcugggaugaca

SEQ ID NO: 136081 - RNA, 19 nt, Homo sapiens
gggcucaagaggccacuua

SEQ ID NO: 136082 - RNA, 19 nt, Homo sapiens
aacaagaaauuuggccuuu

SEQ ID NO: 136083 - RNA, 19 nt, Homo sapiens
aaccucaacugacauauag

SEQ ID NO: 136084 - RNA, 19 nt, Homo sapiens
cuuagaaccucaacugaca

SEQ ID NO: 136085 - RNA, 19 nt, Homo sapiens
guaagaaggcagugcuuuc

SEQ ID NO: 136086 - RNA, 19 nt, Homo sapiens
ucacugcaauuuuguguaa

SEQ ID NO: 136087 - RNA, 19 nt, Homo sapiens
ccaagaaaaugaagggauu

SEQ ID NO: 136088 - RNA, 19 nt, Homo sapiens
ccacuguugguauuauaua

SEQ ID NO: 136089 - RNA, 19 nt, Homo sapiens
uaucauggcauauaaccaa

SEQ ID NO: 136090 - RNA, 19 nt, Homo sapiens
caacugacaaccagaucaa

SEQ ID NO: 136091 - RNA, 19 nt, Homo sapiens
gcagcggcuuugaagaaga

SEQ ID NO: 136092 - RNA, 19 nt, Homo sapiens
ggaccucuaugccaugaac

SEQ ID NO: 136093 - RNA, 19 nt, Homo sapiens
uggagaauauuugggauga

SEQ ID NO: 136094 - RNA, 19 nt, Homo sapiens
gaagugaacugaugcguuu

SEQ ID NO: 136095 - RNA, 19 nt, Homo sapiens
ggagaaaucugaagccaaa

SEQ ID NO: 136096 - RNA, 19 nt, Homo sapiens
gaaguugucuguugaagaa

SEQ ID NO: 136097 - RNA, 19 nt, Homo sapiens
gagauuaccuugcuuguug

SEQ ID NO: 136098 - RNA, 19 nt, Homo sapiens
gaagagagagcaacucaua

SEQ ID NO: 136099 - RNA, 19 nt, Homo sapiens
gaacagaugcugcuggaua

SEQ ID NO: 136100 - RNA, 19 nt, Homo sapiens
ggagauggaugacuuuaau

SEQ ID NO: 136101 - RNA, 19 nt, Homo sapiens
ucauggaucuucacaauuu

SEQ ID NO: 136102 - RNA, 19 nt, Homo sapiens
ucaagaagguggagaagaa

SEQ ID NO: 136103 - RNA, 19 nt, Homo sapiens
gaaauucuucugcaucaua

SEQ ID NO: 136104 - RNA, 19 nt, Homo sapiens
gauaugagagugcaacuaa

SEQ ID NO: 136105 - RNA, 19 nt, Homo sapiens
agacaaagguggagaaauc

SEQ ID NO: 136106 - RNA, 19 nt, Homo sapiens
gaucaaugcucucaucaca

SEQ ID NO: 136107 - RNA, 19 nt, Homo sapiens
ccaagaaguugucuguuga

SEQ ID NO: 136108 - RNA, 19 nt, Homo sapiens
gagcugagauggaugaagu

SEQ ID NO: 136109 - RNA, 19 nt, Homo sapiens
gggauuaauugaucaaaug

SEQ ID NO: 136110 - RNA, 19 nt, Homo sapiens
gaugaugcauucuaacaug

SEQ ID NO: 136111 - RNA, 19 nt, Homo sapiens
gaaccuagaucagaugaag

SEQ ID NO: 136112 - RNA, 19 nt, Homo sapiens
gcacagucauugcaagaug

SEQ ID NO: 136113 - RNA, 19 nt, Homo sapiens
ggagaaagccagccgaguu

SEQ ID NO: 136114 - RNA, 19 nt, Homo sapiens
caagaaggaucaagaaggu

SEQ ID NO: 136115 - RNA, 19 nt, Homo sapiens
gaaccacuauugcacugaa

SEQ ID NO: 136116 - RNA, 19 nt, Homo sapiens
gaagaugccaagaaagaaa

SEQ ID NO: 136117 - RNA, 19 nt, Homo sapiens
gaauguauuucccagauag

SEQ ID NO: 136118 - RNA, 19 nt, Homo sapiens
gcauggagauggaugacuu

SEQ ID NO: 136119 - RNA, 19 nt, Homo sapiens
gaaccugaaugaggagaaa

SEQ ID NO: 136120 - RNA, 19 nt, Homo sapiens
gauggacagucuucuagaa

SEQ ID NO: 136121 - RNA, 19 nt, Homo sapiens
aauaucagcuuccucugua

SEQ ID NO: 136122 - RNA, 19 nt, Homo sapiens
gaaaagaaaucugugcaaa

SEQ ID NO: 136123 - RNA, 19 nt, Homo sapiens
gagaaagccagccgaguuu

SEQ ID NO: 136124 - RNA, 19 nt, Homo sapiens
gcgagcaaguggagaauau

SEQ ID NO: 136125 - RNA, 19 nt, Homo sapiens
gaaugaggcuguucugacu

SEQ ID NO: 136126 - RNA, 19 nt, Homo sapiens
ugagauggaugaaguggaa

SEQ ID NO: 136127 - RNA, 19 nt, Homo sapiens
gcgaguacuuccucuuuga

SEQ ID NO: 136128 - RNA, 19 nt, Homo sapiens
uaaagguguuggauucaaa

SEQ ID NO: 136129 - RNA, 19 nt, Homo sapiens
acaaauuucugauguggaa

SEQ ID NO: 136130 - RNA, 19 nt, Homo sapiens
gcaugagaauuaagaagga

SEQ ID NO: 136131 - RNA, 19 nt, Homo sapiens
agaaagagcugagauggau

SEQ ID NO: 136132 - RNA, 19 nt, Homo sapiens
gaauuaagaaggagaagga

SEQ ID NO: 136133 - RNA, 19 nt, Homo sapiens
agaaauggcuucccucucu

SEQ ID NO: 136134 - RNA, 19 nt, Homo sapiens
caacaaguuuggaaucaag

SEQ ID NO: 136135 - RNA, 19 nt, Homo sapiens
gaacaacaaguuuggaauc

SEQ ID NO: 136136 - RNA, 19 nt, Homo sapiens
ucaguugggugcaaacauu

SEQ ID NO: 136137 - RNA, 19 nt, Homo sapiens
gagagcaacucauagacau

SEQ ID NO: 136138 - RNA, 19 nt, Homo sapiens
ggccagaccucaguacuau

SEQ ID NO: 136139 - RNA, 19 nt, Homo sapiens
gaucagaugaagaaacaaa

SEQ ID NO: 136140 - RNA, 19 nt, Homo sapiens
gcugaaaacuugcaaaaga

SEQ ID NO: 136141 - RNA, 19 nt, Homo sapiens
cagacgagcuugcccaugu

SEQ ID NO: 136142 - RNA, 19 nt, Homo sapiens
gcagaagcuucaagaucuu

SEQ ID NO: 136143 - RNA, 19 nt, Homo sapiens
gcaggaccuucgagagauu

SEQ ID NO: 136144 - RNA, 19 nt, Homo sapiens
auaaggagcugggcgagua

SEQ ID NO: 136145 - RNA, 19 nt, Homo sapiens
gagaauaucaagccagaga

SEQ ID NO: 136146 - RNA, 19 nt, Homo sapiens
uagaucagaugaagaaaca

SEQ ID NO: 136147 - RNA, 19 nt, Homo sapiens
uuucugaacugaaggauga

SEQ ID NO: 136148 - RNA, 19 nt, Homo sapiens
gcaacuaaauguguuugau

SEQ ID NO: 136149 - RNA, 19 nt, Homo sapiens
gaauaucaagccagagauu

SEQ ID NO: 136150 - RNA, 19 nt, Homo sapiens
gagaaggacaucaucauca

SEQ ID NO: 136151 - RNA, 19 nt, Homo sapiens
ggagaaacagcaaccuuug

SEQ ID NO: 136152 - RNA, 19 nt, Homo sapiens
caagaacagugagacauuc

SEQ ID NO: 136153 - RNA, 19 nt, Homo sapiens
cccaagaaguugucuguug

SEQ ID NO: 136154 - RNA, 19 nt, Homo sapiens
aacgugauguucagaauuu

SEQ ID NO: 136155 - RNA, 19 nt, Homo sapiens
gagcagaagcuucaagauc

SEQ ID NO: 136156 - RNA, 19 nt, Homo sapiens
gagauugagggauuaauug

SEQ ID NO: 136157 - RNA, 19 nt, Homo sapiens
uaaacacagugaaggauuc

SEQ ID NO: 136158 - RNA, 19 nt, Homo sapiens
ugcaagauguuucagauga

SEQ ID NO: 136159 - RNA, 19 nt, Homo sapiens
cuucggagcugaccaagga

SEQ ID NO: 136160 - RNA, 19 nt, Homo sapiens
ccagaccucaguacuauaa

SEQ ID NO: 136161 - RNA, 19 nt, Homo sapiens
gauggugucccaauacuug

SEQ ID NO: 136162 - RNA, 19 nt, Homo sapiens
agaaggacaucaucaucaa

SEQ ID NO: 136163 - RNA, 19 nt, Homo sapiens
gagcaaaacuagccaagga

SEQ ID NO: 136164 - RNA, 19 nt, Homo sapiens
gcacaggaacaguauaaca

SEQ ID NO: 136165 - RNA, 19 nt, Homo sapiens
gaacuuuucgccaaacuua

SEQ ID NO: 136166 - RNA, 19 nt, Homo sapiens
uggaugaaguggaacguuu

SEQ ID NO: 136167 - RNA, 19 nt, Homo sapiens
cagaaucucucaaucuuuu

SEQ ID NO: 136168 - RNA, 19 nt, Homo sapiens
gauugagauugagggauua

SEQ ID NO: 136169 - RNA, 19 nt, Homo sapiens
agauugagauugagggauu

SEQ ID NO: 136170 - RNA, 19 nt, Homo sapiens
gcccaauucugcucauaga

SEQ ID NO: 136171 - RNA, 19 nt, Homo sapiens
ugauguauauucaggaguu

SEQ ID NO: 136172 - RNA, 19 nt, Homo sapiens
gagaaacagcaaccuuuga

SEQ ID NO: 136173 - RNA, 19 nt, Homo sapiens
gguguuggauucaaagaca

SEQ ID NO: 136174 - RNA, 19 nt, Homo sapiens
cagaggacaugaaugaaag

SEQ ID NO: 136175 - RNA, 19 nt, Homo sapiens
ccagaggacaugaaugaaa

SEQ ID NO: 136176 - RNA, 19 nt, Homo sapiens
ccaagaacagugagacauu

SEQ ID NO: 136177 - RNA, 19 nt, Homo sapiens
acauggagacccucuauaa

SEQ ID NO: 136178 - RNA, 19 nt, Homo sapiens
agaauguauuucccagaua

SEQ ID NO: 136179 - RNA, 19 nt, Homo sapiens
gaaucaagaccauguugga

SEQ ID NO: 136180 - RNA, 19 nt, Homo sapiens
gaucauucgcugcuugaaa

SEQ ID NO: 136181 - RNA, 19 nt, Homo sapiens
gaaugacuaucccgauguc

SEQ ID NO: 136182 - RNA, 19 nt, Homo sapiens
guucugccauuuggauuaa

SEQ ID NO: 136183 - RNA, 19 nt, Homo sapiens
caacuaaauguguuugaug

SEQ ID NO: 136184 - RNA, 19 nt, Homo sapiens
ggacauucuuaaacgacuu

SEQ ID NO: 136185 - RNA, 19 nt, Homo sapiens
gaggaccgcuuugagaaca

SEQ ID NO: 136186 - RNA, 19 nt, Homo sapiens
ggaagaugccaagaaagaa

SEQ ID NO: 136187 - RNA, 19 nt, Homo sapiens
acuggaagaugccaagaaa

SEQ ID NO: 136188 - RNA, 19 nt, Homo sapiens
gcagagccacacuuccuuu

SEQ ID NO: 136189 - RNA, 19 nt, Homo sapiens
gcugaucaaugcucucauc

SEQ ID NO: 136190 - RNA, 19 nt, Homo sapiens
gagaaggagcggcuagaga

SEQ ID NO: 136191 - RNA, 19 nt, Homo sapiens
ccaaggagaaggcagagaa

SEQ ID NO: 136192 - RNA, 19 nt, Homo sapiens
gggcugauccugacuucaa

SEQ ID NO: 136193 - RNA, 19 nt, Homo sapiens
ggagacagaagaaggaauc

SEQ ID NO: 136194 - RNA, 19 nt, Homo sapiens
gcacagauaucuacuuuau

SEQ ID NO: 136195 - RNA, 19 nt, Homo sapiens
uagcagagcuuaagaauga

SEQ ID NO: 136196 - RNA, 19 nt, Homo sapiens
gaagagaaauggaagagaa

SEQ ID NO: 136197 - RNA, 19 nt, Homo sapiens
ccaauaauaugauggcuua

SEQ ID NO: 136198 - RNA, 19 nt, Homo sapiens
gaucagagauacuaaauca

SEQ ID NO: 136199 - RNA, 19 nt, Homo sapiens
gaaguucgaugaagaauuc

SEQ ID NO: 136200 - RNA, 19 nt, Homo sapiens
gaucgaaguuugucucuaa

SEQ ID NO: 136201 - RNA, 19 nt, Homo sapiens
gaagauacucaacgaauua

SEQ ID NO: 136202 - RNA, 19 nt, Homo sapiens
gaaaacagguucuacauuu

SEQ ID NO: 136203 - RNA, 19 nt, Homo sapiens
gagcagaaauggaugauau

SEQ ID NO: 136204 - RNA, 19 nt, Homo sapiens
gaaguagugugcauuugua

SEQ ID NO: 136205 - RNA, 19 nt, Homo sapiens
gauacaaacuugccuuauu

SEQ ID NO: 136206 - RNA, 19 nt, Homo sapiens
agagaaagcugaacaagaa

SEQ ID NO: 136207 - RNA, 19 nt, Homo sapiens
cgauuuaacucaucugaua

SEQ ID NO: 136208 - RNA, 19 nt, Homo sapiens
gaugaacgaucuuugaauu

SEQ ID NO: 136209 - RNA, 19 nt, Homo sapiens
gaacacaguuaucaggauu

SEQ ID NO: 136210 - RNA, 19 nt, Homo sapiens
caugaugacugaaauagua

SEQ ID NO: 136211 - RNA, 19 nt, Homo sapiens
caaagaaguucgaugaaga

SEQ ID NO: 136212 - RNA, 19 nt, Homo sapiens
ggagaaugaucuugaaaug

SEQ ID NO: 136213 - RNA, 19 nt, Homo sapiens
gacaggcuauucuaaauuu

SEQ ID NO: 136214 - RNA, 19 nt, Homo sapiens
ggagagaggcuaauauuau

SEQ ID NO: 136215 - RNA, 19 nt, Homo sapiens
ccaaaugccuucuaugguu

SEQ ID NO: 136216 - RNA, 19 nt, Homo sapiens
cauccaaguucaucauuua

SEQ ID NO: 136217 - RNA, 19 nt, Homo sapiens
gugaacuucuucucaauua

SEQ ID NO: 136218 - RNA, 19 nt, Homo sapiens
gaagacauaagaaacguua

SEQ ID NO: 136219 - RNA, 19 nt, Homo sapiens
gaucauaucgcaugccaua

SEQ ID NO: 136220 - RNA, 19 nt, Homo sapiens
ccucaugagucuuaacuua

SEQ ID NO: 136221 - RNA, 19 nt, Homo sapiens
caaagcacauuguagauau

SEQ ID NO: 136222 - RNA, 19 nt, Homo sapiens
gagagaggcuaauauuaug

SEQ ID NO: 136223 - RNA, 19 nt, Homo sapiens
caaagaagaugaccuaacu

SEQ ID NO: 136224 - RNA, 19 nt, Homo sapiens
caaauaagguacuaucaca

SEQ ID NO: 136225 - RNA, 19 nt, Homo sapiens
caccaugccuggcuaauuu

SEQ ID NO: 136226 - RNA, 19 nt, Homo sapiens
gaaaggaaauaagugcauu

SEQ ID NO: 136227 - RNA, 19 nt, Homo sapiens
ugaccuaacugaauuauca

SEQ ID NO: 136228 - RNA, 19 nt, Homo sapiens
ggagcuaucucaucuaagu

SEQ ID NO: 136229 - RNA, 19 nt, Homo sapiens
aaagaacgcagaagcauua

SEQ ID NO: 136230 - RNA, 19 nt, Homo sapiens
gaacaaggcgaaaguugaa

SEQ ID NO: 136231 - RNA, 19 nt, Homo sapiens
gaaggacacugcugcugaa

SEQ ID NO: 136232 - RNA, 19 nt, Homo sapiens
gaagaugaccuaacugaau

SEQ ID NO: 136233 - RNA, 19 nt, Homo sapiens
ccagauuacuccaggauaa

SEQ ID NO: 136234 - RNA, 19 nt, Homo sapiens
ucugaaaggucaauuguuu

SEQ ID NO: 136235 - RNA, 19 nt, Homo sapiens
caaagaacuugaagcagaa

SEQ ID NO: 136236 - RNA, 19 nt, Homo sapiens
gauugaacccacagaauua

SEQ ID NO: 136237 - RNA, 19 nt, Homo sapiens
uaaaugcccuugucacuuc

SEQ ID NO: 136238 - RNA, 19 nt, Homo sapiens
ucaggaagccuugcaauua

SEQ ID NO: 136239 - RNA, 19 nt, Homo sapiens
gaauuacgaucggguauau

SEQ ID NO: 136240 - RNA, 19 nt, Homo sapiens
gagauaaaguaaacaagug

SEQ ID NO: 136241 - RNA, 19 nt, Homo sapiens
guaagaaauugaagaguuc

SEQ ID NO: 136242 - RNA, 19 nt, Homo sapiens
gaaagugcaagcaaaguuu

SEQ ID NO: 136243 - RNA, 19 nt, Homo sapiens
gcagaagcauuagaagaaa

SEQ ID NO: 136244 - RNA, 19 nt, Homo sapiens
gaacgcagaagcauuagaa

SEQ ID NO: 136245 - RNA, 19 nt, Homo sapiens
caaauacaggcaaagauua

SEQ ID NO: 136246 - RNA, 19 nt, Homo sapiens
ucacauugauucacacauu

SEQ ID NO: 136247 - RNA, 19 nt, Homo sapiens
gcacaaguacucucaaguu

SEQ ID NO: 136248 - RNA, 19 nt, Homo sapiens
aaacauagcucccuguaac

SEQ ID NO: 136249 - RNA, 19 nt, Homo sapiens
gcacacacaugcacacaca

SEQ ID NO: 136250 - RNA, 19 nt, Homo sapiens
ugaugaagcucuaugagaa

SEQ ID NO: 136251 - RNA, 19 nt, Homo sapiens
gaacucaggcucaagaaau

SEQ ID NO: 136252 - RNA, 19 nt, Homo sapiens
gaaauaacagggaacgauu

SEQ ID NO: 136253 - RNA, 19 nt, Homo sapiens
gcaguaauccucuuucuca

SEQ ID NO: 136254 - RNA, 19 nt, Homo sapiens
gaauaaacaccuaucucua

SEQ ID NO: 136255 - RNA, 19 nt, Homo sapiens
uaacuucucuggagugcaa

SEQ ID NO: 136256 - RNA, 19 nt, Homo sapiens
aagaaugacuugcaaucua

SEQ ID NO: 136257 - RNA, 19 nt, Homo sapiens
gaacaggcauaggauaaca

SEQ ID NO: 136258 - RNA, 19 nt, Homo sapiens
gaacaagaacgaaugaagu

SEQ ID NO: 136259 - RNA, 19 nt, Homo sapiens
aaacacacauacacaaaug

SEQ ID NO: 136260 - RNA, 19 nt, Homo sapiens
gauucaaacugcugccuuu

SEQ ID NO: 136261 - RNA, 19 nt, Homo sapiens
ccaguugaguuauuuagaa

SEQ ID NO: 136262 - RNA, 19 nt, Homo sapiens
guagugugcauuuguaaua

SEQ ID NO: 136263 - RNA, 19 nt, Homo sapiens
gaacgugacaucaagaaau

SEQ ID NO: 136264 - RNA, 19 nt, Homo sapiens
gaagacaaguuugagaauc

SEQ ID NO: 136265 - RNA, 19 nt, Homo sapiens
ggacaugaaccuuaacgaa

SEQ ID NO: 136266 - RNA, 19 nt, Homo sapiens
ggaaguauuggaucucuuu

SEQ ID NO: 136267 - RNA, 19 nt, Homo sapiens
gcucagccauuauaugaug

SEQ ID NO: 136268 - RNA, 19 nt, Homo sapiens
gagaaccagugaaacagaa

SEQ ID NO: 136269 - RNA, 19 nt, Homo sapiens
caagguagaaauacugaua

SEQ ID NO: 136270 - RNA, 19 nt, Homo sapiens
aagaucaacuuccuuugua

SEQ ID NO: 136271 - RNA, 19 nt, Homo sapiens
gaagaacacauaaacaaca

SEQ ID NO: 136272 - RNA, 19 nt, Homo sapiens
ccaggaauaucacuuaauc

SEQ ID NO: 136273 - RNA, 19 nt, Homo sapiens
gcagaaauccagcaacuuc

SEQ ID NO: 136274 - RNA, 19 nt, Homo sapiens
aaacaaagaagaugaccua

SEQ ID NO: 136275 - RNA, 19 nt, Homo sapiens
gaacgaucuuugaauuugu

SEQ ID NO: 136276 - RNA, 19 nt, Homo sapiens
gguaaaggcaaucuaguuu

SEQ ID NO: 136277 - RNA, 19 nt, Homo sapiens
ggaaguguuucugauggua

SEQ ID NO: 136278 - RNA, 19 nt, Homo sapiens
aaacaacccuuuugcauuu

SEQ ID NO: 136279 - RNA, 19 nt, Homo sapiens
uaacaacuuuggccaugaa

SEQ ID NO: 136280 - RNA, 19 nt, Homo sapiens
gaucggguauaucagauga

SEQ ID NO: 136281 - RNA, 19 nt, Homo sapiens
gaaaccaaauuacacuaag

SEQ ID NO: 136282 - RNA, 19 nt, Homo sapiens
caaagaagaaagugaaaga

SEQ ID NO: 136283 - RNA, 19 nt, Homo sapiens
ugaacgaucuuugaauuug

SEQ ID NO: 136284 - RNA, 19 nt, Homo sapiens
ggacaggcuauucuaaauu

SEQ ID NO: 136285 - RNA, 19 nt, Homo sapiens
gcagcucacuacacuauuc

SEQ ID NO: 136286 - RNA, 19 nt, Homo sapiens
cauccuuacuuagguauua

SEQ ID NO: 136287 - RNA, 19 nt, Homo sapiens
gcccacagauaauuccuuu

SEQ ID NO: 136288 - RNA, 19 nt, Homo sapiens
agacuggugugauggauaa

SEQ ID NO: 136289 - RNA, 19 nt, Homo sapiens
caucaaaccaagcaucaua

SEQ ID NO: 136290 - RNA, 19 nt, Homo sapiens
ccaaguucaucauuuauuc

SEQ ID NO: 136291 - RNA, 19 nt, Homo sapiens
gacuugaucuugcuauguu

SEQ ID NO: 136292 - RNA, 19 nt, Homo sapiens
gaacgaaugaaguacuauu

SEQ ID NO: 136293 - RNA, 19 nt, Homo sapiens
caagacuccucccacaauu

SEQ ID NO: 136294 - RNA, 19 nt, Homo sapiens
uagcagagcuuaagaauga

SEQ ID NO: 136295 - RNA, 19 nt, Homo sapiens
gaagagaaauggaagagaa

SEQ ID NO: 136296 - RNA, 19 nt, Homo sapiens
gaucagagauacuaaauca

SEQ ID NO: 136297 - RNA, 19 nt, Homo sapiens
gaaguucgaugaagaauuc

SEQ ID NO: 136298 - RNA, 19 nt, Homo sapiens
gaagauacucaacgaauua

SEQ ID NO: 136299 - RNA, 19 nt, Homo sapiens
gagcagaaauggaugauau

SEQ ID NO: 136300 - RNA, 19 nt, Homo sapiens
agagaaagcugaacaagaa

SEQ ID NO: 136301 - RNA, 19 nt, Homo sapiens
cgauuuaacucaucugaua

SEQ ID NO: 136302 - RNA, 19 nt, Homo sapiens
gaugaacgaucuuugaauu

SEQ ID NO: 136303 - RNA, 19 nt, Homo sapiens
caugaugacugaaauagua

SEQ ID NO: 136304 - RNA, 19 nt, Homo sapiens
caaagaaguucgaugaaga

SEQ ID NO: 136305 - RNA, 19 nt, Homo sapiens
gaagacauaagaaacguua

SEQ ID NO: 136306 - RNA, 19 nt, Homo sapiens
gaucauaucgcaugccaua

SEQ ID NO: 136307 - RNA, 19 nt, Homo sapiens
caaagaagaugaccuaacu

SEQ ID NO: 136308 - RNA, 19 nt, Homo sapiens
ugaccuaacugaauuauca

SEQ ID NO: 136309 - RNA, 19 nt, Homo sapiens
aaagaacgcagaagcauua

SEQ ID NO: 136310 - RNA, 19 nt, Homo sapiens
gaacaaggcgaaaguugaa

SEQ ID NO: 136311 - RNA, 19 nt, Homo sapiens
gaaggacacugcugcugaa

SEQ ID NO: 136312 - RNA, 19 nt, Homo sapiens
gaagaugaccuaacugaau

SEQ ID NO: 136313 - RNA, 19 nt, Homo sapiens
caaagaacuugaagcagaa

SEQ ID NO: 136314 - RNA, 19 nt, Homo sapiens
gauugaacccacagaauua

SEQ ID NO: 136315 - RNA, 19 nt, Homo sapiens
uaaaugcccuugucacuuc

SEQ ID NO: 136316 - RNA, 19 nt, Homo sapiens
ucaggaagccuugcaauua

SEQ ID NO: 136317 - RNA, 19 nt, Homo sapiens
gaauuacgaucggguauau

SEQ ID NO: 136318 - RNA, 19 nt, Homo sapiens
gaaagugcaagcaaaguuu

SEQ ID NO: 136319 - RNA, 19 nt, Homo sapiens
gcagaagcauuagaagaaa

SEQ ID NO: 136320 - RNA, 19 nt, Homo sapiens
gaacgcagaagcauuagaa

SEQ ID NO: 136321 - RNA, 19 nt, Homo sapiens
caaauacaggcaaagauua

SEQ ID NO: 136322 - RNA, 19 nt, Homo sapiens
ggaauccagugguaaauca

SEQ ID NO: 136323 - RNA, 19 nt, Homo sapiens
gcacaaguacucucaaguu

SEQ ID NO: 136324 - RNA, 19 nt, Homo sapiens
ugaugaagcucuaugagaa

SEQ ID NO: 136325 - RNA, 19 nt, Homo sapiens
gaacucaggcucaagaaau

SEQ ID NO: 136326 - RNA, 19 nt, Homo sapiens
gaaauaacagggaacgauu

SEQ ID NO: 136327 - RNA, 19 nt, Homo sapiens
gaacgugacaucaagaaau

SEQ ID NO: 136328 - RNA, 19 nt, Homo sapiens
gaagacaaguuugagaauc

SEQ ID NO: 136329 - RNA, 19 nt, Homo sapiens
ggacaugaaccuuaacgaa

SEQ ID NO: 136330 - RNA, 19 nt, Homo sapiens
ggaaguauuggaucucuuu

SEQ ID NO: 136331 - RNA, 19 nt, Homo sapiens
gcucagccauuauaugaug

SEQ ID NO: 136332 - RNA, 19 nt, Homo sapiens
aagaucaacuuccuuugua

SEQ ID NO: 136333 - RNA, 19 nt, Homo sapiens
gaagaacacauaaacaaca

SEQ ID NO: 136334 - RNA, 19 nt, Homo sapiens
ccaggaauaucacuuaauc

SEQ ID NO: 136335 - RNA, 19 nt, Homo sapiens
gcagaaauccagcaacuuc

SEQ ID NO: 136336 - RNA, 19 nt, Homo sapiens
aaacaaagaagaugaccua

SEQ ID NO: 136337 - RNA, 19 nt, Homo sapiens
gaacgaucuuugaauuugu

SEQ ID NO: 136338 - RNA, 19 nt, Homo sapiens
aaacaacccuuuugcauuu

SEQ ID NO: 136339 - RNA, 19 nt, Homo sapiens
uaacaacuuuggccaugaa

SEQ ID NO: 136340 - RNA, 19 nt, Homo sapiens
gaucggguauaucagauga

SEQ ID NO: 136341 - RNA, 19 nt, Homo sapiens
caaagaagaaagugaaaga

SEQ ID NO: 136342 - RNA, 19 nt, Homo sapiens
ugaacgaucuuugaauuug

SEQ ID NO: 136343 - RNA, 19 nt, Homo sapiens
agacuggugugauggauaa

SEQ ID NO: 136344 - RNA, 19 nt, Homo sapiens
caucaaaccaagcaucaua

SEQ ID NO: 136345 - RNA, 19 nt, Homo sapiens
gugaaagaacugagaauuu

SEQ ID NO: 136346 - RNA, 19 nt, Homo sapiens
uaaucuaccuuauggaaug

SEQ ID NO: 136347 - RNA, 19 nt, Homo sapiens
gauccagacuucaaauaca

SEQ ID NO: 136348 - RNA, 19 nt, Homo sapiens
aagaugaccuaacugaauu

SEQ ID NO: 136349 - RNA, 19 nt, Homo sapiens
gaaagugaaagaacugaga

SEQ ID NO: 136350 - RNA, 19 nt, Homo sapiens
caacaugaugacugaaaua

SEQ ID NO: 136351 - RNA, 19 nt, Homo sapiens
gauggauaaucuucuagaa

SEQ ID NO: 136352 - RNA, 19 nt, Homo sapiens
gaacacauaaacaacauca

SEQ ID NO: 136353 - RNA, 19 nt, Homo sapiens
agaagauacucaacgaauu

SEQ ID NO: 136354 - RNA, 19 nt, Homo sapiens
caaaguuucagcucaaauu

SEQ ID NO: 136355 - RNA, 19 nt, Homo sapiens
agaauuaucugagaacugu

SEQ ID NO: 136356 - RNA, 19 nt, Homo sapiens
caguaacucuugccuguga

SEQ ID NO: 136357 - RNA, 19 nt, Homo sapiens
gaauuuugcuacucagaua

SEQ ID NO: 136358 - RNA, 19 nt, Homo sapiens
caaguacucucaaguucau

SEQ ID NO: 136359 - RNA, 19 nt, Homo sapiens
ucaaauacaggcaaagauu

SEQ ID NO: 136360 - RNA, 19 nt, Homo sapiens
ugaaggucuuggacucuua

SEQ ID NO: 136361 - RNA, 19 nt, Homo sapiens
ugagaugguuguccaguau

SEQ ID NO: 136362 - RNA, 19 nt, Homo sapiens
gaugguacaacaugacuuu

SEQ ID NO: 136363 - RNA, 19 nt, Homo sapiens
caaagagggugaugagacu

SEQ ID NO: 136364 - RNA, 19 nt, Homo sapiens
caacuuccuuuguaagauc

SEQ ID NO: 136365 - RNA, 19 nt, Homo sapiens
ggagguuaaugaagacaug

SEQ ID NO: 136366 - RNA, 19 nt, Homo sapiens
cagcucagccauuauauga

SEQ ID NO: 136367 - RNA, 19 nt, Homo sapiens
caaagacagugagcauaga

SEQ ID NO: 136368 - RNA, 19 nt, Homo sapiens
agaguuaguucuucuuguu

SEQ ID NO: 136369 - RNA, 19 nt, Homo sapiens
ugaaugaagucuaccaucu

SEQ ID NO: 136370 - RNA, 19 nt, Homo sapiens
caacagcagcagaaagaaa

SEQ ID NO: 136371 - RNA, 19 nt, Homo sapiens
ccucaaagcauuuaugaau

SEQ ID NO: 136372 - RNA, 19 nt, Homo sapiens
acaugaaccuuaacgaaga

SEQ ID NO: 136373 - RNA, 19 nt, Homo sapiens
gccauuauaugaugaacga

SEQ ID NO: 136374 - RNA, 19 nt, Homo sapiens
acaaucaggugcagcauuc

SEQ ID NO: 136375 - RNA, 19 nt, Homo sapiens
cguagaaagugcaagcaaa

SEQ ID NO: 136376 - RNA, 19 nt, Homo sapiens
ugaagaaucacguguguug

SEQ ID NO: 136377 - RNA, 19 nt, Homo sapiens
ggcgaaaguugaagaaagu

SEQ ID NO: 136378 - RNA, 19 nt, Homo sapiens
gauuagacaucgauuuaac

SEQ ID NO: 136379 - RNA, 19 nt, Homo sapiens
cagcuggguuaacaacuuu

SEQ ID NO: 136380 - RNA, 19 nt, Homo sapiens
caaggaauccagugguaaa

SEQ ID NO: 136381 - RNA, 19 nt, Homo sapiens
gaagaaagugaaagaacug

SEQ ID NO: 136382 - RNA, 19 nt, Homo sapiens
agacugggccuacaaagaa

SEQ ID NO: 136383 - RNA, 19 nt, Homo sapiens
gagaaucaauuggucaaag

SEQ ID NO: 136384 - RNA, 19 nt, Homo sapiens
gaaaguugaagaaagugaa

SEQ ID NO: 136385 - RNA, 19 nt, Homo sapiens
augaugagcuugauauuca

SEQ ID NO: 136386 - RNA, 19 nt, Homo sapiens
gaaccuuaacgaagagaaa

SEQ ID NO: 136387 - RNA, 19 nt, Homo sapiens
uggaggacaugaaccuuaa

SEQ ID NO: 136388 - RNA, 19 nt, Homo sapiens
ucuagaagcccuacaauca

SEQ ID NO: 136389 - RNA, 19 nt, Homo sapiens
gguuaagagucaaagaaga

SEQ ID NO: 136390 - RNA, 19 nt, Homo sapiens
aaacccaaauugaacauuc

SEQ ID NO: 136391 - RNA, 19 nt, Homo sapiens
agaaucaauuggucaaaga

SEQ ID NO: 136392 - RNA, 19 nt, Homo sapiens
gaaugaagucuaccaucuu

SEQ ID NO: 136393 - RNA, 19 nt, Homo sapiens
gcagaaauggaugauauga

SEQ ID NO: 136394 - RNA, 19 nt, Homo sapiens
caaagcggaugcucugaug

SEQ ID NO: 136395 - RNA, 19 nt, Homo sapiens
gaagaugcaggcccaaaug

SEQ ID NO: 136396 - RNA, 19 nt, Homo sapiens
gggaucaguugaaggaaga

SEQ ID NO: 136397 - RNA, 19 nt, Homo sapiens
ggguuugacuucacgcuaa

SEQ ID NO: 136398 - RNA, 19 nt, Homo sapiens
caacaucaucccagucauu

SEQ ID NO: 136399 - RNA, 19 nt, Homo sapiens
ggaaauccacccucaucaa

SEQ ID NO: 136400 - RNA, 19 nt, Homo sapiens
gaaugugacucugaugaag

SEQ ID NO: 136401 - RNA, 19 nt, Homo sapiens
ugcaagagaugcuggagaa

SEQ ID NO: 136402 - RNA, 19 nt, Homo sapiens
cacagacccuggccauuga

SEQ ID NO: 136403 - RNA, 19 nt, Homo sapiens
ggagucaggccuagggaaa

SEQ ID NO: 136404 - RNA, 19 nt, Homo sapiens
uaacaaagggagccacuuc

SEQ ID NO: 136405 - RNA, 19 nt, Homo sapiens
gaucgagccagccgcagua

SEQ ID NO: 136406 - RNA, 19 nt, Homo sapiens
gaggcaggaugcagagaug

SEQ ID NO: 136407 - RNA, 19 nt, Homo sapiens
gaaauccacccucaucaac

SEQ ID NO: 136408 - RNA, 19 nt, Homo sapiens
ccgcaagucugucaagaag

SEQ ID NO: 136409 - RNA, 19 nt, Homo sapiens
gacggcaggugcagugaug

SEQ ID NO: 136410 - RNA, 19 nt, Homo sapiens
caagagaugcuggagaaga

SEQ ID NO: 136411 - RNA, 19 nt, Homo sapiens
ugacucugaugaagaugaa

SEQ ID NO: 136412 - RNA, 19 nt, Homo sapiens
ggccagugcucgcuugaca

SEQ ID NO: 136413 - RNA, 19 nt, Homo sapiens
ucacugcgauuuccugaac

SEQ ID NO: 136414 - RNA, 19 nt, Homo sapiens
caauuugagcaguaccuua

SEQ ID NO: 136415 - RNA, 19 nt, Homo sapiens
aagagaugcuggagaagau

SEQ ID NO: 136416 - RNA, 19 nt, Homo sapiens
gcaaagcggaugcucugau

SEQ ID NO: 136417 - RNA, 19 nt, Homo sapiens
acacagacccuggccauug

SEQ ID NO: 136418 - RNA, 19 nt, Homo sapiens
gaagcugauccgcgagaaa

SEQ ID NO: 136419 - RNA, 19 nt, Homo sapiens
cgaaugugacucugaugaa

SEQ ID NO: 136420 - RNA, 19 nt, Homo sapiens
gcaguacacgagaaaguca

SEQ ID NO: 136421 - RNA, 19 nt, Homo sapiens
gcggagucauggacaagga

SEQ ID NO: 136422 - RNA, 19 nt, Homo sapiens
aagugaagcugacccuugu

SEQ ID NO: 136423 - RNA, 19 nt, Homo sapiens
ccacgaugauggagcuaca

SEQ ID NO: 136424 - RNA, 19 nt, Homo sapiens
gagaagaugcaggcccaaa

SEQ ID NO: 136425 - RNA, 19 nt, Homo sapiens
augcagagaugaaggaaag

SEQ ID NO: 136426 - RNA, 19 nt, Homo sapiens
gaaauucaucgaggagcaa

SEQ ID NO: 136427 - RNA, 19 nt, Homo sapiens
ggaagaggagauccacauc

SEQ ID NO: 136428 - RNA, 19 nt, Homo sapiens
cgagaaagucaacaucauc

SEQ ID NO: 136429 - RNA, 19 nt, Homo sapiens
ggcuuccgguggugaaauu

SEQ ID NO: 136430 - RNA, 19 nt, Homo sapiens
gggcguagagauugaggaa

SEQ ID NO: 136431 - RNA, 19 nt, Homo sapiens
ccacaucacugcgauuucc

SEQ ID NO: 136432 - RNA, 19 nt, Homo sapiens
acaaggaguacguggguuu

SEQ ID NO: 136433 - RNA, 19 nt, Homo sapiens
ccagagcgccacagagauc

SEQ ID NO: 136434 - RNA, 19 nt, Homo sapiens
cccaggcccucaagcagaa

SEQ ID NO: 136435 - RNA, 19 nt, Homo sapiens
ccacugcugccucuacuuc

SEQ ID NO: 136436 - RNA, 19 nt, Homo sapiens
ggccugaaccggaagaaca

SEQ ID NO: 136437 - RNA, 19 nt, Homo sapiens
ggaugagaguggccugaac

SEQ ID NO: 136438 - RNA, 19 nt, Homo sapiens
agcaguaccuuagggauga

SEQ ID NO: 136439 - RNA, 19 nt, Homo sapiens
ggagcaauuugagcaguac

SEQ ID NO: 136440 - RNA, 19 nt, Homo sapiens
aggagcaauuugagcagua

SEQ ID NO: 136441 - RNA, 19 nt, Homo sapiens
gggaaauccacccucauca

SEQ ID NO: 136442 - RNA, 19 nt, Homo sapiens
gguuugacuucacgcuaau

SEQ ID NO: 136443 - RNA, 19 nt, Homo sapiens
cgcacgaucugcucuacga

SEQ ID NO: 136444 - RNA, 19 nt, Homo sapiens
gacucugucuucaauaaaa

SEQ ID NO: 136445 - RNA, 19 nt, Homo sapiens
ccaugucucaccacgauga

SEQ ID NO: 136446 - RNA, 19 nt, Homo sapiens
gccagccgcaguaagcuuu

SEQ ID NO: 136447 - RNA, 19 nt, Homo sapiens
ggaugcuggugcagacaca

SEQ ID NO: 136448 - RNA, 19 nt, Homo sapiens
ccgaaugugacucugauga

SEQ ID NO: 136449 - RNA, 19 nt, Homo sapiens
gggcaguacacgagaaagu

SEQ ID NO: 136450 - RNA, 19 nt, Homo sapiens
agugcucgcuugacacaga

SEQ ID NO: 136451 - RNA, 19 nt, Homo sapiens
ggagcuacagugggacuug

SEQ ID NO: 136452 - RNA, 19 nt, Homo sapiens
ggaauccagaugugugaag

SEQ ID NO: 136453 - RNA, 19 nt, Homo sapiens
gauccacaucuaccaguuc

SEQ ID NO: 136454 - RNA, 19 nt, Homo sapiens
ggaaacccaggcccucaag

SEQ ID NO: 136455 - RNA, 19 nt, Homo sapiens
acgagaaagucaacaucau

SEQ ID NO: 136456 - RNA, 19 nt, Homo sapiens
gcaauuugagcaguaccuu

SEQ ID NO: 136457 - RNA, 19 nt, Homo sapiens
ggaccguggagguggagaa

SEQ ID NO: 136458 - RNA, 19 nt, Homo sapiens
gucaacaucaucccaguca

SEQ ID NO: 136459 - RNA, 19 nt, Homo sapiens
ucaucgaggagcaauuuga

SEQ ID NO: 136460 - RNA, 19 nt, Homo sapiens
gauccgcgagaaagacgaa

SEQ ID NO: 136461 - RNA, 19 nt, Homo sapiens
gcagagaugaaggaaagca

SEQ ID NO: 136462 - RNA, 19 nt, Homo sapiens
ggcaggaugcagagaugaa

SEQ ID NO: 136463 - RNA, 19 nt, Homo sapiens
cacgagaaagucaacauca

SEQ ID NO: 136464 - RNA, 19 nt, Homo sapiens
caccgcaagucugucaaga

SEQ ID NO: 136465 - RNA, 19 nt, Homo sapiens
ggacagaggugcaacauuu

SEQ ID NO: 136466 - RNA, 19 nt, Homo sapiens
guaaagugcuucugauauu

SEQ ID NO: 136467 - RNA, 19 nt, Homo sapiens
gguaacacaucccuaauuu

SEQ ID NO: 136468 - RNA, 19 nt, Homo sapiens
gcaguaaacuaauaacaga

SEQ ID NO: 136469 - RNA, 19 nt, Homo sapiens
ggucauuuguguuagauua

SEQ ID NO: 136470 - RNA, 19 nt, Homo sapiens
acagauaccucaauucuag

SEQ ID NO: 136471 - RNA, 19 nt, Homo sapiens
ccaguucccuguugaagaa

SEQ ID NO: 136472 - RNA, 19 nt, Homo sapiens
gaggagaguacucacuuua

SEQ ID NO: 136473 - RNA, 19 nt, Homo sapiens
ugcagaagcucauuuguga

SEQ ID NO: 136474 - RNA, 19 nt, Homo sapiens
gaagaggagggauuagaaa

SEQ ID NO: 136475 - RNA, 19 nt, Homo sapiens
gaacuacaacccagaggaa

SEQ ID NO: 136476 - RNA, 19 nt, Homo sapiens
ggaagaggagggauuagaa

SEQ ID NO: 136477 - RNA, 19 nt, Homo sapiens
ggacagauaccucaauucu

SEQ ID NO: 136478 - RNA, 19 nt, Homo sapiens
guuauaagaugcaguaaac

SEQ ID NO: 136479 - RNA, 19 nt, Homo sapiens
gauauuguuuccagacaga

SEQ ID NO: 136480 - RNA, 19 nt, Homo sapiens
gagggcuucucaaggcuua

SEQ ID NO: 136481 - RNA, 19 nt, Homo sapiens
gaaaucaccagaaccuuca

SEQ ID NO: 136482 - RNA, 19 nt, Homo sapiens
gucccuagcugaaucacua

SEQ ID NO: 136483 - RNA, 19 nt, Homo sapiens
uaaagugcuucugauauug

SEQ ID NO: 136484 - RNA, 19 nt, Homo sapiens
gaagagaugaggaguugga

SEQ ID NO: 136485 - RNA, 19 nt, Homo sapiens
gaacaacauggacaucaga

SEQ ID NO: 136486 - RNA, 19 nt, Homo sapiens
uaccugaccuucauuuaug

SEQ ID NO: 136487 - RNA, 19 nt, Homo sapiens
ccacagcacccaaucaaga

SEQ ID NO: 136488 - RNA, 19 nt, Homo sapiens
caacauggacaucagaaau

SEQ ID NO: 136489 - RNA, 19 nt, Homo sapiens
ggccacuggugcugaauuu

SEQ ID NO: 136490 - RNA, 19 nt, Homo sapiens
gagaugaggaguuggaaga

SEQ ID NO: 136491 - RNA, 19 nt, Homo sapiens
ggagguggcugugcaugug

SEQ ID NO: 136492 - RNA, 19 nt, Homo sapiens
ugaagaagcacaugcauca

SEQ ID NO: 136493 - RNA, 19 nt, Homo sapiens
ucaacagagucaucuagaa

SEQ ID NO: 136494 - RNA, 19 nt, Homo sapiens
ugacacugcucccacuuug

SEQ ID NO: 136495 - RNA, 19 nt, Homo sapiens
gaaaguagagccugacacu

SEQ ID NO: 136496 - RNA, 19 nt, Homo sapiens
gggaguuuaugcaagguaa

SEQ ID NO: 136497 - RNA, 19 nt, Homo sapiens
gguaaagugcuucugauau

SEQ ID NO: 136498 - RNA, 19 nt, Homo sapiens
cagaagcucauuugugaaa

SEQ ID NO: 136499 - RNA, 19 nt, Homo sapiens
gcuggcauuccuucuauua

SEQ ID NO: 136500 - RNA, 19 nt, Homo sapiens
ccacucugauaccaaguaa

SEQ ID NO: 136501 - RNA, 19 nt, Homo sapiens
caucagaaaucaccagaac

SEQ ID NO: 136502 - RNA, 19 nt, Homo sapiens
ugaagacuuuaguuccaua

SEQ ID NO: 136503 - RNA, 19 nt, Homo sapiens
guaccugaccuucauuuau

SEQ ID NO: 136504 - RNA, 19 nt, Homo sapiens
acacggcugugacuugauu

SEQ ID NO: 136505 - RNA, 19 nt, Homo sapiens
guacucacuuuaccaucuu

SEQ ID NO: 136506 - RNA, 19 nt, Homo sapiens
ggauagccauugguauuca

SEQ ID NO: 136507 - RNA, 19 nt, Homo sapiens
gcacacggucuuugagaga

SEQ ID NO: 136508 - RNA, 19 nt, Homo sapiens
gcaggcagcccaucuacug

SEQ ID NO: 136509 - RNA, 19 nt, Homo sapiens
ucagauggcugggcuuuua

SEQ ID NO: 136510 - RNA, 19 nt, Homo sapiens
caggcacacuucugaggua

SEQ ID NO: 136511 - RNA, 19 nt, Homo sapiens
ccauugguauucaucuauu

SEQ ID NO: 136512 - RNA, 19 nt, Homo sapiens
caacagagucaucuagaag

SEQ ID NO: 136513 - RNA, 19 nt, Homo sapiens
ccaauuugcauuuauggaa

SEQ ID NO: 136514 - RNA, 19 nt, Homo sapiens
ggguaaagugcuucugaua

SEQ ID NO: 136515 - RNA, 19 nt, Homo sapiens
aggaagagaugaggaguug

SEQ ID NO: 136516 - RNA, 19 nt, Homo sapiens
gaagaauuccaguuguuag

SEQ ID NO: 136517 - RNA, 19 nt, Homo sapiens
ugggugaguuuccauggua

SEQ ID NO: 136518 - RNA, 19 nt, Homo sapiens
gaccuucauuuauguucaa

SEQ ID NO: 136519 - RNA, 19 nt, Homo sapiens
gaaaaugaagcaacacuug

SEQ ID NO: 136520 - RNA, 19 nt, Homo sapiens
gugcaacauuugggaguuu

SEQ ID NO: 136521 - RNA, 19 nt, Homo sapiens
caugguaacacaucccuaa

SEQ ID NO: 136522 - RNA, 19 nt, Homo sapiens
ggucguggguaaagugcuu

SEQ ID NO: 136523 - RNA, 19 nt, Homo sapiens
ggaaguucgugcuguucug

SEQ ID NO: 136524 - RNA, 19 nt, Homo sapiens
guaaaucuggcccuuggaa

SEQ ID NO: 136525 - RNA, 19 nt, Homo sapiens
uuaguuccauagcagauuu

SEQ ID NO: 136526 - RNA, 19 nt, Homo sapiens
gaguuuaugcaagguaaua

SEQ ID NO: 136527 - RNA, 19 nt, Homo sapiens
agaggagaguacucacuuu

SEQ ID NO: 136528 - RNA, 19 nt, Homo sapiens
gaaccaauuaugggaagaa

SEQ ID NO: 136529 - RNA, 19 nt, Homo sapiens
caagcuggcauuccuucua

SEQ ID NO: 136530 - RNA, 19 nt, Homo sapiens
cacgacaacuggauaccaa

SEQ ID NO: 136531 - RNA, 19 nt, Homo sapiens
agacggguaugaccaggaa

SEQ ID NO: 136532 - RNA, 19 nt, Homo sapiens
gaggcuuauugaagacuuu

SEQ ID NO: 136533 - RNA, 19 nt, Homo sapiens
ugaccaaaccaaacaauag

SEQ ID NO: 136534 - RNA, 19 nt, Homo sapiens
auuuaaaccuguccacauu

SEQ ID NO: 136535 - RNA, 19 nt, Homo sapiens
gacagauaccucaauucua

SEQ ID NO: 136536 - RNA, 19 nt, Homo sapiens
gaaaagcuccacaguuaau

SEQ ID NO: 136537 - RNA, 19 nt, Homo sapiens
ccagggcuguggcugaaga

SEQ ID NO: 136538 - RNA, 19 nt, Homo sapiens
gucauucaguuaugcagaa

SEQ ID NO: 136539 - RNA, 19 nt, Homo sapiens
gaggagggauuagaaacag

SEQ ID NO: 136540 - RNA, 19 nt, Homo sapiens
aagcuggcauuccuucuau

SEQ ID NO: 136541 - RNA, 19 nt, Homo sapiens
uaugauggccacagccuaa

SEQ ID NO: 136542 - RNA, 19 nt, Homo sapiens
gaguuuccaugguaacaca

SEQ ID NO: 136543 - RNA, 19 nt, Homo sapiens
agaggaaguucgugcuguu

SEQ ID NO: 136544 - RNA, 19 nt, Homo sapiens
gaccaguucaagaggcuua

SEQ ID NO: 136545 - RNA, 19 nt, Homo sapiens
gacuagaggacacgacuga

SEQ ID NO: 136546 - RNA, 19 nt, Homo sapiens
ucuguacccugaaaucuuc

SEQ ID NO: 136547 - RNA, 19 nt, Homo sapiens
ggagaguacucacuuuacc

SEQ ID NO: 136548 - RNA, 19 nt, Homo sapiens
acucugauaccaaguaauu

SEQ ID NO: 136549 - RNA, 19 nt, Homo sapiens
caacuggauaccaaccuuu

SEQ ID NO: 136550 - RNA, 19 nt, Homo sapiens
ucgcaagucucuuaauggu

SEQ ID NO: 136551 - RNA, 19 nt, Homo sapiens
cuucgcaagucucuuaaug

SEQ ID NO: 136552 - RNA, 19 nt, Homo sapiens
aagcauaaccuugaccaaa

SEQ ID NO: 136553 - RNA, 19 nt, Homo sapiens
guuggaagaggagggauua

SEQ ID NO: 136554 - RNA, 19 nt, Homo sapiens
agaagcacaugcaucagau

SEQ ID NO: 136555 - RNA, 19 nt, Homo sapiens
acaauaggcaccagcaaug

SEQ ID NO: 136556 - RNA, 19 nt, Homo sapiens
ccacuagccucacuuuuca

SEQ ID NO: 136557 - RNA, 19 nt, Homo sapiens
cuggacagauaccucaauu

SEQ ID NO: 136558 - RNA, 19 nt, Homo sapiens
ggccacagccuaaaguaca

SEQ ID NO: 136559 - RNA, 19 nt, Homo sapiens
agaaaucuagcucucugua

SEQ ID NO: 136560 - RNA, 19 nt, Homo sapiens
gggaagaggagaguacuca

SEQ ID NO: 136561 - RNA, 19 nt, Homo sapiens
gggugaguuuccaugguaa

SEQ ID NO: 136562 - RNA, 19 nt, Homo sapiens
gaugaugggugaguuucca

SEQ ID NO: 136563 - RNA, 19 nt, Homo sapiens
gauuuaaaccuguccacau

SEQ ID NO: 136564 - RNA, 19 nt, Homo sapiens
gcauuuauggaauugauca

SEQ ID NO: 136565 - RNA, 19 nt, Homo sapiens
ccagugaucuguucaguua

SEQ ID NO: 136566 - RNA, 19 nt, Homo sapiens
ggaggaagauguucaauag

SEQ ID NO: 136567 - RNA, 19 nt, Homo sapiens
ucacagaguuucacccuua

SEQ ID NO: 136568 - RNA, 19 nt, Homo sapiens
cauaucaccucucuucuua

SEQ ID NO: 136569 - RNA, 19 nt, Homo sapiens
ggaagaacaugaaucucua

SEQ ID NO: 136570 - RNA, 19 nt, Homo sapiens
gaacugcuuugggagauua

SEQ ID NO: 136571 - RNA, 19 nt, Homo sapiens
ggaugaaucuggacauuug

SEQ ID NO: 136572 - RNA, 19 nt, Homo sapiens
gcaaggaaauuaagaacug

SEQ ID NO: 136573 - RNA, 19 nt, Homo sapiens
gaugauaacuacugacgaa

SEQ ID NO: 136574 - RNA, 19 nt, Homo sapiens
caagaagaauugacugauu

SEQ ID NO: 136575 - RNA, 19 nt, Homo sapiens
gcacaguaauguagaaaug

SEQ ID NO: 136576 - RNA, 19 nt, Homo sapiens
gcaagaaccaaacguauuu

SEQ ID NO: 136577 - RNA, 19 nt, Homo sapiens
gaaaugaaauugacaagcu

SEQ ID NO: 136578 - RNA, 19 nt, Homo sapiens
gaagaaggagcucaacuaa

SEQ ID NO: 136579 - RNA, 19 nt, Homo sapiens
caaacccacucuucauaua

SEQ ID NO: 136580 - RNA, 19 nt, Homo sapiens
gagaagaauuucagcaaga

SEQ ID NO: 136581 - RNA, 19 nt, Homo sapiens
gaauuuccauugacauuug

SEQ ID NO: 136582 - RNA, 19 nt, Homo sapiens
aagaauaggugcaaacaaa

SEQ ID NO: 136583 - RNA, 19 nt, Homo sapiens
gcauugggcugaguaagua

SEQ ID NO: 136584 - RNA, 19 nt, Homo sapiens
gaacaugaaucucuaacag

SEQ ID NO: 136585 - RNA, 19 nt, Homo sapiens
ggacuucucuuuaugucaa

SEQ ID NO: 136586 - RNA, 19 nt, Homo sapiens
gaagaggaaguuagagaua

SEQ ID NO: 136587 - RNA, 19 nt, Homo sapiens
caaaguaggugagcuauag

SEQ ID NO: 136588 - RNA, 19 nt, Homo sapiens
guacauacacacauacaua

SEQ ID NO: 136589 - RNA, 19 nt, Homo sapiens
gaaagaaacaggcuacguu

SEQ ID NO: 136590 - RNA, 19 nt, Homo sapiens
gcaaacaugugcagauauc

SEQ ID NO: 136591 - RNA, 19 nt, Homo sapiens
gaaaagacuuaccugaaua

SEQ ID NO: 136592 - RNA, 19 nt, Homo sapiens
ggacaaagcucaggaaucc

SEQ ID NO: 136593 - RNA, 19 nt, Homo sapiens
guaacaguaugucagauaa

SEQ ID NO: 136594 - RNA, 19 nt, Homo sapiens
caaacaagcuuacuuccau

SEQ ID NO: 136595 - RNA, 19 nt, Homo sapiens
gauaacuacugacgaaaga

SEQ ID NO: 136596 - RNA, 19 nt, Homo sapiens
ggagaugcccgcacaguaa

SEQ ID NO: 136597 - RNA, 19 nt, Homo sapiens
ggaaaaggaugauggaaaa

SEQ ID NO: 136598 - RNA, 19 nt, Homo sapiens
gagauuaucaguagaaaga

SEQ ID NO: 136599 - RNA, 19 nt, Homo sapiens
gccaacagguaaacacaua

SEQ ID NO: 136600 - RNA, 19 nt, Homo sapiens
gguuagaccuuauguuaga

SEQ ID NO: 136601 - RNA, 19 nt, Homo sapiens
ucaccucucuucuuaguaa

SEQ ID NO: 136602 - RNA, 19 nt, Homo sapiens
uuacaggacuucucuuuau

SEQ ID NO: 136603 - RNA, 19 nt, Homo sapiens
agaaggaggucguuuaugu

SEQ ID NO: 136604 - RNA, 19 nt, Homo sapiens
caaccacuuucguaucaua

SEQ ID NO: 136605 - RNA, 19 nt, Homo sapiens
gaaagaggaggcagaaaga

SEQ ID NO: 136606 - RNA, 19 nt, Homo sapiens
ggacaauaacgccaacaua

SEQ ID NO: 136607 - RNA, 19 nt, Homo sapiens
gaucauaugaccauugaaa

SEQ ID NO: 136608 - RNA, 19 nt, Homo sapiens
caacauaucagucguguca

SEQ ID NO: 136609 - RNA, 19 nt, Homo sapiens
caugauaccuauuaaagga

SEQ ID NO: 136610 - RNA, 19 nt, Homo sapiens
ggcauuggcuggagaagaa

SEQ ID NO: 136611 - RNA, 19 nt, Homo sapiens
guuaagcccuguaauuaug

SEQ ID NO: 136612 - RNA, 19 nt, Homo sapiens
gcugguauauuguguaaau

SEQ ID NO: 136613 - RNA, 19 nt, Homo sapiens
gagagugggucacauuugu

SEQ ID NO: 136614 - RNA, 19 nt, Homo sapiens
acauggagcuaucgguuua

SEQ ID NO: 136615 - RNA, 19 nt, Homo sapiens
ggguuaagcccuguaauua

SEQ ID NO: 136616 - RNA, 19 nt, Homo sapiens
ggaaggaaacauagaaaga

SEQ ID NO: 136617 - RNA, 19 nt, Homo sapiens
caacaucagcuuucuaaug

SEQ ID NO: 136618 - RNA, 19 nt, Homo sapiens
uagauuagcugguuaaagg

SEQ ID NO: 136619 - RNA, 19 nt, Homo sapiens
cauaugugcuucucaguug

SEQ ID NO: 136620 - RNA, 19 nt, Homo sapiens
uagcacgucuccuugauuu

SEQ ID NO: 136621 - RNA, 19 nt, Homo sapiens
guuguuaacuucuacauuc

SEQ ID NO: 136622 - RNA, 19 nt, Homo sapiens
ucagauuccucaguuguua

SEQ ID NO: 136623 - RNA, 19 nt, Homo sapiens
gauuauagcucccaaaaga

SEQ ID NO: 136624 - RNA, 19 nt, Homo sapiens
gcauagagaauacacauau

SEQ ID NO: 136625 - RNA, 19 nt, Homo sapiens
gagcauagagacaaugaaa

SEQ ID NO: 136626 - RNA, 19 nt, Homo sapiens
cuagugggaucaacaauga

SEQ ID NO: 136627 - RNA, 19 nt, Homo sapiens
uagcugagguuuaguaauc

SEQ ID NO: 136628 - RNA, 19 nt, Homo sapiens
augcugagcugaagaaauu

SEQ ID NO: 136629 - RNA, 19 nt, Homo sapiens
gcaguguucucucugaaug

SEQ ID NO: 136630 - RNA, 19 nt, Homo sapiens
agaaggagcucaacuaaaa

SEQ ID NO: 136631 - RNA, 19 nt, Homo sapiens
ucuaacagcuccauacuuc

SEQ ID NO: 136632 - RNA, 19 nt, Homo sapiens
ucucauaggugcuuggaaa

SEQ ID NO: 136633 - RNA, 19 nt, Homo sapiens
gaguuuaucuaucggaaga

SEQ ID NO: 136634 - RNA, 19 nt, Homo sapiens
gaauccauauuucaacaga

SEQ ID NO: 136635 - RNA, 19 nt, Homo sapiens
uaagagcccuggguaaaug

SEQ ID NO: 136636 - RNA, 19 nt, Homo sapiens
cagcagauguuuaaugaag

SEQ ID NO: 136637 - RNA, 19 nt, Homo sapiens
aagcaaacaugugcagaua

SEQ ID NO: 136638 - RNA, 19 nt, Homo sapiens
cauauaugcuuccagaaug

SEQ ID NO: 136639 - RNA, 19 nt, Homo sapiens
ucacuuaacuuacaugacu

SEQ ID NO: 136640 - RNA, 19 nt, Homo sapiens
cugauaugcugagaaauua

SEQ ID NO: 136641 - RNA, 19 nt, Homo sapiens
ggaagcuacugucuacguu

SEQ ID NO: 136642 - RNA, 19 nt, Homo sapiens
gacagucacuuaacuuaca

SEQ ID NO: 136643 - RNA, 19 nt, Homo sapiens
aggaagauguucaauagaa

SEQ ID NO: 136644 - RNA, 19 nt, Homo sapiens
gaaauugacaagcuaggaa

SEQ ID NO: 136645 - RNA, 19 nt, Homo sapiens
aaacuagauuagcugguua

SEQ ID NO: 136646 - RNA, 19 nt, Homo sapiens
aaacaagacugcucaugca

SEQ ID NO: 136647 - RNA, 19 nt, Homo sapiens
ugggagagcuagaaaguug

SEQ ID NO: 136648 - RNA, 19 nt, Homo sapiens
auacguacauacacacaua

SEQ ID NO: 136649 - RNA, 19 nt, Homo sapiens
agaaggaacugauacaucu

SEQ ID NO: 136650 - RNA, 19 nt, Homo sapiens
gcugaaggcugcugcaagu

SEQ ID NO: 136651 - RNA, 19 nt, Homo sapiens
ccauguaugugguauguau

SEQ ID NO: 136652 - RNA, 19 nt, Homo sapiens
ggaaagaggaggcagaaag

SEQ ID NO: 136653 - RNA, 19 nt, Homo sapiens
cauaggugcuuggaaauga

SEQ ID NO: 136654 - RNA, 19 nt, Homo sapiens
uaacuguuccuacuuugua

SEQ ID NO: 136655 - RNA, 19 nt, Homo sapiens
cagcugguauauuguguaa

SEQ ID NO: 136656 - RNA, 19 nt, Homo sapiens
gaagcuacugucuacguua

SEQ ID NO: 136657 - RNA, 19 nt, Homo sapiens
gaaaagaucccaagaugga

SEQ ID NO: 136658 - RNA, 19 nt, Homo sapiens
gaagaacaugaaucucuaa

SEQ ID NO: 136659 - RNA, 19 nt, Homo sapiens
gcuaagagcccuggguaaa

SEQ ID NO: 136660 - RNA, 19 nt, Homo sapiens
gggaggaagauguucaaua

SEQ ID NO: 136661 - RNA, 19 nt, Homo sapiens
agaaagacaugggcuauca

SEQ ID NO: 136662 - RNA, 19 nt, Homo sapiens
cuaguugucugaaaugaga

SEQ ID NO: 136663 - RNA, 19 nt, Homo sapiens
ccacuuucguaucauaauu

SEQ ID NO: 136664 - RNA, 19 nt, Homo sapiens
agaaagagaagcacagaaa

SEQ ID NO: 136665 - RNA, 19 nt, Homo sapiens
ccagugaucuguucaguua

SEQ ID NO: 136666 - RNA, 19 nt, Homo sapiens
ggaggaagauguucaauag

SEQ ID NO: 136667 - RNA, 19 nt, Homo sapiens
ucacagaguuucacccuua

SEQ ID NO: 136668 - RNA, 19 nt, Homo sapiens
cauaucaccucucuucuua

SEQ ID NO: 136669 - RNA, 19 nt, Homo sapiens
ggaagaacaugaaucucua

SEQ ID NO: 136670 - RNA, 19 nt, Homo sapiens
gaacugcuuugggagauua

SEQ ID NO: 136671 - RNA, 19 nt, Homo sapiens
ggaugaaucuggacauuug

SEQ ID NO: 136672 - RNA, 19 nt, Homo sapiens
gcaaggaaauuaagaacug

SEQ ID NO: 136673 - RNA, 19 nt, Homo sapiens
gaugauaacuacugacgaa

SEQ ID NO: 136674 - RNA, 19 nt, Homo sapiens
caagaagaauugacugauu

SEQ ID NO: 136675 - RNA, 19 nt, Homo sapiens
gcacaguaauguagaaaug

SEQ ID NO: 136676 - RNA, 19 nt, Homo sapiens
gcaagaaccaaacguauuu

SEQ ID NO: 136677 - RNA, 19 nt, Homo sapiens
gaaaugaaauugacaagcu

SEQ ID NO: 136678 - RNA, 19 nt, Homo sapiens
gaagaaggagcucaacuaa

SEQ ID NO: 136679 - RNA, 19 nt, Homo sapiens
caaacccacucuucauaua

SEQ ID NO: 136680 - RNA, 19 nt, Homo sapiens
gagaagaauuucagcaaga

SEQ ID NO: 136681 - RNA, 19 nt, Homo sapiens
gaauuuccauugacauuug

SEQ ID NO: 136682 - RNA, 19 nt, Homo sapiens
aagaauaggugcaaacaaa

SEQ ID NO: 136683 - RNA, 19 nt, Homo sapiens
gcauugggcugaguaagua

SEQ ID NO: 136684 - RNA, 19 nt, Homo sapiens
gaacaugaaucucuaacag

SEQ ID NO: 136685 - RNA, 19 nt, Homo sapiens
ggacuucucuuuaugucaa

SEQ ID NO: 136686 - RNA, 19 nt, Homo sapiens
gaagaggaaguuagagaua

SEQ ID NO: 136687 - RNA, 19 nt, Homo sapiens
caaaguaggugagcuauag

SEQ ID NO: 136688 - RNA, 19 nt, Homo sapiens
guacauacacacauacaua

SEQ ID NO: 136689 - RNA, 19 nt, Homo sapiens
gaaagaaacaggcuacguu

SEQ ID NO: 136690 - RNA, 19 nt, Homo sapiens
gcaaacaugugcagauauc

SEQ ID NO: 136691 - RNA, 19 nt, Homo sapiens
gaaaagacuuaccugaaua

SEQ ID NO: 136692 - RNA, 19 nt, Homo sapiens
ggacaaagcucaggaaucc

SEQ ID NO: 136693 - RNA, 19 nt, Homo sapiens
guaacaguaugucagauaa

SEQ ID NO: 136694 - RNA, 19 nt, Homo sapiens
caaacaagcuuacuuccau

SEQ ID NO: 136695 - RNA, 19 nt, Homo sapiens
gauaacuacugacgaaaga

SEQ ID NO: 136696 - RNA, 19 nt, Homo sapiens
ggagaugcccgcacaguaa

SEQ ID NO: 136697 - RNA, 19 nt, Homo sapiens
ggaaaaggaugauggaaaa

SEQ ID NO: 136698 - RNA, 19 nt, Homo sapiens
gagauuaucaguagaaaga

SEQ ID NO: 136699 - RNA, 19 nt, Homo sapiens
gccaacagguaaacacaua

SEQ ID NO: 136700 - RNA, 19 nt, Homo sapiens
gguuagaccuuauguuaga

SEQ ID NO: 136701 - RNA, 19 nt, Homo sapiens
ucaccucucuucuuaguaa

SEQ ID NO: 136702 - RNA, 19 nt, Homo sapiens
ugacagagguaacuggauu

SEQ ID NO: 136703 - RNA, 19 nt, Homo sapiens
uuacaggacuucucuuuau

SEQ ID NO: 136704 - RNA, 19 nt, Homo sapiens
agaaggaggucguuuaugu

SEQ ID NO: 136705 - RNA, 19 nt, Homo sapiens
caaccacuuucguaucaua

SEQ ID NO: 136706 - RNA, 19 nt, Homo sapiens
gaaagaggaggcagaaaga

SEQ ID NO: 136707 - RNA, 19 nt, Homo sapiens
ggacaauaacgccaacaua

SEQ ID NO: 136708 - RNA, 19 nt, Homo sapiens
gaucauaugaccauugaaa

SEQ ID NO: 136709 - RNA, 19 nt, Homo sapiens
caacauaucagucguguca

SEQ ID NO: 136710 - RNA, 19 nt, Homo sapiens
caugauaccuauuaaagga

SEQ ID NO: 136711 - RNA, 19 nt, Homo sapiens
ggcauuggcuggagaagaa

SEQ ID NO: 136712 - RNA, 19 nt, Homo sapiens
guuaagcccuguaauuaug

SEQ ID NO: 136713 - RNA, 19 nt, Homo sapiens
gcugguauauuguguaaau

SEQ ID NO: 136714 - RNA, 19 nt, Homo sapiens
gagagugggucacauuugu

SEQ ID NO: 136715 - RNA, 19 nt, Homo sapiens
acauggagcuaucgguuua

SEQ ID NO: 136716 - RNA, 19 nt, Homo sapiens
ggguuaagcccuguaauua

SEQ ID NO: 136717 - RNA, 19 nt, Homo sapiens
ggaaggaaacauagaaaga

SEQ ID NO: 136718 - RNA, 19 nt, Homo sapiens
caacaucagcuuucuaaug

SEQ ID NO: 136719 - RNA, 19 nt, Homo sapiens
uagauuagcugguuaaagg

SEQ ID NO: 136720 - RNA, 19 nt, Homo sapiens
cauaugugcuucucaguug

SEQ ID NO: 136721 - RNA, 19 nt, Homo sapiens
uagcacgucuccuugauuu

SEQ ID NO: 136722 - RNA, 19 nt, Homo sapiens
guuguuaacuucuacauuc

SEQ ID NO: 136723 - RNA, 19 nt, Homo sapiens
ucagauuccucaguuguua

SEQ ID NO: 136724 - RNA, 19 nt, Homo sapiens
gauuauagcucccaaaaga

SEQ ID NO: 136725 - RNA, 19 nt, Homo sapiens
gcauagagaauacacauau

SEQ ID NO: 136726 - RNA, 19 nt, Homo sapiens
gagcauagagacaaugaaa

SEQ ID NO: 136727 - RNA, 19 nt, Homo sapiens
cuagugggaucaacaauga

SEQ ID NO: 136728 - RNA, 19 nt, Homo sapiens
uagcugagguuuaguaauc

SEQ ID NO: 136729 - RNA, 19 nt, Homo sapiens
augcugagcugaagaaauu

SEQ ID NO: 136730 - RNA, 19 nt, Homo sapiens
gcaguguucucucugaaug

SEQ ID NO: 136731 - RNA, 19 nt, Homo sapiens
agaaggagcucaacuaaaa

SEQ ID NO: 136732 - RNA, 19 nt, Homo sapiens
ucuaacagcuccauacuuc

SEQ ID NO: 136733 - RNA, 19 nt, Homo sapiens
ucucauaggugcuuggaaa

SEQ ID NO: 136734 - RNA, 19 nt, Homo sapiens
gaguuuaucuaucggaaga

SEQ ID NO: 136735 - RNA, 19 nt, Homo sapiens
gaauccauauuucaacaga

SEQ ID NO: 136736 - RNA, 19 nt, Homo sapiens
uaagagcccuggguaaaug

SEQ ID NO: 136737 - RNA, 19 nt, Homo sapiens
cagcagauguuuaaugaag

SEQ ID NO: 136738 - RNA, 19 nt, Homo sapiens
aagcaaacaugugcagaua

SEQ ID NO: 136739 - RNA, 19 nt, Homo sapiens
cauauaugcuuccagaaug

SEQ ID NO: 136740 - RNA, 19 nt, Homo sapiens
ucacuuaacuuacaugacu

SEQ ID NO: 136741 - RNA, 19 nt, Homo sapiens
cugauaugcugagaaauua

SEQ ID NO: 136742 - RNA, 19 nt, Homo sapiens
ggaagcuacugucuacguu

SEQ ID NO: 136743 - RNA, 19 nt, Homo sapiens
gacagucacuuaacuuaca

SEQ ID NO: 136744 - RNA, 19 nt, Homo sapiens
aggaagauguucaauagaa

SEQ ID NO: 136745 - RNA, 19 nt, Homo sapiens
gaaauugacaagcuaggaa

SEQ ID NO: 136746 - RNA, 19 nt, Homo sapiens
aaacuagauuagcugguua

SEQ ID NO: 136747 - RNA, 19 nt, Homo sapiens
aaacaagacugcucaugca

SEQ ID NO: 136748 - RNA, 19 nt, Homo sapiens
ugggagagcuagaaaguug

SEQ ID NO: 136749 - RNA, 19 nt, Homo sapiens
auacguacauacacacaua

SEQ ID NO: 136750 - RNA, 19 nt, Homo sapiens
agaaggaacugauacaucu

SEQ ID NO: 136751 - RNA, 19 nt, Homo sapiens
ugaaagaggagacaacuug

SEQ ID NO: 136752 - RNA, 19 nt, Homo sapiens
gcugaaggcugcugcaagu

SEQ ID NO: 136753 - RNA, 19 nt, Homo sapiens
ccauguaugugguauguau

SEQ ID NO: 136754 - RNA, 19 nt, Homo sapiens
ggaaagaggaggcagaaag

SEQ ID NO: 136755 - RNA, 19 nt, Homo sapiens
cauaggugcuuggaaauga

SEQ ID NO: 136756 - RNA, 19 nt, Homo sapiens
uaacuguuccuacuuugua

SEQ ID NO: 136757 - RNA, 19 nt, Homo sapiens
cagcugguauauuguguaa

SEQ ID NO: 136758 - RNA, 19 nt, Homo sapiens
gaagcuacugucuacguua

SEQ ID NO: 136759 - RNA, 19 nt, Homo sapiens
gaaaagaucccaagaugga

SEQ ID NO: 136760 - RNA, 19 nt, Homo sapiens
gaagaacaugaaucucuaa

SEQ ID NO: 136761 - RNA, 19 nt, Homo sapiens
gcuaagagcccuggguaaa

SEQ ID NO: 136762 - RNA, 19 nt, Homo sapiens
gggaggaagauguucaaua

SEQ ID NO: 136763 - RNA, 19 nt, Homo sapiens
agaaagacaugggcuauca

SEQ ID NO: 136764 - RNA, 19 nt, Homo sapiens
agaaagagaagcacagaaa

SEQ ID NO: 136765 - RNA, 19 nt, Homo sapiens
aauaaaggcuugagguaaa

SEQ ID NO: 136766 - RNA, 19 nt, Homo sapiens
ggacucugcuucuguaacu

SEQ ID NO: 136767 - RNA, 19 nt, Homo sapiens
ggaacgcuaugaugagcaa

SEQ ID NO: 136768 - RNA, 19 nt, Homo sapiens
aaguggagcucaacaguga

SEQ ID NO: 136769 - RNA, 19 nt, Homo sapiens
gaugacgaacuaucucuaa

SEQ ID NO: 136770 - RNA, 19 nt, Homo sapiens
uaauaaaggcuugagguaa

SEQ ID NO: 136771 - RNA, 19 nt, Homo sapiens
caagauuucuagggcauug

SEQ ID NO: 136772 - RNA, 19 nt, Homo sapiens
agaggaagauagcuugaga

SEQ ID NO: 136773 - RNA, 19 nt, Homo sapiens
ccucaaagcagcaccuaaa

SEQ ID NO: 136774 - RNA, 19 nt, Homo sapiens
ucucugagcugcgcacuug

SEQ ID NO: 136775 - RNA, 19 nt, Homo sapiens
gacgaacuaucucuaacug

SEQ ID NO: 136776 - RNA, 19 nt, Homo sapiens
guaaacauccaacggacaa

SEQ ID NO: 136777 - RNA, 19 nt, Homo sapiens
gagaggcauuggcgagguu

SEQ ID NO: 136778 - RNA, 19 nt, Homo sapiens
uucuguaacugucucauua

SEQ ID NO: 136779 - RNA, 19 nt, Homo sapiens
gcccgcugguucucaauuu

SEQ ID NO: 136780 - RNA, 19 nt, Homo sapiens
gggaagugaugucguggau

SEQ ID NO: 136781 - RNA, 19 nt, Homo sapiens
acaauugacugaacuuggu

SEQ ID NO: 136782 - RNA, 19 nt, Homo sapiens
ggagggugcucuggguuuc

SEQ ID NO: 136783 - RNA, 19 nt, Homo sapiens
gccagcacauccucgacua

SEQ ID NO: 136784 - RNA, 19 nt, Homo sapiens
gacgucgacuuccucauca

SEQ ID NO: 136785 - RNA, 19 nt, Homo sapiens
gcucuggcuucucgauuuc

SEQ ID NO: 136786 - RNA, 19 nt, Homo sapiens
aauugaagccuccgcuaua

SEQ ID NO: 136787 - RNA, 19 nt, Homo sapiens
gugcugagccaccauuuca

SEQ ID NO: 136788 - RNA, 19 nt, Homo sapiens
gaagccuccgcuauaaauu

SEQ ID NO: 136789 - RNA, 19 nt, Homo sapiens
gguuggaacgcuaugauga

SEQ ID NO: 136790 - RNA, 19 nt, Homo sapiens
ugaagccuccgcuauaaau

SEQ ID NO: 136791 - RNA, 19 nt, Homo sapiens
auaauaaaggcuugaggua

SEQ ID NO: 136792 - RNA, 19 nt, Homo sapiens
ggacaauugacugaacuug

SEQ ID NO: 136793 - RNA, 19 nt, Homo sapiens
auugaagccuccgcuauaa

SEQ ID NO: 136794 - RNA, 19 nt, Homo sapiens
caauugaagccuccgcuau

SEQ ID NO: 136795 - RNA, 19 nt, Homo sapiens
gcuucucgauuucuugugu

SEQ ID NO: 136796 - RNA, 19 nt, Homo sapiens
gaccagaggaagauagcuu

SEQ ID NO: 136797 - RNA, 19 nt, Homo sapiens
ucccgcagcugcacagaga

SEQ ID NO: 136798 - RNA, 19 nt, Homo sapiens
cgacgucgacuuccucauc

SEQ ID NO: 136799 - RNA, 19 nt, Homo sapiens
gggagggugcucuggguuu

SEQ ID NO: 136800 - RNA, 19 nt, Homo sapiens
cugggacucugcuucugua

SEQ ID NO: 136801 - RNA, 19 nt, Homo sapiens
ggacucucccuacaucauc

SEQ ID NO: 136802 - RNA, 19 nt, Homo sapiens
caaagcagcaccuaaaccu

SEQ ID NO: 136803 - RNA, 19 nt, Homo sapiens
cuacuucgagcgucucuau

SEQ ID NO: 136804 - RNA, 19 nt, Homo sapiens
cgaaggccauuuggugagu

SEQ ID NO: 136805 - RNA, 19 nt, Homo sapiens
gggguucccuguugcuuuu

SEQ ID NO: 136806 - RNA, 19 nt, Homo sapiens
caacggacaauugacugaa

SEQ ID NO: 136807 - RNA, 19 nt, Homo sapiens
aaacauccaacggacaauu

SEQ ID NO: 136808 - RNA, 19 nt, Homo sapiens
caucaucuacaucgaggaa

SEQ ID NO: 136809 - RNA, 19 nt, Homo sapiens
ggcuugagguaaacugcaa

SEQ ID NO: 136810 - RNA, 19 nt, Homo sapiens
ucagccacaugaacaaucu

SEQ ID NO: 136811 - RNA, 19 nt, Homo sapiens
gacuuugccucuacagcau

SEQ ID NO: 136812 - RNA, 19 nt, Homo sapiens
ccaacggacaauugacuga

SEQ ID NO: 136813 - RNA, 19 nt, Homo sapiens
gcugcgcacuugguuggaa

SEQ ID NO: 136814 - RNA, 19 nt, Homo sapiens
ccucgugccucgugcucuu

SEQ ID NO: 136815 - RNA, 19 nt, Homo sapiens
cuucgaagcccacgugcaa

SEQ ID NO: 136816 - RNA, 19 nt, Homo sapiens
ugcucuggcuucucgauuu

SEQ ID NO: 136817 - RNA, 19 nt, Homo sapiens
cacggacucucccuacauc

SEQ ID NO: 136818 - RNA, 19 nt, Homo sapiens
ucgacuuccucaucaucua

SEQ ID NO: 136819 - RNA, 19 nt, Homo sapiens
ggccauuuggugaguguuu

SEQ ID NO: 136820 - RNA, 19 nt, Homo sapiens
agccuccgcuauaaauuga

SEQ ID NO: 136821 - RNA, 19 nt, Homo sapiens
cgaaguggagcucaacagu

SEQ ID NO: 136822 - RNA, 19 nt, Homo sapiens
uuaaaugggagggaaguug

SEQ ID NO: 136823 - RNA, 19 nt, Homo sapiens
gaugugcugagccaccauu

SEQ ID NO: 136824 - RNA, 19 nt, Homo sapiens
gagcuaguucugaauugca

SEQ ID NO: 136825 - RNA, 19 nt, Homo sapiens
gaccacgagcuaguucuga

SEQ ID NO: 136826 - RNA, 19 nt, Homo sapiens
gcccucagccaagugcuuu

SEQ ID NO: 136827 - RNA, 19 nt, Homo sapiens
ccaggacuuugccucuaca

SEQ ID NO: 136828 - RNA, 19 nt, Homo sapiens
ugcaagcgccucaaaccaa

SEQ ID NO: 136829 - RNA, 19 nt, Homo sapiens
ccacggacucucccuacau

SEQ ID NO: 136830 - RNA, 19 nt, Homo sapiens
ccagaggaagauagcuuga

SEQ ID NO: 136831 - RNA, 19 nt, Homo sapiens
aagccuccgcuauaaauug

SEQ ID NO: 136832 - RNA, 19 nt, Homo sapiens
gcccaacuccgaggugguu

SEQ ID NO: 136833 - RNA, 19 nt, Homo sapiens
gaagaguucuggcacauuu

SEQ ID NO: 136834 - RNA, 19 nt, Homo sapiens
ggagaagaauguuguaauu

SEQ ID NO: 136835 - RNA, 19 nt, Homo sapiens
gaaagacagugcaguaaau

SEQ ID NO: 136836 - RNA, 19 nt, Homo sapiens
caaggugacugguuguuua

SEQ ID NO: 136837 - RNA, 19 nt, Homo sapiens
guacagugcucaccuaaau

SEQ ID NO: 136838 - RNA, 19 nt, Homo sapiens
uaucaaaccugaauccaaa

SEQ ID NO: 136839 - RNA, 19 nt, Homo sapiens
acaacacgcugaagaauuu

SEQ ID NO: 136840 - RNA, 19 nt, Homo sapiens
ggauauggguggugaaaga

SEQ ID NO: 136841 - RNA, 19 nt, Homo sapiens
cuaaauaagugguagaaga

SEQ ID NO: 136842 - RNA, 19 nt, Homo sapiens
ugaauacgauccugaaaga

SEQ ID NO: 136843 - RNA, 19 nt, Homo sapiens
ggacagguuucauuaaucu

SEQ ID NO: 136844 - RNA, 19 nt, Homo sapiens
gaugaaagaggcagaguuu

SEQ ID NO: 136845 - RNA, 19 nt, Homo sapiens
gaaacuaaagccuuauuga

SEQ ID NO: 136846 - RNA, 19 nt, Homo sapiens
guagaacccuaaauaagug

SEQ ID NO: 136847 - RNA, 19 nt, Homo sapiens
ugacuucucuguuugaguu

SEQ ID NO: 136848 - RNA, 19 nt, Homo sapiens
ucagugaaaugcuguagaa

SEQ ID NO: 136849 - RNA, 19 nt, Homo sapiens
cccaaugacuucucuguuu

SEQ ID NO: 136850 - RNA, 19 nt, Homo sapiens
gcaccuacauucggacauu

SEQ ID NO: 136851 - RNA, 19 nt, Homo sapiens
ggaagucauugccagaaga

SEQ ID NO: 136852 - RNA, 19 nt, Homo sapiens
ggugguugcugaaguggua

SEQ ID NO: 136853 - RNA, 19 nt, Homo sapiens
ccaaugacuucucuguuug

SEQ ID NO: 136854 - RNA, 19 nt, Homo sapiens
aggagaaacuaaagccuua

SEQ ID NO: 136855 - RNA, 19 nt, Homo sapiens
ccaagaagaagaagaagaa

SEQ ID NO: 136856 - RNA, 19 nt, Homo sapiens
gcaccuugguuuguuauug

SEQ ID NO: 136857 - RNA, 19 nt, Homo sapiens
ccucaaagcuuguguacag

SEQ ID NO: 136858 - RNA, 19 nt, Homo sapiens
gcagguaguugccgaagca

SEQ ID NO: 136859 - RNA, 19 nt, Homo sapiens
gaagaaagcaaaagaggua

SEQ ID NO: 136860 - RNA, 19 nt, Homo sapiens
guaaggacaacacacuaua

SEQ ID NO: 136861 - RNA, 19 nt, Homo sapiens
ccacagcggucaucucuac

SEQ ID NO: 136862 - RNA, 19 nt, Homo sapiens
gcucaguggcuguaugaua

SEQ ID NO: 136863 - RNA, 19 nt, Homo sapiens
caggacagguuucauuaau

SEQ ID NO: 136864 - RNA, 19 nt, Homo sapiens
ugaaagaggcagaguuuau

SEQ ID NO: 136865 - RNA, 19 nt, Homo sapiens
gacaaugcaugaugugcuu

SEQ ID NO: 136866 - RNA, 19 nt, Homo sapiens
ccaaagaaacauaagaaga

SEQ ID NO: 136867 - RNA, 19 nt, Homo sapiens
gcuagugguugucuuaaca

SEQ ID NO: 136868 - RNA, 19 nt, Homo sapiens
acuaaagccuuauugagaa

SEQ ID NO: 136869 - RNA, 19 nt, Homo sapiens
gcauggcuauugcauuaau

SEQ ID NO: 136870 - RNA, 19 nt, Homo sapiens
cucaguggcuguaugauaa

SEQ ID NO: 136871 - RNA, 19 nt, Homo sapiens
aaaccugaauccaaaguug

SEQ ID NO: 136872 - RNA, 19 nt, Homo sapiens
gcaggaguauguugacuac

SEQ ID NO: 136873 - RNA, 19 nt, Homo sapiens
ggaagcaggaguauguuga

SEQ ID NO: 136874 - RNA, 19 nt, Homo sapiens
gcacagugguacucuggau

SEQ ID NO: 136875 - RNA, 19 nt, Homo sapiens
gcuguagaacccuaaauaa

SEQ ID NO: 136876 - RNA, 19 nt, Homo sapiens
gaaagaggcagaguuuauc

SEQ ID NO: 136877 - RNA, 19 nt, Homo sapiens
ucucauaaacggcugguua

SEQ ID NO: 136878 - RNA, 19 nt, Homo sapiens
cuaaagccuuauugagaaa

SEQ ID NO: 136879 - RNA, 19 nt, Homo sapiens
agaagaagaagaagaagaa

SEQ ID NO: 136880 - RNA, 19 nt, Homo sapiens
agaagaagaagaagaagaa

SEQ ID NO: 136881 - RNA, 19 nt, Homo sapiens
guucuggagucaugaguga

SEQ ID NO: 136882 - RNA, 19 nt, Homo sapiens
uaacaucguaguccuaguu

SEQ ID NO: 136883 - RNA, 19 nt, Homo sapiens
gcaaaaugauugaauacga

SEQ ID NO: 136884 - RNA, 19 nt, Homo sapiens
gcugagagaguggaacaua

SEQ ID NO: 136885 - RNA, 19 nt, Homo sapiens
aauccaaaguugcuaaguu

SEQ ID NO: 136886 - RNA, 19 nt, Homo sapiens
aaauccaucugacuacuug

SEQ ID NO: 136887 - RNA, 19 nt, Homo sapiens
ccaccaagaagaagaagaa

SEQ ID NO: 136888 - RNA, 19 nt, Homo sapiens
caaaggcaagucagaagaa

SEQ ID NO: 136889 - RNA, 19 nt, Homo sapiens
guaaaugccaucugcuaug

SEQ ID NO: 136890 - RNA, 19 nt, Homo sapiens
ucaagagagugaucaugga

SEQ ID NO: 136891 - RNA, 19 nt, Homo sapiens
ugaaagacagugcaguaaa

SEQ ID NO: 136892 - RNA, 19 nt, Homo sapiens
uaugaaagacagugcagua

SEQ ID NO: 136893 - RNA, 19 nt, Homo sapiens
ucugacaggugccuuauuc

SEQ ID NO: 136894 - RNA, 19 nt, Homo sapiens
cuauacaccucuugcaugu

SEQ ID NO: 136895 - RNA, 19 nt, Homo sapiens
guucauugcugggagaaga

SEQ ID NO: 136896 - RNA, 19 nt, Homo sapiens
gaagucauugccagaagaa

SEQ ID NO: 136897 - RNA, 19 nt, Homo sapiens
gagaaacuaaagccuuauu

SEQ ID NO: 136898 - RNA, 19 nt, Homo sapiens
gaaaagaagaagaguaaga

SEQ ID NO: 136899 - RNA, 19 nt, Homo sapiens
gauaugaggacggcauuga

SEQ ID NO: 136900 - RNA, 19 nt, Homo sapiens
gaguuuaucccaaugacuu

SEQ ID NO: 136901 - RNA, 19 nt, Homo sapiens
gaugcggaaguaauuauuu

SEQ ID NO: 136902 - RNA, 19 nt, Homo sapiens
agaagaagaagaaagcaaa

SEQ ID NO: 136903 - RNA, 19 nt, Homo sapiens
gaagaagaagaagaagaaa

SEQ ID NO: 136904 - RNA, 19 nt, Homo sapiens
gcuccucaguugaucaaga

SEQ ID NO: 136905 - RNA, 19 nt, Homo sapiens
ggaguauguugacuacagu

SEQ ID NO: 136906 - RNA, 19 nt, Homo sapiens
cugcgaccaugguauagua

SEQ ID NO: 136907 - RNA, 19 nt, Homo sapiens
gggaguugguggucagaug

SEQ ID NO: 136908 - RNA, 19 nt, Homo sapiens
ggucaguccuuugcacuuc

SEQ ID NO: 136909 - RNA, 19 nt, Homo sapiens
cgaaauacaacacgcugaa

SEQ ID NO: 136910 - RNA, 19 nt, Homo sapiens
aagaagauguagccgaaau

SEQ ID NO: 136911 - RNA, 19 nt, Homo sapiens
gccuagaggucaguccuuu

SEQ ID NO: 136912 - RNA, 19 nt, Homo sapiens
gcuggugucuggguuauag

SEQ ID NO: 136913 - RNA, 19 nt, Homo sapiens
uugauaagcugaauguaag

SEQ ID NO: 136914 - RNA, 19 nt, Homo sapiens
agaagaagaguaagaagga

SEQ ID NO: 136915 - RNA, 19 nt, Homo sapiens
uccagcagcuccucaguug

SEQ ID NO: 136916 - RNA, 19 nt, Homo sapiens
gcacaccugccaccuggaa

SEQ ID NO: 136917 - RNA, 19 nt, Homo sapiens
gccaagaucaagagaguga

SEQ ID NO: 136918 - RNA, 19 nt, Homo sapiens
ccacaaggaugagaguuac

SEQ ID NO: 136919 - RNA, 19 nt, Homo sapiens
ggugacugguuguuuaauc

SEQ ID NO: 136920 - RNA, 19 nt, Homo sapiens
uaucaggacagguuucauu

SEQ ID NO: 136921 - RNA, 19 nt, Homo sapiens
uagccaagaucaagagagu

SEQ ID NO: 136922 - RNA, 19 nt, Homo sapiens
gcgaguuguuuacccuuug

SEQ ID NO: 136923 - RNA, 19 nt, Homo sapiens
caucccaucuuguccuguu

SEQ ID NO: 136924 - RNA, 19 nt, Homo sapiens
caaaagagguagaauuggu

SEQ ID NO: 136925 - RNA, 19 nt, Homo sapiens
ucauggagagagacacuua

SEQ ID NO: 136926 - RNA, 19 nt, Homo sapiens
cagguguucuucgauauga

SEQ ID NO: 136927 - RNA, 19 nt, Homo sapiens
gcuguugacaucucauaaa

SEQ ID NO: 136928 - RNA, 19 nt, Homo sapiens
caccuacauucggacauua

SEQ ID NO: 136929 - RNA, 19 nt, Homo sapiens
gggagaagaauguuguaau

SEQ ID NO: 136930 - RNA, 19 nt, Homo sapiens
uaaauaagugguagaagag

SEQ ID NO: 136931 - RNA, 19 nt, Homo sapiens
gcagaguuuaucccaauga

SEQ ID NO: 136932 - RNA, 19 nt, Homo sapiens
uauggguggugaaagauga

SEQ ID NO: 136933 - RNA, 19 nt, Homo sapiens
gcacagcgauuaaugcaau

SEQ ID NO: 136934 - RNA, 19 nt, Homo sapiens
gcagauauaucagcauuug

SEQ ID NO: 136935 - RNA, 19 nt, Homo sapiens
ucacacugauucauucuua

SEQ ID NO: 136936 - RNA, 19 nt, Homo sapiens
uaaagccacuguuggauuu

SEQ ID NO: 136937 - RNA, 19 nt, Homo sapiens
gaaguuggcaguagagaaa

SEQ ID NO: 136938 - RNA, 19 nt, Homo sapiens
caaccgaaguaacagauuu

SEQ ID NO: 136939 - RNA, 19 nt, Homo sapiens
agaaggauaucgacucuuu

SEQ ID NO: 136940 - RNA, 19 nt, Homo sapiens
gcaaagaaguuggcaguag

SEQ ID NO: 136941 - RNA, 19 nt, Homo sapiens
caaagaaguuggcaguaga

SEQ ID NO: 136942 - RNA, 19 nt, Homo sapiens
ggauugaucuuacacaagu

SEQ ID NO: 136943 - RNA, 19 nt, Homo sapiens
ggacacaguuauaagacaa

SEQ ID NO: 136944 - RNA, 19 nt, Homo sapiens
ggacucaucacaccuauug

SEQ ID NO: 136945 - RNA, 19 nt, Homo sapiens
gaaagggauugaucuuaca

SEQ ID NO: 136946 - RNA, 19 nt, Homo sapiens
acaggugucuucacagaua

SEQ ID NO: 136947 - RNA, 19 nt, Homo sapiens
gagaaagggauugaucuua

SEQ ID NO: 136948 - RNA, 19 nt, Homo sapiens
auacaaggcucauuucuuc

SEQ ID NO: 136949 - RNA, 19 nt, Homo sapiens
guacggaaagaacuuaaua

SEQ ID NO: 136950 - RNA, 19 nt, Homo sapiens
ucacauuacuccuggugua

SEQ ID NO: 136951 - RNA, 19 nt, Homo sapiens
gcaaucaaagcaaaccaua

SEQ ID NO: 136952 - RNA, 19 nt, Homo sapiens
uggcagagauagaaacuga

SEQ ID NO: 136953 - RNA, 19 nt, Homo sapiens
gaacuacaauguuuuggaa

SEQ ID NO: 136954 - RNA, 19 nt, Homo sapiens
uugcagagguugaaacuga

SEQ ID NO: 136955 - RNA, 19 nt, Homo sapiens
gcucuggccucuugagaug

SEQ ID NO: 136956 - RNA, 19 nt, Homo sapiens
gaucuccaauuuaggaaug

SEQ ID NO: 136957 - RNA, 19 nt, Homo sapiens
gaagggagaagcaaaauuu

SEQ ID NO: 136958 - RNA, 19 nt, Homo sapiens
guguaaauauggagaaguu

SEQ ID NO: 136959 - RNA, 19 nt, Homo sapiens
uaacccaccucaagcaugu

SEQ ID NO: 136960 - RNA, 19 nt, Homo sapiens
aaagauacuuguugcugaa

SEQ ID NO: 136961 - RNA, 19 nt, Homo sapiens
caacauucgucggguuauu

SEQ ID NO: 136962 - RNA, 19 nt, Homo sapiens
cuacaggugucuucacaga

SEQ ID NO: 136963 - RNA, 19 nt, Homo sapiens
caagaaggauaucgacucu

SEQ ID NO: 136964 - RNA, 19 nt, Homo sapiens
gcuagcaugaugucuguua

SEQ ID NO: 136965 - RNA, 19 nt, Homo sapiens
gcagauaacgguccugagu

SEQ ID NO: 136966 - RNA, 19 nt, Homo sapiens
ugacaaagccacuauaggu

SEQ ID NO: 136967 - RNA, 19 nt, Homo sapiens
ggagcgaucaucuguauca

SEQ ID NO: 136968 - RNA, 19 nt, Homo sapiens
ggucuuugcuguucggaau

SEQ ID NO: 136969 - RNA, 19 nt, Homo sapiens
aaccauaccucauuauuac

SEQ ID NO: 136970 - RNA, 19 nt, Homo sapiens
ggggagaacuacaauguuu

SEQ ID NO: 136971 - RNA, 19 nt, Homo sapiens
ccaguggcuugcugaguuu

SEQ ID NO: 136972 - RNA, 19 nt, Homo sapiens
gauggacacaguuauaaga

SEQ ID NO: 136973 - RNA, 19 nt, Homo sapiens
caaaccauaccucauuauu

SEQ ID NO: 136974 - RNA, 19 nt, Homo sapiens
agaaagggauugaucuuac

SEQ ID NO: 136975 - RNA, 19 nt, Homo sapiens
agauaacgguccugaguug

SEQ ID NO: 136976 - RNA, 19 nt, Homo sapiens
ggugguggauggagcaguu

SEQ ID NO: 136977 - RNA, 19 nt, Homo sapiens
gauguuguuucuuuagcaa

SEQ ID NO: 136978 - RNA, 19 nt, Homo sapiens
gcaggacucaucacaccua

SEQ ID NO: 136979 - RNA, 19 nt, Homo sapiens
gaagguaccagggauguuc

SEQ ID NO: 136980 - RNA, 19 nt, Homo sapiens
gaagagacacuagucaucu

SEQ ID NO: 136981 - RNA, 19 nt, Homo sapiens
ggaagagacacuagucauc

SEQ ID NO: 136982 - RNA, 19 nt, Homo sapiens
aaacuggucccugcagaua

SEQ ID NO: 136983 - RNA, 19 nt, Homo sapiens
aagcaaaccauaccucauu

SEQ ID NO: 136984 - RNA, 19 nt, Homo sapiens
ucacagauaucccaaucag

SEQ ID NO: 136985 - RNA, 19 nt, Homo sapiens
gaguggaaaccauugcuaa

SEQ ID NO: 136986 - RNA, 19 nt, Homo sapiens
acaaagccacuauagguuu

SEQ ID NO: 136987 - RNA, 19 nt, Homo sapiens
gacaaagccacuauagguu

SEQ ID NO: 136988 - RNA, 19 nt, Homo sapiens
gcagagguugaaacugaua

SEQ ID NO: 136989 - RNA, 19 nt, Homo sapiens
caagagaggguaaacuaca

SEQ ID NO: 136990 - RNA, 19 nt, Homo sapiens
agcaaaccauaccucauua

SEQ ID NO: 136991 - RNA, 19 nt, Homo sapiens
ccacaagugccaccaccua

SEQ ID NO: 136992 - RNA, 19 nt, Homo sapiens
ggauauugaggccuuuaaa

SEQ ID NO: 136993 - RNA, 19 nt, Homo sapiens
ucggagcgaucaucuguau

SEQ ID NO: 136994 - RNA, 19 nt, Homo sapiens
ggcaagagcccacggaagu

SEQ ID NO: 136995 - RNA, 19 nt, Homo sapiens
uugcugaguuuagaaagua

SEQ ID NO: 136996 - RNA, 19 nt, Homo sapiens
cccaguggcuugcugaguu

SEQ ID NO: 136997 - RNA, 19 nt, Homo sapiens
uaacgguccugaguugaug

SEQ ID NO: 136998 - RNA, 19 nt, Homo sapiens
cuucagcuuuggcauguuu

SEQ ID NO: 136999 - RNA, 19 nt, Homo sapiens
gggaagagaugggaaaaug

SEQ ID NO: 137000 - RNA, 19 nt, Homo sapiens
ugauguggcuagcaugaug

SEQ ID NO: 137001 - RNA, 19 nt, Homo sapiens
ccaccucaagcauguauuu

SEQ ID NO: 137002 - RNA, 19 nt, Homo sapiens
cacuauagguuuugaagua

SEQ ID NO: 137003 - RNA, 19 nt, Homo sapiens
uggcaagccugaggauauu

SEQ ID NO: 137004 - RNA, 19 nt, Homo sapiens
guaaacuacagccacauga

SEQ ID NO: 137005 - RNA, 19 nt, Homo sapiens
uaccuucuaucguguaaau

SEQ ID NO: 137006 - RNA, 19 nt, Homo sapiens
gcaaaccauaccucauuau

SEQ ID NO: 137007 - RNA, 19 nt, Homo sapiens
gaccguucuuccuguacua

SEQ ID NO: 137008 - RNA, 19 nt, Homo sapiens
agagauagaaacugacaaa

SEQ ID NO: 137009 - RNA, 19 nt, Homo sapiens
gagacuuacuggcagagau

SEQ ID NO: 137010 - RNA, 19 nt, Homo sapiens
gcaagccugaggauauuga

SEQ ID NO: 137011 - RNA, 19 nt, Homo sapiens
ggaauguuuggaauuaaga

SEQ ID NO: 137012 - RNA, 19 nt, Homo sapiens
ggaguggaaaccauugcua

SEQ ID NO: 137013 - RNA, 19 nt, Homo sapiens
guagagaaagggauugauc

SEQ ID NO: 137014 - RNA, 19 nt, Homo sapiens
aggcagauauaucagcauu

SEQ ID NO: 137015 - RNA, 19 nt, Homo sapiens
gcagagauagaaacugaca

SEQ ID NO: 137016 - RNA, 19 nt, Homo sapiens
ccacugcucuacgacuuau

SEQ ID NO: 137017 - RNA, 19 nt, Homo sapiens
gauugaucuuacacaagua

SEQ ID NO: 137018 - RNA, 19 nt, Homo sapiens
gaagcaaaauuucugucaa

SEQ ID NO: 137019 - RNA, 19 nt, Homo sapiens
caaagccacuauagguuuu

SEQ ID NO: 137020 - RNA, 19 nt, Homo sapiens
agacuuacuggcagagaua

SEQ ID NO: 137021 - RNA, 19 nt, Homo sapiens
ugauaaagccacuguugga

SEQ ID NO: 137022 - RNA, 19 nt, Homo sapiens
cuaucacuauguuguugua

SEQ ID NO: 137023 - RNA, 19 nt, Homo sapiens
uuuacgaucuccaauuuag

SEQ ID NO: 137024 - RNA, 19 nt, Homo sapiens
uaaacuacagccacaugaa

SEQ ID NO: 137025 - RNA, 19 nt, Homo sapiens
ucacuacccucaguucagu

SEQ ID NO: 137026 - RNA, 19 nt, Homo sapiens
gguuauugcacagcgauua

SEQ ID NO: 137027 - RNA, 19 nt, Homo sapiens
ccaaagcaagagaggguaa

SEQ ID NO: 137028 - RNA, 19 nt, Homo sapiens
agggaaggguguuuguuga

SEQ ID NO: 137029 - RNA, 19 nt, Homo sapiens
gaaacugacaaagccacua

SEQ ID NO: 137030 - RNA, 19 nt, Homo sapiens
uguuguaacuaacucaaga

SEQ ID NO: 137031 - RNA, 19 nt, Homo sapiens
aaacuacagccacaugaau

SEQ ID NO: 137032 - RNA, 19 nt, Homo sapiens
gcaagagaggguaaacuac

SEQ ID NO: 137033 - RNA, 19 nt, Homo sapiens
gaacaacucucauuauuac

SEQ ID NO: 137034 - RNA, 19 nt, Homo sapiens
gaaguucgcuugaauuuag

SEQ ID NO: 137035 - RNA, 19 nt, Homo sapiens
uauuaaagcugcccaguua

SEQ ID NO: 137036 - RNA, 19 nt, Homo sapiens
gcacagugaucaaguuauu

SEQ ID NO: 137037 - RNA, 19 nt, Homo sapiens
gcacuaauauguaagacaa

SEQ ID NO: 137038 - RNA, 19 nt, Homo sapiens
caauggauauggaaagaua

SEQ ID NO: 137039 - RNA, 19 nt, Homo sapiens
guacaaaguugggaaauuc

SEQ ID NO: 137040 - RNA, 19 nt, Homo sapiens
guaaguaaauggucucuca

SEQ ID NO: 137041 - RNA, 19 nt, Homo sapiens
gaaauuuccugggagcuuu

SEQ ID NO: 137042 - RNA, 19 nt, Homo sapiens
ccaaauaucuaugccauug

SEQ ID NO: 137043 - RNA, 19 nt, Homo sapiens
cgacgacccuuuacuaaga

SEQ ID NO: 137044 - RNA, 19 nt, Homo sapiens
aguaauagguguagaauug

SEQ ID NO: 137045 - RNA, 19 nt, Homo sapiens
uagaagagcugggaauuga

SEQ ID NO: 137046 - RNA, 19 nt, Homo sapiens
guucagaaguuacuccuuu

SEQ ID NO: 137047 - RNA, 19 nt, Homo sapiens
gcacucagguuauugauac

SEQ ID NO: 137048 - RNA, 19 nt, Homo sapiens
gaagagcaguugaaagaag

SEQ ID NO: 137049 - RNA, 19 nt, Homo sapiens
gcuagaauuugauauguga

SEQ ID NO: 137050 - RNA, 19 nt, Homo sapiens
gaggauauguugcugcuau

SEQ ID NO: 137051 - RNA, 19 nt, Homo sapiens
gaagcacagugaucaaguu

SEQ ID NO: 137052 - RNA, 19 nt, Homo sapiens
gcaaagacuuggugcagau

SEQ ID NO: 137053 - RNA, 19 nt, Homo sapiens
ggaaacaagucagucauuc

SEQ ID NO: 137054 - RNA, 19 nt, Homo sapiens
ucucacagcuccaagaauu

SEQ ID NO: 137055 - RNA, 19 nt, Homo sapiens
agaauaagguuguucaugu

SEQ ID NO: 137056 - RNA, 19 nt, Homo sapiens
aaaccaaacugauguaagu

SEQ ID NO: 137057 - RNA, 19 nt, Homo sapiens
gaauugaaauguccgaagu

SEQ ID NO: 137058 - RNA, 19 nt, Homo sapiens
gaagucacauuccugaaca

SEQ ID NO: 137059 - RNA, 19 nt, Homo sapiens
gaaaucgacagacagagua

SEQ ID NO: 137060 - RNA, 19 nt, Homo sapiens
cagaagagcaguugaaaga

SEQ ID NO: 137061 - RNA, 19 nt, Homo sapiens
ucagugcacuaauauguaa

SEQ ID NO: 137062 - RNA, 19 nt, Homo sapiens
uaaauggucucucacuugu

SEQ ID NO: 137063 - RNA, 19 nt, Homo sapiens
cagcggaggugaaaguauu

SEQ ID NO: 137064 - RNA, 19 nt, Homo sapiens
ucaagucacugcuacgaaa

SEQ ID NO: 137065 - RNA, 19 nt, Homo sapiens
caagagaggccauuucaau

SEQ ID NO: 137066 - RNA, 19 nt, Homo sapiens
gaauaucuccgucaacuca

SEQ ID NO: 137067 - RNA, 19 nt, Homo sapiens
gaagauccuugggcagaaa

SEQ ID NO: 137068 - RNA, 19 nt, Homo sapiens
uacaggugcuuuaucuuua

SEQ ID NO: 137069 - RNA, 19 nt, Homo sapiens
gaauaagguuguucauguc

SEQ ID NO: 137070 - RNA, 19 nt, Homo sapiens
ccaaacugauguaaguaaa

SEQ ID NO: 137071 - RNA, 19 nt, Homo sapiens
uuacauggcuggagcuaga

SEQ ID NO: 137072 - RNA, 19 nt, Homo sapiens
gggcagaaaucgacagaca

SEQ ID NO: 137073 - RNA, 19 nt, Homo sapiens
gacaaaugcugacacagau

SEQ ID NO: 137074 - RNA, 19 nt, Homo sapiens
guaaauggucucucacuug

SEQ ID NO: 137075 - RNA, 19 nt, Homo sapiens
gagcuagaauuugauaugu

SEQ ID NO: 137076 - RNA, 19 nt, Homo sapiens
cagcagagcuaagacaaau

SEQ ID NO: 137077 - RNA, 19 nt, Homo sapiens
ggaaugaagauacugaaau

SEQ ID NO: 137078 - RNA, 19 nt, Homo sapiens
cuggagaaaugguaaauga

SEQ ID NO: 137079 - RNA, 19 nt, Homo sapiens
gaaagaagaggguauugag

SEQ ID NO: 137080 - RNA, 19 nt, Homo sapiens
gaaucacgauagaugaaga

SEQ ID NO: 137081 - RNA, 19 nt, Homo sapiens
ggacugaauuaugaaacuu

SEQ ID NO: 137082 - RNA, 19 nt, Homo sapiens
agauauagcuagagucugu

SEQ ID NO: 137083 - RNA, 19 nt, Homo sapiens
gaagauauagcuagagucu

SEQ ID NO: 137084 - RNA, 19 nt, Homo sapiens
gcagaaaucgacagacaga

SEQ ID NO: 137085 - RNA, 19 nt, Homo sapiens
gguauugaguacaaaguug

SEQ ID NO: 137086 - RNA, 19 nt, Homo sapiens
aauggucucucacuuguuu

SEQ ID NO: 137087 - RNA, 19 nt, Homo sapiens
ggagcauccugugaagaua

SEQ ID NO: 137088 - RNA, 19 nt, Homo sapiens
uaagacaaaugcugacaca

SEQ ID NO: 137089 - RNA, 19 nt, Homo sapiens
gguggaacaugcuugaaug

SEQ ID NO: 137090 - RNA, 19 nt, Homo sapiens
gauugaugcugauguaaca

SEQ ID NO: 137091 - RNA, 19 nt, Homo sapiens
ucaaauacgugggcauuca

SEQ ID NO: 137092 - RNA, 19 nt, Homo sapiens
cugcaacucugaaggguaa

SEQ ID NO: 137093 - RNA, 19 nt, Homo sapiens
gaaacaagucagucauuca

SEQ ID NO: 137094 - RNA, 19 nt, Homo sapiens
cuacaggugcuuuaucuuu

SEQ ID NO: 137095 - RNA, 19 nt, Homo sapiens
ggcuggagcuagaauuuga

SEQ ID NO: 137096 - RNA, 19 nt, Homo sapiens
gauccuagagguagaauuc

SEQ ID NO: 137097 - RNA, 19 nt, Homo sapiens
cacgauagaugaagauaca

SEQ ID NO: 137098 - RNA, 19 nt, Homo sapiens
gauauguugcugcuauuaa

SEQ ID NO: 137099 - RNA, 19 nt, Homo sapiens
caagucagucauucagaua

SEQ ID NO: 137100 - RNA, 19 nt, Homo sapiens
ggagaaaugguaaaugaag

SEQ ID NO: 137101 - RNA, 19 nt, Homo sapiens
aagaagaggguauugagua

SEQ ID NO: 137102 - RNA, 19 nt, Homo sapiens
gccgauugaugcugaugua

SEQ ID NO: 137103 - RNA, 19 nt, Homo sapiens
ggagcuagaauuugauaug

SEQ ID NO: 137104 - RNA, 19 nt, Homo sapiens
gucaauaccagauuucaaa

SEQ ID NO: 137105 - RNA, 19 nt, Homo sapiens
ugguaaagcugaaguuauc

SEQ ID NO: 137106 - RNA, 19 nt, Homo sapiens
uuacggaacucaaauacgu

SEQ ID NO: 137107 - RNA, 19 nt, Homo sapiens
gagaggccauuucaaucga

SEQ ID NO: 137108 - RNA, 19 nt, Homo sapiens
guacugggagcacauauuc

SEQ ID NO: 137109 - RNA, 19 nt, Homo sapiens
ucacaaagcagaggaugaa

SEQ ID NO: 137110 - RNA, 19 nt, Homo sapiens
ggaauugaacuagauccua

SEQ ID NO: 137111 - RNA, 19 nt, Homo sapiens
ugugacagcaguugaauuu

SEQ ID NO: 137112 - RNA, 19 nt, Homo sapiens
gaaaagaugguuguuauug

SEQ ID NO: 137113 - RNA, 19 nt, Homo sapiens
cagaaaagaugguuguuau

SEQ ID NO: 137114 - RNA, 19 nt, Homo sapiens
acaggugcuuuaucuuuaa

SEQ ID NO: 137115 - RNA, 19 nt, Homo sapiens
gcaucuagaggaauugaaa

SEQ ID NO: 137116 - RNA, 19 nt, Homo sapiens
ggauauguugcugcuauua

SEQ ID NO: 137117 - RNA, 19 nt, Homo sapiens
cauccgaccuuaucagaag

SEQ ID NO: 137118 - RNA, 19 nt, Homo sapiens
gauggcggcacucagguua

SEQ ID NO: 137119 - RNA, 19 nt, Homo sapiens
uuugauaugugaacaguug

SEQ ID NO: 137120 - RNA, 19 nt, Homo sapiens
gugaagauauagcuagagu

SEQ ID NO: 137121 - RNA, 19 nt, Homo sapiens
agacaaaugcugacacaga

SEQ ID NO: 137122 - RNA, 19 nt, Homo sapiens
gcuaacagcagagcuaaga

SEQ ID NO: 137123 - RNA, 19 nt, Homo sapiens
gauacaauagugucaucua

SEQ ID NO: 137124 - RNA, 19 nt, Homo sapiens
gaauuuagacaagaugaug

SEQ ID NO: 137125 - RNA, 19 nt, Homo sapiens
caacucugaaggguaauua

SEQ ID NO: 137126 - RNA, 19 nt, Homo sapiens
gagcuggagucguguguac

SEQ ID NO: 137127 - RNA, 19 nt, Homo sapiens
gcugggaauugaacuagau

SEQ ID NO: 137128 - RNA, 19 nt, Homo sapiens
agaauuggguucaguuugg

SEQ ID NO: 137129 - RNA, 19 nt, Homo sapiens
uggcaaaucaaucaacuuu

SEQ ID NO: 137130 - RNA, 19 nt, Homo sapiens
gcaaaucagaagagcaguu

SEQ ID NO: 137131 - RNA, 19 nt, Homo sapiens
gaaggcauuaucuguguug

SEQ ID NO: 137132 - RNA, 19 nt, Homo sapiens
gguagaauuccagucaaua

SEQ ID NO: 137133 - RNA, 19 nt, Homo sapiens
ggagaugacucaaguauuu

SEQ ID NO: 137134 - RNA, 19 nt, Homo sapiens
gaagugaccuuacuggaua

SEQ ID NO: 137135 - RNA, 19 nt, Homo sapiens
gagaagaacuuaucagaga

SEQ ID NO: 137136 - RNA, 19 nt, Homo sapiens
gaagaaaucacacuugaaa

SEQ ID NO: 137137 - RNA, 19 nt, Homo sapiens
gaaagaacgagcccgauua

SEQ ID NO: 137138 - RNA, 19 nt, Homo sapiens
gaaaugccauaaagagauu

SEQ ID NO: 137139 - RNA, 19 nt, Homo sapiens
gcucagaaguuccauagaa

SEQ ID NO: 137140 - RNA, 19 nt, Homo sapiens
gaauacgucuuaucuuaug

SEQ ID NO: 137141 - RNA, 19 nt, Homo sapiens
uaucagagauugagaaugu

SEQ ID NO: 137142 - RNA, 19 nt, Homo sapiens
gcacagaugcagauuauga

SEQ ID NO: 137143 - RNA, 19 nt, Homo sapiens
ugaaacagaucauagaaga

SEQ ID NO: 137144 - RNA, 19 nt, Homo sapiens
gaauaagcgucuaacagaa

SEQ ID NO: 137145 - RNA, 19 nt, Homo sapiens
caacacagauagcuuggaa

SEQ ID NO: 137146 - RNA, 19 nt, Homo sapiens
gagcagaugaugaauagua

SEQ ID NO: 137147 - RNA, 19 nt, Homo sapiens
uagaagaaguuacucauga

SEQ ID NO: 137148 - RNA, 19 nt, Homo sapiens
gaacaggaguuuacugaac

SEQ ID NO: 137149 - RNA, 19 nt, Homo sapiens
ccacaaguauguauaugaa

SEQ ID NO: 137150 - RNA, 19 nt, Homo sapiens
gaagcaagauacccagaga

SEQ ID NO: 137151 - RNA, 19 nt, Homo sapiens
caggauaaaugaugacuug

SEQ ID NO: 137152 - RNA, 19 nt, Homo sapiens
ggucuuggguuuagcauug

SEQ ID NO: 137153 - RNA, 19 nt, Homo sapiens
gaaagaagcagggucuauu

SEQ ID NO: 137154 - RNA, 19 nt, Homo sapiens
gauaaaugaugacuugauc

SEQ ID NO: 137155 - RNA, 19 nt, Homo sapiens
ggaguuuacugaacauuuc

SEQ ID NO: 137156 - RNA, 19 nt, Homo sapiens
gaauguccauggauuuguu

SEQ ID NO: 137157 - RNA, 19 nt, Homo sapiens
gaaaagcuaugaaaacuca

SEQ ID NO: 137158 - RNA, 19 nt, Homo sapiens
gaaaugaauaagcgucuaa

SEQ ID NO: 137159 - RNA, 19 nt, Homo sapiens
ggaaagggcaaacacugua

SEQ ID NO: 137160 - RNA, 19 nt, Homo sapiens
gggagcagaugaugaauag

SEQ ID NO: 137161 - RNA, 19 nt, Homo sapiens
gaaacaccaacuuacguua

SEQ ID NO: 137162 - RNA, 19 nt, Homo sapiens
gaaggaaaccagugucaga

SEQ ID NO: 137163 - RNA, 19 nt, Homo sapiens
gaucauagaagaacaaucu

SEQ ID NO: 137164 - RNA, 19 nt, Homo sapiens
gaacauuucacagcuauug

SEQ ID NO: 137165 - RNA, 19 nt, Homo sapiens
ccaggaacauaaauucauu

SEQ ID NO: 137166 - RNA, 19 nt, Homo sapiens
ugaaagacaggauaaauga

SEQ ID NO: 137167 - RNA, 19 nt, Homo sapiens
ggaagacauuuacaaccaa

SEQ ID NO: 137168 - RNA, 19 nt, Homo sapiens
gagauauccuccauguuau

SEQ ID NO: 137169 - RNA, 19 nt, Homo sapiens
gaaauucagggcuugguuu

SEQ ID NO: 137170 - RNA, 19 nt, Homo sapiens
cauugaagcuggccaguau

SEQ ID NO: 137171 - RNA, 19 nt, Homo sapiens
gaagcagggucuauuguac

SEQ ID NO: 137172 - RNA, 19 nt, Homo sapiens
agugauagguccagaauug

SEQ ID NO: 137173 - RNA, 19 nt, Homo sapiens
gaagauacaccuccucaag

SEQ ID NO: 137174 - RNA, 19 nt, Homo sapiens
gaagacagacagcucagaa

SEQ ID NO: 137175 - RNA, 19 nt, Homo sapiens
ugaauaagcgucuaacaga

SEQ ID NO: 137176 - RNA, 19 nt, Homo sapiens
guaacugccuuaaagaaca

SEQ ID NO: 137177 - RNA, 19 nt, Homo sapiens
gcccuaguguagagaaaua

SEQ ID NO: 137178 - RNA, 19 nt, Homo sapiens
ccauagaacggguuauuaa

SEQ ID NO: 137179 - RNA, 19 nt, Homo sapiens
ggaaaugaauaagcgucua

SEQ ID NO: 137180 - RNA, 19 nt, Homo sapiens
ggaaaugccauaaagagau

SEQ ID NO: 137181 - RNA, 19 nt, Homo sapiens
gauauccuccauguuauua

SEQ ID NO: 137182 - RNA, 19 nt, Homo sapiens
gauggagaaggaauauuua

SEQ ID NO: 137183 - RNA, 19 nt, Homo sapiens
agaaguuacucaugaagaa

SEQ ID NO: 137184 - RNA, 19 nt, Homo sapiens
ugagaauacugucauccua

SEQ ID NO: 137185 - RNA, 19 nt, Homo sapiens
gaaauuacaagggaaccua

SEQ ID NO: 137186 - RNA, 19 nt, Homo sapiens
ggucacgccucucuucaga

SEQ ID NO: 137187 - RNA, 19 nt, Homo sapiens
uagcaucuauguaaccaaa

SEQ ID NO: 137188 - RNA, 19 nt, Homo sapiens
ugaaguagauguucgugau

SEQ ID NO: 137189 - RNA, 19 nt, Homo sapiens
gggcuugguuucagcauug

SEQ ID NO: 137190 - RNA, 19 nt, Homo sapiens
gaagaacuuaucagagauu

SEQ ID NO: 137191 - RNA, 19 nt, Homo sapiens
cggaggaccugcugaucua

SEQ ID NO: 137192 - RNA, 19 nt, Homo sapiens
ggaggaauaucguucaaaa

SEQ ID NO: 137193 - RNA, 19 nt, Homo sapiens
guauaugaaugauggcuau

SEQ ID NO: 137194 - RNA, 19 nt, Homo sapiens
gugaauacuugggagauuu

SEQ ID NO: 137195 - RNA, 19 nt, Homo sapiens
aaagauauccaggaacaua

SEQ ID NO: 137196 - RNA, 19 nt, Homo sapiens
ggaaacaccaacuuacguu

SEQ ID NO: 137197 - RNA, 19 nt, Homo sapiens
cuuccaagcucuacuguga

SEQ ID NO: 137198 - RNA, 19 nt, Homo sapiens
gcacagcuuuacccuaucu

SEQ ID NO: 137199 - RNA, 19 nt, Homo sapiens
ugacaagacuaaagacagu

SEQ ID NO: 137200 - RNA, 19 nt, Homo sapiens
gcucuacugugacuucaga

SEQ ID NO: 137201 - RNA, 19 nt, Homo sapiens
gggauacgcuggaagacau

SEQ ID NO: 137202 - RNA, 19 nt, Homo sapiens
ugagguagauggaagagau

SEQ ID NO: 137203 - RNA, 19 nt, Homo sapiens
gagauaaagggcagucauu

SEQ ID NO: 137204 - RNA, 19 nt, Homo sapiens
cagaagcgaucccucuaug

SEQ ID NO: 137205 - RNA, 19 nt, Homo sapiens
ggacaacccacacauugga

SEQ ID NO: 137206 - RNA, 19 nt, Homo sapiens
cagagagcauugcaccuuu

SEQ ID NO: 137207 - RNA, 19 nt, Homo sapiens
uggcacagaugcagauuau

SEQ ID NO: 137208 - RNA, 19 nt, Homo sapiens
guacuggucaacacagaua

SEQ ID NO: 137209 - RNA, 19 nt, Homo sapiens
gaagugauagguccagaau

SEQ ID NO: 137210 - RNA, 19 nt, Homo sapiens
ccacaaaucacaaaugaag

SEQ ID NO: 137211 - RNA, 19 nt, Homo sapiens
ccaaauccauggaaaauau

SEQ ID NO: 137212 - RNA, 19 nt, Homo sapiens
gaagauggagaaggaauau

SEQ ID NO: 137213 - RNA, 19 nt, Homo sapiens
agaagaaguuacucaugaa

SEQ ID NO: 137214 - RNA, 19 nt, Homo sapiens
gaaccaauucaaccuguga

SEQ ID NO: 137215 - RNA, 19 nt, Homo sapiens
gaucguauuauaucgguaa

SEQ ID NO: 137216 - RNA, 19 nt, Homo sapiens
caacgggccuugguuucaa

SEQ ID NO: 137217 - RNA, 19 nt, Homo sapiens
cauuaaagguccuaaaggu

SEQ ID NO: 137218 - RNA, 19 nt, Homo sapiens
caaccucuuucaggcuuua

SEQ ID NO: 137219 - RNA, 19 nt, Homo sapiens
gaagcuggccaguauaaca

SEQ ID NO: 137220 - RNA, 19 nt, Homo sapiens
gauggaagagauuaucauu

SEQ ID NO: 137221 - RNA, 19 nt, Homo sapiens
aaaacgagauuaugaggua

SEQ ID NO: 137222 - RNA, 19 nt, Homo sapiens
cgucuuaucuuaugaacca

SEQ ID NO: 137223 - RNA, 19 nt, Homo sapiens
gauaaagggcagucauuca

SEQ ID NO: 137224 - RNA, 19 nt, Homo sapiens
gaacuucaaauuuggagau

SEQ ID NO: 137225 - RNA, 19 nt, Homo sapiens
ggccuugguuucaacauug

SEQ ID NO: 137226 - RNA, 19 nt, Homo sapiens
caaggugugugcccucuuc

SEQ ID NO: 137227 - RNA, 19 nt, Homo sapiens
gagcauauuuccccacaaa

SEQ ID NO: 137228 - RNA, 19 nt, Homo sapiens
ugacuugaucucagaauuu

SEQ ID NO: 137229 - RNA, 19 nt, Homo sapiens
aaagaacgagcccgauuaa

SEQ ID NO: 137230 - RNA, 19 nt, Homo sapiens
ccucagagcugcuagucau

SEQ ID NO: 137231 - RNA, 19 nt, Homo sapiens
gugaauaacguauguuuag

SEQ ID NO: 137232 - RNA, 19 nt, Homo sapiens
ggaaaccagugucagaaaa

SEQ ID NO: 137233 - RNA, 19 nt, Homo sapiens
ggacagaaauugaauauga

SEQ ID NO: 137234 - RNA, 19 nt, Homo sapiens
caacugaggucuuaacuuu

SEQ ID NO: 137235 - RNA, 19 nt, Homo sapiens
ggacuaacgugaagaagua

SEQ ID NO: 137236 - RNA, 19 nt, Homo sapiens
gaaccucucucaaauagaa

SEQ ID NO: 137237 - RNA, 19 nt, Homo sapiens
caucagagguaguuuauuu

SEQ ID NO: 137238 - RNA, 19 nt, Homo sapiens
gaacggaugcucuuuagua

SEQ ID NO: 137239 - RNA, 19 nt, Homo sapiens
aaacagagaucaaugcauu

SEQ ID NO: 137240 - RNA, 19 nt, Homo sapiens
gaacaaauggagaaagaua

SEQ ID NO: 137241 - RNA, 19 nt, Homo sapiens
ggacagacagugacgauua

SEQ ID NO: 137242 - RNA, 19 nt, Homo sapiens
ggagauacuuuagaagaua

SEQ ID NO: 137243 - RNA, 19 nt, Homo sapiens
gagaacaaauggagaaaga

SEQ ID NO: 137244 - RNA, 19 nt, Homo sapiens
gaagaaguaucgauaucaa

SEQ ID NO: 137245 - RNA, 19 nt, Homo sapiens
ccaguacaaugacaauuua

SEQ ID NO: 137246 - RNA, 19 nt, Homo sapiens
ccaaggagauacuuuagaa

SEQ ID NO: 137247 - RNA, 19 nt, Homo sapiens
gaacaagaauuuggagaau

SEQ ID NO: 137248 - RNA, 19 nt, Homo sapiens
caauuaagcuagaacaaga

SEQ ID NO: 137249 - RNA, 19 nt, Homo sapiens
caauggcacuuuagaauau

SEQ ID NO: 137250 - RNA, 19 nt, Homo sapiens
gacaacagcauuuauguaa

SEQ ID NO: 137251 - RNA, 19 nt, Homo sapiens
ggagaaagauauccaagag

SEQ ID NO: 137252 - RNA, 19 nt, Homo sapiens
ggcaaacacuguauacuug

SEQ ID NO: 137253 - RNA, 19 nt, Homo sapiens
gaaaagaaccucucucaaa

SEQ ID NO: 137254 - RNA, 19 nt, Homo sapiens
ugaagacagugaaguuuaa

SEQ ID NO: 137255 - RNA, 19 nt, Homo sapiens
ggagauagacuacuaaugg

SEQ ID NO: 137256 - RNA, 19 nt, Homo sapiens
gguuuaggcuucaguauug

SEQ ID NO: 137257 - RNA, 19 nt, Homo sapiens
gaaaggaacgugcccgauu

SEQ ID NO: 137258 - RNA, 19 nt, Homo sapiens
gaacgugcccgauugaaga

SEQ ID NO: 137259 - RNA, 19 nt, Homo sapiens
gcaaguaggagauagacua

SEQ ID NO: 137260 - RNA, 19 nt, Homo sapiens
gauggaagguugcaaguag

SEQ ID NO: 137261 - RNA, 19 nt, Homo sapiens
gacccuggcauauuuauua

SEQ ID NO: 137262 - RNA, 19 nt, Homo sapiens
gaaagaggcaaacacugua

SEQ ID NO: 137263 - RNA, 19 nt, Homo sapiens
gagcacaaguuuauagaag

SEQ ID NO: 137264 - RNA, 19 nt, Homo sapiens
gaacacaucagagguaguu

SEQ ID NO: 137265 - RNA, 19 nt, Homo sapiens
cgaagaggcaguagcaaua

SEQ ID NO: 137266 - RNA, 19 nt, Homo sapiens
ggccugggcuucaacauug

SEQ ID NO: 137267 - RNA, 19 nt, Homo sapiens
cagaagagcauuuagaaga

SEQ ID NO: 137268 - RNA, 19 nt, Homo sapiens
gaaccagugugcagucugu

SEQ ID NO: 137269 - RNA, 19 nt, Homo sapiens
ggaaaccagugauccugaa

SEQ ID NO: 137270 - RNA, 19 nt, Homo sapiens
gaaugagguugauguguca

SEQ ID NO: 137271 - RNA, 19 nt, Homo sapiens
gcccagaacucgugcaugu

SEQ ID NO: 137272 - RNA, 19 nt, Homo sapiens
aaaggaggguggaaagaaa

SEQ ID NO: 137273 - RNA, 19 nt, Homo sapiens
gaagauggagaagguauuu

SEQ ID NO: 137274 - RNA, 19 nt, Homo sapiens
ggccugggauucaguauug

SEQ ID NO: 137275 - RNA, 19 nt, Homo sapiens
cagucaaugugaauucuua

SEQ ID NO: 137276 - RNA, 19 nt, Homo sapiens
aaugcaagcuuguuauuga

SEQ ID NO: 137277 - RNA, 19 nt, Homo sapiens
uccauaugcuccuuauuua

SEQ ID NO: 137278 - RNA, 19 nt, Homo sapiens
gacuaucacuuugucauuu

SEQ ID NO: 137279 - RNA, 19 nt, Homo sapiens
gaagauuacgcucgauuug

SEQ ID NO: 137280 - RNA, 19 nt, Homo sapiens
cguagaagacgaccuauuu

SEQ ID NO: 137281 - RNA, 19 nt, Homo sapiens
agaagagcauuuagaagaa

SEQ ID NO: 137282 - RNA, 19 nt, Homo sapiens
ugaauaagcgucuaacaga

SEQ ID NO: 137283 - RNA, 19 nt, Homo sapiens
uggcaacaauggcacuuua

SEQ ID NO: 137284 - RNA, 19 nt, Homo sapiens
gauagacuacuaaugguaa

SEQ ID NO: 137285 - RNA, 19 nt, Homo sapiens
caacagcauuuauguaacu

SEQ ID NO: 137286 - RNA, 19 nt, Homo sapiens
ucaaaggcccuaaagguuu

SEQ ID NO: 137287 - RNA, 19 nt, Homo sapiens
gaaaucaaacuguucaaag

SEQ ID NO: 137288 - RNA, 19 nt, Homo sapiens
gauauguccugcagucuca

SEQ ID NO: 137289 - RNA, 19 nt, Homo sapiens
gaacaaacuaugugauaag

SEQ ID NO: 137290 - RNA, 19 nt, Homo sapiens
agaugacccuggcauauuu

SEQ ID NO: 137291 - RNA, 19 nt, Homo sapiens
caauguucuuugcauguua

SEQ ID NO: 137292 - RNA, 19 nt, Homo sapiens
aaaggaacgugcccgauug

SEQ ID NO: 137293 - RNA, 19 nt, Homo sapiens
gugaacaaacuaugugaua

SEQ ID NO: 137294 - RNA, 19 nt, Homo sapiens
caaugugaauucuuacgaa

SEQ ID NO: 137295 - RNA, 19 nt, Homo sapiens
gacagaagagcauuuagaa

SEQ ID NO: 137296 - RNA, 19 nt, Homo sapiens
gcaagcuuguuauugaaga

SEQ ID NO: 137297 - RNA, 19 nt, Homo sapiens
ugccaaaccuggagugauu

SEQ ID NO: 137298 - RNA, 19 nt, Homo sapiens
gacagacagugacgauuau

SEQ ID NO: 137299 - RNA, 19 nt, Homo sapiens
ggagacaacagcauuuaug

SEQ ID NO: 137300 - RNA, 19 nt, Homo sapiens
guccauaugcuccuuauuu

SEQ ID NO: 137301 - RNA, 19 nt, Homo sapiens
uggcagagacuaucacuuu

SEQ ID NO: 137302 - RNA, 19 nt, Homo sapiens
gagagcagaugaugaacca

SEQ ID NO: 137303 - RNA, 19 nt, Homo sapiens
gggagguacucaccaauuc

SEQ ID NO: 137304 - RNA, 19 nt, Homo sapiens
aaagaaccucucucaaaua

SEQ ID NO: 137305 - RNA, 19 nt, Homo sapiens
gagaugacccuggcauauu

SEQ ID NO: 137306 - RNA, 19 nt, Homo sapiens
ggccaguccugcuccuaua

SEQ ID NO: 137307 - RNA, 19 nt, Homo sapiens
ucucauauuucuccucuga

SEQ ID NO: 137308 - RNA, 19 nt, Homo sapiens
guccugcagucucauauuu

SEQ ID NO: 137309 - RNA, 19 nt, Homo sapiens
gcccagcucuaucccauug

SEQ ID NO: 137310 - RNA, 19 nt, Homo sapiens
uuacaaggcaggaaauaaa

SEQ ID NO: 137311 - RNA, 19 nt, Homo sapiens
ucagagccauguucgacua

SEQ ID NO: 137312 - RNA, 19 nt, Homo sapiens
gggaacggaugcucuuuag

SEQ ID NO: 137313 - RNA, 19 nt, Homo sapiens
ugacgauuauagcacaaua

SEQ ID NO: 137314 - RNA, 19 nt, Homo sapiens
caacaauggcacuuuagaa

SEQ ID NO: 137315 - RNA, 19 nt, Homo sapiens
ggaaaucaaacuguucaaa

SEQ ID NO: 137316 - RNA, 19 nt, Homo sapiens
aaagaacacaucagaggua

SEQ ID NO: 137317 - RNA, 19 nt, Homo sapiens
gcaguagcaauauuaaaga

SEQ ID NO: 137318 - RNA, 19 nt, Homo sapiens
gagauagacuacuaauggu

SEQ ID NO: 137319 - RNA, 19 nt, Homo sapiens
ucagagguuucccacagua

SEQ ID NO: 137320 - RNA, 19 nt, Homo sapiens
aagaaccucucucaaauag

SEQ ID NO: 137321 - RNA, 19 nt, Homo sapiens
ccauugccaucuucauaaa

SEQ ID NO: 137322 - RNA, 19 nt, Homo sapiens
gcaaacacuguauacuuga

SEQ ID NO: 137323 - RNA, 19 nt, Homo sapiens
gccaguacaaugacaauuu

SEQ ID NO: 137324 - RNA, 19 nt, Homo sapiens
caagacaugucguuuugua

SEQ ID NO: 137325 - RNA, 19 nt, Homo sapiens
gcaagguaguccugcacaa

SEQ ID NO: 137326 - RNA, 19 nt, Homo sapiens
acaauggcacuuuagaaua

SEQ ID NO: 137327 - RNA, 19 nt, Homo sapiens
gaagaggcaguagcaauau

SEQ ID NO: 137328 - RNA, 19 nt, Homo sapiens
caacacaaacuguaugaag

SEQ ID NO: 137329 - RNA, 19 nt, Homo sapiens
cgacagaagagcauuuaga

SEQ ID NO: 137330 - RNA, 19 nt, Homo sapiens
ggagaugacccuggcauau

SEQ ID NO: 137331 - RNA, 19 nt, Homo sapiens
acagugggcugccaaguca

SEQ ID NO: 137332 - RNA, 19 nt, Homo sapiens
cacaauuccuuaugucaau

SEQ ID NO: 137333 - RNA, 19 nt, Homo sapiens
agaaagagcucgauugaaa

SEQ ID NO: 137334 - RNA, 19 nt, Homo sapiens
gaagauacaugacuuacga

SEQ ID NO: 137335 - RNA, 19 nt, Homo sapiens
guacagaccugaagaauac

SEQ ID NO: 137336 - RNA, 19 nt, Homo sapiens
gaacaaauggagaaagaua

SEQ ID NO: 137337 - RNA, 19 nt, Homo sapiens
caucugauaugguguauuu

SEQ ID NO: 137338 - RNA, 19 nt, Homo sapiens
gagaacaaauggagaaaga

SEQ ID NO: 137339 - RNA, 19 nt, Homo sapiens
ggacaagacuaccacuuug

SEQ ID NO: 137340 - RNA, 19 nt, Homo sapiens
gaaaagagguccuuguaug

SEQ ID NO: 137341 - RNA, 19 nt, Homo sapiens
gaaagaaagagcucgauug

SEQ ID NO: 137342 - RNA, 19 nt, Homo sapiens
gugauggcauguucaaaua

SEQ ID NO: 137343 - RNA, 19 nt, Homo sapiens
gggcucagcuucucuuaug

SEQ ID NO: 137344 - RNA, 19 nt, Homo sapiens
gaagaacacaucugauaug

SEQ ID NO: 137345 - RNA, 19 nt, Homo sapiens
gcagacauaugaacaagca

SEQ ID NO: 137346 - RNA, 19 nt, Homo sapiens
aagcagaagugaagagaaa

SEQ ID NO: 137347 - RNA, 19 nt, Homo sapiens
agaaagauauucaggacaa

SEQ ID NO: 137348 - RNA, 19 nt, Homo sapiens
gggcaagcacugcaucuua

SEQ ID NO: 137349 - RNA, 19 nt, Homo sapiens
gcaagaaauucacuaugca

SEQ ID NO: 137350 - RNA, 19 nt, Homo sapiens
gcaaauaagaucuaugaca

SEQ ID NO: 137351 - RNA, 19 nt, Homo sapiens
gaggaggacugauggaaag

SEQ ID NO: 137352 - RNA, 19 nt, Homo sapiens
gaauuuggagaguacuuua

SEQ ID NO: 137353 - RNA, 19 nt, Homo sapiens
gaaacuggagcaggaauuu

SEQ ID NO: 137354 - RNA, 19 nt, Homo sapiens
gaggaaaucguacuugaga

SEQ ID NO: 137355 - RNA, 19 nt, Homo sapiens
gaacagaagaaaucaaguc

SEQ ID NO: 137356 - RNA, 19 nt, Homo sapiens
gagaacaaaugaugaacag

SEQ ID NO: 137357 - RNA, 19 nt, Homo sapiens
gauggacgccuacagauug

SEQ ID NO: 137358 - RNA, 19 nt, Homo sapiens
gauggcauguucaaauaug

SEQ ID NO: 137359 - RNA, 19 nt, Homo sapiens
gaccugaucuccgaauuuc

SEQ ID NO: 137360 - RNA, 19 nt, Homo sapiens
aaagaaagagcucgauuga

SEQ ID NO: 137361 - RNA, 19 nt, Homo sapiens
gcaaugcuaucaagagacu

SEQ ID NO: 137362 - RNA, 19 nt, Homo sapiens
gcaggaauuuggagaguac

SEQ ID NO: 137363 - RNA, 19 nt, Homo sapiens
ggcaagaaauucacuaugc

SEQ ID NO: 137364 - RNA, 19 nt, Homo sapiens
gguuaagugacgauuauua

SEQ ID NO: 137365 - RNA, 19 nt, Homo sapiens
caaauaugaggaaaucgua

SEQ ID NO: 137366 - RNA, 19 nt, Homo sapiens
guucaaauaugaggaaauc

SEQ ID NO: 137367 - RNA, 19 nt, Homo sapiens
uaaaugcaccacaugauga

SEQ ID NO: 137368 - RNA, 19 nt, Homo sapiens
guaagugcccugagugcua

SEQ ID NO: 137369 - RNA, 19 nt, Homo sapiens
gaagaauacagucgcuuug

SEQ ID NO: 137370 - RNA, 19 nt, Homo sapiens
gcaagaucauccugcacaa

SEQ ID NO: 137371 - RNA, 19 nt, Homo sapiens
gacaacagcaucuacauca

SEQ ID NO: 137372 - RNA, 19 nt, Homo sapiens
gaauacagucgcuuugaau

SEQ ID NO: 137373 - RNA, 19 nt, Homo sapiens
cugaagaacacaucugaua

SEQ ID NO: 137374 - RNA, 19 nt, Homo sapiens
gcuguggccucacugaaga

SEQ ID NO: 137375 - RNA, 19 nt, Homo sapiens
acaccaaucugcaggaugu

SEQ ID NO: 137376 - RNA, 19 nt, Homo sapiens
ggacaagaggaugcuauuu

SEQ ID NO: 137377 - RNA, 19 nt, Homo sapiens
gagcaaagaaccugaaagg

SEQ ID NO: 137378 - RNA, 19 nt, Homo sapiens
ggcaagcacugcaucuuag

SEQ ID NO: 137379 - RNA, 19 nt, Homo sapiens
gguaugagcaggugaaugg

SEQ ID NO: 137380 - RNA, 19 nt, Homo sapiens
agaauacagucgcuuugaa

SEQ ID NO: 137381 - RNA, 19 nt, Homo sapiens
gaaaagaggaggacugaug

SEQ ID NO: 137382 - RNA, 19 nt, Homo sapiens
ugaaggaccgagucaauga

SEQ ID NO: 137383 - RNA, 19 nt, Homo sapiens
ggauggacgccuacagauu

SEQ ID NO: 137384 - RNA, 19 nt, Homo sapiens
gaacaagcaaauaagaucu

SEQ ID NO: 137385 - RNA, 19 nt, Homo sapiens
gaaggcagacauaugaaca

SEQ ID NO: 137386 - RNA, 19 nt, Homo sapiens
ggcugcagcugcucugaaa

SEQ ID NO: 137387 - RNA, 19 nt, Homo sapiens
gacaaccacauaagccaua

SEQ ID NO: 137388 - RNA, 19 nt, Homo sapiens
ggaagugucggagguggua

SEQ ID NO: 137389 - RNA, 19 nt, Homo sapiens
ggacugauggaaagacaga

SEQ ID NO: 137390 - RNA, 19 nt, Homo sapiens
ggaauuuggagaguacuuu

SEQ ID NO: 137391 - RNA, 19 nt, Homo sapiens
gagcaggaauuuggagagu

SEQ ID NO: 137392 - RNA, 19 nt, Homo sapiens
cggcaaugcuaucaagaga

SEQ ID NO: 137393 - RNA, 19 nt, Homo sapiens
ggaccagcauccagucagu

SEQ ID NO: 137394 - RNA, 19 nt, Homo sapiens
ggagugaaucugaggaaug

SEQ ID NO: 137395 - RNA, 19 nt, Homo sapiens
ccacaggccugggcuucaa

SEQ ID NO: 137396 - RNA, 19 nt, Homo sapiens
gcagcaagcacaacuuuac

SEQ ID NO: 137397 - RNA, 19 nt, Homo sapiens
aaucgaagauacaugacuu

SEQ ID NO: 137398 - RNA, 19 nt, Homo sapiens
cagagagccucgcaagauc

SEQ ID NO: 137399 - RNA, 19 nt, Homo sapiens
ggccuggguuucagcauug

SEQ ID NO: 137400 - RNA, 19 nt, Homo sapiens
ggagaacaaaugcuacugu

SEQ ID NO: 137401 - RNA, 19 nt, Homo sapiens
gcaggugaauggcagugau

SEQ ID NO: 137402 - RNA, 19 nt, Homo sapiens
cauugaagcccuuauggaa

SEQ ID NO: 137403 - RNA, 19 nt, Homo sapiens
uaagugcccugagugcuau

SEQ ID NO: 137404 - RNA, 19 nt, Homo sapiens
ccagugacacggcaagaaa

SEQ ID NO: 137405 - RNA, 19 nt, Homo sapiens
ugacuuacgagaacaaaug

SEQ ID NO: 137406 - RNA, 19 nt, Homo sapiens
ugaagaauacagucgcuuu

SEQ ID NO: 137407 - RNA, 19 nt, Homo sapiens
gugaauggagugaaucuga

SEQ ID NO: 137408 - RNA, 19 nt, Homo sapiens
ccagagagccucgcaagau

SEQ ID NO: 137409 - RNA, 19 nt, Homo sapiens
ucuccgaauuuccacauaa

SEQ ID NO: 137410 - RNA, 19 nt, Homo sapiens
ggccugggcuucaguaucg

SEQ ID NO: 137411 - RNA, 19 nt, Homo sapiens
ugaagaacacaucugauau

SEQ ID NO: 137412 - RNA, 19 nt, Homo sapiens
caaaugcuacuguucuugu

SEQ ID NO: 137413 - RNA, 19 nt, Homo sapiens
gaaccgaaggcagacauau

SEQ ID NO: 137414 - RNA, 19 nt, Homo sapiens
uugaagcccuuauggaaau

SEQ ID NO: 137415 - RNA, 19 nt, Homo sapiens
gaggacugauggaaagaca

SEQ ID NO: 137416 - RNA, 19 nt, Homo sapiens
ugacaaagccaugaaacug

SEQ ID NO: 137417 - RNA, 19 nt, Homo sapiens
auacaugacuuacgagaac

SEQ ID NO: 137418 - RNA, 19 nt, Homo sapiens
gagugaaucugaggaaugc

SEQ ID NO: 137419 - RNA, 19 nt, Homo sapiens
cugcacggcuugugaagug

SEQ ID NO: 137420 - RNA, 19 nt, Homo sapiens
caaccauucucuugugaac

SEQ ID NO: 137421 - RNA, 19 nt, Homo sapiens
gcagugauggcauguucaa

SEQ ID NO: 137422 - RNA, 19 nt, Homo sapiens
caagaaauucacuaugcaa

SEQ ID NO: 137423 - RNA, 19 nt, Homo sapiens
ggagacaacagcaucuaca

SEQ ID NO: 137424 - RNA, 19 nt, Homo sapiens
gcacaucccaggagacaac

SEQ ID NO: 137425 - RNA, 19 nt, Homo sapiens
gacaagaggaugcuauuuu

SEQ ID NO: 137426 - RNA, 19 nt, Homo sapiens
gaucuuaucggugaaugga

SEQ ID NO: 137427 - RNA, 19 nt, Homo sapiens
caacaccaaucugcaggau

SEQ ID NO: 137428 - RNA, 19 nt, Homo sapiens
cuaaaugcaccacaugaug

SEQ ID NO: 137429 - RNA, 19 nt, Homo sapiens
ucacuggaagagauuuaua

SEQ ID NO: 137430 - RNA, 19 nt, Homo sapiens
gcacaacuuuaccccauug

SEQ ID NO: 137431 - RNA, 19 nt, Homo sapiens
uggacaagacuaccacuuu

SEQ ID NO: 137432 - RNA, 19 nt, Homo sapiens
uaagugacgauuauuaugg

SEQ ID NO: 137433 - RNA, 19 nt, Homo sapiens
gagaggaacugcaggaauu

SEQ ID NO: 137434 - RNA, 19 nt, Homo sapiens
gaucaucgcucaguauaaa

SEQ ID NO: 137435 - RNA, 19 nt, Homo sapiens
ggaauucuccugccucuua

SEQ ID NO: 137436 - RNA, 19 nt, Homo sapiens
caacacagauacccuagaa

SEQ ID NO: 137437 - RNA, 19 nt, Homo sapiens
gaugggagguugcagauug

SEQ ID NO: 137438 - RNA, 19 nt, Homo sapiens
gaaccgaggcgaauuguga

SEQ ID NO: 137439 - RNA, 19 nt, Homo sapiens
gcagagacauggaaagaca

SEQ ID NO: 137440 - RNA, 19 nt, Homo sapiens
gaaagagaaguguaaggua

SEQ ID NO: 137441 - RNA, 19 nt, Homo sapiens
gauaugaguugcaggugaa

SEQ ID NO: 137442 - RNA, 19 nt, Homo sapiens
gagaaugugcuagagauua

SEQ ID NO: 137443 - RNA, 19 nt, Homo sapiens
ggauggagguggacugaug

SEQ ID NO: 137444 - RNA, 19 nt, Homo sapiens
gcccugagcuuccgcuuug

SEQ ID NO: 137445 - RNA, 19 nt, Homo sapiens
agaaugugcuagagauuaa

SEQ ID NO: 137446 - RNA, 19 nt, Homo sapiens
ggacacuccucugcaugua

SEQ ID NO: 137447 - RNA, 19 nt, Homo sapiens
gggaacagcucaugaacag

SEQ ID NO: 137448 - RNA, 19 nt, Homo sapiens
gaggaaaucacauuggaaa

SEQ ID NO: 137449 - RNA, 19 nt, Homo sapiens
gauguaggccauucacuaa

SEQ ID NO: 137450 - RNA, 19 nt, Homo sapiens
cgagaguggucaagguuaa

SEQ ID NO: 137451 - RNA, 19 nt, Homo sapiens
cagcuacaguuucacagua

SEQ ID NO: 137452 - RNA, 19 nt, Homo sapiens
gaaauaccgcuaccaagau

SEQ ID NO: 137453 - RNA, 19 nt, Homo sapiens
gaagagacagauacuugaa

SEQ ID NO: 137454 - RNA, 19 nt, Homo sapiens
ggaagagacagauacuuga

SEQ ID NO: 137455 - RNA, 19 nt, Homo sapiens
gcacaucccaggagauaau

SEQ ID NO: 137456 - RNA, 19 nt, Homo sapiens
agaagcagcucaacuccaa

SEQ ID NO: 137457 - RNA, 19 nt, Homo sapiens
gagcaggaguucacagagu

SEQ ID NO: 137458 - RNA, 19 nt, Homo sapiens
gaacauucccuucugucuu

SEQ ID NO: 137459 - RNA, 19 nt, Homo sapiens
gaaaggaagagacagauac

SEQ ID NO: 137460 - RNA, 19 nt, Homo sapiens
ccacacacauuccagaagu

SEQ ID NO: 137461 - RNA, 19 nt, Homo sapiens
gcucagagacggccuacuu

SEQ ID NO: 137462 - RNA, 19 nt, Homo sapiens
ggagauggaauacgaggaa

SEQ ID NO: 137463 - RNA, 19 nt, Homo sapiens
uggacauccuggacuauua

SEQ ID NO: 137464 - RNA, 19 nt, Homo sapiens
aacauucccuucugucuuu

SEQ ID NO: 137465 - RNA, 19 nt, Homo sapiens
gaacagcuacaguuucaca

SEQ ID NO: 137466 - RNA, 19 nt, Homo sapiens
ggccuccgcucucuccuaa

SEQ ID NO: 137467 - RNA, 19 nt, Homo sapiens
ccgcaaagccuucgacaga

SEQ ID NO: 137468 - RNA, 19 nt, Homo sapiens
guacaacagccaccucuau

SEQ ID NO: 137469 - RNA, 19 nt, Homo sapiens
acucacagcuggaauuuag

SEQ ID NO: 137470 - RNA, 19 nt, Homo sapiens
gcaggaagucccaaacaau

SEQ ID NO: 137471 - RNA, 19 nt, Homo sapiens
ggcaggaagucccaaacaa

SEQ ID NO: 137472 - RNA, 19 nt, Homo sapiens
uggaacagcuacaguuuca

SEQ ID NO: 137473 - RNA, 19 nt, Homo sapiens
gugaguacccuaaguguau

SEQ ID NO: 137474 - RNA, 19 nt, Homo sapiens
agaaauaccgcuaccaaga

SEQ ID NO: 137475 - RNA, 19 nt, Homo sapiens
ucagagacggccuacuuua

SEQ ID NO: 137476 - RNA, 19 nt, Homo sapiens
ggaaagagaaguguaaggu

SEQ ID NO: 137477 - RNA, 19 nt, Homo sapiens
ggaauacgaggaaaucaca

SEQ ID NO: 137478 - RNA, 19 nt, Homo sapiens
ggacauccuggacuauuau

SEQ ID NO: 137479 - RNA, 19 nt, Homo sapiens
caaaagggguuucuacauc

SEQ ID NO: 137480 - RNA, 19 nt, Homo sapiens
gauguugucuaccuaaagg

SEQ ID NO: 137481 - RNA, 19 nt, Homo sapiens
caggaagucccaaacaauu

SEQ ID NO: 137482 - RNA, 19 nt, Homo sapiens
gagauuaacaagcggauca

SEQ ID NO: 137483 - RNA, 19 nt, Homo sapiens
uagcaucuauguaacaaag

SEQ ID NO: 137484 - RNA, 19 nt, Homo sapiens
cagcacaucccaggagaua

SEQ ID NO: 137485 - RNA, 19 nt, Homo sapiens
ggaagucccaaacaauuuc

SEQ ID NO: 137486 - RNA, 19 nt, Homo sapiens
caagcgggaguaugagaua

SEQ ID NO: 137487 - RNA, 19 nt, Homo sapiens
ggugacgacccauccauuu

SEQ ID NO: 137488 - RNA, 19 nt, Homo sapiens
cauguuaccuugauuucuc

SEQ ID NO: 137489 - RNA, 19 nt, Homo sapiens
aaauaccgcuaccaagaug

SEQ ID NO: 137490 - RNA, 19 nt, Homo sapiens
ucugagaccuuccugaaca

SEQ ID NO: 137491 - RNA, 19 nt, Homo sapiens
ugaaaggaagagacagaua

SEQ ID NO: 137492 - RNA, 19 nt, Homo sapiens
ugaagaacacguaugaugu

SEQ ID NO: 137493 - RNA, 19 nt, Homo sapiens
ccucuuugcuggcuucuca

SEQ ID NO: 137494 - RNA, 19 nt, Homo sapiens
acucuaggguuccugauga

SEQ ID NO: 137495 - RNA, 19 nt, Homo sapiens
ggagaaugugcuagagauu

SEQ ID NO: 137496 - RNA, 19 nt, Homo sapiens
ggcccaagcgggaguauga

SEQ ID NO: 137497 - RNA, 19 nt, Homo sapiens
gcagauggaagugcacuau

SEQ ID NO: 137498 - RNA, 19 nt, Homo sapiens
gcauccuguuuguaaauga

SEQ ID NO: 137499 - RNA, 19 nt, Homo sapiens
ggaaaucacauuggaaagg

SEQ ID NO: 137500 - RNA, 19 nt, Homo sapiens
gagauggaauacgaggaaa

SEQ ID NO: 137501 - RNA, 19 nt, Homo sapiens
gaaaugcugccgccuucug

SEQ ID NO: 137502 - RNA, 19 nt, Homo sapiens
cguggagggugacagcuuu

SEQ ID NO: 137503 - RNA, 19 nt, Homo sapiens
cgacgagaguggucaaggu

SEQ ID NO: 137504 - RNA, 19 nt, Homo sapiens
guaugauguugucuaccua

SEQ ID NO: 137505 - RNA, 19 nt, Homo sapiens
gguggaagcccucaaagag

SEQ ID NO: 137506 - RNA, 19 nt, Homo sapiens
gagauuaaagugagagaag

SEQ ID NO: 137507 - RNA, 19 nt, Homo sapiens
ggaggauuagggagauuaa

SEQ ID NO: 137508 - RNA, 19 nt, Homo sapiens
guauaaaccagaagaguac

SEQ ID NO: 137509 - RNA, 19 nt, Homo sapiens
gcaucuucaucuccuuuau

SEQ ID NO: 137510 - RNA, 19 nt, Homo sapiens
gcaaugccuaccugaguga

SEQ ID NO: 137511 - RNA, 19 nt, Homo sapiens
ggaaggggcuuaagucacu

SEQ ID NO: 137512 - RNA, 19 nt, Homo sapiens
gugauugucaacacagaua

SEQ ID NO: 137513 - RNA, 19 nt, Homo sapiens
uaaguguauucuucugaga

SEQ ID NO: 137514 - RNA, 19 nt, Homo sapiens
aguauaaaccagaagagua

SEQ ID NO: 137515 - RNA, 19 nt, Homo sapiens
ggucagacggucacgauca

SEQ ID NO: 137516 - RNA, 19 nt, Homo sapiens
gguguggaccuccgaaaug

SEQ ID NO: 137517 - RNA, 19 nt, Homo sapiens
gagaaggucauggagauca

SEQ ID NO: 137518 - RNA, 19 nt, Homo sapiens
ucagaaauaccgcuaccaa

SEQ ID NO: 137519 - RNA, 19 nt, Homo sapiens
gcugccgccuucugcaauu

SEQ ID NO: 137520 - RNA, 19 nt, Homo sapiens
uugaggagaucuaccacaa

SEQ ID NO: 137521 - RNA, 19 nt, Homo sapiens
aagacucgguucugagcua

SEQ ID NO: 137522 - RNA, 19 nt, Homo sapiens
cugagaaggucauggagau

SEQ ID NO: 137523 - RNA, 19 nt, Homo sapiens
cauccuguuuguaaaugaa

SEQ ID NO: 137524 - RNA, 19 nt, Homo sapiens
uaaagugagagaagagaga

SEQ ID NO: 137525 - RNA, 19 nt, Homo sapiens
ggauuagggagauuaaagu

SEQ ID NO: 137526 - RNA, 19 nt, Homo sapiens
uuaacaagcggaucacaga

SEQ ID NO: 137527 - RNA, 19 nt, Homo sapiens
cgagaaccgaggcgaauug

SEQ ID NO: 137528 - RNA, 19 nt, Homo sapiens
uacccuaaguguauucuuc

SEQ ID NO: 137529 - RNA, 19 nt, Homo sapiens
gggagaagcagcucaacuc

SEQ ID NO: 137530 - RNA, 19 nt, Homo sapiens
gagacggccuacuuuacuc

SEQ ID NO: 137531 - RNA, 19 nt, Homo sapiens
uggagaaugugcuagagau

SEQ ID NO: 137532 - RNA, 19 nt, Homo sapiens
gggagaaaauggagaagga

SEQ ID NO: 137533 - RNA, 19 nt, Homo sapiens
gcaggaagguugucauuaa

SEQ ID NO: 137534 - RNA, 19 nt, Homo sapiens
gaagaaacauaaccucaaa

SEQ ID NO: 137535 - RNA, 19 nt, Homo sapiens
ccaaagaggugguguauag

SEQ ID NO: 137536 - RNA, 19 nt, Homo sapiens
gcagagaggcugugacuuu

SEQ ID NO: 137537 - RNA, 19 nt, Homo sapiens
ggcgguaccuucaccauua

SEQ ID NO: 137538 - RNA, 19 nt, Homo sapiens
gugcaaugcugacaacuuu

SEQ ID NO: 137539 - RNA, 19 nt, Homo sapiens
gaacuugccauugaagaua

SEQ ID NO: 137540 - RNA, 19 nt, Homo sapiens
gaugagggcucggcacaaa

SEQ ID NO: 137541 - RNA, 19 nt, Homo sapiens
aaacauaaccucaaacuag

SEQ ID NO: 137542 - RNA, 19 nt, Homo sapiens
ccucaugggucccggguua

SEQ ID NO: 137543 - RNA, 19 nt, Homo sapiens
gcaaauggcgugauugaag

SEQ ID NO: 137544 - RNA, 19 nt, Homo sapiens
gauugaaacugacaagaca

SEQ ID NO: 137545 - RNA, 19 nt, Homo sapiens
caagacaucugugcagguu

SEQ ID NO: 137546 - RNA, 19 nt, Homo sapiens
ugaagugguuugugagauu

SEQ ID NO: 137547 - RNA, 19 nt, Homo sapiens
uaacaacagugucuucagu

SEQ ID NO: 137548 - RNA, 19 nt, Homo sapiens
ccacacacccuacaaguug

SEQ ID NO: 137549 - RNA, 19 nt, Homo sapiens
gauugaagcucuuuuggua

SEQ ID NO: 137550 - RNA, 19 nt, Homo sapiens
caaauuaaagggcagauau

SEQ ID NO: 137551 - RNA, 19 nt, Homo sapiens
caucagcucucugcaaaga

SEQ ID NO: 137552 - RNA, 19 nt, Homo sapiens
gagaaggcccgaaagaaug

SEQ ID NO: 137553 - RNA, 19 nt, Homo sapiens
gaagugguuugugagauug

SEQ ID NO: 137554 - RNA, 19 nt, Homo sapiens
ucacugaacugggagagaa

SEQ ID NO: 137555 - RNA, 19 nt, Homo sapiens
gaaacauaaccucaaacua

SEQ ID NO: 137556 - RNA, 19 nt, Homo sapiens
aagaugaagugguuuguga

SEQ ID NO: 137557 - RNA, 19 nt, Homo sapiens
ggagagaaggcccgaaaga

SEQ ID NO: 137558 - RNA, 19 nt, Homo sapiens
ggaagcagagcacugugua

SEQ ID NO: 137559 - RNA, 19 nt, Homo sapiens
gugauuaaguuccuaucuu

SEQ ID NO: 137560 - RNA, 19 nt, Homo sapiens
gccuugagcuuuucaguua

SEQ ID NO: 137561 - RNA, 19 nt, Homo sapiens
gggaccaugugauuaaguu

SEQ ID NO: 137562 - RNA, 19 nt, Homo sapiens
gaucaugcaggaacugaaa

SEQ ID NO: 137563 - RNA, 19 nt, Homo sapiens
gaacggaccaucacugaac

SEQ ID NO: 137564 - RNA, 19 nt, Homo sapiens
gagacacaguugcagaaga

SEQ ID NO: 137565 - RNA, 19 nt, Homo sapiens
gagagaaggcccgaaagaa

SEQ ID NO: 137566 - RNA, 19 nt, Homo sapiens
ucaggaauguggaagcuau

SEQ ID NO: 137567 - RNA, 19 nt, Homo sapiens
guuaguaccuaguggugaa

SEQ ID NO: 137568 - RNA, 19 nt, Homo sapiens
gcauuguaaucaucauaga

SEQ ID NO: 137569 - RNA, 19 nt, Homo sapiens
gcagagcacuguguaacca

SEQ ID NO: 137570 - RNA, 19 nt, Homo sapiens
agacacaguugcagaagau

SEQ ID NO: 137571 - RNA, 19 nt, Homo sapiens
ggucaugcauuguaaucau

SEQ ID NO: 137572 - RNA, 19 nt, Homo sapiens
uuaaugagauugacaugag

SEQ ID NO: 137573 - RNA, 19 nt, Homo sapiens
gaaagcuguuggagacaca

SEQ ID NO: 137574 - RNA, 19 nt, Homo sapiens
gcaaauuaaagggcagaua

SEQ ID NO: 137575 - RNA, 19 nt, Homo sapiens
caucauaggcugacaccaa

SEQ ID NO: 137576 - RNA, 19 nt, Homo sapiens
gagauugacaugaguaaca

SEQ ID NO: 137577 - RNA, 19 nt, Homo sapiens
uuugugagauugaaacuga

SEQ ID NO: 137578 - RNA, 19 nt, Homo sapiens
agagagagccuuaauggau

SEQ ID NO: 137579 - RNA, 19 nt, Homo sapiens
gaagcagagcacuguguaa

SEQ ID NO: 137580 - RNA, 19 nt, Homo sapiens
gaaggaggcccagaauaca

SEQ ID NO: 137581 - RNA, 19 nt, Homo sapiens
gaacaucgggagaaaauga

SEQ ID NO: 137582 - RNA, 19 nt, Homo sapiens
gggauuauauugacaucag

SEQ ID NO: 137583 - RNA, 19 nt, Homo sapiens
gauauugaacggaccauca

SEQ ID NO: 137584 - RNA, 19 nt, Homo sapiens
gaauguggaagcuaugaau

SEQ ID NO: 137585 - RNA, 19 nt, Homo sapiens
ugaguaacauccaggagau

SEQ ID NO: 137586 - RNA, 19 nt, Homo sapiens
aaaccugugucugcaguaa

SEQ ID NO: 137587 - RNA, 19 nt, Homo sapiens
cagcaaauggcgugauuga

SEQ ID NO: 137588 - RNA, 19 nt, Homo sapiens
ugaggcugcugacguuuga

SEQ ID NO: 137589 - RNA, 19 nt, Homo sapiens
gaggugguguauagggauu

SEQ ID NO: 137590 - RNA, 19 nt, Homo sapiens
cagaauacaugugcaaugc

SEQ ID NO: 137591 - RNA, 19 nt, Homo sapiens
ugcagaagaugaagugguu

SEQ ID NO: 137592 - RNA, 19 nt, Homo sapiens
ucacauugccuugagcuuu

SEQ ID NO: 137593 - RNA, 19 nt, Homo sapiens
ucagcucucugcaaagaug

SEQ ID NO: 137594 - RNA, 19 nt, Homo sapiens
uccaucagcucucugcaaa

SEQ ID NO: 137595 - RNA, 19 nt, Homo sapiens
cagagaggcugugacuuuc

SEQ ID NO: 137596 - RNA, 19 nt, Homo sapiens
gcaaugcugacaacuuuua

SEQ ID NO: 137597 - RNA, 19 nt, Homo sapiens
ugaaggaggcccagaauac

SEQ ID NO: 137598 - RNA, 19 nt, Homo sapiens
ugucuucaguguucgcuuu

SEQ ID NO: 137599 - RNA, 19 nt, Homo sapiens
cuacuacucugucuucacu

SEQ ID NO: 137600 - RNA, 19 nt, Homo sapiens
ucaguuaaguugcuguaag

SEQ ID NO: 137601 - RNA, 19 nt, Homo sapiens
cauagccucgaauaucuua

SEQ ID NO: 137602 - RNA, 19 nt, Homo sapiens
ucucugcaccugucucaua

SEQ ID NO: 137603 - RNA, 19 nt, Homo sapiens
agagaaggcccgaaagaau

SEQ ID NO: 137604 - RNA, 19 nt, Homo sapiens
ucacuauucagaacuugua

SEQ ID NO: 137605 - RNA, 19 nt, Homo sapiens
gcacauucucccuugauuc

SEQ ID NO: 137606 - RNA, 19 nt, Homo sapiens
cugcuuugcuucuucaaug

SEQ ID NO: 137607 - RNA, 19 nt, Homo sapiens
caaggaagcagagcacugu

SEQ ID NO: 137608 - RNA, 19 nt, Homo sapiens
gaugaagugguuugugaga

SEQ ID NO: 137609 - RNA, 19 nt, Homo sapiens
uauauugacaucaguguug

SEQ ID NO: 137610 - RNA, 19 nt, Homo sapiens
uguuguaaaugcagugauu

SEQ ID NO: 137611 - RNA, 19 nt, Homo sapiens
ugaagaaacauaaccucaa

SEQ ID NO: 137612 - RNA, 19 nt, Homo sapiens
aagggcagauauucucaaa

SEQ ID NO: 137613 - RNA, 19 nt, Homo sapiens
gaacccacacacccuacaa

SEQ ID NO: 137614 - RNA, 19 nt, Homo sapiens
gcacccauacccacucaga

SEQ ID NO: 137615 - RNA, 19 nt, Homo sapiens
ggucauuucuaaggugugu

SEQ ID NO: 137616 - RNA, 19 nt, Homo sapiens
ucauauuccugccuuucuu

SEQ ID NO: 137617 - RNA, 19 nt, Homo sapiens
gagagagagccuuaaugga

SEQ ID NO: 137618 - RNA, 19 nt, Homo sapiens
gcuaugaauuuugcagaua

SEQ ID NO: 137619 - RNA, 19 nt, Homo sapiens
aaacugacaagacaucugu

SEQ ID NO: 137620 - RNA, 19 nt, Homo sapiens
caagcguggucccgaggaa

SEQ ID NO: 137621 - RNA, 19 nt, Homo sapiens
ucuagcaccuuguucuuag

SEQ ID NO: 137622 - RNA, 19 nt, Homo sapiens
gaugucaggugggagaaag

SEQ ID NO: 137623 - RNA, 19 nt, Homo sapiens
aagaggugcugcuuugcuu

SEQ ID NO: 137624 - RNA, 19 nt, Homo sapiens
gaagaugaagugguuugug

SEQ ID NO: 137625 - RNA, 19 nt, Homo sapiens
acaacagugucuucagugu

SEQ ID NO: 137626 - RNA, 19 nt, Homo sapiens
caaggcagcgguagaggau

SEQ ID NO: 137627 - RNA, 19 nt, Homo sapiens
ggaauguggaagcuaugaa

SEQ ID NO: 137628 - RNA, 19 nt, Homo sapiens
cagcaggaagguugucauu

SEQ ID NO: 137629 - RNA, 19 nt, Homo sapiens
uggcaaaggucugcguuca

SEQ ID NO: 137630 - RNA, 19 nt, Homo sapiens
ugggauucauggcuuugua

SEQ ID NO: 137631 - RNA, 19 nt, Homo sapiens
ccucuagacugacucacau

SEQ ID NO: 137632 - RNA, 19 nt, Homo sapiens
cugaggucaugcauuguaa

SEQ ID NO: 137633 - RNA, 19 nt, Homo sapiens
ggacacagaguuuguaaau

SEQ ID NO: 137634 - RNA, 19 nt, Homo sapiens
ggacuuggacacagaguuu

SEQ ID NO: 137635 - RNA, 19 nt, Homo sapiens
gacacagaguuuguaaaua

SEQ ID NO: 137636 - RNA, 19 nt, Homo sapiens
gaacgggaagccaaagaaa

SEQ ID NO: 137637 - RNA, 19 nt, Homo sapiens
gaaaacaacaugcucuuaa

SEQ ID NO: 137638 - RNA, 19 nt, Homo sapiens
cuacugauuuggauuuguu

SEQ ID NO: 137639 - RNA, 19 nt, Homo sapiens
ccacuuauccucauugcuu

SEQ ID NO: 137640 - RNA, 19 nt, Homo sapiens
gcaaaggccucccuaaaag

SEQ ID NO: 137641 - RNA, 19 nt, Homo sapiens
gguccaaguucaagaagau

SEQ ID NO: 137642 - RNA, 19 nt, Homo sapiens
gagcagagaccacuuaucc

SEQ ID NO: 137643 - RNA, 19 nt, Homo sapiens
ugagagcagagaccacuua

SEQ ID NO: 137644 - RNA, 19 nt, Homo sapiens
ccucagcucucuccucauc

SEQ ID NO: 137645 - RNA, 19 nt, Homo sapiens
ggaccuugagccugaaauu

SEQ ID NO: 137646 - RNA, 19 nt, Homo sapiens
acaacgagccugagaagga

SEQ ID NO: 137647 - RNA, 19 nt, Homo sapiens
gacagcagcuuggcaaagg

SEQ ID NO: 137648 - RNA, 19 nt, Homo sapiens
cacuuauccucauugcuua

SEQ ID NO: 137649 - RNA, 19 nt, Homo sapiens
gagaccacuuauccucauu

SEQ ID NO: 137650 - RNA, 19 nt, Homo sapiens
agggagaacucgccagaga

SEQ ID NO: 137651 - RNA, 19 nt, Homo sapiens
ccaaaagacucaguacuug

SEQ ID NO: 137652 - RNA, 19 nt, Homo sapiens
caacaacgagccugagaag

SEQ ID NO: 137653 - RNA, 19 nt, Homo sapiens
aaacaacaugcucuuaaug

SEQ ID NO: 137654 - RNA, 19 nt, Homo sapiens
gaaagguauuuugggguua

SEQ ID NO: 137655 - RNA, 19 nt, Homo sapiens
gcucucuccucauccauca

SEQ ID NO: 137656 - RNA, 19 nt, Homo sapiens
uaucguauccuaaagucuu

SEQ ID NO: 137657 - RNA, 19 nt, Homo sapiens
uggcaaaggccucccuaaa

SEQ ID NO: 137658 - RNA, 19 nt, Homo sapiens
ucccacugauuuauuugua

SEQ ID NO: 137659 - RNA, 19 nt, Homo sapiens
ucaacaacgucccuuacuc

SEQ ID NO: 137660 - RNA, 19 nt, Homo sapiens
gcucggacgcugcaguuau

SEQ ID NO: 137661 - RNA, 19 nt, Homo sapiens
caaagaaaguccggaaacc

SEQ ID NO: 137662 - RNA, 19 nt, Homo sapiens
ggcaaaggccucccuaaaa

SEQ ID NO: 137663 - RNA, 19 nt, Homo sapiens
cucggacgcugcaguuauu

SEQ ID NO: 137664 - RNA, 19 nt, Homo sapiens
ccugaaauucggauaguga

SEQ ID NO: 137665 - RNA, 19 nt, Homo sapiens
uaaaaggccgcauuucuga

SEQ ID NO: 137666 - RNA, 19 nt, Homo sapiens
ggacagcagcuuggcaaag

SEQ ID NO: 137667 - RNA, 19 nt, Homo sapiens
ggagaacucgccagagacu

SEQ ID NO: 137668 - RNA, 19 nt, Homo sapiens
ccaaagaaaguccggaaac

SEQ ID NO: 137669 - RNA, 19 nt, Homo sapiens
gcuaugaccugggcuacac

SEQ ID NO: 137670 - RNA, 19 nt, Homo sapiens
gugcagauuuucccacuga

SEQ ID NO: 137671 - RNA, 19 nt, Homo sapiens
gcucugaggcuucuuucuc

SEQ ID NO: 137672 - RNA, 19 nt, Homo sapiens
gagagcagagaccacuuau

SEQ ID NO: 137673 - RNA, 19 nt, Homo sapiens
agaacucgccagagacuga

SEQ ID NO: 137674 - RNA, 19 nt, Homo sapiens
agucuuuguuguugaaaug

SEQ ID NO: 137675 - RNA, 19 nt, Homo sapiens
uuauuagccuggacuugga

SEQ ID NO: 137676 - RNA, 19 nt, Homo sapiens
ggaggaccuugagccugaa

SEQ ID NO: 137677 - RNA, 19 nt, Homo sapiens
aagcuacugauuuggauuu

SEQ ID NO: 137678 - RNA, 19 nt, Homo sapiens
uaggugccuuugcggauga

SEQ ID NO: 137679 - RNA, 19 nt, Homo sapiens
gacagucuaguggcugaua

SEQ ID NO: 137680 - RNA, 19 nt, Homo sapiens
aagaagauguggaaaagug

SEQ ID NO: 137681 - RNA, 19 nt, Homo sapiens
cacccagacucaggucaaa

SEQ ID NO: 137682 - RNA, 19 nt, Homo sapiens
ugaacgggaagccaaagaa

SEQ ID NO: 137683 - RNA, 19 nt, Homo sapiens
guuguugaaaugaaaggua

SEQ ID NO: 137684 - RNA, 19 nt, Homo sapiens
uuaagcuacugauuuggau

SEQ ID NO: 137685 - RNA, 19 nt, Homo sapiens
ucaagaagauguggaaaag

SEQ ID NO: 137686 - RNA, 19 nt, Homo sapiens
ccaacaacgagccugagaa

SEQ ID NO: 137687 - RNA, 19 nt, Homo sapiens
cuccuacgcucccuaugga

SEQ ID NO: 137688 - RNA, 19 nt, Homo sapiens
gcaccaucuacuccaguuu

SEQ ID NO: 137689 - RNA, 19 nt, Homo sapiens
gccaaagaaaguccggaaa

SEQ ID NO: 137690 - RNA, 19 nt, Homo sapiens
gaccuugagccugaaauuc

SEQ ID NO: 137691 - RNA, 19 nt, Homo sapiens
cagaguuuguaaauaaagg

SEQ ID NO: 137692 - RNA, 19 nt, Homo sapiens
ccagcggccucaacaacgu

SEQ ID NO: 137693 - RNA, 19 nt, Homo sapiens
agagaccacuuauccucau

SEQ ID NO: 137694 - RNA, 19 nt, Homo sapiens
cuucagcggcguuuccaaa

SEQ ID NO: 137695 - RNA, 19 nt, Homo sapiens
gcuacugauuuggauuugu

SEQ ID NO: 137696 - RNA, 19 nt, Homo sapiens
uggagucuuugacagucua

SEQ ID NO: 137697 - RNA, 19 nt, Homo sapiens
caagccagcggccucaaca

SEQ ID NO: 137698 - RNA, 19 nt, Homo sapiens
cccacugauuuauuuguau

SEQ ID NO: 137699 - RNA, 19 nt, Homo sapiens
gccuggacuuggacacaga

SEQ ID NO: 137700 - RNA, 19 nt, Homo sapiens
gccaacaacgagccugaga

SEQ ID NO: 137701 - RNA, 19 nt, Homo sapiens
gaccacuuauccucauugc

SEQ ID NO: 137702 - RNA, 19 nt, Homo sapiens
cagcggcguuuccaaaaga

SEQ ID NO: 137703 - RNA, 19 nt, Homo sapiens
gagccugaaauucggauag

SEQ ID NO: 137704 - RNA, 19 nt, Homo sapiens
ggaaaccccgcaccaucua

SEQ ID NO: 137705 - RNA, 19 nt, Homo sapiens
ucaagaaacucuacaagaa

SEQ ID NO: 137706 - RNA, 19 nt, Homo sapiens
gaaagccgcguacaaucua

SEQ ID NO: 137707 - RNA, 19 nt, Homo sapiens
ucacugaccugggcuacua

SEQ ID NO: 137708 - RNA, 19 nt, Homo sapiens
gagcacagucccaauaaca

SEQ ID NO: 137709 - RNA, 19 nt, Homo sapiens
gcacagucccaauaacagu

SEQ ID NO: 137710 - RNA, 19 nt, Homo sapiens
cgaaagccgcguacaaucu

SEQ ID NO: 137711 - RNA, 19 nt, Homo sapiens
caccaccaauucaaucuca

SEQ ID NO: 137712 - RNA, 19 nt, Homo sapiens
caagaaacucuacaagaac

SEQ ID NO: 137713 - RNA, 19 nt, Homo sapiens
ccaagucggaauauaccua

SEQ ID NO: 137714 - RNA, 19 nt, Homo sapiens
gugauuccauggccugcaa

SEQ ID NO: 137715 - RNA, 19 nt, Homo sapiens
ggagcacagucccaauaac

SEQ ID NO: 137716 - RNA, 19 nt, Homo sapiens
acaccuaccaccaccaauu

SEQ ID NO: 137717 - RNA, 19 nt, Homo sapiens
gcagcauccucaccgacau

SEQ ID NO: 137718 - RNA, 19 nt, Homo sapiens
gcccgagucuucugucacu

SEQ ID NO: 137719 - RNA, 19 nt, Homo sapiens
ccaauaacagugauuccau

SEQ ID NO: 137720 - RNA, 19 nt, Homo sapiens
gacaucuccagcucccuua

SEQ ID NO: 137721 - RNA, 19 nt, Homo sapiens
guacaaucuacuccagcua

SEQ ID NO: 137722 - RNA, 19 nt, Homo sapiens
gaggugcgcauggugaaug

SEQ ID NO: 137723 - RNA, 19 nt, Homo sapiens
uggagcacagucccaauaa

SEQ ID NO: 137724 - RNA, 19 nt, Homo sapiens
cuggagcacagucccaaua

SEQ ID NO: 137725 - RNA, 19 nt, Homo sapiens
aagcagaggugcgcauggu

SEQ ID NO: 137726 - RNA, 19 nt, Homo sapiens
ucgcccaagucggaauaua

SEQ ID NO: 137727 - RNA, 19 nt, Homo sapiens
gaaggaggagccggaagca

SEQ ID NO: 137728 - RNA, 19 nt, Homo sapiens
ccugguaucacgcacagaa

SEQ ID NO: 137729 - RNA, 19 nt, Homo sapiens
ccaccaauucaaucucaau

SEQ ID NO: 137730 - RNA, 19 nt, Homo sapiens
caccuaccaccaccaauuc

SEQ ID NO: 137731 - RNA, 19 nt, Homo sapiens
gaacaaacgcuccaaguau

SEQ ID NO: 137732 - RNA, 19 nt, Homo sapiens
uagaagagaugcagagaaa

SEQ ID NO: 137733 - RNA, 19 nt, Homo sapiens
gaagagaugcagagaaaug

SEQ ID NO: 137734 - RNA, 19 nt, Homo sapiens
aacaaacgcuccaaguaua

SEQ ID NO: 137735 - RNA, 19 nt, Homo sapiens
ggaccucagccuuauauaa

SEQ ID NO: 137736 - RNA, 19 nt, Homo sapiens
gggaggaccuucucugugu

SEQ ID NO: 137737 - RNA, 19 nt, Homo sapiens
gcaagaaacauugaguauu

SEQ ID NO: 137738 - RNA, 19 nt, Homo sapiens
auaagaagcuccugaagca

SEQ ID NO: 137739 - RNA, 19 nt, Homo sapiens
ccucggcgcuuucuuccua

SEQ ID NO: 137740 - RNA, 19 nt, Homo sapiens
gcagacgagaugcaaauaa

SEQ ID NO: 137741 - RNA, 19 nt, Homo sapiens
gaccucagccuuauauaau

SEQ ID NO: 137742 - RNA, 19 nt, Homo sapiens
ggaccuauggguaauuuau

SEQ ID NO: 137743 - RNA, 19 nt, Homo sapiens
gaauggagcagagccugua

SEQ ID NO: 137744 - RNA, 19 nt, Homo sapiens
agaacaaacgcuccaagua

SEQ ID NO: 137745 - RNA, 19 nt, Homo sapiens
cagacgagaugcaaauaag

SEQ ID NO: 137746 - RNA, 19 nt, Homo sapiens
cagcaagaaacauugagua

SEQ ID NO: 137747 - RNA, 19 nt, Homo sapiens
cgagaugcaaauaagcuua

SEQ ID NO: 137748 - RNA, 19 nt, Homo sapiens
gaggaaaccagcuccagau

SEQ ID NO: 137749 - RNA, 19 nt, Homo sapiens
agaacugcgucuuguauca

SEQ ID NO: 137750 - RNA, 19 nt, Homo sapiens
guggaccuauggguaauuu

SEQ ID NO: 137751 - RNA, 19 nt, Homo sapiens
gcaagccgaggaccaucua

SEQ ID NO: 137752 - RNA, 19 nt, Homo sapiens
ccacagccuuccugcaaag

SEQ ID NO: 137753 - RNA, 19 nt, Homo sapiens
acaaacgcuccaaguauaa

SEQ ID NO: 137754 - RNA, 19 nt, Homo sapiens
ccucagccuuauauaauca

SEQ ID NO: 137755 - RNA, 19 nt, Homo sapiens
acaagcaguuagaggagaa

SEQ ID NO: 137756 - RNA, 19 nt, Homo sapiens
gcccacagccuuccugcaa

SEQ ID NO: 137757 - RNA, 19 nt, Homo sapiens
aauuuaugcuuuccuccua

SEQ ID NO: 137758 - RNA, 19 nt, Homo sapiens
guagaagagaugcagagaa

SEQ ID NO: 137759 - RNA, 19 nt, Homo sapiens
ggacugaaucgccacuaca

SEQ ID NO: 137760 - RNA, 19 nt, Homo sapiens
ugauuuaccuacuuaccau

SEQ ID NO: 137761 - RNA, 19 nt, Homo sapiens
cgccucagaugaugugaau

SEQ ID NO: 137762 - RNA, 19 nt, Homo sapiens
agaagcuccugaagcagaa

SEQ ID NO: 137763 - RNA, 19 nt, Homo sapiens
ggaauuuguggaccuaugg

SEQ ID NO: 137764 - RNA, 19 nt, Homo sapiens
uuucuccucucccugcuuu

SEQ ID NO: 137765 - RNA, 19 nt, Homo sapiens
cuucugggcugggaggaaa

SEQ ID NO: 137766 - RNA, 19 nt, Homo sapiens
cccuaacccuaacagcuaa

SEQ ID NO: 137767 - RNA, 19 nt, Homo sapiens
gaccuauggguaauuuaug

SEQ ID NO: 137768 - RNA, 19 nt, Homo sapiens
gauuuaccuacuuaccaua

SEQ ID NO: 137769 - RNA, 19 nt, Homo sapiens
ucacccagacccagguaaa

SEQ ID NO: 137770 - RNA, 19 nt, Homo sapiens
uggcuggaguugagacugu

SEQ ID NO: 137771 - RNA, 19 nt, Homo sapiens
cagaacaaacgcuccaagu

SEQ ID NO: 137772 - RNA, 19 nt, Homo sapiens
cauaacugauuuaccuacu

SEQ ID NO: 137773 - RNA, 19 nt, Homo sapiens
ggccuugcacaacccauuu

SEQ ID NO: 137774 - RNA, 19 nt, Homo sapiens
cccacagccuuccugcaaa

SEQ ID NO: 137775 - RNA, 19 nt, Homo sapiens
agguaaagaucugguuuca

SEQ ID NO: 137776 - RNA, 19 nt, Homo sapiens
uggaauuuguggaccuaug

SEQ ID NO: 137777 - RNA, 19 nt, Homo sapiens
gguagaagagaugcagaga

SEQ ID NO: 137778 - RNA, 19 nt, Homo sapiens
gcuccacgcggaagguaga

SEQ ID NO: 137779 - RNA, 19 nt, Homo sapiens
aaucagcaagaaacauuga

SEQ ID NO: 137780 - RNA, 19 nt, Homo sapiens
uaugaaacuguccguccua

SEQ ID NO: 137781 - RNA, 19 nt, Homo sapiens
gaacaaacgcuccaaguau

SEQ ID NO: 137782 - RNA, 19 nt, Homo sapiens
uagaagagaugcagagaaa

SEQ ID NO: 137783 - RNA, 19 nt, Homo sapiens
gaagagaugcagagaaaug

SEQ ID NO: 137784 - RNA, 19 nt, Homo sapiens
aacaaacgcuccaaguaua

SEQ ID NO: 137785 - RNA, 19 nt, Homo sapiens
ggaccucagccuuauauaa

SEQ ID NO: 137786 - RNA, 19 nt, Homo sapiens
gggaggaccuucucugugu

SEQ ID NO: 137787 - RNA, 19 nt, Homo sapiens
gcaagaaacauugaguauu

SEQ ID NO: 137788 - RNA, 19 nt, Homo sapiens
ugaaagaggcucagagaga

SEQ ID NO: 137789 - RNA, 19 nt, Homo sapiens
auaagaagcuccugaagca

SEQ ID NO: 137790 - RNA, 19 nt, Homo sapiens
gaccucagccuuauauaau

SEQ ID NO: 137791 - RNA, 19 nt, Homo sapiens
ggaccuauggguaauuuau

SEQ ID NO: 137792 - RNA, 19 nt, Homo sapiens
gaauggagcagagccugua

SEQ ID NO: 137793 - RNA, 19 nt, Homo sapiens
agaacaaacgcuccaagua

SEQ ID NO: 137794 - RNA, 19 nt, Homo sapiens
cagcaagaaacauugagua

SEQ ID NO: 137795 - RNA, 19 nt, Homo sapiens
gaggaaaccagcuccagau

SEQ ID NO: 137796 - RNA, 19 nt, Homo sapiens
guggaccuauggguaauuu

SEQ ID NO: 137797 - RNA, 19 nt, Homo sapiens
gcaagccgaggaccaucua

SEQ ID NO: 137798 - RNA, 19 nt, Homo sapiens
ccacagccuuccugcaaag

SEQ ID NO: 137799 - RNA, 19 nt, Homo sapiens
acaaacgcuccaaguauaa

SEQ ID NO: 137800 - RNA, 19 nt, Homo sapiens
ccucagccuuauauaauca

SEQ ID NO: 137801 - RNA, 19 nt, Homo sapiens
acaagcaguuagaggagaa

SEQ ID NO: 137802 - RNA, 19 nt, Homo sapiens
gcccacagccuuccugcaa

SEQ ID NO: 137803 - RNA, 19 nt, Homo sapiens
aauuuaugcuuuccuccua

SEQ ID NO: 137804 - RNA, 19 nt, Homo sapiens
guagaagagaugcagagaa

SEQ ID NO: 137805 - RNA, 19 nt, Homo sapiens
ggacugaaucgccacuaca

SEQ ID NO: 137806 - RNA, 19 nt, Homo sapiens
ugauuuaccuacuuaccau

SEQ ID NO: 137807 - RNA, 19 nt, Homo sapiens
uggccacaaugaccucuuu

SEQ ID NO: 137808 - RNA, 19 nt, Homo sapiens
cgccucagaugaugugaau

SEQ ID NO: 137809 - RNA, 19 nt, Homo sapiens
agaagcuccugaagcagaa

SEQ ID NO: 137810 - RNA, 19 nt, Homo sapiens
gcucagagagacacuuucu

SEQ ID NO: 137811 - RNA, 19 nt, Homo sapiens
ggaauuuguggaccuaugg

SEQ ID NO: 137812 - RNA, 19 nt, Homo sapiens
uuucuccucucccugcuuu

SEQ ID NO: 137813 - RNA, 19 nt, Homo sapiens
cuucugggcugggaggaaa

SEQ ID NO: 137814 - RNA, 19 nt, Homo sapiens
auggccaccuccugucuua

SEQ ID NO: 137815 - RNA, 19 nt, Homo sapiens
ucuccgggaucuuaagugu

SEQ ID NO: 137816 - RNA, 19 nt, Homo sapiens
cccuaacccuaacagcuaa

SEQ ID NO: 137817 - RNA, 19 nt, Homo sapiens
caacgccggaggcuuggaa

SEQ ID NO: 137818 - RNA, 19 nt, Homo sapiens
gaccuauggguaauuuaug

SEQ ID NO: 137819 - RNA, 19 nt, Homo sapiens
gauuuaccuacuuaccaua

SEQ ID NO: 137820 - RNA, 19 nt, Homo sapiens
ucacccagacccagguaaa

SEQ ID NO: 137821 - RNA, 19 nt, Homo sapiens
uggcuggaguugagacugu

SEQ ID NO: 137822 - RNA, 19 nt, Homo sapiens
cagaacaaacgcuccaagu

SEQ ID NO: 137823 - RNA, 19 nt, Homo sapiens
cauaacugauuuaccuacu

SEQ ID NO: 137824 - RNA, 19 nt, Homo sapiens
ggccuugcacaacccauuu

SEQ ID NO: 137825 - RNA, 19 nt, Homo sapiens
cccacagccuuccugcaaa

SEQ ID NO: 137826 - RNA, 19 nt, Homo sapiens
agguaaagaucugguuuca

SEQ ID NO: 137827 - RNA, 19 nt, Homo sapiens
uggaauuuguggaccuaug

SEQ ID NO: 137828 - RNA, 19 nt, Homo sapiens
gguagaagagaugcagaga

SEQ ID NO: 137829 - RNA, 19 nt, Homo sapiens
aaucagcaagaaacauuga

SEQ ID NO: 137830 - RNA, 19 nt, Homo sapiens
cacuuucuccgggaucuua

SEQ ID NO: 137831 - RNA, 19 nt, Homo sapiens
gcagccagcucaaucaauu

SEQ ID NO: 137832 - RNA, 19 nt, Homo sapiens
cagagaagguuucagaaga

SEQ ID NO: 137833 - RNA, 19 nt, Homo sapiens
cguaaacccaggacuauuu

SEQ ID NO: 137834 - RNA, 19 nt, Homo sapiens
caacuuugcccgagucuuc

SEQ ID NO: 137835 - RNA, 19 nt, Homo sapiens
gcuuucagcuggccgcauu

SEQ ID NO: 137836 - RNA, 19 nt, Homo sapiens
caaagcuuaugccgacuau

SEQ ID NO: 137837 - RNA, 19 nt, Homo sapiens
ucgcugggauugacacaaa

SEQ ID NO: 137838 - RNA, 19 nt, Homo sapiens
gaauggcaaaccaaagaaa

SEQ ID NO: 137839 - RNA, 19 nt, Homo sapiens
gacuauuuauuccagcuuu

SEQ ID NO: 137840 - RNA, 19 nt, Homo sapiens
gaagguuucagaagacuca

SEQ ID NO: 137841 - RNA, 19 nt, Homo sapiens
uuacagagaagguuucaga

SEQ ID NO: 137842 - RNA, 19 nt, Homo sapiens
ccaaagaaaguucguaaac

SEQ ID NO: 137843 - RNA, 19 nt, Homo sapiens
gugaauggcaaaccaaaga

SEQ ID NO: 137844 - RNA, 19 nt, Homo sapiens
gcgacccaauggcguguaa

SEQ ID NO: 137845 - RNA, 19 nt, Homo sapiens
ccaaccagccagagaaaga

SEQ ID NO: 137846 - RNA, 19 nt, Homo sapiens
caaagaaaguucguaaacc

SEQ ID NO: 137847 - RNA, 19 nt, Homo sapiens
ucucaggaaucgccaacuu

SEQ ID NO: 137848 - RNA, 19 nt, Homo sapiens
guucguaaacccaggacua

SEQ ID NO: 137849 - RNA, 19 nt, Homo sapiens
aaacccaggacuauuuauu

SEQ ID NO: 137850 - RNA, 19 nt, Homo sapiens
gagaauggugaauggcaaa

SEQ ID NO: 137851 - RNA, 19 nt, Homo sapiens
ccuccgggacacucuauua

SEQ ID NO: 137852 - RNA, 19 nt, Homo sapiens
gacaggaguguuugacaga

SEQ ID NO: 137853 - RNA, 19 nt, Homo sapiens
ucaggaaucgccaacuuug

SEQ ID NO: 137854 - RNA, 19 nt, Homo sapiens
ccaccaaccagccagagaa

SEQ ID NO: 137855 - RNA, 19 nt, Homo sapiens
caccauccgucucaggaau

SEQ ID NO: 137856 - RNA, 19 nt, Homo sapiens
ccaaagcuuaugccgacua

SEQ ID NO: 137857 - RNA, 19 nt, Homo sapiens
aaacacaggugaaaaucug

SEQ ID NO: 137858 - RNA, 19 nt, Homo sapiens
gacacaaacacaggugaaa

SEQ ID NO: 137859 - RNA, 19 nt, Homo sapiens
gguuucagaagacucagua

SEQ ID NO: 137860 - RNA, 19 nt, Homo sapiens
gagaagguuucagaagacu

SEQ ID NO: 137861 - RNA, 19 nt, Homo sapiens
gaggugagaauggugaaug

SEQ ID NO: 137862 - RNA, 19 nt, Homo sapiens
caaccagccagagaaagaa

SEQ ID NO: 137863 - RNA, 19 nt, Homo sapiens
aagcuuaugccgacuauag

SEQ ID NO: 137864 - RNA, 19 nt, Homo sapiens
cuaccgauucugacuacua

SEQ ID NO: 137865 - RNA, 19 nt, Homo sapiens
agagaagguuucagaagac

SEQ ID NO: 137866 - RNA, 19 nt, Homo sapiens
aaccaaagaaaguucguaa

SEQ ID NO: 137867 - RNA, 19 nt, Homo sapiens
cauccgauccggcgacuuc

SEQ ID NO: 137868 - RNA, 19 nt, Homo sapiens
gcuacccagccaaagcuua

SEQ ID NO: 137869 - RNA, 19 nt, Homo sapiens
gcaccauccgucucaggaa

SEQ ID NO: 137870 - RNA, 19 nt, Homo sapiens
ugacacaaacacaggugaa

SEQ ID NO: 137871 - RNA, 19 nt, Homo sapiens
acaggaguguuugacagaa

SEQ ID NO: 137872 - RNA, 19 nt, Homo sapiens
cagcuggccgcauuacaga

SEQ ID NO: 137873 - RNA, 19 nt, Homo sapiens
caggaguguuugacagaag

SEQ ID NO: 137874 - RNA, 19 nt, Homo sapiens
ugaauggcaaaccaaagaa

SEQ ID NO: 137875 - RNA, 19 nt, Homo sapiens
gcuggccgcauuacagaga

SEQ ID NO: 137876 - RNA, 19 nt, Homo sapiens
ccagacguccgcagcuaug

SEQ ID NO: 137877 - RNA, 19 nt, Homo sapiens
cagcuaccgauucugacua

SEQ ID NO: 137878 - RNA, 19 nt, Homo sapiens
cuacccagccaaagcuuau

SEQ ID NO: 137879 - RNA, 19 nt, Homo sapiens
uaccgauucugacuacuac

SEQ ID NO: 137880 - RNA, 19 nt, Homo sapiens
gcauuacagagaagguuuc

SEQ ID NO: 137881 - RNA, 19 nt, Homo sapiens
ggacuauuuauuccagcuu

SEQ ID NO: 137882 - RNA, 19 nt, Homo sapiens
caccaaccagccagagaaa

SEQ ID NO: 137883 - RNA, 19 nt, Homo sapiens
uggcaaaccaaagaaaguu

SEQ ID NO: 137884 - RNA, 19 nt, Homo sapiens
gaaaucagguucaauggaa

SEQ ID NO: 137885 - RNA, 19 nt, Homo sapiens
aaacacaggugaagauaug

SEQ ID NO: 137886 - RNA, 19 nt, Homo sapiens
ggaagccucggaccauuua

SEQ ID NO: 137887 - RNA, 19 nt, Homo sapiens
gcccuuaccuccaguccua

SEQ ID NO: 137888 - RNA, 19 nt, Homo sapiens
gauaugguuucagaacaaa

SEQ ID NO: 137889 - RNA, 19 nt, Homo sapiens
ggacgacacagaucaacaa

SEQ ID NO: 137890 - RNA, 19 nt, Homo sapiens
cgaacuggcagcuuccuua

SEQ ID NO: 137891 - RNA, 19 nt, Homo sapiens
cuacaugccuggcuauucu

SEQ ID NO: 137892 - RNA, 19 nt, Homo sapiens
gaagauaugguuucagaac

SEQ ID NO: 137893 - RNA, 19 nt, Homo sapiens
ggaaaucagguucaaugga

SEQ ID NO: 137894 - RNA, 19 nt, Homo sapiens
gcagagaccacagaugaug

SEQ ID NO: 137895 - RNA, 19 nt, Homo sapiens
ggccaagggugucaguaug

SEQ ID NO: 137896 - RNA, 19 nt, Homo sapiens
gcuccaggcuuuaaaccau

SEQ ID NO: 137897 - RNA, 19 nt, Homo sapiens
agauaugguuucagaacaa

SEQ ID NO: 137898 - RNA, 19 nt, Homo sapiens
agaacaaacgcucuaaguu

SEQ ID NO: 137899 - RNA, 19 nt, Homo sapiens
gaacuggcagcuuccuuag

SEQ ID NO: 137900 - RNA, 19 nt, Homo sapiens
gcuuucagcagacacagua

SEQ ID NO: 137901 - RNA, 19 nt, Homo sapiens
caaacacaggugaagauau

SEQ ID NO: 137902 - RNA, 19 nt, Homo sapiens
cagaacaaacgcucuaagu

SEQ ID NO: 137903 - RNA, 19 nt, Homo sapiens
acaaacacaggugaagaua

SEQ ID NO: 137904 - RNA, 19 nt, Homo sapiens
aaaucagguucaauggaaa

SEQ ID NO: 137905 - RNA, 19 nt, Homo sapiens
aagauaugguuucagaaca

SEQ ID NO: 137906 - RNA, 19 nt, Homo sapiens
augcagagaccacagauga

SEQ ID NO: 137907 - RNA, 19 nt, Homo sapiens
gggcaguaauccucaugag

SEQ ID NO: 137908 - RNA, 19 nt, Homo sapiens
ggcaguaauccucaugaga

SEQ ID NO: 137909 - RNA, 19 nt, Homo sapiens
gcagggcaguaauccucau

SEQ ID NO: 137910 - RNA, 19 nt, Homo sapiens
cacaaacacaggugaagau

SEQ ID NO: 137911 - RNA, 19 nt, Homo sapiens
ggcuuuaaaccaucgcuuu

SEQ ID NO: 137912 - RNA, 19 nt, Homo sapiens
ugacacaaacacaggugaa

SEQ ID NO: 137913 - RNA, 19 nt, Homo sapiens
cggaagccucggaccauuu

SEQ ID NO: 137914 - RNA, 19 nt, Homo sapiens
gacgacacagaucaacaaa

SEQ ID NO: 137915 - RNA, 19 nt, Homo sapiens
gcuuuaaaccaucgcuuuc

SEQ ID NO: 137916 - RNA, 19 nt, Homo sapiens
acacaaacacaggugaaga

SEQ ID NO: 137917 - RNA, 19 nt, Homo sapiens
ccuuaggacugacacaaac

SEQ ID NO: 137918 - RNA, 19 nt, Homo sapiens
ucggaagccucggaccauu

SEQ ID NO: 137919 - RNA, 19 nt, Homo sapiens
gcuacaugccuggcuauuc

SEQ ID NO: 137920 - RNA, 19 nt, Homo sapiens
ggacagaccuccguauuca

SEQ ID NO: 137921 - RNA, 19 nt, Homo sapiens
gaagguggcugcaacuaug

SEQ ID NO: 137922 - RNA, 19 nt, Homo sapiens
gggaaaaucuguaaugaua

SEQ ID NO: 137923 - RNA, 19 nt, Homo sapiens
ggagucaacuguagcagaa

SEQ ID NO: 137924 - RNA, 19 nt, Homo sapiens
ggagucaacuguagcagaa

SEQ ID NO: 137925 - RNA, 19 nt, Homo sapiens
ccaaugacuucacgucuuu

SEQ ID NO: 137926 - RNA, 19 nt, Homo sapiens
agacuacgcuucacugauu

SEQ ID NO: 137927 - RNA, 19 nt, Homo sapiens
ggaucaaacuguagcagaa

SEQ ID NO: 137928 - RNA, 19 nt, Homo sapiens
gaauucugguuaucgcaua

SEQ ID NO: 137929 - RNA, 19 nt, Homo sapiens
gcucaggacacgagucuua

SEQ ID NO: 137930 - RNA, 19 nt, Homo sapiens
gcucaggacacgagucuua

SEQ ID NO: 137931 - RNA, 19 nt, Homo sapiens
gcaccaaccugcucugucu

SEQ ID NO: 137932 - RNA, 19 nt, Homo sapiens
gauaccaggcaaauauuua

SEQ ID NO: 137933 - RNA, 19 nt, Homo sapiens
cgaagacgcuggugucauc

SEQ ID NO: 137934 - RNA, 19 nt, Homo sapiens
ugagaggguuacuuacaua

SEQ ID NO: 137935 - RNA, 19 nt, Homo sapiens
ccagaaaguuggccuguca

SEQ ID NO: 137936 - RNA, 19 nt, Homo sapiens
ucacgucuuugacuuauga

SEQ ID NO: 137937 - RNA, 19 nt, Homo sapiens
uauagcagcagcagaaaua

SEQ ID NO: 137938 - RNA, 19 nt, Homo sapiens
ucagagauguccagcuuga

SEQ ID NO: 137939 - RNA, 19 nt, Homo sapiens
aaauugugguggcuucuua

SEQ ID NO: 137940 - RNA, 19 nt, Homo sapiens
ggacaccaaugaugccaau

SEQ ID NO: 137941 - RNA, 19 nt, Homo sapiens
ugaagacgcuggugucauc

SEQ ID NO: 137942 - RNA, 19 nt, Homo sapiens
ggacaccaaugaugccaau

SEQ ID NO: 137943 - RNA, 19 nt, Homo sapiens
ugaagacgcuggugucauc

SEQ ID NO: 137944 - RNA, 19 nt, Homo sapiens
ggacaccaaugaugccaau

SEQ ID NO: 137945 - RNA, 19 nt, Homo sapiens
ugaagacgcuggugucauc

SEQ ID NO: 137946 - RNA, 19 nt, Homo sapiens
ggacaccaaugaugccaau

SEQ ID NO: 137947 - RNA, 19 nt, Homo sapiens
ugaagacgcuggugucauc

SEQ ID NO: 137948 - RNA, 19 nt, Homo sapiens
ugaagacgcuggugucauc

SEQ ID NO: 137949 - RNA, 19 nt, Homo sapiens
ggacaccaaugaugccaau

SEQ ID NO: 137950 - RNA, 19 nt, Homo sapiens
gaagugaauucugguuauc

SEQ ID NO: 137951 - RNA, 19 nt, Homo sapiens
gcccuuggaucaaacugua

SEQ ID NO: 137952 - RNA, 19 nt, Homo sapiens
gcagaaugcuucagaacac

SEQ ID NO: 137953 - RNA, 19 nt, Homo sapiens
uaaguguguuugggaaaua

SEQ ID NO: 137954 - RNA, 19 nt, Homo sapiens
gaggguuacuuacauaaag

SEQ ID NO: 137955 - RNA, 19 nt, Homo sapiens
gaaauccuccauucugaug

SEQ ID NO: 137956 - RNA, 19 nt, Homo sapiens
caaaacaacuaccguguga

SEQ ID NO: 137957 - RNA, 19 nt, Homo sapiens
ggugucaucugcucaggaa

SEQ ID NO: 137958 - RNA, 19 nt, Homo sapiens
caugucagcuccaggaaau

SEQ ID NO: 137959 - RNA, 19 nt, Homo sapiens
gaggugcccuuggaucaaa

SEQ ID NO: 137960 - RNA, 19 nt, Homo sapiens
ugagguuggucaauuuaaa

SEQ ID NO: 137961 - RNA, 19 nt, Homo sapiens
ggacaccagugacgccaau

SEQ ID NO: 137962 - RNA, 19 nt, Homo sapiens
gaauggauacuacgagugu

SEQ ID NO: 137963 - RNA, 19 nt, Homo sapiens
caacuguaaucaucgugaa

SEQ ID NO: 137964 - RNA, 19 nt, Homo sapiens
ugaagaugcugguguuauc

SEQ ID NO: 137965 - RNA, 19 nt, Homo sapiens
ccauccacguugcuaauaa

SEQ ID NO: 137966 - RNA, 19 nt, Homo sapiens
cgccgaaccuggugauauu

SEQ ID NO: 137967 - RNA, 19 nt, Homo sapiens
ccacagucauccuugaaau

SEQ ID NO: 137968 - RNA, 19 nt, Homo sapiens
gccagaggcuccuucacuu

SEQ ID NO: 137969 - RNA, 19 nt, Homo sapiens
ugacugugaucuucagaga

SEQ ID NO: 137970 - RNA, 19 nt, Homo sapiens
caacuuaccggcauugaca

SEQ ID NO: 137971 - RNA, 19 nt, Homo sapiens
caucgacuauuccaacuuc

SEQ ID NO: 137972 - RNA, 19 nt, Homo sapiens
gaccacagcaucacaagga

SEQ ID NO: 137973 - RNA, 19 nt, Homo sapiens
gaccugacgucccagaauc

SEQ ID NO: 137974 - RNA, 19 nt, Homo sapiens
gaagugacaucaguuucca

SEQ ID NO: 137975 - RNA, 19 nt, Homo sapiens
guugaaaucuuugauggau

SEQ ID NO: 137976 - RNA, 19 nt, Homo sapiens
cauccuacccugcauacua

SEQ ID NO: 137977 - RNA, 19 nt, Homo sapiens
uaaauucuacuacgacaga

SEQ ID NO: 137978 - RNA, 19 nt, Homo sapiens
gcucagccacccaaauaaa

SEQ ID NO: 137979 - RNA, 19 nt, Homo sapiens
cccaggaaaugcccaguuu

SEQ ID NO: 137980 - RNA, 19 nt, Homo sapiens
ggaccugaauccaguuugg

SEQ ID NO: 137981 - RNA, 19 nt, Homo sapiens
cccaggaaaugcccaguuu

SEQ ID NO: 137982 - RNA, 19 nt, Homo sapiens
ggugucauauuccaacuca

SEQ ID NO: 137983 - RNA, 19 nt, Homo sapiens
cuucagagauguccagcuu

SEQ ID NO: 137984 - RNA, 19 nt, Homo sapiens
gaugacuccuggaccauuc

SEQ ID NO: 137985 - RNA, 19 nt, Homo sapiens
gaaguccaguauggcaauu

SEQ ID NO: 137986 - RNA, 19 nt, Homo sapiens
ucucauugcucgaguuugu

SEQ ID NO: 137987 - RNA, 19 nt, Homo sapiens
ggaacuauccaaacaaugc

SEQ ID NO: 137988 - RNA, 19 nt, Homo sapiens
ggugucaucugcucagcuu

SEQ ID NO: 137989 - RNA, 19 nt, Homo sapiens
ggugucaucugcucagcuu

SEQ ID NO: 137990 - RNA, 19 nt, Homo sapiens
ggugucaucugcucagcuu

SEQ ID NO: 137991 - RNA, 19 nt, Homo sapiens
guucagggccuuccacuuc

SEQ ID NO: 137992 - RNA, 19 nt, Homo sapiens
cugaaauccuccauucuga

SEQ ID NO: 137993 - RNA, 19 nt, Homo sapiens
gaaccaggacuuguacguu

SEQ ID NO: 137994 - RNA, 19 nt, Homo sapiens
caaacaaugccaagugugu

SEQ ID NO: 137995 - RNA, 19 nt, Homo sapiens
gaauccaguuuggcucuga

SEQ ID NO: 137996 - RNA, 19 nt, Homo sapiens
gccaaccucucgugcauca

SEQ ID NO: 137997 - RNA, 19 nt, Homo sapiens
gagaggguuacuuacauaa

SEQ ID NO: 137998 - RNA, 19 nt, Homo sapiens
caacaucacccguccaaac

SEQ ID NO: 137999 - RNA, 19 nt, Homo sapiens
aaugauaccaggcaaauau

SEQ ID NO: 138000 - RNA, 19 nt, Homo sapiens
gaaauuggaggcacaccau

SEQ ID NO: 138001 - RNA, 19 nt, Homo sapiens
gaguggagguccuguaucg

SEQ ID NO: 138002 - RNA, 19 nt, Homo sapiens
gaguggagguccuauacca

SEQ ID NO: 138003 - RNA, 19 nt, Homo sapiens
gaguggagguccuauacca

SEQ ID NO: 138004 - RNA, 19 nt, Homo sapiens
ucaagcaggcagacaauga

SEQ ID NO: 138005 - RNA, 19 nt, Homo sapiens
gaccucacaugcaucaaca

SEQ ID NO: 138006 - RNA, 19 nt, Homo sapiens
ccauugcccuggaugaugu

SEQ ID NO: 138007 - RNA, 19 nt, Homo sapiens
agaaauauaccacccuaga

SEQ ID NO: 138008 - RNA, 19 nt, Homo sapiens
aaccugggcuucaguaauc

SEQ ID NO: 138009 - RNA, 19 nt, Homo sapiens
gaaauauaccacccuagag

SEQ ID NO: 138010 - RNA, 19 nt, Homo sapiens
caacuguggccaucaugaa

SEQ ID NO: 138011 - RNA, 19 nt, Homo sapiens
caacuguggccaucaugaa

SEQ ID NO: 138012 - RNA, 19 nt, Homo sapiens
caacuguggccaucaugaa

SEQ ID NO: 138013 - RNA, 19 nt, Homo sapiens
gcugaaauccuccauucug

SEQ ID NO: 138014 - RNA, 19 nt, Homo sapiens
acaaugacaccaucgacua

SEQ ID NO: 138015 - RNA, 19 nt, Homo sapiens
gcauaaaccugggcuucag

SEQ ID NO: 138016 - RNA, 19 nt, Homo sapiens
gggacaaguucuaucuaca

SEQ ID NO: 138017 - RNA, 19 nt, Homo sapiens
cauacggaguugaaucaga

SEQ ID NO: 138018 - RNA, 19 nt, Homo sapiens
uagcagcagcagaaauaua

SEQ ID NO: 138019 - RNA, 19 nt, Homo sapiens
caacuguggccaucacgaa

SEQ ID NO: 138020 - RNA, 19 nt, Homo sapiens
ggacagaccuccguauuca

SEQ ID NO: 138021 - RNA, 19 nt, Homo sapiens
gaagguggcugcaacuaug

SEQ ID NO: 138022 - RNA, 19 nt, Homo sapiens
gggaaaaucuguaaugaua

SEQ ID NO: 138023 - RNA, 19 nt, Homo sapiens
ggagucaacuguagcagaa

SEQ ID NO: 138024 - RNA, 19 nt, Homo sapiens
ggagucaacuguagcagaa

SEQ ID NO: 138025 - RNA, 19 nt, Homo sapiens
ccaaugacuucacgucuuu

SEQ ID NO: 138026 - RNA, 19 nt, Homo sapiens
agacuacgcuucacugauu

SEQ ID NO: 138027 - RNA, 19 nt, Homo sapiens
ggugucaucugcucaguuu

SEQ ID NO: 138028 - RNA, 19 nt, Homo sapiens
ggaucaaacuguagcagaa

SEQ ID NO: 138029 - RNA, 19 nt, Homo sapiens
gaauucugguuaucgcaua

SEQ ID NO: 138030 - RNA, 19 nt, Homo sapiens
gcucaggacacgagucuua

SEQ ID NO: 138031 - RNA, 19 nt, Homo sapiens
gcucaggacacgagucuua

SEQ ID NO: 138032 - RNA, 19 nt, Homo sapiens
gcaccaaccugcucugucu

SEQ ID NO: 138033 - RNA, 19 nt, Homo sapiens
gauaccaggcaaauauuua

SEQ ID NO: 138034 - RNA, 19 nt, Homo sapiens
cgaagacgcuggugucauc

SEQ ID NO: 138035 - RNA, 19 nt, Homo sapiens
ugagaggguuacuuacaua

SEQ ID NO: 138036 - RNA, 19 nt, Homo sapiens
ccagaaaguuggccuguca

SEQ ID NO: 138037 - RNA, 19 nt, Homo sapiens
ucacgucuuugacuuauga

SEQ ID NO: 138038 - RNA, 19 nt, Homo sapiens
uauagcagcagcagaaaua

SEQ ID NO: 138039 - RNA, 19 nt, Homo sapiens
ucagagauguccagcuuga

SEQ ID NO: 138040 - RNA, 19 nt, Homo sapiens
aaauugugguggcuucuua

SEQ ID NO: 138041 - RNA, 19 nt, Homo sapiens
ggacaccaaugaugccaau

SEQ ID NO: 138042 - RNA, 19 nt, Homo sapiens
ugaagacgcuggugucauc

SEQ ID NO: 138043 - RNA, 19 nt, Homo sapiens
ggacaccaaugaugccaau

SEQ ID NO: 138044 - RNA, 19 nt, Homo sapiens
ugaagacgcuggugucauc

SEQ ID NO: 138045 - RNA, 19 nt, Homo sapiens
ggacaccaaugaugccaau

SEQ ID NO: 138046 - RNA, 19 nt, Homo sapiens
ugaagacgcuggugucauc

SEQ ID NO: 138047 - RNA, 19 nt, Homo sapiens
ggacaccaaugaugccaau

SEQ ID NO: 138048 - RNA, 19 nt, Homo sapiens
ugaagacgcuggugucauc

SEQ ID NO: 138049 - RNA, 19 nt, Homo sapiens
ggacaccaaugaugccaau

SEQ ID NO: 138050 - RNA, 19 nt, Homo sapiens
ugaagacgcuggugucauc

SEQ ID NO: 138051 - RNA, 19 nt, Homo sapiens
ggacaccaaugaugccaau

SEQ ID NO: 138052 - RNA, 19 nt, Homo sapiens
ugaagacgcuggugucauc

SEQ ID NO: 138053 - RNA, 19 nt, Homo sapiens
ggacaccaaugaugccaau

SEQ ID NO: 138054 - RNA, 19 nt, Homo sapiens
ugaagacgcuggugucauc

SEQ ID NO: 138055 - RNA, 19 nt, Homo sapiens
ugaagacgcuggugucauc

SEQ ID NO: 138056 - RNA, 19 nt, Homo sapiens
ggacaccaaugaugccaau

SEQ ID NO: 138057 - RNA, 19 nt, Homo sapiens
gaagugaauucugguuauc

SEQ ID NO: 138058 - RNA, 19 nt, Homo sapiens
gcccuuggaucaaacugua

SEQ ID NO: 138059 - RNA, 19 nt, Homo sapiens
gcagaaugcuucagaacac

SEQ ID NO: 138060 - RNA, 19 nt, Homo sapiens
uaaguguguuugggaaaua

SEQ ID NO: 138061 - RNA, 19 nt, Homo sapiens
ggaaugaguccuacuugug

SEQ ID NO: 138062 - RNA, 19 nt, Homo sapiens
gaggguuacuuacauaaag

SEQ ID NO: 138063 - RNA, 19 nt, Homo sapiens
gaaauccuccauucugaug

SEQ ID NO: 138064 - RNA, 19 nt, Homo sapiens
caaaacaacuaccguguga

SEQ ID NO: 138065 - RNA, 19 nt, Homo sapiens
ggugucaucugcucaggaa

SEQ ID NO: 138066 - RNA, 19 nt, Homo sapiens
caugucagcuccaggaaau

SEQ ID NO: 138067 - RNA, 19 nt, Homo sapiens
gaggugcccuuggaucaaa

SEQ ID NO: 138068 - RNA, 19 nt, Homo sapiens
ugagguuggucaauuuaaa

SEQ ID NO: 138069 - RNA, 19 nt, Homo sapiens
ggacaccagugacgccaau

SEQ ID NO: 138070 - RNA, 19 nt, Homo sapiens
ggacaccagugacgccaau

SEQ ID NO: 138071 - RNA, 19 nt, Homo sapiens
gaauggauacuacgagugu

SEQ ID NO: 138072 - RNA, 19 nt, Homo sapiens
caacuguaaucaucgugaa

SEQ ID NO: 138073 - RNA, 19 nt, Homo sapiens
ugaagaugcugguguuauc

SEQ ID NO: 138074 - RNA, 19 nt, Homo sapiens
ccauccacguugcuaauaa

SEQ ID NO: 138075 - RNA, 19 nt, Homo sapiens
cgccgaaccuggugauauu

SEQ ID NO: 138076 - RNA, 19 nt, Homo sapiens
ccacagucauccuugaaau

SEQ ID NO: 138077 - RNA, 19 nt, Homo sapiens
gggaaugaguccuacuugu

SEQ ID NO: 138078 - RNA, 19 nt, Homo sapiens
gccagaggcuccuucacuu

SEQ ID NO: 138079 - RNA, 19 nt, Homo sapiens
ugacugugaucuucagaga

SEQ ID NO: 138080 - RNA, 19 nt, Homo sapiens
caacuuaccggcauugaca

SEQ ID NO: 138081 - RNA, 19 nt, Homo sapiens
caucgacuauuccaacuuc

SEQ ID NO: 138082 - RNA, 19 nt, Homo sapiens
gaccacagcaucacaagga

SEQ ID NO: 138083 - RNA, 19 nt, Homo sapiens
gaugacagcugggauacca

SEQ ID NO: 138084 - RNA, 19 nt, Homo sapiens
gaccugacgucccagaauc

SEQ ID NO: 138085 - RNA, 19 nt, Homo sapiens
gaagugacaucaguuucca

SEQ ID NO: 138086 - RNA, 19 nt, Homo sapiens
guugaaaucuuugauggau

SEQ ID NO: 138087 - RNA, 19 nt, Homo sapiens
cauccuacccugcauacua

SEQ ID NO: 138088 - RNA, 19 nt, Homo sapiens
uaaauucuacuacgacaga

SEQ ID NO: 138089 - RNA, 19 nt, Homo sapiens
gcucagccacccaaauaaa

SEQ ID NO: 138090 - RNA, 19 nt, Homo sapiens
cccaggaaaugcccaguuu

SEQ ID NO: 138091 - RNA, 19 nt, Homo sapiens
ggaccugaauccaguuugg

SEQ ID NO: 138092 - RNA, 19 nt, Homo sapiens
ggaccugaauccaguuugg

SEQ ID NO: 138093 - RNA, 19 nt, Homo sapiens
cccaggaaaugcccaguuu

SEQ ID NO: 138094 - RNA, 19 nt, Homo sapiens
ggugucauauuccaacuca

SEQ ID NO: 138095 - RNA, 19 nt, Homo sapiens
cuucagagauguccagcuu

SEQ ID NO: 138096 - RNA, 19 nt, Homo sapiens
gaugacuccuggaccauuc

SEQ ID NO: 138097 - RNA, 19 nt, Homo sapiens
ucccauaacuguggccaua

SEQ ID NO: 138098 - RNA, 19 nt, Homo sapiens
gaaguccaguauggcaauu

SEQ ID NO: 138099 - RNA, 19 nt, Homo sapiens
ucucauugcucgaguuugu

SEQ ID NO: 138100 - RNA, 19 nt, Homo sapiens
ggaacuauccaaacaaugc

SEQ ID NO: 138101 - RNA, 19 nt, Homo sapiens
ggugucaucugcucagcuu

SEQ ID NO: 138102 - RNA, 19 nt, Homo sapiens
ggugucaucugcucagcuu

SEQ ID NO: 138103 - RNA, 19 nt, Homo sapiens
ggugucaucugcucagcuu

SEQ ID NO: 138104 - RNA, 19 nt, Homo sapiens
ggugucaucugcucagcuu

SEQ ID NO: 138105 - RNA, 19 nt, Homo sapiens
guucagggccuuccacuuc

SEQ ID NO: 138106 - RNA, 19 nt, Homo sapiens
cugaaauccuccauucuga

SEQ ID NO: 138107 - RNA, 19 nt, Homo sapiens
gaaccaggacuuguacguu

SEQ ID NO: 138108 - RNA, 19 nt, Homo sapiens
caaacaaugccaagugugu

SEQ ID NO: 138109 - RNA, 19 nt, Homo sapiens
gaauccaguuuggcucuga

SEQ ID NO: 138110 - RNA, 19 nt, Homo sapiens
gccaaccucucgugcauca

SEQ ID NO: 138111 - RNA, 19 nt, Homo sapiens
gagaggguuacuuacauaa

SEQ ID NO: 138112 - RNA, 19 nt, Homo sapiens
caacaucacccguccaaac

SEQ ID NO: 138113 - RNA, 19 nt, Homo sapiens
aaugauaccaggcaaauau

SEQ ID NO: 138114 - RNA, 19 nt, Homo sapiens
gaaauuggaggcacaccau

SEQ ID NO: 138115 - RNA, 19 nt, Homo sapiens
gaguggagguccuguaucg

SEQ ID NO: 138116 - RNA, 19 nt, Homo sapiens
gaguggagguccuauacca

SEQ ID NO: 138117 - RNA, 19 nt, Homo sapiens
gaguggagguccuauacca

SEQ ID NO: 138118 - RNA, 19 nt, Homo sapiens
ggauaccaaugaugccaau

SEQ ID NO: 138119 - RNA, 19 nt, Homo sapiens
ucaagcaggcagacaauga

SEQ ID NO: 138120 - RNA, 19 nt, Homo sapiens
ggacagaccuccguauuca

SEQ ID NO: 138121 - RNA, 19 nt, Homo sapiens
gaagguggcugcaacuaug

SEQ ID NO: 138122 - RNA, 19 nt, Homo sapiens
gggaaaaucuguaaugaua

SEQ ID NO: 138123 - RNA, 19 nt, Homo sapiens
ggagucaacuguagcagaa

SEQ ID NO: 138124 - RNA, 19 nt, Homo sapiens
ggagucaacuguagcagaa

SEQ ID NO: 138125 - RNA, 19 nt, Homo sapiens
ccaaugacuucacgucuuu

SEQ ID NO: 138126 - RNA, 19 nt, Homo sapiens
agacuacgcuucacugauu

SEQ ID NO: 138127 - RNA, 19 nt, Homo sapiens
ggugucaucugcucaguuu

SEQ ID NO: 138128 - RNA, 19 nt, Homo sapiens
gaauucugguuaucgcaua

SEQ ID NO: 138129 - RNA, 19 nt, Homo sapiens
gcucaggacacgagucuua

SEQ ID NO: 138130 - RNA, 19 nt, Homo sapiens
gcucaggacacgagucuua

SEQ ID NO: 138131 - RNA, 19 nt, Homo sapiens
gcaccaaccugcucugucu

SEQ ID NO: 138132 - RNA, 19 nt, Homo sapiens
gauaccaggcaaauauuua

SEQ ID NO: 138133 - RNA, 19 nt, Homo sapiens
cgaagacgcuggugucauc

SEQ ID NO: 138134 - RNA, 19 nt, Homo sapiens
ugagaggguuacuuacaua

SEQ ID NO: 138135 - RNA, 19 nt, Homo sapiens
ccagaaaguuggccuguca

SEQ ID NO: 138136 - RNA, 19 nt, Homo sapiens
ucacgucuuugacuuauga

SEQ ID NO: 138137 - RNA, 19 nt, Homo sapiens
uauagcagcagcagaaaua

SEQ ID NO: 138138 - RNA, 19 nt, Homo sapiens
ucagagauguccagcuuga

SEQ ID NO: 138139 - RNA, 19 nt, Homo sapiens
aaauugugguggcuucuua

SEQ ID NO: 138140 - RNA, 19 nt, Homo sapiens
ggacaccaaugaugccaau

SEQ ID NO: 138141 - RNA, 19 nt, Homo sapiens
ugaagacgcuggugucauc

SEQ ID NO: 138142 - RNA, 19 nt, Homo sapiens
ggacaccaaugaugccaau

SEQ ID NO: 138143 - RNA, 19 nt, Homo sapiens
ugaagacgcuggugucauc

SEQ ID NO: 138144 - RNA, 19 nt, Homo sapiens
ggacaccaaugaugccaau

SEQ ID NO: 138145 - RNA, 19 nt, Homo sapiens
ugaagacgcuggugucauc

SEQ ID NO: 138146 - RNA, 19 nt, Homo sapiens
ggacaccaaugaugccaau

SEQ ID NO: 138147 - RNA, 19 nt, Homo sapiens
ugaagacgcuggugucauc

SEQ ID NO: 138148 - RNA, 19 nt, Homo sapiens
ggacaccaaugaugccaau

SEQ ID NO: 138149 - RNA, 19 nt, Homo sapiens
ugaagacgcuggugucauc

SEQ ID NO: 138150 - RNA, 19 nt, Homo sapiens
ggacaccaaugaugccaau

SEQ ID NO: 138151 - RNA, 19 nt, Homo sapiens
ugaagacgcuggugucauc

SEQ ID NO: 138152 - RNA, 19 nt, Homo sapiens
ggacaccaaugaugccaau

SEQ ID NO: 138153 - RNA, 19 nt, Homo sapiens
ugaagacgcuggugucauc

SEQ ID NO: 138154 - RNA, 19 nt, Homo sapiens
ugaagacgcuggugucauc

SEQ ID NO: 138155 - RNA, 19 nt, Homo sapiens
ggacaccaaugaugccaau

SEQ ID NO: 138156 - RNA, 19 nt, Homo sapiens
gaagugaauucugguuauc

SEQ ID NO: 138157 - RNA, 19 nt, Homo sapiens
gcagaaugcuucagaacac

SEQ ID NO: 138158 - RNA, 19 nt, Homo sapiens
uaaguguguuugggaaaua

SEQ ID NO: 138159 - RNA, 19 nt, Homo sapiens
ggaaugaguccuacuugug

SEQ ID NO: 138160 - RNA, 19 nt, Homo sapiens
gaggguuacuuacauaaag

SEQ ID NO: 138161 - RNA, 19 nt, Homo sapiens
gaaauccuccauucugaug

SEQ ID NO: 138162 - RNA, 19 nt, Homo sapiens
caaaacaacuaccguguga

SEQ ID NO: 138163 - RNA, 19 nt, Homo sapiens
ggugucaucugcucaggaa

SEQ ID NO: 138164 - RNA, 19 nt, Homo sapiens
caugucagcuccaggaaau

SEQ ID NO: 138165 - RNA, 19 nt, Homo sapiens
ugagguuggucaauuuaaa

SEQ ID NO: 138166 - RNA, 19 nt, Homo sapiens
ggacaccagugacgccaau

SEQ ID NO: 138167 - RNA, 19 nt, Homo sapiens
ggacaccagugacgccaau

SEQ ID NO: 138168 - RNA, 19 nt, Homo sapiens
gaauggauacuacgagugu

SEQ ID NO: 138169 - RNA, 19 nt, Homo sapiens
caacuguaaucaucgugaa

SEQ ID NO: 138170 - RNA, 19 nt, Homo sapiens
ugaagaugcugguguuauc

SEQ ID NO: 138171 - RNA, 19 nt, Homo sapiens
ccauccacguugcuaauaa

SEQ ID NO: 138172 - RNA, 19 nt, Homo sapiens
ccacagucauccuugaaau

SEQ ID NO: 138173 - RNA, 19 nt, Homo sapiens
cgccgaaccuggugauauu

SEQ ID NO: 138174 - RNA, 19 nt, Homo sapiens
gggaaugaguccuacuugu

SEQ ID NO: 138175 - RNA, 19 nt, Homo sapiens
gccagaggcuccuucacuu

SEQ ID NO: 138176 - RNA, 19 nt, Homo sapiens
ugacugugaucuucagaga

SEQ ID NO: 138177 - RNA, 19 nt, Homo sapiens
caacuuaccggcauugaca

SEQ ID NO: 138178 - RNA, 19 nt, Homo sapiens
caucgacuauuccaacuuc

SEQ ID NO: 138179 - RNA, 19 nt, Homo sapiens
gaccacagcaucacaagga

SEQ ID NO: 138180 - RNA, 19 nt, Homo sapiens
gaugacagcugggauacca

SEQ ID NO: 138181 - RNA, 19 nt, Homo sapiens
gaccugacgucccagaauc

SEQ ID NO: 138182 - RNA, 19 nt, Homo sapiens
gaagugacaucaguuucca

SEQ ID NO: 138183 - RNA, 19 nt, Homo sapiens
guugaaaucuuugauggau

SEQ ID NO: 138184 - RNA, 19 nt, Homo sapiens
cauccuacccugcauacua

SEQ ID NO: 138185 - RNA, 19 nt, Homo sapiens
uaaauucuacuacgacaga

SEQ ID NO: 138186 - RNA, 19 nt, Homo sapiens
gcucagccacccaaauaaa

SEQ ID NO: 138187 - RNA, 19 nt, Homo sapiens
cccaggaaaugcccaguuu

SEQ ID NO: 138188 - RNA, 19 nt, Homo sapiens
ggaccugaauccaguuugg

SEQ ID NO: 138189 - RNA, 19 nt, Homo sapiens
ggaccugaauccaguuugg

SEQ ID NO: 138190 - RNA, 19 nt, Homo sapiens
cccaggaaaugcccaguuu

SEQ ID NO: 138191 - RNA, 19 nt, Homo sapiens
ggugucauauuccaacuca

SEQ ID NO: 138192 - RNA, 19 nt, Homo sapiens
cuucagagauguccagcuu

SEQ ID NO: 138193 - RNA, 19 nt, Homo sapiens
gaugacuccuggaccauuc

SEQ ID NO: 138194 - RNA, 19 nt, Homo sapiens
ucccauaacuguggccaua

SEQ ID NO: 138195 - RNA, 19 nt, Homo sapiens
gaggugcccuuggauacaa

SEQ ID NO: 138196 - RNA, 19 nt, Homo sapiens
gaaguccaguauggcaauu

SEQ ID NO: 138197 - RNA, 19 nt, Homo sapiens
ucucauugcucgaguuugu

SEQ ID NO: 138198 - RNA, 19 nt, Homo sapiens
ggaacuauccaaacaaugc

SEQ ID NO: 138199 - RNA, 19 nt, Homo sapiens
ggugucaucugcucagcuu

SEQ ID NO: 138200 - RNA, 19 nt, Homo sapiens
ggugucaucugcucagcuu

SEQ ID NO: 138201 - RNA, 19 nt, Homo sapiens
ggugucaucugcucagcuu

SEQ ID NO: 138202 - RNA, 19 nt, Homo sapiens
ggugucaucugcucagcuu

SEQ ID NO: 138203 - RNA, 19 nt, Homo sapiens
guucagggccuuccacuuc

SEQ ID NO: 138204 - RNA, 19 nt, Homo sapiens
cugaaauccuccauucuga

SEQ ID NO: 138205 - RNA, 19 nt, Homo sapiens
gaaccaggacuuguacguu

SEQ ID NO: 138206 - RNA, 19 nt, Homo sapiens
caaacaaugccaagugugu

SEQ ID NO: 138207 - RNA, 19 nt, Homo sapiens
gaauccaguuuggcucuga

SEQ ID NO: 138208 - RNA, 19 nt, Homo sapiens
gccaaccucucgugcauca

SEQ ID NO: 138209 - RNA, 19 nt, Homo sapiens
gagaggguuacuuacauaa

SEQ ID NO: 138210 - RNA, 19 nt, Homo sapiens
caacaucacccguccaaac

SEQ ID NO: 138211 - RNA, 19 nt, Homo sapiens
aaugauaccaggcaaauau

SEQ ID NO: 138212 - RNA, 19 nt, Homo sapiens
gaaauuggaggcacaccau

SEQ ID NO: 138213 - RNA, 19 nt, Homo sapiens
gaguggagguccuguaucg

SEQ ID NO: 138214 - RNA, 19 nt, Homo sapiens
gaguggagguccuauacca

SEQ ID NO: 138215 - RNA, 19 nt, Homo sapiens
gaguggagguccuauacca

SEQ ID NO: 138216 - RNA, 19 nt, Homo sapiens
ggauaccaaugaugccaau

SEQ ID NO: 138217 - RNA, 19 nt, Homo sapiens
ucaagcaggcagacaauga

SEQ ID NO: 138218 - RNA, 19 nt, Homo sapiens
ccauugcccuggaugaugu

SEQ ID NO: 138219 - RNA, 19 nt, Homo sapiens
gaccucacaugcaucaaca

SEQ ID NO: 138220 - RNA, 19 nt, Homo sapiens
gagcacaggucauugagaa

SEQ ID NO: 138221 - RNA, 19 nt, Homo sapiens
ggacaaaguacccauguuu

SEQ ID NO: 138222 - RNA, 19 nt, Homo sapiens
ggagagacccgcugcauga

SEQ ID NO: 138223 - RNA, 19 nt, Homo sapiens
gaacuacuccgucgucuuc

SEQ ID NO: 138224 - RNA, 19 nt, Homo sapiens
ccagaaagcaaaccuguaa

SEQ ID NO: 138225 - RNA, 19 nt, Homo sapiens
caacagcgcaggaaugaug

SEQ ID NO: 138226 - RNA, 19 nt, Homo sapiens
ggacaugcauggcuaugac

SEQ ID NO: 138227 - RNA, 19 nt, Homo sapiens
agaagagugugccauauca

SEQ ID NO: 138228 - RNA, 19 nt, Homo sapiens
gaaagcaaaccuguaagug

SEQ ID NO: 138229 - RNA, 19 nt, Homo sapiens
ggaaggcagucucuaaucc

SEQ ID NO: 138230 - RNA, 19 nt, Homo sapiens
gaggagcacaggucauuga

SEQ ID NO: 138231 - RNA, 19 nt, Homo sapiens
cagcuccgguccucgagua

SEQ ID NO: 138232 - RNA, 19 nt, Homo sapiens
ggagcgaccgggaugguuu

SEQ ID NO: 138233 - RNA, 19 nt, Homo sapiens
gagaagacaggaaucaagu

SEQ ID NO: 138234 - RNA, 19 nt, Homo sapiens
cgagaagagugugccauau

SEQ ID NO: 138235 - RNA, 19 nt, Homo sapiens
ggagaagacaggaaucaag

SEQ ID NO: 138236 - RNA, 19 nt, Homo sapiens
caaggcguaugguguggaa

SEQ ID NO: 138237 - RNA, 19 nt, Homo sapiens
gagaagagugugccauauc

SEQ ID NO: 138238 - RNA, 19 nt, Homo sapiens
caccauggaggacaaagua

SEQ ID NO: 138239 - RNA, 19 nt, Homo sapiens
ucucacaggucccaaaugg

SEQ ID NO: 138240 - RNA, 19 nt, Homo sapiens
acaagagggugaagggaau

SEQ ID NO: 138241 - RNA, 19 nt, Homo sapiens
gcaagccacaccauccaaa

SEQ ID NO: 138242 - RNA, 19 nt, Homo sapiens
ggacuaugcccuggagaga

SEQ ID NO: 138243 - RNA, 19 nt, Homo sapiens
caaaccagauacggacaga

SEQ ID NO: 138244 - RNA, 19 nt, Homo sapiens
gcugggagcugcacauucc

SEQ ID NO: 138245 - RNA, 19 nt, Homo sapiens
gcaggagugugggcaagug

SEQ ID NO: 138246 - RNA, 19 nt, Homo sapiens
gcacaacuggucccacauc

SEQ ID NO: 138247 - RNA, 19 nt, Homo sapiens
ccggauggcuggagucaag

SEQ ID NO: 138248 - RNA, 19 nt, Homo sapiens
gcucauucgucacccuguu

SEQ ID NO: 138249 - RNA, 19 nt, Homo sapiens
aaagcaaaccuguaagugu

SEQ ID NO: 138250 - RNA, 19 nt, Homo sapiens
uguggugacugcugcguuu

SEQ ID NO: 138251 - RNA, 19 nt, Homo sapiens
ccaugcggcuguccuuugu

SEQ ID NO: 138252 - RNA, 19 nt, Homo sapiens
caauguccgugaucaugau

SEQ ID NO: 138253 - RNA, 19 nt, Homo sapiens
gaauguggacgaccucuac

SEQ ID NO: 138254 - RNA, 19 nt, Homo sapiens
ccgagaagagugugccaua

SEQ ID NO: 138255 - RNA, 19 nt, Homo sapiens
gaccaucgccuacgguuac

SEQ ID NO: 138256 - RNA, 19 nt, Homo sapiens
ggacccagccagaacuugu

SEQ ID NO: 138257 - RNA, 19 nt, Homo sapiens
ccaauguccgugaucauga

SEQ ID NO: 138258 - RNA, 19 nt, Homo sapiens
gcaaaccuguaagugucuu

SEQ ID NO: 138259 - RNA, 19 nt, Homo sapiens
gaccuggguaugaucagua

SEQ ID NO: 138260 - RNA, 19 nt, Homo sapiens
uguacccgcugaugaaugu

SEQ ID NO: 138261 - RNA, 19 nt, Homo sapiens
ggaccuggguaugaucagu

SEQ ID NO: 138262 - RNA, 19 nt, Homo sapiens
gagcuggcccacuggauca

SEQ ID NO: 138263 - RNA, 19 nt, Homo sapiens
ggugaagggaaucuacuga

SEQ ID NO: 138264 - RNA, 19 nt, Homo sapiens
acuaugcccuggagagaau

SEQ ID NO: 138265 - RNA, 19 nt, Homo sapiens
gaaggacaugcauggcuau

SEQ ID NO: 138266 - RNA, 19 nt, Homo sapiens
gaggacaaaguacccaugu

SEQ ID NO: 138267 - RNA, 19 nt, Homo sapiens
gagcugcacauuccaaagg

SEQ ID NO: 138268 - RNA, 19 nt, Homo sapiens
gaaggcagucucuaaucca

SEQ ID NO: 138269 - RNA, 19 nt, Homo sapiens
gaggagacgggacuacaca

SEQ ID NO: 138270 - RNA, 19 nt, Homo sapiens
aaaggugcuuaguaaauac

SEQ ID NO: 138271 - RNA, 19 nt, Homo sapiens
cagggaccauggcuuguag

SEQ ID NO: 138272 - RNA, 19 nt, Homo sapiens
ucgcuggacuuugugaaga

SEQ ID NO: 138273 - RNA, 19 nt, Homo sapiens
ccagccagccgagccauuu

SEQ ID NO: 138274 - RNA, 19 nt, Homo sapiens
gcacaggucauugagaacu

SEQ ID NO: 138275 - RNA, 19 nt, Homo sapiens
acgcagaccugagcaacga

SEQ ID NO: 138276 - RNA, 19 nt, Homo sapiens
ccgaggaccuggguaugau

SEQ ID NO: 138277 - RNA, 19 nt, Homo sapiens
uguuugacauguccuacuu

SEQ ID NO: 138278 - RNA, 19 nt, Homo sapiens
ucagggaccauggcuugua

SEQ ID NO: 138279 - RNA, 19 nt, Homo sapiens
ccacagccgagaagagugu

SEQ ID NO: 138280 - RNA, 19 nt, Homo sapiens
cacaacuggucccacauca

SEQ ID NO: 138281 - RNA, 19 nt, Homo sapiens
guguguggacggaugauuu

SEQ ID NO: 138282 - RNA, 19 nt, Homo sapiens
ccgaggagcacaggucauu

SEQ ID NO: 138283 - RNA, 19 nt, Homo sapiens
agaaagcaaaccuguaagu

SEQ ID NO: 138284 - RNA, 19 nt, Homo sapiens
cccaugcuguccauccauu

SEQ ID NO: 138285 - RNA, 19 nt, Homo sapiens
gccaagcacggccucauca

SEQ ID NO: 138286 - RNA, 19 nt, Homo sapiens
guucuccacccacaagcua

SEQ ID NO: 138287 - RNA, 19 nt, Homo sapiens
acacgugcaugcucaacca

SEQ ID NO: 138288 - RNA, 19 nt, Homo sapiens
gcucuucuccgcagauguc

SEQ ID NO: 138289 - RNA, 19 nt, Homo sapiens
acgacacgaucaagaagga

SEQ ID NO: 138290 - RNA, 19 nt, Homo sapiens
gccaugcggcuguccuuug

SEQ ID NO: 138291 - RNA, 19 nt, Homo sapiens
ggagcacaggucauugaga

SEQ ID NO: 138292 - RNA, 19 nt, Homo sapiens
aaccagauacggacagaga

SEQ ID NO: 138293 - RNA, 19 nt, Homo sapiens
cguccugcgugccugugua

SEQ ID NO: 138294 - RNA, 19 nt, Homo sapiens
gccaaguggugggccaugu

SEQ ID NO: 138295 - RNA, 19 nt, Homo sapiens
ucgacucccugagcauuga

SEQ ID NO: 138296 - RNA, 19 nt, Homo sapiens
gcuccgaggaccuggguau

SEQ ID NO: 138297 - RNA, 19 nt, Homo sapiens
caucgacucccugagcauu

SEQ ID NO: 138298 - RNA, 19 nt, Homo sapiens
gggagcugcacauuccaaa

SEQ ID NO: 138299 - RNA, 19 nt, Homo sapiens
gaggagagacccgcugcau

SEQ ID NO: 138300 - RNA, 19 nt, Homo sapiens
cgagagcgaagccaugagu

SEQ ID NO: 138301 - RNA, 19 nt, Homo sapiens
gaucaugaugccucugucu

SEQ ID NO: 138302 - RNA, 19 nt, Homo sapiens
ucgcggguguggagacuca

SEQ ID NO: 138303 - RNA, 19 nt, Homo sapiens
cccauccuguggucacuga

SEQ ID NO: 138304 - RNA, 19 nt, Homo sapiens
cggucucgcuggacuuugu

SEQ ID NO: 138305 - RNA, 19 nt, Homo sapiens
gaguacaagaggcucaugu

SEQ ID NO: 138306 - RNA, 19 nt, Homo sapiens
gaggaccuggguaugauca

SEQ ID NO: 138307 - RNA, 19 nt, Homo sapiens
augcauggcuaugacauca

SEQ ID NO: 138308 - RNA, 19 nt, Homo sapiens
gaaaggaucugcaugauaa

SEQ ID NO: 138309 - RNA, 19 nt, Homo sapiens
gcagggaacuugacaauga

SEQ ID NO: 138310 - RNA, 19 nt, Homo sapiens
agagaaacgugaauaguua

SEQ ID NO: 138311 - RNA, 19 nt, Homo sapiens
ggaaagccauucugaggaa

SEQ ID NO: 138312 - RNA, 19 nt, Homo sapiens
uaaagcagguuaagacuug

SEQ ID NO: 138313 - RNA, 19 nt, Homo sapiens
ccacguagcuaacagaguu

SEQ ID NO: 138314 - RNA, 19 nt, Homo sapiens
gcauagauuuccucuuuga

SEQ ID NO: 138315 - RNA, 19 nt, Homo sapiens
gaacagugcaggcaugaaa

SEQ ID NO: 138316 - RNA, 19 nt, Homo sapiens
gcuauuggguguccaugua

SEQ ID NO: 138317 - RNA, 19 nt, Homo sapiens
caaagaggcuaguaagcaa

SEQ ID NO: 138318 - RNA, 19 nt, Homo sapiens
ucagaaggcaguaaaguua

SEQ ID NO: 138319 - RNA, 19 nt, Homo sapiens
agaaauuccucuuuacgua

SEQ ID NO: 138320 - RNA, 19 nt, Homo sapiens
ggacucugaugacaccaua

SEQ ID NO: 138321 - RNA, 19 nt, Homo sapiens
gcauaggguuuccucauug

SEQ ID NO: 138322 - RNA, 19 nt, Homo sapiens
ugauaaagaugacgaugaa

SEQ ID NO: 138323 - RNA, 19 nt, Homo sapiens
ugagauaguuccuaauuca

SEQ ID NO: 138324 - RNA, 19 nt, Homo sapiens
cagcugagauaguuccuaa

SEQ ID NO: 138325 - RNA, 19 nt, Homo sapiens
caagaaaggaucugcauga

SEQ ID NO: 138326 - RNA, 19 nt, Homo sapiens
gaaaggaauugcuggacau

SEQ ID NO: 138327 - RNA, 19 nt, Homo sapiens
ucacagagguuuaaauacu

SEQ ID NO: 138328 - RNA, 19 nt, Homo sapiens
aagaagcaguugucacaua

SEQ ID NO: 138329 - RNA, 19 nt, Homo sapiens
ugaggaagauggccaguug

SEQ ID NO: 138330 - RNA, 19 nt, Homo sapiens
gcaagacagugcccaagau

SEQ ID NO: 138331 - RNA, 19 nt, Homo sapiens
agaagcaguugucacauaa

SEQ ID NO: 138332 - RNA, 19 nt, Homo sapiens
gcaguaaaguuagcucaga

SEQ ID NO: 138333 - RNA, 19 nt, Homo sapiens
ggaucugcaugauaacuuu

SEQ ID NO: 138334 - RNA, 19 nt, Homo sapiens
auagagagccggaaauuaa

SEQ ID NO: 138335 - RNA, 19 nt, Homo sapiens
gauagagagccggaaauua

SEQ ID NO: 138336 - RNA, 19 nt, Homo sapiens
gaagugaugaggacucuga

SEQ ID NO: 138337 - RNA, 19 nt, Homo sapiens
uaacuuugcagcugagaua

SEQ ID NO: 138338 - RNA, 19 nt, Homo sapiens
uggaagaagucaagaguga

SEQ ID NO: 138339 - RNA, 19 nt, Homo sapiens
gugcaggcaugaaaucaaa

SEQ ID NO: 138340 - RNA, 19 nt, Homo sapiens
aaacaucaccuuacuaauc

SEQ ID NO: 138341 - RNA, 19 nt, Homo sapiens
auaaccagaugccauauuu

SEQ ID NO: 138342 - RNA, 19 nt, Homo sapiens
gauaguuccuaauucauca

SEQ ID NO: 138343 - RNA, 19 nt, Homo sapiens
caagauaccaccagugaga

SEQ ID NO: 138344 - RNA, 19 nt, Homo sapiens
aggaagagguggugaguga

SEQ ID NO: 138345 - RNA, 19 nt, Homo sapiens
gaggagaugauaaagauga

SEQ ID NO: 138346 - RNA, 19 nt, Homo sapiens
gcacuaugcuagguguuga

SEQ ID NO: 138347 - RNA, 19 nt, Homo sapiens
ggaccaagaugacaaugac

SEQ ID NO: 138348 - RNA, 19 nt, Homo sapiens
ggaguuggaagguugcaua

SEQ ID NO: 138349 - RNA, 19 nt, Homo sapiens
gagaauguaaagcagguua

SEQ ID NO: 138350 - RNA, 19 nt, Homo sapiens
uaaauacuguggagugaca

SEQ ID NO: 138351 - RNA, 19 nt, Homo sapiens
gcuccgaguuggacgauga

SEQ ID NO: 138352 - RNA, 19 nt, Homo sapiens
gcugagauaguuccuaauu

SEQ ID NO: 138353 - RNA, 19 nt, Homo sapiens
gacagugacucucaagaca

SEQ ID NO: 138354 - RNA, 19 nt, Homo sapiens
caagacagugcccaagaua

SEQ ID NO: 138355 - RNA, 19 nt, Homo sapiens
caguggagaugacaccuuu

SEQ ID NO: 138356 - RNA, 19 nt, Homo sapiens
agaauaaccagaugccaua

SEQ ID NO: 138357 - RNA, 19 nt, Homo sapiens
ggaagucucgcaucucaga

SEQ ID NO: 138358 - RNA, 19 nt, Homo sapiens
cagaggaacaggcaaauga

SEQ ID NO: 138359 - RNA, 19 nt, Homo sapiens
ggagagcagugagucauca

SEQ ID NO: 138360 - RNA, 19 nt, Homo sapiens
cagaagaauuggaguugga

SEQ ID NO: 138361 - RNA, 19 nt, Homo sapiens
caagcaaacacucaagauu

SEQ ID NO: 138362 - RNA, 19 nt, Homo sapiens
gagagcaucaggagugaaa

SEQ ID NO: 138363 - RNA, 19 nt, Homo sapiens
ccaguaaccagguaucaaa

SEQ ID NO: 138364 - RNA, 19 nt, Homo sapiens
guaaccagguaucaaaaua

SEQ ID NO: 138365 - RNA, 19 nt, Homo sapiens
gaauuggaguuggaagguu

SEQ ID NO: 138366 - RNA, 19 nt, Homo sapiens
gcaguugucacauaaagga

SEQ ID NO: 138367 - RNA, 19 nt, Homo sapiens
gaagauggccaguugaaaa

SEQ ID NO: 138368 - RNA, 19 nt, Homo sapiens
gaugaggacucugaugaca

SEQ ID NO: 138369 - RNA, 19 nt, Homo sapiens
gaagagugggagaaagaaa

SEQ ID NO: 138370 - RNA, 19 nt, Homo sapiens
uaggaagucucgcaucuca

SEQ ID NO: 138371 - RNA, 19 nt, Homo sapiens
aacaucaccuuacuaauca

SEQ ID NO: 138372 - RNA, 19 nt, Homo sapiens
uagauuuccucuuugagaa

SEQ ID NO: 138373 - RNA, 19 nt, Homo sapiens
gcccaaagacagacaagaa

SEQ ID NO: 138374 - RNA, 19 nt, Homo sapiens
gaagaugacaguggagaug

SEQ ID NO: 138375 - RNA, 19 nt, Homo sapiens
guagaacucccauaaacau

SEQ ID NO: 138376 - RNA, 19 nt, Homo sapiens
caagagaacagcagugagu

SEQ ID NO: 138377 - RNA, 19 nt, Homo sapiens
cagcaagggugacucucaa

SEQ ID NO: 138378 - RNA, 19 nt, Homo sapiens
agaaaggaucugcaugaua

SEQ ID NO: 138379 - RNA, 19 nt, Homo sapiens
gagcagggaacuugacaau

SEQ ID NO: 138380 - RNA, 19 nt, Homo sapiens
aggaggagaugauaaagau

SEQ ID NO: 138381 - RNA, 19 nt, Homo sapiens
gagcaaaauucuguaugua

SEQ ID NO: 138382 - RNA, 19 nt, Homo sapiens
gcuaugaacacgauaucaa

SEQ ID NO: 138383 - RNA, 19 nt, Homo sapiens
gaauaguuacaacccagua

SEQ ID NO: 138384 - RNA, 19 nt, Homo sapiens
cagcagauccaaagaagau

SEQ ID NO: 138385 - RNA, 19 nt, Homo sapiens
caucagcuguccuaagaag

SEQ ID NO: 138386 - RNA, 19 nt, Homo sapiens
gcacacacucucccacuca

SEQ ID NO: 138387 - RNA, 19 nt, Homo sapiens
caacaacacaauggaagaa

SEQ ID NO: 138388 - RNA, 19 nt, Homo sapiens
uaacagagggguauguaua

SEQ ID NO: 138389 - RNA, 19 nt, Homo sapiens
ccauaaacaucaccuuacu

SEQ ID NO: 138390 - RNA, 19 nt, Homo sapiens
aagagaaacgugaauaguu

SEQ ID NO: 138391 - RNA, 19 nt, Homo sapiens
uaugcuagguguugagaau

SEQ ID NO: 138392 - RNA, 19 nt, Homo sapiens
ccaaagaggcuaguaagca

SEQ ID NO: 138393 - RNA, 19 nt, Homo sapiens
cuaagaagcaguugucaca

SEQ ID NO: 138394 - RNA, 19 nt, Homo sapiens
agcaucagcuguccuaaga

SEQ ID NO: 138395 - RNA, 19 nt, Homo sapiens
ggaagauggccaguugaaa

SEQ ID NO: 138396 - RNA, 19 nt, Homo sapiens
ugagaaggauaaccaaugc

SEQ ID NO: 138397 - RNA, 19 nt, Homo sapiens
guaacaaacaaagcuauug

SEQ ID NO: 138398 - RNA, 19 nt, Homo sapiens
guaucacacccaacuauga

SEQ ID NO: 138399 - RNA, 19 nt, Homo sapiens
gcgaggaaagccauucuga

SEQ ID NO: 138400 - RNA, 19 nt, Homo sapiens
caagggugacucucaagaa

SEQ ID NO: 138401 - RNA, 19 nt, Homo sapiens
gcaagggugacucucaaga

SEQ ID NO: 138402 - RNA, 19 nt, Homo sapiens
gcaagcaaacacucaagau

SEQ ID NO: 138403 - RNA, 19 nt, Homo sapiens
gugaugaggacucugauga

SEQ ID NO: 138404 - RNA, 19 nt, Homo sapiens
gcaaaauucuguauguaag

SEQ ID NO: 138405 - RNA, 19 nt, Homo sapiens
ggagaacgagggaggacuu

SEQ ID NO: 138406 - RNA, 19 nt, Homo sapiens
guaaagcagguuaagacuu

SEQ ID NO: 138407 - RNA, 19 nt, Homo sapiens
gcuagguguugagaaugua

SEQ ID NO: 138408 - RNA, 19 nt, Homo sapiens
ccaagaagcuccagcagua

SEQ ID NO: 138409 - RNA, 19 nt, Homo sapiens
gcaaccagaugaacaagaa

SEQ ID NO: 138410 - RNA, 19 nt, Homo sapiens
agaaggagguggaggaaua

SEQ ID NO: 138411 - RNA, 19 nt, Homo sapiens
gaaagaaauucaccgacuu

SEQ ID NO: 138412 - RNA, 19 nt, Homo sapiens
gaauauccauggcauuaga

SEQ ID NO: 138413 - RNA, 19 nt, Homo sapiens
gagcuaaucagcaccguua

SEQ ID NO: 138414 - RNA, 19 nt, Homo sapiens
gcuaugcuaucaagaauau

SEQ ID NO: 138415 - RNA, 19 nt, Homo sapiens
ggaaucuuguggacucaua

SEQ ID NO: 138416 - RNA, 19 nt, Homo sapiens
gcauaucuuugcccucuuu

SEQ ID NO: 138417 - RNA, 19 nt, Homo sapiens
ggacauugauggcaagaag

SEQ ID NO: 138418 - RNA, 19 nt, Homo sapiens
ggaccaaccucccgacauc

SEQ ID NO: 138419 - RNA, 19 nt, Homo sapiens
gagaucagcuaugcuauca

SEQ ID NO: 138420 - RNA, 19 nt, Homo sapiens
gcaguuugccguagacuuu

SEQ ID NO: 138421 - RNA, 19 nt, Homo sapiens
guggugagcugauacauuc

SEQ ID NO: 138422 - RNA, 19 nt, Homo sapiens
agaaauacaugcugucugu

SEQ ID NO: 138423 - RNA, 19 nt, Homo sapiens
gaagggagaucagcuaugc

SEQ ID NO: 138424 - RNA, 19 nt, Homo sapiens
ccacuuggcugaccguaug

SEQ ID NO: 138425 - RNA, 19 nt, Homo sapiens
gaucagcuaugcuaucaag

SEQ ID NO: 138426 - RNA, 19 nt, Homo sapiens
gagacaugcuuaugcaguu

SEQ ID NO: 138427 - RNA, 19 nt, Homo sapiens
aaacagaucccuccucuuc

SEQ ID NO: 138428 - RNA, 19 nt, Homo sapiens
gcagaggaaugucuacaag

SEQ ID NO: 138429 - RNA, 19 nt, Homo sapiens
gacuuaaucuguuguagug

SEQ ID NO: 138430 - RNA, 19 nt, Homo sapiens
cugagaaucuguccuggua

SEQ ID NO: 138431 - RNA, 19 nt, Homo sapiens
gagaaucuguccugguaca

SEQ ID NO: 138432 - RNA, 19 nt, Homo sapiens
ucaaugcaaccacagaaua

SEQ ID NO: 138433 - RNA, 19 nt, Homo sapiens
ccagugagccuccuuguca

SEQ ID NO: 138434 - RNA, 19 nt, Homo sapiens
ggaaugucuacaaggauua

SEQ ID NO: 138435 - RNA, 19 nt, Homo sapiens
aagaauauccauggcauua

SEQ ID NO: 138436 - RNA, 19 nt, Homo sapiens
gguaugcccuugcccuguu

SEQ ID NO: 138437 - RNA, 19 nt, Homo sapiens
gaaagagaagaaauacaug

SEQ ID NO: 138438 - RNA, 19 nt, Homo sapiens
cgcaagggcuggcugacua

SEQ ID NO: 138439 - RNA, 19 nt, Homo sapiens
gcacugcaagggaaagaaa

SEQ ID NO: 138440 - RNA, 19 nt, Homo sapiens
ggagcuagccugugagaca

SEQ ID NO: 138441 - RNA, 19 nt, Homo sapiens
gaaccaggaugagauucug

SEQ ID NO: 138442 - RNA, 19 nt, Homo sapiens
ggaguuugaugagaaggaa

SEQ ID NO: 138443 - RNA, 19 nt, Homo sapiens
gugaugugcuggagaacaa

SEQ ID NO: 138444 - RNA, 19 nt, Homo sapiens
agaggaaugucuacaagga

SEQ ID NO: 138445 - RNA, 19 nt, Homo sapiens
caaggaugaugaggagaaa

SEQ ID NO: 138446 - RNA, 19 nt, Homo sapiens
gcgcagaggcuacauugga

SEQ ID NO: 138447 - RNA, 19 nt, Homo sapiens
ucaccaagcuggaccugau

SEQ ID NO: 138448 - RNA, 19 nt, Homo sapiens
acucugaccuggccaauuc

SEQ ID NO: 138449 - RNA, 19 nt, Homo sapiens
gcagaugguccagcaguuu

SEQ ID NO: 138450 - RNA, 19 nt, Homo sapiens
gagaccauccggaaucuug

SEQ ID NO: 138451 - RNA, 19 nt, Homo sapiens
cagcuacuguccauugaga

SEQ ID NO: 138452 - RNA, 19 nt, Homo sapiens
gcacagaugcccgugaugu

SEQ ID NO: 138453 - RNA, 19 nt, Homo sapiens
ggacggcuguucugugacu

SEQ ID NO: 138454 - RNA, 19 nt, Homo sapiens
ggagcaaccagaugaacaa

SEQ ID NO: 138455 - RNA, 19 nt, Homo sapiens
cagcuaugcuaucaagaau

SEQ ID NO: 138456 - RNA, 19 nt, Homo sapiens
cacagaauaugccgaguuc

SEQ ID NO: 138457 - RNA, 19 nt, Homo sapiens
ccaaggaguucaucuucuc

SEQ ID NO: 138458 - RNA, 19 nt, Homo sapiens
ugcagaagguccucaauca

SEQ ID NO: 138459 - RNA, 19 nt, Homo sapiens
ggcugacuaucaauaauau

SEQ ID NO: 138460 - RNA, 19 nt, Homo sapiens
cagaggagcaaccagauga

SEQ ID NO: 138461 - RNA, 19 nt, Homo sapiens
guuagacagugcaccaaga

SEQ ID NO: 138462 - RNA, 19 nt, Homo sapiens
gaucgacaccuacgaacug

SEQ ID NO: 138463 - RNA, 19 nt, Homo sapiens
caaugcaaccacagaauau

SEQ ID NO: 138464 - RNA, 19 nt, Homo sapiens
gcccuugcccuguucuaua

SEQ ID NO: 138465 - RNA, 19 nt, Homo sapiens
acucauacauggccauugu

SEQ ID NO: 138466 - RNA, 19 nt, Homo sapiens
ggucaugcuucucaucgau

SEQ ID NO: 138467 - RNA, 19 nt, Homo sapiens
agauggaguuugaugagaa

SEQ ID NO: 138468 - RNA, 19 nt, Homo sapiens
cccuugcccuguucuauaa

SEQ ID NO: 138469 - RNA, 19 nt, Homo sapiens
uccgacagcuucaugcauu

SEQ ID NO: 138470 - RNA, 19 nt, Homo sapiens
ggagaaagagaagaaauac

SEQ ID NO: 138471 - RNA, 19 nt, Homo sapiens
cgacaucccacuccaaagu

SEQ ID NO: 138472 - RNA, 19 nt, Homo sapiens
ucacugugcuauccuugug

SEQ ID NO: 138473 - RNA, 19 nt, Homo sapiens
cuucaucugugacuuaauc

SEQ ID NO: 138474 - RNA, 19 nt, Homo sapiens
aggaaugucuacaaggauu

SEQ ID NO: 138475 - RNA, 19 nt, Homo sapiens
gaagaaauacaugcugucu

SEQ ID NO: 138476 - RNA, 19 nt, Homo sapiens
cuggacggcuguucuguga

SEQ ID NO: 138477 - RNA, 19 nt, Homo sapiens
aggagaaagagaagaaaua

SEQ ID NO: 138478 - RNA, 19 nt, Homo sapiens
uggcuuacaugaacaccaa

SEQ ID NO: 138479 - RNA, 19 nt, Homo sapiens
cgagcuggcuuacaugaac

SEQ ID NO: 138480 - RNA, 19 nt, Homo sapiens
ggagaucagcuaugcuauc

SEQ ID NO: 138481 - RNA, 19 nt, Homo sapiens
ggagccagaaggacauuga

SEQ ID NO: 138482 - RNA, 19 nt, Homo sapiens
gcuguucugugacuugaca

SEQ ID NO: 138483 - RNA, 19 nt, Homo sapiens
gcauguaccacgcacugaa

SEQ ID NO: 138484 - RNA, 19 nt, Homo sapiens
gauggaguuugaugagaag

SEQ ID NO: 138485 - RNA, 19 nt, Homo sapiens
ccacagaauaugccgaguu

SEQ ID NO: 138486 - RNA, 19 nt, Homo sapiens
agacaugcuuaugcaguuu

SEQ ID NO: 138487 - RNA, 19 nt, Homo sapiens
gaggagaaagagaagaaau

SEQ ID NO: 138488 - RNA, 19 nt, Homo sapiens
uggcugacuaucaauaaua

SEQ ID NO: 138489 - RNA, 19 nt, Homo sapiens
gcuggcugacuaucaauaa

SEQ ID NO: 138490 - RNA, 19 nt, Homo sapiens
cagaugaacaagaagaaga

SEQ ID NO: 138491 - RNA, 19 nt, Homo sapiens
gcagaggagcaaccagaug

SEQ ID NO: 138492 - RNA, 19 nt, Homo sapiens
cgacaucgaguuccagauc

SEQ ID NO: 138493 - RNA, 19 nt, Homo sapiens
gccagcuacuguccauuga

SEQ ID NO: 138494 - RNA, 19 nt, Homo sapiens
ucgaggaucuggcauuguc

SEQ ID NO: 138495 - RNA, 19 nt, Homo sapiens
gcacuaaggagcaggucau

SEQ ID NO: 138496 - RNA, 19 nt, Homo sapiens
ucagcuaugcuaucaagaa

SEQ ID NO: 138497 - RNA, 19 nt, Homo sapiens
caccucaugauuaacaaua

SEQ ID NO: 138498 - RNA, 19 nt, Homo sapiens
ccucgaggaucuggcauug

SEQ ID NO: 138499 - RNA, 19 nt, Homo sapiens
gaggaggugcgccuugaga

SEQ ID NO: 138500 - RNA, 19 nt, Homo sapiens
gagcuggcuuacaugaaca

SEQ ID NO: 138501 - RNA, 19 nt, Homo sapiens
ggaggaauacaagaacuuc

SEQ ID NO: 138502 - RNA, 19 nt, Homo sapiens
cgccuuggcugcugaacga

SEQ ID NO: 138503 - RNA, 19 nt, Homo sapiens
ccuucgaccucuaaacaga

SEQ ID NO: 138504 - RNA, 19 nt, Homo sapiens
gcaucucgccggugccuau

SEQ ID NO: 138505 - RNA, 19 nt, Homo sapiens
ggucaaugcaaccacagaa

SEQ ID NO: 138506 - RNA, 19 nt, Homo sapiens
gcaagggcuggcugacuau

SEQ ID NO: 138507 - RNA, 19 nt, Homo sapiens
ucaaguguguggacauggu

SEQ ID NO: 138508 - RNA, 19 nt, Homo sapiens
gaacuucgccagucaacua

SEQ ID NO: 138509 - RNA, 19 nt, Homo sapiens
gaucacagaccauuucuuu

SEQ ID NO: 138510 - RNA, 19 nt, Homo sapiens
cgacauuccucgguauuua

SEQ ID NO: 138511 - RNA, 19 nt, Homo sapiens
acacaucccuucuucuuug

SEQ ID NO: 138512 - RNA, 19 nt, Homo sapiens
ggacacaucccuucuucuu

SEQ ID NO: 138513 - RNA, 19 nt, Homo sapiens
guacguggccgacuucuug

SEQ ID NO: 138514 - RNA, 19 nt, Homo sapiens
gcagguucuucuugaaauu

SEQ ID NO: 138515 - RNA, 19 nt, Homo sapiens
gcaagaucguccacuacaa

SEQ ID NO: 138516 - RNA, 19 nt, Homo sapiens
gggcuuggcuccaccacuu

SEQ ID NO: 138517 - RNA, 19 nt, Homo sapiens
gcaaagcuuucuugugcau

SEQ ID NO: 138518 - RNA, 19 nt, Homo sapiens
gcacuucgccuuccaggau

SEQ ID NO: 138519 - RNA, 19 nt, Homo sapiens
ugaggaggcucgagacuuc

SEQ ID NO: 138520 - RNA, 19 nt, Homo sapiens
ggauccaccuucccaucua

SEQ ID NO: 138521 - RNA, 19 nt, Homo sapiens
cgcgaucucugccugcuua

SEQ ID NO: 138522 - RNA, 19 nt, Homo sapiens
ggagaccuauggcaagauc

SEQ ID NO: 138523 - RNA, 19 nt, Homo sapiens
ccuaugaaauguucuaugg

SEQ ID NO: 138524 - RNA, 19 nt, Homo sapiens
agagagaaguggccagaga

SEQ ID NO: 138525 - RNA, 19 nt, Homo sapiens
gcacggacaaccagaacuu

SEQ ID NO: 138526 - RNA, 19 nt, Homo sapiens
caucaaacccgacaacauc

SEQ ID NO: 138527 - RNA, 19 nt, Homo sapiens
aaagcuuucuugugcauga

SEQ ID NO: 138528 - RNA, 19 nt, Homo sapiens
acagaccauuucuuucuuu

SEQ ID NO: 138529 - RNA, 19 nt, Homo sapiens
ggaugaaacagcugaagug

SEQ ID NO: 138530 - RNA, 19 nt, Homo sapiens
gagggacgacuucgagauu

SEQ ID NO: 138531 - RNA, 19 nt, Homo sapiens
gcggagaccuauggcaaga

SEQ ID NO: 138532 - RNA, 19 nt, Homo sapiens
uguauucgccuaugaaaug

SEQ ID NO: 138533 - RNA, 19 nt, Homo sapiens
ucacagaccauuucuuucu

SEQ ID NO: 138534 - RNA, 19 nt, Homo sapiens
ugaagaucaugaacaagug

SEQ ID NO: 138535 - RNA, 19 nt, Homo sapiens
gcacugagaccccgacauu

SEQ ID NO: 138536 - RNA, 19 nt, Homo sapiens
ggugggcgcuggguguauu

SEQ ID NO: 138537 - RNA, 19 nt, Homo sapiens
gcacugaaggguucugaag

SEQ ID NO: 138538 - RNA, 19 nt, Homo sapiens
ggcagguucuucuugaaau

SEQ ID NO: 138539 - RNA, 19 nt, Homo sapiens
gcaaugggcagguucuucu

SEQ ID NO: 138540 - RNA, 19 nt, Homo sapiens
gggcagguucuucuugaaa

SEQ ID NO: 138541 - RNA, 19 nt, Homo sapiens
gacacaucccuucuucuuu

SEQ ID NO: 138542 - RNA, 19 nt, Homo sapiens
gauccaccuucccaucuag

SEQ ID NO: 138543 - RNA, 19 nt, Homo sapiens
agagggacguguuggugaa

SEQ ID NO: 138544 - RNA, 19 nt, Homo sapiens
cgguuuggauauuuauuga

SEQ ID NO: 138545 - RNA, 19 nt, Homo sapiens
caagaucguccacuacaag

SEQ ID NO: 138546 - RNA, 19 nt, Homo sapiens
ccagguguaugccaugaag

SEQ ID NO: 138547 - RNA, 19 nt, Homo sapiens
cgagguagcgguagugaag

SEQ ID NO: 138548 - RNA, 19 nt, Homo sapiens
cacagaccauuucuuucuu

SEQ ID NO: 138549 - RNA, 19 nt, Homo sapiens
gcgguuuggauauuuauug

SEQ ID NO: 138550 - RNA, 19 nt, Homo sapiens
ccugagggcuaaauuuaac

SEQ ID NO: 138551 - RNA, 19 nt, Homo sapiens
guucagcaaugggcagguu

SEQ ID NO: 138552 - RNA, 19 nt, Homo sapiens
ccggacacaucccuucuuc

SEQ ID NO: 138553 - RNA, 19 nt, Homo sapiens
ggaauccaucucugaguca

SEQ ID NO: 138554 - RNA, 19 nt, Homo sapiens
gacauuccucgguauuuau

SEQ ID NO: 138555 - RNA, 19 nt, Homo sapiens
ggacaucaaacccgacaac

SEQ ID NO: 138556 - RNA, 19 nt, Homo sapiens
gcagacgggccagguguau

SEQ ID NO: 138557 - RNA, 19 nt, Homo sapiens
gccugagggcuaaauuuaa

SEQ ID NO: 138558 - RNA, 19 nt, Homo sapiens
ucggcgguuuggauauuua

SEQ ID NO: 138559 - RNA, 19 nt, Homo sapiens
acaaggagcaccucucucu

SEQ ID NO: 138560 - RNA, 19 nt, Homo sapiens
gcuucuaccuggcggagau

SEQ ID NO: 138561 - RNA, 19 nt, Homo sapiens
uagcgguagugaagaugaa

SEQ ID NO: 138562 - RNA, 19 nt, Homo sapiens
ggccagguguaugccauga

SEQ ID NO: 138563 - RNA, 19 nt, Homo sapiens
ggugcugccuguccaacau

SEQ ID NO: 138564 - RNA, 19 nt, Homo sapiens
ugacguggaugggcaaacu

SEQ ID NO: 138565 - RNA, 19 nt, Homo sapiens
guauucgccuaugaaaugu

SEQ ID NO: 138566 - RNA, 19 nt, Homo sapiens
gggacgacuucgagauucu

SEQ ID NO: 138567 - RNA, 19 nt, Homo sapiens
cuucggcgguuuggauauu

SEQ ID NO: 138568 - RNA, 19 nt, Homo sapiens
ggcaagaucguccacuaca

SEQ ID NO: 138569 - RNA, 19 nt, Homo sapiens
gguguauucgccuaugaaa

SEQ ID NO: 138570 - RNA, 19 nt, Homo sapiens
gagauugucauggccauag

SEQ ID NO: 138571 - RNA, 19 nt, Homo sapiens
ggagauugucauggccaua

SEQ ID NO: 138572 - RNA, 19 nt, Homo sapiens
cagaccauuucuuucuuuc

SEQ ID NO: 138573 - RNA, 19 nt, Homo sapiens
cacaugcaacuucgacuug

SEQ ID NO: 138574 - RNA, 19 nt, Homo sapiens
ggaugagaacuaccuguac

SEQ ID NO: 138575 - RNA, 19 nt, Homo sapiens
gaucucugccugcuuacuc

SEQ ID NO: 138576 - RNA, 19 nt, Homo sapiens
aggaugagaacuaccugua

SEQ ID NO: 138577 - RNA, 19 nt, Homo sapiens
guagcgguagugaagauga

SEQ ID NO: 138578 - RNA, 19 nt, Homo sapiens
ggucacucagccucaauug

SEQ ID NO: 138579 - RNA, 19 nt, Homo sapiens
ggaucacgcagcugcacuu

SEQ ID NO: 138580 - RNA, 19 nt, Homo sapiens
gggacguguuggugaaugg

SEQ ID NO: 138581 - RNA, 19 nt, Homo sapiens
ccucugugcucuaccuuuu

SEQ ID NO: 138582 - RNA, 19 nt, Homo sapiens
ccagggacaggcagacaug

SEQ ID NO: 138583 - RNA, 19 nt, Homo sapiens
uaucguugguucgcaaagu

SEQ ID NO: 138584 - RNA, 19 nt, Homo sapiens
gugaggagagggacguguu

SEQ ID NO: 138585 - RNA, 19 nt, Homo sapiens
ccccgacccucgcgaauaa

SEQ ID NO: 138586 - RNA, 19 nt, Homo sapiens
caaccccaauccacguuuu

SEQ ID NO: 138587 - RNA, 19 nt, Homo sapiens
aauuggcccuguucagcaa

SEQ ID NO: 138588 - RNA, 19 nt, Homo sapiens
cagcuccaguccuguguac

SEQ ID NO: 138589 - RNA, 19 nt, Homo sapiens
cuacaaggagcaccucucu

SEQ ID NO: 138590 - RNA, 19 nt, Homo sapiens
guucugaagggcccuggaa

SEQ ID NO: 138591 - RNA, 19 nt, Homo sapiens
gaacacaccugaccugguu

SEQ ID NO: 138592 - RNA, 19 nt, Homo sapiens
gcaaugagcucccaguaca

SEQ ID NO: 138593 - RNA, 19 nt, Homo sapiens
gaaaagagcaggcaaaauu

SEQ ID NO: 138594 - RNA, 19 nt, Homo sapiens
gaagucugcuaaauggaua

SEQ ID NO: 138595 - RNA, 19 nt, Homo sapiens
ggaaaccaguggcagauga

SEQ ID NO: 138596 - RNA, 19 nt, Homo sapiens
gcuauggaguacuuuguua

SEQ ID NO: 138597 - RNA, 19 nt, Homo sapiens
cauacuaucuuaacuguug

SEQ ID NO: 138598 - RNA, 19 nt, Homo sapiens
caaaggcagugcuugaaug

SEQ ID NO: 138599 - RNA, 19 nt, Homo sapiens
cuacuuaguugcagcugua

SEQ ID NO: 138600 - RNA, 19 nt, Homo sapiens
gcagcucuccuauuaguaa

SEQ ID NO: 138601 - RNA, 19 nt, Homo sapiens
cagaagccauccugaaaug

SEQ ID NO: 138602 - RNA, 19 nt, Homo sapiens
gcagagggcauguggagaa

SEQ ID NO: 138603 - RNA, 19 nt, Homo sapiens
cacaagcgcuucugcaugu

SEQ ID NO: 138604 - RNA, 19 nt, Homo sapiens
gaagccauccugaaaugaa

SEQ ID NO: 138605 - RNA, 19 nt, Homo sapiens
gagaacguauuugguuuau

SEQ ID NO: 138606 - RNA, 19 nt, Homo sapiens
uaaagugaccuuagugaug

SEQ ID NO: 138607 - RNA, 19 nt, Homo sapiens
aguacaggaugcauucuua

SEQ ID NO: 138608 - RNA, 19 nt, Homo sapiens
uaacagaagccauccugaa

SEQ ID NO: 138609 - RNA, 19 nt, Homo sapiens
acagugcaauuuaaaguga

SEQ ID NO: 138610 - RNA, 19 nt, Homo sapiens
cagaggcuguaacacauuu

SEQ ID NO: 138611 - RNA, 19 nt, Homo sapiens
uaucuuaacuguugagaac

SEQ ID NO: 138612 - RNA, 19 nt, Homo sapiens
cgucucuguuuccuuauua

SEQ ID NO: 138613 - RNA, 19 nt, Homo sapiens
gaggaggaauuggguauca

SEQ ID NO: 138614 - RNA, 19 nt, Homo sapiens
aggcagugcuugaauguga

SEQ ID NO: 138615 - RNA, 19 nt, Homo sapiens
ggauauauuguguguguug

SEQ ID NO: 138616 - RNA, 19 nt, Homo sapiens
caagugaagccauuugugu

SEQ ID NO: 138617 - RNA, 19 nt, Homo sapiens
ugagaacguauuugguuua

SEQ ID NO: 138618 - RNA, 19 nt, Homo sapiens
gagaaccgccaugcaauga

SEQ ID NO: 138619 - RNA, 19 nt, Homo sapiens
cuacagauuugaguucaug

SEQ ID NO: 138620 - RNA, 19 nt, Homo sapiens
acacugguuucauguaguu

SEQ ID NO: 138621 - RNA, 19 nt, Homo sapiens
ggagaaccgccaugcaaug

SEQ ID NO: 138622 - RNA, 19 nt, Homo sapiens
acaacaaucuauacaacug

SEQ ID NO: 138623 - RNA, 19 nt, Homo sapiens
gagagaacaauggcaguaa

SEQ ID NO: 138624 - RNA, 19 nt, Homo sapiens
acuaccaucugcaugauuu

SEQ ID NO: 138625 - RNA, 19 nt, Homo sapiens
uaacaggcuuauuccacuu

SEQ ID NO: 138626 - RNA, 19 nt, Homo sapiens
gcaauuuaaagugaccuua

SEQ ID NO: 138627 - RNA, 19 nt, Homo sapiens
ugaaaucuuaggugccuua

SEQ ID NO: 138628 - RNA, 19 nt, Homo sapiens
ugacacugguuucauguag

SEQ ID NO: 138629 - RNA, 19 nt, Homo sapiens
ggccuuggcugcugauucu

SEQ ID NO: 138630 - RNA, 19 nt, Homo sapiens
agccgucucuguuuccuua

SEQ ID NO: 138631 - RNA, 19 nt, Homo sapiens
gcagcuguaccugaaauaa

SEQ ID NO: 138632 - RNA, 19 nt, Homo sapiens
gaaacauuaaagccuguaa

SEQ ID NO: 138633 - RNA, 19 nt, Homo sapiens
guugagaacguauuugguu

SEQ ID NO: 138634 - RNA, 19 nt, Homo sapiens
gaaaccaguggcagaugaa

SEQ ID NO: 138635 - RNA, 19 nt, Homo sapiens
aaauugcuauggaguacuu

SEQ ID NO: 138636 - RNA, 19 nt, Homo sapiens
ccauuugugugccucuaaa

SEQ ID NO: 138637 - RNA, 19 nt, Homo sapiens
cccagcagcuucacaguca

SEQ ID NO: 138638 - RNA, 19 nt, Homo sapiens
caggaugcauucuuacuac

SEQ ID NO: 138639 - RNA, 19 nt, Homo sapiens
cagcuguaccugaaauaaa

SEQ ID NO: 138640 - RNA, 19 nt, Homo sapiens
ggcuguaacacauuuguaa

SEQ ID NO: 138641 - RNA, 19 nt, Homo sapiens
gcaagaagugcaaccugau

SEQ ID NO: 138642 - RNA, 19 nt, Homo sapiens
ucauuguucuacuuaguug

SEQ ID NO: 138643 - RNA, 19 nt, Homo sapiens
ugauuuaagugcuuuacuc

SEQ ID NO: 138644 - RNA, 19 nt, Homo sapiens
uugagaacguauuugguuu

SEQ ID NO: 138645 - RNA, 19 nt, Homo sapiens
cggccgagcugcuugucaa

SEQ ID NO: 138646 - RNA, 19 nt, Homo sapiens
aagccauccugaaaugaaa

SEQ ID NO: 138647 - RNA, 19 nt, Homo sapiens
gaagaaaagagcaggcaaa

SEQ ID NO: 138648 - RNA, 19 nt, Homo sapiens
cgauggcgguucacuugga

SEQ ID NO: 138649 - RNA, 19 nt, Homo sapiens
gcucuccuauuaguaacaa

SEQ ID NO: 138650 - RNA, 19 nt, Homo sapiens
gcccagcagucaagauucu

SEQ ID NO: 138651 - RNA, 19 nt, Homo sapiens
aacagaagccauccugaaa

SEQ ID NO: 138652 - RNA, 19 nt, Homo sapiens
aaaaguugcuacagauuug

SEQ ID NO: 138653 - RNA, 19 nt, Homo sapiens
cauacauucuuucuacuac

SEQ ID NO: 138654 - RNA, 19 nt, Homo sapiens
gagugguguuuguagaaug

SEQ ID NO: 138655 - RNA, 19 nt, Homo sapiens
gauuuaagugcuuuacuca

SEQ ID NO: 138656 - RNA, 19 nt, Homo sapiens
gccgauggcgguucacuug

SEQ ID NO: 138657 - RNA, 19 nt, Homo sapiens
cacagucacucccgucauc

SEQ ID NO: 138658 - RNA, 19 nt, Homo sapiens
aaaagagcaggcaaaauua

SEQ ID NO: 138659 - RNA, 19 nt, Homo sapiens
gugacuaccaucugcauga

SEQ ID NO: 138660 - RNA, 19 nt, Homo sapiens
uggaguaacaggcuuauuc

SEQ ID NO: 138661 - RNA, 19 nt, Homo sapiens
ggacuguuguaaccuuagg

SEQ ID NO: 138662 - RNA, 19 nt, Homo sapiens
gcuaaauggauauauugug

SEQ ID NO: 138663 - RNA, 19 nt, Homo sapiens
cagauuugaguucaugauu

SEQ ID NO: 138664 - RNA, 19 nt, Homo sapiens
guguguugcuguuggaaau

SEQ ID NO: 138665 - RNA, 19 nt, Homo sapiens
gaagccagggcgagcguau

SEQ ID NO: 138666 - RNA, 19 nt, Homo sapiens
acaggaugcauucuuacua

SEQ ID NO: 138667 - RNA, 19 nt, Homo sapiens
auggauauauugugugugu

SEQ ID NO: 138668 - RNA, 19 nt, Homo sapiens
ccaucugcaugauuuaagu

SEQ ID NO: 138669 - RNA, 19 nt, Homo sapiens
caucgaggaggacgaguga

SEQ ID NO: 138670 - RNA, 19 nt, Homo sapiens
ugagugguguuuguagaau

SEQ ID NO: 138671 - RNA, 19 nt, Homo sapiens
ccugagugguguuuguaga

SEQ ID NO: 138672 - RNA, 19 nt, Homo sapiens
guccagaggcuguaacaca

SEQ ID NO: 138673 - RNA, 19 nt, Homo sapiens
gcauucagcaagcccucua

SEQ ID NO: 138674 - RNA, 19 nt, Homo sapiens
cuaccagccgucucuguuu

SEQ ID NO: 138675 - RNA, 19 nt, Homo sapiens
acccgugccucaugacuga

SEQ ID NO: 138676 - RNA, 19 nt, Homo sapiens
agugguguuuguagaauga

SEQ ID NO: 138677 - RNA, 19 nt, Homo sapiens
guuccugagugguguuugu

SEQ ID NO: 138678 - RNA, 19 nt, Homo sapiens
caauuuaaagugaccuuag

SEQ ID NO: 138679 - RNA, 19 nt, Homo sapiens
ccaaaacguaacugaaaua

SEQ ID NO: 138680 - RNA, 19 nt, Homo sapiens
aguaacccgugccucauga

SEQ ID NO: 138681 - RNA, 19 nt, Homo sapiens
caagaagugcaaccugauc

SEQ ID NO: 138682 - RNA, 19 nt, Homo sapiens
ccugacgggugagaagaaa

SEQ ID NO: 138683 - RNA, 19 nt, Homo sapiens
gacacugguuucauguagu

SEQ ID NO: 138684 - RNA, 19 nt, Homo sapiens
ugacuaccaucugcaugau

SEQ ID NO: 138685 - RNA, 19 nt, Homo sapiens
uaccagccgucucuguuuc

SEQ ID NO: 138686 - RNA, 19 nt, Homo sapiens
cuggacuguuguaaccuua

SEQ ID NO: 138687 - RNA, 19 nt, Homo sapiens
ccagaggcuguaacacauu

SEQ ID NO: 138688 - RNA, 19 nt, Homo sapiens
agagagaacaauggcagua

SEQ ID NO: 138689 - RNA, 19 nt, Homo sapiens
acagaagccauccugaaau

SEQ ID NO: 138690 - RNA, 19 nt, Homo sapiens
ccuuagugaugcagaguuc

SEQ ID NO: 138691 - RNA, 19 nt, Homo sapiens
gaaagaaacugagauguua

SEQ ID NO: 138692 - RNA, 19 nt, Homo sapiens
ggacaucacugaauauuga

SEQ ID NO: 138693 - RNA, 19 nt, Homo sapiens
aaacugagcuuguacauga

SEQ ID NO: 138694 - RNA, 19 nt, Homo sapiens
gaaguucccugcccuaauu

SEQ ID NO: 138695 - RNA, 19 nt, Homo sapiens
gaugugaccugguuugaua

SEQ ID NO: 138696 - RNA, 19 nt, Homo sapiens
gggcaaggcugugcuauua

SEQ ID NO: 138697 - RNA, 19 nt, Homo sapiens
ggaaauacaucacauauac

SEQ ID NO: 138698 - RNA, 19 nt, Homo sapiens
gaaacuaaaucguccaauu

SEQ ID NO: 138699 - RNA, 19 nt, Homo sapiens
gaaacgagauagauacaaa

SEQ ID NO: 138700 - RNA, 19 nt, Homo sapiens
gaacagaugucgaaagcuu

SEQ ID NO: 138701 - RNA, 19 nt, Homo sapiens
ggaaccaaaugaucuguua

SEQ ID NO: 138702 - RNA, 19 nt, Homo sapiens
gcaaugaagucaccaaaug

SEQ ID NO: 138703 - RNA, 19 nt, Homo sapiens
ggucagaggugaauauuga

SEQ ID NO: 138704 - RNA, 19 nt, Homo sapiens
gaaagucagugcugugaaa

SEQ ID NO: 138705 - RNA, 19 nt, Homo sapiens
ggacaugaaucuuucuaaa

SEQ ID NO: 138706 - RNA, 19 nt, Homo sapiens
gagaucagguuacgaauga

SEQ ID NO: 138707 - RNA, 19 nt, Homo sapiens
ggaaagaaccuaaaucuca

SEQ ID NO: 138708 - RNA, 19 nt, Homo sapiens
caaagaagcuucagagucu

SEQ ID NO: 138709 - RNA, 19 nt, Homo sapiens
caaauaacccugagacuuu

SEQ ID NO: 138710 - RNA, 19 nt, Homo sapiens
gaacacauuugcuaagguu

SEQ ID NO: 138711 - RNA, 19 nt, Homo sapiens
cauaagcaguuucccauua

SEQ ID NO: 138712 - RNA, 19 nt, Homo sapiens
ggaacuagauccagcacua

SEQ ID NO: 138713 - RNA, 19 nt, Homo sapiens
caagaucucucgugucauu

SEQ ID NO: 138714 - RNA, 19 nt, Homo sapiens
ugaagaagcugguuuaauc

SEQ ID NO: 138715 - RNA, 19 nt, Homo sapiens
ugaaggaacuagaagauaa

SEQ ID NO: 138716 - RNA, 19 nt, Homo sapiens
gaaagaagaugacuguuuu

SEQ ID NO: 138717 - RNA, 19 nt, Homo sapiens
cgacagaaccuucauauug

SEQ ID NO: 138718 - RNA, 19 nt, Homo sapiens
gagguuggcuucauucauu

SEQ ID NO: 138719 - RNA, 19 nt, Homo sapiens
gaacauggaugcucuucug

SEQ ID NO: 138720 - RNA, 19 nt, Homo sapiens
gaucacaucucuguuugua

SEQ ID NO: 138721 - RNA, 19 nt, Homo sapiens
aaacagagcuuugaaguuc

SEQ ID NO: 138722 - RNA, 19 nt, Homo sapiens
guacaacagugucauagaa

SEQ ID NO: 138723 - RNA, 19 nt, Homo sapiens
gaaaguuggugacaaggaa

SEQ ID NO: 138724 - RNA, 19 nt, Homo sapiens
ggaaagaagaugacuguuu

SEQ ID NO: 138725 - RNA, 19 nt, Homo sapiens
gagauaaugugacuaugaa

SEQ ID NO: 138726 - RNA, 19 nt, Homo sapiens
gaagaagcccuuagaaaug

SEQ ID NO: 138727 - RNA, 19 nt, Homo sapiens
gcaaaucuccauugacuuu

SEQ ID NO: 138728 - RNA, 19 nt, Homo sapiens
ggagaaauuucgaaacaga

SEQ ID NO: 138729 - RNA, 19 nt, Homo sapiens
gaacuuagaauacaagaug

SEQ ID NO: 138730 - RNA, 19 nt, Homo sapiens
gaccagauaucgagaaaug

SEQ ID NO: 138731 - RNA, 19 nt, Homo sapiens
guacacagcugacuugaag

SEQ ID NO: 138732 - RNA, 19 nt, Homo sapiens
caaaggacaaugugaaaua

SEQ ID NO: 138733 - RNA, 19 nt, Homo sapiens
gaacaggccaugacugaaa

SEQ ID NO: 138734 - RNA, 19 nt, Homo sapiens
gacaagaucuuugguguga

SEQ ID NO: 138735 - RNA, 19 nt, Homo sapiens
ucacaucucuguuuguaaa

SEQ ID NO: 138736 - RNA, 19 nt, Homo sapiens
ggacugacuuucuaauuca

SEQ ID NO: 138737 - RNA, 19 nt, Homo sapiens
caacuucccucuuccagaa

SEQ ID NO: 138738 - RNA, 19 nt, Homo sapiens
ggaaggccuuugcuuauug

SEQ ID NO: 138739 - RNA, 19 nt, Homo sapiens
caaaugaucuguuaaagcu

SEQ ID NO: 138740 - RNA, 19 nt, Homo sapiens
gcauguaaagccuauauua

SEQ ID NO: 138741 - RNA, 19 nt, Homo sapiens
uaacauggcugaauuuggu

SEQ ID NO: 138742 - RNA, 19 nt, Homo sapiens
gacagaaccuucauauugu

SEQ ID NO: 138743 - RNA, 19 nt, Homo sapiens
gaaaugccaaguuugauaa

SEQ ID NO: 138744 - RNA, 19 nt, Homo sapiens
gagcaaaucuccauugacu

SEQ ID NO: 138745 - RNA, 19 nt, Homo sapiens
ugacauacuugaacugaaa

SEQ ID NO: 138746 - RNA, 19 nt, Homo sapiens
agacagcucuggaagcaua

SEQ ID NO: 138747 - RNA, 19 nt, Homo sapiens
gacauaacauggcugaauu

SEQ ID NO: 138748 - RNA, 19 nt, Homo sapiens
gagaugcgcuugguuaaug

SEQ ID NO: 138749 - RNA, 19 nt, Homo sapiens
gaagauaacuugcuuuacc

SEQ ID NO: 138750 - RNA, 19 nt, Homo sapiens
ucagugagauguugauuga

SEQ ID NO: 138751 - RNA, 19 nt, Homo sapiens
aaucauaccucuccuuuau

SEQ ID NO: 138752 - RNA, 19 nt, Homo sapiens
gaacggacuugaacuacau

SEQ ID NO: 138753 - RNA, 19 nt, Homo sapiens
gaaauagacagaaugcaaa

SEQ ID NO: 138754 - RNA, 19 nt, Homo sapiens
gaaaugaacuccagaucac

SEQ ID NO: 138755 - RNA, 19 nt, Homo sapiens
uaacgaagauucugacaag

SEQ ID NO: 138756 - RNA, 19 nt, Homo sapiens
ugaagcaagugauuaauga

SEQ ID NO: 138757 - RNA, 19 nt, Homo sapiens
gaauauaccuaaucuuggu

SEQ ID NO: 138758 - RNA, 19 nt, Homo sapiens
gaucauggauugcguacug

SEQ ID NO: 138759 - RNA, 19 nt, Homo sapiens
ugacuggacugaugggaua

SEQ ID NO: 138760 - RNA, 19 nt, Homo sapiens
gaacuggaagcagcaauua

SEQ ID NO: 138761 - RNA, 19 nt, Homo sapiens
ggaaauagaggacaucugu

SEQ ID NO: 138762 - RNA, 19 nt, Homo sapiens
uuacaacccucaagacgua

SEQ ID NO: 138763 - RNA, 19 nt, Homo sapiens
gaaggaagcggaugacguu

SEQ ID NO: 138764 - RNA, 19 nt, Homo sapiens
ccuacgagguuuauaagua

SEQ ID NO: 138765 - RNA, 19 nt, Homo sapiens
ggaguuuggugaagagaaa

SEQ ID NO: 138766 - RNA, 19 nt, Homo sapiens
cagcaaauuuccauuauuc

SEQ ID NO: 138767 - RNA, 19 nt, Homo sapiens
cagaacaguuugcccauuu

SEQ ID NO: 138768 - RNA, 19 nt, Homo sapiens
ggaaauagacagaaugcaa

SEQ ID NO: 138769 - RNA, 19 nt, Homo sapiens
cauagaaacugagcuugua

SEQ ID NO: 138770 - RNA, 19 nt, Homo sapiens
ggaaguagauguguuggau

SEQ ID NO: 138771 - RNA, 19 nt, Homo sapiens
gcaaggcugugcuauuaau

SEQ ID NO: 138772 - RNA, 19 nt, Homo sapiens
ggaaugaaagcuuuaaguu

SEQ ID NO: 138773 - RNA, 19 nt, Homo sapiens
gggaagagauagacaaagu

SEQ ID NO: 138774 - RNA, 19 nt, Homo sapiens
cgaaacugcugaagacuug

SEQ ID NO: 138775 - RNA, 19 nt, Homo sapiens
cagcaucucuaaagacaaa

SEQ ID NO: 138776 - RNA, 19 nt, Homo sapiens
ggaaauacgucgugguuuu

SEQ ID NO: 138777 - RNA, 19 nt, Homo sapiens
gacgaugccucgggaaaua

SEQ ID NO: 138778 - RNA, 19 nt, Homo sapiens
ccaacuaacugaauuucuu

SEQ ID NO: 138779 - RNA, 19 nt, Homo sapiens
ccaagcagcugcccaagga

SEQ ID NO: 138780 - RNA, 19 nt, Homo sapiens
uguaaauggugcacaaaua

SEQ ID NO: 138781 - RNA, 19 nt, Homo sapiens
caugaaaggucuagaagau

SEQ ID NO: 138782 - RNA, 19 nt, Homo sapiens
caagaucuuuggugugauu

SEQ ID NO: 138783 - RNA, 19 nt, Homo sapiens
gcagaagccaaaccuauaa

SEQ ID NO: 138784 - RNA, 19 nt, Homo sapiens
gcagagcgaugcagacaca

SEQ ID NO: 138785 - RNA, 19 nt, Homo sapiens
uuacagaacuuacagcaau

SEQ ID NO: 138786 - RNA, 19 nt, Homo sapiens
caaauauucuucuggacaa

SEQ ID NO: 138787 - RNA, 19 nt, Homo sapiens
aaacagaaaccacuaaaga

SEQ ID NO: 138788 - RNA, 19 nt, Homo sapiens
cauuaaaucugucaaguuc

SEQ ID NO: 138789 - RNA, 19 nt, Homo sapiens
uggaauacauggccaguaa

SEQ ID NO: 138790 - RNA, 19 nt, Homo sapiens
ggagauggauauucgaauc

SEQ ID NO: 138791 - RNA, 19 nt, Homo sapiens
gagcaaagcuguuucagua

SEQ ID NO: 138792 - RNA, 19 nt, Homo sapiens
ggaaagaaaugcucaguuu

SEQ ID NO: 138793 - RNA, 19 nt, Homo sapiens
gcaaaugaauccaaagaua

SEQ ID NO: 138794 - RNA, 19 nt, Homo sapiens
ggaaguugcugguuaauuu

SEQ ID NO: 138795 - RNA, 19 nt, Homo sapiens
ggaagaagcugucagagaa

SEQ ID NO: 138796 - RNA, 19 nt, Homo sapiens
gaaauuuccuggcuugaua

SEQ ID NO: 138797 - RNA, 19 nt, Homo sapiens
cgaggaagcugaagaauuu

SEQ ID NO: 138798 - RNA, 19 nt, Homo sapiens
gaaauacacugggaaagua

SEQ ID NO: 138799 - RNA, 19 nt, Homo sapiens
gaaaguauauugcagauuc

SEQ ID NO: 138800 - RNA, 19 nt, Homo sapiens
ggugaaaucucguuugaua

SEQ ID NO: 138801 - RNA, 19 nt, Homo sapiens
gaagauaaccuccucuaua

SEQ ID NO: 138802 - RNA, 19 nt, Homo sapiens
uaagugagcccaucaauua

SEQ ID NO: 138803 - RNA, 19 nt, Homo sapiens
caugaucgauuuccaauua

SEQ ID NO: 138804 - RNA, 19 nt, Homo sapiens
gaaagucggugauaaggaa

SEQ ID NO: 138805 - RNA, 19 nt, Homo sapiens
gaagaagccuaugcuauuu

SEQ ID NO: 138806 - RNA, 19 nt, Homo sapiens
gggaagguguguauauuua

SEQ ID NO: 138807 - RNA, 19 nt, Homo sapiens
ugaagagacuguugaguua

SEQ ID NO: 138808 - RNA, 19 nt, Homo sapiens
gaaaucagaucagaaauuc

SEQ ID NO: 138809 - RNA, 19 nt, Homo sapiens
caaggaauguugaccauaa

SEQ ID NO: 138810 - RNA, 19 nt, Homo sapiens
ggacaagccuggagacuuc

SEQ ID NO: 138811 - RNA, 19 nt, Homo sapiens
caaaucaccuacugacuuu

SEQ ID NO: 138812 - RNA, 19 nt, Homo sapiens
gaaguuggauguaccagaa

SEQ ID NO: 138813 - RNA, 19 nt, Homo sapiens
cuaagaagcuuuaucauuc

SEQ ID NO: 138814 - RNA, 19 nt, Homo sapiens
ggacagaauuugacacaga

SEQ ID NO: 138815 - RNA, 19 nt, Homo sapiens
aagauaaccuccucuauaa

SEQ ID NO: 138816 - RNA, 19 nt, Homo sapiens
gagaucagauaacuaauga

SEQ ID NO: 138817 - RNA, 19 nt, Homo sapiens
gaaauaaaccacacaauag

SEQ ID NO: 138818 - RNA, 19 nt, Homo sapiens
cauaguaacuguugaagaa

SEQ ID NO: 138819 - RNA, 19 nt, Homo sapiens
gagaugagauggaugaaau

SEQ ID NO: 138820 - RNA, 19 nt, Homo sapiens
ggaaauuuguuacguauuc

SEQ ID NO: 138821 - RNA, 19 nt, Homo sapiens
gauagaaucuccgaguuaa

SEQ ID NO: 138822 - RNA, 19 nt, Homo sapiens
ggaggaaauuuguuacgua

SEQ ID NO: 138823 - RNA, 19 nt, Homo sapiens
gguaacaaaucaaauggua

SEQ ID NO: 138824 - RNA, 19 nt, Homo sapiens
gaguaaacuuccacaauuu

SEQ ID NO: 138825 - RNA, 19 nt, Homo sapiens
gcacaccuuugaagaagua

SEQ ID NO: 138826 - RNA, 19 nt, Homo sapiens
ugaaaggacuugagaauca

SEQ ID NO: 138827 - RNA, 19 nt, Homo sapiens
ugacaucucugaaccguaa

SEQ ID NO: 138828 - RNA, 19 nt, Homo sapiens
gaugaucucucaauucaga

SEQ ID NO: 138829 - RNA, 19 nt, Homo sapiens
ccuaaaggcucaaaucaaa

SEQ ID NO: 138830 - RNA, 19 nt, Homo sapiens
gaucuaagcaaguuugaua

SEQ ID NO: 138831 - RNA, 19 nt, Homo sapiens
gaagaggcuuuacguaaug

SEQ ID NO: 138832 - RNA, 19 nt, Homo sapiens
gcaacaggcuacagauauu

SEQ ID NO: 138833 - RNA, 19 nt, Homo sapiens
gaagaucagugacuugugu

SEQ ID NO: 138834 - RNA, 19 nt, Homo sapiens
ggaacuauuugcuuaaaga

SEQ ID NO: 138835 - RNA, 19 nt, Homo sapiens
gaaacgcacugcacaggaa

SEQ ID NO: 138836 - RNA, 19 nt, Homo sapiens
gcaaagagucauuucagua

SEQ ID NO: 138837 - RNA, 19 nt, Homo sapiens
ugaguaaacuuccacaauu

SEQ ID NO: 138838 - RNA, 19 nt, Homo sapiens
guuguaagcuucuguuuga

SEQ ID NO: 138839 - RNA, 19 nt, Homo sapiens
gauagugaauuaagcauug

SEQ ID NO: 138840 - RNA, 19 nt, Homo sapiens
aaacagaugucguaaacuu

SEQ ID NO: 138841 - RNA, 19 nt, Homo sapiens
gagaaucaguuacuaagga

SEQ ID NO: 138842 - RNA, 19 nt, Homo sapiens
gcagcgagcucaugagaau

SEQ ID NO: 138843 - RNA, 19 nt, Homo sapiens
gcagauuuaugaagugaaa

SEQ ID NO: 138844 - RNA, 19 nt, Homo sapiens
gaacagguacuuauugaga

SEQ ID NO: 138845 - RNA, 19 nt, Homo sapiens
cgaaaggacucuuaaaugg

SEQ ID NO: 138846 - RNA, 19 nt, Homo sapiens
gacaagaaauugacagaau

SEQ ID NO: 138847 - RNA, 19 nt, Homo sapiens
ugacaaaggccaccagaua

SEQ ID NO: 138848 - RNA, 19 nt, Homo sapiens
ucagagagcugugaaaguu

SEQ ID NO: 138849 - RNA, 19 nt, Homo sapiens
gaacuuaaauuccguuuug

SEQ ID NO: 138850 - RNA, 19 nt, Homo sapiens
gacuuuggauugagaaaua

SEQ ID NO: 138851 - RNA, 19 nt, Homo sapiens
ggaaucuucuuaacgauga

SEQ ID NO: 138852 - RNA, 19 nt, Homo sapiens
ugaauugccuguauuauca

SEQ ID NO: 138853 - RNA, 19 nt, Homo sapiens
ugaaguacaucuugcaauu

SEQ ID NO: 138854 - RNA, 19 nt, Homo sapiens
ucagagagauuucacaguu

SEQ ID NO: 138855 - RNA, 19 nt, Homo sapiens
gaggugaaaucucguuuga

SEQ ID NO: 138856 - RNA, 19 nt, Homo sapiens
gcagggugguuggguauua

SEQ ID NO: 138857 - RNA, 19 nt, Homo sapiens
ggacaccucugauaugcuu

SEQ ID NO: 138858 - RNA, 19 nt, Homo sapiens
aaacgucagucauugauuu

SEQ ID NO: 138859 - RNA, 19 nt, Homo sapiens
ccaaugauguuucagagaa

SEQ ID NO: 138860 - RNA, 19 nt, Homo sapiens
gcaccacuccuuaaacaua

SEQ ID NO: 138861 - RNA, 19 nt, Homo sapiens
gcccaucaauuauuucuuu

SEQ ID NO: 138862 - RNA, 19 nt, Homo sapiens
gaaauugacagaaugcaaa

SEQ ID NO: 138863 - RNA, 19 nt, Homo sapiens
gcagacagauuuauaacuc

SEQ ID NO: 138864 - RNA, 19 nt, Homo sapiens
cgagaucuuuccagaauuu

SEQ ID NO: 138865 - RNA, 19 nt, Homo sapiens
ccaaagauaaugucagaua

SEQ ID NO: 138866 - RNA, 19 nt, Homo sapiens
gaagcgcucuuuacuguuc

SEQ ID NO: 138867 - RNA, 19 nt, Homo sapiens
ugacaaacgucuacuuaau

SEQ ID NO: 138868 - RNA, 19 nt, Homo sapiens
gaaagaacuugaagauaac

SEQ ID NO: 138869 - RNA, 19 nt, Homo sapiens
caaaguagaagauauguug

SEQ ID NO: 138870 - RNA, 19 nt, Homo sapiens
ugacacagauuucuuagau

SEQ ID NO: 138871 - RNA, 19 nt, Homo sapiens
ccaaacugcuaaagaauug

SEQ ID NO: 138872 - RNA, 19 nt, Homo sapiens
aaacuggaauguagaacua

SEQ ID NO: 138873 - RNA, 19 nt, Homo sapiens
caaaugauauugccacagu

SEQ ID NO: 138874 - RNA, 19 nt, Homo sapiens
gaugagcagugguuuaaug

SEQ ID NO: 138875 - RNA, 19 nt, Homo sapiens
gaagaugagcagugguuua

SEQ ID NO: 138876 - RNA, 19 nt, Homo sapiens
ggauagaaucuccgaguua

SEQ ID NO: 138877 - RNA, 19 nt, Homo sapiens
gaagcuguauggauuguau

SEQ ID NO: 138878 - RNA, 19 nt, Homo sapiens
ggaccuaugguuccaaaua

SEQ ID NO: 138879 - RNA, 19 nt, Homo sapiens
cgaaagcagucagaagaua

SEQ ID NO: 138880 - RNA, 19 nt, Homo sapiens
gaagguguguauauuuaug

SEQ ID NO: 138881 - RNA, 19 nt, Homo sapiens
aaagguguaucauggaaua

SEQ ID NO: 138882 - RNA, 19 nt, Homo sapiens
ucgaguaccugacauauga

SEQ ID NO: 138883 - RNA, 19 nt, Homo sapiens
uaagagauaugaaccuuuc

SEQ ID NO: 138884 - RNA, 19 nt, Homo sapiens
gaggugacauuucauacaa

SEQ ID NO: 138885 - RNA, 19 nt, Homo sapiens
ggaaguaugucagaaguca

SEQ ID NO: 138886 - RNA, 19 nt, Homo sapiens
caaaaggacuuaaagauug

SEQ ID NO: 138887 - RNA, 19 nt, Homo sapiens
auacagagccgaugaaauu

SEQ ID NO: 138888 - RNA, 19 nt, Homo sapiens
uguaggagcacuugaauua

SEQ ID NO: 138889 - RNA, 19 nt, Homo sapiens
guaaggcugucauaaaugu

SEQ ID NO: 138890 - RNA, 19 nt, Homo sapiens
gaacugauuugaccuucau

SEQ ID NO: 138891 - RNA, 19 nt, Homo sapiens
gaacagcgcuacaacuaua

SEQ ID NO: 138892 - RNA, 19 nt, Homo sapiens
gcacagagcugccagagaa

SEQ ID NO: 138893 - RNA, 19 nt, Homo sapiens
gaacaagaauugccagaaa

SEQ ID NO: 138894 - RNA, 19 nt, Homo sapiens
ggagaucacuaucaacuuu

SEQ ID NO: 138895 - RNA, 19 nt, Homo sapiens
uuaaagagcuagcuuauga

SEQ ID NO: 138896 - RNA, 19 nt, Homo sapiens
gaaccuguauugucacuuu

SEQ ID NO: 138897 - RNA, 19 nt, Homo sapiens
uaaaggagaucacaaaugu

SEQ ID NO: 138898 - RNA, 19 nt, Homo sapiens
gaaaugagcuaucuugaac

SEQ ID NO: 138899 - RNA, 19 nt, Homo sapiens
gaaccaucuuugacuauua

SEQ ID NO: 138900 - RNA, 19 nt, Homo sapiens
gaaaagagcucaagugcaa

SEQ ID NO: 138901 - RNA, 19 nt, Homo sapiens
gcagggaucuuguacauca

SEQ ID NO: 138902 - RNA, 19 nt, Homo sapiens
ggaccucgcugccaagaaa

SEQ ID NO: 138903 - RNA, 19 nt, Homo sapiens
caagaucgcucaccuuaau

SEQ ID NO: 138904 - RNA, 19 nt, Homo sapiens
gaagaccuaugaacaagaa

SEQ ID NO: 138905 - RNA, 19 nt, Homo sapiens
gaucacaaauguacaguau

SEQ ID NO: 138906 - RNA, 19 nt, Homo sapiens
ccaaagcagucacaaauga

SEQ ID NO: 138907 - RNA, 19 nt, Homo sapiens
ggagcaagcugucccuaaa

SEQ ID NO: 138908 - RNA, 19 nt, Homo sapiens
ggaguucaauccugaguuu

SEQ ID NO: 138909 - RNA, 19 nt, Homo sapiens
caaaucgacuccuaugaaa

SEQ ID NO: 138910 - RNA, 19 nt, Homo sapiens
caaggugacugaagugaaa

SEQ ID NO: 138911 - RNA, 19 nt, Homo sapiens
uaaaggagcugcagacuac

SEQ ID NO: 138912 - RNA, 19 nt, Homo sapiens
ggauacaucugauaaauac

SEQ ID NO: 138913 - RNA, 19 nt, Homo sapiens
gggauaagaugguagaaga

SEQ ID NO: 138914 - RNA, 19 nt, Homo sapiens
gcaggcagcuucaccauca

SEQ ID NO: 138915 - RNA, 19 nt, Homo sapiens
gggcccagguuucuuaaua

SEQ ID NO: 138916 - RNA, 19 nt, Homo sapiens
gaaggugacucucuguuuc

SEQ ID NO: 138917 - RNA, 19 nt, Homo sapiens
ccaugaagcuccucuuuga

SEQ ID NO: 138918 - RNA, 19 nt, Homo sapiens
gaaagcauauucacuggau

SEQ ID NO: 138919 - RNA, 19 nt, Homo sapiens
guacagagauguuguugca

SEQ ID NO: 138920 - RNA, 19 nt, Homo sapiens
gaaaucaccaguaguauuc

SEQ ID NO: 138921 - RNA, 19 nt, Homo sapiens
gcacagccauccacugguu

SEQ ID NO: 138922 - RNA, 19 nt, Homo sapiens
gaagugagguagaagaaag

SEQ ID NO: 138923 - RNA, 19 nt, Homo sapiens
gaaagcaacagcagacaaa

SEQ ID NO: 138924 - RNA, 19 nt, Homo sapiens
gcaucgacauugacuuuaa

SEQ ID NO: 138925 - RNA, 19 nt, Homo sapiens
gcaaaucgacuccuaugaa

SEQ ID NO: 138926 - RNA, 19 nt, Homo sapiens
agacagaagugcucaagaa

SEQ ID NO: 138927 - RNA, 19 nt, Homo sapiens
gaacaugccugagguggau

SEQ ID NO: 138928 - RNA, 19 nt, Homo sapiens
gaacaagaaacucaucuau

SEQ ID NO: 138929 - RNA, 19 nt, Homo sapiens
gcagauggauuacaagucu

SEQ ID NO: 138930 - RNA, 19 nt, Homo sapiens
ggcagaagauuaugacuau

SEQ ID NO: 138931 - RNA, 19 nt, Homo sapiens
cgaaggagaucacuaucaa

SEQ ID NO: 138932 - RNA, 19 nt, Homo sapiens
gaagaacagagaagaguuu

SEQ ID NO: 138933 - RNA, 19 nt, Homo sapiens
gaagagaaguuaggaagca

SEQ ID NO: 138934 - RNA, 19 nt, Homo sapiens
gaaggacuauuauaagaag

SEQ ID NO: 138935 - RNA, 19 nt, Homo sapiens
ggaaagcgaaugcaacaaa

SEQ ID NO: 138936 - RNA, 19 nt, Homo sapiens
ucacaaauguacaguaugu

SEQ ID NO: 138937 - RNA, 19 nt, Homo sapiens
gaugauugcucagaaggua

SEQ ID NO: 138938 - RNA, 19 nt, Homo sapiens
ggacaaagcugcaaaagag

SEQ ID NO: 138939 - RNA, 19 nt, Homo sapiens
gagagcggcuuacucaaga

SEQ ID NO: 138940 - RNA, 19 nt, Homo sapiens
ggauacaccuucaacaauc

SEQ ID NO: 138941 - RNA, 19 nt, Homo sapiens
aaaugaagaugcagacaaa

SEQ ID NO: 138942 - RNA, 19 nt, Homo sapiens
gagcagggaucuuguacau

SEQ ID NO: 138943 - RNA, 19 nt, Homo sapiens
gcaaagaagaggaguaugu

SEQ ID NO: 138944 - RNA, 19 nt, Homo sapiens
cagaaggcauuugcgauua

SEQ ID NO: 138945 - RNA, 19 nt, Homo sapiens
gguaugaagaucugaaaua

SEQ ID NO: 138946 - RNA, 19 nt, Homo sapiens
gaagguggccgucaucaug

SEQ ID NO: 138947 - RNA, 19 nt, Homo sapiens
ugaagaaucucaacacagu

SEQ ID NO: 138948 - RNA, 19 nt, Homo sapiens
aaaggucacuggguuauuu

SEQ ID NO: 138949 - RNA, 19 nt, Homo sapiens
ggaguuggauuuccugcuu

SEQ ID NO: 138950 - RNA, 19 nt, Homo sapiens
gagcaaugguccaagauca

SEQ ID NO: 138951 - RNA, 19 nt, Homo sapiens
caaugugaccucucaguua

SEQ ID NO: 138952 - RNA, 19 nt, Homo sapiens
gaguaacacugaugagaug

SEQ ID NO: 138953 - RNA, 19 nt, Homo sapiens
gcgauuaugucacugaaau

SEQ ID NO: 138954 - RNA, 19 nt, Homo sapiens
caacaaagaucuggaugca

SEQ ID NO: 138955 - RNA, 19 nt, Homo sapiens
ccagguggaugaucugaaa

SEQ ID NO: 138956 - RNA, 19 nt, Homo sapiens
gcauugagcccacaguaaa

SEQ ID NO: 138957 - RNA, 19 nt, Homo sapiens
gcacaagaccuaucagauc

SEQ ID NO: 138958 - RNA, 19 nt, Homo sapiens
ccaaguauguugcuuucuu

SEQ ID NO: 138959 - RNA, 19 nt, Homo sapiens
caagguacuuucaucaaug

SEQ ID NO: 138960 - RNA, 19 nt, Homo sapiens
guaaagcagucgauuagca

SEQ ID NO: 138961 - RNA, 19 nt, Homo sapiens
ggaaccaucuuugacuauu

SEQ ID NO: 138962 - RNA, 19 nt, Homo sapiens
guauguugcuuucuucuug

SEQ ID NO: 138963 - RNA, 19 nt, Homo sapiens
gagcuguggugcugauuga

SEQ ID NO: 138964 - RNA, 19 nt, Homo sapiens
ggagaccggcagaagauua

SEQ ID NO: 138965 - RNA, 19 nt, Homo sapiens
ggacucaccuggaaagcau

SEQ ID NO: 138966 - RNA, 19 nt, Homo sapiens
cagaagaccugcugagaag

SEQ ID NO: 138967 - RNA, 19 nt, Homo sapiens
gcuccugggucaucaauau

SEQ ID NO: 138968 - RNA, 19 nt, Homo sapiens
gaacaagaccaaccugaca

SEQ ID NO: 138969 - RNA, 19 nt, Homo sapiens
ccuuauggcuguuaaagaa

SEQ ID NO: 138970 - RNA, 19 nt, Homo sapiens
ggaagaaauugaagaccau

SEQ ID NO: 138971 - RNA, 19 nt, Homo sapiens
aaacaugggugacuccaau

SEQ ID NO: 138972 - RNA, 19 nt, Homo sapiens
ccagagagaugaaacacau

SEQ ID NO: 138973 - RNA, 19 nt, Homo sapiens
ucaaagccauguacagaga

SEQ ID NO: 138974 - RNA, 19 nt, Homo sapiens
gaaguccgaucucacaaag

SEQ ID NO: 138975 - RNA, 19 nt, Homo sapiens
gccaagaucgcucaccuua

SEQ ID NO: 138976 - RNA, 19 nt, Homo sapiens
gcccgaaccuguauuguca

SEQ ID NO: 138977 - RNA, 19 nt, Homo sapiens
gggcagaguucagcaaaug

SEQ ID NO: 138978 - RNA, 19 nt, Homo sapiens
aagaucagcuuguggacua

SEQ ID NO: 138979 - RNA, 19 nt, Homo sapiens
gugagcagcuggauugaga

SEQ ID NO: 138980 - RNA, 19 nt, Homo sapiens
uuaaagaacggcagaguaa

SEQ ID NO: 138981 - RNA, 19 nt, Homo sapiens
gcaucucugcugaauauua

SEQ ID NO: 138982 - RNA, 19 nt, Homo sapiens
cauggaaucugcagaagga

SEQ ID NO: 138983 - RNA, 19 nt, Homo sapiens
gggacuaucuuuauucaag

SEQ ID NO: 138984 - RNA, 19 nt, Homo sapiens
ggacuacaaugguuaucau

SEQ ID NO: 138985 - RNA, 19 nt, Homo sapiens
gcauaaccuucucugugua

SEQ ID NO: 138986 - RNA, 19 nt, Homo sapiens
caaagcagcagaauggauu

SEQ ID NO: 138987 - RNA, 19 nt, Homo sapiens
agaaagccauggcagauga

SEQ ID NO: 138988 - RNA, 19 nt, Homo sapiens
uggaugaucugaaagcaaa

SEQ ID NO: 138989 - RNA, 19 nt, Homo sapiens
caagaugcgauuagagaua

SEQ ID NO: 138990 - RNA, 19 nt, Homo sapiens
gcaaguggcccagcucaaa

SEQ ID NO: 138991 - RNA, 19 nt, Homo sapiens
ggaccucgcugccaagaaa

SEQ ID NO: 138992 - RNA, 19 nt, Homo sapiens
caaggugacugaagugaaa

SEQ ID NO: 138993 - RNA, 19 nt, Homo sapiens
gggcccagguuucuuaaua

SEQ ID NO: 138994 - RNA, 19 nt, Homo sapiens
gaagaacagagaagaguuu

SEQ ID NO: 138995 - RNA, 19 nt, Homo sapiens
gaagagaaguuaggaagca

SEQ ID NO: 138996 - RNA, 19 nt, Homo sapiens
ggauacaccuucaacaauc

SEQ ID NO: 138997 - RNA, 19 nt, Homo sapiens
aaaggucacuggguuauuu

SEQ ID NO: 138998 - RNA, 19 nt, Homo sapiens
ggaguuggauuuccugcuu

SEQ ID NO: 138999 - RNA, 19 nt, Homo sapiens
caagguacuuucaucaaug

SEQ ID NO: 139000 - RNA, 19 nt, Homo sapiens
ggacuacaaugguuaucau

SEQ ID NO: 139001 - RNA, 19 nt, Homo sapiens
gcauaaccuucucugugua

SEQ ID NO: 139002 - RNA, 19 nt, Homo sapiens
caaagcagcagaauggauu

SEQ ID NO: 139003 - RNA, 19 nt, Homo sapiens
gaguguggccggaugaaua

SEQ ID NO: 139004 - RNA, 19 nt, Homo sapiens
cagcucaccuuucagauuc

SEQ ID NO: 139005 - RNA, 19 nt, Homo sapiens
caagauccauccaauguac

SEQ ID NO: 139006 - RNA, 19 nt, Homo sapiens
ggcccagguuucuuaauaa

SEQ ID NO: 139007 - RNA, 19 nt, Homo sapiens
ucacaaagcagcagaaugg

SEQ ID NO: 139008 - RNA, 19 nt, Homo sapiens
ggagaggugugccuaaggu

SEQ ID NO: 139009 - RNA, 19 nt, Homo sapiens
gcaagauccauccaaugua

SEQ ID NO: 139010 - RNA, 19 nt, Homo sapiens
gcccagguuucuuaauaaa

SEQ ID NO: 139011 - RNA, 19 nt, Homo sapiens
ugaaggauguagaaaguca

SEQ ID NO: 139012 - RNA, 19 nt, Homo sapiens
gggaagagcccuagauuuu

SEQ ID NO: 139013 - RNA, 19 nt, Homo sapiens
gaaguuaggaagcaaauac

SEQ ID NO: 139014 - RNA, 19 nt, Homo sapiens
gauuugcgcuaccuguuug

SEQ ID NO: 139015 - RNA, 19 nt, Homo sapiens
ugaauguccucuacaacuu

SEQ ID NO: 139016 - RNA, 19 nt, Homo sapiens
gcagaaagacgaaaauuug

SEQ ID NO: 139017 - RNA, 19 nt, Homo sapiens
gauacaccuucaacaauca

SEQ ID NO: 139018 - RNA, 19 nt, Homo sapiens
ucaagguacuuucaucaau

SEQ ID NO: 139019 - RNA, 19 nt, Homo sapiens
aggcugagcugaaggaaug

SEQ ID NO: 139020 - RNA, 19 nt, Homo sapiens
ugaauauccucaccagaga

SEQ ID NO: 139021 - RNA, 19 nt, Homo sapiens
ucacugcucuacuucauca

SEQ ID NO: 139022 - RNA, 19 nt, Homo sapiens
aggcaaagcugaaggaucu

SEQ ID NO: 139023 - RNA, 19 nt, Homo sapiens
ggucaaggcacuucuggaa

SEQ ID NO: 139024 - RNA, 19 nt, Homo sapiens
gaggccauaucacagauga

SEQ ID NO: 139025 - RNA, 19 nt, Homo sapiens
cuacauccauggccucuuc

SEQ ID NO: 139026 - RNA, 19 nt, Homo sapiens
gaacagagaagaguuuagg

SEQ ID NO: 139027 - RNA, 19 nt, Homo sapiens
gaaguuagugcuuuaggau

SEQ ID NO: 139028 - RNA, 19 nt, Homo sapiens
acaaggcccuggacaacuu

SEQ ID NO: 139029 - RNA, 19 nt, Homo sapiens
guccgaauguccugagaaa

SEQ ID NO: 139030 - RNA, 19 nt, Homo sapiens
ccacggcucgcaagaauga

SEQ ID NO: 139031 - RNA, 19 nt, Homo sapiens
caacauggacuacaauggu

SEQ ID NO: 139032 - RNA, 19 nt, Homo sapiens
aaacuuggauacaccuuca

SEQ ID NO: 139033 - RNA, 19 nt, Homo sapiens
uguagaaagucaaggaaga

SEQ ID NO: 139034 - RNA, 19 nt, Homo sapiens
gggccucacugcucuacuu

SEQ ID NO: 139035 - RNA, 19 nt, Homo sapiens
aaacagugcugguggaaaa

SEQ ID NO: 139036 - RNA, 19 nt, Homo sapiens
ucagcacccuggagaagaa

SEQ ID NO: 139037 - RNA, 19 nt, Homo sapiens
gugauaagcugaccuaccu

SEQ ID NO: 139038 - RNA, 19 nt, Homo sapiens
gggccaaggugacugaagu

SEQ ID NO: 139039 - RNA, 19 nt, Homo sapiens
gccugaaguuagugcuuua

SEQ ID NO: 139040 - RNA, 19 nt, Homo sapiens
ccgaauguccugagaaaga

SEQ ID NO: 139041 - RNA, 19 nt, Homo sapiens
ggaagaauucucuaaucug

SEQ ID NO: 139042 - RNA, 19 nt, Homo sapiens
gaaccgagaagucaaugca

SEQ ID NO: 139043 - RNA, 19 nt, Homo sapiens
ugacgaagaagaacagaga

SEQ ID NO: 139044 - RNA, 19 nt, Homo sapiens
ugaaguuagugcuuuagga

SEQ ID NO: 139045 - RNA, 19 nt, Homo sapiens
cuacagcugccugaaguua

SEQ ID NO: 139046 - RNA, 19 nt, Homo sapiens
gagaacagccacccagagu

SEQ ID NO: 139047 - RNA, 19 nt, Homo sapiens
caaccucauuugaagaauc

SEQ ID NO: 139048 - RNA, 19 nt, Homo sapiens
uaaucuggaucgggacaua

SEQ ID NO: 139049 - RNA, 19 nt, Homo sapiens
caaccuaauagacagcaua

SEQ ID NO: 139050 - RNA, 19 nt, Homo sapiens
gaagaagaacagagaagag

SEQ ID NO: 139051 - RNA, 19 nt, Homo sapiens
cuucaacaaucagaacuuu

SEQ ID NO: 139052 - RNA, 19 nt, Homo sapiens
agaauucucuaaucuggau

SEQ ID NO: 139053 - RNA, 19 nt, Homo sapiens
uggaagaauucucuaaucu

SEQ ID NO: 139054 - RNA, 19 nt, Homo sapiens
caacaggaagguuauucuu

SEQ ID NO: 139055 - RNA, 19 nt, Homo sapiens
ucaaugcaguggaguugga

SEQ ID NO: 139056 - RNA, 19 nt, Homo sapiens
gagggcugcuccugacgaa

SEQ ID NO: 139057 - RNA, 19 nt, Homo sapiens
ucagcaagauccauccaau

SEQ ID NO: 139058 - RNA, 19 nt, Homo sapiens
ggaaugugggcccagguuu

SEQ ID NO: 139059 - RNA, 19 nt, Homo sapiens
gaaggagaacugucuuugg

SEQ ID NO: 139060 - RNA, 19 nt, Homo sapiens
caacuucacucaggacacu

SEQ ID NO: 139061 - RNA, 19 nt, Homo sapiens
gaaaggucacuggguuauu

SEQ ID NO: 139062 - RNA, 19 nt, Homo sapiens
ugaacgaccucagcaagau

SEQ ID NO: 139063 - RNA, 19 nt, Homo sapiens
gaacgguaagaaaccauga

SEQ ID NO: 139064 - RNA, 19 nt, Homo sapiens
agauggcccugcaauguga

SEQ ID NO: 139065 - RNA, 19 nt, Homo sapiens
agaaugcccuguacuucga

SEQ ID NO: 139066 - RNA, 19 nt, Homo sapiens
auggagaacuuacagaaug

SEQ ID NO: 139067 - RNA, 19 nt, Homo sapiens
acagaugacugggacagaa

SEQ ID NO: 139068 - RNA, 19 nt, Homo sapiens
ggaccagccacuccuaugu

SEQ ID NO: 139069 - RNA, 19 nt, Homo sapiens
caauggaagaauucucuaa

SEQ ID NO: 139070 - RNA, 19 nt, Homo sapiens
gaacuuccugggagaaaca

SEQ ID NO: 139071 - RNA, 19 nt, Homo sapiens
gcacucacaauucuguaga

SEQ ID NO: 139072 - RNA, 19 nt, Homo sapiens
ccagauggcccugcaaugu

SEQ ID NO: 139073 - RNA, 19 nt, Homo sapiens
guccacggcucgcaagaau

SEQ ID NO: 139074 - RNA, 19 nt, Homo sapiens
guuccugacugccaucaug

SEQ ID NO: 139075 - RNA, 19 nt, Homo sapiens
gggauggaaucgcucauac

SEQ ID NO: 139076 - RNA, 19 nt, Homo sapiens
gcacaaggcccuggacaac

SEQ ID NO: 139077 - RNA, 19 nt, Homo sapiens
guagaaagucaaggaagaa

SEQ ID NO: 139078 - RNA, 19 nt, Homo sapiens
acacaggcugggaucauua

SEQ ID NO: 139079 - RNA, 19 nt, Homo sapiens
ggacgggugacuuuacaau

SEQ ID NO: 139080 - RNA, 19 nt, Homo sapiens
uuggagagaucauguaugg

SEQ ID NO: 139081 - RNA, 19 nt, Homo sapiens
agacggaguuuaagagcau

SEQ ID NO: 139082 - RNA, 19 nt, Homo sapiens
ucaacaaucagaacuuuca

SEQ ID NO: 139083 - RNA, 19 nt, Homo sapiens
guggggagcugucaaggua

SEQ ID NO: 139084 - RNA, 19 nt, Homo sapiens
aauccgaucucacaaagca

SEQ ID NO: 139085 - RNA, 19 nt, Homo sapiens
gaaugugggcccagguuuc

SEQ ID NO: 139086 - RNA, 19 nt, Homo sapiens
gaaaagaugagauccacuu

SEQ ID NO: 139087 - RNA, 19 nt, Homo sapiens
caggcaacauggacuacaa

SEQ ID NO: 139088 - RNA, 19 nt, Homo sapiens
gcaaagguccccuaugaug

SEQ ID NO: 139089 - RNA, 19 nt, Homo sapiens
gaagaaaacuuggauacac

SEQ ID NO: 139090 - RNA, 19 nt, Homo sapiens
ggauguagaaagucaagga

SEQ ID NO: 139091 - RNA, 19 nt, Homo sapiens
ucagagaccuuucuucaua

SEQ ID NO: 139092 - RNA, 19 nt, Homo sapiens
caaaggauauuccagauuc

SEQ ID NO: 139093 - RNA, 19 nt, Homo sapiens
acacucggguuaagaaaua

SEQ ID NO: 139094 - RNA, 19 nt, Homo sapiens
cgacucggcucuucccuuu

SEQ ID NO: 139095 - RNA, 19 nt, Homo sapiens
caagaaaccugugcuuaca

SEQ ID NO: 139096 - RNA, 19 nt, Homo sapiens
ggacaucaccaucaucuca

SEQ ID NO: 139097 - RNA, 19 nt, Homo sapiens
ucacagaggucagggaguu

SEQ ID NO: 139098 - RNA, 19 nt, Homo sapiens
ccacacagagccauuguuu

SEQ ID NO: 139099 - RNA, 19 nt, Homo sapiens
ggagaaaauugucaucaaa

SEQ ID NO: 139100 - RNA, 19 nt, Homo sapiens
ggucacagcugccugaacu

SEQ ID NO: 139101 - RNA, 19 nt, Homo sapiens
gcaagaaaccugugcuuac

SEQ ID NO: 139102 - RNA, 19 nt, Homo sapiens
gaucgacgcucucuaugac

SEQ ID NO: 139103 - RNA, 19 nt, Homo sapiens
gaucgcagccuucaacauc

SEQ ID NO: 139104 - RNA, 19 nt, Homo sapiens
acacacagccuauugucua

SEQ ID NO: 139105 - RNA, 19 nt, Homo sapiens
ggacggaacagcuauaagg

SEQ ID NO: 139106 - RNA, 19 nt, Homo sapiens
ggacagcuacuacuacgau

SEQ ID NO: 139107 - RNA, 19 nt, Homo sapiens
acucggcucuucccuuuaa

SEQ ID NO: 139108 - RNA, 19 nt, Homo sapiens
gcuauaaugagccaugauu

SEQ ID NO: 139109 - RNA, 19 nt, Homo sapiens
ucagggaguuugccauugu

SEQ ID NO: 139110 - RNA, 19 nt, Homo sapiens
caacacacacucggguuaa

SEQ ID NO: 139111 - RNA, 19 nt, Homo sapiens
ccaacacacacucggguua

SEQ ID NO: 139112 - RNA, 19 nt, Homo sapiens
ccuauugucuaccucaaga

SEQ ID NO: 139113 - RNA, 19 nt, Homo sapiens
ggguuaagaaauaccuuua

SEQ ID NO: 139114 - RNA, 19 nt, Homo sapiens
agaccaagauguccaaugc

SEQ ID NO: 139115 - RNA, 19 nt, Homo sapiens
ggucagggaguuugccauu

SEQ ID NO: 139116 - RNA, 19 nt, Homo sapiens
caaccgagagccagccauu

SEQ ID NO: 139117 - RNA, 19 nt, Homo sapiens
gaccuuucuucauagacua

SEQ ID NO: 139118 - RNA, 19 nt, Homo sapiens
cuaaacacacagccuauug

SEQ ID NO: 139119 - RNA, 19 nt, Homo sapiens
caccagacaccuaucacua

SEQ ID NO: 139120 - RNA, 19 nt, Homo sapiens
gcauucucgucaucucuga

SEQ ID NO: 139121 - RNA, 19 nt, Homo sapiens
ggauauuccagauucuuga

SEQ ID NO: 139122 - RNA, 19 nt, Homo sapiens
caacccaccuaugcggaaa

SEQ ID NO: 139123 - RNA, 19 nt, Homo sapiens
caguggaggugaugcugaa

SEQ ID NO: 139124 - RNA, 19 nt, Homo sapiens
ccagauucuugacagcauu

SEQ ID NO: 139125 - RNA, 19 nt, Homo sapiens
gggcuccauuugcaccuuu

SEQ ID NO: 139126 - RNA, 19 nt, Homo sapiens
ggaagcugcuggacaaccu

SEQ ID NO: 139127 - RNA, 19 nt, Homo sapiens
cagagaccuuucuucauag

SEQ ID NO: 139128 - RNA, 19 nt, Homo sapiens
ucacagcugccugaacuuu

SEQ ID NO: 139129 - RNA, 19 nt, Homo sapiens
gugcaagggacacgggaua

SEQ ID NO: 139130 - RNA, 19 nt, Homo sapiens
ucaaaggauauuccagauu

SEQ ID NO: 139131 - RNA, 19 nt, Homo sapiens
ucagcuacauugugcagau

SEQ ID NO: 139132 - RNA, 19 nt, Homo sapiens
ucugagcccuggcgguuga

SEQ ID NO: 139133 - RNA, 19 nt, Homo sapiens
uauaaugagccaugauugu

SEQ ID NO: 139134 - RNA, 19 nt, Homo sapiens
cgucaucucugaggacauc

SEQ ID NO: 139135 - RNA, 19 nt, Homo sapiens
cagaaagaaacacgugcua

SEQ ID NO: 139136 - RNA, 19 nt, Homo sapiens
gcgguugaggcuauaauga

SEQ ID NO: 139137 - RNA, 19 nt, Homo sapiens
gaggacaucaccaucaucu

SEQ ID NO: 139138 - RNA, 19 nt, Homo sapiens
uaaacacacagccuauugu

SEQ ID NO: 139139 - RNA, 19 nt, Homo sapiens
acagcugccugaacuuuua

SEQ ID NO: 139140 - RNA, 19 nt, Homo sapiens
uaagugcaaacgugauuau

SEQ ID NO: 139141 - RNA, 19 nt, Homo sapiens
ggacaaccucaaucaggau

SEQ ID NO: 139142 - RNA, 19 nt, Homo sapiens
cugcuuggcuggcaauugg

SEQ ID NO: 139143 - RNA, 19 nt, Homo sapiens
uggaggacgucauguugau

SEQ ID NO: 139144 - RNA, 19 nt, Homo sapiens
ggaugcaccagacaccuau

SEQ ID NO: 139145 - RNA, 19 nt, Homo sapiens
agagaccuuucuucauaga

SEQ ID NO: 139146 - RNA, 19 nt, Homo sapiens
cuucagagaccuuucuuca

SEQ ID NO: 139147 - RNA, 19 nt, Homo sapiens
gggcugcagcuaugugaga

SEQ ID NO: 139148 - RNA, 19 nt, Homo sapiens
ccuucaacauccagacauu

SEQ ID NO: 139149 - RNA, 19 nt, Homo sapiens
gcuagcaacccaccuaugc

SEQ ID NO: 139150 - RNA, 19 nt, Homo sapiens
gaaccuuuggccuuguuau

SEQ ID NO: 139151 - RNA, 19 nt, Homo sapiens
gguaaauaaagcucaagga

SEQ ID NO: 139152 - RNA, 19 nt, Homo sapiens
cagggaguuugccauuguu

SEQ ID NO: 139153 - RNA, 19 nt, Homo sapiens
auaaggagcgcuaccuguu

SEQ ID NO: 139154 - RNA, 19 nt, Homo sapiens
caagggacacgggauagga

SEQ ID NO: 139155 - RNA, 19 nt, Homo sapiens
ggacgcaguagccgagauc

SEQ ID NO: 139156 - RNA, 19 nt, Homo sapiens
uaaggagcgcuaccuguuc

SEQ ID NO: 139157 - RNA, 19 nt, Homo sapiens
gacggaacagcuauaagga

SEQ ID NO: 139158 - RNA, 19 nt, Homo sapiens
ggaaccuuuggccuuguua

SEQ ID NO: 139159 - RNA, 19 nt, Homo sapiens
gggcuuggaggacgucaug

SEQ ID NO: 139160 - RNA, 19 nt, Homo sapiens
agaguugccugcaccugau

SEQ ID NO: 139161 - RNA, 19 nt, Homo sapiens
gaggagggaggauuaucug

SEQ ID NO: 139162 - RNA, 19 nt, Homo sapiens
gaaaauugucaucaaagga

SEQ ID NO: 139163 - RNA, 19 nt, Homo sapiens
ccagccuccugcagaguug

SEQ ID NO: 139164 - RNA, 19 nt, Homo sapiens
ggcugaggagggaggauua

SEQ ID NO: 139165 - RNA, 19 nt, Homo sapiens
uggaggugaugcugaagug

SEQ ID NO: 139166 - RNA, 19 nt, Homo sapiens
caaccucaaucaggaugca

SEQ ID NO: 139167 - RNA, 19 nt, Homo sapiens
gcacugccaggccuugaag

SEQ ID NO: 139168 - RNA, 19 nt, Homo sapiens
acacagagccauuguuuuc

SEQ ID NO: 139169 - RNA, 19 nt, Homo sapiens
caaaacaaaagaaccaaga

SEQ ID NO: 139170 - RNA, 19 nt, Homo sapiens
gagaccaagauguccaaug

SEQ ID NO: 139171 - RNA, 19 nt, Homo sapiens
aaagaaacacgugcuagca

SEQ ID NO: 139172 - RNA, 19 nt, Homo sapiens
cuaagugcaaacgugauua

SEQ ID NO: 139173 - RNA, 19 nt, Homo sapiens
aaugcgggcugcagcuaug

SEQ ID NO: 139174 - RNA, 19 nt, Homo sapiens
gcuuggaggacgucauguu

SEQ ID NO: 139175 - RNA, 19 nt, Homo sapiens
gucagggaguuugccauug

SEQ ID NO: 139176 - RNA, 19 nt, Homo sapiens
cgagagccagccauuguca

SEQ ID NO: 139177 - RNA, 19 nt, Homo sapiens
gcaccagacaccuaucacu

SEQ ID NO: 139178 - RNA, 19 nt, Homo sapiens
aagaaacacgugcuagcaa

SEQ ID NO: 139179 - RNA, 19 nt, Homo sapiens
aaacacacagccuauuguc

SEQ ID NO: 139180 - RNA, 19 nt, Homo sapiens
gccaggccuugaagugcuu

SEQ ID NO: 139181 - RNA, 19 nt, Homo sapiens
agaucgacgcucucuauga

SEQ ID NO: 139182 - RNA, 19 nt, Homo sapiens
agccagccauugucagguu

SEQ ID NO: 139183 - RNA, 19 nt, Homo sapiens
cauuugcaccuuuggaugu

SEQ ID NO: 139184 - RNA, 19 nt, Homo sapiens
gaaugaagauguuguauga

SEQ ID NO: 139185 - RNA, 19 nt, Homo sapiens
ggucauguguuaacuauaa

SEQ ID NO: 139186 - RNA, 19 nt, Homo sapiens
gaaggaaaguuacugagaa

SEQ ID NO: 139187 - RNA, 19 nt, Homo sapiens
cuagaagggucauguguua

SEQ ID NO: 139188 - RNA, 19 nt, Homo sapiens
gaaaguuacugagaacaaa

SEQ ID NO: 139189 - RNA, 19 nt, Homo sapiens
ccagagcgcuugcaucaaa

SEQ ID NO: 139190 - RNA, 19 nt, Homo sapiens
gcaccuacauggagacgua

SEQ ID NO: 139191 - RNA, 19 nt, Homo sapiens
gcaaacaccgggaaacauu

SEQ ID NO: 139192 - RNA, 19 nt, Homo sapiens
caacaucuccacacagaaa

SEQ ID NO: 139193 - RNA, 19 nt, Homo sapiens
gaaagaggaaugaagaugu

SEQ ID NO: 139194 - RNA, 19 nt, Homo sapiens
agacguauguguacuucua

SEQ ID NO: 139195 - RNA, 19 nt, Homo sapiens
ggcaacaucuccacacaga

SEQ ID NO: 139196 - RNA, 19 nt, Homo sapiens
cgaugaggaugacgucuuu

SEQ ID NO: 139197 - RNA, 19 nt, Homo sapiens
gcagucaggccuguuauaa

SEQ ID NO: 139198 - RNA, 19 nt, Homo sapiens
caaggagggugguuaaucu

SEQ ID NO: 139199 - RNA, 19 nt, Homo sapiens
aaagaggaaugaagauguu

SEQ ID NO: 139200 - RNA, 19 nt, Homo sapiens
uaucaggaguggagacaaa

SEQ ID NO: 139201 - RNA, 19 nt, Homo sapiens
ucacauuuaugguuuggaa

SEQ ID NO: 139202 - RNA, 19 nt, Homo sapiens
ggaaaguuacugagaacaa

SEQ ID NO: 139203 - RNA, 19 nt, Homo sapiens
gcuguagucuguguuggua

SEQ ID NO: 139204 - RNA, 19 nt, Homo sapiens
ggaaugaagauguuguaug

SEQ ID NO: 139205 - RNA, 19 nt, Homo sapiens
gaaacauuuuggcucauua

SEQ ID NO: 139206 - RNA, 19 nt, Homo sapiens
cagccucacuguucuguug

SEQ ID NO: 139207 - RNA, 19 nt, Homo sapiens
cuacagccaucccaugaga

SEQ ID NO: 139208 - RNA, 19 nt, Homo sapiens
gaagggaggguucagaaag

SEQ ID NO: 139209 - RNA, 19 nt, Homo sapiens
caagaaggaaaguuacuga

SEQ ID NO: 139210 - RNA, 19 nt, Homo sapiens
ugauuuggcucuuguucuu

SEQ ID NO: 139211 - RNA, 19 nt, Homo sapiens
ccaaagugcugggauuaca

SEQ ID NO: 139212 - RNA, 19 nt, Homo sapiens
ugguuaaucugcuauauca

SEQ ID NO: 139213 - RNA, 19 nt, Homo sapiens
ucagaaagaggaaugaaga

SEQ ID NO: 139214 - RNA, 19 nt, Homo sapiens
ggaagggaggguucagaaa

SEQ ID NO: 139215 - RNA, 19 nt, Homo sapiens
gcacacugcggcugccuuu

SEQ ID NO: 139216 - RNA, 19 nt, Homo sapiens
gagggugguuaaucugcua

SEQ ID NO: 139217 - RNA, 19 nt, Homo sapiens
ggagacguauguguacuuc

SEQ ID NO: 139218 - RNA, 19 nt, Homo sapiens
ggguaucgcgauccacuua

SEQ ID NO: 139219 - RNA, 19 nt, Homo sapiens
caccaguuauguaagcuaa

SEQ ID NO: 139220 - RNA, 19 nt, Homo sapiens
gaggaaugaagauguugua

SEQ ID NO: 139221 - RNA, 19 nt, Homo sapiens
caacaacagggacagaaga

SEQ ID NO: 139222 - RNA, 19 nt, Homo sapiens
ggguaagaaucaccaggaa

SEQ ID NO: 139223 - RNA, 19 nt, Homo sapiens
ggacacuugugcagcagau

SEQ ID NO: 139224 - RNA, 19 nt, Homo sapiens
ugaacgcccucuacgaugu

SEQ ID NO: 139225 - RNA, 19 nt, Homo sapiens
caaacaccgggaaacauuu

SEQ ID NO: 139226 - RNA, 19 nt, Homo sapiens
ggacaccuuaguucggaua

SEQ ID NO: 139227 - RNA, 19 nt, Homo sapiens
cuacaaggagggugguuaa

SEQ ID NO: 139228 - RNA, 19 nt, Homo sapiens
aagggaggguucagaaaga

SEQ ID NO: 139229 - RNA, 19 nt, Homo sapiens
gcccaggccuuucgcaucu

SEQ ID NO: 139230 - RNA, 19 nt, Homo sapiens
ccagauuggugagauagga

SEQ ID NO: 139231 - RNA, 19 nt, Homo sapiens
acgcccagcccauaauuua

SEQ ID NO: 139232 - RNA, 19 nt, Homo sapiens
guaagaaucaccaggaaac

SEQ ID NO: 139233 - RNA, 19 nt, Homo sapiens
guacaacgaugaggaugac

SEQ ID NO: 139234 - RNA, 19 nt, Homo sapiens
caacugcacuccucuuccu

SEQ ID NO: 139235 - RNA, 19 nt, Homo sapiens
gcuagaagggucauguguu

SEQ ID NO: 139236 - RNA, 19 nt, Homo sapiens
ggaaacauuuuggcucauu

SEQ ID NO: 139237 - RNA, 19 nt, Homo sapiens
gggaagggaggguucagaa

SEQ ID NO: 139238 - RNA, 19 nt, Homo sapiens
gcugaacgcccucuacgau

SEQ ID NO: 139239 - RNA, 19 nt, Homo sapiens
cgagaacucaaucgauuug

SEQ ID NO: 139240 - RNA, 19 nt, Homo sapiens
gguaagaaucaccaggaaa

SEQ ID NO: 139241 - RNA, 19 nt, Homo sapiens
cugcaugccugguaaaguc

SEQ ID NO: 139242 - RNA, 19 nt, Homo sapiens
gccagguaguguaguauca

SEQ ID NO: 139243 - RNA, 19 nt, Homo sapiens
guuccuacguguacaacga

SEQ ID NO: 139244 - RNA, 19 nt, Homo sapiens
ucacgacuguggccagauc

SEQ ID NO: 139245 - RNA, 19 nt, Homo sapiens
gaagggucauguguuaacu

SEQ ID NO: 139246 - RNA, 19 nt, Homo sapiens
gcuacaaggagggugguua

SEQ ID NO: 139247 - RNA, 19 nt, Homo sapiens
ccagggagcaggugaugga

SEQ ID NO: 139248 - RNA, 19 nt, Homo sapiens
ggugguuaaucugcuauau

SEQ ID NO: 139249 - RNA, 19 nt, Homo sapiens
cugccugccuuguuugauu

SEQ ID NO: 139250 - RNA, 19 nt, Homo sapiens
acacugcggcugccuuuga

SEQ ID NO: 139251 - RNA, 19 nt, Homo sapiens
agaaggaaaguuacugaga

SEQ ID NO: 139252 - RNA, 19 nt, Homo sapiens
augaagauguuguaugaca

SEQ ID NO: 139253 - RNA, 19 nt, Homo sapiens
ccucucagccucacuguuc

SEQ ID NO: 139254 - RNA, 19 nt, Homo sapiens
gcacccacugcaccuauga

SEQ ID NO: 139255 - RNA, 19 nt, Homo sapiens
cuaaggccguagagaagga

SEQ ID NO: 139256 - RNA, 19 nt, Homo sapiens
augagaagcugaguggauu

SEQ ID NO: 139257 - RNA, 19 nt, Homo sapiens
ggacucagaacccaacaac

SEQ ID NO: 139258 - RNA, 19 nt, Homo sapiens
gcaccaguuauguaagcua

SEQ ID NO: 139259 - RNA, 19 nt, Homo sapiens
aaucugcaccaguuaugua

SEQ ID NO: 139260 - RNA, 19 nt, Homo sapiens
gcagagcaaggacgugauc

SEQ ID NO: 139261 - RNA, 19 nt, Homo sapiens
gccaugcacuacccaacug

SEQ ID NO: 139262 - RNA, 19 nt, Homo sapiens
gaggcagacuuggugacaa

SEQ ID NO: 139263 - RNA, 19 nt, Homo sapiens
gaaaaucugcaccaguuau

SEQ ID NO: 139264 - RNA, 19 nt, Homo sapiens
gcuucugcaugccugguaa

SEQ ID NO: 139265 - RNA, 19 nt, Homo sapiens
guaucgcgauccacuuaag

SEQ ID NO: 139266 - RNA, 19 nt, Homo sapiens
cagaucauguguggacugu

SEQ ID NO: 139267 - RNA, 19 nt, Homo sapiens
ccugggugcuguagucugu

SEQ ID NO: 139268 - RNA, 19 nt, Homo sapiens
uauuguggauggguaagaa

SEQ ID NO: 139269 - RNA, 19 nt, Homo sapiens
aaacccagauuggugagau

SEQ ID NO: 139270 - RNA, 19 nt, Homo sapiens
augacaagaaggaaaguua

SEQ ID NO: 139271 - RNA, 19 nt, Homo sapiens
uaccacgucgaauccauua

SEQ ID NO: 139272 - RNA, 19 nt, Homo sapiens
ugccugccuuguuugauuu

SEQ ID NO: 139273 - RNA, 19 nt, Homo sapiens
gaacgcccucuacgaugug

SEQ ID NO: 139274 - RNA, 19 nt, Homo sapiens
gaaucaccaggaaaccauu

SEQ ID NO: 139275 - RNA, 19 nt, Homo sapiens
caugagaagcugaguggau

SEQ ID NO: 139276 - RNA, 19 nt, Homo sapiens
gggcuugugccuagauuag

SEQ ID NO: 139277 - RNA, 19 nt, Homo sapiens
agggucauguguuaacuau

SEQ ID NO: 139278 - RNA, 19 nt, Homo sapiens
ccaguuauguaagcuaaaa

SEQ ID NO: 139279 - RNA, 19 nt, Homo sapiens
uauaauccggugaacaaug

SEQ ID NO: 139280 - RNA, 19 nt, Homo sapiens
uguccgagcaccucauuug

SEQ ID NO: 139281 - RNA, 19 nt, Homo sapiens
cagcaaacaccgggaaaca

SEQ ID NO: 139282 - RNA, 19 nt, Homo sapiens
ggugagauaggacacuugu

SEQ ID NO: 139283 - RNA, 19 nt, Homo sapiens
gcugacugcgcuucacuga

SEQ ID NO: 139284 - RNA, 19 nt, Homo sapiens
gcagugaggucuucaagug

SEQ ID NO: 139285 - RNA, 19 nt, Homo sapiens
gagcuucggugacagcaaa

SEQ ID NO: 139286 - RNA, 19 nt, Homo sapiens
caucggagccuucaacauu

SEQ ID NO: 139287 - RNA, 19 nt, Homo sapiens
acaaggagauguaccuguu

SEQ ID NO: 139288 - RNA, 19 nt, Homo sapiens
agauguaccuguucgugua

SEQ ID NO: 139289 - RNA, 19 nt, Homo sapiens
gagcacgaguacagcuuug

SEQ ID NO: 139290 - RNA, 19 nt, Homo sapiens
gaggagcagugaggucuuc

SEQ ID NO: 139291 - RNA, 19 nt, Homo sapiens
gauccuggcuggcuaugac

SEQ ID NO: 139292 - RNA, 19 nt, Homo sapiens
ggaccagacucaggcucuu

SEQ ID NO: 139293 - RNA, 19 nt, Homo sapiens
gugaugugcugcucuguac

SEQ ID NO: 139294 - RNA, 19 nt, Homo sapiens
cacagaaccuggugcugau

SEQ ID NO: 139295 - RNA, 19 nt, Homo sapiens
gaagauccuggcuggcuau

SEQ ID NO: 139296 - RNA, 19 nt, Homo sapiens
caacgccgacugcagcuau

SEQ ID NO: 139297 - RNA, 19 nt, Homo sapiens
gcagcaucaucgcgaagau

SEQ ID NO: 139298 - RNA, 19 nt, Homo sapiens
gcacgaguacagcuuugug

SEQ ID NO: 139299 - RNA, 19 nt, Homo sapiens
gacccuggcucugaggaau

SEQ ID NO: 139300 - RNA, 19 nt, Homo sapiens
auucagagcuucggugaca

SEQ ID NO: 139301 - RNA, 19 nt, Homo sapiens
gcaccgacgacaugcuguu

SEQ ID NO: 139302 - RNA, 19 nt, Homo sapiens
ggagaucgacgcgcucuac

SEQ ID NO: 139303 - RNA, 19 nt, Homo sapiens
gagcagugaggucuucaag

SEQ ID NO: 139304 - RNA, 19 nt, Homo sapiens
ggcagccacccuucaguga

SEQ ID NO: 139305 - RNA, 19 nt, Homo sapiens
cgagcacgaguacagcuuu

SEQ ID NO: 139306 - RNA, 19 nt, Homo sapiens
ccucaaguuccaccgauga

SEQ ID NO: 139307 - RNA, 19 nt, Homo sapiens
cgugaugugcugcucugua

SEQ ID NO: 139308 - RNA, 19 nt, Homo sapiens
ucugaggaauggcccaaca

SEQ ID NO: 139309 - RNA, 19 nt, Homo sapiens
ugccaucagcgaccacuuu

SEQ ID NO: 139310 - RNA, 19 nt, Homo sapiens
ucggagccuucaacauuca

SEQ ID NO: 139311 - RNA, 19 nt, Homo sapiens
caaggagauguaccuguuc

SEQ ID NO: 139312 - RNA, 19 nt, Homo sapiens
gccgggaccaguacaagga

SEQ ID NO: 139313 - RNA, 19 nt, Homo sapiens
ccaagggucucaucuuauu

SEQ ID NO: 139314 - RNA, 19 nt, Homo sapiens
caaacgcugugacaucaua

SEQ ID NO: 139315 - RNA, 19 nt, Homo sapiens
gacaagaaaucgucaguuc

SEQ ID NO: 139316 - RNA, 19 nt, Homo sapiens
gaagaggaguuaucacuac

SEQ ID NO: 139317 - RNA, 19 nt, Homo sapiens
uggagaagcugaacagaaa

SEQ ID NO: 139318 - RNA, 19 nt, Homo sapiens
ucaaagacuucgugauuau

SEQ ID NO: 139319 - RNA, 19 nt, Homo sapiens
ggaagaaacacauauaaag

SEQ ID NO: 139320 - RNA, 19 nt, Homo sapiens
gucaaagacuucgugauua

SEQ ID NO: 139321 - RNA, 19 nt, Homo sapiens
ggaguuaucacuaccauga

SEQ ID NO: 139322 - RNA, 19 nt, Homo sapiens
ggagaucgaugaguugguu

SEQ ID NO: 139323 - RNA, 19 nt, Homo sapiens
uuaaggagaucgaugaguu

SEQ ID NO: 139324 - RNA, 19 nt, Homo sapiens
gaaaucgucaguucuguug

SEQ ID NO: 139325 - RNA, 19 nt, Homo sapiens
gcuggaaggcggagaauuu

SEQ ID NO: 139326 - RNA, 19 nt, Homo sapiens
ggagaggcauaacguacaa

SEQ ID NO: 139327 - RNA, 19 nt, Homo sapiens
gcacugcugucuucucaca

SEQ ID NO: 139328 - RNA, 19 nt, Homo sapiens
caauaugccuuucucuaca

SEQ ID NO: 139329 - RNA, 19 nt, Homo sapiens
ggucucaucuuauuaacca

SEQ ID NO: 139330 - RNA, 19 nt, Homo sapiens
gcucucggcuuggaagaaa

SEQ ID NO: 139331 - RNA, 19 nt, Homo sapiens
ccacuuuccaguugaauuu

SEQ ID NO: 139332 - RNA, 19 nt, Homo sapiens
cuuacaagcugacugaaga

SEQ ID NO: 139333 - RNA, 19 nt, Homo sapiens
ugucaaagacuucgugauu

SEQ ID NO: 139334 - RNA, 19 nt, Homo sapiens
aaccauuucuugccucuaa

SEQ ID NO: 139335 - RNA, 19 nt, Homo sapiens
gagaagcugaacagaaauu

SEQ ID NO: 139336 - RNA, 19 nt, Homo sapiens
gcaagcaggaagacaagaa

SEQ ID NO: 139337 - RNA, 19 nt, Homo sapiens
gaagaagagcaccaacugu

SEQ ID NO: 139338 - RNA, 19 nt, Homo sapiens
ggaagaacauccgcuugag

SEQ ID NO: 139339 - RNA, 19 nt, Homo sapiens
ccaagaaggccuggaagaa

SEQ ID NO: 139340 - RNA, 19 nt, Homo sapiens
ccauggaugucauugugaa

SEQ ID NO: 139341 - RNA, 19 nt, Homo sapiens
ggaugucagcgaccacuuu

SEQ ID NO: 139342 - RNA, 19 nt, Homo sapiens
gugcuuagaggacaagaaa

SEQ ID NO: 139343 - RNA, 19 nt, Homo sapiens
aagaaggccuggaagaaca

SEQ ID NO: 139344 - RNA, 19 nt, Homo sapiens
agacauccguuaaggagau

SEQ ID NO: 139345 - RNA, 19 nt, Homo sapiens
agacaagaaugccauggau

SEQ ID NO: 139346 - RNA, 19 nt, Homo sapiens
caagggucucaucuuauua

SEQ ID NO: 139347 - RNA, 19 nt, Homo sapiens
gaaggcggagaauuucauu

SEQ ID NO: 139348 - RNA, 19 nt, Homo sapiens
ccacacugcugucaaagac

SEQ ID NO: 139349 - RNA, 19 nt, Homo sapiens
ugaagaggaguuaucacua

SEQ ID NO: 139350 - RNA, 19 nt, Homo sapiens
ggacaagaaaucgucaguu

SEQ ID NO: 139351 - RNA, 19 nt, Homo sapiens
ggauggagacgcagaugug

SEQ ID NO: 139352 - RNA, 19 nt, Homo sapiens
caaggagaggcauaacgua

SEQ ID NO: 139353 - RNA, 19 nt, Homo sapiens
uuucaugggugacuucaau

SEQ ID NO: 139354 - RNA, 19 nt, Homo sapiens
ccagagacauccguuaagg

SEQ ID NO: 139355 - RNA, 19 nt, Homo sapiens
acacugcugucaaagacuu

SEQ ID NO: 139356 - RNA, 19 nt, Homo sapiens
gauuagcucucggcuugga

SEQ ID NO: 139357 - RNA, 19 nt, Homo sapiens
aaucgucaguucuguuguu

SEQ ID NO: 139358 - RNA, 19 nt, Homo sapiens
gaaaagcuggugucuguga

SEQ ID NO: 139359 - RNA, 19 nt, Homo sapiens
caucaaacgcugugacauc

SEQ ID NO: 139360 - RNA, 19 nt, Homo sapiens
cgaccacuuuccaguugaa

SEQ ID NO: 139361 - RNA, 19 nt, Homo sapiens
ugacaggauugugcuuaga

SEQ ID NO: 139362 - RNA, 19 nt, Homo sapiens
gaaaucaaggacagcaaca

SEQ ID NO: 139363 - RNA, 19 nt, Homo sapiens
gcuuagaggacaagaaauc

SEQ ID NO: 139364 - RNA, 19 nt, Homo sapiens
gagcagcgccaggauguca

SEQ ID NO: 139365 - RNA, 19 nt, Homo sapiens
uggagacgcagauguguuu

SEQ ID NO: 139366 - RNA, 19 nt, Homo sapiens
guacaacuaugugauuagc

SEQ ID NO: 139367 - RNA, 19 nt, Homo sapiens
aggcauaacguacaacuau

SEQ ID NO: 139368 - RNA, 19 nt, Homo sapiens
gaggaguuaucacuaccau

SEQ ID NO: 139369 - RNA, 19 nt, Homo sapiens
acguacaacuaugugauua

SEQ ID NO: 139370 - RNA, 19 nt, Homo sapiens
ugaagaagagcaccaacug

SEQ ID NO: 139371 - RNA, 19 nt, Homo sapiens
gcagcuacguccccaagaa

SEQ ID NO: 139372 - RNA, 19 nt, Homo sapiens
ggaaggcggagaauuucau

SEQ ID NO: 139373 - RNA, 19 nt, Homo sapiens
acaagaaugccauggaugu

SEQ ID NO: 139374 - RNA, 19 nt, Homo sapiens
uggaagaacauccgcuuga

SEQ ID NO: 139375 - RNA, 19 nt, Homo sapiens
aauaugccuuucucuacaa

SEQ ID NO: 139376 - RNA, 19 nt, Homo sapiens
gaacaauaugccuuucucu

SEQ ID NO: 139377 - RNA, 19 nt, Homo sapiens
gcgaccacuuuccaguuga

SEQ ID NO: 139378 - RNA, 19 nt, Homo sapiens
aaagcaagcaggaagacaa

SEQ ID NO: 139379 - RNA, 19 nt, Homo sapiens
gggaaagcaagcaggaaga

SEQ ID NO: 139380 - RNA, 19 nt, Homo sapiens
caagaaggccuggaagaac

SEQ ID NO: 139381 - RNA, 19 nt, Homo sapiens
ugccauggaugucauugug

SEQ ID NO: 139382 - RNA, 19 nt, Homo sapiens
uaaggagaucgaugaguug

SEQ ID NO: 139383 - RNA, 19 nt, Homo sapiens
uaacguacaacuaugugau

SEQ ID NO: 139384 - RNA, 19 nt, Homo sapiens
aagggucucaucuuauuaa

SEQ ID NO: 139385 - RNA, 19 nt, Homo sapiens
uaugacaggauugugcuua

SEQ ID NO: 139386 - RNA, 19 nt, Homo sapiens
aggaaaagcuggugucugu

SEQ ID NO: 139387 - RNA, 19 nt, Homo sapiens
gaggaggcccuggauguca

SEQ ID NO: 139388 - RNA, 19 nt, Homo sapiens
gaagaaaacaaagagcaaa

SEQ ID NO: 139389 - RNA, 19 nt, Homo sapiens
gaaagcaagcaggaagaca

SEQ ID NO: 139390 - RNA, 19 nt, Homo sapiens
gcggagaauuucauuuuca

SEQ ID NO: 139391 - RNA, 19 nt, Homo sapiens
ucacuaccaugacuaucag

SEQ ID NO: 139392 - RNA, 19 nt, Homo sapiens
acaauaugccuuucucuac

SEQ ID NO: 139393 - RNA, 19 nt, Homo sapiens
aacaauaugccuuucucua

SEQ ID NO: 139394 - RNA, 19 nt, Homo sapiens
cagagcagcgccaggaugu

SEQ ID NO: 139395 - RNA, 19 nt, Homo sapiens
gaugucagcgaccacuuuc

SEQ ID NO: 139396 - RNA, 19 nt, Homo sapiens
caagcaggaagacaagaau

SEQ ID NO: 139397 - RNA, 19 nt, Homo sapiens
cuuggaagaaacacauaua

SEQ ID NO: 139398 - RNA, 19 nt, Homo sapiens
gaggcauaacguacaacua

SEQ ID NO: 139399 - RNA, 19 nt, Homo sapiens
cagcgaccacuuuccaguu

SEQ ID NO: 139400 - RNA, 19 nt, Homo sapiens
ggagaagcugaacagaaau

SEQ ID NO: 139401 - RNA, 19 nt, Homo sapiens
aagaggaggcccuggaugu

SEQ ID NO: 139402 - RNA, 19 nt, Homo sapiens
cacgagagcacuccaagca

SEQ ID NO: 139403 - RNA, 19 nt, Homo sapiens
ucaaggagaggcauaacgu

SEQ ID NO: 139404 - RNA, 19 nt, Homo sapiens
ggccuucaccaacagcaaa

SEQ ID NO: 139405 - RNA, 19 nt, Homo sapiens
guucuguuguucccaaguc

SEQ ID NO: 139406 - RNA, 19 nt, Homo sapiens
ggaagaaaacaaagagcaa

SEQ ID NO: 139407 - RNA, 19 nt, Homo sapiens
caacaggaucugccccaua

SEQ ID NO: 139408 - RNA, 19 nt, Homo sapiens
agaaugccauggaugucau

SEQ ID NO: 139409 - RNA, 19 nt, Homo sapiens
agcgaccacuuuccaguug

SEQ ID NO: 139410 - RNA, 19 nt, Homo sapiens
caccaacugugcauaugac

SEQ ID NO: 139411 - RNA, 19 nt, Homo sapiens
caaagacuucgugauuauc

SEQ ID NO: 139412 - RNA, 19 nt, Homo sapiens
aucaaacgcugugacauca

SEQ ID NO: 139413 - RNA, 19 nt, Homo sapiens
gcauacagcuggccucaua

SEQ ID NO: 139414 - RNA, 19 nt, Homo sapiens
cagcagagcuuauaagauc

SEQ ID NO: 139415 - RNA, 19 nt, Homo sapiens
gcaagacucuguuucaaaa

SEQ ID NO: 139416 - RNA, 19 nt, Homo sapiens
gcaagcagcugaccuacac

SEQ ID NO: 139417 - RNA, 19 nt, Homo sapiens
agagagggcugcaguacaa

SEQ ID NO: 139418 - RNA, 19 nt, Homo sapiens
gcacagaggaccacuccaa

SEQ ID NO: 139419 - RNA, 19 nt, Homo sapiens
gagaugggcagaucacuug

SEQ ID NO: 139420 - RNA, 19 nt, Homo sapiens
uguaugaccuugauugugu

SEQ ID NO: 139421 - RNA, 19 nt, Homo sapiens
gcacgcgucugugguccua

SEQ ID NO: 139422 - RNA, 19 nt, Homo sapiens
gaaccaguuuggacuugau

SEQ ID NO: 139423 - RNA, 19 nt, Homo sapiens
caaccugggucacauagca

SEQ ID NO: 139424 - RNA, 19 nt, Homo sapiens
ggagggaggaucacuugaa

SEQ ID NO: 139425 - RNA, 19 nt, Homo sapiens
gcagggcacucaucaacag

SEQ ID NO: 139426 - RNA, 19 nt, Homo sapiens
ucacauagcaagacucugu

SEQ ID NO: 139427 - RNA, 19 nt, Homo sapiens
ggugauaaaugccuguagu

SEQ ID NO: 139428 - RNA, 19 nt, Homo sapiens
ggaaccaguuuggacuuga

SEQ ID NO: 139429 - RNA, 19 nt, Homo sapiens
gaaugagacucugugucaa

SEQ ID NO: 139430 - RNA, 19 nt, Homo sapiens
gcaaggcucaggacucuuc

SEQ ID NO: 139431 - RNA, 19 nt, Homo sapiens
guugaggaguaaauaaaug

SEQ ID NO: 139432 - RNA, 19 nt, Homo sapiens
gaagccagaggaucgauug

SEQ ID NO: 139433 - RNA, 19 nt, Homo sapiens
agaaugagacucuguguca

SEQ ID NO: 139434 - RNA, 19 nt, Homo sapiens
ccagagcuuugccaaguuc

SEQ ID NO: 139435 - RNA, 19 nt, Homo sapiens
ucaggauuguugaggagua

SEQ ID NO: 139436 - RNA, 19 nt, Homo sapiens
gcaggagaaucgcuugaac

SEQ ID NO: 139437 - RNA, 19 nt, Homo sapiens
uagcaagacucuguuucaa

SEQ ID NO: 139438 - RNA, 19 nt, Homo sapiens
gcagagcuuauaagaucua

SEQ ID NO: 139439 - RNA, 19 nt, Homo sapiens
gucaagggccaccacguua

SEQ ID NO: 139440 - RNA, 19 nt, Homo sapiens
ucacuugaacucaggaauu

SEQ ID NO: 139441 - RNA, 19 nt, Homo sapiens
gagggaggaucacuugaac

SEQ ID NO: 139442 - RNA, 19 nt, Homo sapiens
cagaggaccacuccaaaug

SEQ ID NO: 139443 - RNA, 19 nt, Homo sapiens
ggucaagggccaccacguu

SEQ ID NO: 139444 - RNA, 19 nt, Homo sapiens
gaucuuugcccaggaauuc

SEQ ID NO: 139445 - RNA, 19 nt, Homo sapiens
cagcaaggcucaggacucu

SEQ ID NO: 139446 - RNA, 19 nt, Homo sapiens
ugcaguggcucacguaugu

SEQ ID NO: 139447 - RNA, 19 nt, Homo sapiens
gaacuaccagcccuguaau

SEQ ID NO: 139448 - RNA, 19 nt, Homo sapiens
cagucuaccugucugcaaa

SEQ ID NO: 139449 - RNA, 19 nt, Homo sapiens
guccuggccucugauguaa

SEQ ID NO: 139450 - RNA, 19 nt, Homo sapiens
agaacuaccagcccuguaa

SEQ ID NO: 139451 - RNA, 19 nt, Homo sapiens
ccaccacguuagccaagaa

SEQ ID NO: 139452 - RNA, 19 nt, Homo sapiens
cagccugggugacagaaug

SEQ ID NO: 139453 - RNA, 19 nt, Homo sapiens
ggaggcagagguugucaug

SEQ ID NO: 139454 - RNA, 19 nt, Homo sapiens
gaaaccccauauccauuaa

SEQ ID NO: 139455 - RNA, 19 nt, Homo sapiens
uauguaaucccagcacuuu

SEQ ID NO: 139456 - RNA, 19 nt, Homo sapiens
caggauuguugaggaguaa

SEQ ID NO: 139457 - RNA, 19 nt, Homo sapiens
gagggcugcaguacaagua

SEQ ID NO: 139458 - RNA, 19 nt, Homo sapiens
ggcagguucugaaugugaa

SEQ ID NO: 139459 - RNA, 19 nt, Homo sapiens
ugcaguggcucacaucugu

SEQ ID NO: 139460 - RNA, 19 nt, Homo sapiens
ucuggcagguucugaaugu

SEQ ID NO: 139461 - RNA, 19 nt, Homo sapiens
cacuugaacucaggaauuc

SEQ ID NO: 139462 - RNA, 19 nt, Homo sapiens
cagcaaauuuggagaugac

SEQ ID NO: 139463 - RNA, 19 nt, Homo sapiens
aggcagagguugucaugag

SEQ ID NO: 139464 - RNA, 19 nt, Homo sapiens
gccagaggaucgauugaac

SEQ ID NO: 139465 - RNA, 19 nt, Homo sapiens
ucagcaaauuuggagauga

SEQ ID NO: 139466 - RNA, 19 nt, Homo sapiens
gaggaguaaauaaauggaa

SEQ ID NO: 139467 - RNA, 19 nt, Homo sapiens
gauuguugaggaguaaaua

SEQ ID NO: 139468 - RNA, 19 nt, Homo sapiens
gccaaguucagcaaauuug

SEQ ID NO: 139469 - RNA, 19 nt, Homo sapiens
ugaaaccccauauccauua

SEQ ID NO: 139470 - RNA, 19 nt, Homo sapiens
gggaggaucacuugaacuc

SEQ ID NO: 139471 - RNA, 19 nt, Homo sapiens
cugcgugggugacaugaau

SEQ ID NO: 139472 - RNA, 19 nt, Homo sapiens
cccucuaacugcucggaua

SEQ ID NO: 139473 - RNA, 19 nt, Homo sapiens
ugccuuaaccgcucuguga

SEQ ID NO: 139474 - RNA, 19 nt, Homo sapiens
aaugagacucugugucaaa

SEQ ID NO: 139475 - RNA, 19 nt, Homo sapiens
gggagaucauggucacagu

SEQ ID NO: 139476 - RNA, 19 nt, Homo sapiens
ucuaagggcucaggaacca

SEQ ID NO: 139477 - RNA, 19 nt, Homo sapiens
caaggagggaggaucacuu

SEQ ID NO: 139478 - RNA, 19 nt, Homo sapiens
caaguucagcaaauuugga

SEQ ID NO: 139479 - RNA, 19 nt, Homo sapiens
ucgcucaguucucgaagau

SEQ ID NO: 139480 - RNA, 19 nt, Homo sapiens
gcaguggcucacaucugua

SEQ ID NO: 139481 - RNA, 19 nt, Homo sapiens
gggcugcaguacaaguauc

SEQ ID NO: 139482 - RNA, 19 nt, Homo sapiens
caguggcucacaucuguaa

SEQ ID NO: 139483 - RNA, 19 nt, Homo sapiens
caguggcucacguauguaa

SEQ ID NO: 139484 - RNA, 19 nt, Homo sapiens
ucucgaagaugggcaagca

SEQ ID NO: 139485 - RNA, 19 nt, Homo sapiens
ggccuccucugcugcauac

SEQ ID NO: 139486 - RNA, 19 nt, Homo sapiens
gcuaacaccacggcacuuc

SEQ ID NO: 139487 - RNA, 19 nt, Homo sapiens
caggcacggugauaaaugc

SEQ ID NO: 139488 - RNA, 19 nt, Homo sapiens
ccaggcacggugauaaaug

SEQ ID NO: 139489 - RNA, 19 nt, Homo sapiens
ccacaguguaccuaacuuc

SEQ ID NO: 139490 - RNA, 19 nt, Homo sapiens
gaaccagggagaggagcaa

SEQ ID NO: 139491 - RNA, 19 nt, Homo sapiens
cacagaggaccacuccaaa

SEQ ID NO: 139492 - RNA, 19 nt, Homo sapiens
uuccagagcuuugccaagu

SEQ ID NO: 139493 - RNA, 19 nt, Homo sapiens
gagcuuauaagaucuaacc

SEQ ID NO: 139494 - RNA, 19 nt, Homo sapiens
cagagcuuauaagaucuaa

SEQ ID NO: 139495 - RNA, 19 nt, Homo sapiens
aguccuggccucugaugua

SEQ ID NO: 139496 - RNA, 19 nt, Homo sapiens
gcuguaugaccuugauugu

SEQ ID NO: 139497 - RNA, 19 nt, Homo sapiens
ggugacagaaugagacucu

SEQ ID NO: 139498 - RNA, 19 nt, Homo sapiens
ucacuugaggucaggaguu

SEQ ID NO: 139499 - RNA, 19 nt, Homo sapiens
ugagaugggcagaucacuu

SEQ ID NO: 139500 - RNA, 19 nt, Homo sapiens
ccuuccugcucuacaauga

SEQ ID NO: 139501 - RNA, 19 nt, Homo sapiens
ggucacauagcaagacucu

SEQ ID NO: 139502 - RNA, 19 nt, Homo sapiens
ggauuguugaggaguaaau

SEQ ID NO: 139503 - RNA, 19 nt, Homo sapiens
gauugaaccagggagauca

SEQ ID NO: 139504 - RNA, 19 nt, Homo sapiens
ggaccugcgugggugacau

SEQ ID NO: 139505 - RNA, 19 nt, Homo sapiens
acagaggaccacuccaaau

SEQ ID NO: 139506 - RNA, 19 nt, Homo sapiens
cacuugaggucaggaguuc

SEQ ID NO: 139507 - RNA, 19 nt, Homo sapiens
guauguaaucccagcacuu

SEQ ID NO: 139508 - RNA, 19 nt, Homo sapiens
ucuaacugcucggauaucu

SEQ ID NO: 139509 - RNA, 19 nt, Homo sapiens
ggaaggcacuguugaguua

SEQ ID NO: 139510 - RNA, 19 nt, Homo sapiens
gaacauugcugcuccuuau

SEQ ID NO: 139511 - RNA, 19 nt, Homo sapiens
gaagaagacugcauaaacu

SEQ ID NO: 139512 - RNA, 19 nt, Homo sapiens
gcauggagcugguguacaa

SEQ ID NO: 139513 - RNA, 19 nt, Homo sapiens
caugaaaucuuuagagguu

SEQ ID NO: 139514 - RNA, 19 nt, Homo sapiens
gcauggaacguauuuauuu

SEQ ID NO: 139515 - RNA, 19 nt, Homo sapiens
ccacagcauuucuaucuuu

SEQ ID NO: 139516 - RNA, 19 nt, Homo sapiens
ccacauagcaauuacagua

SEQ ID NO: 139517 - RNA, 19 nt, Homo sapiens
gcaaagcauugguaucuca

SEQ ID NO: 139518 - RNA, 19 nt, Homo sapiens
ggaaauucgugcuaacaga

SEQ ID NO: 139519 - RNA, 19 nt, Homo sapiens
gagccaaucuuucuuucaa

SEQ ID NO: 139520 - RNA, 19 nt, Homo sapiens
ggacgacucugaucuggau

SEQ ID NO: 139521 - RNA, 19 nt, Homo sapiens
caaauaucauugaccacua

SEQ ID NO: 139522 - RNA, 19 nt, Homo sapiens
ggcccaagcuggcaaagaa

SEQ ID NO: 139523 - RNA, 19 nt, Homo sapiens
guacagggccaaagacuug

SEQ ID NO: 139524 - RNA, 19 nt, Homo sapiens
ggaagaagacugcauaaac

SEQ ID NO: 139525 - RNA, 19 nt, Homo sapiens
gaauggauuuacuagaaga

SEQ ID NO: 139526 - RNA, 19 nt, Homo sapiens
gauaagagaagagaagaaa

SEQ ID NO: 139527 - RNA, 19 nt, Homo sapiens
ucuggaaccucaacaauga

SEQ ID NO: 139528 - RNA, 19 nt, Homo sapiens
caagggaaguaguguccua

SEQ ID NO: 139529 - RNA, 19 nt, Homo sapiens
gcagugaacgaaaugaauu

SEQ ID NO: 139530 - RNA, 19 nt, Homo sapiens
uagagcaugugcauaauga

SEQ ID NO: 139531 - RNA, 19 nt, Homo sapiens
gaugugguguuccucauau

SEQ ID NO: 139532 - RNA, 19 nt, Homo sapiens
cagcaaguguggccauuga

SEQ ID NO: 139533 - RNA, 19 nt, Homo sapiens
ugaagacaaugcagacuau

SEQ ID NO: 139534 - RNA, 19 nt, Homo sapiens
agaggaauuucucaucuuu

SEQ ID NO: 139535 - RNA, 19 nt, Homo sapiens
ggaaaugguggaaucuaaa

SEQ ID NO: 139536 - RNA, 19 nt, Homo sapiens
cuaaaugugucccaucaug

SEQ ID NO: 139537 - RNA, 19 nt, Homo sapiens
cagcuuugcuccaaguauu

SEQ ID NO: 139538 - RNA, 19 nt, Homo sapiens
caacgggagacgucaauaa

SEQ ID NO: 139539 - RNA, 19 nt, Homo sapiens
ggacccagaaugcucauaa

SEQ ID NO: 139540 - RNA, 19 nt, Homo sapiens
gaugguggcuucuuacaac

SEQ ID NO: 139541 - RNA, 19 nt, Homo sapiens
cauugcugcuccuuauuua

SEQ ID NO: 139542 - RNA, 19 nt, Homo sapiens
ugaggaagaugaggaaaug

SEQ ID NO: 139543 - RNA, 19 nt, Homo sapiens
caucaguguugccaauaaa

SEQ ID NO: 139544 - RNA, 19 nt, Homo sapiens
agucuaugguuccuaaaua

SEQ ID NO: 139545 - RNA, 19 nt, Homo sapiens
cauggaacguauuuauuug

SEQ ID NO: 139546 - RNA, 19 nt, Homo sapiens
cacagcauuucuaucuuua

SEQ ID NO: 139547 - RNA, 19 nt, Homo sapiens
ggguuaaguugcugccuuu

SEQ ID NO: 139548 - RNA, 19 nt, Homo sapiens
ccaggacccuuguggaaau

SEQ ID NO: 139549 - RNA, 19 nt, Homo sapiens
gacaaucgcagucaucgaa

SEQ ID NO: 139550 - RNA, 19 nt, Homo sapiens
caacaacaaugaagaugcu

SEQ ID NO: 139551 - RNA, 19 nt, Homo sapiens
gcacagauaagagaagaga

SEQ ID NO: 139552 - RNA, 19 nt, Homo sapiens
ggaaggaagaggagaggaa

SEQ ID NO: 139553 - RNA, 19 nt, Homo sapiens
ugacaucaguguugccaau

SEQ ID NO: 139554 - RNA, 19 nt, Homo sapiens
gagguuauauuaaguucca

SEQ ID NO: 139555 - RNA, 19 nt, Homo sapiens
gagcugguguacaauaagu

SEQ ID NO: 139556 - RNA, 19 nt, Homo sapiens
aggaaaugguggaaucuaa

SEQ ID NO: 139557 - RNA, 19 nt, Homo sapiens
gaaggaagaggagaggaaa

SEQ ID NO: 139558 - RNA, 19 nt, Homo sapiens
caguauugcugugacauuu

SEQ ID NO: 139559 - RNA, 19 nt, Homo sapiens
aaagaaagaggcugauaug

SEQ ID NO: 139560 - RNA, 19 nt, Homo sapiens
ggaguggccuugguuugga

SEQ ID NO: 139561 - RNA, 19 nt, Homo sapiens
cuuauuaucggguacuuua

SEQ ID NO: 139562 - RNA, 19 nt, Homo sapiens
cgggagacgucaauaacuu

SEQ ID NO: 139563 - RNA, 19 nt, Homo sapiens
gaaggaagccccuccaaga

SEQ ID NO: 139564 - RNA, 19 nt, Homo sapiens
cagacuauguguacgaugu

SEQ ID NO: 139565 - RNA, 19 nt, Homo sapiens
ggaacaugaaguuuaagaa

SEQ ID NO: 139566 - RNA, 19 nt, Homo sapiens
gacgagagacagaggcuuu

SEQ ID NO: 139567 - RNA, 19 nt, Homo sapiens
cagaggaauuucucaucuu

SEQ ID NO: 139568 - RNA, 19 nt, Homo sapiens
gcuaacacagucugagaaa

SEQ ID NO: 139569 - RNA, 19 nt, Homo sapiens
gagcaugugcauaaugaga

SEQ ID NO: 139570 - RNA, 19 nt, Homo sapiens
ccaucaugcuuuccacuga

SEQ ID NO: 139571 - RNA, 19 nt, Homo sapiens
ccaaguauucuaaaugugu

SEQ ID NO: 139572 - RNA, 19 nt, Homo sapiens
gaaaugguggaaucuaaag

SEQ ID NO: 139573 - RNA, 19 nt, Homo sapiens
acaagccgcucuacuccuu

SEQ ID NO: 139574 - RNA, 19 nt, Homo sapiens
ggaagcaaagcagguauug

SEQ ID NO: 139575 - RNA, 19 nt, Homo sapiens
guuuggaacaugaaguuua

SEQ ID NO: 139576 - RNA, 19 nt, Homo sapiens
ucagaggaauuucucaucu

SEQ ID NO: 139577 - RNA, 19 nt, Homo sapiens
aaacagcagauccuucauu

SEQ ID NO: 139578 - RNA, 19 nt, Homo sapiens
ugaagaggaugaggaagau

SEQ ID NO: 139579 - RNA, 19 nt, Homo sapiens
ucggguacuuuaacaauau

SEQ ID NO: 139580 - RNA, 19 nt, Homo sapiens
ucaaucgucaguucuauga

SEQ ID NO: 139581 - RNA, 19 nt, Homo sapiens
acaucaguguugccaauaa

SEQ ID NO: 139582 - RNA, 19 nt, Homo sapiens
cuaaauaugacaucagugu

SEQ ID NO: 139583 - RNA, 19 nt, Homo sapiens
gcaaacgacgagagacaga

SEQ ID NO: 139584 - RNA, 19 nt, Homo sapiens
uguauucgguguccauuca

SEQ ID NO: 139585 - RNA, 19 nt, Homo sapiens
cgacuuuucucaccuguuu

SEQ ID NO: 139586 - RNA, 19 nt, Homo sapiens
uggagcugguguacaauaa

SEQ ID NO: 139587 - RNA, 19 nt, Homo sapiens
agaagaaacggaaggaaga

SEQ ID NO: 139588 - RNA, 19 nt, Homo sapiens
gccaaucuuucuuucaauc

SEQ ID NO: 139589 - RNA, 19 nt, Homo sapiens
aaauaugacaucaguguug

SEQ ID NO: 139590 - RNA, 19 nt, Homo sapiens
gucuaugguuccuaaauau

SEQ ID NO: 139591 - RNA, 19 nt, Homo sapiens
caugggauaccuguuauuu

SEQ ID NO: 139592 - RNA, 19 nt, Homo sapiens
ccacugaagacaugaaauc

SEQ ID NO: 139593 - RNA, 19 nt, Homo sapiens
gcuguugagguuauauuaa

SEQ ID NO: 139594 - RNA, 19 nt, Homo sapiens
ugaggaagguacagucuac

SEQ ID NO: 139595 - RNA, 19 nt, Homo sapiens
gaucgcaaacgacgagaga

SEQ ID NO: 139596 - RNA, 19 nt, Homo sapiens
cacuaauacuucucacuga

SEQ ID NO: 139597 - RNA, 19 nt, Homo sapiens
ugaauggauuuacuagaag

SEQ ID NO: 139598 - RNA, 19 nt, Homo sapiens
agaaagaggcugauaugca

SEQ ID NO: 139599 - RNA, 19 nt, Homo sapiens
uagcacagauaagagaaga

SEQ ID NO: 139600 - RNA, 19 nt, Homo sapiens
ccaguacccugagcugaug

SEQ ID NO: 139601 - RNA, 19 nt, Homo sapiens
aaucgucaguucuaugaug

SEQ ID NO: 139602 - RNA, 19 nt, Homo sapiens
aaaagucuaugguuccuaa

SEQ ID NO: 139603 - RNA, 19 nt, Homo sapiens
gccauauugugccagcuuu

SEQ ID NO: 139604 - RNA, 19 nt, Homo sapiens
guccaagccugucgcuguu

SEQ ID NO: 139605 - RNA, 19 nt, Homo sapiens
cucauaaccucaucacugu

SEQ ID NO: 139606 - RNA, 19 nt, Homo sapiens
gaccggacaauacggguaa

SEQ ID NO: 139607 - RNA, 19 nt, Homo sapiens
acuaauacuucucacugaa

SEQ ID NO: 139608 - RNA, 19 nt, Homo sapiens
uaugaagccagauaugauu

SEQ ID NO: 139609 - RNA, 19 nt, Homo sapiens
gcaaagaacuccacuguca

SEQ ID NO: 139610 - RNA, 19 nt, Homo sapiens
gagagaagcugaagcauug

SEQ ID NO: 139611 - RNA, 19 nt, Homo sapiens
ggaagcagcuacccgaaua

SEQ ID NO: 139612 - RNA, 19 nt, Homo sapiens
gaaagguucuuaaguagau

SEQ ID NO: 139613 - RNA, 19 nt, Homo sapiens
gcauggaguugguucauaa

SEQ ID NO: 139614 - RNA, 19 nt, Homo sapiens
gugcuaaacugucauuaaa

SEQ ID NO: 139615 - RNA, 19 nt, Homo sapiens
guaaagcuuuggacaacua

SEQ ID NO: 139616 - RNA, 19 nt, Homo sapiens
ugggaaagguucuuaagua

SEQ ID NO: 139617 - RNA, 19 nt, Homo sapiens
gaguguaacuaguggauuu

SEQ ID NO: 139618 - RNA, 19 nt, Homo sapiens
gcaaggaaacuuacaaugu

SEQ ID NO: 139619 - RNA, 19 nt, Homo sapiens
ggaagaugaugauguagug

SEQ ID NO: 139620 - RNA, 19 nt, Homo sapiens
gauguuauguggucaccua

SEQ ID NO: 139621 - RNA, 19 nt, Homo sapiens
agaggaagaugaugaugua

SEQ ID NO: 139622 - RNA, 19 nt, Homo sapiens
caaggaaacuuacaauguc

SEQ ID NO: 139623 - RNA, 19 nt, Homo sapiens
gagauuggauuuauggaau

SEQ ID NO: 139624 - RNA, 19 nt, Homo sapiens
gcuaaacugucauuaaauc

SEQ ID NO: 139625 - RNA, 19 nt, Homo sapiens
ggagagauuuggaagacaa

SEQ ID NO: 139626 - RNA, 19 nt, Homo sapiens
guagacuucucacaucuuu

SEQ ID NO: 139627 - RNA, 19 nt, Homo sapiens
ccgaauaccugcuuaguuc

SEQ ID NO: 139628 - RNA, 19 nt, Homo sapiens
gcaguagacuucucacauc

SEQ ID NO: 139629 - RNA, 19 nt, Homo sapiens
ucacucagauuccgauuug

SEQ ID NO: 139630 - RNA, 19 nt, Homo sapiens
gcauacaccuauccauguu

SEQ ID NO: 139631 - RNA, 19 nt, Homo sapiens
ggauaaccguagcaauaaa

SEQ ID NO: 139632 - RNA, 19 nt, Homo sapiens
gcaaagcggaaauacuuaa

SEQ ID NO: 139633 - RNA, 19 nt, Homo sapiens
ggagagaagcugaagcauu

SEQ ID NO: 139634 - RNA, 19 nt, Homo sapiens
gggaaagguucuuaaguag

SEQ ID NO: 139635 - RNA, 19 nt, Homo sapiens
gcauuucuguggaggguaa

SEQ ID NO: 139636 - RNA, 19 nt, Homo sapiens
ggacaacuaagaauaacaa

SEQ ID NO: 139637 - RNA, 19 nt, Homo sapiens
gcccuuguauggaauauga

SEQ ID NO: 139638 - RNA, 19 nt, Homo sapiens
gagaaauugucacguauac

SEQ ID NO: 139639 - RNA, 19 nt, Homo sapiens
gaacacuugcagaaauuaa

SEQ ID NO: 139640 - RNA, 19 nt, Homo sapiens
gcacagaugaaauaaguuc

SEQ ID NO: 139641 - RNA, 19 nt, Homo sapiens
uaaaagaacuccagugcaa

SEQ ID NO: 139642 - RNA, 19 nt, Homo sapiens
gggauaaccguagcaauaa

SEQ ID NO: 139643 - RNA, 19 nt, Homo sapiens
aaacagaccagaagaagga

SEQ ID NO: 139644 - RNA, 19 nt, Homo sapiens
aagcacagaugaaauaagu

SEQ ID NO: 139645 - RNA, 19 nt, Homo sapiens
gaucuaggacgcugcauug

SEQ ID NO: 139646 - RNA, 19 nt, Homo sapiens
gauaaugcagacuauguuu

SEQ ID NO: 139647 - RNA, 19 nt, Homo sapiens
agacaaagaaggagagauu

SEQ ID NO: 139648 - RNA, 19 nt, Homo sapiens
gagaauauuaggcguaguu

SEQ ID NO: 139649 - RNA, 19 nt, Homo sapiens
ugggauaaccguagcaaua

SEQ ID NO: 139650 - RNA, 19 nt, Homo sapiens
cgacuuuccuccucgagaa

SEQ ID NO: 139651 - RNA, 19 nt, Homo sapiens
cagauaauguucucacuac

SEQ ID NO: 139652 - RNA, 19 nt, Homo sapiens
cuuacaaugucccuuuaua

SEQ ID NO: 139653 - RNA, 19 nt, Homo sapiens
ccgaacacuugcagaaauu

SEQ ID NO: 139654 - RNA, 19 nt, Homo sapiens
cagacuauguuuaugaugu

SEQ ID NO: 139655 - RNA, 19 nt, Homo sapiens
gaacuccagugcaaagaac

SEQ ID NO: 139656 - RNA, 19 nt, Homo sapiens
ugagcugacugaagaagaa

SEQ ID NO: 139657 - RNA, 19 nt, Homo sapiens
cugauugacuucacagaaa

SEQ ID NO: 139658 - RNA, 19 nt, Homo sapiens
ggaaagguucuuaaguaga

SEQ ID NO: 139659 - RNA, 19 nt, Homo sapiens
gguaccaacugccagcauu

SEQ ID NO: 139660 - RNA, 19 nt, Homo sapiens
gccgaacacuugcagaaau

SEQ ID NO: 139661 - RNA, 19 nt, Homo sapiens
gcaaagcuggaaucaguga

SEQ ID NO: 139662 - RNA, 19 nt, Homo sapiens
aaauugugcuuugggauaa

SEQ ID NO: 139663 - RNA, 19 nt, Homo sapiens
gugguuaguuguuuggauu

SEQ ID NO: 139664 - RNA, 19 nt, Homo sapiens
ggacgaggaccuauuaaac

SEQ ID NO: 139665 - RNA, 19 nt, Homo sapiens
aaacuuacaaugucccuuu

SEQ ID NO: 139666 - RNA, 19 nt, Homo sapiens
ugaagauaaugcagacuau

SEQ ID NO: 139667 - RNA, 19 nt, Homo sapiens
ggaguugguucauaaacag

SEQ ID NO: 139668 - RNA, 19 nt, Homo sapiens
ucacuggcauccauuguca

SEQ ID NO: 139669 - RNA, 19 nt, Homo sapiens
ucuaccggcuucugcuuua

SEQ ID NO: 139670 - RNA, 19 nt, Homo sapiens
cucaugagcugacugaaga

SEQ ID NO: 139671 - RNA, 19 nt, Homo sapiens
caucaguucuucagcuuca

SEQ ID NO: 139672 - RNA, 19 nt, Homo sapiens
ggagauuggauuuauggaa

SEQ ID NO: 139673 - RNA, 19 nt, Homo sapiens
gcuccuaaaccaccuauug

SEQ ID NO: 139674 - RNA, 19 nt, Homo sapiens
gaagagaaaagaagaagaa

SEQ ID NO: 139675 - RNA, 19 nt, Homo sapiens
cgagaaauugucacguaua

SEQ ID NO: 139676 - RNA, 19 nt, Homo sapiens
gaggguaauccugcucuua

SEQ ID NO: 139677 - RNA, 19 nt, Homo sapiens
ggacaugcuuucccaucca

SEQ ID NO: 139678 - RNA, 19 nt, Homo sapiens
ugauuagcaucucuacuga

SEQ ID NO: 139679 - RNA, 19 nt, Homo sapiens
ggugcuaaacugucauuaa

SEQ ID NO: 139680 - RNA, 19 nt, Homo sapiens
ugaauuaaaggcugaguug

SEQ ID NO: 139681 - RNA, 19 nt, Homo sapiens
uuaaguagauccugagacu

SEQ ID NO: 139682 - RNA, 19 nt, Homo sapiens
uggcaaagcggaaauacuu

SEQ ID NO: 139683 - RNA, 19 nt, Homo sapiens
cgacaggucacaaacaugu

SEQ ID NO: 139684 - RNA, 19 nt, Homo sapiens
uggaaucagugagauguuu

SEQ ID NO: 139685 - RNA, 19 nt, Homo sapiens
cuaagaauaacaagccuuu

SEQ ID NO: 139686 - RNA, 19 nt, Homo sapiens
aggcugaguuggaacguaa

SEQ ID NO: 139687 - RNA, 19 nt, Homo sapiens
gaaucucaauaaugacaca

SEQ ID NO: 139688 - RNA, 19 nt, Homo sapiens
caguagcugugacaucuau

SEQ ID NO: 139689 - RNA, 19 nt, Homo sapiens
ggauuggucaucucaguau

SEQ ID NO: 139690 - RNA, 19 nt, Homo sapiens
ggcaaagcggaaauacuua

SEQ ID NO: 139691 - RNA, 19 nt, Homo sapiens
aacaaauccugcacucuga

SEQ ID NO: 139692 - RNA, 19 nt, Homo sapiens
cucgagaaauugucacgua

SEQ ID NO: 139693 - RNA, 19 nt, Homo sapiens
acgaggaccuauuaaacuu

SEQ ID NO: 139694 - RNA, 19 nt, Homo sapiens
ggguaauccugcucuuaau

SEQ ID NO: 139695 - RNA, 19 nt, Homo sapiens
caaagaaggagagauucaa

SEQ ID NO: 139696 - RNA, 19 nt, Homo sapiens
gggacgaggaccuauuaaa

SEQ ID NO: 139697 - RNA, 19 nt, Homo sapiens
guagauccugagacuauuu

SEQ ID NO: 139698 - RNA, 19 nt, Homo sapiens
caauaaugacacagaggua

SEQ ID NO: 139699 - RNA, 19 nt, Homo sapiens
ccagucagcugugaugucu

SEQ ID NO: 139700 - RNA, 19 nt, Homo sapiens
gcgacuggcccaaaucaga

SEQ ID NO: 139701 - RNA, 19 nt, Homo sapiens
aguuauggcucaacccaaa

SEQ ID NO: 139702 - RNA, 19 nt, Homo sapiens
gaaaagaagaagaaaggaa

SEQ ID NO: 139703 - RNA, 19 nt, Homo sapiens
gaagauaaugcagacuaug

SEQ ID NO: 139704 - RNA, 19 nt, Homo sapiens
caguaaagcuuuggacaac

SEQ ID NO: 139705 - RNA, 19 nt, Homo sapiens
gugcaaagaacuccacugu

SEQ ID NO: 139706 - RNA, 19 nt, Homo sapiens
uugacuggguucuuuguuu

SEQ ID NO: 139707 - RNA, 19 nt, Homo sapiens
uauugaaccugaagaagag

SEQ ID NO: 139708 - RNA, 19 nt, Homo sapiens
gaaaagaagagaaaagaag

SEQ ID NO: 139709 - RNA, 19 nt, Homo sapiens
aaacaacccucaugacuaa

SEQ ID NO: 139710 - RNA, 19 nt, Homo sapiens
gaaaugggcuaguguuuua

SEQ ID NO: 139711 - RNA, 19 nt, Homo sapiens
gagcagguguuccuaauga

SEQ ID NO: 139712 - RNA, 19 nt, Homo sapiens
gaagaagguugucaagguu

SEQ ID NO: 139713 - RNA, 19 nt, Homo sapiens
ggaaguuugugaaagauuu

SEQ ID NO: 139714 - RNA, 19 nt, Homo sapiens
guauggagcugccuugauu

SEQ ID NO: 139715 - RNA, 19 nt, Homo sapiens
acaaaggccugcugaaauu

SEQ ID NO: 139716 - RNA, 19 nt, Homo sapiens
gaagaggccuagaauaucu

SEQ ID NO: 139717 - RNA, 19 nt, Homo sapiens
acaaugugcugacucauaa

SEQ ID NO: 139718 - RNA, 19 nt, Homo sapiens
gauggaaucucugcagaaa

SEQ ID NO: 139719 - RNA, 19 nt, Homo sapiens
gaacggaaguuugugaaag

SEQ ID NO: 139720 - RNA, 19 nt, Homo sapiens
gaagaacuggauagaauga

SEQ ID NO: 139721 - RNA, 19 nt, Homo sapiens
gaugagcauuuggacuuua

SEQ ID NO: 139722 - RNA, 19 nt, Homo sapiens
ugaagaagguugucaaggu

SEQ ID NO: 139723 - RNA, 19 nt, Homo sapiens
guaacaaacucuucaacag

SEQ ID NO: 139724 - RNA, 19 nt, Homo sapiens
cacgagagcuucugaaucu

SEQ ID NO: 139725 - RNA, 19 nt, Homo sapiens
gacaaugugcugacucaua

SEQ ID NO: 139726 - RNA, 19 nt, Homo sapiens
uggaaucucugcagaaaug

SEQ ID NO: 139727 - RNA, 19 nt, Homo sapiens
caccacaccugccuuaguu

SEQ ID NO: 139728 - RNA, 19 nt, Homo sapiens
acacaucagugaaagaaga

SEQ ID NO: 139729 - RNA, 19 nt, Homo sapiens
uaacaaacucuucaacaga

SEQ ID NO: 139730 - RNA, 19 nt, Homo sapiens
gaaagcugguccacgacaa

SEQ ID NO: 139731 - RNA, 19 nt, Homo sapiens
aggaagaacuggauagaau

SEQ ID NO: 139732 - RNA, 19 nt, Homo sapiens
ugucaaauguucaggaaga

SEQ ID NO: 139733 - RNA, 19 nt, Homo sapiens
ggacugugauggaaucucu

SEQ ID NO: 139734 - RNA, 19 nt, Homo sapiens
ggagcugccuugauuuaca

SEQ ID NO: 139735 - RNA, 19 nt, Homo sapiens
ggaugagcauuuggacuuu

SEQ ID NO: 139736 - RNA, 19 nt, Homo sapiens
gccaagaagucaggacaaa

SEQ ID NO: 139737 - RNA, 19 nt, Homo sapiens
gccggaagaugcauaugaa

SEQ ID NO: 139738 - RNA, 19 nt, Homo sapiens
gaagaugguucugguaaaa

SEQ ID NO: 139739 - RNA, 19 nt, Homo sapiens
ccagagacccucgucauuu

SEQ ID NO: 139740 - RNA, 19 nt, Homo sapiens
ccacaaaggccugcugaaa

SEQ ID NO: 139741 - RNA, 19 nt, Homo sapiens
uaugucgaaugaccaaaua

SEQ ID NO: 139742 - RNA, 19 nt, Homo sapiens
ccucaugacuaaacuacaa

SEQ ID NO: 139743 - RNA, 19 nt, Homo sapiens
aacaaacucuucaacagaa

SEQ ID NO: 139744 - RNA, 19 nt, Homo sapiens
ugaagaugguucugguaaa

SEQ ID NO: 139745 - RNA, 19 nt, Homo sapiens
cgaaugaccaaauaacuau

SEQ ID NO: 139746 - RNA, 19 nt, Homo sapiens
ugugaaaccucccgugaga

SEQ ID NO: 139747 - RNA, 19 nt, Homo sapiens
uuacagggaugagcauuug

SEQ ID NO: 139748 - RNA, 19 nt, Homo sapiens
gcugaauccuugccagaga

SEQ ID NO: 139749 - RNA, 19 nt, Homo sapiens
ggaagaggccuagaauauc

SEQ ID NO: 139750 - RNA, 19 nt, Homo sapiens
guauauugaucugcuaaga

SEQ ID NO: 139751 - RNA, 19 nt, Homo sapiens
cagacucuaugguaacaaa

SEQ ID NO: 139752 - RNA, 19 nt, Homo sapiens
gauucuggauggagacuug

SEQ ID NO: 139753 - RNA, 19 nt, Homo sapiens
ggaagaacuggauagaaug

SEQ ID NO: 139754 - RNA, 19 nt, Homo sapiens
gggaugagcauuuggacuu

SEQ ID NO: 139755 - RNA, 19 nt, Homo sapiens
agaugcauaugaagacuuu

SEQ ID NO: 139756 - RNA, 19 nt, Homo sapiens
gcagaaaugggcuaguguu

SEQ ID NO: 139757 - RNA, 19 nt, Homo sapiens
ugaaaccucccgugagaaa

SEQ ID NO: 139758 - RNA, 19 nt, Homo sapiens
gcauaugaagacuuuauug

SEQ ID NO: 139759 - RNA, 19 nt, Homo sapiens
uggagaaggagcacgauua

SEQ ID NO: 139760 - RNA, 19 nt, Homo sapiens
aagccagacucuaugguaa

SEQ ID NO: 139761 - RNA, 19 nt, Homo sapiens
aggaagaggccuagaauau

SEQ ID NO: 139762 - RNA, 19 nt, Homo sapiens
gugaagaugguucugguaa

SEQ ID NO: 139763 - RNA, 19 nt, Homo sapiens
ggaacggaaguuugugaaa

SEQ ID NO: 139764 - RNA, 19 nt, Homo sapiens
caggggagaugaacuuuaa

SEQ ID NO: 139765 - RNA, 19 nt, Homo sapiens
uacgugagcacauugauaa

SEQ ID NO: 139766 - RNA, 19 nt, Homo sapiens
gagcacagccaagaaguca

SEQ ID NO: 139767 - RNA, 19 nt, Homo sapiens
gaugagcagguguuccuaa

SEQ ID NO: 139768 - RNA, 19 nt, Homo sapiens
gaagaugcauaugaagacu

SEQ ID NO: 139769 - RNA, 19 nt, Homo sapiens
gauuuacacaucagugaaa

SEQ ID NO: 139770 - RNA, 19 nt, Homo sapiens
guugucaaauguucaggaa

SEQ ID NO: 139771 - RNA, 19 nt, Homo sapiens
gugacaaugugcugacuca

SEQ ID NO: 139772 - RNA, 19 nt, Homo sapiens
cacaaaggccugcugaaau

SEQ ID NO: 139773 - RNA, 19 nt, Homo sapiens
ucgaaugaccaaauaacua

SEQ ID NO: 139774 - RNA, 19 nt, Homo sapiens
gguaacaaacucuucaaca

SEQ ID NO: 139775 - RNA, 19 nt, Homo sapiens
agacuguguugucaaaugu

SEQ ID NO: 139776 - RNA, 19 nt, Homo sapiens
aaccucgacuuguuguaua

SEQ ID NO: 139777 - RNA, 19 nt, Homo sapiens
cagaaaugggcuaguguuu

SEQ ID NO: 139778 - RNA, 19 nt, Homo sapiens
ggagaaggagcacgauuac

SEQ ID NO: 139779 - RNA, 19 nt, Homo sapiens
gagcuggaacggaaguuug

SEQ ID NO: 139780 - RNA, 19 nt, Homo sapiens
cagagacccucgucauuuu

SEQ ID NO: 139781 - RNA, 19 nt, Homo sapiens
uggauagaaugacucgaaa

SEQ ID NO: 139782 - RNA, 19 nt, Homo sapiens
gcagagcacagccaagaag

SEQ ID NO: 139783 - RNA, 19 nt, Homo sapiens
aacggaaguuugugaaaga

SEQ ID NO: 139784 - RNA, 19 nt, Homo sapiens
aaagccagacucuauggua

SEQ ID NO: 139785 - RNA, 19 nt, Homo sapiens
aaaagacuguguugucaaa

SEQ ID NO: 139786 - RNA, 19 nt, Homo sapiens
gaagcaacagucacuccuu

SEQ ID NO: 139787 - RNA, 19 nt, Homo sapiens
ggaagaugcauaugaagac

SEQ ID NO: 139788 - RNA, 19 nt, Homo sapiens
gagguucugccuucaguau

SEQ ID NO: 139789 - RNA, 19 nt, Homo sapiens
uggcacaugcuaucaguuu

SEQ ID NO: 139790 - RNA, 19 nt, Homo sapiens
acaaacucuucaacagaaa

SEQ ID NO: 139791 - RNA, 19 nt, Homo sapiens
caaaggccugcugaaauuu

SEQ ID NO: 139792 - RNA, 19 nt, Homo sapiens
aagugcauaugucgaauga

SEQ ID NO: 139793 - RNA, 19 nt, Homo sapiens
aagacuguguugucaaaug

SEQ ID NO: 139794 - RNA, 19 nt, Homo sapiens
gaagccggaagaugcauau

SEQ ID NO: 139795 - RNA, 19 nt, Homo sapiens
gccagagacccucgucauu

SEQ ID NO: 139796 - RNA, 19 nt, Homo sapiens
aacauacgguuuccacuuc

SEQ ID NO: 139797 - RNA, 19 nt, Homo sapiens
gaccucaggcuccgaugaa

SEQ ID NO: 139798 - RNA, 19 nt, Homo sapiens
aaaggaagaggccuagaau

SEQ ID NO: 139799 - RNA, 19 nt, Homo sapiens
gcauaugucgaaugaccaa

SEQ ID NO: 139800 - RNA, 19 nt, Homo sapiens
uuacgugagcacauugaua

SEQ ID NO: 139801 - RNA, 19 nt, Homo sapiens
gaccuuggacugugaugga

SEQ ID NO: 139802 - RNA, 19 nt, Homo sapiens
ggagaagaagcugcugcua

SEQ ID NO: 139803 - RNA, 19 nt, Homo sapiens
cggaagaugcauaugaaga

SEQ ID NO: 139804 - RNA, 19 nt, Homo sapiens
uuacacaucagugaaagaa

SEQ ID NO: 139805 - RNA, 19 nt, Homo sapiens
ucuagaccuuggacuguga

SEQ ID NO: 139806 - RNA, 19 nt, Homo sapiens
gguguuggccagcuucuuc

SEQ ID NO: 139807 - RNA, 19 nt, Homo sapiens
gguucugccuucaguaugg

SEQ ID NO: 139808 - RNA, 19 nt, Homo sapiens
ggagcuggaacggaaguuu

SEQ ID NO: 139809 - RNA, 19 nt, Homo sapiens
gcacgcagcugaacaagaa

SEQ ID NO: 139810 - RNA, 19 nt, Homo sapiens
gagaucagcuaugccauua

SEQ ID NO: 139811 - RNA, 19 nt, Homo sapiens
gaaagagcccugucugaaa

SEQ ID NO: 139812 - RNA, 19 nt, Homo sapiens
gagcuaaucaauacaguua

SEQ ID NO: 139813 - RNA, 19 nt, Homo sapiens
agaaggagguggaggagua

SEQ ID NO: 139814 - RNA, 19 nt, Homo sapiens
ccaguaagcucaguuccua

SEQ ID NO: 139815 - RNA, 19 nt, Homo sapiens
gggcaggccuucuauaagu

SEQ ID NO: 139816 - RNA, 19 nt, Homo sapiens
guauaucaacuucccauua

SEQ ID NO: 139817 - RNA, 19 nt, Homo sapiens
gcaaccugguggacucaua

SEQ ID NO: 139818 - RNA, 19 nt, Homo sapiens
aaagagcccugucugaaau

SEQ ID NO: 139819 - RNA, 19 nt, Homo sapiens
gaucagcuaugccauuaag

SEQ ID NO: 139820 - RNA, 19 nt, Homo sapiens
agagaaacgucuacaagga

SEQ ID NO: 139821 - RNA, 19 nt, Homo sapiens
gaacgaaggaccagauucu

SEQ ID NO: 139822 - RNA, 19 nt, Homo sapiens
cauuugagcuggugaagau

SEQ ID NO: 139823 - RNA, 19 nt, Homo sapiens
uauaucaacuucccauuag

SEQ ID NO: 139824 - RNA, 19 nt, Homo sapiens
gcccuggccucuugguuaa

SEQ ID NO: 139825 - RNA, 19 nt, Homo sapiens
gagaucagguggacacucu

SEQ ID NO: 139826 - RNA, 19 nt, Homo sapiens
ccacacguguugaacuuga

SEQ ID NO: 139827 - RNA, 19 nt, Homo sapiens
aaacagaacaugccgaguu

SEQ ID NO: 139828 - RNA, 19 nt, Homo sapiens
ccgagucacuguccuggua

SEQ ID NO: 139829 - RNA, 19 nt, Homo sapiens
gcucggugcuggagaacuu

SEQ ID NO: 139830 - RNA, 19 nt, Homo sapiens
guuaggcaguguaccagua

SEQ ID NO: 139831 - RNA, 19 nt, Homo sapiens
ccagggacgucuuggagaa

SEQ ID NO: 139832 - RNA, 19 nt, Homo sapiens
gcagagaaacgucuacaag

SEQ ID NO: 139833 - RNA, 19 nt, Homo sapiens
ggagaucagcuaugccauu

SEQ ID NO: 139834 - RNA, 19 nt, Homo sapiens
ucaccaagcuugaccugau

SEQ ID NO: 139835 - RNA, 19 nt, Homo sapiens
gagcaguccuacaucaaca

SEQ ID NO: 139836 - RNA, 19 nt, Homo sapiens
aacagaacaugccgaguuu

SEQ ID NO: 139837 - RNA, 19 nt, Homo sapiens
ggccugagguguacauagu

SEQ ID NO: 139838 - RNA, 19 nt, Homo sapiens
gaaaugugucgaccugguu

SEQ ID NO: 139839 - RNA, 19 nt, Homo sapiens
ugaaagagcccugucugaa

SEQ ID NO: 139840 - RNA, 19 nt, Homo sapiens
gcuaugccauuaagaacau

SEQ ID NO: 139841 - RNA, 19 nt, Homo sapiens
gcagaugguccagcaguuu

SEQ ID NO: 139842 - RNA, 19 nt, Homo sapiens
ccagaacccuugacaccau

SEQ ID NO: 139843 - RNA, 19 nt, Homo sapiens
agaucgagcuggccuguga

SEQ ID NO: 139844 - RNA, 19 nt, Homo sapiens
ccgaaucaaucgcaucuuc

SEQ ID NO: 139845 - RNA, 19 nt, Homo sapiens
gagcgaaucgucaccacuu

SEQ ID NO: 139846 - RNA, 19 nt, Homo sapiens
cacgagcgguucccauuug

SEQ ID NO: 139847 - RNA, 19 nt, Homo sapiens
gacaugauccugcaguuca

SEQ ID NO: 139848 - RNA, 19 nt, Homo sapiens
gcacucuguauucuauuaa

SEQ ID NO: 139849 - RNA, 19 nt, Homo sapiens
gaucccaucucggccaguu

SEQ ID NO: 139850 - RNA, 19 nt, Homo sapiens
uggugaagauggaguuuga

SEQ ID NO: 139851 - RNA, 19 nt, Homo sapiens
uagggcaggccuucuauaa

SEQ ID NO: 139852 - RNA, 19 nt, Homo sapiens
gagaaggaccaggcagaaa

SEQ ID NO: 139853 - RNA, 19 nt, Homo sapiens
gcagccagaaggauauuga

SEQ ID NO: 139854 - RNA, 19 nt, Homo sapiens
cgaccagccuccagacauc

SEQ ID NO: 139855 - RNA, 19 nt, Homo sapiens
ugcacucuguauucuauua

SEQ ID NO: 139856 - RNA, 19 nt, Homo sapiens
agaaagagaagaaguacau

SEQ ID NO: 139857 - RNA, 19 nt, Homo sapiens
uccaggagcuaaucaauac

SEQ ID NO: 139858 - RNA, 19 nt, Homo sapiens
ggcccuacguagcaaacua

SEQ ID NO: 139859 - RNA, 19 nt, Homo sapiens
ggagcacgcagcugaacaa

SEQ ID NO: 139860 - RNA, 19 nt, Homo sapiens
ggagaacgaaggaccagau

SEQ ID NO: 139861 - RNA, 19 nt, Homo sapiens
agauggaguuugacgagaa

SEQ ID NO: 139862 - RNA, 19 nt, Homo sapiens
gcacgccacaucugcagaa

SEQ ID NO: 139863 - RNA, 19 nt, Homo sapiens
gagaacgaaggaccagauu

SEQ ID NO: 139864 - RNA, 19 nt, Homo sapiens
gagaggagacagagcgaau

SEQ ID NO: 139865 - RNA, 19 nt, Homo sapiens
ccugcacucuguauucuau

SEQ ID NO: 139866 - RNA, 19 nt, Homo sapiens
caacaucaucggugacauc

SEQ ID NO: 139867 - RNA, 19 nt, Homo sapiens
gcacgucuucgccaucuuc

SEQ ID NO: 139868 - RNA, 19 nt, Homo sapiens
gaagagagccauccccaau

SEQ ID NO: 139869 - RNA, 19 nt, Homo sapiens
caaggaggcgcucaacauc

SEQ ID NO: 139870 - RNA, 19 nt, Homo sapiens
ccacgagcgguucccauuu

SEQ ID NO: 139871 - RNA, 19 nt, Homo sapiens
ggaggaguacaagaucuuu

SEQ ID NO: 139872 - RNA, 19 nt, Homo sapiens
ucaaggaggcgcucaacau

SEQ ID NO: 139873 - RNA, 19 nt, Homo sapiens
caucaaccuucgagucuac

SEQ ID NO: 139874 - RNA, 19 nt, Homo sapiens
ucagcuaugccauuaagaa

SEQ ID NO: 139875 - RNA, 19 nt, Homo sapiens
gaucgagggcucaggagau

SEQ ID NO: 139876 - RNA, 19 nt, Homo sapiens
gaaagagaagaaguacaug

SEQ ID NO: 139877 - RNA, 19 nt, Homo sapiens
gauggaguuugacgagaag

SEQ ID NO: 139878 - RNA, 19 nt, Homo sapiens
ggacaugauccugcaguuc

SEQ ID NO: 139879 - RNA, 19 nt, Homo sapiens
gcaacugaccaaccacauc

SEQ ID NO: 139880 - RNA, 19 nt, Homo sapiens
guugagaagaggcuacauu

SEQ ID NO: 139881 - RNA, 19 nt, Homo sapiens
ucaucgaccucccggguau

SEQ ID NO: 139882 - RNA, 19 nt, Homo sapiens
guagggcaggccuucuaua

SEQ ID NO: 139883 - RNA, 19 nt, Homo sapiens
agccaucccugcucgacua

SEQ ID NO: 139884 - RNA, 19 nt, Homo sapiens
ccaucaaccuucgagucua

SEQ ID NO: 139885 - RNA, 19 nt, Homo sapiens
cgccacacguguugaacuu

SEQ ID NO: 139886 - RNA, 19 nt, Homo sapiens
ggagaaagagaagaaguac

SEQ ID NO: 139887 - RNA, 19 nt, Homo sapiens
gacgggagaucagcuaugc

SEQ ID NO: 139888 - RNA, 19 nt, Homo sapiens
caccaagcuugaccugaug

SEQ ID NO: 139889 - RNA, 19 nt, Homo sapiens
ggagagcagccucauucug

SEQ ID NO: 139890 - RNA, 19 nt, Homo sapiens
ggcaggccuucuauaagug

SEQ ID NO: 139891 - RNA, 19 nt, Homo sapiens
caccucaugaucaacaaua

SEQ ID NO: 139892 - RNA, 19 nt, Homo sapiens
ggagcuaaucaauacaguu

SEQ ID NO: 139893 - RNA, 19 nt, Homo sapiens
guuuacagacuuugaugaa

SEQ ID NO: 139894 - RNA, 19 nt, Homo sapiens
cgggagagcagccucauuc

SEQ ID NO: 139895 - RNA, 19 nt, Homo sapiens
aggagaaagagaagaagua

SEQ ID NO: 139896 - RNA, 19 nt, Homo sapiens
caauacaguuaggcagugu

SEQ ID NO: 139897 - RNA, 19 nt, Homo sapiens
cagcugagaggaaguucuu

SEQ ID NO: 139898 - RNA, 19 nt, Homo sapiens
gccuugcccuugcccuauu

SEQ ID NO: 139899 - RNA, 19 nt, Homo sapiens
acacgaaccaugaggacuu

SEQ ID NO: 139900 - RNA, 19 nt, Homo sapiens
aguccuacaucaacacgaa

SEQ ID NO: 139901 - RNA, 19 nt, Homo sapiens
agagcucggugcuggagaa

SEQ ID NO: 139902 - RNA, 19 nt, Homo sapiens
ugaucccgcuggucaacaa

SEQ ID NO: 139903 - RNA, 19 nt, Homo sapiens
aaaugugucgaccugguua

SEQ ID NO: 139904 - RNA, 19 nt, Homo sapiens
ggagucaggaccgggcuuu

SEQ ID NO: 139905 - RNA, 19 nt, Homo sapiens
gaaguccggcaggagauug

SEQ ID NO: 139906 - RNA, 19 nt, Homo sapiens
uugacaccauccugaauga

SEQ ID NO: 139907 - RNA, 19 nt, Homo sapiens
gacaucgaguaccgaguca

SEQ ID NO: 139908 - RNA, 19 nt, Homo sapiens
cgaccgguguccagcauac

SEQ ID NO: 139909 - RNA, 19 nt, Homo sapiens
gcaaggacaugguuaaauu

SEQ ID NO: 139910 - RNA, 19 nt, Homo sapiens
gagaagagacguagaguua

SEQ ID NO: 139911 - RNA, 19 nt, Homo sapiens
ggaagaagaguuacuauaa

SEQ ID NO: 139912 - RNA, 19 nt, Homo sapiens
gagcggaggugucccaaua

SEQ ID NO: 139913 - RNA, 19 nt, Homo sapiens
gcacagaagucaacccaaa

SEQ ID NO: 139914 - RNA, 19 nt, Homo sapiens
ggacgacccugaccucaaa

SEQ ID NO: 139915 - RNA, 19 nt, Homo sapiens
gcaggcggcucaaagauuu

SEQ ID NO: 139916 - RNA, 19 nt, Homo sapiens
ggaaggagcccguggauga

SEQ ID NO: 139917 - RNA, 19 nt, Homo sapiens
gaacaagaaucgcaucucu

SEQ ID NO: 139918 - RNA, 19 nt, Homo sapiens
gaagaagaguuacuauaag

SEQ ID NO: 139919 - RNA, 19 nt, Homo sapiens
agagacagcuuaacagaaa

SEQ ID NO: 139920 - RNA, 19 nt, Homo sapiens
gaguggaaauuaagacuuu

SEQ ID NO: 139921 - RNA, 19 nt, Homo sapiens
gagaagccgucaagacuga

SEQ ID NO: 139922 - RNA, 19 nt, Homo sapiens
gaaaccaaauuacguaaag

SEQ ID NO: 139923 - RNA, 19 nt, Homo sapiens
gaucaagcuuuguauguug

SEQ ID NO: 139924 - RNA, 19 nt, Homo sapiens
gaagagacguagaguuaca

SEQ ID NO: 139925 - RNA, 19 nt, Homo sapiens
caacagaggacaacaaguu

SEQ ID NO: 139926 - RNA, 19 nt, Homo sapiens
gaauaucgaacucuucuuu

SEQ ID NO: 139927 - RNA, 19 nt, Homo sapiens
uaucaaaucuaccacugua

SEQ ID NO: 139928 - RNA, 19 nt, Homo sapiens
ccacugggcuggccucuau

SEQ ID NO: 139929 - RNA, 19 nt, Homo sapiens
caaugagacugacaucaaa

SEQ ID NO: 139930 - RNA, 19 nt, Homo sapiens
ggaaagagacagcuuaaca

SEQ ID NO: 139931 - RNA, 19 nt, Homo sapiens
ggaagaagaagaaacagaa

SEQ ID NO: 139932 - RNA, 19 nt, Homo sapiens
gcaccucauuugccgaaua

SEQ ID NO: 139933 - RNA, 19 nt, Homo sapiens
gagaagcuguccaucuuug

SEQ ID NO: 139934 - RNA, 19 nt, Homo sapiens
ggaagugaauggacgucua

SEQ ID NO: 139935 - RNA, 19 nt, Homo sapiens
gaaauacuccgacuacauc

SEQ ID NO: 139936 - RNA, 19 nt, Homo sapiens
gaacggugcucaugcuuac

SEQ ID NO: 139937 - RNA, 19 nt, Homo sapiens
acaugaagcuguuguguga

SEQ ID NO: 139938 - RNA, 19 nt, Homo sapiens
gaucuucgauacuuucuuc

SEQ ID NO: 139939 - RNA, 19 nt, Homo sapiens
ggacaacaaguucaaauuc

SEQ ID NO: 139940 - RNA, 19 nt, Homo sapiens
acaugcagcuuucauauau

SEQ ID NO: 139941 - RNA, 19 nt, Homo sapiens
uggagcagguggagaguua

SEQ ID NO: 139942 - RNA, 19 nt, Homo sapiens
cacagaugcugacaaauga

SEQ ID NO: 139943 - RNA, 19 nt, Homo sapiens
ccacagaugcugacaaaug

SEQ ID NO: 139944 - RNA, 19 nt, Homo sapiens
gaaccaacacccaaacaga

SEQ ID NO: 139945 - RNA, 19 nt, Homo sapiens
gugaucaaauugugcagua

SEQ ID NO: 139946 - RNA, 19 nt, Homo sapiens
guaaggacaugagugcauu

SEQ ID NO: 139947 - RNA, 19 nt, Homo sapiens
gggaagaagaguuacuaua

SEQ ID NO: 139948 - RNA, 19 nt, Homo sapiens
gcaagauugugguggaguu

SEQ ID NO: 139949 - RNA, 19 nt, Homo sapiens
gcacgaauuucugcaaaca

SEQ ID NO: 139950 - RNA, 19 nt, Homo sapiens
ggacaugcagcuuucauau

SEQ ID NO: 139951 - RNA, 19 nt, Homo sapiens
ggacaugguuaaauuuggu

SEQ ID NO: 139952 - RNA, 19 nt, Homo sapiens
ggaagaagaaagagaugaa

SEQ ID NO: 139953 - RNA, 19 nt, Homo sapiens
gaaccaagcaagaagugaa

SEQ ID NO: 139954 - RNA, 19 nt, Homo sapiens
ucaguuaugugacuuggaa

SEQ ID NO: 139955 - RNA, 19 nt, Homo sapiens
gaagaaacagaacaagaau

SEQ ID NO: 139956 - RNA, 19 nt, Homo sapiens
ccaaagaaccaacggagaa

SEQ ID NO: 139957 - RNA, 19 nt, Homo sapiens
gagaaugucaggaacuuug

SEQ ID NO: 139958 - RNA, 19 nt, Homo sapiens
gacaacaaguucaaauucu

SEQ ID NO: 139959 - RNA, 19 nt, Homo sapiens
caacgagucuggcuuugag

SEQ ID NO: 139960 - RNA, 19 nt, Homo sapiens
cuaccuggcuaaagucaaa

SEQ ID NO: 139961 - RNA, 19 nt, Homo sapiens
ccaggaagcugcgguauac

SEQ ID NO: 139962 - RNA, 19 nt, Homo sapiens
gacaugcagcuuucauaua

SEQ ID NO: 139963 - RNA, 19 nt, Homo sapiens
gaagucaacccaaagaucu

SEQ ID NO: 139964 - RNA, 19 nt, Homo sapiens
cgagaaagaugagaagaag

SEQ ID NO: 139965 - RNA, 19 nt, Homo sapiens
ggaaauacuccgacuacau

SEQ ID NO: 139966 - RNA, 19 nt, Homo sapiens
gaagaagaaagagaugaaa

SEQ ID NO: 139967 - RNA, 19 nt, Homo sapiens
ccaaugagacugacaucaa

SEQ ID NO: 139968 - RNA, 19 nt, Homo sapiens
gaauuggccggaucaaaga

SEQ ID NO: 139969 - RNA, 19 nt, Homo sapiens
agaagaaacagaacaagaa

SEQ ID NO: 139970 - RNA, 19 nt, Homo sapiens
gagaucaagcuuuguaugu

SEQ ID NO: 139971 - RNA, 19 nt, Homo sapiens
gaagggagacguggagaug

SEQ ID NO: 139972 - RNA, 19 nt, Homo sapiens
caaagaaccaacacccaaa

SEQ ID NO: 139973 - RNA, 19 nt, Homo sapiens
ccagagcacuaccggaaau

SEQ ID NO: 139974 - RNA, 19 nt, Homo sapiens
auaagaaggugugcauuga

SEQ ID NO: 139975 - RNA, 19 nt, Homo sapiens
gaaggaggcagaugacgau

SEQ ID NO: 139976 - RNA, 19 nt, Homo sapiens
gugaauggacgucuagaaa

SEQ ID NO: 139977 - RNA, 19 nt, Homo sapiens
ggaaaccaaauuacguaaa

SEQ ID NO: 139978 - RNA, 19 nt, Homo sapiens
gcaacauccuggacaagca

SEQ ID NO: 139979 - RNA, 19 nt, Homo sapiens
ggaggcagaugacgaugag

SEQ ID NO: 139980 - RNA, 19 nt, Homo sapiens
uaccagaucuucgauacuu

SEQ ID NO: 139981 - RNA, 19 nt, Homo sapiens
caaaaccaaucuaugauga

SEQ ID NO: 139982 - RNA, 19 nt, Homo sapiens
ucagggaccacaucuguaa

SEQ ID NO: 139983 - RNA, 19 nt, Homo sapiens
gaaagagacagcuuaacag

SEQ ID NO: 139984 - RNA, 19 nt, Homo sapiens
gcaacgggcagauguuuca

SEQ ID NO: 139985 - RNA, 19 nt, Homo sapiens
ggacugugucucuguuauu

SEQ ID NO: 139986 - RNA, 19 nt, Homo sapiens
caaggacaugguuaaauuu

SEQ ID NO: 139987 - RNA, 19 nt, Homo sapiens
auaaaugaaugguggauca

SEQ ID NO: 139988 - RNA, 19 nt, Homo sapiens
acaaagaccaggaugagaa

SEQ ID NO: 139989 - RNA, 19 nt, Homo sapiens
caucaaggaagaagacaaa

SEQ ID NO: 139990 - RNA, 19 nt, Homo sapiens
ggagaacggugcucaugcu

SEQ ID NO: 139991 - RNA, 19 nt, Homo sapiens
ggccuuggcugacaugaag

SEQ ID NO: 139992 - RNA, 19 nt, Homo sapiens
gagagagugccucagcuaa

SEQ ID NO: 139993 - RNA, 19 nt, Homo sapiens
gcaaagugaaagucaucua

SEQ ID NO: 139994 - RNA, 19 nt, Homo sapiens
gaagaguuacuauaagaag

SEQ ID NO: 139995 - RNA, 19 nt, Homo sapiens
aaaccaaucuaugaugaug

SEQ ID NO: 139996 - RNA, 19 nt, Homo sapiens
aaacagucaugaacuccaa

SEQ ID NO: 139997 - RNA, 19 nt, Homo sapiens
ccaaauuacguaaagaaga

SEQ ID NO: 139998 - RNA, 19 nt, Homo sapiens
ccugagcccuaccgaauug

SEQ ID NO: 139999 - RNA, 19 nt, Homo sapiens
gaucaagacuacgcgagau

SEQ ID NO: 140000 - RNA, 19 nt, Homo sapiens
gcggaggugucccaauaug

SEQ ID NO: 140001 - RNA, 19 nt, Homo sapiens
gaaguuugugagcaacaua

SEQ ID NO: 140002 - RNA, 19 nt, Homo sapiens
ggaacuuugucuccuucaa

SEQ ID NO: 140003 - RNA, 19 nt, Homo sapiens
caaaucuaccacuguauga

SEQ ID NO: 140004 - RNA, 19 nt, Homo sapiens
cgaauuggccggaucaaag

SEQ ID NO: 140005 - RNA, 19 nt, Homo sapiens
aagaaggugugcauugaug

SEQ ID NO: 140006 - RNA, 19 nt, Homo sapiens
auaaagauuuguccuugga

SEQ ID NO: 140007 - RNA, 19 nt, Homo sapiens
augaggaagucgaugauaa

SEQ ID NO: 140008 - RNA, 19 nt, Homo sapiens
gcaauuccgacucgaccua

SEQ ID NO: 140009 - RNA, 19 nt, Homo sapiens
ggaaggaaauucugacaua

SEQ ID NO: 140010 - RNA, 19 nt, Homo sapiens
gaaagauggucauaugaua

SEQ ID NO: 140011 - RNA, 19 nt, Homo sapiens
acgaauagcuucuuacaua

SEQ ID NO: 140012 - RNA, 19 nt, Homo sapiens
gcgauaugcucuucuguua

SEQ ID NO: 140013 - RNA, 19 nt, Homo sapiens
gcauaaaacucacaucuua

SEQ ID NO: 140014 - RNA, 19 nt, Homo sapiens
caaaauaagugucgaguua

SEQ ID NO: 140015 - RNA, 19 nt, Homo sapiens
gaagagagaugaaaagaaa

SEQ ID NO: 140016 - RNA, 19 nt, Homo sapiens
caacauacacucucaauga

SEQ ID NO: 140017 - RNA, 19 nt, Homo sapiens
gcagggacuugaacagaua

SEQ ID NO: 140018 - RNA, 19 nt, Homo sapiens
cagcagaccucuuggaauu

SEQ ID NO: 140019 - RNA, 19 nt, Homo sapiens
gauaugcucuucuguuaga

SEQ ID NO: 140020 - RNA, 19 nt, Homo sapiens
gauacaaaguuucugauug

SEQ ID NO: 140021 - RNA, 19 nt, Homo sapiens
cgaagaguuugacagauua

SEQ ID NO: 140022 - RNA, 19 nt, Homo sapiens
gaauguagcaugacguuaa

SEQ ID NO: 140023 - RNA, 19 nt, Homo sapiens
gaauguagcuuaguggaau

SEQ ID NO: 140024 - RNA, 19 nt, Homo sapiens
cagaagaaauucacaggaa

SEQ ID NO: 140025 - RNA, 19 nt, Homo sapiens
ugacauggaugaaccuuga

SEQ ID NO: 140026 - RNA, 19 nt, Homo sapiens
gaaggaaauucugacauau

SEQ ID NO: 140027 - RNA, 19 nt, Homo sapiens
gaaauaacucugaaagaug

SEQ ID NO: 140028 - RNA, 19 nt, Homo sapiens
caaacuaagucuugcauca

SEQ ID NO: 140029 - RNA, 19 nt, Homo sapiens
ugaagaauaugucaggaaa

SEQ ID NO: 140030 - RNA, 19 nt, Homo sapiens
caaagucauugcugcgaua

SEQ ID NO: 140031 - RNA, 19 nt, Homo sapiens
cagaaacuaucacuaucua

SEQ ID NO: 140032 - RNA, 19 nt, Homo sapiens
gauggagaauggguaguua

SEQ ID NO: 140033 - RNA, 19 nt, Homo sapiens
ggaugaaccuugaguacau

SEQ ID NO: 140034 - RNA, 19 nt, Homo sapiens
gcuugaaacugcagaagaa

SEQ ID NO: 140035 - RNA, 19 nt, Homo sapiens
guagacagaauguagcuua

SEQ ID NO: 140036 - RNA, 19 nt, Homo sapiens
ccacugcaacuguauauuu

SEQ ID NO: 140037 - RNA, 19 nt, Homo sapiens
gaacguugaaccaaauauu

SEQ ID NO: 140038 - RNA, 19 nt, Homo sapiens
uugcaaagcuucagucaga

SEQ ID NO: 140039 - RNA, 19 nt, Homo sapiens
cacugcaacuguauauuua

SEQ ID NO: 140040 - RNA, 19 nt, Homo sapiens
gcugaggaauguagcauga

SEQ ID NO: 140041 - RNA, 19 nt, Homo sapiens
ucgaagaguuugacagauu

SEQ ID NO: 140042 - RNA, 19 nt, Homo sapiens
guggauaaauuggaaguuu

SEQ ID NO: 140043 - RNA, 19 nt, Homo sapiens
cgaauagcuucuuacauau

SEQ ID NO: 140044 - RNA, 19 nt, Homo sapiens
gaaacaaguccagaaauca

SEQ ID NO: 140045 - RNA, 19 nt, Homo sapiens
ccucugaucccaugucaua

SEQ ID NO: 140046 - RNA, 19 nt, Homo sapiens
cuacaugaguaucuuguga

SEQ ID NO: 140047 - RNA, 19 nt, Homo sapiens
guucagacagagccuauua

SEQ ID NO: 140048 - RNA, 19 nt, Homo sapiens
gaaacuaucacuaucuaca

SEQ ID NO: 140049 - RNA, 19 nt, Homo sapiens
agaaacaaguccagaaauc

SEQ ID NO: 140050 - RNA, 19 nt, Homo sapiens
ucaacacugucgcuaauga

SEQ ID NO: 140051 - RNA, 19 nt, Homo sapiens
aaagaacguugaaccaaau

SEQ ID NO: 140052 - RNA, 19 nt, Homo sapiens
uagcuuaguggaauucuua

SEQ ID NO: 140053 - RNA, 19 nt, Homo sapiens
agacagagccuauuacaag

SEQ ID NO: 140054 - RNA, 19 nt, Homo sapiens
ggaaguuugugcauugcuu

SEQ ID NO: 140055 - RNA, 19 nt, Homo sapiens
ucugaaagauggucauaug

SEQ ID NO: 140056 - RNA, 19 nt, Homo sapiens
gacagaauguagcuuagug

SEQ ID NO: 140057 - RNA, 19 nt, Homo sapiens
ggacuugaacagauauuug

SEQ ID NO: 140058 - RNA, 19 nt, Homo sapiens
gcagaccucuuggaauuag

SEQ ID NO: 140059 - RNA, 19 nt, Homo sapiens
aaggagcacuagagcuuua

SEQ ID NO: 140060 - RNA, 19 nt, Homo sapiens
cagaggaugugcagguuga

SEQ ID NO: 140061 - RNA, 19 nt, Homo sapiens
agaagaaauucacaggaaa

SEQ ID NO: 140062 - RNA, 19 nt, Homo sapiens
caaauucaaggcuacgaua

SEQ ID NO: 140063 - RNA, 19 nt, Homo sapiens
guagagacauuugcuuaca

SEQ ID NO: 140064 - RNA, 19 nt, Homo sapiens
uagcaugacguuaagauuu

SEQ ID NO: 140065 - RNA, 19 nt, Homo sapiens
uagauauucucccaagauu

SEQ ID NO: 140066 - RNA, 19 nt, Homo sapiens
gagcuuuagugucuacaug

SEQ ID NO: 140067 - RNA, 19 nt, Homo sapiens
gaacuaauucuggugaaau

SEQ ID NO: 140068 - RNA, 19 nt, Homo sapiens
acagcagacugaagaauau

SEQ ID NO: 140069 - RNA, 19 nt, Homo sapiens
cuacaaaucccuuaccaau

SEQ ID NO: 140070 - RNA, 19 nt, Homo sapiens
gacgugaaccaguaucuuu

SEQ ID NO: 140071 - RNA, 19 nt, Homo sapiens
caccaacuauaaauacuug

SEQ ID NO: 140072 - RNA, 19 nt, Homo sapiens
gaugaaccuugaguacauu

SEQ ID NO: 140073 - RNA, 19 nt, Homo sapiens
guccagaaaucauauuaca

SEQ ID NO: 140074 - RNA, 19 nt, Homo sapiens
aacuaagucuugcaucaua

SEQ ID NO: 140075 - RNA, 19 nt, Homo sapiens
ccauguguuucaucaaauu

SEQ ID NO: 140076 - RNA, 19 nt, Homo sapiens
uagcuuugauggcagcaua

SEQ ID NO: 140077 - RNA, 19 nt, Homo sapiens
uagcagauguauauguaug

SEQ ID NO: 140078 - RNA, 19 nt, Homo sapiens
auacaaaguuucugauugg

SEQ ID NO: 140079 - RNA, 19 nt, Homo sapiens
ggauacaaaguuucugauu

SEQ ID NO: 140080 - RNA, 19 nt, Homo sapiens
gguagaagcagcccaagug

SEQ ID NO: 140081 - RNA, 19 nt, Homo sapiens
aaagaaacaaguccagaaa

SEQ ID NO: 140082 - RNA, 19 nt, Homo sapiens
gcucuucuguuagacauug

SEQ ID NO: 140083 - RNA, 19 nt, Homo sapiens
ugacauaugcggugacaug

SEQ ID NO: 140084 - RNA, 19 nt, Homo sapiens
gcccaagugucaucccauu

SEQ ID NO: 140085 - RNA, 19 nt, Homo sapiens
ccagaaaucauauuacaag

SEQ ID NO: 140086 - RNA, 19 nt, Homo sapiens
caagacgauugaaggcauu

SEQ ID NO: 140087 - RNA, 19 nt, Homo sapiens
ugaaacugcagaagaaauu

SEQ ID NO: 140088 - RNA, 19 nt, Homo sapiens
cacugucgcuaaugaagua

SEQ ID NO: 140089 - RNA, 19 nt, Homo sapiens
gauauucucccaagauuac

SEQ ID NO: 140090 - RNA, 19 nt, Homo sapiens
ggacgaauagcuucuuaca

SEQ ID NO: 140091 - RNA, 19 nt, Homo sapiens
cuaccagugucauucaauu

SEQ ID NO: 140092 - RNA, 19 nt, Homo sapiens
gcugagagaaagcuguaua

SEQ ID NO: 140093 - RNA, 19 nt, Homo sapiens
uaaugccacugcaacugua

SEQ ID NO: 140094 - RNA, 19 nt, Homo sapiens
gauaaaagcaagugacaaa

SEQ ID NO: 140095 - RNA, 19 nt, Homo sapiens
uugauuaccucuccaugaa

SEQ ID NO: 140096 - RNA, 19 nt, Homo sapiens
gaagauaacagugaaacag

SEQ ID NO: 140097 - RNA, 19 nt, Homo sapiens
ucauauguguucagacaga

SEQ ID NO: 140098 - RNA, 19 nt, Homo sapiens
gaauguagggaagcuguaa

SEQ ID NO: 140099 - RNA, 19 nt, Homo sapiens
cauaacaggcauaacauau

SEQ ID NO: 140100 - RNA, 19 nt, Homo sapiens
gauauuucacuccuaaaga

SEQ ID NO: 140101 - RNA, 19 nt, Homo sapiens
auucaaggcuacgauauuu

SEQ ID NO: 140102 - RNA, 19 nt, Homo sapiens
uauggaaugucugcuauau

SEQ ID NO: 140103 - RNA, 19 nt, Homo sapiens
gacagagccuauuacaagu

SEQ ID NO: 140104 - RNA, 19 nt, Homo sapiens
gcauaauggauacaaaguu

SEQ ID NO: 140105 - RNA, 19 nt, Homo sapiens
cauaugcggugacauggau

SEQ ID NO: 140106 - RNA, 19 nt, Homo sapiens
ggaaaacgcuauggagguu

SEQ ID NO: 140107 - RNA, 19 nt, Homo sapiens
caacgugcauguaguagcu

SEQ ID NO: 140108 - RNA, 19 nt, Homo sapiens
agaaauagcaaaucuccuu

SEQ ID NO: 140109 - RNA, 19 nt, Homo sapiens
ggacaagaaugccaccaaa

SEQ ID NO: 140110 - RNA, 19 nt, Homo sapiens
gaagaaagccaaggucauu

SEQ ID NO: 140111 - RNA, 19 nt, Homo sapiens
gaagaaucccuacaaagaa

SEQ ID NO: 140112 - RNA, 19 nt, Homo sapiens
gaugauugaugccaaagaa

SEQ ID NO: 140113 - RNA, 19 nt, Homo sapiens
gaacaccacacaagacauu

SEQ ID NO: 140114 - RNA, 19 nt, Homo sapiens
cauccagacucaugcaaua

SEQ ID NO: 140115 - RNA, 19 nt, Homo sapiens
caacaucgaauccaugaaa

SEQ ID NO: 140116 - RNA, 19 nt, Homo sapiens
ccaaagaccacgauaauuc

SEQ ID NO: 140117 - RNA, 19 nt, Homo sapiens
gcaaugaccucuccaucgu

SEQ ID NO: 140118 - RNA, 19 nt, Homo sapiens
caagagagcggcuggugua

SEQ ID NO: 140119 - RNA, 19 nt, Homo sapiens
ggaaauaccggagggcuuu

SEQ ID NO: 140120 - RNA, 19 nt, Homo sapiens
ucucuagccugaucagaua

SEQ ID NO: 140121 - RNA, 19 nt, Homo sapiens
acaccgggaucuauguuua

SEQ ID NO: 140122 - RNA, 19 nt, Homo sapiens
ggaaagagagagacacuca

SEQ ID NO: 140123 - RNA, 19 nt, Homo sapiens
cagauguucuucgcuaaua

SEQ ID NO: 140124 - RNA, 19 nt, Homo sapiens
guacaacccgacuucauaa

SEQ ID NO: 140125 - RNA, 19 nt, Homo sapiens
gcuguuaccucuuguuuac

SEQ ID NO: 140126 - RNA, 19 nt, Homo sapiens
ugugggagccucaauguua

SEQ ID NO: 140127 - RNA, 19 nt, Homo sapiens
agaagaaucccuacaaaga

SEQ ID NO: 140128 - RNA, 19 nt, Homo sapiens
gaacaagcccaugauugaa

SEQ ID NO: 140129 - RNA, 19 nt, Homo sapiens
caaaggguuucaccaagga

SEQ ID NO: 140130 - RNA, 19 nt, Homo sapiens
cauccacugugaaugauaa

SEQ ID NO: 140131 - RNA, 19 nt, Homo sapiens
gagagcggcugguguacga

SEQ ID NO: 140132 - RNA, 19 nt, Homo sapiens
agagaagaaucccuacaaa

SEQ ID NO: 140133 - RNA, 19 nt, Homo sapiens
gaaugaaugcuguggaaga

SEQ ID NO: 140134 - RNA, 19 nt, Homo sapiens
ucaaacagcgagaugagua

SEQ ID NO: 140135 - RNA, 19 nt, Homo sapiens
agaacaagcccaugauuga

SEQ ID NO: 140136 - RNA, 19 nt, Homo sapiens
gaaggagaccaacaucgaa

SEQ ID NO: 140137 - RNA, 19 nt, Homo sapiens
cgacacaaaguuaaacaaa

SEQ ID NO: 140138 - RNA, 19 nt, Homo sapiens
gaacugcuuucuggagugu

SEQ ID NO: 140139 - RNA, 19 nt, Homo sapiens
ucauaauggugcuuucaaa

SEQ ID NO: 140140 - RNA, 19 nt, Homo sapiens
caacccgacuucauaaugg

SEQ ID NO: 140141 - RNA, 19 nt, Homo sapiens
aaacugagguagcgacaca

SEQ ID NO: 140142 - RNA, 19 nt, Homo sapiens
gaacagaaggagaccaaca

SEQ ID NO: 140143 - RNA, 19 nt, Homo sapiens
ucagagcuauuacccaaug

SEQ ID NO: 140144 - RNA, 19 nt, Homo sapiens
uggaaaggguauuugguuu

SEQ ID NO: 140145 - RNA, 19 nt, Homo sapiens
caggaaaccuugaagaaaa

SEQ ID NO: 140146 - RNA, 19 nt, Homo sapiens
aaagugaggaccauuacua

SEQ ID NO: 140147 - RNA, 19 nt, Homo sapiens
cgggaucuauguuuaaguu

SEQ ID NO: 140148 - RNA, 19 nt, Homo sapiens
gcagaacaagcccaugauu

SEQ ID NO: 140149 - RNA, 19 nt, Homo sapiens
aaagggaggcugagaagaa

SEQ ID NO: 140150 - RNA, 19 nt, Homo sapiens
gaaacaagaagguuauugc

SEQ ID NO: 140151 - RNA, 19 nt, Homo sapiens
cagaagugccggaacauug

SEQ ID NO: 140152 - RNA, 19 nt, Homo sapiens
ccaagaacaugaggaugga

SEQ ID NO: 140153 - RNA, 19 nt, Homo sapiens
uaaccacgaccaggaauuu

SEQ ID NO: 140154 - RNA, 19 nt, Homo sapiens
acaacaagcagcccaugua

SEQ ID NO: 140155 - RNA, 19 nt, Homo sapiens
guucggagacggcaaauuc

SEQ ID NO: 140156 - RNA, 19 nt, Homo sapiens
gcgcaaaggguuucaccaa

SEQ ID NO: 140157 - RNA, 19 nt, Homo sapiens
gagaacaccacacaagaca

SEQ ID NO: 140158 - RNA, 19 nt, Homo sapiens
gagaagaaucccuacaaag

SEQ ID NO: 140159 - RNA, 19 nt, Homo sapiens
guggugggaucagaacuaa

SEQ ID NO: 140160 - RNA, 19 nt, Homo sapiens
ggagaaagggagacagcuu

SEQ ID NO: 140161 - RNA, 19 nt, Homo sapiens
caaaggacccugcggugau

SEQ ID NO: 140162 - RNA, 19 nt, Homo sapiens
aaacaucagcuuccacguu

SEQ ID NO: 140163 - RNA, 19 nt, Homo sapiens
caaacagcgagaugaguaa

SEQ ID NO: 140164 - RNA, 19 nt, Homo sapiens
uguacaacccgacuucaua

SEQ ID NO: 140165 - RNA, 19 nt, Homo sapiens
gacacaaaguuaaacaaac

SEQ ID NO: 140166 - RNA, 19 nt, Homo sapiens
ccaacccugugaugauuga

SEQ ID NO: 140167 - RNA, 19 nt, Homo sapiens
guccaacccugugaugauu

SEQ ID NO: 140168 - RNA, 19 nt, Homo sapiens
aaacagaacccaguuagca

SEQ ID NO: 140169 - RNA, 19 nt, Homo sapiens
gaaaaggguuggacaucau

SEQ ID NO: 140170 - RNA, 19 nt, Homo sapiens
agagggacaucucgcgauu

SEQ ID NO: 140171 - RNA, 19 nt, Homo sapiens
cagaacaagcccaugauug

SEQ ID NO: 140172 - RNA, 19 nt, Homo sapiens
ggcccaguuucucacuuua

SEQ ID NO: 140173 - RNA, 19 nt, Homo sapiens
ccauaaagcagggcaaaga

SEQ ID NO: 140174 - RNA, 19 nt, Homo sapiens
gcagaagugccggaacauu

SEQ ID NO: 140175 - RNA, 19 nt, Homo sapiens
caccaaggauggagaaagg

SEQ ID NO: 140176 - RNA, 19 nt, Homo sapiens
gacugaaacaagaagguua

SEQ ID NO: 140177 - RNA, 19 nt, Homo sapiens
gcaaggaggagcgccaaga

SEQ ID NO: 140178 - RNA, 19 nt, Homo sapiens
gcgaugacgagccagagua

SEQ ID NO: 140179 - RNA, 19 nt, Homo sapiens
aaugaaugcuguggaagaa

SEQ ID NO: 140180 - RNA, 19 nt, Homo sapiens
gcucaacaccgggaucuau

SEQ ID NO: 140181 - RNA, 19 nt, Homo sapiens
ggacaucucgcgauuucuc

SEQ ID NO: 140182 - RNA, 19 nt, Homo sapiens
gaagagaagaaucccuaca

SEQ ID NO: 140183 - RNA, 19 nt, Homo sapiens
gagacucccucggcaagau

SEQ ID NO: 140184 - RNA, 19 nt, Homo sapiens
gcaaaacagaacccaguua

SEQ ID NO: 140185 - RNA, 19 nt, Homo sapiens
acaauaccuugcagaggaa

SEQ ID NO: 140186 - RNA, 19 nt, Homo sapiens
ggucaaacuccauaaagca

SEQ ID NO: 140187 - RNA, 19 nt, Homo sapiens
gcaaagugaggaccauuac

SEQ ID NO: 140188 - RNA, 19 nt, Homo sapiens
aagaaucccuacaaagaag

SEQ ID NO: 140189 - RNA, 19 nt, Homo sapiens
gugcagaacaagcccauga

SEQ ID NO: 140190 - RNA, 19 nt, Homo sapiens
aagggaggcugagaagaaa

SEQ ID NO: 140191 - RNA, 19 nt, Homo sapiens
ggugggaucagaacuaauc

SEQ ID NO: 140192 - RNA, 19 nt, Homo sapiens
acuguuaacuacuguacaa

SEQ ID NO: 140193 - RNA, 19 nt, Homo sapiens
cacaggaaaccuugaagaa

SEQ ID NO: 140194 - RNA, 19 nt, Homo sapiens
gaaaggugggagagaggaa

SEQ ID NO: 140195 - RNA, 19 nt, Homo sapiens
gaacaugaggauggagaga

SEQ ID NO: 140196 - RNA, 19 nt, Homo sapiens
ccaggcagccauuaaggaa

SEQ ID NO: 140197 - RNA, 19 nt, Homo sapiens
ggaagagcacagcggagaa

SEQ ID NO: 140198 - RNA, 19 nt, Homo sapiens
aggaaugaaugcuguggaa

SEQ ID NO: 140199 - RNA, 19 nt, Homo sapiens
uaauggugcuuucaaacag

SEQ ID NO: 140200 - RNA, 19 nt, Homo sapiens
acaggaaaccuugaagaaa

SEQ ID NO: 140201 - RNA, 19 nt, Homo sapiens
gcugagacccugccugaag

SEQ ID NO: 140202 - RNA, 19 nt, Homo sapiens
gguagcgacacaaaguuaa

SEQ ID NO: 140203 - RNA, 19 nt, Homo sapiens
acaagcccaugauugaaug

SEQ ID NO: 140204 - RNA, 19 nt, Homo sapiens
ccacacaggaaaccuugaa

SEQ ID NO: 140205 - RNA, 19 nt, Homo sapiens
guagcgacacaaaguuaaa

SEQ ID NO: 140206 - RNA, 19 nt, Homo sapiens
ggugcugucucucuuugau

SEQ ID NO: 140207 - RNA, 19 nt, Homo sapiens
caagaaugccaccaaagca

SEQ ID NO: 140208 - RNA, 19 nt, Homo sapiens
acugacgucuccaacauga

SEQ ID NO: 140209 - RNA, 19 nt, Homo sapiens
ggacaagaaugccaccaaa

SEQ ID NO: 140210 - RNA, 19 nt, Homo sapiens
gaagaaagccaaggucauu

SEQ ID NO: 140211 - RNA, 19 nt, Homo sapiens
gaagaaucccuacaaagaa

SEQ ID NO: 140212 - RNA, 19 nt, Homo sapiens
gaugauugaugccaaagaa

SEQ ID NO: 140213 - RNA, 19 nt, Homo sapiens
gaacaccacacaagacauu

SEQ ID NO: 140214 - RNA, 19 nt, Homo sapiens
cauccagacucaugcaaua

SEQ ID NO: 140215 - RNA, 19 nt, Homo sapiens
gcaaugaccucuccaucgu

SEQ ID NO: 140216 - RNA, 19 nt, Homo sapiens
caagagagcggcuggugua

SEQ ID NO: 140217 - RNA, 19 nt, Homo sapiens
ggaaauaccggagggcuuu

SEQ ID NO: 140218 - RNA, 19 nt, Homo sapiens
ucucuagccugaucagaua

SEQ ID NO: 140219 - RNA, 19 nt, Homo sapiens
ggaaagagagagacacuca

SEQ ID NO: 140220 - RNA, 19 nt, Homo sapiens
cagauguucuucgcuaaua

SEQ ID NO: 140221 - RNA, 19 nt, Homo sapiens
guacaacccgacuucauaa

SEQ ID NO: 140222 - RNA, 19 nt, Homo sapiens
gcuguuaccucuuguuuac

SEQ ID NO: 140223 - RNA, 19 nt, Homo sapiens
ugugggagccucaauguua

SEQ ID NO: 140224 - RNA, 19 nt, Homo sapiens
agaagaaucccuacaaaga

SEQ ID NO: 140225 - RNA, 19 nt, Homo sapiens
gaacaagcccaugauugaa

SEQ ID NO: 140226 - RNA, 19 nt, Homo sapiens
caaaggguuucaccaagga

SEQ ID NO: 140227 - RNA, 19 nt, Homo sapiens
cauccacugugaaugauaa

SEQ ID NO: 140228 - RNA, 19 nt, Homo sapiens
gagagcggcugguguacga

SEQ ID NO: 140229 - RNA, 19 nt, Homo sapiens
agagaagaaucccuacaaa

SEQ ID NO: 140230 - RNA, 19 nt, Homo sapiens
gaaugaaugcuguggaaga

SEQ ID NO: 140231 - RNA, 19 nt, Homo sapiens
ucaaacagcgagaugagua

SEQ ID NO: 140232 - RNA, 19 nt, Homo sapiens
agaacaagcccaugauuga

SEQ ID NO: 140233 - RNA, 19 nt, Homo sapiens
cgacacaaaguuaaacaaa

SEQ ID NO: 140234 - RNA, 19 nt, Homo sapiens
gaacugcuuucuggagugu

SEQ ID NO: 140235 - RNA, 19 nt, Homo sapiens
ucauaauggugcuuucaaa

SEQ ID NO: 140236 - RNA, 19 nt, Homo sapiens
caacccgacuucauaaugg

SEQ ID NO: 140237 - RNA, 19 nt, Homo sapiens
aaacugagguagcgacaca

SEQ ID NO: 140238 - RNA, 19 nt, Homo sapiens
uggaaaggguauuugguuu

SEQ ID NO: 140239 - RNA, 19 nt, Homo sapiens
caggaaaccuugaagaaaa

SEQ ID NO: 140240 - RNA, 19 nt, Homo sapiens
aaagugaggaccauuacua

SEQ ID NO: 140241 - RNA, 19 nt, Homo sapiens
gcagaacaagcccaugauu

SEQ ID NO: 140242 - RNA, 19 nt, Homo sapiens
gaaacaagaagguuauugc

SEQ ID NO: 140243 - RNA, 19 nt, Homo sapiens
cagaagugccggaacauug

SEQ ID NO: 140244 - RNA, 19 nt, Homo sapiens
ccaagaacaugaggaugga

SEQ ID NO: 140245 - RNA, 19 nt, Homo sapiens
uaaccacgaccaggaauuu

SEQ ID NO: 140246 - RNA, 19 nt, Homo sapiens
ugauacggcugagaagaaa

SEQ ID NO: 140247 - RNA, 19 nt, Homo sapiens
acaacaagcagcccaugua

SEQ ID NO: 140248 - RNA, 19 nt, Homo sapiens
guucggagacggcaaauuc

SEQ ID NO: 140249 - RNA, 19 nt, Homo sapiens
gcgcaaaggguuucaccaa

SEQ ID NO: 140250 - RNA, 19 nt, Homo sapiens
gagaacaccacacaagaca

SEQ ID NO: 140251 - RNA, 19 nt, Homo sapiens
gagaagaaucccuacaaag

SEQ ID NO: 140252 - RNA, 19 nt, Homo sapiens
guggugggaucagaacuaa

SEQ ID NO: 140253 - RNA, 19 nt, Homo sapiens
ggagaaagggagacagcuu

SEQ ID NO: 140254 - RNA, 19 nt, Homo sapiens
aaacaucagcuuccacguu

SEQ ID NO: 140255 - RNA, 19 nt, Homo sapiens
caaacagcgagaugaguaa

SEQ ID NO: 140256 - RNA, 19 nt, Homo sapiens
uguacaacccgacuucaua

SEQ ID NO: 140257 - RNA, 19 nt, Homo sapiens
gacacaaaguuaaacaaac

SEQ ID NO: 140258 - RNA, 19 nt, Homo sapiens
ccaacccugugaugauuga

SEQ ID NO: 140259 - RNA, 19 nt, Homo sapiens
guccaacccugugaugauu

SEQ ID NO: 140260 - RNA, 19 nt, Homo sapiens
aaacagaacccaguuagca

SEQ ID NO: 140261 - RNA, 19 nt, Homo sapiens
gaaaaggguuggacaucau

SEQ ID NO: 140262 - RNA, 19 nt, Homo sapiens
agagggacaucucgcgauu

SEQ ID NO: 140263 - RNA, 19 nt, Homo sapiens
cagaacaagcccaugauug

SEQ ID NO: 140264 - RNA, 19 nt, Homo sapiens
ggcccaguuucucacuuua

SEQ ID NO: 140265 - RNA, 19 nt, Homo sapiens
ccauaaagcagggcaaaga

SEQ ID NO: 140266 - RNA, 19 nt, Homo sapiens
gcagaagugccggaacauu

SEQ ID NO: 140267 - RNA, 19 nt, Homo sapiens
caccaaggauggagaaagg

SEQ ID NO: 140268 - RNA, 19 nt, Homo sapiens
gacugaaacaagaagguua

SEQ ID NO: 140269 - RNA, 19 nt, Homo sapiens
aaugaaugcuguggaagaa

SEQ ID NO: 140270 - RNA, 19 nt, Homo sapiens
gcgaugacgagccagagua

SEQ ID NO: 140271 - RNA, 19 nt, Homo sapiens
gugauacggcugagaagaa

SEQ ID NO: 140272 - RNA, 19 nt, Homo sapiens
ggacaucucgcgauuucuc

SEQ ID NO: 140273 - RNA, 19 nt, Homo sapiens
gaagagaagaaucccuaca

SEQ ID NO: 140274 - RNA, 19 nt, Homo sapiens
gagacucccucggcaagau

SEQ ID NO: 140275 - RNA, 19 nt, Homo sapiens
gcaaaacagaacccaguua

SEQ ID NO: 140276 - RNA, 19 nt, Homo sapiens
acaauaccuugcagaggaa

SEQ ID NO: 140277 - RNA, 19 nt, Homo sapiens
ggucaaacuccauaaagca

SEQ ID NO: 140278 - RNA, 19 nt, Homo sapiens
gcaaagugaggaccauuac

SEQ ID NO: 140279 - RNA, 19 nt, Homo sapiens
aagaaucccuacaaagaag

SEQ ID NO: 140280 - RNA, 19 nt, Homo sapiens
gugcagaacaagcccauga

SEQ ID NO: 140281 - RNA, 19 nt, Homo sapiens
ggugggaucagaacuaauc

SEQ ID NO: 140282 - RNA, 19 nt, Homo sapiens
aggaaugaaugcuguggaa

SEQ ID NO: 140283 - RNA, 19 nt, Homo sapiens
acuguuaacuacuguacaa

SEQ ID NO: 140284 - RNA, 19 nt, Homo sapiens
cacaggaaaccuugaagaa

SEQ ID NO: 140285 - RNA, 19 nt, Homo sapiens
gaaaggugggagagaggaa

SEQ ID NO: 140286 - RNA, 19 nt, Homo sapiens
gaacaugaggauggagaga

SEQ ID NO: 140287 - RNA, 19 nt, Homo sapiens
ccaggcagccauuaaggaa

SEQ ID NO: 140288 - RNA, 19 nt, Homo sapiens
ggaagagcacagcggagaa

SEQ ID NO: 140289 - RNA, 19 nt, Homo sapiens
uaauggugcuuucaaacag

SEQ ID NO: 140290 - RNA, 19 nt, Homo sapiens
acaggaaaccuugaagaaa

SEQ ID NO: 140291 - RNA, 19 nt, Homo sapiens
gguagcgacacaaaguuaa

SEQ ID NO: 140292 - RNA, 19 nt, Homo sapiens
acaagcccaugauugaaug

SEQ ID NO: 140293 - RNA, 19 nt, Homo sapiens
gaaagacgagugugauacg

SEQ ID NO: 140294 - RNA, 19 nt, Homo sapiens
ccacacaggaaaccuugaa

SEQ ID NO: 140295 - RNA, 19 nt, Homo sapiens
caagaaugccaccaaagca

SEQ ID NO: 140296 - RNA, 19 nt, Homo sapiens
guagcgacacaaaguuaaa

SEQ ID NO: 140297 - RNA, 19 nt, Homo sapiens
ggugcugucucucuuugau

SEQ ID NO: 140298 - RNA, 19 nt, Homo sapiens
ccaaggucauugcaggaau

SEQ ID NO: 140299 - RNA, 19 nt, Homo sapiens
acugacgucuccaacauga

SEQ ID NO: 140300 - RNA, 19 nt, Homo sapiens
auacugacgucuccaacau

SEQ ID NO: 140301 - RNA, 19 nt, Homo sapiens
uggcauccacugugaauga

SEQ ID NO: 140302 - RNA, 19 nt, Homo sapiens
ucagguggaccgcuacauu

SEQ ID NO: 140303 - RNA, 19 nt, Homo sapiens
aggcagccauuaaggaaga

SEQ ID NO: 140304 - RNA, 19 nt, Homo sapiens
agaagugccggaacauuga

SEQ ID NO: 140305 - RNA, 19 nt, Homo sapiens
caaauucucaguggugugu

SEQ ID NO: 140306 - RNA, 19 nt, Homo sapiens
ggacggaaagagagagaca

SEQ ID NO: 140307 - RNA, 19 nt, Homo sapiens
gaaguaucagcacccagaa

SEQ ID NO: 140308 - RNA, 19 nt, Homo sapiens
gaggucaaacuccauaaag

SEQ ID NO: 140309 - RNA, 19 nt, Homo sapiens
ggacaagaaugccaccaaa

SEQ ID NO: 140310 - RNA, 19 nt, Homo sapiens
gaagaaagccaaggucauu

SEQ ID NO: 140311 - RNA, 19 nt, Homo sapiens
gaagaaucccuacaaagaa

SEQ ID NO: 140312 - RNA, 19 nt, Homo sapiens
gaugauugaugccaaagaa

SEQ ID NO: 140313 - RNA, 19 nt, Homo sapiens
gaacaccacacaagacauu

SEQ ID NO: 140314 - RNA, 19 nt, Homo sapiens
cauccagacucaugcaaua

SEQ ID NO: 140315 - RNA, 19 nt, Homo sapiens
caacaucgaauccaugaaa

SEQ ID NO: 140316 - RNA, 19 nt, Homo sapiens
ccaaagaccacgauaauuc

SEQ ID NO: 140317 - RNA, 19 nt, Homo sapiens
gcaaugaccucuccaucgu

SEQ ID NO: 140318 - RNA, 19 nt, Homo sapiens
caagagagcggcuggugua

SEQ ID NO: 140319 - RNA, 19 nt, Homo sapiens
ggaaauaccggagggcuuu

SEQ ID NO: 140320 - RNA, 19 nt, Homo sapiens
ucucuagccugaucagaua

SEQ ID NO: 140321 - RNA, 19 nt, Homo sapiens
acaccgggaucuauguuua

SEQ ID NO: 140322 - RNA, 19 nt, Homo sapiens
ggaaagagagagacacuca

SEQ ID NO: 140323 - RNA, 19 nt, Homo sapiens
cagauguucuucgcuaaua

SEQ ID NO: 140324 - RNA, 19 nt, Homo sapiens
guacaacccgacuucauaa

SEQ ID NO: 140325 - RNA, 19 nt, Homo sapiens
gcuguuaccucuuguuuac

SEQ ID NO: 140326 - RNA, 19 nt, Homo sapiens
ugugggagccucaauguua

SEQ ID NO: 140327 - RNA, 19 nt, Homo sapiens
agaagaaucccuacaaaga

SEQ ID NO: 140328 - RNA, 19 nt, Homo sapiens
gaacaagcccaugauugaa

SEQ ID NO: 140329 - RNA, 19 nt, Homo sapiens
caaaggguuucaccaagga

SEQ ID NO: 140330 - RNA, 19 nt, Homo sapiens
cauccacugugaaugauaa

SEQ ID NO: 140331 - RNA, 19 nt, Homo sapiens
gagagcggcugguguacga

SEQ ID NO: 140332 - RNA, 19 nt, Homo sapiens
agagaagaaucccuacaaa

SEQ ID NO: 140333 - RNA, 19 nt, Homo sapiens
gaaugaaugcuguggaaga

SEQ ID NO: 140334 - RNA, 19 nt, Homo sapiens
ucaaacagcgagaugagua

SEQ ID NO: 140335 - RNA, 19 nt, Homo sapiens
agaacaagcccaugauuga

SEQ ID NO: 140336 - RNA, 19 nt, Homo sapiens
gaaggagaccaacaucgaa

SEQ ID NO: 140337 - RNA, 19 nt, Homo sapiens
cgacacaaaguuaaacaaa

SEQ ID NO: 140338 - RNA, 19 nt, Homo sapiens
gaacugcuuucuggagugu

SEQ ID NO: 140339 - RNA, 19 nt, Homo sapiens
ucauaauggugcuuucaaa

SEQ ID NO: 140340 - RNA, 19 nt, Homo sapiens
caacccgacuucauaaugg

SEQ ID NO: 140341 - RNA, 19 nt, Homo sapiens
aaacugagguagcgacaca

SEQ ID NO: 140342 - RNA, 19 nt, Homo sapiens
gaacagaaggagaccaaca

SEQ ID NO: 140343 - RNA, 19 nt, Homo sapiens
ucagagcuauuacccaaug

SEQ ID NO: 140344 - RNA, 19 nt, Homo sapiens
uggaaaggguauuugguuu

SEQ ID NO: 140345 - RNA, 19 nt, Homo sapiens
caggaaaccuugaagaaaa

SEQ ID NO: 140346 - RNA, 19 nt, Homo sapiens
aaagugaggaccauuacua

SEQ ID NO: 140347 - RNA, 19 nt, Homo sapiens
cgggaucuauguuuaaguu

SEQ ID NO: 140348 - RNA, 19 nt, Homo sapiens
gcagaacaagcccaugauu

SEQ ID NO: 140349 - RNA, 19 nt, Homo sapiens
aaagggaggcugagaagaa

SEQ ID NO: 140350 - RNA, 19 nt, Homo sapiens
gaaacaagaagguuauugc

SEQ ID NO: 140351 - RNA, 19 nt, Homo sapiens
cagaagugccggaacauug

SEQ ID NO: 140352 - RNA, 19 nt, Homo sapiens
ccaagaacaugaggaugga

SEQ ID NO: 140353 - RNA, 19 nt, Homo sapiens
uaaccacgaccaggaauuu

SEQ ID NO: 140354 - RNA, 19 nt, Homo sapiens
acaacaagcagcccaugua

SEQ ID NO: 140355 - RNA, 19 nt, Homo sapiens
guucggagacggcaaauuc

SEQ ID NO: 140356 - RNA, 19 nt, Homo sapiens
gcgcaaaggguuucaccaa

SEQ ID NO: 140357 - RNA, 19 nt, Homo sapiens
gagaacaccacacaagaca

SEQ ID NO: 140358 - RNA, 19 nt, Homo sapiens
gagaagaaucccuacaaag

SEQ ID NO: 140359 - RNA, 19 nt, Homo sapiens
guggugggaucagaacuaa

SEQ ID NO: 140360 - RNA, 19 nt, Homo sapiens
ggagaaagggagacagcuu

SEQ ID NO: 140361 - RNA, 19 nt, Homo sapiens
aaacaucagcuuccacguu

SEQ ID NO: 140362 - RNA, 19 nt, Homo sapiens
caaacagcgagaugaguaa

SEQ ID NO: 140363 - RNA, 19 nt, Homo sapiens
uguacaacccgacuucaua

SEQ ID NO: 140364 - RNA, 19 nt, Homo sapiens
gacacaaaguuaaacaaac

SEQ ID NO: 140365 - RNA, 19 nt, Homo sapiens
ccaacccugugaugauuga

SEQ ID NO: 140366 - RNA, 19 nt, Homo sapiens
guccaacccugugaugauu

SEQ ID NO: 140367 - RNA, 19 nt, Homo sapiens
caaaggacccugcggugau

SEQ ID NO: 140368 - RNA, 19 nt, Homo sapiens
aaacagaacccaguuagca

SEQ ID NO: 140369 - RNA, 19 nt, Homo sapiens
gaaaaggguuggacaucau

SEQ ID NO: 140370 - RNA, 19 nt, Homo sapiens
agagggacaucucgcgauu

SEQ ID NO: 140371 - RNA, 19 nt, Homo sapiens
cagaacaagcccaugauug

SEQ ID NO: 140372 - RNA, 19 nt, Homo sapiens
ggcccaguuucucacuuua

SEQ ID NO: 140373 - RNA, 19 nt, Homo sapiens
ccauaaagcagggcaaaga

SEQ ID NO: 140374 - RNA, 19 nt, Homo sapiens
gcagaagugccggaacauu

SEQ ID NO: 140375 - RNA, 19 nt, Homo sapiens
caccaaggauggagaaagg

SEQ ID NO: 140376 - RNA, 19 nt, Homo sapiens
gacugaaacaagaagguua

SEQ ID NO: 140377 - RNA, 19 nt, Homo sapiens
gcaaggaggagcgccaaga

SEQ ID NO: 140378 - RNA, 19 nt, Homo sapiens
gcgaugacgagccagagua

SEQ ID NO: 140379 - RNA, 19 nt, Homo sapiens
aaugaaugcuguggaagaa

SEQ ID NO: 140380 - RNA, 19 nt, Homo sapiens
gcucaacaccgggaucuau

SEQ ID NO: 140381 - RNA, 19 nt, Homo sapiens
ggacaucucgcgauuucuc

SEQ ID NO: 140382 - RNA, 19 nt, Homo sapiens
gaagagaagaaucccuaca

SEQ ID NO: 140383 - RNA, 19 nt, Homo sapiens
gagacucccucggcaagau

SEQ ID NO: 140384 - RNA, 19 nt, Homo sapiens
gcaaaacagaacccaguua

SEQ ID NO: 140385 - RNA, 19 nt, Homo sapiens
acaauaccuugcagaggaa

SEQ ID NO: 140386 - RNA, 19 nt, Homo sapiens
ggucaaacuccauaaagca

SEQ ID NO: 140387 - RNA, 19 nt, Homo sapiens
gcaaagugaggaccauuac

SEQ ID NO: 140388 - RNA, 19 nt, Homo sapiens
aagaaucccuacaaagaag

SEQ ID NO: 140389 - RNA, 19 nt, Homo sapiens
gugcagaacaagcccauga

SEQ ID NO: 140390 - RNA, 19 nt, Homo sapiens
aagggaggcugagaagaaa

SEQ ID NO: 140391 - RNA, 19 nt, Homo sapiens
ggugggaucagaacuaauc

SEQ ID NO: 140392 - RNA, 19 nt, Homo sapiens
acuguuaacuacuguacaa

SEQ ID NO: 140393 - RNA, 19 nt, Homo sapiens
cacaggaaaccuugaagaa

SEQ ID NO: 140394 - RNA, 19 nt, Homo sapiens
gaaaggugggagagaggaa

SEQ ID NO: 140395 - RNA, 19 nt, Homo sapiens
gaacaugaggauggagaga

SEQ ID NO: 140396 - RNA, 19 nt, Homo sapiens
ccaggcagccauuaaggaa

SEQ ID NO: 140397 - RNA, 19 nt, Homo sapiens
ggaagagcacagcggagaa

SEQ ID NO: 140398 - RNA, 19 nt, Homo sapiens
aggaaugaaugcuguggaa

SEQ ID NO: 140399 - RNA, 19 nt, Homo sapiens
uaauggugcuuucaaacag

SEQ ID NO: 140400 - RNA, 19 nt, Homo sapiens
acaggaaaccuugaagaaa

SEQ ID NO: 140401 - RNA, 19 nt, Homo sapiens
gguagcgacacaaaguuaa

SEQ ID NO: 140402 - RNA, 19 nt, Homo sapiens
acaagcccaugauugaaug

SEQ ID NO: 140403 - RNA, 19 nt, Homo sapiens
gcugagacccugccugaag

SEQ ID NO: 140404 - RNA, 19 nt, Homo sapiens
ccacacaggaaaccuugaa

SEQ ID NO: 140405 - RNA, 19 nt, Homo sapiens
guagcgacacaaaguuaaa

SEQ ID NO: 140406 - RNA, 19 nt, Homo sapiens
ggugcugucucucuuugau

SEQ ID NO: 140407 - RNA, 19 nt, Homo sapiens
caagaaugccaccaaagca

SEQ ID NO: 140408 - RNA, 19 nt, Homo sapiens
acugacgucuccaacauga

SEQ ID NO: 140409 - RNA, 19 nt, Homo sapiens
guacagggcuucacaguuu

SEQ ID NO: 140410 - RNA, 19 nt, Homo sapiens
caaccgagcuguaaacaug

SEQ ID NO: 140411 - RNA, 19 nt, Homo sapiens
ggagagggcugggugauug

SEQ ID NO: 140412 - RNA, 19 nt, Homo sapiens
gaaauuugguugugacagu

SEQ ID NO: 140413 - RNA, 19 nt, Homo sapiens
ugacucaacuggaaauuug

SEQ ID NO: 140414 - RNA, 19 nt, Homo sapiens
caacagcgggcuuucauaa

SEQ ID NO: 140415 - RNA, 19 nt, Homo sapiens
gaacauuuccagaauacaa

SEQ ID NO: 140416 - RNA, 19 nt, Homo sapiens
ccaaagaccacgauaauuc

SEQ ID NO: 140417 - RNA, 19 nt, Homo sapiens
gagaacauuuccagaauac

SEQ ID NO: 140418 - RNA, 19 nt, Homo sapiens
acaccgggaucuauguuua

SEQ ID NO: 140419 - RNA, 19 nt, Homo sapiens
gcuguaaacauguuaguaa

SEQ ID NO: 140420 - RNA, 19 nt, Homo sapiens
agagaacauuuccagaaua

SEQ ID NO: 140421 - RNA, 19 nt, Homo sapiens
uagagaacauuuccagaau

SEQ ID NO: 140422 - RNA, 19 nt, Homo sapiens
ggcagcagauacccuguuu

SEQ ID NO: 140423 - RNA, 19 nt, Homo sapiens
cagcauacccugagaguca

SEQ ID NO: 140424 - RNA, 19 nt, Homo sapiens
ucagagcuauuacccaaug

SEQ ID NO: 140425 - RNA, 19 nt, Homo sapiens
gcauggauccaaccuaaug

SEQ ID NO: 140426 - RNA, 19 nt, Homo sapiens
gauccaaccuaauguucau

SEQ ID NO: 140427 - RNA, 19 nt, Homo sapiens
cgggaucuauguuuaaguu

SEQ ID NO: 140428 - RNA, 19 nt, Homo sapiens
uugcauggauccaaccuaa

SEQ ID NO: 140429 - RNA, 19 nt, Homo sapiens
gcaacagcgggcuuucaua

SEQ ID NO: 140430 - RNA, 19 nt, Homo sapiens
gggcuucacaguuuacaaa

SEQ ID NO: 140431 - RNA, 19 nt, Homo sapiens
guaaugaggacaacuagca

SEQ ID NO: 140432 - RNA, 19 nt, Homo sapiens
gauuaauuggcguaacuua

SEQ ID NO: 140433 - RNA, 19 nt, Homo sapiens
aagcguguaugaugaaaug

SEQ ID NO: 140434 - RNA, 19 nt, Homo sapiens
caaaggacccugcggugau

SEQ ID NO: 140435 - RNA, 19 nt, Homo sapiens
cuggaagccuggaaaguug

SEQ ID NO: 140436 - RNA, 19 nt, Homo sapiens
uacagggcuucacaguuua

SEQ ID NO: 140437 - RNA, 19 nt, Homo sapiens
gcaaggaggagcgccaaga

SEQ ID NO: 140438 - RNA, 19 nt, Homo sapiens
gcucaacaccgggaucuau

SEQ ID NO: 140439 - RNA, 19 nt, Homo sapiens
gcccaggccucuucaucug

SEQ ID NO: 140440 - RNA, 19 nt, Homo sapiens
gugauuguauucuguguac

SEQ ID NO: 140441 - RNA, 19 nt, Homo sapiens
cagguuaagccagcaauuu

SEQ ID NO: 140442 - RNA, 19 nt, Homo sapiens
gcgcauauguuuuauuugg

SEQ ID NO: 140443 - RNA, 19 nt, Homo sapiens
gcugagacccugccugaag

SEQ ID NO: 140444 - RNA, 19 nt, Homo sapiens
auagagaacauuuccagaa

SEQ ID NO: 140445 - RNA, 19 nt, Homo sapiens
cuaauguucaugcaggaua

SEQ ID NO: 140446 - RNA, 19 nt, Homo sapiens
aaagcuagaucuggcaaca

SEQ ID NO: 140447 - RNA, 19 nt, Homo sapiens
ccaagcguguaugaugaaa

SEQ ID NO: 140448 - RNA, 19 nt, Homo sapiens
ccaccagcauacccugaga

SEQ ID NO: 140449 - RNA, 19 nt, Homo sapiens
caagagcaguggaaaaugg

SEQ ID NO: 140450 - RNA, 19 nt, Homo sapiens
gauaauuccuuccccaaag

SEQ ID NO: 140451 - RNA, 19 nt, Homo sapiens
uaauguucaugcaggauag

SEQ ID NO: 140452 - RNA, 19 nt, Homo sapiens
ggauccaaccuaauguuca

SEQ ID NO: 140453 - RNA, 19 nt, Homo sapiens
ccuggaagccuggaaaguu

SEQ ID NO: 140454 - RNA, 19 nt, Homo sapiens
uuccaagcguguaugauga

SEQ ID NO: 140455 - RNA, 19 nt, Homo sapiens
gcucuaccuggccugcuua

SEQ ID NO: 140456 - RNA, 19 nt, Homo sapiens
gcggugacacgccaaagga

SEQ ID NO: 140457 - RNA, 19 nt, Homo sapiens
gcugggugauuguauucug

SEQ ID NO: 140458 - RNA, 19 nt, Homo sapiens
gcacucaagggcagcagau

SEQ ID NO: 140459 - RNA, 19 nt, Homo sapiens
uuucauaacgccaacgauu

SEQ ID NO: 140460 - RNA, 19 nt, Homo sapiens
guucaugcaggauagagaa

SEQ ID NO: 140461 - RNA, 19 nt, Homo sapiens
aaaggacccugcggugauc

SEQ ID NO: 140462 - RNA, 19 nt, Homo sapiens
gguuaagccagcaauuuca

SEQ ID NO: 140463 - RNA, 19 nt, Homo sapiens
agcgcuuucucauacauua

SEQ ID NO: 140464 - RNA, 19 nt, Homo sapiens
gggagagggcugggugauu

SEQ ID NO: 140465 - RNA, 19 nt, Homo sapiens
uugcuagacugggauaaug

SEQ ID NO: 140466 - RNA, 19 nt, Homo sapiens
gcaggauagagaacauuuc

SEQ ID NO: 140467 - RNA, 19 nt, Homo sapiens
cagcagauacccuguuugc

SEQ ID NO: 140468 - RNA, 19 nt, Homo sapiens
uaccuggccugcuuacucu

SEQ ID NO: 140469 - RNA, 19 nt, Homo sapiens
gcccauagaguguuuuaaa

SEQ ID NO: 140470 - RNA, 19 nt, Homo sapiens
cugcgcauauguuuuauuu

SEQ ID NO: 140471 - RNA, 19 nt, Homo sapiens
ccuccaaagaccacgauaa

SEQ ID NO: 140472 - RNA, 19 nt, Homo sapiens
gauuguauucuguguacug

SEQ ID NO: 140473 - RNA, 19 nt, Homo sapiens
cagcaggucccaggaagga

SEQ ID NO: 140474 - RNA, 19 nt, Homo sapiens
caccgggaucuauguuuaa

SEQ ID NO: 140475 - RNA, 19 nt, Homo sapiens
cguguaugaugaaaugagu

SEQ ID NO: 140476 - RNA, 19 nt, Homo sapiens
cuccaaagaccacgauaau

SEQ ID NO: 140477 - RNA, 19 nt, Homo sapiens
uaacucucgccuccaaaga

SEQ ID NO: 140478 - RNA, 19 nt, Homo sapiens
ggugauuguauucugugua

SEQ ID NO: 140479 - RNA, 19 nt, Homo sapiens
gggcugacucaacuggaaa

SEQ ID NO: 140480 - RNA, 19 nt, Homo sapiens
cgccaacgauugcuagacu

SEQ ID NO: 140481 - RNA, 19 nt, Homo sapiens
acagcgggcuuucauaacg

SEQ ID NO: 140482 - RNA, 19 nt, Homo sapiens
ggagagggugcagcugaga

SEQ ID NO: 140483 - RNA, 19 nt, Homo sapiens
caaagaccacgauaauucc

SEQ ID NO: 140484 - RNA, 19 nt, Homo sapiens
ugggcugacucaacuggaa

SEQ ID NO: 140485 - RNA, 19 nt, Homo sapiens
gggaggaggaccgaaagga

SEQ ID NO: 140486 - RNA, 19 nt, Homo sapiens
gggccaaccgagcuguaaa

SEQ ID NO: 140487 - RNA, 19 nt, Homo sapiens
ccagaauacaaauuuccaa

SEQ ID NO: 140488 - RNA, 19 nt, Homo sapiens
cuuccaagcguguaugaug

SEQ ID NO: 140489 - RNA, 19 nt, Homo sapiens
gggcagcagauacccuguu

SEQ ID NO: 140490 - RNA, 19 nt, Homo sapiens
ggcaacagcgggcuuucau

SEQ ID NO: 140491 - RNA, 19 nt, Homo sapiens
gaacaacguugacaaguuu

SEQ ID NO: 140492 - RNA, 19 nt, Homo sapiens
gaaaguacgucgcuucuga

SEQ ID NO: 140493 - RNA, 19 nt, Homo sapiens
gcacugagcucgaaaggau

SEQ ID NO: 140494 - RNA, 19 nt, Homo sapiens
gcaacgaucucucaaaugu

SEQ ID NO: 140495 - RNA, 19 nt, Homo sapiens
ucaauaagcucgucuccua

SEQ ID NO: 140496 - RNA, 19 nt, Homo sapiens
ggaacaacguugacaaguu

SEQ ID NO: 140497 - RNA, 19 nt, Homo sapiens
gcauaaagguaggaaagua

SEQ ID NO: 140498 - RNA, 19 nt, Homo sapiens
acaaauggcuucagauguu

SEQ ID NO: 140499 - RNA, 19 nt, Homo sapiens
cagaaaugcugucauaaug

SEQ ID NO: 140500 - RNA, 19 nt, Homo sapiens
gaacaaauggcuucagaug

SEQ ID NO: 140501 - RNA, 19 nt, Homo sapiens
gagaacaaauggcuucaga

SEQ ID NO: 140502 - RNA, 19 nt, Homo sapiens
gaucagagccgagaacaaa

SEQ ID NO: 140503 - RNA, 19 nt, Homo sapiens
gagaaacaauggcuaagau

SEQ ID NO: 140504 - RNA, 19 nt, Homo sapiens
gugcugaguucuauaauau

SEQ ID NO: 140505 - RNA, 19 nt, Homo sapiens
gaacgggaauucagacaag

SEQ ID NO: 140506 - RNA, 19 nt, Homo sapiens
gaaaugcugucauaauggu

SEQ ID NO: 140507 - RNA, 19 nt, Homo sapiens
ccacaaugaugaugauuuc

SEQ ID NO: 140508 - RNA, 19 nt, Homo sapiens
gaagucugcuacccucauu

SEQ ID NO: 140509 - RNA, 19 nt, Homo sapiens
ucaaagaguugggcauaaa

SEQ ID NO: 140510 - RNA, 19 nt, Homo sapiens
ugaggaacaucacaaagaa

SEQ ID NO: 140511 - RNA, 19 nt, Homo sapiens
gccgagagcugcugcuuug

SEQ ID NO: 140512 - RNA, 19 nt, Homo sapiens
ccucccagcucuuaccuua

SEQ ID NO: 140513 - RNA, 19 nt, Homo sapiens
ggacagacauacauuucuc

SEQ ID NO: 140514 - RNA, 19 nt, Homo sapiens
caagacaguuauugcaaga

SEQ ID NO: 140515 - RNA, 19 nt, Homo sapiens
ccaagcgccucaagacaaa

SEQ ID NO: 140516 - RNA, 19 nt, Homo sapiens
gcucuuaccuuaccaucga

SEQ ID NO: 140517 - RNA, 19 nt, Homo sapiens
agacauacauuucucauac

SEQ ID NO: 140518 - RNA, 19 nt, Homo sapiens
ggacuacuuugcaugugaa

SEQ ID NO: 140519 - RNA, 19 nt, Homo sapiens
cgacagcucuccaauacuc

SEQ ID NO: 140520 - RNA, 19 nt, Homo sapiens
gaauaaggaacaacguuga

SEQ ID NO: 140521 - RNA, 19 nt, Homo sapiens
uuuaccaccugcugaauua

SEQ ID NO: 140522 - RNA, 19 nt, Homo sapiens
caagacaaauugcuauaac

SEQ ID NO: 140523 - RNA, 19 nt, Homo sapiens
cagcagcccuggagacuca

SEQ ID NO: 140524 - RNA, 19 nt, Homo sapiens
guaccucaguucccucuug

SEQ ID NO: 140525 - RNA, 19 nt, Homo sapiens
acaauaggauagccaaguu

SEQ ID NO: 140526 - RNA, 19 nt, Homo sapiens
ugacggaugccuagaguuu

SEQ ID NO: 140527 - RNA, 19 nt, Homo sapiens
gccgacagcucuccaauac

SEQ ID NO: 140528 - RNA, 19 nt, Homo sapiens
gaaggacuacuuugcaugu

SEQ ID NO: 140529 - RNA, 19 nt, Homo sapiens
ugucaugaauggcaaagaa

SEQ ID NO: 140530 - RNA, 19 nt, Homo sapiens
gaacaggcccgugauagca

SEQ ID NO: 140531 - RNA, 19 nt, Homo sapiens
ggaguguaauccagugaug

SEQ ID NO: 140532 - RNA, 19 nt, Homo sapiens
caaauggcuucagauguug

SEQ ID NO: 140533 - RNA, 19 nt, Homo sapiens
guaccaugcucuggagaaa

SEQ ID NO: 140534 - RNA, 19 nt, Homo sapiens
cacgggaccuauuagagua

SEQ ID NO: 140535 - RNA, 19 nt, Homo sapiens
gcacgggaccuauuagagu

SEQ ID NO: 140536 - RNA, 19 nt, Homo sapiens
ggaaggaguuuggaauagg

SEQ ID NO: 140537 - RNA, 19 nt, Homo sapiens
gggaaggaguuuggaauag

SEQ ID NO: 140538 - RNA, 19 nt, Homo sapiens
gcagucagggacagacaua

SEQ ID NO: 140539 - RNA, 19 nt, Homo sapiens
uuacagacgugugcaguug

SEQ ID NO: 140540 - RNA, 19 nt, Homo sapiens
ggagaggagugugaagcaa

SEQ ID NO: 140541 - RNA, 19 nt, Homo sapiens
gaaacaauggcuaagauac

SEQ ID NO: 140542 - RNA, 19 nt, Homo sapiens
gaugaacaggcccgugaua

SEQ ID NO: 140543 - RNA, 19 nt, Homo sapiens
aacgaucucucaaauguga

SEQ ID NO: 140544 - RNA, 19 nt, Homo sapiens
ucagccagcacuuuaauuu

SEQ ID NO: 140545 - RNA, 19 nt, Homo sapiens
gaugacggaugccuagagu

SEQ ID NO: 140546 - RNA, 19 nt, Homo sapiens
caauaggauagccaaguua

SEQ ID NO: 140547 - RNA, 19 nt, Homo sapiens
acacggggcuugaauauga

SEQ ID NO: 140548 - RNA, 19 nt, Homo sapiens
gacgauggcuaucagucuu

SEQ ID NO: 140549 - RNA, 19 nt, Homo sapiens
ggaaauacgagaacaagac

SEQ ID NO: 140550 - RNA, 19 nt, Homo sapiens
uaacuggagccacgacgua

SEQ ID NO: 140551 - RNA, 19 nt, Homo sapiens
gcucggugcucccuuugga

SEQ ID NO: 140552 - RNA, 19 nt, Homo sapiens
ggauagccaaguuaaagaa

SEQ ID NO: 140553 - RNA, 19 nt, Homo sapiens
ccuggaagauggcuguuug

SEQ ID NO: 140554 - RNA, 19 nt, Homo sapiens
acgcacagcugacgacuca

SEQ ID NO: 140555 - RNA, 19 nt, Homo sapiens
gccuagaguuuaccuuaug

SEQ ID NO: 140556 - RNA, 19 nt, Homo sapiens
gccacgacguaacaaauau

SEQ ID NO: 140557 - RNA, 19 nt, Homo sapiens
ugugcugaguucuauaaua

SEQ ID NO: 140558 - RNA, 19 nt, Homo sapiens
ccauuugacuuggugauug

SEQ ID NO: 140559 - RNA, 19 nt, Homo sapiens
uuacauguaugaugacgau

SEQ ID NO: 140560 - RNA, 19 nt, Homo sapiens
ucagaaaugcugucauaau

SEQ ID NO: 140561 - RNA, 19 nt, Homo sapiens
ucagagaaacaauggcuaa

SEQ ID NO: 140562 - RNA, 19 nt, Homo sapiens
aaccaggacucguucagaa

SEQ ID NO: 140563 - RNA, 19 nt, Homo sapiens
ggagguguccagucugcua

SEQ ID NO: 140564 - RNA, 19 nt, Homo sapiens
acagacgugugcaguugua

SEQ ID NO: 140565 - RNA, 19 nt, Homo sapiens
ggagacaguucagaguauc

SEQ ID NO: 140566 - RNA, 19 nt, Homo sapiens
cagacaagcugcauuucag

SEQ ID NO: 140567 - RNA, 19 nt, Homo sapiens
gggccacucuuagcuaaau

SEQ ID NO: 140568 - RNA, 19 nt, Homo sapiens
ggacccaggaggugugauu

SEQ ID NO: 140569 - RNA, 19 nt, Homo sapiens
guaggaaauuagaaucaag

SEQ ID NO: 140570 - RNA, 19 nt, Homo sapiens
gcaacagcaucggcaggaa

SEQ ID NO: 140571 - RNA, 19 nt, Homo sapiens
agaaacaauggcuaagaua

SEQ ID NO: 140572 - RNA, 19 nt, Homo sapiens
ggucuaccacucagagaaa

SEQ ID NO: 140573 - RNA, 19 nt, Homo sapiens
caacaagagcagccuggaa

SEQ ID NO: 140574 - RNA, 19 nt, Homo sapiens
cgaaauaacaacagugucu

SEQ ID NO: 140575 - RNA, 19 nt, Homo sapiens
ggugugcugaguucuauaa

SEQ ID NO: 140576 - RNA, 19 nt, Homo sapiens
gauagccaaguuaaagaaa

SEQ ID NO: 140577 - RNA, 19 nt, Homo sapiens
gcuguccgaacucgaaaua

SEQ ID NO: 140578 - RNA, 19 nt, Homo sapiens
caauaaccaccaagucgaa

SEQ ID NO: 140579 - RNA, 19 nt, Homo sapiens
ggaaauuagaaucaaggaa

SEQ ID NO: 140580 - RNA, 19 nt, Homo sapiens
ggagaucagaggccgaaga

SEQ ID NO: 140581 - RNA, 19 nt, Homo sapiens
gaauggcaaagaagauguu

SEQ ID NO: 140582 - RNA, 19 nt, Homo sapiens
cacgguuccuggaguguaa

SEQ ID NO: 140583 - RNA, 19 nt, Homo sapiens
cgaguccugucauuguuug

SEQ ID NO: 140584 - RNA, 19 nt, Homo sapiens
gaaauacgagaacaagacu

SEQ ID NO: 140585 - RNA, 19 nt, Homo sapiens
gagccacgacguaacaaau

SEQ ID NO: 140586 - RNA, 19 nt, Homo sapiens
cugcuacccucauuucuca

SEQ ID NO: 140587 - RNA, 19 nt, Homo sapiens
ggaagauggcuguuugucu

SEQ ID NO: 140588 - RNA, 19 nt, Homo sapiens
uggagacaguucagaguau

SEQ ID NO: 140589 - RNA, 19 nt, Homo sapiens
gacaguuauugcaagaguu

SEQ ID NO: 140590 - RNA, 19 nt, Homo sapiens
gagaucagaggccgaagau

SEQ ID NO: 140591 - RNA, 19 nt, Homo sapiens
gaacaacguugacaaguuu

SEQ ID NO: 140592 - RNA, 19 nt, Homo sapiens
gaaaguacgucgcuucuga

SEQ ID NO: 140593 - RNA, 19 nt, Homo sapiens
gcacugagcucgaaaggau

SEQ ID NO: 140594 - RNA, 19 nt, Homo sapiens
gcaacgaucucucaaaugu

SEQ ID NO: 140595 - RNA, 19 nt, Homo sapiens
ucaauaagcucgucuccua

SEQ ID NO: 140596 - RNA, 19 nt, Homo sapiens
ggaacaacguugacaaguu

SEQ ID NO: 140597 - RNA, 19 nt, Homo sapiens
gcauaaagguaggaaagua

SEQ ID NO: 140598 - RNA, 19 nt, Homo sapiens
acaaauggcuucagauguu

SEQ ID NO: 140599 - RNA, 19 nt, Homo sapiens
cagaaaugcugucauaaug

SEQ ID NO: 140600 - RNA, 19 nt, Homo sapiens
gaacaaauggcuucagaug

SEQ ID NO: 140601 - RNA, 19 nt, Homo sapiens
gagaacaaauggcuucaga

SEQ ID NO: 140602 - RNA, 19 nt, Homo sapiens
gaucagagccgagaacaaa

SEQ ID NO: 140603 - RNA, 19 nt, Homo sapiens
gagaaacaauggcuaagau

SEQ ID NO: 140604 - RNA, 19 nt, Homo sapiens
gugcugaguucuauaauau

SEQ ID NO: 140605 - RNA, 19 nt, Homo sapiens
gaacgggaauucagacaag

SEQ ID NO: 140606 - RNA, 19 nt, Homo sapiens
gaaaugcugucauaauggu

SEQ ID NO: 140607 - RNA, 19 nt, Homo sapiens
ccacaaugaugaugauuuc

SEQ ID NO: 140608 - RNA, 19 nt, Homo sapiens
gaagucugcuacccucauu

SEQ ID NO: 140609 - RNA, 19 nt, Homo sapiens
ucaaagaguugggcauaaa

SEQ ID NO: 140610 - RNA, 19 nt, Homo sapiens
ugaggaacaucacaaagaa

SEQ ID NO: 140611 - RNA, 19 nt, Homo sapiens
gccgagagcugcugcuuug

SEQ ID NO: 140612 - RNA, 19 nt, Homo sapiens
ccucccagcucuuaccuua

SEQ ID NO: 140613 - RNA, 19 nt, Homo sapiens
ggacagacauacauuucuc

SEQ ID NO: 140614 - RNA, 19 nt, Homo sapiens
caagacaguuauugcaaga

SEQ ID NO: 140615 - RNA, 19 nt, Homo sapiens
ccaagcgccucaagacaaa

SEQ ID NO: 140616 - RNA, 19 nt, Homo sapiens
gcucuuaccuuaccaucga

SEQ ID NO: 140617 - RNA, 19 nt, Homo sapiens
agacauacauuucucauac

SEQ ID NO: 140618 - RNA, 19 nt, Homo sapiens
ggacuacuuugcaugugaa

SEQ ID NO: 140619 - RNA, 19 nt, Homo sapiens
cgacagcucuccaauacuc

SEQ ID NO: 140620 - RNA, 19 nt, Homo sapiens
gaauaaggaacaacguuga

SEQ ID NO: 140621 - RNA, 19 nt, Homo sapiens
uuuaccaccugcugaauua

SEQ ID NO: 140622 - RNA, 19 nt, Homo sapiens
caagacaaauugcuauaac

SEQ ID NO: 140623 - RNA, 19 nt, Homo sapiens
cagcagcccuggagacuca

SEQ ID NO: 140624 - RNA, 19 nt, Homo sapiens
guaccucaguucccucuug

SEQ ID NO: 140625 - RNA, 19 nt, Homo sapiens
acaauaggauagccaaguu

SEQ ID NO: 140626 - RNA, 19 nt, Homo sapiens
ugacggaugccuagaguuu

SEQ ID NO: 140627 - RNA, 19 nt, Homo sapiens
gccgacagcucuccaauac

SEQ ID NO: 140628 - RNA, 19 nt, Homo sapiens
gaaggacuacuuugcaugu

SEQ ID NO: 140629 - RNA, 19 nt, Homo sapiens
ugucaugaauggcaaagaa

SEQ ID NO: 140630 - RNA, 19 nt, Homo sapiens
gaacaggcccgugauagca

SEQ ID NO: 140631 - RNA, 19 nt, Homo sapiens
ggaguguaauccagugaug

SEQ ID NO: 140632 - RNA, 19 nt, Homo sapiens
caaauggcuucagauguug

SEQ ID NO: 140633 - RNA, 19 nt, Homo sapiens
guaccaugcucuggagaaa

SEQ ID NO: 140634 - RNA, 19 nt, Homo sapiens
cacgggaccuauuagagua

SEQ ID NO: 140635 - RNA, 19 nt, Homo sapiens
gcacgggaccuauuagagu

SEQ ID NO: 140636 - RNA, 19 nt, Homo sapiens
ggaaggaguuuggaauagg

SEQ ID NO: 140637 - RNA, 19 nt, Homo sapiens
gggaaggaguuuggaauag

SEQ ID NO: 140638 - RNA, 19 nt, Homo sapiens
gcagucagggacagacaua

SEQ ID NO: 140639 - RNA, 19 nt, Homo sapiens
uuacagacgugugcaguug

SEQ ID NO: 140640 - RNA, 19 nt, Homo sapiens
ggagaggagugugaagcaa

SEQ ID NO: 140641 - RNA, 19 nt, Homo sapiens
gaaacaauggcuaagauac

SEQ ID NO: 140642 - RNA, 19 nt, Homo sapiens
gaugaacaggcccgugaua

SEQ ID NO: 140643 - RNA, 19 nt, Homo sapiens
aacgaucucucaaauguga

SEQ ID NO: 140644 - RNA, 19 nt, Homo sapiens
ucagccagcacuuuaauuu

SEQ ID NO: 140645 - RNA, 19 nt, Homo sapiens
gaugacggaugccuagagu

SEQ ID NO: 140646 - RNA, 19 nt, Homo sapiens
caauaggauagccaaguua

SEQ ID NO: 140647 - RNA, 19 nt, Homo sapiens
acacggggcuugaauauga

SEQ ID NO: 140648 - RNA, 19 nt, Homo sapiens
gacgauggcuaucagucuu

SEQ ID NO: 140649 - RNA, 19 nt, Homo sapiens
uaacuggagccacgacgua

SEQ ID NO: 140650 - RNA, 19 nt, Homo sapiens
gcucggugcucccuuugga

SEQ ID NO: 140651 - RNA, 19 nt, Homo sapiens
ggauagccaaguuaaagaa

SEQ ID NO: 140652 - RNA, 19 nt, Homo sapiens
ccuggaagauggcuguuug

SEQ ID NO: 140653 - RNA, 19 nt, Homo sapiens
acgcacagcugacgacuca

SEQ ID NO: 140654 - RNA, 19 nt, Homo sapiens
gccuagaguuuaccuuaug

SEQ ID NO: 140655 - RNA, 19 nt, Homo sapiens
gccacgacguaacaaauau

SEQ ID NO: 140656 - RNA, 19 nt, Homo sapiens
ugugcugaguucuauaaua

SEQ ID NO: 140657 - RNA, 19 nt, Homo sapiens
ccauuugacuuggugauug

SEQ ID NO: 140658 - RNA, 19 nt, Homo sapiens
uuacauguaugaugacgau

SEQ ID NO: 140659 - RNA, 19 nt, Homo sapiens
ucagaaaugcugucauaau

SEQ ID NO: 140660 - RNA, 19 nt, Homo sapiens
ucagagaaacaauggcuaa

SEQ ID NO: 140661 - RNA, 19 nt, Homo sapiens
ggagguguccagucugcua

SEQ ID NO: 140662 - RNA, 19 nt, Homo sapiens
aaccaggacucguucagaa

SEQ ID NO: 140663 - RNA, 19 nt, Homo sapiens
acagacgugugcaguugua

SEQ ID NO: 140664 - RNA, 19 nt, Homo sapiens
ggagacaguucagaguauc

SEQ ID NO: 140665 - RNA, 19 nt, Homo sapiens
cagacaagcugcauuucag

SEQ ID NO: 140666 - RNA, 19 nt, Homo sapiens
gggccacucuuagcuaaau

SEQ ID NO: 140667 - RNA, 19 nt, Homo sapiens
ggacccaggaggugugauu

SEQ ID NO: 140668 - RNA, 19 nt, Homo sapiens
gcaacagcaucggcaggaa

SEQ ID NO: 140669 - RNA, 19 nt, Homo sapiens
agaaacaauggcuaagaua

SEQ ID NO: 140670 - RNA, 19 nt, Homo sapiens
ggucuaccacucagagaaa

SEQ ID NO: 140671 - RNA, 19 nt, Homo sapiens
caacaagagcagccuggaa

SEQ ID NO: 140672 - RNA, 19 nt, Homo sapiens
cgaaauaacaacagugucu

SEQ ID NO: 140673 - RNA, 19 nt, Homo sapiens
ggugugcugaguucuauaa

SEQ ID NO: 140674 - RNA, 19 nt, Homo sapiens
gauagccaaguuaaagaaa

SEQ ID NO: 140675 - RNA, 19 nt, Homo sapiens
ccagagaacaagacucgaa

SEQ ID NO: 140676 - RNA, 19 nt, Homo sapiens
caauaaccaccaagucgaa

SEQ ID NO: 140677 - RNA, 19 nt, Homo sapiens
gcuguccgaacucgaaaua

SEQ ID NO: 140678 - RNA, 19 nt, Homo sapiens
ggagaucagaggccgaaga

SEQ ID NO: 140679 - RNA, 19 nt, Homo sapiens
gaauggcaaagaagauguu

SEQ ID NO: 140680 - RNA, 19 nt, Homo sapiens
cacgguuccuggaguguaa

SEQ ID NO: 140681 - RNA, 19 nt, Homo sapiens
cgaguccugucauuguuug

SEQ ID NO: 140682 - RNA, 19 nt, Homo sapiens
gagccacgacguaacaaau

SEQ ID NO: 140683 - RNA, 19 nt, Homo sapiens
cugcuacccucauuucuca

SEQ ID NO: 140684 - RNA, 19 nt, Homo sapiens
ggaagauggcuguuugucu

SEQ ID NO: 140685 - RNA, 19 nt, Homo sapiens
uggagacaguucagaguau

SEQ ID NO: 140686 - RNA, 19 nt, Homo sapiens
gacaguuauugcaagaguu

SEQ ID NO: 140687 - RNA, 19 nt, Homo sapiens
gagaucagaggccgaagau

SEQ ID NO: 140688 - RNA, 19 nt, Homo sapiens
agagggagguguccagucu

SEQ ID NO: 140689 - RNA, 19 nt, Homo sapiens
uguccagucugcuaagcua

SEQ ID NO: 140690 - RNA, 19 nt, Homo sapiens
gaggaacaucacaaagaaa

SEQ ID NO: 140691 - RNA, 19 nt, Homo sapiens
gaacaacguugacaaguuu

SEQ ID NO: 140692 - RNA, 19 nt, Homo sapiens
gaaaguacgucgcuucuga

SEQ ID NO: 140693 - RNA, 19 nt, Homo sapiens
gcaacgaucucucaaaugu

SEQ ID NO: 140694 - RNA, 19 nt, Homo sapiens
ucaauaagcucgucuccua

SEQ ID NO: 140695 - RNA, 19 nt, Homo sapiens
ggaacaacguugacaaguu

SEQ ID NO: 140696 - RNA, 19 nt, Homo sapiens
gcauaaagguaggaaagua

SEQ ID NO: 140697 - RNA, 19 nt, Homo sapiens
acaaauggcuucagauguu

SEQ ID NO: 140698 - RNA, 19 nt, Homo sapiens
cagaaaugcugucauaaug

SEQ ID NO: 140699 - RNA, 19 nt, Homo sapiens
gaacaaauggcuucagaug

SEQ ID NO: 140700 - RNA, 19 nt, Homo sapiens
gagaacaaauggcuucaga

SEQ ID NO: 140701 - RNA, 19 nt, Homo sapiens
gaucagagccgagaacaaa

SEQ ID NO: 140702 - RNA, 19 nt, Homo sapiens
gagaaacaauggcuaagau

SEQ ID NO: 140703 - RNA, 19 nt, Homo sapiens
gugcugaguucuauaauau

SEQ ID NO: 140704 - RNA, 19 nt, Homo sapiens
gaacgggaauucagacaag

SEQ ID NO: 140705 - RNA, 19 nt, Homo sapiens
gaacaggaucuuuggcuuu

SEQ ID NO: 140706 - RNA, 19 nt, Homo sapiens
gaaaugcugucauaauggu

SEQ ID NO: 140707 - RNA, 19 nt, Homo sapiens
ccacaaugaugaugauuuc

SEQ ID NO: 140708 - RNA, 19 nt, Homo sapiens
gaagucugcuacccucauu

SEQ ID NO: 140709 - RNA, 19 nt, Homo sapiens
ucaaagaguugggcauaaa

SEQ ID NO: 140710 - RNA, 19 nt, Homo sapiens
ugaggaacaucacaaagaa

SEQ ID NO: 140711 - RNA, 19 nt, Homo sapiens
gccgagagcugcugcuuug

SEQ ID NO: 140712 - RNA, 19 nt, Homo sapiens
ccucccagcucuuaccuua

SEQ ID NO: 140713 - RNA, 19 nt, Homo sapiens
ggacagacauacauuucuc

SEQ ID NO: 140714 - RNA, 19 nt, Homo sapiens
caagacaguuauugcaaga

SEQ ID NO: 140715 - RNA, 19 nt, Homo sapiens
ccaagcgccucaagacaaa

SEQ ID NO: 140716 - RNA, 19 nt, Homo sapiens
gcucuuaccuuaccaucga

SEQ ID NO: 140717 - RNA, 19 nt, Homo sapiens
agacauacauuucucauac

SEQ ID NO: 140718 - RNA, 19 nt, Homo sapiens
ggacuacuuugcaugugaa

SEQ ID NO: 140719 - RNA, 19 nt, Homo sapiens
cgacagcucuccaauacuc

SEQ ID NO: 140720 - RNA, 19 nt, Homo sapiens
gaauaaggaacaacguuga

SEQ ID NO: 140721 - RNA, 19 nt, Homo sapiens
uuuaccaccugcugaauua

SEQ ID NO: 140722 - RNA, 19 nt, Homo sapiens
caagacaaauugcuauaac

SEQ ID NO: 140723 - RNA, 19 nt, Homo sapiens
cagcagcccuggagacuca

SEQ ID NO: 140724 - RNA, 19 nt, Homo sapiens
guaccucaguucccucuug

SEQ ID NO: 140725 - RNA, 19 nt, Homo sapiens
ugacggaugccuagaguuu

SEQ ID NO: 140726 - RNA, 19 nt, Homo sapiens
gccgacagcucuccaauac

SEQ ID NO: 140727 - RNA, 19 nt, Homo sapiens
gaaggacuacuuugcaugu

SEQ ID NO: 140728 - RNA, 19 nt, Homo sapiens
ggaguguaauccagugaug

SEQ ID NO: 140729 - RNA, 19 nt, Homo sapiens
caaauggcuucagauguug

SEQ ID NO: 140730 - RNA, 19 nt, Homo sapiens
guaccaugcucuggagaaa

SEQ ID NO: 140731 - RNA, 19 nt, Homo sapiens
cacgggaccuauuagagua

SEQ ID NO: 140732 - RNA, 19 nt, Homo sapiens
gcacgggaccuauuagagu

SEQ ID NO: 140733 - RNA, 19 nt, Homo sapiens
ggaaggaguuuggaauagg

SEQ ID NO: 140734 - RNA, 19 nt, Homo sapiens
gggaaggaguuuggaauag

SEQ ID NO: 140735 - RNA, 19 nt, Homo sapiens
gcagucagggacagacaua

SEQ ID NO: 140736 - RNA, 19 nt, Homo sapiens
uuacagacgugugcaguug

SEQ ID NO: 140737 - RNA, 19 nt, Homo sapiens
ggagaggagugugaagcaa

SEQ ID NO: 140738 - RNA, 19 nt, Homo sapiens
gaaacaauggcuaagauac

SEQ ID NO: 140739 - RNA, 19 nt, Homo sapiens
aacgaucucucaaauguga

SEQ ID NO: 140740 - RNA, 19 nt, Homo sapiens
ucagccagcacuuuaauuu

SEQ ID NO: 140741 - RNA, 19 nt, Homo sapiens
gaugacggaugccuagagu

SEQ ID NO: 140742 - RNA, 19 nt, Homo sapiens
acacggggcuugaauauga

SEQ ID NO: 140743 - RNA, 19 nt, Homo sapiens
gacgauggcuaucagucuu

SEQ ID NO: 140744 - RNA, 19 nt, Homo sapiens
uaacuggagccacgacgua

SEQ ID NO: 140745 - RNA, 19 nt, Homo sapiens
gcucggugcucccuuugga

SEQ ID NO: 140746 - RNA, 19 nt, Homo sapiens
gggaugaacaggaucuuug

SEQ ID NO: 140747 - RNA, 19 nt, Homo sapiens
ccuggaagauggcuguuug

SEQ ID NO: 140748 - RNA, 19 nt, Homo sapiens
acgcacagcugacgacuca

SEQ ID NO: 140749 - RNA, 19 nt, Homo sapiens
gccuagaguuuaccuuaug

SEQ ID NO: 140750 - RNA, 19 nt, Homo sapiens
gccacgacguaacaaauau

SEQ ID NO: 140751 - RNA, 19 nt, Homo sapiens
ugugcugaguucuauaaua

SEQ ID NO: 140752 - RNA, 19 nt, Homo sapiens
ccauuugacuuggugauug

SEQ ID NO: 140753 - RNA, 19 nt, Homo sapiens
uuacauguaugaugacgau

SEQ ID NO: 140754 - RNA, 19 nt, Homo sapiens
ucagaaaugcugucauaau

SEQ ID NO: 140755 - RNA, 19 nt, Homo sapiens
ucagagaaacaauggcuaa

SEQ ID NO: 140756 - RNA, 19 nt, Homo sapiens
acagacgugugcaguugua

SEQ ID NO: 140757 - RNA, 19 nt, Homo sapiens
ggagguguccagucugcua

SEQ ID NO: 140758 - RNA, 19 nt, Homo sapiens
aaccaggacucguucagaa

SEQ ID NO: 140759 - RNA, 19 nt, Homo sapiens
ggagacaguucagaguauc

SEQ ID NO: 140760 - RNA, 19 nt, Homo sapiens
cagacaagcugcauuucag

SEQ ID NO: 140761 - RNA, 19 nt, Homo sapiens
gggccacucuuagcuaaau

SEQ ID NO: 140762 - RNA, 19 nt, Homo sapiens
ggacccaggaggugugauu

SEQ ID NO: 140763 - RNA, 19 nt, Homo sapiens
gcaacagcaucggcaggaa

SEQ ID NO: 140764 - RNA, 19 nt, Homo sapiens
agaaacaauggcuaagaua

SEQ ID NO: 140765 - RNA, 19 nt, Homo sapiens
ggucuaccacucagagaaa

SEQ ID NO: 140766 - RNA, 19 nt, Homo sapiens
caacaagagcagccuggaa

SEQ ID NO: 140767 - RNA, 19 nt, Homo sapiens
cgaaauaacaacagugucu

SEQ ID NO: 140768 - RNA, 19 nt, Homo sapiens
ggugugcugaguucuauaa

SEQ ID NO: 140769 - RNA, 19 nt, Homo sapiens
ccagagaacaagacucgaa

SEQ ID NO: 140770 - RNA, 19 nt, Homo sapiens
gcuguccgaacucgaaaua

SEQ ID NO: 140771 - RNA, 19 nt, Homo sapiens
ggagaucagaggccgaaga

SEQ ID NO: 140772 - RNA, 19 nt, Homo sapiens
cacgguuccuggaguguaa

SEQ ID NO: 140773 - RNA, 19 nt, Homo sapiens
cgaguccugucauuguuug

SEQ ID NO: 140774 - RNA, 19 nt, Homo sapiens
gagccacgacguaacaaau

SEQ ID NO: 140775 - RNA, 19 nt, Homo sapiens
cugcuacccucauuucuca

SEQ ID NO: 140776 - RNA, 19 nt, Homo sapiens
ggaagauggcuguuugucu

SEQ ID NO: 140777 - RNA, 19 nt, Homo sapiens
uggagacaguucagaguau

SEQ ID NO: 140778 - RNA, 19 nt, Homo sapiens
agagggagguguccagucu

SEQ ID NO: 140779 - RNA, 19 nt, Homo sapiens
uguccagucugcuaagcua

SEQ ID NO: 140780 - RNA, 19 nt, Homo sapiens
gacaguuauugcaagaguu

SEQ ID NO: 140781 - RNA, 19 nt, Homo sapiens
gagaucagaggccgaagau

SEQ ID NO: 140782 - RNA, 19 nt, Homo sapiens
gaggaacaucacaaagaaa

SEQ ID NO: 140783 - RNA, 19 nt, Homo sapiens
gacggaugccuagaguuua

SEQ ID NO: 140784 - RNA, 19 nt, Homo sapiens
gaaggggugugcugaguuc

SEQ ID NO: 140785 - RNA, 19 nt, Homo sapiens
agacaguuauugcaagagu

SEQ ID NO: 140786 - RNA, 19 nt, Homo sapiens
caccaggcaucucaaugga

SEQ ID NO: 140787 - RNA, 19 nt, Homo sapiens
ccucaaagaguugggcaua

SEQ ID NO: 140788 - RNA, 19 nt, Homo sapiens
aagcucgucuccuaucgaa

SEQ ID NO: 140789 - RNA, 19 nt, Homo sapiens
gacaagcugcauuucagaa

SEQ ID NO: 140790 - RNA, 19 nt, Homo sapiens
gggagaacgggaauucaga

SEQ ID NO: 140791 - RNA, 19 nt, Homo sapiens
gaacaacguugacaaguuu

SEQ ID NO: 140792 - RNA, 19 nt, Homo sapiens
gaaaguacgucgcuucuga

SEQ ID NO: 140793 - RNA, 19 nt, Homo sapiens
gcacugagcucgaaaggau

SEQ ID NO: 140794 - RNA, 19 nt, Homo sapiens
gcaacgaucucucaaaugu

SEQ ID NO: 140795 - RNA, 19 nt, Homo sapiens
ucaauaagcucgucuccua

SEQ ID NO: 140796 - RNA, 19 nt, Homo sapiens
ggaacaacguugacaaguu

SEQ ID NO: 140797 - RNA, 19 nt, Homo sapiens
gcauaaagguaggaaagua

SEQ ID NO: 140798 - RNA, 19 nt, Homo sapiens
acaaauggcuucagauguu

SEQ ID NO: 140799 - RNA, 19 nt, Homo sapiens
cagaaaugcugucauaaug

SEQ ID NO: 140800 - RNA, 19 nt, Homo sapiens
gaacaaauggcuucagaug

SEQ ID NO: 140801 - RNA, 19 nt, Homo sapiens
gagaacaaauggcuucaga

SEQ ID NO: 140802 - RNA, 19 nt, Homo sapiens
gaucagagccgagaacaaa

SEQ ID NO: 140803 - RNA, 19 nt, Homo sapiens
gagaaacaauggcuaagau

SEQ ID NO: 140804 - RNA, 19 nt, Homo sapiens
gugcugaguucuauaauau

SEQ ID NO: 140805 - RNA, 19 nt, Homo sapiens
gaacgggaauucagacaag

SEQ ID NO: 140806 - RNA, 19 nt, Homo sapiens
gaaaugcugucauaauggu

SEQ ID NO: 140807 - RNA, 19 nt, Homo sapiens
ccacaaugaugaugauuuc

SEQ ID NO: 140808 - RNA, 19 nt, Homo sapiens
gaagucugcuacccucauu

SEQ ID NO: 140809 - RNA, 19 nt, Homo sapiens
ucaaagaguugggcauaaa

SEQ ID NO: 140810 - RNA, 19 nt, Homo sapiens
ugaggaacaucacaaagaa

SEQ ID NO: 140811 - RNA, 19 nt, Homo sapiens
gccgagagcugcugcuuug

SEQ ID NO: 140812 - RNA, 19 nt, Homo sapiens
ccucccagcucuuaccuua

SEQ ID NO: 140813 - RNA, 19 nt, Homo sapiens
ggacagacauacauuucuc

SEQ ID NO: 140814 - RNA, 19 nt, Homo sapiens
caagacaguuauugcaaga

SEQ ID NO: 140815 - RNA, 19 nt, Homo sapiens
ccaagcgccucaagacaaa

SEQ ID NO: 140816 - RNA, 19 nt, Homo sapiens
gcucuuaccuuaccaucga

SEQ ID NO: 140817 - RNA, 19 nt, Homo sapiens
agacauacauuucucauac

SEQ ID NO: 140818 - RNA, 19 nt, Homo sapiens
ggacuacuuugcaugugaa

SEQ ID NO: 140819 - RNA, 19 nt, Homo sapiens
cgacagcucuccaauacuc

SEQ ID NO: 140820 - RNA, 19 nt, Homo sapiens
gaauaaggaacaacguuga

SEQ ID NO: 140821 - RNA, 19 nt, Homo sapiens
uuuaccaccugcugaauua

SEQ ID NO: 140822 - RNA, 19 nt, Homo sapiens
caagacaaauugcuauaac

SEQ ID NO: 140823 - RNA, 19 nt, Homo sapiens
cagcagcccuggagacuca

SEQ ID NO: 140824 - RNA, 19 nt, Homo sapiens
guaccucaguucccucuug

SEQ ID NO: 140825 - RNA, 19 nt, Homo sapiens
acaauaggauagccaaguu

SEQ ID NO: 140826 - RNA, 19 nt, Homo sapiens
ugacggaugccuagaguuu

SEQ ID NO: 140827 - RNA, 19 nt, Homo sapiens
gccgacagcucuccaauac

SEQ ID NO: 140828 - RNA, 19 nt, Homo sapiens
gaaggacuacuuugcaugu

SEQ ID NO: 140829 - RNA, 19 nt, Homo sapiens
ugucaugaauggcaaagaa

SEQ ID NO: 140830 - RNA, 19 nt, Homo sapiens
gaacaggcccgugauagca

SEQ ID NO: 140831 - RNA, 19 nt, Homo sapiens
ggaguguaauccagugaug

SEQ ID NO: 140832 - RNA, 19 nt, Homo sapiens
caaauggcuucagauguug

SEQ ID NO: 140833 - RNA, 19 nt, Homo sapiens
guaccaugcucuggagaaa

SEQ ID NO: 140834 - RNA, 19 nt, Homo sapiens
cacgggaccuauuagagua

SEQ ID NO: 140835 - RNA, 19 nt, Homo sapiens
gcacgggaccuauuagagu

SEQ ID NO: 140836 - RNA, 19 nt, Homo sapiens
ggaaggaguuuggaauagg

SEQ ID NO: 140837 - RNA, 19 nt, Homo sapiens
gggaaggaguuuggaauag

SEQ ID NO: 140838 - RNA, 19 nt, Homo sapiens
gcagucagggacagacaua

SEQ ID NO: 140839 - RNA, 19 nt, Homo sapiens
uuacagacgugugcaguug

SEQ ID NO: 140840 - RNA, 19 nt, Homo sapiens
ggagaggagugugaagcaa

SEQ ID NO: 140841 - RNA, 19 nt, Homo sapiens
gaaacaauggcuaagauac

SEQ ID NO: 140842 - RNA, 19 nt, Homo sapiens
gaugaacaggcccgugaua

SEQ ID NO: 140843 - RNA, 19 nt, Homo sapiens
aacgaucucucaaauguga

SEQ ID NO: 140844 - RNA, 19 nt, Homo sapiens
ucagccagcacuuuaauuu

SEQ ID NO: 140845 - RNA, 19 nt, Homo sapiens
gaugacggaugccuagagu

SEQ ID NO: 140846 - RNA, 19 nt, Homo sapiens
caauaggauagccaaguua

SEQ ID NO: 140847 - RNA, 19 nt, Homo sapiens
acacggggcuugaauauga

SEQ ID NO: 140848 - RNA, 19 nt, Homo sapiens
gacgauggcuaucagucuu

SEQ ID NO: 140849 - RNA, 19 nt, Homo sapiens
uaacuggagccacgacgua

SEQ ID NO: 140850 - RNA, 19 nt, Homo sapiens
gcucggugcucccuuugga

SEQ ID NO: 140851 - RNA, 19 nt, Homo sapiens
ggauagccaaguuaaagaa

SEQ ID NO: 140852 - RNA, 19 nt, Homo sapiens
ccuggaagauggcuguuug

SEQ ID NO: 140853 - RNA, 19 nt, Homo sapiens
acgcacagcugacgacuca

SEQ ID NO: 140854 - RNA, 19 nt, Homo sapiens
gccuagaguuuaccuuaug

SEQ ID NO: 140855 - RNA, 19 nt, Homo sapiens
gccacgacguaacaaauau

SEQ ID NO: 140856 - RNA, 19 nt, Homo sapiens
ugugcugaguucuauaaua

SEQ ID NO: 140857 - RNA, 19 nt, Homo sapiens
ccauuugacuuggugauug

SEQ ID NO: 140858 - RNA, 19 nt, Homo sapiens
uuacauguaugaugacgau

SEQ ID NO: 140859 - RNA, 19 nt, Homo sapiens
ucagaaaugcugucauaau

SEQ ID NO: 140860 - RNA, 19 nt, Homo sapiens
ucagagaaacaauggcuaa

SEQ ID NO: 140861 - RNA, 19 nt, Homo sapiens
acagacgugugcaguugua

SEQ ID NO: 140862 - RNA, 19 nt, Homo sapiens
aaccaggacucguucagaa

SEQ ID NO: 140863 - RNA, 19 nt, Homo sapiens
ggagguguccagucugcua

SEQ ID NO: 140864 - RNA, 19 nt, Homo sapiens
ggagacaguucagaguauc

SEQ ID NO: 140865 - RNA, 19 nt, Homo sapiens
cagacaagcugcauuucag

SEQ ID NO: 140866 - RNA, 19 nt, Homo sapiens
gggccacucuuagcuaaau

SEQ ID NO: 140867 - RNA, 19 nt, Homo sapiens
ggacccaggaggugugauu

SEQ ID NO: 140868 - RNA, 19 nt, Homo sapiens
gcaacagcaucggcaggaa

SEQ ID NO: 140869 - RNA, 19 nt, Homo sapiens
agaaacaauggcuaagaua

SEQ ID NO: 140870 - RNA, 19 nt, Homo sapiens
ggucuaccacucagagaaa

SEQ ID NO: 140871 - RNA, 19 nt, Homo sapiens
caacaagagcagccuggaa

SEQ ID NO: 140872 - RNA, 19 nt, Homo sapiens
cgaaauaacaacagugucu

SEQ ID NO: 140873 - RNA, 19 nt, Homo sapiens
ggugugcugaguucuauaa

SEQ ID NO: 140874 - RNA, 19 nt, Homo sapiens
gauagccaaguuaaagaaa

SEQ ID NO: 140875 - RNA, 19 nt, Homo sapiens
ccagagaacaagacucgaa

SEQ ID NO: 140876 - RNA, 19 nt, Homo sapiens
gcuguccgaacucgaaaua

SEQ ID NO: 140877 - RNA, 19 nt, Homo sapiens
caauaaccaccaagucgaa

SEQ ID NO: 140878 - RNA, 19 nt, Homo sapiens
acaggcagguccuaaaugg

SEQ ID NO: 140879 - RNA, 19 nt, Homo sapiens
gaauggcaaagaagauguu

SEQ ID NO: 140880 - RNA, 19 nt, Homo sapiens
cacgguuccuggaguguaa

SEQ ID NO: 140881 - RNA, 19 nt, Homo sapiens
cgaguccugucauuguuug

SEQ ID NO: 140882 - RNA, 19 nt, Homo sapiens
ggagaucagaggccgaaga

SEQ ID NO: 140883 - RNA, 19 nt, Homo sapiens
gagccacgacguaacaaau

SEQ ID NO: 140884 - RNA, 19 nt, Homo sapiens
cugcuacccucauuucuca

SEQ ID NO: 140885 - RNA, 19 nt, Homo sapiens
ggaagauggcuguuugucu

SEQ ID NO: 140886 - RNA, 19 nt, Homo sapiens
uggagacaguucagaguau

SEQ ID NO: 140887 - RNA, 19 nt, Homo sapiens
gacaguuauugcaagaguu

SEQ ID NO: 140888 - RNA, 19 nt, Homo sapiens
gagaucagaggccgaagau

SEQ ID NO: 140889 - RNA, 19 nt, Homo sapiens
agagggagguguccagucu

SEQ ID NO: 140890 - RNA, 19 nt, Homo sapiens
gaggaacaucacaaagaaa

SEQ ID NO: 140891 - RNA, 19 nt, Homo sapiens
gagagcagcuucuguauug

SEQ ID NO: 140892 - RNA, 19 nt, Homo sapiens
ggaaagaaaugccuaggaa

SEQ ID NO: 140893 - RNA, 19 nt, Homo sapiens
gcaggaagguugaugcuuu

SEQ ID NO: 140894 - RNA, 19 nt, Homo sapiens
ggaagaugauucuggauaa

SEQ ID NO: 140895 - RNA, 19 nt, Homo sapiens
gaaauacugucuaucucua

SEQ ID NO: 140896 - RNA, 19 nt, Homo sapiens
caaauugccucgucaaaga

SEQ ID NO: 140897 - RNA, 19 nt, Homo sapiens
aaacaacuguaaccagaua

SEQ ID NO: 140898 - RNA, 19 nt, Homo sapiens
gacaaaagccugaaauuua

SEQ ID NO: 140899 - RNA, 19 nt, Homo sapiens
gcagauugcuacuagaaau

SEQ ID NO: 140900 - RNA, 19 nt, Homo sapiens
gggauuggauuauauugaa

SEQ ID NO: 140901 - RNA, 19 nt, Homo sapiens
aagcaggauuucuguauua

SEQ ID NO: 140902 - RNA, 19 nt, Homo sapiens
gugaugaacuuaugggaaa

SEQ ID NO: 140903 - RNA, 19 nt, Homo sapiens
agaagagacuauucagaua

SEQ ID NO: 140904 - RNA, 19 nt, Homo sapiens
gaagaaccacuuuaaacaa

SEQ ID NO: 140905 - RNA, 19 nt, Homo sapiens
caggauuucuguauuauga

SEQ ID NO: 140906 - RNA, 19 nt, Homo sapiens
uagaggagauuauugaaga

SEQ ID NO: 140907 - RNA, 19 nt, Homo sapiens
caagagaaaugauguuguc

SEQ ID NO: 140908 - RNA, 19 nt, Homo sapiens
gagaagagacuauucagau

SEQ ID NO: 140909 - RNA, 19 nt, Homo sapiens
gcacagaaaguacaaguca

SEQ ID NO: 140910 - RNA, 19 nt, Homo sapiens
caucugggauuggauuaua

SEQ ID NO: 140911 - RNA, 19 nt, Homo sapiens
gaaggacacagaaggaauu

SEQ ID NO: 140912 - RNA, 19 nt, Homo sapiens
ggaaaggguucaggguuga

SEQ ID NO: 140913 - RNA, 19 nt, Homo sapiens
gaagguugaugcuuuggau

SEQ ID NO: 140914 - RNA, 19 nt, Homo sapiens
gcagacgggugccuugaug

SEQ ID NO: 140915 - RNA, 19 nt, Homo sapiens
gaaagaaaugccuaggaaa

SEQ ID NO: 140916 - RNA, 19 nt, Homo sapiens
ucagugugcugguuaaaga

SEQ ID NO: 140917 - RNA, 19 nt, Homo sapiens
caaaagaucucccaguaug

SEQ ID NO: 140918 - RNA, 19 nt, Homo sapiens
gcagagcguuccucaugga

SEQ ID NO: 140919 - RNA, 19 nt, Homo sapiens
gguccaaggugaaggguau

SEQ ID NO: 140920 - RNA, 19 nt, Homo sapiens
gagaagaaccacuuuaaac

SEQ ID NO: 140921 - RNA, 19 nt, Homo sapiens
cagagaagaaccacuuuaa

SEQ ID NO: 140922 - RNA, 19 nt, Homo sapiens
aaugaagacuccuguguga

SEQ ID NO: 140923 - RNA, 19 nt, Homo sapiens
gauauucacggaugccuuu

SEQ ID NO: 140924 - RNA, 19 nt, Homo sapiens
aaccagagcuccucgaugu

SEQ ID NO: 140925 - RNA, 19 nt, Homo sapiens
gagaaaugauguugucacu

SEQ ID NO: 140926 - RNA, 19 nt, Homo sapiens
uaauaggccauguuuauga

SEQ ID NO: 140927 - RNA, 19 nt, Homo sapiens
gaaaugcagauugcuacua

SEQ ID NO: 140928 - RNA, 19 nt, Homo sapiens
gguaauggguaagguucua

SEQ ID NO: 140929 - RNA, 19 nt, Homo sapiens
uagcugaaauacugucuau

SEQ ID NO: 140930 - RNA, 19 nt, Homo sapiens
ggacaaaagccugaaauuu

SEQ ID NO: 140931 - RNA, 19 nt, Homo sapiens
ggaaaccgguggaaaugac

SEQ ID NO: 140932 - RNA, 19 nt, Homo sapiens
ucuaauaggccauguuuau

SEQ ID NO: 140933 - RNA, 19 nt, Homo sapiens
aaagcaggauuucuguauu

SEQ ID NO: 140934 - RNA, 19 nt, Homo sapiens
ggagauuauugaagaugga

SEQ ID NO: 140935 - RNA, 19 nt, Homo sapiens
gaaaaugagcucagugauu

SEQ ID NO: 140936 - RNA, 19 nt, Homo sapiens
caaggugaaggguaucaua

SEQ ID NO: 140937 - RNA, 19 nt, Homo sapiens
gaaccacuuuaaacaacug

SEQ ID NO: 140938 - RNA, 19 nt, Homo sapiens
cagggaagcucaucaaagc

SEQ ID NO: 140939 - RNA, 19 nt, Homo sapiens
caaagcagaaagugaagaa

SEQ ID NO: 140940 - RNA, 19 nt, Homo sapiens
gacaagaccaagaggauau

SEQ ID NO: 140941 - RNA, 19 nt, Homo sapiens
gucaaagaguggacaguga

SEQ ID NO: 140942 - RNA, 19 nt, Homo sapiens
ccacgagcgucccacuuga

SEQ ID NO: 140943 - RNA, 19 nt, Homo sapiens
caaacucuuuacuucugua

SEQ ID NO: 140944 - RNA, 19 nt, Homo sapiens
uaugagagcagcuucugua

SEQ ID NO: 140945 - RNA, 19 nt, Homo sapiens
caggaagguugaugcuuug

SEQ ID NO: 140946 - RNA, 19 nt, Homo sapiens
ucauagaggagauuauuga

SEQ ID NO: 140947 - RNA, 19 nt, Homo sapiens
gauuuggucgucuucauuu

SEQ ID NO: 140948 - RNA, 19 nt, Homo sapiens
ucacggaugccuuugauau

SEQ ID NO: 140949 - RNA, 19 nt, Homo sapiens
aaaugcagauugcuacuag

SEQ ID NO: 140950 - RNA, 19 nt, Homo sapiens
ccucaaagcagaaagugaa

SEQ ID NO: 140951 - RNA, 19 nt, Homo sapiens
gaucaacagaggaugaaga

SEQ ID NO: 140952 - RNA, 19 nt, Homo sapiens
uauugaagauggagaaagu

SEQ ID NO: 140953 - RNA, 19 nt, Homo sapiens
caacucggguucggauguu

SEQ ID NO: 140954 - RNA, 19 nt, Homo sapiens
gcugaaauacugucuaucu

SEQ ID NO: 140955 - RNA, 19 nt, Homo sapiens
guucuaauaggccauguuu

SEQ ID NO: 140956 - RNA, 19 nt, Homo sapiens
gggaaggugccacugguaa

SEQ ID NO: 140957 - RNA, 19 nt, Homo sapiens
gaagaugauucuggauaac

SEQ ID NO: 140958 - RNA, 19 nt, Homo sapiens
ggaugaagagcaacuuuua

SEQ ID NO: 140959 - RNA, 19 nt, Homo sapiens
gagcagcuucuguauugaa

SEQ ID NO: 140960 - RNA, 19 nt, Homo sapiens
ucagagaagaaccacuuua

SEQ ID NO: 140961 - RNA, 19 nt, Homo sapiens
gaaggugccacugguaaug

SEQ ID NO: 140962 - RNA, 19 nt, Homo sapiens
gcagaaagugaagaagaaa

SEQ ID NO: 140963 - RNA, 19 nt, Homo sapiens
aaaaugagcucagugauuc

SEQ ID NO: 140964 - RNA, 19 nt, Homo sapiens
guaagaagauggggcauga

SEQ ID NO: 140965 - RNA, 19 nt, Homo sapiens
uaucaauccuucaaacucu

SEQ ID NO: 140966 - RNA, 19 nt, Homo sapiens
agaagaaccacuuuaaaca

SEQ ID NO: 140967 - RNA, 19 nt, Homo sapiens
uacaaaagaucucccagua

SEQ ID NO: 140968 - RNA, 19 nt, Homo sapiens
gaaaugccuaggaaagugu

SEQ ID NO: 140969 - RNA, 19 nt, Homo sapiens
cggaagaugauucuggaua

SEQ ID NO: 140970 - RNA, 19 nt, Homo sapiens
ggauuucuguauuaugaag

SEQ ID NO: 140971 - RNA, 19 nt, Homo sapiens
aaagcuguguuaaaugaug

SEQ ID NO: 140972 - RNA, 19 nt, Homo sapiens
ugaaguuaaagcuguguua

SEQ ID NO: 140973 - RNA, 19 nt, Homo sapiens
ggugaaggguaucauagag

SEQ ID NO: 140974 - RNA, 19 nt, Homo sapiens
cucaagacaucaaauuuca

SEQ ID NO: 140975 - RNA, 19 nt, Homo sapiens
cccgaagacuccaccaauu

SEQ ID NO: 140976 - RNA, 19 nt, Homo sapiens
cagauugcuacuagaaaua

SEQ ID NO: 140977 - RNA, 19 nt, Homo sapiens
agaaaugccuaggaaagug

SEQ ID NO: 140978 - RNA, 19 nt, Homo sapiens
gaagauggggcaugaugua

SEQ ID NO: 140979 - RNA, 19 nt, Homo sapiens
cagcuucuguauugaaauc

SEQ ID NO: 140980 - RNA, 19 nt, Homo sapiens
uaaccaugcuuuauaugac

SEQ ID NO: 140981 - RNA, 19 nt, Homo sapiens
acacaugagcggaagauga

SEQ ID NO: 140982 - RNA, 19 nt, Homo sapiens
gaggaugaagagcaacuuu

SEQ ID NO: 140983 - RNA, 19 nt, Homo sapiens
ccgcagagcguuccucaug

SEQ ID NO: 140984 - RNA, 19 nt, Homo sapiens
ugacaagaccaagaggaua

SEQ ID NO: 140985 - RNA, 19 nt, Homo sapiens
gaccuugucagcuguguga

SEQ ID NO: 140986 - RNA, 19 nt, Homo sapiens
uaaaguaaggucggacaaa

SEQ ID NO: 140987 - RNA, 19 nt, Homo sapiens
ucucugccauucacaauca

SEQ ID NO: 140988 - RNA, 19 nt, Homo sapiens
ccacuuuaaacaacuguaa

SEQ ID NO: 140989 - RNA, 19 nt, Homo sapiens
agagaagaaccacuuuaaa

SEQ ID NO: 140990 - RNA, 19 nt, Homo sapiens
aaagaaaugccuaggaaag

SEQ ID NO: 140991 - RNA, 19 nt, Homo sapiens
ggaaacagcauuaagaaua

SEQ ID NO: 140992 - RNA, 19 nt, Homo sapiens
ggacugaugugguagauuu

SEQ ID NO: 140993 - RNA, 19 nt, Homo sapiens
ucaaagaacugaagaagaa

SEQ ID NO: 140994 - RNA, 19 nt, Homo sapiens
cagcaaacaucaagagaua

SEQ ID NO: 140995 - RNA, 19 nt, Homo sapiens
guaccgagguuacacguua

SEQ ID NO: 140996 - RNA, 19 nt, Homo sapiens
gagaaugacuuccuucaga

SEQ ID NO: 140997 - RNA, 19 nt, Homo sapiens
gaaagucgaugguggugaa

SEQ ID NO: 140998 - RNA, 19 nt, Homo sapiens
ucacaggacucuaaggaua

SEQ ID NO: 140999 - RNA, 19 nt, Homo sapiens
gcauauaaauuaccuggaa

SEQ ID NO: 141000 - RNA, 19 nt, Homo sapiens
gcccaaacauucuuucuuu

SEQ ID NO: 141001 - RNA, 19 nt, Homo sapiens
ucaccaagcuggaucauga

SEQ ID NO: 141002 - RNA, 19 nt, Homo sapiens
gaagauaaguguucguucu

SEQ ID NO: 141003 - RNA, 19 nt, Homo sapiens
gaaauuacuuccuggagau

SEQ ID NO: 141004 - RNA, 19 nt, Homo sapiens
ggaaacagaauucuagauu

SEQ ID NO: 141005 - RNA, 19 nt, Homo sapiens
gaaacagcauuaagaauac

SEQ ID NO: 141006 - RNA, 19 nt, Homo sapiens
cagagcagauuguaaguuu

SEQ ID NO: 141007 - RNA, 19 nt, Homo sapiens
ggagacagauuggcuuuga

SEQ ID NO: 141008 - RNA, 19 nt, Homo sapiens
gacaaugaauuugcgaaua

SEQ ID NO: 141009 - RNA, 19 nt, Homo sapiens
gcacaaauaccucgccaaa

SEQ ID NO: 141010 - RNA, 19 nt, Homo sapiens
gcacugaaauacuuaccaa

SEQ ID NO: 141011 - RNA, 19 nt, Homo sapiens
gggcagcacugaaauacuu

SEQ ID NO: 141012 - RNA, 19 nt, Homo sapiens
ccaaagaagucaaccacaa

SEQ ID NO: 141013 - RNA, 19 nt, Homo sapiens
cuugggagcugcaccauua

SEQ ID NO: 141014 - RNA, 19 nt, Homo sapiens
ucaaugugcugaauuucua

SEQ ID NO: 141015 - RNA, 19 nt, Homo sapiens
uuaagaaccucauuggaaa

SEQ ID NO: 141016 - RNA, 19 nt, Homo sapiens
gaaauagcuucuaaacaag

SEQ ID NO: 141017 - RNA, 19 nt, Homo sapiens
cuaaagacauagacagauu

SEQ ID NO: 141018 - RNA, 19 nt, Homo sapiens
gaauuaacuagcacgauua

SEQ ID NO: 141019 - RNA, 19 nt, Homo sapiens
gcaaacaucaagagauauu

SEQ ID NO: 141020 - RNA, 19 nt, Homo sapiens
gcucugguauuuaucauug

SEQ ID NO: 141021 - RNA, 19 nt, Homo sapiens
uaacagacaagccaaguuu

SEQ ID NO: 141022 - RNA, 19 nt, Homo sapiens
uaaaugagcagcuguacaa

SEQ ID NO: 141023 - RNA, 19 nt, Homo sapiens
cagaauccauggagacaaa

SEQ ID NO: 141024 - RNA, 19 nt, Homo sapiens
gaagauaagcagcauuuca

SEQ ID NO: 141025 - RNA, 19 nt, Homo sapiens
gagagaaccauauauacaa

SEQ ID NO: 141026 - RNA, 19 nt, Homo sapiens
cagcaugacugcagagaga

SEQ ID NO: 141027 - RNA, 19 nt, Homo sapiens
gggcaggguuuguggguaa

SEQ ID NO: 141028 - RNA, 19 nt, Homo sapiens
agaauuaacuagcacgauu

SEQ ID NO: 141029 - RNA, 19 nt, Homo sapiens
gaacucugccucaggauga

SEQ ID NO: 141030 - RNA, 19 nt, Homo sapiens
caaaggaguucaguucuca

SEQ ID NO: 141031 - RNA, 19 nt, Homo sapiens
gauaugaggagacagauug

SEQ ID NO: 141032 - RNA, 19 nt, Homo sapiens
uacgacaaauggaagauua

SEQ ID NO: 141033 - RNA, 19 nt, Homo sapiens
uagaauccaucuucaaguu

SEQ ID NO: 141034 - RNA, 19 nt, Homo sapiens
gaugaacuuucuuuacaga

SEQ ID NO: 141035 - RNA, 19 nt, Homo sapiens
aggauuaccuaaagacaua

SEQ ID NO: 141036 - RNA, 19 nt, Homo sapiens
gauggaggccuguuucaaa

SEQ ID NO: 141037 - RNA, 19 nt, Homo sapiens
gaaauggugggcccaauau

SEQ ID NO: 141038 - RNA, 19 nt, Homo sapiens
ucuaugaccuuauugaaug

SEQ ID NO: 141039 - RNA, 19 nt, Homo sapiens
ucaaacagcugaaggaaaa

SEQ ID NO: 141040 - RNA, 19 nt, Homo sapiens
ggcccaagccugacuauuu

SEQ ID NO: 141041 - RNA, 19 nt, Homo sapiens
gaauccaucuucaaguuca

SEQ ID NO: 141042 - RNA, 19 nt, Homo sapiens
agucaucgcugccaaagaa

SEQ ID NO: 141043 - RNA, 19 nt, Homo sapiens
gacauagacagauuacaua

SEQ ID NO: 141044 - RNA, 19 nt, Homo sapiens
caugaucuaugaccuuauu

SEQ ID NO: 141045 - RNA, 19 nt, Homo sapiens
caagagauauuugagaaag

SEQ ID NO: 141046 - RNA, 19 nt, Homo sapiens
ccaaaauccuuaacaagua

SEQ ID NO: 141047 - RNA, 19 nt, Homo sapiens
cagaaacucuacugcuuga

SEQ ID NO: 141048 - RNA, 19 nt, Homo sapiens
gaauucauccucaauguuc

SEQ ID NO: 141049 - RNA, 19 nt, Homo sapiens
gaaaauauuugcacuagca

SEQ ID NO: 141050 - RNA, 19 nt, Homo sapiens
uaaagaagcgauaguugaa

SEQ ID NO: 141051 - RNA, 19 nt, Homo sapiens
guguagugaugauguauaa

SEQ ID NO: 141052 - RNA, 19 nt, Homo sapiens
gggaagcuguguagugaug

SEQ ID NO: 141053 - RNA, 19 nt, Homo sapiens
augcaaagcuucuuaagug

SEQ ID NO: 141054 - RNA, 19 nt, Homo sapiens
guugugcgcuuaauggaaa

SEQ ID NO: 141055 - RNA, 19 nt, Homo sapiens
aaugaggacugauguggua

SEQ ID NO: 141056 - RNA, 19 nt, Homo sapiens
ggucaucacaggacucuaa

SEQ ID NO: 141057 - RNA, 19 nt, Homo sapiens
gaucaagacuuuugggaaa

SEQ ID NO: 141058 - RNA, 19 nt, Homo sapiens
cgucaacgaugugaaauug

SEQ ID NO: 141059 - RNA, 19 nt, Homo sapiens
ugaggcagcugaugaaagu

SEQ ID NO: 141060 - RNA, 19 nt, Homo sapiens
gcauggagcugagggacaa

SEQ ID NO: 141061 - RNA, 19 nt, Homo sapiens
cacaugaucuaugaccuua

SEQ ID NO: 141062 - RNA, 19 nt, Homo sapiens
uaagaauccuccucacugu

SEQ ID NO: 141063 - RNA, 19 nt, Homo sapiens
gaacgagguccagcgauuu

SEQ ID NO: 141064 - RNA, 19 nt, Homo sapiens
cggaugaacuuucuuuaca

SEQ ID NO: 141065 - RNA, 19 nt, Homo sapiens
guauauuuccugcuucaua

SEQ ID NO: 141066 - RNA, 19 nt, Homo sapiens
ugaacgagguccagcgauu

SEQ ID NO: 141067 - RNA, 19 nt, Homo sapiens
gaaaacaucgucaaaguga

SEQ ID NO: 141068 - RNA, 19 nt, Homo sapiens
ccaaagagcucagcaaaau

SEQ ID NO: 141069 - RNA, 19 nt, Homo sapiens
gaugugaaauugguguuug

SEQ ID NO: 141070 - RNA, 19 nt, Homo sapiens
ccucaagucuggaugauag

SEQ ID NO: 141071 - RNA, 19 nt, Homo sapiens
ggaaaucauccacuacuuc

SEQ ID NO: 141072 - RNA, 19 nt, Homo sapiens
ggagauaugaggagacaga

SEQ ID NO: 141073 - RNA, 19 nt, Homo sapiens
ugugguagauuuccuaaug

SEQ ID NO: 141074 - RNA, 19 nt, Homo sapiens
gcacaucuuagaaacauau

SEQ ID NO: 141075 - RNA, 19 nt, Homo sapiens
caccaaugauuauccauau

SEQ ID NO: 141076 - RNA, 19 nt, Homo sapiens
gauauucucagcuauugaa

SEQ ID NO: 141077 - RNA, 19 nt, Homo sapiens
gcagauuacgggaauuuga

SEQ ID NO: 141078 - RNA, 19 nt, Homo sapiens
ugaaagcgcuagaauccau

SEQ ID NO: 141079 - RNA, 19 nt, Homo sapiens
ugacaaaaguguugaagaa

SEQ ID NO: 141080 - RNA, 19 nt, Homo sapiens
gaugaagaugggaauauuu

SEQ ID NO: 141081 - RNA, 19 nt, Homo sapiens
gaacagcaaacaucaagag

SEQ ID NO: 141082 - RNA, 19 nt, Homo sapiens
cgaucugccuccuaaguuu

SEQ ID NO: 141083 - RNA, 19 nt, Homo sapiens
gaagggugguaccgagguu

SEQ ID NO: 141084 - RNA, 19 nt, Homo sapiens
guggguaacauugaaauua

SEQ ID NO: 141085 - RNA, 19 nt, Homo sapiens
acaaaugaauacaggaaga

SEQ ID NO: 141086 - RNA, 19 nt, Homo sapiens
gcucggcucuuaacucagu

SEQ ID NO: 141087 - RNA, 19 nt, Homo sapiens
gcagaggagacgaacagua

SEQ ID NO: 141088 - RNA, 19 nt, Homo sapiens
uaacaaguacggagauaug

SEQ ID NO: 141089 - RNA, 19 nt, Homo sapiens
cagaggcacguccagauua

SEQ ID NO: 141090 - RNA, 19 nt, Homo sapiens
ggacaacaacaccaggaaa

SEQ ID NO: 141091 - RNA, 19 nt, Homo sapiens
gaagaaaccucucuauugg

SEQ ID NO: 141092 - RNA, 19 nt, Homo sapiens
ggaagaaaccucucuauug

SEQ ID NO: 141093 - RNA, 19 nt, Homo sapiens
caaagaggaucccaucuau

SEQ ID NO: 141094 - RNA, 19 nt, Homo sapiens
caaagaagaugguuagaac

SEQ ID NO: 141095 - RNA, 19 nt, Homo sapiens
cagaaugggugcaguuuga

SEQ ID NO: 141096 - RNA, 19 nt, Homo sapiens
gacugugccuggauccuua

SEQ ID NO: 141097 - RNA, 19 nt, Homo sapiens
ccaaagaggaucccaucua

SEQ ID NO: 141098 - RNA, 19 nt, Homo sapiens
gauccuuacuccugcauug

SEQ ID NO: 141099 - RNA, 19 nt, Homo sapiens
gaucaaagaagaugguuag

SEQ ID NO: 141100 - RNA, 19 nt, Homo sapiens
ggacggagcagugauggaa

SEQ ID NO: 141101 - RNA, 19 nt, Homo sapiens
aagaggaucccaucuauga

SEQ ID NO: 141102 - RNA, 19 nt, Homo sapiens
ggaaggacaaucccaggaa

SEQ ID NO: 141103 - RNA, 19 nt, Homo sapiens
gcuaugagcuccccuacaa

SEQ ID NO: 141104 - RNA, 19 nt, Homo sapiens
acaaggucauguucucuuu

SEQ ID NO: 141105 - RNA, 19 nt, Homo sapiens
gauaacccaccuaagcuuu

SEQ ID NO: 141106 - RNA, 19 nt, Homo sapiens
acagggaaaugacaucuuc

SEQ ID NO: 141107 - RNA, 19 nt, Homo sapiens
gcaaggcugagguggcuaa

SEQ ID NO: 141108 - RNA, 19 nt, Homo sapiens
cuacaacccugccacugau

SEQ ID NO: 141109 - RNA, 19 nt, Homo sapiens
gcacuagggaucaaagaag

SEQ ID NO: 141110 - RNA, 19 nt, Homo sapiens
ugccagagaccuauuuaaa

SEQ ID NO: 141111 - RNA, 19 nt, Homo sapiens
ucaaagaagaugguuagaa

SEQ ID NO: 141112 - RNA, 19 nt, Homo sapiens
cgccuggacugcaaaguga

SEQ ID NO: 141113 - RNA, 19 nt, Homo sapiens
accaagagguggaggaaga

SEQ ID NO: 141114 - RNA, 19 nt, Homo sapiens
ggaucaaagaagaugguua

SEQ ID NO: 141115 - RNA, 19 nt, Homo sapiens
cacuagggaucaaagaaga

SEQ ID NO: 141116 - RNA, 19 nt, Homo sapiens
cggaagaaaccucucuauu

SEQ ID NO: 141117 - RNA, 19 nt, Homo sapiens
ccuguaugcugagcccuua

SEQ ID NO: 141118 - RNA, 19 nt, Homo sapiens
gcagaaggcccagggaaag

SEQ ID NO: 141119 - RNA, 19 nt, Homo sapiens
gggacaaggucauguucuc

SEQ ID NO: 141120 - RNA, 19 nt, Homo sapiens
ugaaggaggagggcuauga

SEQ ID NO: 141121 - RNA, 19 nt, Homo sapiens
ccaggacucccuauacuca

SEQ ID NO: 141122 - RNA, 19 nt, Homo sapiens
ggcagaaggcccagggaaa

SEQ ID NO: 141123 - RNA, 19 nt, Homo sapiens
ggaccaagagguggaggaa

SEQ ID NO: 141124 - RNA, 19 nt, Homo sapiens
ggacugugccuggauccuu

SEQ ID NO: 141125 - RNA, 19 nt, Homo sapiens
ggucagaaugggugcaguu

SEQ ID NO: 141126 - RNA, 19 nt, Homo sapiens
ccuacaacccugccacuga

SEQ ID NO: 141127 - RNA, 19 nt, Homo sapiens
ucuauugggacuuguauga

SEQ ID NO: 141128 - RNA, 19 nt, Homo sapiens
ccacaacucagcccuguac

SEQ ID NO: 141129 - RNA, 19 nt, Homo sapiens
cgaguucuuugaccauaag

SEQ ID NO: 141130 - RNA, 19 nt, Homo sapiens
gacaaggucauguucucuu

SEQ ID NO: 141131 - RNA, 19 nt, Homo sapiens
agccaucccuucccuacuu

SEQ ID NO: 141132 - RNA, 19 nt, Homo sapiens
ucgaguucuuugaccauaa

SEQ ID NO: 141133 - RNA, 19 nt, Homo sapiens
gaaggaggagggcuaugag

SEQ ID NO: 141134 - RNA, 19 nt, Homo sapiens
ggacugugggcucucuaga

SEQ ID NO: 141135 - RNA, 19 nt, Homo sapiens
gugccaagcucgggugaag

SEQ ID NO: 141136 - RNA, 19 nt, Homo sapiens
ggcaggagagggaguacaa

SEQ ID NO: 141137 - RNA, 19 nt, Homo sapiens
gggaguacaacggaagaaa

SEQ ID NO: 141138 - RNA, 19 nt, Homo sapiens
uaacggugcagaggacuga

SEQ ID NO: 141139 - RNA, 19 nt, Homo sapiens
gccaagcucgggugaagga

SEQ ID NO: 141140 - RNA, 19 nt, Homo sapiens
ggaguacaacggaagaaac

SEQ ID NO: 141141 - RNA, 19 nt, Homo sapiens
guucuuugccagagaccua

SEQ ID NO: 141142 - RNA, 19 nt, Homo sapiens
cuaccgauaacccaccuaa

SEQ ID NO: 141143 - RNA, 19 nt, Homo sapiens
guacagccagguccagaag

SEQ ID NO: 141144 - RNA, 19 nt, Homo sapiens
gccagagaccuauuuaaaa

SEQ ID NO: 141145 - RNA, 19 nt, Homo sapiens
cccuggagaugcuggagaa

SEQ ID NO: 141146 - RNA, 19 nt, Homo sapiens
uaacccaccuaagcuuucu

SEQ ID NO: 141147 - RNA, 19 nt, Homo sapiens
cccagggccuuuaugaucu

SEQ ID NO: 141148 - RNA, 19 nt, Homo sapiens
caacggaagaaaccucucu

SEQ ID NO: 141149 - RNA, 19 nt, Homo sapiens
gcacagggaaaugacaucu

SEQ ID NO: 141150 - RNA, 19 nt, Homo sapiens
ggacaaggucauguucucu

SEQ ID NO: 141151 - RNA, 19 nt, Homo sapiens
agagcugacucccaugaag

SEQ ID NO: 141152 - RNA, 19 nt, Homo sapiens
agacggcacagggaaauga

SEQ ID NO: 141153 - RNA, 19 nt, Homo sapiens
gaggggccaugcuguguga

SEQ ID NO: 141154 - RNA, 19 nt, Homo sapiens
ggcacuagggaucaaagaa

SEQ ID NO: 141155 - RNA, 19 nt, Homo sapiens
ccagggccuuuaugaucug

SEQ ID NO: 141156 - RNA, 19 nt, Homo sapiens
uggagaugcuggagaacuc

SEQ ID NO: 141157 - RNA, 19 nt, Homo sapiens
gagggaguacaacggaaga

SEQ ID NO: 141158 - RNA, 19 nt, Homo sapiens
cgauaacccaccuaagcuu

SEQ ID NO: 141159 - RNA, 19 nt, Homo sapiens
ugcagacgcugugccgaaa

SEQ ID NO: 141160 - RNA, 19 nt, Homo sapiens
gaguagggacugacaagac

SEQ ID NO: 141161 - RNA, 19 nt, Homo sapiens
guggaggccucagggagau

SEQ ID NO: 141162 - RNA, 19 nt, Homo sapiens
ccaugaagauguuugaaua

SEQ ID NO: 141163 - RNA, 19 nt, Homo sapiens
guacaugugugcagacaaa

SEQ ID NO: 141164 - RNA, 19 nt, Homo sapiens
gacacaagcuccugaaaug

SEQ ID NO: 141165 - RNA, 19 nt, Homo sapiens
guacaugggauacaaauuu

SEQ ID NO: 141166 - RNA, 19 nt, Homo sapiens
gauacaaauuugagcagua

SEQ ID NO: 141167 - RNA, 19 nt, Homo sapiens
gagaggagcugagaagaca

SEQ ID NO: 141168 - RNA, 19 nt, Homo sapiens
gaagauguuugaauauguc

SEQ ID NO: 141169 - RNA, 19 nt, Homo sapiens
gcacgguuguccaggauga

SEQ ID NO: 141170 - RNA, 19 nt, Homo sapiens
ccacagacccugcccucua

SEQ ID NO: 141171 - RNA, 19 nt, Homo sapiens
gaaauggugggcucaguca

SEQ ID NO: 141172 - RNA, 19 nt, Homo sapiens
uugaauaugucaggaauga

SEQ ID NO: 141173 - RNA, 19 nt, Homo sapiens
ggaggaguuucuacagaca

SEQ ID NO: 141174 - RNA, 19 nt, Homo sapiens
cacugucgcugaaugauug

SEQ ID NO: 141175 - RNA, 19 nt, Homo sapiens
uaugguauguggaagcuau

SEQ ID NO: 141176 - RNA, 19 nt, Homo sapiens
gagcacgguuguccaggau

SEQ ID NO: 141177 - RNA, 19 nt, Homo sapiens
uacaugggauacaaauuug

SEQ ID NO: 141178 - RNA, 19 nt, Homo sapiens
caagagaggagcugagaag

SEQ ID NO: 141179 - RNA, 19 nt, Homo sapiens
cccaaauaguaaugcuuua

SEQ ID NO: 141180 - RNA, 19 nt, Homo sapiens
gggaggcagucauaucucu

SEQ ID NO: 141181 - RNA, 19 nt, Homo sapiens
uuagagggaggcagucaua

SEQ ID NO: 141182 - RNA, 19 nt, Homo sapiens
gagggaggcagucauaucu

SEQ ID NO: 141183 - RNA, 19 nt, Homo sapiens
ccucuacucugggcccuuu

SEQ ID NO: 141184 - RNA, 19 nt, Homo sapiens
acaccaagaugcaccuuac

SEQ ID NO: 141185 - RNA, 19 nt, Homo sapiens
acggauacccggaucgaua

SEQ ID NO: 141186 - RNA, 19 nt, Homo sapiens
ucguucaucucuucucuug

SEQ ID NO: 141187 - RNA, 19 nt, Homo sapiens
guuugaauaugucaggaau

SEQ ID NO: 141188 - RNA, 19 nt, Homo sapiens
gaagccacccucugcucuu

SEQ ID NO: 141189 - RNA, 19 nt, Homo sapiens
uagcugagccucggaacaa

SEQ ID NO: 141190 - RNA, 19 nt, Homo sapiens
caagacucccucucccaaa

SEQ ID NO: 141191 - RNA, 19 nt, Homo sapiens
uccgggagcuuauguacau

SEQ ID NO: 141192 - RNA, 19 nt, Homo sapiens
cucaagaccuuuccuacca

SEQ ID NO: 141193 - RNA, 19 nt, Homo sapiens
ccacugucgcugaaugauu

SEQ ID NO: 141194 - RNA, 19 nt, Homo sapiens
gaggagcugagaagacaga

SEQ ID NO: 141195 - RNA, 19 nt, Homo sapiens
agacacaagcuccugaaau

SEQ ID NO: 141196 - RNA, 19 nt, Homo sapiens
aagacucccucucccaaau

SEQ ID NO: 141197 - RNA, 19 nt, Homo sapiens
gaccuuuccuaccaugaag

SEQ ID NO: 141198 - RNA, 19 nt, Homo sapiens
acucugggcccuuuccuuu

SEQ ID NO: 141199 - RNA, 19 nt, Homo sapiens
gcucguucaucucuucucu

SEQ ID NO: 141200 - RNA, 19 nt, Homo sapiens
ucccaaauaguaaugcuuu

SEQ ID NO: 141201 - RNA, 19 nt, Homo sapiens
agacucccucucccaaaua

SEQ ID NO: 141202 - RNA, 19 nt, Homo sapiens
acgaggagguccaggaaag

SEQ ID NO: 141203 - RNA, 19 nt, Homo sapiens
cacagacccugcccucuac

SEQ ID NO: 141204 - RNA, 19 nt, Homo sapiens
ccaaauaguaaugcuuuag

SEQ ID NO: 141205 - RNA, 19 nt, Homo sapiens
ucaagaccuuuccuaccau

SEQ ID NO: 141206 - RNA, 19 nt, Homo sapiens
caaauuugagcaguacaug

SEQ ID NO: 141207 - RNA, 19 nt, Homo sapiens
auacaaauuugagcaguac

SEQ ID NO: 141208 - RNA, 19 nt, Homo sapiens
caggcucguucaucucuuc

SEQ ID NO: 141209 - RNA, 19 nt, Homo sapiens
caauggaggaguuucuaca

SEQ ID NO: 141210 - RNA, 19 nt, Homo sapiens
gacucccucucccaaauag

SEQ ID NO: 141211 - RNA, 19 nt, Homo sapiens
gaggcagucauaucucugu

SEQ ID NO: 141212 - RNA, 19 nt, Homo sapiens
acaccaacguggccuucug

SEQ ID NO: 141213 - RNA, 19 nt, Homo sapiens
gccaauggaggaguuucua

SEQ ID NO: 141214 - RNA, 19 nt, Homo sapiens
ggccuucugcucugugcua

SEQ ID NO: 141215 - RNA, 19 nt, Homo sapiens
cuucggaacugggcugcuu

SEQ ID NO: 141216 - RNA, 19 nt, Homo sapiens
ccaugaagauguuugaaua

SEQ ID NO: 141217 - RNA, 19 nt, Homo sapiens
guacaugugugcagacaaa

SEQ ID NO: 141218 - RNA, 19 nt, Homo sapiens
guacaugggauacaaauuu

SEQ ID NO: 141219 - RNA, 19 nt, Homo sapiens
gauacaaauuugagcagua

SEQ ID NO: 141220 - RNA, 19 nt, Homo sapiens
gagaggagcugagaagaca

SEQ ID NO: 141221 - RNA, 19 nt, Homo sapiens
gaagauguuugaauauguc

SEQ ID NO: 141222 - RNA, 19 nt, Homo sapiens
gcacgguuguccaggauga

SEQ ID NO: 141223 - RNA, 19 nt, Homo sapiens
ccacagacccugcccucua

SEQ ID NO: 141224 - RNA, 19 nt, Homo sapiens
uugaauaugucaggaauga

SEQ ID NO: 141225 - RNA, 19 nt, Homo sapiens
cacugucgcugaaugauug

SEQ ID NO: 141226 - RNA, 19 nt, Homo sapiens
uaugguauguggaagcuau

SEQ ID NO: 141227 - RNA, 19 nt, Homo sapiens
gagcacgguuguccaggau

SEQ ID NO: 141228 - RNA, 19 nt, Homo sapiens
uacaugggauacaaauuug

SEQ ID NO: 141229 - RNA, 19 nt, Homo sapiens
caagagaggagcugagaag

SEQ ID NO: 141230 - RNA, 19 nt, Homo sapiens
cccaaauaguaaugcuuua

SEQ ID NO: 141231 - RNA, 19 nt, Homo sapiens
gggaggcagucauaucucu

SEQ ID NO: 141232 - RNA, 19 nt, Homo sapiens
uuagagggaggcagucaua

SEQ ID NO: 141233 - RNA, 19 nt, Homo sapiens
gagggaggcagucauaucu

SEQ ID NO: 141234 - RNA, 19 nt, Homo sapiens
ccucuacucugggcccuuu

SEQ ID NO: 141235 - RNA, 19 nt, Homo sapiens
acaccaagaugcaccuuac

SEQ ID NO: 141236 - RNA, 19 nt, Homo sapiens
acggauacccggaucgaua

SEQ ID NO: 141237 - RNA, 19 nt, Homo sapiens
ucguucaucucuucucuug

SEQ ID NO: 141238 - RNA, 19 nt, Homo sapiens
guuugaauaugucaggaau

SEQ ID NO: 141239 - RNA, 19 nt, Homo sapiens
gaagccacccucugcucuu

SEQ ID NO: 141240 - RNA, 19 nt, Homo sapiens
uagcugagccucggaacaa

SEQ ID NO: 141241 - RNA, 19 nt, Homo sapiens
caagacucccucucccaaa

SEQ ID NO: 141242 - RNA, 19 nt, Homo sapiens
uccgggagcuuauguacau

SEQ ID NO: 141243 - RNA, 19 nt, Homo sapiens
ccacugucgcugaaugauu

SEQ ID NO: 141244 - RNA, 19 nt, Homo sapiens
gaggagcugagaagacaga

SEQ ID NO: 141245 - RNA, 19 nt, Homo sapiens
aagacucccucucccaaau

SEQ ID NO: 141246 - RNA, 19 nt, Homo sapiens
gaccuuuccuaccaugaag

SEQ ID NO: 141247 - RNA, 19 nt, Homo sapiens
acucugggcccuuuccuuu

SEQ ID NO: 141248 - RNA, 19 nt, Homo sapiens
gcucguucaucucuucucu

SEQ ID NO: 141249 - RNA, 19 nt, Homo sapiens
ucccaaauaguaaugcuuu

SEQ ID NO: 141250 - RNA, 19 nt, Homo sapiens
agacucccucucccaaaua

SEQ ID NO: 141251 - RNA, 19 nt, Homo sapiens
acgaggagguccaggaaag

SEQ ID NO: 141252 - RNA, 19 nt, Homo sapiens
cacagacccugcccucuac

SEQ ID NO: 141253 - RNA, 19 nt, Homo sapiens
ccaaauaguaaugcuuuag

SEQ ID NO: 141254 - RNA, 19 nt, Homo sapiens
caaauuugagcaguacaug

SEQ ID NO: 141255 - RNA, 19 nt, Homo sapiens
auacaaauuugagcaguac

SEQ ID NO: 141256 - RNA, 19 nt, Homo sapiens
caggcucguucaucucuuc

SEQ ID NO: 141257 - RNA, 19 nt, Homo sapiens
gacucccucucccaaauag

SEQ ID NO: 141258 - RNA, 19 nt, Homo sapiens
gggagaccuuuccuaccau

SEQ ID NO: 141259 - RNA, 19 nt, Homo sapiens
gaggcagucauaucucugu

SEQ ID NO: 141260 - RNA, 19 nt, Homo sapiens
ggggagaccuuuccuacca

SEQ ID NO: 141261 - RNA, 19 nt, Homo sapiens
acaccaacguggccuucug

SEQ ID NO: 141262 - RNA, 19 nt, Homo sapiens
ggccuucugcucugugcua

SEQ ID NO: 141263 - RNA, 19 nt, Homo sapiens
cuucggaacugggcugcuu

SEQ ID NO: 141264 - RNA, 19 nt, Homo sapiens
ggagauaccuucuguuacu

SEQ ID NO: 141265 - RNA, 19 nt, Homo sapiens
gagaugagcuauuccaagu

SEQ ID NO: 141266 - RNA, 19 nt, Homo sapiens
gcaagaccaugcuacuauu

SEQ ID NO: 141267 - RNA, 19 nt, Homo sapiens
gaugagcuauuccaaguuc

SEQ ID NO: 141268 - RNA, 19 nt, Homo sapiens
cuugauacauuguccuuua

SEQ ID NO: 141269 - RNA, 19 nt, Homo sapiens
gcaguguucuguaccaaug

SEQ ID NO: 141270 - RNA, 19 nt, Homo sapiens
gacugaagauggugaauuc

SEQ ID NO: 141271 - RNA, 19 nt, Homo sapiens
cucaucaacuugcuacuua

SEQ ID NO: 141272 - RNA, 19 nt, Homo sapiens
guucgacucuucuaugaug

SEQ ID NO: 141273 - RNA, 19 nt, Homo sapiens
guaccaaugccaucaauau

SEQ ID NO: 141274 - RNA, 19 nt, Homo sapiens
gacagcagaucccagaauc

SEQ ID NO: 141275 - RNA, 19 nt, Homo sapiens
ugggagauaccuucuguua

SEQ ID NO: 141276 - RNA, 19 nt, Homo sapiens
ccuagaggcuggccaguca

SEQ ID NO: 141277 - RNA, 19 nt, Homo sapiens
gcaguuauccacacucaca

SEQ ID NO: 141278 - RNA, 19 nt, Homo sapiens
cugagucccuugauacauu

SEQ ID NO: 141279 - RNA, 19 nt, Homo sapiens
gagagaaaccucacauugc

SEQ ID NO: 141280 - RNA, 19 nt, Homo sapiens
gauaccuucuguuacuuug

SEQ ID NO: 141281 - RNA, 19 nt, Homo sapiens
gcugacuacugauuggauu

SEQ ID NO: 141282 - RNA, 19 nt, Homo sapiens
uaaaguccuugggcccaua

SEQ ID NO: 141283 - RNA, 19 nt, Homo sapiens
gacaugucauuugauugua

SEQ ID NO: 141284 - RNA, 19 nt, Homo sapiens
uauccacacucacauuuca

SEQ ID NO: 141285 - RNA, 19 nt, Homo sapiens
ccugauaggugcccuccuu

SEQ ID NO: 141286 - RNA, 19 nt, Homo sapiens
gcccucugcugacuacuga

SEQ ID NO: 141287 - RNA, 19 nt, Homo sapiens
gagauaccuucuguuacuu

SEQ ID NO: 141288 - RNA, 19 nt, Homo sapiens
gccagucacuagucauuuc

SEQ ID NO: 141289 - RNA, 19 nt, Homo sapiens
caauggagacaauaaagug

SEQ ID NO: 141290 - RNA, 19 nt, Homo sapiens
gcaaacuggagaugagcua

SEQ ID NO: 141291 - RNA, 19 nt, Homo sapiens
ggaauccuguacuaugucu

SEQ ID NO: 141292 - RNA, 19 nt, Homo sapiens
uuccugaacugcuuuguga

SEQ ID NO: 141293 - RNA, 19 nt, Homo sapiens
agagaaaccucacauugcu

SEQ ID NO: 141294 - RNA, 19 nt, Homo sapiens
ugccucagcuccugcauau

SEQ ID NO: 141295 - RNA, 19 nt, Homo sapiens
gggcuuugcggaugaugua

SEQ ID NO: 141296 - RNA, 19 nt, Homo sapiens
ccucagcuccugcauauca

SEQ ID NO: 141297 - RNA, 19 nt, Homo sapiens
acucuucuaugaugucuga

SEQ ID NO: 141298 - RNA, 19 nt, Homo sapiens
cauaagcugcugcuaccua

SEQ ID NO: 141299 - RNA, 19 nt, Homo sapiens
ucaucaacuugcuacuuaa

SEQ ID NO: 141300 - RNA, 19 nt, Homo sapiens
cauuucugcuuccaucauu

SEQ ID NO: 141301 - RNA, 19 nt, Homo sapiens
ugccgcugcugaucaauuu

SEQ ID NO: 141302 - RNA, 19 nt, Homo sapiens
gagugagacugaagauggu

SEQ ID NO: 141303 - RNA, 19 nt, Homo sapiens
ugacaguacaccagaguga

SEQ ID NO: 141304 - RNA, 19 nt, Homo sapiens
ucgggaugaucaugucuuu

SEQ ID NO: 141305 - RNA, 19 nt, Homo sapiens
ugggaauccuguacuaugu

SEQ ID NO: 141306 - RNA, 19 nt, Homo sapiens
ccaugccgcugcugaucaa

SEQ ID NO: 141307 - RNA, 19 nt, Homo sapiens
ggauugcucuaccacaacu

SEQ ID NO: 141308 - RNA, 19 nt, Homo sapiens
cggaugauguacugaaucu

SEQ ID NO: 141309 - RNA, 19 nt, Homo sapiens
uggagacaauaaaguguug

SEQ ID NO: 141310 - RNA, 19 nt, Homo sapiens
guuauccacacucacauuu

SEQ ID NO: 141311 - RNA, 19 nt, Homo sapiens
ugaacugcuuugugaagga

SEQ ID NO: 141312 - RNA, 19 nt, Homo sapiens
caucaacuugcuacuuaaa

SEQ ID NO: 141313 - RNA, 19 nt, Homo sapiens
ccacaacugguacccauca

SEQ ID NO: 141314 - RNA, 19 nt, Homo sapiens
ugggauugcucuaccacaa

SEQ ID NO: 141315 - RNA, 19 nt, Homo sapiens
gccacaugcucucaaugga

SEQ ID NO: 141316 - RNA, 19 nt, Homo sapiens
ugagucccuugauacauug

SEQ ID NO: 141317 - RNA, 19 nt, Homo sapiens
ucguucgacucuucuauga

SEQ ID NO: 141318 - RNA, 19 nt, Homo sapiens
ccgcauacccagacucaau

SEQ ID NO: 141319 - RNA, 19 nt, Homo sapiens
ucacuagucauuucugcuu

SEQ ID NO: 141320 - RNA, 19 nt, Homo sapiens
gaauuuguggcccugauag

SEQ ID NO: 141321 - RNA, 19 nt, Homo sapiens
ggccagggcuaggaacaca

SEQ ID NO: 141322 - RNA, 19 nt, Homo sapiens
ggugggauacagcagcuuu

SEQ ID NO: 141323 - RNA, 19 nt, Homo sapiens
uucauacuccuccauauuu

SEQ ID NO: 141324 - RNA, 19 nt, Homo sapiens
gcccauacaugagagaaac

SEQ ID NO: 141325 - RNA, 19 nt, Homo sapiens
ugaauuuguggcccugaua

SEQ ID NO: 141326 - RNA, 19 nt, Homo sapiens
cgacagcagaucccagaau

SEQ ID NO: 141327 - RNA, 19 nt, Homo sapiens
caggcaaacuggagaugag

SEQ ID NO: 141328 - RNA, 19 nt, Homo sapiens
uacccagacucaauaucaa

SEQ ID NO: 141329 - RNA, 19 nt, Homo sapiens
agaccaugcuacuauucuu

SEQ ID NO: 141330 - RNA, 19 nt, Homo sapiens
ugugggagauaccuucugu

SEQ ID NO: 141331 - RNA, 19 nt, Homo sapiens
ggacuugggaauccuguac

SEQ ID NO: 141332 - RNA, 19 nt, Homo sapiens
cuucauacuccuccauauu

SEQ ID NO: 141333 - RNA, 19 nt, Homo sapiens
ucagcucguucgacucuuc

SEQ ID NO: 141334 - RNA, 19 nt, Homo sapiens
aaacuggagaugagcuauu

SEQ ID NO: 141335 - RNA, 19 nt, Homo sapiens
cgcauacccagacucaaua

SEQ ID NO: 141336 - RNA, 19 nt, Homo sapiens
gcuggccagucacuaguca

SEQ ID NO: 141337 - RNA, 19 nt, Homo sapiens
ccucacagucucuaggauu

SEQ ID NO: 141338 - RNA, 19 nt, Homo sapiens
caagaccaugcuacuauuc

SEQ ID NO: 141339 - RNA, 19 nt, Homo sapiens
ucuucaaccugguagaguu

SEQ ID NO: 141340 - RNA, 19 nt, Homo sapiens
ucaauggagacaauaaagu

SEQ ID NO: 141341 - RNA, 19 nt, Homo sapiens
uaucaagacaggcaaacug

SEQ ID NO: 141342 - RNA, 19 nt, Homo sapiens
ggagcaguguaaggcauuc

SEQ ID NO: 141343 - RNA, 19 nt, Homo sapiens
gcauacccagacucaauau

SEQ ID NO: 141344 - RNA, 19 nt, Homo sapiens
gccaucugcugcaugaucu

SEQ ID NO: 141345 - RNA, 19 nt, Homo sapiens
ccaaugccaucaauauccu

SEQ ID NO: 141346 - RNA, 19 nt, Homo sapiens
accuacagcugccucacua

SEQ ID NO: 141347 - RNA, 19 nt, Homo sapiens
gaccaugcuacuauucuuc

SEQ ID NO: 141348 - RNA, 19 nt, Homo sapiens
uuucaccacuuugggauug

SEQ ID NO: 141349 - RNA, 19 nt, Homo sapiens
cuugccaucugcugcauga

SEQ ID NO: 141350 - RNA, 19 nt, Homo sapiens
cucacuaccucuccucaug

SEQ ID NO: 141351 - RNA, 19 nt, Homo sapiens
caccuucuccauucgauau

SEQ ID NO: 141352 - RNA, 19 nt, Homo sapiens
caauaucaagacaggcaaa

SEQ ID NO: 141353 - RNA, 19 nt, Homo sapiens
cagacucaauaucaagaca

SEQ ID NO: 141354 - RNA, 19 nt, Homo sapiens
guucaacuuccucuacuca

SEQ ID NO: 141355 - RNA, 19 nt, Homo sapiens
uugggacacuucagcaaga

SEQ ID NO: 141356 - RNA, 19 nt, Homo sapiens
ggccacaugcucucaaugg

SEQ ID NO: 141357 - RNA, 19 nt, Homo sapiens
agacugaagauggugaauu

SEQ ID NO: 141358 - RNA, 19 nt, Homo sapiens
auacccagacucaauauca

SEQ ID NO: 141359 - RNA, 19 nt, Homo sapiens
ccaugccucucucacucuu

SEQ ID NO: 141360 - RNA, 19 nt, Homo sapiens
ucaacuuccucuacucacu

SEQ ID NO: 141361 - RNA, 19 nt, Homo sapiens
gaggcuggccagucacuag

SEQ ID NO: 141362 - RNA, 19 nt, Homo sapiens
ggucuauuucaccaacuuu

SEQ ID NO: 141363 - RNA, 19 nt, Homo sapiens
caucuggacuugggaaucc

SEQ ID NO: 141364 - RNA, 19 nt, Homo sapiens
ggagguggcuguucuguag

SEQ ID NO: 141365 - RNA, 19 nt, Homo sapiens
ggaggacgcuggagcagau

SEQ ID NO: 141366 - RNA, 19 nt, Homo sapiens
cgacuuggcucacgugucu

SEQ ID NO: 141367 - RNA, 19 nt, Homo sapiens
uggcaggacugaacuugaa

SEQ ID NO: 141368 - RNA, 19 nt, Homo sapiens
gaacuucuacaacaauuac

SEQ ID NO: 141369 - RNA, 19 nt, Homo sapiens
gggccaaccugaccaccuu

SEQ ID NO: 141370 - RNA, 19 nt, Homo sapiens
gagaggacgccugggcuua

SEQ ID NO: 141371 - RNA, 19 nt, Homo sapiens
ggacuuugaugguguucca

SEQ ID NO: 141372 - RNA, 19 nt, Homo sapiens
ucaaggagguggcuguucu

SEQ ID NO: 141373 - RNA, 19 nt, Homo sapiens
gaagguggccagccugauc

SEQ ID NO: 141374 - RNA, 19 nt, Homo sapiens
ccggagaccuuccuguaug

SEQ ID NO: 141375 - RNA, 19 nt, Homo sapiens
gaggacgucuccaaguauc

SEQ ID NO: 141376 - RNA, 19 nt, Homo sapiens
gugaacuucuacaacaauu

SEQ ID NO: 141377 - RNA, 19 nt, Homo sapiens
ggauguacccggagaccuu

SEQ ID NO: 141378 - RNA, 19 nt, Homo sapiens
ggacaguucaggacacaca

SEQ ID NO: 141379 - RNA, 19 nt, Homo sapiens
caccagcagugcaggcauu

SEQ ID NO: 141380 - RNA, 19 nt, Homo sapiens
cuacaacaauuacauuucc

SEQ ID NO: 141381 - RNA, 19 nt, Homo sapiens
gaacuugaacaccagaaac

SEQ ID NO: 141382 - RNA, 19 nt, Homo sapiens
ucaggacacacacacagua

SEQ ID NO: 141383 - RNA, 19 nt, Homo sapiens
ccaaguggccgaccaucug

SEQ ID NO: 141384 - RNA, 19 nt, Homo sapiens
gucugucucuccugugaaa

SEQ ID NO: 141385 - RNA, 19 nt, Homo sapiens
ccaaguauccagaccugau

SEQ ID NO: 141386 - RNA, 19 nt, Homo sapiens
gagccagagccguggguuu

SEQ ID NO: 141387 - RNA, 19 nt, Homo sapiens
gcgacacccagaacaaaga

SEQ ID NO: 141388 - RNA, 19 nt, Homo sapiens
cggagaccuuccuguaugu

SEQ ID NO: 141389 - RNA, 19 nt, Homo sapiens
ggacuccccugucauugau

SEQ ID NO: 141390 - RNA, 19 nt, Homo sapiens
ccaucuggaucacaucaag

SEQ ID NO: 141391 - RNA, 19 nt, Homo sapiens
ggugaacuucuacaacaau

SEQ ID NO: 141392 - RNA, 19 nt, Homo sapiens
auggugaacuucuacaaca

SEQ ID NO: 141393 - RNA, 19 nt, Homo sapiens
ggcagcguguggugaagga

SEQ ID NO: 141394 - RNA, 19 nt, Homo sapiens
cagacagccuggugauggu

SEQ ID NO: 141395 - RNA, 19 nt, Homo sapiens
caccgcaugugccggaugu

SEQ ID NO: 141396 - RNA, 19 nt, Homo sapiens
uacauuuccugcaccaaca

SEQ ID NO: 141397 - RNA, 19 nt, Homo sapiens
ugaacuugaacaccagaaa

SEQ ID NO: 141398 - RNA, 19 nt, Homo sapiens
gcacugcagacuucuuucg

SEQ ID NO: 141399 - RNA, 19 nt, Homo sapiens
gaccaucuggaucacauca

SEQ ID NO: 141400 - RNA, 19 nt, Homo sapiens
caaguauccagaccugauc

SEQ ID NO: 141401 - RNA, 19 nt, Homo sapiens
aggccaaccugucccaagu

SEQ ID NO: 141402 - RNA, 19 nt, Homo sapiens
uggugaacuucuacaacaa

SEQ ID NO: 141403 - RNA, 19 nt, Homo sapiens
gauggugaacuucuacaac

SEQ ID NO: 141404 - RNA, 19 nt, Homo sapiens
gaggcagagaggaucauga

SEQ ID NO: 141405 - RNA, 19 nt, Homo sapiens
gagaccuuccuguauguca

SEQ ID NO: 141406 - RNA, 19 nt, Homo sapiens
ggagagcccuggauuagga

SEQ ID NO: 141407 - RNA, 19 nt, Homo sapiens
gcaaaguccuauccagaga

SEQ ID NO: 141408 - RNA, 19 nt, Homo sapiens
agacaacuaucaauucuug

SEQ ID NO: 141409 - RNA, 19 nt, Homo sapiens
cauggugacugccacauaa

SEQ ID NO: 141410 - RNA, 19 nt, Homo sapiens
ccugggagcugacuucuug

SEQ ID NO: 141411 - RNA, 19 nt, Homo sapiens
agugaaagaucaagaaaug

SEQ ID NO: 141412 - RNA, 19 nt, Homo sapiens
ggaccaguuugcagaguga

SEQ ID NO: 141413 - RNA, 19 nt, Homo sapiens
ggucagcaccauucaguuu

SEQ ID NO: 141414 - RNA, 19 nt, Homo sapiens
agaaaugucucugcuccua

SEQ ID NO: 141415 - RNA, 19 nt, Homo sapiens
ggaaggccuccuccucuuu

SEQ ID NO: 141416 - RNA, 19 nt, Homo sapiens
cuugagacccaaauuauaa

SEQ ID NO: 141417 - RNA, 19 nt, Homo sapiens
gaaggccuccuccucuuug

SEQ ID NO: 141418 - RNA, 19 nt, Homo sapiens
gcauuggguucaaggaauc

SEQ ID NO: 141419 - RNA, 19 nt, Homo sapiens
ggugacugccacauaauaa

SEQ ID NO: 141420 - RNA, 19 nt, Homo sapiens
gcuagcagcccuugugugu

SEQ ID NO: 141421 - RNA, 19 nt, Homo sapiens
ccacgucucuccauugacu

SEQ ID NO: 141422 - RNA, 19 nt, Homo sapiens
guccacgucucuccauuga

SEQ ID NO: 141423 - RNA, 19 nt, Homo sapiens
ggccacaguugccugauuc

SEQ ID NO: 141424 - RNA, 19 nt, Homo sapiens
caacuacaacuuugagauc

SEQ ID NO: 141425 - RNA, 19 nt, Homo sapiens
ucuggagucugucaugauu

SEQ ID NO: 141426 - RNA, 19 nt, Homo sapiens
gguggaggccguuguguau

SEQ ID NO: 141427 - RNA, 19 nt, Homo sapiens
guuaagagacaacuaucaa

SEQ ID NO: 141428 - RNA, 19 nt, Homo sapiens
ggcauuggguucaaggaau

SEQ ID NO: 141429 - RNA, 19 nt, Homo sapiens
guggauaucuuggaaaggu

SEQ ID NO: 141430 - RNA, 19 nt, Homo sapiens
ugaggcugcugcucucuga

SEQ ID NO: 141431 - RNA, 19 nt, Homo sapiens
auaaaguggugauuuccaa

SEQ ID NO: 141432 - RNA, 19 nt, Homo sapiens
agagacaacuaucaauucu

SEQ ID NO: 141433 - RNA, 19 nt, Homo sapiens
caucuggagucugucauga

SEQ ID NO: 141434 - RNA, 19 nt, Homo sapiens
cagaaccaguuaagagaca

SEQ ID NO: 141435 - RNA, 19 nt, Homo sapiens
ccacugcccgcucagcuaa

SEQ ID NO: 141436 - RNA, 19 nt, Homo sapiens
aaacaugaauaugguugga

SEQ ID NO: 141437 - RNA, 19 nt, Homo sapiens
gguccugccuuccaacuac

SEQ ID NO: 141438 - RNA, 19 nt, Homo sapiens
guuggagagcccuggauua

SEQ ID NO: 141439 - RNA, 19 nt, Homo sapiens
gagcacaaggccuuaaugg

SEQ ID NO: 141440 - RNA, 19 nt, Homo sapiens
gaaagaucaagaaaugucu

SEQ ID NO: 141441 - RNA, 19 nt, Homo sapiens
guaccauuguggauaucuu

SEQ ID NO: 141442 - RNA, 19 nt, Homo sapiens
ccuguaccauuguggauau

SEQ ID NO: 141443 - RNA, 19 nt, Homo sapiens
gaaaacgcaaacaugaaua

SEQ ID NO: 141444 - RNA, 19 nt, Homo sapiens
uauaagggcccugccugua

SEQ ID NO: 141445 - RNA, 19 nt, Homo sapiens
caacaagcccaggccaaga

SEQ ID NO: 141446 - RNA, 19 nt, Homo sapiens
ugaaagaucaagaaauguc

SEQ ID NO: 141447 - RNA, 19 nt, Homo sapiens
ccagggcaguccuaagauc

SEQ ID NO: 141448 - RNA, 19 nt, Homo sapiens
cggaaggccuccuccucuu

SEQ ID NO: 141449 - RNA, 19 nt, Homo sapiens
gcagagugaaagaucaaga

SEQ ID NO: 141450 - RNA, 19 nt, Homo sapiens
cagcaagcuuagccuacuu

SEQ ID NO: 141451 - RNA, 19 nt, Homo sapiens
cauuguggauaucuuggaa

SEQ ID NO: 141452 - RNA, 19 nt, Homo sapiens
ggauuaggagggugacaug

SEQ ID NO: 141453 - RNA, 19 nt, Homo sapiens
acgcaaacaugaauauggu

SEQ ID NO: 141454 - RNA, 19 nt, Homo sapiens
aaaugucucugcuccuaca

SEQ ID NO: 141455 - RNA, 19 nt, Homo sapiens
ccaggacccuccacucacu

SEQ ID NO: 141456 - RNA, 19 nt, Homo sapiens
cagagugaaagaucaagaa

SEQ ID NO: 141457 - RNA, 19 nt, Homo sapiens
cgucaggccuaccucaagu

SEQ ID NO: 141458 - RNA, 19 nt, Homo sapiens
caaaguccuauccagagaa

SEQ ID NO: 141459 - RNA, 19 nt, Homo sapiens
uaaaguggugauuuccaaa

SEQ ID NO: 141460 - RNA, 19 nt, Homo sapiens
ccauggugacugccacaua

SEQ ID NO: 141461 - RNA, 19 nt, Homo sapiens
ucuugagacccaaauuaua

SEQ ID NO: 141462 - RNA, 19 nt, Homo sapiens
gagugaaagaucaagaaau

SEQ ID NO: 141463 - RNA, 19 nt, Homo sapiens
ugacggccuucuugguuuc

SEQ ID NO: 141464 - RNA, 19 nt, Homo sapiens
ucagcaccauucaguuugu

SEQ ID NO: 141465 - RNA, 19 nt, Homo sapiens
guacgucuuuguggacauc

SEQ ID NO: 141466 - RNA, 19 nt, Homo sapiens
ccaagaccaucuggaggau

SEQ ID NO: 141467 - RNA, 19 nt, Homo sapiens
ggagcacaaggccuuaaug

SEQ ID NO: 141468 - RNA, 19 nt, Homo sapiens
aagagacaacuaucaauuc

SEQ ID NO: 141469 - RNA, 19 nt, Homo sapiens
gggcauuggguucaaggaa

SEQ ID NO: 141470 - RNA, 19 nt, Homo sapiens
uaagggcccugccuguacu

SEQ ID NO: 141471 - RNA, 19 nt, Homo sapiens
aggccuaccucaaguucuu

SEQ ID NO: 141472 - RNA, 19 nt, Homo sapiens
uugacggccuucuugguuu

SEQ ID NO: 141473 - RNA, 19 nt, Homo sapiens
ccucgaggcuggugguuuu

SEQ ID NO: 141474 - RNA, 19 nt, Homo sapiens
gauccuggagcaccuggaa

SEQ ID NO: 141475 - RNA, 19 nt, Homo sapiens
ggaggccguuguguaucuu

SEQ ID NO: 141476 - RNA, 19 nt, Homo sapiens
cggccacaguugccugauu

SEQ ID NO: 141477 - RNA, 19 nt, Homo sapiens
gugacugccacauaauaaa

SEQ ID NO: 141478 - RNA, 19 nt, Homo sapiens
ccucuuugccuguaccauu

SEQ ID NO: 141479 - RNA, 19 nt, Homo sapiens
gacauugacuugugaaaac

SEQ ID NO: 141480 - RNA, 19 nt, Homo sapiens
cuuggugucugguuucugu

SEQ ID NO: 141481 - RNA, 19 nt, Homo sapiens
ccuacccgauggacuucua

SEQ ID NO: 141482 - RNA, 19 nt, Homo sapiens
ggacauugacuugugaaaa

SEQ ID NO: 141483 - RNA, 19 nt, Homo sapiens
gaagaaaaggggagcacaa

SEQ ID NO: 141484 - RNA, 19 nt, Homo sapiens
gagcaggaggccgacguuu

SEQ ID NO: 141485 - RNA, 19 nt, Homo sapiens
cgccagggcaguccuaaga

SEQ ID NO: 141486 - RNA, 19 nt, Homo sapiens
ccgaguaucgugugagugu

SEQ ID NO: 141487 - RNA, 19 nt, Homo sapiens
ggcccugccuguacugaag

SEQ ID NO: 141488 - RNA, 19 nt, Homo sapiens
auucuugagacccaaauua

SEQ ID NO: 141489 - RNA, 19 nt, Homo sapiens
gagacaacuaucaauucuu

SEQ ID NO: 141490 - RNA, 19 nt, Homo sapiens
ccagcaagcuuagccuacu

SEQ ID NO: 141491 - RNA, 19 nt, Homo sapiens
ugacccauauagcaaaguc

SEQ ID NO: 141492 - RNA, 19 nt, Homo sapiens
ggagcugaaagccgaguau

SEQ ID NO: 141493 - RNA, 19 nt, Homo sapiens
ccaacuacaacuuugagau

SEQ ID NO: 141494 - RNA, 19 nt, Homo sapiens
agagugaaagaucaagaaa

SEQ ID NO: 141495 - RNA, 19 nt, Homo sapiens
gcaggaggccgacguuuuc

SEQ ID NO: 141496 - RNA, 19 nt, Homo sapiens
ccuugggccuuuccuuugu

SEQ ID NO: 141497 - RNA, 19 nt, Homo sapiens
gccuuauucugggcacuuu

SEQ ID NO: 141498 - RNA, 19 nt, Homo sapiens
gcugaaagccgaguaucgu

SEQ ID NO: 141499 - RNA, 19 nt, Homo sapiens
guggacauccggauagaca

SEQ ID NO: 141500 - RNA, 19 nt, Homo sapiens
ugacugccacauaauaaag

SEQ ID NO: 141501 - RNA, 19 nt, Homo sapiens
uggaggccguuguguaucu

SEQ ID NO: 141502 - RNA, 19 nt, Homo sapiens
gguuggagagcccuggauu

SEQ ID NO: 141503 - RNA, 19 nt, Homo sapiens
ccccugagauccugaagaa

SEQ ID NO: 141504 - RNA, 19 nt, Homo sapiens
aaagccgaguaucguguga

SEQ ID NO: 141505 - RNA, 19 nt, Homo sapiens
uggugacugccacauaaua

SEQ ID NO: 141506 - RNA, 19 nt, Homo sapiens
gaucacagcaaccuaaaua

SEQ ID NO: 141507 - RNA, 19 nt, Homo sapiens
ggucaaagauguucauucu

SEQ ID NO: 141508 - RNA, 19 nt, Homo sapiens
gcaguucccugaccagcua

SEQ ID NO: 141509 - RNA, 19 nt, Homo sapiens
ccagacgugucacucauua

SEQ ID NO: 141510 - RNA, 19 nt, Homo sapiens
guacaguagccacuaaaua

SEQ ID NO: 141511 - RNA, 19 nt, Homo sapiens
ggaugucuuugugcuauua

SEQ ID NO: 141512 - RNA, 19 nt, Homo sapiens
ggauugccaucgccuauga

SEQ ID NO: 141513 - RNA, 19 nt, Homo sapiens
ggagaucacagcaaccuaa

SEQ ID NO: 141514 - RNA, 19 nt, Homo sapiens
ggaggcgucuagaagagua

SEQ ID NO: 141515 - RNA, 19 nt, Homo sapiens
cauggaagcuuggcucuga

SEQ ID NO: 141516 - RNA, 19 nt, Homo sapiens
cuaaauacauguggcuaaa

SEQ ID NO: 141517 - RNA, 19 nt, Homo sapiens
ccagauaauucuuuguugu

SEQ ID NO: 141518 - RNA, 19 nt, Homo sapiens
ggucuauacugacucuuau

SEQ ID NO: 141519 - RNA, 19 nt, Homo sapiens
caaccuaaauaaaccagau

SEQ ID NO: 141520 - RNA, 19 nt, Homo sapiens
ucacagcaaccuaaauaaa

SEQ ID NO: 141521 - RNA, 19 nt, Homo sapiens
uagauggacuuaugaaugg

SEQ ID NO: 141522 - RNA, 19 nt, Homo sapiens
ccaguacaguagccacuaa

SEQ ID NO: 141523 - RNA, 19 nt, Homo sapiens
acauguggcuaaacuuaaa

SEQ ID NO: 141524 - RNA, 19 nt, Homo sapiens
caacuucccugagguggau

SEQ ID NO: 141525 - RNA, 19 nt, Homo sapiens
ggagacauagauggacuua

SEQ ID NO: 141526 - RNA, 19 nt, Homo sapiens
auacauguggcuaaacuua

SEQ ID NO: 141527 - RNA, 19 nt, Homo sapiens
ccugcagccucauuccuua

SEQ ID NO: 141528 - RNA, 19 nt, Homo sapiens
guagagagggccagagaug

SEQ ID NO: 141529 - RNA, 19 nt, Homo sapiens
uuguuuggcugauggaaua

SEQ ID NO: 141530 - RNA, 19 nt, Homo sapiens
ucacauuagucauucaagu

SEQ ID NO: 141531 - RNA, 19 nt, Homo sapiens
gccagauaauucuuuguug

SEQ ID NO: 141532 - RNA, 19 nt, Homo sapiens
guauggugccuucuaugua

SEQ ID NO: 141533 - RNA, 19 nt, Homo sapiens
cucaggcucucauacauuu

SEQ ID NO: 141534 - RNA, 19 nt, Homo sapiens
ugagguggaugucuuugug

SEQ ID NO: 141535 - RNA, 19 nt, Homo sapiens
cugccaagcuugccaacuu

SEQ ID NO: 141536 - RNA, 19 nt, Homo sapiens
cagggaagacucaggauga

SEQ ID NO: 141537 - RNA, 19 nt, Homo sapiens
uacaggauaugccaucaug

SEQ ID NO: 141538 - RNA, 19 nt, Homo sapiens
auaaagggcuuagggacuu

SEQ ID NO: 141539 - RNA, 19 nt, Homo sapiens
caaaugaucauggaagcuu

SEQ ID NO: 141540 - RNA, 19 nt, Homo sapiens
uauggugccuucuauguag

SEQ ID NO: 141541 - RNA, 19 nt, Homo sapiens
gaccagcuauugggagaug

SEQ ID NO: 141542 - RNA, 19 nt, Homo sapiens
cagugcagcuacaggauau

SEQ ID NO: 141543 - RNA, 19 nt, Homo sapiens
caguuucucagucacauua

SEQ ID NO: 141544 - RNA, 19 nt, Homo sapiens
ccaguaaugcguguuguuu

SEQ ID NO: 141545 - RNA, 19 nt, Homo sapiens
gccuggaagucaucaaaug

SEQ ID NO: 141546 - RNA, 19 nt, Homo sapiens
ccugagggcugcucuagag

SEQ ID NO: 141547 - RNA, 19 nt, Homo sapiens
guggaugucuuugugcuau

SEQ ID NO: 141548 - RNA, 19 nt, Homo sapiens
gcucaggcucucauacauu

SEQ ID NO: 141549 - RNA, 19 nt, Homo sapiens
ggccagauaauucuuuguu

SEQ ID NO: 141550 - RNA, 19 nt, Homo sapiens
caaacucguacuugacauu

SEQ ID NO: 141551 - RNA, 19 nt, Homo sapiens
cacauuaugcggacuuauu

SEQ ID NO: 141552 - RNA, 19 nt, Homo sapiens
agaguauggugccuucuau

SEQ ID NO: 141553 - RNA, 19 nt, Homo sapiens
gagacgacagggucaaaga

SEQ ID NO: 141554 - RNA, 19 nt, Homo sapiens
gagaucacagcaaccuaaa

SEQ ID NO: 141555 - RNA, 19 nt, Homo sapiens
aaauacauguggcuaaacu

SEQ ID NO: 141556 - RNA, 19 nt, Homo sapiens
gagggucuguccuugucaa

SEQ ID NO: 141557 - RNA, 19 nt, Homo sapiens
gcagccucauuccuuaguu

SEQ ID NO: 141558 - RNA, 19 nt, Homo sapiens
gugaggcacuggcccacuu

SEQ ID NO: 141559 - RNA, 19 nt, Homo sapiens
cucauggagucgauguuua

SEQ ID NO: 141560 - RNA, 19 nt, Homo sapiens
cccaugcccuggaggcuuu

SEQ ID NO: 141561 - RNA, 19 nt, Homo sapiens
aagcucaguuucucaguca

SEQ ID NO: 141562 - RNA, 19 nt, Homo sapiens
cuccagaccuuggcaaaug

SEQ ID NO: 141563 - RNA, 19 nt, Homo sapiens
cgacagggucaaagauguu

SEQ ID NO: 141564 - RNA, 19 nt, Homo sapiens
ucagucacauuagucauuc

SEQ ID NO: 141565 - RNA, 19 nt, Homo sapiens
ggaccuggacggaguguac

SEQ ID NO: 141566 - RNA, 19 nt, Homo sapiens
uacaguagccacuaaauac

SEQ ID NO: 141567 - RNA, 19 nt, Homo sapiens
gcugaaggccgacugugau

SEQ ID NO: 141568 - RNA, 19 nt, Homo sapiens
ccacuagacaucagaagca

SEQ ID NO: 141569 - RNA, 19 nt, Homo sapiens
auagauggacuuaugaaug

SEQ ID NO: 141570 - RNA, 19 nt, Homo sapiens
ggacugcuuacuccucuuc

SEQ ID NO: 141571 - RNA, 19 nt, Homo sapiens
uacugacucuuauuucuca

SEQ ID NO: 141572 - RNA, 19 nt, Homo sapiens
gacgacagggucaaagaug

SEQ ID NO: 141573 - RNA, 19 nt, Homo sapiens
cagauaauucuuuguugug

SEQ ID NO: 141574 - RNA, 19 nt, Homo sapiens
aaacucguacuugacauuu

SEQ ID NO: 141575 - RNA, 19 nt, Homo sapiens
ucauucaaguguucagaca

SEQ ID NO: 141576 - RNA, 19 nt, Homo sapiens
ggcagcccuucacaggaua

SEQ ID NO: 141577 - RNA, 19 nt, Homo sapiens
agucagagcugugggaaac

SEQ ID NO: 141578 - RNA, 19 nt, Homo sapiens
gaagacgauaucugguaga

SEQ ID NO: 141579 - RNA, 19 nt, Homo sapiens
acgaagacgauaucuggua

SEQ ID NO: 141580 - RNA, 19 nt, Homo sapiens
ccagggaggcgucuagaag

SEQ ID NO: 141581 - RNA, 19 nt, Homo sapiens
gaccuuggcaaauguuauc

SEQ ID NO: 141582 - RNA, 19 nt, Homo sapiens
aggcagcccuucacaggau

SEQ ID NO: 141583 - RNA, 19 nt, Homo sapiens
gggaagcggcugauaccau

SEQ ID NO: 141584 - RNA, 19 nt, Homo sapiens
gcuacaggauaugccauca

SEQ ID NO: 141585 - RNA, 19 nt, Homo sapiens
acagugcagcuacaggaua

SEQ ID NO: 141586 - RNA, 19 nt, Homo sapiens
ccucauggagucgauguuu

SEQ ID NO: 141587 - RNA, 19 nt, Homo sapiens
cagccucauuccuuaguuc

SEQ ID NO: 141588 - RNA, 19 nt, Homo sapiens
ccaccugccuggaagucau

SEQ ID NO: 141589 - RNA, 19 nt, Homo sapiens
cacacauuaugcggacuua

SEQ ID NO: 141590 - RNA, 19 nt, Homo sapiens
gcaagcguagcuauguguu

SEQ ID NO: 141591 - RNA, 19 nt, Homo sapiens
gcccugacccagaccuuga

SEQ ID NO: 141592 - RNA, 19 nt, Homo sapiens
cauuagucauucaaguguu

SEQ ID NO: 141593 - RNA, 19 nt, Homo sapiens
aguaaugcguguuguuugg

SEQ ID NO: 141594 - RNA, 19 nt, Homo sapiens
cagggaggcgucuagaaga

SEQ ID NO: 141595 - RNA, 19 nt, Homo sapiens
gagcaggcagcccuucaca

SEQ ID NO: 141596 - RNA, 19 nt, Homo sapiens
acauuaugcggacuuauug

SEQ ID NO: 141597 - RNA, 19 nt, Homo sapiens
uggucuauacugacucuua

SEQ ID NO: 141598 - RNA, 19 nt, Homo sapiens
uaaagggcuuagggacuuc

SEQ ID NO: 141599 - RNA, 19 nt, Homo sapiens
gagagcaggcagcccuuca

SEQ ID NO: 141600 - RNA, 19 nt, Homo sapiens
ggcugaaggccgacuguga

SEQ ID NO: 141601 - RNA, 19 nt, Homo sapiens
cacagcaaccuaaauaaac

SEQ ID NO: 141602 - RNA, 19 nt, Homo sapiens
cacauuagucauucaagug

SEQ ID NO: 141603 - RNA, 19 nt, Homo sapiens
uacauguggcuaaacuuaa

SEQ ID NO: 141604 - RNA, 19 nt, Homo sapiens
gcugcuaggaccuuuagug

SEQ ID NO: 141605 - RNA, 19 nt, Homo sapiens
ucccugagguggaugucuu

SEQ ID NO: 141606 - RNA, 19 nt, Homo sapiens
gcaaagcacugacuucuaa

SEQ ID NO: 141607 - RNA, 19 nt, Homo sapiens
guaaagaggcgaaguauua

SEQ ID NO: 141608 - RNA, 19 nt, Homo sapiens
gguaauagcuucuacaaga

SEQ ID NO: 141609 - RNA, 19 nt, Homo sapiens
caagaaauauccucuacua

SEQ ID NO: 141610 - RNA, 19 nt, Homo sapiens
gagcagagcugaaaauuuu

SEQ ID NO: 141611 - RNA, 19 nt, Homo sapiens
gaaccaaauuuaccaaguu

SEQ ID NO: 141612 - RNA, 19 nt, Homo sapiens
gaacccaaguccaagcaua

SEQ ID NO: 141613 - RNA, 19 nt, Homo sapiens
gaaagacuauucaaacagu

SEQ ID NO: 141614 - RNA, 19 nt, Homo sapiens
gaaguuauacuccuuaaga

SEQ ID NO: 141615 - RNA, 19 nt, Homo sapiens
gagaaagacuauucaaaca

SEQ ID NO: 141616 - RNA, 19 nt, Homo sapiens
aagacaaccuugaccauua

SEQ ID NO: 141617 - RNA, 19 nt, Homo sapiens
ggaagacaauucagcuuug

SEQ ID NO: 141618 - RNA, 19 nt, Homo sapiens
uaagauggauuucagauca

SEQ ID NO: 141619 - RNA, 19 nt, Homo sapiens
ggaaaggugucaguacuau

SEQ ID NO: 141620 - RNA, 19 nt, Homo sapiens
gaggaaggaaucuuuauaa

SEQ ID NO: 141621 - RNA, 19 nt, Homo sapiens
gaagagaggauuccaaaca

SEQ ID NO: 141622 - RNA, 19 nt, Homo sapiens
uaacuggacugguucaaau

SEQ ID NO: 141623 - RNA, 19 nt, Homo sapiens
gaauaucucuacaaacaag

SEQ ID NO: 141624 - RNA, 19 nt, Homo sapiens
gaacaaaggcacagaugau

SEQ ID NO: 141625 - RNA, 19 nt, Homo sapiens
gaaguggcguguucaagug

SEQ ID NO: 141626 - RNA, 19 nt, Homo sapiens
caaguugaguaccuccuua

SEQ ID NO: 141627 - RNA, 19 nt, Homo sapiens
caauucagcuuuggauaaa

SEQ ID NO: 141628 - RNA, 19 nt, Homo sapiens
aaaggcagcugauuacaga

SEQ ID NO: 141629 - RNA, 19 nt, Homo sapiens
ccaaagcccuggucgaugu

SEQ ID NO: 141630 - RNA, 19 nt, Homo sapiens
ggaggaaggaaucuuuaua

SEQ ID NO: 141631 - RNA, 19 nt, Homo sapiens
aaacugcacugucaagaug

SEQ ID NO: 141632 - RNA, 19 nt, Homo sapiens
gcacaccaacauauauaua

SEQ ID NO: 141633 - RNA, 19 nt, Homo sapiens
gcacagcacaccaacauau

SEQ ID NO: 141634 - RNA, 19 nt, Homo sapiens
gaagaagguuacagacaca

SEQ ID NO: 141635 - RNA, 19 nt, Homo sapiens
agaggcagcuugaaacuga

SEQ ID NO: 141636 - RNA, 19 nt, Homo sapiens
ucaggaggauucagaacua

SEQ ID NO: 141637 - RNA, 19 nt, Homo sapiens
caaugcaacuuccauacaa

SEQ ID NO: 141638 - RNA, 19 nt, Homo sapiens
ucaagaaacuuaagguuac

SEQ ID NO: 141639 - RNA, 19 nt, Homo sapiens
ugaagcagccagacaauuu

SEQ ID NO: 141640 - RNA, 19 nt, Homo sapiens
gauaagaucaugcaugcaa

SEQ ID NO: 141641 - RNA, 19 nt, Homo sapiens
ugacaugccucaguuguga

SEQ ID NO: 141642 - RNA, 19 nt, Homo sapiens
cacucuaacugauuacuua

SEQ ID NO: 141643 - RNA, 19 nt, Homo sapiens
cagcaagggugaugggaaa

SEQ ID NO: 141644 - RNA, 19 nt, Homo sapiens
gcaaugugguauacugaug

SEQ ID NO: 141645 - RNA, 19 nt, Homo sapiens
gaagguuacagacacauuu

SEQ ID NO: 141646 - RNA, 19 nt, Homo sapiens
uaacuuccuuggacucauu

SEQ ID NO: 141647 - RNA, 19 nt, Homo sapiens
gaagacaaccuugaccauu

SEQ ID NO: 141648 - RNA, 19 nt, Homo sapiens
gaacugggccacuuaccuu

SEQ ID NO: 141649 - RNA, 19 nt, Homo sapiens
uagcauaugcccaauuuaa

SEQ ID NO: 141650 - RNA, 19 nt, Homo sapiens
aaacuuacacucuaacuga

SEQ ID NO: 141651 - RNA, 19 nt, Homo sapiens
gaauuucucccagucauuu

SEQ ID NO: 141652 - RNA, 19 nt, Homo sapiens
uuaaagggauggcaagaug

SEQ ID NO: 141653 - RNA, 19 nt, Homo sapiens
gggaacauuugaaguugaa

SEQ ID NO: 141654 - RNA, 19 nt, Homo sapiens
ugaaagaggcagcuugaaa

SEQ ID NO: 141655 - RNA, 19 nt, Homo sapiens
uauaguagcuagcuuugau

SEQ ID NO: 141656 - RNA, 19 nt, Homo sapiens
gcaggcccauguagucaaa

SEQ ID NO: 141657 - RNA, 19 nt, Homo sapiens
gaucuugccuccucauuuu

SEQ ID NO: 141658 - RNA, 19 nt, Homo sapiens
acagacacauuugcuauuu

SEQ ID NO: 141659 - RNA, 19 nt, Homo sapiens
auacugauguuccuaguga

SEQ ID NO: 141660 - RNA, 19 nt, Homo sapiens
aaagugacaugccucaguu

SEQ ID NO: 141661 - RNA, 19 nt, Homo sapiens
guaauagcuucuacaagau

SEQ ID NO: 141662 - RNA, 19 nt, Homo sapiens
ggagaacaguacauuugau

SEQ ID NO: 141663 - RNA, 19 nt, Homo sapiens
guucaaauguuguucucuu

SEQ ID NO: 141664 - RNA, 19 nt, Homo sapiens
cacaacagauuauuaccuu

SEQ ID NO: 141665 - RNA, 19 nt, Homo sapiens
gaucaugcaugcaaucaac

SEQ ID NO: 141666 - RNA, 19 nt, Homo sapiens
gaaagaggcagcuugaaac

SEQ ID NO: 141667 - RNA, 19 nt, Homo sapiens
ugaaaagacuccaaagaaa

SEQ ID NO: 141668 - RNA, 19 nt, Homo sapiens
ggacuucugucuucacaac

SEQ ID NO: 141669 - RNA, 19 nt, Homo sapiens
ugaugaagaccauggaaua

SEQ ID NO: 141670 - RNA, 19 nt, Homo sapiens
gaugauaacguucacuuuc

SEQ ID NO: 141671 - RNA, 19 nt, Homo sapiens
ccaaggagauaagaucaug

SEQ ID NO: 141672 - RNA, 19 nt, Homo sapiens
gcuugaaacugagauguga

SEQ ID NO: 141673 - RNA, 19 nt, Homo sapiens
caaacagucucaggaaauc

SEQ ID NO: 141674 - RNA, 19 nt, Homo sapiens
caaauguuguucucuucuu

SEQ ID NO: 141675 - RNA, 19 nt, Homo sapiens
gaucaugaauaucucuaca

SEQ ID NO: 141676 - RNA, 19 nt, Homo sapiens
guacacagaacguuacaug

SEQ ID NO: 141677 - RNA, 19 nt, Homo sapiens
gaaguauuaucagcugaga

SEQ ID NO: 141678 - RNA, 19 nt, Homo sapiens
gcaacacaagaaagaauuu

SEQ ID NO: 141679 - RNA, 19 nt, Homo sapiens
cuacacagcuucauaugac

SEQ ID NO: 141680 - RNA, 19 nt, Homo sapiens
gaggagacgccgacgauga

SEQ ID NO: 141681 - RNA, 19 nt, Homo sapiens
ggaaguggcguguucaagu

SEQ ID NO: 141682 - RNA, 19 nt, Homo sapiens
guacuauucugugucauuc

SEQ ID NO: 141683 - RNA, 19 nt, Homo sapiens
uaacugacuggguuuauga

SEQ ID NO: 141684 - RNA, 19 nt, Homo sapiens
cuuacacucuaacugauua

SEQ ID NO: 141685 - RNA, 19 nt, Homo sapiens
ggaaaucaaauaugcaaag

SEQ ID NO: 141686 - RNA, 19 nt, Homo sapiens
guuguucucuucuuuaaag

SEQ ID NO: 141687 - RNA, 19 nt, Homo sapiens
gaauaacugacuggguuua

SEQ ID NO: 141688 - RNA, 19 nt, Homo sapiens
cagaagagaggauuccaaa

SEQ ID NO: 141689 - RNA, 19 nt, Homo sapiens
ggcaagaugugggcaguga

SEQ ID NO: 141690 - RNA, 19 nt, Homo sapiens
ccaaauuucauaccuauca

SEQ ID NO: 141691 - RNA, 19 nt, Homo sapiens
cagcacaccaacauauaua

SEQ ID NO: 141692 - RNA, 19 nt, Homo sapiens
acagaagacugggaacauu

SEQ ID NO: 141693 - RNA, 19 nt, Homo sapiens
gaagacaauucagcuuugg

SEQ ID NO: 141694 - RNA, 19 nt, Homo sapiens
gcacggcaacacauugaaa

SEQ ID NO: 141695 - RNA, 19 nt, Homo sapiens
caguacauuugaugaguuu

SEQ ID NO: 141696 - RNA, 19 nt, Homo sapiens
caaagaaauguaagggaaa

SEQ ID NO: 141697 - RNA, 19 nt, Homo sapiens
uuuagcauaugcccaauuu

SEQ ID NO: 141698 - RNA, 19 nt, Homo sapiens
uaaauuggcauauguuugg

SEQ ID NO: 141699 - RNA, 19 nt, Homo sapiens
ggucaccagugggucauaa

SEQ ID NO: 141700 - RNA, 19 nt, Homo sapiens
aagagaggauuccaaacaa

SEQ ID NO: 141701 - RNA, 19 nt, Homo sapiens
gaaaucaaauaugcaaagc

SEQ ID NO: 141702 - RNA, 19 nt, Homo sapiens
caauguuucucuuuaccuu

SEQ ID NO: 141703 - RNA, 19 nt, Homo sapiens
gaacauuugaaguugaaga

SEQ ID NO: 141704 - RNA, 19 nt, Homo sapiens
acaauucagcuuuggauaa

SEQ ID NO: 141705 - RNA, 19 nt, Homo sapiens
caucagcaaugaagaaggu

SEQ ID NO: 141706 - RNA, 19 nt, Homo sapiens
ucauggagcucccaacuua

SEQ ID NO: 141707 - RNA, 19 nt, Homo sapiens
ggugugcacugucuauuua

SEQ ID NO: 141708 - RNA, 19 nt, Homo sapiens
gaacagaaaggaacaguga

SEQ ID NO: 141709 - RNA, 19 nt, Homo sapiens
gaaggucacuguagaagau

SEQ ID NO: 141710 - RNA, 19 nt, Homo sapiens
gcaaggaaggugugauuua

SEQ ID NO: 141711 - RNA, 19 nt, Homo sapiens
gcacaaacguggcucuuuc

SEQ ID NO: 141712 - RNA, 19 nt, Homo sapiens
gccaacagcugauauuuau

SEQ ID NO: 141713 - RNA, 19 nt, Homo sapiens
gcacacagcagaacucauu

SEQ ID NO: 141714 - RNA, 19 nt, Homo sapiens
gauaauagucugucucaaa

SEQ ID NO: 141715 - RNA, 19 nt, Homo sapiens
gcuaaugguuaaccugaua

SEQ ID NO: 141716 - RNA, 19 nt, Homo sapiens
caacagagcauacgagaug

SEQ ID NO: 141717 - RNA, 19 nt, Homo sapiens
caaaugaacaugucaagaa

SEQ ID NO: 141718 - RNA, 19 nt, Homo sapiens
uaacagacuucaaacucua

SEQ ID NO: 141719 - RNA, 19 nt, Homo sapiens
caacacaacagauaagaaa

SEQ ID NO: 141720 - RNA, 19 nt, Homo sapiens
gauaagugauacagaauuc

SEQ ID NO: 141721 - RNA, 19 nt, Homo sapiens
cagcagaacucauuacaca

SEQ ID NO: 141722 - RNA, 19 nt, Homo sapiens
ucaagaaggccauaaauga

SEQ ID NO: 141723 - RNA, 19 nt, Homo sapiens
gauauuacguccugagcaa

SEQ ID NO: 141724 - RNA, 19 nt, Homo sapiens
gaacucauuacacaacuaa

SEQ ID NO: 141725 - RNA, 19 nt, Homo sapiens
uaagagccaucagauauga

SEQ ID NO: 141726 - RNA, 19 nt, Homo sapiens
gccaauagcacccauuaaa

SEQ ID NO: 141727 - RNA, 19 nt, Homo sapiens
uauaugggcuugcuacuuc

SEQ ID NO: 141728 - RNA, 19 nt, Homo sapiens
ugaaggagcaguacauuga

SEQ ID NO: 141729 - RNA, 19 nt, Homo sapiens
gaagaaggucacuguagaa

SEQ ID NO: 141730 - RNA, 19 nt, Homo sapiens
aaacguggcucuuucuaca

SEQ ID NO: 141731 - RNA, 19 nt, Homo sapiens
gaagaaacacgaggaugaa

SEQ ID NO: 141732 - RNA, 19 nt, Homo sapiens
guggauaagugauacagaa

SEQ ID NO: 141733 - RNA, 19 nt, Homo sapiens
agaagaaggucacuguaga

SEQ ID NO: 141734 - RNA, 19 nt, Homo sapiens
ggccaacagcugauauuua

SEQ ID NO: 141735 - RNA, 19 nt, Homo sapiens
gcagaggaauuggaaagga

SEQ ID NO: 141736 - RNA, 19 nt, Homo sapiens
cgaagaaacacgaggauga

SEQ ID NO: 141737 - RNA, 19 nt, Homo sapiens
gcaaugcaaagcuucagua

SEQ ID NO: 141738 - RNA, 19 nt, Homo sapiens
uaucaacacucguauacug

SEQ ID NO: 141739 - RNA, 19 nt, Homo sapiens
gauagagaguaugcacuuu

SEQ ID NO: 141740 - RNA, 19 nt, Homo sapiens
agaagcagaucggaaguaa

SEQ ID NO: 141741 - RNA, 19 nt, Homo sapiens
acagggacauugagauuga

SEQ ID NO: 141742 - RNA, 19 nt, Homo sapiens
gggaaauucuaucacauca

SEQ ID NO: 141743 - RNA, 19 nt, Homo sapiens
ggaaaggaauagcaauugc

SEQ ID NO: 141744 - RNA, 19 nt, Homo sapiens
gugcacaacacaacagaua

SEQ ID NO: 141745 - RNA, 19 nt, Homo sapiens
cgagggaaauucuaucaca

SEQ ID NO: 141746 - RNA, 19 nt, Homo sapiens
gcauuucccuacacguuau

SEQ ID NO: 141747 - RNA, 19 nt, Homo sapiens
gugacuggcuguaugaaga

SEQ ID NO: 141748 - RNA, 19 nt, Homo sapiens
caaggaaggugugauuuac

SEQ ID NO: 141749 - RNA, 19 nt, Homo sapiens
gcuaaguggauaagugaua

SEQ ID NO: 141750 - RNA, 19 nt, Homo sapiens
gaggcuaaguggauaagug

SEQ ID NO: 141751 - RNA, 19 nt, Homo sapiens
gaucgucaccucggucaua

SEQ ID NO: 141752 - RNA, 19 nt, Homo sapiens
ccaccaagcggaagcauga

SEQ ID NO: 141753 - RNA, 19 nt, Homo sapiens
gcucugcucucucuccaau

SEQ ID NO: 141754 - RNA, 19 nt, Homo sapiens
gaauucaucuacagagaac

SEQ ID NO: 141755 - RNA, 19 nt, Homo sapiens
gcaauugcacugcuuguca

SEQ ID NO: 141756 - RNA, 19 nt, Homo sapiens
cagaggaauuggaaaggaa

SEQ ID NO: 141757 - RNA, 19 nt, Homo sapiens
gaaaggcuaauuacagcuu

SEQ ID NO: 141758 - RNA, 19 nt, Homo sapiens
gaaacacgaggaugaaagu

SEQ ID NO: 141759 - RNA, 19 nt, Homo sapiens
ugguuaaccugauagaauu

SEQ ID NO: 141760 - RNA, 19 nt, Homo sapiens
ccugugaccugguugagaa

SEQ ID NO: 141761 - RNA, 19 nt, Homo sapiens
gaaggugugauuuacaaug

SEQ ID NO: 141762 - RNA, 19 nt, Homo sapiens
ggucuccacuggcaaggaa

SEQ ID NO: 141763 - RNA, 19 nt, Homo sapiens
acaaauacuucuacugucu

SEQ ID NO: 141764 - RNA, 19 nt, Homo sapiens
gugagacuguggaauguug

SEQ ID NO: 141765 - RNA, 19 nt, Homo sapiens
cagaauucaucuacagaga

SEQ ID NO: 141766 - RNA, 19 nt, Homo sapiens
gcagugcguguucauauau

SEQ ID NO: 141767 - RNA, 19 nt, Homo sapiens
gaacagagcaaaggauggu

SEQ ID NO: 141768 - RNA, 19 nt, Homo sapiens
aaaggcuaauuacagcuua

SEQ ID NO: 141769 - RNA, 19 nt, Homo sapiens
acagaugccuaaaguggaa

SEQ ID NO: 141770 - RNA, 19 nt, Homo sapiens
gugcgaagguccugguguu

SEQ ID NO: 141771 - RNA, 19 nt, Homo sapiens
ggauaagugauacagaauu

SEQ ID NO: 141772 - RNA, 19 nt, Homo sapiens
cuauuuacauccguccuua

SEQ ID NO: 141773 - RNA, 19 nt, Homo sapiens
ccucaagguugucuucaga

SEQ ID NO: 141774 - RNA, 19 nt, Homo sapiens
cugauagaauuaacucgua

SEQ ID NO: 141775 - RNA, 19 nt, Homo sapiens
ggacgaggaggaggacuaa

SEQ ID NO: 141776 - RNA, 19 nt, Homo sapiens
ucugcucucucuccaauaa

SEQ ID NO: 141777 - RNA, 19 nt, Homo sapiens
caaggauggccgaaaguuu

SEQ ID NO: 141778 - RNA, 19 nt, Homo sapiens
ccacagacagaaugaagaa

SEQ ID NO: 141779 - RNA, 19 nt, Homo sapiens
guaaugaggacguucaaca

SEQ ID NO: 141780 - RNA, 19 nt, Homo sapiens
agaaacaaaugaacauguc

SEQ ID NO: 141781 - RNA, 19 nt, Homo sapiens
gagaugaugccgccugaug

SEQ ID NO: 141782 - RNA, 19 nt, Homo sapiens
ccauauaucaacacucgua

SEQ ID NO: 141783 - RNA, 19 nt, Homo sapiens
gaacccauauaucaacacu

SEQ ID NO: 141784 - RNA, 19 nt, Homo sapiens
cauacgagaugaccaaggu

SEQ ID NO: 141785 - RNA, 19 nt, Homo sapiens
gagcauacgagaugaccaa

SEQ ID NO: 141786 - RNA, 19 nt, Homo sapiens
gaauacagggacauugaga

SEQ ID NO: 141787 - RNA, 19 nt, Homo sapiens
augcaaagcuucaguaugc

SEQ ID NO: 141788 - RNA, 19 nt, Homo sapiens
gauacagaauucaucuaca

SEQ ID NO: 141789 - RNA, 19 nt, Homo sapiens
gcacaacacaacagauaag

SEQ ID NO: 141790 - RNA, 19 nt, Homo sapiens
gaaacaaauacuucuacug

SEQ ID NO: 141791 - RNA, 19 nt, Homo sapiens
cagccaauagcacccauua

SEQ ID NO: 141792 - RNA, 19 nt, Homo sapiens
gaaaggaauagcaauugca

SEQ ID NO: 141793 - RNA, 19 nt, Homo sapiens
gagggaaauucuaucacau

SEQ ID NO: 141794 - RNA, 19 nt, Homo sapiens
ggaagauaauagucugucu

SEQ ID NO: 141795 - RNA, 19 nt, Homo sapiens
gcaguuacagcaccauugu

SEQ ID NO: 141796 - RNA, 19 nt, Homo sapiens
aaaugaacaugucaagaag

SEQ ID NO: 141797 - RNA, 19 nt, Homo sapiens
gauccuagccuacgaugag

SEQ ID NO: 141798 - RNA, 19 nt, Homo sapiens
caauguggaacccauauau

SEQ ID NO: 141799 - RNA, 19 nt, Homo sapiens
ugacaccagcggaagauaa

SEQ ID NO: 141800 - RNA, 19 nt, Homo sapiens
gcgcgguggugguaaagug

SEQ ID NO: 141801 - RNA, 19 nt, Homo sapiens
gaaacaaaugaacauguca

SEQ ID NO: 141802 - RNA, 19 nt, Homo sapiens
acucguauacuggauauua

SEQ ID NO: 141803 - RNA, 19 nt, Homo sapiens
gcagaacucauuacacaac

SEQ ID NO: 141804 - RNA, 19 nt, Homo sapiens
ccauggacuugacaacaga

SEQ ID NO: 141805 - RNA, 19 nt, Homo sapiens
ggacgugaccaagauccua

SEQ ID NO: 141806 - RNA, 19 nt, Homo sapiens
ucauggagcucccaacuua

SEQ ID NO: 141807 - RNA, 19 nt, Homo sapiens
ggugugcacugucuauuua

SEQ ID NO: 141808 - RNA, 19 nt, Homo sapiens
gaacagaaaggaacaguga

SEQ ID NO: 141809 - RNA, 19 nt, Homo sapiens
gaaggucacuguagaagau

SEQ ID NO: 141810 - RNA, 19 nt, Homo sapiens
gcaaggaaggugugauuua

SEQ ID NO: 141811 - RNA, 19 nt, Homo sapiens
gcacaaacguggcucuuuc

SEQ ID NO: 141812 - RNA, 19 nt, Homo sapiens
gccaacagcugauauuuau

SEQ ID NO: 141813 - RNA, 19 nt, Homo sapiens
gcacacagcagaacucauu

SEQ ID NO: 141814 - RNA, 19 nt, Homo sapiens
gauaauagucugucucaaa

SEQ ID NO: 141815 - RNA, 19 nt, Homo sapiens
gcuaaugguuaaccugaua

SEQ ID NO: 141816 - RNA, 19 nt, Homo sapiens
caacagagcauacgagaug

SEQ ID NO: 141817 - RNA, 19 nt, Homo sapiens
caaaugaacaugucaagaa

SEQ ID NO: 141818 - RNA, 19 nt, Homo sapiens
uaacagacuucaaacucua

SEQ ID NO: 141819 - RNA, 19 nt, Homo sapiens
caacacaacagauaagaaa

SEQ ID NO: 141820 - RNA, 19 nt, Homo sapiens
gauaagugauacagaauuc

SEQ ID NO: 141821 - RNA, 19 nt, Homo sapiens
cagcagaacucauuacaca

SEQ ID NO: 141822 - RNA, 19 nt, Homo sapiens
ucaagaaggccauaaauga

SEQ ID NO: 141823 - RNA, 19 nt, Homo sapiens
gauauuacguccugagcaa

SEQ ID NO: 141824 - RNA, 19 nt, Homo sapiens
gaacucauuacacaacuaa

SEQ ID NO: 141825 - RNA, 19 nt, Homo sapiens
uaagagccaucagauauga

SEQ ID NO: 141826 - RNA, 19 nt, Homo sapiens
gccaauagcacccauuaaa

SEQ ID NO: 141827 - RNA, 19 nt, Homo sapiens
uauaugggcuugcuacuuc

SEQ ID NO: 141828 - RNA, 19 nt, Homo sapiens
ugaaggagcaguacauuga

SEQ ID NO: 141829 - RNA, 19 nt, Homo sapiens
gaagaaggucacuguagaa

SEQ ID NO: 141830 - RNA, 19 nt, Homo sapiens
aaacguggcucuuucuaca

SEQ ID NO: 141831 - RNA, 19 nt, Homo sapiens
gaagaaacacgaggaugaa

SEQ ID NO: 141832 - RNA, 19 nt, Homo sapiens
guggauaagugauacagaa

SEQ ID NO: 141833 - RNA, 19 nt, Homo sapiens
agaagaaggucacuguaga

SEQ ID NO: 141834 - RNA, 19 nt, Homo sapiens
ggccaacagcugauauuua

SEQ ID NO: 141835 - RNA, 19 nt, Homo sapiens
gcagaggaauuggaaagga

SEQ ID NO: 141836 - RNA, 19 nt, Homo sapiens
cgaagaaacacgaggauga

SEQ ID NO: 141837 - RNA, 19 nt, Homo sapiens
uaucaacacucguauacug

SEQ ID NO: 141838 - RNA, 19 nt, Homo sapiens
gauagagaguaugcacuuu

SEQ ID NO: 141839 - RNA, 19 nt, Homo sapiens
agaagcagaucggaaguaa

SEQ ID NO: 141840 - RNA, 19 nt, Homo sapiens
acagggacauugagauuga

SEQ ID NO: 141841 - RNA, 19 nt, Homo sapiens
gggaaauucuaucacauca

SEQ ID NO: 141842 - RNA, 19 nt, Homo sapiens
ggaaaggaauagcaauugc

SEQ ID NO: 141843 - RNA, 19 nt, Homo sapiens
gagguucacuggcaagauc

SEQ ID NO: 141844 - RNA, 19 nt, Homo sapiens
gugcacaacacaacagaua

SEQ ID NO: 141845 - RNA, 19 nt, Homo sapiens
cgagggaaauucuaucaca

SEQ ID NO: 141846 - RNA, 19 nt, Homo sapiens
gcauuucccuacacguuau

SEQ ID NO: 141847 - RNA, 19 nt, Homo sapiens
gugacuggcuguaugaaga

SEQ ID NO: 141848 - RNA, 19 nt, Homo sapiens
caaggaaggugugauuuac

SEQ ID NO: 141849 - RNA, 19 nt, Homo sapiens
gcuaaguggauaagugaua

SEQ ID NO: 141850 - RNA, 19 nt, Homo sapiens
gaggcuaaguggauaagug

SEQ ID NO: 141851 - RNA, 19 nt, Homo sapiens
gaucgucaccucggucaua

SEQ ID NO: 141852 - RNA, 19 nt, Homo sapiens
ccaccaagcggaagcauga

SEQ ID NO: 141853 - RNA, 19 nt, Homo sapiens
gcucugcucucucuccaau

SEQ ID NO: 141854 - RNA, 19 nt, Homo sapiens
cagaggaauuggaaaggaa

SEQ ID NO: 141855 - RNA, 19 nt, Homo sapiens
gaauucaucuacagagaac

SEQ ID NO: 141856 - RNA, 19 nt, Homo sapiens
gcaauugcacugcuuguca

SEQ ID NO: 141857 - RNA, 19 nt, Homo sapiens
gaaaggcuaauuacagcuu

SEQ ID NO: 141858 - RNA, 19 nt, Homo sapiens
gaaacacgaggaugaaagu

SEQ ID NO: 141859 - RNA, 19 nt, Homo sapiens
ugguuaaccugauagaauu

SEQ ID NO: 141860 - RNA, 19 nt, Homo sapiens
ccugugaccugguugagaa

SEQ ID NO: 141861 - RNA, 19 nt, Homo sapiens
gaaggugugauuuacaaug

SEQ ID NO: 141862 - RNA, 19 nt, Homo sapiens
ggucuccacuggcaaggaa

SEQ ID NO: 141863 - RNA, 19 nt, Homo sapiens
acaaauacuucuacugucu

SEQ ID NO: 141864 - RNA, 19 nt, Homo sapiens
gugagacuguggaauguug

SEQ ID NO: 141865 - RNA, 19 nt, Homo sapiens
cagaauucaucuacagaga

SEQ ID NO: 141866 - RNA, 19 nt, Homo sapiens
gcagugcguguucauauau

SEQ ID NO: 141867 - RNA, 19 nt, Homo sapiens
gaacagagcaaaggauggu

SEQ ID NO: 141868 - RNA, 19 nt, Homo sapiens
aaaggcuaauuacagcuua

SEQ ID NO: 141869 - RNA, 19 nt, Homo sapiens
acagaugccuaaaguggaa

SEQ ID NO: 141870 - RNA, 19 nt, Homo sapiens
gugcgaagguccugguguu

SEQ ID NO: 141871 - RNA, 19 nt, Homo sapiens
ggauaagugauacagaauu

SEQ ID NO: 141872 - RNA, 19 nt, Homo sapiens
cuauuuacauccguccuua

SEQ ID NO: 141873 - RNA, 19 nt, Homo sapiens
ccucaagguugucuucaga

SEQ ID NO: 141874 - RNA, 19 nt, Homo sapiens
cugauagaauuaacucgua

SEQ ID NO: 141875 - RNA, 19 nt, Homo sapiens
ggacgaggaggaggacuaa

SEQ ID NO: 141876 - RNA, 19 nt, Homo sapiens
ucugcucucucuccaauaa

SEQ ID NO: 141877 - RNA, 19 nt, Homo sapiens
caaggauggccgaaaguuu

SEQ ID NO: 141878 - RNA, 19 nt, Homo sapiens
ccacagacagaaugaagaa

SEQ ID NO: 141879 - RNA, 19 nt, Homo sapiens
guaaugaggacguucaaca

SEQ ID NO: 141880 - RNA, 19 nt, Homo sapiens
agaaacaaaugaacauguc

SEQ ID NO: 141881 - RNA, 19 nt, Homo sapiens
gagaugaugccgccugaug

SEQ ID NO: 141882 - RNA, 19 nt, Homo sapiens
ccauauaucaacacucgua

SEQ ID NO: 141883 - RNA, 19 nt, Homo sapiens
gaacccauauaucaacacu

SEQ ID NO: 141884 - RNA, 19 nt, Homo sapiens
cauacgagaugaccaaggu

SEQ ID NO: 141885 - RNA, 19 nt, Homo sapiens
gagcauacgagaugaccaa

SEQ ID NO: 141886 - RNA, 19 nt, Homo sapiens
gaauacagggacauugaga

SEQ ID NO: 141887 - RNA, 19 nt, Homo sapiens
gauacagaauucaucuaca

SEQ ID NO: 141888 - RNA, 19 nt, Homo sapiens
gcacaacacaacagauaag

SEQ ID NO: 141889 - RNA, 19 nt, Homo sapiens
gaaacaaauacuucuacug

SEQ ID NO: 141890 - RNA, 19 nt, Homo sapiens
cagccaauagcacccauua

SEQ ID NO: 141891 - RNA, 19 nt, Homo sapiens
ggaagauaauagucugucu

SEQ ID NO: 141892 - RNA, 19 nt, Homo sapiens
gaaaggaauagcaauugca

SEQ ID NO: 141893 - RNA, 19 nt, Homo sapiens
gagggaaauucuaucacau

SEQ ID NO: 141894 - RNA, 19 nt, Homo sapiens
gcaguuacagcaccauugu

SEQ ID NO: 141895 - RNA, 19 nt, Homo sapiens
aaaugaacaugucaagaag

SEQ ID NO: 141896 - RNA, 19 nt, Homo sapiens
gauccuagccuacgaugag

SEQ ID NO: 141897 - RNA, 19 nt, Homo sapiens
gaaccggagagaaagcaaa

SEQ ID NO: 141898 - RNA, 19 nt, Homo sapiens
ugacaccagcggaagauaa

SEQ ID NO: 141899 - RNA, 19 nt, Homo sapiens
caauguggaacccauauau

SEQ ID NO: 141900 - RNA, 19 nt, Homo sapiens
gcgcgguggugguaaagug

SEQ ID NO: 141901 - RNA, 19 nt, Homo sapiens
gaaacaaaugaacauguca

SEQ ID NO: 141902 - RNA, 19 nt, Homo sapiens
acucguauacuggauauua

SEQ ID NO: 141903 - RNA, 19 nt, Homo sapiens
gcagaacucauuacacaac

SEQ ID NO: 141904 - RNA, 19 nt, Homo sapiens
ccauggacuugacaacaga

SEQ ID NO: 141905 - RNA, 19 nt, Homo sapiens
ggacgugaccaagauccua

SEQ ID NO: 141906 - RNA, 19 nt, Homo sapiens
caacagggcuggcauggaa

SEQ ID NO: 141907 - RNA, 19 nt, Homo sapiens
ggacaugauuuccuacaau

SEQ ID NO: 141908 - RNA, 19 nt, Homo sapiens
gaauacgacugugaauuug

SEQ ID NO: 141909 - RNA, 19 nt, Homo sapiens
ugaauacgacugugaauuu

SEQ ID NO: 141910 - RNA, 19 nt, Homo sapiens
gacaugauuuccuacaauu

SEQ ID NO: 141911 - RNA, 19 nt, Homo sapiens
gaugaugggugggugaauu

SEQ ID NO: 141912 - RNA, 19 nt, Homo sapiens
gggcuggcauggaauggua

SEQ ID NO: 141913 - RNA, 19 nt, Homo sapiens
ugaggagcaucuucaguaa

SEQ ID NO: 141914 - RNA, 19 nt, Homo sapiens
gugaggagcaucuucagua

SEQ ID NO: 141915 - RNA, 19 nt, Homo sapiens
ccauauuccugcuggcuaa

SEQ ID NO: 141916 - RNA, 19 nt, Homo sapiens
agucuucucuggguacuua

SEQ ID NO: 141917 - RNA, 19 nt, Homo sapiens
gcagagaaagugguuguug

SEQ ID NO: 141918 - RNA, 19 nt, Homo sapiens
caguggaaguucauaaugu

SEQ ID NO: 141919 - RNA, 19 nt, Homo sapiens
gcaagaggugcccauauuc

SEQ ID NO: 141920 - RNA, 19 nt, Homo sapiens
agcaagaggugcccauauu

SEQ ID NO: 141921 - RNA, 19 nt, Homo sapiens
gaggagcaacaaccacuuu

SEQ ID NO: 141922 - RNA, 19 nt, Homo sapiens
gugaggaaauggacaugau

SEQ ID NO: 141923 - RNA, 19 nt, Homo sapiens
gagcauggaccucagucuu

SEQ ID NO: 141924 - RNA, 19 nt, Homo sapiens
cagacgugcuccaacaaug

SEQ ID NO: 141925 - RNA, 19 nt, Homo sapiens
gaucgccaguggaaguuca

SEQ ID NO: 141926 - RNA, 19 nt, Homo sapiens
aaaucugggugaaaggaaa

SEQ ID NO: 141927 - RNA, 19 nt, Homo sapiens
cagaauauccaggucacua

SEQ ID NO: 141928 - RNA, 19 nt, Homo sapiens
gcauggaccucagucuucu

SEQ ID NO: 141929 - RNA, 19 nt, Homo sapiens
gaauauccaggucacuaug

SEQ ID NO: 141930 - RNA, 19 nt, Homo sapiens
gguuguugcuccucgguau

SEQ ID NO: 141931 - RNA, 19 nt, Homo sapiens
uaccaaaucugggugaaag

SEQ ID NO: 141932 - RNA, 19 nt, Homo sapiens
uaccagacgugcuccaaca

SEQ ID NO: 141933 - RNA, 19 nt, Homo sapiens
aaagggaucgccaguggaa

SEQ ID NO: 141934 - RNA, 19 nt, Homo sapiens
gcuccucgguauauguaau

SEQ ID NO: 141935 - RNA, 19 nt, Homo sapiens
gaucgggaguggcaguuuu

SEQ ID NO: 141936 - RNA, 19 nt, Homo sapiens
ugacugaauacgacuguga

SEQ ID NO: 141937 - RNA, 19 nt, Homo sapiens
uaaugugccggaugacuga

SEQ ID NO: 141938 - RNA, 19 nt, Homo sapiens
uguuuagauuugccacaua

SEQ ID NO: 141939 - RNA, 19 nt, Homo sapiens
gaugggugggugaauuuga

SEQ ID NO: 141940 - RNA, 19 nt, Homo sapiens
ccaguggaaguucauaaug

SEQ ID NO: 141941 - RNA, 19 nt, Homo sapiens
guuuagauuugccacauac

SEQ ID NO: 141942 - RNA, 19 nt, Homo sapiens
ugugccggaugacugaaua

SEQ ID NO: 141943 - RNA, 19 nt, Homo sapiens
gagcaacaaccacuuucuc

SEQ ID NO: 141944 - RNA, 19 nt, Homo sapiens
caaaucugggugaaaggaa

SEQ ID NO: 141945 - RNA, 19 nt, Homo sapiens
ccagcaguaucaugacuac

SEQ ID NO: 141946 - RNA, 19 nt, Homo sapiens
gcuaacaacagaauaucca

SEQ ID NO: 141947 - RNA, 19 nt, Homo sapiens
ccugcuggcuaacaacaga

SEQ ID NO: 141948 - RNA, 19 nt, Homo sapiens
ugaggaaauggacaugauu

SEQ ID NO: 141949 - RNA, 19 nt, Homo sapiens
cagcaagaggugcccauau

SEQ ID NO: 141950 - RNA, 19 nt, Homo sapiens
aguggaaguucauaaugug

SEQ ID NO: 141951 - RNA, 19 nt, Homo sapiens
gagccgcuacuucgaguca

SEQ ID NO: 141952 - RNA, 19 nt, Homo sapiens
ccaaaucugggugaaagga

SEQ ID NO: 141953 - RNA, 19 nt, Homo sapiens
uggacaugauuuccuacaa

SEQ ID NO: 141954 - RNA, 19 nt, Homo sapiens
auacgacugugaauuugca

SEQ ID NO: 141955 - RNA, 19 nt, Homo sapiens
agaauauccaggucacuau

SEQ ID NO: 141956 - RNA, 19 nt, Homo sapiens
gccaguggaaguucauaau

SEQ ID NO: 141957 - RNA, 19 nt, Homo sapiens
ggagcaacaaccacuuucu

SEQ ID NO: 141958 - RNA, 19 nt, Homo sapiens
gacugaauacgacugugaa

SEQ ID NO: 141959 - RNA, 19 nt, Homo sapiens
gaugacugaauacgacugu

SEQ ID NO: 141960 - RNA, 19 nt, Homo sapiens
ccaguauggcgauuaugga

SEQ ID NO: 141961 - RNA, 19 nt, Homo sapiens
guacuuaugccccuaguca

SEQ ID NO: 141962 - RNA, 19 nt, Homo sapiens
ccagacgugcuccaacaau

SEQ ID NO: 141963 - RNA, 19 nt, Homo sapiens
gaacaaagcucaaaguaug

SEQ ID NO: 141964 - RNA, 19 nt, Homo sapiens
caaaugagaugauaggaua

SEQ ID NO: 141965 - RNA, 19 nt, Homo sapiens
gaagagggacccauuaaua

SEQ ID NO: 141966 - RNA, 19 nt, Homo sapiens
gugagaagcuggagaauaa

SEQ ID NO: 141967 - RNA, 19 nt, Homo sapiens
cagaagagcuguccaacua

SEQ ID NO: 141968 - RNA, 19 nt, Homo sapiens
gcaaugagaugccugaaau

SEQ ID NO: 141969 - RNA, 19 nt, Homo sapiens
guaguuagcuccauaaagu

SEQ ID NO: 141970 - RNA, 19 nt, Homo sapiens
gaaaccaguuccacguaua

SEQ ID NO: 141971 - RNA, 19 nt, Homo sapiens
guucagcucuuuccaaauu

SEQ ID NO: 141972 - RNA, 19 nt, Homo sapiens
gaagaaauguguaucaacu

SEQ ID NO: 141973 - RNA, 19 nt, Homo sapiens
ggaauugacucugcugaaa

SEQ ID NO: 141974 - RNA, 19 nt, Homo sapiens
ggaccuugguguaaagaua

SEQ ID NO: 141975 - RNA, 19 nt, Homo sapiens
gcaauuagugugacaguuu

SEQ ID NO: 141976 - RNA, 19 nt, Homo sapiens
ccaguugucuuaugugaaa

SEQ ID NO: 141977 - RNA, 19 nt, Homo sapiens
gaagagcuguccaacuaau

SEQ ID NO: 141978 - RNA, 19 nt, Homo sapiens
uacauaugcugaucucuua

SEQ ID NO: 141979 - RNA, 19 nt, Homo sapiens
gcaguaccuuggaacauuu

SEQ ID NO: 141980 - RNA, 19 nt, Homo sapiens
cauggcaucuucaauauga

SEQ ID NO: 141981 - RNA, 19 nt, Homo sapiens
aaagagaggcguacccuua

SEQ ID NO: 141982 - RNA, 19 nt, Homo sapiens
guagguggaugcaauuuau

SEQ ID NO: 141983 - RNA, 19 nt, Homo sapiens
auagucaccuucaugauua

SEQ ID NO: 141984 - RNA, 19 nt, Homo sapiens
gaggauagggagaauauuu

SEQ ID NO: 141985 - RNA, 19 nt, Homo sapiens
gaaaauguauccaaggaaa

SEQ ID NO: 141986 - RNA, 19 nt, Homo sapiens
gaaaagcauugaagaacua

SEQ ID NO: 141987 - RNA, 19 nt, Homo sapiens
ggucuucaguuucuccaua

SEQ ID NO: 141988 - RNA, 19 nt, Homo sapiens
cguaugauguagugaauuu

SEQ ID NO: 141989 - RNA, 19 nt, Homo sapiens
ucacaaguauugcaaacaa

SEQ ID NO: 141990 - RNA, 19 nt, Homo sapiens
gaaaagaaauccugauaag

SEQ ID NO: 141991 - RNA, 19 nt, Homo sapiens
gagaguauccuggcuuuaa

SEQ ID NO: 141992 - RNA, 19 nt, Homo sapiens
cgcaagagcugcaaaggaa

SEQ ID NO: 141993 - RNA, 19 nt, Homo sapiens
cagaugcccuggaguuaaa

SEQ ID NO: 141994 - RNA, 19 nt, Homo sapiens
ccaagaaauuagacaagaa

SEQ ID NO: 141995 - RNA, 19 nt, Homo sapiens
gcaguuaauuggauguuca

SEQ ID NO: 141996 - RNA, 19 nt, Homo sapiens
ggacagcaaucagaccuau

SEQ ID NO: 141997 - RNA, 19 nt, Homo sapiens
gcaaagcgaacuacauaug

SEQ ID NO: 141998 - RNA, 19 nt, Homo sapiens
gaaugaagaugaagaucag

SEQ ID NO: 141999 - RNA, 19 nt, Homo sapiens
cuaccaggcuauacaguuu

SEQ ID NO: 142000 - RNA, 19 nt, Homo sapiens
gcauauuggugucaaagug

SEQ ID NO: 142001 - RNA, 19 nt, Homo sapiens
cuugguacauucacaaaua

SEQ ID NO: 142002 - RNA, 19 nt, Homo sapiens
cuacugcacuggccucaaa

SEQ ID NO: 142003 - RNA, 19 nt, Homo sapiens
uaggcaagcuguucagauu

SEQ ID NO: 142004 - RNA, 19 nt, Homo sapiens
gaaaugacucuuagcacuu

SEQ ID NO: 142005 - RNA, 19 nt, Homo sapiens
guacaaacucauccucuuu

SEQ ID NO: 142006 - RNA, 19 nt, Homo sapiens
gggagaauauuuacuaacu

SEQ ID NO: 142007 - RNA, 19 nt, Homo sapiens
gcacugcaguaccuuggaa

SEQ ID NO: 142008 - RNA, 19 nt, Homo sapiens
ucaaggauguaauaggaaa

SEQ ID NO: 142009 - RNA, 19 nt, Homo sapiens
caauuuauaugccacugaa

SEQ ID NO: 142010 - RNA, 19 nt, Homo sapiens
gacaacaccuuaugaacca

SEQ ID NO: 142011 - RNA, 19 nt, Homo sapiens
aaucagaccuauugcuuug

SEQ ID NO: 142012 - RNA, 19 nt, Homo sapiens
auauugagcucaucaguga

SEQ ID NO: 142013 - RNA, 19 nt, Homo sapiens
ggaaugaagaugaagauca

SEQ ID NO: 142014 - RNA, 19 nt, Homo sapiens
ugaaugaaaugacucuuag

SEQ ID NO: 142015 - RNA, 19 nt, Homo sapiens
ccacuucggccaagaaauu

SEQ ID NO: 142016 - RNA, 19 nt, Homo sapiens
guguuaaggugauuuguga

SEQ ID NO: 142017 - RNA, 19 nt, Homo sapiens
uagcugaacucauggacaa

SEQ ID NO: 142018 - RNA, 19 nt, Homo sapiens
gaaaacggcugcauauugg

SEQ ID NO: 142019 - RNA, 19 nt, Homo sapiens
cagaaacuaugcaaacuag

SEQ ID NO: 142020 - RNA, 19 nt, Homo sapiens
agaauauguuggugguuua

SEQ ID NO: 142021 - RNA, 19 nt, Homo sapiens
ccacggaagguuauaguaa

SEQ ID NO: 142022 - RNA, 19 nt, Homo sapiens
gcuccuuucugaauauuga

SEQ ID NO: 142023 - RNA, 19 nt, Homo sapiens
agaaguagauccagaaacu

SEQ ID NO: 142024 - RNA, 19 nt, Homo sapiens
gaaaauggaaugaagauga

SEQ ID NO: 142025 - RNA, 19 nt, Homo sapiens
gugaaugaaaugacucuua

SEQ ID NO: 142026 - RNA, 19 nt, Homo sapiens
gagcagaugcccuggaguu

SEQ ID NO: 142027 - RNA, 19 nt, Homo sapiens
ggacagagcaagaugaaac

SEQ ID NO: 142028 - RNA, 19 nt, Homo sapiens
ggaauagguuugccagaac

SEQ ID NO: 142029 - RNA, 19 nt, Homo sapiens
gcaaugaguaucccacaga

SEQ ID NO: 142030 - RNA, 19 nt, Homo sapiens
gccaagaaauuagacaaga

SEQ ID NO: 142031 - RNA, 19 nt, Homo sapiens
aaauguaguuagcuccaua

SEQ ID NO: 142032 - RNA, 19 nt, Homo sapiens
gcagaugcccuggaguuaa

SEQ ID NO: 142033 - RNA, 19 nt, Homo sapiens
gaaauggccggauugaagu

SEQ ID NO: 142034 - RNA, 19 nt, Homo sapiens
ucacaaauacguacaguca

SEQ ID NO: 142035 - RNA, 19 nt, Homo sapiens
cacggaagguuauaguaaa

SEQ ID NO: 142036 - RNA, 19 nt, Homo sapiens
aagaauauguuggugguuu

SEQ ID NO: 142037 - RNA, 19 nt, Homo sapiens
ccacagaucagaaauccuu

SEQ ID NO: 142038 - RNA, 19 nt, Homo sapiens
uuauggagcugcuaagaug

SEQ ID NO: 142039 - RNA, 19 nt, Homo sapiens
guaacaaucuauggcuuau

SEQ ID NO: 142040 - RNA, 19 nt, Homo sapiens
uaaauaccauucacuacuc

SEQ ID NO: 142041 - RNA, 19 nt, Homo sapiens
aaaggaagguggugccaau

SEQ ID NO: 142042 - RNA, 19 nt, Homo sapiens
ccaaaugucacugauauug

SEQ ID NO: 142043 - RNA, 19 nt, Homo sapiens
ugagugauccuaaaguaaa

SEQ ID NO: 142044 - RNA, 19 nt, Homo sapiens
ggaagaaaagugugaauuu

SEQ ID NO: 142045 - RNA, 19 nt, Homo sapiens
aaaugacucuuagcacuuu

SEQ ID NO: 142046 - RNA, 19 nt, Homo sapiens
agauugagcuaaugaagga

SEQ ID NO: 142047 - RNA, 19 nt, Homo sapiens
gcaaguauaaguugugcuu

SEQ ID NO: 142048 - RNA, 19 nt, Homo sapiens
gagggacccauuaauauug

SEQ ID NO: 142049 - RNA, 19 nt, Homo sapiens
uaaacuauguuccuaacca

SEQ ID NO: 142050 - RNA, 19 nt, Homo sapiens
ggcguacccuuaucuguga

SEQ ID NO: 142051 - RNA, 19 nt, Homo sapiens
gcccuggaguuaaauuuau

SEQ ID NO: 142052 - RNA, 19 nt, Homo sapiens
guggugaugucguugguuu

SEQ ID NO: 142053 - RNA, 19 nt, Homo sapiens
ucugagugauccuaaagua

SEQ ID NO: 142054 - RNA, 19 nt, Homo sapiens
uauaaguugugcuuccuuu

SEQ ID NO: 142055 - RNA, 19 nt, Homo sapiens
caaacaagaacuauuaugg

SEQ ID NO: 142056 - RNA, 19 nt, Homo sapiens
cuucauggcaucuucaaua

SEQ ID NO: 142057 - RNA, 19 nt, Homo sapiens
ugugacaguuuccaaauug

SEQ ID NO: 142058 - RNA, 19 nt, Homo sapiens
gagaagcuggagaauaauu

SEQ ID NO: 142059 - RNA, 19 nt, Homo sapiens
uggaacauuuggugaauug

SEQ ID NO: 142060 - RNA, 19 nt, Homo sapiens
acaaauacguacagucaca

SEQ ID NO: 142061 - RNA, 19 nt, Homo sapiens
acucugacaucacuauauu

SEQ ID NO: 142062 - RNA, 19 nt, Homo sapiens
gcaaacaagaacuauuaug

SEQ ID NO: 142063 - RNA, 19 nt, Homo sapiens
gaacuguccucucuacauu

SEQ ID NO: 142064 - RNA, 19 nt, Homo sapiens
gaaaggcuguguggaaauu

SEQ ID NO: 142065 - RNA, 19 nt, Homo sapiens
aagaauagcuguaggauca

SEQ ID NO: 142066 - RNA, 19 nt, Homo sapiens
gcauaagauugaagguaua

SEQ ID NO: 142067 - RNA, 19 nt, Homo sapiens
gcaccaccaugauuauuga

SEQ ID NO: 142068 - RNA, 19 nt, Homo sapiens
gaggcaaagugguauauga

SEQ ID NO: 142069 - RNA, 19 nt, Homo sapiens
aaagguggcucccucauug

SEQ ID NO: 142070 - RNA, 19 nt, Homo sapiens
ggaggcaccaccaugauua

SEQ ID NO: 142071 - RNA, 19 nt, Homo sapiens
ucaugaaucuguuggcuaa

SEQ ID NO: 142072 - RNA, 19 nt, Homo sapiens
ccaccaugauuauugauuu

SEQ ID NO: 142073 - RNA, 19 nt, Homo sapiens
gaaaaccauuugcugaaua

SEQ ID NO: 142074 - RNA, 19 nt, Homo sapiens
gcacagauggcacucacua

SEQ ID NO: 142075 - RNA, 19 nt, Homo sapiens
ggagugaccagguuaaaga

SEQ ID NO: 142076 - RNA, 19 nt, Homo sapiens
gcaguuaccagcacaaaug

SEQ ID NO: 142077 - RNA, 19 nt, Homo sapiens
gcugagagccaucaccaua

SEQ ID NO: 142078 - RNA, 19 nt, Homo sapiens
acuauaggcuucuuugauu

SEQ ID NO: 142079 - RNA, 19 nt, Homo sapiens
caaggacuaucucagcaaa

SEQ ID NO: 142080 - RNA, 19 nt, Homo sapiens
gagcaagucugcagcuaag

SEQ ID NO: 142081 - RNA, 19 nt, Homo sapiens
gaaagguggcucccucauu

SEQ ID NO: 142082 - RNA, 19 nt, Homo sapiens
ggcaggagaugggaaguuu

SEQ ID NO: 142083 - RNA, 19 nt, Homo sapiens
ggagaagucgccacacuga

SEQ ID NO: 142084 - RNA, 19 nt, Homo sapiens
caccaaggcugcucucuca

SEQ ID NO: 142085 - RNA, 19 nt, Homo sapiens
gauuauugauuucgccauu

SEQ ID NO: 142086 - RNA, 19 nt, Homo sapiens
cagcacaaaugcagccaaa

SEQ ID NO: 142087 - RNA, 19 nt, Homo sapiens
ggacugauaacugcacuuu

SEQ ID NO: 142088 - RNA, 19 nt, Homo sapiens
caacagggacugauaacug

SEQ ID NO: 142089 - RNA, 19 nt, Homo sapiens
caucuuugcuuguacuaga

SEQ ID NO: 142090 - RNA, 19 nt, Homo sapiens
auaaagaucuguacauggu

SEQ ID NO: 142091 - RNA, 19 nt, Homo sapiens
aaacagauuuguggcaguu

SEQ ID NO: 142092 - RNA, 19 nt, Homo sapiens
ggagaugggaaguuuauuc

SEQ ID NO: 142093 - RNA, 19 nt, Homo sapiens
ccacaacagggacugauaa

SEQ ID NO: 142094 - RNA, 19 nt, Homo sapiens
ggcacucacuacuggaaua

SEQ ID NO: 142095 - RNA, 19 nt, Homo sapiens
gcugugaacuguccucucu

SEQ ID NO: 142096 - RNA, 19 nt, Homo sapiens
gcagagggagcaaagaaga

SEQ ID NO: 142097 - RNA, 19 nt, Homo sapiens
gaaaauggagacuuaauug

SEQ ID NO: 142098 - RNA, 19 nt, Homo sapiens
gaccggacuugcacaccua

SEQ ID NO: 142099 - RNA, 19 nt, Homo sapiens
acugauaacugcacuuuca

SEQ ID NO: 142100 - RNA, 19 nt, Homo sapiens
gaauagcuguaggaucaga

SEQ ID NO: 142101 - RNA, 19 nt, Homo sapiens
ggugaaugguguugaagau

SEQ ID NO: 142102 - RNA, 19 nt, Homo sapiens
agaaagcucuugggaagga

SEQ ID NO: 142103 - RNA, 19 nt, Homo sapiens
cuauaaagaucuguacaug

SEQ ID NO: 142104 - RNA, 19 nt, Homo sapiens
agauaaagguguuaacucu

SEQ ID NO: 142105 - RNA, 19 nt, Homo sapiens
cuauaggcuucuuugauuu

SEQ ID NO: 142106 - RNA, 19 nt, Homo sapiens
ggagaagcaggccuuauuc

SEQ ID NO: 142107 - RNA, 19 nt, Homo sapiens
gaaaggaggcugccauucc

SEQ ID NO: 142108 - RNA, 19 nt, Homo sapiens
ugaaucuguuggcuaauga

SEQ ID NO: 142109 - RNA, 19 nt, Homo sapiens
uggaaaggcuguguggaaa

SEQ ID NO: 142110 - RNA, 19 nt, Homo sapiens
ugcauaagauugaagguau

SEQ ID NO: 142111 - RNA, 19 nt, Homo sapiens
gaagguggucuauggugaa

SEQ ID NO: 142112 - RNA, 19 nt, Homo sapiens
gaagcaggccuuauucaac

SEQ ID NO: 142113 - RNA, 19 nt, Homo sapiens
ugucauggguccaccuuug

SEQ ID NO: 142114 - RNA, 19 nt, Homo sapiens
gugaccagguuaaagaaga

SEQ ID NO: 142115 - RNA, 19 nt, Homo sapiens
gcaggagaugggaaguuua

SEQ ID NO: 142116 - RNA, 19 nt, Homo sapiens
ucaucaggcuguuaacuuc

SEQ ID NO: 142117 - RNA, 19 nt, Homo sapiens
gcacucacuacuggaauaa

SEQ ID NO: 142118 - RNA, 19 nt, Homo sapiens
ugaccagguuaaagaagaa

SEQ ID NO: 142119 - RNA, 19 nt, Homo sapiens
gcuuguacuagauuucuua

SEQ ID NO: 142120 - RNA, 19 nt, Homo sapiens
aaugucaucuuugcuugua

SEQ ID NO: 142121 - RNA, 19 nt, Homo sapiens
agaagucgccacacugaaa

SEQ ID NO: 142122 - RNA, 19 nt, Homo sapiens
guguggaaauucauugaug

SEQ ID NO: 142123 - RNA, 19 nt, Homo sapiens
ucccuaggauccuuuagaa

SEQ ID NO: 142124 - RNA, 19 nt, Homo sapiens
gagaagcaggccuuauuca

SEQ ID NO: 142125 - RNA, 19 nt, Homo sapiens
gaagucgccacacugaaau

SEQ ID NO: 142126 - RNA, 19 nt, Homo sapiens
gaugcugacauuguuauuu

SEQ ID NO: 142127 - RNA, 19 nt, Homo sapiens
ggaaaggcuguguggaaau

SEQ ID NO: 142128 - RNA, 19 nt, Homo sapiens
caagaggcaaagugguaua

SEQ ID NO: 142129 - RNA, 19 nt, Homo sapiens
augcugacauuguuauuug

SEQ ID NO: 142130 - RNA, 19 nt, Homo sapiens
acacccgacuuccucauga

SEQ ID NO: 142131 - RNA, 19 nt, Homo sapiens
ggaaaauggagacuuaauu

SEQ ID NO: 142132 - RNA, 19 nt, Homo sapiens
uggagaagcaggccuuauu

SEQ ID NO: 142133 - RNA, 19 nt, Homo sapiens
cuacuggaauaaagaaugg

SEQ ID NO: 142134 - RNA, 19 nt, Homo sapiens
gcaauugcugucuuucuca

SEQ ID NO: 142135 - RNA, 19 nt, Homo sapiens
gauaacugcacuuucaaca

SEQ ID NO: 142136 - RNA, 19 nt, Homo sapiens
gauguuggcucuggggaua

SEQ ID NO: 142137 - RNA, 19 nt, Homo sapiens
gauaaagguguuaacucuu

SEQ ID NO: 142138 - RNA, 19 nt, Homo sapiens
aagcaggccuuauucaacu

SEQ ID NO: 142139 - RNA, 19 nt, Homo sapiens
gaaguuuauuccucgaaaa

SEQ ID NO: 142140 - RNA, 19 nt, Homo sapiens
gagaugggaagguggucua

SEQ ID NO: 142141 - RNA, 19 nt, Homo sapiens
gcucugugauuuuacuuuu

SEQ ID NO: 142142 - RNA, 19 nt, Homo sapiens
ucaggaggcaccaccauga

SEQ ID NO: 142143 - RNA, 19 nt, Homo sapiens
gcacaaaugcagccaaaau

SEQ ID NO: 142144 - RNA, 19 nt, Homo sapiens
caagauguuuauggccuau

SEQ ID NO: 142145 - RNA, 19 nt, Homo sapiens
caggagaugggaaguuuau

SEQ ID NO: 142146 - RNA, 19 nt, Homo sapiens
ugaaauccagagugacaaa

SEQ ID NO: 142147 - RNA, 19 nt, Homo sapiens
ggaagaauagcuguaggau

SEQ ID NO: 142148 - RNA, 19 nt, Homo sapiens
caccaugauuauugauuuc

SEQ ID NO: 142149 - RNA, 19 nt, Homo sapiens
ggaaaggaggcugccauuc

SEQ ID NO: 142150 - RNA, 19 nt, Homo sapiens
uggcgaagcugggcugauc

SEQ ID NO: 142151 - RNA, 19 nt, Homo sapiens
ccaaaaggcacaaggacua

SEQ ID NO: 142152 - RNA, 19 nt, Homo sapiens
gugguaaaauggaugaaaa

SEQ ID NO: 142153 - RNA, 19 nt, Homo sapiens
ugagcaagucugcagcuaa

SEQ ID NO: 142154 - RNA, 19 nt, Homo sapiens
agaagcaggccuuauucaa

SEQ ID NO: 142155 - RNA, 19 nt, Homo sapiens
ccacagcagggaccaggaa

SEQ ID NO: 142156 - RNA, 19 nt, Homo sapiens
gagaagucgccacacugaa

SEQ ID NO: 142157 - RNA, 19 nt, Homo sapiens
ggcaccaccaugauuauug

SEQ ID NO: 142158 - RNA, 19 nt, Homo sapiens
caagauaaagguguuaacu

SEQ ID NO: 142159 - RNA, 19 nt, Homo sapiens
gcaagucugcagcuaaggu

SEQ ID NO: 142160 - RNA, 19 nt, Homo sapiens
gccggaguguucaguguca

SEQ ID NO: 142161 - RNA, 19 nt, Homo sapiens
ucuguuggcuaaugaugau

SEQ ID NO: 142162 - RNA, 19 nt, Homo sapiens
ucacuacuggaauaaagaa

SEQ ID NO: 142163 - RNA, 19 nt, Homo sapiens
ggagagagaugucuuauca

SEQ ID NO: 142164 - RNA, 19 nt, Homo sapiens
ggaggaaaccuuauaaauu

SEQ ID NO: 142165 - RNA, 19 nt, Homo sapiens
gaaccacacccaacacuua

SEQ ID NO: 142166 - RNA, 19 nt, Homo sapiens
aaagaucgcuuccagcuaa

SEQ ID NO: 142167 - RNA, 19 nt, Homo sapiens
gaaccacuaugaucauuga

SEQ ID NO: 142168 - RNA, 19 nt, Homo sapiens
gaagggaacugugguguau

SEQ ID NO: 142169 - RNA, 19 nt, Homo sapiens
gaacggacggcucccauua

SEQ ID NO: 142170 - RNA, 19 nt, Homo sapiens
gaacuggacauccuaauga

SEQ ID NO: 142171 - RNA, 19 nt, Homo sapiens
gaggaaauuugaacaaguu

SEQ ID NO: 142172 - RNA, 19 nt, Homo sapiens
gcacuuagaggaaauuuga

SEQ ID NO: 142173 - RNA, 19 nt, Homo sapiens
ggagaaauguguuuuauga

SEQ ID NO: 142174 - RNA, 19 nt, Homo sapiens
gaaagaggcccuauaaacu

SEQ ID NO: 142175 - RNA, 19 nt, Homo sapiens
caacagcucucucgaguac

SEQ ID NO: 142176 - RNA, 19 nt, Homo sapiens
cccagaagcuuuagaggua

SEQ ID NO: 142177 - RNA, 19 nt, Homo sapiens
cagaagugcuaagcuaaua

SEQ ID NO: 142178 - RNA, 19 nt, Homo sapiens
guucagaagugcuaagcua

SEQ ID NO: 142179 - RNA, 19 nt, Homo sapiens
acaagucucguguuuauua

SEQ ID NO: 142180 - RNA, 19 nt, Homo sapiens
gcuaacggauugccagauu

SEQ ID NO: 142181 - RNA, 19 nt, Homo sapiens
ugacuuguguugcauugua

SEQ ID NO: 142182 - RNA, 19 nt, Homo sapiens
caaccaaagucaccaguuc

SEQ ID NO: 142183 - RNA, 19 nt, Homo sapiens
gagggaagauaaagugaau

SEQ ID NO: 142184 - RNA, 19 nt, Homo sapiens
ggaaugacgucugcugaug

SEQ ID NO: 142185 - RNA, 19 nt, Homo sapiens
caccaagaguuacugauuu

SEQ ID NO: 142186 - RNA, 19 nt, Homo sapiens
ccagaaggcuguaggaaag

SEQ ID NO: 142187 - RNA, 19 nt, Homo sapiens
ccuuaaagcugcccucuug

SEQ ID NO: 142188 - RNA, 19 nt, Homo sapiens
gcagugacuugaugcucua

SEQ ID NO: 142189 - RNA, 19 nt, Homo sapiens
ucagauugaugacaacauu

SEQ ID NO: 142190 - RNA, 19 nt, Homo sapiens
uaacugcagugacuugaug

SEQ ID NO: 142191 - RNA, 19 nt, Homo sapiens
ccacuucccuacacaucua

SEQ ID NO: 142192 - RNA, 19 nt, Homo sapiens
ggacaaggcuguggucacu

SEQ ID NO: 142193 - RNA, 19 nt, Homo sapiens
uaacggauugccagauuua

SEQ ID NO: 142194 - RNA, 19 nt, Homo sapiens
ugaggauucucuucucuuu

SEQ ID NO: 142195 - RNA, 19 nt, Homo sapiens
aagcugcccucuugaaauu

SEQ ID NO: 142196 - RNA, 19 nt, Homo sapiens
uaaauuccuuccucgugua

SEQ ID NO: 142197 - RNA, 19 nt, Homo sapiens
gcagugcucucuggcuaaa

SEQ ID NO: 142198 - RNA, 19 nt, Homo sapiens
cuaaaggauuugagcguuu

SEQ ID NO: 142199 - RNA, 19 nt, Homo sapiens
uggaagcgcuugugaagga

SEQ ID NO: 142200 - RNA, 19 nt, Homo sapiens
caucgugucuguccugaga

SEQ ID NO: 142201 - RNA, 19 nt, Homo sapiens
gcaaacucaucgugucugu

SEQ ID NO: 142202 - RNA, 19 nt, Homo sapiens
cagguucucuuaagcaaug

SEQ ID NO: 142203 - RNA, 19 nt, Homo sapiens
gggaggaaaccuuauaaau

SEQ ID NO: 142204 - RNA, 19 nt, Homo sapiens
gggaagauaaagugaauug

SEQ ID NO: 142205 - RNA, 19 nt, Homo sapiens
gcugcccucuugaaauuaa

SEQ ID NO: 142206 - RNA, 19 nt, Homo sapiens
gaaauuugaacaaguugga

SEQ ID NO: 142207 - RNA, 19 nt, Homo sapiens
gcugcuuccugguuaagua

SEQ ID NO: 142208 - RNA, 19 nt, Homo sapiens
ggucagcuguugauaaagg

SEQ ID NO: 142209 - RNA, 19 nt, Homo sapiens
aaagagagacagaggauug

SEQ ID NO: 142210 - RNA, 19 nt, Homo sapiens
uaagagccugugauaguua

SEQ ID NO: 142211 - RNA, 19 nt, Homo sapiens
caaaggagguaaaauuguu

SEQ ID NO: 142212 - RNA, 19 nt, Homo sapiens
gaucaaaggagguaaaauu

SEQ ID NO: 142213 - RNA, 19 nt, Homo sapiens
gaauaacugcagugacuug

SEQ ID NO: 142214 - RNA, 19 nt, Homo sapiens
caaagucaccaguucagaa

SEQ ID NO: 142215 - RNA, 19 nt, Homo sapiens
uaaaggauuugagcguuug

SEQ ID NO: 142216 - RNA, 19 nt, Homo sapiens
gaaugacgucugcugauga

SEQ ID NO: 142217 - RNA, 19 nt, Homo sapiens
aacgauagaucacaucaga

SEQ ID NO: 142218 - RNA, 19 nt, Homo sapiens
uaaagacacacuacauaga

SEQ ID NO: 142219 - RNA, 19 nt, Homo sapiens
gauuugagcguuugccauu

SEQ ID NO: 142220 - RNA, 19 nt, Homo sapiens
gaucauugaccacguuguu

SEQ ID NO: 142221 - RNA, 19 nt, Homo sapiens
aaagacacacuacauagaa

SEQ ID NO: 142222 - RNA, 19 nt, Homo sapiens
ucuaaagacacacuacaua

SEQ ID NO: 142223 - RNA, 19 nt, Homo sapiens
gugcucagauugaugacaa

SEQ ID NO: 142224 - RNA, 19 nt, Homo sapiens
cuuaagaacucuguguuau

SEQ ID NO: 142225 - RNA, 19 nt, Homo sapiens
cgaagcgguugcacccuuu

SEQ ID NO: 142226 - RNA, 19 nt, Homo sapiens
caagugaaccaaccaaagu

SEQ ID NO: 142227 - RNA, 19 nt, Homo sapiens
aaacaccgagccucauuaa

SEQ ID NO: 142228 - RNA, 19 nt, Homo sapiens
ccucccaggucuaccauuu

SEQ ID NO: 142229 - RNA, 19 nt, Homo sapiens
uuaagagccugugauaguu

SEQ ID NO: 142230 - RNA, 19 nt, Homo sapiens
ggacaacuucacccugauu

SEQ ID NO: 142231 - RNA, 19 nt, Homo sapiens
gggaaccacuaugaucauu

SEQ ID NO: 142232 - RNA, 19 nt, Homo sapiens
guuaaaaccugacgauuuc

SEQ ID NO: 142233 - RNA, 19 nt, Homo sapiens
uaaacaccgagccucauua

SEQ ID NO: 142234 - RNA, 19 nt, Homo sapiens
agggucagcuguugauaaa

SEQ ID NO: 142235 - RNA, 19 nt, Homo sapiens
ugacgucugcugaugauuu

SEQ ID NO: 142236 - RNA, 19 nt, Homo sapiens
uaaagcugcccucuugaaa

SEQ ID NO: 142237 - RNA, 19 nt, Homo sapiens
caagucucguguuuauuau

SEQ ID NO: 142238 - RNA, 19 nt, Homo sapiens
ucacuugagucuuccuguu

SEQ ID NO: 142239 - RNA, 19 nt, Homo sapiens
caagaggagaaauguguuu

SEQ ID NO: 142240 - RNA, 19 nt, Homo sapiens
gacagaggauugcauucau

SEQ ID NO: 142241 - RNA, 19 nt, Homo sapiens
gggcaggcuugcguuauug

SEQ ID NO: 142242 - RNA, 19 nt, Homo sapiens
ccaacugcccgcuguauau

SEQ ID NO: 142243 - RNA, 19 nt, Homo sapiens
gaugaccagucguucuaug

SEQ ID NO: 142244 - RNA, 19 nt, Homo sapiens
ccaggagagagaugucuua

SEQ ID NO: 142245 - RNA, 19 nt, Homo sapiens
agaaagaggcccuauaaac

SEQ ID NO: 142246 - RNA, 19 nt, Homo sapiens
uagaacacaugggagcuuu

SEQ ID NO: 142247 - RNA, 19 nt, Homo sapiens
cuaaccaccugccaucaug

SEQ ID NO: 142248 - RNA, 19 nt, Homo sapiens
gaggagaggaagaaagaga

SEQ ID NO: 142249 - RNA, 19 nt, Homo sapiens
ucaccaagaguuacugauu

SEQ ID NO: 142250 - RNA, 19 nt, Homo sapiens
uccaaccacuccagacuuu

SEQ ID NO: 142251 - RNA, 19 nt, Homo sapiens
ccagauuuaugaaguacug

SEQ ID NO: 142252 - RNA, 19 nt, Homo sapiens
gauggaagcgcuugugaag

SEQ ID NO: 142253 - RNA, 19 nt, Homo sapiens
aguauucacuugagucuuc

SEQ ID NO: 142254 - RNA, 19 nt, Homo sapiens
agaaacacuugcagcucua

SEQ ID NO: 142255 - RNA, 19 nt, Homo sapiens
ggagggaagauaaagugaa

SEQ ID NO: 142256 - RNA, 19 nt, Homo sapiens
gacauucugagacuucuuu

SEQ ID NO: 142257 - RNA, 19 nt, Homo sapiens
cagcaccaaugcagccaaa

SEQ ID NO: 142258 - RNA, 19 nt, Homo sapiens
cuaacggauugccagauuu

SEQ ID NO: 142259 - RNA, 19 nt, Homo sapiens
gacaucagcgaguggcaua

SEQ ID NO: 142260 - RNA, 19 nt, Homo sapiens
uaaaguguguagccagaag

SEQ ID NO: 142261 - RNA, 19 nt, Homo sapiens
uaaagcugauaaagugugu

SEQ ID NO: 142262 - RNA, 19 nt, Homo sapiens
gaaagagagacagaggauu

SEQ ID NO: 142263 - RNA, 19 nt, Homo sapiens
uaaagacgcuuccuucuaa

SEQ ID NO: 142264 - RNA, 19 nt, Homo sapiens
gcauauaccucauugacua

SEQ ID NO: 142265 - RNA, 19 nt, Homo sapiens
gcacauccaugauaaauag

SEQ ID NO: 142266 - RNA, 19 nt, Homo sapiens
cauggaagauggcuuaaua

SEQ ID NO: 142267 - RNA, 19 nt, Homo sapiens
caucucagcuuauaugaaa

SEQ ID NO: 142268 - RNA, 19 nt, Homo sapiens
gaaugaagggccucucuua

SEQ ID NO: 142269 - RNA, 19 nt, Homo sapiens
ucacgugacuguuaaugua

SEQ ID NO: 142270 - RNA, 19 nt, Homo sapiens
gaaccaagaugcucauuuu

SEQ ID NO: 142271 - RNA, 19 nt, Homo sapiens
gagaagcccuuuccaguag

SEQ ID NO: 142272 - RNA, 19 nt, Homo sapiens
acacagagcucuaugagau

SEQ ID NO: 142273 - RNA, 19 nt, Homo sapiens
guacaccgauauuuaagaa

SEQ ID NO: 142274 - RNA, 19 nt, Homo sapiens
ucacaaaggucaugagcaa

SEQ ID NO: 142275 - RNA, 19 nt, Homo sapiens
ugacuaggcuguuacuuug

SEQ ID NO: 142276 - RNA, 19 nt, Homo sapiens
gaagaaauauguucaaccu

SEQ ID NO: 142277 - RNA, 19 nt, Homo sapiens
gaauaucucuuucccuauc

SEQ ID NO: 142278 - RNA, 19 nt, Homo sapiens
gcauagccuugauuuguuu

SEQ ID NO: 142279 - RNA, 19 nt, Homo sapiens
gcagaaucgucaaugauga

SEQ ID NO: 142280 - RNA, 19 nt, Homo sapiens
gaaaauggguuuacuucaa

SEQ ID NO: 142281 - RNA, 19 nt, Homo sapiens
cacauaaacucgcuucuga

SEQ ID NO: 142282 - RNA, 19 nt, Homo sapiens
gcaccaccaugaucauuga

SEQ ID NO: 142283 - RNA, 19 nt, Homo sapiens
gaagauggcuuaauaaaac

SEQ ID NO: 142284 - RNA, 19 nt, Homo sapiens
gagaagagcaggccucaga

SEQ ID NO: 142285 - RNA, 19 nt, Homo sapiens
gaaggaaagcgaauccaaa

SEQ ID NO: 142286 - RNA, 19 nt, Homo sapiens
gaauaucuguggguucuga

SEQ ID NO: 142287 - RNA, 19 nt, Homo sapiens
gcaaaugacacuucucuuc

SEQ ID NO: 142288 - RNA, 19 nt, Homo sapiens
gaaaggguguuugggaaau

SEQ ID NO: 142289 - RNA, 19 nt, Homo sapiens
caagcuaccuucuguucaa

SEQ ID NO: 142290 - RNA, 19 nt, Homo sapiens
uugccuagcuuuacgaaua

SEQ ID NO: 142291 - RNA, 19 nt, Homo sapiens
gcacaaacgcugccaagau

SEQ ID NO: 142292 - RNA, 19 nt, Homo sapiens
guucaucacgugacuguua

SEQ ID NO: 142293 - RNA, 19 nt, Homo sapiens
gcucuuaguuuacacuuca

SEQ ID NO: 142294 - RNA, 19 nt, Homo sapiens
gagcagagggagcacauuu

SEQ ID NO: 142295 - RNA, 19 nt, Homo sapiens
ucacgacugucuauacuga

SEQ ID NO: 142296 - RNA, 19 nt, Homo sapiens
ucaaacaggccuauacaaa

SEQ ID NO: 142297 - RNA, 19 nt, Homo sapiens
uaagggagauguaguaaaa

SEQ ID NO: 142298 - RNA, 19 nt, Homo sapiens
uaagcaagccuuccucaaa

SEQ ID NO: 142299 - RNA, 19 nt, Homo sapiens
uaucacaucucugaguuaa

SEQ ID NO: 142300 - RNA, 19 nt, Homo sapiens
gcaagaucaugcuggaaga

SEQ ID NO: 142301 - RNA, 19 nt, Homo sapiens
caaaugcccuugggaggaa

SEQ ID NO: 142302 - RNA, 19 nt, Homo sapiens
gcacugcccuugggacuuc

SEQ ID NO: 142303 - RNA, 19 nt, Homo sapiens
gcucaggccucuuucuuag

SEQ ID NO: 142304 - RNA, 19 nt, Homo sapiens
ggacaucacccacuggaau

SEQ ID NO: 142305 - RNA, 19 nt, Homo sapiens
cacaguagaugacuucuuc

SEQ ID NO: 142306 - RNA, 19 nt, Homo sapiens
cauuguaaguucccucuuu

SEQ ID NO: 142307 - RNA, 19 nt, Homo sapiens
gaggcagaaucgucaauga

SEQ ID NO: 142308 - RNA, 19 nt, Homo sapiens
gaagggguguuguauauug

SEQ ID NO: 142309 - RNA, 19 nt, Homo sapiens
ccaaacgguugugaucuaa

SEQ ID NO: 142310 - RNA, 19 nt, Homo sapiens
guagagcuauuucuuguac

SEQ ID NO: 142311 - RNA, 19 nt, Homo sapiens
caaccucucugugccauga

SEQ ID NO: 142312 - RNA, 19 nt, Homo sapiens
ugccagaucugaagcauau

SEQ ID NO: 142313 - RNA, 19 nt, Homo sapiens
cagcugaccucaucucaca

SEQ ID NO: 142314 - RNA, 19 nt, Homo sapiens
ggagcaaacccgcauguug

SEQ ID NO: 142315 - RNA, 19 nt, Homo sapiens
ggauuuguaucaaguaucu

SEQ ID NO: 142316 - RNA, 19 nt, Homo sapiens
gcagccagcauucauugua

SEQ ID NO: 142317 - RNA, 19 nt, Homo sapiens
acacugggcuacaaaggaa

SEQ ID NO: 142318 - RNA, 19 nt, Homo sapiens
cacaaacgcugccaagauc

SEQ ID NO: 142319 - RNA, 19 nt, Homo sapiens
gaagaguugcugugacuau

SEQ ID NO: 142320 - RNA, 19 nt, Homo sapiens
guaaguucccucuuugaaa

SEQ ID NO: 142321 - RNA, 19 nt, Homo sapiens
cagccagcauucauuguaa

SEQ ID NO: 142322 - RNA, 19 nt, Homo sapiens
ggaaaggguguuugggaaa

SEQ ID NO: 142323 - RNA, 19 nt, Homo sapiens
gaacccagauggcaaucca

SEQ ID NO: 142324 - RNA, 19 nt, Homo sapiens
gaguggaagugacaugaug

SEQ ID NO: 142325 - RNA, 19 nt, Homo sapiens
uuacaugcaugcaaucaga

SEQ ID NO: 142326 - RNA, 19 nt, Homo sapiens
gaacccaccugugaggaau

SEQ ID NO: 142327 - RNA, 19 nt, Homo sapiens
caaggcggcugcauuugug

SEQ ID NO: 142328 - RNA, 19 nt, Homo sapiens
ugagaagcccuuuccagua

SEQ ID NO: 142329 - RNA, 19 nt, Homo sapiens
ugaagcauauaccucauug

SEQ ID NO: 142330 - RNA, 19 nt, Homo sapiens
gagcaaguccugugagcaa

SEQ ID NO: 142331 - RNA, 19 nt, Homo sapiens
cagcuuauaugaaagucaa

SEQ ID NO: 142332 - RNA, 19 nt, Homo sapiens
ggacagagcaaaugacacu

SEQ ID NO: 142333 - RNA, 19 nt, Homo sapiens
gagaaggcaggcagucuuu

SEQ ID NO: 142334 - RNA, 19 nt, Homo sapiens
gcagaagcaagaagagauu

SEQ ID NO: 142335 - RNA, 19 nt, Homo sapiens
gaucgucucugccaagaac

SEQ ID NO: 142336 - RNA, 19 nt, Homo sapiens
guuaacuccuucaugguuu

SEQ ID NO: 142337 - RNA, 19 nt, Homo sapiens
gcaucgauguccauacuca

SEQ ID NO: 142338 - RNA, 19 nt, Homo sapiens
uuacauggaagauggcuua

SEQ ID NO: 142339 - RNA, 19 nt, Homo sapiens
guacuaagugcuuugaaga

SEQ ID NO: 142340 - RNA, 19 nt, Homo sapiens
uaggucaucucagcuuaua

SEQ ID NO: 142341 - RNA, 19 nt, Homo sapiens
cuucagcacugcccagaaa

SEQ ID NO: 142342 - RNA, 19 nt, Homo sapiens
gagugcagcugaccucauc

SEQ ID NO: 142343 - RNA, 19 nt, Homo sapiens
ugacugaggccuaugagaa

SEQ ID NO: 142344 - RNA, 19 nt, Homo sapiens
ggaaugaccacaguagaug

SEQ ID NO: 142345 - RNA, 19 nt, Homo sapiens
caggaagccucucuuucuu

SEQ ID NO: 142346 - RNA, 19 nt, Homo sapiens
uagggaagcuugcuauuuu

SEQ ID NO: 142347 - RNA, 19 nt, Homo sapiens
ucuaauaucacaucucuga

SEQ ID NO: 142348 - RNA, 19 nt, Homo sapiens
guucuaauaucacaucucu

SEQ ID NO: 142349 - RNA, 19 nt, Homo sapiens
gggaagaguugcugugacu

SEQ ID NO: 142350 - RNA, 19 nt, Homo sapiens
cagcauucauuguaaguuc

SEQ ID NO: 142351 - RNA, 19 nt, Homo sapiens
uaguagagcuauuucuugu

SEQ ID NO: 142352 - RNA, 19 nt, Homo sapiens
gggaaauuguuaaaucagu

SEQ ID NO: 142353 - RNA, 19 nt, Homo sapiens
aaaagacuauuuccccuua

SEQ ID NO: 142354 - RNA, 19 nt, Homo sapiens
ugacugcagguuugaauaa

SEQ ID NO: 142355 - RNA, 19 nt, Homo sapiens
cgaucuaccuugucuguca

SEQ ID NO: 142356 - RNA, 19 nt, Homo sapiens
ggaccugguuccaccuuuc

SEQ ID NO: 142357 - RNA, 19 nt, Homo sapiens
gauccuggcacauccauga

SEQ ID NO: 142358 - RNA, 19 nt, Homo sapiens
ugacguacguuauuuccau

SEQ ID NO: 142359 - RNA, 19 nt, Homo sapiens
gguguuguauauuguguug

SEQ ID NO: 142360 - RNA, 19 nt, Homo sapiens
aaugguacaccgauauuua

SEQ ID NO: 142361 - RNA, 19 nt, Homo sapiens
ggccaaggcggcugcauuu

SEQ ID NO: 142362 - RNA, 19 nt, Homo sapiens
uacuaacucuccaagcaua

SEQ ID NO: 142363 - RNA, 19 nt, Homo sapiens
caacaggaauggcuucaaa

SEQ ID NO: 142364 - RNA, 19 nt, Homo sapiens
cauaaacaguguacagaua

SEQ ID NO: 142365 - RNA, 19 nt, Homo sapiens
ggauuuggcucuuacauca

SEQ ID NO: 142366 - RNA, 19 nt, Homo sapiens
gcuauaaguuucaucuguu

SEQ ID NO: 142367 - RNA, 19 nt, Homo sapiens
gaaauucaccagcugaguu

SEQ ID NO: 142368 - RNA, 19 nt, Homo sapiens
ugaaagaaaugcuuaucug

SEQ ID NO: 142369 - RNA, 19 nt, Homo sapiens
uacaagcacuagaaaguuu

SEQ ID NO: 142370 - RNA, 19 nt, Homo sapiens
ccagagcugcuaucaauaa

SEQ ID NO: 142371 - RNA, 19 nt, Homo sapiens
gaaagaaaugcuuaucugu

SEQ ID NO: 142372 - RNA, 19 nt, Homo sapiens
gagacagcaacaagaauua

SEQ ID NO: 142373 - RNA, 19 nt, Homo sapiens
gaaaggccaguucucguuu

SEQ ID NO: 142374 - RNA, 19 nt, Homo sapiens
gaacugcugcacugaauuc

SEQ ID NO: 142375 - RNA, 19 nt, Homo sapiens
cuagaaaguuugggauuug

SEQ ID NO: 142376 - RNA, 19 nt, Homo sapiens
gcugugcucucucuagaau

SEQ ID NO: 142377 - RNA, 19 nt, Homo sapiens
gcagcaagucuucguuuga

SEQ ID NO: 142378 - RNA, 19 nt, Homo sapiens
ugaagaagaguuauugaga

SEQ ID NO: 142379 - RNA, 19 nt, Homo sapiens
ucauucaccuuauaucuuc

SEQ ID NO: 142380 - RNA, 19 nt, Homo sapiens
ggacuugucauugguauuc

SEQ ID NO: 142381 - RNA, 19 nt, Homo sapiens
cagcugaguuucuauuucu

SEQ ID NO: 142382 - RNA, 19 nt, Homo sapiens
gggcugugcucucucuaga

SEQ ID NO: 142383 - RNA, 19 nt, Homo sapiens
agucuucguuugaucauaa

SEQ ID NO: 142384 - RNA, 19 nt, Homo sapiens
guugugugcuauacaugua

SEQ ID NO: 142385 - RNA, 19 nt, Homo sapiens
ggccaguucucguuuggaa

SEQ ID NO: 142386 - RNA, 19 nt, Homo sapiens
gcaagaguguaaaacagua

SEQ ID NO: 142387 - RNA, 19 nt, Homo sapiens
cugcugcacugaauucauu

SEQ ID NO: 142388 - RNA, 19 nt, Homo sapiens
cagagcugcuaucaauaaa

SEQ ID NO: 142389 - RNA, 19 nt, Homo sapiens
gaaacaggaagguacuaug

SEQ ID NO: 142390 - RNA, 19 nt, Homo sapiens
gcaagucuucguuugauca

SEQ ID NO: 142391 - RNA, 19 nt, Homo sapiens
caacgaugaugaucucacu

SEQ ID NO: 142392 - RNA, 19 nt, Homo sapiens
gugaacugcugcacugaau

SEQ ID NO: 142393 - RNA, 19 nt, Homo sapiens
cagcaagucuucguuugau

SEQ ID NO: 142394 - RNA, 19 nt, Homo sapiens
ugagacagcaacaagaauu

SEQ ID NO: 142395 - RNA, 19 nt, Homo sapiens
acuagaaaguuugggauuu

SEQ ID NO: 142396 - RNA, 19 nt, Homo sapiens
cuauaaguuucaucuguug

SEQ ID NO: 142397 - RNA, 19 nt, Homo sapiens
aagaagaguuauugagaca

SEQ ID NO: 142398 - RNA, 19 nt, Homo sapiens
gcucuuacaucagugaagu

SEQ ID NO: 142399 - RNA, 19 nt, Homo sapiens
gagcugcuaucaauaaaau

SEQ ID NO: 142400 - RNA, 19 nt, Homo sapiens
ccaaacucauccuaaaucu

SEQ ID NO: 142401 - RNA, 19 nt, Homo sapiens
aggaauggcuucaaaugca

SEQ ID NO: 142402 - RNA, 19 nt, Homo sapiens
gaugucugcuauaaguuuc

SEQ ID NO: 142403 - RNA, 19 nt, Homo sapiens
ccagcugaguuucuauuuc

SEQ ID NO: 142404 - RNA, 19 nt, Homo sapiens
ggcgggaucuucucaggau

SEQ ID NO: 142405 - RNA, 19 nt, Homo sapiens
cauacaagcacuagaaagu

SEQ ID NO: 142406 - RNA, 19 nt, Homo sapiens
aaacucauccuaaaucucu

SEQ ID NO: 142407 - RNA, 19 nt, Homo sapiens
gaucauaaacaguguacag

SEQ ID NO: 142408 - RNA, 19 nt, Homo sapiens
uuucaucuguugugugcua

SEQ ID NO: 142409 - RNA, 19 nt, Homo sapiens
gccuggcucuguccauauu

SEQ ID NO: 142410 - RNA, 19 nt, Homo sapiens
gacagcaacaagaauuauu

SEQ ID NO: 142411 - RNA, 19 nt, Homo sapiens
caccagagcaugucauaca

SEQ ID NO: 142412 - RNA, 19 nt, Homo sapiens
acagugaaagaaaugcuua

SEQ ID NO: 142413 - RNA, 19 nt, Homo sapiens
aaauucaccagcugaguuu

SEQ ID NO: 142414 - RNA, 19 nt, Homo sapiens
gagagcugguggugaacug

SEQ ID NO: 142415 - RNA, 19 nt, Homo sapiens
cucgagagcugguggugaa

SEQ ID NO: 142416 - RNA, 19 nt, Homo sapiens
ugucauacaagcacuagaa

SEQ ID NO: 142417 - RNA, 19 nt, Homo sapiens
gacagcaacaagcagaauu

SEQ ID NO: 142418 - RNA, 19 nt, Homo sapiens
aaaggccaguucucguuug

SEQ ID NO: 142419 - RNA, 19 nt, Homo sapiens
uuagauagcagcaagucuu

SEQ ID NO: 142420 - RNA, 19 nt, Homo sapiens
cagcaacaagaauuauuug

SEQ ID NO: 142421 - RNA, 19 nt, Homo sapiens
aaacaggaagguacuaugg

SEQ ID NO: 142422 - RNA, 19 nt, Homo sapiens
gaagccaaugagauuugua

SEQ ID NO: 142423 - RNA, 19 nt, Homo sapiens
gagaaacaggaagguacua

SEQ ID NO: 142424 - RNA, 19 nt, Homo sapiens
uagcagcaagucuucguuu

SEQ ID NO: 142425 - RNA, 19 nt, Homo sapiens
aaacugucucuuugaacua

SEQ ID NO: 142426 - RNA, 19 nt, Homo sapiens
ccucagccagugcaucuaa

SEQ ID NO: 142427 - RNA, 19 nt, Homo sapiens
uaaguuucaucuguugugu

SEQ ID NO: 142428 - RNA, 19 nt, Homo sapiens
ccccagagcugcuaucaau

SEQ ID NO: 142429 - RNA, 19 nt, Homo sapiens
uaaacaguguacagauaac

SEQ ID NO: 142430 - RNA, 19 nt, Homo sapiens
gggaucuucucaggaugaa

SEQ ID NO: 142431 - RNA, 19 nt, Homo sapiens
uggcauuccugaagaagag

SEQ ID NO: 142432 - RNA, 19 nt, Homo sapiens
guguaaaacaguagcauua

SEQ ID NO: 142433 - RNA, 19 nt, Homo sapiens
guuugggauuuggcucuua

SEQ ID NO: 142434 - RNA, 19 nt, Homo sapiens
uaacaaaucggaaaagaag

SEQ ID NO: 142435 - RNA, 19 nt, Homo sapiens
aagccaaugagauuuguaa

SEQ ID NO: 142436 - RNA, 19 nt, Homo sapiens
ugcuauaaguuucaucugu

SEQ ID NO: 142437 - RNA, 19 nt, Homo sapiens
uggcaacgaugaugaucuc

SEQ ID NO: 142438 - RNA, 19 nt, Homo sapiens
uucccaaacucauccuaaa

SEQ ID NO: 142439 - RNA, 19 nt, Homo sapiens
acaggaauggcuucaaaug

SEQ ID NO: 142440 - RNA, 19 nt, Homo sapiens
gcucuguccauauuaguuc

SEQ ID NO: 142441 - RNA, 19 nt, Homo sapiens
gccaaugagauuuguaaca

SEQ ID NO: 142442 - RNA, 19 nt, Homo sapiens
ugaagccaaugagauuugu

SEQ ID NO: 142443 - RNA, 19 nt, Homo sapiens
aaagaagaaaggccaguuc

SEQ ID NO: 142444 - RNA, 19 nt, Homo sapiens
ccugguguuuaugaaauuu

SEQ ID NO: 142445 - RNA, 19 nt, Homo sapiens
gugaaagaaaugcuuaucu

SEQ ID NO: 142446 - RNA, 19 nt, Homo sapiens
ggugaacugcugcacugaa

SEQ ID NO: 142447 - RNA, 19 nt, Homo sapiens
gcuccuccuccguucauuu

SEQ ID NO: 142448 - RNA, 19 nt, Homo sapiens
uugccuggcucuguccaua

SEQ ID NO: 142449 - RNA, 19 nt, Homo sapiens
gggauuuggcucuuacauc

SEQ ID NO: 142450 - RNA, 19 nt, Homo sapiens
cgaugaugaucucacuauc

SEQ ID NO: 142451 - RNA, 19 nt, Homo sapiens
gcaucuugguggacuuguc

SEQ ID NO: 142452 - RNA, 19 nt, Homo sapiens
acagcaacaagcagaauug

SEQ ID NO: 142453 - RNA, 19 nt, Homo sapiens
gcaugucauacaagcacua

SEQ ID NO: 142454 - RNA, 19 nt, Homo sapiens
ugugugcuauacauguaaa

SEQ ID NO: 142455 - RNA, 19 nt, Homo sapiens
auacaagcacuagaaaguu

SEQ ID NO: 142456 - RNA, 19 nt, Homo sapiens
gaccaucucaccagagcau

SEQ ID NO: 142457 - RNA, 19 nt, Homo sapiens
ucauaaacaguguacagau

SEQ ID NO: 142458 - RNA, 19 nt, Homo sapiens
ccacuuucuucccaaacuc

SEQ ID NO: 142459 - RNA, 19 nt, Homo sapiens
cccaaacucauccuaaauc

SEQ ID NO: 142460 - RNA, 19 nt, Homo sapiens
guggacuugucauugguau

SEQ ID NO: 142461 - RNA, 19 nt, Homo sapiens
gguggacuugucauuggua

SEQ ID NO: 142462 - RNA, 19 nt, Homo sapiens
uagaaaguuugggauuugg

SEQ ID NO: 142463 - RNA, 19 nt, Homo sapiens
gaaccaacaucuauaagaa

SEQ ID NO: 142464 - RNA, 19 nt, Homo sapiens
gaagaaagauuacaguacu

SEQ ID NO: 142465 - RNA, 19 nt, Homo sapiens
gaagaaccaacaucuauaa

SEQ ID NO: 142466 - RNA, 19 nt, Homo sapiens
ggauuuauauguacuguug

SEQ ID NO: 142467 - RNA, 19 nt, Homo sapiens
ggacaacaaucagauagaa

SEQ ID NO: 142468 - RNA, 19 nt, Homo sapiens
ccuaacaacucgaauaauu

SEQ ID NO: 142469 - RNA, 19 nt, Homo sapiens
gaagacaucauaagacauu

SEQ ID NO: 142470 - RNA, 19 nt, Homo sapiens
caaauacgauuauccacuu

SEQ ID NO: 142471 - RNA, 19 nt, Homo sapiens
uaacauagucuguggagua

SEQ ID NO: 142472 - RNA, 19 nt, Homo sapiens
ggaagaaccaacaucuaua

SEQ ID NO: 142473 - RNA, 19 nt, Homo sapiens
gauuggauuuguagugaua

SEQ ID NO: 142474 - RNA, 19 nt, Homo sapiens
gaacuagaacuuagaacuu

SEQ ID NO: 142475 - RNA, 19 nt, Homo sapiens
guucuagcauggcauauuu

SEQ ID NO: 142476 - RNA, 19 nt, Homo sapiens
gaaaggacaaauaugauug

SEQ ID NO: 142477 - RNA, 19 nt, Homo sapiens
gaauuguccucucuuuguu

SEQ ID NO: 142478 - RNA, 19 nt, Homo sapiens
gaagaaguguucaccacau

SEQ ID NO: 142479 - RNA, 19 nt, Homo sapiens
acgaagagcuggacaacaa

SEQ ID NO: 142480 - RNA, 19 nt, Homo sapiens
gaugcaguuugcugaaaua

SEQ ID NO: 142481 - RNA, 19 nt, Homo sapiens
uaaaucagcgcuucaaaga

SEQ ID NO: 142482 - RNA, 19 nt, Homo sapiens
uauaugaggugccaguuga

SEQ ID NO: 142483 - RNA, 19 nt, Homo sapiens
gcaguguccuuucuugaug

SEQ ID NO: 142484 - RNA, 19 nt, Homo sapiens
caagguagauguguauauc

SEQ ID NO: 142485 - RNA, 19 nt, Homo sapiens
ggaucaagguagaugugua

SEQ ID NO: 142486 - RNA, 19 nt, Homo sapiens
gcauagguuuagcaguaua

SEQ ID NO: 142487 - RNA, 19 nt, Homo sapiens
augcauagguuuagcagua

SEQ ID NO: 142488 - RNA, 19 nt, Homo sapiens
guacugcccucuccagauc

SEQ ID NO: 142489 - RNA, 19 nt, Homo sapiens
ucacagugcuuucuggaau

SEQ ID NO: 142490 - RNA, 19 nt, Homo sapiens
gucacuaccuucaugcaua

SEQ ID NO: 142491 - RNA, 19 nt, Homo sapiens
ccacagaccugccuuucca

SEQ ID NO: 142492 - RNA, 19 nt, Homo sapiens
uaucgaugcuguuggcuuu

SEQ ID NO: 142493 - RNA, 19 nt, Homo sapiens
caucuugguugccagcaua

SEQ ID NO: 142494 - RNA, 19 nt, Homo sapiens
caccugacguggagacuuu

SEQ ID NO: 142495 - RNA, 19 nt, Homo sapiens
aaucagcgcuucaaagaca

SEQ ID NO: 142496 - RNA, 19 nt, Homo sapiens
acuacaagguuuagcauuu

SEQ ID NO: 142497 - RNA, 19 nt, Homo sapiens
cauagucuguggaguauuc

SEQ ID NO: 142498 - RNA, 19 nt, Homo sapiens
cagcauaccggcuuaaaga

SEQ ID NO: 142499 - RNA, 19 nt, Homo sapiens
ccuggcagcuuuagcauug

SEQ ID NO: 142500 - RNA, 19 nt, Homo sapiens
cuacggcugugacuuuaaa

SEQ ID NO: 142501 - RNA, 19 nt, Homo sapiens
cauaaaagauucugacgaa

SEQ ID NO: 142502 - RNA, 19 nt, Homo sapiens
cagcgucuauucccucaaa

SEQ ID NO: 142503 - RNA, 19 nt, Homo sapiens
gaguaugugucaggcauuu

SEQ ID NO: 142504 - RNA, 19 nt, Homo sapiens
cgaaaggacaaauaugauu

SEQ ID NO: 142505 - RNA, 19 nt, Homo sapiens
aagaaugguugcucaguga

SEQ ID NO: 142506 - RNA, 19 nt, Homo sapiens
uugcaaaggucuucaacuu

SEQ ID NO: 142507 - RNA, 19 nt, Homo sapiens
aagaaguguucaccacaua

SEQ ID NO: 142508 - RNA, 19 nt, Homo sapiens
ggcgaaaggacaaauauga

SEQ ID NO: 142509 - RNA, 19 nt, Homo sapiens
cuacaagguuuagcauuug

SEQ ID NO: 142510 - RNA, 19 nt, Homo sapiens
acaaauggaggauuacgua

SEQ ID NO: 142511 - RNA, 19 nt, Homo sapiens
gaucaagguagauguguau

SEQ ID NO: 142512 - RNA, 19 nt, Homo sapiens
agaccugccuuuccacauu

SEQ ID NO: 142513 - RNA, 19 nt, Homo sapiens
uaauuuggaucaugaccuu

SEQ ID NO: 142514 - RNA, 19 nt, Homo sapiens
gaaugguugcucagugaua

SEQ ID NO: 142515 - RNA, 19 nt, Homo sapiens
ugcagaagcuccucacaga

SEQ ID NO: 142516 - RNA, 19 nt, Homo sapiens
caacaaucagauagaagua

SEQ ID NO: 142517 - RNA, 19 nt, Homo sapiens
gcucuuagaacuagaacuu

SEQ ID NO: 142518 - RNA, 19 nt, Homo sapiens
ggagagcacaggaggcaaa

SEQ ID NO: 142519 - RNA, 19 nt, Homo sapiens
gaaauaaaucagcgcuuca

SEQ ID NO: 142520 - RNA, 19 nt, Homo sapiens
cauaccggcuuaaagaaug

SEQ ID NO: 142521 - RNA, 19 nt, Homo sapiens
caaaaugauugaacccuuu

SEQ ID NO: 142522 - RNA, 19 nt, Homo sapiens
gcaguggccuuuucaguug

SEQ ID NO: 142523 - RNA, 19 nt, Homo sapiens
ugacuggaaugaugaucuu

SEQ ID NO: 142524 - RNA, 19 nt, Homo sapiens
gaccugccuuuccacauug

SEQ ID NO: 142525 - RNA, 19 nt, Homo sapiens
gauugucguucuagccauu

SEQ ID NO: 142526 - RNA, 19 nt, Homo sapiens
cagaaggagugaaaauuuu

SEQ ID NO: 142527 - RNA, 19 nt, Homo sapiens
uaaagggaaugcugaugca

SEQ ID NO: 142528 - RNA, 19 nt, Homo sapiens
acagauugcugggcuuauu

SEQ ID NO: 142529 - RNA, 19 nt, Homo sapiens
uugguuguauccauuguua

SEQ ID NO: 142530 - RNA, 19 nt, Homo sapiens
cagcuaguguggcauuuca

SEQ ID NO: 142531 - RNA, 19 nt, Homo sapiens
cggauuggauuuguaguga

SEQ ID NO: 142532 - RNA, 19 nt, Homo sapiens
agacauuucuggaucaucu

SEQ ID NO: 142533 - RNA, 19 nt, Homo sapiens
gaucuuccucucaacauug

SEQ ID NO: 142534 - RNA, 19 nt, Homo sapiens
ggaaugcugaugcaguuug

SEQ ID NO: 142535 - RNA, 19 nt, Homo sapiens
ucacaaauagagaagacua

SEQ ID NO: 142536 - RNA, 19 nt, Homo sapiens
agaagcuccucacagagua

SEQ ID NO: 142537 - RNA, 19 nt, Homo sapiens
gguuguauccauuguuaaa

SEQ ID NO: 142538 - RNA, 19 nt, Homo sapiens
caaauggaggauuacguaa

SEQ ID NO: 142539 - RNA, 19 nt, Homo sapiens
gaagugaaaagcucaauau

SEQ ID NO: 142540 - RNA, 19 nt, Homo sapiens
gcuuaaccgguaugaauuu

SEQ ID NO: 142541 - RNA, 19 nt, Homo sapiens
gcucagugauauuguuucu

SEQ ID NO: 142542 - RNA, 19 nt, Homo sapiens
aggaagacaucauaagaca

SEQ ID NO: 142543 - RNA, 19 nt, Homo sapiens
ucacuaccuucaugcauag

SEQ ID NO: 142544 - RNA, 19 nt, Homo sapiens
uuguagcacugacagauuu

SEQ ID NO: 142545 - RNA, 19 nt, Homo sapiens
cagccucauucucgacuuu

SEQ ID NO: 142546 - RNA, 19 nt, Homo sapiens
uggaagaaccaacaucuau

SEQ ID NO: 142547 - RNA, 19 nt, Homo sapiens
gcauaccggcuuaaagaau

SEQ ID NO: 142548 - RNA, 19 nt, Homo sapiens
gaaagauuacaguacuuca

SEQ ID NO: 142549 - RNA, 19 nt, Homo sapiens
guauaucguuggaacugau

SEQ ID NO: 142550 - RNA, 19 nt, Homo sapiens
aaaaucaguuguacaguga

SEQ ID NO: 142551 - RNA, 19 nt, Homo sapiens
ucagcaguguccuuucuug

SEQ ID NO: 142552 - RNA, 19 nt, Homo sapiens
cuacaggcucuuagaacua

SEQ ID NO: 142553 - RNA, 19 nt, Homo sapiens
agagaagacuaauauugca

SEQ ID NO: 142554 - RNA, 19 nt, Homo sapiens
ccaguuggcuuuugggauu

SEQ ID NO: 142555 - RNA, 19 nt, Homo sapiens
gauugaacccuuugggaau

SEQ ID NO: 142556 - RNA, 19 nt, Homo sapiens
acaggaagacaucauaaga

SEQ ID NO: 142557 - RNA, 19 nt, Homo sapiens
aagcuuaaccgguaugaau

SEQ ID NO: 142558 - RNA, 19 nt, Homo sapiens
agaauuguccucucuuugu

SEQ ID NO: 142559 - RNA, 19 nt, Homo sapiens
gcuggacaacaaucagaua

SEQ ID NO: 142560 - RNA, 19 nt, Homo sapiens
gcgaaaggacaaauaugau

SEQ ID NO: 142561 - RNA, 19 nt, Homo sapiens
gcuaaaggcaagaagaagu

SEQ ID NO: 142562 - RNA, 19 nt, Homo sapiens
gugauauuguuucugguau

SEQ ID NO: 142563 - RNA, 19 nt, Homo sapiens
gaaaugugauugcaacuga

SEQ ID NO: 142564 - RNA, 19 nt, Homo sapiens
ccacauuucuggccauuua

SEQ ID NO: 142565 - RNA, 19 nt, Homo sapiens
gugcaugccuucauaaauu

SEQ ID NO: 142566 - RNA, 19 nt, Homo sapiens
ccauuuaacuagcacuuua

SEQ ID NO: 142567 - RNA, 19 nt, Homo sapiens
ucacuggauugaugauuua

SEQ ID NO: 142568 - RNA, 19 nt, Homo sapiens
guaggugcaugccuucaua

SEQ ID NO: 142569 - RNA, 19 nt, Homo sapiens
gaaagccugucgaauguuc

SEQ ID NO: 142570 - RNA, 19 nt, Homo sapiens
ggacaugucuuuggcuuca

SEQ ID NO: 142571 - RNA, 19 nt, Homo sapiens
ggacuucucuguucguauc

SEQ ID NO: 142572 - RNA, 19 nt, Homo sapiens
ggacauaugccaucucauc

SEQ ID NO: 142573 - RNA, 19 nt, Homo sapiens
ggcaaagaaucaacaguga

SEQ ID NO: 142574 - RNA, 19 nt, Homo sapiens
gcauggaccuugucuguac

SEQ ID NO: 142575 - RNA, 19 nt, Homo sapiens
uuaacuccguuuccaaaua

SEQ ID NO: 142576 - RNA, 19 nt, Homo sapiens
gagaagauccaacccauca

SEQ ID NO: 142577 - RNA, 19 nt, Homo sapiens
aaacaaauacggcgcauug

SEQ ID NO: 142578 - RNA, 19 nt, Homo sapiens
gaaacuaaaguccugaaga

SEQ ID NO: 142579 - RNA, 19 nt, Homo sapiens
ggguugaguuugcuguaua

SEQ ID NO: 142580 - RNA, 19 nt, Homo sapiens
gaucauggguguguuugug

SEQ ID NO: 142581 - RNA, 19 nt, Homo sapiens
gagaagacauguauuuuca

SEQ ID NO: 142582 - RNA, 19 nt, Homo sapiens
caaauagggcaaagaauca

SEQ ID NO: 142583 - RNA, 19 nt, Homo sapiens
gaccuugucuguacucauc

SEQ ID NO: 142584 - RNA, 19 nt, Homo sapiens
ggaaggcaguggcugagau

SEQ ID NO: 142585 - RNA, 19 nt, Homo sapiens
ucugugagauucuaaaugu

SEQ ID NO: 142586 - RNA, 19 nt, Homo sapiens
gcucugggcucucgaaagg

SEQ ID NO: 142587 - RNA, 19 nt, Homo sapiens
cuacaggauugcucagaaa

SEQ ID NO: 142588 - RNA, 19 nt, Homo sapiens
caaggugaccaacuucuuu

SEQ ID NO: 142589 - RNA, 19 nt, Homo sapiens
uggaaagccugucgaaugu

SEQ ID NO: 142590 - RNA, 19 nt, Homo sapiens
ccaaauagggcaaagaauc

SEQ ID NO: 142591 - RNA, 19 nt, Homo sapiens
ugcaugccuucauaaauua

SEQ ID NO: 142592 - RNA, 19 nt, Homo sapiens
gcaaagaaucaacagugaa

SEQ ID NO: 142593 - RNA, 19 nt, Homo sapiens
gucuuuggcuucagaauug

SEQ ID NO: 142594 - RNA, 19 nt, Homo sapiens
aaacuaagguacggugaga

SEQ ID NO: 142595 - RNA, 19 nt, Homo sapiens
aaacuaaaguccugaagac

SEQ ID NO: 142596 - RNA, 19 nt, Homo sapiens
gucacuggauugaugauuu

SEQ ID NO: 142597 - RNA, 19 nt, Homo sapiens
uaacuccguuuccaaauac

SEQ ID NO: 142598 - RNA, 19 nt, Homo sapiens
ccauagagacggugaguau

SEQ ID NO: 142599 - RNA, 19 nt, Homo sapiens
ugaacaaucuccagcucuu

SEQ ID NO: 142600 - RNA, 19 nt, Homo sapiens
ggacagguauugggcuauc

SEQ ID NO: 142601 - RNA, 19 nt, Homo sapiens
gacagugaccugcagauga

SEQ ID NO: 142602 - RNA, 19 nt, Homo sapiens
caguaggagugagaaauuu

SEQ ID NO: 142603 - RNA, 19 nt, Homo sapiens
cagcaaaguuuucagauug

SEQ ID NO: 142604 - RNA, 19 nt, Homo sapiens
gcuguuggcuaccuuucuu

SEQ ID NO: 142605 - RNA, 19 nt, Homo sapiens
gaaggcaguggcugagauu

SEQ ID NO: 142606 - RNA, 19 nt, Homo sapiens
ggagcgagaagacauguau

SEQ ID NO: 142607 - RNA, 19 nt, Homo sapiens
gauucuaaauguucaugug

SEQ ID NO: 142608 - RNA, 19 nt, Homo sapiens
caaacagggacacuacaaa

SEQ ID NO: 142609 - RNA, 19 nt, Homo sapiens
caggacauaugccaucuca

SEQ ID NO: 142610 - RNA, 19 nt, Homo sapiens
acaaacaggugcuaacacu

SEQ ID NO: 142611 - RNA, 19 nt, Homo sapiens
gcaaucugguuuaccugau

SEQ ID NO: 142612 - RNA, 19 nt, Homo sapiens
guucauguguaacuucuag

SEQ ID NO: 142613 - RNA, 19 nt, Homo sapiens
ccauaagggacaugucuuu

SEQ ID NO: 142614 - RNA, 19 nt, Homo sapiens
gaagauccaacccaucaca

SEQ ID NO: 142615 - RNA, 19 nt, Homo sapiens
gagacggugaguaucaaua

SEQ ID NO: 142616 - RNA, 19 nt, Homo sapiens
ugaagacucugucggugau

SEQ ID NO: 142617 - RNA, 19 nt, Homo sapiens
caggauugcucagaaacaa

SEQ ID NO: 142618 - RNA, 19 nt, Homo sapiens
uaauugaggcuuacaguag

SEQ ID NO: 142619 - RNA, 19 nt, Homo sapiens
ugagauggguugaguuugc

SEQ ID NO: 142620 - RNA, 19 nt, Homo sapiens
cgacgaauaaugccauaga

SEQ ID NO: 142621 - RNA, 19 nt, Homo sapiens
cuaccuuucuucaucuuga

SEQ ID NO: 142622 - RNA, 19 nt, Homo sapiens
aaucaacagugaacagcuu

SEQ ID NO: 142623 - RNA, 19 nt, Homo sapiens
gcaguccacgccaagaauu

SEQ ID NO: 142624 - RNA, 19 nt, Homo sapiens
cuggauugaugauuuagaa

SEQ ID NO: 142625 - RNA, 19 nt, Homo sapiens
cagggacacuacaaacaug

SEQ ID NO: 142626 - RNA, 19 nt, Homo sapiens
gaaaggaagccaagaaaag

SEQ ID NO: 142627 - RNA, 19 nt, Homo sapiens
agacggugaguaucaauaa

SEQ ID NO: 142628 - RNA, 19 nt, Homo sapiens
caacagccccgaaauguga

SEQ ID NO: 142629 - RNA, 19 nt, Homo sapiens
guucauagucaaucaaaca

SEQ ID NO: 142630 - RNA, 19 nt, Homo sapiens
ggagugcaaucugguuuac

SEQ ID NO: 142631 - RNA, 19 nt, Homo sapiens
gaggcuccaucuccaagga

SEQ ID NO: 142632 - RNA, 19 nt, Homo sapiens
ggauugcucagaaacaaau

SEQ ID NO: 142633 - RNA, 19 nt, Homo sapiens
gauccaacccaucacacaa

SEQ ID NO: 142634 - RNA, 19 nt, Homo sapiens
caaagaaucaacagugaac

SEQ ID NO: 142635 - RNA, 19 nt, Homo sapiens
ugacguguuugugugguuu

SEQ ID NO: 142636 - RNA, 19 nt, Homo sapiens
gaucagcguggacagguau

SEQ ID NO: 142637 - RNA, 19 nt, Homo sapiens
acagugaccugcagaugag

SEQ ID NO: 142638 - RNA, 19 nt, Homo sapiens
aggagucacuggauugaug

SEQ ID NO: 142639 - RNA, 19 nt, Homo sapiens
gaccuuacaaccacauuuc

SEQ ID NO: 142640 - RNA, 19 nt, Homo sapiens
acaguaggagugagaaauu

SEQ ID NO: 142641 - RNA, 19 nt, Homo sapiens
aaugagauggguugaguuu

SEQ ID NO: 142642 - RNA, 19 nt, Homo sapiens
gugagacucugagguguca

SEQ ID NO: 142643 - RNA, 19 nt, Homo sapiens
cacacaugcucaucccaaa

SEQ ID NO: 142644 - RNA, 19 nt, Homo sapiens
uaagauguccuucaaaaga

SEQ ID NO: 142645 - RNA, 19 nt, Homo sapiens
ggagucacuggauugauga

SEQ ID NO: 142646 - RNA, 19 nt, Homo sapiens
acaauuaacuccguuucca

SEQ ID NO: 142647 - RNA, 19 nt, Homo sapiens
gugaguaucaauaacaaug

SEQ ID NO: 142648 - RNA, 19 nt, Homo sapiens
guucucaaccggaaaguuc

SEQ ID NO: 142649 - RNA, 19 nt, Homo sapiens
ucuacaggauugcucagaa

SEQ ID NO: 142650 - RNA, 19 nt, Homo sapiens
cuagugcccuuugaacaau

SEQ ID NO: 142651 - RNA, 19 nt, Homo sapiens
gcaaaguuuucagauugua

SEQ ID NO: 142652 - RNA, 19 nt, Homo sapiens
uaccaaauagggcaaagaa

SEQ ID NO: 142653 - RNA, 19 nt, Homo sapiens
caccacagguaauggaaag

SEQ ID NO: 142654 - RNA, 19 nt, Homo sapiens
accaggaucuacaggauug

SEQ ID NO: 142655 - RNA, 19 nt, Homo sapiens
uauccucacugccuguuuc

SEQ ID NO: 142656 - RNA, 19 nt, Homo sapiens
gaacaaucuccagcucuuc

SEQ ID NO: 142657 - RNA, 19 nt, Homo sapiens
gugagauucuaaauguuca

SEQ ID NO: 142658 - RNA, 19 nt, Homo sapiens
ccaaugaagcaaacacaca

SEQ ID NO: 142659 - RNA, 19 nt, Homo sapiens
gcacuuuauaagccaauga

SEQ ID NO: 142660 - RNA, 19 nt, Homo sapiens
gaccuggccugggauccuu

SEQ ID NO: 142661 - RNA, 19 nt, Homo sapiens
ucugggcucucgaaaggaa

SEQ ID NO: 142662 - RNA, 19 nt, Homo sapiens
ucaaacagggacacuacaa

SEQ ID NO: 142663 - RNA, 19 nt, Homo sapiens
gaagaaagccacucagaug

SEQ ID NO: 142664 - RNA, 19 nt, Homo sapiens
ugacggcccugcaauguau

SEQ ID NO: 142665 - RNA, 19 nt, Homo sapiens
uaacaucacuauccaugca

SEQ ID NO: 142666 - RNA, 19 nt, Homo sapiens
augaaacucugcaccguua

SEQ ID NO: 142667 - RNA, 19 nt, Homo sapiens
gagaagaaagccacucaga

SEQ ID NO: 142668 - RNA, 19 nt, Homo sapiens
guaggugaguggaaauuca

SEQ ID NO: 142669 - RNA, 19 nt, Homo sapiens
ucacguggcugggcuaugu

SEQ ID NO: 142670 - RNA, 19 nt, Homo sapiens
gcaagcgagucaacaccaa

SEQ ID NO: 142671 - RNA, 19 nt, Homo sapiens
ccuagacucuguaacauca

SEQ ID NO: 142672 - RNA, 19 nt, Homo sapiens
ggacaucagagguucuuug

SEQ ID NO: 142673 - RNA, 19 nt, Homo sapiens
cagaacgagugcaucauug

SEQ ID NO: 142674 - RNA, 19 nt, Homo sapiens
gaagaaugggcaugccaaa

SEQ ID NO: 142675 - RNA, 19 nt, Homo sapiens
cacugaaucuguccuggua

SEQ ID NO: 142676 - RNA, 19 nt, Homo sapiens
ucacacacauccugaacau

SEQ ID NO: 142677 - RNA, 19 nt, Homo sapiens
ggaccucccucaagaccau

SEQ ID NO: 142678 - RNA, 19 nt, Homo sapiens
ccugagggcuccacuaaag

SEQ ID NO: 142679 - RNA, 19 nt, Homo sapiens
ggugguaggugaguggaaa

SEQ ID NO: 142680 - RNA, 19 nt, Homo sapiens
gcaacgugcuggugugcau

SEQ ID NO: 142681 - RNA, 19 nt, Homo sapiens
cuacaccaccuucaacauu

SEQ ID NO: 142682 - RNA, 19 nt, Homo sapiens
ccagaacgagugcaucauu

SEQ ID NO: 142683 - RNA, 19 nt, Homo sapiens
ccugauggauccacugaau

SEQ ID NO: 142684 - RNA, 19 nt, Homo sapiens
gacaucagagguucuuuga

SEQ ID NO: 142685 - RNA, 19 nt, Homo sapiens
caauguaucccuucucaca

SEQ ID NO: 142686 - RNA, 19 nt, Homo sapiens
ccacccugcugccuucuga

SEQ ID NO: 142687 - RNA, 19 nt, Homo sapiens
ccacuaaagggcaacugua

SEQ ID NO: 142688 - RNA, 19 nt, Homo sapiens
agaaugggcaugccaaaga

SEQ ID NO: 142689 - RNA, 19 nt, Homo sapiens
gcaccguuaucaugaaguc

SEQ ID NO: 142690 - RNA, 19 nt, Homo sapiens
cgauguggaccucuacuuu

SEQ ID NO: 142691 - RNA, 19 nt, Homo sapiens
gaaugggcaugccaaagac

SEQ ID NO: 142692 - RNA, 19 nt, Homo sapiens
uacaccaccuucaacauug

SEQ ID NO: 142693 - RNA, 19 nt, Homo sapiens
acaucaagaucuacauugu

SEQ ID NO: 142694 - RNA, 19 nt, Homo sapiens
gaccagaacgagugcauca

SEQ ID NO: 142695 - RNA, 19 nt, Homo sapiens
gcaccaaacuaauaaaacu

SEQ ID NO: 142696 - RNA, 19 nt, Homo sapiens
gggccuagacucuguaaca

SEQ ID NO: 142697 - RNA, 19 nt, Homo sapiens
gcuaagaggcugcugaaaa

SEQ ID NO: 142698 - RNA, 19 nt, Homo sapiens
gauguggaccucuacuuuc

SEQ ID NO: 142699 - RNA, 19 nt, Homo sapiens
uggcugcccuucuucauca

SEQ ID NO: 142700 - RNA, 19 nt, Homo sapiens
gcacggcgagcauccugaa

SEQ ID NO: 142701 - RNA, 19 nt, Homo sapiens
ccaugcaccaaacuaauaa

SEQ ID NO: 142702 - RNA, 19 nt, Homo sapiens
ccacuuuccuuuucuauuc

SEQ ID NO: 142703 - RNA, 19 nt, Homo sapiens
ggggagagauggacaguuc

SEQ ID NO: 142704 - RNA, 19 nt, Homo sapiens
acacacauccugaacauac

SEQ ID NO: 142705 - RNA, 19 nt, Homo sapiens
caccugagggcuccacuaa

SEQ ID NO: 142706 - RNA, 19 nt, Homo sapiens
ccacuccucuucggacuca

SEQ ID NO: 142707 - RNA, 19 nt, Homo sapiens
ccaucagcaucgacaggua

SEQ ID NO: 142708 - RNA, 19 nt, Homo sapiens
aaucuguccugguaugaug

SEQ ID NO: 142709 - RNA, 19 nt, Homo sapiens
ucaauaacgcagaccagaa

SEQ ID NO: 142710 - RNA, 19 nt, Homo sapiens
uccaugcaccaaacuaaua

SEQ ID NO: 142711 - RNA, 19 nt, Homo sapiens
gggagacccauguaaauac

SEQ ID NO: 142712 - RNA, 19 nt, Homo sapiens
gaaacucugcaccguuauc

SEQ ID NO: 142713 - RNA, 19 nt, Homo sapiens
gcgagcauccugaacuugu

SEQ ID NO: 142714 - RNA, 19 nt, Homo sapiens
ugcaauguaucccuucuca

SEQ ID NO: 142715 - RNA, 19 nt, Homo sapiens
gaagucuaaugggaguuuc

SEQ ID NO: 142716 - RNA, 19 nt, Homo sapiens
cuacaucaagaucuacauu

SEQ ID NO: 142717 - RNA, 19 nt, Homo sapiens
uacgugcccuucauuguca

SEQ ID NO: 142718 - RNA, 19 nt, Homo sapiens
cggcgagcauccugaacuu

SEQ ID NO: 142719 - RNA, 19 nt, Homo sapiens
cuagugagcugggcauggu

SEQ ID NO: 142720 - RNA, 19 nt, Homo sapiens
aaacgcagcagccgagcuu

SEQ ID NO: 142721 - RNA, 19 nt, Homo sapiens
uauccaugcaccaaacuaa

SEQ ID NO: 142722 - RNA, 19 nt, Homo sapiens
ggccuagacucuguaacau

SEQ ID NO: 142723 - RNA, 19 nt, Homo sapiens
gaggcugaguuuucucuuu

SEQ ID NO: 142724 - RNA, 19 nt, Homo sapiens
gggcccagaggcugaguuu

SEQ ID NO: 142725 - RNA, 19 nt, Homo sapiens
cugcuggucuacaucaaga

SEQ ID NO: 142726 - RNA, 19 nt, Homo sapiens
caauaacgcagaccagaac

SEQ ID NO: 142727 - RNA, 19 nt, Homo sapiens
ggagacccauguaaauacc

SEQ ID NO: 142728 - RNA, 19 nt, Homo sapiens
acccggaccucccucaaga

SEQ ID NO: 142729 - RNA, 19 nt, Homo sapiens
ccguuaucaugaagucuaa

SEQ ID NO: 142730 - RNA, 19 nt, Homo sapiens
cugaaucuguccugguaug

SEQ ID NO: 142731 - RNA, 19 nt, Homo sapiens
caagcgagucaacaccaaa

SEQ ID NO: 142732 - RNA, 19 nt, Homo sapiens
ggacagaccccacuacaac

SEQ ID NO: 142733 - RNA, 19 nt, Homo sapiens
cagagauucccaagccaaa

SEQ ID NO: 142734 - RNA, 19 nt, Homo sapiens
gcagaccaccaccaacuac

SEQ ID NO: 142735 - RNA, 19 nt, Homo sapiens
cagaugcucgccauuguuc

SEQ ID NO: 142736 - RNA, 19 nt, Homo sapiens
agaagaaagccacucagau

SEQ ID NO: 142737 - RNA, 19 nt, Homo sapiens
ggaaauucagcaggauuca

SEQ ID NO: 142738 - RNA, 19 nt, Homo sapiens
cgagcauccugaacuugug

SEQ ID NO: 142739 - RNA, 19 nt, Homo sapiens
ugaagucuaaugggaguuu

SEQ ID NO: 142740 - RNA, 19 nt, Homo sapiens
ucacuauccaugcaccaaa

SEQ ID NO: 142741 - RNA, 19 nt, Homo sapiens
cuaagaggcugcugaaaac

SEQ ID NO: 142742 - RNA, 19 nt, Homo sapiens
guccugguaugaugaugau

SEQ ID NO: 142743 - RNA, 19 nt, Homo sapiens
ccgccaaaccagagaagaa

SEQ ID NO: 142744 - RNA, 19 nt, Homo sapiens
cuucuggccuuuccucucu

SEQ ID NO: 142745 - RNA, 19 nt, Homo sapiens
guggaucggccuccucuuc

SEQ ID NO: 142746 - RNA, 19 nt, Homo sapiens
gaagcucucccagcagaag

SEQ ID NO: 142747 - RNA, 19 nt, Homo sapiens
ccaaaccagagaagaaugg

SEQ ID NO: 142748 - RNA, 19 nt, Homo sapiens
ucacccugcuggucuacau

SEQ ID NO: 142749 - RNA, 19 nt, Homo sapiens
ccacugccucugccuuaga

SEQ ID NO: 142750 - RNA, 19 nt, Homo sapiens
cgaggagccaggcaacuuc

SEQ ID NO: 142751 - RNA, 19 nt, Homo sapiens
uggucuacaucaagaucua

SEQ ID NO: 142752 - RNA, 19 nt, Homo sapiens
guucucggcguguucauca

SEQ ID NO: 142753 - RNA, 19 nt, Homo sapiens
caaagaccaccccaagauu

SEQ ID NO: 142754 - RNA, 19 nt, Homo sapiens
cuaaagggcaacuguacuc

SEQ ID NO: 142755 - RNA, 19 nt, Homo sapiens
gaaucuguccugguaugau

SEQ ID NO: 142756 - RNA, 19 nt, Homo sapiens
gagcuggaagccucaagca

SEQ ID NO: 142757 - RNA, 19 nt, Homo sapiens
gaggagccaggcaacuuca

SEQ ID NO: 142758 - RNA, 19 nt, Homo sapiens
ucagaugcucgccauuguu

SEQ ID NO: 142759 - RNA, 19 nt, Homo sapiens
ccaaagaccaccccaagau

SEQ ID NO: 142760 - RNA, 19 nt, Homo sapiens
gagcauccugaacuugugu

SEQ ID NO: 142761 - RNA, 19 nt, Homo sapiens
cuacgugcccuucauuguc

SEQ ID NO: 142762 - RNA, 19 nt, Homo sapiens
ugauggauccacugaaucu

SEQ ID NO: 142763 - RNA, 19 nt, Homo sapiens
gaagaaagccacucagaug

SEQ ID NO: 142764 - RNA, 19 nt, Homo sapiens
ugacggcccugcaauguau

SEQ ID NO: 142765 - RNA, 19 nt, Homo sapiens
uaacaucacuauccaugca

SEQ ID NO: 142766 - RNA, 19 nt, Homo sapiens
gagaagaaagccacucaga

SEQ ID NO: 142767 - RNA, 19 nt, Homo sapiens
guaggugaguggaaauuca

SEQ ID NO: 142768 - RNA, 19 nt, Homo sapiens
ucacguggcugggcuaugu

SEQ ID NO: 142769 - RNA, 19 nt, Homo sapiens
gcaagcgagucaacaccaa

SEQ ID NO: 142770 - RNA, 19 nt, Homo sapiens
ccuagacucuguaacauca

SEQ ID NO: 142771 - RNA, 19 nt, Homo sapiens
ggacaucagagguucuuug

SEQ ID NO: 142772 - RNA, 19 nt, Homo sapiens
cagaacgagugcaucauug

SEQ ID NO: 142773 - RNA, 19 nt, Homo sapiens
gaagaaugggcaugccaaa

SEQ ID NO: 142774 - RNA, 19 nt, Homo sapiens
cacugaaucuguccuggua

SEQ ID NO: 142775 - RNA, 19 nt, Homo sapiens
ucacacacauccugaacau

SEQ ID NO: 142776 - RNA, 19 nt, Homo sapiens
ggaccucccucaagaccau

SEQ ID NO: 142777 - RNA, 19 nt, Homo sapiens
ccugagggcuccacuaaag

SEQ ID NO: 142778 - RNA, 19 nt, Homo sapiens
ggugguaggugaguggaaa

SEQ ID NO: 142779 - RNA, 19 nt, Homo sapiens
gcaacgugcuggugugcau

SEQ ID NO: 142780 - RNA, 19 nt, Homo sapiens
cuacaccaccuucaacauu

SEQ ID NO: 142781 - RNA, 19 nt, Homo sapiens
ccagaacgagugcaucauu

SEQ ID NO: 142782 - RNA, 19 nt, Homo sapiens
gacaucagagguucuuuga

SEQ ID NO: 142783 - RNA, 19 nt, Homo sapiens
ccugauggauccacugaau

SEQ ID NO: 142784 - RNA, 19 nt, Homo sapiens
caauguaucccuucucaca

SEQ ID NO: 142785 - RNA, 19 nt, Homo sapiens
ccacccugcugccuucuga

SEQ ID NO: 142786 - RNA, 19 nt, Homo sapiens
agaaugggcaugccaaaga

SEQ ID NO: 142787 - RNA, 19 nt, Homo sapiens
cgauguggaccucuacuuu

SEQ ID NO: 142788 - RNA, 19 nt, Homo sapiens
gaaugggcaugccaaagac

SEQ ID NO: 142789 - RNA, 19 nt, Homo sapiens
uacaccaccuucaacauug

SEQ ID NO: 142790 - RNA, 19 nt, Homo sapiens
acaucaagaucuacauugu

SEQ ID NO: 142791 - RNA, 19 nt, Homo sapiens
gaccagaacgagugcauca

SEQ ID NO: 142792 - RNA, 19 nt, Homo sapiens
gcaccaaacuaauaaaacu

SEQ ID NO: 142793 - RNA, 19 nt, Homo sapiens
gggccuagacucuguaaca

SEQ ID NO: 142794 - RNA, 19 nt, Homo sapiens
gcuaagaggcugcugaaaa

SEQ ID NO: 142795 - RNA, 19 nt, Homo sapiens
gauguggaccucuacuuuc

SEQ ID NO: 142796 - RNA, 19 nt, Homo sapiens
uggcugcccuucuucauca

SEQ ID NO: 142797 - RNA, 19 nt, Homo sapiens
gcacggcgagcauccugaa

SEQ ID NO: 142798 - RNA, 19 nt, Homo sapiens
ccaugcaccaaacuaauaa

SEQ ID NO: 142799 - RNA, 19 nt, Homo sapiens
ccacuuuccuuuucuauuc

SEQ ID NO: 142800 - RNA, 19 nt, Homo sapiens
ggggagagauggacaguuc

SEQ ID NO: 142801 - RNA, 19 nt, Homo sapiens
acacacauccugaacauac

SEQ ID NO: 142802 - RNA, 19 nt, Homo sapiens
caccugagggcuccacuaa

SEQ ID NO: 142803 - RNA, 19 nt, Homo sapiens
ccacuccucuucggacuca

SEQ ID NO: 142804 - RNA, 19 nt, Homo sapiens
ccaucagcaucgacaggua

SEQ ID NO: 142805 - RNA, 19 nt, Homo sapiens
aaucuguccugguaugaug

SEQ ID NO: 142806 - RNA, 19 nt, Homo sapiens
ucaauaacgcagaccagaa

SEQ ID NO: 142807 - RNA, 19 nt, Homo sapiens
uccaugcaccaaacuaaua

SEQ ID NO: 142808 - RNA, 19 nt, Homo sapiens
gggagacccauguaaauac

SEQ ID NO: 142809 - RNA, 19 nt, Homo sapiens
gcgagcauccugaacuugu

SEQ ID NO: 142810 - RNA, 19 nt, Homo sapiens
ugcaauguaucccuucuca

SEQ ID NO: 142811 - RNA, 19 nt, Homo sapiens
cuacaucaagaucuacauu

SEQ ID NO: 142812 - RNA, 19 nt, Homo sapiens
uacgugcccuucauuguca

SEQ ID NO: 142813 - RNA, 19 nt, Homo sapiens
cggcgagcauccugaacuu

SEQ ID NO: 142814 - RNA, 19 nt, Homo sapiens
cuagugagcugggcauggu

SEQ ID NO: 142815 - RNA, 19 nt, Homo sapiens
aaacgcagcagccgagcuu

SEQ ID NO: 142816 - RNA, 19 nt, Homo sapiens
uauccaugcaccaaacuaa

SEQ ID NO: 142817 - RNA, 19 nt, Homo sapiens
ggccuagacucuguaacau

SEQ ID NO: 142818 - RNA, 19 nt, Homo sapiens
gaggcugaguuuucucuuu

SEQ ID NO: 142819 - RNA, 19 nt, Homo sapiens
gggcccagaggcugaguuu

SEQ ID NO: 142820 - RNA, 19 nt, Homo sapiens
cugcuggucuacaucaaga

SEQ ID NO: 142821 - RNA, 19 nt, Homo sapiens
caauaacgcagaccagaac

SEQ ID NO: 142822 - RNA, 19 nt, Homo sapiens
ggacagaccccacuacaac

SEQ ID NO: 142823 - RNA, 19 nt, Homo sapiens
ggagacccauguaaauacc

SEQ ID NO: 142824 - RNA, 19 nt, Homo sapiens
acccggaccucccucaaga

SEQ ID NO: 142825 - RNA, 19 nt, Homo sapiens
caagcgagucaacaccaaa

SEQ ID NO: 142826 - RNA, 19 nt, Homo sapiens
cugaaucuguccugguaug

SEQ ID NO: 142827 - RNA, 19 nt, Homo sapiens
cagagauucccaagccaaa

SEQ ID NO: 142828 - RNA, 19 nt, Homo sapiens
cagaugcucgccauuguuc

SEQ ID NO: 142829 - RNA, 19 nt, Homo sapiens
agaagaaagccacucagau

SEQ ID NO: 142830 - RNA, 19 nt, Homo sapiens
gcagaccaccaccaacuac

SEQ ID NO: 142831 - RNA, 19 nt, Homo sapiens
cgagcauccugaacuugug

SEQ ID NO: 142832 - RNA, 19 nt, Homo sapiens
ggaaauucagcaggauuca

SEQ ID NO: 142833 - RNA, 19 nt, Homo sapiens
ucacuauccaugcaccaaa

SEQ ID NO: 142834 - RNA, 19 nt, Homo sapiens
cuaagaggcugcugaaaac

SEQ ID NO: 142835 - RNA, 19 nt, Homo sapiens
guccugguaugaugaugau

SEQ ID NO: 142836 - RNA, 19 nt, Homo sapiens
ccgccaaaccagagaagaa

SEQ ID NO: 142837 - RNA, 19 nt, Homo sapiens
cuucuggccuuuccucucu

SEQ ID NO: 142838 - RNA, 19 nt, Homo sapiens
guggaucggccuccucuuc

SEQ ID NO: 142839 - RNA, 19 nt, Homo sapiens
gaagcucucccagcagaag

SEQ ID NO: 142840 - RNA, 19 nt, Homo sapiens
ccaaaccagagaagaaugg

SEQ ID NO: 142841 - RNA, 19 nt, Homo sapiens
ucacccugcuggucuacau

SEQ ID NO: 142842 - RNA, 19 nt, Homo sapiens
ccacugccucugccuuaga

SEQ ID NO: 142843 - RNA, 19 nt, Homo sapiens
cgaggagccaggcaacuuc

SEQ ID NO: 142844 - RNA, 19 nt, Homo sapiens
uggucuacaucaagaucua

SEQ ID NO: 142845 - RNA, 19 nt, Homo sapiens
gaaucuguccugguaugau

SEQ ID NO: 142846 - RNA, 19 nt, Homo sapiens
guucucggcguguucauca

SEQ ID NO: 142847 - RNA, 19 nt, Homo sapiens
caaagaccaccccaagauu

SEQ ID NO: 142848 - RNA, 19 nt, Homo sapiens
ugagggcuccacuaaagga

SEQ ID NO: 142849 - RNA, 19 nt, Homo sapiens
gagcuggaagccucaagca

SEQ ID NO: 142850 - RNA, 19 nt, Homo sapiens
gaggagccaggcaacuuca

SEQ ID NO: 142851 - RNA, 19 nt, Homo sapiens
ucagaugcucgccauuguu

SEQ ID NO: 142852 - RNA, 19 nt, Homo sapiens
ccaaagaccaccccaagau

SEQ ID NO: 142853 - RNA, 19 nt, Homo sapiens
ugauggauccacugaaucu

SEQ ID NO: 142854 - RNA, 19 nt, Homo sapiens
cuacgugcccuucauuguc

SEQ ID NO: 142855 - RNA, 19 nt, Homo sapiens
gagcauccugaacuugugu

SEQ ID NO: 142856 - RNA, 19 nt, Homo sapiens
ggaccaggcuuccaagaaa

SEQ ID NO: 142857 - RNA, 19 nt, Homo sapiens
aagcagcacucaaguaauu

SEQ ID NO: 142858 - RNA, 19 nt, Homo sapiens
gaaagcagcuaugaaacau

SEQ ID NO: 142859 - RNA, 19 nt, Homo sapiens
gaagaaggcaacccaaaug

SEQ ID NO: 142860 - RNA, 19 nt, Homo sapiens
caaguaauuucaccuuaga

SEQ ID NO: 142861 - RNA, 19 nt, Homo sapiens
acucagcaauggcagauua

SEQ ID NO: 142862 - RNA, 19 nt, Homo sapiens
gcaauggccuggugugcau

SEQ ID NO: 142863 - RNA, 19 nt, Homo sapiens
gaaucuauguggugcugaa

SEQ ID NO: 142864 - RNA, 19 nt, Homo sapiens
gguggagucuggaauuuca

SEQ ID NO: 142865 - RNA, 19 nt, Homo sapiens
gagaagaaggcaacccaaa

SEQ ID NO: 142866 - RNA, 19 nt, Homo sapiens
guccugcccucuucuguuu

SEQ ID NO: 142867 - RNA, 19 nt, Homo sapiens
gaaaacggauacauucgaa

SEQ ID NO: 142868 - RNA, 19 nt, Homo sapiens
guacuggccuuugcugugu

SEQ ID NO: 142869 - RNA, 19 nt, Homo sapiens
ggugauuucuuucuguuca

SEQ ID NO: 142870 - RNA, 19 nt, Homo sapiens
gaggagaagacucggaauu

SEQ ID NO: 142871 - RNA, 19 nt, Homo sapiens
agaaagaggaggagaguug

SEQ ID NO: 142872 - RNA, 19 nt, Homo sapiens
ucaaguaauuucaccuuag

SEQ ID NO: 142873 - RNA, 19 nt, Homo sapiens
gaaagaggaggagaguuga

SEQ ID NO: 142874 - RNA, 19 nt, Homo sapiens
guacagccagcauccuuaa

SEQ ID NO: 142875 - RNA, 19 nt, Homo sapiens
gcauggcugugcugaagga

SEQ ID NO: 142876 - RNA, 19 nt, Homo sapiens
gaaaagcagcacucaagua

SEQ ID NO: 142877 - RNA, 19 nt, Homo sapiens
ccucaacccugugaucuau

SEQ ID NO: 142878 - RNA, 19 nt, Homo sapiens
cgaaagcagcuaugaaaca

SEQ ID NO: 142879 - RNA, 19 nt, Homo sapiens
gaaacaaaggagacggaaa

SEQ ID NO: 142880 - RNA, 19 nt, Homo sapiens
gcaccucccucugggcuau

SEQ ID NO: 142881 - RNA, 19 nt, Homo sapiens
uaugaaacaugcacuaagg

SEQ ID NO: 142882 - RNA, 19 nt, Homo sapiens
gaggagaguugaaaagaga

SEQ ID NO: 142883 - RNA, 19 nt, Homo sapiens
cggcacaucuggagcugaa

SEQ ID NO: 142884 - RNA, 19 nt, Homo sapiens
cgacauggcugggcuacgu

SEQ ID NO: 142885 - RNA, 19 nt, Homo sapiens
ccucuucuguuuggcuuua

SEQ ID NO: 142886 - RNA, 19 nt, Homo sapiens
gagccgaagugguaaacuc

SEQ ID NO: 142887 - RNA, 19 nt, Homo sapiens
aaacaugcacuaaggucua

SEQ ID NO: 142888 - RNA, 19 nt, Homo sapiens
cagguggagucuggaauuu

SEQ ID NO: 142889 - RNA, 19 nt, Homo sapiens
gauccucacucgacagaac

SEQ ID NO: 142890 - RNA, 19 nt, Homo sapiens
uggcugggcuacgugaaua

SEQ ID NO: 142891 - RNA, 19 nt, Homo sapiens
ggguaugucugcugucagu

SEQ ID NO: 142892 - RNA, 19 nt, Homo sapiens
caauaucgaguuccggaaa

SEQ ID NO: 142893 - RNA, 19 nt, Homo sapiens
uggcugcccuucuucuuga

SEQ ID NO: 142894 - RNA, 19 nt, Homo sapiens
gauuaucgacaucuuugaa

SEQ ID NO: 142895 - RNA, 19 nt, Homo sapiens
gagugacuguccuugucua

SEQ ID NO: 142896 - RNA, 19 nt, Homo sapiens
gacuaccaccaacuacuua

SEQ ID NO: 142897 - RNA, 19 nt, Homo sapiens
gcuaugaaacaugcacuaa

SEQ ID NO: 142898 - RNA, 19 nt, Homo sapiens
gugcauggcugugcugaag

SEQ ID NO: 142899 - RNA, 19 nt, Homo sapiens
guaugucugcugucaguaa

SEQ ID NO: 142900 - RNA, 19 nt, Homo sapiens
cucaaguaauuucaccuua

SEQ ID NO: 142901 - RNA, 19 nt, Homo sapiens
ggagaagacucggaauucc

SEQ ID NO: 142902 - RNA, 19 nt, Homo sapiens
ugacccauguucucaauac

SEQ ID NO: 142903 - RNA, 19 nt, Homo sapiens
gaacagucagugcaacagu

SEQ ID NO: 142904 - RNA, 19 nt, Homo sapiens
ugacuguccuugucuaugc

SEQ ID NO: 142905 - RNA, 19 nt, Homo sapiens
cgcauuugcugugauguuu

SEQ ID NO: 142906 - RNA, 19 nt, Homo sapiens
gaccaggcuuccaagaaag

SEQ ID NO: 142907 - RNA, 19 nt, Homo sapiens
gagcugaagcguuacuaca

SEQ ID NO: 142908 - RNA, 19 nt, Homo sapiens
ggucaugcccguucacuac

SEQ ID NO: 142909 - RNA, 19 nt, Homo sapiens
ugcaggagccgaaguggua

SEQ ID NO: 142910 - RNA, 19 nt, Homo sapiens
ccugagaaaggcaaaguuu

SEQ ID NO: 142911 - RNA, 19 nt, Homo sapiens
caaaggagacggaaaagga

SEQ ID NO: 142912 - RNA, 19 nt, Homo sapiens
cuucagugguguccuucua

SEQ ID NO: 142913 - RNA, 19 nt, Homo sapiens
gcuguguccugcccucuuc

SEQ ID NO: 142914 - RNA, 19 nt, Homo sapiens
cagcauccuuaaucucugu

SEQ ID NO: 142915 - RNA, 19 nt, Homo sapiens
uaugucugcugucaguaaa

SEQ ID NO: 142916 - RNA, 19 nt, Homo sapiens
gaaagccuuccucaagauc

SEQ ID NO: 142917 - RNA, 19 nt, Homo sapiens
uauaccaccuucaauaucg

SEQ ID NO: 142918 - RNA, 19 nt, Homo sapiens
aucuggagcugaagcguua

SEQ ID NO: 142919 - RNA, 19 nt, Homo sapiens
cuuaaucucugugccauca

SEQ ID NO: 142920 - RNA, 19 nt, Homo sapiens
ugaguagccaccugaacua

SEQ ID NO: 142921 - RNA, 19 nt, Homo sapiens
cuccagaaaucagaagaaa

SEQ ID NO: 142922 - RNA, 19 nt, Homo sapiens
gaucuauaccaccuucaau

SEQ ID NO: 142923 - RNA, 19 nt, Homo sapiens
aaacaaaggagacggaaaa

SEQ ID NO: 142924 - RNA, 19 nt, Homo sapiens
ggugaugcccuggguggua

SEQ ID NO: 142925 - RNA, 19 nt, Homo sapiens
aaaagcagcacucaaguaa

SEQ ID NO: 142926 - RNA, 19 nt, Homo sapiens
agaagaaggcaacccaaau

SEQ ID NO: 142927 - RNA, 19 nt, Homo sapiens
caagaaagaggaggagagu

SEQ ID NO: 142928 - RNA, 19 nt, Homo sapiens
cacccuggaugucaugaug

SEQ ID NO: 142929 - RNA, 19 nt, Homo sapiens
uaccugcccuuuggaguga

SEQ ID NO: 142930 - RNA, 19 nt, Homo sapiens
ucuauaccaccuucaauau

SEQ ID NO: 142931 - RNA, 19 nt, Homo sapiens
cagccagcauccuuaaucu

SEQ ID NO: 142932 - RNA, 19 nt, Homo sapiens
gugaugcccugggugguau

SEQ ID NO: 142933 - RNA, 19 nt, Homo sapiens
aacaugcacuaaggucuaa

SEQ ID NO: 142934 - RNA, 19 nt, Homo sapiens
ccagaaaucagaagaaaau

SEQ ID NO: 142935 - RNA, 19 nt, Homo sapiens
caccuucaauaucgaguuc

SEQ ID NO: 142936 - RNA, 19 nt, Homo sapiens
caugcacuaaggucuaaua

SEQ ID NO: 142937 - RNA, 19 nt, Homo sapiens
ucuauguggugcugaaaca

SEQ ID NO: 142938 - RNA, 19 nt, Homo sapiens
ccaucagcauagacaggua

SEQ ID NO: 142939 - RNA, 19 nt, Homo sapiens
ucaacccugugaucuauac

SEQ ID NO: 142940 - RNA, 19 nt, Homo sapiens
aaacggauacauucgaaag

SEQ ID NO: 142941 - RNA, 19 nt, Homo sapiens
gacagaacagucagugcaa

SEQ ID NO: 142942 - RNA, 19 nt, Homo sapiens
gcagcacucaaguaauuuc

SEQ ID NO: 142943 - RNA, 19 nt, Homo sapiens
acuccucggucuccagaaa

SEQ ID NO: 142944 - RNA, 19 nt, Homo sapiens
ugucugcugucaguaaaug

SEQ ID NO: 142945 - RNA, 19 nt, Homo sapiens
uggaauuucagccgcauuu

SEQ ID NO: 142946 - RNA, 19 nt, Homo sapiens
agacuaccaccaacuacuu

SEQ ID NO: 142947 - RNA, 19 nt, Homo sapiens
acuaugcccucuccuacug

SEQ ID NO: 142948 - RNA, 19 nt, Homo sapiens
gcaggagccgaagugguaa

SEQ ID NO: 142949 - RNA, 19 nt, Homo sapiens
uauguggugcugaaacaaa

SEQ ID NO: 142950 - RNA, 19 nt, Homo sapiens
uggagugacuguccuuguc

SEQ ID NO: 142951 - RNA, 19 nt, Homo sapiens
uucgaaagcagcuaugaaa

SEQ ID NO: 142952 - RNA, 19 nt, Homo sapiens
gaauuucagccgcauuugc

SEQ ID NO: 142953 - RNA, 19 nt, Homo sapiens
ccgcccacaugccuacuau

SEQ ID NO: 142954 - RNA, 19 nt, Homo sapiens
cagcauggcacgggacaga

SEQ ID NO: 142955 - RNA, 19 nt, Homo sapiens
ggaauuucagccgcauuug

SEQ ID NO: 142956 - RNA, 19 nt, Homo sapiens
ggaccaggcuuccaagaaa

SEQ ID NO: 142957 - RNA, 19 nt, Homo sapiens
aagcagcacucaaguaauu

SEQ ID NO: 142958 - RNA, 19 nt, Homo sapiens
gaaagcagcuaugaaacau

SEQ ID NO: 142959 - RNA, 19 nt, Homo sapiens
gaagaaggcaacccaaaug

SEQ ID NO: 142960 - RNA, 19 nt, Homo sapiens
caaguaauuucaccuuaga

SEQ ID NO: 142961 - RNA, 19 nt, Homo sapiens
acucagcaauggcagauua

SEQ ID NO: 142962 - RNA, 19 nt, Homo sapiens
gcaauggccuggugugcau

SEQ ID NO: 142963 - RNA, 19 nt, Homo sapiens
gguggagucuggaauuuca

SEQ ID NO: 142964 - RNA, 19 nt, Homo sapiens
gagaagaaggcaacccaaa

SEQ ID NO: 142965 - RNA, 19 nt, Homo sapiens
guccugcccucuucuguuu

SEQ ID NO: 142966 - RNA, 19 nt, Homo sapiens
gaaaacggauacauucgaa

SEQ ID NO: 142967 - RNA, 19 nt, Homo sapiens
guacuggccuuugcugugu

SEQ ID NO: 142968 - RNA, 19 nt, Homo sapiens
ggugauuucuuucuguuca

SEQ ID NO: 142969 - RNA, 19 nt, Homo sapiens
gaggagaagacucggaauu

SEQ ID NO: 142970 - RNA, 19 nt, Homo sapiens
agaaagaggaggagaguug

SEQ ID NO: 142971 - RNA, 19 nt, Homo sapiens
ucaaguaauuucaccuuag

SEQ ID NO: 142972 - RNA, 19 nt, Homo sapiens
gaaagaggaggagaguuga

SEQ ID NO: 142973 - RNA, 19 nt, Homo sapiens
guacagccagcauccuuaa

SEQ ID NO: 142974 - RNA, 19 nt, Homo sapiens
gcauggcugugcugaagga

SEQ ID NO: 142975 - RNA, 19 nt, Homo sapiens
gaaaagcagcacucaagua

SEQ ID NO: 142976 - RNA, 19 nt, Homo sapiens
ccucaacccugugaucuau

SEQ ID NO: 142977 - RNA, 19 nt, Homo sapiens
cgaaagcagcuaugaaaca

SEQ ID NO: 142978 - RNA, 19 nt, Homo sapiens
gcaccucccucugggcuau

SEQ ID NO: 142979 - RNA, 19 nt, Homo sapiens
gaggagaguugaaaagaga

SEQ ID NO: 142980 - RNA, 19 nt, Homo sapiens
uaugaaacaugcacuaagg

SEQ ID NO: 142981 - RNA, 19 nt, Homo sapiens
cggcacaucuggagcugaa

SEQ ID NO: 142982 - RNA, 19 nt, Homo sapiens
cgacauggcugggcuacgu

SEQ ID NO: 142983 - RNA, 19 nt, Homo sapiens
ccucuucuguuuggcuuua

SEQ ID NO: 142984 - RNA, 19 nt, Homo sapiens
gagccgaagugguaaacuc

SEQ ID NO: 142985 - RNA, 19 nt, Homo sapiens
aaacaugcacuaaggucua

SEQ ID NO: 142986 - RNA, 19 nt, Homo sapiens
cagguggagucuggaauuu

SEQ ID NO: 142987 - RNA, 19 nt, Homo sapiens
gauccucacucgacagaac

SEQ ID NO: 142988 - RNA, 19 nt, Homo sapiens
uggcugggcuacgugaaua

SEQ ID NO: 142989 - RNA, 19 nt, Homo sapiens
ggguaugucugcugucagu

SEQ ID NO: 142990 - RNA, 19 nt, Homo sapiens
caauaucgaguuccggaaa

SEQ ID NO: 142991 - RNA, 19 nt, Homo sapiens
uggcugcccuucuucuuga

SEQ ID NO: 142992 - RNA, 19 nt, Homo sapiens
gauuaucgacaucuuugaa

SEQ ID NO: 142993 - RNA, 19 nt, Homo sapiens
gacuaccaccaacuacuua

SEQ ID NO: 142994 - RNA, 19 nt, Homo sapiens
gugcauggcugugcugaag

SEQ ID NO: 142995 - RNA, 19 nt, Homo sapiens
guaugucugcugucaguaa

SEQ ID NO: 142996 - RNA, 19 nt, Homo sapiens
gcuaugaaacaugcacuaa

SEQ ID NO: 142997 - RNA, 19 nt, Homo sapiens
cucaaguaauuucaccuua

SEQ ID NO: 142998 - RNA, 19 nt, Homo sapiens
ggagaagacucggaauucc

SEQ ID NO: 142999 - RNA, 19 nt, Homo sapiens
ugacccauguucucaauac

SEQ ID NO: 143000 - RNA, 19 nt, Homo sapiens
gaacagucagugcaacagu

SEQ ID NO: 143001 - RNA, 19 nt, Homo sapiens
cgcauuugcugugauguuu

SEQ ID NO: 143002 - RNA, 19 nt, Homo sapiens
gaccaggcuuccaagaaag

SEQ ID NO: 143003 - RNA, 19 nt, Homo sapiens
gagcugaagcguuacuaca

SEQ ID NO: 143004 - RNA, 19 nt, Homo sapiens
ggucaugcccguucacuac

SEQ ID NO: 143005 - RNA, 19 nt, Homo sapiens
ugcaggagccgaaguggua

SEQ ID NO: 143006 - RNA, 19 nt, Homo sapiens
ccugagaaaggcaaaguuu

SEQ ID NO: 143007 - RNA, 19 nt, Homo sapiens
gcuguguccugcccucuuc

SEQ ID NO: 143008 - RNA, 19 nt, Homo sapiens
cagcauccuuaaucucugu

SEQ ID NO: 143009 - RNA, 19 nt, Homo sapiens
uaugucugcugucaguaaa

SEQ ID NO: 143010 - RNA, 19 nt, Homo sapiens
gaaagccuuccucaagauc

SEQ ID NO: 143011 - RNA, 19 nt, Homo sapiens
uauaccaccuucaauaucg

SEQ ID NO: 143012 - RNA, 19 nt, Homo sapiens
aucuggagcugaagcguua

SEQ ID NO: 143013 - RNA, 19 nt, Homo sapiens
cuuaaucucugugccauca

SEQ ID NO: 143014 - RNA, 19 nt, Homo sapiens
ugaguagccaccugaacua

SEQ ID NO: 143015 - RNA, 19 nt, Homo sapiens
cuccagaaaucagaagaaa

SEQ ID NO: 143016 - RNA, 19 nt, Homo sapiens
gaucuauaccaccuucaau

SEQ ID NO: 143017 - RNA, 19 nt, Homo sapiens
ggugaugcccuggguggua

SEQ ID NO: 143018 - RNA, 19 nt, Homo sapiens
aaaagcagcacucaaguaa

SEQ ID NO: 143019 - RNA, 19 nt, Homo sapiens
agaagaaggcaacccaaau

SEQ ID NO: 143020 - RNA, 19 nt, Homo sapiens
caagaaagaggaggagagu

SEQ ID NO: 143021 - RNA, 19 nt, Homo sapiens
cacccuggaugucaugaug

SEQ ID NO: 143022 - RNA, 19 nt, Homo sapiens
ucuauaccaccuucaauau

SEQ ID NO: 143023 - RNA, 19 nt, Homo sapiens
aacaugcacuaaggucuaa

SEQ ID NO: 143024 - RNA, 19 nt, Homo sapiens
cagccagcauccuuaaucu

SEQ ID NO: 143025 - RNA, 19 nt, Homo sapiens
gugaugcccugggugguau

SEQ ID NO: 143026 - RNA, 19 nt, Homo sapiens
ccagaaaucagaagaaaau

SEQ ID NO: 143027 - RNA, 19 nt, Homo sapiens
caccuucaauaucgaguuc

SEQ ID NO: 143028 - RNA, 19 nt, Homo sapiens
caugcacuaaggucuaaua

SEQ ID NO: 143029 - RNA, 19 nt, Homo sapiens
ccaucagcauagacaggua

SEQ ID NO: 143030 - RNA, 19 nt, Homo sapiens
ucaacccugugaucuauac

SEQ ID NO: 143031 - RNA, 19 nt, Homo sapiens
gcagcacucaaguaauuuc

SEQ ID NO: 143032 - RNA, 19 nt, Homo sapiens
gacagaacagucagugcaa

SEQ ID NO: 143033 - RNA, 19 nt, Homo sapiens
aaacggauacauucgaaag

SEQ ID NO: 143034 - RNA, 19 nt, Homo sapiens
acuccucggucuccagaaa

SEQ ID NO: 143035 - RNA, 19 nt, Homo sapiens
uggaauuucagccgcauuu

SEQ ID NO: 143036 - RNA, 19 nt, Homo sapiens
agacuaccaccaacuacuu

SEQ ID NO: 143037 - RNA, 19 nt, Homo sapiens
acuaugcccucuccuacug

SEQ ID NO: 143038 - RNA, 19 nt, Homo sapiens
ugucugcugucaguaaaug

SEQ ID NO: 143039 - RNA, 19 nt, Homo sapiens
gaauuucagccgcauuugc

SEQ ID NO: 143040 - RNA, 19 nt, Homo sapiens
ccgcccacaugccuacuau

SEQ ID NO: 143041 - RNA, 19 nt, Homo sapiens
gcaggagccgaagugguaa

SEQ ID NO: 143042 - RNA, 19 nt, Homo sapiens
uucgaaagcagcuaugaaa

SEQ ID NO: 143043 - RNA, 19 nt, Homo sapiens
cagcauggcacgggacaga

SEQ ID NO: 143044 - RNA, 19 nt, Homo sapiens
ggaauuucagccgcauuug

SEQ ID NO: 143045 - RNA, 19 nt, Homo sapiens
gccaucgucuucggcaaug

SEQ ID NO: 143046 - RNA, 19 nt, Homo sapiens
uagggaagcuggaaaagca

SEQ ID NO: 143047 - RNA, 19 nt, Homo sapiens
aauggcagauuaucgacau

SEQ ID NO: 143048 - RNA, 19 nt, Homo sapiens
ggaggagaguugaaaagag

SEQ ID NO: 143049 - RNA, 19 nt, Homo sapiens
ugggugauuucuuucuguu

SEQ ID NO: 143050 - RNA, 19 nt, Homo sapiens
gccagcauccuuaaucucu

SEQ ID NO: 143051 - RNA, 19 nt, Homo sapiens
acagguggagucuggaauu

SEQ ID NO: 143052 - RNA, 19 nt, Homo sapiens
uguacagccagcauccuua

SEQ ID NO: 143053 - RNA, 19 nt, Homo sapiens
ucacucgacagaacaguca

SEQ ID NO: 143054 - RNA, 19 nt, Homo sapiens
ucucugugccaucagcaua

SEQ ID NO: 143055 - RNA, 19 nt, Homo sapiens
cauccuggccaucgucuuc

SEQ ID NO: 143056 - RNA, 19 nt, Homo sapiens
aagcagcacucaaguaauu

SEQ ID NO: 143057 - RNA, 19 nt, Homo sapiens
gaaagcagcuaugaaacau

SEQ ID NO: 143058 - RNA, 19 nt, Homo sapiens
gaagaaggcaacccaaaug

SEQ ID NO: 143059 - RNA, 19 nt, Homo sapiens
caaguaauuucaccuuaga

SEQ ID NO: 143060 - RNA, 19 nt, Homo sapiens
acucagcaauggcagauua

SEQ ID NO: 143061 - RNA, 19 nt, Homo sapiens
gcaauggccuggugugcau

SEQ ID NO: 143062 - RNA, 19 nt, Homo sapiens
gaaucuauguggugcugaa

SEQ ID NO: 143063 - RNA, 19 nt, Homo sapiens
gguggagucuggaauuuca

SEQ ID NO: 143064 - RNA, 19 nt, Homo sapiens
gaaaacggauacauucgaa

SEQ ID NO: 143065 - RNA, 19 nt, Homo sapiens
gagaagaaggcaacccaaa

SEQ ID NO: 143066 - RNA, 19 nt, Homo sapiens
guccugcccucuucuguuu

SEQ ID NO: 143067 - RNA, 19 nt, Homo sapiens
guacuggccuuugcugugu

SEQ ID NO: 143068 - RNA, 19 nt, Homo sapiens
ggugauuucuuucuguuca

SEQ ID NO: 143069 - RNA, 19 nt, Homo sapiens
ucaaguaauuucaccuuag

SEQ ID NO: 143070 - RNA, 19 nt, Homo sapiens
guacagccagcauccuuaa

SEQ ID NO: 143071 - RNA, 19 nt, Homo sapiens
gcauggcugugcugaagga

SEQ ID NO: 143072 - RNA, 19 nt, Homo sapiens
gaaaagcagcacucaagua

SEQ ID NO: 143073 - RNA, 19 nt, Homo sapiens
ccucaacccugugaucuau

SEQ ID NO: 143074 - RNA, 19 nt, Homo sapiens
gaaacaaaggagacggaaa

SEQ ID NO: 143075 - RNA, 19 nt, Homo sapiens
cgaaagcagcuaugaaaca

SEQ ID NO: 143076 - RNA, 19 nt, Homo sapiens
gcaccucccucugggcuau

SEQ ID NO: 143077 - RNA, 19 nt, Homo sapiens
uaugaaacaugcacuaagg

SEQ ID NO: 143078 - RNA, 19 nt, Homo sapiens
cgacauggcugggcuacgu

SEQ ID NO: 143079 - RNA, 19 nt, Homo sapiens
ccucuucuguuuggcuuua

SEQ ID NO: 143080 - RNA, 19 nt, Homo sapiens
gagccgaagugguaaacuc

SEQ ID NO: 143081 - RNA, 19 nt, Homo sapiens
aaacaugcacuaaggucua

SEQ ID NO: 143082 - RNA, 19 nt, Homo sapiens
cagguggagucuggaauuu

SEQ ID NO: 143083 - RNA, 19 nt, Homo sapiens
gauccucacucgacagaac

SEQ ID NO: 143084 - RNA, 19 nt, Homo sapiens
uggcugggcuacgugaaua

SEQ ID NO: 143085 - RNA, 19 nt, Homo sapiens
ggguaugucugcugucagu

SEQ ID NO: 143086 - RNA, 19 nt, Homo sapiens
caauaucgaguuccggaaa

SEQ ID NO: 143087 - RNA, 19 nt, Homo sapiens
uggcugcccuucuucuuga

SEQ ID NO: 143088 - RNA, 19 nt, Homo sapiens
gauuaucgacaucuuugaa

SEQ ID NO: 143089 - RNA, 19 nt, Homo sapiens
gagugacuguccuugucua

SEQ ID NO: 143090 - RNA, 19 nt, Homo sapiens
gcuaugaaacaugcacuaa

SEQ ID NO: 143091 - RNA, 19 nt, Homo sapiens
gacuaccaccaacuacuua

SEQ ID NO: 143092 - RNA, 19 nt, Homo sapiens
gugcauggcugugcugaag

SEQ ID NO: 143093 - RNA, 19 nt, Homo sapiens
guaugucugcugucaguaa

SEQ ID NO: 143094 - RNA, 19 nt, Homo sapiens
cucaaguaauuucaccuua

SEQ ID NO: 143095 - RNA, 19 nt, Homo sapiens
ugacccauguucucaauac

SEQ ID NO: 143096 - RNA, 19 nt, Homo sapiens
gaacagucagugcaacagu

SEQ ID NO: 143097 - RNA, 19 nt, Homo sapiens
ugacuguccuugucuaugc

SEQ ID NO: 143098 - RNA, 19 nt, Homo sapiens
cgcauuugcugugauguuu

SEQ ID NO: 143099 - RNA, 19 nt, Homo sapiens
ggucaugcccguucacuac

SEQ ID NO: 143100 - RNA, 19 nt, Homo sapiens
ugcaggagccgaaguggua

SEQ ID NO: 143101 - RNA, 19 nt, Homo sapiens
ccugagaaaggcaaaguuu

SEQ ID NO: 143102 - RNA, 19 nt, Homo sapiens
ggcccugagucccaccaua

SEQ ID NO: 143103 - RNA, 19 nt, Homo sapiens
caaaggagacggaaaagga

SEQ ID NO: 143104 - RNA, 19 nt, Homo sapiens
cuucagugguguccuucua

SEQ ID NO: 143105 - RNA, 19 nt, Homo sapiens
gcuguguccugcccucuuc

SEQ ID NO: 143106 - RNA, 19 nt, Homo sapiens
cagcauccuuaaucucugu

SEQ ID NO: 143107 - RNA, 19 nt, Homo sapiens
uaugucugcugucaguaaa

SEQ ID NO: 143108 - RNA, 19 nt, Homo sapiens
gaaagccuuccucaagauc

SEQ ID NO: 143109 - RNA, 19 nt, Homo sapiens
uauaccaccuucaauaucg

SEQ ID NO: 143110 - RNA, 19 nt, Homo sapiens
cuuaaucucugugccauca

SEQ ID NO: 143111 - RNA, 19 nt, Homo sapiens
ugaguagccaccugaacua

SEQ ID NO: 143112 - RNA, 19 nt, Homo sapiens
cuccagaaaucagaagaaa

SEQ ID NO: 143113 - RNA, 19 nt, Homo sapiens
gaucuauaccaccuucaau

SEQ ID NO: 143114 - RNA, 19 nt, Homo sapiens
aaaagcagcacucaaguaa

SEQ ID NO: 143115 - RNA, 19 nt, Homo sapiens
aaacaaaggagacggaaaa

SEQ ID NO: 143116 - RNA, 19 nt, Homo sapiens
ggugaugcccuggguggua

SEQ ID NO: 143117 - RNA, 19 nt, Homo sapiens
agaagaaggcaacccaaau

SEQ ID NO: 143118 - RNA, 19 nt, Homo sapiens
cacccuggaugucaugaug

SEQ ID NO: 143119 - RNA, 19 nt, Homo sapiens
uaccugcccuuuggaguga

SEQ ID NO: 143120 - RNA, 19 nt, Homo sapiens
ucuauaccaccuucaauau

SEQ ID NO: 143121 - RNA, 19 nt, Homo sapiens
cagccagcauccuuaaucu

SEQ ID NO: 143122 - RNA, 19 nt, Homo sapiens
gugaugcccugggugguau

SEQ ID NO: 143123 - RNA, 19 nt, Homo sapiens
ccagaaaucagaagaaaau

SEQ ID NO: 143124 - RNA, 19 nt, Homo sapiens
aacaugcacuaaggucuaa

SEQ ID NO: 143125 - RNA, 19 nt, Homo sapiens
caccuucaauaucgaguuc

SEQ ID NO: 143126 - RNA, 19 nt, Homo sapiens
ucuauguggugcugaaaca

SEQ ID NO: 143127 - RNA, 19 nt, Homo sapiens
ccaucagcauagacaggua

SEQ ID NO: 143128 - RNA, 19 nt, Homo sapiens
caugcacuaaggucuaaua

SEQ ID NO: 143129 - RNA, 19 nt, Homo sapiens
ucaacccugugaucuauac

SEQ ID NO: 143130 - RNA, 19 nt, Homo sapiens
aaacggauacauucgaaag

SEQ ID NO: 143131 - RNA, 19 nt, Homo sapiens
gacagaacagucagugcaa

SEQ ID NO: 143132 - RNA, 19 nt, Homo sapiens
acuccucggucuccagaaa

SEQ ID NO: 143133 - RNA, 19 nt, Homo sapiens
gcagcacucaaguaauuuc

SEQ ID NO: 143134 - RNA, 19 nt, Homo sapiens
uggaauuucagccgcauuu

SEQ ID NO: 143135 - RNA, 19 nt, Homo sapiens
agacuaccaccaacuacuu

SEQ ID NO: 143136 - RNA, 19 nt, Homo sapiens
acuaugcccucuccuacug

SEQ ID NO: 143137 - RNA, 19 nt, Homo sapiens
ugucugcugucaguaaaug

SEQ ID NO: 143138 - RNA, 19 nt, Homo sapiens
uucgaaagcagcuaugaaa

SEQ ID NO: 143139 - RNA, 19 nt, Homo sapiens
uauguggugcugaaacaaa

SEQ ID NO: 143140 - RNA, 19 nt, Homo sapiens
uggagugacuguccuuguc

SEQ ID NO: 143141 - RNA, 19 nt, Homo sapiens
gcaggagccgaagugguaa

SEQ ID NO: 143142 - RNA, 19 nt, Homo sapiens
gaauuucagccgcauuugc

SEQ ID NO: 143143 - RNA, 19 nt, Homo sapiens
ccgcccacaugccuacuau

SEQ ID NO: 143144 - RNA, 19 nt, Homo sapiens
cagcauggcacgggacaga

SEQ ID NO: 143145 - RNA, 19 nt, Homo sapiens
ggaauuucagccgcauuug

SEQ ID NO: 143146 - RNA, 19 nt, Homo sapiens
gccaucgucuucggcaaug

SEQ ID NO: 143147 - RNA, 19 nt, Homo sapiens
aauggcagauuaucgacau

SEQ ID NO: 143148 - RNA, 19 nt, Homo sapiens
gccagcauccuuaaucucu

SEQ ID NO: 143149 - RNA, 19 nt, Homo sapiens
acagguggagucuggaauu

SEQ ID NO: 143150 - RNA, 19 nt, Homo sapiens
uagggaagcuggaaaagca

SEQ ID NO: 143151 - RNA, 19 nt, Homo sapiens
ugggugauuucuuucuguu

SEQ ID NO: 143152 - RNA, 19 nt, Homo sapiens
gcccugagucccaccauag

SEQ ID NO: 143153 - RNA, 19 nt, Homo sapiens
ggagugacuguccuugucu

SEQ ID NO: 143154 - RNA, 19 nt, Homo sapiens
uguacagccagcauccuua

SEQ ID NO: 143155 - RNA, 19 nt, Homo sapiens
ucacucgacagaacaguca

SEQ ID NO: 143156 - RNA, 19 nt, Homo sapiens
aagcagcacucaaguaauu

SEQ ID NO: 143157 - RNA, 19 nt, Homo sapiens
gaaagcagcuaugaaacau

SEQ ID NO: 143158 - RNA, 19 nt, Homo sapiens
gaagaaggcaacccaaaug

SEQ ID NO: 143159 - RNA, 19 nt, Homo sapiens
caaguaauuucaccuuaga

SEQ ID NO: 143160 - RNA, 19 nt, Homo sapiens
acucagcaauggcagauua

SEQ ID NO: 143161 - RNA, 19 nt, Homo sapiens
gcaauggccuggugugcau

SEQ ID NO: 143162 - RNA, 19 nt, Homo sapiens
gguggagucuggaauuuca

SEQ ID NO: 143163 - RNA, 19 nt, Homo sapiens
gaaaacggauacauucgaa

SEQ ID NO: 143164 - RNA, 19 nt, Homo sapiens
gagaagaaggcaacccaaa

SEQ ID NO: 143165 - RNA, 19 nt, Homo sapiens
guccugcccucuucuguuu

SEQ ID NO: 143166 - RNA, 19 nt, Homo sapiens
guacuggccuuugcugugu

SEQ ID NO: 143167 - RNA, 19 nt, Homo sapiens
ggugauuucuuucuguuca

SEQ ID NO: 143168 - RNA, 19 nt, Homo sapiens
ucaaguaauuucaccuuag

SEQ ID NO: 143169 - RNA, 19 nt, Homo sapiens
guacagccagcauccuuaa

SEQ ID NO: 143170 - RNA, 19 nt, Homo sapiens
gcauggcugugcugaagga

SEQ ID NO: 143171 - RNA, 19 nt, Homo sapiens
gaaaagcagcacucaagua

SEQ ID NO: 143172 - RNA, 19 nt, Homo sapiens
ccucaacccugugaucuau

SEQ ID NO: 143173 - RNA, 19 nt, Homo sapiens
cgaaagcagcuaugaaaca

SEQ ID NO: 143174 - RNA, 19 nt, Homo sapiens
gcaccucccucugggcuau

SEQ ID NO: 143175 - RNA, 19 nt, Homo sapiens
uaugaaacaugcacuaagg

SEQ ID NO: 143176 - RNA, 19 nt, Homo sapiens
cgacauggcugggcuacgu

SEQ ID NO: 143177 - RNA, 19 nt, Homo sapiens
ccucuucuguuuggcuuua

SEQ ID NO: 143178 - RNA, 19 nt, Homo sapiens
gagccgaagugguaaacuc

SEQ ID NO: 143179 - RNA, 19 nt, Homo sapiens
cagguggagucuggaauuu

SEQ ID NO: 143180 - RNA, 19 nt, Homo sapiens
aaacaugcacuaaggucua

SEQ ID NO: 143181 - RNA, 19 nt, Homo sapiens
uggcugggcuacgugaaua

SEQ ID NO: 143182 - RNA, 19 nt, Homo sapiens
ggguaugucugcugucagu

SEQ ID NO: 143183 - RNA, 19 nt, Homo sapiens
caauaucgaguuccggaaa

SEQ ID NO: 143184 - RNA, 19 nt, Homo sapiens
uggcugcccuucuucuuga

SEQ ID NO: 143185 - RNA, 19 nt, Homo sapiens
gauuaucgacaucuuugaa

SEQ ID NO: 143186 - RNA, 19 nt, Homo sapiens
gcuaugaaacaugcacuaa

SEQ ID NO: 143187 - RNA, 19 nt, Homo sapiens
gacuaccaccaacuacuua

SEQ ID NO: 143188 - RNA, 19 nt, Homo sapiens
gugcauggcugugcugaag

SEQ ID NO: 143189 - RNA, 19 nt, Homo sapiens
guaugucugcugucaguaa

SEQ ID NO: 143190 - RNA, 19 nt, Homo sapiens
cucaaguaauuucaccuua

SEQ ID NO: 143191 - RNA, 19 nt, Homo sapiens
ugacccauguucucaauac

SEQ ID NO: 143192 - RNA, 19 nt, Homo sapiens
cgcauuugcugugauguuu

SEQ ID NO: 143193 - RNA, 19 nt, Homo sapiens
ggucaugcccguucacuac

SEQ ID NO: 143194 - RNA, 19 nt, Homo sapiens
ugcaggagccgaaguggua

SEQ ID NO: 143195 - RNA, 19 nt, Homo sapiens
ccugagaaaggcaaaguuu

SEQ ID NO: 143196 - RNA, 19 nt, Homo sapiens
gcuguguccugcccucuuc

SEQ ID NO: 143197 - RNA, 19 nt, Homo sapiens
cagcauccuuaaucucugu

SEQ ID NO: 143198 - RNA, 19 nt, Homo sapiens
uaugucugcugucaguaaa

SEQ ID NO: 143199 - RNA, 19 nt, Homo sapiens
gaaagccuuccucaagauc

SEQ ID NO: 143200 - RNA, 19 nt, Homo sapiens
uauaccaccuucaauaucg

SEQ ID NO: 143201 - RNA, 19 nt, Homo sapiens
cuuaaucucugugccauca

SEQ ID NO: 143202 - RNA, 19 nt, Homo sapiens
ugaguagccaccugaacua

SEQ ID NO: 143203 - RNA, 19 nt, Homo sapiens
cuccagaaaucagaagaaa

SEQ ID NO: 143204 - RNA, 19 nt, Homo sapiens
gaucuauaccaccuucaau

SEQ ID NO: 143205 - RNA, 19 nt, Homo sapiens
aaaagcagcacucaaguaa

SEQ ID NO: 143206 - RNA, 19 nt, Homo sapiens
ggugaugcccuggguggua

SEQ ID NO: 143207 - RNA, 19 nt, Homo sapiens
agaagaaggcaacccaaau

SEQ ID NO: 143208 - RNA, 19 nt, Homo sapiens
cacccuggaugucaugaug

SEQ ID NO: 143209 - RNA, 19 nt, Homo sapiens
ucuauaccaccuucaauau

SEQ ID NO: 143210 - RNA, 19 nt, Homo sapiens
cagccagcauccuuaaucu

SEQ ID NO: 143211 - RNA, 19 nt, Homo sapiens
aacaugcacuaaggucuaa

SEQ ID NO: 143212 - RNA, 19 nt, Homo sapiens
gugaugcccugggugguau

SEQ ID NO: 143213 - RNA, 19 nt, Homo sapiens
ccagaaaucagaagaaaau

SEQ ID NO: 143214 - RNA, 19 nt, Homo sapiens
caccuucaauaucgaguuc

SEQ ID NO: 143215 - RNA, 19 nt, Homo sapiens
ccaucagcauagacaggua

SEQ ID NO: 143216 - RNA, 19 nt, Homo sapiens
caugcacuaaggucuaaua

SEQ ID NO: 143217 - RNA, 19 nt, Homo sapiens
gcagcacucaaguaauuuc

SEQ ID NO: 143218 - RNA, 19 nt, Homo sapiens
ucaacccugugaucuauac

SEQ ID NO: 143219 - RNA, 19 nt, Homo sapiens
aaacggauacauucgaaag

SEQ ID NO: 143220 - RNA, 19 nt, Homo sapiens
acuccucggucuccagaaa

SEQ ID NO: 143221 - RNA, 19 nt, Homo sapiens
uggaauuucagccgcauuu

SEQ ID NO: 143222 - RNA, 19 nt, Homo sapiens
agacuaccaccaacuacuu

SEQ ID NO: 143223 - RNA, 19 nt, Homo sapiens
acuaugcccucuccuacug

SEQ ID NO: 143224 - RNA, 19 nt, Homo sapiens
ugucugcugucaguaaaug

SEQ ID NO: 143225 - RNA, 19 nt, Homo sapiens
uucgaaagcagcuaugaaa

SEQ ID NO: 143226 - RNA, 19 nt, Homo sapiens
gaauuucagccgcauuugc

SEQ ID NO: 143227 - RNA, 19 nt, Homo sapiens
ccgcccacaugccuacuau

SEQ ID NO: 143228 - RNA, 19 nt, Homo sapiens
gcaggagccgaagugguaa

SEQ ID NO: 143229 - RNA, 19 nt, Homo sapiens
cagcauggcacgggacaga

SEQ ID NO: 143230 - RNA, 19 nt, Homo sapiens
ggaauuucagccgcauuug

SEQ ID NO: 143231 - RNA, 19 nt, Homo sapiens
gccaucgucuucggcaaug

SEQ ID NO: 143232 - RNA, 19 nt, Homo sapiens
uagggaagcuggaaaagca

SEQ ID NO: 143233 - RNA, 19 nt, Homo sapiens
aauggcagauuaucgacau

SEQ ID NO: 143234 - RNA, 19 nt, Homo sapiens
gccagcauccuuaaucucu

SEQ ID NO: 143235 - RNA, 19 nt, Homo sapiens
acagguggagucuggaauu

SEQ ID NO: 143236 - RNA, 19 nt, Homo sapiens
ugggugauuucuuucuguu

SEQ ID NO: 143237 - RNA, 19 nt, Homo sapiens
uguacagccagcauccuua

SEQ ID NO: 143238 - RNA, 19 nt, Homo sapiens
ucucugugccaucagcaua

SEQ ID NO: 143239 - RNA, 19 nt, Homo sapiens
cauccuggccaucgucuuc

SEQ ID NO: 143240 - RNA, 19 nt, Homo sapiens
cagcuuagaaguucgaaaa

SEQ ID NO: 143241 - RNA, 19 nt, Homo sapiens
uugcuuugcuuggguaugu

SEQ ID NO: 143242 - RNA, 19 nt, Homo sapiens
cuguuuggcuuuaauacca

SEQ ID NO: 143243 - RNA, 19 nt, Homo sapiens
cuaauagggaagcuggaaa

SEQ ID NO: 143244 - RNA, 19 nt, Homo sapiens
ccuacuaugcccucuccua

SEQ ID NO: 143245 - RNA, 19 nt, Homo sapiens
ggaccaggcuuccaagaaa

SEQ ID NO: 143246 - RNA, 19 nt, Homo sapiens
aagcagcacucaaguaauu

SEQ ID NO: 143247 - RNA, 19 nt, Homo sapiens
gaaagcagcuaugaaacau

SEQ ID NO: 143248 - RNA, 19 nt, Homo sapiens
gaagaaggcaacccaaaug

SEQ ID NO: 143249 - RNA, 19 nt, Homo sapiens
caaguaauuucaccuuaga

SEQ ID NO: 143250 - RNA, 19 nt, Homo sapiens
gcaauggccuggugugcau

SEQ ID NO: 143251 - RNA, 19 nt, Homo sapiens
gaaucuauguggugcugaa

SEQ ID NO: 143252 - RNA, 19 nt, Homo sapiens
gguggagucuggaauuuca

SEQ ID NO: 143253 - RNA, 19 nt, Homo sapiens
gagaagaaggcaacccaaa

SEQ ID NO: 143254 - RNA, 19 nt, Homo sapiens
guccugcccucuucuguuu

SEQ ID NO: 143255 - RNA, 19 nt, Homo sapiens
gaaaacggauacauucgaa

SEQ ID NO: 143256 - RNA, 19 nt, Homo sapiens
guacuggccuuugcugugu

SEQ ID NO: 143257 - RNA, 19 nt, Homo sapiens
ggugauuucuuucuguuca

SEQ ID NO: 143258 - RNA, 19 nt, Homo sapiens
gaggagaagacucggaauu

SEQ ID NO: 143259 - RNA, 19 nt, Homo sapiens
agaaagaggaggagaguug

SEQ ID NO: 143260 - RNA, 19 nt, Homo sapiens
ucaaguaauuucaccuuag

SEQ ID NO: 143261 - RNA, 19 nt, Homo sapiens
gaaagaggaggagaguuga

SEQ ID NO: 143262 - RNA, 19 nt, Homo sapiens
guacagccagcauccuuaa

SEQ ID NO: 143263 - RNA, 19 nt, Homo sapiens
gcauggcugugcugaagga

SEQ ID NO: 143264 - RNA, 19 nt, Homo sapiens
gaaaagcagcacucaagua

SEQ ID NO: 143265 - RNA, 19 nt, Homo sapiens
cgaaagcagcuaugaaaca

SEQ ID NO: 143266 - RNA, 19 nt, Homo sapiens
gaaacaaaggagacggaaa

SEQ ID NO: 143267 - RNA, 19 nt, Homo sapiens
gcaccucccucugggcuau

SEQ ID NO: 143268 - RNA, 19 nt, Homo sapiens
gaggagaguugaaaagaga

SEQ ID NO: 143269 - RNA, 19 nt, Homo sapiens
cggcacaucuggagcugaa

SEQ ID NO: 143270 - RNA, 19 nt, Homo sapiens
uaugaaacaugcacuaagg

SEQ ID NO: 143271 - RNA, 19 nt, Homo sapiens
cgacauggcugggcuacgu

SEQ ID NO: 143272 - RNA, 19 nt, Homo sapiens
ccucuucuguuuggcuuua

SEQ ID NO: 143273 - RNA, 19 nt, Homo sapiens
gagccgaagugguaaacuc

SEQ ID NO: 143274 - RNA, 19 nt, Homo sapiens
aaacaugcacuaaggucua

SEQ ID NO: 143275 - RNA, 19 nt, Homo sapiens
cagguggagucuggaauuu

SEQ ID NO: 143276 - RNA, 19 nt, Homo sapiens
gauccucacucgacagaac

SEQ ID NO: 143277 - RNA, 19 nt, Homo sapiens
uggcugggcuacgugaaua

SEQ ID NO: 143278 - RNA, 19 nt, Homo sapiens
ggguaugucugcugucagu

SEQ ID NO: 143279 - RNA, 19 nt, Homo sapiens
uggcugcccuucuucuuga

SEQ ID NO: 143280 - RNA, 19 nt, Homo sapiens
gagugacuguccuugucua

SEQ ID NO: 143281 - RNA, 19 nt, Homo sapiens
gacuaccaccaacuacuua

SEQ ID NO: 143282 - RNA, 19 nt, Homo sapiens
gugcauggcugugcugaag

SEQ ID NO: 143283 - RNA, 19 nt, Homo sapiens
guaugucugcugucaguaa

SEQ ID NO: 143284 - RNA, 19 nt, Homo sapiens
cucaaguaauuucaccuua

SEQ ID NO: 143285 - RNA, 19 nt, Homo sapiens
gcuaugaaacaugcacuaa

SEQ ID NO: 143286 - RNA, 19 nt, Homo sapiens
ggagaagacucggaauucc

SEQ ID NO: 143287 - RNA, 19 nt, Homo sapiens
ugacccauguucucaauac

SEQ ID NO: 143288 - RNA, 19 nt, Homo sapiens
gaacagucagugcaacagu

SEQ ID NO: 143289 - RNA, 19 nt, Homo sapiens
ugacuguccuugucuaugc

SEQ ID NO: 143290 - RNA, 19 nt, Homo sapiens
cgcauuugcugugauguuu

SEQ ID NO: 143291 - RNA, 19 nt, Homo sapiens
gaccaggcuuccaagaaag

SEQ ID NO: 143292 - RNA, 19 nt, Homo sapiens
gagcugaagcguuacuaca

SEQ ID NO: 143293 - RNA, 19 nt, Homo sapiens
ggucaugcccguucacuac

SEQ ID NO: 143294 - RNA, 19 nt, Homo sapiens
ugcaggagccgaaguggua

SEQ ID NO: 143295 - RNA, 19 nt, Homo sapiens
ccugagaaaggcaaaguuu

SEQ ID NO: 143296 - RNA, 19 nt, Homo sapiens
caaaggagacggaaaagga

SEQ ID NO: 143297 - RNA, 19 nt, Homo sapiens
cuucagugguguccuucua

SEQ ID NO: 143298 - RNA, 19 nt, Homo sapiens
gcuguguccugcccucuuc

SEQ ID NO: 143299 - RNA, 19 nt, Homo sapiens
cagcauccuuaaucucugu

SEQ ID NO: 143300 - RNA, 19 nt, Homo sapiens
uaugucugcugucaguaaa

SEQ ID NO: 143301 - RNA, 19 nt, Homo sapiens
aucuggagcugaagcguua

SEQ ID NO: 143302 - RNA, 19 nt, Homo sapiens
cuuaaucucugugccauca

SEQ ID NO: 143303 - RNA, 19 nt, Homo sapiens
ugaguagccaccugaacua

SEQ ID NO: 143304 - RNA, 19 nt, Homo sapiens
cuccagaaaucagaagaaa

SEQ ID NO: 143305 - RNA, 19 nt, Homo sapiens
aaacaaaggagacggaaaa

SEQ ID NO: 143306 - RNA, 19 nt, Homo sapiens
aaaagcagcacucaaguaa

SEQ ID NO: 143307 - RNA, 19 nt, Homo sapiens
ggugaugcccuggguggua

SEQ ID NO: 143308 - RNA, 19 nt, Homo sapiens
agaagaaggcaacccaaau

SEQ ID NO: 143309 - RNA, 19 nt, Homo sapiens
caagaaagaggaggagagu

SEQ ID NO: 143310 - RNA, 19 nt, Homo sapiens
cacccuggaugucaugaug

SEQ ID NO: 143311 - RNA, 19 nt, Homo sapiens
uaccugcccuuuggaguga

SEQ ID NO: 143312 - RNA, 19 nt, Homo sapiens
aacaugcacuaaggucuaa

SEQ ID NO: 143313 - RNA, 19 nt, Homo sapiens
cagccagcauccuuaaucu

SEQ ID NO: 143314 - RNA, 19 nt, Homo sapiens
gugaugcccugggugguau

SEQ ID NO: 143315 - RNA, 19 nt, Homo sapiens
ccagaaaucagaagaaaau

SEQ ID NO: 143316 - RNA, 19 nt, Homo sapiens
caugcacuaaggucuaaua

SEQ ID NO: 143317 - RNA, 19 nt, Homo sapiens
ucuauguggugcugaaaca

SEQ ID NO: 143318 - RNA, 19 nt, Homo sapiens
ccaucagcauagacaggua

SEQ ID NO: 143319 - RNA, 19 nt, Homo sapiens
gacagaacagucagugcaa

SEQ ID NO: 143320 - RNA, 19 nt, Homo sapiens
gcagcacucaaguaauuuc

SEQ ID NO: 143321 - RNA, 19 nt, Homo sapiens
aaacggauacauucgaaag

SEQ ID NO: 143322 - RNA, 19 nt, Homo sapiens
acuccucggucuccagaaa

SEQ ID NO: 143323 - RNA, 19 nt, Homo sapiens
uggaauuucagccgcauuu

SEQ ID NO: 143324 - RNA, 19 nt, Homo sapiens
agacuaccaccaacuacuu

SEQ ID NO: 143325 - RNA, 19 nt, Homo sapiens
acuaugcccucuccuacug

SEQ ID NO: 143326 - RNA, 19 nt, Homo sapiens
ugucugcugucaguaaaug

SEQ ID NO: 143327 - RNA, 19 nt, Homo sapiens
uauguggugcugaaacaaa

SEQ ID NO: 143328 - RNA, 19 nt, Homo sapiens
uggagugacuguccuuguc

SEQ ID NO: 143329 - RNA, 19 nt, Homo sapiens
gaauuucagccgcauuugc

SEQ ID NO: 143330 - RNA, 19 nt, Homo sapiens
gcaggagccgaagugguaa

SEQ ID NO: 143331 - RNA, 19 nt, Homo sapiens
ccgcccacaugccuacuau

SEQ ID NO: 143332 - RNA, 19 nt, Homo sapiens
uucgaaagcagcuaugaaa

SEQ ID NO: 143333 - RNA, 19 nt, Homo sapiens
cagcauggcacgggacaga

SEQ ID NO: 143334 - RNA, 19 nt, Homo sapiens
ggaauuucagccgcauuug

SEQ ID NO: 143335 - RNA, 19 nt, Homo sapiens
gccaucgucuucggcaaug

SEQ ID NO: 143336 - RNA, 19 nt, Homo sapiens
ggaggagaguugaaaagag

SEQ ID NO: 143337 - RNA, 19 nt, Homo sapiens
ugggugauuucuuucuguu

SEQ ID NO: 143338 - RNA, 19 nt, Homo sapiens
uagggaagcuggaaaagca

SEQ ID NO: 143339 - RNA, 19 nt, Homo sapiens
gccagcauccuuaaucucu

SEQ ID NO: 143340 - RNA, 19 nt, Homo sapiens
acagguggagucuggaauu

SEQ ID NO: 143341 - RNA, 19 nt, Homo sapiens
ggagugacuguccuugucu

SEQ ID NO: 143342 - RNA, 19 nt, Homo sapiens
uguacagccagcauccuua

SEQ ID NO: 143343 - RNA, 19 nt, Homo sapiens
ucacucgacagaacaguca

SEQ ID NO: 143344 - RNA, 19 nt, Homo sapiens
ucucugugccaucagcaua

SEQ ID NO: 143345 - RNA, 19 nt, Homo sapiens
caucuacacugucuucaac

SEQ ID NO: 143346 - RNA, 19 nt, Homo sapiens
gugcaccgccuccaucuuc

SEQ ID NO: 143347 - RNA, 19 nt, Homo sapiens
ggagggcgcuuuuguacgu

SEQ ID NO: 143348 - RNA, 19 nt, Homo sapiens
cgugugcuccuucuuccua

SEQ ID NO: 143349 - RNA, 19 nt, Homo sapiens
ccaucagcguggacagguu

SEQ ID NO: 143350 - RNA, 19 nt, Homo sapiens
ccucagggaccaaggagau

SEQ ID NO: 143351 - RNA, 19 nt, Homo sapiens
gcaccgccuccaucuucaa

SEQ ID NO: 143352 - RNA, 19 nt, Homo sapiens
uaccauagcuuaagaagua

SEQ ID NO: 143353 - RNA, 19 nt, Homo sapiens
ggagauuucuuuagacaaa

SEQ ID NO: 143354 - RNA, 19 nt, Homo sapiens
gcaauaaacucagucaaau

SEQ ID NO: 143355 - RNA, 19 nt, Homo sapiens
uaagaaguaucccugauuu

SEQ ID NO: 143356 - RNA, 19 nt, Homo sapiens
gcaaauacaugccuuucca

SEQ ID NO: 143357 - RNA, 19 nt, Homo sapiens
gaccaacgauccuaugaga

SEQ ID NO: 143358 - RNA, 19 nt, Homo sapiens
cagaaucaguugcaauaaa

SEQ ID NO: 143359 - RNA, 19 nt, Homo sapiens
gauuuauucuggugucuaa

SEQ ID NO: 143360 - RNA, 19 nt, Homo sapiens
gaaguaucccugauuuauu

SEQ ID NO: 143361 - RNA, 19 nt, Homo sapiens
caaacaaccuggccaacug

SEQ ID NO: 143362 - RNA, 19 nt, Homo sapiens
uaucauguguuucugugua

SEQ ID NO: 143363 - RNA, 19 nt, Homo sapiens
gcacagacacugacaagca

SEQ ID NO: 143364 - RNA, 19 nt, Homo sapiens
gugcuuaugucauuucuuc

SEQ ID NO: 143365 - RNA, 19 nt, Homo sapiens
caaauggcuuguucaguca

SEQ ID NO: 143366 - RNA, 19 nt, Homo sapiens
gaaccuacgccaucucuuc

SEQ ID NO: 143367 - RNA, 19 nt, Homo sapiens
ggcagaaucaguugcaaua

SEQ ID NO: 143368 - RNA, 19 nt, Homo sapiens
gcuuugugcuuaugucauu

SEQ ID NO: 143369 - RNA, 19 nt, Homo sapiens
uguaguagcucgugugcuu

SEQ ID NO: 143370 - RNA, 19 nt, Homo sapiens
caacaugaccaacgucuuc

SEQ ID NO: 143371 - RNA, 19 nt, Homo sapiens
guauggugcuggguccuua

SEQ ID NO: 143372 - RNA, 19 nt, Homo sapiens
gcacacacacgcaaauaca

SEQ ID NO: 143373 - RNA, 19 nt, Homo sapiens
aaugauacuugguccuuaa

SEQ ID NO: 143374 - RNA, 19 nt, Homo sapiens
aaguaucccugauuuauuc

SEQ ID NO: 143375 - RNA, 19 nt, Homo sapiens
ccaacgauccuaugagaga

SEQ ID NO: 143376 - RNA, 19 nt, Homo sapiens
gcucaucuccuacaaccaa

SEQ ID NO: 143377 - RNA, 19 nt, Homo sapiens
guacccagccuaccagaga

SEQ ID NO: 143378 - RNA, 19 nt, Homo sapiens
uaaacucagucaaauguac

SEQ ID NO: 143379 - RNA, 19 nt, Homo sapiens
aaaugauacuugguccuua

SEQ ID NO: 143380 - RNA, 19 nt, Homo sapiens
gcagaaucaguugcaauaa

SEQ ID NO: 143381 - RNA, 19 nt, Homo sapiens
caacgauccuaugagagaa

SEQ ID NO: 143382 - RNA, 19 nt, Homo sapiens
gcugcucccuuuaucaugu

SEQ ID NO: 143383 - RNA, 19 nt, Homo sapiens
aaucgcagcugccuacauc

SEQ ID NO: 143384 - RNA, 19 nt, Homo sapiens
agaaguaucccugauuuau

SEQ ID NO: 143385 - RNA, 19 nt, Homo sapiens
ucccguggcuuugugcuua

SEQ ID NO: 143386 - RNA, 19 nt, Homo sapiens
ugucauuucuucucucugu

SEQ ID NO: 143387 - RNA, 19 nt, Homo sapiens
caauaaacucagucaaaug

SEQ ID NO: 143388 - RNA, 19 nt, Homo sapiens
agaaucaguugcaauaaac

SEQ ID NO: 143389 - RNA, 19 nt, Homo sapiens
agaauuggcagaaucaguu

SEQ ID NO: 143390 - RNA, 19 nt, Homo sapiens
ggcuggaccugccaaacaa

SEQ ID NO: 143391 - RNA, 19 nt, Homo sapiens
uagcucgugugcuuagaaa

SEQ ID NO: 143392 - RNA, 19 nt, Homo sapiens
cuuguucagucacuuguuu

SEQ ID NO: 143393 - RNA, 19 nt, Homo sapiens
cgaagaauuggcagaauca

SEQ ID NO: 143394 - RNA, 19 nt, Homo sapiens
uuaacugcauggucccuuu

SEQ ID NO: 143395 - RNA, 19 nt, Homo sapiens
gcacgcacacacacgcaaa

SEQ ID NO: 143396 - RNA, 19 nt, Homo sapiens
ugcaauaaacucagucaaa

SEQ ID NO: 143397 - RNA, 19 nt, Homo sapiens
ucgaagaauuggcagaauc

SEQ ID NO: 143398 - RNA, 19 nt, Homo sapiens
caagaaggagaccaagguu

SEQ ID NO: 143399 - RNA, 19 nt, Homo sapiens
uuaagaaguaucccugauu

SEQ ID NO: 143400 - RNA, 19 nt, Homo sapiens
ucacuuguuuguguuugaa

SEQ ID NO: 143401 - RNA, 19 nt, Homo sapiens
gaauuggcagaaucaguug

SEQ ID NO: 143402 - RNA, 19 nt, Homo sapiens
gggcuggaccugccaaaca

SEQ ID NO: 143403 - RNA, 19 nt, Homo sapiens
aagaaguaucccugauuua

SEQ ID NO: 143404 - RNA, 19 nt, Homo sapiens
uuagaaaccucaccccauu

SEQ ID NO: 143405 - RNA, 19 nt, Homo sapiens
gcauguuccagaucuauca

SEQ ID NO: 143406 - RNA, 19 nt, Homo sapiens
ugaaugcagagaacuguga

SEQ ID NO: 143407 - RNA, 19 nt, Homo sapiens
ucagucacuuguuuguguu

SEQ ID NO: 143408 - RNA, 19 nt, Homo sapiens
auugguaguucgaagaauu

SEQ ID NO: 143409 - RNA, 19 nt, Homo sapiens
caacgccgacuuucagaag

SEQ ID NO: 143410 - RNA, 19 nt, Homo sapiens
ggauucccguggcuuugug

SEQ ID NO: 143411 - RNA, 19 nt, Homo sapiens
gcgccaacaugaccaacgu

SEQ ID NO: 143412 - RNA, 19 nt, Homo sapiens
uuccagugcugcucccuuu

SEQ ID NO: 143413 - RNA, 19 nt, Homo sapiens
uaaacugcauuaagaaacc

SEQ ID NO: 143414 - RNA, 19 nt, Homo sapiens
cggugaacaucagcaauga

SEQ ID NO: 143415 - RNA, 19 nt, Homo sapiens
ugggcuaacuccucacuca

SEQ ID NO: 143416 - RNA, 19 nt, Homo sapiens
guugcuggcugcccuucuu

SEQ ID NO: 143417 - RNA, 19 nt, Homo sapiens
ucaagaaggagaccaaggu

SEQ ID NO: 143418 - RNA, 19 nt, Homo sapiens
aacagcagguugugugugu

SEQ ID NO: 143419 - RNA, 19 nt, Homo sapiens
cgucaucuaugccuucaac

SEQ ID NO: 143420 - RNA, 19 nt, Homo sapiens
ccaucaugaucgugaccua

SEQ ID NO: 143421 - RNA, 19 nt, Homo sapiens
guaguagcucgugugcuua

SEQ ID NO: 143422 - RNA, 19 nt, Homo sapiens
ccagugcugcucccuuuau

SEQ ID NO: 143423 - RNA, 19 nt, Homo sapiens
ugacaagcacgcacacaca

SEQ ID NO: 143424 - RNA, 19 nt, Homo sapiens
cugcauaaccgcacagaca

SEQ ID NO: 143425 - RNA, 19 nt, Homo sapiens
gccgguuacuggcccuuug

SEQ ID NO: 143426 - RNA, 19 nt, Homo sapiens
ugaccaacgucuucaucgu

SEQ ID NO: 143427 - RNA, 19 nt, Homo sapiens
cugcugacccuacucauca

SEQ ID NO: 143428 - RNA, 19 nt, Homo sapiens
acacacacgcaaauacaug

SEQ ID NO: 143429 - RNA, 19 nt, Homo sapiens
ucagugagaccaccuucga

SEQ ID NO: 143430 - RNA, 19 nt, Homo sapiens
cuuaagaaguaucccugau

SEQ ID NO: 143431 - RNA, 19 nt, Homo sapiens
ggccuggcauggaccuugu

SEQ ID NO: 143432 - RNA, 19 nt, Homo sapiens
uucagucacuuguuugugu

SEQ ID NO: 143433 - RNA, 19 nt, Homo sapiens
cugcccuucuucauccuua

SEQ ID NO: 143434 - RNA, 19 nt, Homo sapiens
gucacuuguuuguguuuga

SEQ ID NO: 143435 - RNA, 19 nt, Homo sapiens
gauccuaugagagaagaga

SEQ ID NO: 143436 - RNA, 19 nt, Homo sapiens
ggaccaacgauccuaugag

SEQ ID NO: 143437 - RNA, 19 nt, Homo sapiens
guucgaagaauuggcagaa

SEQ ID NO: 143438 - RNA, 19 nt, Homo sapiens
ccucauggaucugcauaac

SEQ ID NO: 143439 - RNA, 19 nt, Homo sapiens
gaccuuguccauccucauc

SEQ ID NO: 143440 - RNA, 19 nt, Homo sapiens
gauggaccaacgauccuau

SEQ ID NO: 143441 - RNA, 19 nt, Homo sapiens
guagcucgugugcuuagaa

SEQ ID NO: 143442 - RNA, 19 nt, Homo sapiens
gacuccagccugaaucgaa

SEQ ID NO: 143443 - RNA, 19 nt, Homo sapiens
ccucuuuaccauagcuuaa

SEQ ID NO: 143444 - RNA, 19 nt, Homo sapiens
gugugugugugcagugaug

SEQ ID NO: 143445 - RNA, 19 nt, Homo sapiens
cauguguuucuguguagua

SEQ ID NO: 143446 - RNA, 19 nt, Homo sapiens
guggagacggugaacauca

SEQ ID NO: 143447 - RNA, 19 nt, Homo sapiens
uaaacagcagguugugugu

SEQ ID NO: 143448 - RNA, 19 nt, Homo sapiens
ccaaacaaccuggccaacu

SEQ ID NO: 143449 - RNA, 19 nt, Homo sapiens
ccuaugagagaagagagua

SEQ ID NO: 143450 - RNA, 19 nt, Homo sapiens
ccagauggugacccuguug

SEQ ID NO: 143451 - RNA, 19 nt, Homo sapiens
gaacaaggccacugaguau

SEQ ID NO: 143452 - RNA, 19 nt, Homo sapiens
ggagagggcuuugauguca

SEQ ID NO: 143453 - RNA, 19 nt, Homo sapiens
gcacaagccuaacaucuac

SEQ ID NO: 143454 - RNA, 19 nt, Homo sapiens
agaaggagcuggagucugu

SEQ ID NO: 143455 - RNA, 19 nt, Homo sapiens
ccucaagucucugcuauuu

SEQ ID NO: 143456 - RNA, 19 nt, Homo sapiens
gaguuuaggaucuguauuu

SEQ ID NO: 143457 - RNA, 19 nt, Homo sapiens
ggaggcauuucccauaaga

SEQ ID NO: 143458 - RNA, 19 nt, Homo sapiens
ucaagucucugcuauuuac

SEQ ID NO: 143459 - RNA, 19 nt, Homo sapiens
auacaaaggugccaacauc

SEQ ID NO: 143460 - RNA, 19 nt, Homo sapiens
gcacugagggagcaaguug

SEQ ID NO: 143461 - RNA, 19 nt, Homo sapiens
ucaccacucugacguguau

SEQ ID NO: 143462 - RNA, 19 nt, Homo sapiens
ucaacaagcacaagccuaa

SEQ ID NO: 143463 - RNA, 19 nt, Homo sapiens
ggacagaggccagacuuca

SEQ ID NO: 143464 - RNA, 19 nt, Homo sapiens
ggugguggcaucuccuuua

SEQ ID NO: 143465 - RNA, 19 nt, Homo sapiens
gaauacaagaucuucaaug

SEQ ID NO: 143466 - RNA, 19 nt, Homo sapiens
gcauuucccauaagacuga

SEQ ID NO: 143467 - RNA, 19 nt, Homo sapiens
gugguggcaucuccuuuaa

SEQ ID NO: 143468 - RNA, 19 nt, Homo sapiens
acaaacacccaaacagaaa

SEQ ID NO: 143469 - RNA, 19 nt, Homo sapiens
acacaaacacccaaacaga

SEQ ID NO: 143470 - RNA, 19 nt, Homo sapiens
gcugguagcugggccuguu

SEQ ID NO: 143471 - RNA, 19 nt, Homo sapiens
gugcugagccugcaucugu

SEQ ID NO: 143472 - RNA, 19 nt, Homo sapiens
agaacaaggccacugagua

SEQ ID NO: 143473 - RNA, 19 nt, Homo sapiens
gcccugaccugcaucuaca

SEQ ID NO: 143474 - RNA, 19 nt, Homo sapiens
gguggcaucuccuuuaacu

SEQ ID NO: 143475 - RNA, 19 nt, Homo sapiens
ggacacacaaacacccaaa

SEQ ID NO: 143476 - RNA, 19 nt, Homo sapiens
aauacaagaucuucaaugc

SEQ ID NO: 143477 - RNA, 19 nt, Homo sapiens
gcacgaauacaagaucuuc

SEQ ID NO: 143478 - RNA, 19 nt, Homo sapiens
guguggcgcugauuggauu

SEQ ID NO: 143479 - RNA, 19 nt, Homo sapiens
gcuuugaugucaugaaguc

SEQ ID NO: 143480 - RNA, 19 nt, Homo sapiens
gcagggacuuuugaguuua

SEQ ID NO: 143481 - RNA, 19 nt, Homo sapiens
cacaaacacccaaacagaa

SEQ ID NO: 143482 - RNA, 19 nt, Homo sapiens
gggcuuugaugucaugaag

SEQ ID NO: 143483 - RNA, 19 nt, Homo sapiens
ugcccugccuguauguuua

SEQ ID NO: 143484 - RNA, 19 nt, Homo sapiens
gcgaggcagcguccuauga

SEQ ID NO: 143485 - RNA, 19 nt, Homo sapiens
ggcagggacuuuugaguuu

SEQ ID NO: 143486 - RNA, 19 nt, Homo sapiens
uuggaggcauuucccauaa

SEQ ID NO: 143487 - RNA, 19 nt, Homo sapiens
guuggaggcauuucccaua

SEQ ID NO: 143488 - RNA, 19 nt, Homo sapiens
ggcuguggcugcugucaug

SEQ ID NO: 143489 - RNA, 19 nt, Homo sapiens
guaggcagacgaagagugu

SEQ ID NO: 143490 - RNA, 19 nt, Homo sapiens
uggagaugcuuugggagua

SEQ ID NO: 143491 - RNA, 19 nt, Homo sapiens
gguaaguccacauucuuga

SEQ ID NO: 143492 - RNA, 19 nt, Homo sapiens
ucacagacgccaucauucu

SEQ ID NO: 143493 - RNA, 19 nt, Homo sapiens
ggagaugcuuugggaguac

SEQ ID NO: 143494 - RNA, 19 nt, Homo sapiens
gggcucgguuggaggcauu

SEQ ID NO: 143495 - RNA, 19 nt, Homo sapiens
ugaccugcaucuacaccaa

SEQ ID NO: 143496 - RNA, 19 nt, Homo sapiens
agaagaacaaggccacuga

SEQ ID NO: 143497 - RNA, 19 nt, Homo sapiens
caagaucuucaaugcagaa

SEQ ID NO: 143498 - RNA, 19 nt, Homo sapiens
ugaaggcgcagcccaagga

SEQ ID NO: 143499 - RNA, 19 nt, Homo sapiens
cggacgaguucaucgaugu

SEQ ID NO: 143500 - RNA, 19 nt, Homo sapiens
ggguaaguccacauucuug

SEQ ID NO: 143501 - RNA, 19 nt, Homo sapiens
ccacugggacacacaaaca

SEQ ID NO: 143502 - RNA, 19 nt, Homo sapiens
cuucacagacgccaucauu

SEQ ID NO: 143503 - RNA, 19 nt, Homo sapiens
gaagcugaaccuggacuau

SEQ ID NO: 143504 - RNA, 19 nt, Homo sapiens
gaggacagaggccagacuu

SEQ ID NO: 143505 - RNA, 19 nt, Homo sapiens
gcauccgccucaacaagca

SEQ ID NO: 143506 - RNA, 19 nt, Homo sapiens
acaaggccacugaguauca

SEQ ID NO: 143507 - RNA, 19 nt, Homo sapiens
gagagggcuuugaugucau

SEQ ID NO: 143508 - RNA, 19 nt, Homo sapiens
gccagggccuaaagcagau

SEQ ID NO: 143509 - RNA, 19 nt, Homo sapiens
gcagacgaagaguguguug

SEQ ID NO: 143510 - RNA, 19 nt, Homo sapiens
gcuaagcucgccaaguauc

SEQ ID NO: 143511 - RNA, 19 nt, Homo sapiens
cuacuucaagcccaagaaa

SEQ ID NO: 143512 - RNA, 19 nt, Homo sapiens
cggcugacgucaucaucau

SEQ ID NO: 143513 - RNA, 19 nt, Homo sapiens
gaggcagcguccuaugagu

SEQ ID NO: 143514 - RNA, 19 nt, Homo sapiens
agagggcuuugaugucaug

SEQ ID NO: 143515 - RNA, 19 nt, Homo sapiens
uccuuuaacucgacaguca

SEQ ID NO: 143516 - RNA, 19 nt, Homo sapiens
gaaggcgcagcccaaggaa

SEQ ID NO: 143517 - RNA, 19 nt, Homo sapiens
ggucauugaauacaaaggu

SEQ ID NO: 143518 - RNA, 19 nt, Homo sapiens
caaggccacugaguaucau

SEQ ID NO: 143519 - RNA, 19 nt, Homo sapiens
cgccaucauucuccggaaa

SEQ ID NO: 143520 - RNA, 19 nt, Homo sapiens
gucaugaagucgggugaug

SEQ ID NO: 143521 - RNA, 19 nt, Homo sapiens
cagcucauccugcacgaau

SEQ ID NO: 143522 - RNA, 19 nt, Homo sapiens
gcaucuacaccaagaagag

SEQ ID NO: 143523 - RNA, 19 nt, Homo sapiens
cgaauacaagaucuucaau

SEQ ID NO: 143524 - RNA, 19 nt, Homo sapiens
agccuaacaucuacuucaa

SEQ ID NO: 143525 - RNA, 19 nt, Homo sapiens
gcucggacacagaagaaca

SEQ ID NO: 143526 - RNA, 19 nt, Homo sapiens
acacacaaacacccaaaca

SEQ ID NO: 143527 - RNA, 19 nt, Homo sapiens
gcugcggcaugaagcugaa

SEQ ID NO: 143528 - RNA, 19 nt, Homo sapiens
ggacgaguucaucgaugug

SEQ ID NO: 143529 - RNA, 19 nt, Homo sapiens
gggcauccgccucaacaag

SEQ ID NO: 143530 - RNA, 19 nt, Homo sapiens
gaauacaaaggugccaaca

SEQ ID NO: 143531 - RNA, 19 nt, Homo sapiens
aaggagagggcuuugaugu

SEQ ID NO: 143532 - RNA, 19 nt, Homo sapiens
gaagugcuuuuccgagaag

SEQ ID NO: 143533 - RNA, 19 nt, Homo sapiens
agcacaagccuaacaucua

SEQ ID NO: 143534 - RNA, 19 nt, Homo sapiens
ugauuggauuucccucugu

SEQ ID NO: 143535 - RNA, 19 nt, Homo sapiens
ucgaccagaucuccaugga

SEQ ID NO: 143536 - RNA, 19 nt, Homo sapiens
ggagaaggagcuggagucu

SEQ ID NO: 143537 - RNA, 19 nt, Homo sapiens
uccacauucuugagucuga

SEQ ID NO: 143538 - RNA, 19 nt, Homo sapiens
ucaguaggcagacgaagag

SEQ ID NO: 143539 - RNA, 19 nt, Homo sapiens
gaaccaagaucacugaauu

SEQ ID NO: 143540 - RNA, 19 nt, Homo sapiens
gcaaagaaauccaucagaa

SEQ ID NO: 143541 - RNA, 19 nt, Homo sapiens
ucagagagaugaauuguga

SEQ ID NO: 143542 - RNA, 19 nt, Homo sapiens
gagggaagauauccagaaa

SEQ ID NO: 143543 - RNA, 19 nt, Homo sapiens
ccacaucuaccucaaauaa

SEQ ID NO: 143544 - RNA, 19 nt, Homo sapiens
caaauaacucguugccuua

SEQ ID NO: 143545 - RNA, 19 nt, Homo sapiens
caaagaaauccaucagaaa

SEQ ID NO: 143546 - RNA, 19 nt, Homo sapiens
gggaagauauccagaaagg

SEQ ID NO: 143547 - RNA, 19 nt, Homo sapiens
cagggaaacuggucuugaa

SEQ ID NO: 143548 - RNA, 19 nt, Homo sapiens
ggaggaggauuacgaggau

SEQ ID NO: 143549 - RNA, 19 nt, Homo sapiens
gcaugucgguggagaucaa

SEQ ID NO: 143550 - RNA, 19 nt, Homo sapiens
ggacagagagcccgagagu

SEQ ID NO: 143551 - RNA, 19 nt, Homo sapiens
ggacuuacgaggagcaguu

SEQ ID NO: 143552 - RNA, 19 nt, Homo sapiens
ggagaucaacggcaucaug

SEQ ID NO: 143553 - RNA, 19 nt, Homo sapiens
gaaacuacaggccgugaug

SEQ ID NO: 143554 - RNA, 19 nt, Homo sapiens
gaucaaaccuuaggaaaag

SEQ ID NO: 143555 - RNA, 19 nt, Homo sapiens
auacaucccugcacugugu

SEQ ID NO: 143556 - RNA, 19 nt, Homo sapiens
gaacagcaaagaaauccau

SEQ ID NO: 143557 - RNA, 19 nt, Homo sapiens
gagaugaauugugagaaca

SEQ ID NO: 143558 - RNA, 19 nt, Homo sapiens
ggagggaagauauccagaa

SEQ ID NO: 143559 - RNA, 19 nt, Homo sapiens
ggacaugaagcccaaaugg

SEQ ID NO: 143560 - RNA, 19 nt, Homo sapiens
gcagggccaugaaacuaca

SEQ ID NO: 143561 - RNA, 19 nt, Homo sapiens
ggacccaauacaugaagua

SEQ ID NO: 143562 - RNA, 19 nt, Homo sapiens
gagaucaacggcaucaugu

SEQ ID NO: 143563 - RNA, 19 nt, Homo sapiens
ggaauuccuggaugacuug

SEQ ID NO: 143564 - RNA, 19 nt, Homo sapiens
uuaagcagcucuacgaacu

SEQ ID NO: 143565 - RNA, 19 nt, Homo sapiens
aggaggagauggaggaaga

SEQ ID NO: 143566 - RNA, 19 nt, Homo sapiens
caggagaggagcacuuuga

SEQ ID NO: 143567 - RNA, 19 nt, Homo sapiens
caagaaagaggaggacuca

SEQ ID NO: 143568 - RNA, 19 nt, Homo sapiens
aaggaacacuugaauuucu

SEQ ID NO: 143569 - RNA, 19 nt, Homo sapiens
uggaacagcugcgggagaa

SEQ ID NO: 143570 - RNA, 19 nt, Homo sapiens
gaucaacggcaucauguac

SEQ ID NO: 143571 - RNA, 19 nt, Homo sapiens
aagaagcuguggcgugaga

SEQ ID NO: 143572 - RNA, 19 nt, Homo sapiens
gggaucaaaccuuaggaaa

SEQ ID NO: 143573 - RNA, 19 nt, Homo sapiens
agccacagcugacgccaaa

SEQ ID NO: 143574 - RNA, 19 nt, Homo sapiens
cugcagagccuccggagaa

SEQ ID NO: 143575 - RNA, 19 nt, Homo sapiens
ugugagaacagcaaagaaa

SEQ ID NO: 143576 - RNA, 19 nt, Homo sapiens
ccaucagccuucagcuuga

SEQ ID NO: 143577 - RNA, 19 nt, Homo sapiens
aggaggaggaggaggauua

SEQ ID NO: 143578 - RNA, 19 nt, Homo sapiens
ccaggacucugcugugaac

SEQ ID NO: 143579 - RNA, 19 nt, Homo sapiens
acagaaagaggcagacguu

SEQ ID NO: 143580 - RNA, 19 nt, Homo sapiens
gaugacuuguucagcuuca

SEQ ID NO: 143581 - RNA, 19 nt, Homo sapiens
agagaugaauugugagaac

SEQ ID NO: 143582 - RNA, 19 nt, Homo sapiens
acaucuaccucaaauaacu

SEQ ID NO: 143583 - RNA, 19 nt, Homo sapiens
caaccucugcucccaacaa

SEQ ID NO: 143584 - RNA, 19 nt, Homo sapiens
cgccaggacucugcuguga

SEQ ID NO: 143585 - RNA, 19 nt, Homo sapiens
ucguggaggucaucaacaa

SEQ ID NO: 143586 - RNA, 19 nt, Homo sapiens
gcaacagcaucagcauguc

SEQ ID NO: 143587 - RNA, 19 nt, Homo sapiens
ugaaaccccugaaccaaga

SEQ ID NO: 143588 - RNA, 19 nt, Homo sapiens
cagagccuccggagaagaa

SEQ ID NO: 143589 - RNA, 19 nt, Homo sapiens
uuugguggcucccucuuug

SEQ ID NO: 143590 - RNA, 19 nt, Homo sapiens
gggaggaggaggagaugga

SEQ ID NO: 143591 - RNA, 19 nt, Homo sapiens
uggaggucaucaacaagaa

SEQ ID NO: 143592 - RNA, 19 nt, Homo sapiens
ggaucaaaccuuaggaaaa

SEQ ID NO: 143593 - RNA, 19 nt, Homo sapiens
gaauugugagaacagcaaa

SEQ ID NO: 143594 - RNA, 19 nt, Homo sapiens
gccaggagaggagcacuuu

SEQ ID NO: 143595 - RNA, 19 nt, Homo sapiens
aaccucugcucccaacaaa

SEQ ID NO: 143596 - RNA, 19 nt, Homo sapiens
caucauguacacaggaguu

SEQ ID NO: 143597 - RNA, 19 nt, Homo sapiens
uggaugacuuguucagcuu

SEQ ID NO: 143598 - RNA, 19 nt, Homo sapiens
ggaugcagcgggcucagau

SEQ ID NO: 143599 - RNA, 19 nt, Homo sapiens
gugagaacagcaaagaaau

SEQ ID NO: 143600 - RNA, 19 nt, Homo sapiens
aaauaacucguugccuuaa

SEQ ID NO: 143601 - RNA, 19 nt, Homo sapiens
ccgcagggccaugaaacua

SEQ ID NO: 143602 - RNA, 19 nt, Homo sapiens
ccccuaagaucaagaaaga

SEQ ID NO: 143603 - RNA, 19 nt, Homo sapiens
ggagcacuuugaggacaug

SEQ ID NO: 143604 - RNA, 19 nt, Homo sapiens
cgauccuguuuaccucaua

SEQ ID NO: 143605 - RNA, 19 nt, Homo sapiens
cccaugagcauucggauca

SEQ ID NO: 143606 - RNA, 19 nt, Homo sapiens
guggaggucaucaacaaga

SEQ ID NO: 143607 - RNA, 19 nt, Homo sapiens
gauccuguuuaccucauac

SEQ ID NO: 143608 - RNA, 19 nt, Homo sapiens
ugagaacagcaaagaaauc

SEQ ID NO: 143609 - RNA, 19 nt, Homo sapiens
cacuugaauuucucagguu

SEQ ID NO: 143610 - RNA, 19 nt, Homo sapiens
cuccacaucuaccucaaau

SEQ ID NO: 143611 - RNA, 19 nt, Homo sapiens
cuucucguguccagugaaa

SEQ ID NO: 143612 - RNA, 19 nt, Homo sapiens
acuugaauuucucagguuu

SEQ ID NO: 143613 - RNA, 19 nt, Homo sapiens
cuuacgaggagcaguuuaa

SEQ ID NO: 143614 - RNA, 19 nt, Homo sapiens
aacgugcacuccagcagaa

SEQ ID NO: 143615 - RNA, 19 nt, Homo sapiens
gcucuccucacccaagcua

SEQ ID NO: 143616 - RNA, 19 nt, Homo sapiens
cugcggacccaauacauga

SEQ ID NO: 143617 - RNA, 19 nt, Homo sapiens
gcucuggugucugguuugg

SEQ ID NO: 143618 - RNA, 19 nt, Homo sapiens
gagagaugaauugugagaa

SEQ ID NO: 143619 - RNA, 19 nt, Homo sapiens
cagcugcccaugagcauuc

SEQ ID NO: 143620 - RNA, 19 nt, Homo sapiens
cccaauacaugaaguaccu

SEQ ID NO: 143621 - RNA, 19 nt, Homo sapiens
agagagaugaauugugaga

SEQ ID NO: 143622 - RNA, 19 nt, Homo sapiens
uccacacccuccacaucua

SEQ ID NO: 143623 - RNA, 19 nt, Homo sapiens
aaccaagaucacugaauuu

SEQ ID NO: 143624 - RNA, 19 nt, Homo sapiens
gcacuguguguuuucauuu

SEQ ID NO: 143625 - RNA, 19 nt, Homo sapiens
gagaacagcaaagaaaucc

SEQ ID NO: 143626 - RNA, 19 nt, Homo sapiens
ugaauugugagaacagcaa

SEQ ID NO: 143627 - RNA, 19 nt, Homo sapiens
ggaagauauccagaaagga

SEQ ID NO: 143628 - RNA, 19 nt, Homo sapiens
ggaggaaacaccggaacca

SEQ ID NO: 143629 - RNA, 19 nt, Homo sapiens
cagccaagccuccgaaagc

SEQ ID NO: 143630 - RNA, 19 nt, Homo sapiens
gcagagccuccggagaaga

SEQ ID NO: 143631 - RNA, 19 nt, Homo sapiens
ucacccugcggacccaaua

SEQ ID NO: 143632 - RNA, 19 nt, Homo sapiens
gaagcuguggcgugagauc

SEQ ID NO: 143633 - RNA, 19 nt, Homo sapiens
cagaaagaggcagacguuu

SEQ ID NO: 143634 - RNA, 19 nt, Homo sapiens
ggaacacuugaauuucuca

SEQ ID NO: 143635 - RNA, 19 nt, Homo sapiens
gaacuaagcacuacucuaa

SEQ ID NO: 143636 - RNA, 19 nt, Homo sapiens
gcuaagaggugcuugauga

SEQ ID NO: 143637 - RNA, 19 nt, Homo sapiens
ggacagaccacuccagaua

SEQ ID NO: 143638 - RNA, 19 nt, Homo sapiens
ccacauuccucaacuagua

SEQ ID NO: 143639 - RNA, 19 nt, Homo sapiens
gagaucagcccuuuaagua

SEQ ID NO: 143640 - RNA, 19 nt, Homo sapiens
ccaauaaaguucccuacua

SEQ ID NO: 143641 - RNA, 19 nt, Homo sapiens
gaguaaaguuggugaauga

SEQ ID NO: 143642 - RNA, 19 nt, Homo sapiens
gugaguggcuaucguaaua

SEQ ID NO: 143643 - RNA, 19 nt, Homo sapiens
cuagaaauguucccuuuaa

SEQ ID NO: 143644 - RNA, 19 nt, Homo sapiens
caaaauugcuccuucuuua

SEQ ID NO: 143645 - RNA, 19 nt, Homo sapiens
gcaggcagcugaccaguuc

SEQ ID NO: 143646 - RNA, 19 nt, Homo sapiens
cuauuaagcuguucaaaga

SEQ ID NO: 143647 - RNA, 19 nt, Homo sapiens
gcagggaucuggugguaug

SEQ ID NO: 143648 - RNA, 19 nt, Homo sapiens
gcuuggaccugguaacuuu

SEQ ID NO: 143649 - RNA, 19 nt, Homo sapiens
ggacuuugccacaaccuua

SEQ ID NO: 143650 - RNA, 19 nt, Homo sapiens
caugaaagauggaguaaag

SEQ ID NO: 143651 - RNA, 19 nt, Homo sapiens
gagcacauccaggcuauua

SEQ ID NO: 143652 - RNA, 19 nt, Homo sapiens
ccacagcccuggaaaucuu

SEQ ID NO: 143653 - RNA, 19 nt, Homo sapiens
ggaaucagaagcuacauga

SEQ ID NO: 143654 - RNA, 19 nt, Homo sapiens
gaaauguucccuuuaaucu

SEQ ID NO: 143655 - RNA, 19 nt, Homo sapiens
caacagaccaccgcaauga

SEQ ID NO: 143656 - RNA, 19 nt, Homo sapiens
gacacacacucccgaauug

SEQ ID NO: 143657 - RNA, 19 nt, Homo sapiens
ggaguaaaguuggugaaug

SEQ ID NO: 143658 - RNA, 19 nt, Homo sapiens
gcacccauuugaggaguua

SEQ ID NO: 143659 - RNA, 19 nt, Homo sapiens
gccagaaacuaugaauuaa

SEQ ID NO: 143660 - RNA, 19 nt, Homo sapiens
gaugugcacuugucaaugg

SEQ ID NO: 143661 - RNA, 19 nt, Homo sapiens
gaaagauggaguaaaguug

SEQ ID NO: 143662 - RNA, 19 nt, Homo sapiens
cacccaaccuuuccaguuu

SEQ ID NO: 143663 - RNA, 19 nt, Homo sapiens
gcaugcagauccucgaaga

SEQ ID NO: 143664 - RNA, 19 nt, Homo sapiens
caauaaaguucccuacuac

SEQ ID NO: 143665 - RNA, 19 nt, Homo sapiens
gcugaccaguuccaucaua

SEQ ID NO: 143666 - RNA, 19 nt, Homo sapiens
ugaauuaacuccucucaac

SEQ ID NO: 143667 - RNA, 19 nt, Homo sapiens
ugccagaaacuaugaauua

SEQ ID NO: 143668 - RNA, 19 nt, Homo sapiens
gcacggaagugaaggaaaa

SEQ ID NO: 143669 - RNA, 19 nt, Homo sapiens
ggagacacaugcggccuuu

SEQ ID NO: 143670 - RNA, 19 nt, Homo sapiens
uagcugaucugaacaacau

SEQ ID NO: 143671 - RNA, 19 nt, Homo sapiens
cgaaacagcggauccagaa

SEQ ID NO: 143672 - RNA, 19 nt, Homo sapiens
cagcagggaucugguggua

SEQ ID NO: 143673 - RNA, 19 nt, Homo sapiens
gaccagcaccgucacauug

SEQ ID NO: 143674 - RNA, 19 nt, Homo sapiens
gcauagacgaggaccagua

SEQ ID NO: 143675 - RNA, 19 nt, Homo sapiens
ccacaaccuuaaagaacaa

SEQ ID NO: 143676 - RNA, 19 nt, Homo sapiens
gaucaacguccgauggaaa

SEQ ID NO: 143677 - RNA, 19 nt, Homo sapiens
uaaaguuggugaaugaucu

SEQ ID NO: 143678 - RNA, 19 nt, Homo sapiens
caacuugccauuucugaug

SEQ ID NO: 143679 - RNA, 19 nt, Homo sapiens
gcuggaggcugacuacagu

SEQ ID NO: 143680 - RNA, 19 nt, Homo sapiens
gccacaaccuuaaagaaca

SEQ ID NO: 143681 - RNA, 19 nt, Homo sapiens
gaucugaacaacauuaagu

SEQ ID NO: 143682 - RNA, 19 nt, Homo sapiens
aaaguucccuacuacauca

SEQ ID NO: 143683 - RNA, 19 nt, Homo sapiens
agagcaauuucacccaaua

SEQ ID NO: 143684 - RNA, 19 nt, Homo sapiens
ccaugaaucuguguuggaa

SEQ ID NO: 143685 - RNA, 19 nt, Homo sapiens
cgacacacacucccgaauu

SEQ ID NO: 143686 - RNA, 19 nt, Homo sapiens
ugccagaccugcuucuuga

SEQ ID NO: 143687 - RNA, 19 nt, Homo sapiens
ggucaaagagccaggaugu

SEQ ID NO: 143688 - RNA, 19 nt, Homo sapiens
ccucgaagaucacaacaag

SEQ ID NO: 143689 - RNA, 19 nt, Homo sapiens
gauccuggcccacuuggaa

SEQ ID NO: 143690 - RNA, 19 nt, Homo sapiens
gugcgaaguucugauguga

SEQ ID NO: 143691 - RNA, 19 nt, Homo sapiens
aaauuccgcuccaagcauu

SEQ ID NO: 143692 - RNA, 19 nt, Homo sapiens
ugacagaguuauaccaaac

SEQ ID NO: 143693 - RNA, 19 nt, Homo sapiens
ccaagaugacagaguuaua

SEQ ID NO: 143694 - RNA, 19 nt, Homo sapiens
aauguucccuuuaaucuuc

SEQ ID NO: 143695 - RNA, 19 nt, Homo sapiens
gggaucuggugguauguga

SEQ ID NO: 143696 - RNA, 19 nt, Homo sapiens
gcugaucugaacaacauua

SEQ ID NO: 143697 - RNA, 19 nt, Homo sapiens
gagcaauuucacccaauaa

SEQ ID NO: 143698 - RNA, 19 nt, Homo sapiens
ugaaagauggaguaaaguu

SEQ ID NO: 143699 - RNA, 19 nt, Homo sapiens
aaauaucacuuggccauuc

SEQ ID NO: 143700 - RNA, 19 nt, Homo sapiens
gaagauccuggcccacuug

SEQ ID NO: 143701 - RNA, 19 nt, Homo sapiens
caagcauuauuucagcaaa

SEQ ID NO: 143702 - RNA, 19 nt, Homo sapiens
uaacuccucucaacaaagc

SEQ ID NO: 143703 - RNA, 19 nt, Homo sapiens
gaucuggcccaccaacuug

SEQ ID NO: 143704 - RNA, 19 nt, Homo sapiens
ggaggcaugauucuucuga

SEQ ID NO: 143705 - RNA, 19 nt, Homo sapiens
ucaaagagccaggauguca

SEQ ID NO: 143706 - RNA, 19 nt, Homo sapiens
gcacgugauggauguggua

SEQ ID NO: 143707 - RNA, 19 nt, Homo sapiens
gaugacagaguuauaccaa

SEQ ID NO: 143708 - RNA, 19 nt, Homo sapiens
uaaaugccagaaacuauga

SEQ ID NO: 143709 - RNA, 19 nt, Homo sapiens
caauuucacccaauaaagu

SEQ ID NO: 143710 - RNA, 19 nt, Homo sapiens
ggggaucucuucauugauu

SEQ ID NO: 143711 - RNA, 19 nt, Homo sapiens
gaaucuguguuggaaugaa

SEQ ID NO: 143712 - RNA, 19 nt, Homo sapiens
uggaggacaucauggagaa

SEQ ID NO: 143713 - RNA, 19 nt, Homo sapiens
gagcugaggcgccugaagu

SEQ ID NO: 143714 - RNA, 19 nt, Homo sapiens
gaggcugacuacagugaga

SEQ ID NO: 143715 - RNA, 19 nt, Homo sapiens
cguaguugcuuccguuuua

SEQ ID NO: 143716 - RNA, 19 nt, Homo sapiens
gaggcauccuggucaaugu

SEQ ID NO: 143717 - RNA, 19 nt, Homo sapiens
gcaauuucacccaauaaag

SEQ ID NO: 143718 - RNA, 19 nt, Homo sapiens
ggaacuaagcacuacucua

SEQ ID NO: 143719 - RNA, 19 nt, Homo sapiens
ggaccagcaccgucacauu

SEQ ID NO: 143720 - RNA, 19 nt, Homo sapiens
gaaucucagccgcuuugua

SEQ ID NO: 143721 - RNA, 19 nt, Homo sapiens
gcgaaguucugaugugacu

SEQ ID NO: 143722 - RNA, 19 nt, Homo sapiens
ccacugaggcagcaacaga

SEQ ID NO: 143723 - RNA, 19 nt, Homo sapiens
gaagaugagaaccggauuc

SEQ ID NO: 143724 - RNA, 19 nt, Homo sapiens
uugcugagauggaaaguca

SEQ ID NO: 143725 - RNA, 19 nt, Homo sapiens
ggacuucuucgcugauuca

SEQ ID NO: 143726 - RNA, 19 nt, Homo sapiens
gaauuaacuccucucaaca

SEQ ID NO: 143727 - RNA, 19 nt, Homo sapiens
gcacauccaggcuauuaag

SEQ ID NO: 143728 - RNA, 19 nt, Homo sapiens
ucacuuggccauucagaug

SEQ ID NO: 143729 - RNA, 19 nt, Homo sapiens
gcuauuaagcuguucaaag

SEQ ID NO: 143730 - RNA, 19 nt, Homo sapiens
cagagcacauccaggcuau

SEQ ID NO: 143731 - RNA, 19 nt, Homo sapiens
aaucucagccgcuuuguau

SEQ ID NO: 143732 - RNA, 19 nt, Homo sapiens
aaacuucaguaccucuuca

SEQ ID NO: 143733 - RNA, 19 nt, Homo sapiens
cccuagaaauguucccuuu

SEQ ID NO: 143734 - RNA, 19 nt, Homo sapiens
ucauaguccucuccugguu

SEQ ID NO: 143735 - RNA, 19 nt, Homo sapiens
gaaaacagauccugcaaaa

SEQ ID NO: 143736 - RNA, 19 nt, Homo sapiens
gcuccaagcuggccaagaa

SEQ ID NO: 143737 - RNA, 19 nt, Homo sapiens
caccauggcuccuacauug

SEQ ID NO: 143738 - RNA, 19 nt, Homo sapiens
ccacccaccuccacucuuu

SEQ ID NO: 143739 - RNA, 19 nt, Homo sapiens
ggacagaaagcgcacagaa

SEQ ID NO: 143740 - RNA, 19 nt, Homo sapiens
gaauaaagacucgauguca

SEQ ID NO: 143741 - RNA, 19 nt, Homo sapiens
gggcggagccuuaaugaug

SEQ ID NO: 143742 - RNA, 19 nt, Homo sapiens
cccaugagguuuccuuauu

SEQ ID NO: 143743 - RNA, 19 nt, Homo sapiens
gcaagaugcuauccaugca

SEQ ID NO: 143744 - RNA, 19 nt, Homo sapiens
gcagugcgguggcuacagu

SEQ ID NO: 143745 - RNA, 19 nt, Homo sapiens
ggcggagccuuaaugauga

SEQ ID NO: 143746 - RNA, 19 nt, Homo sapiens
ggaguggacggaagaaaga

SEQ ID NO: 143747 - RNA, 19 nt, Homo sapiens
gccagaggcuagcuuugaa

SEQ ID NO: 143748 - RNA, 19 nt, Homo sapiens
caagaaggcccgaguagag

SEQ ID NO: 143749 - RNA, 19 nt, Homo sapiens
gaagacacgacagaauaaa

SEQ ID NO: 143750 - RNA, 19 nt, Homo sapiens
ugaagacacgacagaauaa

SEQ ID NO: 143751 - RNA, 19 nt, Homo sapiens
gcgacaagccacuguagaa

SEQ ID NO: 143752 - RNA, 19 nt, Homo sapiens
ccaccgggcuaucgaggaa

SEQ ID NO: 143753 - RNA, 19 nt, Homo sapiens
ggagaaugacucugacuca

SEQ ID NO: 143754 - RNA, 19 nt, Homo sapiens
aauaaagacucgaugucaa

SEQ ID NO: 143755 - RNA, 19 nt, Homo sapiens
gaaagcgcacagaaucuug

SEQ ID NO: 143756 - RNA, 19 nt, Homo sapiens
acagucaccugaagaagga

SEQ ID NO: 143757 - RNA, 19 nt, Homo sapiens
ccaccagucucaacacauc

SEQ ID NO: 143758 - RNA, 19 nt, Homo sapiens
caacagcaaugcccaucca

SEQ ID NO: 143759 - RNA, 19 nt, Homo sapiens
ccaugagguuuccuuauuc

SEQ ID NO: 143760 - RNA, 19 nt, Homo sapiens
ccaggucucucuuccuugu

SEQ ID NO: 143761 - RNA, 19 nt, Homo sapiens
caccuggccugcacccuuu

SEQ ID NO: 143762 - RNA, 19 nt, Homo sapiens
agagggugcugcucaguug

SEQ ID NO: 143763 - RNA, 19 nt, Homo sapiens
gcagcgaccuguacuucgu

SEQ ID NO: 143764 - RNA, 19 nt, Homo sapiens
ggagccggcugaggaguau

SEQ ID NO: 143765 - RNA, 19 nt, Homo sapiens
gcaccauggcuccuacauu

SEQ ID NO: 143766 - RNA, 19 nt, Homo sapiens
ccaacaagccucucugucu

SEQ ID NO: 143767 - RNA, 19 nt, Homo sapiens
gaaagugaggagaccaaug

SEQ ID NO: 143768 - RNA, 19 nt, Homo sapiens
agaaggagcgcgagcuuga

SEQ ID NO: 143769 - RNA, 19 nt, Homo sapiens
caugagguuuccuuauuca

SEQ ID NO: 143770 - RNA, 19 nt, Homo sapiens
cuggaaguguggagaauga

SEQ ID NO: 143771 - RNA, 19 nt, Homo sapiens
gcuaccagcagguuucauu

SEQ ID NO: 143772 - RNA, 19 nt, Homo sapiens
gaaugaagacacgacagaa

SEQ ID NO: 143773 - RNA, 19 nt, Homo sapiens
gaagaaggaaagcgacaag

SEQ ID NO: 143774 - RNA, 19 nt, Homo sapiens
ugucaugucuccuggcaau

SEQ ID NO: 143775 - RNA, 19 nt, Homo sapiens
acagaaagcgcacagaauc

SEQ ID NO: 143776 - RNA, 19 nt, Homo sapiens
caauggcccuccagucucu

SEQ ID NO: 143777 - RNA, 19 nt, Homo sapiens
ccuuauucauccucuagua

SEQ ID NO: 143778 - RNA, 19 nt, Homo sapiens
ccuccgaucuggauagcuu

SEQ ID NO: 143779 - RNA, 19 nt, Homo sapiens
gacagaaagcgcacagaau

SEQ ID NO: 143780 - RNA, 19 nt, Homo sapiens
ccacuacucccauuucagu

SEQ ID NO: 143781 - RNA, 19 nt, Homo sapiens
gcagcgacccuagggauau

SEQ ID NO: 143782 - RNA, 19 nt, Homo sapiens
ggagaccaaugcaccaaaa

SEQ ID NO: 143783 - RNA, 19 nt, Homo sapiens
guccagcagugauggcaaa

SEQ ID NO: 143784 - RNA, 19 nt, Homo sapiens
ggagggagggacagacaga

SEQ ID NO: 143785 - RNA, 19 nt, Homo sapiens
ggccugacauguccuaugc

SEQ ID NO: 143786 - RNA, 19 nt, Homo sapiens
agacacgacagaauaaaga

SEQ ID NO: 143787 - RNA, 19 nt, Homo sapiens
gaaagcgacaagccacugu

SEQ ID NO: 143788 - RNA, 19 nt, Homo sapiens
gccucagggucucaccuua

SEQ ID NO: 143789 - RNA, 19 nt, Homo sapiens
ccaucgcccuccauuugaa

SEQ ID NO: 143790 - RNA, 19 nt, Homo sapiens
gcagccuccucuuccaguu

SEQ ID NO: 143791 - RNA, 19 nt, Homo sapiens
augaagacacgacagaaua

SEQ ID NO: 143792 - RNA, 19 nt, Homo sapiens
uauucauccucuaguagua

SEQ ID NO: 143793 - RNA, 19 nt, Homo sapiens
uccacagccugaagaauga

SEQ ID NO: 143794 - RNA, 19 nt, Homo sapiens
cuacuacagucaccugaag

SEQ ID NO: 143795 - RNA, 19 nt, Homo sapiens
gcuccuggguuacaauguc

SEQ ID NO: 143796 - RNA, 19 nt, Homo sapiens
cugcagaugcucaauguga

SEQ ID NO: 143797 - RNA, 19 nt, Homo sapiens
ggcugcagaugcucaaugu

SEQ ID NO: 143798 - RNA, 19 nt, Homo sapiens
gcaaucgcaaccauccauu

SEQ ID NO: 143799 - RNA, 19 nt, Homo sapiens
gcagcagccuccucuucca

SEQ ID NO: 143800 - RNA, 19 nt, Homo sapiens
aaacagauccugcaaaagu

SEQ ID NO: 143801 - RNA, 19 nt, Homo sapiens
ggguggagcagagaaguuu

SEQ ID NO: 143802 - RNA, 19 nt, Homo sapiens
cagcuggaacucucccuaa

SEQ ID NO: 143803 - RNA, 19 nt, Homo sapiens
gaaggagcgcgagcuugaa

SEQ ID NO: 143804 - RNA, 19 nt, Homo sapiens
cagaauaaagacucgaugu

SEQ ID NO: 143805 - RNA, 19 nt, Homo sapiens
gcagcagcaucacggaaac

SEQ ID NO: 143806 - RNA, 19 nt, Homo sapiens
ccaagaaggcccgaguaga

SEQ ID NO: 143807 - RNA, 19 nt, Homo sapiens
caaaaccaaccaaacaaaa

SEQ ID NO: 143808 - RNA, 19 nt, Homo sapiens
cuccgcagcuggacagaga

SEQ ID NO: 143809 - RNA, 19 nt, Homo sapiens
ucgcaaccauccauucuac

SEQ ID NO: 143810 - RNA, 19 nt, Homo sapiens
ccucuuagccaacagcaau

SEQ ID NO: 143811 - RNA, 19 nt, Homo sapiens
ccuccacucuuuccuccuu

SEQ ID NO: 143812 - RNA, 19 nt, Homo sapiens
ccaggcagacagccaagaa

SEQ ID NO: 143813 - RNA, 19 nt, Homo sapiens
cagcagugauggcaaagcu

SEQ ID NO: 143814 - RNA, 19 nt, Homo sapiens
agaaugaagacacgacaga

SEQ ID NO: 143815 - RNA, 19 nt, Homo sapiens
uguagaaccugcgaucaag

SEQ ID NO: 143816 - RNA, 19 nt, Homo sapiens
gcgcagcgaccuguacuuc

SEQ ID NO: 143817 - RNA, 19 nt, Homo sapiens
gaaggcccgaguagaggaa

SEQ ID NO: 143818 - RNA, 19 nt, Homo sapiens
auaaagacucgaugucaau

SEQ ID NO: 143819 - RNA, 19 nt, Homo sapiens
gcgccacgcagaucaaaca

SEQ ID NO: 143820 - RNA, 19 nt, Homo sapiens
gcacacccuuacgccaugu

SEQ ID NO: 143821 - RNA, 19 nt, Homo sapiens
ggugggaaccuaccuucug

SEQ ID NO: 143822 - RNA, 19 nt, Homo sapiens
ugcccacacuggaaacuug

SEQ ID NO: 143823 - RNA, 19 nt, Homo sapiens
gcaaccauccauucuacgu

SEQ ID NO: 143824 - RNA, 19 nt, Homo sapiens
guagaaccugcgaucaaga

SEQ ID NO: 143825 - RNA, 19 nt, Homo sapiens
ccaggaggacuacuacagu

SEQ ID NO: 143826 - RNA, 19 nt, Homo sapiens
caaguauacucagccuucu

SEQ ID NO: 143827 - RNA, 19 nt, Homo sapiens
ucuauaugacgcucuuaaa

SEQ ID NO: 143828 - RNA, 19 nt, Homo sapiens
ucuguuagauguggcuguu

SEQ ID NO: 143829 - RNA, 19 nt, Homo sapiens
agaaagcgcacagaaucuu

SEQ ID NO: 143830 - RNA, 19 nt, Homo sapiens
ucucaacacaucaccauca

SEQ ID NO: 143831 - RNA, 19 nt, Homo sapiens
aagccucucugucuccaau

SEQ ID NO: 143832 - RNA, 19 nt, Homo sapiens
gacacccacuggauaucau

SEQ ID NO: 143833 - RNA, 19 nt, Homo sapiens
aaagugaggagaccaaugc

SEQ ID NO: 143834 - RNA, 19 nt, Homo sapiens
gaagccuagugagcuggaa

SEQ ID NO: 143835 - RNA, 19 nt, Homo sapiens
gaagauaacugguuugaaa

SEQ ID NO: 143836 - RNA, 19 nt, Homo sapiens
gaagauggcucaauuuaca

SEQ ID NO: 143837 - RNA, 19 nt, Homo sapiens
caacaugguuuacuacuaa

SEQ ID NO: 143838 - RNA, 19 nt, Homo sapiens
gcaaagacaugcaucaaga

SEQ ID NO: 143839 - RNA, 19 nt, Homo sapiens
gcacagauccaaauacaaa

SEQ ID NO: 143840 - RNA, 19 nt, Homo sapiens
agacaugcaucaagaaaua

SEQ ID NO: 143841 - RNA, 19 nt, Homo sapiens
acaaagaacccuucaauuu

SEQ ID NO: 143842 - RNA, 19 nt, Homo sapiens
cagccuaaauuuacaguua

SEQ ID NO: 143843 - RNA, 19 nt, Homo sapiens
acacauauguuaacaguga

SEQ ID NO: 143844 - RNA, 19 nt, Homo sapiens
ugaaggaccuggagaagaa

SEQ ID NO: 143845 - RNA, 19 nt, Homo sapiens
gauagagaauccaaauuug

SEQ ID NO: 143846 - RNA, 19 nt, Homo sapiens
gaaaguuuaucuucgaguu

SEQ ID NO: 143847 - RNA, 19 nt, Homo sapiens
ggaugaagauaacugguuu

SEQ ID NO: 143848 - RNA, 19 nt, Homo sapiens
gaaauuagccggacauggu

SEQ ID NO: 143849 - RNA, 19 nt, Homo sapiens
gagacuagcaccuugaaua

SEQ ID NO: 143850 - RNA, 19 nt, Homo sapiens
gcauugaccgugagaaaua

SEQ ID NO: 143851 - RNA, 19 nt, Homo sapiens
ugacuuaugcucacaaaua

SEQ ID NO: 143852 - RNA, 19 nt, Homo sapiens
gaaugaagguacaggauca

SEQ ID NO: 143853 - RNA, 19 nt, Homo sapiens
agaacaagcucauagcaaa

SEQ ID NO: 143854 - RNA, 19 nt, Homo sapiens
gaagucaaucgccaaguua

SEQ ID NO: 143855 - RNA, 19 nt, Homo sapiens
gaaaacaagucuccuaaga

SEQ ID NO: 143856 - RNA, 19 nt, Homo sapiens
ggacaaagaacccuucaau

SEQ ID NO: 143857 - RNA, 19 nt, Homo sapiens
ggaaauauccaguggugaa

SEQ ID NO: 143858 - RNA, 19 nt, Homo sapiens
gaauuugcauuguagaugu

SEQ ID NO: 143859 - RNA, 19 nt, Homo sapiens
gguguuggguucuguauug

SEQ ID NO: 143860 - RNA, 19 nt, Homo sapiens
aaagaacccuucaauuugu

SEQ ID NO: 143861 - RNA, 19 nt, Homo sapiens
uaagagaacagucaagaaa

SEQ ID NO: 143862 - RNA, 19 nt, Homo sapiens
gagaguaugugacuguuca

SEQ ID NO: 143863 - RNA, 19 nt, Homo sapiens
ggauaauucugccaguaaa

SEQ ID NO: 143864 - RNA, 19 nt, Homo sapiens
gaacacagagugacuaucu

SEQ ID NO: 143865 - RNA, 19 nt, Homo sapiens
aaacaagucuccuaagaag

SEQ ID NO: 143866 - RNA, 19 nt, Homo sapiens
ggaaagauaaggaccagaa

SEQ ID NO: 143867 - RNA, 19 nt, Homo sapiens
gguaaggguacuauaaaua

SEQ ID NO: 143868 - RNA, 19 nt, Homo sapiens
gaagagacauaccaaagac

SEQ ID NO: 143869 - RNA, 19 nt, Homo sapiens
gaaagaugaauuugcauug

SEQ ID NO: 143870 - RNA, 19 nt, Homo sapiens
gguaaacuuugucauguau

SEQ ID NO: 143871 - RNA, 19 nt, Homo sapiens
ggacuggaguuucuagauc

SEQ ID NO: 143872 - RNA, 19 nt, Homo sapiens
caagagacguuagaccaaa

SEQ ID NO: 143873 - RNA, 19 nt, Homo sapiens
ccauguggauuuguuguua

SEQ ID NO: 143874 - RNA, 19 nt, Homo sapiens
gagguaaacuuugucaugu

SEQ ID NO: 143875 - RNA, 19 nt, Homo sapiens
guuggguucuguauuguua

SEQ ID NO: 143876 - RNA, 19 nt, Homo sapiens
gacguuagaccaaauguaa

SEQ ID NO: 143877 - RNA, 19 nt, Homo sapiens
cuacaacugucaccguuaa

SEQ ID NO: 143878 - RNA, 19 nt, Homo sapiens
gcagcgagcucacaaacuc

SEQ ID NO: 143879 - RNA, 19 nt, Homo sapiens
gaaccugacacucuccaua

SEQ ID NO: 143880 - RNA, 19 nt, Homo sapiens
gcauuuagacguaauugaa

SEQ ID NO: 143881 - RNA, 19 nt, Homo sapiens
cauuguagauguacgaauu

SEQ ID NO: 143882 - RNA, 19 nt, Homo sapiens
guaacggaagcaaauauua

SEQ ID NO: 143883 - RNA, 19 nt, Homo sapiens
ugagaaauacgaacaguuu

SEQ ID NO: 143884 - RNA, 19 nt, Homo sapiens
uagaagauggcucaauuua

SEQ ID NO: 143885 - RNA, 19 nt, Homo sapiens
ucuagaagauggcucaauu

SEQ ID NO: 143886 - RNA, 19 nt, Homo sapiens
gaauaugccagaaauugaa

SEQ ID NO: 143887 - RNA, 19 nt, Homo sapiens
gcacagaauuacaccaucu

SEQ ID NO: 143888 - RNA, 19 nt, Homo sapiens
ggacuagaauguauaugag

SEQ ID NO: 143889 - RNA, 19 nt, Homo sapiens
ucagugcaaucuucaguuu

SEQ ID NO: 143890 - RNA, 19 nt, Homo sapiens
cauaguuggugccagauaa

SEQ ID NO: 143891 - RNA, 19 nt, Homo sapiens
uaacuuccauguucucuag

SEQ ID NO: 143892 - RNA, 19 nt, Homo sapiens
gcauaaacauugugaagac

SEQ ID NO: 143893 - RNA, 19 nt, Homo sapiens
agacaggcaugguuuaguu

SEQ ID NO: 143894 - RNA, 19 nt, Homo sapiens
gaauauccacucccuuuga

SEQ ID NO: 143895 - RNA, 19 nt, Homo sapiens
gcaggagaaucgcuugaau

SEQ ID NO: 143896 - RNA, 19 nt, Homo sapiens
gacuuaugcucacaaauau

SEQ ID NO: 143897 - RNA, 19 nt, Homo sapiens
gaaguaacggaagcaaaua

SEQ ID NO: 143898 - RNA, 19 nt, Homo sapiens
ggugaaggcuuaagguauc

SEQ ID NO: 143899 - RNA, 19 nt, Homo sapiens
gaauugacguggagauuuu

SEQ ID NO: 143900 - RNA, 19 nt, Homo sapiens
ggaaagcuggguauuauag

SEQ ID NO: 143901 - RNA, 19 nt, Homo sapiens
gaacccaaauuuaggacau

SEQ ID NO: 143902 - RNA, 19 nt, Homo sapiens
gacaagaugaggagcauaa

SEQ ID NO: 143903 - RNA, 19 nt, Homo sapiens
gaggacacacucugauuaa

SEQ ID NO: 143904 - RNA, 19 nt, Homo sapiens
ugaagucaaucgccaaguu

SEQ ID NO: 143905 - RNA, 19 nt, Homo sapiens
cucaaaggcuguauacaaa

SEQ ID NO: 143906 - RNA, 19 nt, Homo sapiens
gccaaacacuccucacuca

SEQ ID NO: 143907 - RNA, 19 nt, Homo sapiens
ggagguaaacuuugucaug

SEQ ID NO: 143908 - RNA, 19 nt, Homo sapiens
gauaaaaguuguacuguca

SEQ ID NO: 143909 - RNA, 19 nt, Homo sapiens
caacuagcccugaugcauu

SEQ ID NO: 143910 - RNA, 19 nt, Homo sapiens
caaaggagguggacaucag

SEQ ID NO: 143911 - RNA, 19 nt, Homo sapiens
gaaggagugcuguguguug

SEQ ID NO: 143912 - RNA, 19 nt, Homo sapiens
caaacacuccucacucaaa

SEQ ID NO: 143913 - RNA, 19 nt, Homo sapiens
caacaaaucccagaucauc

SEQ ID NO: 143914 - RNA, 19 nt, Homo sapiens
cagaauauccacucccuuu

SEQ ID NO: 143915 - RNA, 19 nt, Homo sapiens
ucaacaugguuuacuacua

SEQ ID NO: 143916 - RNA, 19 nt, Homo sapiens
gaagauuacaugagaagau

SEQ ID NO: 143917 - RNA, 19 nt, Homo sapiens
gggagauacuggcagauau

SEQ ID NO: 143918 - RNA, 19 nt, Homo sapiens
agagaacagucaagaaaug

SEQ ID NO: 143919 - RNA, 19 nt, Homo sapiens
gcacuggacccggaaauau

SEQ ID NO: 143920 - RNA, 19 nt, Homo sapiens
acgaacaguuugcguuaua

SEQ ID NO: 143921 - RNA, 19 nt, Homo sapiens
gacccugccuucagaauuc

SEQ ID NO: 143922 - RNA, 19 nt, Homo sapiens
ugaaacacuuguaggcaaa

SEQ ID NO: 143923 - RNA, 19 nt, Homo sapiens
ucagaaaguuuaucuucga

SEQ ID NO: 143924 - RNA, 19 nt, Homo sapiens
gggacuagaauguauauga

SEQ ID NO: 143925 - RNA, 19 nt, Homo sapiens
ucaacacacuggcgacuug

SEQ ID NO: 143926 - RNA, 19 nt, Homo sapiens
cuuaagguaucagaaguua

SEQ ID NO: 143927 - RNA, 19 nt, Homo sapiens
caggaacaauuacuauuuc

SEQ ID NO: 143928 - RNA, 19 nt, Homo sapiens
gagcauugaccgugagaaa

SEQ ID NO: 143929 - RNA, 19 nt, Homo sapiens
gaagacauagcccagcaaa

SEQ ID NO: 143930 - RNA, 19 nt, Homo sapiens
gaugggcuauucuugcuau

SEQ ID NO: 143931 - RNA, 19 nt, Homo sapiens
gaucacgcaccucaaauug

SEQ ID NO: 143932 - RNA, 19 nt, Homo sapiens
gcaaguuggugucauuaac

SEQ ID NO: 143933 - RNA, 19 nt, Homo sapiens
uagcacagauccaaauaca

SEQ ID NO: 143934 - RNA, 19 nt, Homo sapiens
gagcgaaacuccgucucaa

SEQ ID NO: 143935 - RNA, 19 nt, Homo sapiens
gaagauaacugguuugaaa

SEQ ID NO: 143936 - RNA, 19 nt, Homo sapiens
gaagauggcucaauuuaca

SEQ ID NO: 143937 - RNA, 19 nt, Homo sapiens
caacaugguuuacuacuaa

SEQ ID NO: 143938 - RNA, 19 nt, Homo sapiens
gcaaagacaugcaucaaga

SEQ ID NO: 143939 - RNA, 19 nt, Homo sapiens
gcacagauccaaauacaaa

SEQ ID NO: 143940 - RNA, 19 nt, Homo sapiens
agacaugcaucaagaaaua

SEQ ID NO: 143941 - RNA, 19 nt, Homo sapiens
acaaagaacccuucaauuu

SEQ ID NO: 143942 - RNA, 19 nt, Homo sapiens
cagccuaaauuuacaguua

SEQ ID NO: 143943 - RNA, 19 nt, Homo sapiens
acacauauguuaacaguga

SEQ ID NO: 143944 - RNA, 19 nt, Homo sapiens
ugaaggaccuggagaagaa

SEQ ID NO: 143945 - RNA, 19 nt, Homo sapiens
gauagagaauccaaauuug

SEQ ID NO: 143946 - RNA, 19 nt, Homo sapiens
gaaaguuuaucuucgaguu

SEQ ID NO: 143947 - RNA, 19 nt, Homo sapiens
ggaugaagauaacugguuu

SEQ ID NO: 143948 - RNA, 19 nt, Homo sapiens
gaaauuagccggacauggu

SEQ ID NO: 143949 - RNA, 19 nt, Homo sapiens
gagacuagcaccuugaaua

SEQ ID NO: 143950 - RNA, 19 nt, Homo sapiens
gcauugaccgugagaaaua

SEQ ID NO: 143951 - RNA, 19 nt, Homo sapiens
ugacuuaugcucacaaaua

SEQ ID NO: 143952 - RNA, 19 nt, Homo sapiens
gaaugaagguacaggauca

SEQ ID NO: 143953 - RNA, 19 nt, Homo sapiens
agaacaagcucauagcaaa

SEQ ID NO: 143954 - RNA, 19 nt, Homo sapiens
gaagucaaucgccaaguua

SEQ ID NO: 143955 - RNA, 19 nt, Homo sapiens
gaaaacaagucuccuaaga

SEQ ID NO: 143956 - RNA, 19 nt, Homo sapiens
ggacaaagaacccuucaau

SEQ ID NO: 143957 - RNA, 19 nt, Homo sapiens
ggaaauauccaguggugaa

SEQ ID NO: 143958 - RNA, 19 nt, Homo sapiens
gaauuugcauuguagaugu

SEQ ID NO: 143959 - RNA, 19 nt, Homo sapiens
gguguuggguucuguauug

SEQ ID NO: 143960 - RNA, 19 nt, Homo sapiens
aaagaacccuucaauuugu

SEQ ID NO: 143961 - RNA, 19 nt, Homo sapiens
uaagagaacagucaagaaa

SEQ ID NO: 143962 - RNA, 19 nt, Homo sapiens
gagaguaugugacuguuca

SEQ ID NO: 143963 - RNA, 19 nt, Homo sapiens
ggauaauucugccaguaaa

SEQ ID NO: 143964 - RNA, 19 nt, Homo sapiens
gaacacagagugacuaucu

SEQ ID NO: 143965 - RNA, 19 nt, Homo sapiens
aaacaagucuccuaagaag

SEQ ID NO: 143966 - RNA, 19 nt, Homo sapiens
ggaaagauaaggaccagaa

SEQ ID NO: 143967 - RNA, 19 nt, Homo sapiens
gguaaggguacuauaaaua

SEQ ID NO: 143968 - RNA, 19 nt, Homo sapiens
gaagagacauaccaaagac

SEQ ID NO: 143969 - RNA, 19 nt, Homo sapiens
gaaagaugaauuugcauug

SEQ ID NO: 143970 - RNA, 19 nt, Homo sapiens
gguaaacuuugucauguau

SEQ ID NO: 143971 - RNA, 19 nt, Homo sapiens
ggacuggaguuucuagauc

SEQ ID NO: 143972 - RNA, 19 nt, Homo sapiens
caagagacguuagaccaaa

SEQ ID NO: 143973 - RNA, 19 nt, Homo sapiens
ccauguggauuuguuguua

SEQ ID NO: 143974 - RNA, 19 nt, Homo sapiens
gagguaaacuuugucaugu

SEQ ID NO: 143975 - RNA, 19 nt, Homo sapiens
guuggguucuguauuguua

SEQ ID NO: 143976 - RNA, 19 nt, Homo sapiens
gacguuagaccaaauguaa

SEQ ID NO: 143977 - RNA, 19 nt, Homo sapiens
cuacaacugucaccguuaa

SEQ ID NO: 143978 - RNA, 19 nt, Homo sapiens
gcagcgagcucacaaacuc

SEQ ID NO: 143979 - RNA, 19 nt, Homo sapiens
gaaccugacacucuccaua

SEQ ID NO: 143980 - RNA, 19 nt, Homo sapiens
gcauuuagacguaauugaa

SEQ ID NO: 143981 - RNA, 19 nt, Homo sapiens
cauuguagauguacgaauu

SEQ ID NO: 143982 - RNA, 19 nt, Homo sapiens
guaacggaagcaaauauua

SEQ ID NO: 143983 - RNA, 19 nt, Homo sapiens
ugagaaauacgaacaguuu

SEQ ID NO: 143984 - RNA, 19 nt, Homo sapiens
uagaagauggcucaauuua

SEQ ID NO: 143985 - RNA, 19 nt, Homo sapiens
ucuagaagauggcucaauu

SEQ ID NO: 143986 - RNA, 19 nt, Homo sapiens
gaauaugccagaaauugaa

SEQ ID NO: 143987 - RNA, 19 nt, Homo sapiens
gcacagaauuacaccaucu

SEQ ID NO: 143988 - RNA, 19 nt, Homo sapiens
ggacuagaauguauaugag

SEQ ID NO: 143989 - RNA, 19 nt, Homo sapiens
ucagugcaaucuucaguuu

SEQ ID NO: 143990 - RNA, 19 nt, Homo sapiens
cauaguuggugccagauaa

SEQ ID NO: 143991 - RNA, 19 nt, Homo sapiens
uaacuuccauguucucuag

SEQ ID NO: 143992 - RNA, 19 nt, Homo sapiens
gcauaaacauugugaagac

SEQ ID NO: 143993 - RNA, 19 nt, Homo sapiens
agacaggcaugguuuaguu

SEQ ID NO: 143994 - RNA, 19 nt, Homo sapiens
gaauauccacucccuuuga

SEQ ID NO: 143995 - RNA, 19 nt, Homo sapiens
gcaggagaaucgcuugaau

SEQ ID NO: 143996 - RNA, 19 nt, Homo sapiens
gacuuaugcucacaaauau

SEQ ID NO: 143997 - RNA, 19 nt, Homo sapiens
gaaguaacggaagcaaaua

SEQ ID NO: 143998 - RNA, 19 nt, Homo sapiens
ggugaaggcuuaagguauc

SEQ ID NO: 143999 - RNA, 19 nt, Homo sapiens
gaauugacguggagauuuu

SEQ ID NO: 144000 - RNA, 19 nt, Homo sapiens
ggaaagcuggguauuauag

SEQ ID NO: 144001 - RNA, 19 nt, Homo sapiens
gaacccaaauuuaggacau

SEQ ID NO: 144002 - RNA, 19 nt, Homo sapiens
gacaagaugaggagcauaa

SEQ ID NO: 144003 - RNA, 19 nt, Homo sapiens
ugaagucaaucgccaaguu

SEQ ID NO: 144004 - RNA, 19 nt, Homo sapiens
cucaaaggcuguauacaaa

SEQ ID NO: 144005 - RNA, 19 nt, Homo sapiens
gccaaacacuccucacuca

SEQ ID NO: 144006 - RNA, 19 nt, Homo sapiens
ggagguaaacuuugucaug

SEQ ID NO: 144007 - RNA, 19 nt, Homo sapiens
gauaaaaguuguacuguca

SEQ ID NO: 144008 - RNA, 19 nt, Homo sapiens
caacuagcccugaugcauu

SEQ ID NO: 144009 - RNA, 19 nt, Homo sapiens
caaaggagguggacaucag

SEQ ID NO: 144010 - RNA, 19 nt, Homo sapiens
gaaggagugcuguguguug

SEQ ID NO: 144011 - RNA, 19 nt, Homo sapiens
caaacacuccucacucaaa

SEQ ID NO: 144012 - RNA, 19 nt, Homo sapiens
caacaaaucccagaucauc

SEQ ID NO: 144013 - RNA, 19 nt, Homo sapiens
cagaauauccacucccuuu

SEQ ID NO: 144014 - RNA, 19 nt, Homo sapiens
ucaacaugguuuacuacua

SEQ ID NO: 144015 - RNA, 19 nt, Homo sapiens
gaagauuacaugagaagau

SEQ ID NO: 144016 - RNA, 19 nt, Homo sapiens
gggagauacuggcagauau

SEQ ID NO: 144017 - RNA, 19 nt, Homo sapiens
agagaacagucaagaaaug

SEQ ID NO: 144018 - RNA, 19 nt, Homo sapiens
gcacuggacccggaaauau

SEQ ID NO: 144019 - RNA, 19 nt, Homo sapiens
acgaacaguuugcguuaua

SEQ ID NO: 144020 - RNA, 19 nt, Homo sapiens
gacccugccuucagaauuc

SEQ ID NO: 144021 - RNA, 19 nt, Homo sapiens
ugaaacacuuguaggcaaa

SEQ ID NO: 144022 - RNA, 19 nt, Homo sapiens
ucagaaaguuuaucuucga

SEQ ID NO: 144023 - RNA, 19 nt, Homo sapiens
gggacuagaauguauauga

SEQ ID NO: 144024 - RNA, 19 nt, Homo sapiens
ucaacacacuggcgacuug

SEQ ID NO: 144025 - RNA, 19 nt, Homo sapiens
cuuaagguaucagaaguua

SEQ ID NO: 144026 - RNA, 19 nt, Homo sapiens
caggaacaauuacuauuuc

SEQ ID NO: 144027 - RNA, 19 nt, Homo sapiens
gagcauugaccgugagaaa

SEQ ID NO: 144028 - RNA, 19 nt, Homo sapiens
gaagacauagcccagcaaa

SEQ ID NO: 144029 - RNA, 19 nt, Homo sapiens
gaugggcuauucuugcuau

SEQ ID NO: 144030 - RNA, 19 nt, Homo sapiens
gaucacgcaccucaaauug

SEQ ID NO: 144031 - RNA, 19 nt, Homo sapiens
gcaaguuggugucauuaac

SEQ ID NO: 144032 - RNA, 19 nt, Homo sapiens
uagcacagauccaaauaca

SEQ ID NO: 144033 - RNA, 19 nt, Homo sapiens
gagcgaaacuccgucucaa

SEQ ID NO: 144034 - RNA, 19 nt, Homo sapiens
gaauuaccaucuguauuag

SEQ ID NO: 144035 - RNA, 19 nt, Homo sapiens
gaaauuaacugauccaaca

SEQ ID NO: 144036 - RNA, 19 nt, Homo sapiens
aaacaaagguccuaaagaa

SEQ ID NO: 144037 - RNA, 19 nt, Homo sapiens
guggaaaucuuacgaguua

SEQ ID NO: 144038 - RNA, 19 nt, Homo sapiens
gaaauuaaagucugccuua

SEQ ID NO: 144039 - RNA, 19 nt, Homo sapiens
ccaagaaccucggaauuua

SEQ ID NO: 144040 - RNA, 19 nt, Homo sapiens
gauccugacuuccaaauuu

SEQ ID NO: 144041 - RNA, 19 nt, Homo sapiens
caaacuagaugccgagaaa

SEQ ID NO: 144042 - RNA, 19 nt, Homo sapiens
gcaaauugguguaguuaau

SEQ ID NO: 144043 - RNA, 19 nt, Homo sapiens
gagagacacuggaaacuug

SEQ ID NO: 144044 - RNA, 19 nt, Homo sapiens
gaagagaaguuuuaccaua

SEQ ID NO: 144045 - RNA, 19 nt, Homo sapiens
gaacaacaagcaauggaua

SEQ ID NO: 144046 - RNA, 19 nt, Homo sapiens
gagaguuaauugacaagua

SEQ ID NO: 144047 - RNA, 19 nt, Homo sapiens
agaccuugcuuuaacauua

SEQ ID NO: 144048 - RNA, 19 nt, Homo sapiens
ccaaggaggucuacagaga

SEQ ID NO: 144049 - RNA, 19 nt, Homo sapiens
cauaagagguccuggaguu

SEQ ID NO: 144050 - RNA, 19 nt, Homo sapiens
gcagaagcaugcaugaaga

SEQ ID NO: 144051 - RNA, 19 nt, Homo sapiens
ggaguucuuuguguaguua

SEQ ID NO: 144052 - RNA, 19 nt, Homo sapiens
ugaaggaguucuuugugua

SEQ ID NO: 144053 - RNA, 19 nt, Homo sapiens
gagacacuauaaacaagua

SEQ ID NO: 144054 - RNA, 19 nt, Homo sapiens
guagagaccuugcuuuaac

SEQ ID NO: 144055 - RNA, 19 nt, Homo sapiens
agacauggauggucaguau

SEQ ID NO: 144056 - RNA, 19 nt, Homo sapiens
cagcagaaccuaauuguau

SEQ ID NO: 144057 - RNA, 19 nt, Homo sapiens
gaaagaaaaugcagaagug

SEQ ID NO: 144058 - RNA, 19 nt, Homo sapiens
gaaaaugacugcacacauc

SEQ ID NO: 144059 - RNA, 19 nt, Homo sapiens
gcucauauguaguaccuau

SEQ ID NO: 144060 - RNA, 19 nt, Homo sapiens
cagagaauguggagacuga

SEQ ID NO: 144061 - RNA, 19 nt, Homo sapiens
uaaagcauaugacccagaa

SEQ ID NO: 144062 - RNA, 19 nt, Homo sapiens
ugacaacagccaauuuaua

SEQ ID NO: 144063 - RNA, 19 nt, Homo sapiens
gaaaguguaucuguguaau

SEQ ID NO: 144064 - RNA, 19 nt, Homo sapiens
gcacgucuuuccuaucaga

SEQ ID NO: 144065 - RNA, 19 nt, Homo sapiens
gauaacagcccauucauac

SEQ ID NO: 144066 - RNA, 19 nt, Homo sapiens
gaguuacuguugaggauaa

SEQ ID NO: 144067 - RNA, 19 nt, Homo sapiens
ggaggaugguucagucuau

SEQ ID NO: 144068 - RNA, 19 nt, Homo sapiens
gaaccuaauuguaucaaac

SEQ ID NO: 144069 - RNA, 19 nt, Homo sapiens
gcaguggcauaagguauaa

SEQ ID NO: 144070 - RNA, 19 nt, Homo sapiens
ucagaagccuggauagaga

SEQ ID NO: 144071 - RNA, 19 nt, Homo sapiens
cagcacgucuuuccuauca

SEQ ID NO: 144072 - RNA, 19 nt, Homo sapiens
gaggaugguucagucuaua

SEQ ID NO: 144073 - RNA, 19 nt, Homo sapiens
gacaacagccaauuuauag

SEQ ID NO: 144074 - RNA, 19 nt, Homo sapiens
caacaagcaauggauauaa

SEQ ID NO: 144075 - RNA, 19 nt, Homo sapiens
gagagacacuauaaacaag

SEQ ID NO: 144076 - RNA, 19 nt, Homo sapiens
gaggacacacucugauuaa

SEQ ID NO: 144077 - RNA, 19 nt, Homo sapiens
ccauuuggcucauauguag

SEQ ID NO: 144078 - RNA, 19 nt, Homo sapiens
guaguuaagccuuugaauu

SEQ ID NO: 144079 - RNA, 19 nt, Homo sapiens
gagaagaugggcuccaauu

SEQ ID NO: 144080 - RNA, 19 nt, Homo sapiens
uuacagagagacacuauaa

SEQ ID NO: 144081 - RNA, 19 nt, Homo sapiens
agaugaguguguucuaaua

SEQ ID NO: 144082 - RNA, 19 nt, Homo sapiens
gauuggcgguggaggagua

SEQ ID NO: 144083 - RNA, 19 nt, Homo sapiens
ggcauaagguauaagaaau

SEQ ID NO: 144084 - RNA, 19 nt, Homo sapiens
acuggaaacuuguauugua

SEQ ID NO: 144085 - RNA, 19 nt, Homo sapiens
agccaggcauugacuauua

SEQ ID NO: 144086 - RNA, 19 nt, Homo sapiens
gccaauuuauagugcaaua

SEQ ID NO: 144087 - RNA, 19 nt, Homo sapiens
ccaguggcuuuaugacuuu

SEQ ID NO: 144088 - RNA, 19 nt, Homo sapiens
ggccauccuugcaauauug

SEQ ID NO: 144089 - RNA, 19 nt, Homo sapiens
ggacaagugugugcuacug

SEQ ID NO: 144090 - RNA, 19 nt, Homo sapiens
cugcaaaucuaauucauuc

SEQ ID NO: 144091 - RNA, 19 nt, Homo sapiens
gaaaauacaggaucaauca

SEQ ID NO: 144092 - RNA, 19 nt, Homo sapiens
cgagaaacuuguugguaga

SEQ ID NO: 144093 - RNA, 19 nt, Homo sapiens
gcaauggauauaaagcaua

SEQ ID NO: 144094 - RNA, 19 nt, Homo sapiens
cagagaggcuaguccaaga

SEQ ID NO: 144095 - RNA, 19 nt, Homo sapiens
ugauguaaaugaccacuug

SEQ ID NO: 144096 - RNA, 19 nt, Homo sapiens
gaccuugcuuuaacauuau

SEQ ID NO: 144097 - RNA, 19 nt, Homo sapiens
gaacaucuaaaguguguag

SEQ ID NO: 144098 - RNA, 19 nt, Homo sapiens
gaugaguguguucuaauaa

SEQ ID NO: 144099 - RNA, 19 nt, Homo sapiens
agaagaagaugggcuugaa

SEQ ID NO: 144100 - RNA, 19 nt, Homo sapiens
aaauacaguugauguggaa

SEQ ID NO: 144101 - RNA, 19 nt, Homo sapiens
caacagccaauuuauagug

SEQ ID NO: 144102 - RNA, 19 nt, Homo sapiens
caaacaaagguccuaaaga

SEQ ID NO: 144103 - RNA, 19 nt, Homo sapiens
aagucugccuuauuuguua

SEQ ID NO: 144104 - RNA, 19 nt, Homo sapiens
ggaggucuacagagaaauu

SEQ ID NO: 144105 - RNA, 19 nt, Homo sapiens
agagaugaguguguucuaa

SEQ ID NO: 144106 - RNA, 19 nt, Homo sapiens
acacggagguggacaacug

SEQ ID NO: 144107 - RNA, 19 nt, Homo sapiens
uuacaguccuugcaucaga

SEQ ID NO: 144108 - RNA, 19 nt, Homo sapiens
guuaagccuuugaauuaug

SEQ ID NO: 144109 - RNA, 19 nt, Homo sapiens
gacagagaguuaauugaca

SEQ ID NO: 144110 - RNA, 19 nt, Homo sapiens
aaugacaacagccaauuua

SEQ ID NO: 144111 - RNA, 19 nt, Homo sapiens
ucuaauaagucucugaaag

SEQ ID NO: 144112 - RNA, 19 nt, Homo sapiens
gcagugaacgacaagaaga

SEQ ID NO: 144113 - RNA, 19 nt, Homo sapiens
agaaguagcaguggcauaa

SEQ ID NO: 144114 - RNA, 19 nt, Homo sapiens
gagagcuaauuauaccauu

SEQ ID NO: 144115 - RNA, 19 nt, Homo sapiens
ucagcuagacagagaguua

SEQ ID NO: 144116 - RNA, 19 nt, Homo sapiens
guauuguacucguccugua

SEQ ID NO: 144117 - RNA, 19 nt, Homo sapiens
caaaaguaauuccugauga

SEQ ID NO: 144118 - RNA, 19 nt, Homo sapiens
gggccauccuugcaauauu

SEQ ID NO: 144119 - RNA, 19 nt, Homo sapiens
caaggagggagaacaugua

SEQ ID NO: 144120 - RNA, 19 nt, Homo sapiens
gacccucgcgaucuuaaua

SEQ ID NO: 144121 - RNA, 19 nt, Homo sapiens
gaagcacaaccuaauggaa

SEQ ID NO: 144122 - RNA, 19 nt, Homo sapiens
cuuuacagcugcaaaucua

SEQ ID NO: 144123 - RNA, 19 nt, Homo sapiens
ugaaagaaaguguaucugu

SEQ ID NO: 144124 - RNA, 19 nt, Homo sapiens
ggugaagaauccauuagag

SEQ ID NO: 144125 - RNA, 19 nt, Homo sapiens
cauguucccuccaaacuag

SEQ ID NO: 144126 - RNA, 19 nt, Homo sapiens
ggaaaagccccuuggauga

SEQ ID NO: 144127 - RNA, 19 nt, Homo sapiens
gaugagggcccugagugua

SEQ ID NO: 144128 - RNA, 19 nt, Homo sapiens
acagagaguuaauugacaa

SEQ ID NO: 144129 - RNA, 19 nt, Homo sapiens
gaccaagaaccucggaauu

SEQ ID NO: 144130 - RNA, 19 nt, Homo sapiens
gagaugacaaaguguauuc

SEQ ID NO: 144131 - RNA, 19 nt, Homo sapiens
gcaauauuguugggcauag

SEQ ID NO: 144132 - RNA, 19 nt, Homo sapiens
agacagugaucaucugcaa

SEQ ID NO: 144133 - RNA, 19 nt, Homo sapiens
cauuuacucguacuucuua

SEQ ID NO: 144134 - RNA, 19 nt, Homo sapiens
uguguagacugcauucuug

SEQ ID NO: 144135 - RNA, 19 nt, Homo sapiens
gaaauuaacugauccaaca

SEQ ID NO: 144136 - RNA, 19 nt, Homo sapiens
aaacaaagguccuaaagaa

SEQ ID NO: 144137 - RNA, 19 nt, Homo sapiens
guggaaaucuuacgaguua

SEQ ID NO: 144138 - RNA, 19 nt, Homo sapiens
gaaauuaaagucugccuua

SEQ ID NO: 144139 - RNA, 19 nt, Homo sapiens
ccaagaaccucggaauuua

SEQ ID NO: 144140 - RNA, 19 nt, Homo sapiens
gauccugacuuccaaauuu

SEQ ID NO: 144141 - RNA, 19 nt, Homo sapiens
caaacuagaugccgagaaa

SEQ ID NO: 144142 - RNA, 19 nt, Homo sapiens
gcaaauugguguaguuaau

SEQ ID NO: 144143 - RNA, 19 nt, Homo sapiens
gagagacacuggaaacuug

SEQ ID NO: 144144 - RNA, 19 nt, Homo sapiens
gaagagaaguuuuaccaua

SEQ ID NO: 144145 - RNA, 19 nt, Homo sapiens
gaacaacaagcaauggaua

SEQ ID NO: 144146 - RNA, 19 nt, Homo sapiens
gagaguuaauugacaagua

SEQ ID NO: 144147 - RNA, 19 nt, Homo sapiens
agaccuugcuuuaacauua

SEQ ID NO: 144148 - RNA, 19 nt, Homo sapiens
ccaaggaggucuacagaga

SEQ ID NO: 144149 - RNA, 19 nt, Homo sapiens
cauaagagguccuggaguu

SEQ ID NO: 144150 - RNA, 19 nt, Homo sapiens
gcagaagcaugcaugaaga

SEQ ID NO: 144151 - RNA, 19 nt, Homo sapiens
ggaguucuuuguguaguua

SEQ ID NO: 144152 - RNA, 19 nt, Homo sapiens
ugaaggaguucuuugugua

SEQ ID NO: 144153 - RNA, 19 nt, Homo sapiens
gagacacuauaaacaagua

SEQ ID NO: 144154 - RNA, 19 nt, Homo sapiens
guagagaccuugcuuuaac

SEQ ID NO: 144155 - RNA, 19 nt, Homo sapiens
agacauggauggucaguau

SEQ ID NO: 144156 - RNA, 19 nt, Homo sapiens
cagcagaaccuaauuguau

SEQ ID NO: 144157 - RNA, 19 nt, Homo sapiens
gaaagaaaaugcagaagug

SEQ ID NO: 144158 - RNA, 19 nt, Homo sapiens
gaaaaugacugcacacauc

SEQ ID NO: 144159 - RNA, 19 nt, Homo sapiens
gcucauauguaguaccuau

SEQ ID NO: 144160 - RNA, 19 nt, Homo sapiens
cagagaauguggagacuga

SEQ ID NO: 144161 - RNA, 19 nt, Homo sapiens
uaaagcauaugacccagaa

SEQ ID NO: 144162 - RNA, 19 nt, Homo sapiens
ugacaacagccaauuuaua

SEQ ID NO: 144163 - RNA, 19 nt, Homo sapiens
gcacgucuuuccuaucaga

SEQ ID NO: 144164 - RNA, 19 nt, Homo sapiens
gauaacagcccauucauac

SEQ ID NO: 144165 - RNA, 19 nt, Homo sapiens
gaguuacuguugaggauaa

SEQ ID NO: 144166 - RNA, 19 nt, Homo sapiens
ggaggaugguucagucuau

SEQ ID NO: 144167 - RNA, 19 nt, Homo sapiens
gaaccuaauuguaucaaac

SEQ ID NO: 144168 - RNA, 19 nt, Homo sapiens
gcaguggcauaagguauaa

SEQ ID NO: 144169 - RNA, 19 nt, Homo sapiens
ucagaagccuggauagaga

SEQ ID NO: 144170 - RNA, 19 nt, Homo sapiens
cagcacgucuuuccuauca

SEQ ID NO: 144171 - RNA, 19 nt, Homo sapiens
gaggaugguucagucuaua

SEQ ID NO: 144172 - RNA, 19 nt, Homo sapiens
gacaacagccaauuuauag

SEQ ID NO: 144173 - RNA, 19 nt, Homo sapiens
caacaagcaauggauauaa

SEQ ID NO: 144174 - RNA, 19 nt, Homo sapiens
gagagacacuauaaacaag

SEQ ID NO: 144175 - RNA, 19 nt, Homo sapiens
ccauuuggcucauauguag

SEQ ID NO: 144176 - RNA, 19 nt, Homo sapiens
guaguuaagccuuugaauu

SEQ ID NO: 144177 - RNA, 19 nt, Homo sapiens
gagaagaugggcuccaauu

SEQ ID NO: 144178 - RNA, 19 nt, Homo sapiens
uuacagagagacacuauaa

SEQ ID NO: 144179 - RNA, 19 nt, Homo sapiens
agaugaguguguucuaaua

SEQ ID NO: 144180 - RNA, 19 nt, Homo sapiens
gauuggcgguggaggagua

SEQ ID NO: 144181 - RNA, 19 nt, Homo sapiens
ggcauaagguauaagaaau

SEQ ID NO: 144182 - RNA, 19 nt, Homo sapiens
acuggaaacuuguauugua

SEQ ID NO: 144183 - RNA, 19 nt, Homo sapiens
agccaggcauugacuauua

SEQ ID NO: 144184 - RNA, 19 nt, Homo sapiens
gccaauuuauagugcaaua

SEQ ID NO: 144185 - RNA, 19 nt, Homo sapiens
ccaguggcuuuaugacuuu

SEQ ID NO: 144186 - RNA, 19 nt, Homo sapiens
ggccauccuugcaauauug

SEQ ID NO: 144187 - RNA, 19 nt, Homo sapiens
ggacaagugugugcuacug

SEQ ID NO: 144188 - RNA, 19 nt, Homo sapiens
cugcaaaucuaauucauuc

SEQ ID NO: 144189 - RNA, 19 nt, Homo sapiens
cgagaaacuuguugguaga

SEQ ID NO: 144190 - RNA, 19 nt, Homo sapiens
gaaaauacaggaucaauca

SEQ ID NO: 144191 - RNA, 19 nt, Homo sapiens
gcaauggauauaaagcaua

SEQ ID NO: 144192 - RNA, 19 nt, Homo sapiens
cagagaggcuaguccaaga

SEQ ID NO: 144193 - RNA, 19 nt, Homo sapiens
ugauguaaaugaccacuug

SEQ ID NO: 144194 - RNA, 19 nt, Homo sapiens
gaccuugcuuuaacauuau

SEQ ID NO: 144195 - RNA, 19 nt, Homo sapiens
gaacaucuaaaguguguag

SEQ ID NO: 144196 - RNA, 19 nt, Homo sapiens
gaugaguguguucuaauaa

SEQ ID NO: 144197 - RNA, 19 nt, Homo sapiens
agaagaagaugggcuugaa

SEQ ID NO: 144198 - RNA, 19 nt, Homo sapiens
aaauacaguugauguggaa

SEQ ID NO: 144199 - RNA, 19 nt, Homo sapiens
caacagccaauuuauagug

SEQ ID NO: 144200 - RNA, 19 nt, Homo sapiens
caaacaaagguccuaaaga

SEQ ID NO: 144201 - RNA, 19 nt, Homo sapiens
aagucugccuuauuuguua

SEQ ID NO: 144202 - RNA, 19 nt, Homo sapiens
ggaggucuacagagaaauu

SEQ ID NO: 144203 - RNA, 19 nt, Homo sapiens
agagaugaguguguucuaa

SEQ ID NO: 144204 - RNA, 19 nt, Homo sapiens
acacggagguggacaacug

SEQ ID NO: 144205 - RNA, 19 nt, Homo sapiens
uuacaguccuugcaucaga

SEQ ID NO: 144206 - RNA, 19 nt, Homo sapiens
guuaagccuuugaauuaug

SEQ ID NO: 144207 - RNA, 19 nt, Homo sapiens
gacagagaguuaauugaca

SEQ ID NO: 144208 - RNA, 19 nt, Homo sapiens
aaugacaacagccaauuua

SEQ ID NO: 144209 - RNA, 19 nt, Homo sapiens
ucuaauaagucucugaaag

SEQ ID NO: 144210 - RNA, 19 nt, Homo sapiens
gcagugaacgacaagaaga

SEQ ID NO: 144211 - RNA, 19 nt, Homo sapiens
agaaguagcaguggcauaa

SEQ ID NO: 144212 - RNA, 19 nt, Homo sapiens
gagagcuaauuauaccauu

SEQ ID NO: 144213 - RNA, 19 nt, Homo sapiens
ucagcuagacagagaguua

SEQ ID NO: 144214 - RNA, 19 nt, Homo sapiens
guauuguacucguccugua

SEQ ID NO: 144215 - RNA, 19 nt, Homo sapiens
caaaaguaauuccugauga

SEQ ID NO: 144216 - RNA, 19 nt, Homo sapiens
gggccauccuugcaauauu

SEQ ID NO: 144217 - RNA, 19 nt, Homo sapiens
caaggagggagaacaugua

SEQ ID NO: 144218 - RNA, 19 nt, Homo sapiens
gacccucgcgaucuuaaua

SEQ ID NO: 144219 - RNA, 19 nt, Homo sapiens
gaagcacaaccuaauggaa

SEQ ID NO: 144220 - RNA, 19 nt, Homo sapiens
cuuuacagcugcaaaucua

SEQ ID NO: 144221 - RNA, 19 nt, Homo sapiens
ggaaaagccccuuggauga

SEQ ID NO: 144222 - RNA, 19 nt, Homo sapiens
cauguucccuccaaacuag

SEQ ID NO: 144223 - RNA, 19 nt, Homo sapiens
gaugagggcccugagugua

SEQ ID NO: 144224 - RNA, 19 nt, Homo sapiens
acagagaguuaauugacaa

SEQ ID NO: 144225 - RNA, 19 nt, Homo sapiens
gaccaagaaccucggaauu

SEQ ID NO: 144226 - RNA, 19 nt, Homo sapiens
gagaugacaaaguguauuc

SEQ ID NO: 144227 - RNA, 19 nt, Homo sapiens
gcaauauuguugggcauag

SEQ ID NO: 144228 - RNA, 19 nt, Homo sapiens
agacagugaucaucugcaa

SEQ ID NO: 144229 - RNA, 19 nt, Homo sapiens
cauuuacucguacuucuua

SEQ ID NO: 144230 - RNA, 19 nt, Homo sapiens
uguguagacugcauucuug

SEQ ID NO: 144231 - RNA, 19 nt, Homo sapiens
aaggaggucuacagagaaa

SEQ ID NO: 144232 - RNA, 19 nt, Homo sapiens
aagcaugcaugaagagaug

SEQ ID NO: 144233 - RNA, 19 nt, Homo sapiens
guggacaacugcagauaca

SEQ ID NO: 144234 - RNA, 19 nt, Homo sapiens
gagauagacuuggcauguc

SEQ ID NO: 144235 - RNA, 19 nt, Homo sapiens
gaaguuaaauccucuauug

SEQ ID NO: 144236 - RNA, 19 nt, Homo sapiens
gaacaugugugaaaguuga

SEQ ID NO: 144237 - RNA, 19 nt, Homo sapiens
ggagaaagcagcccaagua

SEQ ID NO: 144238 - RNA, 19 nt, Homo sapiens
ggagauugauuguccuuaa

SEQ ID NO: 144239 - RNA, 19 nt, Homo sapiens
uaaagccacugaauuauga

SEQ ID NO: 144240 - RNA, 19 nt, Homo sapiens
gacaaguacucauugauaa

SEQ ID NO: 144241 - RNA, 19 nt, Homo sapiens
cuaagaaggucuaugaauu

SEQ ID NO: 144242 - RNA, 19 nt, Homo sapiens
gcacuaagaaggucuauga

SEQ ID NO: 144243 - RNA, 19 nt, Homo sapiens
gcagaagcaugcacaaaga

SEQ ID NO: 144244 - RNA, 19 nt, Homo sapiens
aaagaaacuuggcugcuua

SEQ ID NO: 144245 - RNA, 19 nt, Homo sapiens
aagauuauguccucacuua

SEQ ID NO: 144246 - RNA, 19 nt, Homo sapiens
ucacuucccuguuuauaaa

SEQ ID NO: 144247 - RNA, 19 nt, Homo sapiens
gaaaguugaucauacgaau

SEQ ID NO: 144248 - RNA, 19 nt, Homo sapiens
gaacagagccuugguuaca

SEQ ID NO: 144249 - RNA, 19 nt, Homo sapiens
gaaaguaguagaccuggua

SEQ ID NO: 144250 - RNA, 19 nt, Homo sapiens
caaagaaacuaaugaaggu

SEQ ID NO: 144251 - RNA, 19 nt, Homo sapiens
gaacuauacugucuucuac

SEQ ID NO: 144252 - RNA, 19 nt, Homo sapiens
caacaucgucugcuucaua

SEQ ID NO: 144253 - RNA, 19 nt, Homo sapiens
cacaucaacuuguaucaua

SEQ ID NO: 144254 - RNA, 19 nt, Homo sapiens
agacauggauggccaguuu

SEQ ID NO: 144255 - RNA, 19 nt, Homo sapiens
ccaaguagguuauuuguac

SEQ ID NO: 144256 - RNA, 19 nt, Homo sapiens
aaacuuaccuuuacugaag

SEQ ID NO: 144257 - RNA, 19 nt, Homo sapiens
gcacagacaaagaaacuaa

SEQ ID NO: 144258 - RNA, 19 nt, Homo sapiens
gaaggcauuugcaggauga

SEQ ID NO: 144259 - RNA, 19 nt, Homo sapiens
gaauuaaggucucuaaagc

SEQ ID NO: 144260 - RNA, 19 nt, Homo sapiens
ggaaacagacacagaaaga

SEQ ID NO: 144261 - RNA, 19 nt, Homo sapiens
uaaggaagcagcugucuaa

SEQ ID NO: 144262 - RNA, 19 nt, Homo sapiens
ggagaggccacaaggaaua

SEQ ID NO: 144263 - RNA, 19 nt, Homo sapiens
gauuauguccucacuuaua

SEQ ID NO: 144264 - RNA, 19 nt, Homo sapiens
gaauaugggugggaguaaa

SEQ ID NO: 144265 - RNA, 19 nt, Homo sapiens
gaaagcagcccaaguaggu

SEQ ID NO: 144266 - RNA, 19 nt, Homo sapiens
gagauugauuguccuuaaa

SEQ ID NO: 144267 - RNA, 19 nt, Homo sapiens
ggaagcagcugucuaaaau

SEQ ID NO: 144268 - RNA, 19 nt, Homo sapiens
gcacaaagagauaauguca

SEQ ID NO: 144269 - RNA, 19 nt, Homo sapiens
ucaccacagucucucauua

SEQ ID NO: 144270 - RNA, 19 nt, Homo sapiens
guggaaaucuuacgaauac

SEQ ID NO: 144271 - RNA, 19 nt, Homo sapiens
gggaggaucuuacugaaag

SEQ ID NO: 144272 - RNA, 19 nt, Homo sapiens
ggaaauagggaauccaaug

SEQ ID NO: 144273 - RNA, 19 nt, Homo sapiens
uaaagaaacuuggcugcuu

SEQ ID NO: 144274 - RNA, 19 nt, Homo sapiens
caguaucacuucccuguuu

SEQ ID NO: 144275 - RNA, 19 nt, Homo sapiens
ggaagaagauggccuugac

SEQ ID NO: 144276 - RNA, 19 nt, Homo sapiens
caacaacucuagccaaggu

SEQ ID NO: 144277 - RNA, 19 nt, Homo sapiens
caacuuguaucauaacagu

SEQ ID NO: 144278 - RNA, 19 nt, Homo sapiens
guagacaaguacucauuga

SEQ ID NO: 144279 - RNA, 19 nt, Homo sapiens
gaaccggacacaaugcaua

SEQ ID NO: 144280 - RNA, 19 nt, Homo sapiens
ccauauggcuuucugacaa

SEQ ID NO: 144281 - RNA, 19 nt, Homo sapiens
cagcagagauucccuuaag

SEQ ID NO: 144282 - RNA, 19 nt, Homo sapiens
gaagaaaaccgucaaguga

SEQ ID NO: 144283 - RNA, 19 nt, Homo sapiens
gcugaaauuuccugcugua

SEQ ID NO: 144284 - RNA, 19 nt, Homo sapiens
ggaugagccugaacugguu

SEQ ID NO: 144285 - RNA, 19 nt, Homo sapiens
ugaagugcccuaugaagua

SEQ ID NO: 144286 - RNA, 19 nt, Homo sapiens
acaaagagauaaugucaca

SEQ ID NO: 144287 - RNA, 19 nt, Homo sapiens
cagccaaccucuucucuau

SEQ ID NO: 144288 - RNA, 19 nt, Homo sapiens
gcagucuguuucaagauuu

SEQ ID NO: 144289 - RNA, 19 nt, Homo sapiens
aauaguuccuguccaauuu

SEQ ID NO: 144290 - RNA, 19 nt, Homo sapiens
caacuaaagggaaacguuu

SEQ ID NO: 144291 - RNA, 19 nt, Homo sapiens
caagugaaccuggaaauug

SEQ ID NO: 144292 - RNA, 19 nt, Homo sapiens
gaacaguagcuuugcuuug

SEQ ID NO: 144293 - RNA, 19 nt, Homo sapiens
gaaauaaaugugugugugu

SEQ ID NO: 144294 - RNA, 19 nt, Homo sapiens
gaauuaugcuacucaccaa

SEQ ID NO: 144295 - RNA, 19 nt, Homo sapiens
gcacccacuuucagacaaa

SEQ ID NO: 144296 - RNA, 19 nt, Homo sapiens
cacagucucucauuauuug

SEQ ID NO: 144297 - RNA, 19 nt, Homo sapiens
gagaugaaccggacacaau

SEQ ID NO: 144298 - RNA, 19 nt, Homo sapiens
guccagagaugagguguuu

SEQ ID NO: 144299 - RNA, 19 nt, Homo sapiens
aagaaacaaugaagacuga

SEQ ID NO: 144300 - RNA, 19 nt, Homo sapiens
gcacugcucuuuucuguau

SEQ ID NO: 144301 - RNA, 19 nt, Homo sapiens
agacaaguacucauugaua

SEQ ID NO: 144302 - RNA, 19 nt, Homo sapiens
gaacucagggcacaaaaua

SEQ ID NO: 144303 - RNA, 19 nt, Homo sapiens
gaacaaacaaggcauucau

SEQ ID NO: 144304 - RNA, 19 nt, Homo sapiens
gaaaguacaagacauggau

SEQ ID NO: 144305 - RNA, 19 nt, Homo sapiens
gagauucccuuaagugacu

SEQ ID NO: 144306 - RNA, 19 nt, Homo sapiens
ggaauuaaggucucuaaag

SEQ ID NO: 144307 - RNA, 19 nt, Homo sapiens
gauguaaucagaaugaaga

SEQ ID NO: 144308 - RNA, 19 nt, Homo sapiens
gaguuaaucugugugaaug

SEQ ID NO: 144309 - RNA, 19 nt, Homo sapiens
gauagaucauguacuggaa

SEQ ID NO: 144310 - RNA, 19 nt, Homo sapiens
gcaauagacaaagaugaua

SEQ ID NO: 144311 - RNA, 19 nt, Homo sapiens
gaaauuuccugcuguaacc

SEQ ID NO: 144312 - RNA, 19 nt, Homo sapiens
uaacugagucuaugaggaa

SEQ ID NO: 144313 - RNA, 19 nt, Homo sapiens
gaagugcccuaugaaguag

SEQ ID NO: 144314 - RNA, 19 nt, Homo sapiens
cuacugcacuaccaaauuc

SEQ ID NO: 144315 - RNA, 19 nt, Homo sapiens
guuaaucugugugaaugua

SEQ ID NO: 144316 - RNA, 19 nt, Homo sapiens
acagacaacugguaaaucu

SEQ ID NO: 144317 - RNA, 19 nt, Homo sapiens
gaaccuggaaauuggagua

SEQ ID NO: 144318 - RNA, 19 nt, Homo sapiens
guaaagccacugaauuaug

SEQ ID NO: 144319 - RNA, 19 nt, Homo sapiens
uaaugaagguguucuuucu

SEQ ID NO: 144320 - RNA, 19 nt, Homo sapiens
gcagagauucccuuaagug

SEQ ID NO: 144321 - RNA, 19 nt, Homo sapiens
uagcaaggguccagagaug

SEQ ID NO: 144322 - RNA, 19 nt, Homo sapiens
gaagguguucuuucuguug

SEQ ID NO: 144323 - RNA, 19 nt, Homo sapiens
aagagacacuggaaaucua

SEQ ID NO: 144324 - RNA, 19 nt, Homo sapiens
gacguggaguugauaaaga

SEQ ID NO: 144325 - RNA, 19 nt, Homo sapiens
aaacuuggcugcuuaaaau

SEQ ID NO: 144326 - RNA, 19 nt, Homo sapiens
uaaacuagaggcagacaaa

SEQ ID NO: 144327 - RNA, 19 nt, Homo sapiens
caaaauaauuggcagaguu

SEQ ID NO: 144328 - RNA, 19 nt, Homo sapiens
gaaaccagaccuuggaauc

SEQ ID NO: 144329 - RNA, 19 nt, Homo sapiens
ccagaaauacuucaagaau

SEQ ID NO: 144330 - RNA, 19 nt, Homo sapiens
gccauuugcuagagauauu

SEQ ID NO: 144331 - RNA, 19 nt, Homo sapiens
gaacaucagaagaagguau

SEQ ID NO: 144332 - RNA, 19 nt, Homo sapiens
aagccuaguugcugaaauu

SEQ ID NO: 144333 - RNA, 19 nt, Homo sapiens
aaauaaccauguccuccua

SEQ ID NO: 144334 - RNA, 19 nt, Homo sapiens
ggauuuaugacccaaacua

SEQ ID NO: 144335 - RNA, 19 nt, Homo sapiens
gaaguuaaauccucuauug

SEQ ID NO: 144336 - RNA, 19 nt, Homo sapiens
gaacaugugugaaaguuga

SEQ ID NO: 144337 - RNA, 19 nt, Homo sapiens
ggagaaagcagcccaagua

SEQ ID NO: 144338 - RNA, 19 nt, Homo sapiens
ggagauugauuguccuuaa

SEQ ID NO: 144339 - RNA, 19 nt, Homo sapiens
uaaagccacugaauuauga

SEQ ID NO: 144340 - RNA, 19 nt, Homo sapiens
gacaaguacucauugauaa

SEQ ID NO: 144341 - RNA, 19 nt, Homo sapiens
cuaagaaggucuaugaauu

SEQ ID NO: 144342 - RNA, 19 nt, Homo sapiens
gcacuaagaaggucuauga

SEQ ID NO: 144343 - RNA, 19 nt, Homo sapiens
gcagaagcaugcacaaaga

SEQ ID NO: 144344 - RNA, 19 nt, Homo sapiens
gaaauugcaucgauguaau

SEQ ID NO: 144345 - RNA, 19 nt, Homo sapiens
aaagaaacuuggcugcuua

SEQ ID NO: 144346 - RNA, 19 nt, Homo sapiens
aagauuauguccucacuua

SEQ ID NO: 144347 - RNA, 19 nt, Homo sapiens
ucacuucccuguuuauaaa

SEQ ID NO: 144348 - RNA, 19 nt, Homo sapiens
gaaaguugaucauacgaau

SEQ ID NO: 144349 - RNA, 19 nt, Homo sapiens
gaacagagccuugguuaca

SEQ ID NO: 144350 - RNA, 19 nt, Homo sapiens
gaaaguaguagaccuggua

SEQ ID NO: 144351 - RNA, 19 nt, Homo sapiens
caaagaaacuaaugaaggu

SEQ ID NO: 144352 - RNA, 19 nt, Homo sapiens
gaacuauacugucuucuac

SEQ ID NO: 144353 - RNA, 19 nt, Homo sapiens
caacaucgucugcuucaua

SEQ ID NO: 144354 - RNA, 19 nt, Homo sapiens
cacaucaacuuguaucaua

SEQ ID NO: 144355 - RNA, 19 nt, Homo sapiens
agacauggauggccaguuu

SEQ ID NO: 144356 - RNA, 19 nt, Homo sapiens
ccaaguagguuauuuguac

SEQ ID NO: 144357 - RNA, 19 nt, Homo sapiens
aaacuuaccuuuacugaag

SEQ ID NO: 144358 - RNA, 19 nt, Homo sapiens
gcacagacaaagaaacuaa

SEQ ID NO: 144359 - RNA, 19 nt, Homo sapiens
gaaggcauuugcaggauga

SEQ ID NO: 144360 - RNA, 19 nt, Homo sapiens
gaauuaaggucucuaaagc

SEQ ID NO: 144361 - RNA, 19 nt, Homo sapiens
ggaaacagacacagaaaga

SEQ ID NO: 144362 - RNA, 19 nt, Homo sapiens
uaaggaagcagcugucuaa

SEQ ID NO: 144363 - RNA, 19 nt, Homo sapiens
ggagaggccacaaggaaua

SEQ ID NO: 144364 - RNA, 19 nt, Homo sapiens
gauuauguccucacuuaua

SEQ ID NO: 144365 - RNA, 19 nt, Homo sapiens
gaauaugggugggaguaaa

SEQ ID NO: 144366 - RNA, 19 nt, Homo sapiens
gaaagcagcccaaguaggu

SEQ ID NO: 144367 - RNA, 19 nt, Homo sapiens
gagauugauuguccuuaaa

SEQ ID NO: 144368 - RNA, 19 nt, Homo sapiens
ggaagcagcugucuaaaau

SEQ ID NO: 144369 - RNA, 19 nt, Homo sapiens
gcacaaagagauaauguca

SEQ ID NO: 144370 - RNA, 19 nt, Homo sapiens
ucaccacagucucucauua

SEQ ID NO: 144371 - RNA, 19 nt, Homo sapiens
guggaaaucuuacgaauac

SEQ ID NO: 144372 - RNA, 19 nt, Homo sapiens
gggaggaucuuacugaaag

SEQ ID NO: 144373 - RNA, 19 nt, Homo sapiens
ggaaauagggaauccaaug

SEQ ID NO: 144374 - RNA, 19 nt, Homo sapiens
uaaagaaacuuggcugcuu

SEQ ID NO: 144375 - RNA, 19 nt, Homo sapiens
caguaucacuucccuguuu

SEQ ID NO: 144376 - RNA, 19 nt, Homo sapiens
ggaagaagauggccuugac

SEQ ID NO: 144377 - RNA, 19 nt, Homo sapiens
caacaacucuagccaaggu

SEQ ID NO: 144378 - RNA, 19 nt, Homo sapiens
caacuuguaucauaacagu

SEQ ID NO: 144379 - RNA, 19 nt, Homo sapiens
guagacaaguacucauuga

SEQ ID NO: 144380 - RNA, 19 nt, Homo sapiens
gaaccggacacaaugcaua

SEQ ID NO: 144381 - RNA, 19 nt, Homo sapiens
ccauauggcuuucugacaa

SEQ ID NO: 144382 - RNA, 19 nt, Homo sapiens
cagcagagauucccuuaag

SEQ ID NO: 144383 - RNA, 19 nt, Homo sapiens
gaagaaaaccgucaaguga

SEQ ID NO: 144384 - RNA, 19 nt, Homo sapiens
gcugaaauuuccugcugua

SEQ ID NO: 144385 - RNA, 19 nt, Homo sapiens
ggaugagccugaacugguu

SEQ ID NO: 144386 - RNA, 19 nt, Homo sapiens
ugaagugcccuaugaagua

SEQ ID NO: 144387 - RNA, 19 nt, Homo sapiens
acaaagagauaaugucaca

SEQ ID NO: 144388 - RNA, 19 nt, Homo sapiens
cagccaaccucuucucuau

SEQ ID NO: 144389 - RNA, 19 nt, Homo sapiens
gcagucuguuucaagauuu

SEQ ID NO: 144390 - RNA, 19 nt, Homo sapiens
aauaguuccuguccaauuu

SEQ ID NO: 144391 - RNA, 19 nt, Homo sapiens
caacuaaagggaaacguuu

SEQ ID NO: 144392 - RNA, 19 nt, Homo sapiens
caagugaaccuggaaauug

SEQ ID NO: 144393 - RNA, 19 nt, Homo sapiens
gaacaguagcuuugcuuug

SEQ ID NO: 144394 - RNA, 19 nt, Homo sapiens
gaaauaaaugugugugugu

SEQ ID NO: 144395 - RNA, 19 nt, Homo sapiens
gaauuaugcuacucaccaa

SEQ ID NO: 144396 - RNA, 19 nt, Homo sapiens
gcacccacuuucagacaaa

SEQ ID NO: 144397 - RNA, 19 nt, Homo sapiens
cacagucucucauuauuug

SEQ ID NO: 144398 - RNA, 19 nt, Homo sapiens
gagaugaaccggacacaau

SEQ ID NO: 144399 - RNA, 19 nt, Homo sapiens
guccagagaugagguguuu

SEQ ID NO: 144400 - RNA, 19 nt, Homo sapiens
aagaaacaaugaagacuga

SEQ ID NO: 144401 - RNA, 19 nt, Homo sapiens
gcacugcucuuuucuguau

SEQ ID NO: 144402 - RNA, 19 nt, Homo sapiens
agacaaguacucauugaua

SEQ ID NO: 144403 - RNA, 19 nt, Homo sapiens
gaacucagggcacaaaaua

SEQ ID NO: 144404 - RNA, 19 nt, Homo sapiens
gaacaaacaaggcauucau

SEQ ID NO: 144405 - RNA, 19 nt, Homo sapiens
gaaaguacaagacauggau

SEQ ID NO: 144406 - RNA, 19 nt, Homo sapiens
gagauucccuuaagugacu

SEQ ID NO: 144407 - RNA, 19 nt, Homo sapiens
ggaauuaaggucucuaaag

SEQ ID NO: 144408 - RNA, 19 nt, Homo sapiens
gauguaaucagaaugaaga

SEQ ID NO: 144409 - RNA, 19 nt, Homo sapiens
gaguuaaucugugugaaug

SEQ ID NO: 144410 - RNA, 19 nt, Homo sapiens
gauagaucauguacuggaa

SEQ ID NO: 144411 - RNA, 19 nt, Homo sapiens
gcaauagacaaagaugaua

SEQ ID NO: 144412 - RNA, 19 nt, Homo sapiens
gaaauuuccugcuguaacc

SEQ ID NO: 144413 - RNA, 19 nt, Homo sapiens
uaacugagucuaugaggaa

SEQ ID NO: 144414 - RNA, 19 nt, Homo sapiens
gaagugcccuaugaaguag

SEQ ID NO: 144415 - RNA, 19 nt, Homo sapiens
cuacugcacuaccaaauuc

SEQ ID NO: 144416 - RNA, 19 nt, Homo sapiens
guuaaucugugugaaugua

SEQ ID NO: 144417 - RNA, 19 nt, Homo sapiens
acagacaacugguaaaucu

SEQ ID NO: 144418 - RNA, 19 nt, Homo sapiens
gaaccuggaaauuggagua

SEQ ID NO: 144419 - RNA, 19 nt, Homo sapiens
guaaagccacugaauuaug

SEQ ID NO: 144420 - RNA, 19 nt, Homo sapiens
uaaugaagguguucuuucu

SEQ ID NO: 144421 - RNA, 19 nt, Homo sapiens
gcagagauucccuuaagug

SEQ ID NO: 144422 - RNA, 19 nt, Homo sapiens
uagcaaggguccagagaug

SEQ ID NO: 144423 - RNA, 19 nt, Homo sapiens
gaagguguucuuucuguug

SEQ ID NO: 144424 - RNA, 19 nt, Homo sapiens
aagagacacuggaaaucua

SEQ ID NO: 144425 - RNA, 19 nt, Homo sapiens
gacguggaguugauaaaga

SEQ ID NO: 144426 - RNA, 19 nt, Homo sapiens
aaacuuggcugcuuaaaau

SEQ ID NO: 144427 - RNA, 19 nt, Homo sapiens
caaaauaauuggcagaguu

SEQ ID NO: 144428 - RNA, 19 nt, Homo sapiens
gaaaccagaccuuggaauc

SEQ ID NO: 144429 - RNA, 19 nt, Homo sapiens
ccagaaauacuucaagaau

SEQ ID NO: 144430 - RNA, 19 nt, Homo sapiens
gccauuugcuagagauauu

SEQ ID NO: 144431 - RNA, 19 nt, Homo sapiens
uaaacuagaggcagacaaa

SEQ ID NO: 144432 - RNA, 19 nt, Homo sapiens
gaacaucagaagaagguau

SEQ ID NO: 144433 - RNA, 19 nt, Homo sapiens
aagccuaguugcugaaauu

SEQ ID NO: 144434 - RNA, 19 nt, Homo sapiens
aaauaaccauguccuccua

SEQ ID NO: 144435 - RNA, 19 nt, Homo sapiens
gcgcauaagugaaaucaua

SEQ ID NO: 144436 - RNA, 19 nt, Homo sapiens
gaaugaagauggauuguau

SEQ ID NO: 144437 - RNA, 19 nt, Homo sapiens
gcaaagaguuuagcugaaa

SEQ ID NO: 144438 - RNA, 19 nt, Homo sapiens
caacggcacucuccaaauu

SEQ ID NO: 144439 - RNA, 19 nt, Homo sapiens
gaucaaagaugucaaagca

SEQ ID NO: 144440 - RNA, 19 nt, Homo sapiens
ggacagcgguuguaaauac

SEQ ID NO: 144441 - RNA, 19 nt, Homo sapiens
gaagauggauuguauaacu

SEQ ID NO: 144442 - RNA, 19 nt, Homo sapiens
gaaacaauccuuacgcaaa

SEQ ID NO: 144443 - RNA, 19 nt, Homo sapiens
ggaggaagaguaaugaaua

SEQ ID NO: 144444 - RNA, 19 nt, Homo sapiens
guacaucacugucgucuca

SEQ ID NO: 144445 - RNA, 19 nt, Homo sapiens
gccaugcuauuaauucuua

SEQ ID NO: 144446 - RNA, 19 nt, Homo sapiens
gaaaugcucaugaguaaga

SEQ ID NO: 144447 - RNA, 19 nt, Homo sapiens
ggaggaccguggaauaauu

SEQ ID NO: 144448 - RNA, 19 nt, Homo sapiens
caauggaacucuuaaacuu

SEQ ID NO: 144449 - RNA, 19 nt, Homo sapiens
gaacuacgauggcaguaca

SEQ ID NO: 144450 - RNA, 19 nt, Homo sapiens
acaaagagagcgacaguua

SEQ ID NO: 144451 - RNA, 19 nt, Homo sapiens
gaggaagaguaaugaauau

SEQ ID NO: 144452 - RNA, 19 nt, Homo sapiens
caacagcagugaaaucauc

SEQ ID NO: 144453 - RNA, 19 nt, Homo sapiens
gaaggaggaccgaaucauu

SEQ ID NO: 144454 - RNA, 19 nt, Homo sapiens
ggaucuagauuucucauca

SEQ ID NO: 144455 - RNA, 19 nt, Homo sapiens
caacggaagcuucauuauu

SEQ ID NO: 144456 - RNA, 19 nt, Homo sapiens
ccauguaccucacgguuaa

SEQ ID NO: 144457 - RNA, 19 nt, Homo sapiens
gcaaagcagucauccucaa

SEQ ID NO: 144458 - RNA, 19 nt, Homo sapiens
gcgaggagaucuacgaugu

SEQ ID NO: 144459 - RNA, 19 nt, Homo sapiens
gagccuauaucaucucaga

SEQ ID NO: 144460 - RNA, 19 nt, Homo sapiens
gcagaagacuccggcuauu

SEQ ID NO: 144461 - RNA, 19 nt, Homo sapiens
cugaaaugcucaugaguaa

SEQ ID NO: 144462 - RNA, 19 nt, Homo sapiens
gaacucggccaccaucauu

SEQ ID NO: 144463 - RNA, 19 nt, Homo sapiens
ggacgggauuuauggcaaa

SEQ ID NO: 144464 - RNA, 19 nt, Homo sapiens
gagaacaauggaacucuua

SEQ ID NO: 144465 - RNA, 19 nt, Homo sapiens
gcacgaauccugaccuuca

SEQ ID NO: 144466 - RNA, 19 nt, Homo sapiens
ucgaggaugugcccaguua

SEQ ID NO: 144467 - RNA, 19 nt, Homo sapiens
agacacagaucgagcaaga

SEQ ID NO: 144468 - RNA, 19 nt, Homo sapiens
gaacaauggaacucuuaaa

SEQ ID NO: 144469 - RNA, 19 nt, Homo sapiens
caagaacucuaaccugcuu

SEQ ID NO: 144470 - RNA, 19 nt, Homo sapiens
acgggagccuuguauauua

SEQ ID NO: 144471 - RNA, 19 nt, Homo sapiens
guaccuuaauccaugauaa

SEQ ID NO: 144472 - RNA, 19 nt, Homo sapiens
ggaccucucucuccaaguc

SEQ ID NO: 144473 - RNA, 19 nt, Homo sapiens
guaccaggcucgaauaaac

SEQ ID NO: 144474 - RNA, 19 nt, Homo sapiens
gcugaaaugcucaugagua

SEQ ID NO: 144475 - RNA, 19 nt, Homo sapiens
ggaaggcucccaagaaaca

SEQ ID NO: 144476 - RNA, 19 nt, Homo sapiens
ggaagacaguggcuacuac

SEQ ID NO: 144477 - RNA, 19 nt, Homo sapiens
cagaguuccucccaaguuu

SEQ ID NO: 144478 - RNA, 19 nt, Homo sapiens
ucagggagguuccagaaga

SEQ ID NO: 144479 - RNA, 19 nt, Homo sapiens
gaacucagccccauccaua

SEQ ID NO: 144480 - RNA, 19 nt, Homo sapiens
aacggaagcuucauuauuc

SEQ ID NO: 144481 - RNA, 19 nt, Homo sapiens
ggaggagcaucuuuagcaa

SEQ ID NO: 144482 - RNA, 19 nt, Homo sapiens
gcagucauccucaauuguu

SEQ ID NO: 144483 - RNA, 19 nt, Homo sapiens
cauacaacccuuugaguuu

SEQ ID NO: 144484 - RNA, 19 nt, Homo sapiens
caaaggagcaggagcuguu

SEQ ID NO: 144485 - RNA, 19 nt, Homo sapiens
gcagucaaauggaugaaag

SEQ ID NO: 144486 - RNA, 19 nt, Homo sapiens
ccaaggaggugggagaaga

SEQ ID NO: 144487 - RNA, 19 nt, Homo sapiens
caaagccaguugauuguca

SEQ ID NO: 144488 - RNA, 19 nt, Homo sapiens
acucuaaccugcuuccuuu

SEQ ID NO: 144489 - RNA, 19 nt, Homo sapiens
gcagagccgguuucccuua

SEQ ID NO: 144490 - RNA, 19 nt, Homo sapiens
gcaaagaccuuaggaaaag

SEQ ID NO: 144491 - RNA, 19 nt, Homo sapiens
gggcggaggagcaucuuua

SEQ ID NO: 144492 - RNA, 19 nt, Homo sapiens
gaacaccuuugcccacgau

SEQ ID NO: 144493 - RNA, 19 nt, Homo sapiens
gcuguccgcucaagacuau

SEQ ID NO: 144494 - RNA, 19 nt, Homo sapiens
gaccugagcuuaggacaag

SEQ ID NO: 144495 - RNA, 19 nt, Homo sapiens
gaauauggcaguuccaaag

SEQ ID NO: 144496 - RNA, 19 nt, Homo sapiens
ucacucacacgguccauua

SEQ ID NO: 144497 - RNA, 19 nt, Homo sapiens
guugacggaugcugacuuu

SEQ ID NO: 144498 - RNA, 19 nt, Homo sapiens
gggaucugaugaaauuauu

SEQ ID NO: 144499 - RNA, 19 nt, Homo sapiens
ggugguggcuguuacuuca

SEQ ID NO: 144500 - RNA, 19 nt, Homo sapiens
uggacaaccugaauaaguu

SEQ ID NO: 144501 - RNA, 19 nt, Homo sapiens
gcaacgagcucaccaucac

SEQ ID NO: 144502 - RNA, 19 nt, Homo sapiens
gucaaagcacgcacaauua

SEQ ID NO: 144503 - RNA, 19 nt, Homo sapiens
gugauuggcuauccguauu

SEQ ID NO: 144504 - RNA, 19 nt, Homo sapiens
gcuacgauauugaaugcaa

SEQ ID NO: 144505 - RNA, 19 nt, Homo sapiens
aagaagggcugacgaccaa

SEQ ID NO: 144506 - RNA, 19 nt, Homo sapiens
cagaagacuccggcuauua

SEQ ID NO: 144507 - RNA, 19 nt, Homo sapiens
gguccacacuuuccaagga

SEQ ID NO: 144508 - RNA, 19 nt, Homo sapiens
gcucagagaaccaaagaug

SEQ ID NO: 144509 - RNA, 19 nt, Homo sapiens
caucacaggcuacgauauu

SEQ ID NO: 144510 - RNA, 19 nt, Homo sapiens
aaggaggaccgaaucauua

SEQ ID NO: 144511 - RNA, 19 nt, Homo sapiens
caccaaagccaguugauug

SEQ ID NO: 144512 - RNA, 19 nt, Homo sapiens
ucacuugucucaggaucua

SEQ ID NO: 144513 - RNA, 19 nt, Homo sapiens
ggagagcugggugagauua

SEQ ID NO: 144514 - RNA, 19 nt, Homo sapiens
ggacgggacacauacauuc

SEQ ID NO: 144515 - RNA, 19 nt, Homo sapiens
gggcucagcuuuugauuga

SEQ ID NO: 144516 - RNA, 19 nt, Homo sapiens
caaagaguuuagcugaaau

SEQ ID NO: 144517 - RNA, 19 nt, Homo sapiens
cuaaagaggcugcgagaug

SEQ ID NO: 144518 - RNA, 19 nt, Homo sapiens
gaaccucauuggcuggaau

SEQ ID NO: 144519 - RNA, 19 nt, Homo sapiens
gcaucagggucacauggaa

SEQ ID NO: 144520 - RNA, 19 nt, Homo sapiens
ugucaaagcacgcacaauu

SEQ ID NO: 144521 - RNA, 19 nt, Homo sapiens
ggacacauacauucacugu

SEQ ID NO: 144522 - RNA, 19 nt, Homo sapiens
gcgaaugcacaucgacaua

SEQ ID NO: 144523 - RNA, 19 nt, Homo sapiens
guaccgcaauggugaaauc

SEQ ID NO: 144524 - RNA, 19 nt, Homo sapiens
uacaauuccuccacucauu

SEQ ID NO: 144525 - RNA, 19 nt, Homo sapiens
aagcaaagaccuuaggaaa

SEQ ID NO: 144526 - RNA, 19 nt, Homo sapiens
cauagaagcaaagaccuua

SEQ ID NO: 144527 - RNA, 19 nt, Homo sapiens
ccaccacucucgaggaugu

SEQ ID NO: 144528 - RNA, 19 nt, Homo sapiens
gaauccaaguucucagcaa

SEQ ID NO: 144529 - RNA, 19 nt, Homo sapiens
gaacugaggaccaggaacu

SEQ ID NO: 144530 - RNA, 19 nt, Homo sapiens
ucauacauuugccuccaua

SEQ ID NO: 144531 - RNA, 19 nt, Homo sapiens
gaagcaaagaccuuaggaa

SEQ ID NO: 144532 - RNA, 19 nt, Homo sapiens
caaauagguuaccgagagu

SEQ ID NO: 144533 - RNA, 19 nt, Homo sapiens
ggugagaagcccauuauag

SEQ ID NO: 144534 - RNA, 19 nt, Homo sapiens
ggacucaggcagcuauguu

SEQ ID NO: 144535 - RNA, 19 nt, Homo sapiens
ggagagagcuuccuguuuc

SEQ ID NO: 144536 - RNA, 19 nt, Homo sapiens
gaucugaaauuccucugua

SEQ ID NO: 144537 - RNA, 19 nt, Homo sapiens
gcucagaccuuacacauag

SEQ ID NO: 144538 - RNA, 19 nt, Homo sapiens
ggacaucaccuuucaguau

SEQ ID NO: 144539 - RNA, 19 nt, Homo sapiens
gcaaugcaauguggaaauu

SEQ ID NO: 144540 - RNA, 19 nt, Homo sapiens
gaaagaaugaggagaccua

SEQ ID NO: 144541 - RNA, 19 nt, Homo sapiens
agacuaaccuuuguucgua

SEQ ID NO: 144542 - RNA, 19 nt, Homo sapiens
ggaagaagaggaaauggaa

SEQ ID NO: 144543 - RNA, 19 nt, Homo sapiens
gacaucaccuuucaguauu

SEQ ID NO: 144544 - RNA, 19 nt, Homo sapiens
ccacgaagacaucaagaua

SEQ ID NO: 144545 - RNA, 19 nt, Homo sapiens
ggacgcauuccaaaucaua

SEQ ID NO: 144546 - RNA, 19 nt, Homo sapiens
gggagacuaagauguauua

SEQ ID NO: 144547 - RNA, 19 nt, Homo sapiens
guagaucuguggcgauaug

SEQ ID NO: 144548 - RNA, 19 nt, Homo sapiens
ugaaucauauguuguagga

SEQ ID NO: 144549 - RNA, 19 nt, Homo sapiens
aaauuugagucccucuuua

SEQ ID NO: 144550 - RNA, 19 nt, Homo sapiens
gggccacucucuacuggua

SEQ ID NO: 144551 - RNA, 19 nt, Homo sapiens
gcagaaaucccaguucaug

SEQ ID NO: 144552 - RNA, 19 nt, Homo sapiens
caaagcaugucaaguggau

SEQ ID NO: 144553 - RNA, 19 nt, Homo sapiens
uaauguguaugucugguaa

SEQ ID NO: 144554 - RNA, 19 nt, Homo sapiens
gaaacuguugguugagaua

SEQ ID NO: 144555 - RNA, 19 nt, Homo sapiens
gaggacgcauuccaaauca

SEQ ID NO: 144556 - RNA, 19 nt, Homo sapiens
ggaaaggaaaugaaguuau

SEQ ID NO: 144557 - RNA, 19 nt, Homo sapiens
caaaagaaguugaucugaa

SEQ ID NO: 144558 - RNA, 19 nt, Homo sapiens
ucagugagcucaggagaga

SEQ ID NO: 144559 - RNA, 19 nt, Homo sapiens
gaaauuuggaagaugguuu

SEQ ID NO: 144560 - RNA, 19 nt, Homo sapiens
gaggaaauggaaagaauga

SEQ ID NO: 144561 - RNA, 19 nt, Homo sapiens
guauuaaccuaccugugaa

SEQ ID NO: 144562 - RNA, 19 nt, Homo sapiens
gaccucaguuucuguuguu

SEQ ID NO: 144563 - RNA, 19 nt, Homo sapiens
caaauuugagucccucuuu

SEQ ID NO: 144564 - RNA, 19 nt, Homo sapiens
gaaggaggaagaagaggaa

SEQ ID NO: 144565 - RNA, 19 nt, Homo sapiens
guguaugucugguaaauag

SEQ ID NO: 144566 - RNA, 19 nt, Homo sapiens
gaaaucccaguucauguug

SEQ ID NO: 144567 - RNA, 19 nt, Homo sapiens
ggaccucaguuucuguugu

SEQ ID NO: 144568 - RNA, 19 nt, Homo sapiens
gaucggaccucaguuucug

SEQ ID NO: 144569 - RNA, 19 nt, Homo sapiens
uaguagaucuguggcgaua

SEQ ID NO: 144570 - RNA, 19 nt, Homo sapiens
ggaaacuguugguugagau

SEQ ID NO: 144571 - RNA, 19 nt, Homo sapiens
caguuucuguuguuucuuu

SEQ ID NO: 144572 - RNA, 19 nt, Homo sapiens
gaagaggaaauggaaagaa

SEQ ID NO: 144573 - RNA, 19 nt, Homo sapiens
gacaagcaguuucugaucu

SEQ ID NO: 144574 - RNA, 19 nt, Homo sapiens
gcagagagguugugaaaac

SEQ ID NO: 144575 - RNA, 19 nt, Homo sapiens
gugcagagagguugugaaa

SEQ ID NO: 144576 - RNA, 19 nt, Homo sapiens
gaagaagaggaaauggaaa

SEQ ID NO: 144577 - RNA, 19 nt, Homo sapiens
gggcacaguaugcuccuua

SEQ ID NO: 144578 - RNA, 19 nt, Homo sapiens
ucaaacgagucagaauaaa

SEQ ID NO: 144579 - RNA, 19 nt, Homo sapiens
gagagcuuccuguuucuaa

SEQ ID NO: 144580 - RNA, 19 nt, Homo sapiens
aagaggaaauggaaagaau

SEQ ID NO: 144581 - RNA, 19 nt, Homo sapiens
gggaaaggaaaugaaguua

SEQ ID NO: 144582 - RNA, 19 nt, Homo sapiens
acaguaugcuccuuacaga

SEQ ID NO: 144583 - RNA, 19 nt, Homo sapiens
uguauuaaccuaccuguga

SEQ ID NO: 144584 - RNA, 19 nt, Homo sapiens
gcauaagacugaguuucug

SEQ ID NO: 144585 - RNA, 19 nt, Homo sapiens
gcugauagcauauauucau

SEQ ID NO: 144586 - RNA, 19 nt, Homo sapiens
gaaaacagcagcaaugcaa

SEQ ID NO: 144587 - RNA, 19 nt, Homo sapiens
ggaggaagaagaggaaaug

SEQ ID NO: 144588 - RNA, 19 nt, Homo sapiens
uugcaucgcuguccaagug

SEQ ID NO: 144589 - RNA, 19 nt, Homo sapiens
uaacaaugcaugcuuugga

SEQ ID NO: 144590 - RNA, 19 nt, Homo sapiens
agacuaagauguauuaacc

SEQ ID NO: 144591 - RNA, 19 nt, Homo sapiens
acuaugaucucuuauaugc

SEQ ID NO: 144592 - RNA, 19 nt, Homo sapiens
gguaagagggagccgguuu

SEQ ID NO: 144593 - RNA, 19 nt, Homo sapiens
ugagauaguugguucuuuu

SEQ ID NO: 144594 - RNA, 19 nt, Homo sapiens
gacuggagcuucauugacu

SEQ ID NO: 144595 - RNA, 19 nt, Homo sapiens
ccagugggauggaaacaag

SEQ ID NO: 144596 - RNA, 19 nt, Homo sapiens
ggaauuguuauacuagguu

SEQ ID NO: 144597 - RNA, 19 nt, Homo sapiens
gaaaagcuguucccauguc

SEQ ID NO: 144598 - RNA, 19 nt, Homo sapiens
uuuagugggugagaaauuu

SEQ ID NO: 144599 - RNA, 19 nt, Homo sapiens
uaauaaaugggcacaguau

SEQ ID NO: 144600 - RNA, 19 nt, Homo sapiens
uauaauaaaugggcacagu

SEQ ID NO: 144601 - RNA, 19 nt, Homo sapiens
ucaaguggauaguagaucu

SEQ ID NO: 144602 - RNA, 19 nt, Homo sapiens
uaaccuaccugugaaucau

SEQ ID NO: 144603 - RNA, 19 nt, Homo sapiens
guuguacacuugggugaaa

SEQ ID NO: 144604 - RNA, 19 nt, Homo sapiens
agaaguugaucugaaauuc

SEQ ID NO: 144605 - RNA, 19 nt, Homo sapiens
ggaagagguaccacaggaa

SEQ ID NO: 144606 - RNA, 19 nt, Homo sapiens
gccaaucacugaguuugug

SEQ ID NO: 144607 - RNA, 19 nt, Homo sapiens
uggcagaaaucccaguuca

SEQ ID NO: 144608 - RNA, 19 nt, Homo sapiens
gaucuguggcgauaugaga

SEQ ID NO: 144609 - RNA, 19 nt, Homo sapiens
uuuggaaacuguugguuga

SEQ ID NO: 144610 - RNA, 19 nt, Homo sapiens
ggugguuucuauacaugaa

SEQ ID NO: 144611 - RNA, 19 nt, Homo sapiens
ccaggaaagcguuuggaaa

SEQ ID NO: 144612 - RNA, 19 nt, Homo sapiens
cuucaaacgagucagaaua

SEQ ID NO: 144613 - RNA, 19 nt, Homo sapiens
gauggaaacaaguggaaga

SEQ ID NO: 144614 - RNA, 19 nt, Homo sapiens
aaguaacaaugcaugcuuu

SEQ ID NO: 144615 - RNA, 19 nt, Homo sapiens
cguaucaccuuucccagau

SEQ ID NO: 144616 - RNA, 19 nt, Homo sapiens
gagagagcuuccuguuucu

SEQ ID NO: 144617 - RNA, 19 nt, Homo sapiens
ucugguagguucugucugu

SEQ ID NO: 144618 - RNA, 19 nt, Homo sapiens
gaucgcacaaggacauuug

SEQ ID NO: 144619 - RNA, 19 nt, Homo sapiens
agaaaucccaguucauguu

SEQ ID NO: 144620 - RNA, 19 nt, Homo sapiens
ugagagugaucaagagaag

SEQ ID NO: 144621 - RNA, 19 nt, Homo sapiens
aacaaugcaugcuuuggaa

SEQ ID NO: 144622 - RNA, 19 nt, Homo sapiens
caugucaaguggauaguag

SEQ ID NO: 144623 - RNA, 19 nt, Homo sapiens
guaaauaaagcugauagca

SEQ ID NO: 144624 - RNA, 19 nt, Homo sapiens
uuacaccguuguuguuuua

SEQ ID NO: 144625 - RNA, 19 nt, Homo sapiens
caaguaacaaugcaugcuu

SEQ ID NO: 144626 - RNA, 19 nt, Homo sapiens
guaauguguaugucuggua

SEQ ID NO: 144627 - RNA, 19 nt, Homo sapiens
uguggaaauuguagcguuu

SEQ ID NO: 144628 - RNA, 19 nt, Homo sapiens
ggacguaugacaaggacau

SEQ ID NO: 144629 - RNA, 19 nt, Homo sapiens
gccaagggcagguugauca

SEQ ID NO: 144630 - RNA, 19 nt, Homo sapiens
uaaugcugcacaccaguua

SEQ ID NO: 144631 - RNA, 19 nt, Homo sapiens
cgaggacgcauuccaaauc

SEQ ID NO: 144632 - RNA, 19 nt, Homo sapiens
guaagagggagccgguuug

SEQ ID NO: 144633 - RNA, 19 nt, Homo sapiens
gcauauauucauaccuguu

SEQ ID NO: 144634 - RNA, 19 nt, Homo sapiens
gcuuauacaauucagagaa

SEQ ID NO: 144635 - RNA, 19 nt, Homo sapiens
caaaugaccuuccaaguaa

SEQ ID NO: 144636 - RNA, 19 nt, Homo sapiens
uuacauagcucugaaguua

SEQ ID NO: 144637 - RNA, 19 nt, Homo sapiens
gaugacagcuucuuggaua

SEQ ID NO: 144638 - RNA, 19 nt, Homo sapiens
gcaaaugaccuuccaagua

SEQ ID NO: 144639 - RNA, 19 nt, Homo sapiens
gaaaguacuucuuccacua

SEQ ID NO: 144640 - RNA, 19 nt, Homo sapiens
cgagaugggucgaauguua

SEQ ID NO: 144641 - RNA, 19 nt, Homo sapiens
gaacaucuacugagaaauu

SEQ ID NO: 144642 - RNA, 19 nt, Homo sapiens
gaaauugguuugagauaga

SEQ ID NO: 144643 - RNA, 19 nt, Homo sapiens
gauguagucuugacgaaua

SEQ ID NO: 144644 - RNA, 19 nt, Homo sapiens
agaauacucuggaacauua

SEQ ID NO: 144645 - RNA, 19 nt, Homo sapiens
gaagucgaaucacaaagua

SEQ ID NO: 144646 - RNA, 19 nt, Homo sapiens
gaacgauucucucuauaga

SEQ ID NO: 144647 - RNA, 19 nt, Homo sapiens
gaacagagaagaacaaaca

SEQ ID NO: 144648 - RNA, 19 nt, Homo sapiens
ugacaacccuccaguguuu

SEQ ID NO: 144649 - RNA, 19 nt, Homo sapiens
caaagaacuugcacuggua

SEQ ID NO: 144650 - RNA, 19 nt, Homo sapiens
gaaggaaauugguuugaga

SEQ ID NO: 144651 - RNA, 19 nt, Homo sapiens
caacagaaauacuggagaa

SEQ ID NO: 144652 - RNA, 19 nt, Homo sapiens
gcaccaagcucuagucuac

SEQ ID NO: 144653 - RNA, 19 nt, Homo sapiens
gaccaucacuuuaaccaaa

SEQ ID NO: 144654 - RNA, 19 nt, Homo sapiens
guaagaacaucuacugaga

SEQ ID NO: 144655 - RNA, 19 nt, Homo sapiens
ggauauaaccacugucaua

SEQ ID NO: 144656 - RNA, 19 nt, Homo sapiens
gaaggacgcccaucuaaug

SEQ ID NO: 144657 - RNA, 19 nt, Homo sapiens
ccacaaauaccaccugaua

SEQ ID NO: 144658 - RNA, 19 nt, Homo sapiens
gaugggaacugaauugugu

SEQ ID NO: 144659 - RNA, 19 nt, Homo sapiens
caaauuugcucgagauuag

SEQ ID NO: 144660 - RNA, 19 nt, Homo sapiens
cagaaauacuggagaaauu

SEQ ID NO: 144661 - RNA, 19 nt, Homo sapiens
cagaugaaccgaacaauuu

SEQ ID NO: 144662 - RNA, 19 nt, Homo sapiens
gcagagaaaugcaagaucu

SEQ ID NO: 144663 - RNA, 19 nt, Homo sapiens
ggacuggaguuucuucaga

SEQ ID NO: 144664 - RNA, 19 nt, Homo sapiens
gaauaucacacucgucuuu

SEQ ID NO: 144665 - RNA, 19 nt, Homo sapiens
auacaaggguuaaccauuu

SEQ ID NO: 144666 - RNA, 19 nt, Homo sapiens
ccucaaagccugcauguaa

SEQ ID NO: 144667 - RNA, 19 nt, Homo sapiens
uaugggaucuuugucauua

SEQ ID NO: 144668 - RNA, 19 nt, Homo sapiens
ggaccuaaauuuaagaagu

SEQ ID NO: 144669 - RNA, 19 nt, Homo sapiens
caaauacacuggugaugau

SEQ ID NO: 144670 - RNA, 19 nt, Homo sapiens
gguaagagauuauaacacu

SEQ ID NO: 144671 - RNA, 19 nt, Homo sapiens
gaaggaggucugaauauga

SEQ ID NO: 144672 - RNA, 19 nt, Homo sapiens
ccaaguauauucuucugaa

SEQ ID NO: 144673 - RNA, 19 nt, Homo sapiens
auacagagccgaacacuaa

SEQ ID NO: 144674 - RNA, 19 nt, Homo sapiens
gaugaagaguucucagcua

SEQ ID NO: 144675 - RNA, 19 nt, Homo sapiens
uaauaucccuuacauggaa

SEQ ID NO: 144676 - RNA, 19 nt, Homo sapiens
acaagaaccuucagauuca

SEQ ID NO: 144677 - RNA, 19 nt, Homo sapiens
gaauugaucagccaccaua

SEQ ID NO: 144678 - RNA, 19 nt, Homo sapiens
gcaaauacacuggugauga

SEQ ID NO: 144679 - RNA, 19 nt, Homo sapiens
guaguaugcuuaagcuuug

SEQ ID NO: 144680 - RNA, 19 nt, Homo sapiens
gaguggagcuggcauaagu

SEQ ID NO: 144681 - RNA, 19 nt, Homo sapiens
gaaacggagccaaagauuu

SEQ ID NO: 144682 - RNA, 19 nt, Homo sapiens
gaacaggcaaacucacuuu

SEQ ID NO: 144683 - RNA, 19 nt, Homo sapiens
ggaaauugguuugagauag

SEQ ID NO: 144684 - RNA, 19 nt, Homo sapiens
acacucgucuuucccuuua

SEQ ID NO: 144685 - RNA, 19 nt, Homo sapiens
ugauuugcauggaauguua

SEQ ID NO: 144686 - RNA, 19 nt, Homo sapiens
ugagauaugucaagaauac

SEQ ID NO: 144687 - RNA, 19 nt, Homo sapiens
gagagagaaugacaggauu

SEQ ID NO: 144688 - RNA, 19 nt, Homo sapiens
ccaaggaacaguacaauau

SEQ ID NO: 144689 - RNA, 19 nt, Homo sapiens
ggagaaauucgaacgauga

SEQ ID NO: 144690 - RNA, 19 nt, Homo sapiens
gacaagaaccuucagauuc

SEQ ID NO: 144691 - RNA, 19 nt, Homo sapiens
guaagcagaugggaacuga

SEQ ID NO: 144692 - RNA, 19 nt, Homo sapiens
ggagcaaggugagaaauca

SEQ ID NO: 144693 - RNA, 19 nt, Homo sapiens
gaugaucuguugugauugu

SEQ ID NO: 144694 - RNA, 19 nt, Homo sapiens
uaggugauauucauucgua

SEQ ID NO: 144695 - RNA, 19 nt, Homo sapiens
ccugauaacgcaaauauaa

SEQ ID NO: 144696 - RNA, 19 nt, Homo sapiens
gaaaugaaggaaauugguu

SEQ ID NO: 144697 - RNA, 19 nt, Homo sapiens
gcagaugaaccgaacaauu

SEQ ID NO: 144698 - RNA, 19 nt, Homo sapiens
ucagaaaacuggugaaauu

SEQ ID NO: 144699 - RNA, 19 nt, Homo sapiens
gcacugguacaauuaauau

SEQ ID NO: 144700 - RNA, 19 nt, Homo sapiens
ccaguaugcucuugcugua

SEQ ID NO: 144701 - RNA, 19 nt, Homo sapiens
acauagcucugaaguuaaa

SEQ ID NO: 144702 - RNA, 19 nt, Homo sapiens
ggucacuccuuucuucauu

SEQ ID NO: 144703 - RNA, 19 nt, Homo sapiens
caaaccagcaaguuacaua

SEQ ID NO: 144704 - RNA, 19 nt, Homo sapiens
gagauggacuggaguuucu

SEQ ID NO: 144705 - RNA, 19 nt, Homo sapiens
aagaacaucuacugagaaa

SEQ ID NO: 144706 - RNA, 19 nt, Homo sapiens
ugacgaauauugcuuacug

SEQ ID NO: 144707 - RNA, 19 nt, Homo sapiens
acuccuaccuuaauuauug

SEQ ID NO: 144708 - RNA, 19 nt, Homo sapiens
gagaaugacaggauuugaa

SEQ ID NO: 144709 - RNA, 19 nt, Homo sapiens
agugauagauguagucuug

SEQ ID NO: 144710 - RNA, 19 nt, Homo sapiens
ggaaacggagccaaagauu

SEQ ID NO: 144711 - RNA, 19 nt, Homo sapiens
gaacagucuucauauacca

SEQ ID NO: 144712 - RNA, 19 nt, Homo sapiens
gcaauaggaugagguuucu

SEQ ID NO: 144713 - RNA, 19 nt, Homo sapiens
ccauauagcucgagcaaaa

SEQ ID NO: 144714 - RNA, 19 nt, Homo sapiens
gacaggauuugaacuaaca

SEQ ID NO: 144715 - RNA, 19 nt, Homo sapiens
uugaugaucuguugugauu

SEQ ID NO: 144716 - RNA, 19 nt, Homo sapiens
gguauguaaugggaaauaa

SEQ ID NO: 144717 - RNA, 19 nt, Homo sapiens
caacgacuguuagguaugu

SEQ ID NO: 144718 - RNA, 19 nt, Homo sapiens
gguaauaugggaucaaaug

SEQ ID NO: 144719 - RNA, 19 nt, Homo sapiens
gcagaugggaacugaauug

SEQ ID NO: 144720 - RNA, 19 nt, Homo sapiens
cuggugagguugaggaaua

SEQ ID NO: 144721 - RNA, 19 nt, Homo sapiens
caaaugugguagugacaga

SEQ ID NO: 144722 - RNA, 19 nt, Homo sapiens
gugacuguguuaaauguaa

SEQ ID NO: 144723 - RNA, 19 nt, Homo sapiens
gagaaggaggucugaauau

SEQ ID NO: 144724 - RNA, 19 nt, Homo sapiens
gagggaauguagagaagga

SEQ ID NO: 144725 - RNA, 19 nt, Homo sapiens
ucauagucauugugguuua

SEQ ID NO: 144726 - RNA, 19 nt, Homo sapiens
uuacgcagaugaagaugaa

SEQ ID NO: 144727 - RNA, 19 nt, Homo sapiens
uaauccagcugaccugcua

SEQ ID NO: 144728 - RNA, 19 nt, Homo sapiens
gguuugagauagaaaugaa

SEQ ID NO: 144729 - RNA, 19 nt, Homo sapiens
gguagaaguuaacagugaa

SEQ ID NO: 144730 - RNA, 19 nt, Homo sapiens
ccagaugcccuguugguuu

SEQ ID NO: 144731 - RNA, 19 nt, Homo sapiens
ugagaaaucacaaugagaa

SEQ ID NO: 144732 - RNA, 19 nt, Homo sapiens
gcagacaucagccuaggaa

SEQ ID NO: 144733 - RNA, 19 nt, Homo sapiens
ggagagagaaugacaggau

SEQ ID NO: 144734 - RNA, 19 nt, Homo sapiens
ccgcaucucuggaguagga

SEQ ID NO: 144735 - RNA, 19 nt, Homo sapiens
gaaaguaacucaggaaaua

SEQ ID NO: 144736 - RNA, 19 nt, Homo sapiens
gaacacagcuucacauuca

SEQ ID NO: 144737 - RNA, 19 nt, Homo sapiens
ggaaguagauuaugaagaa

SEQ ID NO: 144738 - RNA, 19 nt, Homo sapiens
caauauaccuguaguagaa

SEQ ID NO: 144739 - RNA, 19 nt, Homo sapiens
gagaggaucuguccaagaa

SEQ ID NO: 144740 - RNA, 19 nt, Homo sapiens
gcacaguccuuaucaaugu

SEQ ID NO: 144741 - RNA, 19 nt, Homo sapiens
gcauuaagguucuugauau

SEQ ID NO: 144742 - RNA, 19 nt, Homo sapiens
uaacaaagauacuggagaa

SEQ ID NO: 144743 - RNA, 19 nt, Homo sapiens
ggaauugugacccuuauua

SEQ ID NO: 144744 - RNA, 19 nt, Homo sapiens
gaaagaggacucaaaauua

SEQ ID NO: 144745 - RNA, 19 nt, Homo sapiens
aaucuugacuucaguguua

SEQ ID NO: 144746 - RNA, 19 nt, Homo sapiens
gaaaugugauagcaacaga

SEQ ID NO: 144747 - RNA, 19 nt, Homo sapiens
ggaaauagucacugaaaga

SEQ ID NO: 144748 - RNA, 19 nt, Homo sapiens
aaacagaugcucaaacuaa

SEQ ID NO: 144749 - RNA, 19 nt, Homo sapiens
caacagaaacuuccuaugu

SEQ ID NO: 144750 - RNA, 19 nt, Homo sapiens
gaaacugaaucgcugaaug

SEQ ID NO: 144751 - RNA, 19 nt, Homo sapiens
gaacacagcagcuacacuu

SEQ ID NO: 144752 - RNA, 19 nt, Homo sapiens
gaugaccgcuucuuagaug

SEQ ID NO: 144753 - RNA, 19 nt, Homo sapiens
ccaauacccugaauucgaa

SEQ ID NO: 144754 - RNA, 19 nt, Homo sapiens
gaugaaauagguucugaua

SEQ ID NO: 144755 - RNA, 19 nt, Homo sapiens
gcacuguacagcauucuua

SEQ ID NO: 144756 - RNA, 19 nt, Homo sapiens
gaaaauagcacgccaagaa

SEQ ID NO: 144757 - RNA, 19 nt, Homo sapiens
gcaauugcgcucaugauuu

SEQ ID NO: 144758 - RNA, 19 nt, Homo sapiens
ggcaguagcuucccaguuc

SEQ ID NO: 144759 - RNA, 19 nt, Homo sapiens
aagauugccuucugguuua

SEQ ID NO: 144760 - RNA, 19 nt, Homo sapiens
gcagcgucaucucaauuua

SEQ ID NO: 144761 - RNA, 19 nt, Homo sapiens
ccaguguucuaccuaaaua

SEQ ID NO: 144762 - RNA, 19 nt, Homo sapiens
gaauccaauugccaagaua

SEQ ID NO: 144763 - RNA, 19 nt, Homo sapiens
gaagauagagauaauugga

SEQ ID NO: 144764 - RNA, 19 nt, Homo sapiens
ucaagucaauguagaaguu

SEQ ID NO: 144765 - RNA, 19 nt, Homo sapiens
gaaauugagcagagacaaa

SEQ ID NO: 144766 - RNA, 19 nt, Homo sapiens
aagcaaaggccaaauaauu

SEQ ID NO: 144767 - RNA, 19 nt, Homo sapiens
gaggaucuguccaagaaga

SEQ ID NO: 144768 - RNA, 19 nt, Homo sapiens
ggacagaaugugacaguga

SEQ ID NO: 144769 - RNA, 19 nt, Homo sapiens
gaauugugacccuuauuaa

SEQ ID NO: 144770 - RNA, 19 nt, Homo sapiens
gaaagaaggcauucauuuu

SEQ ID NO: 144771 - RNA, 19 nt, Homo sapiens
gagguuauuuccacauaga

SEQ ID NO: 144772 - RNA, 19 nt, Homo sapiens
caaagauacuggagaacug

SEQ ID NO: 144773 - RNA, 19 nt, Homo sapiens
acaagucgauuaggaguaa

SEQ ID NO: 144774 - RNA, 19 nt, Homo sapiens
ggaaggcacucagcaucuu

SEQ ID NO: 144775 - RNA, 19 nt, Homo sapiens
uuacaggucuuaagcacaa

SEQ ID NO: 144776 - RNA, 19 nt, Homo sapiens
cagcuacacuuugacagua

SEQ ID NO: 144777 - RNA, 19 nt, Homo sapiens
ccaauggcuucuagaaaug

SEQ ID NO: 144778 - RNA, 19 nt, Homo sapiens
caaguucagauucguauuu

SEQ ID NO: 144779 - RNA, 19 nt, Homo sapiens
gaaaaucaaugcaacagau

SEQ ID NO: 144780 - RNA, 19 nt, Homo sapiens
gcauagcacuguacagcau

SEQ ID NO: 144781 - RNA, 19 nt, Homo sapiens
cccaauggcuucuagaaau

SEQ ID NO: 144782 - RNA, 19 nt, Homo sapiens
gcuagaugaccgcuucuua

SEQ ID NO: 144783 - RNA, 19 nt, Homo sapiens
gaaauggaguaggagguau

SEQ ID NO: 144784 - RNA, 19 nt, Homo sapiens
uagaucagccuuaugcuaa

SEQ ID NO: 144785 - RNA, 19 nt, Homo sapiens
caauugcgcucaugauuuu

SEQ ID NO: 144786 - RNA, 19 nt, Homo sapiens
caggagagauuuauacaac

SEQ ID NO: 144787 - RNA, 19 nt, Homo sapiens
gaagaaagaggacucaaaa

SEQ ID NO: 144788 - RNA, 19 nt, Homo sapiens
gaaauagucacugaaagau

SEQ ID NO: 144789 - RNA, 19 nt, Homo sapiens
aaagauugccuucugguuu

SEQ ID NO: 144790 - RNA, 19 nt, Homo sapiens
agaaacagaugcucaaacu

SEQ ID NO: 144791 - RNA, 19 nt, Homo sapiens
cacagcagcuacacuuuga

SEQ ID NO: 144792 - RNA, 19 nt, Homo sapiens
ggagagauuuauacaacca

SEQ ID NO: 144793 - RNA, 19 nt, Homo sapiens
ggccauaucagaagauuau

SEQ ID NO: 144794 - RNA, 19 nt, Homo sapiens
agagaaacccuuagagcua

SEQ ID NO: 144795 - RNA, 19 nt, Homo sapiens
caauguagagaaacccuua

SEQ ID NO: 144796 - RNA, 19 nt, Homo sapiens
gcaguaggacagaauguga

SEQ ID NO: 144797 - RNA, 19 nt, Homo sapiens
caacugucccacacugaua

SEQ ID NO: 144798 - RNA, 19 nt, Homo sapiens
guucgaugcagaugaaaua

SEQ ID NO: 144799 - RNA, 19 nt, Homo sapiens
agacaaaccuguaaaacaa

SEQ ID NO: 144800 - RNA, 19 nt, Homo sapiens
caaggaagccacgaugaaa

SEQ ID NO: 144801 - RNA, 19 nt, Homo sapiens
gaagggaugguugaagaaa

SEQ ID NO: 144802 - RNA, 19 nt, Homo sapiens
ccuuagagcuacgcauuaa

SEQ ID NO: 144803 - RNA, 19 nt, Homo sapiens
gaggaaacaauguagagaa

SEQ ID NO: 144804 - RNA, 19 nt, Homo sapiens
guuaccagauucccacuga

SEQ ID NO: 144805 - RNA, 19 nt, Homo sapiens
agauguaccuuacgucaug

SEQ ID NO: 144806 - RNA, 19 nt, Homo sapiens
acagaaacuuccuauguca

SEQ ID NO: 144807 - RNA, 19 nt, Homo sapiens
gagcaaacuaugguuaauu

SEQ ID NO: 144808 - RNA, 19 nt, Homo sapiens
ucaagacgcuagcugaagu

SEQ ID NO: 144809 - RNA, 19 nt, Homo sapiens
gaaacagaugcucaaacua

SEQ ID NO: 144810 - RNA, 19 nt, Homo sapiens
ggaaaugaaggagguuauu

SEQ ID NO: 144811 - RNA, 19 nt, Homo sapiens
caaugacaauauaccugua

SEQ ID NO: 144812 - RNA, 19 nt, Homo sapiens
ugauaucaaugacaacgaa

SEQ ID NO: 144813 - RNA, 19 nt, Homo sapiens
gaaacaauguagagaaacc

SEQ ID NO: 144814 - RNA, 19 nt, Homo sapiens
aggaaacaauguagagaaa

SEQ ID NO: 144815 - RNA, 19 nt, Homo sapiens
uguggucacugaaagagua

SEQ ID NO: 144816 - RNA, 19 nt, Homo sapiens
guagaucagccuuaugcua

SEQ ID NO: 144817 - RNA, 19 nt, Homo sapiens
gagaaaguaacucaggaaa

SEQ ID NO: 144818 - RNA, 19 nt, Homo sapiens
uuagaugauuugggacuua

SEQ ID NO: 144819 - RNA, 19 nt, Homo sapiens
ucugucacaucugaaauua

SEQ ID NO: 144820 - RNA, 19 nt, Homo sapiens
ucaagcaaaggccaaauaa

SEQ ID NO: 144821 - RNA, 19 nt, Homo sapiens
caaccaguguuaccuugga

SEQ ID NO: 144822 - RNA, 19 nt, Homo sapiens
gauacaggagagauuuaua

SEQ ID NO: 144823 - RNA, 19 nt, Homo sapiens
uaaugaagguacaguugug

SEQ ID NO: 144824 - RNA, 19 nt, Homo sapiens
gcugaaugcuucuauuggu

SEQ ID NO: 144825 - RNA, 19 nt, Homo sapiens
aggaagaaauggaguagga

SEQ ID NO: 144826 - RNA, 19 nt, Homo sapiens
gauagagccugugcagaca

SEQ ID NO: 144827 - RNA, 19 nt, Homo sapiens
agagacacauacacauuga

SEQ ID NO: 144828 - RNA, 19 nt, Homo sapiens
gcgcuaucaugaccacuga

SEQ ID NO: 144829 - RNA, 19 nt, Homo sapiens
acaagguggugccaucauu

SEQ ID NO: 144830 - RNA, 19 nt, Homo sapiens
gcagggaagcacagcauga

SEQ ID NO: 144831 - RNA, 19 nt, Homo sapiens
ucagaagauuauccuagaa

SEQ ID NO: 144832 - RNA, 19 nt, Homo sapiens
gaucagccuuaugcuaaug

SEQ ID NO: 144833 - RNA, 19 nt, Homo sapiens
ggccaugccuaauauagca

SEQ ID NO: 144834 - RNA, 19 nt, Homo sapiens
gcuaaugaagguacaguug

SEQ ID NO: 144835 - RNA, 19 nt, Homo sapiens
uaacaaagcugccucaaau

SEQ ID NO: 144836 - RNA, 19 nt, Homo sapiens
gcaaaugacugcuuguuga

SEQ ID NO: 144837 - RNA, 19 nt, Homo sapiens
gaauggaaaugaccacuaa

SEQ ID NO: 144838 - RNA, 19 nt, Homo sapiens
ugaaagaugucaacgauaa

SEQ ID NO: 144839 - RNA, 19 nt, Homo sapiens
gaaggaaauugguuugaaa

SEQ ID NO: 144840 - RNA, 19 nt, Homo sapiens
cuacaaagcgugaaacuua

SEQ ID NO: 144841 - RNA, 19 nt, Homo sapiens
gaaccgagauucuacuuuc

SEQ ID NO: 144842 - RNA, 19 nt, Homo sapiens
cuuauuagcuucucucaua

SEQ ID NO: 144843 - RNA, 19 nt, Homo sapiens
gcagacggcuggcaggaua

SEQ ID NO: 144844 - RNA, 19 nt, Homo sapiens
uagcaaagcucacuguauu

SEQ ID NO: 144845 - RNA, 19 nt, Homo sapiens
gcuaauaauuuggcacuua

SEQ ID NO: 144846 - RNA, 19 nt, Homo sapiens
ggaaaguucugaaguuugu

SEQ ID NO: 144847 - RNA, 19 nt, Homo sapiens
ucaaggagcuucugcuuug

SEQ ID NO: 144848 - RNA, 19 nt, Homo sapiens
ggugaaggcucuagauuau

SEQ ID NO: 144849 - RNA, 19 nt, Homo sapiens
gcuagaacacugaauaaua

SEQ ID NO: 144850 - RNA, 19 nt, Homo sapiens
gaauuucaccaaucaguua

SEQ ID NO: 144851 - RNA, 19 nt, Homo sapiens
uaacagauuuggaugaaga

SEQ ID NO: 144852 - RNA, 19 nt, Homo sapiens
ggaagacgauggccaggaa

SEQ ID NO: 144853 - RNA, 19 nt, Homo sapiens
gaugaagaguacacagaua

SEQ ID NO: 144854 - RNA, 19 nt, Homo sapiens
agacaaagauggagaagga

SEQ ID NO: 144855 - RNA, 19 nt, Homo sapiens
ccaaaccacuugaauucua

SEQ ID NO: 144856 - RNA, 19 nt, Homo sapiens
gaaggacuaucaacucaau

SEQ ID NO: 144857 - RNA, 19 nt, Homo sapiens
gaaccaaaccacuugaauu

SEQ ID NO: 144858 - RNA, 19 nt, Homo sapiens
gagaaaccacuuauacuaa

SEQ ID NO: 144859 - RNA, 19 nt, Homo sapiens
gagaaggacuaucaacuca

SEQ ID NO: 144860 - RNA, 19 nt, Homo sapiens
auaauuggcuugcaguaua

SEQ ID NO: 144861 - RNA, 19 nt, Homo sapiens
gauccuugcucccgucuaa

SEQ ID NO: 144862 - RNA, 19 nt, Homo sapiens
ugaaggcucuagauuauga

SEQ ID NO: 144863 - RNA, 19 nt, Homo sapiens
gcagcaugguaacuauuua

SEQ ID NO: 144864 - RNA, 19 nt, Homo sapiens
gaugguggauaccuaauga

SEQ ID NO: 144865 - RNA, 19 nt, Homo sapiens
cuagaacacugaauaauag

SEQ ID NO: 144866 - RNA, 19 nt, Homo sapiens
ccucaaaugucaaauaugu

SEQ ID NO: 144867 - RNA, 19 nt, Homo sapiens
caaaccacuugaauucuaa

SEQ ID NO: 144868 - RNA, 19 nt, Homo sapiens
ggaaauugguuugaaauac

SEQ ID NO: 144869 - RNA, 19 nt, Homo sapiens
guggauaccuaaugauuga

SEQ ID NO: 144870 - RNA, 19 nt, Homo sapiens
ugauaauccuccaguauuu

SEQ ID NO: 144871 - RNA, 19 nt, Homo sapiens
gagauaagccuugguguug

SEQ ID NO: 144872 - RNA, 19 nt, Homo sapiens
gauaacuucccaauguuua

SEQ ID NO: 144873 - RNA, 19 nt, Homo sapiens
cuacgagggucacauacua

SEQ ID NO: 144874 - RNA, 19 nt, Homo sapiens
cagcagacaggauuuguua

SEQ ID NO: 144875 - RNA, 19 nt, Homo sapiens
gacaaggaaaucacaaaua

SEQ ID NO: 144876 - RNA, 19 nt, Homo sapiens
aaacugauccuagaacuaa

SEQ ID NO: 144877 - RNA, 19 nt, Homo sapiens
agaaugagcuggaauacca

SEQ ID NO: 144878 - RNA, 19 nt, Homo sapiens
uaacgaugguggauaccua

SEQ ID NO: 144879 - RNA, 19 nt, Homo sapiens
caagauuacuucagauuac

SEQ ID NO: 144880 - RNA, 19 nt, Homo sapiens
gcagagaaggagaagauaa

SEQ ID NO: 144881 - RNA, 19 nt, Homo sapiens
agacagcgguuaugggauu

SEQ ID NO: 144882 - RNA, 19 nt, Homo sapiens
cauggaaaguucugaaguu

SEQ ID NO: 144883 - RNA, 19 nt, Homo sapiens
gaacauaucaagccaucga

SEQ ID NO: 144884 - RNA, 19 nt, Homo sapiens
uaacauaacagcuauaguc

SEQ ID NO: 144885 - RNA, 19 nt, Homo sapiens
cauaaacugaucacgauua

SEQ ID NO: 144886 - RNA, 19 nt, Homo sapiens
gaaugaaggaaauugguuu

SEQ ID NO: 144887 - RNA, 19 nt, Homo sapiens
ccaagauuacuucagauua

SEQ ID NO: 144888 - RNA, 19 nt, Homo sapiens
gaaacccaauugccaagau

SEQ ID NO: 144889 - RNA, 19 nt, Homo sapiens
gacuaaaggucaauaugau

SEQ ID NO: 144890 - RNA, 19 nt, Homo sapiens
ggaaaugaccacuaagcuu

SEQ ID NO: 144891 - RNA, 19 nt, Homo sapiens
caauggagccgauuucaug

SEQ ID NO: 144892 - RNA, 19 nt, Homo sapiens
gaagaguacacagauaauu

SEQ ID NO: 144893 - RNA, 19 nt, Homo sapiens
gauacuaaaugccacagau

SEQ ID NO: 144894 - RNA, 19 nt, Homo sapiens
gcuuguugaucuaugauaa

SEQ ID NO: 144895 - RNA, 19 nt, Homo sapiens
cacgguauauguuagagua

SEQ ID NO: 144896 - RNA, 19 nt, Homo sapiens
agagaaaccacuuauacua

SEQ ID NO: 144897 - RNA, 19 nt, Homo sapiens
ugaaggaaauugguuugaa

SEQ ID NO: 144898 - RNA, 19 nt, Homo sapiens
cauauugguucauggagaa

SEQ ID NO: 144899 - RNA, 19 nt, Homo sapiens
aacgauaacuucccaaugu

SEQ ID NO: 144900 - RNA, 19 nt, Homo sapiens
guagagaaaccacuuauac

SEQ ID NO: 144901 - RNA, 19 nt, Homo sapiens
cacuggagauauuaacaua

SEQ ID NO: 144902 - RNA, 19 nt, Homo sapiens
gauaagccuugguguugau

SEQ ID NO: 144903 - RNA, 19 nt, Homo sapiens
agggugaucugucccauuu

SEQ ID NO: 144904 - RNA, 19 nt, Homo sapiens
caacucaaugugaauguaa

SEQ ID NO: 144905 - RNA, 19 nt, Homo sapiens
aagaagagaugacuaugca

SEQ ID NO: 144906 - RNA, 19 nt, Homo sapiens
cgucuaauaugaccagaau

SEQ ID NO: 144907 - RNA, 19 nt, Homo sapiens
ggaauggaaaugaccacua

SEQ ID NO: 144908 - RNA, 19 nt, Homo sapiens
ccgagauucuacuuucaua

SEQ ID NO: 144909 - RNA, 19 nt, Homo sapiens
gaaauacaaacugauccua

SEQ ID NO: 144910 - RNA, 19 nt, Homo sapiens
ggaaugaaggaaauugguu

SEQ ID NO: 144911 - RNA, 19 nt, Homo sapiens
uagcuucucucauaaacug

SEQ ID NO: 144912 - RNA, 19 nt, Homo sapiens
gaaggaacaauucaucagu

SEQ ID NO: 144913 - RNA, 19 nt, Homo sapiens
caacagcuguccucgaaaa

SEQ ID NO: 144914 - RNA, 19 nt, Homo sapiens
agacuaaaggucaauauga

SEQ ID NO: 144915 - RNA, 19 nt, Homo sapiens
gaucacaugucgggcucua

SEQ ID NO: 144916 - RNA, 19 nt, Homo sapiens
agacaggauuuguuaagug

SEQ ID NO: 144917 - RNA, 19 nt, Homo sapiens
gaacaaucggugugagaug

SEQ ID NO: 144918 - RNA, 19 nt, Homo sapiens
aaaguugccugccguaugg

SEQ ID NO: 144919 - RNA, 19 nt, Homo sapiens
gaagaucaaccuguaaagu

SEQ ID NO: 144920 - RNA, 19 nt, Homo sapiens
uaauuggcuugcaguauau

SEQ ID NO: 144921 - RNA, 19 nt, Homo sapiens
gaaucgaucagccgccuuu

SEQ ID NO: 144922 - RNA, 19 nt, Homo sapiens
uccaacagcuguccucgaa

SEQ ID NO: 144923 - RNA, 19 nt, Homo sapiens
aauacaaacugauccuaga

SEQ ID NO: 144924 - RNA, 19 nt, Homo sapiens
ggagaaggacuaucaacuc

SEQ ID NO: 144925 - RNA, 19 nt, Homo sapiens
uaaugauaauccuccagua

SEQ ID NO: 144926 - RNA, 19 nt, Homo sapiens
aggacuagauguagagaaa

SEQ ID NO: 144927 - RNA, 19 nt, Homo sapiens
gaaguucagccacccucua

SEQ ID NO: 144928 - RNA, 19 nt, Homo sapiens
aaagcugccucaaauguca

SEQ ID NO: 144929 - RNA, 19 nt, Homo sapiens
gccaaacccugcagagaag

SEQ ID NO: 144930 - RNA, 19 nt, Homo sapiens
caagacauuuacugugcaa

SEQ ID NO: 144931 - RNA, 19 nt, Homo sapiens
ucaauaugaugaagaagag

SEQ ID NO: 144932 - RNA, 19 nt, Homo sapiens
gauguagagaaaccacuua

SEQ ID NO: 144933 - RNA, 19 nt, Homo sapiens
caagcuuccugaucacaug

SEQ ID NO: 144934 - RNA, 19 nt, Homo sapiens
gaaaaucaccuaccgaauc

SEQ ID NO: 144935 - RNA, 19 nt, Homo sapiens
ggagaaggccggaagcuua

SEQ ID NO: 144936 - RNA, 19 nt, Homo sapiens
cagagcagcuggagaaguu

SEQ ID NO: 144937 - RNA, 19 nt, Homo sapiens
ccauggaucuggugaagaa

SEQ ID NO: 144938 - RNA, 19 nt, Homo sapiens
gggcagagccacuaaacuu

SEQ ID NO: 144939 - RNA, 19 nt, Homo sapiens
gagagcugguggagaagaa

SEQ ID NO: 144940 - RNA, 19 nt, Homo sapiens
uccgagagcugguggagaa

SEQ ID NO: 144941 - RNA, 19 nt, Homo sapiens
gaagaacucccagcuagag

SEQ ID NO: 144942 - RNA, 19 nt, Homo sapiens
gcagagccacuaaacuugu

SEQ ID NO: 144943 - RNA, 19 nt, Homo sapiens
ggccauagacaacaaguuc

SEQ ID NO: 144944 - RNA, 19 nt, Homo sapiens
cagagccacuaaacuuguu

SEQ ID NO: 144945 - RNA, 19 nt, Homo sapiens
ucugauguaugcugugaga

SEQ ID NO: 144946 - RNA, 19 nt, Homo sapiens
ggcagagccacuaaacuug

SEQ ID NO: 144947 - RNA, 19 nt, Homo sapiens
gagaaggccggaagcuuac

SEQ ID NO: 144948 - RNA, 19 nt, Homo sapiens
ggccauggaucuggugaag

SEQ ID NO: 144949 - RNA, 19 nt, Homo sapiens
gaagcuuaccagccgagaa

SEQ ID NO: 144950 - RNA, 19 nt, Homo sapiens
auuccuagcuagcuucaga

SEQ ID NO: 144951 - RNA, 19 nt, Homo sapiens
ugagagaggagguggagau

SEQ ID NO: 144952 - RNA, 19 nt, Homo sapiens
ugauguaugcugugagaga

SEQ ID NO: 144953 - RNA, 19 nt, Homo sapiens
ccagcgugguggccauaga

SEQ ID NO: 144954 - RNA, 19 nt, Homo sapiens
uggaucuggugaagaauca

SEQ ID NO: 144955 - RNA, 19 nt, Homo sapiens
gggagaaggccggaagcuu

SEQ ID NO: 144956 - RNA, 19 nt, Homo sapiens
gagcuuaucugaagaaaua

SEQ ID NO: 144957 - RNA, 19 nt, Homo sapiens
ggaagaagcuggaggaaga

SEQ ID NO: 144958 - RNA, 19 nt, Homo sapiens
ggaaaugccuggaagauga

SEQ ID NO: 144959 - RNA, 19 nt, Homo sapiens
gaagacauguuaaagguuu

SEQ ID NO: 144960 - RNA, 19 nt, Homo sapiens
gagcaggcauccauuguua

SEQ ID NO: 144961 - RNA, 19 nt, Homo sapiens
ucaauaagcugaaacaaga

SEQ ID NO: 144962 - RNA, 19 nt, Homo sapiens
gcuaguagauucugguaua

SEQ ID NO: 144963 - RNA, 19 nt, Homo sapiens
gaaauuagagucugagaaa

SEQ ID NO: 144964 - RNA, 19 nt, Homo sapiens
gcaagaggcugcagauguu

SEQ ID NO: 144965 - RNA, 19 nt, Homo sapiens
ucaaggagcuggagaaaga

SEQ ID NO: 144966 - RNA, 19 nt, Homo sapiens
gcagauauaugcagcagaa

SEQ ID NO: 144967 - RNA, 19 nt, Homo sapiens
acagauggcuacuuaaaua

SEQ ID NO: 144968 - RNA, 19 nt, Homo sapiens
gaaugagucuccuuuaguu

SEQ ID NO: 144969 - RNA, 19 nt, Homo sapiens
gaggagagcguaagauaua

SEQ ID NO: 144970 - RNA, 19 nt, Homo sapiens
ggaagaaggugacagcaau

SEQ ID NO: 144971 - RNA, 19 nt, Homo sapiens
gaacuugcacagugaaaua

SEQ ID NO: 144972 - RNA, 19 nt, Homo sapiens
caacugaaaucacucauca

SEQ ID NO: 144973 - RNA, 19 nt, Homo sapiens
ugaaauaucuggcaaacga

SEQ ID NO: 144974 - RNA, 19 nt, Homo sapiens
gccaagaugucaaccauaa

SEQ ID NO: 144975 - RNA, 19 nt, Homo sapiens
guaaacaagucuaagaaga

SEQ ID NO: 144976 - RNA, 19 nt, Homo sapiens
caggaaacaucaucucuuu

SEQ ID NO: 144977 - RNA, 19 nt, Homo sapiens
gcaaccaucuuggaacuaa

SEQ ID NO: 144978 - RNA, 19 nt, Homo sapiens
gcaggaagauuacaugaag

SEQ ID NO: 144979 - RNA, 19 nt, Homo sapiens
ggaaccagcucuacaucaa

SEQ ID NO: 144980 - RNA, 19 nt, Homo sapiens
cgacaugaaucaguaagua

SEQ ID NO: 144981 - RNA, 19 nt, Homo sapiens
gaaaccagcuugauagacu

SEQ ID NO: 144982 - RNA, 19 nt, Homo sapiens
gaagacagaacuacagaaa

SEQ ID NO: 144983 - RNA, 19 nt, Homo sapiens
cuucuuagcucaucuuaaa

SEQ ID NO: 144984 - RNA, 19 nt, Homo sapiens
ggaggaagccuacaagaga

SEQ ID NO: 144985 - RNA, 19 nt, Homo sapiens
ucacugagcuaguagauuc

SEQ ID NO: 144986 - RNA, 19 nt, Homo sapiens
ggagaaagaacgagagaaa

SEQ ID NO: 144987 - RNA, 19 nt, Homo sapiens
ucaaccagcuuaaagauau

SEQ ID NO: 144988 - RNA, 19 nt, Homo sapiens
gcagagaucaagagaauug

SEQ ID NO: 144989 - RNA, 19 nt, Homo sapiens
gaucagaaccugcagaaau

SEQ ID NO: 144990 - RNA, 19 nt, Homo sapiens
gcauccagcuucagacaaa

SEQ ID NO: 144991 - RNA, 19 nt, Homo sapiens
aaagaaagaugcauuaagg

SEQ ID NO: 144992 - RNA, 19 nt, Homo sapiens
gguauucgcuuauuagaag

SEQ ID NO: 144993 - RNA, 19 nt, Homo sapiens
gaagauagaaucggaaaga

SEQ ID NO: 144994 - RNA, 19 nt, Homo sapiens
caagaugucaaccauaaua

SEQ ID NO: 144995 - RNA, 19 nt, Homo sapiens
guacuuguuugguuuggua

SEQ ID NO: 144996 - RNA, 19 nt, Homo sapiens
aaagaugcauuaaggauga

SEQ ID NO: 144997 - RNA, 19 nt, Homo sapiens
ccacgguauucgcuuauua

SEQ ID NO: 144998 - RNA, 19 nt, Homo sapiens
aacagaagcuuggcauuua

SEQ ID NO: 144999 - RNA, 19 nt, Homo sapiens
ggagacacagucacaguua

SEQ ID NO: 145000 - RNA, 19 nt, Homo sapiens
gaaauaaagaggcugaaga

SEQ ID NO: 145001 - RNA, 19 nt, Homo sapiens
ugaaaucacucaucaugga

SEQ ID NO: 145002 - RNA, 19 nt, Homo sapiens
ggucaaaguuuucuguuua

SEQ ID NO: 145003 - RNA, 19 nt, Homo sapiens
gcacaaaucgaacuuagga

SEQ ID NO: 145004 - RNA, 19 nt, Homo sapiens
ggaaguucuuugaucagua

SEQ ID NO: 145005 - RNA, 19 nt, Homo sapiens
gaggagaucauuagcuuaa

SEQ ID NO: 145006 - RNA, 19 nt, Homo sapiens
guaagaaaccacuauaaug

SEQ ID NO: 145007 - RNA, 19 nt, Homo sapiens
gagaagaucacccgacuga

SEQ ID NO: 145008 - RNA, 19 nt, Homo sapiens
uacaagaucuggagacuau

SEQ ID NO: 145009 - RNA, 19 nt, Homo sapiens
caagaguucaucagaaaua

SEQ ID NO: 145010 - RNA, 19 nt, Homo sapiens
gagagaaaauccuugaaua

SEQ ID NO: 145011 - RNA, 19 nt, Homo sapiens
gaacuuaggauuuguuucu

SEQ ID NO: 145012 - RNA, 19 nt, Homo sapiens
ugaggaggcucucuucuga

SEQ ID NO: 145013 - RNA, 19 nt, Homo sapiens
gaagaaggcacccggaaga

SEQ ID NO: 145014 - RNA, 19 nt, Homo sapiens
gugagaugcugaagaguuu

SEQ ID NO: 145015 - RNA, 19 nt, Homo sapiens
acagaucgacuuuagauua

SEQ ID NO: 145016 - RNA, 19 nt, Homo sapiens
gcacagaggcugcaagaca

SEQ ID NO: 145017 - RNA, 19 nt, Homo sapiens
ggaagugcaugggaggaua

SEQ ID NO: 145018 - RNA, 19 nt, Homo sapiens
ggagauugauaaacucaga

SEQ ID NO: 145019 - RNA, 19 nt, Homo sapiens
cagagaaccugaccaagga

SEQ ID NO: 145020 - RNA, 19 nt, Homo sapiens
gaagacauccaacagcaaa

SEQ ID NO: 145021 - RNA, 19 nt, Homo sapiens
gaggagaugaguaauuuaa

SEQ ID NO: 145022 - RNA, 19 nt, Homo sapiens
uggauaaaguggaagcuua

SEQ ID NO: 145023 - RNA, 19 nt, Homo sapiens
guacugcuauuuacagaau

SEQ ID NO: 145024 - RNA, 19 nt, Homo sapiens
aaacauggaugcugaugga

SEQ ID NO: 145025 - RNA, 19 nt, Homo sapiens
gauagccgaccuugaguua

SEQ ID NO: 145026 - RNA, 19 nt, Homo sapiens
ggaguuggauucuucagau

SEQ ID NO: 145027 - RNA, 19 nt, Homo sapiens
caaaugcgagcccuuuaua

SEQ ID NO: 145028 - RNA, 19 nt, Homo sapiens
ggaaacaucaucucuuugu

SEQ ID NO: 145029 - RNA, 19 nt, Homo sapiens
aaacagaacgcucccgaua

SEQ ID NO: 145030 - RNA, 19 nt, Homo sapiens
gagauuaacauuacgaaga

SEQ ID NO: 145031 - RNA, 19 nt, Homo sapiens
gaaguauggagauggaaua

SEQ ID NO: 145032 - RNA, 19 nt, Homo sapiens
cgucaggaauuuaaccaua

SEQ ID NO: 145033 - RNA, 19 nt, Homo sapiens
caaaggagagccaucguuu

SEQ ID NO: 145034 - RNA, 19 nt, Homo sapiens
ggagugagaucgaaagacu

SEQ ID NO: 145035 - RNA, 19 nt, Homo sapiens
gagagagccuucuggugaa

SEQ ID NO: 145036 - RNA, 19 nt, Homo sapiens
gauauaagcaaucucuuga

SEQ ID NO: 145037 - RNA, 19 nt, Homo sapiens
ggagauggaauacaacuga

SEQ ID NO: 145038 - RNA, 19 nt, Homo sapiens
cuuaugagauugaagauga

SEQ ID NO: 145039 - RNA, 19 nt, Homo sapiens
caagaucuggagacuauua

SEQ ID NO: 145040 - RNA, 19 nt, Homo sapiens
ucacagcaguauccacuuu

SEQ ID NO: 145041 - RNA, 19 nt, Homo sapiens
gaccgucacugagcuagua

SEQ ID NO: 145042 - RNA, 19 nt, Homo sapiens
ccuccaagcugguguuuga

SEQ ID NO: 145043 - RNA, 19 nt, Homo sapiens
aagcagagaucaagagaau

SEQ ID NO: 145044 - RNA, 19 nt, Homo sapiens
gauagaaucggaaagagaa

SEQ ID NO: 145045 - RNA, 19 nt, Homo sapiens
agaaggcgauagaagauaa

SEQ ID NO: 145046 - RNA, 19 nt, Homo sapiens
guagaguggucauaguuga

SEQ ID NO: 145047 - RNA, 19 nt, Homo sapiens
agcagaagcuuaaaugaaa

SEQ ID NO: 145048 - RNA, 19 nt, Homo sapiens
ucagaagacuccugcaaga

SEQ ID NO: 145049 - RNA, 19 nt, Homo sapiens
caacugaucgacaaagaaa

SEQ ID NO: 145050 - RNA, 19 nt, Homo sapiens
uaagugagaugcugaagag

SEQ ID NO: 145051 - RNA, 19 nt, Homo sapiens
ggaccuggauaaaguggaa

SEQ ID NO: 145052 - RNA, 19 nt, Homo sapiens
caacaucgcucagaaacag

SEQ ID NO: 145053 - RNA, 19 nt, Homo sapiens
gggaugaguucaccaaaca

SEQ ID NO: 145054 - RNA, 19 nt, Homo sapiens
uaaguaagauuuccaccau

SEQ ID NO: 145055 - RNA, 19 nt, Homo sapiens
gaaugugaaugggaagaaa

SEQ ID NO: 145056 - RNA, 19 nt, Homo sapiens
gaacaccgcuuauuucuau

SEQ ID NO: 145057 - RNA, 19 nt, Homo sapiens
uagaagaccuggauaauuu

SEQ ID NO: 145058 - RNA, 19 nt, Homo sapiens
gaaaugaacacuuuaggua

SEQ ID NO: 145059 - RNA, 19 nt, Homo sapiens
gaagauacguucugcaaug

SEQ ID NO: 145060 - RNA, 19 nt, Homo sapiens
ggaaagggauaaagcaaga

SEQ ID NO: 145061 - RNA, 19 nt, Homo sapiens
caaagaacaccgcuuauuu

SEQ ID NO: 145062 - RNA, 19 nt, Homo sapiens
uaaggcagcucccagaauu

SEQ ID NO: 145063 - RNA, 19 nt, Homo sapiens
acacacaaaugaagacuuu

SEQ ID NO: 145064 - RNA, 19 nt, Homo sapiens
gaaaacaccagaugaguua

SEQ ID NO: 145065 - RNA, 19 nt, Homo sapiens
ugaaauagccacaguaaug

SEQ ID NO: 145066 - RNA, 19 nt, Homo sapiens
gaucauguaucacuugcaa

SEQ ID NO: 145067 - RNA, 19 nt, Homo sapiens
ccagaugaguuaggaauaa

SEQ ID NO: 145068 - RNA, 19 nt, Homo sapiens
gcauuacgauggcuacuau

SEQ ID NO: 145069 - RNA, 19 nt, Homo sapiens
ucacacauguucuuauaga

SEQ ID NO: 145070 - RNA, 19 nt, Homo sapiens
gagauuguguucugagaga

SEQ ID NO: 145071 - RNA, 19 nt, Homo sapiens
aaacucagcaugauacuuu

SEQ ID NO: 145072 - RNA, 19 nt, Homo sapiens
caagaagcauuuaaagaca

SEQ ID NO: 145073 - RNA, 19 nt, Homo sapiens
gauaaagcaagaagcauuu

SEQ ID NO: 145074 - RNA, 19 nt, Homo sapiens
gcaagaagcauuuaaagac

SEQ ID NO: 145075 - RNA, 19 nt, Homo sapiens
caauagacuuggaaggaaa

SEQ ID NO: 145076 - RNA, 19 nt, Homo sapiens
caucaacuaugacucagaa

SEQ ID NO: 145077 - RNA, 19 nt, Homo sapiens
gauggaaacccuauuaauc

SEQ ID NO: 145078 - RNA, 19 nt, Homo sapiens
guacugugaugaccaugaa

SEQ ID NO: 145079 - RNA, 19 nt, Homo sapiens
ggauaaagcaagaagcauu

SEQ ID NO: 145080 - RNA, 19 nt, Homo sapiens
uagaguccaucaacuauga

SEQ ID NO: 145081 - RNA, 19 nt, Homo sapiens
gaacagagagcuccucacu

SEQ ID NO: 145082 - RNA, 19 nt, Homo sapiens
gacauuagcaggacuuguu

SEQ ID NO: 145083 - RNA, 19 nt, Homo sapiens
caugauacuuugagauugu

SEQ ID NO: 145084 - RNA, 19 nt, Homo sapiens
gcaugauacuuugagauug

SEQ ID NO: 145085 - RNA, 19 nt, Homo sapiens
ccaaagaacaccgcuuauu

SEQ ID NO: 145086 - RNA, 19 nt, Homo sapiens
uacgauggcuacuauaaau

SEQ ID NO: 145087 - RNA, 19 nt, Homo sapiens
gacauucgauuggauggaa

SEQ ID NO: 145088 - RNA, 19 nt, Homo sapiens
gcccuucaccuccagaaua

SEQ ID NO: 145089 - RNA, 19 nt, Homo sapiens
gaaggaaagggauaaagca

SEQ ID NO: 145090 - RNA, 19 nt, Homo sapiens
ggucagagccaaaggaaag

SEQ ID NO: 145091 - RNA, 19 nt, Homo sapiens
cgauggcuacuauaaauaa

SEQ ID NO: 145092 - RNA, 19 nt, Homo sapiens
aaagaacaccgcuuauuuc

SEQ ID NO: 145093 - RNA, 19 nt, Homo sapiens
cagaugaguuaggaauaaa

SEQ ID NO: 145094 - RNA, 19 nt, Homo sapiens
guaccucacugauaacaac

SEQ ID NO: 145095 - RNA, 19 nt, Homo sapiens
acaauagacuuggaaggaa

SEQ ID NO: 145096 - RNA, 19 nt, Homo sapiens
caucuguaccucacugaua

SEQ ID NO: 145097 - RNA, 19 nt, Homo sapiens
ggauggaaacccuauuaau

SEQ ID NO: 145098 - RNA, 19 nt, Homo sapiens
ugggagccuugucuaauuu

SEQ ID NO: 145099 - RNA, 19 nt, Homo sapiens
guaaggcacuagaggacau

SEQ ID NO: 145100 - RNA, 19 nt, Homo sapiens
ccaugaacuugaugcuauu

SEQ ID NO: 145101 - RNA, 19 nt, Homo sapiens
ugucuuugguguacuugua

SEQ ID NO: 145102 - RNA, 19 nt, Homo sapiens
cacauguucuuauagauca

SEQ ID NO: 145103 - RNA, 19 nt, Homo sapiens
cccuucaccuccagaauaa

SEQ ID NO: 145104 - RNA, 19 nt, Homo sapiens
gaagaugcauuccgaaaac

SEQ ID NO: 145105 - RNA, 19 nt, Homo sapiens
caaccugucuuugguguac

SEQ ID NO: 145106 - RNA, 19 nt, Homo sapiens
gaaauagccacaguaaugc

SEQ ID NO: 145107 - RNA, 19 nt, Homo sapiens
aaccuaugaugccaccuua

SEQ ID NO: 145108 - RNA, 19 nt, Homo sapiens
agacauguaugaucuccau

SEQ ID NO: 145109 - RNA, 19 nt, Homo sapiens
ucacuaaggcauguuuauu

SEQ ID NO: 145110 - RNA, 19 nt, Homo sapiens
gagcaaaacuaagugauag

SEQ ID NO: 145111 - RNA, 19 nt, Homo sapiens
accaugaacuugaugcuau

SEQ ID NO: 145112 - RNA, 19 nt, Homo sapiens
gugaugaccaugaacuuga

SEQ ID NO: 145113 - RNA, 19 nt, Homo sapiens
uugggagccuugucuaauu

SEQ ID NO: 145114 - RNA, 19 nt, Homo sapiens
gaagacauuagcaggacuu

SEQ ID NO: 145115 - RNA, 19 nt, Homo sapiens
gcaagccuaagugauuuaa

SEQ ID NO: 145116 - RNA, 19 nt, Homo sapiens
ugccaaagaacaccgcuua

SEQ ID NO: 145117 - RNA, 19 nt, Homo sapiens
guauaaguaccaccgugua

SEQ ID NO: 145118 - RNA, 19 nt, Homo sapiens
uugccaagauuuagauguu

SEQ ID NO: 145119 - RNA, 19 nt, Homo sapiens
ucugagagaugauaugacu

SEQ ID NO: 145120 - RNA, 19 nt, Homo sapiens
ggaaacccuauuaaucuca

SEQ ID NO: 145121 - RNA, 19 nt, Homo sapiens
ggaaggaaagggauaaagc

SEQ ID NO: 145122 - RNA, 19 nt, Homo sapiens
uagcaacaauagacuugga

SEQ ID NO: 145123 - RNA, 19 nt, Homo sapiens
ugagauugaugaagaugca

SEQ ID NO: 145124 - RNA, 19 nt, Homo sapiens
uuagaagaccuggauaauu

SEQ ID NO: 145125 - RNA, 19 nt, Homo sapiens
uuauuucuauucccgcuuu

SEQ ID NO: 145126 - RNA, 19 nt, Homo sapiens
ucagucacuuugugccauu

SEQ ID NO: 145127 - RNA, 19 nt, Homo sapiens
aaacaaaacucagcaugau

SEQ ID NO: 145128 - RNA, 19 nt, Homo sapiens
ggaaaugcacgaagauacg

SEQ ID NO: 145129 - RNA, 19 nt, Homo sapiens
uugcaagccuaagugauuu

SEQ ID NO: 145130 - RNA, 19 nt, Homo sapiens
gaagaccuggauaauuugu

SEQ ID NO: 145131 - RNA, 19 nt, Homo sapiens
ccucacugauaacaacuug

SEQ ID NO: 145132 - RNA, 19 nt, Homo sapiens
agaagcauuuaaagacaug

SEQ ID NO: 145133 - RNA, 19 nt, Homo sapiens
gaccaugaacuugaugcua

SEQ ID NO: 145134 - RNA, 19 nt, Homo sapiens
ggacuuguucugggacuug

SEQ ID NO: 145135 - RNA, 19 nt, Homo sapiens
gauugaaauagccacagua

SEQ ID NO: 145136 - RNA, 19 nt, Homo sapiens
uuacugcucucuuccaaaa

SEQ ID NO: 145137 - RNA, 19 nt, Homo sapiens
ggagccuugucuaauuuca

SEQ ID NO: 145138 - RNA, 19 nt, Homo sapiens
uagaggacauucgauugga

SEQ ID NO: 145139 - RNA, 19 nt, Homo sapiens
gccaaaggaaagcuugaaa

SEQ ID NO: 145140 - RNA, 19 nt, Homo sapiens
uuacgauggcuacuauaaa

SEQ ID NO: 145141 - RNA, 19 nt, Homo sapiens
ucugggacuugucaucuug

SEQ ID NO: 145142 - RNA, 19 nt, Homo sapiens
ucacugauaacaacuugga

SEQ ID NO: 145143 - RNA, 19 nt, Homo sapiens
gaaagggauaaagcaagaa

SEQ ID NO: 145144 - RNA, 19 nt, Homo sapiens
gcugauugauggcucuucu

SEQ ID NO: 145145 - RNA, 19 nt, Homo sapiens
gaagaggaggaggaaucua

SEQ ID NO: 145146 - RNA, 19 nt, Homo sapiens
cacuaaggcauguuuauuc

SEQ ID NO: 145147 - RNA, 19 nt, Homo sapiens
guucugagagaugauauga

SEQ ID NO: 145148 - RNA, 19 nt, Homo sapiens
ccuccagaauaacaacauu

SEQ ID NO: 145149 - RNA, 19 nt, Homo sapiens
ggaagaggaggaggaaucu

SEQ ID NO: 145150 - RNA, 19 nt, Homo sapiens
ccuaugaugccaccuuaga

SEQ ID NO: 145151 - RNA, 19 nt, Homo sapiens
cauccucagucacuuugug

SEQ ID NO: 145152 - RNA, 19 nt, Homo sapiens
gaaggcccaggaagaggaa

SEQ ID NO: 145153 - RNA, 19 nt, Homo sapiens
guaaugccuucagggaaca

SEQ ID NO: 145154 - RNA, 19 nt, Homo sapiens
cauaccuguugauaaaguu

SEQ ID NO: 145155 - RNA, 19 nt, Homo sapiens
ugccaagauuuagauguuu

SEQ ID NO: 145156 - RNA, 19 nt, Homo sapiens
gaaagaagaugaucaugau

SEQ ID NO: 145157 - RNA, 19 nt, Homo sapiens
guacaugccuguuaauauu

SEQ ID NO: 145158 - RNA, 19 nt, Homo sapiens
ggaaucaaaucaaacaguu

SEQ ID NO: 145159 - RNA, 19 nt, Homo sapiens
gcaaggagaugaucccaau

SEQ ID NO: 145160 - RNA, 19 nt, Homo sapiens
gaggagaugcuucuuauaa

SEQ ID NO: 145161 - RNA, 19 nt, Homo sapiens
gcacaucagacacuaauaa

SEQ ID NO: 145162 - RNA, 19 nt, Homo sapiens
ggaaagaagaugaucauga

SEQ ID NO: 145163 - RNA, 19 nt, Homo sapiens
gaaauaacaccucagauca

SEQ ID NO: 145164 - RNA, 19 nt, Homo sapiens
ggacacagcaauacaggua

SEQ ID NO: 145165 - RNA, 19 nt, Homo sapiens
ggagaauucugcugguauu

SEQ ID NO: 145166 - RNA, 19 nt, Homo sapiens
ucaaguagcuggaagcaau

SEQ ID NO: 145167 - RNA, 19 nt, Homo sapiens
gaucaaaugugucaguaca

SEQ ID NO: 145168 - RNA, 19 nt, Homo sapiens
gcaaaccacuggagagaca

SEQ ID NO: 145169 - RNA, 19 nt, Homo sapiens
ggaaugaucuugggcaaag

SEQ ID NO: 145170 - RNA, 19 nt, Homo sapiens
caacgaagguaaagaggau

SEQ ID NO: 145171 - RNA, 19 nt, Homo sapiens
gagccaagauaagggaaua

SEQ ID NO: 145172 - RNA, 19 nt, Homo sapiens
uaaggaagcugagguaaca

SEQ ID NO: 145173 - RNA, 19 nt, Homo sapiens
gaagauggaccucaaguag

SEQ ID NO: 145174 - RNA, 19 nt, Homo sapiens
gcaaugaugaugcuaauuc

SEQ ID NO: 145175 - RNA, 19 nt, Homo sapiens
ucaaacaguuggauucaga

SEQ ID NO: 145176 - RNA, 19 nt, Homo sapiens
gauagugacagcagugaua

SEQ ID NO: 145177 - RNA, 19 nt, Homo sapiens
gauagugacagcagugaua

SEQ ID NO: 145178 - RNA, 19 nt, Homo sapiens
ggaaaagacaguaguaaua

SEQ ID NO: 145179 - RNA, 19 nt, Homo sapiens
ggaugucgcuguuguccaa

SEQ ID NO: 145180 - RNA, 19 nt, Homo sapiens
gcagugauagugacaguaa

SEQ ID NO: 145181 - RNA, 19 nt, Homo sapiens
gaaaggcaacgaagguaaa

SEQ ID NO: 145182 - RNA, 19 nt, Homo sapiens
caagauaagggaauagaaa

SEQ ID NO: 145183 - RNA, 19 nt, Homo sapiens
gaagugacagugacaguga

SEQ ID NO: 145184 - RNA, 19 nt, Homo sapiens
gauaguagcauaggucaaa

SEQ ID NO: 145185 - RNA, 19 nt, Homo sapiens
ccaagaagauggaccucaa

SEQ ID NO: 145186 - RNA, 19 nt, Homo sapiens
gaauagaggacacccagaa

SEQ ID NO: 145187 - RNA, 19 nt, Homo sapiens
guacagacaaugaggauga

SEQ ID NO: 145188 - RNA, 19 nt, Homo sapiens
ggacaaguaagcaucauug

SEQ ID NO: 145189 - RNA, 19 nt, Homo sapiens
gcagaaacauauggucaug

SEQ ID NO: 145190 - RNA, 19 nt, Homo sapiens
gcaagagaauacccaagau

SEQ ID NO: 145191 - RNA, 19 nt, Homo sapiens
ggauaugacaguuaugauu

SEQ ID NO: 145192 - RNA, 19 nt, Homo sapiens
uaaagaggauaaaggacaa

SEQ ID NO: 145193 - RNA, 19 nt, Homo sapiens
ggaaaggcaacgaagguaa

SEQ ID NO: 145194 - RNA, 19 nt, Homo sapiens
gaggagaauucugcuggua

SEQ ID NO: 145195 - RNA, 19 nt, Homo sapiens
gaagcaacacuaauggaaa

SEQ ID NO: 145196 - RNA, 19 nt, Homo sapiens
agaagugacaguaguaaua

SEQ ID NO: 145197 - RNA, 19 nt, Homo sapiens
caacagcagugauaguagu

SEQ ID NO: 145198 - RNA, 19 nt, Homo sapiens
caucagacacuaauaauag

SEQ ID NO: 145199 - RNA, 19 nt, Homo sapiens
gaauuugcaucuccuagca

SEQ ID NO: 145200 - RNA, 19 nt, Homo sapiens
gaagaugaugacagugaua

SEQ ID NO: 145201 - RNA, 19 nt, Homo sapiens
gauaaaggacaacauggaa

SEQ ID NO: 145202 - RNA, 19 nt, Homo sapiens
gaaagcaaacgcguagaaa

SEQ ID NO: 145203 - RNA, 19 nt, Homo sapiens
caaguaagcaucauugaca

SEQ ID NO: 145204 - RNA, 19 nt, Homo sapiens
cagcacaucugacagcaau

SEQ ID NO: 145205 - RNA, 19 nt, Homo sapiens
caacagcagugacaguagu

SEQ ID NO: 145206 - RNA, 19 nt, Homo sapiens
ggagaugcuucuuauaacu

SEQ ID NO: 145207 - RNA, 19 nt, Homo sapiens
uaacagcagugauaguagu

SEQ ID NO: 145208 - RNA, 19 nt, Homo sapiens
gauagcacaucagacacua

SEQ ID NO: 145209 - RNA, 19 nt, Homo sapiens
caauagcagugaugaaucu

SEQ ID NO: 145210 - RNA, 19 nt, Homo sapiens
caaagaagauccccauaau

SEQ ID NO: 145211 - RNA, 19 nt, Homo sapiens
gaaacgaggguaauacaag

SEQ ID NO: 145212 - RNA, 19 nt, Homo sapiens
gcaauaacaguacagacaa

SEQ ID NO: 145213 - RNA, 19 nt, Homo sapiens
agugauagcaguaauagua

SEQ ID NO: 145214 - RNA, 19 nt, Homo sapiens
agugaaagcaguaauagua

SEQ ID NO: 145215 - RNA, 19 nt, Homo sapiens
caauagaagugacaguagu

SEQ ID NO: 145216 - RNA, 19 nt, Homo sapiens
ggaaugaugacaaugacaa

SEQ ID NO: 145217 - RNA, 19 nt, Homo sapiens
ccgaggagaugcuucuuau

SEQ ID NO: 145218 - RNA, 19 nt, Homo sapiens
gaaccaggaaauaaaguug

SEQ ID NO: 145219 - RNA, 19 nt, Homo sapiens
gaagaugaucaugauagua

SEQ ID NO: 145220 - RNA, 19 nt, Homo sapiens
gaagaagcagggaauggaa

SEQ ID NO: 145221 - RNA, 19 nt, Homo sapiens
gaauggagcagaugaggau

SEQ ID NO: 145222 - RNA, 19 nt, Homo sapiens
agacaaugaggaugaaaua

SEQ ID NO: 145223 - RNA, 19 nt, Homo sapiens
gaaguaggagggaagaguu

SEQ ID NO: 145224 - RNA, 19 nt, Homo sapiens
ccaagaaaguaaagaaagg

SEQ ID NO: 145225 - RNA, 19 nt, Homo sapiens
gcaagucugguaacgguaa

SEQ ID NO: 145226 - RNA, 19 nt, Homo sapiens
cccagaagcucaaccauag

SEQ ID NO: 145227 - RNA, 19 nt, Homo sapiens
gagcagaugaggaugaaga

SEQ ID NO: 145228 - RNA, 19 nt, Homo sapiens
gagaauuccuguagaaacg

SEQ ID NO: 145229 - RNA, 19 nt, Homo sapiens
gcacaucugacagcaauga

SEQ ID NO: 145230 - RNA, 19 nt, Homo sapiens
gcagugacagcacaucuga

SEQ ID NO: 145231 - RNA, 19 nt, Homo sapiens
cgacagcagugacagcaau

SEQ ID NO: 145232 - RNA, 19 nt, Homo sapiens
gauagcgacagcagcaaua

SEQ ID NO: 145233 - RNA, 19 nt, Homo sapiens
gauagcgacagcagcaaua

SEQ ID NO: 145234 - RNA, 19 nt, Homo sapiens
gacagugacagcagugaua

SEQ ID NO: 145235 - RNA, 19 nt, Homo sapiens
gacagugacagcagugaua

SEQ ID NO: 145236 - RNA, 19 nt, Homo sapiens
gcaauggcagugacucaaa

SEQ ID NO: 145237 - RNA, 19 nt, Homo sapiens
cagcaauagugauggauau

SEQ ID NO: 145238 - RNA, 19 nt, Homo sapiens
gaagaugcuggccuggaua

SEQ ID NO: 145239 - RNA, 19 nt, Homo sapiens
gcuggaagcaauaacagua

SEQ ID NO: 145240 - RNA, 19 nt, Homo sapiens
aaaguuugguaaugggaua

SEQ ID NO: 145241 - RNA, 19 nt, Homo sapiens
ugacagcaaugaugagagu

SEQ ID NO: 145242 - RNA, 19 nt, Homo sapiens
ugacagcagugauagcaau

SEQ ID NO: 145243 - RNA, 19 nt, Homo sapiens
caaugaugaugcuaauuca

SEQ ID NO: 145244 - RNA, 19 nt, Homo sapiens
gauaagggaauagaaauca

SEQ ID NO: 145245 - RNA, 19 nt, Homo sapiens
gagaagggaauggcucuaa

SEQ ID NO: 145246 - RNA, 19 nt, Homo sapiens
gaagugacaguaguaauag

SEQ ID NO: 145247 - RNA, 19 nt, Homo sapiens
gcaauagugauggauauga

SEQ ID NO: 145248 - RNA, 19 nt, Homo sapiens
ggauaaaggacaacaugga

SEQ ID NO: 145249 - RNA, 19 nt, Homo sapiens
ugaaauaacaccucagauc

SEQ ID NO: 145250 - RNA, 19 nt, Homo sapiens
caauaacaguacagacaau

SEQ ID NO: 145251 - RNA, 19 nt, Homo sapiens
cuagcaagaucaaaugugu

SEQ ID NO: 145252 - RNA, 19 nt, Homo sapiens
gaauacaugggaaagaaga

SEQ ID NO: 145253 - RNA, 19 nt, Homo sapiens
agaaacauauggucaugau

SEQ ID NO: 145254 - RNA, 19 nt, Homo sapiens
gauaguagugacagcagua

SEQ ID NO: 145255 - RNA, 19 nt, Homo sapiens
gagagcgacagcagugaua

SEQ ID NO: 145256 - RNA, 19 nt, Homo sapiens
gaaauaggccuacuuguug

SEQ ID NO: 145257 - RNA, 19 nt, Homo sapiens
acaguuaucugguuuguua

SEQ ID NO: 145258 - RNA, 19 nt, Homo sapiens
gaaaucagauacaaacuuc

SEQ ID NO: 145259 - RNA, 19 nt, Homo sapiens
guauugaacuguacuguaa

SEQ ID NO: 145260 - RNA, 19 nt, Homo sapiens
gaagguagauagaagaaug

SEQ ID NO: 145261 - RNA, 19 nt, Homo sapiens
acaagaaccuucagacuaa

SEQ ID NO: 145262 - RNA, 19 nt, Homo sapiens
ccaaagaacucaaugaaca

SEQ ID NO: 145263 - RNA, 19 nt, Homo sapiens
gaaagaaguucgcagagau

SEQ ID NO: 145264 - RNA, 19 nt, Homo sapiens
ccagaaaugucuucagaaa

SEQ ID NO: 145265 - RNA, 19 nt, Homo sapiens
gaaaguaaagagcaacaua

SEQ ID NO: 145266 - RNA, 19 nt, Homo sapiens
gcaaagacauugguuaaag

SEQ ID NO: 145267 - RNA, 19 nt, Homo sapiens
ggaguacugugccuuauga

SEQ ID NO: 145268 - RNA, 19 nt, Homo sapiens
ccaaguggcuagauauuau

SEQ ID NO: 145269 - RNA, 19 nt, Homo sapiens
ggauacaugucuucagaaa

SEQ ID NO: 145270 - RNA, 19 nt, Homo sapiens
uaauaaagguggcuuggaa

SEQ ID NO: 145271 - RNA, 19 nt, Homo sapiens
guacugacuucaagcaauu

SEQ ID NO: 145272 - RNA, 19 nt, Homo sapiens
gaagaaggcagcaaagaga

SEQ ID NO: 145273 - RNA, 19 nt, Homo sapiens
caagaaacaugguuacaca

SEQ ID NO: 145274 - RNA, 19 nt, Homo sapiens
ccauagugcuccuuccuua

SEQ ID NO: 145275 - RNA, 19 nt, Homo sapiens
caaagacauugguuaaaga

SEQ ID NO: 145276 - RNA, 19 nt, Homo sapiens
gaaaugucuucagaaagua

SEQ ID NO: 145277 - RNA, 19 nt, Homo sapiens
aguaauagcuccuuuguuc

SEQ ID NO: 145278 - RNA, 19 nt, Homo sapiens
caagagaaaucagauacaa

SEQ ID NO: 145279 - RNA, 19 nt, Homo sapiens
ucaagaggcuucuggauca

SEQ ID NO: 145280 - RNA, 19 nt, Homo sapiens
agaaaugucuucagaaagu

SEQ ID NO: 145281 - RNA, 19 nt, Homo sapiens
ggaaugcaauaaguaugua

SEQ ID NO: 145282 - RNA, 19 nt, Homo sapiens
gcuguagacuucuuuaugu

SEQ ID NO: 145283 - RNA, 19 nt, Homo sapiens
gaaguugggauuuacauug

SEQ ID NO: 145284 - RNA, 19 nt, Homo sapiens
gcggugaaguugggauuua

SEQ ID NO: 145285 - RNA, 19 nt, Homo sapiens
gauaugaaguauucuugga

SEQ ID NO: 145286 - RNA, 19 nt, Homo sapiens
gaucuuaucaccagccuuu

SEQ ID NO: 145287 - RNA, 19 nt, Homo sapiens
ugaaggaaaugacaguuau

SEQ ID NO: 145288 - RNA, 19 nt, Homo sapiens
caacggagaauauugcaaa

SEQ ID NO: 145289 - RNA, 19 nt, Homo sapiens
ugaaauaggccuacuuguu

SEQ ID NO: 145290 - RNA, 19 nt, Homo sapiens
agacucagcugaaggaaau

SEQ ID NO: 145291 - RNA, 19 nt, Homo sapiens
gaucacaaagucauaacua

SEQ ID NO: 145292 - RNA, 19 nt, Homo sapiens
uaucaucccuuccuucuuc

SEQ ID NO: 145293 - RNA, 19 nt, Homo sapiens
guaccagaauggaaccuaa

SEQ ID NO: 145294 - RNA, 19 nt, Homo sapiens
gcgaugggcuucuuucaag

SEQ ID NO: 145295 - RNA, 19 nt, Homo sapiens
ccaagaaccugucuauggu

SEQ ID NO: 145296 - RNA, 19 nt, Homo sapiens
uaucauaggauccuuauug

SEQ ID NO: 145297 - RNA, 19 nt, Homo sapiens
caaagggaaucaaguacug

SEQ ID NO: 145298 - RNA, 19 nt, Homo sapiens
gauauuauuccuccuuuga

SEQ ID NO: 145299 - RNA, 19 nt, Homo sapiens
gaaaugucagugcaacuuu

SEQ ID NO: 145300 - RNA, 19 nt, Homo sapiens
guacugugccuuaugauug

SEQ ID NO: 145301 - RNA, 19 nt, Homo sapiens
caaugcagaccuuaucaua

SEQ ID NO: 145302 - RNA, 19 nt, Homo sapiens
agacagguuuguucuugua

SEQ ID NO: 145303 - RNA, 19 nt, Homo sapiens
gagaugaagcggugaaguu

SEQ ID NO: 145304 - RNA, 19 nt, Homo sapiens
ccaucuaucuccagaaaug

SEQ ID NO: 145305 - RNA, 19 nt, Homo sapiens
auacaugucuucagaaaca

SEQ ID NO: 145306 - RNA, 19 nt, Homo sapiens
ggugugggcucacucauca

SEQ ID NO: 145307 - RNA, 19 nt, Homo sapiens
cuuuauagcuggaguuuau

SEQ ID NO: 145308 - RNA, 19 nt, Homo sapiens
gggagcacauuauuaaauc

SEQ ID NO: 145309 - RNA, 19 nt, Homo sapiens
gaagaaugucuagccaaua

SEQ ID NO: 145310 - RNA, 19 nt, Homo sapiens
ugaaagaaguucgcagaga

SEQ ID NO: 145311 - RNA, 19 nt, Homo sapiens
gcagggauccacacacuga

SEQ ID NO: 145312 - RNA, 19 nt, Homo sapiens
uggcagcacuguaaccuuu

SEQ ID NO: 145313 - RNA, 19 nt, Homo sapiens
ggagagagggaaagaaugu

SEQ ID NO: 145314 - RNA, 19 nt, Homo sapiens
cuuaauuacucuccuguuu

SEQ ID NO: 145315 - RNA, 19 nt, Homo sapiens
gcaaagagaaagaucaaag

SEQ ID NO: 145316 - RNA, 19 nt, Homo sapiens
ucacuauucuuacaucuca

SEQ ID NO: 145317 - RNA, 19 nt, Homo sapiens
uaacagcccugguucuuuu

SEQ ID NO: 145318 - RNA, 19 nt, Homo sapiens
gacauugguuaaagaauca

SEQ ID NO: 145319 - RNA, 19 nt, Homo sapiens
aaacaugguuacacaguca

SEQ ID NO: 145320 - RNA, 19 nt, Homo sapiens
uugcagauaugaaguauuc

SEQ ID NO: 145321 - RNA, 19 nt, Homo sapiens
ccuuggagcugcauacuau

SEQ ID NO: 145322 - RNA, 19 nt, Homo sapiens
gcacugcuaaguacugaaa

SEQ ID NO: 145323 - RNA, 19 nt, Homo sapiens
gggagcccuucguaaauuu

SEQ ID NO: 145324 - RNA, 19 nt, Homo sapiens
ugagauguuugccaagaaa

SEQ ID NO: 145325 - RNA, 19 nt, Homo sapiens
gaaccugucuauggucugu

SEQ ID NO: 145326 - RNA, 19 nt, Homo sapiens
gcuuguagcuggacagagu

SEQ ID NO: 145327 - RNA, 19 nt, Homo sapiens
caaagagaaagaucaaaga

SEQ ID NO: 145328 - RNA, 19 nt, Homo sapiens
uugaaucugugucugcuua

SEQ ID NO: 145329 - RNA, 19 nt, Homo sapiens
cccaaaauguggaguauua

SEQ ID NO: 145330 - RNA, 19 nt, Homo sapiens
uuaaccaaguggcuagaua

SEQ ID NO: 145331 - RNA, 19 nt, Homo sapiens
aagaaugucuagccaauag

SEQ ID NO: 145332 - RNA, 19 nt, Homo sapiens
gaaguucgcagagauuaug

SEQ ID NO: 145333 - RNA, 19 nt, Homo sapiens
uaauagcuccuuuguucua

SEQ ID NO: 145334 - RNA, 19 nt, Homo sapiens
uaguauugcuggacauauu

SEQ ID NO: 145335 - RNA, 19 nt, Homo sapiens
ggaaaugacaguuauccau

SEQ ID NO: 145336 - RNA, 19 nt, Homo sapiens
cuagacagguuuguucuug

SEQ ID NO: 145337 - RNA, 19 nt, Homo sapiens
agucauaacuagacagguu

SEQ ID NO: 145338 - RNA, 19 nt, Homo sapiens
uuucaaguguccaacauuu

SEQ ID NO: 145339 - RNA, 19 nt, Homo sapiens
agacauugguuaaagaauc

SEQ ID NO: 145340 - RNA, 19 nt, Homo sapiens
aagcaaaccaggaaaugua

SEQ ID NO: 145341 - RNA, 19 nt, Homo sapiens
accaaucucugugaucuua

SEQ ID NO: 145342 - RNA, 19 nt, Homo sapiens
ugagacaguugaccgagaa

SEQ ID NO: 145343 - RNA, 19 nt, Homo sapiens
gaugugaugucaggcuuga

SEQ ID NO: 145344 - RNA, 19 nt, Homo sapiens
guaaagagcaacauaacgu

SEQ ID NO: 145345 - RNA, 19 nt, Homo sapiens
agaagaaugucuagccaau

SEQ ID NO: 145346 - RNA, 19 nt, Homo sapiens
gugauuaauugagaaggua

SEQ ID NO: 145347 - RNA, 19 nt, Homo sapiens
uacaagaaccuucagacua

SEQ ID NO: 145348 - RNA, 19 nt, Homo sapiens
ccacauuagccucucauuu

SEQ ID NO: 145349 - RNA, 19 nt, Homo sapiens
uuacaucucaggccaagua

SEQ ID NO: 145350 - RNA, 19 nt, Homo sapiens
acagaaagcuggcuaugac

SEQ ID NO: 145351 - RNA, 19 nt, Homo sapiens
caccugcucuaguaccaua

SEQ ID NO: 145352 - RNA, 19 nt, Homo sapiens
gccaauagguuaaaauuuc

SEQ ID NO: 145353 - RNA, 19 nt, Homo sapiens
gaguauguguucccaaugg

SEQ ID NO: 145354 - RNA, 19 nt, Homo sapiens
ggaagaaggcagcaaagag

SEQ ID NO: 145355 - RNA, 19 nt, Homo sapiens
ucagaaacauccauaagac

SEQ ID NO: 145356 - RNA, 19 nt, Homo sapiens
gcacaaaguucaagaagaa

SEQ ID NO: 145357 - RNA, 19 nt, Homo sapiens
ugaaagagcugaauucuga

SEQ ID NO: 145358 - RNA, 19 nt, Homo sapiens
caacuuggcucacaucguu

SEQ ID NO: 145359 - RNA, 19 nt, Homo sapiens
gaaaucaccugcuaagaag

SEQ ID NO: 145360 - RNA, 19 nt, Homo sapiens
gaagaucauggacaaauua

SEQ ID NO: 145361 - RNA, 19 nt, Homo sapiens
ggaaaucaccugcuaagaa

SEQ ID NO: 145362 - RNA, 19 nt, Homo sapiens
gaagaaacuuaaggaauga

SEQ ID NO: 145363 - RNA, 19 nt, Homo sapiens
gaagaacacaggcuaauug

SEQ ID NO: 145364 - RNA, 19 nt, Homo sapiens
ggaagaucauggacaaauu

SEQ ID NO: 145365 - RNA, 19 nt, Homo sapiens
gcugugcucuccacuauuu

SEQ ID NO: 145366 - RNA, 19 nt, Homo sapiens
agaagaaacuuaaggaaug

SEQ ID NO: 145367 - RNA, 19 nt, Homo sapiens
gaaagaagacagcuguuug

SEQ ID NO: 145368 - RNA, 19 nt, Homo sapiens
gaaauaccauggcagaaag

SEQ ID NO: 145369 - RNA, 19 nt, Homo sapiens
cuaagaagcugacuaaugc

SEQ ID NO: 145370 - RNA, 19 nt, Homo sapiens
ggaaauaccauggcagaaa

SEQ ID NO: 145371 - RNA, 19 nt, Homo sapiens
ggaaauguguaaggucaaa

SEQ ID NO: 145372 - RNA, 19 nt, Homo sapiens
gagaagugcuccugacauc

SEQ ID NO: 145373 - RNA, 19 nt, Homo sapiens
gagggaagaucauggacaa

SEQ ID NO: 145374 - RNA, 19 nt, Homo sapiens
caaaccggcuugaugaaga

SEQ ID NO: 145375 - RNA, 19 nt, Homo sapiens
gaucauggacaaauuaaga

SEQ ID NO: 145376 - RNA, 19 nt, Homo sapiens
gaacaggacgucugagugu

SEQ ID NO: 145377 - RNA, 19 nt, Homo sapiens
aacagaagcugcaagauga

SEQ ID NO: 145378 - RNA, 19 nt, Homo sapiens
gcgcaaagaugagcuggaa

SEQ ID NO: 145379 - RNA, 19 nt, Homo sapiens
aggaauaccugaaacagaa

SEQ ID NO: 145380 - RNA, 19 nt, Homo sapiens
ggagugaaacagagaguaa

SEQ ID NO: 145381 - RNA, 19 nt, Homo sapiens
gcaaagggauacaguacag

SEQ ID NO: 145382 - RNA, 19 nt, Homo sapiens
gcuaagaagcugacuaaug

SEQ ID NO: 145383 - RNA, 19 nt, Homo sapiens
ugaacaaccuggacccaaa

SEQ ID NO: 145384 - RNA, 19 nt, Homo sapiens
gaagaaugaacacagcuuu

SEQ ID NO: 145385 - RNA, 19 nt, Homo sapiens
uguguaaggucaaauacua

SEQ ID NO: 145386 - RNA, 19 nt, Homo sapiens
agaguaauguggauucuga

SEQ ID NO: 145387 - RNA, 19 nt, Homo sapiens
gauugaagauagugggaaa

SEQ ID NO: 145388 - RNA, 19 nt, Homo sapiens
gagaaugauugaagauagu

SEQ ID NO: 145389 - RNA, 19 nt, Homo sapiens
gaacagagaaaucuuacag

SEQ ID NO: 145390 - RNA, 19 nt, Homo sapiens
gccaacagugucacaauua

SEQ ID NO: 145391 - RNA, 19 nt, Homo sapiens
gaggaaagcuaaggaagag

SEQ ID NO: 145392 - RNA, 19 nt, Homo sapiens
gcaaauccaugcccgaaaa

SEQ ID NO: 145393 - RNA, 19 nt, Homo sapiens
ggaaggccaugguaaaauu

SEQ ID NO: 145394 - RNA, 19 nt, Homo sapiens
caggucagcuugcaagguu

SEQ ID NO: 145395 - RNA, 19 nt, Homo sapiens
ggaaagcuaaggaagagaa

SEQ ID NO: 145396 - RNA, 19 nt, Homo sapiens
gcugauugcugagcuagaa

SEQ ID NO: 145397 - RNA, 19 nt, Homo sapiens
agaacagcaugcaagcuua

SEQ ID NO: 145398 - RNA, 19 nt, Homo sapiens
gcugcaagaugaagcuuau

SEQ ID NO: 145399 - RNA, 19 nt, Homo sapiens
aaacagaagcugcaagaug

SEQ ID NO: 145400 - RNA, 19 nt, Homo sapiens
gcaaagaugagcuggaaca

SEQ ID NO: 145401 - RNA, 19 nt, Homo sapiens
gcaaccagcaccaaaugaa

SEQ ID NO: 145402 - RNA, 19 nt, Homo sapiens
aaagucacguuaaaugguu

SEQ ID NO: 145403 - RNA, 19 nt, Homo sapiens
ugagaaugauugaagauag

SEQ ID NO: 145404 - RNA, 19 nt, Homo sapiens
cagcauauguaguacuuca

SEQ ID NO: 145405 - RNA, 19 nt, Homo sapiens
cagacaggcuagcugauga

SEQ ID NO: 145406 - RNA, 19 nt, Homo sapiens
cacguuaaaugguuucuug

SEQ ID NO: 145407 - RNA, 19 nt, Homo sapiens
ggaguuguuuggaaaugug

SEQ ID NO: 145408 - RNA, 19 nt, Homo sapiens
ucagacagcgcaaagauga

SEQ ID NO: 145409 - RNA, 19 nt, Homo sapiens
gaguacacgucauggaaau

SEQ ID NO: 145410 - RNA, 19 nt, Homo sapiens
gaugguuuauggacgauau

SEQ ID NO: 145411 - RNA, 19 nt, Homo sapiens
ucauggaaaucaccugcua

SEQ ID NO: 145412 - RNA, 19 nt, Homo sapiens
gccaaccacucaccaaauc

SEQ ID NO: 145413 - RNA, 19 nt, Homo sapiens
caggcuagcugaugaacau

SEQ ID NO: 145414 - RNA, 19 nt, Homo sapiens
caagaagaaacuuaaggaa

SEQ ID NO: 145415 - RNA, 19 nt, Homo sapiens
caaggacagugaaguagag

SEQ ID NO: 145416 - RNA, 19 nt, Homo sapiens
gaggaauaccugaaacaga

SEQ ID NO: 145417 - RNA, 19 nt, Homo sapiens
uauguccucucuugugaaa

SEQ ID NO: 145418 - RNA, 19 nt, Homo sapiens
cuuaaggaaugacuugcua

SEQ ID NO: 145419 - RNA, 19 nt, Homo sapiens
caaccagcaccaaaugaaa

SEQ ID NO: 145420 - RNA, 19 nt, Homo sapiens
gugagaguaugaugggauu

SEQ ID NO: 145421 - RNA, 19 nt, Homo sapiens
gauggaggaauaccugaaa

SEQ ID NO: 145422 - RNA, 19 nt, Homo sapiens
gaggguccuucauuugguu

SEQ ID NO: 145423 - RNA, 19 nt, Homo sapiens
gcugcucucuccuucagaa

SEQ ID NO: 145424 - RNA, 19 nt, Homo sapiens
gcagauuccaucacuaaca

SEQ ID NO: 145425 - RNA, 19 nt, Homo sapiens
gaugaagaacacaggcuaa

SEQ ID NO: 145426 - RNA, 19 nt, Homo sapiens
ccaucagccuccuccuuaa

SEQ ID NO: 145427 - RNA, 19 nt, Homo sapiens
caugcaagcuuagguuugu

SEQ ID NO: 145428 - RNA, 19 nt, Homo sapiens
ugaaacagaagcugcaaga

SEQ ID NO: 145429 - RNA, 19 nt, Homo sapiens
aaaccggcuugaugaagaa

SEQ ID NO: 145430 - RNA, 19 nt, Homo sapiens
gcuagcugaugaacauguu

SEQ ID NO: 145431 - RNA, 19 nt, Homo sapiens
ccacucaacuuggcucaca

SEQ ID NO: 145432 - RNA, 19 nt, Homo sapiens
ugaaagaguacacgucaug

SEQ ID NO: 145433 - RNA, 19 nt, Homo sapiens
ggaggguccuucauuuggu

SEQ ID NO: 145434 - RNA, 19 nt, Homo sapiens
gcauccgacucuccaccua

SEQ ID NO: 145435 - RNA, 19 nt, Homo sapiens
gcaauauccuuuuaucaca

SEQ ID NO: 145436 - RNA, 19 nt, Homo sapiens
uccggcagcuggagaauga

SEQ ID NO: 145437 - RNA, 19 nt, Homo sapiens
gcuaguggcugcagauucc

SEQ ID NO: 145438 - RNA, 19 nt, Homo sapiens
gcauauguaguacuucaga

SEQ ID NO: 145439 - RNA, 19 nt, Homo sapiens
gcagacaggcuagcugaug

SEQ ID NO: 145440 - RNA, 19 nt, Homo sapiens
ccaguggggugaugguuua

SEQ ID NO: 145441 - RNA, 19 nt, Homo sapiens
gaacagcaugcaagcuuag

SEQ ID NO: 145442 - RNA, 19 nt, Homo sapiens
aaacuuaaggaaugacuug

SEQ ID NO: 145443 - RNA, 19 nt, Homo sapiens
ucaagaagaaacuuaagga

SEQ ID NO: 145444 - RNA, 19 nt, Homo sapiens
ucaugaagcuacuaaagac

SEQ ID NO: 145445 - RNA, 19 nt, Homo sapiens
ugaaguagagcagaacaaa

SEQ ID NO: 145446 - RNA, 19 nt, Homo sapiens
uggacgauaugaccaauuc

SEQ ID NO: 145447 - RNA, 19 nt, Homo sapiens
caacgugucccgcuuagag

SEQ ID NO: 145448 - RNA, 19 nt, Homo sapiens
gacugagaaugauugaaga

SEQ ID NO: 145449 - RNA, 19 nt, Homo sapiens
ggaagaaugaacacagcuu

SEQ ID NO: 145450 - RNA, 19 nt, Homo sapiens
gagagcuaaugguccaguu

SEQ ID NO: 145451 - RNA, 19 nt, Homo sapiens
gaagugcuccugacaucuc

SEQ ID NO: 145452 - RNA, 19 nt, Homo sapiens
acagugaaguagagcagaa

SEQ ID NO: 145453 - RNA, 19 nt, Homo sapiens
uagcaaauguggaaaaugu

SEQ ID NO: 145454 - RNA, 19 nt, Homo sapiens
gggaagaucauggacaaau

SEQ ID NO: 145455 - RNA, 19 nt, Homo sapiens
cagaacagcaugcaagcuu

SEQ ID NO: 145456 - RNA, 19 nt, Homo sapiens
gaaagacuguacuccauaa

SEQ ID NO: 145457 - RNA, 19 nt, Homo sapiens
caacuuggcucacaucguu

SEQ ID NO: 145458 - RNA, 19 nt, Homo sapiens
gaaaucaccugcuaagaag

SEQ ID NO: 145459 - RNA, 19 nt, Homo sapiens
gaagaucauggacaaauua

SEQ ID NO: 145460 - RNA, 19 nt, Homo sapiens
caacguaucuuucauuucu

SEQ ID NO: 145461 - RNA, 19 nt, Homo sapiens
gaucagacccuucucuuaa

SEQ ID NO: 145462 - RNA, 19 nt, Homo sapiens
ggaaaucaccugcuaagaa

SEQ ID NO: 145463 - RNA, 19 nt, Homo sapiens
gggaacgaauugucauuua

SEQ ID NO: 145464 - RNA, 19 nt, Homo sapiens
gaagaacacaggcuaauug

SEQ ID NO: 145465 - RNA, 19 nt, Homo sapiens
ggaagaucauggacaaauu

SEQ ID NO: 145466 - RNA, 19 nt, Homo sapiens
gcugugcucuccacuauuu

SEQ ID NO: 145467 - RNA, 19 nt, Homo sapiens
ggaacgaauugucauuuau

SEQ ID NO: 145468 - RNA, 19 nt, Homo sapiens
gaaagaagacagcuguuug

SEQ ID NO: 145469 - RNA, 19 nt, Homo sapiens
gaaauaccauggcagaaag

SEQ ID NO: 145470 - RNA, 19 nt, Homo sapiens
cuaagaagcugacuaaugc

SEQ ID NO: 145471 - RNA, 19 nt, Homo sapiens
ggaaauaccauggcagaaa

SEQ ID NO: 145472 - RNA, 19 nt, Homo sapiens
ggaaauguguaaggucaaa

SEQ ID NO: 145473 - RNA, 19 nt, Homo sapiens
gugcuugaauugagauaua

SEQ ID NO: 145474 - RNA, 19 nt, Homo sapiens
gagaagugcuccugacauc

SEQ ID NO: 145475 - RNA, 19 nt, Homo sapiens
caauauaucccacucacua

SEQ ID NO: 145476 - RNA, 19 nt, Homo sapiens
gagaaagacuguacuccau

SEQ ID NO: 145477 - RNA, 19 nt, Homo sapiens
gagggaagaucauggacaa

SEQ ID NO: 145478 - RNA, 19 nt, Homo sapiens
caaaccggcuugaugaaga

SEQ ID NO: 145479 - RNA, 19 nt, Homo sapiens
gaucauggacaaauuaaga

SEQ ID NO: 145480 - RNA, 19 nt, Homo sapiens
gaacaggacgucugagugu

SEQ ID NO: 145481 - RNA, 19 nt, Homo sapiens
gcgcaaagaugagcuggaa

SEQ ID NO: 145482 - RNA, 19 nt, Homo sapiens
ccacagcacucagaagcua

SEQ ID NO: 145483 - RNA, 19 nt, Homo sapiens
gaagaaugaacacagcuuu

SEQ ID NO: 145484 - RNA, 19 nt, Homo sapiens
gcaaagggauacaguacag

SEQ ID NO: 145485 - RNA, 19 nt, Homo sapiens
gcuaagaagcugacuaaug

SEQ ID NO: 145486 - RNA, 19 nt, Homo sapiens
ugaacaaccuggacccaaa

SEQ ID NO: 145487 - RNA, 19 nt, Homo sapiens
uguguaaggucaaauacua

SEQ ID NO: 145488 - RNA, 19 nt, Homo sapiens
ucaaaccagucuuagcuuu

SEQ ID NO: 145489 - RNA, 19 nt, Homo sapiens
gaacugaagcagggaguaa

SEQ ID NO: 145490 - RNA, 19 nt, Homo sapiens
gauugaagauagugggaaa

SEQ ID NO: 145491 - RNA, 19 nt, Homo sapiens
gcaauuaaaucccuuuuca

SEQ ID NO: 145492 - RNA, 19 nt, Homo sapiens
ucaugaagcuacuaaagga

SEQ ID NO: 145493 - RNA, 19 nt, Homo sapiens
gagaaugauugaagauagu

SEQ ID NO: 145494 - RNA, 19 nt, Homo sapiens
gaacagagaaaucuuacag

SEQ ID NO: 145495 - RNA, 19 nt, Homo sapiens
gccaacagugucacaauua

SEQ ID NO: 145496 - RNA, 19 nt, Homo sapiens
gaggaaagcuaaggaagag

SEQ ID NO: 145497 - RNA, 19 nt, Homo sapiens
gcauguaccacgcuaugua

SEQ ID NO: 145498 - RNA, 19 nt, Homo sapiens
ggaaggccaugguaaaauu

SEQ ID NO: 145499 - RNA, 19 nt, Homo sapiens
ggaaagcuaaggaagagaa

SEQ ID NO: 145500 - RNA, 19 nt, Homo sapiens
acgagagggucauuacaua

SEQ ID NO: 145501 - RNA, 19 nt, Homo sapiens
gcugauugcugagcuagaa

SEQ ID NO: 145502 - RNA, 19 nt, Homo sapiens
agaacagcaugcaagcuua

SEQ ID NO: 145503 - RNA, 19 nt, Homo sapiens
gagggucauuacauacuuu

SEQ ID NO: 145504 - RNA, 19 nt, Homo sapiens
gcaaagaugagcuggaaca

SEQ ID NO: 145505 - RNA, 19 nt, Homo sapiens
gcaaccagcaccaaaugaa

SEQ ID NO: 145506 - RNA, 19 nt, Homo sapiens
cagcauauguaguacuuca

SEQ ID NO: 145507 - RNA, 19 nt, Homo sapiens
ucaguucgguuucauuuua

SEQ ID NO: 145508 - RNA, 19 nt, Homo sapiens
aaagucacguuaaaugguu

SEQ ID NO: 145509 - RNA, 19 nt, Homo sapiens
ugagaaugauugaagauag

SEQ ID NO: 145510 - RNA, 19 nt, Homo sapiens
cagacaggcuagcugauga

SEQ ID NO: 145511 - RNA, 19 nt, Homo sapiens
cacguuaaaugguuucuug

SEQ ID NO: 145512 - RNA, 19 nt, Homo sapiens
cuccauaacugacuauuca

SEQ ID NO: 145513 - RNA, 19 nt, Homo sapiens
ucagacagcgcaaagauga

SEQ ID NO: 145514 - RNA, 19 nt, Homo sapiens
gaguacacgucauggaaau

SEQ ID NO: 145515 - RNA, 19 nt, Homo sapiens
gaugguuuauggacgauau

SEQ ID NO: 145516 - RNA, 19 nt, Homo sapiens
ggaguuguuuggaaaugug

SEQ ID NO: 145517 - RNA, 19 nt, Homo sapiens
ggaaauaggggcauuguga

SEQ ID NO: 145518 - RNA, 19 nt, Homo sapiens
accacaaccuguccaauuu

SEQ ID NO: 145519 - RNA, 19 nt, Homo sapiens
ugaagcagggaguaaguua

SEQ ID NO: 145520 - RNA, 19 nt, Homo sapiens
ucauggaaaucaccugcua

SEQ ID NO: 145521 - RNA, 19 nt, Homo sapiens
gccaaccacucaccaaauc

SEQ ID NO: 145522 - RNA, 19 nt, Homo sapiens
cugcaggucuuaacuaaca

SEQ ID NO: 145523 - RNA, 19 nt, Homo sapiens
caggcuagcugaugaacau

SEQ ID NO: 145524 - RNA, 19 nt, Homo sapiens
caaggacagugaaguagag

SEQ ID NO: 145525 - RNA, 19 nt, Homo sapiens
gcucuaauguauguucaug

SEQ ID NO: 145526 - RNA, 19 nt, Homo sapiens
caaccagcaccaaaugaaa

SEQ ID NO: 145527 - RNA, 19 nt, Homo sapiens
gugagaguaugaugggauu

SEQ ID NO: 145528 - RNA, 19 nt, Homo sapiens
ccacucacuagcauuauuu

SEQ ID NO: 145529 - RNA, 19 nt, Homo sapiens
gguugacaguaaucucuuu

SEQ ID NO: 145530 - RNA, 19 nt, Homo sapiens
gaggguccuucauuugguu

SEQ ID NO: 145531 - RNA, 19 nt, Homo sapiens
gcugcucucuccuucagaa

SEQ ID NO: 145532 - RNA, 19 nt, Homo sapiens
uuccauggaucaauuagaa

SEQ ID NO: 145533 - RNA, 19 nt, Homo sapiens
cgcuauguaugacaauaua

SEQ ID NO: 145534 - RNA, 19 nt, Homo sapiens
cuauucacgucccaucuuu

SEQ ID NO: 145535 - RNA, 19 nt, Homo sapiens
gaugaagaacacaggcuaa

SEQ ID NO: 145536 - RNA, 19 nt, Homo sapiens
ccaucagccuccuccuuaa

SEQ ID NO: 145537 - RNA, 19 nt, Homo sapiens
caugcaagcuuagguuugu

SEQ ID NO: 145538 - RNA, 19 nt, Homo sapiens
uauguguguuuguguguaa

SEQ ID NO: 145539 - RNA, 19 nt, Homo sapiens
agaaagacuguacuccaua

SEQ ID NO: 145540 - RNA, 19 nt, Homo sapiens
cgaauugucauuuauugga

SEQ ID NO: 145541 - RNA, 19 nt, Homo sapiens
aaaccggcuugaugaagaa

SEQ ID NO: 145542 - RNA, 19 nt, Homo sapiens
gcuagcugaugaacauguu

SEQ ID NO: 145543 - RNA, 19 nt, Homo sapiens
ccacucaacuuggcucaca

SEQ ID NO: 145544 - RNA, 19 nt, Homo sapiens
ugaaagaguacacgucaug

SEQ ID NO: 145545 - RNA, 19 nt, Homo sapiens
ggaggguccuucauuuggu

SEQ ID NO: 145546 - RNA, 19 nt, Homo sapiens
gcauccgacucuccaccua

SEQ ID NO: 145547 - RNA, 19 nt, Homo sapiens
caaagcagaauccuuacug

SEQ ID NO: 145548 - RNA, 19 nt, Homo sapiens
gaagcagggaguaaguuau

SEQ ID NO: 145549 - RNA, 19 nt, Homo sapiens
gcagacaggcuagcugaug

SEQ ID NO: 145550 - RNA, 19 nt, Homo sapiens
gcauauguaguacuucaga

SEQ ID NO: 145551 - RNA, 19 nt, Homo sapiens
ccaguggggugaugguuua

SEQ ID NO: 145552 - RNA, 19 nt, Homo sapiens
gaacagcaugcaagcuuag

SEQ ID NO: 145553 - RNA, 19 nt, Homo sapiens
ggagacgagagggucauua

SEQ ID NO: 145554 - RNA, 19 nt, Homo sapiens
gagauacccugagguucau

SEQ ID NO: 145555 - RNA, 19 nt, Homo sapiens
ugaucagacccuucucuua

SEQ ID NO: 145556 - RNA, 19 nt, Homo sapiens
caacuuggcucacaucguu

SEQ ID NO: 145557 - RNA, 19 nt, Homo sapiens
gaaaucaccugcuaagaag

SEQ ID NO: 145558 - RNA, 19 nt, Homo sapiens
gaagaucauggacaaauua

SEQ ID NO: 145559 - RNA, 19 nt, Homo sapiens
ggaaaucaccugcuaagaa

SEQ ID NO: 145560 - RNA, 19 nt, Homo sapiens
ggaagaucauggacaaauu

SEQ ID NO: 145561 - RNA, 19 nt, Homo sapiens
caacugccauuucaaagaa

SEQ ID NO: 145562 - RNA, 19 nt, Homo sapiens
gcugugcucuccacuauuu

SEQ ID NO: 145563 - RNA, 19 nt, Homo sapiens
ugagggugcuguucaauaa

SEQ ID NO: 145564 - RNA, 19 nt, Homo sapiens
gaaagaagacagcuguuug

SEQ ID NO: 145565 - RNA, 19 nt, Homo sapiens
gaaauaccauggcagaaag

SEQ ID NO: 145566 - RNA, 19 nt, Homo sapiens
cuaagaagcugacuaaugc

SEQ ID NO: 145567 - RNA, 19 nt, Homo sapiens
ggaaauaccauggcagaaa

SEQ ID NO: 145568 - RNA, 19 nt, Homo sapiens
gagggaagaucauggacaa

SEQ ID NO: 145569 - RNA, 19 nt, Homo sapiens
gaucauggacaaauuaaga

SEQ ID NO: 145570 - RNA, 19 nt, Homo sapiens
gcacuuccaacauuauuaa

SEQ ID NO: 145571 - RNA, 19 nt, Homo sapiens
auaaagcuguguacacuaa

SEQ ID NO: 145572 - RNA, 19 nt, Homo sapiens
gcuaagaagcugacuaaug

SEQ ID NO: 145573 - RNA, 19 nt, Homo sapiens
ugaacaaccuggacccaaa

SEQ ID NO: 145574 - RNA, 19 nt, Homo sapiens
gauugaagauagugggaaa

SEQ ID NO: 145575 - RNA, 19 nt, Homo sapiens
guuuaaagcucacauuucu

SEQ ID NO: 145576 - RNA, 19 nt, Homo sapiens
caauaaagcuguguacacu

SEQ ID NO: 145577 - RNA, 19 nt, Homo sapiens
gccaacagugucacaauua

SEQ ID NO: 145578 - RNA, 19 nt, Homo sapiens
gcccguccauuccaagaua

SEQ ID NO: 145579 - RNA, 19 nt, Homo sapiens
ggacaccuucuaagaguuu

SEQ ID NO: 145580 - RNA, 19 nt, Homo sapiens
ggaaggccaugguaaaauu

SEQ ID NO: 145581 - RNA, 19 nt, Homo sapiens
ggaugcgucuagauggaua

SEQ ID NO: 145582 - RNA, 19 nt, Homo sapiens
agaacagcaugcaagcuua

SEQ ID NO: 145583 - RNA, 19 nt, Homo sapiens
gauaacaugacuucuucua

SEQ ID NO: 145584 - RNA, 19 nt, Homo sapiens
gcaaccagcaccaaaugaa

SEQ ID NO: 145585 - RNA, 19 nt, Homo sapiens
gagauuggccuacgguuuc

SEQ ID NO: 145586 - RNA, 19 nt, Homo sapiens
aaagucacguuaaaugguu

SEQ ID NO: 145587 - RNA, 19 nt, Homo sapiens
cacguuaaaugguuucuug

SEQ ID NO: 145588 - RNA, 19 nt, Homo sapiens
gcagaccaauggacaccuu

SEQ ID NO: 145589 - RNA, 19 nt, Homo sapiens
gaguacacgucauggaaau

SEQ ID NO: 145590 - RNA, 19 nt, Homo sapiens
gaugguuuauggacgauau

SEQ ID NO: 145591 - RNA, 19 nt, Homo sapiens
auaaucaacugccauuuca

SEQ ID NO: 145592 - RNA, 19 nt, Homo sapiens
ucauggaaaucaccugcua

SEQ ID NO: 145593 - RNA, 19 nt, Homo sapiens
gccaaccacucaccaaauc

SEQ ID NO: 145594 - RNA, 19 nt, Homo sapiens
uggauaacaugacuucuuc

SEQ ID NO: 145595 - RNA, 19 nt, Homo sapiens
caauggacaccuucuaaga

SEQ ID NO: 145596 - RNA, 19 nt, Homo sapiens
caaccagcaccaaaugaaa

SEQ ID NO: 145597 - RNA, 19 nt, Homo sapiens
gugagaguaugaugggauu

SEQ ID NO: 145598 - RNA, 19 nt, Homo sapiens
gaggguccuucauuugguu

SEQ ID NO: 145599 - RNA, 19 nt, Homo sapiens
aaaccucccugcagaccaa

SEQ ID NO: 145600 - RNA, 19 nt, Homo sapiens
ccaucagccuccuccuuaa

SEQ ID NO: 145601 - RNA, 19 nt, Homo sapiens
caugcaagcuuagguuugu

SEQ ID NO: 145602 - RNA, 19 nt, Homo sapiens
ccacucaacuuggcucaca

SEQ ID NO: 145603 - RNA, 19 nt, Homo sapiens
ugaaagaguacacgucaug

SEQ ID NO: 145604 - RNA, 19 nt, Homo sapiens
ggaggguccuucauuuggu

SEQ ID NO: 145605 - RNA, 19 nt, Homo sapiens
gcauccgacucuccaccua

SEQ ID NO: 145606 - RNA, 19 nt, Homo sapiens
ccaguggggugaugguuua

SEQ ID NO: 145607 - RNA, 19 nt, Homo sapiens
ccacaugacccacaacucu

SEQ ID NO: 145608 - RNA, 19 nt, Homo sapiens
gaacagcaugcaagcuuag

SEQ ID NO: 145609 - RNA, 19 nt, Homo sapiens
acaguuguguuguuuaaag

SEQ ID NO: 145610 - RNA, 19 nt, Homo sapiens
acuuugagcuguucugguu

SEQ ID NO: 145611 - RNA, 19 nt, Homo sapiens
uggacgauaugaccaauuc

SEQ ID NO: 145612 - RNA, 19 nt, Homo sapiens
caacgugucccgcuuagag

SEQ ID NO: 145613 - RNA, 19 nt, Homo sapiens
cauaaucaacugccauuuc

SEQ ID NO: 145614 - RNA, 19 nt, Homo sapiens
uagcaaauguggaaaaugu

SEQ ID NO: 145615 - RNA, 19 nt, Homo sapiens
gggaagaucauggacaaau

SEQ ID NO: 145616 - RNA, 19 nt, Homo sapiens
cagaacagcaugcaagcuu

SEQ ID NO: 145617 - RNA, 19 nt, Homo sapiens
acaauuaccagcucuguca

SEQ ID NO: 145618 - RNA, 19 nt, Homo sapiens
ccaacagugucacaauuac

SEQ ID NO: 145619 - RNA, 19 nt, Homo sapiens
ugccaacagugucacaauu

SEQ ID NO: 145620 - RNA, 19 nt, Homo sapiens
agacagcuguuugcagaga

SEQ ID NO: 145621 - RNA, 19 nt, Homo sapiens
agaaagaagacagcuguuu

SEQ ID NO: 145622 - RNA, 19 nt, Homo sapiens
aaucaacugccauuucaaa

SEQ ID NO: 145623 - RNA, 19 nt, Homo sapiens
uaagugccauaaucaacug

SEQ ID NO: 145624 - RNA, 19 nt, Homo sapiens
uuuggaggguccuucauuu

SEQ ID NO: 145625 - RNA, 19 nt, Homo sapiens
uccaucagccuccuccuua

SEQ ID NO: 145626 - RNA, 19 nt, Homo sapiens
uuuggaauguucucuguga

SEQ ID NO: 145627 - RNA, 19 nt, Homo sapiens
gcgucuagauggauaacau

SEQ ID NO: 145628 - RNA, 19 nt, Homo sapiens
auagaagcauugcgggaaa

SEQ ID NO: 145629 - RNA, 19 nt, Homo sapiens
cuaagaguuuggcgaguca

SEQ ID NO: 145630 - RNA, 19 nt, Homo sapiens
cugcuaagaagcugacuaa

SEQ ID NO: 145631 - RNA, 19 nt, Homo sapiens
guacacgucauggaaauca

SEQ ID NO: 145632 - RNA, 19 nt, Homo sapiens
ucaacugccauuucaaaga

SEQ ID NO: 145633 - RNA, 19 nt, Homo sapiens
aaagcuguguacacuaaau

SEQ ID NO: 145634 - RNA, 19 nt, Homo sapiens
uaagaaagcggcuccuacu

SEQ ID NO: 145635 - RNA, 19 nt, Homo sapiens
gcaugcaagcuuagguuug

SEQ ID NO: 145636 - RNA, 19 nt, Homo sapiens
guggaugcgucuagaugga

SEQ ID NO: 145637 - RNA, 19 nt, Homo sapiens
gcucacaucguugauacuu

SEQ ID NO: 145638 - RNA, 19 nt, Homo sapiens
guccauuccaagauaaaua

SEQ ID NO: 145639 - RNA, 19 nt, Homo sapiens
cgcagugucuggucugguu

SEQ ID NO: 145640 - RNA, 19 nt, Homo sapiens
aggcugugcucuccacuau

SEQ ID NO: 145641 - RNA, 19 nt, Homo sapiens
uaccauggcagaaagaaga

SEQ ID NO: 145642 - RNA, 19 nt, Homo sapiens
cuugggaagucuuuaagug

SEQ ID NO: 145643 - RNA, 19 nt, Homo sapiens
cccggcacuuccaacauua

SEQ ID NO: 145644 - RNA, 19 nt, Homo sapiens
cuagauggauaacaugacu

SEQ ID NO: 145645 - RNA, 19 nt, Homo sapiens
gaguuuggcgagucaguga

SEQ ID NO: 145646 - RNA, 19 nt, Homo sapiens
gaccaauggacaccuucua

SEQ ID NO: 145647 - RNA, 19 nt, Homo sapiens
gagaguaugaugggauuuc

SEQ ID NO: 145648 - RNA, 19 nt, Homo sapiens
gaacaaccuggacccaaac

SEQ ID NO: 145649 - RNA, 19 nt, Homo sapiens
cccaaacacugaacucaac

SEQ ID NO: 145650 - RNA, 19 nt, Homo sapiens
ggcacuuccaacauuauua

SEQ ID NO: 145651 - RNA, 19 nt, Homo sapiens
acccggcacuuccaacauu

SEQ ID NO: 145652 - RNA, 19 nt, Homo sapiens
cauagcaaccagcaccaaa

SEQ ID NO: 145653 - RNA, 19 nt, Homo sapiens
gucuuuaagugccauaauc

SEQ ID NO: 145654 - RNA, 19 nt, Homo sapiens
gauccggaaggccauggua

SEQ ID NO: 145655 - RNA, 19 nt, Homo sapiens
gccauaaucaacugccauu

SEQ ID NO: 145656 - RNA, 19 nt, Homo sapiens
gcacaaaguucaagaagaa

SEQ ID NO: 145657 - RNA, 19 nt, Homo sapiens
ugaaagagcugaauucuga

SEQ ID NO: 145658 - RNA, 19 nt, Homo sapiens
caacuuggcucacaucguu

SEQ ID NO: 145659 - RNA, 19 nt, Homo sapiens
gaaaucaccugcuaagaag

SEQ ID NO: 145660 - RNA, 19 nt, Homo sapiens
gaagaucauggacaaauua

SEQ ID NO: 145661 - RNA, 19 nt, Homo sapiens
ggaaaucaccugcuaagaa

SEQ ID NO: 145662 - RNA, 19 nt, Homo sapiens
gaagaaacuuaaggaauga

SEQ ID NO: 145663 - RNA, 19 nt, Homo sapiens
gaagaacacaggcuaauug

SEQ ID NO: 145664 - RNA, 19 nt, Homo sapiens
ggaagaucauggacaaauu

SEQ ID NO: 145665 - RNA, 19 nt, Homo sapiens
gcugugcucuccacuauuu

SEQ ID NO: 145666 - RNA, 19 nt, Homo sapiens
agaagaaacuuaaggaaug

SEQ ID NO: 145667 - RNA, 19 nt, Homo sapiens
gaaagaagacagcuguuug

SEQ ID NO: 145668 - RNA, 19 nt, Homo sapiens
gaaauaccauggcagaaag

SEQ ID NO: 145669 - RNA, 19 nt, Homo sapiens
cuaagaagcugacuaaugc

SEQ ID NO: 145670 - RNA, 19 nt, Homo sapiens
ggaaauaccauggcagaaa

SEQ ID NO: 145671 - RNA, 19 nt, Homo sapiens
gagaagugcuccugacauc

SEQ ID NO: 145672 - RNA, 19 nt, Homo sapiens
cuaaagauguguccugaug

SEQ ID NO: 145673 - RNA, 19 nt, Homo sapiens
gagggaagaucauggacaa

SEQ ID NO: 145674 - RNA, 19 nt, Homo sapiens
caaaccggcuugaugaaga

SEQ ID NO: 145675 - RNA, 19 nt, Homo sapiens
gaucauggacaaauuaaga

SEQ ID NO: 145676 - RNA, 19 nt, Homo sapiens
aacagaagcugcaagauga

SEQ ID NO: 145677 - RNA, 19 nt, Homo sapiens
gcgcaaagaugagcuggaa

SEQ ID NO: 145678 - RNA, 19 nt, Homo sapiens
aggaauaccugaaacagaa

SEQ ID NO: 145679 - RNA, 19 nt, Homo sapiens
ggagugaaacagagaguaa

SEQ ID NO: 145680 - RNA, 19 nt, Homo sapiens
gcuaagaagcugacuaaug

SEQ ID NO: 145681 - RNA, 19 nt, Homo sapiens
ugaacaaccuggacccaaa

SEQ ID NO: 145682 - RNA, 19 nt, Homo sapiens
ucagacagaugaugaaagu

SEQ ID NO: 145683 - RNA, 19 nt, Homo sapiens
agaguaauguggauucuga

SEQ ID NO: 145684 - RNA, 19 nt, Homo sapiens
gauugaagauagugggaaa

SEQ ID NO: 145685 - RNA, 19 nt, Homo sapiens
gauguguccugaugacuau

SEQ ID NO: 145686 - RNA, 19 nt, Homo sapiens
ggagcaugcuugagaguuc

SEQ ID NO: 145687 - RNA, 19 nt, Homo sapiens
gaacagagaaaucuuacag

SEQ ID NO: 145688 - RNA, 19 nt, Homo sapiens
gccaacagugucacaauua

SEQ ID NO: 145689 - RNA, 19 nt, Homo sapiens
gcagcagccucaccgaaga

SEQ ID NO: 145690 - RNA, 19 nt, Homo sapiens
agacagaugaugaaaguaa

SEQ ID NO: 145691 - RNA, 19 nt, Homo sapiens
gcaaauccaugcccgaaaa

SEQ ID NO: 145692 - RNA, 19 nt, Homo sapiens
ggaaggccaugguaaaauu

SEQ ID NO: 145693 - RNA, 19 nt, Homo sapiens
caggucagcuugcaagguu

SEQ ID NO: 145694 - RNA, 19 nt, Homo sapiens
gcugauugcugagcuagaa

SEQ ID NO: 145695 - RNA, 19 nt, Homo sapiens
agaacagcaugcaagcuua

SEQ ID NO: 145696 - RNA, 19 nt, Homo sapiens
gcugcaagaugaagcuuau

SEQ ID NO: 145697 - RNA, 19 nt, Homo sapiens
aaacagaagcugcaagaug

SEQ ID NO: 145698 - RNA, 19 nt, Homo sapiens
gcaaagaugagcuggaaca

SEQ ID NO: 145699 - RNA, 19 nt, Homo sapiens
gcaaccagcaccaaaugaa

SEQ ID NO: 145700 - RNA, 19 nt, Homo sapiens
aaagucacguuaaaugguu

SEQ ID NO: 145701 - RNA, 19 nt, Homo sapiens
cacguuaaaugguuucuug

SEQ ID NO: 145702 - RNA, 19 nt, Homo sapiens
gaugaugaaaguaacauga

SEQ ID NO: 145703 - RNA, 19 nt, Homo sapiens
ucagacagcgcaaagauga

SEQ ID NO: 145704 - RNA, 19 nt, Homo sapiens
gaguacacgucauggaaau

SEQ ID NO: 145705 - RNA, 19 nt, Homo sapiens
gaugguuuauggacgauau

SEQ ID NO: 145706 - RNA, 19 nt, Homo sapiens
gugcauagguguguguuuc

SEQ ID NO: 145707 - RNA, 19 nt, Homo sapiens
ucauggaaaucaccugcua

SEQ ID NO: 145708 - RNA, 19 nt, Homo sapiens
gccaaccacucaccaaauc

SEQ ID NO: 145709 - RNA, 19 nt, Homo sapiens
caagaagaaacuuaaggaa

SEQ ID NO: 145710 - RNA, 19 nt, Homo sapiens
gaggaauaccugaaacaga

SEQ ID NO: 145711 - RNA, 19 nt, Homo sapiens
uauguccucucuugugaaa

SEQ ID NO: 145712 - RNA, 19 nt, Homo sapiens
cuuaaggaaugacuugcua

SEQ ID NO: 145713 - RNA, 19 nt, Homo sapiens
caaccagcaccaaaugaaa

SEQ ID NO: 145714 - RNA, 19 nt, Homo sapiens
gugagaguaugaugggauu

SEQ ID NO: 145715 - RNA, 19 nt, Homo sapiens
gaaaguaacaugaaaacug

SEQ ID NO: 145716 - RNA, 19 nt, Homo sapiens
gauggaggaauaccugaaa

SEQ ID NO: 145717 - RNA, 19 nt, Homo sapiens
gcauagguguguguuucaa

SEQ ID NO: 145718 - RNA, 19 nt, Homo sapiens
caugcaagcuuagguuugu

SEQ ID NO: 145719 - RNA, 19 nt, Homo sapiens
gcagauuccaucacuaaca

SEQ ID NO: 145720 - RNA, 19 nt, Homo sapiens
gaugaagaacacaggcuaa

SEQ ID NO: 145721 - RNA, 19 nt, Homo sapiens
ccaucagccuccuccuuaa

SEQ ID NO: 145722 - RNA, 19 nt, Homo sapiens
ugaaacagaagcugcaaga

SEQ ID NO: 145723 - RNA, 19 nt, Homo sapiens
aaaccggcuugaugaagaa

SEQ ID NO: 145724 - RNA, 19 nt, Homo sapiens
ccacucaacuuggcucaca

SEQ ID NO: 145725 - RNA, 19 nt, Homo sapiens
ugaaagaguacacgucaug

SEQ ID NO: 145726 - RNA, 19 nt, Homo sapiens
gcauccgacucuccaccua

SEQ ID NO: 145727 - RNA, 19 nt, Homo sapiens
gaaaacuggugaugaugga

SEQ ID NO: 145728 - RNA, 19 nt, Homo sapiens
gcaauauccuuuuaucaca

SEQ ID NO: 145729 - RNA, 19 nt, Homo sapiens
uccggcagcuggagaauga

SEQ ID NO: 145730 - RNA, 19 nt, Homo sapiens
gcuaguggcugcagauucc

SEQ ID NO: 145731 - RNA, 19 nt, Homo sapiens
gaacagcaugcaagcuuag

SEQ ID NO: 145732 - RNA, 19 nt, Homo sapiens
ccaguggggugaugguuua

SEQ ID NO: 145733 - RNA, 19 nt, Homo sapiens
aacccaugcugcuguuaua

SEQ ID NO: 145734 - RNA, 19 nt, Homo sapiens
gaaaacccaugcugcuguu

SEQ ID NO: 145735 - RNA, 19 nt, Homo sapiens
cccagcagcuccugacaga

SEQ ID NO: 145736 - RNA, 19 nt, Homo sapiens
ucacacuccucucaagcaa

SEQ ID NO: 145737 - RNA, 19 nt, Homo sapiens
aaacuuaaggaaugacuug

SEQ ID NO: 145738 - RNA, 19 nt, Homo sapiens
ucaagaagaaacuuaagga

SEQ ID NO: 145739 - RNA, 19 nt, Homo sapiens
ucaugaagcuacuaaagac

SEQ ID NO: 145740 - RNA, 19 nt, Homo sapiens
uggacgauaugaccaauuc

SEQ ID NO: 145741 - RNA, 19 nt, Homo sapiens
caacgugucccgcuuagag

SEQ ID NO: 145742 - RNA, 19 nt, Homo sapiens
aaacaaacacaggcugaaa

SEQ ID NO: 145743 - RNA, 19 nt, Homo sapiens
gagagcuaaugguccaguu

SEQ ID NO: 145744 - RNA, 19 nt, Homo sapiens
gaagugcuccugacaucuc

SEQ ID NO: 145745 - RNA, 19 nt, Homo sapiens
cagaacagcaugcaagcuu

SEQ ID NO: 145746 - RNA, 19 nt, Homo sapiens
uagcaaauguggaaaaugu

SEQ ID NO: 145747 - RNA, 19 nt, Homo sapiens
gggaagaucauggacaaau

SEQ ID NO: 145748 - RNA, 19 nt, Homo sapiens
agaaagaagacagcuguuu

SEQ ID NO: 145749 - RNA, 19 nt, Homo sapiens
agacagcuguuugcagaga

SEQ ID NO: 145750 - RNA, 19 nt, Homo sapiens
gacuucggcuagagcauga

SEQ ID NO: 145751 - RNA, 19 nt, Homo sapiens
aaacaagaacagagaaauc

SEQ ID NO: 145752 - RNA, 19 nt, Homo sapiens
gagcaugcuugagaguuca

SEQ ID NO: 145753 - RNA, 19 nt, Homo sapiens
acaauuaccagcucuguca

SEQ ID NO: 145754 - RNA, 19 nt, Homo sapiens
ccaacagugucacaauuac

SEQ ID NO: 145755 - RNA, 19 nt, Homo sapiens
ugccaacagugucacaauu

SEQ ID NO: 145756 - RNA, 19 nt, Homo sapiens
gaaagacuguacuccauaa

SEQ ID NO: 145757 - RNA, 19 nt, Homo sapiens
gaaaucaccugcuaagaag

SEQ ID NO: 145758 - RNA, 19 nt, Homo sapiens
gaagaucauggacaaauua

SEQ ID NO: 145759 - RNA, 19 nt, Homo sapiens
gaucagacccuucucuuaa

SEQ ID NO: 145760 - RNA, 19 nt, Homo sapiens
ggaaaucaccugcuaagaa

SEQ ID NO: 145761 - RNA, 19 nt, Homo sapiens
gggaacgaauugucauuua

SEQ ID NO: 145762 - RNA, 19 nt, Homo sapiens
gaagaacacaggcuaauug

SEQ ID NO: 145763 - RNA, 19 nt, Homo sapiens
ggaagaucauggacaaauu

SEQ ID NO: 145764 - RNA, 19 nt, Homo sapiens
gcugugcucuccacuauuu

SEQ ID NO: 145765 - RNA, 19 nt, Homo sapiens
ggaacgaauugucauuuau

SEQ ID NO: 145766 - RNA, 19 nt, Homo sapiens
gaaagaagacagcuguuug

SEQ ID NO: 145767 - RNA, 19 nt, Homo sapiens
gaaauaccauggcagaaag

SEQ ID NO: 145768 - RNA, 19 nt, Homo sapiens
cuaagaagcugacuaaugc

SEQ ID NO: 145769 - RNA, 19 nt, Homo sapiens
ggaaauaccauggcagaaa

SEQ ID NO: 145770 - RNA, 19 nt, Homo sapiens
ggaaauguguaaggucaaa

SEQ ID NO: 145771 - RNA, 19 nt, Homo sapiens
gugcuugaauugagauaua

SEQ ID NO: 145772 - RNA, 19 nt, Homo sapiens
gagaagugcuccugacauc

SEQ ID NO: 145773 - RNA, 19 nt, Homo sapiens
gagaaagacuguacuccau

SEQ ID NO: 145774 - RNA, 19 nt, Homo sapiens
gagggaagaucauggacaa

SEQ ID NO: 145775 - RNA, 19 nt, Homo sapiens
caaaccggcuugaugaaga

SEQ ID NO: 145776 - RNA, 19 nt, Homo sapiens
gaucauggacaaauuaaga

SEQ ID NO: 145777 - RNA, 19 nt, Homo sapiens
gcgcaaagaugagcuggaa

SEQ ID NO: 145778 - RNA, 19 nt, Homo sapiens
ccacagcacucagaagcua

SEQ ID NO: 145779 - RNA, 19 nt, Homo sapiens
gcaaagggauacaguacag

SEQ ID NO: 145780 - RNA, 19 nt, Homo sapiens
gcuaagaagcugacuaaug

SEQ ID NO: 145781 - RNA, 19 nt, Homo sapiens
gaagaaugaacacagcuuu

SEQ ID NO: 145782 - RNA, 19 nt, Homo sapiens
ugaacaaccuggacccaaa

SEQ ID NO: 145783 - RNA, 19 nt, Homo sapiens
uguguaaggucaaauacua

SEQ ID NO: 145784 - RNA, 19 nt, Homo sapiens
ucaaaccagucuuagcuuu

SEQ ID NO: 145785 - RNA, 19 nt, Homo sapiens
gaacugaagcagggaguaa

SEQ ID NO: 145786 - RNA, 19 nt, Homo sapiens
gauugaagauagugggaaa

SEQ ID NO: 145787 - RNA, 19 nt, Homo sapiens
gcaauuaaaucccuuuuca

SEQ ID NO: 145788 - RNA, 19 nt, Homo sapiens
ucaugaagcuacuaaagga

SEQ ID NO: 145789 - RNA, 19 nt, Homo sapiens
gaacagagaaaucuuacag

SEQ ID NO: 145790 - RNA, 19 nt, Homo sapiens
gccaacagugucacaauua

SEQ ID NO: 145791 - RNA, 19 nt, Homo sapiens
ggaaggccaugguaaaauu

SEQ ID NO: 145792 - RNA, 19 nt, Homo sapiens
ccagaaugauugaagauag

SEQ ID NO: 145793 - RNA, 19 nt, Homo sapiens
acgagagggucauuacaua

SEQ ID NO: 145794 - RNA, 19 nt, Homo sapiens
gcugauugcugagcuagaa

SEQ ID NO: 145795 - RNA, 19 nt, Homo sapiens
agaacagcaugcaagcuua

SEQ ID NO: 145796 - RNA, 19 nt, Homo sapiens
gagggucauuacauacuuu

SEQ ID NO: 145797 - RNA, 19 nt, Homo sapiens
gcaaagaugagcuggaaca

SEQ ID NO: 145798 - RNA, 19 nt, Homo sapiens
gcaaccagcaccaaaugaa

SEQ ID NO: 145799 - RNA, 19 nt, Homo sapiens
ucaguucgguuucauuuua

SEQ ID NO: 145800 - RNA, 19 nt, Homo sapiens
aaagucacguuaaaugguu

SEQ ID NO: 145801 - RNA, 19 nt, Homo sapiens
cagcauauguaguacuuca

SEQ ID NO: 145802 - RNA, 19 nt, Homo sapiens
cagacaggcuagcugauga

SEQ ID NO: 145803 - RNA, 19 nt, Homo sapiens
cacguuaaaugguuucuug

SEQ ID NO: 145804 - RNA, 19 nt, Homo sapiens
aaaccagaaugauugaaga

SEQ ID NO: 145805 - RNA, 19 nt, Homo sapiens
cuccauaacugacuauuca

SEQ ID NO: 145806 - RNA, 19 nt, Homo sapiens
ucagacagcgcaaagauga

SEQ ID NO: 145807 - RNA, 19 nt, Homo sapiens
gaguacacgucauggaaau

SEQ ID NO: 145808 - RNA, 19 nt, Homo sapiens
gaugguuuauggacgauau

SEQ ID NO: 145809 - RNA, 19 nt, Homo sapiens
ggaaauaggggcauuguga

SEQ ID NO: 145810 - RNA, 19 nt, Homo sapiens
ucacuacuauccacaucaa

SEQ ID NO: 145811 - RNA, 19 nt, Homo sapiens
ugaagcagggaguaaguua

SEQ ID NO: 145812 - RNA, 19 nt, Homo sapiens
ucauggaaaucaccugcua

SEQ ID NO: 145813 - RNA, 19 nt, Homo sapiens
gccaaccacucaccaaauc

SEQ ID NO: 145814 - RNA, 19 nt, Homo sapiens
caggcuagcugaugaacau

SEQ ID NO: 145815 - RNA, 19 nt, Homo sapiens
ggaguuuguuuggaaaugu

SEQ ID NO: 145816 - RNA, 19 nt, Homo sapiens
caaggacagugaaguagag

SEQ ID NO: 145817 - RNA, 19 nt, Homo sapiens
gcucuaauguauguucaug

SEQ ID NO: 145818 - RNA, 19 nt, Homo sapiens
caaccagcaccaaaugaaa

SEQ ID NO: 145819 - RNA, 19 nt, Homo sapiens
gugagaguaugaugggauu

SEQ ID NO: 145820 - RNA, 19 nt, Homo sapiens
aagcuuagguuuguucaga

SEQ ID NO: 145821 - RNA, 19 nt, Homo sapiens
gguugacaguaaucucuuu

SEQ ID NO: 145822 - RNA, 19 nt, Homo sapiens
cuauucacgucccaucuuu

SEQ ID NO: 145823 - RNA, 19 nt, Homo sapiens
gaugaagaacacaggcuaa

SEQ ID NO: 145824 - RNA, 19 nt, Homo sapiens
ccaucagccuccuccuuaa

SEQ ID NO: 145825 - RNA, 19 nt, Homo sapiens
caugcaagcuuagguuugu

SEQ ID NO: 145826 - RNA, 19 nt, Homo sapiens
cagaaugauugaagauagu

SEQ ID NO: 145827 - RNA, 19 nt, Homo sapiens
agaaagacuguacuccaua

SEQ ID NO: 145828 - RNA, 19 nt, Homo sapiens
cgaauugucauuuauugga

SEQ ID NO: 145829 - RNA, 19 nt, Homo sapiens
aaaccggcuugaugaagaa

SEQ ID NO: 145830 - RNA, 19 nt, Homo sapiens
gcuagcugaugaacauguu

SEQ ID NO: 145831 - RNA, 19 nt, Homo sapiens
ccacucaacuuggcucaca

SEQ ID NO: 145832 - RNA, 19 nt, Homo sapiens
ugaaagaguacacgucaug

SEQ ID NO: 145833 - RNA, 19 nt, Homo sapiens
gcauccgacucuccaccua

SEQ ID NO: 145834 - RNA, 19 nt, Homo sapiens
caaagcagaauccuuacug

SEQ ID NO: 145835 - RNA, 19 nt, Homo sapiens
gaagcagggaguaaguuau

SEQ ID NO: 145836 - RNA, 19 nt, Homo sapiens
gcauauguaguacuucaga

SEQ ID NO: 145837 - RNA, 19 nt, Homo sapiens
gcagacaggcuagcugaug

SEQ ID NO: 145838 - RNA, 19 nt, Homo sapiens
ccaguggggugaugguuua

SEQ ID NO: 145839 - RNA, 19 nt, Homo sapiens
gaacagcaugcaagcuuag

SEQ ID NO: 145840 - RNA, 19 nt, Homo sapiens
ggagacgagagggucauua

SEQ ID NO: 145841 - RNA, 19 nt, Homo sapiens
gagauacccugagguucau

SEQ ID NO: 145842 - RNA, 19 nt, Homo sapiens
ugaucagacccuucucuua

SEQ ID NO: 145843 - RNA, 19 nt, Homo sapiens
agucuuagcuuuucaaguu

SEQ ID NO: 145844 - RNA, 19 nt, Homo sapiens
ugaaguagagcagaacaaa

SEQ ID NO: 145845 - RNA, 19 nt, Homo sapiens
uggacgauaugaccaauuc

SEQ ID NO: 145846 - RNA, 19 nt, Homo sapiens
caacgugucccgcuuagag

SEQ ID NO: 145847 - RNA, 19 nt, Homo sapiens
gcuacuaaaggaagaagaa

SEQ ID NO: 145848 - RNA, 19 nt, Homo sapiens
gagagcuaaugguccaguu

SEQ ID NO: 145849 - RNA, 19 nt, Homo sapiens
gaagugcuccugacaucuc

SEQ ID NO: 145850 - RNA, 19 nt, Homo sapiens
acagugaaguagagcagaa

SEQ ID NO: 145851 - RNA, 19 nt, Homo sapiens
uagcaaauguggaaaaugu

SEQ ID NO: 145852 - RNA, 19 nt, Homo sapiens
ggaagaaugaacacagcuu

SEQ ID NO: 145853 - RNA, 19 nt, Homo sapiens
gggaagaucauggacaaau

SEQ ID NO: 145854 - RNA, 19 nt, Homo sapiens
cagaacagcaugcaagcuu

SEQ ID NO: 145855 - RNA, 19 nt, Homo sapiens
agacuguacuccauaacug

SEQ ID NO: 145856 - RNA, 19 nt, Homo sapiens
gaaagacuguacuccauaa

SEQ ID NO: 145857 - RNA, 19 nt, Homo sapiens
caacuuggcucacaucguu

SEQ ID NO: 145858 - RNA, 19 nt, Homo sapiens
gaaaucaccugcuaagaag

SEQ ID NO: 145859 - RNA, 19 nt, Homo sapiens
gaagaucauggacaaauua

SEQ ID NO: 145860 - RNA, 19 nt, Homo sapiens
gaucagacccuucucuuaa

SEQ ID NO: 145861 - RNA, 19 nt, Homo sapiens
ggaaaucaccugcuaagaa

SEQ ID NO: 145862 - RNA, 19 nt, Homo sapiens
gggaacgaauugucauuua

SEQ ID NO: 145863 - RNA, 19 nt, Homo sapiens
gaagaacacaggcuaauug

SEQ ID NO: 145864 - RNA, 19 nt, Homo sapiens
ggaagaucauggacaaauu

SEQ ID NO: 145865 - RNA, 19 nt, Homo sapiens
gcugugcucuccacuauuu

SEQ ID NO: 145866 - RNA, 19 nt, Homo sapiens
ggaacgaauugucauuuau

SEQ ID NO: 145867 - RNA, 19 nt, Homo sapiens
gaaagaagacagcuguuug

SEQ ID NO: 145868 - RNA, 19 nt, Homo sapiens
gaaauaccauggcagaaag

SEQ ID NO: 145869 - RNA, 19 nt, Homo sapiens
cuaagaagcugacuaaugc

SEQ ID NO: 145870 - RNA, 19 nt, Homo sapiens
ggaaauaccauggcagaaa

SEQ ID NO: 145871 - RNA, 19 nt, Homo sapiens
gugcuugaauugagauaua

SEQ ID NO: 145872 - RNA, 19 nt, Homo sapiens
gagaagugcuccugacauc

SEQ ID NO: 145873 - RNA, 19 nt, Homo sapiens
gagaaagacuguacuccau

SEQ ID NO: 145874 - RNA, 19 nt, Homo sapiens
gagggaagaucauggacaa

SEQ ID NO: 145875 - RNA, 19 nt, Homo sapiens
caaaccggcuugaugaaga

SEQ ID NO: 145876 - RNA, 19 nt, Homo sapiens
gaucauggacaaauuaaga

SEQ ID NO: 145877 - RNA, 19 nt, Homo sapiens
gcgcaaagaugagcuggaa

SEQ ID NO: 145878 - RNA, 19 nt, Homo sapiens
ccacagcacucagaagcua

SEQ ID NO: 145879 - RNA, 19 nt, Homo sapiens
gcuaagaagcugacuaaug

SEQ ID NO: 145880 - RNA, 19 nt, Homo sapiens
ugaacaaccuggacccaaa

SEQ ID NO: 145881 - RNA, 19 nt, Homo sapiens
ucaaaccagucuuagcuuu

SEQ ID NO: 145882 - RNA, 19 nt, Homo sapiens
gaacugaagcagggaguaa

SEQ ID NO: 145883 - RNA, 19 nt, Homo sapiens
gauugaagauagugggaaa

SEQ ID NO: 145884 - RNA, 19 nt, Homo sapiens
gcaauuaaaucccuuuuca

SEQ ID NO: 145885 - RNA, 19 nt, Homo sapiens
ucaugaagcuacuaaagga

SEQ ID NO: 145886 - RNA, 19 nt, Homo sapiens
ggagcaugcuugagaguuc

SEQ ID NO: 145887 - RNA, 19 nt, Homo sapiens
gaacagagaaaucuuacag

SEQ ID NO: 145888 - RNA, 19 nt, Homo sapiens
gccaacagugucacaauua

SEQ ID NO: 145889 - RNA, 19 nt, Homo sapiens
ggaaggccaugguaaaauu

SEQ ID NO: 145890 - RNA, 19 nt, Homo sapiens
acgagagggucauuacaua

SEQ ID NO: 145891 - RNA, 19 nt, Homo sapiens
gcugauugcugagcuagaa

SEQ ID NO: 145892 - RNA, 19 nt, Homo sapiens
agaacagcaugcaagcuua

SEQ ID NO: 145893 - RNA, 19 nt, Homo sapiens
gagggucauuacauacuuu

SEQ ID NO: 145894 - RNA, 19 nt, Homo sapiens
gcaaagaugagcuggaaca

SEQ ID NO: 145895 - RNA, 19 nt, Homo sapiens
gcaaccagcaccaaaugaa

SEQ ID NO: 145896 - RNA, 19 nt, Homo sapiens
ucaguucgguuucauuuua

SEQ ID NO: 145897 - RNA, 19 nt, Homo sapiens
aaagucacguuaaaugguu

SEQ ID NO: 145898 - RNA, 19 nt, Homo sapiens
cacguuaaaugguuucuug

SEQ ID NO: 145899 - RNA, 19 nt, Homo sapiens
cuccauaacugacuauuca

SEQ ID NO: 145900 - RNA, 19 nt, Homo sapiens
ucagacagcgcaaagauga

SEQ ID NO: 145901 - RNA, 19 nt, Homo sapiens
gaguacacgucauggaaau

SEQ ID NO: 145902 - RNA, 19 nt, Homo sapiens
gaugguuuauggacgauau

SEQ ID NO: 145903 - RNA, 19 nt, Homo sapiens
ggaaauaggggcauuguga

SEQ ID NO: 145904 - RNA, 19 nt, Homo sapiens
ugaagcagggaguaaguua

SEQ ID NO: 145905 - RNA, 19 nt, Homo sapiens
ucauggaaaucaccugcua

SEQ ID NO: 145906 - RNA, 19 nt, Homo sapiens
gccaaccacucaccaaauc

SEQ ID NO: 145907 - RNA, 19 nt, Homo sapiens
cugcaggucuuaacuaaca

SEQ ID NO: 145908 - RNA, 19 nt, Homo sapiens
gcucuaauguauguucaug

SEQ ID NO: 145909 - RNA, 19 nt, Homo sapiens
caaccagcaccaaaugaaa

SEQ ID NO: 145910 - RNA, 19 nt, Homo sapiens
gugagaguaugaugggauu

SEQ ID NO: 145911 - RNA, 19 nt, Homo sapiens
gguugacaguaaucucuuu

SEQ ID NO: 145912 - RNA, 19 nt, Homo sapiens
gaggguccuucauuugguu

SEQ ID NO: 145913 - RNA, 19 nt, Homo sapiens
cuauucacgucccaucuuu

SEQ ID NO: 145914 - RNA, 19 nt, Homo sapiens
gaugaagaacacaggcuaa

SEQ ID NO: 145915 - RNA, 19 nt, Homo sapiens
ccaucagccuccuccuuaa

SEQ ID NO: 145916 - RNA, 19 nt, Homo sapiens
caugcaagcuuagguuugu

SEQ ID NO: 145917 - RNA, 19 nt, Homo sapiens
agaaagacuguacuccaua

SEQ ID NO: 145918 - RNA, 19 nt, Homo sapiens
cgaauugucauuuauugga

SEQ ID NO: 145919 - RNA, 19 nt, Homo sapiens
aaaccggcuugaugaagaa

SEQ ID NO: 145920 - RNA, 19 nt, Homo sapiens
ccacucaacuuggcucaca

SEQ ID NO: 145921 - RNA, 19 nt, Homo sapiens
ugaaagaguacacgucaug

SEQ ID NO: 145922 - RNA, 19 nt, Homo sapiens
gcauccgacucuccaccua

SEQ ID NO: 145923 - RNA, 19 nt, Homo sapiens
ggaggguccuucauuuggu

SEQ ID NO: 145924 - RNA, 19 nt, Homo sapiens
caaagcagaauccuuacug

SEQ ID NO: 145925 - RNA, 19 nt, Homo sapiens
gaagcagggaguaaguuau

SEQ ID NO: 145926 - RNA, 19 nt, Homo sapiens
gaacagcaugcaagcuuag

SEQ ID NO: 145927 - RNA, 19 nt, Homo sapiens
ccaguggggugaugguuua

SEQ ID NO: 145928 - RNA, 19 nt, Homo sapiens
ggagacgagagggucauua

SEQ ID NO: 145929 - RNA, 19 nt, Homo sapiens
gagauacccugagguucau

SEQ ID NO: 145930 - RNA, 19 nt, Homo sapiens
ugaucagacccuucucuua

SEQ ID NO: 145931 - RNA, 19 nt, Homo sapiens
agucuuagcuuuucaaguu

SEQ ID NO: 145932 - RNA, 19 nt, Homo sapiens
uacugcaggucuuaacuaa

SEQ ID NO: 145933 - RNA, 19 nt, Homo sapiens
uggacgauaugaccaauuc

SEQ ID NO: 145934 - RNA, 19 nt, Homo sapiens
caacgugucccgcuuagag

SEQ ID NO: 145935 - RNA, 19 nt, Homo sapiens
cagaacagcaugcaagcuu

SEQ ID NO: 145936 - RNA, 19 nt, Homo sapiens
gcuacuaaaggaagaagaa

SEQ ID NO: 145937 - RNA, 19 nt, Homo sapiens
gagagcuaaugguccaguu

SEQ ID NO: 145938 - RNA, 19 nt, Homo sapiens
gaagugcuccugacaucuc

SEQ ID NO: 145939 - RNA, 19 nt, Homo sapiens
uagcaaauguggaaaaugu

SEQ ID NO: 145940 - RNA, 19 nt, Homo sapiens
gggaagaucauggacaaau

SEQ ID NO: 145941 - RNA, 19 nt, Homo sapiens
agacuguacuccauaacug

SEQ ID NO: 145942 - RNA, 19 nt, Homo sapiens
agaaagaagacagcuguuu

SEQ ID NO: 145943 - RNA, 19 nt, Homo sapiens
gacuucggcuagagcauga

SEQ ID NO: 145944 - RNA, 19 nt, Homo sapiens
aaacaagaacagagaaauc

SEQ ID NO: 145945 - RNA, 19 nt, Homo sapiens
gagcaugcuugagaguuca

SEQ ID NO: 145946 - RNA, 19 nt, Homo sapiens
acaauuaccagcucuguca

SEQ ID NO: 145947 - RNA, 19 nt, Homo sapiens
ccaacagugucacaauuac

SEQ ID NO: 145948 - RNA, 19 nt, Homo sapiens
ugccaacagugucacaauu

SEQ ID NO: 145949 - RNA, 19 nt, Homo sapiens
agacagcuguuugcagaga

SEQ ID NO: 145950 - RNA, 19 nt, Homo sapiens
agagauacccugagguuca

SEQ ID NO: 145951 - RNA, 19 nt, Homo sapiens
ccagagaaggcacagcaaa

SEQ ID NO: 145952 - RNA, 19 nt, Homo sapiens
uuuggaggguccuucauuu

SEQ ID NO: 145953 - RNA, 19 nt, Homo sapiens
uccaucagccuccuccuua

SEQ ID NO: 145954 - RNA, 19 nt, Homo sapiens
aaagcagaauccuuacugu

SEQ ID NO: 145955 - RNA, 19 nt, Homo sapiens
auagaagcauugcgggaaa

SEQ ID NO: 145956 - RNA, 19 nt, Homo sapiens
gcacaaaguucaagaagaa

SEQ ID NO: 145957 - RNA, 19 nt, Homo sapiens
ugaaagagcugaauucuga

SEQ ID NO: 145958 - RNA, 19 nt, Homo sapiens
gaagaaacuuaaggaauga

SEQ ID NO: 145959 - RNA, 19 nt, Homo sapiens
gaagaacacaggcuaauug

SEQ ID NO: 145960 - RNA, 19 nt, Homo sapiens
gaauuaaagggcaaacuua

SEQ ID NO: 145961 - RNA, 19 nt, Homo sapiens
agaagaaacuuaaggaaug

SEQ ID NO: 145962 - RNA, 19 nt, Homo sapiens
caagcaagcuauagucaga

SEQ ID NO: 145963 - RNA, 19 nt, Homo sapiens
cuaagaagcugacuaaugc

SEQ ID NO: 145964 - RNA, 19 nt, Homo sapiens
gagaagugcuccugacauc

SEQ ID NO: 145965 - RNA, 19 nt, Homo sapiens
cuaaagauguguccugaug

SEQ ID NO: 145966 - RNA, 19 nt, Homo sapiens
caaaccggcuugaugaaga

SEQ ID NO: 145967 - RNA, 19 nt, Homo sapiens
aacagaagcugcaagauga

SEQ ID NO: 145968 - RNA, 19 nt, Homo sapiens
gcgcaaagaugagcuggaa

SEQ ID NO: 145969 - RNA, 19 nt, Homo sapiens
aggaauaccugaaacagaa

SEQ ID NO: 145970 - RNA, 19 nt, Homo sapiens
ggagugaaacagagaguaa

SEQ ID NO: 145971 - RNA, 19 nt, Homo sapiens
gcuaagaagcugacuaaug

SEQ ID NO: 145972 - RNA, 19 nt, Homo sapiens
ucagacagaugaugaaagu

SEQ ID NO: 145973 - RNA, 19 nt, Homo sapiens
agaguaauguggauucuga

SEQ ID NO: 145974 - RNA, 19 nt, Homo sapiens
caaggaugguggcagaauu

SEQ ID NO: 145975 - RNA, 19 nt, Homo sapiens
gauguguccugaugacuau

SEQ ID NO: 145976 - RNA, 19 nt, Homo sapiens
ggaacauaaucuuacauuc

SEQ ID NO: 145977 - RNA, 19 nt, Homo sapiens
gaacagagaaaucuuacag

SEQ ID NO: 145978 - RNA, 19 nt, Homo sapiens
gcucuuacuuauucuguug

SEQ ID NO: 145979 - RNA, 19 nt, Homo sapiens
gcagcagccucaccgaaga

SEQ ID NO: 145980 - RNA, 19 nt, Homo sapiens
agacagaugaugaaaguaa

SEQ ID NO: 145981 - RNA, 19 nt, Homo sapiens
gcaaauccaugcccgaaaa

SEQ ID NO: 145982 - RNA, 19 nt, Homo sapiens
caggucagcuugcaagguu

SEQ ID NO: 145983 - RNA, 19 nt, Homo sapiens
gcugauugcugagcuagaa

SEQ ID NO: 145984 - RNA, 19 nt, Homo sapiens
gcugcaagaugaagcuuau

SEQ ID NO: 145985 - RNA, 19 nt, Homo sapiens
aaacagaagcugcaagaug

SEQ ID NO: 145986 - RNA, 19 nt, Homo sapiens
gcaaagaugagcuggaaca

SEQ ID NO: 145987 - RNA, 19 nt, Homo sapiens
caucccaggucuaguauuc

SEQ ID NO: 145988 - RNA, 19 nt, Homo sapiens
gaugaugaaaguaacauga

SEQ ID NO: 145989 - RNA, 19 nt, Homo sapiens
ucagacagcgcaaagauga

SEQ ID NO: 145990 - RNA, 19 nt, Homo sapiens
gugcauagguguguguuuc

SEQ ID NO: 145991 - RNA, 19 nt, Homo sapiens
caguguagcuuccugagau

SEQ ID NO: 145992 - RNA, 19 nt, Homo sapiens
gcuauagucagacagauga

SEQ ID NO: 145993 - RNA, 19 nt, Homo sapiens
caaaaucaccugcuaagaa

SEQ ID NO: 145994 - RNA, 19 nt, Homo sapiens
caagaagaaacuuaaggaa

SEQ ID NO: 145995 - RNA, 19 nt, Homo sapiens
caaggacagugaaguagag

SEQ ID NO: 145996 - RNA, 19 nt, Homo sapiens
uaaagggaauaucaaggau

SEQ ID NO: 145997 - RNA, 19 nt, Homo sapiens
guagcuuccugagauuuaa

SEQ ID NO: 145998 - RNA, 19 nt, Homo sapiens
gaggaauaccugaaacaga

SEQ ID NO: 145999 - RNA, 19 nt, Homo sapiens
uauguccucucuugugaaa

SEQ ID NO: 146000 - RNA, 19 nt, Homo sapiens
cuuaaggaaugacuugcua

SEQ ID NO: 146001 - RNA, 19 nt, Homo sapiens
gaugguggcagaauuaaag

SEQ ID NO: 146002 - RNA, 19 nt, Homo sapiens
gaaaguaacaugaaaacug

SEQ ID NO: 146003 - RNA, 19 nt, Homo sapiens
gauggaggaauaccugaaa

SEQ ID NO: 146004 - RNA, 19 nt, Homo sapiens
gugagugugcccagaguua

SEQ ID NO: 146005 - RNA, 19 nt, Homo sapiens
gcauagguguguguuucaa

SEQ ID NO: 146006 - RNA, 19 nt, Homo sapiens
gcagauuccaucacuaaca

SEQ ID NO: 146007 - RNA, 19 nt, Homo sapiens
gaugaagaacacaggcuaa

SEQ ID NO: 146008 - RNA, 19 nt, Homo sapiens
ugaaacagaagcugcaaga

SEQ ID NO: 146009 - RNA, 19 nt, Homo sapiens
aaaccggcuugaugaagaa

SEQ ID NO: 146010 - RNA, 19 nt, Homo sapiens
ccacucaacuuggcucaca

SEQ ID NO: 146011 - RNA, 19 nt, Homo sapiens
gaaaacuggugaugaugga

SEQ ID NO: 146012 - RNA, 19 nt, Homo sapiens
gcaauauccuuuuaucaca

SEQ ID NO: 146013 - RNA, 19 nt, Homo sapiens
uccggcagcuggagaauga

SEQ ID NO: 146014 - RNA, 19 nt, Homo sapiens
gcuaguggcugcagauucc

SEQ ID NO: 146015 - RNA, 19 nt, Homo sapiens
ggcaaaggcaugcuugaga

SEQ ID NO: 146016 - RNA, 19 nt, Homo sapiens
gcccagaguuaaagggaau

SEQ ID NO: 146017 - RNA, 19 nt, Homo sapiens
aacccaugcugcuguuaua

SEQ ID NO: 146018 - RNA, 19 nt, Homo sapiens
gaaaacccaugcugcuguu

SEQ ID NO: 146019 - RNA, 19 nt, Homo sapiens
cccagcagcuccugacaga

SEQ ID NO: 146020 - RNA, 19 nt, Homo sapiens
ucacacuccucucaagcaa

SEQ ID NO: 146021 - RNA, 19 nt, Homo sapiens
aaacuuaaggaaugacuug

SEQ ID NO: 146022 - RNA, 19 nt, Homo sapiens
ucaagaagaaacuuaagga

SEQ ID NO: 146023 - RNA, 19 nt, Homo sapiens
ucaugaagcuacuaaagac

SEQ ID NO: 146024 - RNA, 19 nt, Homo sapiens
ugaaguagagcagaacaaa

SEQ ID NO: 146025 - RNA, 19 nt, Homo sapiens
aaacaaacacaggcugaaa

SEQ ID NO: 146026 - RNA, 19 nt, Homo sapiens
gagagcuaaugguccaguu

SEQ ID NO: 146027 - RNA, 19 nt, Homo sapiens
gaagugcuccugacaucuc

SEQ ID NO: 146028 - RNA, 19 nt, Homo sapiens
acagugaaguagagcagaa

SEQ ID NO: 146029 - RNA, 19 nt, Homo sapiens
aaggaugguggcagaauua

SEQ ID NO: 146030 - RNA, 19 nt, Homo sapiens
gacuucggcuagagcauga

SEQ ID NO: 146031 - RNA, 19 nt, Homo sapiens
aaacaagaacagagaaauc

SEQ ID NO: 146032 - RNA, 19 nt, Homo sapiens
uuaaagggaauaucaagga

SEQ ID NO: 146033 - RNA, 19 nt, Homo sapiens
ccagagaaggcacagcaaa

SEQ ID NO: 146034 - RNA, 19 nt, Homo sapiens
gggcaaacuuaccuuccau

SEQ ID NO: 146035 - RNA, 19 nt, Homo sapiens
aaaccuggguacauucaca

SEQ ID NO: 146036 - RNA, 19 nt, Homo sapiens
acuauguccucucuuguga

SEQ ID NO: 146037 - RNA, 19 nt, Homo sapiens
gagcuggaacagagaaugu

SEQ ID NO: 146038 - RNA, 19 nt, Homo sapiens
caggagauccagagacuuc

SEQ ID NO: 146039 - RNA, 19 nt, Homo sapiens
gaaaacaagaacagagaaa

SEQ ID NO: 146040 - RNA, 19 nt, Homo sapiens
cugcuaagaagcugacuaa

SEQ ID NO: 146041 - RNA, 19 nt, Homo sapiens
cuauagugcagcuaacuuu

SEQ ID NO: 146042 - RNA, 19 nt, Homo sapiens
agaauuaaagggcaaacuu

SEQ ID NO: 146043 - RNA, 19 nt, Homo sapiens
cugcagauuccaucacuaa

SEQ ID NO: 146044 - RNA, 19 nt, Homo sapiens
gcuagagcaugaacaagcu

SEQ ID NO: 146045 - RNA, 19 nt, Homo sapiens
ugaagaacacaggcuaauu

SEQ ID NO: 146046 - RNA, 19 nt, Homo sapiens
cgugguucaucccugguua

SEQ ID NO: 146047 - RNA, 19 nt, Homo sapiens
caagcuauagucagacaga

SEQ ID NO: 146048 - RNA, 19 nt, Homo sapiens
aacacuauguccucucuug

SEQ ID NO: 146049 - RNA, 19 nt, Homo sapiens
ugaagcuacuaaagacuca

SEQ ID NO: 146050 - RNA, 19 nt, Homo sapiens
gaagggcaaaggcaugcuu

SEQ ID NO: 146051 - RNA, 19 nt, Homo sapiens
ccaaggacagugaaguaga

SEQ ID NO: 146052 - RNA, 19 nt, Homo sapiens
ugcgugcucuuacuuauuc

SEQ ID NO: 146053 - RNA, 19 nt, Homo sapiens
uaaagauguguccugauga

SEQ ID NO: 146054 - RNA, 19 nt, Homo sapiens
caugaaaacuggugaugau

SEQ ID NO: 146055 - RNA, 19 nt, Homo sapiens
agaguuaaagggaauauca

SEQ ID NO: 146056 - RNA, 19 nt, Homo sapiens
gaaagacuguacuccauaa

SEQ ID NO: 146057 - RNA, 19 nt, Homo sapiens
gaucagacccuucucuuaa

SEQ ID NO: 146058 - RNA, 19 nt, Homo sapiens
gggaacgaauugucauuua

SEQ ID NO: 146059 - RNA, 19 nt, Homo sapiens
gaagaacacaggcuaauug

SEQ ID NO: 146060 - RNA, 19 nt, Homo sapiens
gaauuaaagggcaaacuua

SEQ ID NO: 146061 - RNA, 19 nt, Homo sapiens
ggaacgaauugucauuuau

SEQ ID NO: 146062 - RNA, 19 nt, Homo sapiens
cuaagaagcugacuaaugc

SEQ ID NO: 146063 - RNA, 19 nt, Homo sapiens
gugcuugaauugagauaua

SEQ ID NO: 146064 - RNA, 19 nt, Homo sapiens
gagaagugcuccugacauc

SEQ ID NO: 146065 - RNA, 19 nt, Homo sapiens
gagaaagacuguacuccau

SEQ ID NO: 146066 - RNA, 19 nt, Homo sapiens
caaaccggcuugaugaaga

SEQ ID NO: 146067 - RNA, 19 nt, Homo sapiens
gcgcaaagaugagcuggaa

SEQ ID NO: 146068 - RNA, 19 nt, Homo sapiens
ccacagcacucagaagcua

SEQ ID NO: 146069 - RNA, 19 nt, Homo sapiens
gcuaagaagcugacuaaug

SEQ ID NO: 146070 - RNA, 19 nt, Homo sapiens
ucaaaccagucuuagcuuu

SEQ ID NO: 146071 - RNA, 19 nt, Homo sapiens
gaacugaagcagggaguaa

SEQ ID NO: 146072 - RNA, 19 nt, Homo sapiens
caaggaugguggcagaauu

SEQ ID NO: 146073 - RNA, 19 nt, Homo sapiens
gcaauuaaaucccuuuuca

SEQ ID NO: 146074 - RNA, 19 nt, Homo sapiens
ucaugaagcuacuaaagga

SEQ ID NO: 146075 - RNA, 19 nt, Homo sapiens
ggagcaugcuugagaguuc

SEQ ID NO: 146076 - RNA, 19 nt, Homo sapiens
ggaacauaaucuuacauuc

SEQ ID NO: 146077 - RNA, 19 nt, Homo sapiens
gaacagagaaaucuuacag

SEQ ID NO: 146078 - RNA, 19 nt, Homo sapiens
gcucuuacuuauucuguug

SEQ ID NO: 146079 - RNA, 19 nt, Homo sapiens
acgagagggucauuacaua

SEQ ID NO: 146080 - RNA, 19 nt, Homo sapiens
gcugauugcugagcuagaa

SEQ ID NO: 146081 - RNA, 19 nt, Homo sapiens
gagggucauuacauacuuu

SEQ ID NO: 146082 - RNA, 19 nt, Homo sapiens
gcaaagaugagcuggaaca

SEQ ID NO: 146083 - RNA, 19 nt, Homo sapiens
ucaguucgguuucauuuua

SEQ ID NO: 146084 - RNA, 19 nt, Homo sapiens
caucccaggucuaguauuc

SEQ ID NO: 146085 - RNA, 19 nt, Homo sapiens
cuccauaacugacuauuca

SEQ ID NO: 146086 - RNA, 19 nt, Homo sapiens
ucagacagcgcaaagauga

SEQ ID NO: 146087 - RNA, 19 nt, Homo sapiens
ggaaauaggggcauuguga

SEQ ID NO: 146088 - RNA, 19 nt, Homo sapiens
ugaagcagggaguaaguua

SEQ ID NO: 146089 - RNA, 19 nt, Homo sapiens
caguguagcuuccugagau

SEQ ID NO: 146090 - RNA, 19 nt, Homo sapiens
cugcaggucuuaacuaaca

SEQ ID NO: 146091 - RNA, 19 nt, Homo sapiens
caaaaucaccugcuaagaa

SEQ ID NO: 146092 - RNA, 19 nt, Homo sapiens
uaaagggaauaucaaggau

SEQ ID NO: 146093 - RNA, 19 nt, Homo sapiens
guagcuuccugagauuuaa

SEQ ID NO: 146094 - RNA, 19 nt, Homo sapiens
gcucuaauguauguucaug

SEQ ID NO: 146095 - RNA, 19 nt, Homo sapiens
gaugguggcagaauuaaag

SEQ ID NO: 146096 - RNA, 19 nt, Homo sapiens
gguugacaguaaucucuuu

SEQ ID NO: 146097 - RNA, 19 nt, Homo sapiens
gugagugugcccagaguua

SEQ ID NO: 146098 - RNA, 19 nt, Homo sapiens
cuauucacgucccaucuuu

SEQ ID NO: 146099 - RNA, 19 nt, Homo sapiens
gaugaagaacacaggcuaa

SEQ ID NO: 146100 - RNA, 19 nt, Homo sapiens
agaaagacuguacuccaua

SEQ ID NO: 146101 - RNA, 19 nt, Homo sapiens
cgaauugucauuuauugga

SEQ ID NO: 146102 - RNA, 19 nt, Homo sapiens
aaaccggcuugaugaagaa

SEQ ID NO: 146103 - RNA, 19 nt, Homo sapiens
ccacucaacuuggcucaca

SEQ ID NO: 146104 - RNA, 19 nt, Homo sapiens
caaagcagaauccuuacug

SEQ ID NO: 146105 - RNA, 19 nt, Homo sapiens
gcccagaguuaaagggaau

SEQ ID NO: 146106 - RNA, 19 nt, Homo sapiens
gaagcagggaguaaguuau

SEQ ID NO: 146107 - RNA, 19 nt, Homo sapiens
ggagacgagagggucauua

SEQ ID NO: 146108 - RNA, 19 nt, Homo sapiens
gagauacccugagguucau

SEQ ID NO: 146109 - RNA, 19 nt, Homo sapiens
ugaucagacccuucucuua

SEQ ID NO: 146110 - RNA, 19 nt, Homo sapiens
agucuuagcuuuucaaguu

SEQ ID NO: 146111 - RNA, 19 nt, Homo sapiens
uacugcaggucuuaacuaa

SEQ ID NO: 146112 - RNA, 19 nt, Homo sapiens
gcuacuaaaggaagaagaa

SEQ ID NO: 146113 - RNA, 19 nt, Homo sapiens
gagagcuaaugguccaguu

SEQ ID NO: 146114 - RNA, 19 nt, Homo sapiens
gaagugcuccugacaucuc

SEQ ID NO: 146115 - RNA, 19 nt, Homo sapiens
aaggaugguggcagaauua

SEQ ID NO: 146116 - RNA, 19 nt, Homo sapiens
agacuguacuccauaacug

SEQ ID NO: 146117 - RNA, 19 nt, Homo sapiens
gacuucggcuagagcauga

SEQ ID NO: 146118 - RNA, 19 nt, Homo sapiens
aaacaagaacagagaaauc

SEQ ID NO: 146119 - RNA, 19 nt, Homo sapiens
gagcaugcuugagaguuca

SEQ ID NO: 146120 - RNA, 19 nt, Homo sapiens
agagauacccugagguuca

SEQ ID NO: 146121 - RNA, 19 nt, Homo sapiens
uuaaagggaauaucaagga

SEQ ID NO: 146122 - RNA, 19 nt, Homo sapiens
ccagagaaggcacagcaaa

SEQ ID NO: 146123 - RNA, 19 nt, Homo sapiens
aaagcagaauccuuacugu

SEQ ID NO: 146124 - RNA, 19 nt, Homo sapiens
cuagagauacccugagguu

SEQ ID NO: 146125 - RNA, 19 nt, Homo sapiens
guauguucaugcuucaguu

SEQ ID NO: 146126 - RNA, 19 nt, Homo sapiens
gaccugcgguuuucucauu

SEQ ID NO: 146127 - RNA, 19 nt, Homo sapiens
aagaagaacuaugacaucu

SEQ ID NO: 146128 - RNA, 19 nt, Homo sapiens
gggcaaacuuaccuuccau

SEQ ID NO: 146129 - RNA, 19 nt, Homo sapiens
ugaagcuacuaaaggaaga

SEQ ID NO: 146130 - RNA, 19 nt, Homo sapiens
gagcuggaacagagaaugu

SEQ ID NO: 146131 - RNA, 19 nt, Homo sapiens
caggagauccagagacuuc

SEQ ID NO: 146132 - RNA, 19 nt, Homo sapiens
gaaaacaagaacagagaaa

SEQ ID NO: 146133 - RNA, 19 nt, Homo sapiens
cugcuaagaagcugacuaa

SEQ ID NO: 146134 - RNA, 19 nt, Homo sapiens
agaauuaaagggcaaacuu

SEQ ID NO: 146135 - RNA, 19 nt, Homo sapiens
aaagaagaacuaugacauc

SEQ ID NO: 146136 - RNA, 19 nt, Homo sapiens
gcuagagcaugaacaagcu

SEQ ID NO: 146137 - RNA, 19 nt, Homo sapiens
ugaagaacacaggcuaauu

SEQ ID NO: 146138 - RNA, 19 nt, Homo sapiens
ugcgugcucuuacuuauuc

SEQ ID NO: 146139 - RNA, 19 nt, Homo sapiens
gacgagagggucauuacau

SEQ ID NO: 146140 - RNA, 19 nt, Homo sapiens
uaggaagacucaaaacuau

SEQ ID NO: 146141 - RNA, 19 nt, Homo sapiens
uaaaggaagaagaacugaa

SEQ ID NO: 146142 - RNA, 19 nt, Homo sapiens
ggucucaugaagcuacuaa

SEQ ID NO: 146143 - RNA, 19 nt, Homo sapiens
agaguuaaagggaauauca

SEQ ID NO: 146144 - RNA, 19 nt, Homo sapiens
gagugugcccagaguuaaa

SEQ ID NO: 146145 - RNA, 19 nt, Homo sapiens
ccagagguauaaguuucaa

SEQ ID NO: 146146 - RNA, 19 nt, Homo sapiens
cuacugcaggucuuaacua

SEQ ID NO: 146147 - RNA, 19 nt, Homo sapiens
cuucuggaacauaaucuua

SEQ ID NO: 146148 - RNA, 19 nt, Homo sapiens
uguagcuuccugagauuua

SEQ ID NO: 146149 - RNA, 19 nt, Homo sapiens
aaaggaagaagaacugaag

SEQ ID NO: 146150 - RNA, 19 nt, Homo sapiens
guuggagggucucaugaag

SEQ ID NO: 146151 - RNA, 19 nt, Homo sapiens
ggaugguggcagaauuaaa

SEQ ID NO: 146152 - RNA, 19 nt, Homo sapiens
gagacgagagggucauuac

SEQ ID NO: 146153 - RNA, 19 nt, Homo sapiens
aauccuuacuguugguuga

SEQ ID NO: 146154 - RNA, 19 nt, Homo sapiens
gagauaccacagucacuag

SEQ ID NO: 146155 - RNA, 19 nt, Homo sapiens
agagauaccacagucacua

SEQ ID NO: 146156 - RNA, 19 nt, Homo sapiens
cagaacagccugcaaauua

SEQ ID NO: 146157 - RNA, 19 nt, Homo sapiens
caacaaagacagcuuauug

SEQ ID NO: 146158 - RNA, 19 nt, Homo sapiens
ggaaaucuccugcaaagaa

SEQ ID NO: 146159 - RNA, 19 nt, Homo sapiens
uggaagagcugaugaaguu

SEQ ID NO: 146160 - RNA, 19 nt, Homo sapiens
guugauaucuggaacauga

SEQ ID NO: 146161 - RNA, 19 nt, Homo sapiens
gcacauuccucuccaucuu

SEQ ID NO: 146162 - RNA, 19 nt, Homo sapiens
gacuugagcuuuaacuuug

SEQ ID NO: 146163 - RNA, 19 nt, Homo sapiens
ggaagaccauggcagagaa

SEQ ID NO: 146164 - RNA, 19 nt, Homo sapiens
gaagagaagaugcagaaug

SEQ ID NO: 146165 - RNA, 19 nt, Homo sapiens
gcacaggcuugcccauguu

SEQ ID NO: 146166 - RNA, 19 nt, Homo sapiens
ucauacgacuaucaacuua

SEQ ID NO: 146167 - RNA, 19 nt, Homo sapiens
gaaaucuccugcaaagaag

SEQ ID NO: 146168 - RNA, 19 nt, Homo sapiens
uccaauggcuuaaugauau

SEQ ID NO: 146169 - RNA, 19 nt, Homo sapiens
gaaaugcgugcucagaauu

SEQ ID NO: 146170 - RNA, 19 nt, Homo sapiens
ggauauacccagucacuug

SEQ ID NO: 146171 - RNA, 19 nt, Homo sapiens
ccacugacuugagcuuuaa

SEQ ID NO: 146172 - RNA, 19 nt, Homo sapiens
gcacagcccugcauguacu

SEQ ID NO: 146173 - RNA, 19 nt, Homo sapiens
gaagugagcaaggaugauu

SEQ ID NO: 146174 - RNA, 19 nt, Homo sapiens
aaacaacaaagacagcuua

SEQ ID NO: 146175 - RNA, 19 nt, Homo sapiens
accaagagguuacaguaua

SEQ ID NO: 146176 - RNA, 19 nt, Homo sapiens
uagcaaguuugaccaguuu

SEQ ID NO: 146177 - RNA, 19 nt, Homo sapiens
gaggaacaccgucuuauag

SEQ ID NO: 146178 - RNA, 19 nt, Homo sapiens
gaugaggaacaccgucuua

SEQ ID NO: 146179 - RNA, 19 nt, Homo sapiens
cccaacagcugucuuugaa

SEQ ID NO: 146180 - RNA, 19 nt, Homo sapiens
agaggcagcuguucauaga

SEQ ID NO: 146181 - RNA, 19 nt, Homo sapiens
gaagaggcagcuguucaua

SEQ ID NO: 146182 - RNA, 19 nt, Homo sapiens
gcagagaaagauaaugcua

SEQ ID NO: 146183 - RNA, 19 nt, Homo sapiens
gccacagggucaccacaua

SEQ ID NO: 146184 - RNA, 19 nt, Homo sapiens
aagcugagccaugcaauua

SEQ ID NO: 146185 - RNA, 19 nt, Homo sapiens
ccacagcagagaaagauaa

SEQ ID NO: 146186 - RNA, 19 nt, Homo sapiens
aagagaagaugcagaaugg

SEQ ID NO: 146187 - RNA, 19 nt, Homo sapiens
agaggaaggugcagaggaa

SEQ ID NO: 146188 - RNA, 19 nt, Homo sapiens
ugacuugagcuuuaacuuu

SEQ ID NO: 146189 - RNA, 19 nt, Homo sapiens
ccaagagguuacaguauag

SEQ ID NO: 146190 - RNA, 19 nt, Homo sapiens
gugagaguaugauggguuu

SEQ ID NO: 146191 - RNA, 19 nt, Homo sapiens
gaggcaaguugacgguauu

SEQ ID NO: 146192 - RNA, 19 nt, Homo sapiens
ggaagaagaagagaagaug

SEQ ID NO: 146193 - RNA, 19 nt, Homo sapiens
ugaggaacaccgucuuaua

SEQ ID NO: 146194 - RNA, 19 nt, Homo sapiens
ccacuugaccuugcacaua

SEQ ID NO: 146195 - RNA, 19 nt, Homo sapiens
ccaauggcuuaaugauauu

SEQ ID NO: 146196 - RNA, 19 nt, Homo sapiens
ggacaaauugagauauguu

SEQ ID NO: 146197 - RNA, 19 nt, Homo sapiens
gcaaccagcaccagaugaa

SEQ ID NO: 146198 - RNA, 19 nt, Homo sapiens
agaaaugcgugcucagaau

SEQ ID NO: 146199 - RNA, 19 nt, Homo sapiens
cagaggagccggacacaga

SEQ ID NO: 146200 - RNA, 19 nt, Homo sapiens
gcacaagguacgaggagaa

SEQ ID NO: 146201 - RNA, 19 nt, Homo sapiens
gcaggaggccuucgcacaa

SEQ ID NO: 146202 - RNA, 19 nt, Homo sapiens
ccaccaagagguuacagua

SEQ ID NO: 146203 - RNA, 19 nt, Homo sapiens
ugucaucccuggugaagga

SEQ ID NO: 146204 - RNA, 19 nt, Homo sapiens
gagaagaggcagcuguuca

SEQ ID NO: 146205 - RNA, 19 nt, Homo sapiens
gaagcugagccaugcaauu

SEQ ID NO: 146206 - RNA, 19 nt, Homo sapiens
gaagaugcagaaugggaaa

SEQ ID NO: 146207 - RNA, 19 nt, Homo sapiens
cccacugacuugagcuuua

SEQ ID NO: 146208 - RNA, 19 nt, Homo sapiens
caaggaugauugaggaaag

SEQ ID NO: 146209 - RNA, 19 nt, Homo sapiens
gaacaagcgccuuccuucu

SEQ ID NO: 146210 - RNA, 19 nt, Homo sapiens
cgagacaauggccuuaaua

SEQ ID NO: 146211 - RNA, 19 nt, Homo sapiens
ugaugaaguugcugaagga

SEQ ID NO: 146212 - RNA, 19 nt, Homo sapiens
gcaaaggaaggaugaacug

SEQ ID NO: 146213 - RNA, 19 nt, Homo sapiens
cacuugaccuugcacauau

SEQ ID NO: 146214 - RNA, 19 nt, Homo sapiens
gaaaccacuugaccuugca

SEQ ID NO: 146215 - RNA, 19 nt, Homo sapiens
cagagaaagauaaugcuaa

SEQ ID NO: 146216 - RNA, 19 nt, Homo sapiens
uuaauacacuggaccauac

SEQ ID NO: 146217 - RNA, 19 nt, Homo sapiens
gaacuggagcagaggaugu

SEQ ID NO: 146218 - RNA, 19 nt, Homo sapiens
ggaacaagcggaagaccau

SEQ ID NO: 146219 - RNA, 19 nt, Homo sapiens
ccaaauuaguguggaacaa

SEQ ID NO: 146220 - RNA, 19 nt, Homo sapiens
aggcagcuguucauagaaa

SEQ ID NO: 146221 - RNA, 19 nt, Homo sapiens
ugaaggaaguucugaagcu

SEQ ID NO: 146222 - RNA, 19 nt, Homo sapiens
gcaaggaugauugaggaaa

SEQ ID NO: 146223 - RNA, 19 nt, Homo sapiens
uuacagaacagccugcaaa

SEQ ID NO: 146224 - RNA, 19 nt, Homo sapiens
ggaacaccgucuuauagcu

SEQ ID NO: 146225 - RNA, 19 nt, Homo sapiens
gcaauuaguaaaucuuugg

SEQ ID NO: 146226 - RNA, 19 nt, Homo sapiens
gcugagccaugcaauuagu

SEQ ID NO: 146227 - RNA, 19 nt, Homo sapiens
cgaggcaaguugacgguau

SEQ ID NO: 146228 - RNA, 19 nt, Homo sapiens
ggaaggugcagaggaagaa

SEQ ID NO: 146229 - RNA, 19 nt, Homo sapiens
ccagucacuuggccgauga

SEQ ID NO: 146230 - RNA, 19 nt, Homo sapiens
gaagggccaucuuuugguu

SEQ ID NO: 146231 - RNA, 19 nt, Homo sapiens
cuccucaacuuuaugauug

SEQ ID NO: 146232 - RNA, 19 nt, Homo sapiens
acaauggccuuaauacacu

SEQ ID NO: 146233 - RNA, 19 nt, Homo sapiens
aagaagagaagaugcagaa

SEQ ID NO: 146234 - RNA, 19 nt, Homo sapiens
gccaggauauacccaguca

SEQ ID NO: 146235 - RNA, 19 nt, Homo sapiens
gacaauggccuuaauacac

SEQ ID NO: 146236 - RNA, 19 nt, Homo sapiens
cgaugagcaugcgcugaua

SEQ ID NO: 146237 - RNA, 19 nt, Homo sapiens
caaauuaguguggaacaau

SEQ ID NO: 146238 - RNA, 19 nt, Homo sapiens
acuaucaacuuacagaaca

SEQ ID NO: 146239 - RNA, 19 nt, Homo sapiens
ucaccaaauuaguguggaa

SEQ ID NO: 146240 - RNA, 19 nt, Homo sapiens
gggaagugagcaaggauga

SEQ ID NO: 146241 - RNA, 19 nt, Homo sapiens
agaacagccugcaaauuac

SEQ ID NO: 146242 - RNA, 19 nt, Homo sapiens
gcucccaacagcugucuuu

SEQ ID NO: 146243 - RNA, 19 nt, Homo sapiens
uuagcaaguuugaccaguu

SEQ ID NO: 146244 - RNA, 19 nt, Homo sapiens
aaauuaguguggaacaauc

SEQ ID NO: 146245 - RNA, 19 nt, Homo sapiens
aacaagcgccuuccuucua

SEQ ID NO: 146246 - RNA, 19 nt, Homo sapiens
caucuccgcaucaggaauu

SEQ ID NO: 146247 - RNA, 19 nt, Homo sapiens
gccaugcaauuaguaaauc

SEQ ID NO: 146248 - RNA, 19 nt, Homo sapiens
uuggaaaucuccugcaaag

SEQ ID NO: 146249 - RNA, 19 nt, Homo sapiens
gaccauaccaccgagauca

SEQ ID NO: 146250 - RNA, 19 nt, Homo sapiens
gaugucauacgacuaucaa

SEQ ID NO: 146251 - RNA, 19 nt, Homo sapiens
ugacucguccucccacuga

SEQ ID NO: 146252 - RNA, 19 nt, Homo sapiens
ugaaugacaccaugguuag

SEQ ID NO: 146253 - RNA, 19 nt, Homo sapiens
gagacaauggccuuaauac

SEQ ID NO: 146254 - RNA, 19 nt, Homo sapiens
ccgagacaauggccuuaau

SEQ ID NO: 146255 - RNA, 19 nt, Homo sapiens
gcagaaugggaaagacaga

SEQ ID NO: 146256 - RNA, 19 nt, Homo sapiens
cagaacagccugcaaauua

SEQ ID NO: 146257 - RNA, 19 nt, Homo sapiens
caacaaagacagcuuauug

SEQ ID NO: 146258 - RNA, 19 nt, Homo sapiens
ggaaaucuccugcaaagaa

SEQ ID NO: 146259 - RNA, 19 nt, Homo sapiens
uggaagagcugaugaaguu

SEQ ID NO: 146260 - RNA, 19 nt, Homo sapiens
guugauaucuggaacauga

SEQ ID NO: 146261 - RNA, 19 nt, Homo sapiens
uagagcauguucuuacuua

SEQ ID NO: 146262 - RNA, 19 nt, Homo sapiens
gacuugagcuuuaacuuug

SEQ ID NO: 146263 - RNA, 19 nt, Homo sapiens
ggaagaccauggcagagaa

SEQ ID NO: 146264 - RNA, 19 nt, Homo sapiens
gcacaggcuugcccauguu

SEQ ID NO: 146265 - RNA, 19 nt, Homo sapiens
ucauacgacuaucaacuua

SEQ ID NO: 146266 - RNA, 19 nt, Homo sapiens
gaaaucuccugcaaagaag

SEQ ID NO: 146267 - RNA, 19 nt, Homo sapiens
uccaauggcuuaaugauau

SEQ ID NO: 146268 - RNA, 19 nt, Homo sapiens
gaaaugcgugcucagaauu

SEQ ID NO: 146269 - RNA, 19 nt, Homo sapiens
gggcuaauauccagaaucu

SEQ ID NO: 146270 - RNA, 19 nt, Homo sapiens
gaacaggcaaccuacagaa

SEQ ID NO: 146271 - RNA, 19 nt, Homo sapiens
ggauauacccagucacuug

SEQ ID NO: 146272 - RNA, 19 nt, Homo sapiens
gaagaggguuuuaugugua

SEQ ID NO: 146273 - RNA, 19 nt, Homo sapiens
ccacugacuugagcuuuaa

SEQ ID NO: 146274 - RNA, 19 nt, Homo sapiens
aaagucaauugcaggcuua

SEQ ID NO: 146275 - RNA, 19 nt, Homo sapiens
gaagugagcaaggaugauu

SEQ ID NO: 146276 - RNA, 19 nt, Homo sapiens
aaacaacaaagacagcuua

SEQ ID NO: 146277 - RNA, 19 nt, Homo sapiens
accaagagguuacaguaua

SEQ ID NO: 146278 - RNA, 19 nt, Homo sapiens
gaaugaaugugcaugaaaa

SEQ ID NO: 146279 - RNA, 19 nt, Homo sapiens
uagcaaguuugaccaguuu

SEQ ID NO: 146280 - RNA, 19 nt, Homo sapiens
gcaggcuuaucuacaauau

SEQ ID NO: 146281 - RNA, 19 nt, Homo sapiens
gagcauguucuuacuuaaa

SEQ ID NO: 146282 - RNA, 19 nt, Homo sapiens
gaggaacaccgucuuauag

SEQ ID NO: 146283 - RNA, 19 nt, Homo sapiens
gaugaggaacaccgucuua

SEQ ID NO: 146284 - RNA, 19 nt, Homo sapiens
cccaacagcugucuuugaa

SEQ ID NO: 146285 - RNA, 19 nt, Homo sapiens
gcaaucuacucaucugaca

SEQ ID NO: 146286 - RNA, 19 nt, Homo sapiens
gaagaggcagcuguucaua

SEQ ID NO: 146287 - RNA, 19 nt, Homo sapiens
agaggcagcuguucauaga

SEQ ID NO: 146288 - RNA, 19 nt, Homo sapiens
gaagcugaguuuucguuua

SEQ ID NO: 146289 - RNA, 19 nt, Homo sapiens
aaccagagcuuguaaguac

SEQ ID NO: 146290 - RNA, 19 nt, Homo sapiens
gcagagaaagauaaugcua

SEQ ID NO: 146291 - RNA, 19 nt, Homo sapiens
cuacaaagaacucaaacaa

SEQ ID NO: 146292 - RNA, 19 nt, Homo sapiens
aagcugagccaugcaauua

SEQ ID NO: 146293 - RNA, 19 nt, Homo sapiens
ccacagcagagaaagauaa

SEQ ID NO: 146294 - RNA, 19 nt, Homo sapiens
ccacugacccacucaagaa

SEQ ID NO: 146295 - RNA, 19 nt, Homo sapiens
cuauagauguccuuuaaca

SEQ ID NO: 146296 - RNA, 19 nt, Homo sapiens
ugacuugagcuuuaacuuu

SEQ ID NO: 146297 - RNA, 19 nt, Homo sapiens
ccaagagguuacaguauag

SEQ ID NO: 146298 - RNA, 19 nt, Homo sapiens
gugagaguaugauggguuu

SEQ ID NO: 146299 - RNA, 19 nt, Homo sapiens
gaggcaaguugacgguauu

SEQ ID NO: 146300 - RNA, 19 nt, Homo sapiens
gcaaugauuuccuguucag

SEQ ID NO: 146301 - RNA, 19 nt, Homo sapiens
gcucuuucauucucuguug

SEQ ID NO: 146302 - RNA, 19 nt, Homo sapiens
ugaggaacaccgucuuaua

SEQ ID NO: 146303 - RNA, 19 nt, Homo sapiens
ccacuugaccuugcacaua

SEQ ID NO: 146304 - RNA, 19 nt, Homo sapiens
ccaauggcuuaaugauauu

SEQ ID NO: 146305 - RNA, 19 nt, Homo sapiens
ggacaaauugagauauguu

SEQ ID NO: 146306 - RNA, 19 nt, Homo sapiens
ggagguuuauguuuguuuc

SEQ ID NO: 146307 - RNA, 19 nt, Homo sapiens
agaaaugcgugcucagaau

SEQ ID NO: 146308 - RNA, 19 nt, Homo sapiens
gcaaccagcaccagaugaa

SEQ ID NO: 146309 - RNA, 19 nt, Homo sapiens
gcuaauauccagaaucuac

SEQ ID NO: 146310 - RNA, 19 nt, Homo sapiens
ccaccaagagguuacagua

SEQ ID NO: 146311 - RNA, 19 nt, Homo sapiens
ggacuucuuuugcuaacua

SEQ ID NO: 146312 - RNA, 19 nt, Homo sapiens
gagaagaggcagcuguuca

SEQ ID NO: 146313 - RNA, 19 nt, Homo sapiens
gaagcugagccaugcaauu

SEQ ID NO: 146314 - RNA, 19 nt, Homo sapiens
auugaagugugcaugauua

SEQ ID NO: 146315 - RNA, 19 nt, Homo sapiens
cccacugacuugagcuuua

SEQ ID NO: 146316 - RNA, 19 nt, Homo sapiens
caaggaugauugaggaaag

SEQ ID NO: 146317 - RNA, 19 nt, Homo sapiens
gaacaagcgccuuccuucu

SEQ ID NO: 146318 - RNA, 19 nt, Homo sapiens
cgagacaauggccuuaaua

SEQ ID NO: 146319 - RNA, 19 nt, Homo sapiens
uauccagaaucuacaaaga

SEQ ID NO: 146320 - RNA, 19 nt, Homo sapiens
guaaguacccaucuguugu

SEQ ID NO: 146321 - RNA, 19 nt, Homo sapiens
uaaaauggccuaaaaguuc

SEQ ID NO: 146322 - RNA, 19 nt, Homo sapiens
ugaugaaguugcugaagga

SEQ ID NO: 146323 - RNA, 19 nt, Homo sapiens
gcaaaggaaggaugaacug

SEQ ID NO: 146324 - RNA, 19 nt, Homo sapiens
cacuugaccuugcacauau

SEQ ID NO: 146325 - RNA, 19 nt, Homo sapiens
gaaaccacuugaccuugca

SEQ ID NO: 146326 - RNA, 19 nt, Homo sapiens
cagagaaagauaaugcuaa

SEQ ID NO: 146327 - RNA, 19 nt, Homo sapiens
uuaauacacuggaccauac

SEQ ID NO: 146328 - RNA, 19 nt, Homo sapiens
ggaacaagcggaagaccau

SEQ ID NO: 146329 - RNA, 19 nt, Homo sapiens
gccggacucucgcuccuuu

SEQ ID NO: 146330 - RNA, 19 nt, Homo sapiens
gaacuggagcagaggaugu

SEQ ID NO: 146331 - RNA, 19 nt, Homo sapiens
ccaaauuaguguggaacaa

SEQ ID NO: 146332 - RNA, 19 nt, Homo sapiens
aggcagcuguucauagaaa

SEQ ID NO: 146333 - RNA, 19 nt, Homo sapiens
gcaaggaugauugaggaaa

SEQ ID NO: 146334 - RNA, 19 nt, Homo sapiens
uuacagaacagccugcaaa

SEQ ID NO: 146335 - RNA, 19 nt, Homo sapiens
ugaaggaaguucugaagcu

SEQ ID NO: 146336 - RNA, 19 nt, Homo sapiens
cuacaauauuagcaccaua

SEQ ID NO: 146337 - RNA, 19 nt, Homo sapiens
ugacuccacuugcaaugau

SEQ ID NO: 146338 - RNA, 19 nt, Homo sapiens
aaaguucaaggcauguuua

SEQ ID NO: 146339 - RNA, 19 nt, Homo sapiens
guucuuccuuuccucauau

SEQ ID NO: 146340 - RNA, 19 nt, Homo sapiens
ggaacaccgucuuauagcu

SEQ ID NO: 146341 - RNA, 19 nt, Homo sapiens
gcaauuaguaaaucuuugg

SEQ ID NO: 146342 - RNA, 19 nt, Homo sapiens
gcugagccaugcaauuagu

SEQ ID NO: 146343 - RNA, 19 nt, Homo sapiens
cgaggcaaguugacgguau

SEQ ID NO: 146344 - RNA, 19 nt, Homo sapiens
gcauugaagugugcaugau

SEQ ID NO: 146345 - RNA, 19 nt, Homo sapiens
ccagucacuuggccgauga

SEQ ID NO: 146346 - RNA, 19 nt, Homo sapiens
gaagggccaucuuuugguu

SEQ ID NO: 146347 - RNA, 19 nt, Homo sapiens
cuccucaacuuuaugauug

SEQ ID NO: 146348 - RNA, 19 nt, Homo sapiens
acaauggccuuaauacacu

SEQ ID NO: 146349 - RNA, 19 nt, Homo sapiens
auaaauguuucuccucuuc

SEQ ID NO: 146350 - RNA, 19 nt, Homo sapiens
ugaaugaaugugcaugaaa

SEQ ID NO: 146351 - RNA, 19 nt, Homo sapiens
gccaggauauacccaguca

SEQ ID NO: 146352 - RNA, 19 nt, Homo sapiens
gacaauggccuuaauacac

SEQ ID NO: 146353 - RNA, 19 nt, Homo sapiens
gauuucaaagcacacauuu

SEQ ID NO: 146354 - RNA, 19 nt, Homo sapiens
cgaugagcaugcgcugaua

SEQ ID NO: 146355 - RNA, 19 nt, Homo sapiens
caaauuaguguggaacaau

SEQ ID NO: 146356 - RNA, 19 nt, Homo sapiens
cagaacagccugcaaauua

SEQ ID NO: 146357 - RNA, 19 nt, Homo sapiens
caacaaagacagcuuauug

SEQ ID NO: 146358 - RNA, 19 nt, Homo sapiens
ggaaaucuccugcaaagaa

SEQ ID NO: 146359 - RNA, 19 nt, Homo sapiens
uggaagagcugaugaaguu

SEQ ID NO: 146360 - RNA, 19 nt, Homo sapiens
guugauaucuggaacauga

SEQ ID NO: 146361 - RNA, 19 nt, Homo sapiens
gcacauuccucuccaucuu

SEQ ID NO: 146362 - RNA, 19 nt, Homo sapiens
gacuugagcuuuaacuuug

SEQ ID NO: 146363 - RNA, 19 nt, Homo sapiens
ggaagaccauggcagagaa

SEQ ID NO: 146364 - RNA, 19 nt, Homo sapiens
gaagagaagaugcagaaug

SEQ ID NO: 146365 - RNA, 19 nt, Homo sapiens
gcacaggcuugcccauguu

SEQ ID NO: 146366 - RNA, 19 nt, Homo sapiens
ucauacgacuaucaacuua

SEQ ID NO: 146367 - RNA, 19 nt, Homo sapiens
gaaaucuccugcaaagaag

SEQ ID NO: 146368 - RNA, 19 nt, Homo sapiens
uccaauggcuuaaugauau

SEQ ID NO: 146369 - RNA, 19 nt, Homo sapiens
gaaaugcgugcucagaauu

SEQ ID NO: 146370 - RNA, 19 nt, Homo sapiens
ccacugacuugagcuuuaa

SEQ ID NO: 146371 - RNA, 19 nt, Homo sapiens
gcacagcccugcauguacu

SEQ ID NO: 146372 - RNA, 19 nt, Homo sapiens
gaagugagcaaggaugauu

SEQ ID NO: 146373 - RNA, 19 nt, Homo sapiens
aaacaacaaagacagcuua

SEQ ID NO: 146374 - RNA, 19 nt, Homo sapiens
uagcaaguuugaccaguuu

SEQ ID NO: 146375 - RNA, 19 nt, Homo sapiens
gaggaacaccgucuuauag

SEQ ID NO: 146376 - RNA, 19 nt, Homo sapiens
gaugaggaacaccgucuua

SEQ ID NO: 146377 - RNA, 19 nt, Homo sapiens
cccaacagcugucuuugaa

SEQ ID NO: 146378 - RNA, 19 nt, Homo sapiens
agaggcagcuguucauaga

SEQ ID NO: 146379 - RNA, 19 nt, Homo sapiens
gaagaggcagcuguucaua

SEQ ID NO: 146380 - RNA, 19 nt, Homo sapiens
gcagagaaagauaaugcua

SEQ ID NO: 146381 - RNA, 19 nt, Homo sapiens
gccacagggucaccacaua

SEQ ID NO: 146382 - RNA, 19 nt, Homo sapiens
aagcugagccaugcaauua

SEQ ID NO: 146383 - RNA, 19 nt, Homo sapiens
ccacagcagagaaagauaa

SEQ ID NO: 146384 - RNA, 19 nt, Homo sapiens
aagagaagaugcagaaugg

SEQ ID NO: 146385 - RNA, 19 nt, Homo sapiens
agaggaaggugcagaggaa

SEQ ID NO: 146386 - RNA, 19 nt, Homo sapiens
ugacuugagcuuuaacuuu

SEQ ID NO: 146387 - RNA, 19 nt, Homo sapiens
gugagaguaugauggguuu

SEQ ID NO: 146388 - RNA, 19 nt, Homo sapiens
gaggcaaguugacgguauu

SEQ ID NO: 146389 - RNA, 19 nt, Homo sapiens
ggaagaagaagagaagaug

SEQ ID NO: 146390 - RNA, 19 nt, Homo sapiens
ugaggaacaccgucuuaua

SEQ ID NO: 146391 - RNA, 19 nt, Homo sapiens
ccacuugaccuugcacaua

SEQ ID NO: 146392 - RNA, 19 nt, Homo sapiens
ccaauggcuuaaugauauu

SEQ ID NO: 146393 - RNA, 19 nt, Homo sapiens
ggacaaauugagauauguu

SEQ ID NO: 146394 - RNA, 19 nt, Homo sapiens
gcaaccagcaccagaugaa

SEQ ID NO: 146395 - RNA, 19 nt, Homo sapiens
agaaaugcgugcucagaau

SEQ ID NO: 146396 - RNA, 19 nt, Homo sapiens
cagaggagccggacacaga

SEQ ID NO: 146397 - RNA, 19 nt, Homo sapiens
gcaggaggccuucgcacaa

SEQ ID NO: 146398 - RNA, 19 nt, Homo sapiens
gaagcugagccaugcaauu

SEQ ID NO: 146399 - RNA, 19 nt, Homo sapiens
gagaagaggcagcuguuca

SEQ ID NO: 146400 - RNA, 19 nt, Homo sapiens
gaagaugcagaaugggaaa

SEQ ID NO: 146401 - RNA, 19 nt, Homo sapiens
cccacugacuugagcuuua

SEQ ID NO: 146402 - RNA, 19 nt, Homo sapiens
caaggaugauugaggaaag

SEQ ID NO: 146403 - RNA, 19 nt, Homo sapiens
gaacaagcgccuuccuucu

SEQ ID NO: 146404 - RNA, 19 nt, Homo sapiens
cgagacaauggccuuaaua

SEQ ID NO: 146405 - RNA, 19 nt, Homo sapiens
ugaugaaguugcugaagga

SEQ ID NO: 146406 - RNA, 19 nt, Homo sapiens
gcaaaggaaggaugaacug

SEQ ID NO: 146407 - RNA, 19 nt, Homo sapiens
cacuugaccuugcacauau

SEQ ID NO: 146408 - RNA, 19 nt, Homo sapiens
gaaaccacuugaccuugca

SEQ ID NO: 146409 - RNA, 19 nt, Homo sapiens
cagagaaagauaaugcuaa

SEQ ID NO: 146410 - RNA, 19 nt, Homo sapiens
uuaauacacuggaccauac

SEQ ID NO: 146411 - RNA, 19 nt, Homo sapiens
gaacuggagcagaggaugu

SEQ ID NO: 146412 - RNA, 19 nt, Homo sapiens
ggaacaagcggaagaccau

SEQ ID NO: 146413 - RNA, 19 nt, Homo sapiens
ccaaauuaguguggaacaa

SEQ ID NO: 146414 - RNA, 19 nt, Homo sapiens
aggcagcuguucauagaaa

SEQ ID NO: 146415 - RNA, 19 nt, Homo sapiens
ugaaggaaguucugaagcu

SEQ ID NO: 146416 - RNA, 19 nt, Homo sapiens
uuacagaacagccugcaaa

SEQ ID NO: 146417 - RNA, 19 nt, Homo sapiens
gcaaggaugauugaggaaa

SEQ ID NO: 146418 - RNA, 19 nt, Homo sapiens
ggaacaccgucuuauagcu

SEQ ID NO: 146419 - RNA, 19 nt, Homo sapiens
gcaauuaguaaaucuuugg

SEQ ID NO: 146420 - RNA, 19 nt, Homo sapiens
gcugagccaugcaauuagu

SEQ ID NO: 146421 - RNA, 19 nt, Homo sapiens
cgaggcaaguugacgguau

SEQ ID NO: 146422 - RNA, 19 nt, Homo sapiens
ggaaggugcagaggaagaa

SEQ ID NO: 146423 - RNA, 19 nt, Homo sapiens
gaagggccaucuuuugguu

SEQ ID NO: 146424 - RNA, 19 nt, Homo sapiens
cuccucaacuuuaugauug

SEQ ID NO: 146425 - RNA, 19 nt, Homo sapiens
acaauggccuuaauacacu

SEQ ID NO: 146426 - RNA, 19 nt, Homo sapiens
aagaagagaagaugcagaa

SEQ ID NO: 146427 - RNA, 19 nt, Homo sapiens
gacaauggccuuaauacac

SEQ ID NO: 146428 - RNA, 19 nt, Homo sapiens
caaauuaguguggaacaau

SEQ ID NO: 146429 - RNA, 19 nt, Homo sapiens
acuaucaacuuacagaaca

SEQ ID NO: 146430 - RNA, 19 nt, Homo sapiens
ucaccaaauuaguguggaa

SEQ ID NO: 146431 - RNA, 19 nt, Homo sapiens
gggaagugagcaaggauga

SEQ ID NO: 146432 - RNA, 19 nt, Homo sapiens
gcucccaacagcugucuuu

SEQ ID NO: 146433 - RNA, 19 nt, Homo sapiens
uuagcaaguuugaccaguu

SEQ ID NO: 146434 - RNA, 19 nt, Homo sapiens
agaacagccugcaaauuac

SEQ ID NO: 146435 - RNA, 19 nt, Homo sapiens
aaauuaguguggaacaauc

SEQ ID NO: 146436 - RNA, 19 nt, Homo sapiens
aacaagcgccuuccuucua

SEQ ID NO: 146437 - RNA, 19 nt, Homo sapiens
caucuccgcaucaggaauu

SEQ ID NO: 146438 - RNA, 19 nt, Homo sapiens
gccaugcaauuaguaaauc

SEQ ID NO: 146439 - RNA, 19 nt, Homo sapiens
uuggaaaucuccugcaaag

SEQ ID NO: 146440 - RNA, 19 nt, Homo sapiens
gaccauaccaccgagauca

SEQ ID NO: 146441 - RNA, 19 nt, Homo sapiens
ugacucguccucccacuga

SEQ ID NO: 146442 - RNA, 19 nt, Homo sapiens
gaugucauacgacuaucaa

SEQ ID NO: 146443 - RNA, 19 nt, Homo sapiens
ugaaugacaccaugguuag

SEQ ID NO: 146444 - RNA, 19 nt, Homo sapiens
gagacaauggccuuaauac

SEQ ID NO: 146445 - RNA, 19 nt, Homo sapiens
ccgagacaauggccuuaau

SEQ ID NO: 146446 - RNA, 19 nt, Homo sapiens
gcagaaugggaaagacaga

SEQ ID NO: 146447 - RNA, 19 nt, Homo sapiens
gugcagaggaagaagaaga

SEQ ID NO: 146448 - RNA, 19 nt, Homo sapiens
auacgacuaucaacuuaca

SEQ ID NO: 146449 - RNA, 19 nt, Homo sapiens
agagaaaccacuugaccuu

SEQ ID NO: 146450 - RNA, 19 nt, Homo sapiens
uagaaaugcgugcucagaa

SEQ ID NO: 146451 - RNA, 19 nt, Homo sapiens
ccagaugucagauuccaau

SEQ ID NO: 146452 - RNA, 19 nt, Homo sapiens
cuggacaaauugagauaug

SEQ ID NO: 146453 - RNA, 19 nt, Homo sapiens
ugaccuugcacauauaguu

SEQ ID NO: 146454 - RNA, 19 nt, Homo sapiens
gaauuuugaugucauacga

SEQ ID NO: 146455 - RNA, 19 nt, Homo sapiens
acaagcgccuuccuucuac

SEQ ID NO: 146456 - RNA, 19 nt, Homo sapiens
acacuuaucuucuggauua

SEQ ID NO: 146457 - RNA, 19 nt, Homo sapiens
gaagaaagcaacaaagauu

SEQ ID NO: 146458 - RNA, 19 nt, Homo sapiens
ucaagugccuagacuguua

SEQ ID NO: 146459 - RNA, 19 nt, Homo sapiens
gagaggagguuaugaugug

SEQ ID NO: 146460 - RNA, 19 nt, Homo sapiens
ccaaggugcugaugucaaa

SEQ ID NO: 146461 - RNA, 19 nt, Homo sapiens
ggaaguuucuggugccauu

SEQ ID NO: 146462 - RNA, 19 nt, Homo sapiens
ccacaaagcuaggaugguu

SEQ ID NO: 146463 - RNA, 19 nt, Homo sapiens
ugacccaucuguaguaauu

SEQ ID NO: 146464 - RNA, 19 nt, Homo sapiens
ccacaagccugagaacuga

SEQ ID NO: 146465 - RNA, 19 nt, Homo sapiens
gacacaaggugauuucaga

SEQ ID NO: 146466 - RNA, 19 nt, Homo sapiens
gaacucacuuucccuugug

SEQ ID NO: 146467 - RNA, 19 nt, Homo sapiens
ggauuagaaugccgguuaa

SEQ ID NO: 146468 - RNA, 19 nt, Homo sapiens
gaaggaacagggaacauug

SEQ ID NO: 146469 - RNA, 19 nt, Homo sapiens
gagcaagaaggaaagauuu

SEQ ID NO: 146470 - RNA, 19 nt, Homo sapiens
gaaaaucgcuuauauaccu

SEQ ID NO: 146471 - RNA, 19 nt, Homo sapiens
gugcugaugucaaagugua

SEQ ID NO: 146472 - RNA, 19 nt, Homo sapiens
gagaagccauguacucaag

SEQ ID NO: 146473 - RNA, 19 nt, Homo sapiens
gagagagacuugugcucaa

SEQ ID NO: 146474 - RNA, 19 nt, Homo sapiens
ggacccaugucuucggaaa

SEQ ID NO: 146475 - RNA, 19 nt, Homo sapiens
gcaaaaggcugagaaggaa

SEQ ID NO: 146476 - RNA, 19 nt, Homo sapiens
ggagaaugcaaauauguga

SEQ ID NO: 146477 - RNA, 19 nt, Homo sapiens
gggaaggcuuuguauaauc

SEQ ID NO: 146478 - RNA, 19 nt, Homo sapiens
gacaagacacucaagaaga

SEQ ID NO: 146479 - RNA, 19 nt, Homo sapiens
ggaagaaagcaacaaagau

SEQ ID NO: 146480 - RNA, 19 nt, Homo sapiens
gaacauuggagcugacugu

SEQ ID NO: 146481 - RNA, 19 nt, Homo sapiens
ugaguuaacugugaaauac

SEQ ID NO: 146482 - RNA, 19 nt, Homo sapiens
gaagacacaaggugauuuc

SEQ ID NO: 146483 - RNA, 19 nt, Homo sapiens
cuacauuucugcagaucuu

SEQ ID NO: 146484 - RNA, 19 nt, Homo sapiens
guuuguaaaugccucuuaa

SEQ ID NO: 146485 - RNA, 19 nt, Homo sapiens
ggacugcuaccucugagaa

SEQ ID NO: 146486 - RNA, 19 nt, Homo sapiens
aaagugaaguugggcauga

SEQ ID NO: 146487 - RNA, 19 nt, Homo sapiens
ggaaauacaaggacuucug

SEQ ID NO: 146488 - RNA, 19 nt, Homo sapiens
aaagauuugugaacuggaa

SEQ ID NO: 146489 - RNA, 19 nt, Homo sapiens
ugucaaaguguaacagaua

SEQ ID NO: 146490 - RNA, 19 nt, Homo sapiens
gaucuuccguggucagagu

SEQ ID NO: 146491 - RNA, 19 nt, Homo sapiens
gugccuagacuguuacuuu

SEQ ID NO: 146492 - RNA, 19 nt, Homo sapiens
uuagaaugccgguuaaauu

SEQ ID NO: 146493 - RNA, 19 nt, Homo sapiens
caagacauuucucuaacuc

SEQ ID NO: 146494 - RNA, 19 nt, Homo sapiens
acaagacacucaagaagag

SEQ ID NO: 146495 - RNA, 19 nt, Homo sapiens
ggaaggcuuuguauaaucc

SEQ ID NO: 146496 - RNA, 19 nt, Homo sapiens
gagcugacuguucuuggua

SEQ ID NO: 146497 - RNA, 19 nt, Homo sapiens
acccaugucuucggaaaua

SEQ ID NO: 146498 - RNA, 19 nt, Homo sapiens
gaagaagagggacccaugu

SEQ ID NO: 146499 - RNA, 19 nt, Homo sapiens
gcacuggccacaccaaaca

SEQ ID NO: 146500 - RNA, 19 nt, Homo sapiens
gaagguaugcugucauggu

SEQ ID NO: 146501 - RNA, 19 nt, Homo sapiens
acccaucuguaguaauuua

SEQ ID NO: 146502 - RNA, 19 nt, Homo sapiens
gagaagacacaaggugauu

SEQ ID NO: 146503 - RNA, 19 nt, Homo sapiens
guuaugauguggaaaauga

SEQ ID NO: 146504 - RNA, 19 nt, Homo sapiens
caacuuguauuuccaaacc

SEQ ID NO: 146505 - RNA, 19 nt, Homo sapiens
ggagcugacuguucuuggu

SEQ ID NO: 146506 - RNA, 19 nt, Homo sapiens
ccauggagaaugcaaauau

SEQ ID NO: 146507 - RNA, 19 nt, Homo sapiens
ggacuucuacccagaugga

SEQ ID NO: 146508 - RNA, 19 nt, Homo sapiens
uggauuagaaugccgguua

SEQ ID NO: 146509 - RNA, 19 nt, Homo sapiens
cauggagaaugcaaauaug

SEQ ID NO: 146510 - RNA, 19 nt, Homo sapiens
gucaaaguguaacagauau

SEQ ID NO: 146511 - RNA, 19 nt, Homo sapiens
gaaggaaagauuugugaac

SEQ ID NO: 146512 - RNA, 19 nt, Homo sapiens
gagcaagacaagacacuca

SEQ ID NO: 146513 - RNA, 19 nt, Homo sapiens
gaagaaggagagcaagaag

SEQ ID NO: 146514 - RNA, 19 nt, Homo sapiens
ggagaggagguuaugaugu

SEQ ID NO: 146515 - RNA, 19 nt, Homo sapiens
gcaagaaggaaagauuugu

SEQ ID NO: 146516 - RNA, 19 nt, Homo sapiens
caagacaagacacucaaga

SEQ ID NO: 146517 - RNA, 19 nt, Homo sapiens
ccaaaacgaugaagguaug

SEQ ID NO: 146518 - RNA, 19 nt, Homo sapiens
cauuggagcugacuguucu

SEQ ID NO: 146519 - RNA, 19 nt, Homo sapiens
agaaagcaacaaagauuga

SEQ ID NO: 146520 - RNA, 19 nt, Homo sapiens
gcaaggggcuagggaagaa

SEQ ID NO: 146521 - RNA, 19 nt, Homo sapiens
uuugaugaguuaacuguga

SEQ ID NO: 146522 - RNA, 19 nt, Homo sapiens
gaacuggaagaaagcaaca

SEQ ID NO: 146523 - RNA, 19 nt, Homo sapiens
ccaggaucuuugacugaaa

SEQ ID NO: 146524 - RNA, 19 nt, Homo sapiens
gaaaaugaagagaaaguga

SEQ ID NO: 146525 - RNA, 19 nt, Homo sapiens
gccaauugcuaccgagaag

SEQ ID NO: 146526 - RNA, 19 nt, Homo sapiens
ucaagacauuucucuaacu

SEQ ID NO: 146527 - RNA, 19 nt, Homo sapiens
caaaguguaacagauauca

SEQ ID NO: 146528 - RNA, 19 nt, Homo sapiens
cccacaaucuggcuuagug

SEQ ID NO: 146529 - RNA, 19 nt, Homo sapiens
gugcuggauuugaugaguu

SEQ ID NO: 146530 - RNA, 19 nt, Homo sapiens
agaaggagagcaagaagga

SEQ ID NO: 146531 - RNA, 19 nt, Homo sapiens
aaacacuuaucuucuggau

SEQ ID NO: 146532 - RNA, 19 nt, Homo sapiens
ucaagugccaaacagagua

SEQ ID NO: 146533 - RNA, 19 nt, Homo sapiens
ugaaguugggcaugacuaa

SEQ ID NO: 146534 - RNA, 19 nt, Homo sapiens
gguccuuucuggaaguuuc

SEQ ID NO: 146535 - RNA, 19 nt, Homo sapiens
ugccuagacuguuacuuug

SEQ ID NO: 146536 - RNA, 19 nt, Homo sapiens
gaacugaauuuugggacuu

SEQ ID NO: 146537 - RNA, 19 nt, Homo sapiens
uggaagaaagcaacaaaga

SEQ ID NO: 146538 - RNA, 19 nt, Homo sapiens
ugacuaauucccacugaga

SEQ ID NO: 146539 - RNA, 19 nt, Homo sapiens
caugacuaauucccacuga

SEQ ID NO: 146540 - RNA, 19 nt, Homo sapiens
gcaucugccacccggguua

SEQ ID NO: 146541 - RNA, 19 nt, Homo sapiens
ugcuggauuugaugaguua

SEQ ID NO: 146542 - RNA, 19 nt, Homo sapiens
caagaaggaaagauuugug

SEQ ID NO: 146543 - RNA, 19 nt, Homo sapiens
gagaaugcaaauaugugaa

SEQ ID NO: 146544 - RNA, 19 nt, Homo sapiens
gaugucaaaguguaacaga

SEQ ID NO: 146545 - RNA, 19 nt, Homo sapiens
ccgguuaaauuccauaugc

SEQ ID NO: 146546 - RNA, 19 nt, Homo sapiens
ggacuucugcauccaugga

SEQ ID NO: 146547 - RNA, 19 nt, Homo sapiens
cgaugaagguaugcuguca

SEQ ID NO: 146548 - RNA, 19 nt, Homo sapiens
gucaagacauuucucuaac

SEQ ID NO: 146549 - RNA, 19 nt, Homo sapiens
acuguuacuuuggcaauuu

SEQ ID NO: 146550 - RNA, 19 nt, Homo sapiens
caguugccgucuaggauug

SEQ ID NO: 146551 - RNA, 19 nt, Homo sapiens
cugauuaccugccaauugc

SEQ ID NO: 146552 - RNA, 19 nt, Homo sapiens
agaaggaacagggaacauu

SEQ ID NO: 146553 - RNA, 19 nt, Homo sapiens
ccacccaccuuugccacaa

SEQ ID NO: 146554 - RNA, 19 nt, Homo sapiens
gauuugaugaguuaacugu

SEQ ID NO: 146555 - RNA, 19 nt, Homo sapiens
agaagaagaaggagagcaa

SEQ ID NO: 146556 - RNA, 19 nt, Homo sapiens
gugaagaacuugaauggua

SEQ ID NO: 146557 - RNA, 19 nt, Homo sapiens
gaagauacaugcagaaggu

SEQ ID NO: 146558 - RNA, 19 nt, Homo sapiens
ggaacgagauccaccacaa

SEQ ID NO: 146559 - RNA, 19 nt, Homo sapiens
gaacagggaccaagagaca

SEQ ID NO: 146560 - RNA, 19 nt, Homo sapiens
uaagagagacacuugcuuu

SEQ ID NO: 146561 - RNA, 19 nt, Homo sapiens
ccaagaagaagcaccuuaa

SEQ ID NO: 146562 - RNA, 19 nt, Homo sapiens
gagagaacccagaguuaga

SEQ ID NO: 146563 - RNA, 19 nt, Homo sapiens
cagagagaacccagaguua

SEQ ID NO: 146564 - RNA, 19 nt, Homo sapiens
gagagacacuugcuuucca

SEQ ID NO: 146565 - RNA, 19 nt, Homo sapiens
caagagacaacacagaaga

SEQ ID NO: 146566 - RNA, 19 nt, Homo sapiens
caagaagaagcaccuuaaa

SEQ ID NO: 146567 - RNA, 19 nt, Homo sapiens
gauauggacaucugcauca

SEQ ID NO: 146568 - RNA, 19 nt, Homo sapiens
agacucaucuucacuaucg

SEQ ID NO: 146569 - RNA, 19 nt, Homo sapiens
gagcugggccugcaauagu

SEQ ID NO: 146570 - RNA, 19 nt, Homo sapiens
ggaugugguucgaagauac

SEQ ID NO: 146571 - RNA, 19 nt, Homo sapiens
gaagaaguucaccgcaaga

SEQ ID NO: 146572 - RNA, 19 nt, Homo sapiens
ccagaacgccuacgagaag

SEQ ID NO: 146573 - RNA, 19 nt, Homo sapiens
gcauggacggccuacgaua

SEQ ID NO: 146574 - RNA, 19 nt, Homo sapiens
gaacccagaguuagaaagg

SEQ ID NO: 146575 - RNA, 19 nt, Homo sapiens
gcuguuuccuccggcauaa

SEQ ID NO: 146576 - RNA, 19 nt, Homo sapiens
guacuccaauggcaacaag

SEQ ID NO: 146577 - RNA, 19 nt, Homo sapiens
ucagagagaacccagaguu

SEQ ID NO: 146578 - RNA, 19 nt, Homo sapiens
gaacgagauccaccacaag

SEQ ID NO: 146579 - RNA, 19 nt, Homo sapiens
ggccaucccacauuccuuu

SEQ ID NO: 146580 - RNA, 19 nt, Homo sapiens
ucugcuaccucaucuacuu

SEQ ID NO: 146581 - RNA, 19 nt, Homo sapiens
gcaagaccaagaagaagca

SEQ ID NO: 146582 - RNA, 19 nt, Homo sapiens
gagcaagagcgacgugaag

SEQ ID NO: 146583 - RNA, 19 nt, Homo sapiens
ccacaagaccgaguuugga

SEQ ID NO: 146584 - RNA, 19 nt, Homo sapiens
caaggacuuuagagcuguu

SEQ ID NO: 146585 - RNA, 19 nt, Homo sapiens
gaccaagagacaacacaga

SEQ ID NO: 146586 - RNA, 19 nt, Homo sapiens
gagaacccagaguuagaaa

SEQ ID NO: 146587 - RNA, 19 nt, Homo sapiens
ggcauaagagagacacuug

SEQ ID NO: 146588 - RNA, 19 nt, Homo sapiens
aacagcaugucgcagauga

SEQ ID NO: 146589 - RNA, 19 nt, Homo sapiens
uugagaacgugcugaagga

SEQ ID NO: 146590 - RNA, 19 nt, Homo sapiens
gaccauccgcaucgucuau

SEQ ID NO: 146591 - RNA, 19 nt, Homo sapiens
gaggaugugguucgaagau

SEQ ID NO: 146592 - RNA, 19 nt, Homo sapiens
gcugaugccugugaauggu

SEQ ID NO: 146593 - RNA, 19 nt, Homo sapiens
ccauccgcaucgucuauga

SEQ ID NO: 146594 - RNA, 19 nt, Homo sapiens
gccgcaagaccaagaagaa

SEQ ID NO: 146595 - RNA, 19 nt, Homo sapiens
ucaacagcaugucgcagau

SEQ ID NO: 146596 - RNA, 19 nt, Homo sapiens
gauacaugcagaaggugaa

SEQ ID NO: 146597 - RNA, 19 nt, Homo sapiens
aggaugugguucgaagaua

SEQ ID NO: 146598 - RNA, 19 nt, Homo sapiens
uaccucaucuacuucaaca

SEQ ID NO: 146599 - RNA, 19 nt, Homo sapiens
gggaacagggaccaagaga

SEQ ID NO: 146600 - RNA, 19 nt, Homo sapiens
cauggacggccuacgauau

SEQ ID NO: 146601 - RNA, 19 nt, Homo sapiens
gcaguccaugcaccaguuu

SEQ ID NO: 146602 - RNA, 19 nt, Homo sapiens
cccggacgcuagcuaccua

SEQ ID NO: 146603 - RNA, 19 nt, Homo sapiens
ccuacgauauggacaucug

SEQ ID NO: 146604 - RNA, 19 nt, Homo sapiens
gggcugaugccugugaaug

SEQ ID NO: 146605 - RNA, 19 nt, Homo sapiens
caucacggccugggagaga

SEQ ID NO: 146606 - RNA, 19 nt, Homo sapiens
ccucgccacugcuaucuac

SEQ ID NO: 146607 - RNA, 19 nt, Homo sapiens
cagcuugugcccuacauca

SEQ ID NO: 146608 - RNA, 19 nt, Homo sapiens
ggagcugggccugcaauag

SEQ ID NO: 146609 - RNA, 19 nt, Homo sapiens
gugcugcggcugcucauca

SEQ ID NO: 146610 - RNA, 19 nt, Homo sapiens
ggacggccuacgauaugga

SEQ ID NO: 146611 - RNA, 19 nt, Homo sapiens
ucaucgaccugcaguccau

SEQ ID NO: 146612 - RNA, 19 nt, Homo sapiens
agagaacccagaguuagaa

SEQ ID NO: 146613 - RNA, 19 nt, Homo sapiens
acugcuaucuacccaacaa

SEQ ID NO: 146614 - RNA, 19 nt, Homo sapiens
gugugggagugucugaaug

SEQ ID NO: 146615 - RNA, 19 nt, Homo sapiens
agagagaacccagaguuag

SEQ ID NO: 146616 - RNA, 19 nt, Homo sapiens
caucccacauuccuuuaac

SEQ ID NO: 146617 - RNA, 19 nt, Homo sapiens
gccaucccacauuccuuua

SEQ ID NO: 146618 - RNA, 19 nt, Homo sapiens
ugugggagugucugaauga

SEQ ID NO: 146619 - RNA, 19 nt, Homo sapiens
ggugugggagugucugaau

SEQ ID NO: 146620 - RNA, 19 nt, Homo sapiens
gaacaagugccguuaauua

SEQ ID NO: 146621 - RNA, 19 nt, Homo sapiens
gcaaaucgcugggaacaag

SEQ ID NO: 146622 - RNA, 19 nt, Homo sapiens
ggaaagaucaacugaaauc

SEQ ID NO: 146623 - RNA, 19 nt, Homo sapiens
ccggaaagaucaacugaaa

SEQ ID NO: 146624 - RNA, 19 nt, Homo sapiens
gaaaucggcaaacuucuga

SEQ ID NO: 146625 - RNA, 19 nt, Homo sapiens
gggaacaagugccguuaau

SEQ ID NO: 146626 - RNA, 19 nt, Homo sapiens
aaagugacguggaggauca

SEQ ID NO: 146627 - RNA, 19 nt, Homo sapiens
caacugaaaucggcaaacu

SEQ ID NO: 146628 - RNA, 19 nt, Homo sapiens
caagugccguuaauuaagg

SEQ ID NO: 146629 - RNA, 19 nt, Homo sapiens
ggaacaagugccguuaauu

SEQ ID NO: 146630 - RNA, 19 nt, Homo sapiens
gccaugagcgcuaugagaa

SEQ ID NO: 146631 - RNA, 19 nt, Homo sapiens
uguaaaugguaaucaguug

SEQ ID NO: 146632 - RNA, 19 nt, Homo sapiens
aacaagugccguuaauuaa

SEQ ID NO: 146633 - RNA, 19 nt, Homo sapiens
cugagcaguuucauuguga

SEQ ID NO: 146634 - RNA, 19 nt, Homo sapiens
acacgacuuugaacuggaa

SEQ ID NO: 146635 - RNA, 19 nt, Homo sapiens
uccaccagcucaugaaaga

SEQ ID NO: 146636 - RNA, 19 nt, Homo sapiens
ucauugugaucacuguaaa

SEQ ID NO: 146637 - RNA, 19 nt, Homo sapiens
acucugagcaguuucauug

SEQ ID NO: 146638 - RNA, 19 nt, Homo sapiens
gguccuguuccuccaguua

SEQ ID NO: 146639 - RNA, 19 nt, Homo sapiens
acucgaagcuguccaugag

SEQ ID NO: 146640 - RNA, 19 nt, Homo sapiens
ugauggcacucuguuguau

SEQ ID NO: 146641 - RNA, 19 nt, Homo sapiens
uaaaugguaaucaguugga

SEQ ID NO: 146642 - RNA, 19 nt, Homo sapiens
auggcacucuguuguauuu

SEQ ID NO: 146643 - RNA, 19 nt, Homo sapiens
ugugaucacuguaaauggu

SEQ ID NO: 146644 - RNA, 19 nt, Homo sapiens
ggacagauacgcauuuucu

SEQ ID NO: 146645 - RNA, 19 nt, Homo sapiens
ugaucacuguaaaugguaa

SEQ ID NO: 146646 - RNA, 19 nt, Homo sapiens
ucugagcaguuucauugug

SEQ ID NO: 146647 - RNA, 19 nt, Homo sapiens
gauggcacucuguuguauu

SEQ ID NO: 146648 - RNA, 19 nt, Homo sapiens
ggccaugagcgcuaugaga

SEQ ID NO: 146649 - RNA, 19 nt, Homo sapiens
ugaaaucggcaaacuucug

SEQ ID NO: 146650 - RNA, 19 nt, Homo sapiens
gugaucacuguaaauggua

SEQ ID NO: 146651 - RNA, 19 nt, Homo sapiens
gcaguuucauugugaucac

SEQ ID NO: 146652 - RNA, 19 nt, Homo sapiens
acugaaaucggcaaacuuc

SEQ ID NO: 146653 - RNA, 19 nt, Homo sapiens
acaagugccguuaauuaag

SEQ ID NO: 146654 - RNA, 19 nt, Homo sapiens
caacuucaggagcucuuuc

SEQ ID NO: 146655 - RNA, 19 nt, Homo sapiens
cugaguuccuacuugcaaa

SEQ ID NO: 146656 - RNA, 19 nt, Homo sapiens
ggaguagaaucaaguuaua

SEQ ID NO: 146657 - RNA, 19 nt, Homo sapiens
aaagagaaccuaccaauuu

SEQ ID NO: 146658 - RNA, 19 nt, Homo sapiens
ggaauggaccgaauaguaa

SEQ ID NO: 146659 - RNA, 19 nt, Homo sapiens
gaagaaaguuuaucagacu

SEQ ID NO: 146660 - RNA, 19 nt, Homo sapiens
gaaauuggcugguggaaaa

SEQ ID NO: 146661 - RNA, 19 nt, Homo sapiens
gaaagaagggacacuguuu

SEQ ID NO: 146662 - RNA, 19 nt, Homo sapiens
aagagaaccuaccaauuua

SEQ ID NO: 146663 - RNA, 19 nt, Homo sapiens
gaaagaggccaucucacua

SEQ ID NO: 146664 - RNA, 19 nt, Homo sapiens
guuuagaucuccagaaauu

SEQ ID NO: 146665 - RNA, 19 nt, Homo sapiens
gaagggacacuguuuggua

SEQ ID NO: 146666 - RNA, 19 nt, Homo sapiens
gcaagacuuccuauuguua

SEQ ID NO: 146667 - RNA, 19 nt, Homo sapiens
gcagaagggugugcauaaa

SEQ ID NO: 146668 - RNA, 19 nt, Homo sapiens
gaaauaccaucuuacacau

SEQ ID NO: 146669 - RNA, 19 nt, Homo sapiens
ggagauauguuccgaaugc

SEQ ID NO: 146670 - RNA, 19 nt, Homo sapiens
aagauuaccuucacuauuc

SEQ ID NO: 146671 - RNA, 19 nt, Homo sapiens
aaacacagccuuuauaauc

SEQ ID NO: 146672 - RNA, 19 nt, Homo sapiens
gggaauggaccgaauagua

SEQ ID NO: 146673 - RNA, 19 nt, Homo sapiens
gguauagucucuaggaguu

SEQ ID NO: 146674 - RNA, 19 nt, Homo sapiens
gcauaaccauguacaacaa

SEQ ID NO: 146675 - RNA, 19 nt, Homo sapiens
uuaacaaacuugcugauga

SEQ ID NO: 146676 - RNA, 19 nt, Homo sapiens
gaagcauaaugacaacaaa

SEQ ID NO: 146677 - RNA, 19 nt, Homo sapiens
gcaaagccuacuuaguuua

SEQ ID NO: 146678 - RNA, 19 nt, Homo sapiens
ugaagaaguuaaugcguuu

SEQ ID NO: 146679 - RNA, 19 nt, Homo sapiens
uaacaaacuugcugaugau

SEQ ID NO: 146680 - RNA, 19 nt, Homo sapiens
gaggagauauguuccgaau

SEQ ID NO: 146681 - RNA, 19 nt, Homo sapiens
aagcaaagccuacuuaguu

SEQ ID NO: 146682 - RNA, 19 nt, Homo sapiens
agacauaauccuccuguua

SEQ ID NO: 146683 - RNA, 19 nt, Homo sapiens
uaaagggcauaaccaugua

SEQ ID NO: 146684 - RNA, 19 nt, Homo sapiens
ccauugaucucuccuacaa

SEQ ID NO: 146685 - RNA, 19 nt, Homo sapiens
gcaguagaguuugcuuaaa

SEQ ID NO: 146686 - RNA, 19 nt, Homo sapiens
agaagggugugcauaaauu

SEQ ID NO: 146687 - RNA, 19 nt, Homo sapiens
acagauuccuucacaauug

SEQ ID NO: 146688 - RNA, 19 nt, Homo sapiens
ugaagaggaugaugacuca

SEQ ID NO: 146689 - RNA, 19 nt, Homo sapiens
ggaaaggcuugaucugagu

SEQ ID NO: 146690 - RNA, 19 nt, Homo sapiens
guaaagggcauaaccaugu

SEQ ID NO: 146691 - RNA, 19 nt, Homo sapiens
uagcaagacuuccuauugu

SEQ ID NO: 146692 - RNA, 19 nt, Homo sapiens
gcuuucauuucuuccauua

SEQ ID NO: 146693 - RNA, 19 nt, Homo sapiens
acaauugccaucuacauua

SEQ ID NO: 146694 - RNA, 19 nt, Homo sapiens
guagcugcauuugucauua

SEQ ID NO: 146695 - RNA, 19 nt, Homo sapiens
gaaccuaccaauuuacuuc

SEQ ID NO: 146696 - RNA, 19 nt, Homo sapiens
guagcaagacuuccuauug

SEQ ID NO: 146697 - RNA, 19 nt, Homo sapiens
uggaacaucuucaucuuga

SEQ ID NO: 146698 - RNA, 19 nt, Homo sapiens
ccagaaagaucaaugucau

SEQ ID NO: 146699 - RNA, 19 nt, Homo sapiens
agaacaaucuucaggcuau

SEQ ID NO: 146700 - RNA, 19 nt, Homo sapiens
caaagagaaccuaccaauu

SEQ ID NO: 146701 - RNA, 19 nt, Homo sapiens
gaacaaagagaaccuacca

SEQ ID NO: 146702 - RNA, 19 nt, Homo sapiens
uauaauguguuaccaggaa

SEQ ID NO: 146703 - RNA, 19 nt, Homo sapiens
uaguuuagaucuccagaaa

SEQ ID NO: 146704 - RNA, 19 nt, Homo sapiens
auacugagcuagaccagaa

SEQ ID NO: 146705 - RNA, 19 nt, Homo sapiens
uaaaucaguuggucaccuu

SEQ ID NO: 146706 - RNA, 19 nt, Homo sapiens
gaagugaaagaagaagaua

SEQ ID NO: 146707 - RNA, 19 nt, Homo sapiens
ccaauuuacuucauaagca

SEQ ID NO: 146708 - RNA, 19 nt, Homo sapiens
gugcauaaauucuauacuc

SEQ ID NO: 146709 - RNA, 19 nt, Homo sapiens
gaggaauuauaccuagaaa

SEQ ID NO: 146710 - RNA, 19 nt, Homo sapiens
gguaagaggagauauguuc

SEQ ID NO: 146711 - RNA, 19 nt, Homo sapiens
ggaaagaagggacacuguu

SEQ ID NO: 146712 - RNA, 19 nt, Homo sapiens
caggcagaauuuaugaaua

SEQ ID NO: 146713 - RNA, 19 nt, Homo sapiens
gaacggaucccuggcuaug

SEQ ID NO: 146714 - RNA, 19 nt, Homo sapiens
ccaaacaguuauaccugaa

SEQ ID NO: 146715 - RNA, 19 nt, Homo sapiens
aaacagacagcuuggaauu

SEQ ID NO: 146716 - RNA, 19 nt, Homo sapiens
cuuauaagguccugugcua

SEQ ID NO: 146717 - RNA, 19 nt, Homo sapiens
gcugagaacucuguaaguc

SEQ ID NO: 146718 - RNA, 19 nt, Homo sapiens
caacuugaauacugguguu

SEQ ID NO: 146719 - RNA, 19 nt, Homo sapiens
uaucacuucuucaggcaua

SEQ ID NO: 146720 - RNA, 19 nt, Homo sapiens
uagcugcauuugucauuaa

SEQ ID NO: 146721 - RNA, 19 nt, Homo sapiens
gaccgugucuccuucuaug

SEQ ID NO: 146722 - RNA, 19 nt, Homo sapiens
agaagaagauacagagcaa

SEQ ID NO: 146723 - RNA, 19 nt, Homo sapiens
gcuaugucuuuacuaugua

SEQ ID NO: 146724 - RNA, 19 nt, Homo sapiens
gguaaaaucucucaguuuc

SEQ ID NO: 146725 - RNA, 19 nt, Homo sapiens
gcaauuccaucgccuccau

SEQ ID NO: 146726 - RNA, 19 nt, Homo sapiens
gaaaucaggggcaacuuua

SEQ ID NO: 146727 - RNA, 19 nt, Homo sapiens
gaagauugcaguuuuguuu

SEQ ID NO: 146728 - RNA, 19 nt, Homo sapiens
gaggccaucucacuagaau

SEQ ID NO: 146729 - RNA, 19 nt, Homo sapiens
uguaguagcugcauuuguc

SEQ ID NO: 146730 - RNA, 19 nt, Homo sapiens
acuuguaccugucauuuaa

SEQ ID NO: 146731 - RNA, 19 nt, Homo sapiens
gaaguuaaugcguuugaau

SEQ ID NO: 146732 - RNA, 19 nt, Homo sapiens
ugaggaggaugaagaagug

SEQ ID NO: 146733 - RNA, 19 nt, Homo sapiens
acucagugguauagcauua

SEQ ID NO: 146734 - RNA, 19 nt, Homo sapiens
caagacuuccuauuguuaa

SEQ ID NO: 146735 - RNA, 19 nt, Homo sapiens
acagacagcuuggaauuca

SEQ ID NO: 146736 - RNA, 19 nt, Homo sapiens
gguguuagcugagaacucu

SEQ ID NO: 146737 - RNA, 19 nt, Homo sapiens
acucaaguaucguucuuaa

SEQ ID NO: 146738 - RNA, 19 nt, Homo sapiens
guaccugucauuuaacaaa

SEQ ID NO: 146739 - RNA, 19 nt, Homo sapiens
ugaagagccuagccuacuu

SEQ ID NO: 146740 - RNA, 19 nt, Homo sapiens
aggaagaucuaccacagaa

SEQ ID NO: 146741 - RNA, 19 nt, Homo sapiens
acacacagaugaacaacca

SEQ ID NO: 146742 - RNA, 19 nt, Homo sapiens
acucaaaucuggaacaucu

SEQ ID NO: 146743 - RNA, 19 nt, Homo sapiens
caauugccaucuacauuag

SEQ ID NO: 146744 - RNA, 19 nt, Homo sapiens
gcugaacaacaacaagaua

SEQ ID NO: 146745 - RNA, 19 nt, Homo sapiens
gaaaggcuugaucugagua

SEQ ID NO: 146746 - RNA, 19 nt, Homo sapiens
aagggacacuguuugguaa

SEQ ID NO: 146747 - RNA, 19 nt, Homo sapiens
ggcagaagggugugcauaa

SEQ ID NO: 146748 - RNA, 19 nt, Homo sapiens
gcaggcagaauuuaugaau

SEQ ID NO: 146749 - RNA, 19 nt, Homo sapiens
cauaagaucauacucaagu

SEQ ID NO: 146750 - RNA, 19 nt, Homo sapiens
cagaagaaauuugcaaugc

SEQ ID NO: 146751 - RNA, 19 nt, Homo sapiens
gaagagccuagccuacuug

SEQ ID NO: 146752 - RNA, 19 nt, Homo sapiens
aagccaaugucaauccuuu

SEQ ID NO: 146753 - RNA, 19 nt, Homo sapiens
ugauacagauuccuucaca

SEQ ID NO: 146754 - RNA, 19 nt, Homo sapiens
ucagugguauagcauuaaa

SEQ ID NO: 146755 - RNA, 19 nt, Homo sapiens
gauuauagcauggaggaaa

SEQ ID NO: 146756 - RNA, 19 nt, Homo sapiens
ggacgaggccuuugaguuu

SEQ ID NO: 146757 - RNA, 19 nt, Homo sapiens
cgagagggcugguccuuau

SEQ ID NO: 146758 - RNA, 19 nt, Homo sapiens
caucaucucucccaacuuc

SEQ ID NO: 146759 - RNA, 19 nt, Homo sapiens
gaggagaaaugcaauaacu

SEQ ID NO: 146760 - RNA, 19 nt, Homo sapiens
ccaauugucccaaccauuu

SEQ ID NO: 146761 - RNA, 19 nt, Homo sapiens
gagggcugguccuuauuua

SEQ ID NO: 146762 - RNA, 19 nt, Homo sapiens
gacaucagcuccugguuca

SEQ ID NO: 146763 - RNA, 19 nt, Homo sapiens
gaaaggacucaguguguga

SEQ ID NO: 146764 - RNA, 19 nt, Homo sapiens
gcugguccuuauuuauuua

SEQ ID NO: 146765 - RNA, 19 nt, Homo sapiens
gagaaaggacucagugugu

SEQ ID NO: 146766 - RNA, 19 nt, Homo sapiens
guuguauguuugcugauua

SEQ ID NO: 146767 - RNA, 19 nt, Homo sapiens
caguuauggugaugacuua

SEQ ID NO: 146768 - RNA, 19 nt, Homo sapiens
gagaggagaaaugcaauaa

SEQ ID NO: 146769 - RNA, 19 nt, Homo sapiens
gggcugguccuuauuuauu

SEQ ID NO: 146770 - RNA, 19 nt, Homo sapiens
gcaagucuucuuccucaaa

SEQ ID NO: 146771 - RNA, 19 nt, Homo sapiens
guaggugucugccuucaca

SEQ ID NO: 146772 - RNA, 19 nt, Homo sapiens
guacaucaaguccaucuga

SEQ ID NO: 146773 - RNA, 19 nt, Homo sapiens
caacgaggccauugacuuc

SEQ ID NO: 146774 - RNA, 19 nt, Homo sapiens
gcacauucgggaccaauau

SEQ ID NO: 146775 - RNA, 19 nt, Homo sapiens
ggcugguccuuauuuauuu

SEQ ID NO: 146776 - RNA, 19 nt, Homo sapiens
ggagaaaugcaauaacucu

SEQ ID NO: 146777 - RNA, 19 nt, Homo sapiens
cgaggccauugacuucaua

SEQ ID NO: 146778 - RNA, 19 nt, Homo sapiens
gacgaggccuuugaguuug

SEQ ID NO: 146779 - RNA, 19 nt, Homo sapiens
aaauaccaguguuggguuu

SEQ ID NO: 146780 - RNA, 19 nt, Homo sapiens
caagacauuugcugaacuc

SEQ ID NO: 146781 - RNA, 19 nt, Homo sapiens
ggacugccgcuccuucuuc

SEQ ID NO: 146782 - RNA, 19 nt, Homo sapiens
caacgucucagccaauugu

SEQ ID NO: 146783 - RNA, 19 nt, Homo sapiens
gacuuagcgucaagacauu

SEQ ID NO: 146784 - RNA, 19 nt, Homo sapiens
gcaguuauggugaugacuu

SEQ ID NO: 146785 - RNA, 19 nt, Homo sapiens
ccaccaccguguucaacuu

SEQ ID NO: 146786 - RNA, 19 nt, Homo sapiens
ugugugauccgguuucuuu

SEQ ID NO: 146787 - RNA, 19 nt, Homo sapiens
gaucaacgucucagccaau

SEQ ID NO: 146788 - RNA, 19 nt, Homo sapiens
agaaccaaauaccucaauu

SEQ ID NO: 146789 - RNA, 19 nt, Homo sapiens
caagucuucuuccucaaag

SEQ ID NO: 146790 - RNA, 19 nt, Homo sapiens
gggacuccaugcuccuuga

SEQ ID NO: 146791 - RNA, 19 nt, Homo sapiens
gccauugacuucauagacu

SEQ ID NO: 146792 - RNA, 19 nt, Homo sapiens
gcuccucucucaguccaaa

SEQ ID NO: 146793 - RNA, 19 nt, Homo sapiens
gcauaacugccuugaucaa

SEQ ID NO: 146794 - RNA, 19 nt, Homo sapiens
aagcagaggcgaagcauca

SEQ ID NO: 146795 - RNA, 19 nt, Homo sapiens
gagggucacuaccaguaca

SEQ ID NO: 146796 - RNA, 19 nt, Homo sapiens
gaagaaccaaauaccucaa

SEQ ID NO: 146797 - RNA, 19 nt, Homo sapiens
uauaguggguacaucaagu

SEQ ID NO: 146798 - RNA, 19 nt, Homo sapiens
ggacauuugggcugugugu

SEQ ID NO: 146799 - RNA, 19 nt, Homo sapiens
ugagaggagaaaugcaaua

SEQ ID NO: 146800 - RNA, 19 nt, Homo sapiens
ucauagacuccaucaagaa

SEQ ID NO: 146801 - RNA, 19 nt, Homo sapiens
uaacugccuugaucaacgu

SEQ ID NO: 146802 - RNA, 19 nt, Homo sapiens
caucaaguccaucugacaa

SEQ ID NO: 146803 - RNA, 19 nt, Homo sapiens
gaguuccucuggguuucua

SEQ ID NO: 146804 - RNA, 19 nt, Homo sapiens
uguagaaucucuucaugcu

SEQ ID NO: 146805 - RNA, 19 nt, Homo sapiens
gugucugccuucacaaaug

SEQ ID NO: 146806 - RNA, 19 nt, Homo sapiens
gccaccaucugccuugcuu

SEQ ID NO: 146807 - RNA, 19 nt, Homo sapiens
cauucgggaccaauauaua

SEQ ID NO: 146808 - RNA, 19 nt, Homo sapiens
caucugccuugcuuaccuu

SEQ ID NO: 146809 - RNA, 19 nt, Homo sapiens
cauagacuccaucaagaau

SEQ ID NO: 146810 - RNA, 19 nt, Homo sapiens
ccgacgacacauauacaua

SEQ ID NO: 146811 - RNA, 19 nt, Homo sapiens
acuguacuauccuguaaau

SEQ ID NO: 146812 - RNA, 19 nt, Homo sapiens
ugucugccuucacaaaugu

SEQ ID NO: 146813 - RNA, 19 nt, Homo sapiens
ucuaagcaguuauggugau

SEQ ID NO: 146814 - RNA, 19 nt, Homo sapiens
uucauagacuccaucaaga

SEQ ID NO: 146815 - RNA, 19 nt, Homo sapiens
cuucauagacuccaucaag

SEQ ID NO: 146816 - RNA, 19 nt, Homo sapiens
guggguacaucaaguccau

SEQ ID NO: 146817 - RNA, 19 nt, Homo sapiens
cacauucgggaccaauaua

SEQ ID NO: 146818 - RNA, 19 nt, Homo sapiens
ucaagacauuugcugaacu

SEQ ID NO: 146819 - RNA, 19 nt, Homo sapiens
agagggcugguccuuauuu

SEQ ID NO: 146820 - RNA, 19 nt, Homo sapiens
gagagggcugguccuuauu

SEQ ID NO: 146821 - RNA, 19 nt, Homo sapiens
cgucaagacauuugcugaa

SEQ ID NO: 146822 - RNA, 19 nt, Homo sapiens
cgaacagugcgcugagcua

SEQ ID NO: 146823 - RNA, 19 nt, Homo sapiens
ccuuugaguuugugaagca

SEQ ID NO: 146824 - RNA, 19 nt, Homo sapiens
cuaagcaguuauggugaug

SEQ ID NO: 146825 - RNA, 19 nt, Homo sapiens
gaaucugggugcaguuccu

SEQ ID NO: 146826 - RNA, 19 nt, Homo sapiens
ucucccaacuucagcuuca

SEQ ID NO: 146827 - RNA, 19 nt, Homo sapiens
cugccuugcuuaccuuaug

SEQ ID NO: 146828 - RNA, 19 nt, Homo sapiens
aggaggauacgaagcguuu

SEQ ID NO: 146829 - RNA, 19 nt, Homo sapiens
gcucuucacaucccauugg

SEQ ID NO: 146830 - RNA, 19 nt, Homo sapiens
caagcuggacgaggccuuu

SEQ ID NO: 146831 - RNA, 19 nt, Homo sapiens
ccaugggccuggagcacau

SEQ ID NO: 146832 - RNA, 19 nt, Homo sapiens
gauggaaaauaccaguguu

SEQ ID NO: 146833 - RNA, 19 nt, Homo sapiens
cuugacauaccuaccagua

SEQ ID NO: 146834 - RNA, 19 nt, Homo sapiens
gucaagacauuugcugaac

SEQ ID NO: 146835 - RNA, 19 nt, Homo sapiens
uagacuccaucaagaaugc

SEQ ID NO: 146836 - RNA, 19 nt, Homo sapiens
ggucacuaccaguacaaga

SEQ ID NO: 146837 - RNA, 19 nt, Homo sapiens
uuuguagaaucucuucaug

SEQ ID NO: 146838 - RNA, 19 nt, Homo sapiens
caauauauaguggguacau

SEQ ID NO: 146839 - RNA, 19 nt, Homo sapiens
cuggguuucuaagcaguua

SEQ ID NO: 146840 - RNA, 19 nt, Homo sapiens
guaccugggcagugcguau

SEQ ID NO: 146841 - RNA, 19 nt, Homo sapiens
gcaucccuguggaggacaa

SEQ ID NO: 146842 - RNA, 19 nt, Homo sapiens
ggugucugccuucacaaau

SEQ ID NO: 146843 - RNA, 19 nt, Homo sapiens
gcagaggcgaagcaucauc

SEQ ID NO: 146844 - RNA, 19 nt, Homo sapiens
gccaauugucccaaccauu

SEQ ID NO: 146845 - RNA, 19 nt, Homo sapiens
gaaaucagcuagacgcuau

SEQ ID NO: 146846 - RNA, 19 nt, Homo sapiens
gugcucagcugacauuuaa

SEQ ID NO: 146847 - RNA, 19 nt, Homo sapiens
ggacgaggccuuugacuuc

SEQ ID NO: 146848 - RNA, 19 nt, Homo sapiens
ggaaagaccgaaaggaaga

SEQ ID NO: 146849 - RNA, 19 nt, Homo sapiens
uacagaacauucaggauuu

SEQ ID NO: 146850 - RNA, 19 nt, Homo sapiens
guuggaaacuuagcacuuu

SEQ ID NO: 146851 - RNA, 19 nt, Homo sapiens
ggaaacuuagcacuuuaua

SEQ ID NO: 146852 - RNA, 19 nt, Homo sapiens
cagcugacauuuaacacuu

SEQ ID NO: 146853 - RNA, 19 nt, Homo sapiens
gaacauucaggauuuguca

SEQ ID NO: 146854 - RNA, 19 nt, Homo sapiens
gaucuugcccuaccuguuc

SEQ ID NO: 146855 - RNA, 19 nt, Homo sapiens
gccauaggcuucauugacu

SEQ ID NO: 146856 - RNA, 19 nt, Homo sapiens
auacagaacauucaggauu

SEQ ID NO: 146857 - RNA, 19 nt, Homo sapiens
gcugcuaccuccucagagu

SEQ ID NO: 146858 - RNA, 19 nt, Homo sapiens
cauucaggauuugucaaua

SEQ ID NO: 146859 - RNA, 19 nt, Homo sapiens
ugaugggugugucauguug

SEQ ID NO: 146860 - RNA, 19 nt, Homo sapiens
uuggaaacuuagcacuuua

SEQ ID NO: 146861 - RNA, 19 nt, Homo sapiens
cgggaaagaccgaaaggaa

SEQ ID NO: 146862 - RNA, 19 nt, Homo sapiens
gaacaagcugugacaacca

SEQ ID NO: 146863 - RNA, 19 nt, Homo sapiens
agacccaggugcuguguca

SEQ ID NO: 146864 - RNA, 19 nt, Homo sapiens
ggcagggguuggaaacuua

SEQ ID NO: 146865 - RNA, 19 nt, Homo sapiens
gcucagcugacauuuaaca

SEQ ID NO: 146866 - RNA, 19 nt, Homo sapiens
ucacagccguccucaacgu

SEQ ID NO: 146867 - RNA, 19 nt, Homo sapiens
acagaacauucaggauuug

SEQ ID NO: 146868 - RNA, 19 nt, Homo sapiens
caucacagccguccucaac

SEQ ID NO: 146869 - RNA, 19 nt, Homo sapiens
gucccgaucugugcucuga

SEQ ID NO: 146870 - RNA, 19 nt, Homo sapiens
ggaagugauggguguguca

SEQ ID NO: 146871 - RNA, 19 nt, Homo sapiens
caaggaacaagcugugaca

SEQ ID NO: 146872 - RNA, 19 nt, Homo sapiens
gggcugcuaccuccucaga

SEQ ID NO: 146873 - RNA, 19 nt, Homo sapiens
cgaggccuuugacuucguu

SEQ ID NO: 146874 - RNA, 19 nt, Homo sapiens
ggccauaggcuucauugac

SEQ ID NO: 146875 - RNA, 19 nt, Homo sapiens
ugcuggcgcuggaaaauua

SEQ ID NO: 146876 - RNA, 19 nt, Homo sapiens
gagcccaagcccuguguuc

SEQ ID NO: 146877 - RNA, 19 nt, Homo sapiens
gguuggaaacuuagcacuu

SEQ ID NO: 146878 - RNA, 19 nt, Homo sapiens
cugcaggccuguggcauca

SEQ ID NO: 146879 - RNA, 19 nt, Homo sapiens
gguccaccaccauguugaa

SEQ ID NO: 146880 - RNA, 19 nt, Homo sapiens
ugugcucagcugacauuua

SEQ ID NO: 146881 - RNA, 19 nt, Homo sapiens
ugugucauguugcgugugu

SEQ ID NO: 146882 - RNA, 19 nt, Homo sapiens
gaggccauaggcuucauug

SEQ ID NO: 146883 - RNA, 19 nt, Homo sapiens
ugaaagggcugccgacuuc

SEQ ID NO: 146884 - RNA, 19 nt, Homo sapiens
ccucagcgcuuacuuugaa

SEQ ID NO: 146885 - RNA, 19 nt, Homo sapiens
gagcugccauguuuaggaa

SEQ ID NO: 146886 - RNA, 19 nt, Homo sapiens
caacaccaaugccaacuuc

SEQ ID NO: 146887 - RNA, 19 nt, Homo sapiens
uguccgagcugccauguuu

SEQ ID NO: 146888 - RNA, 19 nt, Homo sapiens
gaagauggacgucaagucu

SEQ ID NO: 146889 - RNA, 19 nt, Homo sapiens
ucacauaccugggcaucaa

SEQ ID NO: 146890 - RNA, 19 nt, Homo sapiens
caaccucagcgcuuacuuu

SEQ ID NO: 146891 - RNA, 19 nt, Homo sapiens
ggcagaagauggacgucaa

SEQ ID NO: 146892 - RNA, 19 nt, Homo sapiens
cuacaagugugucccaaca

SEQ ID NO: 146893 - RNA, 19 nt, Homo sapiens
ccagcucaaugacagacua

SEQ ID NO: 146894 - RNA, 19 nt, Homo sapiens
guuaucgccuaccucauga

SEQ ID NO: 146895 - RNA, 19 nt, Homo sapiens
ccaguuguccuguuucugu

SEQ ID NO: 146896 - RNA, 19 nt, Homo sapiens
caguuguccuguuucugua

SEQ ID NO: 146897 - RNA, 19 nt, Homo sapiens
caucaaggccaacgacaca

SEQ ID NO: 146898 - RNA, 19 nt, Homo sapiens
caaggacuccggcaucaca

SEQ ID NO: 146899 - RNA, 19 nt, Homo sapiens
ccaaugccaacuucuacaa

SEQ ID NO: 146900 - RNA, 19 nt, Homo sapiens
caacgacacacaggaguuc

SEQ ID NO: 146901 - RNA, 19 nt, Homo sapiens
uacaaggacuccggcauca

SEQ ID NO: 146902 - RNA, 19 nt, Homo sapiens
acaccaaugccaacuucua

SEQ ID NO: 146903 - RNA, 19 nt, Homo sapiens
ugaccaggcuuuggcucaa

SEQ ID NO: 146904 - RNA, 19 nt, Homo sapiens
gcugagggcagguccuuca

SEQ ID NO: 146905 - RNA, 19 nt, Homo sapiens
gggcugccgacuucauuga

SEQ ID NO: 146906 - RNA, 19 nt, Homo sapiens
ggacuccggcaucacauac

SEQ ID NO: 146907 - RNA, 19 nt, Homo sapiens
ucaugcacgucaacaccaa

SEQ ID NO: 146908 - RNA, 19 nt, Homo sapiens
gggagcacauaaagaagcu

SEQ ID NO: 146909 - RNA, 19 nt, Homo sapiens
ccaacgacacacaggaguu

SEQ ID NO: 146910 - RNA, 19 nt, Homo sapiens
acacaguccugggccacuu

SEQ ID NO: 146911 - RNA, 19 nt, Homo sapiens
cuguuucuguaacuuauga

SEQ ID NO: 146912 - RNA, 19 nt, Homo sapiens
guccuguuucuguaacuua

SEQ ID NO: 146913 - RNA, 19 nt, Homo sapiens
gcagaagauggacgucaag

SEQ ID NO: 146914 - RNA, 19 nt, Homo sapiens
aguucaaccucagcgcuua

SEQ ID NO: 146915 - RNA, 19 nt, Homo sapiens
ggaaguaaauggugucuug

SEQ ID NO: 146916 - RNA, 19 nt, Homo sapiens
ggaagaaagggaagaauua

SEQ ID NO: 146917 - RNA, 19 nt, Homo sapiens
ggaagaaagggaagaauua

SEQ ID NO: 146918 - RNA, 19 nt, Homo sapiens
gaagacaaguuucccagaa

SEQ ID NO: 146919 - RNA, 19 nt, Homo sapiens
gcaauaaggacuccgaaua

SEQ ID NO: 146920 - RNA, 19 nt, Homo sapiens
ggacuccgaauacauaaua

SEQ ID NO: 146921 - RNA, 19 nt, Homo sapiens
gcaaagggaugagaagaca

SEQ ID NO: 146922 - RNA, 19 nt, Homo sapiens
gacagcaucucacuauguu

SEQ ID NO: 146923 - RNA, 19 nt, Homo sapiens
uaaggacuccgaauacaua

SEQ ID NO: 146924 - RNA, 19 nt, Homo sapiens
guacaucgaugccgugaag

SEQ ID NO: 146925 - RNA, 19 nt, Homo sapiens
ucacggcucuguugaaugu

SEQ ID NO: 146926 - RNA, 19 nt, Homo sapiens
uaaauggugucuuguagau

SEQ ID NO: 146927 - RNA, 19 nt, Homo sapiens
ggaagaccuugguuugguu

SEQ ID NO: 146928 - RNA, 19 nt, Homo sapiens
ggacugcagugugcucaaa

SEQ ID NO: 146929 - RNA, 19 nt, Homo sapiens
gggaugagaagacaaguuu

SEQ ID NO: 146930 - RNA, 19 nt, Homo sapiens
gacaucagcuccugguuca

SEQ ID NO: 146931 - RNA, 19 nt, Homo sapiens
gaaggacacuaucaguaca

SEQ ID NO: 146932 - RNA, 19 nt, Homo sapiens
ccacagauccuagcaaaug

SEQ ID NO: 146933 - RNA, 19 nt, Homo sapiens
gcaguaaggcuugaaguga

SEQ ID NO: 146934 - RNA, 19 nt, Homo sapiens
aaacagaacacuccaacuu

SEQ ID NO: 146935 - RNA, 19 nt, Homo sapiens
ucaaggcaguuaggaagua

SEQ ID NO: 146936 - RNA, 19 nt, Homo sapiens
ggaggaggccuucgaguuc

SEQ ID NO: 146937 - RNA, 19 nt, Homo sapiens
gcagaugucaaggcaguua

SEQ ID NO: 146938 - RNA, 19 nt, Homo sapiens
ggacugcccaaaccacuuu

SEQ ID NO: 146939 - RNA, 19 nt, Homo sapiens
cugcaggcgucccuucuua

SEQ ID NO: 146940 - RNA, 19 nt, Homo sapiens
aaagacagcaucucacuau

SEQ ID NO: 146941 - RNA, 19 nt, Homo sapiens
gcaguucgucuucagcuuu

SEQ ID NO: 146942 - RNA, 19 nt, Homo sapiens
ggaagaauuagguuugaau

SEQ ID NO: 146943 - RNA, 19 nt, Homo sapiens
gaagaaagggaagaauuag

SEQ ID NO: 146944 - RNA, 19 nt, Homo sapiens
ggaagaauuagguuugaau

SEQ ID NO: 146945 - RNA, 19 nt, Homo sapiens
gaagaaagggaagaauuag

SEQ ID NO: 146946 - RNA, 19 nt, Homo sapiens
caaggcaguuaggaaguaa

SEQ ID NO: 146947 - RNA, 19 nt, Homo sapiens
gaaagggaagaauuagguu

SEQ ID NO: 146948 - RNA, 19 nt, Homo sapiens
gaaagggaagaauuagguu

SEQ ID NO: 146949 - RNA, 19 nt, Homo sapiens
aauggugucuuguagauau

SEQ ID NO: 146950 - RNA, 19 nt, Homo sapiens
gggaagaccuugguuuggu

SEQ ID NO: 146951 - RNA, 19 nt, Homo sapiens
acagaacacuccaacuuag

SEQ ID NO: 146952 - RNA, 19 nt, Homo sapiens
gcaucccaguggaagauaa

SEQ ID NO: 146953 - RNA, 19 nt, Homo sapiens
caucacggcucuguugaau

SEQ ID NO: 146954 - RNA, 19 nt, Homo sapiens
guacuugucccuuuguugu

SEQ ID NO: 146955 - RNA, 19 nt, Homo sapiens
gggaagaauuagguuugaa

SEQ ID NO: 146956 - RNA, 19 nt, Homo sapiens
gggaagaauuagguuugaa

SEQ ID NO: 146957 - RNA, 19 nt, Homo sapiens
gcaguuaggaaguaaaugg

SEQ ID NO: 146958 - RNA, 19 nt, Homo sapiens
aacagaacacuccaacuua

SEQ ID NO: 146959 - RNA, 19 nt, Homo sapiens
ggcagaaaguugggacuga

SEQ ID NO: 146960 - RNA, 19 nt, Homo sapiens
gaagaccuugguuugguuu

SEQ ID NO: 146961 - RNA, 19 nt, Homo sapiens
caauaaggacuccgaauac

SEQ ID NO: 146962 - RNA, 19 nt, Homo sapiens
gggcaucacggcucuguug

SEQ ID NO: 146963 - RNA, 19 nt, Homo sapiens
uagcaaaugugcccaacca

SEQ ID NO: 146964 - RNA, 19 nt, Homo sapiens
caguaaggcuugaagugau

SEQ ID NO: 146965 - RNA, 19 nt, Homo sapiens
ccaccucucccagcuguua

SEQ ID NO: 146966 - RNA, 19 nt, Homo sapiens
uggccuaccugaugaugaa

SEQ ID NO: 146967 - RNA, 19 nt, Homo sapiens
guaaauggugucuuguaga

SEQ ID NO: 146968 - RNA, 19 nt, Homo sapiens
gaccuugguuugguuuaug

SEQ ID NO: 146969 - RNA, 19 nt, Homo sapiens
gcccaaccagcuuuacuaa

SEQ ID NO: 146970 - RNA, 19 nt, Homo sapiens
ggaggaagaaagggaagaa

SEQ ID NO: 146971 - RNA, 19 nt, Homo sapiens
ggaggaagaaagggaagaa

SEQ ID NO: 146972 - RNA, 19 nt, Homo sapiens
caccaacagaugaauaauu

SEQ ID NO: 146973 - RNA, 19 nt, Homo sapiens
ccgcgguccucucucguaa

SEQ ID NO: 146974 - RNA, 19 nt, Homo sapiens
agacaaguuucccagaagu

SEQ ID NO: 146975 - RNA, 19 nt, Homo sapiens
cagggaagaccuugguuug

SEQ ID NO: 146976 - RNA, 19 nt, Homo sapiens
aauaaggacuccgaauaca

SEQ ID NO: 146977 - RNA, 19 nt, Homo sapiens
caucaucucgcccaacuuc

SEQ ID NO: 146978 - RNA, 19 nt, Homo sapiens
cgacaucugccugcucaaa

SEQ ID NO: 146979 - RNA, 19 nt, Homo sapiens
ugucguuguuguaguuaaa

SEQ ID NO: 146980 - RNA, 19 nt, Homo sapiens
ccagggaagaccuugguuu

SEQ ID NO: 146981 - RNA, 19 nt, Homo sapiens
cgacgaggccagccagaau

SEQ ID NO: 146982 - RNA, 19 nt, Homo sapiens
aguaaauggugucuuguag

SEQ ID NO: 146983 - RNA, 19 nt, Homo sapiens
gaaggugugguuuucauuu

SEQ ID NO: 146984 - RNA, 19 nt, Homo sapiens
acccacagauccuagcaaa

SEQ ID NO: 146985 - RNA, 19 nt, Homo sapiens
ugaaggacacuaucaguac

SEQ ID NO: 146986 - RNA, 19 nt, Homo sapiens
caccguagcaugcagaugu

SEQ ID NO: 146987 - RNA, 19 nt, Homo sapiens
gacuccgaauacauaauaa

SEQ ID NO: 146988 - RNA, 19 nt, Homo sapiens
aaagggaagaauuagguuu

SEQ ID NO: 146989 - RNA, 19 nt, Homo sapiens
aaagggaagaauuagguuu

SEQ ID NO: 146990 - RNA, 19 nt, Homo sapiens
gucaccaacagaugaauaa

SEQ ID NO: 146991 - RNA, 19 nt, Homo sapiens
cacagauccuagcaaaugu

SEQ ID NO: 146992 - RNA, 19 nt, Homo sapiens
ccacuuugaaggacacuau

SEQ ID NO: 146993 - RNA, 19 nt, Homo sapiens
gugcaagguagcaugauga

SEQ ID NO: 146994 - RNA, 19 nt, Homo sapiens
uaguuacaguggauuuaga

SEQ ID NO: 146995 - RNA, 19 nt, Homo sapiens
gcaucacggcucuguugaa

SEQ ID NO: 146996 - RNA, 19 nt, Homo sapiens
agacagcaucucacuaugu

SEQ ID NO: 146997 - RNA, 19 nt, Homo sapiens
ucuggguacuugucccuuu

SEQ ID NO: 146998 - RNA, 19 nt, Homo sapiens
gcgguccucucucguaaac

SEQ ID NO: 146999 - RNA, 19 nt, Homo sapiens
acuccaacuuagagcaaua

SEQ ID NO: 147000 - RNA, 19 nt, Homo sapiens
cagaacacuccaacuuaga

SEQ ID NO: 147001 - RNA, 19 nt, Homo sapiens
caucagcuccugguucaug

SEQ ID NO: 147002 - RNA, 19 nt, Homo sapiens
agaaagggaagaauuaggu

SEQ ID NO: 147003 - RNA, 19 nt, Homo sapiens
aggaagaaagggaagaauu

SEQ ID NO: 147004 - RNA, 19 nt, Homo sapiens
agaaagggaagaauuaggu

SEQ ID NO: 147005 - RNA, 19 nt, Homo sapiens
aggaagaaagggaagaauu

SEQ ID NO: 147006 - RNA, 19 nt, Homo sapiens
uggaggagcugcgggagau

SEQ ID NO: 147007 - RNA, 19 nt, Homo sapiens
uugaaggacacuaucagua

SEQ ID NO: 147008 - RNA, 19 nt, Homo sapiens
guagcaugaugagcaacuu

SEQ ID NO: 147009 - RNA, 19 nt, Homo sapiens
gaaguaaauggugucuugu

SEQ ID NO: 147010 - RNA, 19 nt, Homo sapiens
gggcaaagggaugagaaga

SEQ ID NO: 147011 - RNA, 19 nt, Homo sapiens
aguaaggcuugaagugaug

SEQ ID NO: 147012 - RNA, 19 nt, Homo sapiens
gguccucucucguaaacac

SEQ ID NO: 147013 - RNA, 19 nt, Homo sapiens
gaugaaccgggacgagaau

SEQ ID NO: 147014 - RNA, 19 nt, Homo sapiens
aagacaaguuucccagaag

SEQ ID NO: 147015 - RNA, 19 nt, Homo sapiens
ggaaguaaauggugucuug

SEQ ID NO: 147016 - RNA, 19 nt, Homo sapiens
ggaagaaagggaagaauua

SEQ ID NO: 147017 - RNA, 19 nt, Homo sapiens
ggaagaaagggaagaauua

SEQ ID NO: 147018 - RNA, 19 nt, Homo sapiens
gaagcaaacucacuauguu

SEQ ID NO: 147019 - RNA, 19 nt, Homo sapiens
gaagacaaguuucccagaa

SEQ ID NO: 147020 - RNA, 19 nt, Homo sapiens
gcaauaaggacuccgaaua

SEQ ID NO: 147021 - RNA, 19 nt, Homo sapiens
ccaaagcgcuccaagagaa

SEQ ID NO: 147022 - RNA, 19 nt, Homo sapiens
ggacuccgaauacauaaua

SEQ ID NO: 147023 - RNA, 19 nt, Homo sapiens
aaagacagauguaggugua

SEQ ID NO: 147024 - RNA, 19 nt, Homo sapiens
gccaaggacuggaagcaua

SEQ ID NO: 147025 - RNA, 19 nt, Homo sapiens
ggagggcaauggcaucaaa

SEQ ID NO: 147026 - RNA, 19 nt, Homo sapiens
gcaaagggaugagaagaca

SEQ ID NO: 147027 - RNA, 19 nt, Homo sapiens
ggaggcaguuccuggcuaa

SEQ ID NO: 147028 - RNA, 19 nt, Homo sapiens
gguaguuucugcuuacaaa

SEQ ID NO: 147029 - RNA, 19 nt, Homo sapiens
gacagcaucucacuauguu

SEQ ID NO: 147030 - RNA, 19 nt, Homo sapiens
uaaggacuccgaauacaua

SEQ ID NO: 147031 - RNA, 19 nt, Homo sapiens
guacaucgaugccgugaag

SEQ ID NO: 147032 - RNA, 19 nt, Homo sapiens
ucacggcucuguugaaugu

SEQ ID NO: 147033 - RNA, 19 nt, Homo sapiens
gaagcacgaugggaagaaa

SEQ ID NO: 147034 - RNA, 19 nt, Homo sapiens
uaaauggugucuuguagau

SEQ ID NO: 147035 - RNA, 19 nt, Homo sapiens
ggaagaccuugguuugguu

SEQ ID NO: 147036 - RNA, 19 nt, Homo sapiens
gggaugagaagacaaguuu

SEQ ID NO: 147037 - RNA, 19 nt, Homo sapiens
gacaucagcuccugguuca

SEQ ID NO: 147038 - RNA, 19 nt, Homo sapiens
gaaggacacuaucaguaca

SEQ ID NO: 147039 - RNA, 19 nt, Homo sapiens
agauguagguguaaauuga

SEQ ID NO: 147040 - RNA, 19 nt, Homo sapiens
gaagaaaaguucacuccaa

SEQ ID NO: 147041 - RNA, 19 nt, Homo sapiens
ccacagauccuagcaaaug

SEQ ID NO: 147042 - RNA, 19 nt, Homo sapiens
gcaguaaggcuugaaguga

SEQ ID NO: 147043 - RNA, 19 nt, Homo sapiens
aaacagaacacuccaacuu

SEQ ID NO: 147044 - RNA, 19 nt, Homo sapiens
ccagagagccgauuuccuu

SEQ ID NO: 147045 - RNA, 19 nt, Homo sapiens
gagugaaauuugacccuuu

SEQ ID NO: 147046 - RNA, 19 nt, Homo sapiens
ucaaggcaguuaggaagua

SEQ ID NO: 147047 - RNA, 19 nt, Homo sapiens
ggaggaggccuucgaguuc

SEQ ID NO: 147048 - RNA, 19 nt, Homo sapiens
gcagaugucaaggcaguua

SEQ ID NO: 147049 - RNA, 19 nt, Homo sapiens
ggacugcccaaaccacuuu

SEQ ID NO: 147050 - RNA, 19 nt, Homo sapiens
gaaaccagagagccgauuu

SEQ ID NO: 147051 - RNA, 19 nt, Homo sapiens
gaagccaguuugcugaaca

SEQ ID NO: 147052 - RNA, 19 nt, Homo sapiens
aaagacagcaucucacuau

SEQ ID NO: 147053 - RNA, 19 nt, Homo sapiens
agugaaauuugacccuuua

SEQ ID NO: 147054 - RNA, 19 nt, Homo sapiens
gcaguucgucuucagcuuu

SEQ ID NO: 147055 - RNA, 19 nt, Homo sapiens
gggaaacgcugcuguugac

SEQ ID NO: 147056 - RNA, 19 nt, Homo sapiens
ggacuggaagcauaaguug

SEQ ID NO: 147057 - RNA, 19 nt, Homo sapiens
ggaagaauuagguuugaau

SEQ ID NO: 147058 - RNA, 19 nt, Homo sapiens
gaagaaagggaagaauuag

SEQ ID NO: 147059 - RNA, 19 nt, Homo sapiens
ggaagaauuagguuugaau

SEQ ID NO: 147060 - RNA, 19 nt, Homo sapiens
gaagaaagggaagaauuag

SEQ ID NO: 147061 - RNA, 19 nt, Homo sapiens
caaggcaguuaggaaguaa

SEQ ID NO: 147062 - RNA, 19 nt, Homo sapiens
gaaagggaagaauuagguu

SEQ ID NO: 147063 - RNA, 19 nt, Homo sapiens
gaaagggaagaauuagguu

SEQ ID NO: 147064 - RNA, 19 nt, Homo sapiens
aauggugucuuguagauau

SEQ ID NO: 147065 - RNA, 19 nt, Homo sapiens
gggaagaccuugguuuggu

SEQ ID NO: 147066 - RNA, 19 nt, Homo sapiens
caaugaagcaaacucacua

SEQ ID NO: 147067 - RNA, 19 nt, Homo sapiens
cgagagcccuggagauucu

SEQ ID NO: 147068 - RNA, 19 nt, Homo sapiens
ccacguggagucuggauuu

SEQ ID NO: 147069 - RNA, 19 nt, Homo sapiens
caagagaaagugccaggaa

SEQ ID NO: 147070 - RNA, 19 nt, Homo sapiens
acagaacacuccaacuuag

SEQ ID NO: 147071 - RNA, 19 nt, Homo sapiens
gcaucccaguggaagauaa

SEQ ID NO: 147072 - RNA, 19 nt, Homo sapiens
caucacggcucuguugaau

SEQ ID NO: 147073 - RNA, 19 nt, Homo sapiens
gaaauuugacccuuuagac

SEQ ID NO: 147074 - RNA, 19 nt, Homo sapiens
aagcaaacucacuauguua

SEQ ID NO: 147075 - RNA, 19 nt, Homo sapiens
guacuugucccuuuguugu

SEQ ID NO: 147076 - RNA, 19 nt, Homo sapiens
aaaauggacugcucagaaa

SEQ ID NO: 147077 - RNA, 19 nt, Homo sapiens
gggaagaauuagguuugaa

SEQ ID NO: 147078 - RNA, 19 nt, Homo sapiens
gggaagaauuagguuugaa

SEQ ID NO: 147079 - RNA, 19 nt, Homo sapiens
gcaguuaggaaguaaaugg

SEQ ID NO: 147080 - RNA, 19 nt, Homo sapiens
aacagaacacuccaacuua

SEQ ID NO: 147081 - RNA, 19 nt, Homo sapiens
ggcagaaaguugggacuga

SEQ ID NO: 147082 - RNA, 19 nt, Homo sapiens
gcaaacucacuauguuaga

SEQ ID NO: 147083 - RNA, 19 nt, Homo sapiens
ccaaggacuggaagcauaa

SEQ ID NO: 147084 - RNA, 19 nt, Homo sapiens
gaagaccuugguuugguuu

SEQ ID NO: 147085 - RNA, 19 nt, Homo sapiens
caauaaggacuccgaauac

SEQ ID NO: 147086 - RNA, 19 nt, Homo sapiens
gggcaucacggcucuguug

SEQ ID NO: 147087 - RNA, 19 nt, Homo sapiens
agacagauguagguguaaa

SEQ ID NO: 147088 - RNA, 19 nt, Homo sapiens
uagcaaaugugcccaacca

SEQ ID NO: 147089 - RNA, 19 nt, Homo sapiens
caguaaggcuugaagugau

SEQ ID NO: 147090 - RNA, 19 nt, Homo sapiens
ccaccucucccagcuguua

SEQ ID NO: 147091 - RNA, 19 nt, Homo sapiens
uggccuaccugaugaugaa

SEQ ID NO: 147092 - RNA, 19 nt, Homo sapiens
aaacgcugcuguugaccuu

SEQ ID NO: 147093 - RNA, 19 nt, Homo sapiens
guaacuaaagacagaugua

SEQ ID NO: 147094 - RNA, 19 nt, Homo sapiens
ggagagaugagggcaauuc

SEQ ID NO: 147095 - RNA, 19 nt, Homo sapiens
guaaauggugucuuguaga

SEQ ID NO: 147096 - RNA, 19 nt, Homo sapiens
ggaggaagggagcuggaaa

SEQ ID NO: 147097 - RNA, 19 nt, Homo sapiens
gcaaauaugguaguuucug

SEQ ID NO: 147098 - RNA, 19 nt, Homo sapiens
uugcaaauaugguaguuuc

SEQ ID NO: 147099 - RNA, 19 nt, Homo sapiens
cguggagucuggauuuguu

SEQ ID NO: 147100 - RNA, 19 nt, Homo sapiens
gaccuugguuugguuuaug

SEQ ID NO: 147101 - RNA, 19 nt, Homo sapiens
guuguuuccugcccauuug

SEQ ID NO: 147102 - RNA, 19 nt, Homo sapiens
guuagacaccauuuacauu

SEQ ID NO: 147103 - RNA, 19 nt, Homo sapiens
ugaagcaaacucacuaugu

SEQ ID NO: 147104 - RNA, 19 nt, Homo sapiens
guaauacaaugcccaugac

SEQ ID NO: 147105 - RNA, 19 nt, Homo sapiens
ggaugucaauauugcauac

SEQ ID NO: 147106 - RNA, 19 nt, Homo sapiens
gcuguugaccuuugguuga

SEQ ID NO: 147107 - RNA, 19 nt, Homo sapiens
gcccaaccagcuuuacuaa

SEQ ID NO: 147108 - RNA, 19 nt, Homo sapiens
ggaaaccucuccccuccaa

SEQ ID NO: 147109 - RNA, 19 nt, Homo sapiens
cagagagccgauuuccuua

SEQ ID NO: 147110 - RNA, 19 nt, Homo sapiens
ggaugucuccaacuaacaa

SEQ ID NO: 147111 - RNA, 19 nt, Homo sapiens
ggaggaagaaagggaagaa

SEQ ID NO: 147112 - RNA, 19 nt, Homo sapiens
ggaggaagaaagggaagaa

SEQ ID NO: 147113 - RNA, 19 nt, Homo sapiens
caccaacagaugaauaauu

SEQ ID NO: 147114 - RNA, 19 nt, Homo sapiens
uuagacaccauuuacauug

SEQ ID NO: 147115 - RNA, 19 nt, Homo sapiens
gaaggguacuugcuaggua

SEQ ID NO: 147116 - RNA, 19 nt, Homo sapiens
gcagcaggcucuucacuga

SEQ ID NO: 147117 - RNA, 19 nt, Homo sapiens
gacauuagcucccacuuuc

SEQ ID NO: 147118 - RNA, 19 nt, Homo sapiens
ucaccaggcuugcaaauga

SEQ ID NO: 147119 - RNA, 19 nt, Homo sapiens
guagcaagauguuggcuuu

SEQ ID NO: 147120 - RNA, 19 nt, Homo sapiens
gaaggaaggccaagccauu

SEQ ID NO: 147121 - RNA, 19 nt, Homo sapiens
aagagaagauugagaguga

SEQ ID NO: 147122 - RNA, 19 nt, Homo sapiens
gaagaaaagcaguauguua

SEQ ID NO: 147123 - RNA, 19 nt, Homo sapiens
gugcuuaugucucuuguga

SEQ ID NO: 147124 - RNA, 19 nt, Homo sapiens
gcaagaugcuccgcaagga

SEQ ID NO: 147125 - RNA, 19 nt, Homo sapiens
gaagcacaauuuccaccuu

SEQ ID NO: 147126 - RNA, 19 nt, Homo sapiens
ucacugaccuuggacuuug

SEQ ID NO: 147127 - RNA, 19 nt, Homo sapiens
aagcacaauuuccaccuua

SEQ ID NO: 147128 - RNA, 19 nt, Homo sapiens
gacuuuggcaugauucuua

SEQ ID NO: 147129 - RNA, 19 nt, Homo sapiens
cggaauauccugaguguug

SEQ ID NO: 147130 - RNA, 19 nt, Homo sapiens
cugcauggcuuaccuuaug

SEQ ID NO: 147131 - RNA, 19 nt, Homo sapiens
aaacugggauggaggaauc

SEQ ID NO: 147132 - RNA, 19 nt, Homo sapiens
gauaugagacuuucuacuc

SEQ ID NO: 147133 - RNA, 19 nt, Homo sapiens
ggaagugccuaccaugcau

SEQ ID NO: 147134 - RNA, 19 nt, Homo sapiens
gcacaauuuccaccuuauu

SEQ ID NO: 147135 - RNA, 19 nt, Homo sapiens
gcugaucaccgucuaguug

SEQ ID NO: 147136 - RNA, 19 nt, Homo sapiens
gccauggguucuucacuga

SEQ ID NO: 147137 - RNA, 19 nt, Homo sapiens
uacuugaacuugucucauu

SEQ ID NO: 147138 - RNA, 19 nt, Homo sapiens
guucuucacugaccuugga

SEQ ID NO: 147139 - RNA, 19 nt, Homo sapiens
guaguugguugaaguagca

SEQ ID NO: 147140 - RNA, 19 nt, Homo sapiens
guagggacaugaucagcau

SEQ ID NO: 147141 - RNA, 19 nt, Homo sapiens
gcuacaggccagcuuauga

SEQ ID NO: 147142 - RNA, 19 nt, Homo sapiens
ugagguaguugguugaagu

SEQ ID NO: 147143 - RNA, 19 nt, Homo sapiens
uuugaacccugaaauguug

SEQ ID NO: 147144 - RNA, 19 nt, Homo sapiens
gcaguuaugaagccaauuc

SEQ ID NO: 147145 - RNA, 19 nt, Homo sapiens
ccacacggcugacauuagc

SEQ ID NO: 147146 - RNA, 19 nt, Homo sapiens
agcaggcucuucacugaua

SEQ ID NO: 147147 - RNA, 19 nt, Homo sapiens
gaagauugagagugagaga

SEQ ID NO: 147148 - RNA, 19 nt, Homo sapiens
cacaauuuccaccuuauuu

SEQ ID NO: 147149 - RNA, 19 nt, Homo sapiens
ucucagagcucagcagaag

SEQ ID NO: 147150 - RNA, 19 nt, Homo sapiens
ggccuucgauuacaucaag

SEQ ID NO: 147151 - RNA, 19 nt, Homo sapiens
ugacauuagcucccacuuu

SEQ ID NO: 147152 - RNA, 19 nt, Homo sapiens
gguagguucucgggacuga

SEQ ID NO: 147153 - RNA, 19 nt, Homo sapiens
uaagacucauggacauuuc

SEQ ID NO: 147154 - RNA, 19 nt, Homo sapiens
ugacccaccuacacuacaa

SEQ ID NO: 147155 - RNA, 19 nt, Homo sapiens
gauaggccauuugcagaca

SEQ ID NO: 147156 - RNA, 19 nt, Homo sapiens
ccacuuucaagaagcaaua

SEQ ID NO: 147157 - RNA, 19 nt, Homo sapiens
ugaccaggguggcccaguu

SEQ ID NO: 147158 - RNA, 19 nt, Homo sapiens
aaacccauuucacaagaga

SEQ ID NO: 147159 - RNA, 19 nt, Homo sapiens
ggaggcagcaggcucuuca

SEQ ID NO: 147160 - RNA, 19 nt, Homo sapiens
uggcuuaccuuaugaagac

SEQ ID NO: 147161 - RNA, 19 nt, Homo sapiens
gagguaguugguugaagua

SEQ ID NO: 147162 - RNA, 19 nt, Homo sapiens
uuucauaccugugcaauac

SEQ ID NO: 147163 - RNA, 19 nt, Homo sapiens
caaauggaucccuguggaa

SEQ ID NO: 147164 - RNA, 19 nt, Homo sapiens
gcaugacccaccuacacua

SEQ ID NO: 147165 - RNA, 19 nt, Homo sapiens
gagaagauugagagugaga

SEQ ID NO: 147166 - RNA, 19 nt, Homo sapiens
gauguuggcuuuucuggau

SEQ ID NO: 147167 - RNA, 19 nt, Homo sapiens
ucaagcauaagccaauaaa

SEQ ID NO: 147168 - RNA, 19 nt, Homo sapiens
gagaaaaggcaguuaugaa

SEQ ID NO: 147169 - RNA, 19 nt, Homo sapiens
caacgugggagaaagaagu

SEQ ID NO: 147170 - RNA, 19 nt, Homo sapiens
caccaggcuugcaaaugaa

SEQ ID NO: 147171 - RNA, 19 nt, Homo sapiens
uaaaacccauuucacaaga

SEQ ID NO: 147172 - RNA, 19 nt, Homo sapiens
ugggccagcuccugcagua

SEQ ID NO: 147173 - RNA, 19 nt, Homo sapiens
ccugaaauguuguguagac

SEQ ID NO: 147174 - RNA, 19 nt, Homo sapiens
aaggaaggccaagccauua

SEQ ID NO: 147175 - RNA, 19 nt, Homo sapiens
cccaagagcaacugugauu

SEQ ID NO: 147176 - RNA, 19 nt, Homo sapiens
caccuacacuacaaaugga

SEQ ID NO: 147177 - RNA, 19 nt, Homo sapiens
ccaccuacacuacaaaugg

SEQ ID NO: 147178 - RNA, 19 nt, Homo sapiens
gagacuuucuacucggaau

SEQ ID NO: 147179 - RNA, 19 nt, Homo sapiens
gcagcaacgugggagaaag

SEQ ID NO: 147180 - RNA, 19 nt, Homo sapiens
caagagcaacugugauuuu

SEQ ID NO: 147181 - RNA, 19 nt, Homo sapiens
caacggccacauccugcua

SEQ ID NO: 147182 - RNA, 19 nt, Homo sapiens
gcggcucgcucaacgucaa

SEQ ID NO: 147183 - RNA, 19 nt, Homo sapiens
cuaagacccgugugaaugu

SEQ ID NO: 147184 - RNA, 19 nt, Homo sapiens
guagauuccaggaggagaa

SEQ ID NO: 147185 - RNA, 19 nt, Homo sapiens
cauggucucgcccaacuuu

SEQ ID NO: 147186 - RNA, 19 nt, Homo sapiens
ggggaaaaggcaauaauuu

SEQ ID NO: 147187 - RNA, 19 nt, Homo sapiens
gauucuuagucauacuuga

SEQ ID NO: 147188 - RNA, 19 nt, Homo sapiens
cagcaacgugggagaaaga

SEQ ID NO: 147189 - RNA, 19 nt, Homo sapiens
caauaaauaccugcagcaa

SEQ ID NO: 147190 - RNA, 19 nt, Homo sapiens
gaagaccucauucugucau

SEQ ID NO: 147191 - RNA, 19 nt, Homo sapiens
cauuccaccucuucucaga

SEQ ID NO: 147192 - RNA, 19 nt, Homo sapiens
gcgggucuacuuccucaaa

SEQ ID NO: 147193 - RNA, 19 nt, Homo sapiens
uuucaagcauaagccaaua

SEQ ID NO: 147194 - RNA, 19 nt, Homo sapiens
ccaagagcaacugugauuu

SEQ ID NO: 147195 - RNA, 19 nt, Homo sapiens
ccaagcaguuccgccugaa

SEQ ID NO: 147196 - RNA, 19 nt, Homo sapiens
uuugaaggaagcacaauuu

SEQ ID NO: 147197 - RNA, 19 nt, Homo sapiens
uuaagacucauggacauuu

SEQ ID NO: 147198 - RNA, 19 nt, Homo sapiens
acuguggacuucugggauu

SEQ ID NO: 147199 - RNA, 19 nt, Homo sapiens
uucaaugucugucucuguu

SEQ ID NO: 147200 - RNA, 19 nt, Homo sapiens
ucuaagacccgugugaaug

SEQ ID NO: 147201 - RNA, 19 nt, Homo sapiens
gcaacgugguacuacuuuu

SEQ ID NO: 147202 - RNA, 19 nt, Homo sapiens
ggagaaaaggcaguuauga

SEQ ID NO: 147203 - RNA, 19 nt, Homo sapiens
uaagacccgugugaaugug

SEQ ID NO: 147204 - RNA, 19 nt, Homo sapiens
aaggguacuugcuagguau

SEQ ID NO: 147205 - RNA, 19 nt, Homo sapiens
agucauacuugaacuuguc

SEQ ID NO: 147206 - RNA, 19 nt, Homo sapiens
ucacaagagaagauugaga

SEQ ID NO: 147207 - RNA, 19 nt, Homo sapiens
caggguggcccaguugaaa

SEQ ID NO: 147208 - RNA, 19 nt, Homo sapiens
gcaggcucuucacugauag

SEQ ID NO: 147209 - RNA, 19 nt, Homo sapiens
uuaugaagaccaagcaguu

SEQ ID NO: 147210 - RNA, 19 nt, Homo sapiens
acccugaaauguuguguag

SEQ ID NO: 147211 - RNA, 19 nt, Homo sapiens
agaguucgccuuuucauuu

SEQ ID NO: 147212 - RNA, 19 nt, Homo sapiens
caauacugaagaccucauu

SEQ ID NO: 147213 - RNA, 19 nt, Homo sapiens
ucauaccugugcaauacug

SEQ ID NO: 147214 - RNA, 19 nt, Homo sapiens
gaguguugcguggauguaa

SEQ ID NO: 147215 - RNA, 19 nt, Homo sapiens
gaacuguggugucuuggua

SEQ ID NO: 147216 - RNA, 19 nt, Homo sapiens
ggaacugacuauauaauug

SEQ ID NO: 147217 - RNA, 19 nt, Homo sapiens
ggaaagacaccaaaucaug

SEQ ID NO: 147218 - RNA, 19 nt, Homo sapiens
gcaguagguuugcucugua

SEQ ID NO: 147219 - RNA, 19 nt, Homo sapiens
cggaauugguuaauacuaa

SEQ ID NO: 147220 - RNA, 19 nt, Homo sapiens
gcaacagacucggauggua

SEQ ID NO: 147221 - RNA, 19 nt, Homo sapiens
ugagagagauucauugaca

SEQ ID NO: 147222 - RNA, 19 nt, Homo sapiens
caggagaguuuaaauacaa

SEQ ID NO: 147223 - RNA, 19 nt, Homo sapiens
ggaaggcgaggcggaauua

SEQ ID NO: 147224 - RNA, 19 nt, Homo sapiens
gagagaaccuccggcuuug

SEQ ID NO: 147225 - RNA, 19 nt, Homo sapiens
gauuucagcucuguauuug

SEQ ID NO: 147226 - RNA, 19 nt, Homo sapiens
gaaugugucuggcccuuca

SEQ ID NO: 147227 - RNA, 19 nt, Homo sapiens
gcaggagaguuuaaauaca

SEQ ID NO: 147228 - RNA, 19 nt, Homo sapiens
gaucuugaaucacuugaca

SEQ ID NO: 147229 - RNA, 19 nt, Homo sapiens
gacaguguuuguuugaauu

SEQ ID NO: 147230 - RNA, 19 nt, Homo sapiens
uggcuuaccuuaugcagaa

SEQ ID NO: 147231 - RNA, 19 nt, Homo sapiens
gaacgcaggagaguuuaaa

SEQ ID NO: 147232 - RNA, 19 nt, Homo sapiens
ucacuaagaccuuguuaug

SEQ ID NO: 147233 - RNA, 19 nt, Homo sapiens
guaggagcauguguucuuu

SEQ ID NO: 147234 - RNA, 19 nt, Homo sapiens
ugagaacgcaggagaguuu

SEQ ID NO: 147235 - RNA, 19 nt, Homo sapiens
agagauucauugacacuaa

SEQ ID NO: 147236 - RNA, 19 nt, Homo sapiens
caaaucaugggcucacuuu

SEQ ID NO: 147237 - RNA, 19 nt, Homo sapiens
caaagacuccaccaacuug

SEQ ID NO: 147238 - RNA, 19 nt, Homo sapiens
gcaguaugccacuucuuaa

SEQ ID NO: 147239 - RNA, 19 nt, Homo sapiens
gacuguggcuuaccuuaug

SEQ ID NO: 147240 - RNA, 19 nt, Homo sapiens
ggccauuucuuucauagau

SEQ ID NO: 147241 - RNA, 19 nt, Homo sapiens
gaaauggcgaucagcaaga

SEQ ID NO: 147242 - RNA, 19 nt, Homo sapiens
uagacaagguuaccaagug

SEQ ID NO: 147243 - RNA, 19 nt, Homo sapiens
ggacaucgagucugaccuu

SEQ ID NO: 147244 - RNA, 19 nt, Homo sapiens
aaucaugggcucacuuuaa

SEQ ID NO: 147245 - RNA, 19 nt, Homo sapiens
gcagcaugcuugacuuuac

SEQ ID NO: 147246 - RNA, 19 nt, Homo sapiens
ugacaguguuuguuugaau

SEQ ID NO: 147247 - RNA, 19 nt, Homo sapiens
agagagaaccuccggcuuu

SEQ ID NO: 147248 - RNA, 19 nt, Homo sapiens
cggacacuauuaucacuaa

SEQ ID NO: 147249 - RNA, 19 nt, Homo sapiens
gguaggagcauguguucuu

SEQ ID NO: 147250 - RNA, 19 nt, Homo sapiens
agagagauuugcuccauuc

SEQ ID NO: 147251 - RNA, 19 nt, Homo sapiens
ggacucagcagcccaugug

SEQ ID NO: 147252 - RNA, 19 nt, Homo sapiens
caacauauccccuaacuuc

SEQ ID NO: 147253 - RNA, 19 nt, Homo sapiens
ggcauuagccgcucaguca

SEQ ID NO: 147254 - RNA, 19 nt, Homo sapiens
aggacaugcuguauagaua

SEQ ID NO: 147255 - RNA, 19 nt, Homo sapiens
ugaggccauuucuuucaua

SEQ ID NO: 147256 - RNA, 19 nt, Homo sapiens
ccaaagacuccaccaacuu

SEQ ID NO: 147257 - RNA, 19 nt, Homo sapiens
caugauagauacgcucaga

SEQ ID NO: 147258 - RNA, 19 nt, Homo sapiens
gauuugcuccauucucuuu

SEQ ID NO: 147259 - RNA, 19 nt, Homo sapiens
gggauaaucugggaaagac

SEQ ID NO: 147260 - RNA, 19 nt, Homo sapiens
gauacaggcaguagguuug

SEQ ID NO: 147261 - RNA, 19 nt, Homo sapiens
ggcaagaacuguggugucu

SEQ ID NO: 147262 - RNA, 19 nt, Homo sapiens
caucuggaacugacuauau

SEQ ID NO: 147263 - RNA, 19 nt, Homo sapiens
ggcaguagguuugcucugu

SEQ ID NO: 147264 - RNA, 19 nt, Homo sapiens
gugcggaauugguuaauac

SEQ ID NO: 147265 - RNA, 19 nt, Homo sapiens
gcagcuucauugagagaga

SEQ ID NO: 147266 - RNA, 19 nt, Homo sapiens
uagaggagccaaagagaga

SEQ ID NO: 147267 - RNA, 19 nt, Homo sapiens
gagauucauugacacuaag

SEQ ID NO: 147268 - RNA, 19 nt, Homo sapiens
ggaauucggcaucaaguac

SEQ ID NO: 147269 - RNA, 19 nt, Homo sapiens
cuagacggcucguguagca

SEQ ID NO: 147270 - RNA, 19 nt, Homo sapiens
augcuugacuuuaccaauu

SEQ ID NO: 147271 - RNA, 19 nt, Homo sapiens
cagagagauuugcuccauu

SEQ ID NO: 147272 - RNA, 19 nt, Homo sapiens
ucggaucacuggagccaaa

SEQ ID NO: 147273 - RNA, 19 nt, Homo sapiens
gccaaagacuccaccaacu

SEQ ID NO: 147274 - RNA, 19 nt, Homo sapiens
gaucuugcccuuccucuac

SEQ ID NO: 147275 - RNA, 19 nt, Homo sapiens
gccaaaaccugucccaguu

SEQ ID NO: 147276 - RNA, 19 nt, Homo sapiens
caauuugccgaaucucuuu

SEQ ID NO: 147277 - RNA, 19 nt, Homo sapiens
acacaguggugcucuacga

SEQ ID NO: 147278 - RNA, 19 nt, Homo sapiens
aaagggagaaagagcagua

SEQ ID NO: 147279 - RNA, 19 nt, Homo sapiens
uuucagcucuguauuugug

SEQ ID NO: 147280 - RNA, 19 nt, Homo sapiens
uaucugggcagcuucauug

SEQ ID NO: 147281 - RNA, 19 nt, Homo sapiens
uuagaagccgcuagacuuu

SEQ ID NO: 147282 - RNA, 19 nt, Homo sapiens
cugggcagcuucauugaga

SEQ ID NO: 147283 - RNA, 19 nt, Homo sapiens
caagugcggaauugguuaa

SEQ ID NO: 147284 - RNA, 19 nt, Homo sapiens
aucaugggcucacuuuaaa

SEQ ID NO: 147285 - RNA, 19 nt, Homo sapiens
cagguggacucucugcaau

SEQ ID NO: 147286 - RNA, 19 nt, Homo sapiens
gccgaguucucccugcauu

SEQ ID NO: 147287 - RNA, 19 nt, Homo sapiens
gggauuagaagccgcuaga

SEQ ID NO: 147288 - RNA, 19 nt, Homo sapiens
gagaacgcaggagaguuua

SEQ ID NO: 147289 - RNA, 19 nt, Homo sapiens
agauuucagcucuguauuu

SEQ ID NO: 147290 - RNA, 19 nt, Homo sapiens
acagagagauuugcuccau

SEQ ID NO: 147291 - RNA, 19 nt, Homo sapiens
gaggccauuucuuucauag

SEQ ID NO: 147292 - RNA, 19 nt, Homo sapiens
ucccugaggccauuucuuu

SEQ ID NO: 147293 - RNA, 19 nt, Homo sapiens
acgcaggagaguuuaaaua

SEQ ID NO: 147294 - RNA, 19 nt, Homo sapiens
ccaauuugccgaaucucuu

SEQ ID NO: 147295 - RNA, 19 nt, Homo sapiens
agcaguaugccacuucuua

SEQ ID NO: 147296 - RNA, 19 nt, Homo sapiens
gguggacucucugcaaucu

SEQ ID NO: 147297 - RNA, 19 nt, Homo sapiens
agaaaucugauacuccauu

SEQ ID NO: 147298 - RNA, 19 nt, Homo sapiens
aucuggaacugacuauaua

SEQ ID NO: 147299 - RNA, 19 nt, Homo sapiens
gaaccuccggcuuugacuu

SEQ ID NO: 147300 - RNA, 19 nt, Homo sapiens
ggaggaauucggcaucaag

SEQ ID NO: 147301 - RNA, 19 nt, Homo sapiens
caguaugccacuucuuaaa

SEQ ID NO: 147302 - RNA, 19 nt, Homo sapiens
guuaccaagugcggaauug

SEQ ID NO: 147303 - RNA, 19 nt, Homo sapiens
ggaguccgaauuaauugga

SEQ ID NO: 147304 - RNA, 19 nt, Homo sapiens
gaauucggcaucaaguaca

SEQ ID NO: 147305 - RNA, 19 nt, Homo sapiens
gacacuauuaucacuaaga

SEQ ID NO: 147306 - RNA, 19 nt, Homo sapiens
gggaaggcgaggcggaauu

SEQ ID NO: 147307 - RNA, 19 nt, Homo sapiens
gcggaauugguuaauacua

SEQ ID NO: 147308 - RNA, 19 nt, Homo sapiens
ccuccuugcuggaaugugu

SEQ ID NO: 147309 - RNA, 19 nt, Homo sapiens
gaaggcgaggcggaauuaa

SEQ ID NO: 147310 - RNA, 19 nt, Homo sapiens
caucgagucugaccuugac

SEQ ID NO: 147311 - RNA, 19 nt, Homo sapiens
gggaaagacaccaaaucau

SEQ ID NO: 147312 - RNA, 19 nt, Homo sapiens
ugggaaagacaccaaauca

SEQ ID NO: 147313 - RNA, 19 nt, Homo sapiens
gaggagccaaagagagauu

SEQ ID NO: 147314 - RNA, 19 nt, Homo sapiens
gcauauagaggagccaaag

SEQ ID NO: 147315 - RNA, 19 nt, Homo sapiens
gaacuguggugucuuggua

SEQ ID NO: 147316 - RNA, 19 nt, Homo sapiens
ggaacugacuauauaauug

SEQ ID NO: 147317 - RNA, 19 nt, Homo sapiens
ggaaagacaccaaaucaug

SEQ ID NO: 147318 - RNA, 19 nt, Homo sapiens
gcaguagguuugcucugua

SEQ ID NO: 147319 - RNA, 19 nt, Homo sapiens
cggaauugguuaauacuaa

SEQ ID NO: 147320 - RNA, 19 nt, Homo sapiens
ugagagagauucauugaca

SEQ ID NO: 147321 - RNA, 19 nt, Homo sapiens
ggaaggcgaggcggaauua

SEQ ID NO: 147322 - RNA, 19 nt, Homo sapiens
gagagaaccuccggcuuug

SEQ ID NO: 147323 - RNA, 19 nt, Homo sapiens
gauuucagcucuguauuug

SEQ ID NO: 147324 - RNA, 19 nt, Homo sapiens
gaaugugucuggcccuuca

SEQ ID NO: 147325 - RNA, 19 nt, Homo sapiens
gaucuugaaucacuugaca

SEQ ID NO: 147326 - RNA, 19 nt, Homo sapiens
gacaguguuuguuugaauu

SEQ ID NO: 147327 - RNA, 19 nt, Homo sapiens
uggcuuaccuuaugcagaa

SEQ ID NO: 147328 - RNA, 19 nt, Homo sapiens
ucacuaagaccuuguuaug

SEQ ID NO: 147329 - RNA, 19 nt, Homo sapiens
guaggagcauguguucuuu

SEQ ID NO: 147330 - RNA, 19 nt, Homo sapiens
agagauucauugacacuaa

SEQ ID NO: 147331 - RNA, 19 nt, Homo sapiens
caaaucaugggcucacuuu

SEQ ID NO: 147332 - RNA, 19 nt, Homo sapiens
gcaguaugccacuucuuaa

SEQ ID NO: 147333 - RNA, 19 nt, Homo sapiens
gacuguggcuuaccuuaug

SEQ ID NO: 147334 - RNA, 19 nt, Homo sapiens
gaaauggcgaucagcaaga

SEQ ID NO: 147335 - RNA, 19 nt, Homo sapiens
uagacaagguuaccaagug

SEQ ID NO: 147336 - RNA, 19 nt, Homo sapiens
aaucaugggcucacuuuaa

SEQ ID NO: 147337 - RNA, 19 nt, Homo sapiens
gcagcaugcuugacuuuac

SEQ ID NO: 147338 - RNA, 19 nt, Homo sapiens
ugacaguguuuguuugaau

SEQ ID NO: 147339 - RNA, 19 nt, Homo sapiens
agagagaaccuccggcuuu

SEQ ID NO: 147340 - RNA, 19 nt, Homo sapiens
cggacacuauuaucacuaa

SEQ ID NO: 147341 - RNA, 19 nt, Homo sapiens
gguaggagcauguguucuu

SEQ ID NO: 147342 - RNA, 19 nt, Homo sapiens
agagagauuugcuccauuc

SEQ ID NO: 147343 - RNA, 19 nt, Homo sapiens
ggacucagcagcccaugug

SEQ ID NO: 147344 - RNA, 19 nt, Homo sapiens
caacauauccccuaacuuc

SEQ ID NO: 147345 - RNA, 19 nt, Homo sapiens
ggcauuagccgcucaguca

SEQ ID NO: 147346 - RNA, 19 nt, Homo sapiens
aggacaugcuguauagaua

SEQ ID NO: 147347 - RNA, 19 nt, Homo sapiens
caugauagauacgcucaga

SEQ ID NO: 147348 - RNA, 19 nt, Homo sapiens
gauuugcuccauucucuuu

SEQ ID NO: 147349 - RNA, 19 nt, Homo sapiens
gggauaaucugggaaagac

SEQ ID NO: 147350 - RNA, 19 nt, Homo sapiens
gauacaggcaguagguuug

SEQ ID NO: 147351 - RNA, 19 nt, Homo sapiens
ggcaagaacuguggugucu

SEQ ID NO: 147352 - RNA, 19 nt, Homo sapiens
caucuggaacugacuauau

SEQ ID NO: 147353 - RNA, 19 nt, Homo sapiens
ggcaguagguuugcucugu

SEQ ID NO: 147354 - RNA, 19 nt, Homo sapiens
gugcggaauugguuaauac

SEQ ID NO: 147355 - RNA, 19 nt, Homo sapiens
gcagcuucauugagagaga

SEQ ID NO: 147356 - RNA, 19 nt, Homo sapiens
uagaggagccaaagagaga

SEQ ID NO: 147357 - RNA, 19 nt, Homo sapiens
gagauucauugacacuaag

SEQ ID NO: 147358 - RNA, 19 nt, Homo sapiens
augcuugacuuuaccaauu

SEQ ID NO: 147359 - RNA, 19 nt, Homo sapiens
cagagagauuugcuccauu

SEQ ID NO: 147360 - RNA, 19 nt, Homo sapiens
cguucuaccuggaagauga

SEQ ID NO: 147361 - RNA, 19 nt, Homo sapiens
acacaguggugcucuacga

SEQ ID NO: 147362 - RNA, 19 nt, Homo sapiens
aaagggagaaagagcagua

SEQ ID NO: 147363 - RNA, 19 nt, Homo sapiens
uuucagcucuguauuugug

SEQ ID NO: 147364 - RNA, 19 nt, Homo sapiens
uaucugggcagcuucauug

SEQ ID NO: 147365 - RNA, 19 nt, Homo sapiens
uuagaagccgcuagacuuu

SEQ ID NO: 147366 - RNA, 19 nt, Homo sapiens
caagugcggaauugguuaa

SEQ ID NO: 147367 - RNA, 19 nt, Homo sapiens
cugggcagcuucauugaga

SEQ ID NO: 147368 - RNA, 19 nt, Homo sapiens
aucaugggcucacuuuaaa

SEQ ID NO: 147369 - RNA, 19 nt, Homo sapiens
cagguggacucucugcaau

SEQ ID NO: 147370 - RNA, 19 nt, Homo sapiens
gggauuagaagccgcuaga

SEQ ID NO: 147371 - RNA, 19 nt, Homo sapiens
agauuucagcucuguauuu

SEQ ID NO: 147372 - RNA, 19 nt, Homo sapiens
acagagagauuugcuccau

SEQ ID NO: 147373 - RNA, 19 nt, Homo sapiens
agcaguaugccacuucuua

SEQ ID NO: 147374 - RNA, 19 nt, Homo sapiens
gguggacucucugcaaucu

SEQ ID NO: 147375 - RNA, 19 nt, Homo sapiens
agaaaucugauacuccauu

SEQ ID NO: 147376 - RNA, 19 nt, Homo sapiens
aucuggaacugacuauaua

SEQ ID NO: 147377 - RNA, 19 nt, Homo sapiens
gaaccuccggcuuugacuu

SEQ ID NO: 147378 - RNA, 19 nt, Homo sapiens
caguaugccacuucuuaaa

SEQ ID NO: 147379 - RNA, 19 nt, Homo sapiens
guuaccaagugcggaauug

SEQ ID NO: 147380 - RNA, 19 nt, Homo sapiens
ggaguccgaauuaauugga

SEQ ID NO: 147381 - RNA, 19 nt, Homo sapiens
gacacuauuaucacuaaga

SEQ ID NO: 147382 - RNA, 19 nt, Homo sapiens
gaaggcgaggcggaauuaa

SEQ ID NO: 147383 - RNA, 19 nt, Homo sapiens
gcggaauugguuaauacua

SEQ ID NO: 147384 - RNA, 19 nt, Homo sapiens
gggaaggcgaggcggaauu

SEQ ID NO: 147385 - RNA, 19 nt, Homo sapiens
ccuccuugcuggaaugugu

SEQ ID NO: 147386 - RNA, 19 nt, Homo sapiens
gggaaagacaccaaaucau

SEQ ID NO: 147387 - RNA, 19 nt, Homo sapiens
ugggaaagacaccaaauca

SEQ ID NO: 147388 - RNA, 19 nt, Homo sapiens
gaggagccaaagagagauu

SEQ ID NO: 147389 - RNA, 19 nt, Homo sapiens
gcauauagaggagccaaag

SEQ ID NO: 147390 - RNA, 19 nt, Homo sapiens
uguggugucuugguacauu

SEQ ID NO: 147391 - RNA, 19 nt, Homo sapiens
ucauugagagagauucauu

SEQ ID NO: 147392 - RNA, 19 nt, Homo sapiens
gagagauucauugacacua

SEQ ID NO: 147393 - RNA, 19 nt, Homo sapiens
ucucugcaaucuacgugaa

SEQ ID NO: 147394 - RNA, 19 nt, Homo sapiens
gagaggacgcugggacuca

SEQ ID NO: 147395 - RNA, 19 nt, Homo sapiens
ggacacuauuaucacuaag

SEQ ID NO: 147396 - RNA, 19 nt, Homo sapiens
ccgaauuaauuggauuuca

SEQ ID NO: 147397 - RNA, 19 nt, Homo sapiens
gagauuucagcucuguauu

SEQ ID NO: 147398 - RNA, 19 nt, Homo sapiens
uugaugggcuuaaaagaaa

SEQ ID NO: 147399 - RNA, 19 nt, Homo sapiens
uaggagcauguguucuuua

SEQ ID NO: 147400 - RNA, 19 nt, Homo sapiens
caggacaugcuguauagau

SEQ ID NO: 147401 - RNA, 19 nt, Homo sapiens
ccagguggacucucugcaa

SEQ ID NO: 147402 - RNA, 19 nt, Homo sapiens
uauaccagguggacucucu

SEQ ID NO: 147403 - RNA, 19 nt, Homo sapiens
cuuccaaccagaauguaua

SEQ ID NO: 147404 - RNA, 19 nt, Homo sapiens
ugacuguggcuuaccuuau

SEQ ID NO: 147405 - RNA, 19 nt, Homo sapiens
uauagaggagccaaagaga

SEQ ID NO: 147406 - RNA, 19 nt, Homo sapiens
aggagcauguguucuuuag

SEQ ID NO: 147407 - RNA, 19 nt, Homo sapiens
caccagcugucuguacuag

SEQ ID NO: 147408 - RNA, 19 nt, Homo sapiens
acacuauuaucacuaagac

SEQ ID NO: 147409 - RNA, 19 nt, Homo sapiens
caucuuuacggacacuauu

SEQ ID NO: 147410 - RNA, 19 nt, Homo sapiens
gauuagaagccgcuagacu

SEQ ID NO: 147411 - RNA, 19 nt, Homo sapiens
aaagagcaguaugccacuu

SEQ ID NO: 147412 - RNA, 19 nt, Homo sapiens
gcaucuggaacugacuaua

SEQ ID NO: 147413 - RNA, 19 nt, Homo sapiens
agauacaggcaguagguuu

SEQ ID NO: 147414 - RNA, 19 nt, Homo sapiens
gugacuguggcuuaccuua

SEQ ID NO: 147415 - RNA, 19 nt, Homo sapiens
gcaaugauuuggcaacagu

SEQ ID NO: 147416 - RNA, 19 nt, Homo sapiens
caaagaaagguaaaugguu

SEQ ID NO: 147417 - RNA, 19 nt, Homo sapiens
gcaaagaaagguaaauggu

SEQ ID NO: 147418 - RNA, 19 nt, Homo sapiens
gaaacacugcugaccuuug

SEQ ID NO: 147419 - RNA, 19 nt, Homo sapiens
ggugauggaugccaagaag

SEQ ID NO: 147420 - RNA, 19 nt, Homo sapiens
ugucugguauuuaaacuga

SEQ ID NO: 147421 - RNA, 19 nt, Homo sapiens
gcagccaggcccguuauaa

SEQ ID NO: 147422 - RNA, 19 nt, Homo sapiens
caacgacaacuacugugaa

SEQ ID NO: 147423 - RNA, 19 nt, Homo sapiens
ccaggcccguuauaaaugu

SEQ ID NO: 147424 - RNA, 19 nt, Homo sapiens
aaacacugcugaccuuugc

SEQ ID NO: 147425 - RNA, 19 nt, Homo sapiens
cagccaggcccguuauaaa

SEQ ID NO: 147426 - RNA, 19 nt, Homo sapiens
gcucagcuccgucaacauc

SEQ ID NO: 147427 - RNA, 19 nt, Homo sapiens
gccaucgccuacaucauga

SEQ ID NO: 147428 - RNA, 19 nt, Homo sapiens
caagccugcugcccugcua

SEQ ID NO: 147429 - RNA, 19 nt, Homo sapiens
aggaaacacugcugaccuu

SEQ ID NO: 147430 - RNA, 19 nt, Homo sapiens
aacgacaacuacugugaaa

SEQ ID NO: 147431 - RNA, 19 nt, Homo sapiens
cacaggacgugguggucua

SEQ ID NO: 147432 - RNA, 19 nt, Homo sapiens
ugcaaaggcugccgagcuu

SEQ ID NO: 147433 - RNA, 19 nt, Homo sapiens
ggaaacacugcugaccuuu

SEQ ID NO: 147434 - RNA, 19 nt, Homo sapiens
caucaacgacaacuacugu

SEQ ID NO: 147435 - RNA, 19 nt, Homo sapiens
gugcucagcuccgucaaca

SEQ ID NO: 147436 - RNA, 19 nt, Homo sapiens
ucaacgacaacuacuguga

SEQ ID NO: 147437 - RNA, 19 nt, Homo sapiens
cgccaucgccuacaucaug

SEQ ID NO: 147438 - RNA, 19 nt, Homo sapiens
cauccugccucaccucuac

SEQ ID NO: 147439 - RNA, 19 nt, Homo sapiens
gccaggcccguuauaaaug

SEQ ID NO: 147440 - RNA, 19 nt, Homo sapiens
gcagcugccagauggaguu

SEQ ID NO: 147441 - RNA, 19 nt, Homo sapiens
cuaaacaaggaucugauga

SEQ ID NO: 147442 - RNA, 19 nt, Homo sapiens
acaaguccaucgaguucau

SEQ ID NO: 147443 - RNA, 19 nt, Homo sapiens
aacauacguuucuaagcaa

SEQ ID NO: 147444 - RNA, 19 nt, Homo sapiens
ccuacagguucgugaagga

SEQ ID NO: 147445 - RNA, 19 nt, Homo sapiens
gcugccagauggaguucga

SEQ ID NO: 147446 - RNA, 19 nt, Homo sapiens
guacaacagcuggcaugug

SEQ ID NO: 147447 - RNA, 19 nt, Homo sapiens
aggacgugguggucuauga

SEQ ID NO: 147448 - RNA, 19 nt, Homo sapiens
cauacguuucuaagcaaua

SEQ ID NO: 147449 - RNA, 19 nt, Homo sapiens
gggugguccucgagcucua

SEQ ID NO: 147450 - RNA, 19 nt, Homo sapiens
ggacacuaaccgccucaag

SEQ ID NO: 147451 - RNA, 19 nt, Homo sapiens
ccaagucaucguccacugu

SEQ ID NO: 147452 - RNA, 19 nt, Homo sapiens
gaauaagcuacguccucaa

SEQ ID NO: 147453 - RNA, 19 nt, Homo sapiens
gaucugaugacgcaaaaug

SEQ ID NO: 147454 - RNA, 19 nt, Homo sapiens
ccuaaacaaggaucugaug

SEQ ID NO: 147455 - RNA, 19 nt, Homo sapiens
gccgagcuuucgugcacuu

SEQ ID NO: 147456 - RNA, 19 nt, Homo sapiens
caggcccguuauaaaugua

SEQ ID NO: 147457 - RNA, 19 nt, Homo sapiens
uaaacaaggaucugaugac

SEQ ID NO: 147458 - RNA, 19 nt, Homo sapiens
gaucuaugcuuguuuguuu

SEQ ID NO: 147459 - RNA, 19 nt, Homo sapiens
cgagaagaauggugacuuu

SEQ ID NO: 147460 - RNA, 19 nt, Homo sapiens
gaggaucuaugcuuguuug

SEQ ID NO: 147461 - RNA, 19 nt, Homo sapiens
gagaggaucuaugcuuguu

SEQ ID NO: 147462 - RNA, 19 nt, Homo sapiens
ccacauccauggccuagga

SEQ ID NO: 147463 - RNA, 19 nt, Homo sapiens
gggccaagcugcagacaca

SEQ ID NO: 147464 - RNA, 19 nt, Homo sapiens
gaagaaggccucacuuuug

SEQ ID NO: 147465 - RNA, 19 nt, Homo sapiens
ggcaguugcuggacuuuga

SEQ ID NO: 147466 - RNA, 19 nt, Homo sapiens
ggagaggcguuugccauca

SEQ ID NO: 147467 - RNA, 19 nt, Homo sapiens
ucaagaggaagaagucuaa

SEQ ID NO: 147468 - RNA, 19 nt, Homo sapiens
gcagacacacacagucauu

SEQ ID NO: 147469 - RNA, 19 nt, Homo sapiens
cgagugcccucaccugugu

SEQ ID NO: 147470 - RNA, 19 nt, Homo sapiens
gccauugaguucauugaug

SEQ ID NO: 147471 - RNA, 19 nt, Homo sapiens
cacacacagucauucauuu

SEQ ID NO: 147472 - RNA, 19 nt, Homo sapiens
gaagaagaaggccucacuu

SEQ ID NO: 147473 - RNA, 19 nt, Homo sapiens
ggaagaagucuaacaucuc

SEQ ID NO: 147474 - RNA, 19 nt, Homo sapiens
ccaccucucucucaacgau

SEQ ID NO: 147475 - RNA, 19 nt, Homo sapiens
cagggaggcuucagcagau

SEQ ID NO: 147476 - RNA, 19 nt, Homo sapiens
aagaagaaggccucacuuu

SEQ ID NO: 147477 - RNA, 19 nt, Homo sapiens
ggaagaagaaggccucacu

SEQ ID NO: 147478 - RNA, 19 nt, Homo sapiens
gggcugccguccuaaucaa

SEQ ID NO: 147479 - RNA, 19 nt, Homo sapiens
uggccuaccucaugcagaa

SEQ ID NO: 147480 - RNA, 19 nt, Homo sapiens
aggaagaagucuaacaucu

SEQ ID NO: 147481 - RNA, 19 nt, Homo sapiens
acacacacagucauucauu

SEQ ID NO: 147482 - RNA, 19 nt, Homo sapiens
ggaggccauugaguucauu

SEQ ID NO: 147483 - RNA, 19 nt, Homo sapiens
guugucaccucccuguuuc

SEQ ID NO: 147484 - RNA, 19 nt, Homo sapiens
ggagaggaucuaugcuugu

SEQ ID NO: 147485 - RNA, 19 nt, Homo sapiens
gagugaggguggccaaacu

SEQ ID NO: 147486 - RNA, 19 nt, Homo sapiens
gauccugcccaaccucuau

SEQ ID NO: 147487 - RNA, 19 nt, Homo sapiens
cuucugcgacuguuacuuu

SEQ ID NO: 147488 - RNA, 19 nt, Homo sapiens
acacagucauucauuucug

SEQ ID NO: 147489 - RNA, 19 nt, Homo sapiens
caugagcuguggccuggau

SEQ ID NO: 147490 - RNA, 19 nt, Homo sapiens
ccaccucguugcacuggau

SEQ ID NO: 147491 - RNA, 19 nt, Homo sapiens
gaggaagaagucuaacauc

SEQ ID NO: 147492 - RNA, 19 nt, Homo sapiens
agaagaauggugacuuuca

SEQ ID NO: 147493 - RNA, 19 nt, Homo sapiens
guaauccauaucauaguug

SEQ ID NO: 147494 - RNA, 19 nt, Homo sapiens
acacacagucauucauuuc

SEQ ID NO: 147495 - RNA, 19 nt, Homo sapiens
caaccucccaaacuucuuc

SEQ ID NO: 147496 - RNA, 19 nt, Homo sapiens
cuaaucaacgugccuaugg

SEQ ID NO: 147497 - RNA, 19 nt, Homo sapiens
aaacugggcauccgcuaca

SEQ ID NO: 147498 - RNA, 19 nt, Homo sapiens
ggaucuaugcuuguuuguu

SEQ ID NO: 147499 - RNA, 19 nt, Homo sapiens
gcugaccgcgacuccauga

SEQ ID NO: 147500 - RNA, 19 nt, Homo sapiens
gcagaagcuccaccucucu

SEQ ID NO: 147501 - RNA, 19 nt, Homo sapiens
gagaagaauggugacuuuc

SEQ ID NO: 147502 - RNA, 19 nt, Homo sapiens
gagaggcguuugccaucac

SEQ ID NO: 147503 - RNA, 19 nt, Homo sapiens
ucucaacgaugccuaugac

SEQ ID NO: 147504 - RNA, 19 nt, Homo sapiens
agacacacacagucauuca

SEQ ID NO: 147505 - RNA, 19 nt, Homo sapiens
ugccaucacugguguuguc

SEQ ID NO: 147506 - RNA, 19 nt, Homo sapiens
uggagagccuggccaaacu

SEQ ID NO: 147507 - RNA, 19 nt, Homo sapiens
cuuuaauuguuccuucuga

SEQ ID NO: 147508 - RNA, 19 nt, Homo sapiens
ccuggagccuggagaggau

SEQ ID NO: 147509 - RNA, 19 nt, Homo sapiens
agaagaaggccucacuuuu

SEQ ID NO: 147510 - RNA, 19 nt, Homo sapiens
cuggugggcuguuuuguuu

SEQ ID NO: 147511 - RNA, 19 nt, Homo sapiens
agaggaagaagucuaacau

SEQ ID NO: 147512 - RNA, 19 nt, Homo sapiens
gucaagaggaagaagucua

SEQ ID NO: 147513 - RNA, 19 nt, Homo sapiens
ggagaaagcuguugugaaa

SEQ ID NO: 147514 - RNA, 19 nt, Homo sapiens
gcaauaggcuguaaucaag

SEQ ID NO: 147515 - RNA, 19 nt, Homo sapiens
uguaggagcuggugucaua

SEQ ID NO: 147516 - RNA, 19 nt, Homo sapiens
caaauucuuucacaaggua

SEQ ID NO: 147517 - RNA, 19 nt, Homo sapiens
uuaauacccugcaauguaa

SEQ ID NO: 147518 - RNA, 19 nt, Homo sapiens
uguaaacagugucuucuua

SEQ ID NO: 147519 - RNA, 19 nt, Homo sapiens
ggacugauucuguggcuua

SEQ ID NO: 147520 - RNA, 19 nt, Homo sapiens
gcaaaacacuuuauugaug

SEQ ID NO: 147521 - RNA, 19 nt, Homo sapiens
gaagagacacccgccauuu

SEQ ID NO: 147522 - RNA, 19 nt, Homo sapiens
guagagguauguuugugaa

SEQ ID NO: 147523 - RNA, 19 nt, Homo sapiens
gauuauagaggaaauguug

SEQ ID NO: 147524 - RNA, 19 nt, Homo sapiens
ggaacuaucagcccacuug

SEQ ID NO: 147525 - RNA, 19 nt, Homo sapiens
gcaaauuguacuaguugua

SEQ ID NO: 147526 - RNA, 19 nt, Homo sapiens
gauaaauccucuauugacu

SEQ ID NO: 147527 - RNA, 19 nt, Homo sapiens
aaggagagauuaaagguau

SEQ ID NO: 147528 - RNA, 19 nt, Homo sapiens
guaaacagugucuucuuaa

SEQ ID NO: 147529 - RNA, 19 nt, Homo sapiens
aacaagaagucauaccuuu

SEQ ID NO: 147530 - RNA, 19 nt, Homo sapiens
uggcuuaccuugauuaaca

SEQ ID NO: 147531 - RNA, 19 nt, Homo sapiens
gcagauaugggacugauuc

SEQ ID NO: 147532 - RNA, 19 nt, Homo sapiens
gagguauguuugugaaaga

SEQ ID NO: 147533 - RNA, 19 nt, Homo sapiens
gcaauugaagguuguaugu

SEQ ID NO: 147534 - RNA, 19 nt, Homo sapiens
gaauugcacagcucauuug

SEQ ID NO: 147535 - RNA, 19 nt, Homo sapiens
gaugaagauuauagaggaa

SEQ ID NO: 147536 - RNA, 19 nt, Homo sapiens
gauaugggacugauucugu

SEQ ID NO: 147537 - RNA, 19 nt, Homo sapiens
gaccugauguaaacagugu

SEQ ID NO: 147538 - RNA, 19 nt, Homo sapiens
uugcacuucuguaaacuua

SEQ ID NO: 147539 - RNA, 19 nt, Homo sapiens
gaggaaauguugguguugu

SEQ ID NO: 147540 - RNA, 19 nt, Homo sapiens
gaaaacggacauucagaua

SEQ ID NO: 147541 - RNA, 19 nt, Homo sapiens
uuuaauacccugcaaugua

SEQ ID NO: 147542 - RNA, 19 nt, Homo sapiens
gcauuucauugcagauaug

SEQ ID NO: 147543 - RNA, 19 nt, Homo sapiens
guacagugccuaugauuac

SEQ ID NO: 147544 - RNA, 19 nt, Homo sapiens
ccacuugaccacccaguuu

SEQ ID NO: 147545 - RNA, 19 nt, Homo sapiens
uuucucagauuccuuugua

SEQ ID NO: 147546 - RNA, 19 nt, Homo sapiens
uagaggaaauguugguguu

SEQ ID NO: 147547 - RNA, 19 nt, Homo sapiens
gguguuguacuguuuaauu

SEQ ID NO: 147548 - RNA, 19 nt, Homo sapiens
ggucaggcuuggcugcaaa

SEQ ID NO: 147549 - RNA, 19 nt, Homo sapiens
gccaugaaaucaacucagu

SEQ ID NO: 147550 - RNA, 19 nt, Homo sapiens
gugaaagacauguaacuug

SEQ ID NO: 147551 - RNA, 19 nt, Homo sapiens
gguacaaaaucuugcauaa

SEQ ID NO: 147552 - RNA, 19 nt, Homo sapiens
caucucaucaggcaaauug

SEQ ID NO: 147553 - RNA, 19 nt, Homo sapiens
ugccuaugauuacacaaua

SEQ ID NO: 147554 - RNA, 19 nt, Homo sapiens
guggugaccugauguaaac

SEQ ID NO: 147555 - RNA, 19 nt, Homo sapiens
ugcauaagcugaacuaaaa

SEQ ID NO: 147556 - RNA, 19 nt, Homo sapiens
guauguaaaucugcuuugu

SEQ ID NO: 147557 - RNA, 19 nt, Homo sapiens
cgaauugcacagcucauuu

SEQ ID NO: 147558 - RNA, 19 nt, Homo sapiens
cauaccagguugggcuaua

SEQ ID NO: 147559 - RNA, 19 nt, Homo sapiens
gaacuaucagcccacuuga

SEQ ID NO: 147560 - RNA, 19 nt, Homo sapiens
caggcaaauuguacuaguu

SEQ ID NO: 147561 - RNA, 19 nt, Homo sapiens
uuacuagcuuuaccuucua

SEQ ID NO: 147562 - RNA, 19 nt, Homo sapiens
caauaccaccuauggagaa

SEQ ID NO: 147563 - RNA, 19 nt, Homo sapiens
gguuuguucccuugaauuu

SEQ ID NO: 147564 - RNA, 19 nt, Homo sapiens
aaacggacauucagauagc

SEQ ID NO: 147565 - RNA, 19 nt, Homo sapiens
aauaggcuguaaucaagaa

SEQ ID NO: 147566 - RNA, 19 nt, Homo sapiens
cauaagcagcauuucauug

SEQ ID NO: 147567 - RNA, 19 nt, Homo sapiens
gaacagaaaacaagaaguc

SEQ ID NO: 147568 - RNA, 19 nt, Homo sapiens
caaauuguacuaguuguag

SEQ ID NO: 147569 - RNA, 19 nt, Homo sapiens
aggaaauguugguguugua

SEQ ID NO: 147570 - RNA, 19 nt, Homo sapiens
gaaguagcaauaggcugua

SEQ ID NO: 147571 - RNA, 19 nt, Homo sapiens
gguagagguauguuuguga

SEQ ID NO: 147572 - RNA, 19 nt, Homo sapiens
cuagugugcuuuccuuucu

SEQ ID NO: 147573 - RNA, 19 nt, Homo sapiens
ccucagugaaguagcaaua

SEQ ID NO: 147574 - RNA, 19 nt, Homo sapiens
aaaggagagauuaaaggua

SEQ ID NO: 147575 - RNA, 19 nt, Homo sapiens
gccaugcccugcucugaag

SEQ ID NO: 147576 - RNA, 19 nt, Homo sapiens
cagcauuucauugcagaua

SEQ ID NO: 147577 - RNA, 19 nt, Homo sapiens
gaagguuguauguaaaucu

SEQ ID NO: 147578 - RNA, 19 nt, Homo sapiens
caauugaagguuguaugua

SEQ ID NO: 147579 - RNA, 19 nt, Homo sapiens
cuuacuagcuuuaccuucu

SEQ ID NO: 147580 - RNA, 19 nt, Homo sapiens
aaacaagaagucauaccuu

SEQ ID NO: 147581 - RNA, 19 nt, Homo sapiens
gcaugcagcuccgcuuugc

SEQ ID NO: 147582 - RNA, 19 nt, Homo sapiens
gauuacacaauaccaccua

SEQ ID NO: 147583 - RNA, 19 nt, Homo sapiens
ucacauacauaagcagcau

SEQ ID NO: 147584 - RNA, 19 nt, Homo sapiens
caucaggcaaauuguacua

SEQ ID NO: 147585 - RNA, 19 nt, Homo sapiens
ggagagauuaaagguauuc

SEQ ID NO: 147586 - RNA, 19 nt, Homo sapiens
uguacagugccuaugauua

SEQ ID NO: 147587 - RNA, 19 nt, Homo sapiens
cagaaaacaagaagucaua

SEQ ID NO: 147588 - RNA, 19 nt, Homo sapiens
acacuuuauugauguagga

SEQ ID NO: 147589 - RNA, 19 nt, Homo sapiens
auaccagguugggcuauaa

SEQ ID NO: 147590 - RNA, 19 nt, Homo sapiens
uaguuguaguuacgaguuu

SEQ ID NO: 147591 - RNA, 19 nt, Homo sapiens
ggguagagguauguuugug

SEQ ID NO: 147592 - RNA, 19 nt, Homo sapiens
gaagauuauagaggaaaug

SEQ ID NO: 147593 - RNA, 19 nt, Homo sapiens
uaagcagcauuucauugca

SEQ ID NO: 147594 - RNA, 19 nt, Homo sapiens
ucaggcaaauuguacuagu

SEQ ID NO: 147595 - RNA, 19 nt, Homo sapiens
ucagauagcgcucccuucu

SEQ ID NO: 147596 - RNA, 19 nt, Homo sapiens
gcucauuugcgaacggauu

SEQ ID NO: 147597 - RNA, 19 nt, Homo sapiens
agagacacccgccauuuca

SEQ ID NO: 147598 - RNA, 19 nt, Homo sapiens
ugaagagacacccgccauu

SEQ ID NO: 147599 - RNA, 19 nt, Homo sapiens
ugagacaccaggcaucguu

SEQ ID NO: 147600 - RNA, 19 nt, Homo sapiens
acaaauucuuucacaaggu

SEQ ID NO: 147601 - RNA, 19 nt, Homo sapiens
gcuuuguggugaccugaug

SEQ ID NO: 147602 - RNA, 19 nt, Homo sapiens
aaauguugguguuguacug

SEQ ID NO: 147603 - RNA, 19 nt, Homo sapiens
uuagugagccaugaaauca

SEQ ID NO: 147604 - RNA, 19 nt, Homo sapiens
gaagcacaggcaagagugu

SEQ ID NO: 147605 - RNA, 19 nt, Homo sapiens
gagacaccaggcaucguuu

SEQ ID NO: 147606 - RNA, 19 nt, Homo sapiens
gcuuuccuuucuuuacuau

SEQ ID NO: 147607 - RNA, 19 nt, Homo sapiens
auacauaagcagcauuuca

SEQ ID NO: 147608 - RNA, 19 nt, Homo sapiens
ucucaucaggcaaauugua

SEQ ID NO: 147609 - RNA, 19 nt, Homo sapiens
uugcauaagcugaacuaaa

SEQ ID NO: 147610 - RNA, 19 nt, Homo sapiens
uaugaucucccuucagcaa

SEQ ID NO: 147611 - RNA, 19 nt, Homo sapiens
gccuguauuuaacucauau

SEQ ID NO: 147612 - RNA, 19 nt, Homo sapiens
cagguugggcuauaaaaua

SEQ ID NO: 147613 - RNA, 19 nt, Homo sapiens
ugaaugacgugaacuuuga

SEQ ID NO: 147614 - RNA, 19 nt, Homo sapiens
ggagaucuuugaugacaau

SEQ ID NO: 147615 - RNA, 19 nt, Homo sapiens
gaggagaucuuugaugaca

SEQ ID NO: 147616 - RNA, 19 nt, Homo sapiens
guaaagcuguugauaucga

SEQ ID NO: 147617 - RNA, 19 nt, Homo sapiens
uacauuggcuccaucauga

SEQ ID NO: 147618 - RNA, 19 nt, Homo sapiens
gccuacaaauucuucuuua

SEQ ID NO: 147619 - RNA, 19 nt, Homo sapiens
gcagucaggcuuccucgua

SEQ ID NO: 147620 - RNA, 19 nt, Homo sapiens
gaccgcauguggcuuaaga

SEQ ID NO: 147621 - RNA, 19 nt, Homo sapiens
aggaggagaucuuugauga

SEQ ID NO: 147622 - RNA, 19 nt, Homo sapiens
gaucguaaagcuguugaua

SEQ ID NO: 147623 - RNA, 19 nt, Homo sapiens
gaacaugagcaaugacgau

SEQ ID NO: 147624 - RNA, 19 nt, Homo sapiens
ugaaggaggagaucuuuga

SEQ ID NO: 147625 - RNA, 19 nt, Homo sapiens
ucguaaagcuguugauauc

SEQ ID NO: 147626 - RNA, 19 nt, Homo sapiens
gcacggacagccacacaga

SEQ ID NO: 147627 - RNA, 19 nt, Homo sapiens
gacgugaacuuugagaaca

SEQ ID NO: 147628 - RNA, 19 nt, Homo sapiens
gcaggugaaugacgugaac

SEQ ID NO: 147629 - RNA, 19 nt, Homo sapiens
gagcagagcaccucaucca

SEQ ID NO: 147630 - RNA, 19 nt, Homo sapiens
gcauguggcuuaagaucac

SEQ ID NO: 147631 - RNA, 19 nt, Homo sapiens
gcagugcuacuacgucuuc

SEQ ID NO: 147632 - RNA, 19 nt, Homo sapiens
gguggagagugacaugaau

SEQ ID NO: 147633 - RNA, 19 nt, Homo sapiens
ucaacaagaucaccuucuc

SEQ ID NO: 147634 - RNA, 19 nt, Homo sapiens
gugaaugacgugaacuuug

SEQ ID NO: 147635 - RNA, 19 nt, Homo sapiens
gcagcgggaucguaaagcu

SEQ ID NO: 147636 - RNA, 19 nt, Homo sapiens
uugagaacaugagcaauga

SEQ ID NO: 147637 - RNA, 19 nt, Homo sapiens
ggcacacggucaacaagau

SEQ ID NO: 147638 - RNA, 19 nt, Homo sapiens
ggaaguacgccagcagcuu

SEQ ID NO: 147639 - RNA, 19 nt, Homo sapiens
guggagagugacaugaaua

SEQ ID NO: 147640 - RNA, 19 nt, Homo sapiens
gaaggaggagaucuuugau

SEQ ID NO: 147641 - RNA, 19 nt, Homo sapiens
uaaagcuguugauaucgau

SEQ ID NO: 147642 - RNA, 19 nt, Homo sapiens
ggugaaggaggagaucuuu

SEQ ID NO: 147643 - RNA, 19 nt, Homo sapiens
cgaccaaggccuauacagu

SEQ ID NO: 147644 - RNA, 19 nt, Homo sapiens
uggcggagaccaagauuau

SEQ ID NO: 147645 - RNA, 19 nt, Homo sapiens
ggugaaugacgugaacuuu

SEQ ID NO: 147646 - RNA, 19 nt, Homo sapiens
ggacagugacagugaaucg

SEQ ID NO: 147647 - RNA, 19 nt, Homo sapiens
uaagaucaccaucgccaau

SEQ ID NO: 147648 - RNA, 19 nt, Homo sapiens
gcacgccuacaaauucuuc

SEQ ID NO: 147649 - RNA, 19 nt, Homo sapiens
ccagugggacuucggauca

SEQ ID NO: 147650 - RNA, 19 nt, Homo sapiens
cuacauuggcuccaucaug

SEQ ID NO: 147651 - RNA, 19 nt, Homo sapiens
cggaguccauggucaguca

SEQ ID NO: 147652 - RNA, 19 nt, Homo sapiens
gcccugagcgugcagacuu

SEQ ID NO: 147653 - RNA, 19 nt, Homo sapiens
gcacacggucaacaagauc

SEQ ID NO: 147654 - RNA, 19 nt, Homo sapiens
uggacuggcuguacacaca

SEQ ID NO: 147655 - RNA, 19 nt, Homo sapiens
gugacgggauggacaacga

SEQ ID NO: 147656 - RNA, 19 nt, Homo sapiens
gugcacgccuacaaauucu

SEQ ID NO: 147657 - RNA, 19 nt, Homo sapiens
acauguugcugcaggugaa

SEQ ID NO: 147658 - RNA, 19 nt, Homo sapiens
ugaugacaaugccaagcuu

SEQ ID NO: 147659 - RNA, 19 nt, Homo sapiens
gcagagugaagggagcaaa

SEQ ID NO: 147660 - RNA, 19 nt, Homo sapiens
gugguggacuggcuguaca

SEQ ID NO: 147661 - RNA, 19 nt, Homo sapiens
cgugcacgccuacaaauuc

SEQ ID NO: 147662 - RNA, 19 nt, Homo sapiens
caucgccaaugccgucauc

SEQ ID NO: 147663 - RNA, 19 nt, Homo sapiens
gcccgugcacgccuacaaa

SEQ ID NO: 147664 - RNA, 19 nt, Homo sapiens
gagauccgcgaccgcaugu

SEQ ID NO: 147665 - RNA, 19 nt, Homo sapiens
gcaucuacauuggcuccau

SEQ ID NO: 147666 - RNA, 19 nt, Homo sapiens
ggggaucucugcagcaauc

SEQ ID NO: 147667 - RNA, 19 nt, Homo sapiens
cgccguaccuggucaagcu

SEQ ID NO: 147668 - RNA, 19 nt, Homo sapiens
gcuugaguccagcagcuuu

SEQ ID NO: 147669 - RNA, 19 nt, Homo sapiens
gcgaccgcauguggcuuaa

SEQ ID NO: 147670 - RNA, 19 nt, Homo sapiens
ugaaugacaugaacuuuga

SEQ ID NO: 147671 - RNA, 19 nt, Homo sapiens
uaauaggcauuuccucuuu

SEQ ID NO: 147672 - RNA, 19 nt, Homo sapiens
gaagaaauuucagaugaca

SEQ ID NO: 147673 - RNA, 19 nt, Homo sapiens
gcagugcuauuacgucuuc

SEQ ID NO: 147674 - RNA, 19 nt, Homo sapiens
uacauuggcuccaucauga

SEQ ID NO: 147675 - RNA, 19 nt, Homo sapiens
aggaagaaauuucagauga

SEQ ID NO: 147676 - RNA, 19 nt, Homo sapiens
gggagacgaaggugauuua

SEQ ID NO: 147677 - RNA, 19 nt, Homo sapiens
gacaugaacuuugagaaca

SEQ ID NO: 147678 - RNA, 19 nt, Homo sapiens
cgucacagauuccacaaug

SEQ ID NO: 147679 - RNA, 19 nt, Homo sapiens
ggaagaaauuucagaugac

SEQ ID NO: 147680 - RNA, 19 nt, Homo sapiens
cacaaugucucucaauauc

SEQ ID NO: 147681 - RNA, 19 nt, Homo sapiens
caccaucccuaaugccuuu

SEQ ID NO: 147682 - RNA, 19 nt, Homo sapiens
gcacaagccuggccccauu

SEQ ID NO: 147683 - RNA, 19 nt, Homo sapiens
gaaggaagaaauuucagau

SEQ ID NO: 147684 - RNA, 19 nt, Homo sapiens
ugugagagcuaccuaguca

SEQ ID NO: 147685 - RNA, 19 nt, Homo sapiens
gcucaaagcaggccugauc

SEQ ID NO: 147686 - RNA, 19 nt, Homo sapiens
agacgaaggugauuuacca

SEQ ID NO: 147687 - RNA, 19 nt, Homo sapiens
gacagaaaccgagucagua

SEQ ID NO: 147688 - RNA, 19 nt, Homo sapiens
gcuuucaucuuacaccuau

SEQ ID NO: 147689 - RNA, 19 nt, Homo sapiens
ccagguuccuccuccauga

SEQ ID NO: 147690 - RNA, 19 nt, Homo sapiens
cgcuaaacauggagaagua

SEQ ID NO: 147691 - RNA, 19 nt, Homo sapiens
caaugucucucaauaucau

SEQ ID NO: 147692 - RNA, 19 nt, Homo sapiens
ccacaaugucucucaauau

SEQ ID NO: 147693 - RNA, 19 nt, Homo sapiens
cuggguaucuccauuguug

SEQ ID NO: 147694 - RNA, 19 nt, Homo sapiens
gcaucacccucggcgauuu

SEQ ID NO: 147695 - RNA, 19 nt, Homo sapiens
acucaaggccuccaucuuu

SEQ ID NO: 147696 - RNA, 19 nt, Homo sapiens
cgacacaccgucaacaaga

SEQ ID NO: 147697 - RNA, 19 nt, Homo sapiens
gaccgcauguggcucaaga

SEQ ID NO: 147698 - RNA, 19 nt, Homo sapiens
gcaggugaaugacaugaac

SEQ ID NO: 147699 - RNA, 19 nt, Homo sapiens
gagcuccucuacccucaug

SEQ ID NO: 147700 - RNA, 19 nt, Homo sapiens
uggcugguguccucagaua

SEQ ID NO: 147701 - RNA, 19 nt, Homo sapiens
uccacaaugucucucaaua

SEQ ID NO: 147702 - RNA, 19 nt, Homo sapiens
gaaaccgagucaguagugu

SEQ ID NO: 147703 - RNA, 19 nt, Homo sapiens
caaccugucucucaaugac

SEQ ID NO: 147704 - RNA, 19 nt, Homo sapiens
ucaacaagaucaccuucuc

SEQ ID NO: 147705 - RNA, 19 nt, Homo sapiens
cauggcagcuccagagucu

SEQ ID NO: 147706 - RNA, 19 nt, Homo sapiens
gagcccauccagccaauug

SEQ ID NO: 147707 - RNA, 19 nt, Homo sapiens
gagauuguggccacuguga

SEQ ID NO: 147708 - RNA, 19 nt, Homo sapiens
gcauguggcucaagaucac

SEQ ID NO: 147709 - RNA, 19 nt, Homo sapiens
gugaaugacaugaacuuug

SEQ ID NO: 147710 - RNA, 19 nt, Homo sapiens
gacggaggcaucuacauug

SEQ ID NO: 147711 - RNA, 19 nt, Homo sapiens
agacggaggcaucuacauu

SEQ ID NO: 147712 - RNA, 19 nt, Homo sapiens
gcaguggcagugagucuga

SEQ ID NO: 147713 - RNA, 19 nt, Homo sapiens
caagaucaccaucccuaau

SEQ ID NO: 147714 - RNA, 19 nt, Homo sapiens
gagaggaccagcggcauug

SEQ ID NO: 147715 - RNA, 19 nt, Homo sapiens
cgucaugugcuugcucuua

SEQ ID NO: 147716 - RNA, 19 nt, Homo sapiens
gacacaccgucaacaagau

SEQ ID NO: 147717 - RNA, 19 nt, Homo sapiens
ugauuuaccaccuggauga

SEQ ID NO: 147718 - RNA, 19 nt, Homo sapiens
gaacaugagcaacgaugac

SEQ ID NO: 147719 - RNA, 19 nt, Homo sapiens
gguggugaaggaagaaauu

SEQ ID NO: 147720 - RNA, 19 nt, Homo sapiens
agacagaaaccgagucagu

SEQ ID NO: 147721 - RNA, 19 nt, Homo sapiens
gcugguguccucagauaau

SEQ ID NO: 147722 - RNA, 19 nt, Homo sapiens
cuacauuggcuccaucaug

SEQ ID NO: 147723 - RNA, 19 nt, Homo sapiens
gucaaccugucucucaaug

SEQ ID NO: 147724 - RNA, 19 nt, Homo sapiens
gagaaucuggagccugaga

SEQ ID NO: 147725 - RNA, 19 nt, Homo sapiens
gcgaguucuuuguggaugu

SEQ ID NO: 147726 - RNA, 19 nt, Homo sapiens
uugacuggcucuaccauca

SEQ ID NO: 147727 - RNA, 19 nt, Homo sapiens
ucaagaucaccaucccuaa

SEQ ID NO: 147728 - RNA, 19 nt, Homo sapiens
cgagaggaccagcggcauu

SEQ ID NO: 147729 - RNA, 19 nt, Homo sapiens
cuagucaaccugucucuca

SEQ ID NO: 147730 - RNA, 19 nt, Homo sapiens
uuacaucuggaucgucuuu

SEQ ID NO: 147731 - RNA, 19 nt, Homo sapiens
ucacagauuccacaauguc

SEQ ID NO: 147732 - RNA, 19 nt, Homo sapiens
ucagcagcgucacagauuc

SEQ ID NO: 147733 - RNA, 19 nt, Homo sapiens
cgaguucuuuguggauguu

SEQ ID NO: 147734 - RNA, 19 nt, Homo sapiens
ccacuuucuccuaccagua

SEQ ID NO: 147735 - RNA, 19 nt, Homo sapiens
ccucuccucaggccuauuu

SEQ ID NO: 147736 - RNA, 19 nt, Homo sapiens
ugacaugaacuuugagaac

SEQ ID NO: 147737 - RNA, 19 nt, Homo sapiens
ccaugagccucgggcagaa

SEQ ID NO: 147738 - RNA, 19 nt, Homo sapiens
ggugaaugacaugaacuuu

SEQ ID NO: 147739 - RNA, 19 nt, Homo sapiens
cucaaggccuccaucuuuc

SEQ ID NO: 147740 - RNA, 19 nt, Homo sapiens
ggacucaaggccuccaucu

SEQ ID NO: 147741 - RNA, 19 nt, Homo sapiens
uuaauaggcauuuccucuu

SEQ ID NO: 147742 - RNA, 19 nt, Homo sapiens
gcauggcccuccccuacaa

SEQ ID NO: 147743 - RNA, 19 nt, Homo sapiens
gccagcagccagcauagug

SEQ ID NO: 147744 - RNA, 19 nt, Homo sapiens
caacaagaucaccuucucu

SEQ ID NO: 147745 - RNA, 19 nt, Homo sapiens
aagaucaccaucccuaaug

SEQ ID NO: 147746 - RNA, 19 nt, Homo sapiens
ccaccuggaugaggaagag

SEQ ID NO: 147747 - RNA, 19 nt, Homo sapiens
uaaacauggagaaguacaa

SEQ ID NO: 147748 - RNA, 19 nt, Homo sapiens
acaugaacuuugagaacau

SEQ ID NO: 147749 - RNA, 19 nt, Homo sapiens
ucaucacagucacgcuaaa

SEQ ID NO: 147750 - RNA, 19 nt, Homo sapiens
acagaaaccgagucaguag

SEQ ID NO: 147751 - RNA, 19 nt, Homo sapiens
cuccaucuuuccacccuaa

SEQ ID NO: 147752 - RNA, 19 nt, Homo sapiens
gucaugugcuugcucuuac

SEQ ID NO: 147753 - RNA, 19 nt, Homo sapiens
gcaaucccagcgaguucuu

SEQ ID NO: 147754 - RNA, 19 nt, Homo sapiens
ccagcagccagcauaguga

SEQ ID NO: 147755 - RNA, 19 nt, Homo sapiens
acaagaucaccuucucuga

SEQ ID NO: 147756 - RNA, 19 nt, Homo sapiens
cucaauaucaucacaguca

SEQ ID NO: 147757 - RNA, 19 nt, Homo sapiens
gcaggagagacagcaguga

SEQ ID NO: 147758 - RNA, 19 nt, Homo sapiens
agaaaccgagucaguagug

SEQ ID NO: 147759 - RNA, 19 nt, Homo sapiens
cagcagccaugagaaucug

SEQ ID NO: 147760 - RNA, 19 nt, Homo sapiens
caucuuuccacccuaaugu

SEQ ID NO: 147761 - RNA, 19 nt, Homo sapiens
gggcaaucccagcgaguuc

SEQ ID NO: 147762 - RNA, 19 nt, Homo sapiens
uagucaaccugucucucaa

SEQ ID NO: 147763 - RNA, 19 nt, Homo sapiens
gcaucuacauuggcuccau

SEQ ID NO: 147764 - RNA, 19 nt, Homo sapiens
ggagacggaggcaucuaca

SEQ ID NO: 147765 - RNA, 19 nt, Homo sapiens
cagucacgcuaaacaugga

SEQ ID NO: 147766 - RNA, 19 nt, Homo sapiens
gaaucuggagccugagaca

SEQ ID NO: 147767 - RNA, 19 nt, Homo sapiens
cuuuguggauguuauguag

SEQ ID NO: 147768 - RNA, 19 nt, Homo sapiens
cucccuaccuggugaagau

SEQ ID NO: 147769 - RNA, 19 nt, Homo sapiens
cacagucacgcuaaacaug

SEQ ID NO: 147770 - RNA, 19 nt, Homo sapiens
gcacagagaugcauacaca

SEQ ID NO: 147771 - RNA, 19 nt, Homo sapiens
gugcaaaccucuugacuuu

SEQ ID NO: 147772 - RNA, 19 nt, Homo sapiens
uagaguaggugcucaauaa

SEQ ID NO: 147773 - RNA, 19 nt, Homo sapiens
gcagagggcuuuguuggaa

SEQ ID NO: 147774 - RNA, 19 nt, Homo sapiens
gagcuuacauuccuucuuc

SEQ ID NO: 147775 - RNA, 19 nt, Homo sapiens
gaacaugaguaaugacgau

SEQ ID NO: 147776 - RNA, 19 nt, Homo sapiens
gcaaaccucuugacuuuac

SEQ ID NO: 147777 - RNA, 19 nt, Homo sapiens
ccacauuacugaaaccaaa

SEQ ID NO: 147778 - RNA, 19 nt, Homo sapiens
ucaguucccucguauguaa

SEQ ID NO: 147779 - RNA, 19 nt, Homo sapiens
gcaccugccuguaaucuca

SEQ ID NO: 147780 - RNA, 19 nt, Homo sapiens
ucugggagcucuagaauug

SEQ ID NO: 147781 - RNA, 19 nt, Homo sapiens
gccaggagauauguuguua

SEQ ID NO: 147782 - RNA, 19 nt, Homo sapiens
gcuauaaguucuucuucaa

SEQ ID NO: 147783 - RNA, 19 nt, Homo sapiens
caacuucacccaugcauga

SEQ ID NO: 147784 - RNA, 19 nt, Homo sapiens
aaagugagaugaaguucuu

SEQ ID NO: 147785 - RNA, 19 nt, Homo sapiens
uacauuggcucuaucauga

SEQ ID NO: 147786 - RNA, 19 nt, Homo sapiens
gcauguggcucaagauuac

SEQ ID NO: 147787 - RNA, 19 nt, Homo sapiens
cuacaucaucccucuauua

SEQ ID NO: 147788 - RNA, 19 nt, Homo sapiens
aggagaaccuggacaauga

SEQ ID NO: 147789 - RNA, 19 nt, Homo sapiens
gaagugugacucaaucuug

SEQ ID NO: 147790 - RNA, 19 nt, Homo sapiens
cuuuagaucuguauuggua

SEQ ID NO: 147791 - RNA, 19 nt, Homo sapiens
uaucagugcuuccaucguu

SEQ ID NO: 147792 - RNA, 19 nt, Homo sapiens
ccucagggcuucccaagga

SEQ ID NO: 147793 - RNA, 19 nt, Homo sapiens
caacucaucugcccaacca

SEQ ID NO: 147794 - RNA, 19 nt, Homo sapiens
gauagcucauccacccuua

SEQ ID NO: 147795 - RNA, 19 nt, Homo sapiens
ggaugacaaugccaagcua

SEQ ID NO: 147796 - RNA, 19 nt, Homo sapiens
gaggagaucucggaugaca

SEQ ID NO: 147797 - RNA, 19 nt, Homo sapiens
gagccucaguucccucgua

SEQ ID NO: 147798 - RNA, 19 nt, Homo sapiens
ccaacacucugucuugaau

SEQ ID NO: 147799 - RNA, 19 nt, Homo sapiens
ggacaucucuauggacagu

SEQ ID NO: 147800 - RNA, 19 nt, Homo sapiens
cuccugggcuuccauauuu

SEQ ID NO: 147801 - RNA, 19 nt, Homo sapiens
gcucaugccugucaguauc

SEQ ID NO: 147802 - RNA, 19 nt, Homo sapiens
aauuccagcucuacuauuu

SEQ ID NO: 147803 - RNA, 19 nt, Homo sapiens
uacauaggcucaccagcua

SEQ ID NO: 147804 - RNA, 19 nt, Homo sapiens
ucacuucucuuuccuuucu

SEQ ID NO: 147805 - RNA, 19 nt, Homo sapiens
caggagauauguuguuaca

SEQ ID NO: 147806 - RNA, 19 nt, Homo sapiens
ggagaccaccagcuucuuu

SEQ ID NO: 147807 - RNA, 19 nt, Homo sapiens
caaccugucucuccacgau

SEQ ID NO: 147808 - RNA, 19 nt, Homo sapiens
gguaaacgagaucaacuuu

SEQ ID NO: 147809 - RNA, 19 nt, Homo sapiens
ugagacagguggaucacuu

SEQ ID NO: 147810 - RNA, 19 nt, Homo sapiens
guucuuagcuccagguuuu

SEQ ID NO: 147811 - RNA, 19 nt, Homo sapiens
gggaauguguucucucagu

SEQ ID NO: 147812 - RNA, 19 nt, Homo sapiens
ggagaucucggaugacaau

SEQ ID NO: 147813 - RNA, 19 nt, Homo sapiens
gagcaugggauuuggaguu

SEQ ID NO: 147814 - RNA, 19 nt, Homo sapiens
guauguuccuccugaauuc

SEQ ID NO: 147815 - RNA, 19 nt, Homo sapiens
uuaagccucugcuauaaau

SEQ ID NO: 147816 - RNA, 19 nt, Homo sapiens
cuccaggccugaaacauuu

SEQ ID NO: 147817 - RNA, 19 nt, Homo sapiens
aggaggagaucucggauga

SEQ ID NO: 147818 - RNA, 19 nt, Homo sapiens
aaaccaagguaggaacauu

SEQ ID NO: 147819 - RNA, 19 nt, Homo sapiens
caacauggccaaccugucu

SEQ ID NO: 147820 - RNA, 19 nt, Homo sapiens
ggugauucccaaauacaua

SEQ ID NO: 147821 - RNA, 19 nt, Homo sapiens
gaccgcauguggcucaaga

SEQ ID NO: 147822 - RNA, 19 nt, Homo sapiens
aguaggugcucaauaaaug

SEQ ID NO: 147823 - RNA, 19 nt, Homo sapiens
gaauuccucuccugguuac

SEQ ID NO: 147824 - RNA, 19 nt, Homo sapiens
cguauagacucaacucauc

SEQ ID NO: 147825 - RNA, 19 nt, Homo sapiens
gcaucuacauuggcucuau

SEQ ID NO: 147826 - RNA, 19 nt, Homo sapiens
caccuuauucucuacuuua

SEQ ID NO: 147827 - RNA, 19 nt, Homo sapiens
gcagugcuacuacaucuuc

SEQ ID NO: 147828 - RNA, 19 nt, Homo sapiens
gaauguguucucucaguga

SEQ ID NO: 147829 - RNA, 19 nt, Homo sapiens
gagacgccguaccuuguga

SEQ ID NO: 147830 - RNA, 19 nt, Homo sapiens
gcuguagucgccuccaaua

SEQ ID NO: 147831 - RNA, 19 nt, Homo sapiens
uacaucaucccucuauuaa

SEQ ID NO: 147832 - RNA, 19 nt, Homo sapiens
gagcgguccucguccuuca

SEQ ID NO: 147833 - RNA, 19 nt, Homo sapiens
gaucaucuaccacuuggau

SEQ ID NO: 147834 - RNA, 19 nt, Homo sapiens
gagcaugcaacccggcuaa

SEQ ID NO: 147835 - RNA, 19 nt, Homo sapiens
ugaauuccucuccugguua

SEQ ID NO: 147836 - RNA, 19 nt, Homo sapiens
caucaucccucuauuaacc

SEQ ID NO: 147837 - RNA, 19 nt, Homo sapiens
cucaauaaaugguagcuau

SEQ ID NO: 147838 - RNA, 19 nt, Homo sapiens
guagaguaggugcucaaua

SEQ ID NO: 147839 - RNA, 19 nt, Homo sapiens
aacacucugucuugaauuu

SEQ ID NO: 147840 - RNA, 19 nt, Homo sapiens
cagcuagaaacauuuauga

SEQ ID NO: 147841 - RNA, 19 nt, Homo sapiens
caaguauguuccuccugaa

SEQ ID NO: 147842 - RNA, 19 nt, Homo sapiens
ccacaggccaguugagguu

SEQ ID NO: 147843 - RNA, 19 nt, Homo sapiens
gaaccuggacaaugacaca

SEQ ID NO: 147844 - RNA, 19 nt, Homo sapiens
gaguaggugcucaauaaau

SEQ ID NO: 147845 - RNA, 19 nt, Homo sapiens
ggacaguuccguauagacu

SEQ ID NO: 147846 - RNA, 19 nt, Homo sapiens
cuuuaagccucugcuauaa

SEQ ID NO: 147847 - RNA, 19 nt, Homo sapiens
ucuuuaagccucugcuaua

SEQ ID NO: 147848 - RNA, 19 nt, Homo sapiens
ucaccuuauucucuacuuu

SEQ ID NO: 147849 - RNA, 19 nt, Homo sapiens
ucaacaagaucaccuucuc

SEQ ID NO: 147850 - RNA, 19 nt, Homo sapiens
ucccauaucuuaucagcau

SEQ ID NO: 147851 - RNA, 19 nt, Homo sapiens
gccauaccgucaacaagau

SEQ ID NO: 147852 - RNA, 19 nt, Homo sapiens
uugagaacaugaguaauga

SEQ ID NO: 147853 - RNA, 19 nt, Homo sapiens
gaagguuucucggauugag

SEQ ID NO: 147854 - RNA, 19 nt, Homo sapiens
gcaacccggcuaaauggaa

SEQ ID NO: 147855 - RNA, 19 nt, Homo sapiens
ggaagugugacucaaucuu

SEQ ID NO: 147856 - RNA, 19 nt, Homo sapiens
guaggaacauuuuggcauu

SEQ ID NO: 147857 - RNA, 19 nt, Homo sapiens
gaauuccagcucuacuauu

SEQ ID NO: 147858 - RNA, 19 nt, Homo sapiens
agcaugggauuuggaguua

SEQ ID NO: 147859 - RNA, 19 nt, Homo sapiens
uacauuccuucuucccaua

SEQ ID NO: 147860 - RNA, 19 nt, Homo sapiens
uauggacaguuccguauag

SEQ ID NO: 147861 - RNA, 19 nt, Homo sapiens
gcuccuccaucaccaguuc

SEQ ID NO: 147862 - RNA, 19 nt, Homo sapiens
cgacccagcuauaaguucu

SEQ ID NO: 147863 - RNA, 19 nt, Homo sapiens
caaguacccaggugagaug

SEQ ID NO: 147864 - RNA, 19 nt, Homo sapiens
gguuugaauuccagcucua

SEQ ID NO: 147865 - RNA, 19 nt, Homo sapiens
caccagcuagaaacauuua

SEQ ID NO: 147866 - RNA, 19 nt, Homo sapiens
ccaagaauuucgggcuguu

SEQ ID NO: 147867 - RNA, 19 nt, Homo sapiens
gcaaguacccaggugagau

SEQ ID NO: 147868 - RNA, 19 nt, Homo sapiens
uagcucccuuucaccauuu

SEQ ID NO: 147869 - RNA, 19 nt, Homo sapiens
cuagacgacuuccacuugu

SEQ ID NO: 147870 - RNA, 19 nt, Homo sapiens
gaacgugacuggucuccua

SEQ ID NO: 147871 - RNA, 19 nt, Homo sapiens
ggacuucugugcauuguaa

SEQ ID NO: 147872 - RNA, 19 nt, Homo sapiens
gaucagaacucuccuaucu

SEQ ID NO: 147873 - RNA, 19 nt, Homo sapiens
gcacauaauuugcauaaag

SEQ ID NO: 147874 - RNA, 19 nt, Homo sapiens
gauaucaucuugaguauag

SEQ ID NO: 147875 - RNA, 19 nt, Homo sapiens
gaaccuaacacgaaaguuu

SEQ ID NO: 147876 - RNA, 19 nt, Homo sapiens
uaaggaugcuugauuauga

SEQ ID NO: 147877 - RNA, 19 nt, Homo sapiens
gggauaaccuuuggccuua

SEQ ID NO: 147878 - RNA, 19 nt, Homo sapiens
gauaaccuguuuaagauga

SEQ ID NO: 147879 - RNA, 19 nt, Homo sapiens
cagacaggcugguauuuaa

SEQ ID NO: 147880 - RNA, 19 nt, Homo sapiens
gaaagaagacgaugcauac

SEQ ID NO: 147881 - RNA, 19 nt, Homo sapiens
gcacggaaaugcaguacug

SEQ ID NO: 147882 - RNA, 19 nt, Homo sapiens
gcuaauaccuuggacuuug

SEQ ID NO: 147883 - RNA, 19 nt, Homo sapiens
gaauggaaacuuggaaaua

SEQ ID NO: 147884 - RNA, 19 nt, Homo sapiens
gcagacaggcugguauuua

SEQ ID NO: 147885 - RNA, 19 nt, Homo sapiens
gaaaacagcugaugaaggu

SEQ ID NO: 147886 - RNA, 19 nt, Homo sapiens
gaagguacaaauacaagua

SEQ ID NO: 147887 - RNA, 19 nt, Homo sapiens
caacagguccagaguauga

SEQ ID NO: 147888 - RNA, 19 nt, Homo sapiens
aaacucgaauucaaccuua

SEQ ID NO: 147889 - RNA, 19 nt, Homo sapiens
uaaccaaggugcacugaga

SEQ ID NO: 147890 - RNA, 19 nt, Homo sapiens
gaauggagcuauggacguu

SEQ ID NO: 147891 - RNA, 19 nt, Homo sapiens
gcaguugauucuuguauuc

SEQ ID NO: 147892 - RNA, 19 nt, Homo sapiens
aauuauggcuguacuauug

SEQ ID NO: 147893 - RNA, 19 nt, Homo sapiens
gagcaaagcagcaauuaca

SEQ ID NO: 147894 - RNA, 19 nt, Homo sapiens
gcacuuggaacuuaaagaa

SEQ ID NO: 147895 - RNA, 19 nt, Homo sapiens
gggaaugccuuaugaccuu

SEQ ID NO: 147896 - RNA, 19 nt, Homo sapiens
uuacugcuguuuaggaaua

SEQ ID NO: 147897 - RNA, 19 nt, Homo sapiens
aaagaaaggcuaaacacua

SEQ ID NO: 147898 - RNA, 19 nt, Homo sapiens
uaaccuacuuguaaacuug

SEQ ID NO: 147899 - RNA, 19 nt, Homo sapiens
gcucgugacuacauugaaa

SEQ ID NO: 147900 - RNA, 19 nt, Homo sapiens
uuaaauaccuguguucaga

SEQ ID NO: 147901 - RNA, 19 nt, Homo sapiens
gcuaaacacuauguaaaug

SEQ ID NO: 147902 - RNA, 19 nt, Homo sapiens
aagaaaggcuaaacacuau

SEQ ID NO: 147903 - RNA, 19 nt, Homo sapiens
ggagaaugaagauaaguaa

SEQ ID NO: 147904 - RNA, 19 nt, Homo sapiens
ggccaagggucuacaauuc

SEQ ID NO: 147905 - RNA, 19 nt, Homo sapiens
gauaugagacuugaaagaa

SEQ ID NO: 147906 - RNA, 19 nt, Homo sapiens
caucuugaguauagcaaua

SEQ ID NO: 147907 - RNA, 19 nt, Homo sapiens
ggacgguuguggugaaguu

SEQ ID NO: 147908 - RNA, 19 nt, Homo sapiens
gaaaugcaguacuguaagg

SEQ ID NO: 147909 - RNA, 19 nt, Homo sapiens
ccgauaaccuguuuaagau

SEQ ID NO: 147910 - RNA, 19 nt, Homo sapiens
gaacauaguagauugacau

SEQ ID NO: 147911 - RNA, 19 nt, Homo sapiens
gccaauacauuuacagcaa

SEQ ID NO: 147912 - RNA, 19 nt, Homo sapiens
ucacagaaguagugguuug

SEQ ID NO: 147913 - RNA, 19 nt, Homo sapiens
uagaagagccuaccauuuc

SEQ ID NO: 147914 - RNA, 19 nt, Homo sapiens
gaaggacaucugacaauga

SEQ ID NO: 147915 - RNA, 19 nt, Homo sapiens
gaugauaugagacuugaaa

SEQ ID NO: 147916 - RNA, 19 nt, Homo sapiens
gcaaagggacauugaagug

SEQ ID NO: 147917 - RNA, 19 nt, Homo sapiens
gcaaggggcugauagagaa

SEQ ID NO: 147918 - RNA, 19 nt, Homo sapiens
gcaaucaggccuaccagaa

SEQ ID NO: 147919 - RNA, 19 nt, Homo sapiens
ccaaugagguagaucagau

SEQ ID NO: 147920 - RNA, 19 nt, Homo sapiens
cuuaugaccuugccauuga

SEQ ID NO: 147921 - RNA, 19 nt, Homo sapiens
caaaaggaauucaguaguu

SEQ ID NO: 147922 - RNA, 19 nt, Homo sapiens
gaacaccgcguuucauucu

SEQ ID NO: 147923 - RNA, 19 nt, Homo sapiens
caugcggucuuauguauga

SEQ ID NO: 147924 - RNA, 19 nt, Homo sapiens
ugaaagaagacgaugcaua

SEQ ID NO: 147925 - RNA, 19 nt, Homo sapiens
gaacuguuguugaauccau

SEQ ID NO: 147926 - RNA, 19 nt, Homo sapiens
gcaauuuccugcuccucuu

SEQ ID NO: 147927 - RNA, 19 nt, Homo sapiens
uuaaugagguuuacuaugc

SEQ ID NO: 147928 - RNA, 19 nt, Homo sapiens
ucaagccuguggaugauuu

SEQ ID NO: 147929 - RNA, 19 nt, Homo sapiens
gccgauaaccuguuuaaga

SEQ ID NO: 147930 - RNA, 19 nt, Homo sapiens
gaguaugagugcaagcaaa

SEQ ID NO: 147931 - RNA, 19 nt, Homo sapiens
gugacuacauugaaacuug

SEQ ID NO: 147932 - RNA, 19 nt, Homo sapiens
gacaggaguuugugugcaa

SEQ ID NO: 147933 - RNA, 19 nt, Homo sapiens
gagcuauggacguuaauuu

SEQ ID NO: 147934 - RNA, 19 nt, Homo sapiens
gcugaugaagguacaaaua

SEQ ID NO: 147935 - RNA, 19 nt, Homo sapiens
gaaguucaaagaccucauu

SEQ ID NO: 147936 - RNA, 19 nt, Homo sapiens
gcagugcaaucaagauagu

SEQ ID NO: 147937 - RNA, 19 nt, Homo sapiens
gaaggucacagaaguagug

SEQ ID NO: 147938 - RNA, 19 nt, Homo sapiens
gauggcacuuggaacuuaa

SEQ ID NO: 147939 - RNA, 19 nt, Homo sapiens
aaaaguggauggaucguua

SEQ ID NO: 147940 - RNA, 19 nt, Homo sapiens
gauauugucauguuacaga

SEQ ID NO: 147941 - RNA, 19 nt, Homo sapiens
gcaaagcagcaauuacaug

SEQ ID NO: 147942 - RNA, 19 nt, Homo sapiens
ggcagaggauauaccagua

SEQ ID NO: 147943 - RNA, 19 nt, Homo sapiens
cugauuaaccuacuuguaa

SEQ ID NO: 147944 - RNA, 19 nt, Homo sapiens
aaagggacauugaaguguu

SEQ ID NO: 147945 - RNA, 19 nt, Homo sapiens
gaauucaaccuuauuaugc

SEQ ID NO: 147946 - RNA, 19 nt, Homo sapiens
guucaaagaccucauuuua

SEQ ID NO: 147947 - RNA, 19 nt, Homo sapiens
cuacauagugcauuugaaa

SEQ ID NO: 147948 - RNA, 19 nt, Homo sapiens
gaaucaagcacagauagaa

SEQ ID NO: 147949 - RNA, 19 nt, Homo sapiens
ggacuugcuguguauauug

SEQ ID NO: 147950 - RNA, 19 nt, Homo sapiens
gcacugaagcuccuacaca

SEQ ID NO: 147951 - RNA, 19 nt, Homo sapiens
uaacauucuuggaguggaa

SEQ ID NO: 147952 - RNA, 19 nt, Homo sapiens
gaacuuaguaucauucacu

SEQ ID NO: 147953 - RNA, 19 nt, Homo sapiens
aaacauaaacagcauggaa

SEQ ID NO: 147954 - RNA, 19 nt, Homo sapiens
gugcuuuacuacacaguuu

SEQ ID NO: 147955 - RNA, 19 nt, Homo sapiens
gaaaggcuaaacacuaugu

SEQ ID NO: 147956 - RNA, 19 nt, Homo sapiens
ggugaugccugauauuguc

SEQ ID NO: 147957 - RNA, 19 nt, Homo sapiens
uaaucuaccucugccgaua

SEQ ID NO: 147958 - RNA, 19 nt, Homo sapiens
gaaaagaagcaguaaucua

SEQ ID NO: 147959 - RNA, 19 nt, Homo sapiens
ucacuuugcgugugucaua

SEQ ID NO: 147960 - RNA, 19 nt, Homo sapiens
ugacuacauugaaacuuga

SEQ ID NO: 147961 - RNA, 19 nt, Homo sapiens
gcuauggacguuaauuuga

SEQ ID NO: 147962 - RNA, 19 nt, Homo sapiens
uaugagacuugaaagaaga

SEQ ID NO: 147963 - RNA, 19 nt, Homo sapiens
aaacucauccuguucaaga

SEQ ID NO: 147964 - RNA, 19 nt, Homo sapiens
ccaggugcgucagcaauuu

SEQ ID NO: 147965 - RNA, 19 nt, Homo sapiens
aaaugugaauggaaacuug

SEQ ID NO: 147966 - RNA, 19 nt, Homo sapiens
ggacauugaaguguuuaaa

SEQ ID NO: 147967 - RNA, 19 nt, Homo sapiens
agauggcacuuggaacuua

SEQ ID NO: 147968 - RNA, 19 nt, Homo sapiens
uuacuacacaguuugguua

SEQ ID NO: 147969 - RNA, 19 nt, Homo sapiens
gggagaaugaagauaagua

SEQ ID NO: 147970 - RNA, 19 nt, Homo sapiens
gaacgugacuggucuccua

SEQ ID NO: 147971 - RNA, 19 nt, Homo sapiens
ggacuucugugcauuguaa

SEQ ID NO: 147972 - RNA, 19 nt, Homo sapiens
gaucagaacucuccuaucu

SEQ ID NO: 147973 - RNA, 19 nt, Homo sapiens
gcacauaauuugcauaaag

SEQ ID NO: 147974 - RNA, 19 nt, Homo sapiens
gauaucaucuugaguauag

SEQ ID NO: 147975 - RNA, 19 nt, Homo sapiens
gaaccuaacacgaaaguuu

SEQ ID NO: 147976 - RNA, 19 nt, Homo sapiens
uaaggaugcuugauuauga

SEQ ID NO: 147977 - RNA, 19 nt, Homo sapiens
gggauaaccuuuggccuua

SEQ ID NO: 147978 - RNA, 19 nt, Homo sapiens
gaucauagguggucacuac

SEQ ID NO: 147979 - RNA, 19 nt, Homo sapiens
gauaaccuguuuaagauga

SEQ ID NO: 147980 - RNA, 19 nt, Homo sapiens
ccaggugccuuuagaauga

SEQ ID NO: 147981 - RNA, 19 nt, Homo sapiens
cagacaggcugguauuuaa

SEQ ID NO: 147982 - RNA, 19 nt, Homo sapiens
gaaagaagacgaugcauac

SEQ ID NO: 147983 - RNA, 19 nt, Homo sapiens
gcacggaaaugcaguacug

SEQ ID NO: 147984 - RNA, 19 nt, Homo sapiens
gcuaauaccuuggacuuug

SEQ ID NO: 147985 - RNA, 19 nt, Homo sapiens
gaauggaaacuuggaaaua

SEQ ID NO: 147986 - RNA, 19 nt, Homo sapiens
gcagacaggcugguauuua

SEQ ID NO: 147987 - RNA, 19 nt, Homo sapiens
gaaaacagcugaugaaggu

SEQ ID NO: 147988 - RNA, 19 nt, Homo sapiens
gaaaugugcgucagcaauu

SEQ ID NO: 147989 - RNA, 19 nt, Homo sapiens
gaagguacaaauacaagua

SEQ ID NO: 147990 - RNA, 19 nt, Homo sapiens
caacagguccagaguauga

SEQ ID NO: 147991 - RNA, 19 nt, Homo sapiens
aaacucgaauucaaccuua

SEQ ID NO: 147992 - RNA, 19 nt, Homo sapiens
ggauuacaguguuauaguu

SEQ ID NO: 147993 - RNA, 19 nt, Homo sapiens
uaaccaaggugcacugaga

SEQ ID NO: 147994 - RNA, 19 nt, Homo sapiens
gaauggagcuauggacguu

SEQ ID NO: 147995 - RNA, 19 nt, Homo sapiens
gcaguugauucuuguauuc

SEQ ID NO: 147996 - RNA, 19 nt, Homo sapiens
aauuauggcuguacuauug

SEQ ID NO: 147997 - RNA, 19 nt, Homo sapiens
gagcaaagcagcaauuaca

SEQ ID NO: 147998 - RNA, 19 nt, Homo sapiens
gcacuuggaacuuaaagaa

SEQ ID NO: 147999 - RNA, 19 nt, Homo sapiens
gggaaugccuuaugaccuu

SEQ ID NO: 148000 - RNA, 19 nt, Homo sapiens
uuacugcuguuuaggaaua

SEQ ID NO: 148001 - RNA, 19 nt, Homo sapiens
aaagaaaggcuaaacacua

SEQ ID NO: 148002 - RNA, 19 nt, Homo sapiens
uaaccuacuuguaaacuug

SEQ ID NO: 148003 - RNA, 19 nt, Homo sapiens
gcucgugacuacauugaaa

SEQ ID NO: 148004 - RNA, 19 nt, Homo sapiens
gcacgugguucauuugcuu

SEQ ID NO: 148005 - RNA, 19 nt, Homo sapiens
uuaaauaccuguguucaga

SEQ ID NO: 148006 - RNA, 19 nt, Homo sapiens
gcuaaacacuauguaaaug

SEQ ID NO: 148007 - RNA, 19 nt, Homo sapiens
aagaaaggcuaaacacuau

SEQ ID NO: 148008 - RNA, 19 nt, Homo sapiens
ggagaaugaagauaaguaa

SEQ ID NO: 148009 - RNA, 19 nt, Homo sapiens
ggccaagggucuacaauuc

SEQ ID NO: 148010 - RNA, 19 nt, Homo sapiens
gcucgcacgugguucauuu

SEQ ID NO: 148011 - RNA, 19 nt, Homo sapiens
gauaugagacuugaaagaa

SEQ ID NO: 148012 - RNA, 19 nt, Homo sapiens
caucuugaguauagcaaua

SEQ ID NO: 148013 - RNA, 19 nt, Homo sapiens
ggacgguuguggugaaguu

SEQ ID NO: 148014 - RNA, 19 nt, Homo sapiens
gaaaugcaguacuguaagg

SEQ ID NO: 148015 - RNA, 19 nt, Homo sapiens
ccgauaaccuguuuaagau

SEQ ID NO: 148016 - RNA, 19 nt, Homo sapiens
gaacauaguagauugacau

SEQ ID NO: 148017 - RNA, 19 nt, Homo sapiens
gccaauacauuuacagcaa

SEQ ID NO: 148018 - RNA, 19 nt, Homo sapiens
ucacagaaguagugguuug

SEQ ID NO: 148019 - RNA, 19 nt, Homo sapiens
uagaagagccuaccauuuc

SEQ ID NO: 148020 - RNA, 19 nt, Homo sapiens
gaaggacaucugacaauga

SEQ ID NO: 148021 - RNA, 19 nt, Homo sapiens
gaugauaugagacuugaaa

SEQ ID NO: 148022 - RNA, 19 nt, Homo sapiens
gcaaagggacauugaagug

SEQ ID NO: 148023 - RNA, 19 nt, Homo sapiens
gcaaggggcugauagagaa

SEQ ID NO: 148024 - RNA, 19 nt, Homo sapiens
gcaaucaggccuaccagaa

SEQ ID NO: 148025 - RNA, 19 nt, Homo sapiens
ccaaugagguagaucagau

SEQ ID NO: 148026 - RNA, 19 nt, Homo sapiens
cuuaugaccuugccauuga

SEQ ID NO: 148027 - RNA, 19 nt, Homo sapiens
caaaaggaauucaguaguu

SEQ ID NO: 148028 - RNA, 19 nt, Homo sapiens
gaacaccgcguuucauucu

SEQ ID NO: 148029 - RNA, 19 nt, Homo sapiens
caugcggucuuauguauga

SEQ ID NO: 148030 - RNA, 19 nt, Homo sapiens
ugaaagaagacgaugcaua

SEQ ID NO: 148031 - RNA, 19 nt, Homo sapiens
gaacuguuguugaauccau

SEQ ID NO: 148032 - RNA, 19 nt, Homo sapiens
gcaauuuccugcuccucuu

SEQ ID NO: 148033 - RNA, 19 nt, Homo sapiens
uuaaugagguuuacuaugc

SEQ ID NO: 148034 - RNA, 19 nt, Homo sapiens
ucaagccuguggaugauuu

SEQ ID NO: 148035 - RNA, 19 nt, Homo sapiens
gccgauaaccuguuuaaga

SEQ ID NO: 148036 - RNA, 19 nt, Homo sapiens
gaguaugagugcaagcaaa

SEQ ID NO: 148037 - RNA, 19 nt, Homo sapiens
gugacuacauugaaacuug

SEQ ID NO: 148038 - RNA, 19 nt, Homo sapiens
gacaggaguuugugugcaa

SEQ ID NO: 148039 - RNA, 19 nt, Homo sapiens
gagcuauggacguuaauuu

SEQ ID NO: 148040 - RNA, 19 nt, Homo sapiens
gcugaugaagguacaaaua

SEQ ID NO: 148041 - RNA, 19 nt, Homo sapiens
gaaguucaaagaccucauu

SEQ ID NO: 148042 - RNA, 19 nt, Homo sapiens
gcagugcaaucaagauagu

SEQ ID NO: 148043 - RNA, 19 nt, Homo sapiens
gaaggucacagaaguagug

SEQ ID NO: 148044 - RNA, 19 nt, Homo sapiens
gauggcacuuggaacuuaa

SEQ ID NO: 148045 - RNA, 19 nt, Homo sapiens
aaaaguggauggaucguua

SEQ ID NO: 148046 - RNA, 19 nt, Homo sapiens
gauauugucauguuacaga

SEQ ID NO: 148047 - RNA, 19 nt, Homo sapiens
gcaaagcagcaauuacaug

SEQ ID NO: 148048 - RNA, 19 nt, Homo sapiens
ggcagaggauauaccagua

SEQ ID NO: 148049 - RNA, 19 nt, Homo sapiens
ucacuacagucucagauuc

SEQ ID NO: 148050 - RNA, 19 nt, Homo sapiens
cugauuaaccuacuuguaa

SEQ ID NO: 148051 - RNA, 19 nt, Homo sapiens
aaagggacauugaaguguu

SEQ ID NO: 148052 - RNA, 19 nt, Homo sapiens
gaauucaaccuuauuaugc

SEQ ID NO: 148053 - RNA, 19 nt, Homo sapiens
guucaaagaccucauuuua

SEQ ID NO: 148054 - RNA, 19 nt, Homo sapiens
cuacauagugcauuugaaa

SEQ ID NO: 148055 - RNA, 19 nt, Homo sapiens
gaaucaagcacagauagaa

SEQ ID NO: 148056 - RNA, 19 nt, Homo sapiens
ggacuugcuguguauauug

SEQ ID NO: 148057 - RNA, 19 nt, Homo sapiens
gcacugaagcuccuacaca

SEQ ID NO: 148058 - RNA, 19 nt, Homo sapiens
uaacauucuuggaguggaa

SEQ ID NO: 148059 - RNA, 19 nt, Homo sapiens
gaacuuaguaucauucacu

SEQ ID NO: 148060 - RNA, 19 nt, Homo sapiens
aaacauaaacagcauggaa

SEQ ID NO: 148061 - RNA, 19 nt, Homo sapiens
gugcuuuacuacacaguuu

SEQ ID NO: 148062 - RNA, 19 nt, Homo sapiens
gaaaggcuaaacacuaugu

SEQ ID NO: 148063 - RNA, 19 nt, Homo sapiens
uaaucuaccucugccgaua

SEQ ID NO: 148064 - RNA, 19 nt, Homo sapiens
gaaaagaagcaguaaucua

SEQ ID NO: 148065 - RNA, 19 nt, Homo sapiens
ucacuuugcgugugucaua

SEQ ID NO: 148066 - RNA, 19 nt, Homo sapiens
uaugagacuugaaagaaga

SEQ ID NO: 148067 - RNA, 19 nt, Homo sapiens
ugacuacauugaaacuuga

SEQ ID NO: 148068 - RNA, 19 nt, Homo sapiens
gcuauggacguuaauuuga

SEQ ID NO: 148069 - RNA, 19 nt, Homo sapiens
aaacucauccuguucaaga

SEQ ID NO: 148070 - RNA, 19 nt, Homo sapiens
gaacgugacuggucuccua

SEQ ID NO: 148071 - RNA, 19 nt, Homo sapiens
ggacuucugugcauuguaa

SEQ ID NO: 148072 - RNA, 19 nt, Homo sapiens
gaucagaacucuccuaucu

SEQ ID NO: 148073 - RNA, 19 nt, Homo sapiens
gaacuauacugaggcaaua

SEQ ID NO: 148074 - RNA, 19 nt, Homo sapiens
guaauugucuugcaucauu

SEQ ID NO: 148075 - RNA, 19 nt, Homo sapiens
gcacauaauuugcauaaag

SEQ ID NO: 148076 - RNA, 19 nt, Homo sapiens
gauaucaucuugaguauag

SEQ ID NO: 148077 - RNA, 19 nt, Homo sapiens
gaaccuaacacgaaaguuu

SEQ ID NO: 148078 - RNA, 19 nt, Homo sapiens
agaaaugucucagaacuua

SEQ ID NO: 148079 - RNA, 19 nt, Homo sapiens
uaaggaugcuugauuauga

SEQ ID NO: 148080 - RNA, 19 nt, Homo sapiens
gggauaaccuuuggccuua

SEQ ID NO: 148081 - RNA, 19 nt, Homo sapiens
gguggaauauucagguuua

SEQ ID NO: 148082 - RNA, 19 nt, Homo sapiens
cauguugucuuuccuauaa

SEQ ID NO: 148083 - RNA, 19 nt, Homo sapiens
gauaaccuguuuaagauga

SEQ ID NO: 148084 - RNA, 19 nt, Homo sapiens
uaacucauauugucucuga

SEQ ID NO: 148085 - RNA, 19 nt, Homo sapiens
ucacucaacuccuuuagaa

SEQ ID NO: 148086 - RNA, 19 nt, Homo sapiens
cagacaggcugguauuuaa

SEQ ID NO: 148087 - RNA, 19 nt, Homo sapiens
gaaagaagacgaugcauac

SEQ ID NO: 148088 - RNA, 19 nt, Homo sapiens
gaauuugucuggaggaugu

SEQ ID NO: 148089 - RNA, 19 nt, Homo sapiens
gcacggaaaugcaguacug

SEQ ID NO: 148090 - RNA, 19 nt, Homo sapiens
gcuaauaccuuggacuuug

SEQ ID NO: 148091 - RNA, 19 nt, Homo sapiens
gaauggaaacuuggaaaua

SEQ ID NO: 148092 - RNA, 19 nt, Homo sapiens
gcagacaggcugguauuua

SEQ ID NO: 148093 - RNA, 19 nt, Homo sapiens
gaaaacagcugaugaaggu

SEQ ID NO: 148094 - RNA, 19 nt, Homo sapiens
uaacuuuaccucugucuua

SEQ ID NO: 148095 - RNA, 19 nt, Homo sapiens
gaagguacaaauacaagua

SEQ ID NO: 148096 - RNA, 19 nt, Homo sapiens
gcaauaggagcuuuguaua

SEQ ID NO: 148097 - RNA, 19 nt, Homo sapiens
caacagguccagaguauga

SEQ ID NO: 148098 - RNA, 19 nt, Homo sapiens
aaacucgaauucaaccuua

SEQ ID NO: 148099 - RNA, 19 nt, Homo sapiens
ccagugaaguguuuaguau

SEQ ID NO: 148100 - RNA, 19 nt, Homo sapiens
uaaccaaggugcacugaga

SEQ ID NO: 148101 - RNA, 19 nt, Homo sapiens
gaauggagcuauggacguu

SEQ ID NO: 148102 - RNA, 19 nt, Homo sapiens
ccaguugguuucuuucuuu

SEQ ID NO: 148103 - RNA, 19 nt, Homo sapiens
gcaguugauucuuguauuc

SEQ ID NO: 148104 - RNA, 19 nt, Homo sapiens
aauuauggcuguacuauug

SEQ ID NO: 148105 - RNA, 19 nt, Homo sapiens
gagcaaagcagcaauuaca

SEQ ID NO: 148106 - RNA, 19 nt, Homo sapiens
gcacuuggaacuuaaagaa

SEQ ID NO: 148107 - RNA, 19 nt, Homo sapiens
gggaaugccuuaugaccuu

SEQ ID NO: 148108 - RNA, 19 nt, Homo sapiens
uuacugcuguuuaggaaua

SEQ ID NO: 148109 - RNA, 19 nt, Homo sapiens
aaagaaaggcuaaacacua

SEQ ID NO: 148110 - RNA, 19 nt, Homo sapiens
uaaccuacuuguaaacuug

SEQ ID NO: 148111 - RNA, 19 nt, Homo sapiens
gcucgugacuacauugaaa

SEQ ID NO: 148112 - RNA, 19 nt, Homo sapiens
uuaaauaccuguguucaga

SEQ ID NO: 148113 - RNA, 19 nt, Homo sapiens
gcuaaacacuauguaaaug

SEQ ID NO: 148114 - RNA, 19 nt, Homo sapiens
aagaaaggcuaaacacuau

SEQ ID NO: 148115 - RNA, 19 nt, Homo sapiens
ggagaaugaagauaaguaa

SEQ ID NO: 148116 - RNA, 19 nt, Homo sapiens
ggccaagggucuacaauuc

SEQ ID NO: 148117 - RNA, 19 nt, Homo sapiens
gauaugagacuugaaagaa

SEQ ID NO: 148118 - RNA, 19 nt, Homo sapiens
guacuugucuuuaccucuu

SEQ ID NO: 148119 - RNA, 19 nt, Homo sapiens
caucuugaguauagcaaua

SEQ ID NO: 148120 - RNA, 19 nt, Homo sapiens
ggacgguuguggugaaguu

SEQ ID NO: 148121 - RNA, 19 nt, Homo sapiens
gaaaugcaguacuguaagg

SEQ ID NO: 148122 - RNA, 19 nt, Homo sapiens
ccgauaaccuguuuaagau

SEQ ID NO: 148123 - RNA, 19 nt, Homo sapiens
gaacauaguagauugacau

SEQ ID NO: 148124 - RNA, 19 nt, Homo sapiens
gccaauacauuuacagcaa

SEQ ID NO: 148125 - RNA, 19 nt, Homo sapiens
gccaacauaugcaacauug

SEQ ID NO: 148126 - RNA, 19 nt, Homo sapiens
ucacagaaguagugguuug

SEQ ID NO: 148127 - RNA, 19 nt, Homo sapiens
uagaagagccuaccauuuc

SEQ ID NO: 148128 - RNA, 19 nt, Homo sapiens
gaaggacaucugacaauga

SEQ ID NO: 148129 - RNA, 19 nt, Homo sapiens
gaacuuggccaacauaugc

SEQ ID NO: 148130 - RNA, 19 nt, Homo sapiens
gcaaagggacauugaagug

SEQ ID NO: 148131 - RNA, 19 nt, Homo sapiens
gcaaggggcugauagagaa

SEQ ID NO: 148132 - RNA, 19 nt, Homo sapiens
gcaaucaggccuaccagaa

SEQ ID NO: 148133 - RNA, 19 nt, Homo sapiens
gaugauaugagacuugaaa

SEQ ID NO: 148134 - RNA, 19 nt, Homo sapiens
ccaaugagguagaucagau

SEQ ID NO: 148135 - RNA, 19 nt, Homo sapiens
cuuaugaccuugccauuga

SEQ ID NO: 148136 - RNA, 19 nt, Homo sapiens
caaaaggaauucaguaguu

SEQ ID NO: 148137 - RNA, 19 nt, Homo sapiens
gaacaccgcguuucauucu

SEQ ID NO: 148138 - RNA, 19 nt, Homo sapiens
caugcggucuuauguauga

SEQ ID NO: 148139 - RNA, 19 nt, Homo sapiens
gaacuguuguugaauccau

SEQ ID NO: 148140 - RNA, 19 nt, Homo sapiens
ggcaauaaguauagacuca

SEQ ID NO: 148141 - RNA, 19 nt, Homo sapiens
gcaauuuccugcuccucuu

SEQ ID NO: 148142 - RNA, 19 nt, Homo sapiens
uuaaugagguuuacuaugc

SEQ ID NO: 148143 - RNA, 19 nt, Homo sapiens
ugaaagaagacgaugcaua

SEQ ID NO: 148144 - RNA, 19 nt, Homo sapiens
ucaagccuguggaugauuu

SEQ ID NO: 148145 - RNA, 19 nt, Homo sapiens
gccgauaaccuguuuaaga

SEQ ID NO: 148146 - RNA, 19 nt, Homo sapiens
gaguaugagugcaagcaaa

SEQ ID NO: 148147 - RNA, 19 nt, Homo sapiens
gugacuacauugaaacuug

SEQ ID NO: 148148 - RNA, 19 nt, Homo sapiens
gacaggaguuugugugcaa

SEQ ID NO: 148149 - RNA, 19 nt, Homo sapiens
gagcuauggacguuaauuu

SEQ ID NO: 148150 - RNA, 19 nt, Homo sapiens
gcugaugaagguacaaaua

SEQ ID NO: 148151 - RNA, 19 nt, Homo sapiens
gaaguucaaagaccucauu

SEQ ID NO: 148152 - RNA, 19 nt, Homo sapiens
gcagugcaaucaagauagu

SEQ ID NO: 148153 - RNA, 19 nt, Homo sapiens
gaauucguguuccucuuga

SEQ ID NO: 148154 - RNA, 19 nt, Homo sapiens
ggucaaccaugaguuauca

SEQ ID NO: 148155 - RNA, 19 nt, Homo sapiens
gaaggucacagaaguagug

SEQ ID NO: 148156 - RNA, 19 nt, Homo sapiens
gauggcacuuggaacuuaa

SEQ ID NO: 148157 - RNA, 19 nt, Homo sapiens
aaaaguggauggaucguua

SEQ ID NO: 148158 - RNA, 19 nt, Homo sapiens
gcaaagcagcaauuacaug

SEQ ID NO: 148159 - RNA, 19 nt, Homo sapiens
ggcagaggauauaccagua

SEQ ID NO: 148160 - RNA, 19 nt, Homo sapiens
uaacauugguagauugaca

SEQ ID NO: 148161 - RNA, 19 nt, Homo sapiens
acacugagauuacuuucau

SEQ ID NO: 148162 - RNA, 19 nt, Homo sapiens
uaggagcuuuguauaguaa

SEQ ID NO: 148163 - RNA, 19 nt, Homo sapiens
cugauuaaccuacuuguaa

SEQ ID NO: 148164 - RNA, 19 nt, Homo sapiens
aaagggacauugaaguguu

SEQ ID NO: 148165 - RNA, 19 nt, Homo sapiens
gaauucaaccuuauuaugc

SEQ ID NO: 148166 - RNA, 19 nt, Homo sapiens
guucaaagaccucauuuua

SEQ ID NO: 148167 - RNA, 19 nt, Homo sapiens
cuacauagugcauuugaaa

SEQ ID NO: 148168 - RNA, 19 nt, Homo sapiens
gaaucaagcacagauagaa

SEQ ID NO: 148169 - RNA, 19 nt, Homo sapiens
gauguagaauugaagaagu

SEQ ID NO: 148170 - RNA, 19 nt, Homo sapiens
gaacgugacuggucuccua

SEQ ID NO: 148171 - RNA, 19 nt, Homo sapiens
ggacuucugugcauuguaa

SEQ ID NO: 148172 - RNA, 19 nt, Homo sapiens
gaucagaacucuccuaucu

SEQ ID NO: 148173 - RNA, 19 nt, Homo sapiens
gcacauaauuugcauaaag

SEQ ID NO: 148174 - RNA, 19 nt, Homo sapiens
gauaucaucuugaguauag

SEQ ID NO: 148175 - RNA, 19 nt, Homo sapiens
gaaccuaacacgaaaguuu

SEQ ID NO: 148176 - RNA, 19 nt, Homo sapiens
uaaggaugcuugauuauga

SEQ ID NO: 148177 - RNA, 19 nt, Homo sapiens
gggauaaccuuuggccuua

SEQ ID NO: 148178 - RNA, 19 nt, Homo sapiens
gauaaccuguuuaagauga

SEQ ID NO: 148179 - RNA, 19 nt, Homo sapiens
ccaggugccuuuagaauga

SEQ ID NO: 148180 - RNA, 19 nt, Homo sapiens
cagacaggcugguauuuaa

SEQ ID NO: 148181 - RNA, 19 nt, Homo sapiens
gaaagaagacgaugcauac

SEQ ID NO: 148182 - RNA, 19 nt, Homo sapiens
gcacggaaaugcaguacug

SEQ ID NO: 148183 - RNA, 19 nt, Homo sapiens
gcuaauaccuuggacuuug

SEQ ID NO: 148184 - RNA, 19 nt, Homo sapiens
gaauggaaacuuggaaaua

SEQ ID NO: 148185 - RNA, 19 nt, Homo sapiens
gcagacaggcugguauuua

SEQ ID NO: 148186 - RNA, 19 nt, Homo sapiens
gaaaacagcugaugaaggu

SEQ ID NO: 148187 - RNA, 19 nt, Homo sapiens
gaaaugugcgucagcaauu

SEQ ID NO: 148188 - RNA, 19 nt, Homo sapiens
gaagguacaaauacaagua

SEQ ID NO: 148189 - RNA, 19 nt, Homo sapiens
caacagguccagaguauga

SEQ ID NO: 148190 - RNA, 19 nt, Homo sapiens
aaacucgaauucaaccuua

SEQ ID NO: 148191 - RNA, 19 nt, Homo sapiens
uaaccaaggugcacugaga

SEQ ID NO: 148192 - RNA, 19 nt, Homo sapiens
gaauggagcuauggacguu

SEQ ID NO: 148193 - RNA, 19 nt, Homo sapiens
gcaguugauucuuguauuc

SEQ ID NO: 148194 - RNA, 19 nt, Homo sapiens
aauuauggcuguacuauug

SEQ ID NO: 148195 - RNA, 19 nt, Homo sapiens
gagcaaagcagcaauuaca

SEQ ID NO: 148196 - RNA, 19 nt, Homo sapiens
gcacuuggaacuuaaagaa

SEQ ID NO: 148197 - RNA, 19 nt, Homo sapiens
gggaaugccuuaugaccuu

SEQ ID NO: 148198 - RNA, 19 nt, Homo sapiens
uuacugcuguuuaggaaua

SEQ ID NO: 148199 - RNA, 19 nt, Homo sapiens
aaagaaaggcuaaacacua

SEQ ID NO: 148200 - RNA, 19 nt, Homo sapiens
uaaccuacuuguaaacuug

SEQ ID NO: 148201 - RNA, 19 nt, Homo sapiens
gcucgugacuacauugaaa

SEQ ID NO: 148202 - RNA, 19 nt, Homo sapiens
uuaaauaccuguguucaga

SEQ ID NO: 148203 - RNA, 19 nt, Homo sapiens
gcuaaacacuauguaaaug

SEQ ID NO: 148204 - RNA, 19 nt, Homo sapiens
aagaaaggcuaaacacuau

SEQ ID NO: 148205 - RNA, 19 nt, Homo sapiens
ggagaaugaagauaaguaa

SEQ ID NO: 148206 - RNA, 19 nt, Homo sapiens
gauaugagacuugaaagaa

SEQ ID NO: 148207 - RNA, 19 nt, Homo sapiens
ggccaagggucuacaauuc

SEQ ID NO: 148208 - RNA, 19 nt, Homo sapiens
caucuugaguauagcaaua

SEQ ID NO: 148209 - RNA, 19 nt, Homo sapiens
ggacgguuguggugaaguu

SEQ ID NO: 148210 - RNA, 19 nt, Homo sapiens
gaaaugcaguacuguaagg

SEQ ID NO: 148211 - RNA, 19 nt, Homo sapiens
ccgauaaccuguuuaagau

SEQ ID NO: 148212 - RNA, 19 nt, Homo sapiens
gaacauaguagauugacau

SEQ ID NO: 148213 - RNA, 19 nt, Homo sapiens
gccaauacauuuacagcaa

SEQ ID NO: 148214 - RNA, 19 nt, Homo sapiens
ucacagaaguagugguuug

SEQ ID NO: 148215 - RNA, 19 nt, Homo sapiens
uagaagagccuaccauuuc

SEQ ID NO: 148216 - RNA, 19 nt, Homo sapiens
gaaggacaucugacaauga

SEQ ID NO: 148217 - RNA, 19 nt, Homo sapiens
gaugauaugagacuugaaa

SEQ ID NO: 148218 - RNA, 19 nt, Homo sapiens
gcaaagggacauugaagug

SEQ ID NO: 148219 - RNA, 19 nt, Homo sapiens
gcaaggggcugauagagaa

SEQ ID NO: 148220 - RNA, 19 nt, Homo sapiens
gcaaucaggccuaccagaa

SEQ ID NO: 148221 - RNA, 19 nt, Homo sapiens
ccaaugagguagaucagau

SEQ ID NO: 148222 - RNA, 19 nt, Homo sapiens
cuuaugaccuugccauuga

SEQ ID NO: 148223 - RNA, 19 nt, Homo sapiens
caaaaggaauucaguaguu

SEQ ID NO: 148224 - RNA, 19 nt, Homo sapiens
gaacaccgcguuucauucu

SEQ ID NO: 148225 - RNA, 19 nt, Homo sapiens
caugcggucuuauguauga

SEQ ID NO: 148226 - RNA, 19 nt, Homo sapiens
gaacuguuguugaauccau

SEQ ID NO: 148227 - RNA, 19 nt, Homo sapiens
gcaauuuccugcuccucuu

SEQ ID NO: 148228 - RNA, 19 nt, Homo sapiens
ugaaagaagacgaugcaua

SEQ ID NO: 148229 - RNA, 19 nt, Homo sapiens
uuaaugagguuuacuaugc

SEQ ID NO: 148230 - RNA, 19 nt, Homo sapiens
ucaagccuguggaugauuu

SEQ ID NO: 148231 - RNA, 19 nt, Homo sapiens
gccgauaaccuguuuaaga

SEQ ID NO: 148232 - RNA, 19 nt, Homo sapiens
gaguaugagugcaagcaaa

SEQ ID NO: 148233 - RNA, 19 nt, Homo sapiens
gugacuacauugaaacuug

SEQ ID NO: 148234 - RNA, 19 nt, Homo sapiens
gacaggaguuugugugcaa

SEQ ID NO: 148235 - RNA, 19 nt, Homo sapiens
gagcuauggacguuaauuu

SEQ ID NO: 148236 - RNA, 19 nt, Homo sapiens
gcugaugaagguacaaaua

SEQ ID NO: 148237 - RNA, 19 nt, Homo sapiens
gaaguucaaagaccucauu

SEQ ID NO: 148238 - RNA, 19 nt, Homo sapiens
gcagugcaaucaagauagu

SEQ ID NO: 148239 - RNA, 19 nt, Homo sapiens
gaaggucacagaaguagug

SEQ ID NO: 148240 - RNA, 19 nt, Homo sapiens
gauauugucauguuacaga

SEQ ID NO: 148241 - RNA, 19 nt, Homo sapiens
gauggcacuuggaacuuaa

SEQ ID NO: 148242 - RNA, 19 nt, Homo sapiens
aaaaguggauggaucguua

SEQ ID NO: 148243 - RNA, 19 nt, Homo sapiens
gcaaagcagcaauuacaug

SEQ ID NO: 148244 - RNA, 19 nt, Homo sapiens
ggcagaggauauaccagua

SEQ ID NO: 148245 - RNA, 19 nt, Homo sapiens
cugauuaaccuacuuguaa

SEQ ID NO: 148246 - RNA, 19 nt, Homo sapiens
aaagggacauugaaguguu

SEQ ID NO: 148247 - RNA, 19 nt, Homo sapiens
gaauucaaccuuauuaugc

SEQ ID NO: 148248 - RNA, 19 nt, Homo sapiens
guucaaagaccucauuuua

SEQ ID NO: 148249 - RNA, 19 nt, Homo sapiens
cuacauagugcauuugaaa

SEQ ID NO: 148250 - RNA, 19 nt, Homo sapiens
gaaucaagcacagauagaa

SEQ ID NO: 148251 - RNA, 19 nt, Homo sapiens
ggacuugcuguguauauug

SEQ ID NO: 148252 - RNA, 19 nt, Homo sapiens
gcacugaagcuccuacaca

SEQ ID NO: 148253 - RNA, 19 nt, Homo sapiens
uaacauucuuggaguggaa

SEQ ID NO: 148254 - RNA, 19 nt, Homo sapiens
gaacuuaguaucauucacu

SEQ ID NO: 148255 - RNA, 19 nt, Homo sapiens
aaacauaaacagcauggaa

SEQ ID NO: 148256 - RNA, 19 nt, Homo sapiens
gugcuuuacuacacaguuu

SEQ ID NO: 148257 - RNA, 19 nt, Homo sapiens
gaaaggcuaaacacuaugu

SEQ ID NO: 148258 - RNA, 19 nt, Homo sapiens
uaaucuaccucugccgaua

SEQ ID NO: 148259 - RNA, 19 nt, Homo sapiens
gaaaagaagcaguaaucua

SEQ ID NO: 148260 - RNA, 19 nt, Homo sapiens
ucacuuugcgugugucaua

SEQ ID NO: 148261 - RNA, 19 nt, Homo sapiens
uaugagacuugaaagaaga

SEQ ID NO: 148262 - RNA, 19 nt, Homo sapiens
ugacuacauugaaacuuga

SEQ ID NO: 148263 - RNA, 19 nt, Homo sapiens
gcuauggacguuaauuuga

SEQ ID NO: 148264 - RNA, 19 nt, Homo sapiens
aaacucauccuguucaaga

SEQ ID NO: 148265 - RNA, 19 nt, Homo sapiens
ggaaaugugcgucagcaau

SEQ ID NO: 148266 - RNA, 19 nt, Homo sapiens
ggugaugccugauauuguc

SEQ ID NO: 148267 - RNA, 19 nt, Homo sapiens
aaaugugaauggaaacuug

SEQ ID NO: 148268 - RNA, 19 nt, Homo sapiens
ggacauugaaguguuuaaa

SEQ ID NO: 148269 - RNA, 19 nt, Homo sapiens
gaugccaggugccuuuaga

SEQ ID NO: 148270 - RNA, 19 nt, Homo sapiens
gaacgugacuggucuccua

SEQ ID NO: 148271 - RNA, 19 nt, Homo sapiens
ggacuucugugcauuguaa

SEQ ID NO: 148272 - RNA, 19 nt, Homo sapiens
gaucagaacucuccuaucu

SEQ ID NO: 148273 - RNA, 19 nt, Homo sapiens
gcacauaauuugcauaaag

SEQ ID NO: 148274 - RNA, 19 nt, Homo sapiens
gauaucaucuugaguauag

SEQ ID NO: 148275 - RNA, 19 nt, Homo sapiens
gaaccuaacacgaaaguuu

SEQ ID NO: 148276 - RNA, 19 nt, Homo sapiens
uaaggaugcuugauuauga

SEQ ID NO: 148277 - RNA, 19 nt, Homo sapiens
gggauaaccuuuggccuua

SEQ ID NO: 148278 - RNA, 19 nt, Homo sapiens
gauaaccuguuuaagauga

SEQ ID NO: 148279 - RNA, 19 nt, Homo sapiens
cagacaggcugguauuuaa

SEQ ID NO: 148280 - RNA, 19 nt, Homo sapiens
gaaagaagacgaugcauac

SEQ ID NO: 148281 - RNA, 19 nt, Homo sapiens
gcacggaaaugcaguacug

SEQ ID NO: 148282 - RNA, 19 nt, Homo sapiens
gcuaauaccuuggacuuug

SEQ ID NO: 148283 - RNA, 19 nt, Homo sapiens
gaauggaaacuuggaaaua

SEQ ID NO: 148284 - RNA, 19 nt, Homo sapiens
gcagacaggcugguauuua

SEQ ID NO: 148285 - RNA, 19 nt, Homo sapiens
gaaaacagcugaugaaggu

SEQ ID NO: 148286 - RNA, 19 nt, Homo sapiens
gaagguacaaauacaagua

SEQ ID NO: 148287 - RNA, 19 nt, Homo sapiens
caacagguccagaguauga

SEQ ID NO: 148288 - RNA, 19 nt, Homo sapiens
aaacucgaauucaaccuua

SEQ ID NO: 148289 - RNA, 19 nt, Homo sapiens
uaaccaaggugcacugaga

SEQ ID NO: 148290 - RNA, 19 nt, Homo sapiens
gaauggagcuauggacguu

SEQ ID NO: 148291 - RNA, 19 nt, Homo sapiens
gcaguugauucuuguauuc

SEQ ID NO: 148292 - RNA, 19 nt, Homo sapiens
aauuauggcuguacuauug

SEQ ID NO: 148293 - RNA, 19 nt, Homo sapiens
gagcaaagcagcaauuaca

SEQ ID NO: 148294 - RNA, 19 nt, Homo sapiens
gcacuuggaacuuaaagaa

SEQ ID NO: 148295 - RNA, 19 nt, Homo sapiens
gggaaugccuuaugaccuu

SEQ ID NO: 148296 - RNA, 19 nt, Homo sapiens
uuacugcuguuuaggaaua

SEQ ID NO: 148297 - RNA, 19 nt, Homo sapiens
aaagaaaggcuaaacacua

SEQ ID NO: 148298 - RNA, 19 nt, Homo sapiens
uaaccuacuuguaaacuug

SEQ ID NO: 148299 - RNA, 19 nt, Homo sapiens
gcucgugacuacauugaaa

SEQ ID NO: 148300 - RNA, 19 nt, Homo sapiens
uuaaauaccuguguucaga

SEQ ID NO: 148301 - RNA, 19 nt, Homo sapiens
gcuaaacacuauguaaaug

SEQ ID NO: 148302 - RNA, 19 nt, Homo sapiens
aagaaaggcuaaacacuau

SEQ ID NO: 148303 - RNA, 19 nt, Homo sapiens
ggagaaugaagauaaguaa

SEQ ID NO: 148304 - RNA, 19 nt, Homo sapiens
ggccaagggucuacaauuc

SEQ ID NO: 148305 - RNA, 19 nt, Homo sapiens
gauaugagacuugaaagaa

SEQ ID NO: 148306 - RNA, 19 nt, Homo sapiens
caucuugaguauagcaaua

SEQ ID NO: 148307 - RNA, 19 nt, Homo sapiens
ggacgguuguggugaaguu

SEQ ID NO: 148308 - RNA, 19 nt, Homo sapiens
gaaaugcaguacuguaagg

SEQ ID NO: 148309 - RNA, 19 nt, Homo sapiens
ccgauaaccuguuuaagau

SEQ ID NO: 148310 - RNA, 19 nt, Homo sapiens
gaacauaguagauugacau

SEQ ID NO: 148311 - RNA, 19 nt, Homo sapiens
gccaauacauuuacagcaa

SEQ ID NO: 148312 - RNA, 19 nt, Homo sapiens
ucacagaaguagugguuug

SEQ ID NO: 148313 - RNA, 19 nt, Homo sapiens
gaaggacaucugacaauga

SEQ ID NO: 148314 - RNA, 19 nt, Homo sapiens
gaugauaugagacuugaaa

SEQ ID NO: 148315 - RNA, 19 nt, Homo sapiens
gcaaagggacauugaagug

SEQ ID NO: 148316 - RNA, 19 nt, Homo sapiens
gcaaggggcugauagagaa

SEQ ID NO: 148317 - RNA, 19 nt, Homo sapiens
gcaaucaggccuaccagaa

SEQ ID NO: 148318 - RNA, 19 nt, Homo sapiens
ccaaugagguagaucagau

SEQ ID NO: 148319 - RNA, 19 nt, Homo sapiens
cuuaugaccuugccauuga

SEQ ID NO: 148320 - RNA, 19 nt, Homo sapiens
caaaaggaauucaguaguu

SEQ ID NO: 148321 - RNA, 19 nt, Homo sapiens
gaacaccgcguuucauucu

SEQ ID NO: 148322 - RNA, 19 nt, Homo sapiens
caugcggucuuauguauga

SEQ ID NO: 148323 - RNA, 19 nt, Homo sapiens
ugaaagaagacgaugcaua

SEQ ID NO: 148324 - RNA, 19 nt, Homo sapiens
gaacuguuguugaauccau

SEQ ID NO: 148325 - RNA, 19 nt, Homo sapiens
gcaauuuccugcuccucuu

SEQ ID NO: 148326 - RNA, 19 nt, Homo sapiens
uuaaugagguuuacuaugc

SEQ ID NO: 148327 - RNA, 19 nt, Homo sapiens
ucaagccuguggaugauuu

SEQ ID NO: 148328 - RNA, 19 nt, Homo sapiens
gccgauaaccuguuuaaga

SEQ ID NO: 148329 - RNA, 19 nt, Homo sapiens
gaguaugagugcaagcaaa

SEQ ID NO: 148330 - RNA, 19 nt, Homo sapiens
gugacuacauugaaacuug

SEQ ID NO: 148331 - RNA, 19 nt, Homo sapiens
gacaggaguuugugugcaa

SEQ ID NO: 148332 - RNA, 19 nt, Homo sapiens
gagcuauggacguuaauuu

SEQ ID NO: 148333 - RNA, 19 nt, Homo sapiens
gcugaugaagguacaaaua

SEQ ID NO: 148334 - RNA, 19 nt, Homo sapiens
gaaguucaaagaccucauu

SEQ ID NO: 148335 - RNA, 19 nt, Homo sapiens
gcagugcaaucaagauagu

SEQ ID NO: 148336 - RNA, 19 nt, Homo sapiens
gaaggucacagaaguagug

SEQ ID NO: 148337 - RNA, 19 nt, Homo sapiens
gauggcacuuggaacuuaa

SEQ ID NO: 148338 - RNA, 19 nt, Homo sapiens
aaaaguggauggaucguua

SEQ ID NO: 148339 - RNA, 19 nt, Homo sapiens
gauauugucauguuacaga

SEQ ID NO: 148340 - RNA, 19 nt, Homo sapiens
gcaaagcagcaauuacaug

SEQ ID NO: 148341 - RNA, 19 nt, Homo sapiens
ggcagaggauauaccagua

SEQ ID NO: 148342 - RNA, 19 nt, Homo sapiens
cugauuaaccuacuuguaa

SEQ ID NO: 148343 - RNA, 19 nt, Homo sapiens
aaagggacauugaaguguu

SEQ ID NO: 148344 - RNA, 19 nt, Homo sapiens
gaauucaaccuuauuaugc

SEQ ID NO: 148345 - RNA, 19 nt, Homo sapiens
guucaaagaccucauuuua

SEQ ID NO: 148346 - RNA, 19 nt, Homo sapiens
cuacauagugcauuugaaa

SEQ ID NO: 148347 - RNA, 19 nt, Homo sapiens
gaaucaagcacagauagaa

SEQ ID NO: 148348 - RNA, 19 nt, Homo sapiens
ggacuugcuguguauauug

SEQ ID NO: 148349 - RNA, 19 nt, Homo sapiens
gcacugaagcuccuacaca

SEQ ID NO: 148350 - RNA, 19 nt, Homo sapiens
uaacauucuuggaguggaa

SEQ ID NO: 148351 - RNA, 19 nt, Homo sapiens
gaacuuaguaucauucacu

SEQ ID NO: 148352 - RNA, 19 nt, Homo sapiens
aaacauaaacagcauggaa

SEQ ID NO: 148353 - RNA, 19 nt, Homo sapiens
gugcuuuacuacacaguuu

SEQ ID NO: 148354 - RNA, 19 nt, Homo sapiens
gaaaggcuaaacacuaugu

SEQ ID NO: 148355 - RNA, 19 nt, Homo sapiens
uaaucuaccucugccgaua

SEQ ID NO: 148356 - RNA, 19 nt, Homo sapiens
gaaaagaagcaguaaucua

SEQ ID NO: 148357 - RNA, 19 nt, Homo sapiens
ggugaugccugauauuguc

SEQ ID NO: 148358 - RNA, 19 nt, Homo sapiens
ucacuuugcgugugucaua

SEQ ID NO: 148359 - RNA, 19 nt, Homo sapiens
uagaacagccuaccauuuc

SEQ ID NO: 148360 - RNA, 19 nt, Homo sapiens
ugacuacauugaaacuuga

SEQ ID NO: 148361 - RNA, 19 nt, Homo sapiens
gcuauggacguuaauuuga

SEQ ID NO: 148362 - RNA, 19 nt, Homo sapiens
uaugagacuugaaagaaga

SEQ ID NO: 148363 - RNA, 19 nt, Homo sapiens
aaacucauccuguucaaga

SEQ ID NO: 148364 - RNA, 19 nt, Homo sapiens
aaaugugaauggaaacuug

SEQ ID NO: 148365 - RNA, 19 nt, Homo sapiens
ggacauugaaguguuuaaa

SEQ ID NO: 148366 - RNA, 19 nt, Homo sapiens
agauggcacuuggaacuua

SEQ ID NO: 148367 - RNA, 19 nt, Homo sapiens
uuacuacacaguuugguua

SEQ ID NO: 148368 - RNA, 19 nt, Homo sapiens
gggagaaugaagauaagua

SEQ ID NO: 148369 - RNA, 19 nt, Homo sapiens
ucuggcaguugcuaaauuu

SEQ ID NO: 148370 - RNA, 19 nt, Homo sapiens
gcaaauggcuaccguuuua

SEQ ID NO: 148371 - RNA, 19 nt, Homo sapiens
gaagaggaauccagugaau

SEQ ID NO: 148372 - RNA, 19 nt, Homo sapiens
ggauguggcuggagcauga

SEQ ID NO: 148373 - RNA, 19 nt, Homo sapiens
caucuuaaaugccguguuu

SEQ ID NO: 148374 - RNA, 19 nt, Homo sapiens
gcuaugaaauugaugaaga

SEQ ID NO: 148375 - RNA, 19 nt, Homo sapiens
uuacauagacugugaagua

SEQ ID NO: 148376 - RNA, 19 nt, Homo sapiens
uaaaugccguguuugguuu

SEQ ID NO: 148377 - RNA, 19 nt, Homo sapiens
ggaaccucauugauuauuu

SEQ ID NO: 148378 - RNA, 19 nt, Homo sapiens
gcucucugcuggauucuaa

SEQ ID NO: 148379 - RNA, 19 nt, Homo sapiens
agaaagccauguucauauu

SEQ ID NO: 148380 - RNA, 19 nt, Homo sapiens
gaauguuccuguuugaugu

SEQ ID NO: 148381 - RNA, 19 nt, Homo sapiens
cagaaaggaucacagaugu

SEQ ID NO: 148382 - RNA, 19 nt, Homo sapiens
ccagaaagccauguucaua

SEQ ID NO: 148383 - RNA, 19 nt, Homo sapiens
gcagaaaggaucacagaug

SEQ ID NO: 148384 - RNA, 19 nt, Homo sapiens
ucugcuggauucuaaauua

SEQ ID NO: 148385 - RNA, 19 nt, Homo sapiens
gaaagccauguucauauuu

SEQ ID NO: 148386 - RNA, 19 nt, Homo sapiens
gggcagaagcggagccuua

SEQ ID NO: 148387 - RNA, 19 nt, Homo sapiens
cuucaaacaucaccuugua

SEQ ID NO: 148388 - RNA, 19 nt, Homo sapiens
gcaagaucaucgcagagaa

SEQ ID NO: 148389 - RNA, 19 nt, Homo sapiens
gaccggaaccucauugauu

SEQ ID NO: 148390 - RNA, 19 nt, Homo sapiens
gggaagacaucaagcucaa

SEQ ID NO: 148391 - RNA, 19 nt, Homo sapiens
gaucaucgcagagaauauu

SEQ ID NO: 148392 - RNA, 19 nt, Homo sapiens
agaaggaucuggacgacaa

SEQ ID NO: 148393 - RNA, 19 nt, Homo sapiens
aaggaaggaugaauaaguu

SEQ ID NO: 148394 - RNA, 19 nt, Homo sapiens
ccacaugcuucaaacauca

SEQ ID NO: 148395 - RNA, 19 nt, Homo sapiens
gaacggugucuuucuuuau

SEQ ID NO: 148396 - RNA, 19 nt, Homo sapiens
gaaacaacacucaguccuu

SEQ ID NO: 148397 - RNA, 19 nt, Homo sapiens
gggaggcacugcagaagga

SEQ ID NO: 148398 - RNA, 19 nt, Homo sapiens
cgagguccaucuucauauu

SEQ ID NO: 148399 - RNA, 19 nt, Homo sapiens
accggaaccucauugauua

SEQ ID NO: 148400 - RNA, 19 nt, Homo sapiens
ggaauucucccuggcauug

SEQ ID NO: 148401 - RNA, 19 nt, Homo sapiens
gagcagaaaggaucacaga

SEQ ID NO: 148402 - RNA, 19 nt, Homo sapiens
aacggugucuuucuuuaua

SEQ ID NO: 148403 - RNA, 19 nt, Homo sapiens
guucauauuucucagcaau

SEQ ID NO: 148404 - RNA, 19 nt, Homo sapiens
ucacuguccauuccaaaua

SEQ ID NO: 148405 - RNA, 19 nt, Homo sapiens
caaggaaggaugaauaagu

SEQ ID NO: 148406 - RNA, 19 nt, Homo sapiens
guacaaggaucaguuacag

SEQ ID NO: 148407 - RNA, 19 nt, Homo sapiens
gaaaccuccuauaaagcuu

SEQ ID NO: 148408 - RNA, 19 nt, Homo sapiens
agccuuuccucgacuauua

SEQ ID NO: 148409 - RNA, 19 nt, Homo sapiens
gcuggauucuaaauuaugu

SEQ ID NO: 148410 - RNA, 19 nt, Homo sapiens
cauagacugugaaguaucu

SEQ ID NO: 148411 - RNA, 19 nt, Homo sapiens
ggaagaggaauccagugaa

SEQ ID NO: 148412 - RNA, 19 nt, Homo sapiens
cagaguggcugaggagaug

SEQ ID NO: 148413 - RNA, 19 nt, Homo sapiens
cagaaagccauguucauau

SEQ ID NO: 148414 - RNA, 19 nt, Homo sapiens
cccgaaaccuccuauaaag

SEQ ID NO: 148415 - RNA, 19 nt, Homo sapiens
gaagacaucaagcucaaag

SEQ ID NO: 148416 - RNA, 19 nt, Homo sapiens
uggcacagcagcuuaauug

SEQ ID NO: 148417 - RNA, 19 nt, Homo sapiens
gaaagcagagggaagacau

SEQ ID NO: 148418 - RNA, 19 nt, Homo sapiens
ggacgacaaccucuuugga

SEQ ID NO: 148419 - RNA, 19 nt, Homo sapiens
acaaggaucaguuacaguu

SEQ ID NO: 148420 - RNA, 19 nt, Homo sapiens
ucgcagggcucaugauuuu

SEQ ID NO: 148421 - RNA, 19 nt, Homo sapiens
cagugaauguuccuguuug

SEQ ID NO: 148422 - RNA, 19 nt, Homo sapiens
aaagccauguucauauuuc

SEQ ID NO: 148423 - RNA, 19 nt, Homo sapiens
gaaggacaaguagguaaga

SEQ ID NO: 148424 - RNA, 19 nt, Homo sapiens
guguuuaggugaaggacaa

SEQ ID NO: 148425 - RNA, 19 nt, Homo sapiens
cagauguggcuuuggauuu

SEQ ID NO: 148426 - RNA, 19 nt, Homo sapiens
gagguccaucuucauauuu

SEQ ID NO: 148427 - RNA, 19 nt, Homo sapiens
gccacacugucaacauuug

SEQ ID NO: 148428 - RNA, 19 nt, Homo sapiens
gcagagggaagacaucaag

SEQ ID NO: 148429 - RNA, 19 nt, Homo sapiens
acauugcacuuuccacaug

SEQ ID NO: 148430 - RNA, 19 nt, Homo sapiens
uggccacacugucaacauu

SEQ ID NO: 148431 - RNA, 19 nt, Homo sapiens
agacugugaaguaucuuua

SEQ ID NO: 148432 - RNA, 19 nt, Homo sapiens
uacauagacugugaaguau

SEQ ID NO: 148433 - RNA, 19 nt, Homo sapiens
ccagugaauguuccuguuu

SEQ ID NO: 148434 - RNA, 19 nt, Homo sapiens
gaugcaugcaggccucaua

SEQ ID NO: 148435 - RNA, 19 nt, Homo sapiens
uuaaaugccguguuugguu

SEQ ID NO: 148436 - RNA, 19 nt, Homo sapiens
gcacagcagcuuaauugac

SEQ ID NO: 148437 - RNA, 19 nt, Homo sapiens
gcaugcaggccucauagau

SEQ ID NO: 148438 - RNA, 19 nt, Homo sapiens
ugaauguuccuguuugaug

SEQ ID NO: 148439 - RNA, 19 nt, Homo sapiens
gaaauugaugaagacauug

SEQ ID NO: 148440 - RNA, 19 nt, Homo sapiens
ggaauacaaacaccuaaaa

SEQ ID NO: 148441 - RNA, 19 nt, Homo sapiens
caagaucaucgcagagaau

SEQ ID NO: 148442 - RNA, 19 nt, Homo sapiens
gguccaucuucauauuuga

SEQ ID NO: 148443 - RNA, 19 nt, Homo sapiens
gugacuauguccaccuguu

SEQ ID NO: 148444 - RNA, 19 nt, Homo sapiens
gugaaggacaaguagguaa

SEQ ID NO: 148445 - RNA, 19 nt, Homo sapiens
gucccgaggcuaugaaauu

SEQ ID NO: 148446 - RNA, 19 nt, Homo sapiens
acaucaagcucaaagacau

SEQ ID NO: 148447 - RNA, 19 nt, Homo sapiens
caacccaaagcccaagaaa

SEQ ID NO: 148448 - RNA, 19 nt, Homo sapiens
ucaagccuuuccucgacua

SEQ ID NO: 148449 - RNA, 19 nt, Homo sapiens
ugaaauggauaagaugcau

SEQ ID NO: 148450 - RNA, 19 nt, Homo sapiens
gcacuuuccacaugcuuca

SEQ ID NO: 148451 - RNA, 19 nt, Homo sapiens
ugacuauguccaccuguuu

SEQ ID NO: 148452 - RNA, 19 nt, Homo sapiens
agaggaauccagugaaugu

SEQ ID NO: 148453 - RNA, 19 nt, Homo sapiens
gcagaguggcugaggagau

SEQ ID NO: 148454 - RNA, 19 nt, Homo sapiens
agauguggcuuuggauuuc

SEQ ID NO: 148455 - RNA, 19 nt, Homo sapiens
aggguggucugaacaguga

SEQ ID NO: 148456 - RNA, 19 nt, Homo sapiens
uuuguuacguucaaucaga

SEQ ID NO: 148457 - RNA, 19 nt, Homo sapiens
ccaaguguuucuguuucaa

SEQ ID NO: 148458 - RNA, 19 nt, Homo sapiens
ugccguguuugguuucaua

SEQ ID NO: 148459 - RNA, 19 nt, Homo sapiens
aaaccuccuauaaagcuua

SEQ ID NO: 148460 - RNA, 19 nt, Homo sapiens
guguuucuguuucaaggaa

SEQ ID NO: 148461 - RNA, 19 nt, Homo sapiens
caucgcagggcucaugauu

SEQ ID NO: 148462 - RNA, 19 nt, Homo sapiens
caguuacaguuguggauuc

SEQ ID NO: 148463 - RNA, 19 nt, Homo sapiens
ucaaacaucaccuuguaca

SEQ ID NO: 148464 - RNA, 19 nt, Homo sapiens
cgaaaccuccuauaaagcu

SEQ ID NO: 148465 - RNA, 19 nt, Homo sapiens
cuucaggcaccacagauaa

SEQ ID NO: 148466 - RNA, 19 nt, Homo sapiens
ucgcagagaauauuuacga

SEQ ID NO: 148467 - RNA, 19 nt, Homo sapiens
ggugaaggacaaguaggua

SEQ ID NO: 148468 - RNA, 19 nt, Homo sapiens
uaucuuuacuggaaaugag

SEQ ID NO: 148469 - RNA, 19 nt, Homo sapiens
ccgaggcuaugaaauugau

SEQ ID NO: 148470 - RNA, 19 nt, Homo sapiens
ugagagcacuucugucuua

SEQ ID NO: 148471 - RNA, 19 nt, Homo sapiens
gaaugaaggugaacauaca

SEQ ID NO: 148472 - RNA, 19 nt, Homo sapiens
gaccaggguuuccagagua

SEQ ID NO: 148473 - RNA, 19 nt, Homo sapiens
gcacuucugucuuaaaggu

SEQ ID NO: 148474 - RNA, 19 nt, Homo sapiens
uuucagaucucccuuaaga

SEQ ID NO: 148475 - RNA, 19 nt, Homo sapiens
gaacagggccacugacucu

SEQ ID NO: 148476 - RNA, 19 nt, Homo sapiens
cagaguagcucaccuuguc

SEQ ID NO: 148477 - RNA, 19 nt, Homo sapiens
gagcacuucugucuuaaag

SEQ ID NO: 148478 - RNA, 19 nt, Homo sapiens
ccuccaaucugcacuuuga

SEQ ID NO: 148479 - RNA, 19 nt, Homo sapiens
ggaccaggguuuccagagu

SEQ ID NO: 148480 - RNA, 19 nt, Homo sapiens
ccucaucccucaccacaga

SEQ ID NO: 148481 - RNA, 19 nt, Homo sapiens
ggagacagacugacugaca

SEQ ID NO: 148482 - RNA, 19 nt, Homo sapiens
cccaggaggucacuucuga

SEQ ID NO: 148483 - RNA, 19 nt, Homo sapiens
gagagcacuucugucuuaa

SEQ ID NO: 148484 - RNA, 19 nt, Homo sapiens
ggcuggaccuggaaacuga

SEQ ID NO: 148485 - RNA, 19 nt, Homo sapiens
ggaaugaaggugaacauac

SEQ ID NO: 148486 - RNA, 19 nt, Homo sapiens
aggccugggugauuuauuu

SEQ ID NO: 148487 - RNA, 19 nt, Homo sapiens
aagcuuuaauggagcguua

SEQ ID NO: 148488 - RNA, 19 nt, Homo sapiens
uggaccaccugaugaauau

SEQ ID NO: 148489 - RNA, 19 nt, Homo sapiens
ucggagaacuuucagaucu

SEQ ID NO: 148490 - RNA, 19 nt, Homo sapiens
gaacugaggccugggugau

SEQ ID NO: 148491 - RNA, 19 nt, Homo sapiens
ggagcguuauuuauuuauc

SEQ ID NO: 148492 - RNA, 19 nt, Homo sapiens
ccugggugauuuauuuauu

SEQ ID NO: 148493 - RNA, 19 nt, Homo sapiens
ccucuucgacugugacuuu

SEQ ID NO: 148494 - RNA, 19 nt, Homo sapiens
ggugagagcacuucugucu

SEQ ID NO: 148495 - RNA, 19 nt, Homo sapiens
gggaaugaaggugaacaua

SEQ ID NO: 148496 - RNA, 19 nt, Homo sapiens
gaaugugugugagcaugug

SEQ ID NO: 148497 - RNA, 19 nt, Homo sapiens
gcagaugguuauggugauc

SEQ ID NO: 148498 - RNA, 19 nt, Homo sapiens
gaggaguucaucagccuuu

SEQ ID NO: 148499 - RNA, 19 nt, Homo sapiens
gagaagucacgcuaugaga

SEQ ID NO: 148500 - RNA, 19 nt, Homo sapiens
gaagggaaggagucugugu

SEQ ID NO: 148501 - RNA, 19 nt, Homo sapiens
cagagcagaugguuauggu

SEQ ID NO: 148502 - RNA, 19 nt, Homo sapiens
gagcguuauuuauuuaucg

SEQ ID NO: 148503 - RNA, 19 nt, Homo sapiens
gagcaagaaccgcuguugu

SEQ ID NO: 148504 - RNA, 19 nt, Homo sapiens
cacugacucugccaccaua

SEQ ID NO: 148505 - RNA, 19 nt, Homo sapiens
gagucugugugguguguau

SEQ ID NO: 148506 - RNA, 19 nt, Homo sapiens
gagggcauccagcucauug

SEQ ID NO: 148507 - RNA, 19 nt, Homo sapiens
ucccugagcuguucuucug

SEQ ID NO: 148508 - RNA, 19 nt, Homo sapiens
ggagaagucacgcuaugag

SEQ ID NO: 148509 - RNA, 19 nt, Homo sapiens
gcagcuggaccaccugaug

SEQ ID NO: 148510 - RNA, 19 nt, Homo sapiens
cacugaaucugaccaccaa

SEQ ID NO: 148511 - RNA, 19 nt, Homo sapiens
gcaaacaaggcccgaucga

SEQ ID NO: 148512 - RNA, 19 nt, Homo sapiens
cugggugauuuauuuauug

SEQ ID NO: 148513 - RNA, 19 nt, Homo sapiens
ggccugggugauuuauuua

SEQ ID NO: 148514 - RNA, 19 nt, Homo sapiens
acugaggccugggugauuu

SEQ ID NO: 148515 - RNA, 19 nt, Homo sapiens
gggaucagcccugggaaga

SEQ ID NO: 148516 - RNA, 19 nt, Homo sapiens
ggacucuucggagaacuuu

SEQ ID NO: 148517 - RNA, 19 nt, Homo sapiens
ucaggaccuucguagcauu

SEQ ID NO: 148518 - RNA, 19 nt, Homo sapiens
ugacaucaccaacguccuu

SEQ ID NO: 148519 - RNA, 19 nt, Homo sapiens
ccaagaaguccaagaacca

SEQ ID NO: 148520 - RNA, 19 nt, Homo sapiens
ucuguucccuccugcuuug

SEQ ID NO: 148521 - RNA, 19 nt, Homo sapiens
gggagaagucacgcuauga

SEQ ID NO: 148522 - RNA, 19 nt, Homo sapiens
ggagcaagaaccgcuguug

SEQ ID NO: 148523 - RNA, 19 nt, Homo sapiens
cagcuggaccaccugauga

SEQ ID NO: 148524 - RNA, 19 nt, Homo sapiens
acuuucagaucucccuuaa

SEQ ID NO: 148525 - RNA, 19 nt, Homo sapiens
ggagggagacagacugacu

SEQ ID NO: 148526 - RNA, 19 nt, Homo sapiens
caaacaaggcccgaucgau

SEQ ID NO: 148527 - RNA, 19 nt, Homo sapiens
ucuaugacaucaccaacgu

SEQ ID NO: 148528 - RNA, 19 nt, Homo sapiens
agccauggguggucagaug

SEQ ID NO: 148529 - RNA, 19 nt, Homo sapiens
ccucgcagaucgucaucau

SEQ ID NO: 148530 - RNA, 19 nt, Homo sapiens
gaucccagccagucucuac

SEQ ID NO: 148531 - RNA, 19 nt, Homo sapiens
gagaacagggccacugacu

SEQ ID NO: 148532 - RNA, 19 nt, Homo sapiens
ugaugaauaucuguacuac

SEQ ID NO: 148533 - RNA, 19 nt, Homo sapiens
cuggaccaccugaugaaua

SEQ ID NO: 148534 - RNA, 19 nt, Homo sapiens
acuuugauuugcuuccuaa

SEQ ID NO: 148535 - RNA, 19 nt, Homo sapiens
ugauugaagcuuuaaugga

SEQ ID NO: 148536 - RNA, 19 nt, Homo sapiens
gagaccucuucgacuguga

SEQ ID NO: 148537 - RNA, 19 nt, Homo sapiens
gcacuuugauuugcuuccu

SEQ ID NO: 148538 - RNA, 19 nt, Homo sapiens
caacucccucuacccuuga

SEQ ID NO: 148539 - RNA, 19 nt, Homo sapiens
acuucugucuuaaagguuu

SEQ ID NO: 148540 - RNA, 19 nt, Homo sapiens
ccucccagccuguuuggaa

SEQ ID NO: 148541 - RNA, 19 nt, Homo sapiens
agaucucccuuaagagcaa

SEQ ID NO: 148542 - RNA, 19 nt, Homo sapiens
gcagagcagaugguuaugg

SEQ ID NO: 148543 - RNA, 19 nt, Homo sapiens
gcaucuaugacaucaccaa

SEQ ID NO: 148544 - RNA, 19 nt, Homo sapiens
ugugugagcaugugugugu

SEQ ID NO: 148545 - RNA, 19 nt, Homo sapiens
gaucucccuuaagagcaaa

SEQ ID NO: 148546 - RNA, 19 nt, Homo sapiens
cggcgcaucuaugacauca

SEQ ID NO: 148547 - RNA, 19 nt, Homo sapiens
ggaccuucguagcauugca

SEQ ID NO: 148548 - RNA, 19 nt, Homo sapiens
gcucuguucccuccugcuu

SEQ ID NO: 148549 - RNA, 19 nt, Homo sapiens
ggggagaagucacgcuaug

SEQ ID NO: 148550 - RNA, 19 nt, Homo sapiens
ugucaggaccuucguagca

SEQ ID NO: 148551 - RNA, 19 nt, Homo sapiens
gcaagaaggccaagaacaa

SEQ ID NO: 148552 - RNA, 19 nt, Homo sapiens
ucaccaagaaguucauuua

SEQ ID NO: 148553 - RNA, 19 nt, Homo sapiens
gaggacaaccugcagauau

SEQ ID NO: 148554 - RNA, 19 nt, Homo sapiens
aggacaaccugcagauaua

SEQ ID NO: 148555 - RNA, 19 nt, Homo sapiens
ugaaggagcugaugaacac

SEQ ID NO: 148556 - RNA, 19 nt, Homo sapiens
gggagaagacucgguauga

SEQ ID NO: 148557 - RNA, 19 nt, Homo sapiens
ccaagaaguucauuuaccu

SEQ ID NO: 148558 - RNA, 19 nt, Homo sapiens
gagaagacucgguaugaca

SEQ ID NO: 148559 - RNA, 19 nt, Homo sapiens
gcaccugacugaggacaag

SEQ ID NO: 148560 - RNA, 19 nt, Homo sapiens
ggacaaccugcagauauau

SEQ ID NO: 148561 - RNA, 19 nt, Homo sapiens
ggagaagacucgguaugac

SEQ ID NO: 148562 - RNA, 19 nt, Homo sapiens
uaugugacuuaccaggaua

SEQ ID NO: 148563 - RNA, 19 nt, Homo sapiens
cgacaggacugaggacaac

SEQ ID NO: 148564 - RNA, 19 nt, Homo sapiens
caggauauccgugcuguug

SEQ ID NO: 148565 - RNA, 19 nt, Homo sapiens
gggaccuguugauuaauug

SEQ ID NO: 148566 - RNA, 19 nt, Homo sapiens
cagcuacugcuaccuacua

SEQ ID NO: 148567 - RNA, 19 nt, Homo sapiens
gggcaucagcgaucucuuc

SEQ ID NO: 148568 - RNA, 19 nt, Homo sapiens
agacagugauugccgucaa

SEQ ID NO: 148569 - RNA, 19 nt, Homo sapiens
gcaggggaauguuugaaga

SEQ ID NO: 148570 - RNA, 19 nt, Homo sapiens
gaggacaaggccaacaaga

SEQ ID NO: 148571 - RNA, 19 nt, Homo sapiens
caccgacccuagcaucaug

SEQ ID NO: 148572 - RNA, 19 nt, Homo sapiens
cuaugugacuuaccaggau

SEQ ID NO: 148573 - RNA, 19 nt, Homo sapiens
gcccagcuacugcuaccua

SEQ ID NO: 148574 - RNA, 19 nt, Homo sapiens
acacggagcaggccuugga

SEQ ID NO: 148575 - RNA, 19 nt, Homo sapiens
uccaagcggcgaucucuaa

SEQ ID NO: 148576 - RNA, 19 nt, Homo sapiens
gacagugauugccgucaag

SEQ ID NO: 148577 - RNA, 19 nt, Homo sapiens
ggaccuguugauuaauuga

SEQ ID NO: 148578 - RNA, 19 nt, Homo sapiens
ggggaccuguugauuaauu

SEQ ID NO: 148579 - RNA, 19 nt, Homo sapiens
ucuaugacaucaccaacgu

SEQ ID NO: 148580 - RNA, 19 nt, Homo sapiens
gagcgagccgcaaggaagu

SEQ ID NO: 148581 - RNA, 19 nt, Homo sapiens
uuaaggagcagacagugau

SEQ ID NO: 148582 - RNA, 19 nt, Homo sapiens
gcaccgacccuagcaucau

SEQ ID NO: 148583 - RNA, 19 nt, Homo sapiens
ugaggacaaccugcagaua

SEQ ID NO: 148584 - RNA, 19 nt, Homo sapiens
caagaaggccaagaacaac

SEQ ID NO: 148585 - RNA, 19 nt, Homo sapiens
gagagcgagccgcaaggaa

SEQ ID NO: 148586 - RNA, 19 nt, Homo sapiens
gcgaucucuucgacuccua

SEQ ID NO: 148587 - RNA, 19 nt, Homo sapiens
gaagugcaucagaguggau

SEQ ID NO: 148588 - RNA, 19 nt, Homo sapiens
ccaagggcccaucgaaguc

SEQ ID NO: 148589 - RNA, 19 nt, Homo sapiens
gcaucuaugacaucaccaa

SEQ ID NO: 148590 - RNA, 19 nt, Homo sapiens
uaaggagcagacagugauu

SEQ ID NO: 148591 - RNA, 19 nt, Homo sapiens
cggcgcaucuaugacauca

SEQ ID NO: 148592 - RNA, 19 nt, Homo sapiens
gggcugcucaccaagaagu

SEQ ID NO: 148593 - RNA, 19 nt, Homo sapiens
gaacaaaccucgaaacgaa

SEQ ID NO: 148594 - RNA, 19 nt, Homo sapiens
gaagaaagcugacauuuua

SEQ ID NO: 148595 - RNA, 19 nt, Homo sapiens
gaagauggcuugcagagua

SEQ ID NO: 148596 - RNA, 19 nt, Homo sapiens
gcacucaacucauauguuu

SEQ ID NO: 148597 - RNA, 19 nt, Homo sapiens
gaaauuagaugaacugauc

SEQ ID NO: 148598 - RNA, 19 nt, Homo sapiens
aaacaaaggugcagacuau

SEQ ID NO: 148599 - RNA, 19 nt, Homo sapiens
gaaacgaacaguuaaauug

SEQ ID NO: 148600 - RNA, 19 nt, Homo sapiens
gcaaaugccuacuuaguuc

SEQ ID NO: 148601 - RNA, 19 nt, Homo sapiens
gaauggaacugcagcaaau

SEQ ID NO: 148602 - RNA, 19 nt, Homo sapiens
ugaagugccugacucaaua

SEQ ID NO: 148603 - RNA, 19 nt, Homo sapiens
acagcaaucuuccuuaaua

SEQ ID NO: 148604 - RNA, 19 nt, Homo sapiens
gaaggcauccaccucauua

SEQ ID NO: 148605 - RNA, 19 nt, Homo sapiens
gaacaaggcagcagaagug

SEQ ID NO: 148606 - RNA, 19 nt, Homo sapiens
gagcucaccuggcuagauu

SEQ ID NO: 148607 - RNA, 19 nt, Homo sapiens
ggaauggugucccaaguug

SEQ ID NO: 148608 - RNA, 19 nt, Homo sapiens
aaacagcaaucuuccuuaa

SEQ ID NO: 148609 - RNA, 19 nt, Homo sapiens
ggagggauaugaaggaaga

SEQ ID NO: 148610 - RNA, 19 nt, Homo sapiens
uguaaacacugccagaaua

SEQ ID NO: 148611 - RNA, 19 nt, Homo sapiens
ggaaagggcucucuuacac

SEQ ID NO: 148612 - RNA, 19 nt, Homo sapiens
ggaaugagggagucagaua

SEQ ID NO: 148613 - RNA, 19 nt, Homo sapiens
ccaaauuccuuccaaccua

SEQ ID NO: 148614 - RNA, 19 nt, Homo sapiens
gguccuagaugaagcauug

SEQ ID NO: 148615 - RNA, 19 nt, Homo sapiens
gaaaauaucccuuaggaaa

SEQ ID NO: 148616 - RNA, 19 nt, Homo sapiens
gaaacacacaguccaauga

SEQ ID NO: 148617 - RNA, 19 nt, Homo sapiens
gcacuacgaaguccagaua

SEQ ID NO: 148618 - RNA, 19 nt, Homo sapiens
ggagucagauaaagaacaa

SEQ ID NO: 148619 - RNA, 19 nt, Homo sapiens
gaucuuaccacuucaaaug

SEQ ID NO: 148620 - RNA, 19 nt, Homo sapiens
gcugugaucuuaccacuuc

SEQ ID NO: 148621 - RNA, 19 nt, Homo sapiens
gagagggagcuuuguguua

SEQ ID NO: 148622 - RNA, 19 nt, Homo sapiens
ccagguagauuuccacaau

SEQ ID NO: 148623 - RNA, 19 nt, Homo sapiens
gaaacagcaaucuuccuua

SEQ ID NO: 148624 - RNA, 19 nt, Homo sapiens
cugcaaauccuaccaguua

SEQ ID NO: 148625 - RNA, 19 nt, Homo sapiens
gcauccaccucauuaagaa

SEQ ID NO: 148626 - RNA, 19 nt, Homo sapiens
caugacaacucguguguau

SEQ ID NO: 148627 - RNA, 19 nt, Homo sapiens
ccaauguguuugugaguuu

SEQ ID NO: 148628 - RNA, 19 nt, Homo sapiens
gagaguaucaugaaguaaa

SEQ ID NO: 148629 - RNA, 19 nt, Homo sapiens
ccauugagguuuacuuaug

SEQ ID NO: 148630 - RNA, 19 nt, Homo sapiens
agagggagcuuuguguuaa

SEQ ID NO: 148631 - RNA, 19 nt, Homo sapiens
ccaguuauguccaagaaug

SEQ ID NO: 148632 - RNA, 19 nt, Homo sapiens
gcagaaugcaugucuuuga

SEQ ID NO: 148633 - RNA, 19 nt, Homo sapiens
gagaaggauuuaugauauc

SEQ ID NO: 148634 - RNA, 19 nt, Homo sapiens
ggagaaagcggucaucagu

SEQ ID NO: 148635 - RNA, 19 nt, Homo sapiens
gcuagauuguuguguguuu

SEQ ID NO: 148636 - RNA, 19 nt, Homo sapiens
gaugacaccagcacuuuaa

SEQ ID NO: 148637 - RNA, 19 nt, Homo sapiens
cagggugucucccgcuuua

SEQ ID NO: 148638 - RNA, 19 nt, Homo sapiens
ccaucaccauuucaauuua

SEQ ID NO: 148639 - RNA, 19 nt, Homo sapiens
cgugugaacucuccuuaaa

SEQ ID NO: 148640 - RNA, 19 nt, Homo sapiens
gaagagaagaaauuagaug

SEQ ID NO: 148641 - RNA, 19 nt, Homo sapiens
gaaugagggagucagauaa

SEQ ID NO: 148642 - RNA, 19 nt, Homo sapiens
aagagaguaucaugaagua

SEQ ID NO: 148643 - RNA, 19 nt, Homo sapiens
caacucguguguaugagaa

SEQ ID NO: 148644 - RNA, 19 nt, Homo sapiens
ugacaacucguguguauga

SEQ ID NO: 148645 - RNA, 19 nt, Homo sapiens
ucuaagcuguuguggauuu

SEQ ID NO: 148646 - RNA, 19 nt, Homo sapiens
uccaagaucuccuggcuaa

SEQ ID NO: 148647 - RNA, 19 nt, Homo sapiens
cuucauguguaguugauua

SEQ ID NO: 148648 - RNA, 19 nt, Homo sapiens
caaagguuagcuuauguua

SEQ ID NO: 148649 - RNA, 19 nt, Homo sapiens
aaaguuccuucaugcauaa

SEQ ID NO: 148650 - RNA, 19 nt, Homo sapiens
gagaagaaauuagaugaac

SEQ ID NO: 148651 - RNA, 19 nt, Homo sapiens
ucaccuggcuagauuguug

SEQ ID NO: 148652 - RNA, 19 nt, Homo sapiens
aguaggcacucaacucaua

SEQ ID NO: 148653 - RNA, 19 nt, Homo sapiens
ucaaccaacucaggacaua

SEQ ID NO: 148654 - RNA, 19 nt, Homo sapiens
uagaugaacugauccaaag

SEQ ID NO: 148655 - RNA, 19 nt, Homo sapiens
ggaaguauuucucccaaaa

SEQ ID NO: 148656 - RNA, 19 nt, Homo sapiens
guaaugccguauuuauugu

SEQ ID NO: 148657 - RNA, 19 nt, Homo sapiens
aagguuagcuuauguuaca

SEQ ID NO: 148658 - RNA, 19 nt, Homo sapiens
caacacaugagcugucaaa

SEQ ID NO: 148659 - RNA, 19 nt, Homo sapiens
guuacaagugugcaaauua

SEQ ID NO: 148660 - RNA, 19 nt, Homo sapiens
aggaagagcugcacuacga

SEQ ID NO: 148661 - RNA, 19 nt, Homo sapiens
aaucaaagguuagcuuaug

SEQ ID NO: 148662 - RNA, 19 nt, Homo sapiens
gaagaaauuagaugaacug

SEQ ID NO: 148663 - RNA, 19 nt, Homo sapiens
gaaggagggauaugaagga

SEQ ID NO: 148664 - RNA, 19 nt, Homo sapiens
gaaaugcacugugggguuu

SEQ ID NO: 148665 - RNA, 19 nt, Homo sapiens
ggaauggaacugcagcaaa

SEQ ID NO: 148666 - RNA, 19 nt, Homo sapiens
gagaaagcggucaucagua

SEQ ID NO: 148667 - RNA, 19 nt, Homo sapiens
caucagcgaucucuucgau

SEQ ID NO: 148668 - RNA, 19 nt, Homo sapiens
guaccucucagaugguuua

SEQ ID NO: 148669 - RNA, 19 nt, Homo sapiens
caaaguggguuaguacuac

SEQ ID NO: 148670 - RNA, 19 nt, Homo sapiens
cagguagauuuccacaaua

SEQ ID NO: 148671 - RNA, 19 nt, Homo sapiens
gcuaaggacugcgggaaug

SEQ ID NO: 148672 - RNA, 19 nt, Homo sapiens
gcaguguugucccuuccua

SEQ ID NO: 148673 - RNA, 19 nt, Homo sapiens
caaccuagaaggaccguuu

SEQ ID NO: 148674 - RNA, 19 nt, Homo sapiens
ccauugaguugcugcuauu

SEQ ID NO: 148675 - RNA, 19 nt, Homo sapiens
acacuggacuugguacaaa

SEQ ID NO: 148676 - RNA, 19 nt, Homo sapiens
acagaagacuaguagaguu

SEQ ID NO: 148677 - RNA, 19 nt, Homo sapiens
cuucagcucuucuuaggaa

SEQ ID NO: 148678 - RNA, 19 nt, Homo sapiens
cuuaaagaccaaacuguua

SEQ ID NO: 148679 - RNA, 19 nt, Homo sapiens
caaaggaagagcugcacua

SEQ ID NO: 148680 - RNA, 19 nt, Homo sapiens
agaaagcggucaucaguac

SEQ ID NO: 148681 - RNA, 19 nt, Homo sapiens
uguguuguaugcuaguuua

SEQ ID NO: 148682 - RNA, 19 nt, Homo sapiens
cuuucuagcugcuuuguaa

SEQ ID NO: 148683 - RNA, 19 nt, Homo sapiens
gcuuuacucuucaggaaug

SEQ ID NO: 148684 - RNA, 19 nt, Homo sapiens
ggagaaccaggucagauga

SEQ ID NO: 148685 - RNA, 19 nt, Homo sapiens
cuaaaccugugugaucuaa

SEQ ID NO: 148686 - RNA, 19 nt, Homo sapiens
guggauuguucuagacuuu

SEQ ID NO: 148687 - RNA, 19 nt, Homo sapiens
cggaugggcuguagaaugg

SEQ ID NO: 148688 - RNA, 19 nt, Homo sapiens
cagaagagacugaaacaca

SEQ ID NO: 148689 - RNA, 19 nt, Homo sapiens
guuuauauguacagaguug

SEQ ID NO: 148690 - RNA, 19 nt, Homo sapiens
gcacauaguaggcacucaa

SEQ ID NO: 148691 - RNA, 19 nt, Homo sapiens
caggucagaugauguaaca

SEQ ID NO: 148692 - RNA, 19 nt, Homo sapiens
gaucagagcaucuaaaccu

SEQ ID NO: 148693 - RNA, 19 nt, Homo sapiens
ccaaagagcugucagaaau

SEQ ID NO: 148694 - RNA, 19 nt, Homo sapiens
ggagauugcugacaaacug

SEQ ID NO: 148695 - RNA, 19 nt, Homo sapiens
ucaaugggcagaagaagua

SEQ ID NO: 148696 - RNA, 19 nt, Homo sapiens
cagaagaaguaccagauuc

SEQ ID NO: 148697 - RNA, 19 nt, Homo sapiens
gcagaagaaguaccagauu

SEQ ID NO: 148698 - RNA, 19 nt, Homo sapiens
gaagguaucgggcuaaucg

SEQ ID NO: 148699 - RNA, 19 nt, Homo sapiens
gugcagaaguccagggaau

SEQ ID NO: 148700 - RNA, 19 nt, Homo sapiens
gccaccaccugaagauuug

SEQ ID NO: 148701 - RNA, 19 nt, Homo sapiens
ggacaguggugagcucagu

SEQ ID NO: 148702 - RNA, 19 nt, Homo sapiens
gagcccaucugcuguuucu

SEQ ID NO: 148703 - RNA, 19 nt, Homo sapiens
ucacagaggacgugcagaa

SEQ ID NO: 148704 - RNA, 19 nt, Homo sapiens
caggaagccucacguccaa

SEQ ID NO: 148705 - RNA, 19 nt, Homo sapiens
ucugugaccucuuugaugu

SEQ ID NO: 148706 - RNA, 19 nt, Homo sapiens
gaguugauguccucagaag

SEQ ID NO: 148707 - RNA, 19 nt, Homo sapiens
gaagccucacguccaaaua

SEQ ID NO: 148708 - RNA, 19 nt, Homo sapiens
guaucgggcuaaucgagaa

SEQ ID NO: 148709 - RNA, 19 nt, Homo sapiens
guucucaaccucugacuga

SEQ ID NO: 148710 - RNA, 19 nt, Homo sapiens
gauguccucagaaguguuu

SEQ ID NO: 148711 - RNA, 19 nt, Homo sapiens
cgggagaccacgauuauau

SEQ ID NO: 148712 - RNA, 19 nt, Homo sapiens
caacccuucuaccuccuuu

SEQ ID NO: 148713 - RNA, 19 nt, Homo sapiens
gagugugaguggucccauu

SEQ ID NO: 148714 - RNA, 19 nt, Homo sapiens
cggcggauuuacgacauua

SEQ ID NO: 148715 - RNA, 19 nt, Homo sapiens
gcagcgggagcaagaacua

SEQ ID NO: 148716 - RNA, 19 nt, Homo sapiens
agaccacgauuauaucuac

SEQ ID NO: 148717 - RNA, 19 nt, Homo sapiens
ggacugcucaccaccaagu

SEQ ID NO: 148718 - RNA, 19 nt, Homo sapiens
aaagagcugucagaaaucu

SEQ ID NO: 148719 - RNA, 19 nt, Homo sapiens
ggaagccucacguccaaau

SEQ ID NO: 148720 - RNA, 19 nt, Homo sapiens
uggccuacgucacucauga

SEQ ID NO: 148721 - RNA, 19 nt, Homo sapiens
ggauuuacgacauuaccaa

SEQ ID NO: 148722 - RNA, 19 nt, Homo sapiens
guugauguccucagaagug

SEQ ID NO: 148723 - RNA, 19 nt, Homo sapiens
cagaggacgugcagaacag

SEQ ID NO: 148724 - RNA, 19 nt, Homo sapiens
gagaccacgauuauaucua

SEQ ID NO: 148725 - RNA, 19 nt, Homo sapiens
ggagaccacgauuauaucu

SEQ ID NO: 148726 - RNA, 19 nt, Homo sapiens
caaagagcugucagaaauc

SEQ ID NO: 148727 - RNA, 19 nt, Homo sapiens
gcagaaguccagggaaugg

SEQ ID NO: 148728 - RNA, 19 nt, Homo sapiens
agaagaaguaccagauuca

SEQ ID NO: 148729 - RNA, 19 nt, Homo sapiens
ggaguugauguccucagaa

SEQ ID NO: 148730 - RNA, 19 nt, Homo sapiens
cggagcugcuggaggaguu

SEQ ID NO: 148731 - RNA, 19 nt, Homo sapiens
agagcugucagaaaucuuu

SEQ ID NO: 148732 - RNA, 19 nt, Homo sapiens
cagaugcuuugcuggagau

SEQ ID NO: 148733 - RNA, 19 nt, Homo sapiens
cccgggagauugcugacaa

SEQ ID NO: 148734 - RNA, 19 nt, Homo sapiens
agagugaaggugucuguga

SEQ ID NO: 148735 - RNA, 19 nt, Homo sapiens
gggagaccacgauuauauc

SEQ ID NO: 148736 - RNA, 19 nt, Homo sapiens
gagauugcugacaaacuga

SEQ ID NO: 148737 - RNA, 19 nt, Homo sapiens
ugaugugccuguucucaac

SEQ ID NO: 148738 - RNA, 19 nt, Homo sapiens
ccgggagauugcugacaaa

SEQ ID NO: 148739 - RNA, 19 nt, Homo sapiens
cccaaagagcugucagaaa

SEQ ID NO: 148740 - RNA, 19 nt, Homo sapiens
ugccaccaccugaagauuu

SEQ ID NO: 148741 - RNA, 19 nt, Homo sapiens
ggcagaagaaguaccagau

SEQ ID NO: 148742 - RNA, 19 nt, Homo sapiens
ccacgauuauaucuacaac

SEQ ID NO: 148743 - RNA, 19 nt, Homo sapiens
ccaaguucgugucccuucu

SEQ ID NO: 148744 - RNA, 19 nt, Homo sapiens
gauuuacgacauuaccaau

SEQ ID NO: 148745 - RNA, 19 nt, Homo sapiens
caaccuggacgagagugaa

SEQ ID NO: 148746 - RNA, 19 nt, Homo sapiens
gaccacgauuauaucuaca

SEQ ID NO: 148747 - RNA, 19 nt, Homo sapiens
acuccaagccggcacgaaa

SEQ ID NO: 148748 - RNA, 19 nt, Homo sapiens
ggacccaacccuucuaccu

SEQ ID NO: 148749 - RNA, 19 nt, Homo sapiens
gcccugggacugauagcaa

SEQ ID NO: 148750 - RNA, 19 nt, Homo sapiens
ggaaagaucuguuuaugua

SEQ ID NO: 148751 - RNA, 19 nt, Homo sapiens
ggaauugacuugauugaaa

SEQ ID NO: 148752 - RNA, 19 nt, Homo sapiens
gcagaugacuacaacuuua

SEQ ID NO: 148753 - RNA, 19 nt, Homo sapiens
gacaucagcuacagauaua

SEQ ID NO: 148754 - RNA, 19 nt, Homo sapiens
caacaugucucugaaagaa

SEQ ID NO: 148755 - RNA, 19 nt, Homo sapiens
ccacuaaacugccuguauu

SEQ ID NO: 148756 - RNA, 19 nt, Homo sapiens
gaagacaucuguaauugcu

SEQ ID NO: 148757 - RNA, 19 nt, Homo sapiens
cuaaagaagucauagauag

SEQ ID NO: 148758 - RNA, 19 nt, Homo sapiens
ucacaaaacuucaaccaua

SEQ ID NO: 148759 - RNA, 19 nt, Homo sapiens
ugacguguuuccucucuua

SEQ ID NO: 148760 - RNA, 19 nt, Homo sapiens
ggggauaagugauuuaaua

SEQ ID NO: 148761 - RNA, 19 nt, Homo sapiens
ggugcuggcuguaauacua

SEQ ID NO: 148762 - RNA, 19 nt, Homo sapiens
gaacagauuuugugaagug

SEQ ID NO: 148763 - RNA, 19 nt, Homo sapiens
ggacucauuacuugucuua

SEQ ID NO: 148764 - RNA, 19 nt, Homo sapiens
gaggauauauaacuguuuc

SEQ ID NO: 148765 - RNA, 19 nt, Homo sapiens
aaacaaagggcucugauug

SEQ ID NO: 148766 - RNA, 19 nt, Homo sapiens
ggacuguuaucuaccucua

SEQ ID NO: 148767 - RNA, 19 nt, Homo sapiens
agacaucuguaauugcuuu

SEQ ID NO: 148768 - RNA, 19 nt, Homo sapiens
ugauaucaccaaugucuua

SEQ ID NO: 148769 - RNA, 19 nt, Homo sapiens
ggagguacccauuccagaa

SEQ ID NO: 148770 - RNA, 19 nt, Homo sapiens
uaggaaagaucuguuuaug

SEQ ID NO: 148771 - RNA, 19 nt, Homo sapiens
aaacgaggauauauaacug

SEQ ID NO: 148772 - RNA, 19 nt, Homo sapiens
ggauguaaacgaggauaua

SEQ ID NO: 148773 - RNA, 19 nt, Homo sapiens
cgaaggaguuugugaucug

SEQ ID NO: 148774 - RNA, 19 nt, Homo sapiens
caaagcggcugcugauacu

SEQ ID NO: 148775 - RNA, 19 nt, Homo sapiens
caugugcugcuuauaaaua

SEQ ID NO: 148776 - RNA, 19 nt, Homo sapiens
uaaacugccuguauuucug

SEQ ID NO: 148777 - RNA, 19 nt, Homo sapiens
gaugauaacgaaggaguuu

SEQ ID NO: 148778 - RNA, 19 nt, Homo sapiens
caaaagaaauaccagauca

SEQ ID NO: 148779 - RNA, 19 nt, Homo sapiens
caugaagacaucuguaauu

SEQ ID NO: 148780 - RNA, 19 nt, Homo sapiens
ggaaagagaacuugaucag

SEQ ID NO: 148781 - RNA, 19 nt, Homo sapiens
gaucuagaacugaaggaaa

SEQ ID NO: 148782 - RNA, 19 nt, Homo sapiens
gaaggaguuugugaucugu

SEQ ID NO: 148783 - RNA, 19 nt, Homo sapiens
uaaauaaagagucgaguuc

SEQ ID NO: 148784 - RNA, 19 nt, Homo sapiens
gcugauacuuuggcuguga

SEQ ID NO: 148785 - RNA, 19 nt, Homo sapiens
gaaggaaagagaacuugau

SEQ ID NO: 148786 - RNA, 19 nt, Homo sapiens
agagggaauugacuugauu

SEQ ID NO: 148787 - RNA, 19 nt, Homo sapiens
guaaagugaaggauguaaa

SEQ ID NO: 148788 - RNA, 19 nt, Homo sapiens
gcagacaucagcuacagau

SEQ ID NO: 148789 - RNA, 19 nt, Homo sapiens
ucagcaggaucuauuagug

SEQ ID NO: 148790 - RNA, 19 nt, Homo sapiens
gagcaacaugucucugaaa

SEQ ID NO: 148791 - RNA, 19 nt, Homo sapiens
agaaaugggucagaaugga

SEQ ID NO: 148792 - RNA, 19 nt, Homo sapiens
gagguacccauuccagaaa

SEQ ID NO: 148793 - RNA, 19 nt, Homo sapiens
guucuucccuaauacuuuc

SEQ ID NO: 148794 - RNA, 19 nt, Homo sapiens
cauggaaacuugggacugu

SEQ ID NO: 148795 - RNA, 19 nt, Homo sapiens
uugaagaucuagaacugaa

SEQ ID NO: 148796 - RNA, 19 nt, Homo sapiens
gauguaaacgaggauauau

SEQ ID NO: 148797 - RNA, 19 nt, Homo sapiens
gacguucacugccacuugu

SEQ ID NO: 148798 - RNA, 19 nt, Homo sapiens
cagaugacuacaacuuuaa

SEQ ID NO: 148799 - RNA, 19 nt, Homo sapiens
agacaucagcuacagauau

SEQ ID NO: 148800 - RNA, 19 nt, Homo sapiens
uccaugugcugcuuauaaa

SEQ ID NO: 148801 - RNA, 19 nt, Homo sapiens
guauguccuucuauccaaa

SEQ ID NO: 148802 - RNA, 19 nt, Homo sapiens
ggccaaggacucauuacuu

SEQ ID NO: 148803 - RNA, 19 nt, Homo sapiens
gcaacaugucucugaaaga

SEQ ID NO: 148804 - RNA, 19 nt, Homo sapiens
augaagacaucuguaauug

SEQ ID NO: 148805 - RNA, 19 nt, Homo sapiens
aagcugaaauugaagaucu

SEQ ID NO: 148806 - RNA, 19 nt, Homo sapiens
uuugugaucuguuugaugu

SEQ ID NO: 148807 - RNA, 19 nt, Homo sapiens
guaggugcuggcuguaaua

SEQ ID NO: 148808 - RNA, 19 nt, Homo sapiens
uccagugacuccacagaaa

SEQ ID NO: 148809 - RNA, 19 nt, Homo sapiens
ccagaaaugggucagaaug

SEQ ID NO: 148810 - RNA, 19 nt, Homo sapiens
uuuguugacuucugacauu

SEQ ID NO: 148811 - RNA, 19 nt, Homo sapiens
cacaaaacuucaaccauaa

SEQ ID NO: 148812 - RNA, 19 nt, Homo sapiens
ugagcaacaugucucugaa

SEQ ID NO: 148813 - RNA, 19 nt, Homo sapiens
gaacugaaggaaagagaac

SEQ ID NO: 148814 - RNA, 19 nt, Homo sapiens
gaaagaucuguuuauguag

SEQ ID NO: 148815 - RNA, 19 nt, Homo sapiens
ccacuuuccuagguuauag

SEQ ID NO: 148816 - RNA, 19 nt, Homo sapiens
uaacgaaggaguuugugau

SEQ ID NO: 148817 - RNA, 19 nt, Homo sapiens
ggcagaugacuacaacuuu

SEQ ID NO: 148818 - RNA, 19 nt, Homo sapiens
cuauguaacucaugaagac

SEQ ID NO: 148819 - RNA, 19 nt, Homo sapiens
guccuucuauccaaacaga

SEQ ID NO: 148820 - RNA, 19 nt, Homo sapiens
gauguccagauacuaaauu

SEQ ID NO: 148821 - RNA, 19 nt, Homo sapiens
aauugaagaucuagaacug

SEQ ID NO: 148822 - RNA, 19 nt, Homo sapiens
gaaaguuaaaggacacuac

SEQ ID NO: 148823 - RNA, 19 nt, Homo sapiens
gcuguaauacuaaagaagu

SEQ ID NO: 148824 - RNA, 19 nt, Homo sapiens
aagagucgaguucaucuaa

SEQ ID NO: 148825 - RNA, 19 nt, Homo sapiens
uagagggaauugacuugau

SEQ ID NO: 148826 - RNA, 19 nt, Homo sapiens
gaaauugaagaucuagaac

SEQ ID NO: 148827 - RNA, 19 nt, Homo sapiens
ucaaagcggcugcugauac

SEQ ID NO: 148828 - RNA, 19 nt, Homo sapiens
gacacuacaggucaucaaa

SEQ ID NO: 148829 - RNA, 19 nt, Homo sapiens
uuuccucucuuaaggcuuu

SEQ ID NO: 148830 - RNA, 19 nt, Homo sapiens
caacuggagguacccauuc

SEQ ID NO: 148831 - RNA, 19 nt, Homo sapiens
ucaggcaccuucugguaca

SEQ ID NO: 148832 - RNA, 19 nt, Homo sapiens
cuucugacauuccacuuuc

SEQ ID NO: 148833 - RNA, 19 nt, Homo sapiens
uaucaccaaugucuuagag

SEQ ID NO: 148834 - RNA, 19 nt, Homo sapiens
ggacacuacaggucaucaa

SEQ ID NO: 148835 - RNA, 19 nt, Homo sapiens
gcugcucacuaccaaguuc

SEQ ID NO: 148836 - RNA, 19 nt, Homo sapiens
aaugucuucugacguguuu

SEQ ID NO: 148837 - RNA, 19 nt, Homo sapiens
caucuaagcccgugguuuu

SEQ ID NO: 148838 - RNA, 19 nt, Homo sapiens
cuuguaaagugaaggaugu

SEQ ID NO: 148839 - RNA, 19 nt, Homo sapiens
aggaguuugugaucuguuu

SEQ ID NO: 148840 - RNA, 19 nt, Homo sapiens
aauaaagagucgaguucau

SEQ ID NO: 148841 - RNA, 19 nt, Homo sapiens
acaaagggcucugauugcu

SEQ ID NO: 148842 - RNA, 19 nt, Homo sapiens
gggaauugacuugauugaa

SEQ ID NO: 148843 - RNA, 19 nt, Homo sapiens
caaggacggcguucuggau

SEQ ID NO: 148844 - RNA, 19 nt, Homo sapiens
uguauguccuucuauccaa

SEQ ID NO: 148845 - RNA, 19 nt, Homo sapiens
uggaaacuugggacuguua

SEQ ID NO: 148846 - RNA, 19 nt, Homo sapiens
cagcagacaucagcuacag

SEQ ID NO: 148847 - RNA, 19 nt, Homo sapiens
uaugauaucaccaaugucu

SEQ ID NO: 148848 - RNA, 19 nt, Homo sapiens
caaguuggccaaggacuca

SEQ ID NO: 148849 - RNA, 19 nt, Homo sapiens
caaagggcucugauugcuu

SEQ ID NO: 148850 - RNA, 19 nt, Homo sapiens
ggaaauagcugaauucauu

SEQ ID NO: 148851 - RNA, 19 nt, Homo sapiens
ggaggaacuuucugacuua

SEQ ID NO: 148852 - RNA, 19 nt, Homo sapiens
gcaguuaccuguuguacau

SEQ ID NO: 148853 - RNA, 19 nt, Homo sapiens
gcaaguagauuuuguaaug

SEQ ID NO: 148854 - RNA, 19 nt, Homo sapiens
guuaacagaugacaaagaa

SEQ ID NO: 148855 - RNA, 19 nt, Homo sapiens
gagaaaagcucuaaaagug

SEQ ID NO: 148856 - RNA, 19 nt, Homo sapiens
cuuaagaagugcucaauaa

SEQ ID NO: 148857 - RNA, 19 nt, Homo sapiens
guaagcaacugauggcauu

SEQ ID NO: 148858 - RNA, 19 nt, Homo sapiens
uaaacaagguugcaacgaa

SEQ ID NO: 148859 - RNA, 19 nt, Homo sapiens
uagcauaugugaccuauca

SEQ ID NO: 148860 - RNA, 19 nt, Homo sapiens
gaaaccagauuggauguuc

SEQ ID NO: 148861 - RNA, 19 nt, Homo sapiens
gaaagacuagcauauguga

SEQ ID NO: 148862 - RNA, 19 nt, Homo sapiens
aaacaagguugcaacgaaa

SEQ ID NO: 148863 - RNA, 19 nt, Homo sapiens
gcauagauguacacacgaa

SEQ ID NO: 148864 - RNA, 19 nt, Homo sapiens
aagaagugcucaauaaaug

SEQ ID NO: 148865 - RNA, 19 nt, Homo sapiens
ucacauaccuagcuguuuc

SEQ ID NO: 148866 - RNA, 19 nt, Homo sapiens
gaaauggacaguucuuugu

SEQ ID NO: 148867 - RNA, 19 nt, Homo sapiens
gaucgucauugcaguuaaa

SEQ ID NO: 148868 - RNA, 19 nt, Homo sapiens
cauauuagauggauaggau

SEQ ID NO: 148869 - RNA, 19 nt, Homo sapiens
gauggcauuugagaauuua

SEQ ID NO: 148870 - RNA, 19 nt, Homo sapiens
gaagagaccucguuuugau

SEQ ID NO: 148871 - RNA, 19 nt, Homo sapiens
caauauguguccaugagaa

SEQ ID NO: 148872 - RNA, 19 nt, Homo sapiens
gaaaagcucuaaaagugaa

SEQ ID NO: 148873 - RNA, 19 nt, Homo sapiens
ucagcaaagugaagaauug

SEQ ID NO: 148874 - RNA, 19 nt, Homo sapiens
uaagcugucuaccuaauug

SEQ ID NO: 148875 - RNA, 19 nt, Homo sapiens
gauguacacacgaauuuaa

SEQ ID NO: 148876 - RNA, 19 nt, Homo sapiens
caacggaccuaucgauguc

SEQ ID NO: 148877 - RNA, 19 nt, Homo sapiens
uugaggaguucaccacuua

SEQ ID NO: 148878 - RNA, 19 nt, Homo sapiens
gaagaauugcuugaaguaa

SEQ ID NO: 148879 - RNA, 19 nt, Homo sapiens
caccaugccuggcccuuaa

SEQ ID NO: 148880 - RNA, 19 nt, Homo sapiens
gaguucaccacuuagauua

SEQ ID NO: 148881 - RNA, 19 nt, Homo sapiens
gacaaauucucuaaucucu

SEQ ID NO: 148882 - RNA, 19 nt, Homo sapiens
ccaagaaccauauuagaug

SEQ ID NO: 148883 - RNA, 19 nt, Homo sapiens
gaaagcggagaguguauga

SEQ ID NO: 148884 - RNA, 19 nt, Homo sapiens
cagcucugcucccacauuu

SEQ ID NO: 148885 - RNA, 19 nt, Homo sapiens
ggaguucaccacuuagauu

SEQ ID NO: 148886 - RNA, 19 nt, Homo sapiens
ugacagacaaauucucuaa

SEQ ID NO: 148887 - RNA, 19 nt, Homo sapiens
caaaagaaauugccuuaca

SEQ ID NO: 148888 - RNA, 19 nt, Homo sapiens
gaaucgaccucguugaaaa

SEQ ID NO: 148889 - RNA, 19 nt, Homo sapiens
auguaucgcugguuuauuu

SEQ ID NO: 148890 - RNA, 19 nt, Homo sapiens
acagacaaauucucuaauc

SEQ ID NO: 148891 - RNA, 19 nt, Homo sapiens
caaguagcuucaucacaga

SEQ ID NO: 148892 - RNA, 19 nt, Homo sapiens
caacugauggcauuugaga

SEQ ID NO: 148893 - RNA, 19 nt, Homo sapiens
ugauggcauuugagaauuu

SEQ ID NO: 148894 - RNA, 19 nt, Homo sapiens
ugaguuaacagaugacaaa

SEQ ID NO: 148895 - RNA, 19 nt, Homo sapiens
gaaauagcugaauucauug

SEQ ID NO: 148896 - RNA, 19 nt, Homo sapiens
ggaugaggguuagaagaga

SEQ ID NO: 148897 - RNA, 19 nt, Homo sapiens
ugaagaauugcuugaagua

SEQ ID NO: 148898 - RNA, 19 nt, Homo sapiens
aguuaaagcuccagcagaa

SEQ ID NO: 148899 - RNA, 19 nt, Homo sapiens
ucaagacauucauagcauu

SEQ ID NO: 148900 - RNA, 19 nt, Homo sapiens
gaagaugcuuuggaugagu

SEQ ID NO: 148901 - RNA, 19 nt, Homo sapiens
ucaguuuacucuguaguuu

SEQ ID NO: 148902 - RNA, 19 nt, Homo sapiens
gcauucaggccuuccauga

SEQ ID NO: 148903 - RNA, 19 nt, Homo sapiens
ggaagaugcuuuggaugag

SEQ ID NO: 148904 - RNA, 19 nt, Homo sapiens
gugaagaauugcuugaagu

SEQ ID NO: 148905 - RNA, 19 nt, Homo sapiens
gagggacuuugucauaauc

SEQ ID NO: 148906 - RNA, 19 nt, Homo sapiens
acucuguaguuuaccauua

SEQ ID NO: 148907 - RNA, 19 nt, Homo sapiens
gaaauccaagaaccauauu

SEQ ID NO: 148908 - RNA, 19 nt, Homo sapiens
ggaaucgaccucguugaaa

SEQ ID NO: 148909 - RNA, 19 nt, Homo sapiens
caucaccaaugucuuagau

SEQ ID NO: 148910 - RNA, 19 nt, Homo sapiens
guacacacgaauuuaaaug

SEQ ID NO: 148911 - RNA, 19 nt, Homo sapiens
gauaauuggaaacuccuuu

SEQ ID NO: 148912 - RNA, 19 nt, Homo sapiens
gucagauacuucuugguuu

SEQ ID NO: 148913 - RNA, 19 nt, Homo sapiens
ucacagagugucaugaaga

SEQ ID NO: 148914 - RNA, 19 nt, Homo sapiens
agaaggcccugaggaagaa

SEQ ID NO: 148915 - RNA, 19 nt, Homo sapiens
gagaagacucuaucacagu

SEQ ID NO: 148916 - RNA, 19 nt, Homo sapiens
ugagggacuuugucauaau

SEQ ID NO: 148917 - RNA, 19 nt, Homo sapiens
ugaaauggacaguucuuug

SEQ ID NO: 148918 - RNA, 19 nt, Homo sapiens
ucagugaaauagacaucuu

SEQ ID NO: 148919 - RNA, 19 nt, Homo sapiens
ggagaauuacgcaucaaau

SEQ ID NO: 148920 - RNA, 19 nt, Homo sapiens
aggaggaacuuucugacuu

SEQ ID NO: 148921 - RNA, 19 nt, Homo sapiens
gaauucagucauggugaua

SEQ ID NO: 148922 - RNA, 19 nt, Homo sapiens
aagaauugcuugaaguaag

SEQ ID NO: 148923 - RNA, 19 nt, Homo sapiens
cagaaggcccugaggaaga

SEQ ID NO: 148924 - RNA, 19 nt, Homo sapiens
uggaugaguuaauuaagga

SEQ ID NO: 148925 - RNA, 19 nt, Homo sapiens
uggaagaugcuuuggauga

SEQ ID NO: 148926 - RNA, 19 nt, Homo sapiens
cagacaaauucucuaaucu

SEQ ID NO: 148927 - RNA, 19 nt, Homo sapiens
uaugugaccuaucaagaca

SEQ ID NO: 148928 - RNA, 19 nt, Homo sapiens
aauggaagaugcuuuggau

SEQ ID NO: 148929 - RNA, 19 nt, Homo sapiens
caucacagagugucaugaa

SEQ ID NO: 148930 - RNA, 19 nt, Homo sapiens
ugaauucagucauggugau

SEQ ID NO: 148931 - RNA, 19 nt, Homo sapiens
uuccaaacuucuacaugua

SEQ ID NO: 148932 - RNA, 19 nt, Homo sapiens
uagauguacacacgaauuu

SEQ ID NO: 148933 - RNA, 19 nt, Homo sapiens
gaagaaaauccucagcaaa

SEQ ID NO: 148934 - RNA, 19 nt, Homo sapiens
uugagggacuuugucauaa

SEQ ID NO: 148935 - RNA, 19 nt, Homo sapiens
cuugagggacuuugucaua

SEQ ID NO: 148936 - RNA, 19 nt, Homo sapiens
uuuccaaacuucuacaugu

SEQ ID NO: 148937 - RNA, 19 nt, Homo sapiens
gaaacugggaguccgaaag

SEQ ID NO: 148938 - RNA, 19 nt, Homo sapiens
cucaauaaaugucugaaca

SEQ ID NO: 148939 - RNA, 19 nt, Homo sapiens
gaagugcucaauaaauguc

SEQ ID NO: 148940 - RNA, 19 nt, Homo sapiens
caguuuacucuguaguuua

SEQ ID NO: 148941 - RNA, 19 nt, Homo sapiens
gaccuaucgaugucuauuu

SEQ ID NO: 148942 - RNA, 19 nt, Homo sapiens
uacaauauguguccaugag

SEQ ID NO: 148943 - RNA, 19 nt, Homo sapiens
cucauuggguaacucauuu

SEQ ID NO: 148944 - RNA, 19 nt, Homo sapiens
ucagauacuucuugguuuu

SEQ ID NO: 148945 - RNA, 19 nt, Homo sapiens
aggcugaaauggacaguuc

SEQ ID NO: 148946 - RNA, 19 nt, Homo sapiens
augaaagacuagcauaugu

SEQ ID NO: 148947 - RNA, 19 nt, Homo sapiens
agaaauccaagaaccauau

SEQ ID NO: 148948 - RNA, 19 nt, Homo sapiens
guacaauauguguccauga

SEQ ID NO: 148949 - RNA, 19 nt, Homo sapiens
guuuuaagcugucuaccua

SEQ ID NO: 148950 - RNA, 19 nt, Homo sapiens
gaacaaggauggccgcuau

SEQ ID NO: 148951 - RNA, 19 nt, Homo sapiens
ggacacaccuggaggagaa

SEQ ID NO: 148952 - RNA, 19 nt, Homo sapiens
ggacgugguugucagcaaa

SEQ ID NO: 148953 - RNA, 19 nt, Homo sapiens
ccacgcaucugaccuuguu

SEQ ID NO: 148954 - RNA, 19 nt, Homo sapiens
ggcaagcgcuacaagacua

SEQ ID NO: 148955 - RNA, 19 nt, Homo sapiens
gcgagaagccguucaagug

SEQ ID NO: 148956 - RNA, 19 nt, Homo sapiens
ggaguucucguccguggua

SEQ ID NO: 148957 - RNA, 19 nt, Homo sapiens
gcgggaagcucuacaagac

SEQ ID NO: 148958 - RNA, 19 nt, Homo sapiens
gcaaggaccacgagugcaa

SEQ ID NO: 148959 - RNA, 19 nt, Homo sapiens
gaagauggcacaggaugga

SEQ ID NO: 148960 - RNA, 19 nt, Homo sapiens
cagaggagcccaucacugu

SEQ ID NO: 148961 - RNA, 19 nt, Homo sapiens
agacggacaguguacauaa

SEQ ID NO: 148962 - RNA, 19 nt, Homo sapiens
ggacgcacgugcagguucu

SEQ ID NO: 148963 - RNA, 19 nt, Homo sapiens
aaaauccgcuucaguguga

SEQ ID NO: 148964 - RNA, 19 nt, Homo sapiens
ugaagcuacuggugaacaa

SEQ ID NO: 148965 - RNA, 19 nt, Homo sapiens
agaguuucuuguugcuuua

SEQ ID NO: 148966 - RNA, 19 nt, Homo sapiens
ucaccgccuuggaggauuu

SEQ ID NO: 148967 - RNA, 19 nt, Homo sapiens
acaagaccauugcccaugu

SEQ ID NO: 148968 - RNA, 19 nt, Homo sapiens
cgaggaagaugaggacgau

SEQ ID NO: 148969 - RNA, 19 nt, Homo sapiens
uagcugacacccaggagua

SEQ ID NO: 148970 - RNA, 19 nt, Homo sapiens
aggaguugcuggugucuga

SEQ ID NO: 148971 - RNA, 19 nt, Homo sapiens
gcaagcgcuacaagacuaa

SEQ ID NO: 148972 - RNA, 19 nt, Homo sapiens
ggacagccacaucaugaag

SEQ ID NO: 148973 - RNA, 19 nt, Homo sapiens
agaagccguucaagugcua

SEQ ID NO: 148974 - RNA, 19 nt, Homo sapiens
cgacauggagggcgagaug

SEQ ID NO: 148975 - RNA, 19 nt, Homo sapiens
gaacuccggcaucguccuu

SEQ ID NO: 148976 - RNA, 19 nt, Homo sapiens
gcugggagacggugagaug

SEQ ID NO: 148977 - RNA, 19 nt, Homo sapiens
caagaccauugcccaugug

SEQ ID NO: 148978 - RNA, 19 nt, Homo sapiens
ugaggacgaugugcacaga

SEQ ID NO: 148979 - RNA, 19 nt, Homo sapiens
ugaagguggugcagcagau

SEQ ID NO: 148980 - RNA, 19 nt, Homo sapiens
gcaccgucauccacgaagu

SEQ ID NO: 148981 - RNA, 19 nt, Homo sapiens
ggacaguguacauaagagu

SEQ ID NO: 148982 - RNA, 19 nt, Homo sapiens
gacggacaguguacauaag

SEQ ID NO: 148983 - RNA, 19 nt, Homo sapiens
ggaagaugaggacgaugug

SEQ ID NO: 148984 - RNA, 19 nt, Homo sapiens
cgaaguccacguccagaug

SEQ ID NO: 148985 - RNA, 19 nt, Homo sapiens
cuacaagugcuccaagugu

SEQ ID NO: 148986 - RNA, 19 nt, Homo sapiens
gcgagccuauagagacuuc

SEQ ID NO: 148987 - RNA, 19 nt, Homo sapiens
gcacaucaaagaggucauc

SEQ ID NO: 148988 - RNA, 19 nt, Homo sapiens
guggugggcacaucaaaga

SEQ ID NO: 148989 - RNA, 19 nt, Homo sapiens
ccagugaggccacggagau

SEQ ID NO: 148990 - RNA, 19 nt, Homo sapiens
cggaagacccgcacacagu

SEQ ID NO: 148991 - RNA, 19 nt, Homo sapiens
gcagcugccgguacuggaa

SEQ ID NO: 148992 - RNA, 19 nt, Homo sapiens
aaacaugagaaccugcaaa

SEQ ID NO: 148993 - RNA, 19 nt, Homo sapiens
acaguguacauaagaguuu

SEQ ID NO: 148994 - RNA, 19 nt, Homo sapiens
gacaguguacauaagaguu

SEQ ID NO: 148995 - RNA, 19 nt, Homo sapiens
gcugacacccaggaguaua

SEQ ID NO: 148996 - RNA, 19 nt, Homo sapiens
aaggauggccgcuaugugu

SEQ ID NO: 148997 - RNA, 19 nt, Homo sapiens
ugccuggccugguagagaa

SEQ ID NO: 148998 - RNA, 19 nt, Homo sapiens
guucagcacaagauucaga

SEQ ID NO: 148999 - RNA, 19 nt, Homo sapiens
gcacgugcgacaccacaca

SEQ ID NO: 149000 - RNA, 19 nt, Homo sapiens
gaagggcagccgugagaac

SEQ ID NO: 149001 - RNA, 19 nt, Homo sapiens
gagcugucccugggcauga

SEQ ID NO: 149002 - RNA, 19 nt, Homo sapiens
gagcaaggacgugguuguc

SEQ ID NO: 149003 - RNA, 19 nt, Homo sapiens
ggauggccgcuaugugugu

SEQ ID NO: 149004 - RNA, 19 nt, Homo sapiens
ccuaccugcucaagacaga

SEQ ID NO: 149005 - RNA, 19 nt, Homo sapiens
caagacggacaguguacau

SEQ ID NO: 149006 - RNA, 19 nt, Homo sapiens
gcaccaagggcucacucau

SEQ ID NO: 149007 - RNA, 19 nt, Homo sapiens
cagagcagguggccaugac

SEQ ID NO: 149008 - RNA, 19 nt, Homo sapiens
ugcagaacgucaccaugga

SEQ ID NO: 149009 - RNA, 19 nt, Homo sapiens
aggacgaugugcacagaug

SEQ ID NO: 149010 - RNA, 19 nt, Homo sapiens
ggaagggcagccgugagaa

SEQ ID NO: 149011 - RNA, 19 nt, Homo sapiens
gaagcucuacaagaccauu

SEQ ID NO: 149012 - RNA, 19 nt, Homo sapiens
caccaagggcucacucauc

SEQ ID NO: 149013 - RNA, 19 nt, Homo sapiens
aggugaagcuacuggugaa

SEQ ID NO: 149014 - RNA, 19 nt, Homo sapiens
caaggauggccgcuaugug

SEQ ID NO: 149015 - RNA, 19 nt, Homo sapiens
gaaaucugguguaaacaaa

SEQ ID NO: 149016 - RNA, 19 nt, Homo sapiens
gcaggaggcugaaaggauu

SEQ ID NO: 149017 - RNA, 19 nt, Homo sapiens
agaaaggacugaauagauu

SEQ ID NO: 149018 - RNA, 19 nt, Homo sapiens
ggacuucccuuauaaagca

SEQ ID NO: 149019 - RNA, 19 nt, Homo sapiens
gaaaggacugaauagauua

SEQ ID NO: 149020 - RNA, 19 nt, Homo sapiens
cuuaauaacucccaaugua

SEQ ID NO: 149021 - RNA, 19 nt, Homo sapiens
gcaagucaguguaucgauu

SEQ ID NO: 149022 - RNA, 19 nt, Homo sapiens
ggauauguacuuccacuua

SEQ ID NO: 149023 - RNA, 19 nt, Homo sapiens
ccaaauuucucucaauguu

SEQ ID NO: 149024 - RNA, 19 nt, Homo sapiens
gauuauauauugccagaug

SEQ ID NO: 149025 - RNA, 19 nt, Homo sapiens
gggcauguuucauaggaua

SEQ ID NO: 149026 - RNA, 19 nt, Homo sapiens
uaacugcgcuaguguuuua

SEQ ID NO: 149027 - RNA, 19 nt, Homo sapiens
gaaguaagcccaagagaac

SEQ ID NO: 149028 - RNA, 19 nt, Homo sapiens
gaugauacauuccaagucu

SEQ ID NO: 149029 - RNA, 19 nt, Homo sapiens
ugagaaaucugguguaaac

SEQ ID NO: 149030 - RNA, 19 nt, Homo sapiens
gauauguacuuccacuuau

SEQ ID NO: 149031 - RNA, 19 nt, Homo sapiens
gacguaaacuguaugacaa

SEQ ID NO: 149032 - RNA, 19 nt, Homo sapiens
ggaaguaagcccaagagaa

SEQ ID NO: 149033 - RNA, 19 nt, Homo sapiens
aaaggaggcgcucuuaaua

SEQ ID NO: 149034 - RNA, 19 nt, Homo sapiens
gagaacaacauaaagcaaa

SEQ ID NO: 149035 - RNA, 19 nt, Homo sapiens
cuucagaacugccaaacaa

SEQ ID NO: 149036 - RNA, 19 nt, Homo sapiens
uugcaggacuucccuuaua

SEQ ID NO: 149037 - RNA, 19 nt, Homo sapiens
agagaaagguuaugaggau

SEQ ID NO: 149038 - RNA, 19 nt, Homo sapiens
agacauucguuccagauuu

SEQ ID NO: 149039 - RNA, 19 nt, Homo sapiens
caaacaacauaaagcacaa

SEQ ID NO: 149040 - RNA, 19 nt, Homo sapiens
aaacgcagaugaugauaca

SEQ ID NO: 149041 - RNA, 19 nt, Homo sapiens
cuaaaucucuucccuggau

SEQ ID NO: 149042 - RNA, 19 nt, Homo sapiens
gugcauauuugucuggauu

SEQ ID NO: 149043 - RNA, 19 nt, Homo sapiens
caacauaaagcaaacaaca

SEQ ID NO: 149044 - RNA, 19 nt, Homo sapiens
gaaagugaaauggauugua

SEQ ID NO: 149045 - RNA, 19 nt, Homo sapiens
guaaaggguauaagagaaa

SEQ ID NO: 149046 - RNA, 19 nt, Homo sapiens
gauaacugcgcuaguguuu

SEQ ID NO: 149047 - RNA, 19 nt, Homo sapiens
guacuuccacuuauaauca

SEQ ID NO: 149048 - RNA, 19 nt, Homo sapiens
uuuaugaccugccugagua

SEQ ID NO: 149049 - RNA, 19 nt, Homo sapiens
aagcuucguuucucuaauu

SEQ ID NO: 149050 - RNA, 19 nt, Homo sapiens
gacauucguuccagauuuc

SEQ ID NO: 149051 - RNA, 19 nt, Homo sapiens
gaaaugacugugaccucua

SEQ ID NO: 149052 - RNA, 19 nt, Homo sapiens
ucucugcacuuuacaguau

SEQ ID NO: 149053 - RNA, 19 nt, Homo sapiens
ggaccaccaccaauggaua

SEQ ID NO: 149054 - RNA, 19 nt, Homo sapiens
ugucuggauucuaguauuu

SEQ ID NO: 149055 - RNA, 19 nt, Homo sapiens
ggguauaagagaaagguua

SEQ ID NO: 149056 - RNA, 19 nt, Homo sapiens
gcauguaaaggguauaaga

SEQ ID NO: 149057 - RNA, 19 nt, Homo sapiens
caguaugccugaugaacuu

SEQ ID NO: 149058 - RNA, 19 nt, Homo sapiens
ccucuacgcuacaacaaga

SEQ ID NO: 149059 - RNA, 19 nt, Homo sapiens
ucauugggcucgugggaaa

SEQ ID NO: 149060 - RNA, 19 nt, Homo sapiens
caacaaauggcuagaaagg

SEQ ID NO: 149061 - RNA, 19 nt, Homo sapiens
caagucaguguaucgauuu

SEQ ID NO: 149062 - RNA, 19 nt, Homo sapiens
uguaaaggguauaagagaa

SEQ ID NO: 149063 - RNA, 19 nt, Homo sapiens
gcucucaacacaauuauuc

SEQ ID NO: 149064 - RNA, 19 nt, Homo sapiens
ucacagcacggccaggaua

SEQ ID NO: 149065 - RNA, 19 nt, Homo sapiens
ccacuuauaaucauucuca

SEQ ID NO: 149066 - RNA, 19 nt, Homo sapiens
uaggauaacugcgcuagug

SEQ ID NO: 149067 - RNA, 19 nt, Homo sapiens
cuacacgaauagccuacua

SEQ ID NO: 149068 - RNA, 19 nt, Homo sapiens
guucagcuuccaauuagua

SEQ ID NO: 149069 - RNA, 19 nt, Homo sapiens
ugcaggacuucccuuauaa

SEQ ID NO: 149070 - RNA, 19 nt, Homo sapiens
gaaacggcaagucagugua

SEQ ID NO: 149071 - RNA, 19 nt, Homo sapiens
cuacuucuuugcauguaaa

SEQ ID NO: 149072 - RNA, 19 nt, Homo sapiens
gcaaaaggcgugugcauau

SEQ ID NO: 149073 - RNA, 19 nt, Homo sapiens
gcaggacuucccuuauaaa

SEQ ID NO: 149074 - RNA, 19 nt, Homo sapiens
gaagcuucguuucucuaau

SEQ ID NO: 149075 - RNA, 19 nt, Homo sapiens
uuucacaccuuaccauguu

SEQ ID NO: 149076 - RNA, 19 nt, Homo sapiens
gaaacuuacuagccuuggu

SEQ ID NO: 149077 - RNA, 19 nt, Homo sapiens
ucaaauggaaagugaaaug

SEQ ID NO: 149078 - RNA, 19 nt, Homo sapiens
ucucagaucugcugcaaac

SEQ ID NO: 149079 - RNA, 19 nt, Homo sapiens
ugaccugccugaguauuga

SEQ ID NO: 149080 - RNA, 19 nt, Homo sapiens
ugccagauguuaauacugu

SEQ ID NO: 149081 - RNA, 19 nt, Homo sapiens
uagaaaggacugaauagau

SEQ ID NO: 149082 - RNA, 19 nt, Homo sapiens
aaaugacugugaccucuau

SEQ ID NO: 149083 - RNA, 19 nt, Homo sapiens
aaaggcgugugcauauuug

SEQ ID NO: 149084 - RNA, 19 nt, Homo sapiens
gcaggugugaacuuuauga

SEQ ID NO: 149085 - RNA, 19 nt, Homo sapiens
gucaguguaucgauuucua

SEQ ID NO: 149086 - RNA, 19 nt, Homo sapiens
acugagaaaucugguguaa

SEQ ID NO: 149087 - RNA, 19 nt, Homo sapiens
uaaucauucucaucugcua

SEQ ID NO: 149088 - RNA, 19 nt, Homo sapiens
aaggaacucuuuuggaaua

SEQ ID NO: 149089 - RNA, 19 nt, Homo sapiens
gaggcgcucuuaauaacuc

SEQ ID NO: 149090 - RNA, 19 nt, Homo sapiens
ugacagaaacgcagaugau

SEQ ID NO: 149091 - RNA, 19 nt, Homo sapiens
uuaaggaacucuuuuggaa

SEQ ID NO: 149092 - RNA, 19 nt, Homo sapiens
cccaagagaacaacauaaa

SEQ ID NO: 149093 - RNA, 19 nt, Homo sapiens
gcugcaaacucuucagaac

SEQ ID NO: 149094 - RNA, 19 nt, Homo sapiens
ugacguaaacuguaugaca

SEQ ID NO: 149095 - RNA, 19 nt, Homo sapiens
cagaaacgcagaugaugau

SEQ ID NO: 149096 - RNA, 19 nt, Homo sapiens
ugauuaagaagcuucguuu

SEQ ID NO: 149097 - RNA, 19 nt, Homo sapiens
gaguauugaccgcuucauu

SEQ ID NO: 149098 - RNA, 19 nt, Homo sapiens
aaggaggcgcucuuaauaa

SEQ ID NO: 149099 - RNA, 19 nt, Homo sapiens
ccuggaauguagccaaaga

SEQ ID NO: 149100 - RNA, 19 nt, Homo sapiens
accaauggauauacaaaug

SEQ ID NO: 149101 - RNA, 19 nt, Homo sapiens
caacuccucagggaaauga

SEQ ID NO: 149102 - RNA, 19 nt, Homo sapiens
ggcuagaaaggacugaaua

SEQ ID NO: 149103 - RNA, 19 nt, Homo sapiens
caagagaacaacauaaagc

SEQ ID NO: 149104 - RNA, 19 nt, Homo sapiens
auagugacguaaacuguau

SEQ ID NO: 149105 - RNA, 19 nt, Homo sapiens
uauagugacguaaacugua

SEQ ID NO: 149106 - RNA, 19 nt, Homo sapiens
ugcaaacucuucagaacug

SEQ ID NO: 149107 - RNA, 19 nt, Homo sapiens
ucaucaacccuaugucaaa

SEQ ID NO: 149108 - RNA, 19 nt, Homo sapiens
caaaaggcgugugcauauu

SEQ ID NO: 149109 - RNA, 19 nt, Homo sapiens
acagaaacgcagaugauga

SEQ ID NO: 149110 - RNA, 19 nt, Homo sapiens
ggauaacugcgcuaguguu

SEQ ID NO: 149111 - RNA, 19 nt, Homo sapiens
uuaauucccucaauaacac

SEQ ID NO: 149112 - RNA, 19 nt, Homo sapiens
gcucgugggaaacuuacua

SEQ ID NO: 149113 - RNA, 19 nt, Homo sapiens
guaaacgaauacaccaaaa

SEQ ID NO: 149114 - RNA, 19 nt, Homo sapiens
aauggaaagugaaauggau

SEQ ID NO: 149115 - RNA, 19 nt, Homo sapiens
gagcgaagcuugugucuca

SEQ ID NO: 149116 - RNA, 19 nt, Homo sapiens
gagcagaucuccacucuca

SEQ ID NO: 149117 - RNA, 19 nt, Homo sapiens
ccaaggagcuggacaaagu

SEQ ID NO: 149118 - RNA, 19 nt, Homo sapiens
gaaaggcgcaaguauacua

SEQ ID NO: 149119 - RNA, 19 nt, Homo sapiens
gagaucauccuggagauua

SEQ ID NO: 149120 - RNA, 19 nt, Homo sapiens
ccaccuggcucacccauga

SEQ ID NO: 149121 - RNA, 19 nt, Homo sapiens
gaacacaaccaagcaauca

SEQ ID NO: 149122 - RNA, 19 nt, Homo sapiens
cagcagaucuuggacuuug

SEQ ID NO: 149123 - RNA, 19 nt, Homo sapiens
agaaggugcugaccggaua

SEQ ID NO: 149124 - RNA, 19 nt, Homo sapiens
ccaaaccucuaauggaguu

SEQ ID NO: 149125 - RNA, 19 nt, Homo sapiens
gagaaaggcgcaaguauac

SEQ ID NO: 149126 - RNA, 19 nt, Homo sapiens
ccagaccucuacuuugaaa

SEQ ID NO: 149127 - RNA, 19 nt, Homo sapiens
gagcauagccaccgagauc

SEQ ID NO: 149128 - RNA, 19 nt, Homo sapiens
uaagaaggcauuugaggaa

SEQ ID NO: 149129 - RNA, 19 nt, Homo sapiens
agagaaaggcgcaaguaua

SEQ ID NO: 149130 - RNA, 19 nt, Homo sapiens
uggacaaaguguuuaauga

SEQ ID NO: 149131 - RNA, 19 nt, Homo sapiens
acagaugccugcucaacaa

SEQ ID NO: 149132 - RNA, 19 nt, Homo sapiens
agaacugggugaagaagaa

SEQ ID NO: 149133 - RNA, 19 nt, Homo sapiens
gagcucaucuaccacaaag

SEQ ID NO: 149134 - RNA, 19 nt, Homo sapiens
cuaauggaguugauugaga

SEQ ID NO: 149135 - RNA, 19 nt, Homo sapiens
gggagaacaucgccgacaa

SEQ ID NO: 149136 - RNA, 19 nt, Homo sapiens
agagaucaguggagcauga

SEQ ID NO: 149137 - RNA, 19 nt, Homo sapiens
ucuacaacaugauaggaua

SEQ ID NO: 149138 - RNA, 19 nt, Homo sapiens
gaaaaucagccaaggaaaa

SEQ ID NO: 149139 - RNA, 19 nt, Homo sapiens
gaugccugcucaacaacua

SEQ ID NO: 149140 - RNA, 19 nt, Homo sapiens
ccggauaucugaacuacau

SEQ ID NO: 149141 - RNA, 19 nt, Homo sapiens
ggacgccgaugagaaguuc

SEQ ID NO: 149142 - RNA, 19 nt, Homo sapiens
acaacuacaugaucuggaa

SEQ ID NO: 149143 - RNA, 19 nt, Homo sapiens
gugaccagcuccaucuuga

SEQ ID NO: 149144 - RNA, 19 nt, Homo sapiens
uuccagaccucuacuuuga

SEQ ID NO: 149145 - RNA, 19 nt, Homo sapiens
gacaaaguguuuaaugacu

SEQ ID NO: 149146 - RNA, 19 nt, Homo sapiens
gccaugacuucuucagcua

SEQ ID NO: 149147 - RNA, 19 nt, Homo sapiens
cccaaggccuuaaacuuug

SEQ ID NO: 149148 - RNA, 19 nt, Homo sapiens
aggaauaccuugagcagau

SEQ ID NO: 149149 - RNA, 19 nt, Homo sapiens
gagagacuauuaccugaac

SEQ ID NO: 149150 - RNA, 19 nt, Homo sapiens
gagagaaaggcgcaaguau

SEQ ID NO: 149151 - RNA, 19 nt, Homo sapiens
caagaaugagauuguguuu

SEQ ID NO: 149152 - RNA, 19 nt, Homo sapiens
ggagcuggacaaaguguuu

SEQ ID NO: 149153 - RNA, 19 nt, Homo sapiens
caagugcgaagucugguaa

SEQ ID NO: 149154 - RNA, 19 nt, Homo sapiens
gaucuccacucucaucaac

SEQ ID NO: 149155 - RNA, 19 nt, Homo sapiens
ccaauaaccagcucuucuu

SEQ ID NO: 149156 - RNA, 19 nt, Homo sapiens
caaaguguuuaaugacuac

SEQ ID NO: 149157 - RNA, 19 nt, Homo sapiens
ggacaaaguguuuaaugac

SEQ ID NO: 149158 - RNA, 19 nt, Homo sapiens
cuuaaacuuugguggcaua

SEQ ID NO: 149159 - RNA, 19 nt, Homo sapiens
gcagaucuccacucucauc

SEQ ID NO: 149160 - RNA, 19 nt, Homo sapiens
gcucagggccaaaccucua

SEQ ID NO: 149161 - RNA, 19 nt, Homo sapiens
ccaacggccugcaggugaa

SEQ ID NO: 149162 - RNA, 19 nt, Homo sapiens
agaaugagauuguguuucc

SEQ ID NO: 149163 - RNA, 19 nt, Homo sapiens
gcucaucuaccacaaagug

SEQ ID NO: 149164 - RNA, 19 nt, Homo sapiens
aaacuuugguggcauaggu

SEQ ID NO: 149165 - RNA, 19 nt, Homo sapiens
ggaauaccuugagcagauc

SEQ ID NO: 149166 - RNA, 19 nt, Homo sapiens
gugcugaccggauaucuga

SEQ ID NO: 149167 - RNA, 19 nt, Homo sapiens
acccaaggccuuaaacuuu

SEQ ID NO: 149168 - RNA, 19 nt, Homo sapiens
gagcuggacaaaguguuua

SEQ ID NO: 149169 - RNA, 19 nt, Homo sapiens
agaagcggcuggugguguu

SEQ ID NO: 149170 - RNA, 19 nt, Homo sapiens
caaccaagcaaucaucaag

SEQ ID NO: 149171 - RNA, 19 nt, Homo sapiens
ugacuacacugcaguucca

SEQ ID NO: 149172 - RNA, 19 nt, Homo sapiens
gcucaacaacuacaugauc

SEQ ID NO: 149173 - RNA, 19 nt, Homo sapiens
ccaagaaugagauuguguu

SEQ ID NO: 149174 - RNA, 19 nt, Homo sapiens
gaggacagcaagagcauag

SEQ ID NO: 149175 - RNA, 19 nt, Homo sapiens
agacggcacuggccaacau

SEQ ID NO: 149176 - RNA, 19 nt, Homo sapiens
gaccggauaucugaacuac

SEQ ID NO: 149177 - RNA, 19 nt, Homo sapiens
ucaagcaccuccucgaaaa

SEQ ID NO: 149178 - RNA, 19 nt, Homo sapiens
ccaccaagaaugagauugu

SEQ ID NO: 149179 - RNA, 19 nt, Homo sapiens
gaaguggauggaugaggaa

SEQ ID NO: 149180 - RNA, 19 nt, Homo sapiens
caaugaauccgagccuauu

SEQ ID NO: 149181 - RNA, 19 nt, Homo sapiens
gggccaaaccucuaaugga

SEQ ID NO: 149182 - RNA, 19 nt, Homo sapiens
gaagucugguaaggacgaa

SEQ ID NO: 149183 - RNA, 19 nt, Homo sapiens
cccugggccucaccaauaa

SEQ ID NO: 149184 - RNA, 19 nt, Homo sapiens
gaucaaggacgggaguaug

SEQ ID NO: 149185 - RNA, 19 nt, Homo sapiens
ggaacacaaccaagcaauc

SEQ ID NO: 149186 - RNA, 19 nt, Homo sapiens
gcaggcaccauucuacaca

SEQ ID NO: 149187 - RNA, 19 nt, Homo sapiens
gaaaacaaccugggcuuug

SEQ ID NO: 149188 - RNA, 19 nt, Homo sapiens
aagaaggcauuugaggaaa

SEQ ID NO: 149189 - RNA, 19 nt, Homo sapiens
gaaaacaagcuccuuccuu

SEQ ID NO: 149190 - RNA, 19 nt, Homo sapiens
agaucauccuggagauuaa

SEQ ID NO: 149191 - RNA, 19 nt, Homo sapiens
caucaagcaccuccucgaa

SEQ ID NO: 149192 - RNA, 19 nt, Homo sapiens
agauuaagaaggcauuuga

SEQ ID NO: 149193 - RNA, 19 nt, Homo sapiens
ccguggagaucaaugaauc

SEQ ID NO: 149194 - RNA, 19 nt, Homo sapiens
ggagcucaucuaccacaaa

SEQ ID NO: 149195 - RNA, 19 nt, Homo sapiens
ccaagaacuccaacagcaa

SEQ ID NO: 149196 - RNA, 19 nt, Homo sapiens
guagagcaguacagcaacu

SEQ ID NO: 149197 - RNA, 19 nt, Homo sapiens
gaaggcauuugaggaaagc

SEQ ID NO: 149198 - RNA, 19 nt, Homo sapiens
gagauuaagaaggcauuug

SEQ ID NO: 149199 - RNA, 19 nt, Homo sapiens
ucaaugaauccgagccuau

SEQ ID NO: 149200 - RNA, 19 nt, Homo sapiens
caauaaccagcucuucuuc

SEQ ID NO: 149201 - RNA, 19 nt, Homo sapiens
gaagcuugugucucaguga

SEQ ID NO: 149202 - RNA, 19 nt, Homo sapiens
gagacuauuaccugaacaa

SEQ ID NO: 149203 - RNA, 19 nt, Homo sapiens
ucagaccgagugcauggua

SEQ ID NO: 149204 - RNA, 19 nt, Homo sapiens
ugagcacccugaaguggau

SEQ ID NO: 149205 - RNA, 19 nt, Homo sapiens
gacagaugccugcucaaca

SEQ ID NO: 149206 - RNA, 19 nt, Homo sapiens
agagagaaaggcgcaagua

SEQ ID NO: 149207 - RNA, 19 nt, Homo sapiens
ccaugaacccgccucacaa

SEQ ID NO: 149208 - RNA, 19 nt, Homo sapiens
gagaaguucauggaaguca

SEQ ID NO: 149209 - RNA, 19 nt, Homo sapiens
caggagaagcgccgugaug

SEQ ID NO: 149210 - RNA, 19 nt, Homo sapiens
acccugggccucaccaaua

SEQ ID NO: 149211 - RNA, 19 nt, Homo sapiens
agaaggcauuugaggaaag

SEQ ID NO: 149212 - RNA, 19 nt, Homo sapiens
ggagauuaagaaggcauuu

SEQ ID NO: 149213 - RNA, 19 nt, Homo sapiens
ucagcaaccucugggaaca

SEQ ID NO: 149214 - RNA, 19 nt, Homo sapiens
uguggucuaugacaaggaa

SEQ ID NO: 149215 - RNA, 19 nt, Homo sapiens
uggauaagcuggagucuau

SEQ ID NO: 149216 - RNA, 19 nt, Homo sapiens
cagccuccauucucaguaa

SEQ ID NO: 149217 - RNA, 19 nt, Homo sapiens
gauaagcuggagucuauuc

SEQ ID NO: 149218 - RNA, 19 nt, Homo sapiens
gcugcaaggugccaaugau

SEQ ID NO: 149219 - RNA, 19 nt, Homo sapiens
ggacggaauccuauaugca

SEQ ID NO: 149220 - RNA, 19 nt, Homo sapiens
caggaggcaccuuggauaa

SEQ ID NO: 149221 - RNA, 19 nt, Homo sapiens
gcccagagcagaugcaagu

SEQ ID NO: 149222 - RNA, 19 nt, Homo sapiens
ggaggcaccuuggauaagc

SEQ ID NO: 149223 - RNA, 19 nt, Homo sapiens
acaggaggcaccuuggaua

SEQ ID NO: 149224 - RNA, 19 nt, Homo sapiens
uggagucuauuccuggauu

SEQ ID NO: 149225 - RNA, 19 nt, Homo sapiens
ggugguggacguuaaguuc

SEQ ID NO: 149226 - RNA, 19 nt, Homo sapiens
ggagucuauuccuggauuc

SEQ ID NO: 149227 - RNA, 19 nt, Homo sapiens
caucacagccuccauucuc

SEQ ID NO: 149228 - RNA, 19 nt, Homo sapiens
gcgauggcagccuugauga

SEQ ID NO: 149229 - RNA, 19 nt, Homo sapiens
ggacagccugccacucauc

SEQ ID NO: 149230 - RNA, 19 nt, Homo sapiens
gcucuggugguggacguua

SEQ ID NO: 149231 - RNA, 19 nt, Homo sapiens
gucuauuccuggauucaau

SEQ ID NO: 149232 - RNA, 19 nt, Homo sapiens
gcaaggugccaaugaucag

SEQ ID NO: 149233 - RNA, 19 nt, Homo sapiens
ggaagggagccagggacuu

SEQ ID NO: 149234 - RNA, 19 nt, Homo sapiens
gcggacggaauccuauaug

SEQ ID NO: 149235 - RNA, 19 nt, Homo sapiens
guagagugcuucaacaaga

SEQ ID NO: 149236 - RNA, 19 nt, Homo sapiens
ucaacaagauuucgagaga

SEQ ID NO: 149237 - RNA, 19 nt, Homo sapiens
ggaaugccaugaacaaggu

SEQ ID NO: 149238 - RNA, 19 nt, Homo sapiens
gaugacaguuguuucuaug

SEQ ID NO: 149239 - RNA, 19 nt, Homo sapiens
ggguuuggcugccgaugua

SEQ ID NO: 149240 - RNA, 19 nt, Homo sapiens
ccacaaacaauaaagcaaa

SEQ ID NO: 149241 - RNA, 19 nt, Homo sapiens
ugacccaguuucccaguuu

SEQ ID NO: 149242 - RNA, 19 nt, Homo sapiens
caugcuggaugcugccuua

SEQ ID NO: 149243 - RNA, 19 nt, Homo sapiens
gacccaguuucccaguuua

SEQ ID NO: 149244 - RNA, 19 nt, Homo sapiens
gaugggcgaugacaguugu

SEQ ID NO: 149245 - RNA, 19 nt, Homo sapiens
guauugaccugauggacau

SEQ ID NO: 149246 - RNA, 19 nt, Homo sapiens
cgaugacaguuguuucuau

SEQ ID NO: 149247 - RNA, 19 nt, Homo sapiens
caagaggaaugccaugaac

SEQ ID NO: 149248 - RNA, 19 nt, Homo sapiens
ccaguuucccaguuuauaa

SEQ ID NO: 149249 - RNA, 19 nt, Homo sapiens
cccaagaccucgugaaguc

SEQ ID NO: 149250 - RNA, 19 nt, Homo sapiens
gcccaaggccuuaucuuca

SEQ ID NO: 149251 - RNA, 19 nt, Homo sapiens
aauguucacugcagguauu

SEQ ID NO: 149252 - RNA, 19 nt, Homo sapiens
gagagaugguagagugcuu

SEQ ID NO: 149253 - RNA, 19 nt, Homo sapiens
guaccuccgugacaucauc

SEQ ID NO: 149254 - RNA, 19 nt, Homo sapiens
uacccgggacucaguauua

SEQ ID NO: 149255 - RNA, 19 nt, Homo sapiens
cagcaagaccaccguguug

SEQ ID NO: 149256 - RNA, 19 nt, Homo sapiens
gaggaugggcgaugacagu

SEQ ID NO: 149257 - RNA, 19 nt, Homo sapiens
ugagaacaaggaacugaaa

SEQ ID NO: 149258 - RNA, 19 nt, Homo sapiens
cggaguagcccucggugaa

SEQ ID NO: 149259 - RNA, 19 nt, Homo sapiens
ucaacgagcuggccuucac

SEQ ID NO: 149260 - RNA, 19 nt, Homo sapiens
gcccaaaggagaugaugug

SEQ ID NO: 149261 - RNA, 19 nt, Homo sapiens
caacuacccgggacucagu

SEQ ID NO: 149262 - RNA, 19 nt, Homo sapiens
uagagugcuucaacaagau

SEQ ID NO: 149263 - RNA, 19 nt, Homo sapiens
ggagguggacguggguuug

SEQ ID NO: 149264 - RNA, 19 nt, Homo sapiens
gcugguaccuccgugacau

SEQ ID NO: 149265 - RNA, 19 nt, Homo sapiens
agaggaaugccaugaacaa

SEQ ID NO: 149266 - RNA, 19 nt, Homo sapiens
gcgaugacaguuguuucua

SEQ ID NO: 149267 - RNA, 19 nt, Homo sapiens
cgacugagaacaaggaacu

SEQ ID NO: 149268 - RNA, 19 nt, Homo sapiens
gaugguagagugcuucaac

SEQ ID NO: 149269 - RNA, 19 nt, Homo sapiens
cccgagauuuccagcaaga

SEQ ID NO: 149270 - RNA, 19 nt, Homo sapiens
uaugagucccuucguguga

SEQ ID NO: 149271 - RNA, 19 nt, Homo sapiens
acaagaggaaugccaugaa

SEQ ID NO: 149272 - RNA, 19 nt, Homo sapiens
ggaugggcgaugacaguug

SEQ ID NO: 149273 - RNA, 19 nt, Homo sapiens
ccacgacugagaacaagga

SEQ ID NO: 149274 - RNA, 19 nt, Homo sapiens
ccgagagccucaacuacgu

SEQ ID NO: 149275 - RNA, 19 nt, Homo sapiens
gacccaagaccucgugaag

SEQ ID NO: 149276 - RNA, 19 nt, Homo sapiens
guggcguccuggaacauga

SEQ ID NO: 149277 - RNA, 19 nt, Homo sapiens
ccagcaagaccaccguguu

SEQ ID NO: 149278 - RNA, 19 nt, Homo sapiens
cgcccgagauuuccagcaa

SEQ ID NO: 149279 - RNA, 19 nt, Homo sapiens
gauaccaggagaccuucaa

SEQ ID NO: 149280 - RNA, 19 nt, Homo sapiens
gaucucuggugcaggaaaa

SEQ ID NO: 149281 - RNA, 19 nt, Homo sapiens
gguagagugcuucaacaag

SEQ ID NO: 149282 - RNA, 19 nt, Homo sapiens
cgugauugcugccguccau

SEQ ID NO: 149283 - RNA, 19 nt, Homo sapiens
ucucaagcccaaggccuua

SEQ ID NO: 149284 - RNA, 19 nt, Homo sapiens
aagggaggaugggcgauga

SEQ ID NO: 149285 - RNA, 19 nt, Homo sapiens
ggaguagcccucggugaag

SEQ ID NO: 149286 - RNA, 19 nt, Homo sapiens
gcccacgacugagaacaag

SEQ ID NO: 149287 - RNA, 19 nt, Homo sapiens
cuucaccgcccacaagaug

SEQ ID NO: 149288 - RNA, 19 nt, Homo sapiens
gaaguaaguuggagaagaa

SEQ ID NO: 149289 - RNA, 19 nt, Homo sapiens
gcaaguaaaucauccucuu

SEQ ID NO: 149290 - RNA, 19 nt, Homo sapiens
gagcugauaucaaggaaau

SEQ ID NO: 149291 - RNA, 19 nt, Homo sapiens
ggaaguaaguuggagaaga

SEQ ID NO: 149292 - RNA, 19 nt, Homo sapiens
ucauacagaugcugauuaa

SEQ ID NO: 149293 - RNA, 19 nt, Homo sapiens
gagaaaggccaacuucaaa

SEQ ID NO: 149294 - RNA, 19 nt, Homo sapiens
ggaagaagccauccagugu

SEQ ID NO: 149295 - RNA, 19 nt, Homo sapiens
gaaugcagcuuuugaaaug

SEQ ID NO: 149296 - RNA, 19 nt, Homo sapiens
ccggagaucuuaauaggaa

SEQ ID NO: 149297 - RNA, 19 nt, Homo sapiens
gaaaggccaacuucaaaga

SEQ ID NO: 149298 - RNA, 19 nt, Homo sapiens
gcugugagcuugccaugau

SEQ ID NO: 149299 - RNA, 19 nt, Homo sapiens
gcugucugcugccuucaua

SEQ ID NO: 149300 - RNA, 19 nt, Homo sapiens
gagcaccuucuaaaucuaa

SEQ ID NO: 149301 - RNA, 19 nt, Homo sapiens
gaugcugauuaaagugaua

SEQ ID NO: 149302 - RNA, 19 nt, Homo sapiens
ggagcaccuucuaaaucua

SEQ ID NO: 149303 - RNA, 19 nt, Homo sapiens
caaguaaaucauccucuuu

SEQ ID NO: 149304 - RNA, 19 nt, Homo sapiens
agucaucgcugcugucaau

SEQ ID NO: 149305 - RNA, 19 nt, Homo sapiens
caacuucaaagaccaguga

SEQ ID NO: 149306 - RNA, 19 nt, Homo sapiens
aagcaggucuugucagcaa

SEQ ID NO: 149307 - RNA, 19 nt, Homo sapiens
gcacagccggagaucuuaa

SEQ ID NO: 149308 - RNA, 19 nt, Homo sapiens
uaguagcgauggccaaaga

SEQ ID NO: 149309 - RNA, 19 nt, Homo sapiens
gaaaugcagaaccugaguu

SEQ ID NO: 149310 - RNA, 19 nt, Homo sapiens
uacagaugcugauuaaagu

SEQ ID NO: 149311 - RNA, 19 nt, Homo sapiens
gaugaccgcguuuguggaa

SEQ ID NO: 149312 - RNA, 19 nt, Homo sapiens
ggccaaagaaucagugaau

SEQ ID NO: 149313 - RNA, 19 nt, Homo sapiens
cagcaagauuuguccuguu

SEQ ID NO: 149314 - RNA, 19 nt, Homo sapiens
uuaaagugauagcgauuca

SEQ ID NO: 149315 - RNA, 19 nt, Homo sapiens
gacauuaacagaaggaagu

SEQ ID NO: 149316 - RNA, 19 nt, Homo sapiens
gccaaagaaucagugaaug

SEQ ID NO: 149317 - RNA, 19 nt, Homo sapiens
uggagcaccuucuaaaucu

SEQ ID NO: 149318 - RNA, 19 nt, Homo sapiens
agagaaaggccaacuucaa

SEQ ID NO: 149319 - RNA, 19 nt, Homo sapiens
uaacagaaggaaguaaguu

SEQ ID NO: 149320 - RNA, 19 nt, Homo sapiens
ugaguuuccaggacuguua

SEQ ID NO: 149321 - RNA, 19 nt, Homo sapiens
gugcuaacuuugaguacau

SEQ ID NO: 149322 - RNA, 19 nt, Homo sapiens
caagauuuguccuguugag

SEQ ID NO: 149323 - RNA, 19 nt, Homo sapiens
aaagagaaaggccaacuuc

SEQ ID NO: 149324 - RNA, 19 nt, Homo sapiens
auacagaugcugauuaaag

SEQ ID NO: 149325 - RNA, 19 nt, Homo sapiens
gucaauggcuaugccuuug

SEQ ID NO: 149326 - RNA, 19 nt, Homo sapiens
ucaaggaaaugcagaaccu

SEQ ID NO: 149327 - RNA, 19 nt, Homo sapiens
gacuggagcaccuucuaaa

SEQ ID NO: 149328 - RNA, 19 nt, Homo sapiens
cgccucgggugcuaacuuu

SEQ ID NO: 149329 - RNA, 19 nt, Homo sapiens
ugacuggagcaccuucuaa

SEQ ID NO: 149330 - RNA, 19 nt, Homo sapiens
caaagaaucagugaaugca

SEQ ID NO: 149331 - RNA, 19 nt, Homo sapiens
agcaagauuuguccuguug

SEQ ID NO: 149332 - RNA, 19 nt, Homo sapiens
aaagugauagcgauucaga

SEQ ID NO: 149333 - RNA, 19 nt, Homo sapiens
gauuaaagugauagcgauu

SEQ ID NO: 149334 - RNA, 19 nt, Homo sapiens
gaagggaugaccgcguuug

SEQ ID NO: 149335 - RNA, 19 nt, Homo sapiens
aaaugcagaaccugaguuu

SEQ ID NO: 149336 - RNA, 19 nt, Homo sapiens
cagaugcugauuaaaguga

SEQ ID NO: 149337 - RNA, 19 nt, Homo sapiens
uugagacacugguggaaga

SEQ ID NO: 149338 - RNA, 19 nt, Homo sapiens
ggaaaugcagaaccugagu

SEQ ID NO: 149339 - RNA, 19 nt, Homo sapiens
caaccuuugccacugauga

SEQ ID NO: 149340 - RNA, 19 nt, Homo sapiens
agugauagcgauucagauu

SEQ ID NO: 149341 - RNA, 19 nt, Homo sapiens
ggugcuaacuuugaguaca

SEQ ID NO: 149342 - RNA, 19 nt, Homo sapiens
gaguacaucaucgcagaaa

SEQ ID NO: 149343 - RNA, 19 nt, Homo sapiens
gagacucacccgugcuguu

SEQ ID NO: 149344 - RNA, 19 nt, Homo sapiens
ggugagaaggcccaguuug

SEQ ID NO: 149345 - RNA, 19 nt, Homo sapiens
aagugcagccugucaguuu

SEQ ID NO: 149346 - RNA, 19 nt, Homo sapiens
ccaaagaaucagugaaugc

SEQ ID NO: 149347 - RNA, 19 nt, Homo sapiens
ugugugauaucaucuaugc

SEQ ID NO: 149348 - RNA, 19 nt, Homo sapiens
uaacuuugaguacaucauc

SEQ ID NO: 149349 - RNA, 19 nt, Homo sapiens
ccacugaugaccggaaaga

SEQ ID NO: 149350 - RNA, 19 nt, Homo sapiens
gcaagauuuguccuguuga

SEQ ID NO: 149351 - RNA, 19 nt, Homo sapiens
ugucaauggcuaugccuuu

SEQ ID NO: 149352 - RNA, 19 nt, Homo sapiens
cuucaaagaccagugagaa

SEQ ID NO: 149353 - RNA, 19 nt, Homo sapiens
auucaaccuuugccacuga

SEQ ID NO: 149354 - RNA, 19 nt, Homo sapiens
cagaaggaaguaaguugga

SEQ ID NO: 149355 - RNA, 19 nt, Homo sapiens
ggucaagaagccagucauc

SEQ ID NO: 149356 - RNA, 19 nt, Homo sapiens
cuucacaccucugcuugga

SEQ ID NO: 149357 - RNA, 19 nt, Homo sapiens
aaucagugaaugcagcuuu

SEQ ID NO: 149358 - RNA, 19 nt, Homo sapiens
gccauccagugugcagaaa

SEQ ID NO: 149359 - RNA, 19 nt, Homo sapiens
ccucgggugcuaacuuuga

SEQ ID NO: 149360 - RNA, 19 nt, Homo sapiens
acuuugcgauggccugauu

SEQ ID NO: 149361 - RNA, 19 nt, Homo sapiens
uagaagcaaguaaaucauc

SEQ ID NO: 149362 - RNA, 19 nt, Homo sapiens
caaagaccagugagaacca

SEQ ID NO: 149363 - RNA, 19 nt, Homo sapiens
gacuguuacuccagcaagu

SEQ ID NO: 149364 - RNA, 19 nt, Homo sapiens
agacucacccgugcuguug

SEQ ID NO: 149365 - RNA, 19 nt, Homo sapiens
caucuaugccggugagaag

SEQ ID NO: 149366 - RNA, 19 nt, Homo sapiens
guagcgauggccaaagaau

SEQ ID NO: 149367 - RNA, 19 nt, Homo sapiens
ggagcugauaucaaggaaa

SEQ ID NO: 149368 - RNA, 19 nt, Homo sapiens
caagugcagccugucaguu

SEQ ID NO: 149369 - RNA, 19 nt, Homo sapiens
gaacguggcucuagugucu

SEQ ID NO: 149370 - RNA, 19 nt, Homo sapiens
cuaaacaccucuuggauuu

SEQ ID NO: 149371 - RNA, 19 nt, Homo sapiens
gaacacucauuacacuaaa

SEQ ID NO: 149372 - RNA, 19 nt, Homo sapiens
gaggagaaauuaaccuuca

SEQ ID NO: 149373 - RNA, 19 nt, Homo sapiens
gaaccugaguccuggaaug

SEQ ID NO: 149374 - RNA, 19 nt, Homo sapiens
aggauacccuugacaaaua

SEQ ID NO: 149375 - RNA, 19 nt, Homo sapiens
aaccaaaucugccuuccua

SEQ ID NO: 149376 - RNA, 19 nt, Homo sapiens
ccagagcacuuucaagaag

SEQ ID NO: 149377 - RNA, 19 nt, Homo sapiens
gugcagaggaggagaaauu

SEQ ID NO: 149378 - RNA, 19 nt, Homo sapiens
ucaccaagcauaaacauau

SEQ ID NO: 149379 - RNA, 19 nt, Homo sapiens
cgggacaucuugaccauug

SEQ ID NO: 149380 - RNA, 19 nt, Homo sapiens
gauauuuccucgggucuug

SEQ ID NO: 149381 - RNA, 19 nt, Homo sapiens
gaacaggucaacugcuuca

SEQ ID NO: 149382 - RNA, 19 nt, Homo sapiens
gaagacccaccaccacuug

SEQ ID NO: 149383 - RNA, 19 nt, Homo sapiens
ggccagagcacuuucaaga

SEQ ID NO: 149384 - RNA, 19 nt, Homo sapiens
gcagaggaggagaaauuaa

SEQ ID NO: 149385 - RNA, 19 nt, Homo sapiens
gggcugauccacaacauga

SEQ ID NO: 149386 - RNA, 19 nt, Homo sapiens
ggaggauacccuugacaaa

SEQ ID NO: 149387 - RNA, 19 nt, Homo sapiens
aaucacaccuguacaugga

SEQ ID NO: 149388 - RNA, 19 nt, Homo sapiens
caccaagcauaaacauauu

SEQ ID NO: 149389 - RNA, 19 nt, Homo sapiens
gaggauacccuugacaaau

SEQ ID NO: 149390 - RNA, 19 nt, Homo sapiens
cagcauggcccucccuuug

SEQ ID NO: 149391 - RNA, 19 nt, Homo sapiens
ugaacacucauuacacuaa

SEQ ID NO: 149392 - RNA, 19 nt, Homo sapiens
ucaauuaucugaggaacgu

SEQ ID NO: 149393 - RNA, 19 nt, Homo sapiens
cauccagacuugccugaga

SEQ ID NO: 149394 - RNA, 19 nt, Homo sapiens
aaagaguucucaccaagca

SEQ ID NO: 149395 - RNA, 19 nt, Homo sapiens
ggaacaaucacaccuguac

SEQ ID NO: 149396 - RNA, 19 nt, Homo sapiens
ccacgcaaccugccagcua

SEQ ID NO: 149397 - RNA, 19 nt, Homo sapiens
caggucaacugcuucaaca

SEQ ID NO: 149398 - RNA, 19 nt, Homo sapiens
ggauacccuugacaaauac

SEQ ID NO: 149399 - RNA, 19 nt, Homo sapiens
uggaaggccugggaggaua

SEQ ID NO: 149400 - RNA, 19 nt, Homo sapiens
gucaacugcuucaacauca

SEQ ID NO: 149401 - RNA, 19 nt, Homo sapiens
aaacaccucuuggauuugg

SEQ ID NO: 149402 - RNA, 19 nt, Homo sapiens
gacaauaucaagaacaucu

SEQ ID NO: 149403 - RNA, 19 nt, Homo sapiens
gcuucaacaucaauuaucu

SEQ ID NO: 149404 - RNA, 19 nt, Homo sapiens
gcauggcccucccuuugag

SEQ ID NO: 149405 - RNA, 19 nt, Homo sapiens
gagaaauuaaccuucauca

SEQ ID NO: 149406 - RNA, 19 nt, Homo sapiens
ccuagagugugccaaacuu

SEQ ID NO: 149407 - RNA, 19 nt, Homo sapiens
gaccagagccauccagaac

SEQ ID NO: 149408 - RNA, 19 nt, Homo sapiens
ggaccagagccauccagaa

SEQ ID NO: 149409 - RNA, 19 nt, Homo sapiens
gggaugaacaggucaacug

SEQ ID NO: 149410 - RNA, 19 nt, Homo sapiens
ggucaacugcuucaacauc

SEQ ID NO: 149411 - RNA, 19 nt, Homo sapiens
gggaggauacccuugacaa

SEQ ID NO: 149412 - RNA, 19 nt, Homo sapiens
gcugugaccugccauuucc

SEQ ID NO: 149413 - RNA, 19 nt, Homo sapiens
cagagcagccuuggucuug

SEQ ID NO: 149414 - RNA, 19 nt, Homo sapiens
gaacaaucacaccuguaca

SEQ ID NO: 149415 - RNA, 19 nt, Homo sapiens
gaacgccagcuccauuugg

SEQ ID NO: 149416 - RNA, 19 nt, Homo sapiens
ggaacgccagcuccauuug

SEQ ID NO: 149417 - RNA, 19 nt, Homo sapiens
acacuaaacaccucuugga

SEQ ID NO: 149418 - RNA, 19 nt, Homo sapiens
ggagaaauuaaccuucauc

SEQ ID NO: 149419 - RNA, 19 nt, Homo sapiens
gcugcuaccugcccaacuc

SEQ ID NO: 149420 - RNA, 19 nt, Homo sapiens
agaguucucaccaagcaua

SEQ ID NO: 149421 - RNA, 19 nt, Homo sapiens
gcaaccugccagcuacuga

SEQ ID NO: 149422 - RNA, 19 nt, Homo sapiens
acuaaacaccucuuggauu

SEQ ID NO: 149423 - RNA, 19 nt, Homo sapiens
ugaggaacguggcucuagu

SEQ ID NO: 149424 - RNA, 19 nt, Homo sapiens
cuauuuggcuguugcuucu

SEQ ID NO: 149425 - RNA, 19 nt, Homo sapiens
gccagagcacuuucaagaa

SEQ ID NO: 149426 - RNA, 19 nt, Homo sapiens
gaccugccauuuccagaac

SEQ ID NO: 149427 - RNA, 19 nt, Homo sapiens
acccugcccucugcuguua

SEQ ID NO: 149428 - RNA, 19 nt, Homo sapiens
gagcagccuuggucuugac

SEQ ID NO: 149429 - RNA, 19 nt, Homo sapiens
gaagcaaugagccgauucu

SEQ ID NO: 149430 - RNA, 19 nt, Homo sapiens
gcccaacucccugcugaaa

SEQ ID NO: 149431 - RNA, 19 nt, Homo sapiens
ucaacugcuucaacaucaa

SEQ ID NO: 149432 - RNA, 19 nt, Homo sapiens
ggaaaccaaagaguucuca

SEQ ID NO: 149433 - RNA, 19 nt, Homo sapiens
gggacaucuugaccauuga

SEQ ID NO: 149434 - RNA, 19 nt, Homo sapiens
gaccgggaguaugcuguga

SEQ ID NO: 149435 - RNA, 19 nt, Homo sapiens
gcugaggccagagcacuuu

SEQ ID NO: 149436 - RNA, 19 nt, Homo sapiens
uggacaauaucaagaacau

SEQ ID NO: 149437 - RNA, 19 nt, Homo sapiens
ccacacaaaccgccuagag

SEQ ID NO: 149438 - RNA, 19 nt, Homo sapiens
gucagcaugugguauaugg

SEQ ID NO: 149439 - RNA, 19 nt, Homo sapiens
cguaacagccaccagacaa

SEQ ID NO: 149440 - RNA, 19 nt, Homo sapiens
gaggaacguggcucuagug

SEQ ID NO: 149441 - RNA, 19 nt, Homo sapiens
caacugcuucaacaucaau

SEQ ID NO: 149442 - RNA, 19 nt, Homo sapiens
caaugagccgauucuguga

SEQ ID NO: 149443 - RNA, 19 nt, Homo sapiens
augaacaggucaacugcuu

SEQ ID NO: 149444 - RNA, 19 nt, Homo sapiens
gggaacaaucacaccugua

SEQ ID NO: 149445 - RNA, 19 nt, Homo sapiens
ccucugcuguuaccugagu

SEQ ID NO: 149446 - RNA, 19 nt, Homo sapiens
gggagcugcuggcacugau

SEQ ID NO: 149447 - RNA, 19 nt, Homo sapiens
gaaggaacgccagcuccau

SEQ ID NO: 149448 - RNA, 19 nt, Homo sapiens
ccucaugggccaccucugu

SEQ ID NO: 149449 - RNA, 19 nt, Homo sapiens
caucuugaccauugacauc

SEQ ID NO: 149450 - RNA, 19 nt, Homo sapiens
gggaguaugcugugaagac

SEQ ID NO: 149451 - RNA, 19 nt, Homo sapiens
ccagagccauccagaaccu

SEQ ID NO: 149452 - RNA, 19 nt, Homo sapiens
ugaccugccauuuccagaa

SEQ ID NO: 149453 - RNA, 19 nt, Homo sapiens
cagaggaggagaaauuaac

SEQ ID NO: 149454 - RNA, 19 nt, Homo sapiens
ugcagaggaggagaaauua

SEQ ID NO: 149455 - RNA, 19 nt, Homo sapiens
ugaagacccaccaccacuu

SEQ ID NO: 149456 - RNA, 19 nt, Homo sapiens
ggaagcaaugagccgauuc

SEQ ID NO: 149457 - RNA, 19 nt, Homo sapiens
aaggaacgccagcuccauu

SEQ ID NO: 149458 - RNA, 19 nt, Homo sapiens
uuccugggcugauccacaa

SEQ ID NO: 149459 - RNA, 19 nt, Homo sapiens
ccaaaucugccuuccuaac

SEQ ID NO: 149460 - RNA, 19 nt, Homo sapiens
gacaaucugaaccaaaucu

SEQ ID NO: 149461 - RNA, 19 nt, Homo sapiens
guaacagccaccagacaag

SEQ ID NO: 149462 - RNA, 19 nt, Homo sapiens
accaaagaguucucaccaa

SEQ ID NO: 149463 - RNA, 19 nt, Homo sapiens
ccaacucccugcugaaaag

SEQ ID NO: 149464 - RNA, 19 nt, Homo sapiens
agagcagccuuggucuuga

SEQ ID NO: 149465 - RNA, 19 nt, Homo sapiens
gaacguggcucuagugucu

SEQ ID NO: 149466 - RNA, 19 nt, Homo sapiens
cuaaacaccucuuggauuu

SEQ ID NO: 149467 - RNA, 19 nt, Homo sapiens
gaacacucauuacacuaaa

SEQ ID NO: 149468 - RNA, 19 nt, Homo sapiens
gaggagaaauuaaccuuca

SEQ ID NO: 149469 - RNA, 19 nt, Homo sapiens
gaaccugaguccuggaaug

SEQ ID NO: 149470 - RNA, 19 nt, Homo sapiens
aggauacccuugacaaaua

SEQ ID NO: 149471 - RNA, 19 nt, Homo sapiens
aaccaaaucugccuuccua

SEQ ID NO: 149472 - RNA, 19 nt, Homo sapiens
ccagagcacuuucaagaag

SEQ ID NO: 149473 - RNA, 19 nt, Homo sapiens
gugcagaggaggagaaauu

SEQ ID NO: 149474 - RNA, 19 nt, Homo sapiens
ucaccaagcauaaacauau

SEQ ID NO: 149475 - RNA, 19 nt, Homo sapiens
cgggacaucuugaccauug

SEQ ID NO: 149476 - RNA, 19 nt, Homo sapiens
gaacaggucaacugcuuca

SEQ ID NO: 149477 - RNA, 19 nt, Homo sapiens
gaagacccaccaccacuug

SEQ ID NO: 149478 - RNA, 19 nt, Homo sapiens
aaacuugugugggaggaua

SEQ ID NO: 149479 - RNA, 19 nt, Homo sapiens
ggccagagcacuuucaaga

SEQ ID NO: 149480 - RNA, 19 nt, Homo sapiens
gcagaggaggagaaauuaa

SEQ ID NO: 149481 - RNA, 19 nt, Homo sapiens
gggcugauccacaacauga

SEQ ID NO: 149482 - RNA, 19 nt, Homo sapiens
ggaggauacccuugacaaa

SEQ ID NO: 149483 - RNA, 19 nt, Homo sapiens
caccaagcauaaacauauu

SEQ ID NO: 149484 - RNA, 19 nt, Homo sapiens
gaggauacccuugacaaau

SEQ ID NO: 149485 - RNA, 19 nt, Homo sapiens
cagcauggcccucccuuug

SEQ ID NO: 149486 - RNA, 19 nt, Homo sapiens
ugaacacucauuacacuaa

SEQ ID NO: 149487 - RNA, 19 nt, Homo sapiens
ucaauuaucugaggaacgu

SEQ ID NO: 149488 - RNA, 19 nt, Homo sapiens
cauccagacuugccugaga

SEQ ID NO: 149489 - RNA, 19 nt, Homo sapiens
aaagaguucucaccaagca

SEQ ID NO: 149490 - RNA, 19 nt, Homo sapiens
caggucaacugcuucaaca

SEQ ID NO: 149491 - RNA, 19 nt, Homo sapiens
ggauacccuugacaaauac

SEQ ID NO: 149492 - RNA, 19 nt, Homo sapiens
gucaacugcuucaacauca

SEQ ID NO: 149493 - RNA, 19 nt, Homo sapiens
aaacaccucuuggauuugg

SEQ ID NO: 149494 - RNA, 19 nt, Homo sapiens
gcuucaacaucaauuaucu

SEQ ID NO: 149495 - RNA, 19 nt, Homo sapiens
gcauggcccucccuuugag

SEQ ID NO: 149496 - RNA, 19 nt, Homo sapiens
gagaaauuaaccuucauca

SEQ ID NO: 149497 - RNA, 19 nt, Homo sapiens
ccuagagugugccaaacuu

SEQ ID NO: 149498 - RNA, 19 nt, Homo sapiens
gaccagagccauccagaac

SEQ ID NO: 149499 - RNA, 19 nt, Homo sapiens
ggaccagagccauccagaa

SEQ ID NO: 149500 - RNA, 19 nt, Homo sapiens
gggaugaacaggucaacug

SEQ ID NO: 149501 - RNA, 19 nt, Homo sapiens
ggucaacugcuucaacauc

SEQ ID NO: 149502 - RNA, 19 nt, Homo sapiens
gggaggauacccuugacaa

SEQ ID NO: 149503 - RNA, 19 nt, Homo sapiens
gcugugaccugccauuucc

SEQ ID NO: 149504 - RNA, 19 nt, Homo sapiens
cagagcagccuuggucuug

SEQ ID NO: 149505 - RNA, 19 nt, Homo sapiens
gaacgccagcuccauuugg

SEQ ID NO: 149506 - RNA, 19 nt, Homo sapiens
ggaacgccagcuccauuug

SEQ ID NO: 149507 - RNA, 19 nt, Homo sapiens
acacuaaacaccucuugga

SEQ ID NO: 149508 - RNA, 19 nt, Homo sapiens
ggagaaauuaaccuucauc

SEQ ID NO: 149509 - RNA, 19 nt, Homo sapiens
gcugcuaccugcccaacuc

SEQ ID NO: 149510 - RNA, 19 nt, Homo sapiens
agaguucucaccaagcaua

SEQ ID NO: 149511 - RNA, 19 nt, Homo sapiens
acuaaacaccucuuggauu

SEQ ID NO: 149512 - RNA, 19 nt, Homo sapiens
ugaggaacguggcucuagu

SEQ ID NO: 149513 - RNA, 19 nt, Homo sapiens
gccagagcacuuucaagaa

SEQ ID NO: 149514 - RNA, 19 nt, Homo sapiens
cuauuuggcuguugcuucu

SEQ ID NO: 149515 - RNA, 19 nt, Homo sapiens
gaccugccauuuccagaac

SEQ ID NO: 149516 - RNA, 19 nt, Homo sapiens
acccugcccucugcuguua

SEQ ID NO: 149517 - RNA, 19 nt, Homo sapiens
gagcagccuuggucuugac

SEQ ID NO: 149518 - RNA, 19 nt, Homo sapiens
gcccaacucccugcugaaa

SEQ ID NO: 149519 - RNA, 19 nt, Homo sapiens
gcugaggccagagcacuuu

SEQ ID NO: 149520 - RNA, 19 nt, Homo sapiens
ucaacugcuucaacaucaa

SEQ ID NO: 149521 - RNA, 19 nt, Homo sapiens
ggaaaccaaagaguucuca

SEQ ID NO: 149522 - RNA, 19 nt, Homo sapiens
gggacaucuugaccauuga

SEQ ID NO: 149523 - RNA, 19 nt, Homo sapiens
gaccgggaguaugcuguga

SEQ ID NO: 149524 - RNA, 19 nt, Homo sapiens
ccacacaaaccgccuagag

SEQ ID NO: 149525 - RNA, 19 nt, Homo sapiens
gucagcaugugguauaugg

SEQ ID NO: 149526 - RNA, 19 nt, Homo sapiens
cguaacagccaccagacaa

SEQ ID NO: 149527 - RNA, 19 nt, Homo sapiens
gaggaacguggcucuagug

SEQ ID NO: 149528 - RNA, 19 nt, Homo sapiens
caacugcuucaacaucaau

SEQ ID NO: 149529 - RNA, 19 nt, Homo sapiens
augaacaggucaacugcuu

SEQ ID NO: 149530 - RNA, 19 nt, Homo sapiens
ccucugcuguuaccugagu

SEQ ID NO: 149531 - RNA, 19 nt, Homo sapiens
gaaggaacgccagcuccau

SEQ ID NO: 149532 - RNA, 19 nt, Homo sapiens
ccucaugggccaccucugu

SEQ ID NO: 149533 - RNA, 19 nt, Homo sapiens
caucuugaccauugacauc

SEQ ID NO: 149534 - RNA, 19 nt, Homo sapiens
gggaguaugcugugaagac

SEQ ID NO: 149535 - RNA, 19 nt, Homo sapiens
ccagagccauccagaaccu

SEQ ID NO: 149536 - RNA, 19 nt, Homo sapiens
ugaccugccauuuccagaa

SEQ ID NO: 149537 - RNA, 19 nt, Homo sapiens
cagaggaggagaaauuaac

SEQ ID NO: 149538 - RNA, 19 nt, Homo sapiens
ugcagaggaggagaaauua

SEQ ID NO: 149539 - RNA, 19 nt, Homo sapiens
ugaagacccaccaccacuu

SEQ ID NO: 149540 - RNA, 19 nt, Homo sapiens
uuccugggcugauccacaa

SEQ ID NO: 149541 - RNA, 19 nt, Homo sapiens
ccaaaucugccuuccuaac

SEQ ID NO: 149542 - RNA, 19 nt, Homo sapiens
gacaaucugaaccaaaucu

SEQ ID NO: 149543 - RNA, 19 nt, Homo sapiens
aaggaacgccagcuccauu

SEQ ID NO: 149544 - RNA, 19 nt, Homo sapiens
guaacagccaccagacaag

SEQ ID NO: 149545 - RNA, 19 nt, Homo sapiens
ccaacucccugcugaaaag

SEQ ID NO: 149546 - RNA, 19 nt, Homo sapiens
accaaagaguucucaccaa

SEQ ID NO: 149547 - RNA, 19 nt, Homo sapiens
agagcagccuuggucuuga

SEQ ID NO: 149548 - RNA, 19 nt, Homo sapiens
gaaacugacuuaaauggua

SEQ ID NO: 149549 - RNA, 19 nt, Homo sapiens
gauaaaggaugaucuugaa

SEQ ID NO: 149550 - RNA, 19 nt, Homo sapiens
gcacucaccuuguaguuga

SEQ ID NO: 149551 - RNA, 19 nt, Homo sapiens
caaaugugcuacucaguuu

SEQ ID NO: 149552 - RNA, 19 nt, Homo sapiens
ggaagaauuugaagguuug

SEQ ID NO: 149553 - RNA, 19 nt, Homo sapiens
caacagagcaggcaaaugu

SEQ ID NO: 149554 - RNA, 19 nt, Homo sapiens
gaagagaugccucagauug

SEQ ID NO: 149555 - RNA, 19 nt, Homo sapiens
gaagggcucuuaugacauc

SEQ ID NO: 149556 - RNA, 19 nt, Homo sapiens
cagaggagauuaagacuau

SEQ ID NO: 149557 - RNA, 19 nt, Homo sapiens
ucacauggguggaguuauu

SEQ ID NO: 149558 - RNA, 19 nt, Homo sapiens
ggaaugaacaggauuucua

SEQ ID NO: 149559 - RNA, 19 nt, Homo sapiens
gacagaagauugccauaau

SEQ ID NO: 149560 - RNA, 19 nt, Homo sapiens
guacaaguaugaugaaucu

SEQ ID NO: 149561 - RNA, 19 nt, Homo sapiens
guagauggaugcccagcua

SEQ ID NO: 149562 - RNA, 19 nt, Homo sapiens
acagaaagauugagaaaca

SEQ ID NO: 149563 - RNA, 19 nt, Homo sapiens
acacuaagauaaaggauga

SEQ ID NO: 149564 - RNA, 19 nt, Homo sapiens
gaugaaaacuugcauagaa

SEQ ID NO: 149565 - RNA, 19 nt, Homo sapiens
ugacagaggagaacaagua

SEQ ID NO: 149566 - RNA, 19 nt, Homo sapiens
guugaugacuuuagaaaug

SEQ ID NO: 149567 - RNA, 19 nt, Homo sapiens
gagagaguacgguauauuu

SEQ ID NO: 149568 - RNA, 19 nt, Homo sapiens
aaggagaagucauacguua

SEQ ID NO: 149569 - RNA, 19 nt, Homo sapiens
ggacagaaagauugagaaa

SEQ ID NO: 149570 - RNA, 19 nt, Homo sapiens
gauaaggacagaaagauug

SEQ ID NO: 149571 - RNA, 19 nt, Homo sapiens
gaaggaagauaaauaacac

SEQ ID NO: 149572 - RNA, 19 nt, Homo sapiens
cauuugauaugaagcguua

SEQ ID NO: 149573 - RNA, 19 nt, Homo sapiens
ggcaacaauuauucaguua

SEQ ID NO: 149574 - RNA, 19 nt, Homo sapiens
agaaaugacugaaaugcaa

SEQ ID NO: 149575 - RNA, 19 nt, Homo sapiens
guacuaugcuuuacuggau

SEQ ID NO: 149576 - RNA, 19 nt, Homo sapiens
uuacugagauuuccaagga

SEQ ID NO: 149577 - RNA, 19 nt, Homo sapiens
gauaguguguggaauuuua

SEQ ID NO: 149578 - RNA, 19 nt, Homo sapiens
gcaaaugugcuacucaguu

SEQ ID NO: 149579 - RNA, 19 nt, Homo sapiens
gaaaugagcaaggaaacaa

SEQ ID NO: 149580 - RNA, 19 nt, Homo sapiens
guaauuagcacuuggugaa

SEQ ID NO: 149581 - RNA, 19 nt, Homo sapiens
aaaccaagauuucaugcuu

SEQ ID NO: 149582 - RNA, 19 nt, Homo sapiens
uaacagcaaucgcaaacga

SEQ ID NO: 149583 - RNA, 19 nt, Homo sapiens
ccagaauccuuugaaguaa

SEQ ID NO: 149584 - RNA, 19 nt, Homo sapiens
gcagagccuuguugaacuu

SEQ ID NO: 149585 - RNA, 19 nt, Homo sapiens
gaccaccaguuguauuaaa

SEQ ID NO: 149586 - RNA, 19 nt, Homo sapiens
gauuugcccucauuaacaa

SEQ ID NO: 149587 - RNA, 19 nt, Homo sapiens
ggaaggaagauaaauaaca

SEQ ID NO: 149588 - RNA, 19 nt, Homo sapiens
guaaugagucgucuuucua

SEQ ID NO: 149589 - RNA, 19 nt, Homo sapiens
uaagagagacagaagauug

SEQ ID NO: 149590 - RNA, 19 nt, Homo sapiens
acaccagagucuagcauua

SEQ ID NO: 149591 - RNA, 19 nt, Homo sapiens
ucugugaaaugcauagaua

SEQ ID NO: 149592 - RNA, 19 nt, Homo sapiens
gauaugaagcguuaccaaa

SEQ ID NO: 149593 - RNA, 19 nt, Homo sapiens
gcauacagcugaugaaaau

SEQ ID NO: 149594 - RNA, 19 nt, Homo sapiens
gugcugauuuagaagaaua

SEQ ID NO: 149595 - RNA, 19 nt, Homo sapiens
gauguacacacuaagauaa

SEQ ID NO: 149596 - RNA, 19 nt, Homo sapiens
ccagauaucuuugauguac

SEQ ID NO: 149597 - RNA, 19 nt, Homo sapiens
ugacuuaaaugguacuugu

SEQ ID NO: 149598 - RNA, 19 nt, Homo sapiens
aaagaaaacuggcuaaaga

SEQ ID NO: 149599 - RNA, 19 nt, Homo sapiens
gaagguauuggacauaaga

SEQ ID NO: 149600 - RNA, 19 nt, Homo sapiens
uaaaguuccuccauuucaa

SEQ ID NO: 149601 - RNA, 19 nt, Homo sapiens
aagaagaacuagucagguu

SEQ ID NO: 149602 - RNA, 19 nt, Homo sapiens
ggagucaguggaagaauuu

SEQ ID NO: 149603 - RNA, 19 nt, Homo sapiens
ccacuccuuucacaguuua

SEQ ID NO: 149604 - RNA, 19 nt, Homo sapiens
uaaauaaccacuccuuuca

SEQ ID NO: 149605 - RNA, 19 nt, Homo sapiens
gauauggacaguacauuga

SEQ ID NO: 149606 - RNA, 19 nt, Homo sapiens
gaagauugccauaaugcuu

SEQ ID NO: 149607 - RNA, 19 nt, Homo sapiens
aagaugcacucaccuugua

SEQ ID NO: 149608 - RNA, 19 nt, Homo sapiens
gaaacaagagugauauugg

SEQ ID NO: 149609 - RNA, 19 nt, Homo sapiens
gaaaggagaagucauacgu

SEQ ID NO: 149610 - RNA, 19 nt, Homo sapiens
cuacucaguuuccagauga

SEQ ID NO: 149611 - RNA, 19 nt, Homo sapiens
guaacucucuuccucuuca

SEQ ID NO: 149612 - RNA, 19 nt, Homo sapiens
ugucaaugcuuucucuaaa

SEQ ID NO: 149613 - RNA, 19 nt, Homo sapiens
gaaacuuuauguugucaag

SEQ ID NO: 149614 - RNA, 19 nt, Homo sapiens
ggauuucuaugcagcaguu

SEQ ID NO: 149615 - RNA, 19 nt, Homo sapiens
gaaugaacaggauuucuau

SEQ ID NO: 149616 - RNA, 19 nt, Homo sapiens
uggaagaauuugaagguuu

SEQ ID NO: 149617 - RNA, 19 nt, Homo sapiens
gagaguacgguauauuuau

SEQ ID NO: 149618 - RNA, 19 nt, Homo sapiens
gaaagauugagaaacauug

SEQ ID NO: 149619 - RNA, 19 nt, Homo sapiens
gcuggaaggaagauaaaua

SEQ ID NO: 149620 - RNA, 19 nt, Homo sapiens
gaagucauacguuaaguag

SEQ ID NO: 149621 - RNA, 19 nt, Homo sapiens
cagaauggauuuauaaagc

SEQ ID NO: 149622 - RNA, 19 nt, Homo sapiens
ucaagaagcuggaaaacaa

SEQ ID NO: 149623 - RNA, 19 nt, Homo sapiens
ucagagagaguacgguaua

SEQ ID NO: 149624 - RNA, 19 nt, Homo sapiens
caagauguuuguagcuguu

SEQ ID NO: 149625 - RNA, 19 nt, Homo sapiens
gacaguacauugaguagag

SEQ ID NO: 149626 - RNA, 19 nt, Homo sapiens
cagaauccuuugaaguaaa

SEQ ID NO: 149627 - RNA, 19 nt, Homo sapiens
gagcaaggaaacaauuauu

SEQ ID NO: 149628 - RNA, 19 nt, Homo sapiens
ucagcaagguggcaaguug

SEQ ID NO: 149629 - RNA, 19 nt, Homo sapiens
gaucuucccuuugaaccuu

SEQ ID NO: 149630 - RNA, 19 nt, Homo sapiens
uggaagaaaugacugaaau

SEQ ID NO: 149631 - RNA, 19 nt, Homo sapiens
gaaguugccaucaguuuua

SEQ ID NO: 149632 - RNA, 19 nt, Homo sapiens
uugcaacccugauagagua

SEQ ID NO: 149633 - RNA, 19 nt, Homo sapiens
uagcuaacaccauuuguaa

SEQ ID NO: 149634 - RNA, 19 nt, Homo sapiens
gaugcugugucgacaugua

SEQ ID NO: 149635 - RNA, 19 nt, Homo sapiens
ccacuccaguuccuucaaa

SEQ ID NO: 149636 - RNA, 19 nt, Homo sapiens
gcucagcuuucaagagaga

SEQ ID NO: 149637 - RNA, 19 nt, Homo sapiens
aagaagagaugccucagau

SEQ ID NO: 149638 - RNA, 19 nt, Homo sapiens
gauugaaacaagagugaua

SEQ ID NO: 149639 - RNA, 19 nt, Homo sapiens
gccuagagauagcaagaaa

SEQ ID NO: 149640 - RNA, 19 nt, Homo sapiens
cuugaagaccuuauaguua

SEQ ID NO: 149641 - RNA, 19 nt, Homo sapiens
gaggagauuaagacuauuu

SEQ ID NO: 149642 - RNA, 19 nt, Homo sapiens
gaagaagagaugccucaga

SEQ ID NO: 149643 - RNA, 19 nt, Homo sapiens
uaaaagauuugcccucauu

SEQ ID NO: 149644 - RNA, 19 nt, Homo sapiens
uuaaauagugggucuguuu

SEQ ID NO: 149645 - RNA, 19 nt, Homo sapiens
aaacaagagugauauuggu

SEQ ID NO: 149646 - RNA, 19 nt, Homo sapiens
gcaaugauaagcauguaau

SEQ ID NO: 149647 - RNA, 19 nt, Homo sapiens
ucgaagggcucuuaugaca

SEQ ID NO: 149648 - RNA, 19 nt, Homo sapiens
gcaaauagauucagagaaa

SEQ ID NO: 149649 - RNA, 19 nt, Homo sapiens
ggaaauagaugugcaguuu

SEQ ID NO: 149650 - RNA, 19 nt, Homo sapiens
gaacagcggguacuuauuu

SEQ ID NO: 149651 - RNA, 19 nt, Homo sapiens
gcaaagcaauuuacugaug

SEQ ID NO: 149652 - RNA, 19 nt, Homo sapiens
cuccaaagcuguuccauua

SEQ ID NO: 149653 - RNA, 19 nt, Homo sapiens
gagagaauguggaaauaga

SEQ ID NO: 149654 - RNA, 19 nt, Homo sapiens
gcaauuuacugaugagaga

SEQ ID NO: 149655 - RNA, 19 nt, Homo sapiens
gaaccacuccuucauguuu

SEQ ID NO: 149656 - RNA, 19 nt, Homo sapiens
gaagaucgccgucaagaug

SEQ ID NO: 149657 - RNA, 19 nt, Homo sapiens
gcaccaaccuccagacuca

SEQ ID NO: 149658 - RNA, 19 nt, Homo sapiens
gaugugcaguuuggaauua

SEQ ID NO: 149659 - RNA, 19 nt, Homo sapiens
gcagagaccauaagagaaa

SEQ ID NO: 149660 - RNA, 19 nt, Homo sapiens
ucagagaaauuuagagcua

SEQ ID NO: 149661 - RNA, 19 nt, Homo sapiens
caaagcaauuuacugauga

SEQ ID NO: 149662 - RNA, 19 nt, Homo sapiens
ccacauggccaucuucuuu

SEQ ID NO: 149663 - RNA, 19 nt, Homo sapiens
gcaccuacuucaucuauag

SEQ ID NO: 149664 - RNA, 19 nt, Homo sapiens
caaagaagaaagcugauuu

SEQ ID NO: 149665 - RNA, 19 nt, Homo sapiens
cuacuagugugacuccuua

SEQ ID NO: 149666 - RNA, 19 nt, Homo sapiens
agagaugccugauuucauu

SEQ ID NO: 149667 - RNA, 19 nt, Homo sapiens
gaaguaguauuugccuauu

SEQ ID NO: 149668 - RNA, 19 nt, Homo sapiens
ucagaucuauuguuuguug

SEQ ID NO: 149669 - RNA, 19 nt, Homo sapiens
guugucagaucuauuguuu

SEQ ID NO: 149670 - RNA, 19 nt, Homo sapiens
gaagaaggcaaggcugaua

SEQ ID NO: 149671 - RNA, 19 nt, Homo sapiens
gccauacucugaagaagaa

SEQ ID NO: 149672 - RNA, 19 nt, Homo sapiens
gacuagaacuccugucuuc

SEQ ID NO: 149673 - RNA, 19 nt, Homo sapiens
gggaugaccuccagaaguc

SEQ ID NO: 149674 - RNA, 19 nt, Homo sapiens
ccagaaugaccuugaguua

SEQ ID NO: 149675 - RNA, 19 nt, Homo sapiens
gaagaaaguaggcguguuc

SEQ ID NO: 149676 - RNA, 19 nt, Homo sapiens
gcaaagugcaaagcaauuu

SEQ ID NO: 149677 - RNA, 19 nt, Homo sapiens
caccacagccuucuaaauu

SEQ ID NO: 149678 - RNA, 19 nt, Homo sapiens
cccaacagaucauauggua

SEQ ID NO: 149679 - RNA, 19 nt, Homo sapiens
gaacuccugucuucuuucu

SEQ ID NO: 149680 - RNA, 19 nt, Homo sapiens
ggauguaaguuuguguaaa

SEQ ID NO: 149681 - RNA, 19 nt, Homo sapiens
caaagugcaaagcaauuua

SEQ ID NO: 149682 - RNA, 19 nt, Homo sapiens
gaacuuguggccuuuaugu

SEQ ID NO: 149683 - RNA, 19 nt, Homo sapiens
ccuuagagcucuuguguuc

SEQ ID NO: 149684 - RNA, 19 nt, Homo sapiens
ccaaagcuguuccauuaca

SEQ ID NO: 149685 - RNA, 19 nt, Homo sapiens
cugguuaccuggagaagua

SEQ ID NO: 149686 - RNA, 19 nt, Homo sapiens
gugcaaagcaauuuacuga

SEQ ID NO: 149687 - RNA, 19 nt, Homo sapiens
gaaggcaaggcugauaaua

SEQ ID NO: 149688 - RNA, 19 nt, Homo sapiens
gagcauugcagccuaagaa

SEQ ID NO: 149689 - RNA, 19 nt, Homo sapiens
gcugacaucuccaucaaca

SEQ ID NO: 149690 - RNA, 19 nt, Homo sapiens
gagcagauggcccaguuaa

SEQ ID NO: 149691 - RNA, 19 nt, Homo sapiens
acccagagaugccugauuu

SEQ ID NO: 149692 - RNA, 19 nt, Homo sapiens
aggcaaggcugauaauaug

SEQ ID NO: 149693 - RNA, 19 nt, Homo sapiens
caagaacagcggguacuua

SEQ ID NO: 149694 - RNA, 19 nt, Homo sapiens
gaaguuugcugugcuuugg

SEQ ID NO: 149695 - RNA, 19 nt, Homo sapiens
ugucagaucuauuguuugu

SEQ ID NO: 149696 - RNA, 19 nt, Homo sapiens
gaugagagaauguggaaau

SEQ ID NO: 149697 - RNA, 19 nt, Homo sapiens
gaugaugagggaagcaaua

SEQ ID NO: 149698 - RNA, 19 nt, Homo sapiens
gaugauaaaggaaauagga

SEQ ID NO: 149699 - RNA, 19 nt, Homo sapiens
gaacagccuuagagcucuu

SEQ ID NO: 149700 - RNA, 19 nt, Homo sapiens
cgaggucccuguugucaga

SEQ ID NO: 149701 - RNA, 19 nt, Homo sapiens
ucacugacuuugccagcua

SEQ ID NO: 149702 - RNA, 19 nt, Homo sapiens
ccagauggcccuauugaau

SEQ ID NO: 149703 - RNA, 19 nt, Homo sapiens
ucgagagccuuacuucaaa

SEQ ID NO: 149704 - RNA, 19 nt, Homo sapiens
agaaugaccuugaguuaac

SEQ ID NO: 149705 - RNA, 19 nt, Homo sapiens
gagaaaugccccaguguua

SEQ ID NO: 149706 - RNA, 19 nt, Homo sapiens
uguauuaucuccuuugaag

SEQ ID NO: 149707 - RNA, 19 nt, Homo sapiens
uagcagaaaccaacaagaa

SEQ ID NO: 149708 - RNA, 19 nt, Homo sapiens
ggucagcaauucaagucaa

SEQ ID NO: 149709 - RNA, 19 nt, Homo sapiens
agauggcccuauugaauuu

SEQ ID NO: 149710 - RNA, 19 nt, Homo sapiens
gaaucuuccuggcacaaug

SEQ ID NO: 149711 - RNA, 19 nt, Homo sapiens
ccgcagaccuggagcuuca

SEQ ID NO: 149712 - RNA, 19 nt, Homo sapiens
ggcccuaacuccuauaaag

SEQ ID NO: 149713 - RNA, 19 nt, Homo sapiens
gaaguauacuacaucaacu

SEQ ID NO: 149714 - RNA, 19 nt, Homo sapiens
ggacggcaccuacuucauc

SEQ ID NO: 149715 - RNA, 19 nt, Homo sapiens
gaaauagaugugcaguuug

SEQ ID NO: 149716 - RNA, 19 nt, Homo sapiens
gacccuugauucauucuga

SEQ ID NO: 149717 - RNA, 19 nt, Homo sapiens
ggagggaagaccugaaaga

SEQ ID NO: 149718 - RNA, 19 nt, Homo sapiens
cauguugacugacuuaugg

SEQ ID NO: 149719 - RNA, 19 nt, Homo sapiens
ggguuuacaugaagcagaa

SEQ ID NO: 149720 - RNA, 19 nt, Homo sapiens
cagguggagugcucaauga

SEQ ID NO: 149721 - RNA, 19 nt, Homo sapiens
gaacagcugccugcucuuc

SEQ ID NO: 149722 - RNA, 19 nt, Homo sapiens
ggagcccuauugcugcuaa

SEQ ID NO: 149723 - RNA, 19 nt, Homo sapiens
cuaaagagcauccugauac

SEQ ID NO: 149724 - RNA, 19 nt, Homo sapiens
ggugugucauuucuauauu

SEQ ID NO: 149725 - RNA, 19 nt, Homo sapiens
gaaucuagcccaaccuaca

SEQ ID NO: 149726 - RNA, 19 nt, Homo sapiens
gcagaugacagagguuuga

SEQ ID NO: 149727 - RNA, 19 nt, Homo sapiens
aaauagaugugcaguuugg

SEQ ID NO: 149728 - RNA, 19 nt, Homo sapiens
caccauaccuuagagacuu

SEQ ID NO: 149729 - RNA, 19 nt, Homo sapiens
cagauggcccuauugaauu

SEQ ID NO: 149730 - RNA, 19 nt, Homo sapiens
ccuauugaauuucuucuuc

SEQ ID NO: 149731 - RNA, 19 nt, Homo sapiens
guauauaaacugggaugua

SEQ ID NO: 149732 - RNA, 19 nt, Homo sapiens
gaacaggaaagagcaggaa

SEQ ID NO: 149733 - RNA, 19 nt, Homo sapiens
ggccaagggucagcaauuc

SEQ ID NO: 149734 - RNA, 19 nt, Homo sapiens
gcccagagagggaagauga

SEQ ID NO: 149735 - RNA, 19 nt, Homo sapiens
ggucuagagagaaccaaua

SEQ ID NO: 149736 - RNA, 19 nt, Homo sapiens
ggaauuugaggucuagaga

SEQ ID NO: 149737 - RNA, 19 nt, Homo sapiens
caagaaccacuccuucaug

SEQ ID NO: 149738 - RNA, 19 nt, Homo sapiens
ggagugggaaggagcauug

SEQ ID NO: 149739 - RNA, 19 nt, Homo sapiens
uaacaggacaguugaugga

SEQ ID NO: 149740 - RNA, 19 nt, Homo sapiens
cagaaugaccuugaguuaa

SEQ ID NO: 149741 - RNA, 19 nt, Homo sapiens
cagcauccagugugagaua

SEQ ID NO: 149742 - RNA, 19 nt, Homo sapiens
gcugcagccuucaucagaa

SEQ ID NO: 149743 - RNA, 19 nt, Homo sapiens
uagcuuaccugggcacaga

SEQ ID NO: 149744 - RNA, 19 nt, Homo sapiens
ugaguuaacaggacaguug

SEQ ID NO: 149745 - RNA, 19 nt, Homo sapiens
ucugaacccuccaaaggaa

SEQ ID NO: 149746 - RNA, 19 nt, Homo sapiens
ccacuggacccuugauuca

SEQ ID NO: 149747 - RNA, 19 nt, Homo sapiens
cuuagagacuuugauacua

SEQ ID NO: 149748 - RNA, 19 nt, Homo sapiens
gcacauagcuuuaucaacu

SEQ ID NO: 149749 - RNA, 19 nt, Homo sapiens
gcaaaugagucuaacaaau

SEQ ID NO: 149750 - RNA, 19 nt, Homo sapiens
gagaacagcauuaaacuga

SEQ ID NO: 149751 - RNA, 19 nt, Homo sapiens
caagggagauuucuuagca

SEQ ID NO: 149752 - RNA, 19 nt, Homo sapiens
cggaagcgcucuuuacuug

SEQ ID NO: 149753 - RNA, 19 nt, Homo sapiens
gcacugagccaaaggucua

SEQ ID NO: 149754 - RNA, 19 nt, Homo sapiens
gcaauuaaaccgagagaug

SEQ ID NO: 149755 - RNA, 19 nt, Homo sapiens
gccgaaaucugcauaagga

SEQ ID NO: 149756 - RNA, 19 nt, Homo sapiens
ggaagcccacuuuaucuaa

SEQ ID NO: 149757 - RNA, 19 nt, Homo sapiens
gugcacuucugcuucuuua

SEQ ID NO: 149758 - RNA, 19 nt, Homo sapiens
gaagcgagccguacagauc

SEQ ID NO: 149759 - RNA, 19 nt, Homo sapiens
gaauucagccgcagcaaau

SEQ ID NO: 149760 - RNA, 19 nt, Homo sapiens
cuugugcccuuaagcauua

SEQ ID NO: 149761 - RNA, 19 nt, Homo sapiens
gcaccaaccccaucauuua

SEQ ID NO: 149762 - RNA, 19 nt, Homo sapiens
uaaggaagcccacuuuauc

SEQ ID NO: 149763 - RNA, 19 nt, Homo sapiens
gcauaaggaagcccacuuu

SEQ ID NO: 149764 - RNA, 19 nt, Homo sapiens
gaagcgcucuuuacuuggu

SEQ ID NO: 149765 - RNA, 19 nt, Homo sapiens
uaaguccagcuauucauua

SEQ ID NO: 149766 - RNA, 19 nt, Homo sapiens
ggagaacaucuuugucuug

SEQ ID NO: 149767 - RNA, 19 nt, Homo sapiens
gcaccacggucuucacucu

SEQ ID NO: 149768 - RNA, 19 nt, Homo sapiens
ccaaaggucuagcauuguc

SEQ ID NO: 149769 - RNA, 19 nt, Homo sapiens
ggacaaggagaacagcauu

SEQ ID NO: 149770 - RNA, 19 nt, Homo sapiens
accgagagaugucuuguuu

SEQ ID NO: 149771 - RNA, 19 nt, Homo sapiens
ggaauucagccgcagcaaa

SEQ ID NO: 149772 - RNA, 19 nt, Homo sapiens
cagcuaaccugcucuuguc

SEQ ID NO: 149773 - RNA, 19 nt, Homo sapiens
gaucgaucaucuauagcaa

SEQ ID NO: 149774 - RNA, 19 nt, Homo sapiens
agccaaaggucuagcauug

SEQ ID NO: 149775 - RNA, 19 nt, Homo sapiens
ggagaaacagacaagcaaa

SEQ ID NO: 149776 - RNA, 19 nt, Homo sapiens
gaauuugguugaagucacu

SEQ ID NO: 149777 - RNA, 19 nt, Homo sapiens
gcucaagaccguaauuauc

SEQ ID NO: 149778 - RNA, 19 nt, Homo sapiens
auucucaucugcugcuuua

SEQ ID NO: 149779 - RNA, 19 nt, Homo sapiens
gacaaggagaacagcauua

SEQ ID NO: 149780 - RNA, 19 nt, Homo sapiens
gcccuuaagcauuacuuua

SEQ ID NO: 149781 - RNA, 19 nt, Homo sapiens
cauaaggaagcccacuuua

SEQ ID NO: 149782 - RNA, 19 nt, Homo sapiens
agacucugcuggcaaauuc

SEQ ID NO: 149783 - RNA, 19 nt, Homo sapiens
aaauaugacauccgucuuu

SEQ ID NO: 149784 - RNA, 19 nt, Homo sapiens
ggacaacccagagaccauu

SEQ ID NO: 149785 - RNA, 19 nt, Homo sapiens
gauaucaucguccggcauu

SEQ ID NO: 149786 - RNA, 19 nt, Homo sapiens
gauauuagccaggauccuu

SEQ ID NO: 149787 - RNA, 19 nt, Homo sapiens
cggagacucugcuggcaaa

SEQ ID NO: 149788 - RNA, 19 nt, Homo sapiens
gcaauaacuuccgccucuu

SEQ ID NO: 149789 - RNA, 19 nt, Homo sapiens
ucacaaugcugaaaaugaa

SEQ ID NO: 149790 - RNA, 19 nt, Homo sapiens
ggaagaugaagaugguuug

SEQ ID NO: 149791 - RNA, 19 nt, Homo sapiens
gggaagaugaagaugguuu

SEQ ID NO: 149792 - RNA, 19 nt, Homo sapiens
guccagcuauucauuagau

SEQ ID NO: 149793 - RNA, 19 nt, Homo sapiens
guagggaacgccagaacuu

SEQ ID NO: 149794 - RNA, 19 nt, Homo sapiens
aaccaagggagauuucuua

SEQ ID NO: 149795 - RNA, 19 nt, Homo sapiens
gcuccuaaaggguucauuu

SEQ ID NO: 149796 - RNA, 19 nt, Homo sapiens
gcaaaccaagggagauuuc

SEQ ID NO: 149797 - RNA, 19 nt, Homo sapiens
gcagcaaaucggacaauuc

SEQ ID NO: 149798 - RNA, 19 nt, Homo sapiens
ccacuuuuguugauguuua

SEQ ID NO: 149799 - RNA, 19 nt, Homo sapiens
gaagccgaaaucugcauaa

SEQ ID NO: 149800 - RNA, 19 nt, Homo sapiens
ggaagggaguauguuugug

SEQ ID NO: 149801 - RNA, 19 nt, Homo sapiens
ucaaugaaauguguuacca

SEQ ID NO: 149802 - RNA, 19 nt, Homo sapiens
caagcacuauauccucuuc

SEQ ID NO: 149803 - RNA, 19 nt, Homo sapiens
gggaagggaguauguuugu

SEQ ID NO: 149804 - RNA, 19 nt, Homo sapiens
caaggagaacagcauuaaa

SEQ ID NO: 149805 - RNA, 19 nt, Homo sapiens
acaaggagaacagcauuaa

SEQ ID NO: 149806 - RNA, 19 nt, Homo sapiens
uagcaaaugagucuaacaa

SEQ ID NO: 149807 - RNA, 19 nt, Homo sapiens
ggagaacagcauuaaacug

SEQ ID NO: 149808 - RNA, 19 nt, Homo sapiens
caauuaaaccgagagaugu

SEQ ID NO: 149809 - RNA, 19 nt, Homo sapiens
cguguuaacuuuucuagaa

SEQ ID NO: 149810 - RNA, 19 nt, Homo sapiens
ccgaauggauuaacuuuug

SEQ ID NO: 149811 - RNA, 19 nt, Homo sapiens
ucgaucaucuauagcaaau

SEQ ID NO: 149812 - RNA, 19 nt, Homo sapiens
ggaaacgucaacucuucuu

SEQ ID NO: 149813 - RNA, 19 nt, Homo sapiens
cuggaaacgucaacucuuc

SEQ ID NO: 149814 - RNA, 19 nt, Homo sapiens
gcgggaagggaguauguuu

SEQ ID NO: 149815 - RNA, 19 nt, Homo sapiens
agcauuacuuuaacuggua

SEQ ID NO: 149816 - RNA, 19 nt, Homo sapiens
gugggaagaugaagauggu

SEQ ID NO: 149817 - RNA, 19 nt, Homo sapiens
cauuaugucuucuggaaac

SEQ ID NO: 149818 - RNA, 19 nt, Homo sapiens
gacaacccagagaccauua

SEQ ID NO: 149819 - RNA, 19 nt, Homo sapiens
cacauagcuuuaucaacuu

SEQ ID NO: 149820 - RNA, 19 nt, Homo sapiens
gaagaagucauuuuaugga

SEQ ID NO: 149821 - RNA, 19 nt, Homo sapiens
guauuuguuucaggaagaa

SEQ ID NO: 149822 - RNA, 19 nt, Homo sapiens
gcacuucugcuucuuuagg

SEQ ID NO: 149823 - RNA, 19 nt, Homo sapiens
ggugaagaccugugacauc

SEQ ID NO: 149824 - RNA, 19 nt, Homo sapiens
caacgggagcaauaacuuc

SEQ ID NO: 149825 - RNA, 19 nt, Homo sapiens
cgacccauguacuauuuua

SEQ ID NO: 149826 - RNA, 19 nt, Homo sapiens
ucaggaagaagucauuuua

SEQ ID NO: 149827 - RNA, 19 nt, Homo sapiens
gugaaaaccgaauggauua

SEQ ID NO: 149828 - RNA, 19 nt, Homo sapiens
gagcugggguuguggaaug

SEQ ID NO: 149829 - RNA, 19 nt, Homo sapiens
ggucuagcauugucaagcu

SEQ ID NO: 149830 - RNA, 19 nt, Homo sapiens
gagccaaaggucuagcauu

SEQ ID NO: 149831 - RNA, 19 nt, Homo sapiens
agggagauuucuuagcaaa

SEQ ID NO: 149832 - RNA, 19 nt, Homo sapiens
guccuucgcugaggccaaa

SEQ ID NO: 149833 - RNA, 19 nt, Homo sapiens
gagcuuugaggagauguuu

SEQ ID NO: 149834 - RNA, 19 nt, Homo sapiens
ggucuucacucugcuucug

SEQ ID NO: 149835 - RNA, 19 nt, Homo sapiens
uggagaacaucuuugucuu

SEQ ID NO: 149836 - RNA, 19 nt, Homo sapiens
guagaguuaguuccuguga

SEQ ID NO: 149837 - RNA, 19 nt, Homo sapiens
gaaacgucaacucuucuuc

SEQ ID NO: 149838 - RNA, 19 nt, Homo sapiens
accauuaugucuucuggaa

SEQ ID NO: 149839 - RNA, 19 nt, Homo sapiens
aagaugguuuggaggugua

SEQ ID NO: 149840 - RNA, 19 nt, Homo sapiens
ucuagaauccacccucuug

SEQ ID NO: 149841 - RNA, 19 nt, Homo sapiens
ccaccggaagcgcucuuua

SEQ ID NO: 149842 - RNA, 19 nt, Homo sapiens
gagacucugcuggcaaauu

SEQ ID NO: 149843 - RNA, 19 nt, Homo sapiens
cgccugacguuccgcaaga

SEQ ID NO: 149844 - RNA, 19 nt, Homo sapiens
ugacuuuuguggaucauuu

SEQ ID NO: 149845 - RNA, 19 nt, Homo sapiens
uguauuuguuucaggaaga

SEQ ID NO: 149846 - RNA, 19 nt, Homo sapiens
gauguuuuccuucacuuua

SEQ ID NO: 149847 - RNA, 19 nt, Homo sapiens
gggcaccgcucuucauccu

SEQ ID NO: 149848 - RNA, 19 nt, Homo sapiens
gaaaugagcgccaccuuua

SEQ ID NO: 149849 - RNA, 19 nt, Homo sapiens
gaaagcaucuugccacaga

SEQ ID NO: 149850 - RNA, 19 nt, Homo sapiens
cauagaagaugaagcacua

SEQ ID NO: 149851 - RNA, 19 nt, Homo sapiens
ggauacguuucacuuaaua

SEQ ID NO: 149852 - RNA, 19 nt, Homo sapiens
ggaaauagaaccuagacuu

SEQ ID NO: 149853 - RNA, 19 nt, Homo sapiens
gcaauggaauucaagaaca

SEQ ID NO: 149854 - RNA, 19 nt, Homo sapiens
gaauucaacucugccauga

SEQ ID NO: 149855 - RNA, 19 nt, Homo sapiens
aaacaaugcucuaaucaca

SEQ ID NO: 149856 - RNA, 19 nt, Homo sapiens
ggacuuggaaucacuguuu

SEQ ID NO: 149857 - RNA, 19 nt, Homo sapiens
gaaauagaaccuagacuuc

SEQ ID NO: 149858 - RNA, 19 nt, Homo sapiens
ccaaguacauucuaauuac

SEQ ID NO: 149859 - RNA, 19 nt, Homo sapiens
uuagaaagcaugcauguaa

SEQ ID NO: 149860 - RNA, 19 nt, Homo sapiens
caacucauguacuuaaaca

SEQ ID NO: 149861 - RNA, 19 nt, Homo sapiens
cuacagugacucuuacuua

SEQ ID NO: 149862 - RNA, 19 nt, Homo sapiens
ugacaacccucaucuugau

SEQ ID NO: 149863 - RNA, 19 nt, Homo sapiens
aaggauacguuucacuuaa

SEQ ID NO: 149864 - RNA, 19 nt, Homo sapiens
cuuaaacacuaaccaauga

SEQ ID NO: 149865 - RNA, 19 nt, Homo sapiens
ucucuaugcucacaucuuu

SEQ ID NO: 149866 - RNA, 19 nt, Homo sapiens
gcaaucgagaggcacauua

SEQ ID NO: 149867 - RNA, 19 nt, Homo sapiens
gaaguaaccaccuuuaaaa

SEQ ID NO: 149868 - RNA, 19 nt, Homo sapiens
gaagaugaagcacuauaau

SEQ ID NO: 149869 - RNA, 19 nt, Homo sapiens
aauaaauucuggcuaguug

SEQ ID NO: 149870 - RNA, 19 nt, Homo sapiens
gcgacgugcuggccuauga

SEQ ID NO: 149871 - RNA, 19 nt, Homo sapiens
aaauuugucucccguaguu

SEQ ID NO: 149872 - RNA, 19 nt, Homo sapiens
gccuauauguguauuguau

SEQ ID NO: 149873 - RNA, 19 nt, Homo sapiens
uagcaugacuucgaucuga

SEQ ID NO: 149874 - RNA, 19 nt, Homo sapiens
gaauccacaacuucauuua

SEQ ID NO: 149875 - RNA, 19 nt, Homo sapiens
gcaaacaaugcucuaauca

SEQ ID NO: 149876 - RNA, 19 nt, Homo sapiens
gugcaagucagaauaaauu

SEQ ID NO: 149877 - RNA, 19 nt, Homo sapiens
ggagaaaagucaacucaug

SEQ ID NO: 149878 - RNA, 19 nt, Homo sapiens
gaaccacagugcuucuaca

SEQ ID NO: 149879 - RNA, 19 nt, Homo sapiens
aagcaugcauguaauguau

SEQ ID NO: 149880 - RNA, 19 nt, Homo sapiens
gaacggaaacugagaugag

SEQ ID NO: 149881 - RNA, 19 nt, Homo sapiens
uaauuggagucauacugua

SEQ ID NO: 149882 - RNA, 19 nt, Homo sapiens
gcaugcauguaauguaugu

SEQ ID NO: 149883 - RNA, 19 nt, Homo sapiens
gcauguuugugauggauga

SEQ ID NO: 149884 - RNA, 19 nt, Homo sapiens
gcucacaucuuuggcuaug

SEQ ID NO: 149885 - RNA, 19 nt, Homo sapiens
gagaggcacauuacgguuu

SEQ ID NO: 149886 - RNA, 19 nt, Homo sapiens
cuacuucuaucucauguuc

SEQ ID NO: 149887 - RNA, 19 nt, Homo sapiens
guuuguaucuucaucaugu

SEQ ID NO: 149888 - RNA, 19 nt, Homo sapiens
agaaguaaccaccuuuaaa

SEQ ID NO: 149889 - RNA, 19 nt, Homo sapiens
uaaaggauacguuucacuu

SEQ ID NO: 149890 - RNA, 19 nt, Homo sapiens
gaaauucuuccuucuccuu

SEQ ID NO: 149891 - RNA, 19 nt, Homo sapiens
gaaucgggauaccaugaug

SEQ ID NO: 149892 - RNA, 19 nt, Homo sapiens
aacagggaauguaaguuua

SEQ ID NO: 149893 - RNA, 19 nt, Homo sapiens
acaaugcucuaaucacaau

SEQ ID NO: 149894 - RNA, 19 nt, Homo sapiens
ccagaaguaaccaccuuua

SEQ ID NO: 149895 - RNA, 19 nt, Homo sapiens
aaaggauacguuucacuua

SEQ ID NO: 149896 - RNA, 19 nt, Homo sapiens
ugaagacuguggucauugu

SEQ ID NO: 149897 - RNA, 19 nt, Homo sapiens
cccaaguacauucuaauua

SEQ ID NO: 149898 - RNA, 19 nt, Homo sapiens
aauagaaccuagacuucaa

SEQ ID NO: 149899 - RNA, 19 nt, Homo sapiens
uaucacaacccagaaguaa

SEQ ID NO: 149900 - RNA, 19 nt, Homo sapiens
gaaagcaugcauguaaugu

SEQ ID NO: 149901 - RNA, 19 nt, Homo sapiens
uagaaagcaugcauguaau

SEQ ID NO: 149902 - RNA, 19 nt, Homo sapiens
ccaaugacaguauuuguuc

SEQ ID NO: 149903 - RNA, 19 nt, Homo sapiens
gaaugucucggcauaguuc

SEQ ID NO: 149904 - RNA, 19 nt, Homo sapiens
ggacuauggccaucguuau

SEQ ID NO: 149905 - RNA, 19 nt, Homo sapiens
cccauguuguuaacuauuu

SEQ ID NO: 149906 - RNA, 19 nt, Homo sapiens
guacuuaaacacuaaccaa

SEQ ID NO: 149907 - RNA, 19 nt, Homo sapiens
aaacugagaugaggaacca

SEQ ID NO: 149908 - RNA, 19 nt, Homo sapiens
ccagaggacuaugagaaug

SEQ ID NO: 149909 - RNA, 19 nt, Homo sapiens
uaaccgaaguggaaagcau

SEQ ID NO: 149910 - RNA, 19 nt, Homo sapiens
cagaaguaaccaccuuuaa

SEQ ID NO: 149911 - RNA, 19 nt, Homo sapiens
uggaaucacuguuuguauc

SEQ ID NO: 149912 - RNA, 19 nt, Homo sapiens
cgaguccauugccuucuuu

SEQ ID NO: 149913 - RNA, 19 nt, Homo sapiens
agaagaugaagcacuauaa

SEQ ID NO: 149914 - RNA, 19 nt, Homo sapiens
ccuaucagcauguuuguga

SEQ ID NO: 149915 - RNA, 19 nt, Homo sapiens
ggaguguccauuuagacua

SEQ ID NO: 149916 - RNA, 19 nt, Homo sapiens
ggaaccagccguccucucu

SEQ ID NO: 149917 - RNA, 19 nt, Homo sapiens
gggauaccaugaugagucu

SEQ ID NO: 149918 - RNA, 19 nt, Homo sapiens
gguaauggugguucucuau

SEQ ID NO: 149919 - RNA, 19 nt, Homo sapiens
uaaauucuggcuaguugaa

SEQ ID NO: 149920 - RNA, 19 nt, Homo sapiens
agaaaugagcgccaccuuu

SEQ ID NO: 149921 - RNA, 19 nt, Homo sapiens
cugcuggacuccuggauug

SEQ ID NO: 149922 - RNA, 19 nt, Homo sapiens
guggucaucuggacuaugg

SEQ ID NO: 149923 - RNA, 19 nt, Homo sapiens
cggcaucuguggccaacuu

SEQ ID NO: 149924 - RNA, 19 nt, Homo sapiens
uagaagaugaagcacuaua

SEQ ID NO: 149925 - RNA, 19 nt, Homo sapiens
cagggaauguaaguuuauu

SEQ ID NO: 149926 - RNA, 19 nt, Homo sapiens
agugugggcuggaacugua

SEQ ID NO: 149927 - RNA, 19 nt, Homo sapiens
gaaucacuguuuguaucuu

SEQ ID NO: 149928 - RNA, 19 nt, Homo sapiens
cuacuuccaucccuguaau

SEQ ID NO: 149929 - RNA, 19 nt, Homo sapiens
ggucaugaagcaaacaaug

SEQ ID NO: 149930 - RNA, 19 nt, Homo sapiens
ucugaagacuguggucauu

SEQ ID NO: 149931 - RNA, 19 nt, Homo sapiens
ggucaugguggcaaucuau

SEQ ID NO: 149932 - RNA, 19 nt, Homo sapiens
ugaaugaaccacagugcuu

SEQ ID NO: 149933 - RNA, 19 nt, Homo sapiens
uaaaguugcagaaauuugg

SEQ ID NO: 149934 - RNA, 19 nt, Homo sapiens
gaguguccauuuagacuac

SEQ ID NO: 149935 - RNA, 19 nt, Homo sapiens
caauggaauucaagaacag

SEQ ID NO: 149936 - RNA, 19 nt, Homo sapiens
uacagugacucuuacuuag

SEQ ID NO: 149937 - RNA, 19 nt, Homo sapiens
gacuuggaaucacuguuug

SEQ ID NO: 149938 - RNA, 19 nt, Homo sapiens
auacccaaguacauucuaa

SEQ ID NO: 149939 - RNA, 19 nt, Homo sapiens
gugacaacccucaucuuga

SEQ ID NO: 149940 - RNA, 19 nt, Homo sapiens
ucaacuuggugaccuuugu

SEQ ID NO: 149941 - RNA, 19 nt, Homo sapiens
ggaaucacuguuuguaucu

SEQ ID NO: 149942 - RNA, 19 nt, Homo sapiens
gaugggacuuggaaucacu

SEQ ID NO: 149943 - RNA, 19 nt, Homo sapiens
cgaaguggaaagcaucuug

SEQ ID NO: 149944 - RNA, 19 nt, Homo sapiens
uuccaucccuguaauuuca

SEQ ID NO: 149945 - RNA, 19 nt, Homo sapiens
gucaacucauguacuuaaa

SEQ ID NO: 149946 - RNA, 19 nt, Homo sapiens
gaaccagccguccucucuu

SEQ ID NO: 149947 - RNA, 19 nt, Homo sapiens
ggguagugguggucauugu

SEQ ID NO: 149948 - RNA, 19 nt, Homo sapiens
gaaaugagcgccaccuuua

SEQ ID NO: 149949 - RNA, 19 nt, Homo sapiens
gaaagcaucuugccacaga

SEQ ID NO: 149950 - RNA, 19 nt, Homo sapiens
cauagaagaugaagcacua

SEQ ID NO: 149951 - RNA, 19 nt, Homo sapiens
ggauacguuucacuuaaua

SEQ ID NO: 149952 - RNA, 19 nt, Homo sapiens
ggaaauagaaccuagacuu

SEQ ID NO: 149953 - RNA, 19 nt, Homo sapiens
gcaauggaauucaagaaca

SEQ ID NO: 149954 - RNA, 19 nt, Homo sapiens
gaauucaacucugccauga

SEQ ID NO: 149955 - RNA, 19 nt, Homo sapiens
aaacaaugcucuaaucaca

SEQ ID NO: 149956 - RNA, 19 nt, Homo sapiens
ggacuuggaaucacuguuu

SEQ ID NO: 149957 - RNA, 19 nt, Homo sapiens
gaaauagaaccuagacuuc

SEQ ID NO: 149958 - RNA, 19 nt, Homo sapiens
ccaaguacauucuaauuac

SEQ ID NO: 149959 - RNA, 19 nt, Homo sapiens
uuagaaagcaugcauguaa

SEQ ID NO: 149960 - RNA, 19 nt, Homo sapiens
caacucauguacuuaaaca

SEQ ID NO: 149961 - RNA, 19 nt, Homo sapiens
cuacagugacucuuacuua

SEQ ID NO: 149962 - RNA, 19 nt, Homo sapiens
guggacgucugauuuauga

SEQ ID NO: 149963 - RNA, 19 nt, Homo sapiens
ugacaacccucaucuugau

SEQ ID NO: 149964 - RNA, 19 nt, Homo sapiens
aaggauacguuucacuuaa

SEQ ID NO: 149965 - RNA, 19 nt, Homo sapiens
cuuaaacacuaaccaauga

SEQ ID NO: 149966 - RNA, 19 nt, Homo sapiens
ucucuaugcucacaucuuu

SEQ ID NO: 149967 - RNA, 19 nt, Homo sapiens
gcaaucgagaggcacauua

SEQ ID NO: 149968 - RNA, 19 nt, Homo sapiens
gaaguaaccaccuuuaaaa

SEQ ID NO: 149969 - RNA, 19 nt, Homo sapiens
gaagaugaagcacuauaau

SEQ ID NO: 149970 - RNA, 19 nt, Homo sapiens
aauaaauucuggcuaguug

SEQ ID NO: 149971 - RNA, 19 nt, Homo sapiens
gcgacgugcuggccuauga

SEQ ID NO: 149972 - RNA, 19 nt, Homo sapiens
aaauuugucucccguaguu

SEQ ID NO: 149973 - RNA, 19 nt, Homo sapiens
gccuauauguguauuguau

SEQ ID NO: 149974 - RNA, 19 nt, Homo sapiens
gaauccacaacuucauuua

SEQ ID NO: 149975 - RNA, 19 nt, Homo sapiens
uagcaugacuucgaucuga

SEQ ID NO: 149976 - RNA, 19 nt, Homo sapiens
gcaaacaaugcucuaauca

SEQ ID NO: 149977 - RNA, 19 nt, Homo sapiens
gugcaagucagaauaaauu

SEQ ID NO: 149978 - RNA, 19 nt, Homo sapiens
ggagaaaagucaacucaug

SEQ ID NO: 149979 - RNA, 19 nt, Homo sapiens
gaaccacagugcuucuaca

SEQ ID NO: 149980 - RNA, 19 nt, Homo sapiens
aagcaugcauguaauguau

SEQ ID NO: 149981 - RNA, 19 nt, Homo sapiens
gaacggaaacugagaugag

SEQ ID NO: 149982 - RNA, 19 nt, Homo sapiens
uaauuggagucauacugua

SEQ ID NO: 149983 - RNA, 19 nt, Homo sapiens
gcaugcauguaauguaugu

SEQ ID NO: 149984 - RNA, 19 nt, Homo sapiens
gcauguuugugauggauga

SEQ ID NO: 149985 - RNA, 19 nt, Homo sapiens
gcucacaucuuuggcuaug

SEQ ID NO: 149986 - RNA, 19 nt, Homo sapiens
gagaggcacauuacgguuu

SEQ ID NO: 149987 - RNA, 19 nt, Homo sapiens
cuacuucuaucucauguuc

SEQ ID NO: 149988 - RNA, 19 nt, Homo sapiens
guuuguaucuucaucaugu

SEQ ID NO: 149989 - RNA, 19 nt, Homo sapiens
agaaguaaccaccuuuaaa

SEQ ID NO: 149990 - RNA, 19 nt, Homo sapiens
uaaaggauacguuucacuu

SEQ ID NO: 149991 - RNA, 19 nt, Homo sapiens
gaaauucuuccuucuccuu

SEQ ID NO: 149992 - RNA, 19 nt, Homo sapiens
gaaucgggauaccaugaug

SEQ ID NO: 149993 - RNA, 19 nt, Homo sapiens
aacagggaauguaaguuua

SEQ ID NO: 149994 - RNA, 19 nt, Homo sapiens
acaaugcucuaaucacaau

SEQ ID NO: 149995 - RNA, 19 nt, Homo sapiens
ccagaaguaaccaccuuua

SEQ ID NO: 149996 - RNA, 19 nt, Homo sapiens
aaaggauacguuucacuua

SEQ ID NO: 149997 - RNA, 19 nt, Homo sapiens
ccagguggacgucugauuu

SEQ ID NO: 149998 - RNA, 19 nt, Homo sapiens
ugaagacuguggucauugu

SEQ ID NO: 149999 - RNA, 19 nt, Homo sapiens
cccaaguacauucuaauua

SEQ ID NO: 150000 - RNA, 19 nt, Homo sapiens
aauagaaccuagacuucaa

SEQ ID NO: 150001 - RNA, 19 nt, Homo sapiens
uaucacaacccagaaguaa

SEQ ID NO: 150002 - RNA, 19 nt, Homo sapiens
cagguggacgucugauuua

SEQ ID NO: 150003 - RNA, 19 nt, Homo sapiens
gaaagcaugcauguaaugu

SEQ ID NO: 150004 - RNA, 19 nt, Homo sapiens
uagaaagcaugcauguaau

SEQ ID NO: 150005 - RNA, 19 nt, Homo sapiens
ccaaugacaguauuuguuc

SEQ ID NO: 150006 - RNA, 19 nt, Homo sapiens
gaaugucucggcauaguuc

SEQ ID NO: 150007 - RNA, 19 nt, Homo sapiens
ggacuauggccaucguuau

SEQ ID NO: 150008 - RNA, 19 nt, Homo sapiens
cccauguuguuaacuauuu

SEQ ID NO: 150009 - RNA, 19 nt, Homo sapiens
guacuuaaacacuaaccaa

SEQ ID NO: 150010 - RNA, 19 nt, Homo sapiens
aaacugagaugaggaacca

SEQ ID NO: 150011 - RNA, 19 nt, Homo sapiens
ccagaggacuaugagaaug

SEQ ID NO: 150012 - RNA, 19 nt, Homo sapiens
uaaccgaaguggaaagcau

SEQ ID NO: 150013 - RNA, 19 nt, Homo sapiens
cagaaguaaccaccuuuaa

SEQ ID NO: 150014 - RNA, 19 nt, Homo sapiens
ggacugacaccuacagcau

SEQ ID NO: 150015 - RNA, 19 nt, Homo sapiens
uggaaucacuguuuguauc

SEQ ID NO: 150016 - RNA, 19 nt, Homo sapiens
cgaguccauugccuucuuu

SEQ ID NO: 150017 - RNA, 19 nt, Homo sapiens
agaagaugaagcacuauaa

SEQ ID NO: 150018 - RNA, 19 nt, Homo sapiens
ccuaucagcauguuuguga

SEQ ID NO: 150019 - RNA, 19 nt, Homo sapiens
ggaguguccauuuagacua

SEQ ID NO: 150020 - RNA, 19 nt, Homo sapiens
ggaaccagccguccucucu

SEQ ID NO: 150021 - RNA, 19 nt, Homo sapiens
gggauaccaugaugagucu

SEQ ID NO: 150022 - RNA, 19 nt, Homo sapiens
ccauccaccuaucugagua

SEQ ID NO: 150023 - RNA, 19 nt, Homo sapiens
gguaauggugguucucuau

SEQ ID NO: 150024 - RNA, 19 nt, Homo sapiens
uaaauucuggcuaguugaa

SEQ ID NO: 150025 - RNA, 19 nt, Homo sapiens
agaaaugagcgccaccuuu

SEQ ID NO: 150026 - RNA, 19 nt, Homo sapiens
cugcuggacuccuggauug

SEQ ID NO: 150027 - RNA, 19 nt, Homo sapiens
guggucaucuggacuaugg

SEQ ID NO: 150028 - RNA, 19 nt, Homo sapiens
cggcaucuguggccaacuu

SEQ ID NO: 150029 - RNA, 19 nt, Homo sapiens
uagaagaugaagcacuaua

SEQ ID NO: 150030 - RNA, 19 nt, Homo sapiens
cagggaauguaaguuuauu

SEQ ID NO: 150031 - RNA, 19 nt, Homo sapiens
agugugggcuggaacugua

SEQ ID NO: 150032 - RNA, 19 nt, Homo sapiens
gaaucacuguuuguaucuu

SEQ ID NO: 150033 - RNA, 19 nt, Homo sapiens
ggucaugaagcaaacaaug

SEQ ID NO: 150034 - RNA, 19 nt, Homo sapiens
ucugaagacuguggucauu

SEQ ID NO: 150035 - RNA, 19 nt, Homo sapiens
cuacuuccaucccuguaau

SEQ ID NO: 150036 - RNA, 19 nt, Homo sapiens
ggucaugguggcaaucuau

SEQ ID NO: 150037 - RNA, 19 nt, Homo sapiens
ugaaugaaccacagugcuu

SEQ ID NO: 150038 - RNA, 19 nt, Homo sapiens
uaaaguugcagaaauuugg

SEQ ID NO: 150039 - RNA, 19 nt, Homo sapiens
gaguguccauuuagacuac

SEQ ID NO: 150040 - RNA, 19 nt, Homo sapiens
caauggaauucaagaacag

SEQ ID NO: 150041 - RNA, 19 nt, Homo sapiens
ggacgucugauuuaugaag

SEQ ID NO: 150042 - RNA, 19 nt, Homo sapiens
uacagugacucuuacuuag

SEQ ID NO: 150043 - RNA, 19 nt, Homo sapiens
gacuuggaaucacuguuug

SEQ ID NO: 150044 - RNA, 19 nt, Homo sapiens
auacccaaguacauucuaa

SEQ ID NO: 150045 - RNA, 19 nt, Homo sapiens
gugacaacccucaucuuga

SEQ ID NO: 150046 - RNA, 19 nt, Homo sapiens
ucaacuuggugaccuuugu

SEQ ID NO: 150047 - RNA, 19 nt, Homo sapiens
ggaaucacuguuuguaucu

SEQ ID NO: 150048 - RNA, 19 nt, Homo sapiens
gagcggcacuugacaauga

SEQ ID NO: 150049 - RNA, 19 nt, Homo sapiens
gaacgcagcacuucagaau

SEQ ID NO: 150050 - RNA, 19 nt, Homo sapiens
ggaacugccugcacaaucu

SEQ ID NO: 150051 - RNA, 19 nt, Homo sapiens
gggaugugcuggcucauug

SEQ ID NO: 150052 - RNA, 19 nt, Homo sapiens
ucaagcagcagcaacaaua

SEQ ID NO: 150053 - RNA, 19 nt, Homo sapiens
ggacaagaacgcagcacuu

SEQ ID NO: 150054 - RNA, 19 nt, Homo sapiens
gacccaagcagaaguaaau

SEQ ID NO: 150055 - RNA, 19 nt, Homo sapiens
uacauugccuucugcauca

SEQ ID NO: 150056 - RNA, 19 nt, Homo sapiens
gugcucaacuccgccauga

SEQ ID NO: 150057 - RNA, 19 nt, Homo sapiens
acgcagcacuucagaaugg

SEQ ID NO: 150058 - RNA, 19 nt, Homo sapiens
gcaucuacuuccuggugaa

SEQ ID NO: 150059 - RNA, 19 nt, Homo sapiens
gacaagaacgcagcacuuc

SEQ ID NO: 150060 - RNA, 19 nt, Homo sapiens
ccaagcagaaguaaaucaa

SEQ ID NO: 150061 - RNA, 19 nt, Homo sapiens
cuccgaaggucaaggaaga

SEQ ID NO: 150062 - RNA, 19 nt, Homo sapiens
ucugaugucuggcaagaag

SEQ ID NO: 150063 - RNA, 19 nt, Homo sapiens
gcagcuucaucgucuugga

SEQ ID NO: 150064 - RNA, 19 nt, Homo sapiens
ccaccgugcucuucuuggu

SEQ ID NO: 150065 - RNA, 19 nt, Homo sapiens
aaugggaucuucugcaacu

SEQ ID NO: 150066 - RNA, 19 nt, Homo sapiens
cauccugcaucauggacaa

SEQ ID NO: 150067 - RNA, 19 nt, Homo sapiens
gcucaacuccgccaugaac

SEQ ID NO: 150068 - RNA, 19 nt, Homo sapiens
gccguaagguggccaacca

SEQ ID NO: 150069 - RNA, 19 nt, Homo sapiens
caaggucaacauucugaug

SEQ ID NO: 150070 - RNA, 19 nt, Homo sapiens
ucacaaccgcauguacuuu

SEQ ID NO: 150071 - RNA, 19 nt, Homo sapiens
caagaacgcagcacuucag

SEQ ID NO: 150072 - RNA, 19 nt, Homo sapiens
gcgggagcauuaccaguac

SEQ ID NO: 150073 - RNA, 19 nt, Homo sapiens
cuuacaaggucaacauucu

SEQ ID NO: 150074 - RNA, 19 nt, Homo sapiens
ucaccaccgugcucuucuu

SEQ ID NO: 150075 - RNA, 19 nt, Homo sapiens
gcgcucgacccaagcagaa

SEQ ID NO: 150076 - RNA, 19 nt, Homo sapiens
ggcguccaccugcagcuua

SEQ ID NO: 150077 - RNA, 19 nt, Homo sapiens
guaaaucaagcagcagcaa

SEQ ID NO: 150078 - RNA, 19 nt, Homo sapiens
ugaccaucgugauccucua

SEQ ID NO: 150079 - RNA, 19 nt, Homo sapiens
uacaaggucaacauucuga

SEQ ID NO: 150080 - RNA, 19 nt, Homo sapiens
ugcgggagcauuaccagua

SEQ ID NO: 150081 - RNA, 19 nt, Homo sapiens
agacccugcgggagcauua

SEQ ID NO: 150082 - RNA, 19 nt, Homo sapiens
caagcagcagcaacaauag

SEQ ID NO: 150083 - RNA, 19 nt, Homo sapiens
ggucaucugcagcuucauc

SEQ ID NO: 150084 - RNA, 19 nt, Homo sapiens
uucauccucuuccucauug

SEQ ID NO: 150085 - RNA, 19 nt, Homo sapiens
aaaucaagcagcagcaaca

SEQ ID NO: 150086 - RNA, 19 nt, Homo sapiens
gcucaccaccgugcucuuc

SEQ ID NO: 150087 - RNA, 19 nt, Homo sapiens
caagaaagguuaaggaguu

SEQ ID NO: 150088 - RNA, 19 nt, Homo sapiens
gagaaagacuggaauaauc

SEQ ID NO: 150089 - RNA, 19 nt, Homo sapiens
gagaauagaugccaaugug

SEQ ID NO: 150090 - RNA, 19 nt, Homo sapiens
ccaaggagcuccagaaaca

SEQ ID NO: 150091 - RNA, 19 nt, Homo sapiens
gacaagaagugcuggaauu

SEQ ID NO: 150092 - RNA, 19 nt, Homo sapiens
gcucgucccugauggauaa

SEQ ID NO: 150093 - RNA, 19 nt, Homo sapiens
agacaaacaugcaaguaaa

SEQ ID NO: 150094 - RNA, 19 nt, Homo sapiens
caacagaccgugagaauag

SEQ ID NO: 150095 - RNA, 19 nt, Homo sapiens
cagaagaaguucagaggaa

SEQ ID NO: 150096 - RNA, 19 nt, Homo sapiens
gaaacagcgucaaaucauc

SEQ ID NO: 150097 - RNA, 19 nt, Homo sapiens
gaggaacaccuaagacaaa

SEQ ID NO: 150098 - RNA, 19 nt, Homo sapiens
ggaauaaucauaagaaagg

SEQ ID NO: 150099 - RNA, 19 nt, Homo sapiens
uaaagagugugucuacuuc

SEQ ID NO: 150100 - RNA, 19 nt, Homo sapiens
ucuaaggaaugcacaaauu

SEQ ID NO: 150101 - RNA, 19 nt, Homo sapiens
gggccugucugaagccaua

SEQ ID NO: 150102 - RNA, 19 nt, Homo sapiens
gagaaacagcgucaaauca

SEQ ID NO: 150103 - RNA, 19 nt, Homo sapiens
ggagaaagacuggaauaau

SEQ ID NO: 150104 - RNA, 19 nt, Homo sapiens
gaauuuacuucccacaaag

SEQ ID NO: 150105 - RNA, 19 nt, Homo sapiens
agaauuuacuucccacaaa

SEQ ID NO: 150106 - RNA, 19 nt, Homo sapiens
gcaacagaccgugagaaua

SEQ ID NO: 150107 - RNA, 19 nt, Homo sapiens
agagagccuuggagaauuu

SEQ ID NO: 150108 - RNA, 19 nt, Homo sapiens
gaaacacacagucacauuc

SEQ ID NO: 150109 - RNA, 19 nt, Homo sapiens
cugaagacauuauggagaa

SEQ ID NO: 150110 - RNA, 19 nt, Homo sapiens
ugagggaccugaagcuguu

SEQ ID NO: 150111 - RNA, 19 nt, Homo sapiens
uaacugcuuuggucucuuc

SEQ ID NO: 150112 - RNA, 19 nt, Homo sapiens
caaaguccacacaaagauu

SEQ ID NO: 150113 - RNA, 19 nt, Homo sapiens
gcuuuggucucuucuuuca

SEQ ID NO: 150114 - RNA, 19 nt, Homo sapiens
uaaggaaugcacaaauuga

SEQ ID NO: 150115 - RNA, 19 nt, Homo sapiens
ggauaaagagugugucuac

SEQ ID NO: 150116 - RNA, 19 nt, Homo sapiens
gcagaaacacacagucaca

SEQ ID NO: 150117 - RNA, 19 nt, Homo sapiens
ggguggaguuucugacgaa

SEQ ID NO: 150118 - RNA, 19 nt, Homo sapiens
gcugaaggaucgcuuugag

SEQ ID NO: 150119 - RNA, 19 nt, Homo sapiens
uccagaaacagcagucuua

SEQ ID NO: 150120 - RNA, 19 nt, Homo sapiens
caaacaugcaaguaaagaa

SEQ ID NO: 150121 - RNA, 19 nt, Homo sapiens
cugcuuuggucucuucuuu

SEQ ID NO: 150122 - RNA, 19 nt, Homo sapiens
caucuucacuggcuuccau

SEQ ID NO: 150123 - RNA, 19 nt, Homo sapiens
aagacaaacaugcaaguaa

SEQ ID NO: 150124 - RNA, 19 nt, Homo sapiens
acacaaagauuuucuaagg

SEQ ID NO: 150125 - RNA, 19 nt, Homo sapiens
ggaccucucagcagaaaca

SEQ ID NO: 150126 - RNA, 19 nt, Homo sapiens
guguauuuaucagcaguua

SEQ ID NO: 150127 - RNA, 19 nt, Homo sapiens
agaaagacuggaauaauca

SEQ ID NO: 150128 - RNA, 19 nt, Homo sapiens
aagagagccuuggagaauu

SEQ ID NO: 150129 - RNA, 19 nt, Homo sapiens
ggacaucauuugggucaac

SEQ ID NO: 150130 - RNA, 19 nt, Homo sapiens
cuaaggaaugcacaaauug

SEQ ID NO: 150131 - RNA, 19 nt, Homo sapiens
aaaguccacacaaagauuu

SEQ ID NO: 150132 - RNA, 19 nt, Homo sapiens
gagaauuuacuucccacaa

SEQ ID NO: 150133 - RNA, 19 nt, Homo sapiens
caugagaaacagcgucaaa

SEQ ID NO: 150134 - RNA, 19 nt, Homo sapiens
gaacaccuaagacaaacca

SEQ ID NO: 150135 - RNA, 19 nt, Homo sapiens
gcaguuagugagaggaaga

SEQ ID NO: 150136 - RNA, 19 nt, Homo sapiens
acaagaagugcuggaauuu

SEQ ID NO: 150137 - RNA, 19 nt, Homo sapiens
ccugauggauaaagagugu

SEQ ID NO: 150138 - RNA, 19 nt, Homo sapiens
ugaaggaucgcuuugagau

SEQ ID NO: 150139 - RNA, 19 nt, Homo sapiens
ggacuuggaagcccuaggu

SEQ ID NO: 150140 - RNA, 19 nt, Homo sapiens
gcacguuguuccguaugga

SEQ ID NO: 150141 - RNA, 19 nt, Homo sapiens
acuccaaaguccacacaaa

SEQ ID NO: 150142 - RNA, 19 nt, Homo sapiens
gauaaagagugugucuacu

SEQ ID NO: 150143 - RNA, 19 nt, Homo sapiens
aaagacaaacaugcaagua

SEQ ID NO: 150144 - RNA, 19 nt, Homo sapiens
ccaaaguccacacaaagau

SEQ ID NO: 150145 - RNA, 19 nt, Homo sapiens
agaaacacacagucacauu

SEQ ID NO: 150146 - RNA, 19 nt, Homo sapiens
cagcagaaacacacaguca

SEQ ID NO: 150147 - RNA, 19 nt, Homo sapiens
ugagaaacagcgucaaauc

SEQ ID NO: 150148 - RNA, 19 nt, Homo sapiens
ggcaacagaccgugagaau

SEQ ID NO: 150149 - RNA, 19 nt, Homo sapiens
gguaacugcuuuggucucu

SEQ ID NO: 150150 - RNA, 19 nt, Homo sapiens
guauuuaucagcaguuagu

SEQ ID NO: 150151 - RNA, 19 nt, Homo sapiens
gaaagacuggaauaaucau

SEQ ID NO: 150152 - RNA, 19 nt, Homo sapiens
agaaacagcgucaaaucau

SEQ ID NO: 150153 - RNA, 19 nt, Homo sapiens
ugaagacauuauggagaaa

SEQ ID NO: 150154 - RNA, 19 nt, Homo sapiens
cgagcacguuguuccguau

SEQ ID NO: 150155 - RNA, 19 nt, Homo sapiens
cagaggaacaccuaagaca

SEQ ID NO: 150156 - RNA, 19 nt, Homo sapiens
agacuggaauaaucauaag

SEQ ID NO: 150157 - RNA, 19 nt, Homo sapiens
auaaagagugugucuacuu

SEQ ID NO: 150158 - RNA, 19 nt, Homo sapiens
ggaaugcacaaauugaaaa

SEQ ID NO: 150159 - RNA, 19 nt, Homo sapiens
uggauuauuugcucaugau

SEQ ID NO: 150160 - RNA, 19 nt, Homo sapiens
gauuuucucucugcuguuu

SEQ ID NO: 150161 - RNA, 19 nt, Homo sapiens
aaacauuccaagaaagguu

SEQ ID NO: 150162 - RNA, 19 nt, Homo sapiens
guucaaaacauuccaagaa

SEQ ID NO: 150163 - RNA, 19 nt, Homo sapiens
gaggaacccgcagcgcuuu

SEQ ID NO: 150164 - RNA, 19 nt, Homo sapiens
gggcugaagacauuaugga

SEQ ID NO: 150165 - RNA, 19 nt, Homo sapiens
cacagucacauucgaauuc

SEQ ID NO: 150166 - RNA, 19 nt, Homo sapiens
gaaaacacacucaaaagac

SEQ ID NO: 150167 - RNA, 19 nt, Homo sapiens
ggaacccgcagcgcuuuga

SEQ ID NO: 150168 - RNA, 19 nt, Homo sapiens
gaccagcguccucguucaa

SEQ ID NO: 150169 - RNA, 19 nt, Homo sapiens
cgagcacauuggugacaga

SEQ ID NO: 150170 - RNA, 19 nt, Homo sapiens
aagacauuauggagaaaga

SEQ ID NO: 150171 - RNA, 19 nt, Homo sapiens
gagagccuuggagaauuua

SEQ ID NO: 150172 - RNA, 19 nt, Homo sapiens
ugaaaacacacucaaaaga

SEQ ID NO: 150173 - RNA, 19 nt, Homo sapiens
acacacagucacauucgaa

SEQ ID NO: 150174 - RNA, 19 nt, Homo sapiens
gacaaacaugcaaguaaag

SEQ ID NO: 150175 - RNA, 19 nt, Homo sapiens
ccuaagggaguguuugugu

SEQ ID NO: 150176 - RNA, 19 nt, Homo sapiens
agagagagaggaaggagau

SEQ ID NO: 150177 - RNA, 19 nt, Homo sapiens
uggcuuccaucagugguaa

SEQ ID NO: 150178 - RNA, 19 nt, Homo sapiens
uggagaaagacuggaauaa

SEQ ID NO: 150179 - RNA, 19 nt, Homo sapiens
acaaacaugcaaguaaaga

SEQ ID NO: 150180 - RNA, 19 nt, Homo sapiens
gaugacaauggaccucuca

SEQ ID NO: 150181 - RNA, 19 nt, Homo sapiens
cacccuggcugggaucaga

SEQ ID NO: 150182 - RNA, 19 nt, Homo sapiens
aaacagcgucaaaucaucu

SEQ ID NO: 150183 - RNA, 19 nt, Homo sapiens
gaagacauuauggagaaag

SEQ ID NO: 150184 - RNA, 19 nt, Homo sapiens
aaaacacacucaaaagaca

SEQ ID NO: 150185 - RNA, 19 nt, Homo sapiens
uaagggaguguuugugucu

SEQ ID NO: 150186 - RNA, 19 nt, Homo sapiens
gacaucauuugggucaaca

SEQ ID NO: 150187 - RNA, 19 nt, Homo sapiens
gaacacuccugaacagaca

SEQ ID NO: 150188 - RNA, 19 nt, Homo sapiens
ggaggaacauugggaagga

SEQ ID NO: 150189 - RNA, 19 nt, Homo sapiens
ccuaagaacuuugagaauc

SEQ ID NO: 150190 - RNA, 19 nt, Homo sapiens
ggacccauuugccaggauu

SEQ ID NO: 150191 - RNA, 19 nt, Homo sapiens
cgaaggcccuggacugaag

SEQ ID NO: 150192 - RNA, 19 nt, Homo sapiens
ccugcgaacuuguguuuau

SEQ ID NO: 150193 - RNA, 19 nt, Homo sapiens
ggagagaggaggagagaag

SEQ ID NO: 150194 - RNA, 19 nt, Homo sapiens
cuauuuaccugcgaacuug

SEQ ID NO: 150195 - RNA, 19 nt, Homo sapiens
ccagguggaggaagagaua

SEQ ID NO: 150196 - RNA, 19 nt, Homo sapiens
ggugaacacuccugaacag

SEQ ID NO: 150197 - RNA, 19 nt, Homo sapiens
gcgaacuuguguuuauaau

SEQ ID NO: 150198 - RNA, 19 nt, Homo sapiens
agaagggccugcucugcuu

SEQ ID NO: 150199 - RNA, 19 nt, Homo sapiens
ugagggacauuuccacagu

SEQ ID NO: 150200 - RNA, 19 nt, Homo sapiens
gaacagacagcuccuuacg

SEQ ID NO: 150201 - RNA, 19 nt, Homo sapiens
gucgugagcuggaggaaca

SEQ ID NO: 150202 - RNA, 19 nt, Homo sapiens
gacaucaucugggugaaca

SEQ ID NO: 150203 - RNA, 19 nt, Homo sapiens
gaggaacauugggaaggaa

SEQ ID NO: 150204 - RNA, 19 nt, Homo sapiens
ggacauuuccacagucaag

SEQ ID NO: 150205 - RNA, 19 nt, Homo sapiens
gcccuaagaacuuugagaa

SEQ ID NO: 150206 - RNA, 19 nt, Homo sapiens
acuuugagaaucccaauua

SEQ ID NO: 150207 - RNA, 19 nt, Homo sapiens
cugcgaacuuguguuuaua

SEQ ID NO: 150208 - RNA, 19 nt, Homo sapiens
gaagggccugcucugcuuu

SEQ ID NO: 150209 - RNA, 19 nt, Homo sapiens
gaacuuugagaaucccaau

SEQ ID NO: 150210 - RNA, 19 nt, Homo sapiens
caaaggcugagggacauuu

SEQ ID NO: 150211 - RNA, 19 nt, Homo sapiens
caaggagugcgucuacuuc

SEQ ID NO: 150212 - RNA, 19 nt, Homo sapiens
cuaagaacuuugagaaucc

SEQ ID NO: 150213 - RNA, 19 nt, Homo sapiens
cugaacagacagcuccuua

SEQ ID NO: 150214 - RNA, 19 nt, Homo sapiens
ccagcguccucaucucaug

SEQ ID NO: 150215 - RNA, 19 nt, Homo sapiens
gcucguggcccugcaugaa

SEQ ID NO: 150216 - RNA, 19 nt, Homo sapiens
uauuugcccuaagaacuuu

SEQ ID NO: 150217 - RNA, 19 nt, Homo sapiens
cgacaaggagugcgucuac

SEQ ID NO: 150218 - RNA, 19 nt, Homo sapiens
uaccugcgaacuuguguuu

SEQ ID NO: 150219 - RNA, 19 nt, Homo sapiens
guccaaggcaguucugugu

SEQ ID NO: 150220 - RNA, 19 nt, Homo sapiens
gcagccagcguccucaucu

SEQ ID NO: 150221 - RNA, 19 nt, Homo sapiens
acaaggagugcgucuacuu

SEQ ID NO: 150222 - RNA, 19 nt, Homo sapiens
gaaguggccagggcuugug

SEQ ID NO: 150223 - RNA, 19 nt, Homo sapiens
cuuugagaaucccaauuau

SEQ ID NO: 150224 - RNA, 19 nt, Homo sapiens
uuauuugcccuaagaacuu

SEQ ID NO: 150225 - RNA, 19 nt, Homo sapiens
gaauguaucucgaaagaau

SEQ ID NO: 150226 - RNA, 19 nt, Homo sapiens
gagagaaacccaucaauug

SEQ ID NO: 150227 - RNA, 19 nt, Homo sapiens
gggaauggcuucaaaauaa

SEQ ID NO: 150228 - RNA, 19 nt, Homo sapiens
caagcuaacucuuugcaaa

SEQ ID NO: 150229 - RNA, 19 nt, Homo sapiens
cauuuaagaugguguauga

SEQ ID NO: 150230 - RNA, 19 nt, Homo sapiens
gauguuaucccaccaugua

SEQ ID NO: 150231 - RNA, 19 nt, Homo sapiens
cuacaggaguuuaugaauu

SEQ ID NO: 150232 - RNA, 19 nt, Homo sapiens
guagauagguagguagauu

SEQ ID NO: 150233 - RNA, 19 nt, Homo sapiens
gaguaaauguggaucuuug

SEQ ID NO: 150234 - RNA, 19 nt, Homo sapiens
guaaacacauguccaucuu

SEQ ID NO: 150235 - RNA, 19 nt, Homo sapiens
ugacaugacuucucuugga

SEQ ID NO: 150236 - RNA, 19 nt, Homo sapiens
ucaaaguagucacuguaua

SEQ ID NO: 150237 - RNA, 19 nt, Homo sapiens
caaaguagucacuguauau

SEQ ID NO: 150238 - RNA, 19 nt, Homo sapiens
acacauguccaucuuguua

SEQ ID NO: 150239 - RNA, 19 nt, Homo sapiens
gauaggaaacggcauuuga

SEQ ID NO: 150240 - RNA, 19 nt, Homo sapiens
caaggagugugucuacuau

SEQ ID NO: 150241 - RNA, 19 nt, Homo sapiens
gaaaugaaaguggcugauu

SEQ ID NO: 150242 - RNA, 19 nt, Homo sapiens
gaucaacacucccgaacag

SEQ ID NO: 150243 - RNA, 19 nt, Homo sapiens
gcacgugcuucaccuacaa

SEQ ID NO: 150244 - RNA, 19 nt, Homo sapiens
auagagagguagauaggua

SEQ ID NO: 150245 - RNA, 19 nt, Homo sapiens
ugacugacccucuguauuc

SEQ ID NO: 150246 - RNA, 19 nt, Homo sapiens
aagaauguaucucgaaaga

SEQ ID NO: 150247 - RNA, 19 nt, Homo sapiens
gaacagacggugcccuaug

SEQ ID NO: 150248 - RNA, 19 nt, Homo sapiens
gaaaguuaguaucugcaau

SEQ ID NO: 150249 - RNA, 19 nt, Homo sapiens
ccuuagagcuugaauuaca

SEQ ID NO: 150250 - RNA, 19 nt, Homo sapiens
guagagagacauuuaagau

SEQ ID NO: 150251 - RNA, 19 nt, Homo sapiens
aaacacauguccaucuugu

SEQ ID NO: 150252 - RNA, 19 nt, Homo sapiens
gcucaaauacucagaaagu

SEQ ID NO: 150253 - RNA, 19 nt, Homo sapiens
uaaauccucuguguguauu

SEQ ID NO: 150254 - RNA, 19 nt, Homo sapiens
ucacgaacacaaauucuuu

SEQ ID NO: 150255 - RNA, 19 nt, Homo sapiens
gaagcaugcgacuuucaua

SEQ ID NO: 150256 - RNA, 19 nt, Homo sapiens
guagcgcgcucugaaaguu

SEQ ID NO: 150257 - RNA, 19 nt, Homo sapiens
caacuuauaccgucugaca

SEQ ID NO: 150258 - RNA, 19 nt, Homo sapiens
cccaucaauugcucaaaua

SEQ ID NO: 150259 - RNA, 19 nt, Homo sapiens
uacaaacucauacuccuua

SEQ ID NO: 150260 - RNA, 19 nt, Homo sapiens
aaacuguucuccacuccaa

SEQ ID NO: 150261 - RNA, 19 nt, Homo sapiens
gcagaagcaugcgacuuuc

SEQ ID NO: 150262 - RNA, 19 nt, Homo sapiens
agagagaaacccaucaauu

SEQ ID NO: 150263 - RNA, 19 nt, Homo sapiens
ucgaaagaaugaaggaaga

SEQ ID NO: 150264 - RNA, 19 nt, Homo sapiens
cuccuuagagcuugaauua

SEQ ID NO: 150265 - RNA, 19 nt, Homo sapiens
guuaaauccucugugugua

SEQ ID NO: 150266 - RNA, 19 nt, Homo sapiens
cuaacucuuugcaaaugua

SEQ ID NO: 150267 - RNA, 19 nt, Homo sapiens
guggcaagaugguaucaga

SEQ ID NO: 150268 - RNA, 19 nt, Homo sapiens
agagguagauagguaggua

SEQ ID NO: 150269 - RNA, 19 nt, Homo sapiens
gaagucaaggaccaacaaa

SEQ ID NO: 150270 - RNA, 19 nt, Homo sapiens
guauaaaagugaugaccua

SEQ ID NO: 150271 - RNA, 19 nt, Homo sapiens
ucauagcucuacaggaguu

SEQ ID NO: 150272 - RNA, 19 nt, Homo sapiens
ccacgaggcgucggcuuua

SEQ ID NO: 150273 - RNA, 19 nt, Homo sapiens
guucaaaguagucacugua

SEQ ID NO: 150274 - RNA, 19 nt, Homo sapiens
guggaucuguucaaaguag

SEQ ID NO: 150275 - RNA, 19 nt, Homo sapiens
gcuuguuccuguucaguga

SEQ ID NO: 150276 - RNA, 19 nt, Homo sapiens
ggacaucauuuggaucaac

SEQ ID NO: 150277 - RNA, 19 nt, Homo sapiens
aaaugcauaugugcuguuu

SEQ ID NO: 150278 - RNA, 19 nt, Homo sapiens
aggagugugucuacuauug

SEQ ID NO: 150279 - RNA, 19 nt, Homo sapiens
aauguuaaauccucugugu

SEQ ID NO: 150280 - RNA, 19 nt, Homo sapiens
gagagacauuuaagauggu

SEQ ID NO: 150281 - RNA, 19 nt, Homo sapiens
caagaugguaucagagaga

SEQ ID NO: 150282 - RNA, 19 nt, Homo sapiens
gacaucauuuggaucaaca

SEQ ID NO: 150283 - RNA, 19 nt, Homo sapiens
gccugcagcuccaauuuca

SEQ ID NO: 150284 - RNA, 19 nt, Homo sapiens
ggacgucagcaguaauuca

SEQ ID NO: 150285 - RNA, 19 nt, Homo sapiens
ggaguucccaggccuuguu

SEQ ID NO: 150286 - RNA, 19 nt, Homo sapiens
acaaggagugugucuacua

SEQ ID NO: 150287 - RNA, 19 nt, Homo sapiens
gcuaacucuuugcaaaugu

SEQ ID NO: 150288 - RNA, 19 nt, Homo sapiens
gaagggaagguugaaguca

SEQ ID NO: 150289 - RNA, 19 nt, Homo sapiens
cugauuugcugguaggauu

SEQ ID NO: 150290 - RNA, 19 nt, Homo sapiens
acuccaagcuaacucuuug

SEQ ID NO: 150291 - RNA, 19 nt, Homo sapiens
uaagaugguguaugacaga

SEQ ID NO: 150292 - RNA, 19 nt, Homo sapiens
gacccucuguauucuguau

SEQ ID NO: 150293 - RNA, 19 nt, Homo sapiens
gaauaggcugcauggugua

SEQ ID NO: 150294 - RNA, 19 nt, Homo sapiens
ggcaagaugguaucagaga

SEQ ID NO: 150295 - RNA, 19 nt, Homo sapiens
ggccuugaccaaauguuaa

SEQ ID NO: 150296 - RNA, 19 nt, Homo sapiens
gacagagcauuggccuuga

SEQ ID NO: 150297 - RNA, 19 nt, Homo sapiens
auuugaagcuuaugggauu

SEQ ID NO: 150298 - RNA, 19 nt, Homo sapiens
gcaugcgacuuucauaucc

SEQ ID NO: 150299 - RNA, 19 nt, Homo sapiens
gaccuaucaugaggaaaug

SEQ ID NO: 150300 - RNA, 19 nt, Homo sapiens
ugaccuaucaugaggaaau

SEQ ID NO: 150301 - RNA, 19 nt, Homo sapiens
gagauaggaaacggcauuu

SEQ ID NO: 150302 - RNA, 19 nt, Homo sapiens
caaaauaagucacgaacac

SEQ ID NO: 150303 - RNA, 19 nt, Homo sapiens
ggaagggaagguugaaguc

SEQ ID NO: 150304 - RNA, 19 nt, Homo sapiens
uagauagguagguagauuu

SEQ ID NO: 150305 - RNA, 19 nt, Homo sapiens
gaaagaaugaaggaagaag

SEQ ID NO: 150306 - RNA, 19 nt, Homo sapiens
gcucuacaggaguuuauga

SEQ ID NO: 150307 - RNA, 19 nt, Homo sapiens
uaagucacgaacacaaauu

SEQ ID NO: 150308 - RNA, 19 nt, Homo sapiens
ucauauccuugccuagaau

SEQ ID NO: 150309 - RNA, 19 nt, Homo sapiens
uuauguggaucuguucaaa

SEQ ID NO: 150310 - RNA, 19 nt, Homo sapiens
uagagagacauuuaagaug

SEQ ID NO: 150311 - RNA, 19 nt, Homo sapiens
ggcgucggcuuuagacaca

SEQ ID NO: 150312 - RNA, 19 nt, Homo sapiens
gaaauugguuuuggagagu

SEQ ID NO: 150313 - RNA, 19 nt, Homo sapiens
gcaggaaauugguuuugga

SEQ ID NO: 150314 - RNA, 19 nt, Homo sapiens
gacgucagcaguaauucaa

SEQ ID NO: 150315 - RNA, 19 nt, Homo sapiens
cucagaaaguacugucaaa

SEQ ID NO: 150316 - RNA, 19 nt, Homo sapiens
gguaggauuuuguacaguu

SEQ ID NO: 150317 - RNA, 19 nt, Homo sapiens
uuaaauccucuguguguau

SEQ ID NO: 150318 - RNA, 19 nt, Homo sapiens
gaauauuugcuuucaugag

SEQ ID NO: 150319 - RNA, 19 nt, Homo sapiens
aagaaugaaggaagaagaa

SEQ ID NO: 150320 - RNA, 19 nt, Homo sapiens
aaagaaugaaggaagaaga

SEQ ID NO: 150321 - RNA, 19 nt, Homo sapiens
ggaaucugcagcucucaca

SEQ ID NO: 150322 - RNA, 19 nt, Homo sapiens
agcagaagcaugcgacuuu

SEQ ID NO: 150323 - RNA, 19 nt, Homo sapiens
gagaaacccaucaauugcu

SEQ ID NO: 150324 - RNA, 19 nt, Homo sapiens
acauguccaucuuguuaau

SEQ ID NO: 150325 - RNA, 19 nt, Homo sapiens
gcacaaaucuaagcaauca

SEQ ID NO: 150326 - RNA, 19 nt, Homo sapiens
gaaccgaugugaauuacuu

SEQ ID NO: 150327 - RNA, 19 nt, Homo sapiens
ccagacagauugcugauaa

SEQ ID NO: 150328 - RNA, 19 nt, Homo sapiens
gaaaccagaaggauauuua

SEQ ID NO: 150329 - RNA, 19 nt, Homo sapiens
gaacugaccacccuuagaa

SEQ ID NO: 150330 - RNA, 19 nt, Homo sapiens
gcagucaaaucuauuauuc

SEQ ID NO: 150331 - RNA, 19 nt, Homo sapiens
gaaugaagacuguuaaaug

SEQ ID NO: 150332 - RNA, 19 nt, Homo sapiens
ccaugaaacuuuagagauu

SEQ ID NO: 150333 - RNA, 19 nt, Homo sapiens
guauucaggugagcaauua

SEQ ID NO: 150334 - RNA, 19 nt, Homo sapiens
caagaaccgaugugaauua

SEQ ID NO: 150335 - RNA, 19 nt, Homo sapiens
gaacaaauguaugaggaau

SEQ ID NO: 150336 - RNA, 19 nt, Homo sapiens
gaugguauguauggauuua

SEQ ID NO: 150337 - RNA, 19 nt, Homo sapiens
ugacacauuuggcaguuua

SEQ ID NO: 150338 - RNA, 19 nt, Homo sapiens
gcaaccuucugcauucaua

SEQ ID NO: 150339 - RNA, 19 nt, Homo sapiens
aaauagagcuuucaaguac

SEQ ID NO: 150340 - RNA, 19 nt, Homo sapiens
ccacaaaugccaccaguaa

SEQ ID NO: 150341 - RNA, 19 nt, Homo sapiens
ucaauguggugaugaaauu

SEQ ID NO: 150342 - RNA, 19 nt, Homo sapiens
gaaguggccagaugaguuu

SEQ ID NO: 150343 - RNA, 19 nt, Homo sapiens
gagauuaacgacaagauuu

SEQ ID NO: 150344 - RNA, 19 nt, Homo sapiens
gugauaauccugagagaua

SEQ ID NO: 150345 - RNA, 19 nt, Homo sapiens
gcuguggacuagcaauaua

SEQ ID NO: 150346 - RNA, 19 nt, Homo sapiens
gggaaucucuucucugauc

SEQ ID NO: 150347 - RNA, 19 nt, Homo sapiens
guagcaaccuucugcauuc

SEQ ID NO: 150348 - RNA, 19 nt, Homo sapiens
cauaauagccuaacaugau

SEQ ID NO: 150349 - RNA, 19 nt, Homo sapiens
uaacugccauugaaauugu

SEQ ID NO: 150350 - RNA, 19 nt, Homo sapiens
caaugacuuuggcguauuu

SEQ ID NO: 150351 - RNA, 19 nt, Homo sapiens
uuacaucgguauuaacuug

SEQ ID NO: 150352 - RNA, 19 nt, Homo sapiens
aauggcagcuugagaauug

SEQ ID NO: 150353 - RNA, 19 nt, Homo sapiens
gcccauaaguguaaaauaa

SEQ ID NO: 150354 - RNA, 19 nt, Homo sapiens
gauaauuuguugggccaua

SEQ ID NO: 150355 - RNA, 19 nt, Homo sapiens
caggugagcaauuagauua

SEQ ID NO: 150356 - RNA, 19 nt, Homo sapiens
gacaagaaccgaugugaau

SEQ ID NO: 150357 - RNA, 19 nt, Homo sapiens
ggaguucuaccaagaugua

SEQ ID NO: 150358 - RNA, 19 nt, Homo sapiens
cagaugagcuguggacuag

SEQ ID NO: 150359 - RNA, 19 nt, Homo sapiens
ggaauauauuugugugugu

SEQ ID NO: 150360 - RNA, 19 nt, Homo sapiens
guacauggcuagcuuuuau

SEQ ID NO: 150361 - RNA, 19 nt, Homo sapiens
ccgggaaucucuucucuga

SEQ ID NO: 150362 - RNA, 19 nt, Homo sapiens
gugaugaaauugccagguu

SEQ ID NO: 150363 - RNA, 19 nt, Homo sapiens
gauauaugcauguguguga

SEQ ID NO: 150364 - RNA, 19 nt, Homo sapiens
ucaaguacauggcuagcuu

SEQ ID NO: 150365 - RNA, 19 nt, Homo sapiens
caugguacccuuugaauau

SEQ ID NO: 150366 - RNA, 19 nt, Homo sapiens
uuuauggacugguaaguaa

SEQ ID NO: 150367 - RNA, 19 nt, Homo sapiens
ggacaagaaccgaugugaa

SEQ ID NO: 150368 - RNA, 19 nt, Homo sapiens
gguaaguaacugugguuua

SEQ ID NO: 150369 - RNA, 19 nt, Homo sapiens
gcagaugagcuguggacua

SEQ ID NO: 150370 - RNA, 19 nt, Homo sapiens
ggagaaugaagacuguuaa

SEQ ID NO: 150371 - RNA, 19 nt, Homo sapiens
cgaugugaauuacuuaguu

SEQ ID NO: 150372 - RNA, 19 nt, Homo sapiens
gcacugcgaucuucuacac

SEQ ID NO: 150373 - RNA, 19 nt, Homo sapiens
uaacugugguuuacuagca

SEQ ID NO: 150374 - RNA, 19 nt, Homo sapiens
uaacucugccugagacuuu

SEQ ID NO: 150375 - RNA, 19 nt, Homo sapiens
gggagaaugaagacuguua

SEQ ID NO: 150376 - RNA, 19 nt, Homo sapiens
gagaauugcccucagugaa

SEQ ID NO: 150377 - RNA, 19 nt, Homo sapiens
ccagaaggauauuuacuac

SEQ ID NO: 150378 - RNA, 19 nt, Homo sapiens
ccucaaauuugccucaaga

SEQ ID NO: 150379 - RNA, 19 nt, Homo sapiens
uggaugauuucaccacuuu

SEQ ID NO: 150380 - RNA, 19 nt, Homo sapiens
gaugagcuguggacuagca

SEQ ID NO: 150381 - RNA, 19 nt, Homo sapiens
gaguuuaucaugucaguga

SEQ ID NO: 150382 - RNA, 19 nt, Homo sapiens
gaugacacauuuggcaguu

SEQ ID NO: 150383 - RNA, 19 nt, Homo sapiens
gaauugcccucagugaaca

SEQ ID NO: 150384 - RNA, 19 nt, Homo sapiens
uuggagaccuuaucuaugu

SEQ ID NO: 150385 - RNA, 19 nt, Homo sapiens
cagcacaaaucuaagcaau

SEQ ID NO: 150386 - RNA, 19 nt, Homo sapiens
gacagauugcugauaauaa

SEQ ID NO: 150387 - RNA, 19 nt, Homo sapiens
gauauuucuuucagacuuc

SEQ ID NO: 150388 - RNA, 19 nt, Homo sapiens
gcacugguuggauguguaa

SEQ ID NO: 150389 - RNA, 19 nt, Homo sapiens
guguguguguguauauaua

SEQ ID NO: 150390 - RNA, 19 nt, Homo sapiens
gugagcaauuagauuagua

SEQ ID NO: 150391 - RNA, 19 nt, Homo sapiens
uggauuacaucgguauuaa

SEQ ID NO: 150392 - RNA, 19 nt, Homo sapiens
ucuuacugcucauggauua

SEQ ID NO: 150393 - RNA, 19 nt, Homo sapiens
uaacaucagguuccaguug

SEQ ID NO: 150394 - RNA, 19 nt, Homo sapiens
caaccugccucaguccauu

SEQ ID NO: 150395 - RNA, 19 nt, Homo sapiens
gugaugguauguauggauu

SEQ ID NO: 150396 - RNA, 19 nt, Homo sapiens
guaaugcuucaaucagaua

SEQ ID NO: 150397 - RNA, 19 nt, Homo sapiens
ccacgucacuauuuauuuu

SEQ ID NO: 150398 - RNA, 19 nt, Homo sapiens
gguauuaacuuggcaacca

SEQ ID NO: 150399 - RNA, 19 nt, Homo sapiens
gguaacugccauugaaauu

SEQ ID NO: 150400 - RNA, 19 nt, Homo sapiens
ccucugcgcucuuaguguu

SEQ ID NO: 150401 - RNA, 19 nt, Homo sapiens
gagcuguggacuagcaaua

SEQ ID NO: 150402 - RNA, 19 nt, Homo sapiens
uauaagaggcagcgugaaa

SEQ ID NO: 150403 - RNA, 19 nt, Homo sapiens
cgacaagauuuucuacuuu

SEQ ID NO: 150404 - RNA, 19 nt, Homo sapiens
gagaaugaagacuguuaaa

SEQ ID NO: 150405 - RNA, 19 nt, Homo sapiens
uggaaggucuggagcuuug

SEQ ID NO: 150406 - RNA, 19 nt, Homo sapiens
gaagaaaacuguguauaac

SEQ ID NO: 150407 - RNA, 19 nt, Homo sapiens
ggccauuccugaagcgauu

SEQ ID NO: 150408 - RNA, 19 nt, Homo sapiens
gcaguggcccauaagugua

SEQ ID NO: 150409 - RNA, 19 nt, Homo sapiens
guucuuauccucaauucaa

SEQ ID NO: 150410 - RNA, 19 nt, Homo sapiens
gcaugugugugaugguaug

SEQ ID NO: 150411 - RNA, 19 nt, Homo sapiens
acugugauaucuuguacua

SEQ ID NO: 150412 - RNA, 19 nt, Homo sapiens
aaaugaaaccagaaggaua

SEQ ID NO: 150413 - RNA, 19 nt, Homo sapiens
ucauggaguucuaccaaga

SEQ ID NO: 150414 - RNA, 19 nt, Homo sapiens
gacuuuggcguauuucuuu

SEQ ID NO: 150415 - RNA, 19 nt, Homo sapiens
gacuagcaauauaggguuu

SEQ ID NO: 150416 - RNA, 19 nt, Homo sapiens
caacaucucccucccacau

SEQ ID NO: 150417 - RNA, 19 nt, Homo sapiens
gcauaauagccuaacauga

SEQ ID NO: 150418 - RNA, 19 nt, Homo sapiens
caagugcaauaagagauau

SEQ ID NO: 150419 - RNA, 19 nt, Homo sapiens
aaauuugccucaagaugga

SEQ ID NO: 150420 - RNA, 19 nt, Homo sapiens
ggaagaaccacgaucaaaa

SEQ ID NO: 150421 - RNA, 19 nt, Homo sapiens
ggucauugaucucccuauc

SEQ ID NO: 150422 - RNA, 19 nt, Homo sapiens
uuaacacugugauaucuug

SEQ ID NO: 150423 - RNA, 19 nt, Homo sapiens
gccauagguucacaccauu

SEQ ID NO: 150424 - RNA, 19 nt, Homo sapiens
ccacucaucaacccacuaa

SEQ ID NO: 150425 - RNA, 19 nt, Homo sapiens
caacauagcucuuaacaac

SEQ ID NO: 150426 - RNA, 19 nt, Homo sapiens
gaagaacuauucacuguau

SEQ ID NO: 150427 - RNA, 19 nt, Homo sapiens
gaaaguauguacaagagaa

SEQ ID NO: 150428 - RNA, 19 nt, Homo sapiens
ggacagauucccauucuua

SEQ ID NO: 150429 - RNA, 19 nt, Homo sapiens
gcauguagaugauuaaaug

SEQ ID NO: 150430 - RNA, 19 nt, Homo sapiens
cagagugacuuucgaaaua

SEQ ID NO: 150431 - RNA, 19 nt, Homo sapiens
gaucaaaccucacaaagag

SEQ ID NO: 150432 - RNA, 19 nt, Homo sapiens
gcagaggacuggccauuug

SEQ ID NO: 150433 - RNA, 19 nt, Homo sapiens
ccagugaccucauaauaaa

SEQ ID NO: 150434 - RNA, 19 nt, Homo sapiens
ucaaggagacuuucaaaua

SEQ ID NO: 150435 - RNA, 19 nt, Homo sapiens
ucagaggccuguuaucaua

SEQ ID NO: 150436 - RNA, 19 nt, Homo sapiens
ucacugaauuccugcauua

SEQ ID NO: 150437 - RNA, 19 nt, Homo sapiens
gauauucacacaacacuua

SEQ ID NO: 150438 - RNA, 19 nt, Homo sapiens
gcagauugcuuuaaaugau

SEQ ID NO: 150439 - RNA, 19 nt, Homo sapiens
gaagcucacucuuuauaau

SEQ ID NO: 150440 - RNA, 19 nt, Homo sapiens
guacagacacuaauucauu

SEQ ID NO: 150441 - RNA, 19 nt, Homo sapiens
ggaauacaguuuauagcaa

SEQ ID NO: 150442 - RNA, 19 nt, Homo sapiens
gcaugcagauugcuuuaaa

SEQ ID NO: 150443 - RNA, 19 nt, Homo sapiens
guaauuagaugcaaaugag

SEQ ID NO: 150444 - RNA, 19 nt, Homo sapiens
aaauacagcucaucuugaa

SEQ ID NO: 150445 - RNA, 19 nt, Homo sapiens
caaaugagagagcaguuua

SEQ ID NO: 150446 - RNA, 19 nt, Homo sapiens
caaugggacucugauauaa

SEQ ID NO: 150447 - RNA, 19 nt, Homo sapiens
caaggagacuuucaaauac

SEQ ID NO: 150448 - RNA, 19 nt, Homo sapiens
ggaaauaagcuaguaaugu

SEQ ID NO: 150449 - RNA, 19 nt, Homo sapiens
ggacagcaguagaaauugu

SEQ ID NO: 150450 - RNA, 19 nt, Homo sapiens
gaaguuaucugcgaaucug

SEQ ID NO: 150451 - RNA, 19 nt, Homo sapiens
ccaaaggaauacaguuuau

SEQ ID NO: 150452 - RNA, 19 nt, Homo sapiens
gcaaagugccuuaggauag

SEQ ID NO: 150453 - RNA, 19 nt, Homo sapiens
gaaaaucagugggaauuaa

SEQ ID NO: 150454 - RNA, 19 nt, Homo sapiens
ccaacaauguggccagaaa

SEQ ID NO: 150455 - RNA, 19 nt, Homo sapiens
ugaaugugaugguacagua

SEQ ID NO: 150456 - RNA, 19 nt, Homo sapiens
gaagaauaagucacuguaa

SEQ ID NO: 150457 - RNA, 19 nt, Homo sapiens
ggaagaauaagucacugua

SEQ ID NO: 150458 - RNA, 19 nt, Homo sapiens
cuuaacaacuuccaggaua

SEQ ID NO: 150459 - RNA, 19 nt, Homo sapiens
guauuggacuauauuggua

SEQ ID NO: 150460 - RNA, 19 nt, Homo sapiens
ucacggauaugacaacuuc

SEQ ID NO: 150461 - RNA, 19 nt, Homo sapiens
ggaguagaauuaaaggaau

SEQ ID NO: 150462 - RNA, 19 nt, Homo sapiens
ugagagagcaguuuaguug

SEQ ID NO: 150463 - RNA, 19 nt, Homo sapiens
ucaaugggacucugauaua

SEQ ID NO: 150464 - RNA, 19 nt, Homo sapiens
acacaacacuuaggcuuaa

SEQ ID NO: 150465 - RNA, 19 nt, Homo sapiens
cuaaugaccugugaaaugu

SEQ ID NO: 150466 - RNA, 19 nt, Homo sapiens
gacaaguggacauuauuua

SEQ ID NO: 150467 - RNA, 19 nt, Homo sapiens
ccagaaagaaagagcaaua

SEQ ID NO: 150468 - RNA, 19 nt, Homo sapiens
ggccacauguuggaaauaa

SEQ ID NO: 150469 - RNA, 19 nt, Homo sapiens
gugcguuccugccuaauuu

SEQ ID NO: 150470 - RNA, 19 nt, Homo sapiens
caguuuaguuguugcauuu

SEQ ID NO: 150471 - RNA, 19 nt, Homo sapiens
gaaagaagaacuauucacu

SEQ ID NO: 150472 - RNA, 19 nt, Homo sapiens
cccaauagaugugaacuuu

SEQ ID NO: 150473 - RNA, 19 nt, Homo sapiens
uguguaagcuggugccuuu

SEQ ID NO: 150474 - RNA, 19 nt, Homo sapiens
gaaaggcuaucccaaaaga

SEQ ID NO: 150475 - RNA, 19 nt, Homo sapiens
gcgaaacggucccaauauc

SEQ ID NO: 150476 - RNA, 19 nt, Homo sapiens
ucaagcaaguaugaaguua

SEQ ID NO: 150477 - RNA, 19 nt, Homo sapiens
ugagaugugugugaaagua

SEQ ID NO: 150478 - RNA, 19 nt, Homo sapiens
gccagugaccucauaauaa

SEQ ID NO: 150479 - RNA, 19 nt, Homo sapiens
guaacagacuggcacaugu

SEQ ID NO: 150480 - RNA, 19 nt, Homo sapiens
aagaagaacuauucacugu

SEQ ID NO: 150481 - RNA, 19 nt, Homo sapiens
gcaguuuaguuguugcauu

SEQ ID NO: 150482 - RNA, 19 nt, Homo sapiens
gagagcaguuuaguuguug

SEQ ID NO: 150483 - RNA, 19 nt, Homo sapiens
ugugaaauguugagaaaga

SEQ ID NO: 150484 - RNA, 19 nt, Homo sapiens
uaaaguggcuauaguuacu

SEQ ID NO: 150485 - RNA, 19 nt, Homo sapiens
caacuuccguuccaguaau

SEQ ID NO: 150486 - RNA, 19 nt, Homo sapiens
gaaacggucccaauaucuu

SEQ ID NO: 150487 - RNA, 19 nt, Homo sapiens
gccaaaggaauacaguuua

SEQ ID NO: 150488 - RNA, 19 nt, Homo sapiens
gcccugugcucauagcuuu

SEQ ID NO: 150489 - RNA, 19 nt, Homo sapiens
ggacucugauauaaaggaa

SEQ ID NO: 150490 - RNA, 19 nt, Homo sapiens
gaucaaggagacuuucaaa

SEQ ID NO: 150491 - RNA, 19 nt, Homo sapiens
aaacuuggcucugaaacug

SEQ ID NO: 150492 - RNA, 19 nt, Homo sapiens
gcaaaccgcagagauaaug

SEQ ID NO: 150493 - RNA, 19 nt, Homo sapiens
gcaaaugagagagcaguuu

SEQ ID NO: 150494 - RNA, 19 nt, Homo sapiens
ccugugaaauguugagaaa

SEQ ID NO: 150495 - RNA, 19 nt, Homo sapiens
gaacuccacacuucugaga

SEQ ID NO: 150496 - RNA, 19 nt, Homo sapiens
ucaguaucauguucucuaa

SEQ ID NO: 150497 - RNA, 19 nt, Homo sapiens
uaaaucacccacaaacuug

SEQ ID NO: 150498 - RNA, 19 nt, Homo sapiens
gggaugagaugugugugaa

SEQ ID NO: 150499 - RNA, 19 nt, Homo sapiens
acauagcucuuaacaacuu

SEQ ID NO: 150500 - RNA, 19 nt, Homo sapiens
ucagaaugaucccaauaga

SEQ ID NO: 150501 - RNA, 19 nt, Homo sapiens
agagugacuuucgaaauaa

SEQ ID NO: 150502 - RNA, 19 nt, Homo sapiens
gcacagcacacuauuaaaa

SEQ ID NO: 150503 - RNA, 19 nt, Homo sapiens
agaaugaucccaauagaug

SEQ ID NO: 150504 - RNA, 19 nt, Homo sapiens
uaaaugaucaccuaaagca

SEQ ID NO: 150505 - RNA, 19 nt, Homo sapiens
auugauagcuuacauaugg

SEQ ID NO: 150506 - RNA, 19 nt, Homo sapiens
ggacuuuaauauagcaaca

SEQ ID NO: 150507 - RNA, 19 nt, Homo sapiens
gaugagaugugugugaaag

SEQ ID NO: 150508 - RNA, 19 nt, Homo sapiens
gcuguucaguuucuauuuc

SEQ ID NO: 150509 - RNA, 19 nt, Homo sapiens
ccuaaaguggcuauaguua

SEQ ID NO: 150510 - RNA, 19 nt, Homo sapiens
uaauguggauguauguuca

SEQ ID NO: 150511 - RNA, 19 nt, Homo sapiens
gagugacuuucgaaauaaa

SEQ ID NO: 150512 - RNA, 19 nt, Homo sapiens
uaauaaagacugugaacug

SEQ ID NO: 150513 - RNA, 19 nt, Homo sapiens
caauagaugugaacuuuug

SEQ ID NO: 150514 - RNA, 19 nt, Homo sapiens
ugacaaguggacauuauuu

SEQ ID NO: 150515 - RNA, 19 nt, Homo sapiens
ugcuguagcuaacuuuaua

SEQ ID NO: 150516 - RNA, 19 nt, Homo sapiens
ggccaaaggaauacaguuu

SEQ ID NO: 150517 - RNA, 19 nt, Homo sapiens
agagagcaguuuaguuguu

SEQ ID NO: 150518 - RNA, 19 nt, Homo sapiens
gcugaacacugggaaggaa

SEQ ID NO: 150519 - RNA, 19 nt, Homo sapiens
uaaauacagcucaucuuga

SEQ ID NO: 150520 - RNA, 19 nt, Homo sapiens
caaguggacauuauuuaug

SEQ ID NO: 150521 - RNA, 19 nt, Homo sapiens
acauauggccaaaggaaua

SEQ ID NO: 150522 - RNA, 19 nt, Homo sapiens
caauguggccagaaagaaa

SEQ ID NO: 150523 - RNA, 19 nt, Homo sapiens
ggacacuggaaacauuuaa

SEQ ID NO: 150524 - RNA, 19 nt, Homo sapiens
uaacccaauugcucuguau

SEQ ID NO: 150525 - RNA, 19 nt, Homo sapiens
gcagaggacuggccauuug

SEQ ID NO: 150526 - RNA, 19 nt, Homo sapiens
ucaaggagacuuucaaaua

SEQ ID NO: 150527 - RNA, 19 nt, Homo sapiens
ucacugaauuccugcauua

SEQ ID NO: 150528 - RNA, 19 nt, Homo sapiens
gcagauugcuuuaaaugau

SEQ ID NO: 150529 - RNA, 19 nt, Homo sapiens
gaagcucacucuuuauaau

SEQ ID NO: 150530 - RNA, 19 nt, Homo sapiens
gcaugcagauugcuuuaaa

SEQ ID NO: 150531 - RNA, 19 nt, Homo sapiens
caaagugucugucuuccuu

SEQ ID NO: 150532 - RNA, 19 nt, Homo sapiens
caaggagacuuucaaauac

SEQ ID NO: 150533 - RNA, 19 nt, Homo sapiens
ggaaauaagcuaguaaugu

SEQ ID NO: 150534 - RNA, 19 nt, Homo sapiens
ggacagcaguagaaauugu

SEQ ID NO: 150535 - RNA, 19 nt, Homo sapiens
gaaguuaucugcgaaucug

SEQ ID NO: 150536 - RNA, 19 nt, Homo sapiens
ccaacaauguggccagaaa

SEQ ID NO: 150537 - RNA, 19 nt, Homo sapiens
ugaaugugaugguacagua

SEQ ID NO: 150538 - RNA, 19 nt, Homo sapiens
guauuggacuauauuggua

SEQ ID NO: 150539 - RNA, 19 nt, Homo sapiens
ggaguagaauuaaaggaau

SEQ ID NO: 150540 - RNA, 19 nt, Homo sapiens
cuaaugaccugugaaaugu

SEQ ID NO: 150541 - RNA, 19 nt, Homo sapiens
ccagaaagaaagagcaaua

SEQ ID NO: 150542 - RNA, 19 nt, Homo sapiens
ggccacauguuggaaauaa

SEQ ID NO: 150543 - RNA, 19 nt, Homo sapiens
cccaauagaugugaacuuu

SEQ ID NO: 150544 - RNA, 19 nt, Homo sapiens
uguguaagcuggugccuuu

SEQ ID NO: 150545 - RNA, 19 nt, Homo sapiens
gcgaaacggucccaauauc

SEQ ID NO: 150546 - RNA, 19 nt, Homo sapiens
ugugaaauguugagaaaga

SEQ ID NO: 150547 - RNA, 19 nt, Homo sapiens
gaaacggucccaauaucuu

SEQ ID NO: 150548 - RNA, 19 nt, Homo sapiens
gaucaaggagacuuucaaa

SEQ ID NO: 150549 - RNA, 19 nt, Homo sapiens
ccugugaaauguugagaaa

SEQ ID NO: 150550 - RNA, 19 nt, Homo sapiens
gaacuccacacuucugaga

SEQ ID NO: 150551 - RNA, 19 nt, Homo sapiens
gcaaaccgcagagauaaug

SEQ ID NO: 150552 - RNA, 19 nt, Homo sapiens
ucagaaugaucccaauaga

SEQ ID NO: 150553 - RNA, 19 nt, Homo sapiens
agaaugaucccaauagaug

SEQ ID NO: 150554 - RNA, 19 nt, Homo sapiens
uaaaugaucaccuaaagca

SEQ ID NO: 150555 - RNA, 19 nt, Homo sapiens
gcuguucaguuucuauuuc

SEQ ID NO: 150556 - RNA, 19 nt, Homo sapiens
caauagaugugaacuuuug

SEQ ID NO: 150557 - RNA, 19 nt, Homo sapiens
caauguggccagaaagaaa

SEQ ID NO: 150558 - RNA, 19 nt, Homo sapiens
uaacccaauugcucuguau

SEQ ID NO: 150559 - RNA, 19 nt, Homo sapiens
cgaaucugcuugcuucauc

SEQ ID NO: 150560 - RNA, 19 nt, Homo sapiens
gcuguugcuucuuggagua

SEQ ID NO: 150561 - RNA, 19 nt, Homo sapiens
caauugcucuguauuuggu

SEQ ID NO: 150562 - RNA, 19 nt, Homo sapiens
caccauauggauucuauuu

SEQ ID NO: 150563 - RNA, 19 nt, Homo sapiens
gaaugugaugguacaguaa

SEQ ID NO: 150564 - RNA, 19 nt, Homo sapiens
uucugaagcucacucuuua

SEQ ID NO: 150565 - RNA, 19 nt, Homo sapiens
agacagcuuucaugcaguu

SEQ ID NO: 150566 - RNA, 19 nt, Homo sapiens
ggacuacaaaggaaguuau

SEQ ID NO: 150567 - RNA, 19 nt, Homo sapiens
uaaugacgccacccacuaa

SEQ ID NO: 150568 - RNA, 19 nt, Homo sapiens
ucacacaccauauggauuc

SEQ ID NO: 150569 - RNA, 19 nt, Homo sapiens
gaugugaacuuuugagcuu

SEQ ID NO: 150570 - RNA, 19 nt, Homo sapiens
aaagauugguggcuguuca

SEQ ID NO: 150571 - RNA, 19 nt, Homo sapiens
auugguggcuguucaguuu

SEQ ID NO: 150572 - RNA, 19 nt, Homo sapiens
cagaaagaaagagcaauaa

SEQ ID NO: 150573 - RNA, 19 nt, Homo sapiens
uaugugcucugaguauuga

SEQ ID NO: 150574 - RNA, 19 nt, Homo sapiens
cugaagcucacucuuuaua

SEQ ID NO: 150575 - RNA, 19 nt, Homo sapiens
gugaaauguugagaaagaa

SEQ ID NO: 150576 - RNA, 19 nt, Homo sapiens
cccaauugcucuguauuug

SEQ ID NO: 150577 - RNA, 19 nt, Homo sapiens
ggacuauauugguaucaac

SEQ ID NO: 150578 - RNA, 19 nt, Homo sapiens
cagauugcuuuaaaugauc

SEQ ID NO: 150579 - RNA, 19 nt, Homo sapiens
acacuaaugaccugugaaa

SEQ ID NO: 150580 - RNA, 19 nt, Homo sapiens
ugaagcucacucuuuauaa

SEQ ID NO: 150581 - RNA, 19 nt, Homo sapiens
acuaaugaccugugaaaug

SEQ ID NO: 150582 - RNA, 19 nt, Homo sapiens
agccauagguuuugauaua

SEQ ID NO: 150583 - RNA, 19 nt, Homo sapiens
ugauuuggguggucucugu

SEQ ID NO: 150584 - RNA, 19 nt, Homo sapiens
aaugaccugugaaauguug

SEQ ID NO: 150585 - RNA, 19 nt, Homo sapiens
gcuggugccuuucauacag

SEQ ID NO: 150586 - RNA, 19 nt, Homo sapiens
cacaccauauggauucuau

SEQ ID NO: 150587 - RNA, 19 nt, Homo sapiens
ugagcuuucuguugguauu

SEQ ID NO: 150588 - RNA, 19 nt, Homo sapiens
ucagaagacagcuuucaug

SEQ ID NO: 150589 - RNA, 19 nt, Homo sapiens
ccaaggacccaucgagauc

SEQ ID NO: 150590 - RNA, 19 nt, Homo sapiens
gaaugaucccaauagaugu

SEQ ID NO: 150591 - RNA, 19 nt, Homo sapiens
aaggagacuuucaaauaca

SEQ ID NO: 150592 - RNA, 19 nt, Homo sapiens
cagcuuucaugcaguuuua

SEQ ID NO: 150593 - RNA, 19 nt, Homo sapiens
gguucuggcugucccugaa

SEQ ID NO: 150594 - RNA, 19 nt, Homo sapiens
gagucuaugugcucugagu

SEQ ID NO: 150595 - RNA, 19 nt, Homo sapiens
gguauuggacuauauuggu

SEQ ID NO: 150596 - RNA, 19 nt, Homo sapiens
gacagggccacuccgcuuu

SEQ ID NO: 150597 - RNA, 19 nt, Homo sapiens
auacacuaaugaccuguga

SEQ ID NO: 150598 - RNA, 19 nt, Homo sapiens
uggaguagaauuaaaggaa

SEQ ID NO: 150599 - RNA, 19 nt, Homo sapiens
uaagcuggugccuuucaua

SEQ ID NO: 150600 - RNA, 19 nt, Homo sapiens
cuauauugguaucaacaug

SEQ ID NO: 150601 - RNA, 19 nt, Homo sapiens
aaacggucccaauaucuug

SEQ ID NO: 150602 - RNA, 19 nt, Homo sapiens
caugcagauugcuuuaaau

SEQ ID NO: 150603 - RNA, 19 nt, Homo sapiens
ucucuaggcucugaaacug

SEQ ID NO: 150604 - RNA, 19 nt, Homo sapiens
ucuaugugcucugaguauu

SEQ ID NO: 150605 - RNA, 19 nt, Homo sapiens
uuaauucacacaccauaug

SEQ ID NO: 150606 - RNA, 19 nt, Homo sapiens
guaagcuggugccuuucau

SEQ ID NO: 150607 - RNA, 19 nt, Homo sapiens
ugggagaccugcugcacau

SEQ ID NO: 150608 - RNA, 19 nt, Homo sapiens
cgaaacggucccaauaucu

SEQ ID NO: 150609 - RNA, 19 nt, Homo sapiens
uuaacccaauugcucugua

SEQ ID NO: 150610 - RNA, 19 nt, Homo sapiens
cagaaugaucccaauagau

SEQ ID NO: 150611 - RNA, 19 nt, Homo sapiens
cauuggccaucacugcauu

SEQ ID NO: 150612 - RNA, 19 nt, Homo sapiens
ggaaguuaucugcgaaucu

SEQ ID NO: 150613 - RNA, 19 nt, Homo sapiens
gccauagguuuugauauaa

SEQ ID NO: 150614 - RNA, 19 nt, Homo sapiens
gacagcaguagaaauuguu

SEQ ID NO: 150615 - RNA, 19 nt, Homo sapiens
agucaugagcgccaaguuu

SEQ ID NO: 150616 - RNA, 19 nt, Homo sapiens
gaagccauagguuuugaua

SEQ ID NO: 150617 - RNA, 19 nt, Homo sapiens
cugcggaggugccuaaagg

SEQ ID NO: 150618 - RNA, 19 nt, Homo sapiens
gcuugucucuaggcucuga

SEQ ID NO: 150619 - RNA, 19 nt, Homo sapiens
gccaaggacccaucgagau

SEQ ID NO: 150620 - RNA, 19 nt, Homo sapiens
gaacaagugcaugcgaaac

SEQ ID NO: 150621 - RNA, 19 nt, Homo sapiens
auaaugacgccacccacua

SEQ ID NO: 150622 - RNA, 19 nt, Homo sapiens
gggaacuccacacuucuga

SEQ ID NO: 150623 - RNA, 19 nt, Homo sapiens
guaauguuguuuucuguca

SEQ ID NO: 150624 - RNA, 19 nt, Homo sapiens
guaucaacauggcuucacu

SEQ ID NO: 150625 - RNA, 19 nt, Homo sapiens
gaagagaagugcaagaauu

SEQ ID NO: 150626 - RNA, 19 nt, Homo sapiens
ccagauagcucaaauguca

SEQ ID NO: 150627 - RNA, 19 nt, Homo sapiens
gcuaagagguacaauguga

SEQ ID NO: 150628 - RNA, 19 nt, Homo sapiens
gagaaggucuugagucaga

SEQ ID NO: 150629 - RNA, 19 nt, Homo sapiens
gcucaaaugucacuuuaug

SEQ ID NO: 150630 - RNA, 19 nt, Homo sapiens
gcauuuagcccaggucuua

SEQ ID NO: 150631 - RNA, 19 nt, Homo sapiens
gagcagaacuccaauucca

SEQ ID NO: 150632 - RNA, 19 nt, Homo sapiens
gcgagaaggucuugaguca

SEQ ID NO: 150633 - RNA, 19 nt, Homo sapiens
ggaauuacauggcaucaac

SEQ ID NO: 150634 - RNA, 19 nt, Homo sapiens
ggaacuggguggaauguca

SEQ ID NO: 150635 - RNA, 19 nt, Homo sapiens
ucacguaccuuaauccaau

SEQ ID NO: 150636 - RNA, 19 nt, Homo sapiens
gcaaggaacuggguggaau

SEQ ID NO: 150637 - RNA, 19 nt, Homo sapiens
guucagauaauuccaguua

SEQ ID NO: 150638 - RNA, 19 nt, Homo sapiens
ccacaucauugaaggcuuu

SEQ ID NO: 150639 - RNA, 19 nt, Homo sapiens
uagcucaaaugucacuuua

SEQ ID NO: 150640 - RNA, 19 nt, Homo sapiens
gaacuuggcaguaaggaau

SEQ ID NO: 150641 - RNA, 19 nt, Homo sapiens
gcucuguccuauagcuuua

SEQ ID NO: 150642 - RNA, 19 nt, Homo sapiens
ggacagcacaugugguaaa

SEQ ID NO: 150643 - RNA, 19 nt, Homo sapiens
gaacuccaauuccaccaau

SEQ ID NO: 150644 - RNA, 19 nt, Homo sapiens
gaagcacucucuccaacau

SEQ ID NO: 150645 - RNA, 19 nt, Homo sapiens
guaccuuaauccaaucuuu

SEQ ID NO: 150646 - RNA, 19 nt, Homo sapiens
agaaagaguuguuccaauc

SEQ ID NO: 150647 - RNA, 19 nt, Homo sapiens
caauacagcuccaccuaca

SEQ ID NO: 150648 - RNA, 19 nt, Homo sapiens
ccaaugcagcucaguauuu

SEQ ID NO: 150649 - RNA, 19 nt, Homo sapiens
ccaagaggaggaauacaua

SEQ ID NO: 150650 - RNA, 19 nt, Homo sapiens
uagaggagguguacgaguu

SEQ ID NO: 150651 - RNA, 19 nt, Homo sapiens
gaagaaagaguuguuccaa

SEQ ID NO: 150652 - RNA, 19 nt, Homo sapiens
caagaucaauguccucaag

SEQ ID NO: 150653 - RNA, 19 nt, Homo sapiens
gcaggcacauggugguuug

SEQ ID NO: 150654 - RNA, 19 nt, Homo sapiens
caaggcaucuccaguagca

SEQ ID NO: 150655 - RNA, 19 nt, Homo sapiens
uggcuaaugugaaugcuaa

SEQ ID NO: 150656 - RNA, 19 nt, Homo sapiens
uaucaagccgccucaguua

SEQ ID NO: 150657 - RNA, 19 nt, Homo sapiens
gaggucaggaguauaagua

SEQ ID NO: 150658 - RNA, 19 nt, Homo sapiens
acauguggcuguugucauu

SEQ ID NO: 150659 - RNA, 19 nt, Homo sapiens
gaggcagucuagagaacua

SEQ ID NO: 150660 - RNA, 19 nt, Homo sapiens
gaaagaguuguuccaauca

SEQ ID NO: 150661 - RNA, 19 nt, Homo sapiens
gaggagguguacgaguuua

SEQ ID NO: 150662 - RNA, 19 nt, Homo sapiens
caacaucuccugggccuuu

SEQ ID NO: 150663 - RNA, 19 nt, Homo sapiens
caaugcagcucaguauuuc

SEQ ID NO: 150664 - RNA, 19 nt, Homo sapiens
cgacaggcuugacugagaa

SEQ ID NO: 150665 - RNA, 19 nt, Homo sapiens
caacaggccucagcucaag

SEQ ID NO: 150666 - RNA, 19 nt, Homo sapiens
ccacuaucauggagacuga

SEQ ID NO: 150667 - RNA, 19 nt, Homo sapiens
ggcggcagcuuugacauuu

SEQ ID NO: 150668 - RNA, 19 nt, Homo sapiens
gcagaaagcccaaaaguca

SEQ ID NO: 150669 - RNA, 19 nt, Homo sapiens
uuacaguucucaccauuuc

SEQ ID NO: 150670 - RNA, 19 nt, Homo sapiens
ucaaggaccucagaugcaa

SEQ ID NO: 150671 - RNA, 19 nt, Homo sapiens
uccaagcagugaacuagua

SEQ ID NO: 150672 - RNA, 19 nt, Homo sapiens
ccauaucccugugcaaguu

SEQ ID NO: 150673 - RNA, 19 nt, Homo sapiens
gcgcccagccagacacuua

SEQ ID NO: 150674 - RNA, 19 nt, Homo sapiens
ccaagagauugcagaggaa

SEQ ID NO: 150675 - RNA, 19 nt, Homo sapiens
gcgcuaagagguacaaugu

SEQ ID NO: 150676 - RNA, 19 nt, Homo sapiens
gaaggcgaaucuccugaag

SEQ ID NO: 150677 - RNA, 19 nt, Homo sapiens
caagaaggcagaagcagau

SEQ ID NO: 150678 - RNA, 19 nt, Homo sapiens
ucucugcucuguccuauag

SEQ ID NO: 150679 - RNA, 19 nt, Homo sapiens
gggcacauguggcuguugu

SEQ ID NO: 150680 - RNA, 19 nt, Homo sapiens
gggaagagaagugcaagaa

SEQ ID NO: 150681 - RNA, 19 nt, Homo sapiens
ggcagacacucuccacugu

SEQ ID NO: 150682 - RNA, 19 nt, Homo sapiens
ggcacuauuccuuauauaa

SEQ ID NO: 150683 - RNA, 19 nt, Homo sapiens
agacuugguuggcaucuuc

SEQ ID NO: 150684 - RNA, 19 nt, Homo sapiens
ggaagagaagugcaagaau

SEQ ID NO: 150685 - RNA, 19 nt, Homo sapiens
aggcgaaucuccugaagug

SEQ ID NO: 150686 - RNA, 19 nt, Homo sapiens
ccgacaggcuugacugaga

SEQ ID NO: 150687 - RNA, 19 nt, Homo sapiens
acaaaugggugacucaaaa

SEQ ID NO: 150688 - RNA, 19 nt, Homo sapiens
ggaguggccagcagaaugu

SEQ ID NO: 150689 - RNA, 19 nt, Homo sapiens
gcacuauuccuuauauaac

SEQ ID NO: 150690 - RNA, 19 nt, Homo sapiens
gccaaggcaucuccaguag

SEQ ID NO: 150691 - RNA, 19 nt, Homo sapiens
ccucuagccucccaacuca

SEQ ID NO: 150692 - RNA, 19 nt, Homo sapiens
gcuaaugugaaugcuaaua

SEQ ID NO: 150693 - RNA, 19 nt, Homo sapiens
ccacaaaccagucccucaa

SEQ ID NO: 150694 - RNA, 19 nt, Homo sapiens
gcuaccaccuugacccaau

SEQ ID NO: 150695 - RNA, 19 nt, Homo sapiens
ucuggguucuacuuuauuu

SEQ ID NO: 150696 - RNA, 19 nt, Homo sapiens
cuacauggcggcagcuuug

SEQ ID NO: 150697 - RNA, 19 nt, Homo sapiens
aagaaagaguuguuccaau

SEQ ID NO: 150698 - RNA, 19 nt, Homo sapiens
ccaaggcugccaagagauu

SEQ ID NO: 150699 - RNA, 19 nt, Homo sapiens
cuccaaggcugccaagaga

SEQ ID NO: 150700 - RNA, 19 nt, Homo sapiens
guuuauugcuucucuccaa

SEQ ID NO: 150701 - RNA, 19 nt, Homo sapiens
aguaagagcugggcaugga

SEQ ID NO: 150702 - RNA, 19 nt, Homo sapiens
aagagguucugcuccauga

SEQ ID NO: 150703 - RNA, 19 nt, Homo sapiens
cugcugaguuagauaagaa

SEQ ID NO: 150704 - RNA, 19 nt, Homo sapiens
augcaaggcuccacucaga

SEQ ID NO: 150705 - RNA, 19 nt, Homo sapiens
uaggcacuauuccuuauau

SEQ ID NO: 150706 - RNA, 19 nt, Homo sapiens
agaggaggaauacauagua

SEQ ID NO: 150707 - RNA, 19 nt, Homo sapiens
guucucaccauuucacgua

SEQ ID NO: 150708 - RNA, 19 nt, Homo sapiens
ucucuggguucuacuuuau

SEQ ID NO: 150709 - RNA, 19 nt, Homo sapiens
gacaaaugggugacucaaa

SEQ ID NO: 150710 - RNA, 19 nt, Homo sapiens
cuuacucccuugugauuga

SEQ ID NO: 150711 - RNA, 19 nt, Homo sapiens
cagcagcagcucaguaaug

SEQ ID NO: 150712 - RNA, 19 nt, Homo sapiens
ggagguguacgaguuuauu

SEQ ID NO: 150713 - RNA, 19 nt, Homo sapiens
ccgcagcuccucugacauu

SEQ ID NO: 150714 - RNA, 19 nt, Homo sapiens
ggucccugcugccuucuau

SEQ ID NO: 150715 - RNA, 19 nt, Homo sapiens
agaaacagguggugaucca

SEQ ID NO: 150716 - RNA, 19 nt, Homo sapiens
gacccaaucugugcuacug

SEQ ID NO: 150717 - RNA, 19 nt, Homo sapiens
gcgagcagaacuccaauuc

SEQ ID NO: 150718 - RNA, 19 nt, Homo sapiens
ugagugccaugaacaucaa

SEQ ID NO: 150719 - RNA, 19 nt, Homo sapiens
gcaaggcuccacucagaag

SEQ ID NO: 150720 - RNA, 19 nt, Homo sapiens
caccauuucacguaccuua

SEQ ID NO: 150721 - RNA, 19 nt, Homo sapiens
gaugaagcacucucuccaa

SEQ ID NO: 150722 - RNA, 19 nt, Homo sapiens
gaaagugcagcagccaaga

SEQ ID NO: 150723 - RNA, 19 nt, Homo sapiens
aagagaagugcaagaauug

SEQ ID NO: 150724 - RNA, 19 nt, Homo sapiens
ccaaucauguaaccuucug

SEQ ID NO: 150725 - RNA, 19 nt, Homo sapiens
agacggcgcuucagaguuu

SEQ ID NO: 150726 - RNA, 19 nt, Homo sapiens
ggaaagaacagcuggaguu

SEQ ID NO: 150727 - RNA, 19 nt, Homo sapiens
ucagauaacucaagcuaug

SEQ ID NO: 150728 - RNA, 19 nt, Homo sapiens
ucacaaagagcauuaagaa

SEQ ID NO: 150729 - RNA, 19 nt, Homo sapiens
ggagauagcagaggaauuc

SEQ ID NO: 150730 - RNA, 19 nt, Homo sapiens
gaaagaacagcuggaguuu

SEQ ID NO: 150731 - RNA, 19 nt, Homo sapiens
caagugagccaccaaguga

SEQ ID NO: 150732 - RNA, 19 nt, Homo sapiens
gaagacgucuacgaauuca

SEQ ID NO: 150733 - RNA, 19 nt, Homo sapiens
gagcagagccagacagaca

SEQ ID NO: 150734 - RNA, 19 nt, Homo sapiens
ggguggacuuugccuauaa

SEQ ID NO: 150735 - RNA, 19 nt, Homo sapiens
gagccuggacugacagaua

SEQ ID NO: 150736 - RNA, 19 nt, Homo sapiens
caaagagcauuaagaaagc

SEQ ID NO: 150737 - RNA, 19 nt, Homo sapiens
caaauccugacgcauguua

SEQ ID NO: 150738 - RNA, 19 nt, Homo sapiens
ccacacuucuuugccuaua

SEQ ID NO: 150739 - RNA, 19 nt, Homo sapiens
acaaagagcauuaagaaag

SEQ ID NO: 150740 - RNA, 19 nt, Homo sapiens
agagguagguggcacagaa

SEQ ID NO: 150741 - RNA, 19 nt, Homo sapiens
ccagaauggugagaauaaa

SEQ ID NO: 150742 - RNA, 19 nt, Homo sapiens
gaaagcccuugccuuccuu

SEQ ID NO: 150743 - RNA, 19 nt, Homo sapiens
ucagccagcucaucuacuu

SEQ ID NO: 150744 - RNA, 19 nt, Homo sapiens
gcucagauaacucaagcua

SEQ ID NO: 150745 - RNA, 19 nt, Homo sapiens
acacuucuuugccuauaaa

SEQ ID NO: 150746 - RNA, 19 nt, Homo sapiens
cagcuggaguuucuguuga

SEQ ID NO: 150747 - RNA, 19 nt, Homo sapiens
gcagaggcaaggucagaaa

SEQ ID NO: 150748 - RNA, 19 nt, Homo sapiens
gcacuggcuuccuccaaag

SEQ ID NO: 150749 - RNA, 19 nt, Homo sapiens
ggaaucucaagaagaagua

SEQ ID NO: 150750 - RNA, 19 nt, Homo sapiens
gaguuucuguugaugugaa

SEQ ID NO: 150751 - RNA, 19 nt, Homo sapiens
caacgugggaugcaccaaa

SEQ ID NO: 150752 - RNA, 19 nt, Homo sapiens
ggaggagcccuaucugcaa

SEQ ID NO: 150753 - RNA, 19 nt, Homo sapiens
ccaagugaauguagaagac

SEQ ID NO: 150754 - RNA, 19 nt, Homo sapiens
gccagucugccaccacuua

SEQ ID NO: 150755 - RNA, 19 nt, Homo sapiens
gguuggaaaugaaggacuu

SEQ ID NO: 150756 - RNA, 19 nt, Homo sapiens
agaaagagacggcgcuuca

SEQ ID NO: 150757 - RNA, 19 nt, Homo sapiens
gguuaacucuuccguuguc

SEQ ID NO: 150758 - RNA, 19 nt, Homo sapiens
caaggaggaccaccugaug

SEQ ID NO: 150759 - RNA, 19 nt, Homo sapiens
uaacacacagccaggaaga

SEQ ID NO: 150760 - RNA, 19 nt, Homo sapiens
ccaaggauaccaagaagca

SEQ ID NO: 150761 - RNA, 19 nt, Homo sapiens
gaaagcugcgguggucuga

SEQ ID NO: 150762 - RNA, 19 nt, Homo sapiens
caaagucccaauacucuag

SEQ ID NO: 150763 - RNA, 19 nt, Homo sapiens
gcagagccagacagacauu

SEQ ID NO: 150764 - RNA, 19 nt, Homo sapiens
gaggcaaggucagaaagag

SEQ ID NO: 150765 - RNA, 19 nt, Homo sapiens
caggcaggguuggaaauga

SEQ ID NO: 150766 - RNA, 19 nt, Homo sapiens
cccagaauggugagaauaa

SEQ ID NO: 150767 - RNA, 19 nt, Homo sapiens
ccaaagucccaauacucua

SEQ ID NO: 150768 - RNA, 19 nt, Homo sapiens
cggguggacuuugccuaua

SEQ ID NO: 150769 - RNA, 19 nt, Homo sapiens
aggcaggguuggaaaugaa

SEQ ID NO: 150770 - RNA, 19 nt, Homo sapiens
ugaccgcccuccugguuca

SEQ ID NO: 150771 - RNA, 19 nt, Homo sapiens
gggcagggcauuguucaug

SEQ ID NO: 150772 - RNA, 19 nt, Homo sapiens
agaagacgucuacgaauuc

SEQ ID NO: 150773 - RNA, 19 nt, Homo sapiens
gggcaugggacaccacuuc

SEQ ID NO: 150774 - RNA, 19 nt, Homo sapiens
ggagcccuaucugcaagaa

SEQ ID NO: 150775 - RNA, 19 nt, Homo sapiens
gcgcuucagaguuuccuuu

SEQ ID NO: 150776 - RNA, 19 nt, Homo sapiens
aaagagacggcgcuucaga

SEQ ID NO: 150777 - RNA, 19 nt, Homo sapiens
gggcuacucucuggcaucu

SEQ ID NO: 150778 - RNA, 19 nt, Homo sapiens
gaacccuugucacccaucu

SEQ ID NO: 150779 - RNA, 19 nt, Homo sapiens
uuaccaaggauaccaagaa

SEQ ID NO: 150780 - RNA, 19 nt, Homo sapiens
guuccaagcgcuucuguuc

SEQ ID NO: 150781 - RNA, 19 nt, Homo sapiens
cacacuucuuugccuauaa

SEQ ID NO: 150782 - RNA, 19 nt, Homo sapiens
cacaaagagcauuaagaaa

SEQ ID NO: 150783 - RNA, 19 nt, Homo sapiens
ccaagugagccaccaagug

SEQ ID NO: 150784 - RNA, 19 nt, Homo sapiens
gaaacucugccuccagcau

SEQ ID NO: 150785 - RNA, 19 nt, Homo sapiens
ggauggaggccuagaaagc

SEQ ID NO: 150786 - RNA, 19 nt, Homo sapiens
ggagauggaggagcccuau

SEQ ID NO: 150787 - RNA, 19 nt, Homo sapiens
cuuccuagcagcaauuuga

SEQ ID NO: 150788 - RNA, 19 nt, Homo sapiens
agaguuuccuuuccagaca

SEQ ID NO: 150789 - RNA, 19 nt, Homo sapiens
gcgcagaggcaaggucaga

SEQ ID NO: 150790 - RNA, 19 nt, Homo sapiens
uguagcaaacagccacuua

SEQ ID NO: 150791 - RNA, 19 nt, Homo sapiens
cccaaauccugacgcaugu

SEQ ID NO: 150792 - RNA, 19 nt, Homo sapiens
ccaccaagugaauguagaa

SEQ ID NO: 150793 - RNA, 19 nt, Homo sapiens
ccugacgcauguuaucgaa

SEQ ID NO: 150794 - RNA, 19 nt, Homo sapiens
uaccaaggauaccaagaag

SEQ ID NO: 150795 - RNA, 19 nt, Homo sapiens
cccucaaacucaaguguga

SEQ ID NO: 150796 - RNA, 19 nt, Homo sapiens
gugggagccuggacugaca

SEQ ID NO: 150797 - RNA, 19 nt, Homo sapiens
cacagaagauggggcuuua

SEQ ID NO: 150798 - RNA, 19 nt, Homo sapiens
guuccugccugagaaacuu

SEQ ID NO: 150799 - RNA, 19 nt, Homo sapiens
ugccaccacuuaccaagga

SEQ ID NO: 150800 - RNA, 19 nt, Homo sapiens
uuccauggcuugugcaaag

SEQ ID NO: 150801 - RNA, 19 nt, Homo sapiens
gggaaucucaagaagaagu

SEQ ID NO: 150802 - RNA, 19 nt, Homo sapiens
ccuuaacgcuguguguaug

SEQ ID NO: 150803 - RNA, 19 nt, Homo sapiens
uaucgaaggguuugugauc

SEQ ID NO: 150804 - RNA, 19 nt, Homo sapiens
guagguggcacagaagaug

SEQ ID NO: 150805 - RNA, 19 nt, Homo sapiens
gccaccaagugaauguaga

SEQ ID NO: 150806 - RNA, 19 nt, Homo sapiens
uggaguuucuguugaugug

SEQ ID NO: 150807 - RNA, 19 nt, Homo sapiens
cuucagaguuuccuuucca

SEQ ID NO: 150808 - RNA, 19 nt, Homo sapiens
gagacggcgcuucagaguu

SEQ ID NO: 150809 - RNA, 19 nt, Homo sapiens
agaaagcccuugccuuccu

SEQ ID NO: 150810 - RNA, 19 nt, Homo sapiens
ccacugacucggagaugga

SEQ ID NO: 150811 - RNA, 19 nt, Homo sapiens
gaccugccguguccuuugc

SEQ ID NO: 150812 - RNA, 19 nt, Homo sapiens
gcgguggucugagcaacau

SEQ ID NO: 150813 - RNA, 19 nt, Homo sapiens
guagcaaacagccacuuag

SEQ ID NO: 150814 - RNA, 19 nt, Homo sapiens
uccagccguugcucagaua

SEQ ID NO: 150815 - RNA, 19 nt, Homo sapiens
gugcaaagagguacaacgu

SEQ ID NO: 150816 - RNA, 19 nt, Homo sapiens
gguggacuuugccuauaag

SEQ ID NO: 150817 - RNA, 19 nt, Homo sapiens
cagauaacucaagcuauga

SEQ ID NO: 150818 - RNA, 19 nt, Homo sapiens
uccaagcgcuucuguucca

SEQ ID NO: 150819 - RNA, 19 nt, Homo sapiens
uggggaaucucaagaagaa

SEQ ID NO: 150820 - RNA, 19 nt, Homo sapiens
gcauguuaucgaaggguuu

SEQ ID NO: 150821 - RNA, 19 nt, Homo sapiens
agcacuggcuuccuccaaa

SEQ ID NO: 150822 - RNA, 19 nt, Homo sapiens
gcuggaguuucuguugaug

SEQ ID NO: 150823 - RNA, 19 nt, Homo sapiens
uagcaaacagccacuuagu

SEQ ID NO: 150824 - RNA, 19 nt, Homo sapiens
caucucagccagcucaucu

SEQ ID NO: 150825 - RNA, 19 nt, Homo sapiens
gaagagauaugaggaaauu

SEQ ID NO: 150826 - RNA, 19 nt, Homo sapiens
ucagaaggcuaaaugaaua

SEQ ID NO: 150827 - RNA, 19 nt, Homo sapiens
gaaggaggcugcugagaug

SEQ ID NO: 150828 - RNA, 19 nt, Homo sapiens
ggaaacaacuugaccaaaa

SEQ ID NO: 150829 - RNA, 19 nt, Homo sapiens
guaaaagacugguuaauga

SEQ ID NO: 150830 - RNA, 19 nt, Homo sapiens
gauggaaagucacccguaa

SEQ ID NO: 150831 - RNA, 19 nt, Homo sapiens
gaagauggcccuaaauucu

SEQ ID NO: 150832 - RNA, 19 nt, Homo sapiens
gaagaacggucucagaacu

SEQ ID NO: 150833 - RNA, 19 nt, Homo sapiens
ucaaagcaguggacaagaa

SEQ ID NO: 150834 - RNA, 19 nt, Homo sapiens
acacagagacuuuaucaaa

SEQ ID NO: 150835 - RNA, 19 nt, Homo sapiens
gcugguaucuccaagaaug

SEQ ID NO: 150836 - RNA, 19 nt, Homo sapiens
gaaugugucugucaaggau

SEQ ID NO: 150837 - RNA, 19 nt, Homo sapiens
ggucuuggauaaacugaaa

SEQ ID NO: 150838 - RNA, 19 nt, Homo sapiens
gaaggaaaggagaauguuu

SEQ ID NO: 150839 - RNA, 19 nt, Homo sapiens
ugacugugcuguccugauu

SEQ ID NO: 150840 - RNA, 19 nt, Homo sapiens
gcuggaagauggcccuaaa

SEQ ID NO: 150841 - RNA, 19 nt, Homo sapiens
gaaagucacccguaaggau

SEQ ID NO: 150842 - RNA, 19 nt, Homo sapiens
ucucagaacuguuuguuuc

SEQ ID NO: 150843 - RNA, 19 nt, Homo sapiens
ggacacagagacuuuauca

SEQ ID NO: 150844 - RNA, 19 nt, Homo sapiens
ugauaacaaugcaucguaa

SEQ ID NO: 150845 - RNA, 19 nt, Homo sapiens
cagaagagauaugaggaaa

SEQ ID NO: 150846 - RNA, 19 nt, Homo sapiens
ucaauuggccauuuaaguu

SEQ ID NO: 150847 - RNA, 19 nt, Homo sapiens
ggaagauggcccuaaauuc

SEQ ID NO: 150848 - RNA, 19 nt, Homo sapiens
caacuaauugucgguguua

SEQ ID NO: 150849 - RNA, 19 nt, Homo sapiens
gaacuguuuguuucaauug

SEQ ID NO: 150850 - RNA, 19 nt, Homo sapiens
gcaaguacuaugugacuau

SEQ ID NO: 150851 - RNA, 19 nt, Homo sapiens
uaucaacauugucgucauu

SEQ ID NO: 150852 - RNA, 19 nt, Homo sapiens
ucaagaaugugucugucaa

SEQ ID NO: 150853 - RNA, 19 nt, Homo sapiens
gugcuaacaugccuugguu

SEQ ID NO: 150854 - RNA, 19 nt, Homo sapiens
ugaggaaauuguuaaggaa

SEQ ID NO: 150855 - RNA, 19 nt, Homo sapiens
gauaucuccuuguggaaau

SEQ ID NO: 150856 - RNA, 19 nt, Homo sapiens
caauuggccauuuaaguuu

SEQ ID NO: 150857 - RNA, 19 nt, Homo sapiens
ccaugaagcuuugagugaa

SEQ ID NO: 150858 - RNA, 19 nt, Homo sapiens
ggagccaagugcuaacaug

SEQ ID NO: 150859 - RNA, 19 nt, Homo sapiens
ggaaaagacucauaucaac

SEQ ID NO: 150860 - RNA, 19 nt, Homo sapiens
agacucauaucaacauugu

SEQ ID NO: 150861 - RNA, 19 nt, Homo sapiens
gcucagaaggcuaaaugaa

SEQ ID NO: 150862 - RNA, 19 nt, Homo sapiens
agaaagcucagaaggcuaa

SEQ ID NO: 150863 - RNA, 19 nt, Homo sapiens
gcaagcccauguguguuga

SEQ ID NO: 150864 - RNA, 19 nt, Homo sapiens
ggugugaaacaacuaauug

SEQ ID NO: 150865 - RNA, 19 nt, Homo sapiens
gauuguugcugcugguguu

SEQ ID NO: 150866 - RNA, 19 nt, Homo sapiens
ccauugauaucuccuugug

SEQ ID NO: 150867 - RNA, 19 nt, Homo sapiens
gaaaggaaaagacucauau

SEQ ID NO: 150868 - RNA, 19 nt, Homo sapiens
aagcugguaucuccaagaa

SEQ ID NO: 150869 - RNA, 19 nt, Homo sapiens
cuggccaucugaucuauaa

SEQ ID NO: 150870 - RNA, 19 nt, Homo sapiens
gauaacaaugcaucguaaa

SEQ ID NO: 150871 - RNA, 19 nt, Homo sapiens
ggaaauuguuaaggaaguc

SEQ ID NO: 150872 - RNA, 19 nt, Homo sapiens
gccaucugaucuauaaaug

SEQ ID NO: 150873 - RNA, 19 nt, Homo sapiens
agcaugcccuucuggcuua

SEQ ID NO: 150874 - RNA, 19 nt, Homo sapiens
gcccuaaauucuugaaguc

SEQ ID NO: 150875 - RNA, 19 nt, Homo sapiens
caaguuugcugagcugaag

SEQ ID NO: 150876 - RNA, 19 nt, Homo sapiens
ucuccaggaugucuacaaa

SEQ ID NO: 150877 - RNA, 19 nt, Homo sapiens
uagcauuugugccaauuuc

SEQ ID NO: 150878 - RNA, 19 nt, Homo sapiens
gaaaggagaauguuuugug

SEQ ID NO: 150879 - RNA, 19 nt, Homo sapiens
cuuaaucagugguggaaga

SEQ ID NO: 150880 - RNA, 19 nt, Homo sapiens
gagauaugaggaaauuguu

SEQ ID NO: 150881 - RNA, 19 nt, Homo sapiens
caacauugucgucauugga

SEQ ID NO: 150882 - RNA, 19 nt, Homo sapiens
cagaacuguuuguuucaau

SEQ ID NO: 150883 - RNA, 19 nt, Homo sapiens
ucagaacuguuuguuucaa

SEQ ID NO: 150884 - RNA, 19 nt, Homo sapiens
uggaagauggcccuaaauu

SEQ ID NO: 150885 - RNA, 19 nt, Homo sapiens
caacggaaguaaaaucugu

SEQ ID NO: 150886 - RNA, 19 nt, Homo sapiens
uguuucaauuggccauuua

SEQ ID NO: 150887 - RNA, 19 nt, Homo sapiens
ggcccuaaauucuugaagu

SEQ ID NO: 150888 - RNA, 19 nt, Homo sapiens
agauggcccuaaauucuug

SEQ ID NO: 150889 - RNA, 19 nt, Homo sapiens
caggaugucuacaaaauug

SEQ ID NO: 150890 - RNA, 19 nt, Homo sapiens
ggaaauuugagaccagcaa

SEQ ID NO: 150891 - RNA, 19 nt, Homo sapiens
gacaaaagaaccauugaaa

SEQ ID NO: 150892 - RNA, 19 nt, Homo sapiens
ggcaagcccauguguguug

SEQ ID NO: 150893 - RNA, 19 nt, Homo sapiens
acugaaagcugagcgugaa

SEQ ID NO: 150894 - RNA, 19 nt, Homo sapiens
ggaaaggaaaagacucaua

SEQ ID NO: 150895 - RNA, 19 nt, Homo sapiens
ggaagaacggucucagaac

SEQ ID NO: 150896 - RNA, 19 nt, Homo sapiens
uggaagaacggucucagaa

SEQ ID NO: 150897 - RNA, 19 nt, Homo sapiens
gcuaacaugccuugguuca

SEQ ID NO: 150898 - RNA, 19 nt, Homo sapiens
augaggaaauuguuaagga

SEQ ID NO: 150899 - RNA, 19 nt, Homo sapiens
gaagcugguaucuccaaga

SEQ ID NO: 150900 - RNA, 19 nt, Homo sapiens
ccaggacacagagacuuua

SEQ ID NO: 150901 - RNA, 19 nt, Homo sapiens
caaguacuaugugacuauc

SEQ ID NO: 150902 - RNA, 19 nt, Homo sapiens
caccaacucguccaacuga

SEQ ID NO: 150903 - RNA, 19 nt, Homo sapiens
cacagagacuuuaucaaaa

SEQ ID NO: 150904 - RNA, 19 nt, Homo sapiens
cagaaggaaaggagaaugu

SEQ ID NO: 150905 - RNA, 19 nt, Homo sapiens
caucaaagcaguggacaag

SEQ ID NO: 150906 - RNA, 19 nt, Homo sapiens
aaagauugaucgccguucu

SEQ ID NO: 150907 - RNA, 19 nt, Homo sapiens
cuacaaaauuggugguauu

SEQ ID NO: 150908 - RNA, 19 nt, Homo sapiens
ggaaagucacccguaagga

SEQ ID NO: 150909 - RNA, 19 nt, Homo sapiens
ccagaagagauaugaggaa

SEQ ID NO: 150910 - RNA, 19 nt, Homo sapiens
ccauguguguugagagcuu

SEQ ID NO: 150911 - RNA, 19 nt, Homo sapiens
cuacuggccaucugaucua

SEQ ID NO: 150912 - RNA, 19 nt, Homo sapiens
ccacugagccacccuacag

SEQ ID NO: 150913 - RNA, 19 nt, Homo sapiens
ggccaucugaucuauaaau

SEQ ID NO: 150914 - RNA, 19 nt, Homo sapiens
gaaaagacucauaucaaca

SEQ ID NO: 150915 - RNA, 19 nt, Homo sapiens
uugcugagcugaaggaaaa

SEQ ID NO: 150916 - RNA, 19 nt, Homo sapiens
caugaagcuuugagugaag

SEQ ID NO: 150917 - RNA, 19 nt, Homo sapiens
caacucguccaacugacaa

SEQ ID NO: 150918 - RNA, 19 nt, Homo sapiens
agagauaugaggaaauugu

SEQ ID NO: 150919 - RNA, 19 nt, Homo sapiens
agaaggaggcugcugagau

SEQ ID NO: 150920 - RNA, 19 nt, Homo sapiens
gagcgugaacgugguauca

SEQ ID NO: 150921 - RNA, 19 nt, Homo sapiens
gggacaaugugggcuucaa

SEQ ID NO: 150922 - RNA, 19 nt, Homo sapiens
uucaagggauggaaaguca

SEQ ID NO: 150923 - RNA, 19 nt, Homo sapiens
caaaauuggugguauuggu

SEQ ID NO: 150924 - RNA, 19 nt, Homo sapiens
ccuacagccagaagagaua

SEQ ID NO: 150925 - RNA, 19 nt, Homo sapiens
gcaagaagcuggaggacaa

SEQ ID NO: 150926 - RNA, 19 nt, Homo sapiens
ccacaucgccugcaaguuu

SEQ ID NO: 150927 - RNA, 19 nt, Homo sapiens
ucaagaacguggagaagaa

SEQ ID NO: 150928 - RNA, 19 nt, Homo sapiens
gcuggaagguggagcguaa

SEQ ID NO: 150929 - RNA, 19 nt, Homo sapiens
gaagucagcgccuacauca

SEQ ID NO: 150930 - RNA, 19 nt, Homo sapiens
guacaagauuggcggcauu

SEQ ID NO: 150931 - RNA, 19 nt, Homo sapiens
ucaagaagaucggcuacaa

SEQ ID NO: 150932 - RNA, 19 nt, Homo sapiens
gaaggaggcggcugagaug

SEQ ID NO: 150933 - RNA, 19 nt, Homo sapiens
aaaggaccauugagaaguu

SEQ ID NO: 150934 - RNA, 19 nt, Homo sapiens
ugaagaacgugucggugaa

SEQ ID NO: 150935 - RNA, 19 nt, Homo sapiens
gagaagacccacaucaaca

SEQ ID NO: 150936 - RNA, 19 nt, Homo sapiens
gcgggcaucuccaagaaug

SEQ ID NO: 150937 - RNA, 19 nt, Homo sapiens
gcgccuacaucaagaagau

SEQ ID NO: 150938 - RNA, 19 nt, Homo sapiens
uugcggagcugaaggagaa

SEQ ID NO: 150939 - RNA, 19 nt, Homo sapiens
cuacaaaugcggagguauu

SEQ ID NO: 150940 - RNA, 19 nt, Homo sapiens
caacgucggcuucaaugug

SEQ ID NO: 150941 - RNA, 19 nt, Homo sapiens
gaccucggcuccggaauca

SEQ ID NO: 150942 - RNA, 19 nt, Homo sapiens
ggagaagacccacaucaac

SEQ ID NO: 150943 - RNA, 19 nt, Homo sapiens
gcaggacguguacaagauu

SEQ ID NO: 150944 - RNA, 19 nt, Homo sapiens
gcaaggagaagacccacau

SEQ ID NO: 150945 - RNA, 19 nt, Homo sapiens
gagcugaaggagaagauug

SEQ ID NO: 150946 - RNA, 19 nt, Homo sapiens
cgggaaagcccaugugugu

SEQ ID NO: 150947 - RNA, 19 nt, Homo sapiens
ggaagucagcgccuacauc

SEQ ID NO: 150948 - RNA, 19 nt, Homo sapiens
ggucaucgacugccacaca

SEQ ID NO: 150949 - RNA, 19 nt, Homo sapiens
caccgcgacuucaucaaga

SEQ ID NO: 150950 - RNA, 19 nt, Homo sapiens
cacaucgccugcaaguuug

SEQ ID NO: 150951 - RNA, 19 nt, Homo sapiens
ugaagucaguggagaugca

SEQ ID NO: 150952 - RNA, 19 nt, Homo sapiens
uugagaaguucgagaagga

SEQ ID NO: 150953 - RNA, 19 nt, Homo sapiens
aacgucggcuucaauguga

SEQ ID NO: 150954 - RNA, 19 nt, Homo sapiens
caggacguguacaagauug

SEQ ID NO: 150955 - RNA, 19 nt, Homo sapiens
gaagacccacaucaacauc

SEQ ID NO: 150956 - RNA, 19 nt, Homo sapiens
ccauugagaaguucgagaa

SEQ ID NO: 150957 - RNA, 19 nt, Homo sapiens
augcggagguauugacaaa

SEQ ID NO: 150958 - RNA, 19 nt, Homo sapiens
ccacgggccaccucaucua

SEQ ID NO: 150959 - RNA, 19 nt, Homo sapiens
ccguaggcgucaucaagaa

SEQ ID NO: 150960 - RNA, 19 nt, Homo sapiens
gacaacgucggcuucaaug

SEQ ID NO: 150961 - RNA, 19 nt, Homo sapiens
caacaugccgugguucaag

SEQ ID NO: 150962 - RNA, 19 nt, Homo sapiens
gaagcgcuacgacgagauc

SEQ ID NO: 150963 - RNA, 19 nt, Homo sapiens
ccauguguguggagagcuu

SEQ ID NO: 150964 - RNA, 19 nt, Homo sapiens
cuacaucaccaucaucgau

SEQ ID NO: 150965 - RNA, 19 nt, Homo sapiens
gcaugguggugaccuuugc

SEQ ID NO: 150966 - RNA, 19 nt, Homo sapiens
ccacguggacuccggaaag

SEQ ID NO: 150967 - RNA, 19 nt, Homo sapiens
ugcaggacguguacaagau

SEQ ID NO: 150968 - RNA, 19 nt, Homo sapiens
agaaggaggcggcugagau

SEQ ID NO: 150969 - RNA, 19 nt, Homo sapiens
caucgugggcgugaacaaa

SEQ ID NO: 150970 - RNA, 19 nt, Homo sapiens
ucaccaagucggcgcagaa

SEQ ID NO: 150971 - RNA, 19 nt, Homo sapiens
gaagaacgugucggugaag

SEQ ID NO: 150972 - RNA, 19 nt, Homo sapiens
cgggccaccucaucuacaa

SEQ ID NO: 150973 - RNA, 19 nt, Homo sapiens
ggccguaggcgucaucaag

SEQ ID NO: 150974 - RNA, 19 nt, Homo sapiens
gacaaaaggaccauugaga

SEQ ID NO: 150975 - RNA, 19 nt, Homo sapiens
ccggcaaggucaccaaguc

SEQ ID NO: 150976 - RNA, 19 nt, Homo sapiens
gccguaggcgucaucaaga

SEQ ID NO: 150977 - RNA, 19 nt, Homo sapiens
uggagauggugccgggaaa

SEQ ID NO: 150978 - RNA, 19 nt, Homo sapiens
gcgacuucaucaagaacau

SEQ ID NO: 150979 - RNA, 19 nt, Homo sapiens
ucgagaccaccaaguacua

SEQ ID NO: 150980 - RNA, 19 nt, Homo sapiens
ggaaguucgagaccaccaa

SEQ ID NO: 150981 - RNA, 19 nt, Homo sapiens
caaaugcggagguauugac

SEQ ID NO: 150982 - RNA, 19 nt, Homo sapiens
cagcccacaucgccugcaa

SEQ ID NO: 150983 - RNA, 19 nt, Homo sapiens
gggcaugguggugaccuuu

SEQ ID NO: 150984 - RNA, 19 nt, Homo sapiens
ggaagguggagcguaagga

SEQ ID NO: 150985 - RNA, 19 nt, Homo sapiens
gucagcgccuacaucaaga

SEQ ID NO: 150986 - RNA, 19 nt, Homo sapiens
agucagcgccuacaucaag

SEQ ID NO: 150987 - RNA, 19 nt, Homo sapiens
gcaaaaugggcaaggagaa

SEQ ID NO: 150988 - RNA, 19 nt, Homo sapiens
ggccaccucaucuacaaau

SEQ ID NO: 150989 - RNA, 19 nt, Homo sapiens
gaacaugaucacggguaca

SEQ ID NO: 150990 - RNA, 19 nt, Homo sapiens
ccaccgcgacuucaucaag

SEQ ID NO: 150991 - RNA, 19 nt, Homo sapiens
uacaaaugcggagguauug

SEQ ID NO: 150992 - RNA, 19 nt, Homo sapiens
gagaaggaggcggcugaga

SEQ ID NO: 150993 - RNA, 19 nt, Homo sapiens
agacagauauggcgaaauu

SEQ ID NO: 150994 - RNA, 19 nt, Homo sapiens
ggaaguggagcuacagaua

SEQ ID NO: 150995 - RNA, 19 nt, Homo sapiens
ugccaagucuuccaucuua

SEQ ID NO: 150996 - RNA, 19 nt, Homo sapiens
ggaggaaagugaagaagca

SEQ ID NO: 150997 - RNA, 19 nt, Homo sapiens
ccagugggauacggaauua

SEQ ID NO: 150998 - RNA, 19 nt, Homo sapiens
gggcucaucuaaacuaguu

SEQ ID NO: 150999 - RNA, 19 nt, Homo sapiens
ggaagacacuacaggaagu

SEQ ID NO: 151000 - RNA, 19 nt, Homo sapiens
caaagaggcuaagggaaga

SEQ ID NO: 151001 - RNA, 19 nt, Homo sapiens
gauaaaguuggaacagaua

SEQ ID NO: 151002 - RNA, 19 nt, Homo sapiens
ggaaacgccuccgucucua

SEQ ID NO: 151003 - RNA, 19 nt, Homo sapiens
ggauguggcugcuuucaac

SEQ ID NO: 151004 - RNA, 19 nt, Homo sapiens
cuacagauaguaaagauga

SEQ ID NO: 151005 - RNA, 19 nt, Homo sapiens
aagcagauguggcaguauu

SEQ ID NO: 151006 - RNA, 19 nt, Homo sapiens
uccaggugcucaacgauua

SEQ ID NO: 151007 - RNA, 19 nt, Homo sapiens
ccauggauguggcugcuuu

SEQ ID NO: 151008 - RNA, 19 nt, Homo sapiens
gaagaagcaaagaggcuaa

SEQ ID NO: 151009 - RNA, 19 nt, Homo sapiens
gaaguggagcuacagauag

SEQ ID NO: 151010 - RNA, 19 nt, Homo sapiens
acaagcagauguggcagua

SEQ ID NO: 151011 - RNA, 19 nt, Homo sapiens
ugauaaaguuggaacagau

SEQ ID NO: 151012 - RNA, 19 nt, Homo sapiens
gauacggaauuaagaaacu

SEQ ID NO: 151013 - RNA, 19 nt, Homo sapiens
gaacgucuugcacaauaug

SEQ ID NO: 151014 - RNA, 19 nt, Homo sapiens
ggagaagugggaaugcaaa

SEQ ID NO: 151015 - RNA, 19 nt, Homo sapiens
gguauaaucacaucaaguc

SEQ ID NO: 151016 - RNA, 19 nt, Homo sapiens
ggaucauggcauuuaaaua

SEQ ID NO: 151017 - RNA, 19 nt, Homo sapiens
cacaucaagucuuacgaaa

SEQ ID NO: 151018 - RNA, 19 nt, Homo sapiens
aaacgccuccgucucuaua

SEQ ID NO: 151019 - RNA, 19 nt, Homo sapiens
guaaagaugaugaugacau

SEQ ID NO: 151020 - RNA, 19 nt, Homo sapiens
gcccuacguugguauaauc

SEQ ID NO: 151021 - RNA, 19 nt, Homo sapiens
gggaugaugagacagauau

SEQ ID NO: 151022 - RNA, 19 nt, Homo sapiens
gaaagugaagaagcaaaga

SEQ ID NO: 151023 - RNA, 19 nt, Homo sapiens
gaaacgccuccgucucuau

SEQ ID NO: 151024 - RNA, 19 nt, Homo sapiens
ggaaagugaagaagcaaag

SEQ ID NO: 151025 - RNA, 19 nt, Homo sapiens
ugaugacauugaccucuuu

SEQ ID NO: 151026 - RNA, 19 nt, Homo sapiens
gggaaacgccuccgucucu

SEQ ID NO: 151027 - RNA, 19 nt, Homo sapiens
caauuugcgcgcucucuuu

SEQ ID NO: 151028 - RNA, 19 nt, Homo sapiens
ugaagaugauaaaguugga

SEQ ID NO: 151029 - RNA, 19 nt, Homo sapiens
caauuugugggccauuuaa

SEQ ID NO: 151030 - RNA, 19 nt, Homo sapiens
ugagacagauauggcgaaa

SEQ ID NO: 151031 - RNA, 19 nt, Homo sapiens
gggauacggaauuaagaaa

SEQ ID NO: 151032 - RNA, 19 nt, Homo sapiens
gcacaauaugaaucaaaga

SEQ ID NO: 151033 - RNA, 19 nt, Homo sapiens
caucaagucuuacgaaaag

SEQ ID NO: 151034 - RNA, 19 nt, Homo sapiens
ucacaucaagucuuacgaa

SEQ ID NO: 151035 - RNA, 19 nt, Homo sapiens
acgauuaccuggcggacaa

SEQ ID NO: 151036 - RNA, 19 nt, Homo sapiens
gacauugaccucuuuggau

SEQ ID NO: 151037 - RNA, 19 nt, Homo sapiens
gcagauguggcaguauuug

SEQ ID NO: 151038 - RNA, 19 nt, Homo sapiens
ccuggaucauggcauuuaa

SEQ ID NO: 151039 - RNA, 19 nt, Homo sapiens
uaguaaagaugaugaugac

SEQ ID NO: 151040 - RNA, 19 nt, Homo sapiens
caagucuuccaucuuacua

SEQ ID NO: 151041 - RNA, 19 nt, Homo sapiens
ugacauugaccucuuugga

SEQ ID NO: 151042 - RNA, 19 nt, Homo sapiens
gagcuacagauaguaaaga

SEQ ID NO: 151043 - RNA, 19 nt, Homo sapiens
ggagugcgucagaagcauu

SEQ ID NO: 151044 - RNA, 19 nt, Homo sapiens
acgccuccgucucuauaua

SEQ ID NO: 151045 - RNA, 19 nt, Homo sapiens
aagaugaugaugacauuga

SEQ ID NO: 151046 - RNA, 19 nt, Homo sapiens
cagauauggcgaaauuaga

SEQ ID NO: 151047 - RNA, 19 nt, Homo sapiens
ugugaaaccuugggaugau

SEQ ID NO: 151048 - RNA, 19 nt, Homo sapiens
guggagcuacagauaguaa

SEQ ID NO: 151049 - RNA, 19 nt, Homo sapiens
cuacguugguauaaucaca

SEQ ID NO: 151050 - RNA, 19 nt, Homo sapiens
guguguaguugaagaugau

SEQ ID NO: 151051 - RNA, 19 nt, Homo sapiens
gauaguaaagaugaugaug

SEQ ID NO: 151052 - RNA, 19 nt, Homo sapiens
ccaauucguacguggagaa

SEQ ID NO: 151053 - RNA, 19 nt, Homo sapiens
gaagaugauaaaguuggaa

SEQ ID NO: 151054 - RNA, 19 nt, Homo sapiens
gaggagugcgucagaagca

SEQ ID NO: 151055 - RNA, 19 nt, Homo sapiens
acagauauggcgaaauuag

SEQ ID NO: 151056 - RNA, 19 nt, Homo sapiens
cagccgacaccauggguuu

SEQ ID NO: 151057 - RNA, 19 nt, Homo sapiens
gugaaaccuugggaugaug

SEQ ID NO: 151058 - RNA, 19 nt, Homo sapiens
agaacgucuugcacaauau

SEQ ID NO: 151059 - RNA, 19 nt, Homo sapiens
aaguggagcuacagauagu

SEQ ID NO: 151060 - RNA, 19 nt, Homo sapiens
gucaugcccuacguuggua

SEQ ID NO: 151061 - RNA, 19 nt, Homo sapiens
guggaagacacuacaggaa

SEQ ID NO: 151062 - RNA, 19 nt, Homo sapiens
gaaacuucaaauacagugu

SEQ ID NO: 151063 - RNA, 19 nt, Homo sapiens
uuagaggagugcgucagaa

SEQ ID NO: 151064 - RNA, 19 nt, Homo sapiens
gacagauauggcgaaauua

SEQ ID NO: 151065 - RNA, 19 nt, Homo sapiens
agucuuccaucuuacuaga

SEQ ID NO: 151066 - RNA, 19 nt, Homo sapiens
cagauaguaaagaugauga

SEQ ID NO: 151067 - RNA, 19 nt, Homo sapiens
ggagcuacagauaguaaag

SEQ ID NO: 151068 - RNA, 19 nt, Homo sapiens
caggagugaagaaagcuuu

SEQ ID NO: 151069 - RNA, 19 nt, Homo sapiens
uaaaguuggaacagauaug

SEQ ID NO: 151070 - RNA, 19 nt, Homo sapiens
auucguacguggagaagug

SEQ ID NO: 151071 - RNA, 19 nt, Homo sapiens
uacaggaaguggagcuaca

SEQ ID NO: 151072 - RNA, 19 nt, Homo sapiens
cagauguggcaguauuuga

SEQ ID NO: 151073 - RNA, 19 nt, Homo sapiens
agauguggcaguauuugaa

SEQ ID NO: 151074 - RNA, 19 nt, Homo sapiens
cuccgucucuauauaagga

SEQ ID NO: 151075 - RNA, 19 nt, Homo sapiens
ugaaaccuugggaugauga

SEQ ID NO: 151076 - RNA, 19 nt, Homo sapiens
ugaaucaaagaaagccaaa

SEQ ID NO: 151077 - RNA, 19 nt, Homo sapiens
ugaggaggaaagugaagaa

SEQ ID NO: 151078 - RNA, 19 nt, Homo sapiens
aauaugguccugccgaugu

SEQ ID NO: 151079 - RNA, 19 nt, Homo sapiens
uggcugcuuucaacaagau

SEQ ID NO: 151080 - RNA, 19 nt, Homo sapiens
gaagugggaaugcaaaagu

SEQ ID NO: 151081 - RNA, 19 nt, Homo sapiens
ggauacggaauuaagaaac

SEQ ID NO: 151082 - RNA, 19 nt, Homo sapiens
augauaaaguuggaacaga

SEQ ID NO: 151083 - RNA, 19 nt, Homo sapiens
guggagaagugggaaugca

SEQ ID NO: 151084 - RNA, 19 nt, Homo sapiens
ugcacaauaugaaucaaag

SEQ ID NO: 151085 - RNA, 19 nt, Homo sapiens
agacagauauggcgaaauu

SEQ ID NO: 151086 - RNA, 19 nt, Homo sapiens
ggaaguggagcuacagaua

SEQ ID NO: 151087 - RNA, 19 nt, Homo sapiens
ugccaagucuuccaucuua

SEQ ID NO: 151088 - RNA, 19 nt, Homo sapiens
ggaggaaagugaagaagca

SEQ ID NO: 151089 - RNA, 19 nt, Homo sapiens
ccagugggauacggaauua

SEQ ID NO: 151090 - RNA, 19 nt, Homo sapiens
gggcucaucuaaacuaguu

SEQ ID NO: 151091 - RNA, 19 nt, Homo sapiens
ggaagacacuacaggaagu

SEQ ID NO: 151092 - RNA, 19 nt, Homo sapiens
caaagaggcuaagggaaga

SEQ ID NO: 151093 - RNA, 19 nt, Homo sapiens
gauaaaguuggaacagaua

SEQ ID NO: 151094 - RNA, 19 nt, Homo sapiens
ggauguggcugcuuucaac

SEQ ID NO: 151095 - RNA, 19 nt, Homo sapiens
cuacagauaguaaagauga

SEQ ID NO: 151096 - RNA, 19 nt, Homo sapiens
aagcagauguggcaguauu

SEQ ID NO: 151097 - RNA, 19 nt, Homo sapiens
uccaggugcucaacgauua

SEQ ID NO: 151098 - RNA, 19 nt, Homo sapiens
ccauggauguggcugcuuu

SEQ ID NO: 151099 - RNA, 19 nt, Homo sapiens
gaagaagcaaagaggcuaa

SEQ ID NO: 151100 - RNA, 19 nt, Homo sapiens
gaaguggagcuacagauag

SEQ ID NO: 151101 - RNA, 19 nt, Homo sapiens
acaagcagauguggcagua

SEQ ID NO: 151102 - RNA, 19 nt, Homo sapiens
ugauaaaguuggaacagau

SEQ ID NO: 151103 - RNA, 19 nt, Homo sapiens
gauacggaauuaagaaacu

SEQ ID NO: 151104 - RNA, 19 nt, Homo sapiens
gaacgucuugcacaauaug

SEQ ID NO: 151105 - RNA, 19 nt, Homo sapiens
gguauaaucacaucaaguc

SEQ ID NO: 151106 - RNA, 19 nt, Homo sapiens
ggaucauggcauuuaaaua

SEQ ID NO: 151107 - RNA, 19 nt, Homo sapiens
cacaucaagucuuacgaaa

SEQ ID NO: 151108 - RNA, 19 nt, Homo sapiens
guaaagaugaugaugacau

SEQ ID NO: 151109 - RNA, 19 nt, Homo sapiens
gcccuacguugguauaauc

SEQ ID NO: 151110 - RNA, 19 nt, Homo sapiens
gggaugaugagacagauau

SEQ ID NO: 151111 - RNA, 19 nt, Homo sapiens
gaaagugaagaagcaaaga

SEQ ID NO: 151112 - RNA, 19 nt, Homo sapiens
ggaaagugaagaagcaaag

SEQ ID NO: 151113 - RNA, 19 nt, Homo sapiens
ugaugacauugaccucuuu

SEQ ID NO: 151114 - RNA, 19 nt, Homo sapiens
ugaagaugauaaaguugga

SEQ ID NO: 151115 - RNA, 19 nt, Homo sapiens
ugagacagauauggcgaaa

SEQ ID NO: 151116 - RNA, 19 nt, Homo sapiens
gggauacggaauuaagaaa

SEQ ID NO: 151117 - RNA, 19 nt, Homo sapiens
gcacaauaugaaucaaaga

SEQ ID NO: 151118 - RNA, 19 nt, Homo sapiens
acgauuaccuggcggacaa

SEQ ID NO: 151119 - RNA, 19 nt, Homo sapiens
caucaagucuuacgaaaag

SEQ ID NO: 151120 - RNA, 19 nt, Homo sapiens
ucacaucaagucuuacgaa

SEQ ID NO: 151121 - RNA, 19 nt, Homo sapiens
gacauugaccucuuuggau

SEQ ID NO: 151122 - RNA, 19 nt, Homo sapiens
gcagauguggcaguauuug

SEQ ID NO: 151123 - RNA, 19 nt, Homo sapiens
ccuggaucauggcauuuaa

SEQ ID NO: 151124 - RNA, 19 nt, Homo sapiens
uaguaaagaugaugaugac

SEQ ID NO: 151125 - RNA, 19 nt, Homo sapiens
caagucuuccaucuuacua

SEQ ID NO: 151126 - RNA, 19 nt, Homo sapiens
ugacauugaccucuuugga

SEQ ID NO: 151127 - RNA, 19 nt, Homo sapiens
gagcuacagauaguaaaga

SEQ ID NO: 151128 - RNA, 19 nt, Homo sapiens
ccguggagcucucggauac

SEQ ID NO: 151129 - RNA, 19 nt, Homo sapiens
ggagugcgucagaagcauu

SEQ ID NO: 151130 - RNA, 19 nt, Homo sapiens
aagaugaugaugacauuga

SEQ ID NO: 151131 - RNA, 19 nt, Homo sapiens
cagauauggcgaaauuaga

SEQ ID NO: 151132 - RNA, 19 nt, Homo sapiens
ugugaaaccuugggaugau

SEQ ID NO: 151133 - RNA, 19 nt, Homo sapiens
guggagcuacagauaguaa

SEQ ID NO: 151134 - RNA, 19 nt, Homo sapiens
cuacguugguauaaucaca

SEQ ID NO: 151135 - RNA, 19 nt, Homo sapiens
guguguaguugaagaugau

SEQ ID NO: 151136 - RNA, 19 nt, Homo sapiens
gauaguaaagaugaugaug

SEQ ID NO: 151137 - RNA, 19 nt, Homo sapiens
cagccgacaccauggguuu

SEQ ID NO: 151138 - RNA, 19 nt, Homo sapiens
gaagaugauaaaguuggaa

SEQ ID NO: 151139 - RNA, 19 nt, Homo sapiens
gaggagugcgucagaagca

SEQ ID NO: 151140 - RNA, 19 nt, Homo sapiens
acagauauggcgaaauuag

SEQ ID NO: 151141 - RNA, 19 nt, Homo sapiens
gugaaaccuugggaugaug

SEQ ID NO: 151142 - RNA, 19 nt, Homo sapiens
agaacgucuugcacaauau

SEQ ID NO: 151143 - RNA, 19 nt, Homo sapiens
gucaugcccuacguuggua

SEQ ID NO: 151144 - RNA, 19 nt, Homo sapiens
aaguggagcuacagauagu

SEQ ID NO: 151145 - RNA, 19 nt, Homo sapiens
guggaagacacuacaggaa

SEQ ID NO: 151146 - RNA, 19 nt, Homo sapiens
gaaacuucaaauacagugu

SEQ ID NO: 151147 - RNA, 19 nt, Homo sapiens
uuagaggagugcgucagaa

SEQ ID NO: 151148 - RNA, 19 nt, Homo sapiens
gacagauauggcgaaauua

SEQ ID NO: 151149 - RNA, 19 nt, Homo sapiens
agucuuccaucuuacuaga

SEQ ID NO: 151150 - RNA, 19 nt, Homo sapiens
cagauaguaaagaugauga

SEQ ID NO: 151151 - RNA, 19 nt, Homo sapiens
ggagcuacagauaguaaag

SEQ ID NO: 151152 - RNA, 19 nt, Homo sapiens
caggagugaagaaagcuuu

SEQ ID NO: 151153 - RNA, 19 nt, Homo sapiens
uaaaguuggaacagauaug

SEQ ID NO: 151154 - RNA, 19 nt, Homo sapiens
cagauguggcaguauuuga

SEQ ID NO: 151155 - RNA, 19 nt, Homo sapiens
uacaggaaguggagcuaca

SEQ ID NO: 151156 - RNA, 19 nt, Homo sapiens
agauguggcaguauuugaa

SEQ ID NO: 151157 - RNA, 19 nt, Homo sapiens
ugaaaccuugggaugauga

SEQ ID NO: 151158 - RNA, 19 nt, Homo sapiens
ugaaucaaagaaagccaaa

SEQ ID NO: 151159 - RNA, 19 nt, Homo sapiens
ugaggaggaaagugaagaa

SEQ ID NO: 151160 - RNA, 19 nt, Homo sapiens
aauaugguccugccgaugu

SEQ ID NO: 151161 - RNA, 19 nt, Homo sapiens
uggcugcuuucaacaagau

SEQ ID NO: 151162 - RNA, 19 nt, Homo sapiens
ggauacggaauuaagaaac

SEQ ID NO: 151163 - RNA, 19 nt, Homo sapiens
augauaaaguuggaacaga

SEQ ID NO: 151164 - RNA, 19 nt, Homo sapiens
ugcacaauaugaaucaaag

SEQ ID NO: 151165 - RNA, 19 nt, Homo sapiens
gagagaacauccagaaauc

SEQ ID NO: 151166 - RNA, 19 nt, Homo sapiens
ugacgaggaugaugacauu

SEQ ID NO: 151167 - RNA, 19 nt, Homo sapiens
ucgacaaguucaaauauga

SEQ ID NO: 151168 - RNA, 19 nt, Homo sapiens
caaacuuccuagcacauga

SEQ ID NO: 151169 - RNA, 19 nt, Homo sapiens
uaucgcagcuuucaacaag

SEQ ID NO: 151170 - RNA, 19 nt, Homo sapiens
ccagagagaacauccagaa

SEQ ID NO: 151171 - RNA, 19 nt, Homo sapiens
ccacagacccagcacguau

SEQ ID NO: 151172 - RNA, 19 nt, Homo sapiens
caaauaugacgacgcagaa

SEQ ID NO: 151173 - RNA, 19 nt, Homo sapiens
guccuuggcuggcgucaga

SEQ ID NO: 151174 - RNA, 19 nt, Homo sapiens
gaagaucugguucgacaag

SEQ ID NO: 151175 - RNA, 19 nt, Homo sapiens
ugaugacauugaccuguuu

SEQ ID NO: 151176 - RNA, 19 nt, Homo sapiens
agagagaacauccagaaau

SEQ ID NO: 151177 - RNA, 19 nt, Homo sapiens
gguucgacaaguucaaaua

SEQ ID NO: 151178 - RNA, 19 nt, Homo sapiens
ggcaguacgcggagaagaa

SEQ ID NO: 151179 - RNA, 19 nt, Homo sapiens
gagucugcguggcguggua

SEQ ID NO: 151180 - RNA, 19 nt, Homo sapiens
cggagaagaaggccaagaa

SEQ ID NO: 151181 - RNA, 19 nt, Homo sapiens
cagaggaugacgaggauga

SEQ ID NO: 151182 - RNA, 19 nt, Homo sapiens
gagcucgucguccggauug

SEQ ID NO: 151183 - RNA, 19 nt, Homo sapiens
guucgacaaguucaaauau

SEQ ID NO: 151184 - RNA, 19 nt, Homo sapiens
gaucugguucgacaaguuc

SEQ ID NO: 151185 - RNA, 19 nt, Homo sapiens
gugucgauaucgcagcuuu

SEQ ID NO: 151186 - RNA, 19 nt, Homo sapiens
uccggaagcuacagauuca

SEQ ID NO: 151187 - RNA, 19 nt, Homo sapiens
ggagaagaaggccaagaag

SEQ ID NO: 151188 - RNA, 19 nt, Homo sapiens
ggaaguggagaaccagagu

SEQ ID NO: 151189 - RNA, 19 nt, Homo sapiens
cacaugagaagaucugguu

SEQ ID NO: 151190 - RNA, 19 nt, Homo sapiens
ucgcagcuuucaacaagau

SEQ ID NO: 151191 - RNA, 19 nt, Homo sapiens
acaaugaggaggaggacaa

SEQ ID NO: 151192 - RNA, 19 nt, Homo sapiens
gagauucuacgagcagaug

SEQ ID NO: 151193 - RNA, 19 nt, Homo sapiens
ccacaccagcagaggauga

SEQ ID NO: 151194 - RNA, 19 nt, Homo sapiens
cagagagaacauccagaaa

SEQ ID NO: 151195 - RNA, 19 nt, Homo sapiens
gcaguacgcggagaagaag

SEQ ID NO: 151196 - RNA, 19 nt, Homo sapiens
agaucugguucgacaaguu

SEQ ID NO: 151197 - RNA, 19 nt, Homo sapiens
augaugacauugaccuguu

SEQ ID NO: 151198 - RNA, 19 nt, Homo sapiens
cgauaucgcagcuuucaac

SEQ ID NO: 151199 - RNA, 19 nt, Homo sapiens
cgaggaugaugacauugac

SEQ ID NO: 151200 - RNA, 19 nt, Homo sapiens
gagagaacauccagaaauc

SEQ ID NO: 151201 - RNA, 19 nt, Homo sapiens
ugacgaggaugaugacauu

SEQ ID NO: 151202 - RNA, 19 nt, Homo sapiens
gggaagacaagcacaagua

SEQ ID NO: 151203 - RNA, 19 nt, Homo sapiens
ucgacaaguucaaauauga

SEQ ID NO: 151204 - RNA, 19 nt, Homo sapiens
caaacuuccuagcacauga

SEQ ID NO: 151205 - RNA, 19 nt, Homo sapiens
uaucgcagcuuucaacaag

SEQ ID NO: 151206 - RNA, 19 nt, Homo sapiens
ggaagacaagcacaaguau

SEQ ID NO: 151207 - RNA, 19 nt, Homo sapiens
ccagagagaacauccagaa

SEQ ID NO: 151208 - RNA, 19 nt, Homo sapiens
ccacagacccagcacguau

SEQ ID NO: 151209 - RNA, 19 nt, Homo sapiens
caaauaugacgacgcagaa

SEQ ID NO: 151210 - RNA, 19 nt, Homo sapiens
guccuuggcuggcguuaga

SEQ ID NO: 151211 - RNA, 19 nt, Homo sapiens
gaagacaagcacaaguaug

SEQ ID NO: 151212 - RNA, 19 nt, Homo sapiens
aagacaagcacaaguauga

SEQ ID NO: 151213 - RNA, 19 nt, Homo sapiens
ggaaggugcgccugcaaga

SEQ ID NO: 151214 - RNA, 19 nt, Homo sapiens
gaagaucugguucgacaag

SEQ ID NO: 151215 - RNA, 19 nt, Homo sapiens
ggaucugggucaacaaguc

SEQ ID NO: 151216 - RNA, 19 nt, Homo sapiens
ugaugacauugaccuguuu

SEQ ID NO: 151217 - RNA, 19 nt, Homo sapiens
agagagaacauccagaaau

SEQ ID NO: 151218 - RNA, 19 nt, Homo sapiens
gguucgacaaguucaaaua

SEQ ID NO: 151219 - RNA, 19 nt, Homo sapiens
ggcaguacgcggagaagaa

SEQ ID NO: 151220 - RNA, 19 nt, Homo sapiens
gagucugcguggcguggua

SEQ ID NO: 151221 - RNA, 19 nt, Homo sapiens
gacaggguuucaacguguu

SEQ ID NO: 151222 - RNA, 19 nt, Homo sapiens
cggagaagaaggccaagaa

SEQ ID NO: 151223 - RNA, 19 nt, Homo sapiens
cagaggaugacgaggauga

SEQ ID NO: 151224 - RNA, 19 nt, Homo sapiens
gagcucgucguccggauug

SEQ ID NO: 151225 - RNA, 19 nt, Homo sapiens
guucgacaaguucaaauau

SEQ ID NO: 151226 - RNA, 19 nt, Homo sapiens
gaucugguucgacaaguuc

SEQ ID NO: 151227 - RNA, 19 nt, Homo sapiens
ggccgaggcuccuucuuuu

SEQ ID NO: 151228 - RNA, 19 nt, Homo sapiens
gugucgauaucgcagcuuu

SEQ ID NO: 151229 - RNA, 19 nt, Homo sapiens
uccggaagcuacagauuca

SEQ ID NO: 151230 - RNA, 19 nt, Homo sapiens
ggagaagaaggccaagaag

SEQ ID NO: 151231 - RNA, 19 nt, Homo sapiens
ggaaguggagaaccagagu

SEQ ID NO: 151232 - RNA, 19 nt, Homo sapiens
cacaugagaagaucugguu

SEQ ID NO: 151233 - RNA, 19 nt, Homo sapiens
ucagcaagccugccuacga

SEQ ID NO: 151234 - RNA, 19 nt, Homo sapiens
ucgcagcuuucaacaagau

SEQ ID NO: 151235 - RNA, 19 nt, Homo sapiens
uggccgaggcuccuucuuu

SEQ ID NO: 151236 - RNA, 19 nt, Homo sapiens
acaaugaggaggaggacaa

SEQ ID NO: 151237 - RNA, 19 nt, Homo sapiens
gagauucuacgagcagaug

SEQ ID NO: 151238 - RNA, 19 nt, Homo sapiens
ccacaccagcagaggauga

SEQ ID NO: 151239 - RNA, 19 nt, Homo sapiens
cagagagaacauccagaaa

SEQ ID NO: 151240 - RNA, 19 nt, Homo sapiens
cugccuugcccuacuguua

SEQ ID NO: 151241 - RNA, 19 nt, Homo sapiens
gcaguacgcggagaagaag

SEQ ID NO: 151242 - RNA, 19 nt, Homo sapiens
uagccaggauggucucagu

SEQ ID NO: 151243 - RNA, 19 nt, Homo sapiens
cgcaacaucuuagggaaca

SEQ ID NO: 151244 - RNA, 19 nt, Homo sapiens
ucuacgaggcccuguuuga

SEQ ID NO: 151245 - RNA, 19 nt, Homo sapiens
agaucugguucgacaaguu

SEQ ID NO: 151246 - RNA, 19 nt, Homo sapiens
augaugacauugaccuguu

SEQ ID NO: 151247 - RNA, 19 nt, Homo sapiens
acuguuacuuccugcagaa

SEQ ID NO: 151248 - RNA, 19 nt, Homo sapiens
gaggcuccuucuuuuauga

SEQ ID NO: 151249 - RNA, 19 nt, Homo sapiens
cgauaucgcagcuuucaac

SEQ ID NO: 151250 - RNA, 19 nt, Homo sapiens
cgaggaugaugacauugac

SEQ ID NO: 151251 - RNA, 19 nt, Homo sapiens
ggcguuagagacaggguuu

SEQ ID NO: 151252 - RNA, 19 nt, Homo sapiens
gccugagacccaacagaaa

SEQ ID NO: 151253 - RNA, 19 nt, Homo sapiens
aaaggaaacugaacauuga

SEQ ID NO: 151254 - RNA, 19 nt, Homo sapiens
gaugauggauucugugugu

SEQ ID NO: 151255 - RNA, 19 nt, Homo sapiens
gaacaucucuugccaucac

SEQ ID NO: 151256 - RNA, 19 nt, Homo sapiens
gaagugaaacugugugaga

SEQ ID NO: 151257 - RNA, 19 nt, Homo sapiens
uaaaggaaacugaacauug

SEQ ID NO: 151258 - RNA, 19 nt, Homo sapiens
gacauuggcugacaucaca

SEQ ID NO: 151259 - RNA, 19 nt, Homo sapiens
gugagaagauggcccaguu

SEQ ID NO: 151260 - RNA, 19 nt, Homo sapiens
gaaacugugugagaagaug

SEQ ID NO: 151261 - RNA, 19 nt, Homo sapiens
cgccaggccuuucccaaua

SEQ ID NO: 151262 - RNA, 19 nt, Homo sapiens
gaagauggcccaguuugau

SEQ ID NO: 151263 - RNA, 19 nt, Homo sapiens
caagaguaccuuuguguug

SEQ ID NO: 151264 - RNA, 19 nt, Homo sapiens
ucucaucacuggaauguuc

SEQ ID NO: 151265 - RNA, 19 nt, Homo sapiens
aacaauagcagcuccauuu

SEQ ID NO: 151266 - RNA, 19 nt, Homo sapiens
gccauugccuacuauguga

SEQ ID NO: 151267 - RNA, 19 nt, Homo sapiens
guaccuuuguguuggauga

SEQ ID NO: 151268 - RNA, 19 nt, Homo sapiens
gagaagauggcccaguuug

SEQ ID NO: 151269 - RNA, 19 nt, Homo sapiens
gcugcuggaugcuuacuug

SEQ ID NO: 151270 - RNA, 19 nt, Homo sapiens
ccacugagaaugcaaagga

SEQ ID NO: 151271 - RNA, 19 nt, Homo sapiens
caacgccauugccuacuau

SEQ ID NO: 151272 - RNA, 19 nt, Homo sapiens
gcagagacccaaccuaaaa

SEQ ID NO: 151273 - RNA, 19 nt, Homo sapiens
ucucaucgcugcucaguac

SEQ ID NO: 151274 - RNA, 19 nt, Homo sapiens
gggagcacuuugauaagga

SEQ ID NO: 151275 - RNA, 19 nt, Homo sapiens
caucaugcaccacaacaaa

SEQ ID NO: 151276 - RNA, 19 nt, Homo sapiens
ugggugagcuuugcugauu

SEQ ID NO: 151277 - RNA, 19 nt, Homo sapiens
gcaaggucccagcauuuga

SEQ ID NO: 151278 - RNA, 19 nt, Homo sapiens
uggacaagcugaggaagaa

SEQ ID NO: 151279 - RNA, 19 nt, Homo sapiens
aggaggagauggaugaaug

SEQ ID NO: 151280 - RNA, 19 nt, Homo sapiens
gcuggaugcuuacuugaag

SEQ ID NO: 151281 - RNA, 19 nt, Homo sapiens
aauagcagcuccauuucug

SEQ ID NO: 151282 - RNA, 19 nt, Homo sapiens
gcaaucucaucacuggaau

SEQ ID NO: 151283 - RNA, 19 nt, Homo sapiens
gagcugcaaucucaucacu

SEQ ID NO: 151284 - RNA, 19 nt, Homo sapiens
ucugggagcacuuugauaa

SEQ ID NO: 151285 - RNA, 19 nt, Homo sapiens
acaaacaggccacugagaa

SEQ ID NO: 151286 - RNA, 19 nt, Homo sapiens
caaacaggccacugagaau

SEQ ID NO: 151287 - RNA, 19 nt, Homo sapiens
ccuacuaugugagcaauga

SEQ ID NO: 151288 - RNA, 19 nt, Homo sapiens
gauggauucuguguguuug

SEQ ID NO: 151289 - RNA, 19 nt, Homo sapiens
gugaaacugugugagaaga

SEQ ID NO: 151290 - RNA, 19 nt, Homo sapiens
cagauuggcagguggacua

SEQ ID NO: 151291 - RNA, 19 nt, Homo sapiens
gccaggagcuugccuuucc

SEQ ID NO: 151292 - RNA, 19 nt, Homo sapiens
ugagggugaugauggauuc

SEQ ID NO: 151293 - RNA, 19 nt, Homo sapiens
gcucaccugcccaagagua

SEQ ID NO: 151294 - RNA, 19 nt, Homo sapiens
uugcagagacccaaccuaa

SEQ ID NO: 151295 - RNA, 19 nt, Homo sapiens
gaggaagugaggcgaauuc

SEQ ID NO: 151296 - RNA, 19 nt, Homo sapiens
cugggacccuguacacgua

SEQ ID NO: 151297 - RNA, 19 nt, Homo sapiens
ggucauuaaaggaaacuga

SEQ ID NO: 151298 - RNA, 19 nt, Homo sapiens
caacaauagcagcuccauu

SEQ ID NO: 151299 - RNA, 19 nt, Homo sapiens
cggcaaggucccagcauuu

SEQ ID NO: 151300 - RNA, 19 nt, Homo sapiens
acaacaaacaggccacuga

SEQ ID NO: 151301 - RNA, 19 nt, Homo sapiens
gaacucacucagaccuuca

SEQ ID NO: 151302 - RNA, 19 nt, Homo sapiens
ccaagaguaccuuuguguu

SEQ ID NO: 151303 - RNA, 19 nt, Homo sapiens
cgagugacauuggcugaca

SEQ ID NO: 151304 - RNA, 19 nt, Homo sapiens
gaauuuaagcgcaaguacu

SEQ ID NO: 151305 - RNA, 19 nt, Homo sapiens
ggacacaccacggaaagag

SEQ ID NO: 151306 - RNA, 19 nt, Homo sapiens
caaccgcaccccugaauuu

SEQ ID NO: 151307 - RNA, 19 nt, Homo sapiens
ugauggauucuguguguuu

SEQ ID NO: 151308 - RNA, 19 nt, Homo sapiens
gacaagcugaggaagaaug

SEQ ID NO: 151309 - RNA, 19 nt, Homo sapiens
gcccaagaguaccuuugug

SEQ ID NO: 151310 - RNA, 19 nt, Homo sapiens
uggcugacaucacaguugu

SEQ ID NO: 151311 - RNA, 19 nt, Homo sapiens
uguguuggaugaauuuaag

SEQ ID NO: 151312 - RNA, 19 nt, Homo sapiens
ggaggagauggaugaaugu

SEQ ID NO: 151313 - RNA, 19 nt, Homo sapiens
ccggcaaggucccagcauu

SEQ ID NO: 151314 - RNA, 19 nt, Homo sapiens
gggugaugauggauucugu

SEQ ID NO: 151315 - RNA, 19 nt, Homo sapiens
ggcaaggucccagcauuug

SEQ ID NO: 151316 - RNA, 19 nt, Homo sapiens
uggcccaguuugaugcuaa

SEQ ID NO: 151317 - RNA, 19 nt, Homo sapiens
aagugaaacugugugagaa

SEQ ID NO: 151318 - RNA, 19 nt, Homo sapiens
agaaugccuucgccagugu

SEQ ID NO: 151319 - RNA, 19 nt, Homo sapiens
guacuccaaugaggacaca

SEQ ID NO: 151320 - RNA, 19 nt, Homo sapiens
agaagauggcccaguuuga

SEQ ID NO: 151321 - RNA, 19 nt, Homo sapiens
uguuguggcucuauaagca

SEQ ID NO: 151322 - RNA, 19 nt, Homo sapiens
aaacaggccacugagaaug

SEQ ID NO: 151323 - RNA, 19 nt, Homo sapiens
aaaggacacaccacggaaa

SEQ ID NO: 151324 - RNA, 19 nt, Homo sapiens
ggaagugaggcgaauucug

SEQ ID NO: 151325 - RNA, 19 nt, Homo sapiens
acacaccacggaaagagaa

SEQ ID NO: 151326 - RNA, 19 nt, Homo sapiens
ugagaagauggcccaguuu

SEQ ID NO: 151327 - RNA, 19 nt, Homo sapiens
caauagcagcuccauuucu

SEQ ID NO: 151328 - RNA, 19 nt, Homo sapiens
ggaggaagugaggcgaauu

SEQ ID NO: 151329 - RNA, 19 nt, Homo sapiens
agacgcugguucgagagua

SEQ ID NO: 151330 - RNA, 19 nt, Homo sapiens
ggcccaguuugaugcuaaa

SEQ ID NO: 151331 - RNA, 19 nt, Homo sapiens
gccaggccuuucccaauac

SEQ ID NO: 151332 - RNA, 19 nt, Homo sapiens
aagcgcaaguacuccaaug

SEQ ID NO: 151333 - RNA, 19 nt, Homo sapiens
agaguaccuuuguguugga

SEQ ID NO: 151334 - RNA, 19 nt, Homo sapiens
ucgcucaccugcccaagag

SEQ ID NO: 151335 - RNA, 19 nt, Homo sapiens
cugaggaggagauggauga

SEQ ID NO: 151336 - RNA, 19 nt, Homo sapiens
gggugagcuuugcugauuc

SEQ ID NO: 151337 - RNA, 19 nt, Homo sapiens
ucauacacauggcggaaac

SEQ ID NO: 151338 - RNA, 19 nt, Homo sapiens
gcgcaaguacuccaaugag

SEQ ID NO: 151339 - RNA, 19 nt, Homo sapiens
gggcgaacgagugacauug

SEQ ID NO: 151340 - RNA, 19 nt, Homo sapiens
gcugguuccucaccugcau

SEQ ID NO: 151341 - RNA, 19 nt, Homo sapiens
ccaccccacuuccauuuug

SEQ ID NO: 151342 - RNA, 19 nt, Homo sapiens
guacacguauccugaaaac

SEQ ID NO: 151343 - RNA, 19 nt, Homo sapiens
ccuuuguguuggaugaauu

SEQ ID NO: 151344 - RNA, 19 nt, Homo sapiens
gacacaccacggaaagaga

SEQ ID NO: 151345 - RNA, 19 nt, Homo sapiens
gaaugcaaaggaggaagug

SEQ ID NO: 151346 - RNA, 19 nt, Homo sapiens
gagacacgcuucacugaua

SEQ ID NO: 151347 - RNA, 19 nt, Homo sapiens
caaaggcccucuuaugaug

SEQ ID NO: 151348 - RNA, 19 nt, Homo sapiens
acucagauguccaaacuaa

SEQ ID NO: 151349 - RNA, 19 nt, Homo sapiens
cagcagacacgcccucuua

SEQ ID NO: 151350 - RNA, 19 nt, Homo sapiens
uagaggacaugaugaagaa

SEQ ID NO: 151351 - RNA, 19 nt, Homo sapiens
gcauuaagagguuuauuug

SEQ ID NO: 151352 - RNA, 19 nt, Homo sapiens
uagagaaacuggacaucaa

SEQ ID NO: 151353 - RNA, 19 nt, Homo sapiens
ugccaucacucaaccauaa

SEQ ID NO: 151354 - RNA, 19 nt, Homo sapiens
ggaacacgcggguagauga

SEQ ID NO: 151355 - RNA, 19 nt, Homo sapiens
cgcaagaucuggugcuuug

SEQ ID NO: 151356 - RNA, 19 nt, Homo sapiens
aaacucagauguccaaacu

SEQ ID NO: 151357 - RNA, 19 nt, Homo sapiens
gacgacaccuggagacugu

SEQ ID NO: 151358 - RNA, 19 nt, Homo sapiens
ucagauguccaaacuaauu

SEQ ID NO: 151359 - RNA, 19 nt, Homo sapiens
cgucagcccuguugucaga

SEQ ID NO: 151360 - RNA, 19 nt, Homo sapiens
cagcaaaacugauagagaa

SEQ ID NO: 151361 - RNA, 19 nt, Homo sapiens
gaggagcucuaccagacuu

SEQ ID NO: 151362 - RNA, 19 nt, Homo sapiens
cagacacgcccucuuagua

SEQ ID NO: 151363 - RNA, 19 nt, Homo sapiens
acaacuuccuggacaaauu

SEQ ID NO: 151364 - RNA, 19 nt, Homo sapiens
gcugcgagcuccuguacga

SEQ ID NO: 151365 - RNA, 19 nt, Homo sapiens
gaagcaguuugccgagaug

SEQ ID NO: 151366 - RNA, 19 nt, Homo sapiens
cccaaaggcccucuuauga

SEQ ID NO: 151367 - RNA, 19 nt, Homo sapiens
acaaacgcauuaagagguu

SEQ ID NO: 151368 - RNA, 19 nt, Homo sapiens
gaugccguuucuuucaaua

SEQ ID NO: 151369 - RNA, 19 nt, Homo sapiens
guagaggacaugaugaaga

SEQ ID NO: 151370 - RNA, 19 nt, Homo sapiens
gcaaguccacgcugacaga

SEQ ID NO: 151371 - RNA, 19 nt, Homo sapiens
caacugccaucucccucuu

SEQ ID NO: 151372 - RNA, 19 nt, Homo sapiens
agaaagaggagacagcaaa

SEQ ID NO: 151373 - RNA, 19 nt, Homo sapiens
acacgcggguagaugauuu

SEQ ID NO: 151374 - RNA, 19 nt, Homo sapiens
ccaaaggcccucuuaugau

SEQ ID NO: 151375 - RNA, 19 nt, Homo sapiens
gaaacuggacaucaaacug

SEQ ID NO: 151376 - RNA, 19 nt, Homo sapiens
caacuuccuggacaaauug

SEQ ID NO: 151377 - RNA, 19 nt, Homo sapiens
ggacaacuuccuggacaaa

SEQ ID NO: 151378 - RNA, 19 nt, Homo sapiens
agauguauguggccaaguu

SEQ ID NO: 151379 - RNA, 19 nt, Homo sapiens
gagcaggagcguugcauca

SEQ ID NO: 151380 - RNA, 19 nt, Homo sapiens
acaaccggcuguacaugaa

SEQ ID NO: 151381 - RNA, 19 nt, Homo sapiens
gcgagacggucagugaaga

SEQ ID NO: 151382 - RNA, 19 nt, Homo sapiens
ugaagcggcuggccaaguc

SEQ ID NO: 151383 - RNA, 19 nt, Homo sapiens
ggagacagcaaaacugaua

SEQ ID NO: 151384 - RNA, 19 nt, Homo sapiens
ggacaagaaggccaacauc

SEQ ID NO: 151385 - RNA, 19 nt, Homo sapiens
gccguuucuuucaauauuu

SEQ ID NO: 151386 - RNA, 19 nt, Homo sapiens
cagagaacaaucuugauga

SEQ ID NO: 151387 - RNA, 19 nt, Homo sapiens
ccagagaacaaucuugaug

SEQ ID NO: 151388 - RNA, 19 nt, Homo sapiens
agagaacaaucuugaugau

SEQ ID NO: 151389 - RNA, 19 nt, Homo sapiens
gcaguuugccgagauguau

SEQ ID NO: 151390 - RNA, 19 nt, Homo sapiens
gggagacacgcuucacuga

SEQ ID NO: 151391 - RNA, 19 nt, Homo sapiens
uaaaagcugugaccccaaa

SEQ ID NO: 151392 - RNA, 19 nt, Homo sapiens
gcgaggacaaggacaaaga

SEQ ID NO: 151393 - RNA, 19 nt, Homo sapiens
ugaagcaguuugccgagau

SEQ ID NO: 151394 - RNA, 19 nt, Homo sapiens
cgcauuaagagguuuauuu

SEQ ID NO: 151395 - RNA, 19 nt, Homo sapiens
gggaaacucagauguccaa

SEQ ID NO: 151396 - RNA, 19 nt, Homo sapiens
gcgcaagggccugaaagaa

SEQ ID NO: 151397 - RNA, 19 nt, Homo sapiens
ggagaaugacuugaacuuc

SEQ ID NO: 151398 - RNA, 19 nt, Homo sapiens
gagcguugcaucaccauca

SEQ ID NO: 151399 - RNA, 19 nt, Homo sapiens
gaacacgcggguagaugau

SEQ ID NO: 151400 - RNA, 19 nt, Homo sapiens
gcccucuuaugauguauau

SEQ ID NO: 151401 - RNA, 19 nt, Homo sapiens
cagcuguacuagugccauu

SEQ ID NO: 151402 - RNA, 19 nt, Homo sapiens
cagauguccaaacuaauuu

SEQ ID NO: 151403 - RNA, 19 nt, Homo sapiens
gcagacacgcccucuuagu

SEQ ID NO: 151404 - RNA, 19 nt, Homo sapiens
gguggucgguggcaucuac

SEQ ID NO: 151405 - RNA, 19 nt, Homo sapiens
ggugccggcuuccucauca

SEQ ID NO: 151406 - RNA, 19 nt, Homo sapiens
ccgaggacaucgauaaagg

SEQ ID NO: 151407 - RNA, 19 nt, Homo sapiens
ggucuccacuggccugaag

SEQ ID NO: 151408 - RNA, 19 nt, Homo sapiens
cagacucccuggugugcaa

SEQ ID NO: 151409 - RNA, 19 nt, Homo sapiens
uagugccauuggaauaaua

SEQ ID NO: 151410 - RNA, 19 nt, Homo sapiens
guacuagugccauuggaau

SEQ ID NO: 151411 - RNA, 19 nt, Homo sapiens
ugccguuucuuucaauauu

SEQ ID NO: 151412 - RNA, 19 nt, Homo sapiens
caaggagggcgcacugugu

SEQ ID NO: 151413 - RNA, 19 nt, Homo sapiens
gagaacaaucuugaugaug

SEQ ID NO: 151414 - RNA, 19 nt, Homo sapiens
agucaccgauggcgcauug

SEQ ID NO: 151415 - RNA, 19 nt, Homo sapiens
ugcaguaccucaacgagau

SEQ ID NO: 151416 - RNA, 19 nt, Homo sapiens
gcacaaccggcuguacaug

SEQ ID NO: 151417 - RNA, 19 nt, Homo sapiens
caaggacaaagaaggcaaa

SEQ ID NO: 151418 - RNA, 19 nt, Homo sapiens
ggagacacgcuucacugau

SEQ ID NO: 151419 - RNA, 19 nt, Homo sapiens
gaaagaggagacagcaaaa

SEQ ID NO: 151420 - RNA, 19 nt, Homo sapiens
ucacucaaccauaacacuu

SEQ ID NO: 151421 - RNA, 19 nt, Homo sapiens
ccaucucccucuucuacga

SEQ ID NO: 151422 - RNA, 19 nt, Homo sapiens
acaugcgggugaugaaguu

SEQ ID NO: 151423 - RNA, 19 nt, Homo sapiens
agagaaacuggacaucaaa

SEQ ID NO: 151424 - RNA, 19 nt, Homo sapiens
cacaaccggcuguacauga

SEQ ID NO: 151425 - RNA, 19 nt, Homo sapiens
aaggcccucuuaugaugua

SEQ ID NO: 151426 - RNA, 19 nt, Homo sapiens
gagacgccuuguugcagau

SEQ ID NO: 151427 - RNA, 19 nt, Homo sapiens
ggugccaaccuccgacaaa

SEQ ID NO: 151428 - RNA, 19 nt, Homo sapiens
gugcugaugaugaacaaga

SEQ ID NO: 151429 - RNA, 19 nt, Homo sapiens
cgaggacaaggacaaagaa

SEQ ID NO: 151430 - RNA, 19 nt, Homo sapiens
ucaagccugugcugaugau

SEQ ID NO: 151431 - RNA, 19 nt, Homo sapiens
gaaacucagauguccaaac

SEQ ID NO: 151432 - RNA, 19 nt, Homo sapiens
agacacgcccucuuaguag

SEQ ID NO: 151433 - RNA, 19 nt, Homo sapiens
ggccgaggacaucgauaaa

SEQ ID NO: 151434 - RNA, 19 nt, Homo sapiens
gugaagacgggcaccauca

SEQ ID NO: 151435 - RNA, 19 nt, Homo sapiens
gcaucaccaucaagucaac

SEQ ID NO: 151436 - RNA, 19 nt, Homo sapiens
cacuugaugccguuucuuu

SEQ ID NO: 151437 - RNA, 19 nt, Homo sapiens
ucccugcccuggacaacuu

SEQ ID NO: 151438 - RNA, 19 nt, Homo sapiens
ccaacauccucaccgacau

SEQ ID NO: 151439 - RNA, 19 nt, Homo sapiens
ggugguggacugcguguca

SEQ ID NO: 151440 - RNA, 19 nt, Homo sapiens
cuagugccauuggaauaau

SEQ ID NO: 151441 - RNA, 19 nt, Homo sapiens
ucacugauacccggaagga

SEQ ID NO: 151442 - RNA, 19 nt, Homo sapiens
ccaagggugugcaguaccu

SEQ ID NO: 151443 - RNA, 19 nt, Homo sapiens
caacauccucaccgacauc

SEQ ID NO: 151444 - RNA, 19 nt, Homo sapiens
ugaugccguuucuuucaau

SEQ ID NO: 151445 - RNA, 19 nt, Homo sapiens
uggccgaggacaucgauaa

SEQ ID NO: 151446 - RNA, 19 nt, Homo sapiens
gcacaaagagcgucuaaua

SEQ ID NO: 151447 - RNA, 19 nt, Homo sapiens
gauuacaucuuucgucaua

SEQ ID NO: 151448 - RNA, 19 nt, Homo sapiens
gggagaaucuguccaauug

SEQ ID NO: 151449 - RNA, 19 nt, Homo sapiens
gaacgaucgucauuaacua

SEQ ID NO: 151450 - RNA, 19 nt, Homo sapiens
acaaauggaugagcuguua

SEQ ID NO: 151451 - RNA, 19 nt, Homo sapiens
gaacugaucaagucucuga

SEQ ID NO: 151452 - RNA, 19 nt, Homo sapiens
gacgacaacuggacauaaa

SEQ ID NO: 151453 - RNA, 19 nt, Homo sapiens
acaaagagcgucuaauaaa

SEQ ID NO: 151454 - RNA, 19 nt, Homo sapiens
ucaagucucugaguuagua

SEQ ID NO: 151455 - RNA, 19 nt, Homo sapiens
gcaaaacgcuucaagaaca

SEQ ID NO: 151456 - RNA, 19 nt, Homo sapiens
aaccaagacuccacagaua

SEQ ID NO: 151457 - RNA, 19 nt, Homo sapiens
cagcagaucucagugaaga

SEQ ID NO: 151458 - RNA, 19 nt, Homo sapiens
gaucuucugccaaccuuua

SEQ ID NO: 151459 - RNA, 19 nt, Homo sapiens
gaagaaagggagaaucugu

SEQ ID NO: 151460 - RNA, 19 nt, Homo sapiens
gaaccaagacuccacagau

SEQ ID NO: 151461 - RNA, 19 nt, Homo sapiens
gaaaggaggagcucaacau

SEQ ID NO: 151462 - RNA, 19 nt, Homo sapiens
gaucaagucucugaguuag

SEQ ID NO: 151463 - RNA, 19 nt, Homo sapiens
caaagagcgucuaauaaaa

SEQ ID NO: 151464 - RNA, 19 nt, Homo sapiens
gacauucccuggcuucugu

SEQ ID NO: 151465 - RNA, 19 nt, Homo sapiens
gcucugggcugguaauuuu

SEQ ID NO: 151466 - RNA, 19 nt, Homo sapiens
ggcuauugcuugaagagua

SEQ ID NO: 151467 - RNA, 19 nt, Homo sapiens
uggaaacacccgaggauua

SEQ ID NO: 151468 - RNA, 19 nt, Homo sapiens
ccucaaaccuggcaagaag

SEQ ID NO: 151469 - RNA, 19 nt, Homo sapiens
gcuauugcuugaagaguau

SEQ ID NO: 151470 - RNA, 19 nt, Homo sapiens
gcagugagguccgaacgau

SEQ ID NO: 151471 - RNA, 19 nt, Homo sapiens
ugaaggagcugagcaaagg

SEQ ID NO: 151472 - RNA, 19 nt, Homo sapiens
ggacgacaacuggacauaa

SEQ ID NO: 151473 - RNA, 19 nt, Homo sapiens
cacaaagagcgucuaauaa

SEQ ID NO: 151474 - RNA, 19 nt, Homo sapiens
aggaggagcucaacauugu

SEQ ID NO: 151475 - RNA, 19 nt, Homo sapiens
gagaaucuguccaauugac

SEQ ID NO: 151476 - RNA, 19 nt, Homo sapiens
gaacagcauacagucauga

SEQ ID NO: 151477 - RNA, 19 nt, Homo sapiens
aguaucagcucccucgaaa

SEQ ID NO: 151478 - RNA, 19 nt, Homo sapiens
uccgaacgaucgucauuaa

SEQ ID NO: 151479 - RNA, 19 nt, Homo sapiens
auaaagaagucaagcuaca

SEQ ID NO: 151480 - RNA, 19 nt, Homo sapiens
gcuucgagcugaugugaca

SEQ ID NO: 151481 - RNA, 19 nt, Homo sapiens
ugacaucacccuagcacaa

SEQ ID NO: 151482 - RNA, 19 nt, Homo sapiens
ccuaugugacugcaucuua

SEQ ID NO: 151483 - RNA, 19 nt, Homo sapiens
ggaaacacccgaggauuac

SEQ ID NO: 151484 - RNA, 19 nt, Homo sapiens
cuaaguuccugcagcaaau

SEQ ID NO: 151485 - RNA, 19 nt, Homo sapiens
caacuggacauaaagaagu

SEQ ID NO: 151486 - RNA, 19 nt, Homo sapiens
cagccugccuaucaaguga

SEQ ID NO: 151487 - RNA, 19 nt, Homo sapiens
gaggagcucaacauuguga

SEQ ID NO: 151488 - RNA, 19 nt, Homo sapiens
ugaucaagucucugaguua

SEQ ID NO: 151489 - RNA, 19 nt, Homo sapiens
gaacuuggaggccuauggu

SEQ ID NO: 151490 - RNA, 19 nt, Homo sapiens
acccgaggauuacaucuuu

SEQ ID NO: 151491 - RNA, 19 nt, Homo sapiens
aaagaagucaagcuacaaa

SEQ ID NO: 151492 - RNA, 19 nt, Homo sapiens
gcagcaggagcagauuaua

SEQ ID NO: 151493 - RNA, 19 nt, Homo sapiens
acauaaagaagucaagcua

SEQ ID NO: 151494 - RNA, 19 nt, Homo sapiens
cgacaacuggacauaaaga

SEQ ID NO: 151495 - RNA, 19 nt, Homo sapiens
ggcgaccucugugccauuu

SEQ ID NO: 151496 - RNA, 19 nt, Homo sapiens
gacaucacccuagcacaaa

SEQ ID NO: 151497 - RNA, 19 nt, Homo sapiens
gugacugcaucuuagagaa

SEQ ID NO: 151498 - RNA, 19 nt, Homo sapiens
gcaugacccugcucuucca

SEQ ID NO: 151499 - RNA, 19 nt, Homo sapiens
uaaaaccccucuacugugu

SEQ ID NO: 151500 - RNA, 19 nt, Homo sapiens
gcaaagggguggagagcau

SEQ ID NO: 151501 - RNA, 19 nt, Homo sapiens
ggauucagcagaucucagu

SEQ ID NO: 151502 - RNA, 19 nt, Homo sapiens
caagagcccauugugaaga

SEQ ID NO: 151503 - RNA, 19 nt, Homo sapiens
ugacugcaucuuagagaaa

SEQ ID NO: 151504 - RNA, 19 nt, Homo sapiens
aaaggaggagcucaacauu

SEQ ID NO: 151505 - RNA, 19 nt, Homo sapiens
acacauccaaggucuagaa

SEQ ID NO: 151506 - RNA, 19 nt, Homo sapiens
ggagaaucuguccaauuga

SEQ ID NO: 151507 - RNA, 19 nt, Homo sapiens
aagagcccauugugaagaa

SEQ ID NO: 151508 - RNA, 19 nt, Homo sapiens
gucauuaacuacgccaaga

SEQ ID NO: 151509 - RNA, 19 nt, Homo sapiens
uaaagaagucaagcuacaa

SEQ ID NO: 151510 - RNA, 19 nt, Homo sapiens
guacgugaguggugguaac

SEQ ID NO: 151511 - RNA, 19 nt, Homo sapiens
aauuacagccugccuauca

SEQ ID NO: 151512 - RNA, 19 nt, Homo sapiens
ugaacagcauacagucaug

SEQ ID NO: 151513 - RNA, 19 nt, Homo sapiens
ccaggcacgugaagacaag

SEQ ID NO: 151514 - RNA, 19 nt, Homo sapiens
uccaagcucugggcuggua

SEQ ID NO: 151515 - RNA, 19 nt, Homo sapiens
aaagggagaaucuguccaa

SEQ ID NO: 151516 - RNA, 19 nt, Homo sapiens
cuaugugacugcaucuuag

SEQ ID NO: 151517 - RNA, 19 nt, Homo sapiens
gacaacuggacauaaagaa

SEQ ID NO: 151518 - RNA, 19 nt, Homo sapiens
ggaaaggaggagcucaaca

SEQ ID NO: 151519 - RNA, 19 nt, Homo sapiens
gcugaccucccuuuacuca

SEQ ID NO: 151520 - RNA, 19 nt, Homo sapiens
ucaaaccuggcaagaagaa

SEQ ID NO: 151521 - RNA, 19 nt, Homo sapiens
gaguaucagcucccucgaa

SEQ ID NO: 151522 - RNA, 19 nt, Homo sapiens
gugaagaaagggagaaucu

SEQ ID NO: 151523 - RNA, 19 nt, Homo sapiens
cugaucaagucucugaguu

SEQ ID NO: 151524 - RNA, 19 nt, Homo sapiens
cauuaacuacgccaagaaa

SEQ ID NO: 151525 - RNA, 19 nt, Homo sapiens
cgaacgaucgucauuaacu

SEQ ID NO: 151526 - RNA, 19 nt, Homo sapiens
gguccgaacgaucgucauu

SEQ ID NO: 151527 - RNA, 19 nt, Homo sapiens
cgaccucugugccauuucu

SEQ ID NO: 151528 - RNA, 19 nt, Homo sapiens
cugccaaccuuuacaacau

SEQ ID NO: 151529 - RNA, 19 nt, Homo sapiens
gcugcgcccucgcuuucuu

SEQ ID NO: 151530 - RNA, 19 nt, Homo sapiens
caaaacgcuucaagaacaa

SEQ ID NO: 151531 - RNA, 19 nt, Homo sapiens
acacuuaccaggaccacuu

SEQ ID NO: 151532 - RNA, 19 nt, Homo sapiens
uggcuucugugcucucuuc

SEQ ID NO: 151533 - RNA, 19 nt, Homo sapiens
gccuugaagugccgaguca

SEQ ID NO: 151534 - RNA, 19 nt, Homo sapiens
uguacacgcugugguccua

SEQ ID NO: 151535 - RNA, 19 nt, Homo sapiens
aaacacauccaaggucuag

SEQ ID NO: 151536 - RNA, 19 nt, Homo sapiens
uagcacaaagagcgucuaa

SEQ ID NO: 151537 - RNA, 19 nt, Homo sapiens
cugaccagguguuuggaaa

SEQ ID NO: 151538 - RNA, 19 nt, Homo sapiens
ccaccucggcuggcuauug

SEQ ID NO: 151539 - RNA, 19 nt, Homo sapiens
ccaugggacagucuucuga

SEQ ID NO: 151540 - RNA, 19 nt, Homo sapiens
ggcccuggauucagcagau

SEQ ID NO: 151541 - RNA, 19 nt, Homo sapiens
gguccuauccugaucuucu

SEQ ID NO: 151542 - RNA, 19 nt, Homo sapiens
ggcaagaagaagugacaga

SEQ ID NO: 151543 - RNA, 19 nt, Homo sapiens
cauccaaggucuagaaaag

SEQ ID NO: 151544 - RNA, 19 nt, Homo sapiens
gaucccauccuaugugacu

SEQ ID NO: 151545 - RNA, 19 nt, Homo sapiens
guccgaacgaucgucauua

SEQ ID NO: 151546 - RNA, 19 nt, Homo sapiens
gggcaaagcuugucaaaga

SEQ ID NO: 151547 - RNA, 19 nt, Homo sapiens
ggacacagcuacuacuaca

SEQ ID NO: 151548 - RNA, 19 nt, Homo sapiens
gaagagacuugcagcagau

SEQ ID NO: 151549 - RNA, 19 nt, Homo sapiens
cggagaagcugucugagaa

SEQ ID NO: 151550 - RNA, 19 nt, Homo sapiens
gaaugaggacuacaccaua

SEQ ID NO: 151551 - RNA, 19 nt, Homo sapiens
gugcaggcauggucccuua

SEQ ID NO: 151552 - RNA, 19 nt, Homo sapiens
gaagcugucugagaaguuc

SEQ ID NO: 151553 - RNA, 19 nt, Homo sapiens
uauauaaguugcugugugu

SEQ ID NO: 151554 - RNA, 19 nt, Homo sapiens
ccacgccucuucccacuug

SEQ ID NO: 151555 - RNA, 19 nt, Homo sapiens
agaaagaaguggagacagu

SEQ ID NO: 151556 - RNA, 19 nt, Homo sapiens
gugccaaccuguucuuaga

SEQ ID NO: 151557 - RNA, 19 nt, Homo sapiens
gagccaggaugcccagaug

SEQ ID NO: 151558 - RNA, 19 nt, Homo sapiens
gggcaaggaguucaaagaa

SEQ ID NO: 151559 - RNA, 19 nt, Homo sapiens
gaggugcggguucuacaua

SEQ ID NO: 151560 - RNA, 19 nt, Homo sapiens
ccacguguauaguaucugu

SEQ ID NO: 151561 - RNA, 19 nt, Homo sapiens
gcaaagcuugucaaagaug

SEQ ID NO: 151562 - RNA, 19 nt, Homo sapiens
ggacuacaccauacaugug

SEQ ID NO: 151563 - RNA, 19 nt, Homo sapiens
ccacaggcauaagcuauca

SEQ ID NO: 151564 - RNA, 19 nt, Homo sapiens
gagaagcugucugagaagu

SEQ ID NO: 151565 - RNA, 19 nt, Homo sapiens
ggaaugaggacuacaccau

SEQ ID NO: 151566 - RNA, 19 nt, Homo sapiens
gaccgcugcuugagguuga

SEQ ID NO: 151567 - RNA, 19 nt, Homo sapiens
gggcccacguguauaguau

SEQ ID NO: 151568 - RNA, 19 nt, Homo sapiens
caucaucuguccgcacuau

SEQ ID NO: 151569 - RNA, 19 nt, Homo sapiens
ggcaaagcuugucaaagau

SEQ ID NO: 151570 - RNA, 19 nt, Homo sapiens
ggcaaggaguucaaagaag

SEQ ID NO: 151571 - RNA, 19 nt, Homo sapiens
gcagggcccacguguauag

SEQ ID NO: 151572 - RNA, 19 nt, Homo sapiens
ggagaaagaaguggagaca

SEQ ID NO: 151573 - RNA, 19 nt, Homo sapiens
ccauacaugugcagcugaa

SEQ ID NO: 151574 - RNA, 19 nt, Homo sapiens
ccaccauuccugccuuuaa

SEQ ID NO: 151575 - RNA, 19 nt, Homo sapiens
guagccagguacugcauuc

SEQ ID NO: 151576 - RNA, 19 nt, Homo sapiens
gcacuccaaaccugucuug

SEQ ID NO: 151577 - RNA, 19 nt, Homo sapiens
ucaaagaaggacacagcua

SEQ ID NO: 151578 - RNA, 19 nt, Homo sapiens
gaaguggagacaguccuuu

SEQ ID NO: 151579 - RNA, 19 nt, Homo sapiens
caugaagaccgcugcuuga

SEQ ID NO: 151580 - RNA, 19 nt, Homo sapiens
agaaguuuguagccaggua

SEQ ID NO: 151581 - RNA, 19 nt, Homo sapiens
gagcugccacagagaaguu

SEQ ID NO: 151582 - RNA, 19 nt, Homo sapiens
ccacuucugcugcugcaaa

SEQ ID NO: 151583 - RNA, 19 nt, Homo sapiens
ugaacugacugaaggaaaa

SEQ ID NO: 151584 - RNA, 19 nt, Homo sapiens
cuacauagcaucggucaca

SEQ ID NO: 151585 - RNA, 19 nt, Homo sapiens
gcccggagaagcugucuga

SEQ ID NO: 151586 - RNA, 19 nt, Homo sapiens
caccauuccugccuuuaag

SEQ ID NO: 151587 - RNA, 19 nt, Homo sapiens
gccaaccuguucuuagagu

SEQ ID NO: 151588 - RNA, 19 nt, Homo sapiens
aggcauaagcuaucaccua

SEQ ID NO: 151589 - RNA, 19 nt, Homo sapiens
caguucaaaucccaaguuc

SEQ ID NO: 151590 - RNA, 19 nt, Homo sapiens
ccacaccuggccuuaaaga

SEQ ID NO: 151591 - RNA, 19 nt, Homo sapiens
gcacuaugaagaucacucu

SEQ ID NO: 151592 - RNA, 19 nt, Homo sapiens
ccacaggagaagagacuug

SEQ ID NO: 151593 - RNA, 19 nt, Homo sapiens
guccugauuucuacaacug

SEQ ID NO: 151594 - RNA, 19 nt, Homo sapiens
ugccuagaguguagccuaa

SEQ ID NO: 151595 - RNA, 19 nt, Homo sapiens
aacaguuucuugcuuggaa

SEQ ID NO: 151596 - RNA, 19 nt, Homo sapiens
gccacaccgucuucuggaa

SEQ ID NO: 151597 - RNA, 19 nt, Homo sapiens
gaaggaaaagcaagaaaca

SEQ ID NO: 151598 - RNA, 19 nt, Homo sapiens
gcccagaugaacugacuga

SEQ ID NO: 151599 - RNA, 19 nt, Homo sapiens
gccaggaugcccagaugaa

SEQ ID NO: 151600 - RNA, 19 nt, Homo sapiens
ggacaggcacuccaaaccu

SEQ ID NO: 151601 - RNA, 19 nt, Homo sapiens
gugcugcuccuuccacuuc

SEQ ID NO: 151602 - RNA, 19 nt, Homo sapiens
acacagcuacuacuacauc

SEQ ID NO: 151603 - RNA, 19 nt, Homo sapiens
gaaggacacagcuacuacu

SEQ ID NO: 151604 - RNA, 19 nt, Homo sapiens
uuccagcgcuucacaccuu

SEQ ID NO: 151605 - RNA, 19 nt, Homo sapiens
gccagguacugcauucucu

SEQ ID NO: 151606 - RNA, 19 nt, Homo sapiens
ggaaaagcaagaaacaguu

SEQ ID NO: 151607 - RNA, 19 nt, Homo sapiens
ccagaugaacugacugaag

SEQ ID NO: 151608 - RNA, 19 nt, Homo sapiens
aaugaggacuacaccauac

SEQ ID NO: 151609 - RNA, 19 nt, Homo sapiens
cugugugucuguccugauu

SEQ ID NO: 151610 - RNA, 19 nt, Homo sapiens
caaccuguucuuagagugu

SEQ ID NO: 151611 - RNA, 19 nt, Homo sapiens
uacaugugcagcugaauga

SEQ ID NO: 151612 - RNA, 19 nt, Homo sapiens
gcccacguguauaguaucu

SEQ ID NO: 151613 - RNA, 19 nt, Homo sapiens
ccacguggaugggcaaagc

SEQ ID NO: 151614 - RNA, 19 nt, Homo sapiens
ccuagaguguagccuaaag

SEQ ID NO: 151615 - RNA, 19 nt, Homo sapiens
ccggagaagcugucugaga

SEQ ID NO: 151616 - RNA, 19 nt, Homo sapiens
ugucuguccugauuucuac

SEQ ID NO: 151617 - RNA, 19 nt, Homo sapiens
gugugucuguccugauuuc

SEQ ID NO: 151618 - RNA, 19 nt, Homo sapiens
ugguggagcaugaggagua

SEQ ID NO: 151619 - RNA, 19 nt, Homo sapiens
gggcugugccaaccuguuc

SEQ ID NO: 151620 - RNA, 19 nt, Homo sapiens
caggagaggcagcaugcuu

SEQ ID NO: 151621 - RNA, 19 nt, Homo sapiens
gaugaacugacugaaggaa

SEQ ID NO: 151622 - RNA, 19 nt, Homo sapiens
augugcagcugaaugacua

SEQ ID NO: 151623 - RNA, 19 nt, Homo sapiens
aaucccaaguuccggaaug

SEQ ID NO: 151624 - RNA, 19 nt, Homo sapiens
cuacuacuacaucuccaaa

SEQ ID NO: 151625 - RNA, 19 nt, Homo sapiens
aagaaggacacagcuacua

SEQ ID NO: 151626 - RNA, 19 nt, Homo sapiens
cuacguggacaucaucugu

SEQ ID NO: 151627 - RNA, 19 nt, Homo sapiens
ggagaagcugucugagaag

SEQ ID NO: 151628 - RNA, 19 nt, Homo sapiens
gacaguccuuucccaccau

SEQ ID NO: 151629 - RNA, 19 nt, Homo sapiens
ucggagggacggagaaaga

SEQ ID NO: 151630 - RNA, 19 nt, Homo sapiens
gaggacuacaccauacaug

SEQ ID NO: 151631 - RNA, 19 nt, Homo sapiens
caaggaguucaaagaagga

SEQ ID NO: 151632 - RNA, 19 nt, Homo sapiens
gagggacggagaaagaagu

SEQ ID NO: 151633 - RNA, 19 nt, Homo sapiens
caccacaggcauaagcuau

SEQ ID NO: 151634 - RNA, 19 nt, Homo sapiens
gagggacaggcacuccaaa

SEQ ID NO: 151635 - RNA, 19 nt, Homo sapiens
gaaugacuacguggacauc

SEQ ID NO: 151636 - RNA, 19 nt, Homo sapiens
ggagggacggagaaagaag

SEQ ID NO: 151637 - RNA, 19 nt, Homo sapiens
ccaccacaggcauaagcua

SEQ ID NO: 151638 - RNA, 19 nt, Homo sapiens
agcaauaacucguguagca

SEQ ID NO: 151639 - RNA, 19 nt, Homo sapiens
gcuacgccgucuacuggaa

SEQ ID NO: 151640 - RNA, 19 nt, Homo sapiens
gaggugagcaucaaugacu

SEQ ID NO: 151641 - RNA, 19 nt, Homo sapiens
ccaacgagacccuguacga

SEQ ID NO: 151642 - RNA, 19 nt, Homo sapiens
cggagaaguuccagcucuu

SEQ ID NO: 151643 - RNA, 19 nt, Homo sapiens
augacuaccuggacaucua

SEQ ID NO: 151644 - RNA, 19 nt, Homo sapiens
cgaccaacgagacccugua

SEQ ID NO: 151645 - RNA, 19 nt, Homo sapiens
gccugcgacugaaggugua

SEQ ID NO: 151646 - RNA, 19 nt, Homo sapiens
ccgagcgcauggagcacua

SEQ ID NO: 151647 - RNA, 19 nt, Homo sapiens
ggaagugucugaggaugaa

SEQ ID NO: 151648 - RNA, 19 nt, Homo sapiens
ccagagagagcaaaucgaa

SEQ ID NO: 151649 - RNA, 19 nt, Homo sapiens
gaagaucaacgugcuggaa

SEQ ID NO: 151650 - RNA, 19 nt, Homo sapiens
ggcaugcgguguacuggaa

SEQ ID NO: 151651 - RNA, 19 nt, Homo sapiens
ggauugugguuuggauuga

SEQ ID NO: 151652 - RNA, 19 nt, Homo sapiens
gaacgugaacgacuaucug

SEQ ID NO: 151653 - RNA, 19 nt, Homo sapiens
guacagacucuauaucucu

SEQ ID NO: 151654 - RNA, 19 nt, Homo sapiens
gcauguacagacucuauau

SEQ ID NO: 151655 - RNA, 19 nt, Homo sapiens
caacgugcuggaagacuuu

SEQ ID NO: 151656 - RNA, 19 nt, Homo sapiens
ucaacgugcuggaagacuu

SEQ ID NO: 151657 - RNA, 19 nt, Homo sapiens
gcucugguaauguuuggua

SEQ ID NO: 151658 - RNA, 19 nt, Homo sapiens
gcaggcauguacagacucu

SEQ ID NO: 151659 - RNA, 19 nt, Homo sapiens
gcugugacuuucauacucu

SEQ ID NO: 151660 - RNA, 19 nt, Homo sapiens
uacagacucuauaucucua

SEQ ID NO: 151661 - RNA, 19 nt, Homo sapiens
gauugugguuuggauugaa

SEQ ID NO: 151662 - RNA, 19 nt, Homo sapiens
ucaagugcuuuggcuguga

SEQ ID NO: 151663 - RNA, 19 nt, Homo sapiens
auacucugcucuuagucua

SEQ ID NO: 151664 - RNA, 19 nt, Homo sapiens
gugcuuuggcugugacuuu

SEQ ID NO: 151665 - RNA, 19 nt, Homo sapiens
ccuuguggcucugguaaug

SEQ ID NO: 151666 - RNA, 19 nt, Homo sapiens
ugacguucuuggccuccua

SEQ ID NO: 151667 - RNA, 19 nt, Homo sapiens
ugcccaagcuugagaagag

SEQ ID NO: 151668 - RNA, 19 nt, Homo sapiens
ggcauguacagacucuaua

SEQ ID NO: 151669 - RNA, 19 nt, Homo sapiens
ccaggauugugguuuggau

SEQ ID NO: 151670 - RNA, 19 nt, Homo sapiens
cuuccaggauugugguuug

SEQ ID NO: 151671 - RNA, 19 nt, Homo sapiens
agaucaacgugcuggaaga

SEQ ID NO: 151672 - RNA, 19 nt, Homo sapiens
cucacaaccugcacuggaa

SEQ ID NO: 151673 - RNA, 19 nt, Homo sapiens
gcacagccccaucaaguuc

SEQ ID NO: 151674 - RNA, 19 nt, Homo sapiens
ccacguagggcacuguagu

SEQ ID NO: 151675 - RNA, 19 nt, Homo sapiens
ggcugugacuuucauacuc

SEQ ID NO: 151676 - RNA, 19 nt, Homo sapiens
aggugaacgugaacgacua

SEQ ID NO: 151677 - RNA, 19 nt, Homo sapiens
gagaaguuccagcgcuaca

SEQ ID NO: 151678 - RNA, 19 nt, Homo sapiens
cuggugcccucucccuuug

SEQ ID NO: 151679 - RNA, 19 nt, Homo sapiens
gcaacgcacagacacuuuu

SEQ ID NO: 151680 - RNA, 19 nt, Homo sapiens
ccuggugcccucucccuuu

SEQ ID NO: 151681 - RNA, 19 nt, Homo sapiens
gaccaaaccuucaauaaac

SEQ ID NO: 151682 - RNA, 19 nt, Homo sapiens
caauaaaccacucaucuuu

SEQ ID NO: 151683 - RNA, 19 nt, Homo sapiens
gcaaggagaggaagucuga

SEQ ID NO: 151684 - RNA, 19 nt, Homo sapiens
gaagaagcccugccuacug

SEQ ID NO: 151685 - RNA, 19 nt, Homo sapiens
aagcagaccuucccucuca

SEQ ID NO: 151686 - RNA, 19 nt, Homo sapiens
gagcugggccucaacgauu

SEQ ID NO: 151687 - RNA, 19 nt, Homo sapiens
ccgacaagauggagcauug

SEQ ID NO: 151688 - RNA, 19 nt, Homo sapiens
agaccaaaccuucaauaaa

SEQ ID NO: 151689 - RNA, 19 nt, Homo sapiens
ggagagacuuacuacuaca

SEQ ID NO: 151690 - RNA, 19 nt, Homo sapiens
ucacucacuugucuucuau

SEQ ID NO: 151691 - RNA, 19 nt, Homo sapiens
caucacaggcuaaagaaga

SEQ ID NO: 151692 - RNA, 19 nt, Homo sapiens
ccgagacguuugcuuugua

SEQ ID NO: 151693 - RNA, 19 nt, Homo sapiens
aagaagcccugccuacugu

SEQ ID NO: 151694 - RNA, 19 nt, Homo sapiens
ggaccagggcaaagaagaa

SEQ ID NO: 151695 - RNA, 19 nt, Homo sapiens
caacgauuaccuagacauu

SEQ ID NO: 151696 - RNA, 19 nt, Homo sapiens
agacagcccuggacacucu

SEQ ID NO: 151697 - RNA, 19 nt, Homo sapiens
guucuuaccuggagagacu

SEQ ID NO: 151698 - RNA, 19 nt, Homo sapiens
ucaauaaaccacucaucuu

SEQ ID NO: 151699 - RNA, 19 nt, Homo sapiens
ccagaguccucccaagauc

SEQ ID NO: 151700 - RNA, 19 nt, Homo sapiens
gaagcagaggcaagacaaa

SEQ ID NO: 151701 - RNA, 19 nt, Homo sapiens
ggacuggauuugguaugau

SEQ ID NO: 151702 - RNA, 19 nt, Homo sapiens
ggagaggaagucugaguca

SEQ ID NO: 151703 - RNA, 19 nt, Homo sapiens
cuggagagacuuacuacua

SEQ ID NO: 151704 - RNA, 19 nt, Homo sapiens
gacguuugcuuuguacaug

SEQ ID NO: 151705 - RNA, 19 nt, Homo sapiens
uagaccaaaccuucaauaa

SEQ ID NO: 151706 - RNA, 19 nt, Homo sapiens
ccucggcuuugaguucuua

SEQ ID NO: 151707 - RNA, 19 nt, Homo sapiens
acgauuaccuagacauugu

SEQ ID NO: 151708 - RNA, 19 nt, Homo sapiens
ccucaacgauuaccuagac

SEQ ID NO: 151709 - RNA, 19 nt, Homo sapiens
caggaggacuggauuuggu

SEQ ID NO: 151710 - RNA, 19 nt, Homo sapiens
ccucaucacaggcuaaaga

SEQ ID NO: 151711 - RNA, 19 nt, Homo sapiens
auaaguaucuagaccaaac

SEQ ID NO: 151712 - RNA, 19 nt, Homo sapiens
caauucagaccgacaagau

SEQ ID NO: 151713 - RNA, 19 nt, Homo sapiens
uggagagacuuacuacuac

SEQ ID NO: 151714 - RNA, 19 nt, Homo sapiens
auucagcgcuucacaccuu

SEQ ID NO: 151715 - RNA, 19 nt, Homo sapiens
gagacuuacuacuacaucu

SEQ ID NO: 151716 - RNA, 19 nt, Homo sapiens
ggacucuucaugagguuga

SEQ ID NO: 151717 - RNA, 19 nt, Homo sapiens
uaaagaagagcaguagaca

SEQ ID NO: 151718 - RNA, 19 nt, Homo sapiens
ugagucagcccauccuguu

SEQ ID NO: 151719 - RNA, 19 nt, Homo sapiens
acucacuugucuucuauga

SEQ ID NO: 151720 - RNA, 19 nt, Homo sapiens
cuagaccaaaccuucaaua

SEQ ID NO: 151721 - RNA, 19 nt, Homo sapiens
gacuggauuugguaugauc

SEQ ID NO: 151722 - RNA, 19 nt, Homo sapiens
gguaugaucaaauccucaa

SEQ ID NO: 151723 - RNA, 19 nt, Homo sapiens
agcugggccucaacgauua

SEQ ID NO: 151724 - RNA, 19 nt, Homo sapiens
ggacuggccaggcuaugag

SEQ ID NO: 151725 - RNA, 19 nt, Homo sapiens
gaauuucaugccaguuugu

SEQ ID NO: 151726 - RNA, 19 nt, Homo sapiens
aggacuggauuugguauga

SEQ ID NO: 151727 - RNA, 19 nt, Homo sapiens
uggagagaguggcacauca

SEQ ID NO: 151728 - RNA, 19 nt, Homo sapiens
cgagacguuugcuuuguac

SEQ ID NO: 151729 - RNA, 19 nt, Homo sapiens
ggaucacucacuugucuuc

SEQ ID NO: 151730 - RNA, 19 nt, Homo sapiens
agacaaacacaggcgcuuu

SEQ ID NO: 151731 - RNA, 19 nt, Homo sapiens
ugaagcagaggcaagacaa

SEQ ID NO: 151732 - RNA, 19 nt, Homo sapiens
gggccucaacgauuaccua

SEQ ID NO: 151733 - RNA, 19 nt, Homo sapiens
gccagaguccucccaagau

SEQ ID NO: 151734 - RNA, 19 nt, Homo sapiens
gacaagauggagcauugau

SEQ ID NO: 151735 - RNA, 19 nt, Homo sapiens
ggagcugggccucaacgau

SEQ ID NO: 151736 - RNA, 19 nt, Homo sapiens
ggagagaguggcacaucag

SEQ ID NO: 151737 - RNA, 19 nt, Homo sapiens
ggaggacuggauuugguau

SEQ ID NO: 151738 - RNA, 19 nt, Homo sapiens
ugggagcccuggagagagu

SEQ ID NO: 151739 - RNA, 19 nt, Homo sapiens
guugggagcccuggagaga

SEQ ID NO: 151740 - RNA, 19 nt, Homo sapiens
guagacagcccuggacacu

SEQ ID NO: 151741 - RNA, 19 nt, Homo sapiens
uuacugcugcuucugauuc

SEQ ID NO: 151742 - RNA, 19 nt, Homo sapiens
cuaaagaagagcaguagac

SEQ ID NO: 151743 - RNA, 19 nt, Homo sapiens
gcuaaagaagagcaguaga

SEQ ID NO: 151744 - RNA, 19 nt, Homo sapiens
cgacaagauggagcauuga

SEQ ID NO: 151745 - RNA, 19 nt, Homo sapiens
ggugugcucccugcccuuu

SEQ ID NO: 151746 - RNA, 19 nt, Homo sapiens
gcagaccuucccucucauc

SEQ ID NO: 151747 - RNA, 19 nt, Homo sapiens
ggaagaagguccugucuaa

SEQ ID NO: 151748 - RNA, 19 nt, Homo sapiens
uaaaugaacaggcuucuaa

SEQ ID NO: 151749 - RNA, 19 nt, Homo sapiens
gauacgauauuacaccauu

SEQ ID NO: 151750 - RNA, 19 nt, Homo sapiens
gaacuuugauggcuacagu

SEQ ID NO: 151751 - RNA, 19 nt, Homo sapiens
gcucuccuaugcaauauuu

SEQ ID NO: 151752 - RNA, 19 nt, Homo sapiens
gauauuacaccauuuccua

SEQ ID NO: 151753 - RNA, 19 nt, Homo sapiens
ccaaaggguucaagagaug

SEQ ID NO: 151754 - RNA, 19 nt, Homo sapiens
caaauggaccgcugaaguu

SEQ ID NO: 151755 - RNA, 19 nt, Homo sapiens
uaagaacucaccuccguua

SEQ ID NO: 151756 - RNA, 19 nt, Homo sapiens
auucagaacuguaagauga

SEQ ID NO: 151757 - RNA, 19 nt, Homo sapiens
gcacaaacaccaaggauac

SEQ ID NO: 151758 - RNA, 19 nt, Homo sapiens
ccuaagaagggacuuguua

SEQ ID NO: 151759 - RNA, 19 nt, Homo sapiens
ccgcugaaguucucugaaa

SEQ ID NO: 151760 - RNA, 19 nt, Homo sapiens
uaacugcucauccuaagaa

SEQ ID NO: 151761 - RNA, 19 nt, Homo sapiens
uaagaagggacuuguuauu

SEQ ID NO: 151762 - RNA, 19 nt, Homo sapiens
ggugcgaguuugucuuuau

SEQ ID NO: 151763 - RNA, 19 nt, Homo sapiens
caauauuuaugccuucuca

SEQ ID NO: 151764 - RNA, 19 nt, Homo sapiens
caacaaauagcuguaugaa

SEQ ID NO: 151765 - RNA, 19 nt, Homo sapiens
gaagaagguccugucuaaa

SEQ ID NO: 151766 - RNA, 19 nt, Homo sapiens
agaagggacuuguuauugg

SEQ ID NO: 151767 - RNA, 19 nt, Homo sapiens
cagaugacaccguacauga

SEQ ID NO: 151768 - RNA, 19 nt, Homo sapiens
gucuaaagcucaaagucuu

SEQ ID NO: 151769 - RNA, 19 nt, Homo sapiens
gaacaggcuucuaaaaggu

SEQ ID NO: 151770 - RNA, 19 nt, Homo sapiens
ucccaucacuugucacaga

SEQ ID NO: 151771 - RNA, 19 nt, Homo sapiens
cgagaacgcggcacaaaca

SEQ ID NO: 151772 - RNA, 19 nt, Homo sapiens
ccaaauggaccgcugaagu

SEQ ID NO: 151773 - RNA, 19 nt, Homo sapiens
gaauguaaccggccucacu

SEQ ID NO: 151774 - RNA, 19 nt, Homo sapiens
gcuacgcugucuacuggaa

SEQ ID NO: 151775 - RNA, 19 nt, Homo sapiens
ggaagaauaguggcagaug

SEQ ID NO: 151776 - RNA, 19 nt, Homo sapiens
ucucaccccucccaaauua

SEQ ID NO: 151777 - RNA, 19 nt, Homo sapiens
uuuggcagaugucagauuu

SEQ ID NO: 151778 - RNA, 19 nt, Homo sapiens
gauguuaacgacaaaguag

SEQ ID NO: 151779 - RNA, 19 nt, Homo sapiens
cauuagaaccagcagauga

SEQ ID NO: 151780 - RNA, 19 nt, Homo sapiens
ccaacaaauagcuguauga

SEQ ID NO: 151781 - RNA, 19 nt, Homo sapiens
cggccucacucuccaaaug

SEQ ID NO: 151782 - RNA, 19 nt, Homo sapiens
uucaagagaugggaaugua

SEQ ID NO: 151783 - RNA, 19 nt, Homo sapiens
ccagagauccaccuaacug

SEQ ID NO: 151784 - RNA, 19 nt, Homo sapiens
cuacaucuccucugcaauc

SEQ ID NO: 151785 - RNA, 19 nt, Homo sapiens
ggcacaaacaccaaggaua

SEQ ID NO: 151786 - RNA, 19 nt, Homo sapiens
gcagaugacaccguacaug

SEQ ID NO: 151787 - RNA, 19 nt, Homo sapiens
aagaagggacuuguuauug

SEQ ID NO: 151788 - RNA, 19 nt, Homo sapiens
gauguugacgcugguguuu

SEQ ID NO: 151789 - RNA, 19 nt, Homo sapiens
caccagagauccaccuaac

SEQ ID NO: 151790 - RNA, 19 nt, Homo sapiens
aaacaucagggucuuggaa

SEQ ID NO: 151791 - RNA, 19 nt, Homo sapiens
ccugugcauucuccucuaa

SEQ ID NO: 151792 - RNA, 19 nt, Homo sapiens
gaugacaccguacaugagu

SEQ ID NO: 151793 - RNA, 19 nt, Homo sapiens
ccauauugaugucuguauc

SEQ ID NO: 151794 - RNA, 19 nt, Homo sapiens
guaaaugaacaggcuucua

SEQ ID NO: 151795 - RNA, 19 nt, Homo sapiens
cagccugaauucuaagcaa

SEQ ID NO: 151796 - RNA, 19 nt, Homo sapiens
ucucuaggauuugaauuca

SEQ ID NO: 151797 - RNA, 19 nt, Homo sapiens
ucaagagaugggaauguaa

SEQ ID NO: 151798 - RNA, 19 nt, Homo sapiens
cuauggacaaggaagaaua

SEQ ID NO: 151799 - RNA, 19 nt, Homo sapiens
cgucagcuccugugcauuc

SEQ ID NO: 151800 - RNA, 19 nt, Homo sapiens
ggucuuggaacaccagaga

SEQ ID NO: 151801 - RNA, 19 nt, Homo sapiens
gcacagucuccucccauca

SEQ ID NO: 151802 - RNA, 19 nt, Homo sapiens
aagaagguccugucuaaag

SEQ ID NO: 151803 - RNA, 19 nt, Homo sapiens
ccuauaggaguauguaaau

SEQ ID NO: 151804 - RNA, 19 nt, Homo sapiens
gaggggagguauuaagaau

SEQ ID NO: 151805 - RNA, 19 nt, Homo sapiens
gggacuuguuauuggguuu

SEQ ID NO: 151806 - RNA, 19 nt, Homo sapiens
ccaccuaacugcucauccu

SEQ ID NO: 151807 - RNA, 19 nt, Homo sapiens
gguccugucuaaagcucaa

SEQ ID NO: 151808 - RNA, 19 nt, Homo sapiens
uccaaaggguucaagagau

SEQ ID NO: 151809 - RNA, 19 nt, Homo sapiens
ucuacauggugaacuuuga

SEQ ID NO: 151810 - RNA, 19 nt, Homo sapiens
ugacuaccauauugauguc

SEQ ID NO: 151811 - RNA, 19 nt, Homo sapiens
cgauguuaacgacaaagua

SEQ ID NO: 151812 - RNA, 19 nt, Homo sapiens
aacuauagguguucaugau

SEQ ID NO: 151813 - RNA, 19 nt, Homo sapiens
agauaagacugagcgcuau

SEQ ID NO: 151814 - RNA, 19 nt, Homo sapiens
cuaagaagggacuuguuau

SEQ ID NO: 151815 - RNA, 19 nt, Homo sapiens
aaacuauagguguucauga

SEQ ID NO: 151816 - RNA, 19 nt, Homo sapiens
aaucccagauaauggaaga

SEQ ID NO: 151817 - RNA, 19 nt, Homo sapiens
gggugcgaguuugucuuua

SEQ ID NO: 151818 - RNA, 19 nt, Homo sapiens
gugcgaguuugucuuuauc

SEQ ID NO: 151819 - RNA, 19 nt, Homo sapiens
gcaaucccagauaauggaa

SEQ ID NO: 151820 - RNA, 19 nt, Homo sapiens
gugacuaccauauugaugu

SEQ ID NO: 151821 - RNA, 19 nt, Homo sapiens
agaugaaaaugccaaauug

SEQ ID NO: 151822 - RNA, 19 nt, Homo sapiens
uaagcaacaacuucagguu

SEQ ID NO: 151823 - RNA, 19 nt, Homo sapiens
ccuaacugcucauccuaag

SEQ ID NO: 151824 - RNA, 19 nt, Homo sapiens
ggccaggcgugauguugca

SEQ ID NO: 151825 - RNA, 19 nt, Homo sapiens
aggaguauguaaaugaaca

SEQ ID NO: 151826 - RNA, 19 nt, Homo sapiens
cuauaggaguauguaaaug

SEQ ID NO: 151827 - RNA, 19 nt, Homo sapiens
gaccaacaaauagcuguau

SEQ ID NO: 151828 - RNA, 19 nt, Homo sapiens
caagagaugggaauguaac

SEQ ID NO: 151829 - RNA, 19 nt, Homo sapiens
gauaagacugagcgcuaug

SEQ ID NO: 151830 - RNA, 19 nt, Homo sapiens
aaaugaacaggcuucuaaa

SEQ ID NO: 151831 - RNA, 19 nt, Homo sapiens
agaagguccugucuaaagc

SEQ ID NO: 151832 - RNA, 19 nt, Homo sapiens
ucagaacuguaagaugauc

SEQ ID NO: 151833 - RNA, 19 nt, Homo sapiens
cgacaaaguagaaaauuca

SEQ ID NO: 151834 - RNA, 19 nt, Homo sapiens
ccagauaauggaagaaggu

SEQ ID NO: 151835 - RNA, 19 nt, Homo sapiens
ugaacaggcuucuaaaagg

SEQ ID NO: 151836 - RNA, 19 nt, Homo sapiens
auuuaugccuucucauuca

SEQ ID NO: 151837 - RNA, 19 nt, Homo sapiens
ugugcauucuccucuaaga

SEQ ID NO: 151838 - RNA, 19 nt, Homo sapiens
ucaaugacuaccuggaugu

SEQ ID NO: 151839 - RNA, 19 nt, Homo sapiens
gcgaugcuuuugacauuau

SEQ ID NO: 151840 - RNA, 19 nt, Homo sapiens
ucccagaagauaagacuga

SEQ ID NO: 151841 - RNA, 19 nt, Homo sapiens
uaucaaugacuaccuggau

SEQ ID NO: 151842 - RNA, 19 nt, Homo sapiens
ggcgagaacgcggcacaaa

SEQ ID NO: 151843 - RNA, 19 nt, Homo sapiens
gcucuucacucccuuuucu

SEQ ID NO: 151844 - RNA, 19 nt, Homo sapiens
gggcuauggacaaggaaga

SEQ ID NO: 151845 - RNA, 19 nt, Homo sapiens
gaauucuaagcaacaacuu

SEQ ID NO: 151846 - RNA, 19 nt, Homo sapiens
uguugacgcugguguuucu

SEQ ID NO: 151847 - RNA, 19 nt, Homo sapiens
gaaauacgcuuuaccauca

SEQ ID NO: 151848 - RNA, 19 nt, Homo sapiens
ucaagaagcaccaugauua

SEQ ID NO: 151849 - RNA, 19 nt, Homo sapiens
ccacaccgcuggccaagaa

SEQ ID NO: 151850 - RNA, 19 nt, Homo sapiens
gcaccaugauuacuacauu

SEQ ID NO: 151851 - RNA, 19 nt, Homo sapiens
ggacagcagugggagguuu

SEQ ID NO: 151852 - RNA, 19 nt, Homo sapiens
gagacaagcuggacaucau

SEQ ID NO: 151853 - RNA, 19 nt, Homo sapiens
ggaagggcuuggugaucua

SEQ ID NO: 151854 - RNA, 19 nt, Homo sapiens
gaccuaagcggguauaaga

SEQ ID NO: 151855 - RNA, 19 nt, Homo sapiens
gagcaggaaauacgcuuua

SEQ ID NO: 151856 - RNA, 19 nt, Homo sapiens
caccaugauuacuacauua

SEQ ID NO: 151857 - RNA, 19 nt, Homo sapiens
cauaggaugccauuucuuu

SEQ ID NO: 151858 - RNA, 19 nt, Homo sapiens
ggacuacagagaacaacua

SEQ ID NO: 151859 - RNA, 19 nt, Homo sapiens
gcuaacagacugccacuug

SEQ ID NO: 151860 - RNA, 19 nt, Homo sapiens
gugcccaccuuuguauuua

SEQ ID NO: 151861 - RNA, 19 nt, Homo sapiens
gaagcaccaugauuacuac

SEQ ID NO: 151862 - RNA, 19 nt, Homo sapiens
cacgguaauuaaugucuua

SEQ ID NO: 151863 - RNA, 19 nt, Homo sapiens
aggcagggcuggacacuga

SEQ ID NO: 151864 - RNA, 19 nt, Homo sapiens
gccaagggaucccgaagug

SEQ ID NO: 151865 - RNA, 19 nt, Homo sapiens
gggaagggcuuggugaucu

SEQ ID NO: 151866 - RNA, 19 nt, Homo sapiens
cggcgaacaucuacuacaa

SEQ ID NO: 151867 - RNA, 19 nt, Homo sapiens
cuaacagacugccacuuga

SEQ ID NO: 151868 - RNA, 19 nt, Homo sapiens
cgacaucaucauucccuua

SEQ ID NO: 151869 - RNA, 19 nt, Homo sapiens
ccaccuuuguauuuaguuu

SEQ ID NO: 151870 - RNA, 19 nt, Homo sapiens
gaccggaccucuccuuucg

SEQ ID NO: 151871 - RNA, 19 nt, Homo sapiens
gcacacgcaccaugaagau

SEQ ID NO: 151872 - RNA, 19 nt, Homo sapiens
ggacccugauggcuucuuc

SEQ ID NO: 151873 - RNA, 19 nt, Homo sapiens
agaagcaccaugauuacua

SEQ ID NO: 151874 - RNA, 19 nt, Homo sapiens
cuacagagaacaacuacug

SEQ ID NO: 151875 - RNA, 19 nt, Homo sapiens
ccacccuguucucuccuua

SEQ ID NO: 151876 - RNA, 19 nt, Homo sapiens
ccugauggcuucuucaacu

SEQ ID NO: 151877 - RNA, 19 nt, Homo sapiens
ggagagcccaggagaacga

SEQ ID NO: 151878 - RNA, 19 nt, Homo sapiens
cugcagagcugggaguuuc

SEQ ID NO: 151879 - RNA, 19 nt, Homo sapiens
gcugcccucucgcucagua

SEQ ID NO: 151880 - RNA, 19 nt, Homo sapiens
ccaucaaguuccaggaguu

SEQ ID NO: 151881 - RNA, 19 nt, Homo sapiens
ggaccggaccucuccuuuc

SEQ ID NO: 151882 - RNA, 19 nt, Homo sapiens
gcaagcaugagacugugaa

SEQ ID NO: 151883 - RNA, 19 nt, Homo sapiens
ucaugaagguugggcaaga

SEQ ID NO: 151884 - RNA, 19 nt, Homo sapiens
caagaagcaccaugauuac

SEQ ID NO: 151885 - RNA, 19 nt, Homo sapiens
ggaaggcgaggcgagcuuu

SEQ ID NO: 151886 - RNA, 19 nt, Homo sapiens
gcucuucuaaguacacuga

SEQ ID NO: 151887 - RNA, 19 nt, Homo sapiens
cgagaccucugcgggaaga

SEQ ID NO: 151888 - RNA, 19 nt, Homo sapiens
ccuguucucuccuuaccuu

SEQ ID NO: 151889 - RNA, 19 nt, Homo sapiens
gcccagcgacaucaucauu

SEQ ID NO: 151890 - RNA, 19 nt, Homo sapiens
uacauuaccucaacaucca

SEQ ID NO: 151891 - RNA, 19 nt, Homo sapiens
ggagacaagcuggacauca

SEQ ID NO: 151892 - RNA, 19 nt, Homo sapiens
acuccaagguggcauuguu

SEQ ID NO: 151893 - RNA, 19 nt, Homo sapiens
ucacgguaauuaaugucuu

SEQ ID NO: 151894 - RNA, 19 nt, Homo sapiens
ugacgguccuacuacugaa

SEQ ID NO: 151895 - RNA, 19 nt, Homo sapiens
gcaaggaggcagacaacac

SEQ ID NO: 151896 - RNA, 19 nt, Homo sapiens
caagaucccaaugcuguga

SEQ ID NO: 151897 - RNA, 19 nt, Homo sapiens
ggugggagagggagcagaa

SEQ ID NO: 151898 - RNA, 19 nt, Homo sapiens
ggaugccauuucuuuuaua

SEQ ID NO: 151899 - RNA, 19 nt, Homo sapiens
ggcccaagccaguacaaga

SEQ ID NO: 151900 - RNA, 19 nt, Homo sapiens
gcugugcccaccuuuguau

SEQ ID NO: 151901 - RNA, 19 nt, Homo sapiens
caugaagguugggcaagau

SEQ ID NO: 151902 - RNA, 19 nt, Homo sapiens
gagcuggcccucacaccau

SEQ ID NO: 151903 - RNA, 19 nt, Homo sapiens
gcacggcugcuaacagacu

SEQ ID NO: 151904 - RNA, 19 nt, Homo sapiens
ucacucucacgguaauuaa

SEQ ID NO: 151905 - RNA, 19 nt, Homo sapiens
caacucauuuucaucuguu

SEQ ID NO: 151906 - RNA, 19 nt, Homo sapiens
gagcccagcgacaucauca

SEQ ID NO: 151907 - RNA, 19 nt, Homo sapiens
cgaagcgucucgggaaguc

SEQ ID NO: 151908 - RNA, 19 nt, Homo sapiens
ucuguugccauuuguguaa

SEQ ID NO: 151909 - RNA, 19 nt, Homo sapiens
ucccagagcagccauggaa

SEQ ID NO: 151910 - RNA, 19 nt, Homo sapiens
ggagaccuaagcggguaua

SEQ ID NO: 151911 - RNA, 19 nt, Homo sapiens
uagauuccuugguauuucu

SEQ ID NO: 151912 - RNA, 19 nt, Homo sapiens
gaaccaggaagagaagagu

SEQ ID NO: 151913 - RNA, 19 nt, Homo sapiens
caaggaggcagacaacacu

SEQ ID NO: 151914 - RNA, 19 nt, Homo sapiens
acaugggccuggaguucaa

SEQ ID NO: 151915 - RNA, 19 nt, Homo sapiens
auagauuccuugguauuuc

SEQ ID NO: 151916 - RNA, 19 nt, Homo sapiens
ggucagccaggaagcauag

SEQ ID NO: 151917 - RNA, 19 nt, Homo sapiens
cagcugugcccaccuuugu

SEQ ID NO: 151918 - RNA, 19 nt, Homo sapiens
gaaggcgaggcgagcuuug

SEQ ID NO: 151919 - RNA, 19 nt, Homo sapiens
acacgcaccaugaagauca

SEQ ID NO: 151920 - RNA, 19 nt, Homo sapiens
caggaaauacgcuuuacca

SEQ ID NO: 151921 - RNA, 19 nt, Homo sapiens
ccacacacacacacacaca

SEQ ID NO: 151922 - RNA, 19 nt, Homo sapiens
uaggaugccauuucuuuua

SEQ ID NO: 151923 - RNA, 19 nt, Homo sapiens
gcccaccuuuguauuuagu

SEQ ID NO: 151924 - RNA, 19 nt, Homo sapiens
gccuggaguucaagaagca

SEQ ID NO: 151925 - RNA, 19 nt, Homo sapiens
gaagggcuuggugaucuau

SEQ ID NO: 151926 - RNA, 19 nt, Homo sapiens
aaauacgcuuuaccaucaa

SEQ ID NO: 151927 - RNA, 19 nt, Homo sapiens
guguuggucaccugcaaua

SEQ ID NO: 151928 - RNA, 19 nt, Homo sapiens
gaaccuggagcccguaucc

SEQ ID NO: 151929 - RNA, 19 nt, Homo sapiens
cuacaugggccuggaguuc

SEQ ID NO: 151930 - RNA, 19 nt, Homo sapiens
uaacagacugccacuugag

SEQ ID NO: 151931 - RNA, 19 nt, Homo sapiens
aucauucccuuacggacua

SEQ ID NO: 151932 - RNA, 19 nt, Homo sapiens
guucucuccuuaccuuugg

SEQ ID NO: 151933 - RNA, 19 nt, Homo sapiens
ggccagagcaggaaauacg

SEQ ID NO: 151934 - RNA, 19 nt, Homo sapiens
caauaggccagagcaggaa

SEQ ID NO: 151935 - RNA, 19 nt, Homo sapiens
gacaucaucauucccuuac

SEQ ID NO: 151936 - RNA, 19 nt, Homo sapiens
uuacuacauuaccucaaca

SEQ ID NO: 151937 - RNA, 19 nt, Homo sapiens
gcaaagaucucuagaguuu

SEQ ID NO: 151938 - RNA, 19 nt, Homo sapiens
gcagacagaugcacuauua

SEQ ID NO: 151939 - RNA, 19 nt, Homo sapiens
gaauaaagauccaacaaga

SEQ ID NO: 151940 - RNA, 19 nt, Homo sapiens
ggagacaaauuggauauua

SEQ ID NO: 151941 - RNA, 19 nt, Homo sapiens
gaaaguaggccgcugauga

SEQ ID NO: 151942 - RNA, 19 nt, Homo sapiens
ggaagaaguucgacaacaa

SEQ ID NO: 151943 - RNA, 19 nt, Homo sapiens
ggaaagggcuggcugcaau

SEQ ID NO: 151944 - RNA, 19 nt, Homo sapiens
gacaaggacugguacuaua

SEQ ID NO: 151945 - RNA, 19 nt, Homo sapiens
gaagauaggacguauuuau

SEQ ID NO: 151946 - RNA, 19 nt, Homo sapiens
guaggccgcugaugauaua

SEQ ID NO: 151947 - RNA, 19 nt, Homo sapiens
gggcaggacuguuguggua

SEQ ID NO: 151948 - RNA, 19 nt, Homo sapiens
ggaaguaaauuaugauguc

SEQ ID NO: 151949 - RNA, 19 nt, Homo sapiens
gcaauuaaguggucccaau

SEQ ID NO: 151950 - RNA, 19 nt, Homo sapiens
gguaauccguucauagaaa

SEQ ID NO: 151951 - RNA, 19 nt, Homo sapiens
gagccuaucuauuggaauu

SEQ ID NO: 151952 - RNA, 19 nt, Homo sapiens
gaaagcauuuaggagaaua

SEQ ID NO: 151953 - RNA, 19 nt, Homo sapiens
gaacaauaaugagagcaaa

SEQ ID NO: 151954 - RNA, 19 nt, Homo sapiens
cagcuuaccuagucuugua

SEQ ID NO: 151955 - RNA, 19 nt, Homo sapiens
gauaucaaauucaccauca

SEQ ID NO: 151956 - RNA, 19 nt, Homo sapiens
caaauucaccaucaaguuu

SEQ ID NO: 151957 - RNA, 19 nt, Homo sapiens
gaagaaggcuaggaguuca

SEQ ID NO: 151958 - RNA, 19 nt, Homo sapiens
gaaggaagauaggacguau

SEQ ID NO: 151959 - RNA, 19 nt, Homo sapiens
agacggaaguaaauuauga

SEQ ID NO: 151960 - RNA, 19 nt, Homo sapiens
gggaaagcauuuaggagaa

SEQ ID NO: 151961 - RNA, 19 nt, Homo sapiens
agacucagcugcuauacuu

SEQ ID NO: 151962 - RNA, 19 nt, Homo sapiens
gugcaaagaucucuagagu

SEQ ID NO: 151963 - RNA, 19 nt, Homo sapiens
gugacugcaucauauauuu

SEQ ID NO: 151964 - RNA, 19 nt, Homo sapiens
ggucugcuuuggaugauuu

SEQ ID NO: 151965 - RNA, 19 nt, Homo sapiens
ggcacucgcuguuaucaaa

SEQ ID NO: 151966 - RNA, 19 nt, Homo sapiens
acagaaaguuggaaaggaa

SEQ ID NO: 151967 - RNA, 19 nt, Homo sapiens
ggucuagaauuucagaaga

SEQ ID NO: 151968 - RNA, 19 nt, Homo sapiens
caucaaguuucaagaauuc

SEQ ID NO: 151969 - RNA, 19 nt, Homo sapiens
ggaaagcauuuaggagaau

SEQ ID NO: 151970 - RNA, 19 nt, Homo sapiens
caugaaaguuggacaagau

SEQ ID NO: 151971 - RNA, 19 nt, Homo sapiens
ggacaaggacugguacuau

SEQ ID NO: 151972 - RNA, 19 nt, Homo sapiens
gggcugaaguguucucuag

SEQ ID NO: 151973 - RNA, 19 nt, Homo sapiens
aaagaucucuagaguuuag

SEQ ID NO: 151974 - RNA, 19 nt, Homo sapiens
acuagaagcugguacaaau

SEQ ID NO: 151975 - RNA, 19 nt, Homo sapiens
agaccaagauaucaaauuc

SEQ ID NO: 151976 - RNA, 19 nt, Homo sapiens
guaauccguucauagaaau

SEQ ID NO: 151977 - RNA, 19 nt, Homo sapiens
gacauuaucaucccgcuaa

SEQ ID NO: 151978 - RNA, 19 nt, Homo sapiens
gaucaaccaggaauaaaga

SEQ ID NO: 151979 - RNA, 19 nt, Homo sapiens
gggaggcacucgcuguuau

SEQ ID NO: 151980 - RNA, 19 nt, Homo sapiens
aacaagacguccagaacua

SEQ ID NO: 151981 - RNA, 19 nt, Homo sapiens
ccaucaaguuucaagaauu

SEQ ID NO: 151982 - RNA, 19 nt, Homo sapiens
acagauaggagacaaauug

SEQ ID NO: 151983 - RNA, 19 nt, Homo sapiens
gaacacaagggauauaaaa

SEQ ID NO: 151984 - RNA, 19 nt, Homo sapiens
gcacagcacuuugguuuug

SEQ ID NO: 151985 - RNA, 19 nt, Homo sapiens
ggaagacugugcagaagac

SEQ ID NO: 151986 - RNA, 19 nt, Homo sapiens
cggcgaacauuuacuacaa

SEQ ID NO: 151987 - RNA, 19 nt, Homo sapiens
aaacacagggaaagcauuu

SEQ ID NO: 151988 - RNA, 19 nt, Homo sapiens
ugaagauccucaugaaagu

SEQ ID NO: 151989 - RNA, 19 nt, Homo sapiens
gaugcacuauuaagaagga

SEQ ID NO: 151990 - RNA, 19 nt, Homo sapiens
gcaggaagccgaugugacu

SEQ ID NO: 151991 - RNA, 19 nt, Homo sapiens
gaaaagccccucuucauuc

SEQ ID NO: 151992 - RNA, 19 nt, Homo sapiens
uagcacagcacuuugguuu

SEQ ID NO: 151993 - RNA, 19 nt, Homo sapiens
ggaauaaagauccaacaag

SEQ ID NO: 151994 - RNA, 19 nt, Homo sapiens
gauguuccggcguuuauuu

SEQ ID NO: 151995 - RNA, 19 nt, Homo sapiens
gaagggacuccguguggaa

SEQ ID NO: 151996 - RNA, 19 nt, Homo sapiens
cuuaugggcugaaguguuc

SEQ ID NO: 151997 - RNA, 19 nt, Homo sapiens
caaauuggacagcuacuuc

SEQ ID NO: 151998 - RNA, 19 nt, Homo sapiens
guuccgaaguggccuuauu

SEQ ID NO: 151999 - RNA, 19 nt, Homo sapiens
gauaggagacaaauuggau

SEQ ID NO: 152000 - RNA, 19 nt, Homo sapiens
uuacgacacuuugguuuau

SEQ ID NO: 152001 - RNA, 19 nt, Homo sapiens
ggagggaagggagaaagua

SEQ ID NO: 152002 - RNA, 19 nt, Homo sapiens
gaaagggcuggcugcaauu

SEQ ID NO: 152003 - RNA, 19 nt, Homo sapiens
guuaaggugugcaaagauc

SEQ ID NO: 152004 - RNA, 19 nt, Homo sapiens
uaccuagucuuguagcauu

SEQ ID NO: 152005 - RNA, 19 nt, Homo sapiens
caccagaagaugugaaauu

SEQ ID NO: 152006 - RNA, 19 nt, Homo sapiens
ggccuuauuugcagggauu

SEQ ID NO: 152007 - RNA, 19 nt, Homo sapiens
gaagaaguucgacaacaag

SEQ ID NO: 152008 - RNA, 19 nt, Homo sapiens
gacagaugcacuauuaaga

SEQ ID NO: 152009 - RNA, 19 nt, Homo sapiens
gcuggaagacugugcagaa

SEQ ID NO: 152010 - RNA, 19 nt, Homo sapiens
cagaugcacuauuaagaag

SEQ ID NO: 152011 - RNA, 19 nt, Homo sapiens
guaauuccaucaucaucgu

SEQ ID NO: 152012 - RNA, 19 nt, Homo sapiens
ggaacaaagacggguauug

SEQ ID NO: 152013 - RNA, 19 nt, Homo sapiens
ccaaaucgauaguuuuaga

SEQ ID NO: 152014 - RNA, 19 nt, Homo sapiens
ucagagcccagugacauua

SEQ ID NO: 152015 - RNA, 19 nt, Homo sapiens
cgaaguggccuuauuugca

SEQ ID NO: 152016 - RNA, 19 nt, Homo sapiens
gacagcuacuucugggaaa

SEQ ID NO: 152017 - RNA, 19 nt, Homo sapiens
aggaagauaggacguauuu

SEQ ID NO: 152018 - RNA, 19 nt, Homo sapiens
cugcuauacuuaucacauu

SEQ ID NO: 152019 - RNA, 19 nt, Homo sapiens
gcgaagaaggcuaggaguu

SEQ ID NO: 152020 - RNA, 19 nt, Homo sapiens
ucauagaaauuguguuugc

SEQ ID NO: 152021 - RNA, 19 nt, Homo sapiens
gaacuagaagcugguacaa

SEQ ID NO: 152022 - RNA, 19 nt, Homo sapiens
ucaaauucaccaucaaguu

SEQ ID NO: 152023 - RNA, 19 nt, Homo sapiens
caucaucaucguuguuauu

SEQ ID NO: 152024 - RNA, 19 nt, Homo sapiens
gagagucggucugcuuugg

SEQ ID NO: 152025 - RNA, 19 nt, Homo sapiens
aaauagcgaugugcaggaa

SEQ ID NO: 152026 - RNA, 19 nt, Homo sapiens
gugcauaccggacuuguca

SEQ ID NO: 152027 - RNA, 19 nt, Homo sapiens
gggacuccguguggaagua

SEQ ID NO: 152028 - RNA, 19 nt, Homo sapiens
acagaugcacuauuaagaa

SEQ ID NO: 152029 - RNA, 19 nt, Homo sapiens
caagauguuccggcguuua

SEQ ID NO: 152030 - RNA, 19 nt, Homo sapiens
cgaagaaggcuaggaguuc

SEQ ID NO: 152031 - RNA, 19 nt, Homo sapiens
uaguuaaggugugcaaaga

SEQ ID NO: 152032 - RNA, 19 nt, Homo sapiens
gaagauccucaugaaaguu

SEQ ID NO: 152033 - RNA, 19 nt, Homo sapiens
gacaagagccaugaagauc

SEQ ID NO: 152034 - RNA, 19 nt, Homo sapiens
gucuagaauuucagaagaa

SEQ ID NO: 152035 - RNA, 19 nt, Homo sapiens
caaaccagaccaagauauc

SEQ ID NO: 152036 - RNA, 19 nt, Homo sapiens
ucccaaugcucagcgcuua

SEQ ID NO: 152037 - RNA, 19 nt, Homo sapiens
gaaggugaguggugacuau

SEQ ID NO: 152038 - RNA, 19 nt, Homo sapiens
gaucuccgcuucaccauca

SEQ ID NO: 152039 - RNA, 19 nt, Homo sapiens
gcaccacgauuacuacauc

SEQ ID NO: 152040 - RNA, 19 nt, Homo sapiens
aaacaucuacuacaaggua

SEQ ID NO: 152041 - RNA, 19 nt, Homo sapiens
ucacuccucuccuaauuau

SEQ ID NO: 152042 - RNA, 19 nt, Homo sapiens
ucacguggcuauccugaau

SEQ ID NO: 152043 - RNA, 19 nt, Homo sapiens
ccagagcccuccaaacauc

SEQ ID NO: 152044 - RNA, 19 nt, Homo sapiens
gaguauagcccuaaucucu

SEQ ID NO: 152045 - RNA, 19 nt, Homo sapiens
caaaccuccuucucacuug

SEQ ID NO: 152046 - RNA, 19 nt, Homo sapiens
gaaaaccugugucugaaau

SEQ ID NO: 152047 - RNA, 19 nt, Homo sapiens
ccaucaaguuccaggagua

SEQ ID NO: 152048 - RNA, 19 nt, Homo sapiens
ccucacuccucuccuaauu

SEQ ID NO: 152049 - RNA, 19 nt, Homo sapiens
gcucgcaccacgauuacua

SEQ ID NO: 152050 - RNA, 19 nt, Homo sapiens
ggaggugugugccuaacca

SEQ ID NO: 152051 - RNA, 19 nt, Homo sapiens
cuccaaacaucuacuacaa

SEQ ID NO: 152052 - RNA, 19 nt, Homo sapiens
ccaaaccuccuucucacuu

SEQ ID NO: 152053 - RNA, 19 nt, Homo sapiens
ggcccucacuccucuccua

SEQ ID NO: 152054 - RNA, 19 nt, Homo sapiens
ggcagagggugguuaugug

SEQ ID NO: 152055 - RNA, 19 nt, Homo sapiens
ggaacucggcgaauaagag

SEQ ID NO: 152056 - RNA, 19 nt, Homo sapiens
gaaaugcccauggaaagag

SEQ ID NO: 152057 - RNA, 19 nt, Homo sapiens
cacgauuacuacaucauug

SEQ ID NO: 152058 - RNA, 19 nt, Homo sapiens
ccacgauuacuacaucauu

SEQ ID NO: 152059 - RNA, 19 nt, Homo sapiens
ugaaaugcccauggaaaga

SEQ ID NO: 152060 - RNA, 19 nt, Homo sapiens
ugucugaaaugcccaugga

SEQ ID NO: 152061 - RNA, 19 nt, Homo sapiens
uacuggaacucggcgaaua

SEQ ID NO: 152062 - RNA, 19 nt, Homo sapiens
gggugcuccuccaguuuaa

SEQ ID NO: 152063 - RNA, 19 nt, Homo sapiens
cuaugggcauccuguguau

SEQ ID NO: 152064 - RNA, 19 nt, Homo sapiens
gagccugucuacuggaacu

SEQ ID NO: 152065 - RNA, 19 nt, Homo sapiens
gugcuccuccaguuuaauu

SEQ ID NO: 152066 - RNA, 19 nt, Homo sapiens
ggccaagccuucggagagu

SEQ ID NO: 152067 - RNA, 19 nt, Homo sapiens
aaaugcccauggaaagaga

SEQ ID NO: 152068 - RNA, 19 nt, Homo sapiens
ccaggaguauagcccuaau

SEQ ID NO: 152069 - RNA, 19 nt, Homo sapiens
acuccucuccuaauuauga

SEQ ID NO: 152070 - RNA, 19 nt, Homo sapiens
ucugaaaugcccauggaaa

SEQ ID NO: 152071 - RNA, 19 nt, Homo sapiens
ucaaguuccaggaguauag

SEQ ID NO: 152072 - RNA, 19 nt, Homo sapiens
aaaccuccuucucacuugu

SEQ ID NO: 152073 - RNA, 19 nt, Homo sapiens
caucuacuacaagguauga

SEQ ID NO: 152074 - RNA, 19 nt, Homo sapiens
uaugugcuguacccucaga

SEQ ID NO: 152075 - RNA, 19 nt, Homo sapiens
acuaugggcauccugugua

SEQ ID NO: 152076 - RNA, 19 nt, Homo sapiens
gccuggagccugucuacug

SEQ ID NO: 152077 - RNA, 19 nt, Homo sapiens
ccaggcagagggugguuau

SEQ ID NO: 152078 - RNA, 19 nt, Homo sapiens
aaaccugugucugaaaugc

SEQ ID NO: 152079 - RNA, 19 nt, Homo sapiens
gaaggaagcaauucucuua

SEQ ID NO: 152080 - RNA, 19 nt, Homo sapiens
gcacagaauuuguauguau

SEQ ID NO: 152081 - RNA, 19 nt, Homo sapiens
gcagaaacuuugcaaauug

SEQ ID NO: 152082 - RNA, 19 nt, Homo sapiens
gaaaggacaugguuagaau

SEQ ID NO: 152083 - RNA, 19 nt, Homo sapiens
ggaagcaauucucuuauuu

SEQ ID NO: 152084 - RNA, 19 nt, Homo sapiens
caagagagaguauguaaua

SEQ ID NO: 152085 - RNA, 19 nt, Homo sapiens
caacagugcuuuguaaauu

SEQ ID NO: 152086 - RNA, 19 nt, Homo sapiens
ggacagaacauuuauauca

SEQ ID NO: 152087 - RNA, 19 nt, Homo sapiens
guaaguaaauugccugauu

SEQ ID NO: 152088 - RNA, 19 nt, Homo sapiens
gggauucacugucuugaua

SEQ ID NO: 152089 - RNA, 19 nt, Homo sapiens
gagcgaagcuuucauaugc

SEQ ID NO: 152090 - RNA, 19 nt, Homo sapiens
gaauaacgauugacuucuu

SEQ ID NO: 152091 - RNA, 19 nt, Homo sapiens
agaauuagauggccuuauu

SEQ ID NO: 152092 - RNA, 19 nt, Homo sapiens
caagaagaaugaacuaugu

SEQ ID NO: 152093 - RNA, 19 nt, Homo sapiens
gaaguacugugaagauguu

SEQ ID NO: 152094 - RNA, 19 nt, Homo sapiens
ccuaucagcuaacccauua

SEQ ID NO: 152095 - RNA, 19 nt, Homo sapiens
ggaaaacuauguucugaua

SEQ ID NO: 152096 - RNA, 19 nt, Homo sapiens
caacaggaaggaaucauua

SEQ ID NO: 152097 - RNA, 19 nt, Homo sapiens
gcuaguggcugaaaucaug

SEQ ID NO: 152098 - RNA, 19 nt, Homo sapiens
gagagaguauguaauauag

SEQ ID NO: 152099 - RNA, 19 nt, Homo sapiens
gaaaugggaauucuacuug

SEQ ID NO: 152100 - RNA, 19 nt, Homo sapiens
ggaaucguaucuccauauu

SEQ ID NO: 152101 - RNA, 19 nt, Homo sapiens
gcauguauauugaagcauu

SEQ ID NO: 152102 - RNA, 19 nt, Homo sapiens
gagcagggcuguuaaacuc

SEQ ID NO: 152103 - RNA, 19 nt, Homo sapiens
caagaggacuggcaaagau

SEQ ID NO: 152104 - RNA, 19 nt, Homo sapiens
aaucauggcuguacucuug

SEQ ID NO: 152105 - RNA, 19 nt, Homo sapiens
gaccguaucuucuauucaa

SEQ ID NO: 152106 - RNA, 19 nt, Homo sapiens
ggaaauaguaucuuuagga

SEQ ID NO: 152107 - RNA, 19 nt, Homo sapiens
aaaggaaagucaagaagaa

SEQ ID NO: 152108 - RNA, 19 nt, Homo sapiens
gugaagauguuaaugaaug

SEQ ID NO: 152109 - RNA, 19 nt, Homo sapiens
uaaccuccauucaucauuu

SEQ ID NO: 152110 - RNA, 19 nt, Homo sapiens
gcauuuaacuccucauugg

SEQ ID NO: 152111 - RNA, 19 nt, Homo sapiens
gauggugugugcauguaua

SEQ ID NO: 152112 - RNA, 19 nt, Homo sapiens
ugauguaggucacccauuu

SEQ ID NO: 152113 - RNA, 19 nt, Homo sapiens
cagaaggucucucaguuga

SEQ ID NO: 152114 - RNA, 19 nt, Homo sapiens
uagcaguguuugaggauua

SEQ ID NO: 152115 - RNA, 19 nt, Homo sapiens
gcagucuuauuuccaagua

SEQ ID NO: 152116 - RNA, 19 nt, Homo sapiens
gaaagagcuuggaggacaa

SEQ ID NO: 152117 - RNA, 19 nt, Homo sapiens
ggagacagauacguaguug

SEQ ID NO: 152118 - RNA, 19 nt, Homo sapiens
gaagaugaccaccacuauu

SEQ ID NO: 152119 - RNA, 19 nt, Homo sapiens
aaucguaucuccauauuuc

SEQ ID NO: 152120 - RNA, 19 nt, Homo sapiens
gaucccugcuuauaucaaa

SEQ ID NO: 152121 - RNA, 19 nt, Homo sapiens
gagcagaaacuuugcaaau

SEQ ID NO: 152122 - RNA, 19 nt, Homo sapiens
uaacagcugugucauugga

SEQ ID NO: 152123 - RNA, 19 nt, Homo sapiens
agacaacgaugaauuucuu

SEQ ID NO: 152124 - RNA, 19 nt, Homo sapiens
gagaaucacuagguaacuu

SEQ ID NO: 152125 - RNA, 19 nt, Homo sapiens
aaugccagcugcacaaaua

SEQ ID NO: 152126 - RNA, 19 nt, Homo sapiens
cagaaacuuugcaaauuga

SEQ ID NO: 152127 - RNA, 19 nt, Homo sapiens
aauaacagcugugucauug

SEQ ID NO: 152128 - RNA, 19 nt, Homo sapiens
ggaaggaaucauuacagua

SEQ ID NO: 152129 - RNA, 19 nt, Homo sapiens
gagaguauguaauauagag

SEQ ID NO: 152130 - RNA, 19 nt, Homo sapiens
acacagaaggaaccaauua

SEQ ID NO: 152131 - RNA, 19 nt, Homo sapiens
ccauggaaauaguaucuuu

SEQ ID NO: 152132 - RNA, 19 nt, Homo sapiens
ggaaagucaagaagaauga

SEQ ID NO: 152133 - RNA, 19 nt, Homo sapiens
agagagagcuaauauggau

SEQ ID NO: 152134 - RNA, 19 nt, Homo sapiens
gaccaccacuauuccguaa

SEQ ID NO: 152135 - RNA, 19 nt, Homo sapiens
gagaugggauucacugucu

SEQ ID NO: 152136 - RNA, 19 nt, Homo sapiens
ggauagagagagcuaauau

SEQ ID NO: 152137 - RNA, 19 nt, Homo sapiens
ggcaagaccuccagucaca

SEQ ID NO: 152138 - RNA, 19 nt, Homo sapiens
gguuguagcuggaacuuuc

SEQ ID NO: 152139 - RNA, 19 nt, Homo sapiens
ggaaaggacaugguuagaa

SEQ ID NO: 152140 - RNA, 19 nt, Homo sapiens
cagcauaauuuguuugcaa

SEQ ID NO: 152141 - RNA, 19 nt, Homo sapiens
gaagcaauucucuuauuug

SEQ ID NO: 152142 - RNA, 19 nt, Homo sapiens
cauuggaugugcuugauaa

SEQ ID NO: 152143 - RNA, 19 nt, Homo sapiens
gaaggucucucaguugaag

SEQ ID NO: 152144 - RNA, 19 nt, Homo sapiens
gaaauagugacucugaaug

SEQ ID NO: 152145 - RNA, 19 nt, Homo sapiens
uaagaaauagugacucuga

SEQ ID NO: 152146 - RNA, 19 nt, Homo sapiens
gcacgugcccuguaggauu

SEQ ID NO: 152147 - RNA, 19 nt, Homo sapiens
gaaauaauucccacauucu

SEQ ID NO: 152148 - RNA, 19 nt, Homo sapiens
uacagaaucucaacacaug

SEQ ID NO: 152149 - RNA, 19 nt, Homo sapiens
gaucuaaagaaccaaguaa

SEQ ID NO: 152150 - RNA, 19 nt, Homo sapiens
ggaaggagugauuuaaaug

SEQ ID NO: 152151 - RNA, 19 nt, Homo sapiens
gcuguacucuuggguguaa

SEQ ID NO: 152152 - RNA, 19 nt, Homo sapiens
gcaaauugaggaaaggaaa

SEQ ID NO: 152153 - RNA, 19 nt, Homo sapiens
caacagagaaggaagcaau

SEQ ID NO: 152154 - RNA, 19 nt, Homo sapiens
gaagacuuacccagaauga

SEQ ID NO: 152155 - RNA, 19 nt, Homo sapiens
ucaaaacgccgaagacuua

SEQ ID NO: 152156 - RNA, 19 nt, Homo sapiens
gaaaauaacagcuguguca

SEQ ID NO: 152157 - RNA, 19 nt, Homo sapiens
ucucagugaucauggauuu

SEQ ID NO: 152158 - RNA, 19 nt, Homo sapiens
cagaaggaaccaauuauga

SEQ ID NO: 152159 - RNA, 19 nt, Homo sapiens
ggaaaugggaauucuacuu

SEQ ID NO: 152160 - RNA, 19 nt, Homo sapiens
gcugcucacucuuaucauu

SEQ ID NO: 152161 - RNA, 19 nt, Homo sapiens
ggacugauacagggauuaa

SEQ ID NO: 152162 - RNA, 19 nt, Homo sapiens
cggaguuucuuagucauua

SEQ ID NO: 152163 - RNA, 19 nt, Homo sapiens
gaauuagauggccuuauuu

SEQ ID NO: 152164 - RNA, 19 nt, Homo sapiens
ccaccacuauuccguaaga

SEQ ID NO: 152165 - RNA, 19 nt, Homo sapiens
gggagaggaugccacaugu

SEQ ID NO: 152166 - RNA, 19 nt, Homo sapiens
gaaagccucagaugggaaa

SEQ ID NO: 152167 - RNA, 19 nt, Homo sapiens
cgauugacuucuuaacuga

SEQ ID NO: 152168 - RNA, 19 nt, Homo sapiens
ugaaaguucuucccuccaa

SEQ ID NO: 152169 - RNA, 19 nt, Homo sapiens
gaggaaucguaucuccaua

SEQ ID NO: 152170 - RNA, 19 nt, Homo sapiens
ccugcacccuucuuaauuu

SEQ ID NO: 152171 - RNA, 19 nt, Homo sapiens
ggaagaugaccaccacuau

SEQ ID NO: 152172 - RNA, 19 nt, Homo sapiens
gccgaagacuuacccagaa

SEQ ID NO: 152173 - RNA, 19 nt, Homo sapiens
caaaaugaguugugaugaa

SEQ ID NO: 152174 - RNA, 19 nt, Homo sapiens
caucaguucuuccuuucuu

SEQ ID NO: 152175 - RNA, 19 nt, Homo sapiens
guucugauauagaugaaug

SEQ ID NO: 152176 - RNA, 19 nt, Homo sapiens
gaaccaaguaacaccauug

SEQ ID NO: 152177 - RNA, 19 nt, Homo sapiens
gcccugaaguggauagaga

SEQ ID NO: 152178 - RNA, 19 nt, Homo sapiens
gccaguaguuucaaaauuu

SEQ ID NO: 152179 - RNA, 19 nt, Homo sapiens
gcaaugaccuccuguccua

SEQ ID NO: 152180 - RNA, 19 nt, Homo sapiens
ugacaaugcuccacaauuu

SEQ ID NO: 152181 - RNA, 19 nt, Homo sapiens
gcaaagagguagucuguca

SEQ ID NO: 152182 - RNA, 19 nt, Homo sapiens
ggaaaggcauccugaagaa

SEQ ID NO: 152183 - RNA, 19 nt, Homo sapiens
gccgaaagcuagacaauaa

SEQ ID NO: 152184 - RNA, 19 nt, Homo sapiens
gagagaugcuuauguuauu

SEQ ID NO: 152185 - RNA, 19 nt, Homo sapiens
ggcaaagacugucagcuua

SEQ ID NO: 152186 - RNA, 19 nt, Homo sapiens
ggaauuguccguacaguaa

SEQ ID NO: 152187 - RNA, 19 nt, Homo sapiens
guccagaacugaagacuuu

SEQ ID NO: 152188 - RNA, 19 nt, Homo sapiens
ccagagagaugcuuauguu

SEQ ID NO: 152189 - RNA, 19 nt, Homo sapiens
caaacaagcuccaagaagu

SEQ ID NO: 152190 - RNA, 19 nt, Homo sapiens
acacugagcuggaacuuug

SEQ ID NO: 152191 - RNA, 19 nt, Homo sapiens
cagaagaccuugagaguag

SEQ ID NO: 152192 - RNA, 19 nt, Homo sapiens
gagcaaggcuucccugucu

SEQ ID NO: 152193 - RNA, 19 nt, Homo sapiens
gagggugucuuuacuaugu

SEQ ID NO: 152194 - RNA, 19 nt, Homo sapiens
caacaacacggcucucuuu

SEQ ID NO: 152195 - RNA, 19 nt, Homo sapiens
cgacaaugcuccucaguuc

SEQ ID NO: 152196 - RNA, 19 nt, Homo sapiens
gacagaggaucuaggcuaa

SEQ ID NO: 152197 - RNA, 19 nt, Homo sapiens
gaaagagaauagcauugug

SEQ ID NO: 152198 - RNA, 19 nt, Homo sapiens
cggcagcgauuccaccuua

SEQ ID NO: 152199 - RNA, 19 nt, Homo sapiens
caauagccguggacacuuu

SEQ ID NO: 152200 - RNA, 19 nt, Homo sapiens
gcaguuuggugcugagauu

SEQ ID NO: 152201 - RNA, 19 nt, Homo sapiens
gaacugacggcacucauug

SEQ ID NO: 152202 - RNA, 19 nt, Homo sapiens
gaaugaagaucggccaaug

SEQ ID NO: 152203 - RNA, 19 nt, Homo sapiens
gugagucuguggagcauua

SEQ ID NO: 152204 - RNA, 19 nt, Homo sapiens
gaacucacauaccugaauc

SEQ ID NO: 152205 - RNA, 19 nt, Homo sapiens
auacagggcuggucucuga

SEQ ID NO: 152206 - RNA, 19 nt, Homo sapiens
ggauguguguguuuauuau

SEQ ID NO: 152207 - RNA, 19 nt, Homo sapiens
ugacugugcuggacguuaa

SEQ ID NO: 152208 - RNA, 19 nt, Homo sapiens
ugaagaaccgguugcaaua

SEQ ID NO: 152209 - RNA, 19 nt, Homo sapiens
gaucccaacugcaacaaga

SEQ ID NO: 152210 - RNA, 19 nt, Homo sapiens
caacacggcucucuuugag

SEQ ID NO: 152211 - RNA, 19 nt, Homo sapiens
gggaauaaacuucuauaga

SEQ ID NO: 152212 - RNA, 19 nt, Homo sapiens
ggagauagagggagagaug

SEQ ID NO: 152213 - RNA, 19 nt, Homo sapiens
gcagcuuccugggagauua

SEQ ID NO: 152214 - RNA, 19 nt, Homo sapiens
uuacgacccuguucacaaa

SEQ ID NO: 152215 - RNA, 19 nt, Homo sapiens
ucaaugacgugaaugacaa

SEQ ID NO: 152216 - RNA, 19 nt, Homo sapiens
uaacugugcuagacgagaa

SEQ ID NO: 152217 - RNA, 19 nt, Homo sapiens
gaaacaagggaauucaaga

SEQ ID NO: 152218 - RNA, 19 nt, Homo sapiens
gcucuucuguguccuaaau

SEQ ID NO: 152219 - RNA, 19 nt, Homo sapiens
gaacaagacggcacuggau

SEQ ID NO: 152220 - RNA, 19 nt, Homo sapiens
ccaguacacuuuccagaau

SEQ ID NO: 152221 - RNA, 19 nt, Homo sapiens
gaaugacaaugcuccacaa

SEQ ID NO: 152222 - RNA, 19 nt, Homo sapiens
gaacaguuggacauucuuu

SEQ ID NO: 152223 - RNA, 19 nt, Homo sapiens
ugaggcaccuggaggagua

SEQ ID NO: 152224 - RNA, 19 nt, Homo sapiens
ccacacagcacgcuccuuu

SEQ ID NO: 152225 - RNA, 19 nt, Homo sapiens
gugcugagauuggcaacua

SEQ ID NO: 152226 - RNA, 19 nt, Homo sapiens
gggagggugucuuuacuau

SEQ ID NO: 152227 - RNA, 19 nt, Homo sapiens
gcucgggccucuagucaga

SEQ ID NO: 152228 - RNA, 19 nt, Homo sapiens
aagaagaccucugcacuga

SEQ ID NO: 152229 - RNA, 19 nt, Homo sapiens
gagcuuugcuggcccuguu

SEQ ID NO: 152230 - RNA, 19 nt, Homo sapiens
ccugggaucuccauuauca

SEQ ID NO: 152231 - RNA, 19 nt, Homo sapiens
ggccacaucugcuccuuug

SEQ ID NO: 152232 - RNA, 19 nt, Homo sapiens
ccaaugcccauauaaugua

SEQ ID NO: 152233 - RNA, 19 nt, Homo sapiens
gagcccaccucuggaauug

SEQ ID NO: 152234 - RNA, 19 nt, Homo sapiens
gccacugccuccuauguuu

SEQ ID NO: 152235 - RNA, 19 nt, Homo sapiens
gaguggacauggcggcuuu

SEQ ID NO: 152236 - RNA, 19 nt, Homo sapiens
gaggacgucuucaucuuca

SEQ ID NO: 152237 - RNA, 19 nt, Homo sapiens
gcgagcacauggaaagcua

SEQ ID NO: 152238 - RNA, 19 nt, Homo sapiens
gagccugggaucuccauua

SEQ ID NO: 152239 - RNA, 19 nt, Homo sapiens
ggccguggcucugcaguuu

SEQ ID NO: 152240 - RNA, 19 nt, Homo sapiens
gcaaggaugcagcuaacaa

SEQ ID NO: 152241 - RNA, 19 nt, Homo sapiens
ggccaccgcuguccaacaa

SEQ ID NO: 152242 - RNA, 19 nt, Homo sapiens
agggagagaugcaguuuga

SEQ ID NO: 152243 - RNA, 19 nt, Homo sapiens
caagugcggcucacauauu

SEQ ID NO: 152244 - RNA, 19 nt, Homo sapiens
ccaagaauaugugauugug

SEQ ID NO: 152245 - RNA, 19 nt, Homo sapiens
cuaugaggcucgccaagaa

SEQ ID NO: 152246 - RNA, 19 nt, Homo sapiens
gcaaacaagcuccaagaag

SEQ ID NO: 152247 - RNA, 19 nt, Homo sapiens
ggacaagguggcugugcua

SEQ ID NO: 152248 - RNA, 19 nt, Homo sapiens
gaaggcagacacuacuuau

SEQ ID NO: 152249 - RNA, 19 nt, Homo sapiens
gacaauggcaucccacaga

SEQ ID NO: 152250 - RNA, 19 nt, Homo sapiens
uaucacagcucgggacaau

SEQ ID NO: 152251 - RNA, 19 nt, Homo sapiens
gccaucagcuaccagauca

SEQ ID NO: 152252 - RNA, 19 nt, Homo sapiens
gcagcuaccucagggacaa

SEQ ID NO: 152253 - RNA, 19 nt, Homo sapiens
cggaaucgcuuugccauca

SEQ ID NO: 152254 - RNA, 19 nt, Homo sapiens
ggacuucgaggcagagaga

SEQ ID NO: 152255 - RNA, 19 nt, Homo sapiens
caaggacgccaacggauug

SEQ ID NO: 152256 - RNA, 19 nt, Homo sapiens
gcaaagggagcagaaacaa

SEQ ID NO: 152257 - RNA, 19 nt, Homo sapiens
gggaugcgcucgacuuagg

SEQ ID NO: 152258 - RNA, 19 nt, Homo sapiens
gugccaggcuuccucagaa

SEQ ID NO: 152259 - RNA, 19 nt, Homo sapiens
caagacaaaugggcagugu

SEQ ID NO: 152260 - RNA, 19 nt, Homo sapiens
ccaguucguucgucauguu

SEQ ID NO: 152261 - RNA, 19 nt, Homo sapiens
ugugagaacuacaugaaau

SEQ ID NO: 152262 - RNA, 19 nt, Homo sapiens
gcccugugcucaacaacuu

SEQ ID NO: 152263 - RNA, 19 nt, Homo sapiens
ucccugagcuguuccaaau

SEQ ID NO: 152264 - RNA, 19 nt, Homo sapiens
ucacagaugccaacacuca

SEQ ID NO: 152265 - RNA, 19 nt, Homo sapiens
gccacuuacugccuuauga

SEQ ID NO: 152266 - RNA, 19 nt, Homo sapiens
ggcccaaaguacagaauug

SEQ ID NO: 152267 - RNA, 19 nt, Homo sapiens
ggaugcagcuaacaacaac

SEQ ID NO: 152268 - RNA, 19 nt, Homo sapiens
gaugaacgggaccauguuu

SEQ ID NO: 152269 - RNA, 19 nt, Homo sapiens
ggaggugacuggccacacu

SEQ ID NO: 152270 - RNA, 19 nt, Homo sapiens
uaugaugccugcccuaagu

SEQ ID NO: 152271 - RNA, 19 nt, Homo sapiens
ccagaagaccuugagagua

SEQ ID NO: 152272 - RNA, 19 nt, Homo sapiens
ccacugccuccuauguuua

SEQ ID NO: 152273 - RNA, 19 nt, Homo sapiens
gagcagaaacaagggaauu

SEQ ID NO: 152274 - RNA, 19 nt, Homo sapiens
cagcugaugucguguuuac

SEQ ID NO: 152275 - RNA, 19 nt, Homo sapiens
acaagcagcagcauagaaa

SEQ ID NO: 152276 - RNA, 19 nt, Homo sapiens
gaugcccacuucaaugaga

SEQ ID NO: 152277 - RNA, 19 nt, Homo sapiens
cucaggagccauuacauua

SEQ ID NO: 152278 - RNA, 19 nt, Homo sapiens
gaugguggccgugacagua

SEQ ID NO: 152279 - RNA, 19 nt, Homo sapiens
gcacacagcuggcuacuuc

SEQ ID NO: 152280 - RNA, 19 nt, Homo sapiens
ggaauuggcucucuucuuc

SEQ ID NO: 152281 - RNA, 19 nt, Homo sapiens
gaugcuaacuugauacuaa

SEQ ID NO: 152282 - RNA, 19 nt, Homo sapiens
caaauuaccuugggccaua

SEQ ID NO: 152283 - RNA, 19 nt, Homo sapiens
caaagaugcuggaugcuaa

SEQ ID NO: 152284 - RNA, 19 nt, Homo sapiens
gggaagagguggaauccua

SEQ ID NO: 152285 - RNA, 19 nt, Homo sapiens
agacauggcugacuucauu

SEQ ID NO: 152286 - RNA, 19 nt, Homo sapiens
gaaagaaaggcuccuguuu

SEQ ID NO: 152287 - RNA, 19 nt, Homo sapiens
gagagaacguggcccagua

SEQ ID NO: 152288 - RNA, 19 nt, Homo sapiens
gcugugaagugaauuauga

SEQ ID NO: 152289 - RNA, 19 nt, Homo sapiens
gcaggccagucauguguua

SEQ ID NO: 152290 - RNA, 19 nt, Homo sapiens
cgacaacaauccaaccuuu

SEQ ID NO: 152291 - RNA, 19 nt, Homo sapiens
ggugacaacuguacuaaug

SEQ ID NO: 152292 - RNA, 19 nt, Homo sapiens
cagcugaaauacuacaaua

SEQ ID NO: 152293 - RNA, 19 nt, Homo sapiens
gcuccugucuugugcuuua

SEQ ID NO: 152294 - RNA, 19 nt, Homo sapiens
uuucagagcucccacuaua

SEQ ID NO: 152295 - RNA, 19 nt, Homo sapiens
cgaaaccgcuucuccauca

SEQ ID NO: 152296 - RNA, 19 nt, Homo sapiens
ucugagacauguucuauuu

SEQ ID NO: 152297 - RNA, 19 nt, Homo sapiens
gggaggaaguugauuucua

SEQ ID NO: 152298 - RNA, 19 nt, Homo sapiens
gcaaugccguggugcacua

SEQ ID NO: 152299 - RNA, 19 nt, Homo sapiens
caacaacuaugucaccaau

SEQ ID NO: 152300 - RNA, 19 nt, Homo sapiens
ccgaauuucucuucuuuaa

SEQ ID NO: 152301 - RNA, 19 nt, Homo sapiens
caacaucccugaggucuuc

SEQ ID NO: 152302 - RNA, 19 nt, Homo sapiens
ggaggaaguugauuucuac

SEQ ID NO: 152303 - RNA, 19 nt, Homo sapiens
gaauggagaugcccugucu

SEQ ID NO: 152304 - RNA, 19 nt, Homo sapiens
gcacaguacucccaaggau

SEQ ID NO: 152305 - RNA, 19 nt, Homo sapiens
caacugugaugucagcaaa

SEQ ID NO: 152306 - RNA, 19 nt, Homo sapiens
gaucgugauucuggacuua

SEQ ID NO: 152307 - RNA, 19 nt, Homo sapiens
gacggugacuuuauuguug

SEQ ID NO: 152308 - RNA, 19 nt, Homo sapiens
ccacuggacuacaaacuug

SEQ ID NO: 152309 - RNA, 19 nt, Homo sapiens
ggugagcccucuugacuau

SEQ ID NO: 152310 - RNA, 19 nt, Homo sapiens
gcuggaugcuaacuugaua

SEQ ID NO: 152311 - RNA, 19 nt, Homo sapiens
ggaccaagcccaucugugu

SEQ ID NO: 152312 - RNA, 19 nt, Homo sapiens
ggaugaguuugauguguuu

SEQ ID NO: 152313 - RNA, 19 nt, Homo sapiens
gguagaagcucgagaccau

SEQ ID NO: 152314 - RNA, 19 nt, Homo sapiens
caccauggaugcccucuuu

SEQ ID NO: 152315 - RNA, 19 nt, Homo sapiens
gcuacugccucauaacuau

SEQ ID NO: 152316 - RNA, 19 nt, Homo sapiens
gaugcuggaugcuaacuug

SEQ ID NO: 152317 - RNA, 19 nt, Homo sapiens
caacacggcauccgacgua

SEQ ID NO: 152318 - RNA, 19 nt, Homo sapiens
ccaccugccucuuguguga

SEQ ID NO: 152319 - RNA, 19 nt, Homo sapiens
cagauuauguaccagauug

SEQ ID NO: 152320 - RNA, 19 nt, Homo sapiens
ccagucauguguuaaguug

SEQ ID NO: 152321 - RNA, 19 nt, Homo sapiens
ugacagcccugguagacuu

SEQ ID NO: 152322 - RNA, 19 nt, Homo sapiens
gcacugcucucugucaaca

SEQ ID NO: 152323 - RNA, 19 nt, Homo sapiens
gauacuaaccaucagauug

SEQ ID NO: 152324 - RNA, 19 nt, Homo sapiens
uuuauacgcuggaaauuga

SEQ ID NO: 152325 - RNA, 19 nt, Homo sapiens
gccaacaucuccaagacaa

SEQ ID NO: 152326 - RNA, 19 nt, Homo sapiens
caacuguacuaaugugugu

SEQ ID NO: 152327 - RNA, 19 nt, Homo sapiens
ggaaagaaaggcuccuguu

SEQ ID NO: 152328 - RNA, 19 nt, Homo sapiens
ccaagaagaacguguguga

SEQ ID NO: 152329 - RNA, 19 nt, Homo sapiens
gcacuucacugagaaucug

SEQ ID NO: 152330 - RNA, 19 nt, Homo sapiens
gcaccaaugcccagauuau

SEQ ID NO: 152331 - RNA, 19 nt, Homo sapiens
gacaacaauccaaccuuua

SEQ ID NO: 152332 - RNA, 19 nt, Homo sapiens
gaucuguccugggcaacua

SEQ ID NO: 152333 - RNA, 19 nt, Homo sapiens
acaaugggcguuucaauga

SEQ ID NO: 152334 - RNA, 19 nt, Homo sapiens
gcaagagucagcccagcua

SEQ ID NO: 152335 - RNA, 19 nt, Homo sapiens
gacgugcacuucacugaga

SEQ ID NO: 152336 - RNA, 19 nt, Homo sapiens
ccaaugcccagauuaugua

SEQ ID NO: 152337 - RNA, 19 nt, Homo sapiens
gcaaccacaugacgagcuu

SEQ ID NO: 152338 - RNA, 19 nt, Homo sapiens
ucaucugagucaccauuua

SEQ ID NO: 152339 - RNA, 19 nt, Homo sapiens
gugaagagagaguuaauau

SEQ ID NO: 152340 - RNA, 19 nt, Homo sapiens
gcaaggagguccggaaagc

SEQ ID NO: 152341 - RNA, 19 nt, Homo sapiens
gacccagacugcaacaaga

SEQ ID NO: 152342 - RNA, 19 nt, Homo sapiens
gcaagaagucucuggaucu

SEQ ID NO: 152343 - RNA, 19 nt, Homo sapiens
cggugcagcugaaauacua

SEQ ID NO: 152344 - RNA, 19 nt, Homo sapiens
caagugcgauugcccaucu

SEQ ID NO: 152345 - RNA, 19 nt, Homo sapiens
ggaaaggucaccagaagag

SEQ ID NO: 152346 - RNA, 19 nt, Homo sapiens
cuucaugacuucagggauu

SEQ ID NO: 152347 - RNA, 19 nt, Homo sapiens
caguauguguuggcuguua

SEQ ID NO: 152348 - RNA, 19 nt, Homo sapiens
ggacaugacuuccccuuca

SEQ ID NO: 152349 - RNA, 19 nt, Homo sapiens
gguuguugcuguaaauaug

SEQ ID NO: 152350 - RNA, 19 nt, Homo sapiens
ucaaacccguguccugcua

SEQ ID NO: 152351 - RNA, 19 nt, Homo sapiens
ccaugacccugauaucuca

SEQ ID NO: 152352 - RNA, 19 nt, Homo sapiens
uggagacggugacuuuauu

SEQ ID NO: 152353 - RNA, 19 nt, Homo sapiens
cgauggagacggugacuuu

SEQ ID NO: 152354 - RNA, 19 nt, Homo sapiens
ccucagcaauuccugcaaa

SEQ ID NO: 152355 - RNA, 19 nt, Homo sapiens
ucuuuaacuuccugcauua

SEQ ID NO: 152356 - RNA, 19 nt, Homo sapiens
ggaagaagaggaggaggaa

SEQ ID NO: 152357 - RNA, 19 nt, Homo sapiens
gcagggcuuugagaagaaa

SEQ ID NO: 152358 - RNA, 19 nt, Homo sapiens
cggcagggcuuugagaaga

SEQ ID NO: 152359 - RNA, 19 nt, Homo sapiens
caagaagucucuggaucug

SEQ ID NO: 152360 - RNA, 19 nt, Homo sapiens
gcgacggguugcuguugua

SEQ ID NO: 152361 - RNA, 19 nt, Homo sapiens
gcaggacacggcacagauu

SEQ ID NO: 152362 - RNA, 19 nt, Homo sapiens
ggagagcagggcugggaua

SEQ ID NO: 152363 - RNA, 19 nt, Homo sapiens
ugaagacacugacauacgu

SEQ ID NO: 152364 - RNA, 19 nt, Homo sapiens
gagcaccagucugugugua

SEQ ID NO: 152365 - RNA, 19 nt, Homo sapiens
ugacaacuguacuaaugug

SEQ ID NO: 152366 - RNA, 19 nt, Homo sapiens
gaagagaacagccccauug

SEQ ID NO: 152367 - RNA, 19 nt, Homo sapiens
gaacguggcccaguauguc

SEQ ID NO: 152368 - RNA, 19 nt, Homo sapiens
ugaacgacgugaaugacaa

SEQ ID NO: 152369 - RNA, 19 nt, Homo sapiens
ugagcccucuugacuauga

SEQ ID NO: 152370 - RNA, 19 nt, Homo sapiens
aaaaggaucuccacucuuc

SEQ ID NO: 152371 - RNA, 19 nt, Homo sapiens
ucacugaggugcgcgaugu

SEQ ID NO: 152372 - RNA, 19 nt, Homo sapiens
guagugcgcuuggacaaag

SEQ ID NO: 152373 - RNA, 19 nt, Homo sapiens
caauggcugugaagugaau

SEQ ID NO: 152374 - RNA, 19 nt, Homo sapiens
gagcugcgcccaggaaaug

SEQ ID NO: 152375 - RNA, 19 nt, Homo sapiens
ugagaagcaugacuuugug

SEQ ID NO: 152376 - RNA, 19 nt, Homo sapiens
uggagcagguggcuagaaa

SEQ ID NO: 152377 - RNA, 19 nt, Homo sapiens
gaggaagaguaaacacagu

SEQ ID NO: 152378 - RNA, 19 nt, Homo sapiens
gcacguccaucaccuucuc

SEQ ID NO: 152379 - RNA, 19 nt, Homo sapiens
gaaggaaacugaauucaaa

SEQ ID NO: 152380 - RNA, 19 nt, Homo sapiens
gcaagaauauugucccuuu

SEQ ID NO: 152381 - RNA, 19 nt, Homo sapiens
ggaaauauguacuacgaaa

SEQ ID NO: 152382 - RNA, 19 nt, Homo sapiens
aaacguaucuccuaauuug

SEQ ID NO: 152383 - RNA, 19 nt, Homo sapiens
uaacagcaguccuuuguaa

SEQ ID NO: 152384 - RNA, 19 nt, Homo sapiens
ccacaaagcagugaauuua

SEQ ID NO: 152385 - RNA, 19 nt, Homo sapiens
guaacaagcucacgcaguu

SEQ ID NO: 152386 - RNA, 19 nt, Homo sapiens
gauccaagcugucccaaug

SEQ ID NO: 152387 - RNA, 19 nt, Homo sapiens
gaaagaauaccaugcagaa

SEQ ID NO: 152388 - RNA, 19 nt, Homo sapiens
caaaguguguaacggaaua

SEQ ID NO: 152389 - RNA, 19 nt, Homo sapiens
guaauuauguggugacaga

SEQ ID NO: 152390 - RNA, 19 nt, Homo sapiens
aaaugaagcugcucugaaa

SEQ ID NO: 152391 - RNA, 19 nt, Homo sapiens
gaagauaguuuucuccuuu

SEQ ID NO: 152392 - RNA, 19 nt, Homo sapiens
ggagauaagugauggagau

SEQ ID NO: 152393 - RNA, 19 nt, Homo sapiens
ggaacuggauauucugaaa

SEQ ID NO: 152394 - RNA, 19 nt, Homo sapiens
gcuaugagauggaggaaga

SEQ ID NO: 152395 - RNA, 19 nt, Homo sapiens
gaaaggcagccaccaaauu

SEQ ID NO: 152396 - RNA, 19 nt, Homo sapiens
gaacacaaagacaauauug

SEQ ID NO: 152397 - RNA, 19 nt, Homo sapiens
caagcaacauggucaguuu

SEQ ID NO: 152398 - RNA, 19 nt, Homo sapiens
gaggaaauauguacuacga

SEQ ID NO: 152399 - RNA, 19 nt, Homo sapiens
gacaguagcauuaugagua

SEQ ID NO: 152400 - RNA, 19 nt, Homo sapiens
gcagaggaauuaugaucuu

SEQ ID NO: 152401 - RNA, 19 nt, Homo sapiens
gcaaagugccuaucaagug

SEQ ID NO: 152402 - RNA, 19 nt, Homo sapiens
aaaggcagccaccaaauua

SEQ ID NO: 152403 - RNA, 19 nt, Homo sapiens
caagggaguuuguggagaa

SEQ ID NO: 152404 - RNA, 19 nt, Homo sapiens
gcaaagcugucccaucaag

SEQ ID NO: 152405 - RNA, 19 nt, Homo sapiens
caaagggcaugaacuacuu

SEQ ID NO: 152406 - RNA, 19 nt, Homo sapiens
caugagaaauuuacaggaa

SEQ ID NO: 152407 - RNA, 19 nt, Homo sapiens
gaauucuuccuuagacuua

SEQ ID NO: 152408 - RNA, 19 nt, Homo sapiens
ggagguggcugguuauguc

SEQ ID NO: 152409 - RNA, 19 nt, Homo sapiens
gcucugaaaucuccuuuag

SEQ ID NO: 152410 - RNA, 19 nt, Homo sapiens
gcguuagacugacuuguuu

SEQ ID NO: 152411 - RNA, 19 nt, Homo sapiens
gauaagugauggagaugug

SEQ ID NO: 152412 - RNA, 19 nt, Homo sapiens
gaggagaacugccagaaac

SEQ ID NO: 152413 - RNA, 19 nt, Homo sapiens
ucaaugggcucuuccaaca

SEQ ID NO: 152414 - RNA, 19 nt, Homo sapiens
cugcaaagcugucccauca

SEQ ID NO: 152415 - RNA, 19 nt, Homo sapiens
gaagcaacaucuccgaaag

SEQ ID NO: 152416 - RNA, 19 nt, Homo sapiens
cuacagcauuguuaagaaa

SEQ ID NO: 152417 - RNA, 19 nt, Homo sapiens
gaaguugcauuccuuuguc

SEQ ID NO: 152418 - RNA, 19 nt, Homo sapiens
gcacaagccacaagucuuc

SEQ ID NO: 152419 - RNA, 19 nt, Homo sapiens
ggaagaaaugguucagaaa

SEQ ID NO: 152420 - RNA, 19 nt, Homo sapiens
gauaaugcuuucacaacau

SEQ ID NO: 152421 - RNA, 19 nt, Homo sapiens
gcagugacuuucucagcaa

SEQ ID NO: 152422 - RNA, 19 nt, Homo sapiens
cagcugagaauguggaaua

SEQ ID NO: 152423 - RNA, 19 nt, Homo sapiens
gaucaucgaauucuccaaa

SEQ ID NO: 152424 - RNA, 19 nt, Homo sapiens
ugauggagaugugauaauu

SEQ ID NO: 152425 - RNA, 19 nt, Homo sapiens
uaaagacucacucuccaua

SEQ ID NO: 152426 - RNA, 19 nt, Homo sapiens
uccagaggauguucaauaa

SEQ ID NO: 152427 - RNA, 19 nt, Homo sapiens
ccgaguaucucaacacugu

SEQ ID NO: 152428 - RNA, 19 nt, Homo sapiens
cccagugccugaauacaua

SEQ ID NO: 152429 - RNA, 19 nt, Homo sapiens
gagcugcccaugagaaauu

SEQ ID NO: 152430 - RNA, 19 nt, Homo sapiens
ugaaggagcugcccaugag

SEQ ID NO: 152431 - RNA, 19 nt, Homo sapiens
caaauaauaacucggauuc

SEQ ID NO: 152432 - RNA, 19 nt, Homo sapiens
gcagauagucgcccaaagu

SEQ ID NO: 152433 - RNA, 19 nt, Homo sapiens
gggaaugcguggacaagug

SEQ ID NO: 152434 - RNA, 19 nt, Homo sapiens
ccauaaaugcuacgaauau

SEQ ID NO: 152435 - RNA, 19 nt, Homo sapiens
gaaaucagcaagagaggau

SEQ ID NO: 152436 - RNA, 19 nt, Homo sapiens
gaucgguacuguaucaagu

SEQ ID NO: 152437 - RNA, 19 nt, Homo sapiens
gaugauagacgcagauagu

SEQ ID NO: 152438 - RNA, 19 nt, Homo sapiens
ucaaguggauggcauugga

SEQ ID NO: 152439 - RNA, 19 nt, Homo sapiens
ggucagaaaaccaaaauua

SEQ ID NO: 152440 - RNA, 19 nt, Homo sapiens
uaaacucuccuagucaaua

SEQ ID NO: 152441 - RNA, 19 nt, Homo sapiens
aauccagacucuuucgaua

SEQ ID NO: 152442 - RNA, 19 nt, Homo sapiens
gugaguugaucaucgaauu

SEQ ID NO: 152443 - RNA, 19 nt, Homo sapiens
ggaauuaagagaagcaaca

SEQ ID NO: 152444 - RNA, 19 nt, Homo sapiens
aggaagaaaugguucagaa

SEQ ID NO: 152445 - RNA, 19 nt, Homo sapiens
gaugaauucuuccuuagac

SEQ ID NO: 152446 - RNA, 19 nt, Homo sapiens
caagaauauugucccuuug

SEQ ID NO: 152447 - RNA, 19 nt, Homo sapiens
caaagcagugaauuuauug

SEQ ID NO: 152448 - RNA, 19 nt, Homo sapiens
ccaaauggcaucuuuaagg

SEQ ID NO: 152449 - RNA, 19 nt, Homo sapiens
cagaggauguucaauaacu

SEQ ID NO: 152450 - RNA, 19 nt, Homo sapiens
gaagaaaugguucagaaaa

SEQ ID NO: 152451 - RNA, 19 nt, Homo sapiens
aaacucuccuagucaauau

SEQ ID NO: 152452 - RNA, 19 nt, Homo sapiens
ugauaaugcuuucacaaca

SEQ ID NO: 152453 - RNA, 19 nt, Homo sapiens
uugaggaucuugaaggaaa

SEQ ID NO: 152454 - RNA, 19 nt, Homo sapiens
gcauagaucagaagacuac

SEQ ID NO: 152455 - RNA, 19 nt, Homo sapiens
gggcauagaucagaagacu

SEQ ID NO: 152456 - RNA, 19 nt, Homo sapiens
gggaugaauucuuccuuag

SEQ ID NO: 152457 - RNA, 19 nt, Homo sapiens
ugugaagcauuuacagaaa

SEQ ID NO: 152458 - RNA, 19 nt, Homo sapiens
agaauaccaugcagaagga

SEQ ID NO: 152459 - RNA, 19 nt, Homo sapiens
ggaacacaaagacaauauu

SEQ ID NO: 152460 - RNA, 19 nt, Homo sapiens
cacaggaacuggauauucu

SEQ ID NO: 152461 - RNA, 19 nt, Homo sapiens
cuacaguuauguucaguca

SEQ ID NO: 152462 - RNA, 19 nt, Homo sapiens
gagaauguggaauaccuaa

SEQ ID NO: 152463 - RNA, 19 nt, Homo sapiens
gguacuguaucaagucaug

SEQ ID NO: 152464 - RNA, 19 nt, Homo sapiens
cgaugaagccuacgugaug

SEQ ID NO: 152465 - RNA, 19 nt, Homo sapiens
ccagaaggugagaaaguua

SEQ ID NO: 152466 - RNA, 19 nt, Homo sapiens
aagacucacucuccauaaa

SEQ ID NO: 152467 - RNA, 19 nt, Homo sapiens
gagaacugccagaaacuga

SEQ ID NO: 152468 - RNA, 19 nt, Homo sapiens
gaucaucagaggaaauaug

SEQ ID NO: 152469 - RNA, 19 nt, Homo sapiens
cagaggaauuaugaucuuu

SEQ ID NO: 152470 - RNA, 19 nt, Homo sapiens
ugaauuuauuggagcauga

SEQ ID NO: 152471 - RNA, 19 nt, Homo sapiens
ccaaggaagccaagccaaa

SEQ ID NO: 152472 - RNA, 19 nt, Homo sapiens
gggaugaaagaaugcauuu

SEQ ID NO: 152473 - RNA, 19 nt, Homo sapiens
gucaagugcuggaugauag

SEQ ID NO: 152474 - RNA, 19 nt, Homo sapiens
ggucaagugcuggaugaua

SEQ ID NO: 152475 - RNA, 19 nt, Homo sapiens
ucacgcaguugggcacuuu

SEQ ID NO: 152476 - RNA, 19 nt, Homo sapiens
gcaaagggcaugaacuacu

SEQ ID NO: 152477 - RNA, 19 nt, Homo sapiens
gagcuuguggagccucuua

SEQ ID NO: 152478 - RNA, 19 nt, Homo sapiens
gaugugauaauuucaggaa

SEQ ID NO: 152479 - RNA, 19 nt, Homo sapiens
gaaauuugcuaaagggaaa

SEQ ID NO: 152480 - RNA, 19 nt, Homo sapiens
ggaguuagguccucacuug

SEQ ID NO: 152481 - RNA, 19 nt, Homo sapiens
ggacaugacagcaaccuuu

SEQ ID NO: 152482 - RNA, 19 nt, Homo sapiens
caauggugauccucuauuu

SEQ ID NO: 152483 - RNA, 19 nt, Homo sapiens
aaacagccauguccaaguu

SEQ ID NO: 152484 - RNA, 19 nt, Homo sapiens
gaacuugauuugcauggau

SEQ ID NO: 152485 - RNA, 19 nt, Homo sapiens
gcugauggcuugacaugug

SEQ ID NO: 152486 - RNA, 19 nt, Homo sapiens
caauuacuauucccuuuga

SEQ ID NO: 152487 - RNA, 19 nt, Homo sapiens
guacuuguguuugcuuaaa

SEQ ID NO: 152488 - RNA, 19 nt, Homo sapiens
aaacagcagucccaguauu

SEQ ID NO: 152489 - RNA, 19 nt, Homo sapiens
ccacagggcuuucggacau

SEQ ID NO: 152490 - RNA, 19 nt, Homo sapiens
ggacaagaaagcagacaaa

SEQ ID NO: 152491 - RNA, 19 nt, Homo sapiens
ugaaacagcagucccagua

SEQ ID NO: 152492 - RNA, 19 nt, Homo sapiens
ggaauguuguaguuaccua

SEQ ID NO: 152493 - RNA, 19 nt, Homo sapiens
gcaagaggcauaccaagau

SEQ ID NO: 152494 - RNA, 19 nt, Homo sapiens
ucagaguguuguuccguua

SEQ ID NO: 152495 - RNA, 19 nt, Homo sapiens
gacaauaaguuugaaccuu

SEQ ID NO: 152496 - RNA, 19 nt, Homo sapiens
gaguuggaauguuguaguu

SEQ ID NO: 152497 - RNA, 19 nt, Homo sapiens
gaugaacgcaagaggcaua

SEQ ID NO: 152498 - RNA, 19 nt, Homo sapiens
cgacaucuguggaagaaag

SEQ ID NO: 152499 - RNA, 19 nt, Homo sapiens
gaugaugcugugacaauaa

SEQ ID NO: 152500 - RNA, 19 nt, Homo sapiens
cgacagcagucccauuuac

SEQ ID NO: 152501 - RNA, 19 nt, Homo sapiens
gugacuguuuggcuuauaa

SEQ ID NO: 152502 - RNA, 19 nt, Homo sapiens
gaaggucuauuggccaaca

SEQ ID NO: 152503 - RNA, 19 nt, Homo sapiens
gagcaugugucagaguguu

SEQ ID NO: 152504 - RNA, 19 nt, Homo sapiens
ugaugaugcugugacaaua

SEQ ID NO: 152505 - RNA, 19 nt, Homo sapiens
aguaucaucuccaucauau

SEQ ID NO: 152506 - RNA, 19 nt, Homo sapiens
gaccugaaggcccucaaua

SEQ ID NO: 152507 - RNA, 19 nt, Homo sapiens
gaaacacaagagacuuaaa

SEQ ID NO: 152508 - RNA, 19 nt, Homo sapiens
aagaaacacaagagacuua

SEQ ID NO: 152509 - RNA, 19 nt, Homo sapiens
caagaggcauaccaagauc

SEQ ID NO: 152510 - RNA, 19 nt, Homo sapiens
gaaacagcagucccaguau

SEQ ID NO: 152511 - RNA, 19 nt, Homo sapiens
augcucaccucuagccuua

SEQ ID NO: 152512 - RNA, 19 nt, Homo sapiens
gggacaugcucaccucuag

SEQ ID NO: 152513 - RNA, 19 nt, Homo sapiens
ucucagagcaugugucaga

SEQ ID NO: 152514 - RNA, 19 nt, Homo sapiens
guuacuaccucuuauccau

SEQ ID NO: 152515 - RNA, 19 nt, Homo sapiens
aaagugacuguuuggcuua

SEQ ID NO: 152516 - RNA, 19 nt, Homo sapiens
ccaaguucuucaccucuau

SEQ ID NO: 152517 - RNA, 19 nt, Homo sapiens
gccaaguccucccucucua

SEQ ID NO: 152518 - RNA, 19 nt, Homo sapiens
ccugacaucucucugaaca

SEQ ID NO: 152519 - RNA, 19 nt, Homo sapiens
caugggauaugugguguau

SEQ ID NO: 152520 - RNA, 19 nt, Homo sapiens
gcugugacaauaaguuuga

SEQ ID NO: 152521 - RNA, 19 nt, Homo sapiens
ccuccucucucucuuccua

SEQ ID NO: 152522 - RNA, 19 nt, Homo sapiens
ugacaucucucugaacaac

SEQ ID NO: 152523 - RNA, 19 nt, Homo sapiens
caccuauacuggccgcuuu

SEQ ID NO: 152524 - RNA, 19 nt, Homo sapiens
gcucaccucuagccuuaag

SEQ ID NO: 152525 - RNA, 19 nt, Homo sapiens
ucucacauguggcaaaaua

SEQ ID NO: 152526 - RNA, 19 nt, Homo sapiens
gaaaaucgaguuggcaaaa

SEQ ID NO: 152527 - RNA, 19 nt, Homo sapiens
cccaauuacuauucccuuu

SEQ ID NO: 152528 - RNA, 19 nt, Homo sapiens
caagaaagcagacaaaagu

SEQ ID NO: 152529 - RNA, 19 nt, Homo sapiens
cuucaccucuauccaaaga

SEQ ID NO: 152530 - RNA, 19 nt, Homo sapiens
aaacacaagagacuuaaag

SEQ ID NO: 152531 - RNA, 19 nt, Homo sapiens
ugaccguacucucacaugu

SEQ ID NO: 152532 - RNA, 19 nt, Homo sapiens
ccaauuacuauucccuuug

SEQ ID NO: 152533 - RNA, 19 nt, Homo sapiens
ccaguggaguccugugauc

SEQ ID NO: 152534 - RNA, 19 nt, Homo sapiens
ggcuugacaugugcaauug

SEQ ID NO: 152535 - RNA, 19 nt, Homo sapiens
guuggaauguuguaguuac

SEQ ID NO: 152536 - RNA, 19 nt, Homo sapiens
gaacgcaagaggcauacca

SEQ ID NO: 152537 - RNA, 19 nt, Homo sapiens
aaauaaaguagcugcgauu

SEQ ID NO: 152538 - RNA, 19 nt, Homo sapiens
acccuaagcuggaggagau

SEQ ID NO: 152539 - RNA, 19 nt, Homo sapiens
gugaugaugcugugacaau

SEQ ID NO: 152540 - RNA, 19 nt, Homo sapiens
ucagauggagguucucaga

SEQ ID NO: 152541 - RNA, 19 nt, Homo sapiens
gcaccugaccgcagagucu

SEQ ID NO: 152542 - RNA, 19 nt, Homo sapiens
caacgacagcagucccauu

SEQ ID NO: 152543 - RNA, 19 nt, Homo sapiens
ccugcacgcuucucagugu

SEQ ID NO: 152544 - RNA, 19 nt, Homo sapiens
caguaucaucuccaucaua

SEQ ID NO: 152545 - RNA, 19 nt, Homo sapiens
guucuucaccucuauccaa

SEQ ID NO: 152546 - RNA, 19 nt, Homo sapiens
aaaguguuguggccucuuc

SEQ ID NO: 152547 - RNA, 19 nt, Homo sapiens
ugguguauauccuuccaaa

SEQ ID NO: 152548 - RNA, 19 nt, Homo sapiens
ggaguuggaauguuguagu

SEQ ID NO: 152549 - RNA, 19 nt, Homo sapiens
uucaggaguuggaauguug

SEQ ID NO: 152550 - RNA, 19 nt, Homo sapiens
aacaaaaucugaacucuca

SEQ ID NO: 152551 - RNA, 19 nt, Homo sapiens
ccaauggugauccucuauu

SEQ ID NO: 152552 - RNA, 19 nt, Homo sapiens
uugcauggauuuuggauaa

SEQ ID NO: 152553 - RNA, 19 nt, Homo sapiens
acacaagagacuuaaagga

SEQ ID NO: 152554 - RNA, 19 nt, Homo sapiens
aaucugaacucucaaaagu

SEQ ID NO: 152555 - RNA, 19 nt, Homo sapiens
gaugugaagauaauuugca

SEQ ID NO: 152556 - RNA, 19 nt, Homo sapiens
gcagaaggacaagaaagca

SEQ ID NO: 152557 - RNA, 19 nt, Homo sapiens
uccaaguucuucaccucua

SEQ ID NO: 152558 - RNA, 19 nt, Homo sapiens
gaaagcagacaaaaguguu

SEQ ID NO: 152559 - RNA, 19 nt, Homo sapiens
ccauggacaacuacccuaa

SEQ ID NO: 152560 - RNA, 19 nt, Homo sapiens
uuaaggccuuugccacuca

SEQ ID NO: 152561 - RNA, 19 nt, Homo sapiens
caaggguggcuuccagguu

SEQ ID NO: 152562 - RNA, 19 nt, Homo sapiens
aacgacagcagucccauuu

SEQ ID NO: 152563 - RNA, 19 nt, Homo sapiens
gaugcugugacaauaaguu

SEQ ID NO: 152564 - RNA, 19 nt, Homo sapiens
gauccucuauuuugugaug

SEQ ID NO: 152565 - RNA, 19 nt, Homo sapiens
ggaggaggagauggccaua

SEQ ID NO: 152566 - RNA, 19 nt, Homo sapiens
ccucagcugucaccaacuc

SEQ ID NO: 152567 - RNA, 19 nt, Homo sapiens
uaucaucuccaucauaugc

SEQ ID NO: 152568 - RNA, 19 nt, Homo sapiens
ucaccucuauccaaagaac

SEQ ID NO: 152569 - RNA, 19 nt, Homo sapiens
uggaguggaaggucuauug

SEQ ID NO: 152570 - RNA, 19 nt, Homo sapiens
ccucucuacuggaguggaa

SEQ ID NO: 152571 - RNA, 19 nt, Homo sapiens
agaaacacaagagacuuaa

SEQ ID NO: 152572 - RNA, 19 nt, Homo sapiens
ugcgacaucuguggaagaa

SEQ ID NO: 152573 - RNA, 19 nt, Homo sapiens
gcgcagugccauccaacga

SEQ ID NO: 152574 - RNA, 19 nt, Homo sapiens
uguauuauuuggaguuagg

SEQ ID NO: 152575 - RNA, 19 nt, Homo sapiens
cuugcucccuucaaugcua

SEQ ID NO: 152576 - RNA, 19 nt, Homo sapiens
cgcaagaggcauaccaaga

SEQ ID NO: 152577 - RNA, 19 nt, Homo sapiens
caucuguggaagaaaguuu

SEQ ID NO: 152578 - RNA, 19 nt, Homo sapiens
ggaccugaaggcccucaau

SEQ ID NO: 152579 - RNA, 19 nt, Homo sapiens
gaacagaagugcaauguga

SEQ ID NO: 152580 - RNA, 19 nt, Homo sapiens
uaaauggguugccuuauua

SEQ ID NO: 152581 - RNA, 19 nt, Homo sapiens
gaggagcaauugauuaaua

SEQ ID NO: 152582 - RNA, 19 nt, Homo sapiens
guaaauggguugccuuauu

SEQ ID NO: 152583 - RNA, 19 nt, Homo sapiens
gaaaccagaccuucacuua

SEQ ID NO: 152584 - RNA, 19 nt, Homo sapiens
uaccggagcugauuuguuu

SEQ ID NO: 152585 - RNA, 19 nt, Homo sapiens
uauaauggaugguuuguga

SEQ ID NO: 152586 - RNA, 19 nt, Homo sapiens
gaucucagagguuaacuua

SEQ ID NO: 152587 - RNA, 19 nt, Homo sapiens
ucucagagguuaacuuauu

SEQ ID NO: 152588 - RNA, 19 nt, Homo sapiens
aaacugaugugcacuuuau

SEQ ID NO: 152589 - RNA, 19 nt, Homo sapiens
caagagggcugaggucuga

SEQ ID NO: 152590 - RNA, 19 nt, Homo sapiens
ccagaaggcauaaucaaua

SEQ ID NO: 152591 - RNA, 19 nt, Homo sapiens
ccaggucucuucccaauga

SEQ ID NO: 152592 - RNA, 19 nt, Homo sapiens
ggauguacauauucucuga

SEQ ID NO: 152593 - RNA, 19 nt, Homo sapiens
gaaggcauaaucaauauug

SEQ ID NO: 152594 - RNA, 19 nt, Homo sapiens
gagagucaguggcaaauag

SEQ ID NO: 152595 - RNA, 19 nt, Homo sapiens
ugucagaguugaucuaaga

SEQ ID NO: 152596 - RNA, 19 nt, Homo sapiens
cagaaggcauaaucaauau

SEQ ID NO: 152597 - RNA, 19 nt, Homo sapiens
gcgaggagcaauugauuaa

SEQ ID NO: 152598 - RNA, 19 nt, Homo sapiens
ccacacuguucucuaaauu

SEQ ID NO: 152599 - RNA, 19 nt, Homo sapiens
uuaaaggguuguuugacua

SEQ ID NO: 152600 - RNA, 19 nt, Homo sapiens
aaucagagcauaucuaguu

SEQ ID NO: 152601 - RNA, 19 nt, Homo sapiens
ugacaugacuggagagaag

SEQ ID NO: 152602 - RNA, 19 nt, Homo sapiens
gcaauuguguuggaagugu

SEQ ID NO: 152603 - RNA, 19 nt, Homo sapiens
gaaacuaggaugcaugcaa

SEQ ID NO: 152604 - RNA, 19 nt, Homo sapiens
aaacuaggaugcaugcaau

SEQ ID NO: 152605 - RNA, 19 nt, Homo sapiens
ggagauggcaugaucaaca

SEQ ID NO: 152606 - RNA, 19 nt, Homo sapiens
uuuaugaucucagagguua

SEQ ID NO: 152607 - RNA, 19 nt, Homo sapiens
ugagugaaguauagccuuu

SEQ ID NO: 152608 - RNA, 19 nt, Homo sapiens
guacagugagugaaguaua

SEQ ID NO: 152609 - RNA, 19 nt, Homo sapiens
gaguugaucuaagacguuu

SEQ ID NO: 152610 - RNA, 19 nt, Homo sapiens
gagauggcaugaucaacau

SEQ ID NO: 152611 - RNA, 19 nt, Homo sapiens
aaacuuagcccauucuagu

SEQ ID NO: 152612 - RNA, 19 nt, Homo sapiens
ccacgucggugaccaucuu

SEQ ID NO: 152613 - RNA, 19 nt, Homo sapiens
cagauauaauggaugguuu

SEQ ID NO: 152614 - RNA, 19 nt, Homo sapiens
cucacugacuguuauaaua

SEQ ID NO: 152615 - RNA, 19 nt, Homo sapiens
ggagagagucaguggcaaa

SEQ ID NO: 152616 - RNA, 19 nt, Homo sapiens
gggacucacugacuguuau

SEQ ID NO: 152617 - RNA, 19 nt, Homo sapiens
gagcgaggagcaauugauu

SEQ ID NO: 152618 - RNA, 19 nt, Homo sapiens
ucuacaauccguaacuuua

SEQ ID NO: 152619 - RNA, 19 nt, Homo sapiens
ucacuccacucucuacaau

SEQ ID NO: 152620 - RNA, 19 nt, Homo sapiens
cagagagaccuacauggua

SEQ ID NO: 152621 - RNA, 19 nt, Homo sapiens
guuugugacuauaguguaa

SEQ ID NO: 152622 - RNA, 19 nt, Homo sapiens
uacccacacuguucucuaa

SEQ ID NO: 152623 - RNA, 19 nt, Homo sapiens
gacccuggaugucagaguu

SEQ ID NO: 152624 - RNA, 19 nt, Homo sapiens
gcauaagcccuuccagugu

SEQ ID NO: 152625 - RNA, 19 nt, Homo sapiens
gaaguucagauauaaugga

SEQ ID NO: 152626 - RNA, 19 nt, Homo sapiens
guacauauucucugaaacu

SEQ ID NO: 152627 - RNA, 19 nt, Homo sapiens
aaccagaccuucacuuaca

SEQ ID NO: 152628 - RNA, 19 nt, Homo sapiens
ggccggagauggcaugauc

SEQ ID NO: 152629 - RNA, 19 nt, Homo sapiens
uacaauagguugggagaug

SEQ ID NO: 152630 - RNA, 19 nt, Homo sapiens
cacuggagcugcacaacaa

SEQ ID NO: 152631 - RNA, 19 nt, Homo sapiens
ccacucagauuuuguguau

SEQ ID NO: 152632 - RNA, 19 nt, Homo sapiens
ggacucacugacuguuaua

SEQ ID NO: 152633 - RNA, 19 nt, Homo sapiens
gagagaagaggucguugga

SEQ ID NO: 152634 - RNA, 19 nt, Homo sapiens
ggcauaaucaauauuguga

SEQ ID NO: 152635 - RNA, 19 nt, Homo sapiens
gaacggaguggccggagau

SEQ ID NO: 152636 - RNA, 19 nt, Homo sapiens
gugaccaucuuucccaaug

SEQ ID NO: 152637 - RNA, 19 nt, Homo sapiens
caguaacucucagugguuu

SEQ ID NO: 152638 - RNA, 19 nt, Homo sapiens
gcucuuaauaguugugaaa

SEQ ID NO: 152639 - RNA, 19 nt, Homo sapiens
gagaacagaagugcaaugu

SEQ ID NO: 152640 - RNA, 19 nt, Homo sapiens
gaugucagaguugaucuaa

SEQ ID NO: 152641 - RNA, 19 nt, Homo sapiens
uuaggugaguugacuauca

SEQ ID NO: 152642 - RNA, 19 nt, Homo sapiens
guauggcuguauauuuaug

SEQ ID NO: 152643 - RNA, 19 nt, Homo sapiens
caacuuguuugcuacuuuu

SEQ ID NO: 152644 - RNA, 19 nt, Homo sapiens
gcugauuuguuuggucauu

SEQ ID NO: 152645 - RNA, 19 nt, Homo sapiens
aagcauuuaugaucucaga

SEQ ID NO: 152646 - RNA, 19 nt, Homo sapiens
ucagagaacagaagugcaa

SEQ ID NO: 152647 - RNA, 19 nt, Homo sapiens
gaaaguuugcccggaguga

SEQ ID NO: 152648 - RNA, 19 nt, Homo sapiens
acacuguucucuaaauucu

SEQ ID NO: 152649 - RNA, 19 nt, Homo sapiens
uacagugagugaaguauag

SEQ ID NO: 152650 - RNA, 19 nt, Homo sapiens
gguacccugugcagcagua

SEQ ID NO: 152651 - RNA, 19 nt, Homo sapiens
cgccaaggccguagacaaa

SEQ ID NO: 152652 - RNA, 19 nt, Homo sapiens
gaccaccucaccacccaua

SEQ ID NO: 152653 - RNA, 19 nt, Homo sapiens
gaugguuugugacuauagu

SEQ ID NO: 152654 - RNA, 19 nt, Homo sapiens
guguauauccacucagauu

SEQ ID NO: 152655 - RNA, 19 nt, Homo sapiens
uuugagaaauguaggcuau

SEQ ID NO: 152656 - RNA, 19 nt, Homo sapiens
cuacuguggccgaaaguuu

SEQ ID NO: 152657 - RNA, 19 nt, Homo sapiens
ugacuacuguggccgaaag

SEQ ID NO: 152658 - RNA, 19 nt, Homo sapiens
ccagagagaccuacauggu

SEQ ID NO: 152659 - RNA, 19 nt, Homo sapiens
cagcuuugcucccgucucu

SEQ ID NO: 152660 - RNA, 19 nt, Homo sapiens
gucguuggaucucccauau

SEQ ID NO: 152661 - RNA, 19 nt, Homo sapiens
gugauguagacaaauguua

SEQ ID NO: 152662 - RNA, 19 nt, Homo sapiens
ugugugauguagacaaaug

SEQ ID NO: 152663 - RNA, 19 nt, Homo sapiens
uaggaugcaugcaauugug

SEQ ID NO: 152664 - RNA, 19 nt, Homo sapiens
cucagagguuaacuuauuu

SEQ ID NO: 152665 - RNA, 19 nt, Homo sapiens
acuguucucuaaauucuga

SEQ ID NO: 152666 - RNA, 19 nt, Homo sapiens
cagagcauaucuaguuguc

SEQ ID NO: 152667 - RNA, 19 nt, Homo sapiens
gauggcaugaucaacauug

SEQ ID NO: 152668 - RNA, 19 nt, Homo sapiens
cugauuuguuuggucauua

SEQ ID NO: 152669 - RNA, 19 nt, Homo sapiens
gcaugcaauuguguuggaa

SEQ ID NO: 152670 - RNA, 19 nt, Homo sapiens
cgaguuguuugagaaaugu

SEQ ID NO: 152671 - RNA, 19 nt, Homo sapiens
ugaaucagagcauaucuag

SEQ ID NO: 152672 - RNA, 19 nt, Homo sapiens
gagugaaguauagccuuua

SEQ ID NO: 152673 - RNA, 19 nt, Homo sapiens
caaaacugaugugcacuuu

SEQ ID NO: 152674 - RNA, 19 nt, Homo sapiens
ggaagcgccacaccaagau

SEQ ID NO: 152675 - RNA, 19 nt, Homo sapiens
gacauuguacagugaguga

SEQ ID NO: 152676 - RNA, 19 nt, Homo sapiens
aguaacagcagcagucuug

SEQ ID NO: 152677 - RNA, 19 nt, Homo sapiens
gaauccacacugggcauaa

SEQ ID NO: 152678 - RNA, 19 nt, Homo sapiens
uggguugccuuauuaugga

SEQ ID NO: 152679 - RNA, 19 nt, Homo sapiens
gaacaaaggucuggaguuu

SEQ ID NO: 152680 - RNA, 19 nt, Homo sapiens
ggauauagaugcacacaua

SEQ ID NO: 152681 - RNA, 19 nt, Homo sapiens
ggaaucagauacccuuuaa

SEQ ID NO: 152682 - RNA, 19 nt, Homo sapiens
gaaaugguguaauguugua

SEQ ID NO: 152683 - RNA, 19 nt, Homo sapiens
gcacacauaucuguacaua

SEQ ID NO: 152684 - RNA, 19 nt, Homo sapiens
ugaaugaggugucuccuuu

SEQ ID NO: 152685 - RNA, 19 nt, Homo sapiens
uaacuuaugugaacugaga

SEQ ID NO: 152686 - RNA, 19 nt, Homo sapiens
agacaaaccagauguaaua

SEQ ID NO: 152687 - RNA, 19 nt, Homo sapiens
ucugagcgcuucccucuua

SEQ ID NO: 152688 - RNA, 19 nt, Homo sapiens
gaaaaugcacucuaacuua

SEQ ID NO: 152689 - RNA, 19 nt, Homo sapiens
caacacaacagauagaauu

SEQ ID NO: 152690 - RNA, 19 nt, Homo sapiens
aaacuguucucagacauua

SEQ ID NO: 152691 - RNA, 19 nt, Homo sapiens
gcaugcauguguauaaaga

SEQ ID NO: 152692 - RNA, 19 nt, Homo sapiens
gaauguacuguuccuguua

SEQ ID NO: 152693 - RNA, 19 nt, Homo sapiens
gagagaagaagaugaaguu

SEQ ID NO: 152694 - RNA, 19 nt, Homo sapiens
ucucuaagguacuugguua

SEQ ID NO: 152695 - RNA, 19 nt, Homo sapiens
gcacaugcguacauauaca

SEQ ID NO: 152696 - RNA, 19 nt, Homo sapiens
ggaacaagaccgugaccua

SEQ ID NO: 152697 - RNA, 19 nt, Homo sapiens
gagccugccuuuuaaaaua

SEQ ID NO: 152698 - RNA, 19 nt, Homo sapiens
gcgcaagcguguguguuua

SEQ ID NO: 152699 - RNA, 19 nt, Homo sapiens
gcggaaagguggcgucuag

SEQ ID NO: 152700 - RNA, 19 nt, Homo sapiens
ccuuugaaguggaguaaua

SEQ ID NO: 152701 - RNA, 19 nt, Homo sapiens
gagcugaacugggcugugu

SEQ ID NO: 152702 - RNA, 19 nt, Homo sapiens
ucucagacauuaagcuaaa

SEQ ID NO: 152703 - RNA, 19 nt, Homo sapiens
ucagauggcuacagagaau

SEQ ID NO: 152704 - RNA, 19 nt, Homo sapiens
gagaagaagaugaaguuug

SEQ ID NO: 152705 - RNA, 19 nt, Homo sapiens
guauggauauguguguaua

SEQ ID NO: 152706 - RNA, 19 nt, Homo sapiens
gaaauucuucaccaacauu

SEQ ID NO: 152707 - RNA, 19 nt, Homo sapiens
caacaucauuagccucaug

SEQ ID NO: 152708 - RNA, 19 nt, Homo sapiens
acaaucagauggcuacaga

SEQ ID NO: 152709 - RNA, 19 nt, Homo sapiens
gcaaaugcuaauacaguaa

SEQ ID NO: 152710 - RNA, 19 nt, Homo sapiens
gcagcauggucuugacuga

SEQ ID NO: 152711 - RNA, 19 nt, Homo sapiens
ggaugccgcuugccuggaa

SEQ ID NO: 152712 - RNA, 19 nt, Homo sapiens
uaaaccaacugccugacaa

SEQ ID NO: 152713 - RNA, 19 nt, Homo sapiens
acaaaggucuggaguuuac

SEQ ID NO: 152714 - RNA, 19 nt, Homo sapiens
acucagagcccgugucuuu

SEQ ID NO: 152715 - RNA, 19 nt, Homo sapiens
uaaaaggacucuaguggaa

SEQ ID NO: 152716 - RNA, 19 nt, Homo sapiens
ucaguaaguugcccagaga

SEQ ID NO: 152717 - RNA, 19 nt, Homo sapiens
guaggcguauacagcuuua

SEQ ID NO: 152718 - RNA, 19 nt, Homo sapiens
agaagaagaugaaguuugc

SEQ ID NO: 152719 - RNA, 19 nt, Homo sapiens
gaaaaccuauggggaauga

SEQ ID NO: 152720 - RNA, 19 nt, Homo sapiens
gcaccggaauaaagagaau

SEQ ID NO: 152721 - RNA, 19 nt, Homo sapiens
gguugugaauuuccaggua

SEQ ID NO: 152722 - RNA, 19 nt, Homo sapiens
gagaauuuguaggcguaua

SEQ ID NO: 152723 - RNA, 19 nt, Homo sapiens
gaacugggcuguguuuacc

SEQ ID NO: 152724 - RNA, 19 nt, Homo sapiens
gcccaucccuucccuucuu

SEQ ID NO: 152725 - RNA, 19 nt, Homo sapiens
gccaggagggcccauauuu

SEQ ID NO: 152726 - RNA, 19 nt, Homo sapiens
gcagugcaccggaauaaag

SEQ ID NO: 152727 - RNA, 19 nt, Homo sapiens
gcggcgaccucuacucaga

SEQ ID NO: 152728 - RNA, 19 nt, Homo sapiens
gcuccuuugucauauugua

SEQ ID NO: 152729 - RNA, 19 nt, Homo sapiens
ugaauguacuguuccuguu

SEQ ID NO: 152730 - RNA, 19 nt, Homo sapiens
cauccgcucugaaaucaug

SEQ ID NO: 152731 - RNA, 19 nt, Homo sapiens
gguaaaaucuuucuuugca

SEQ ID NO: 152732 - RNA, 19 nt, Homo sapiens
ggugguggauaaauaauac

SEQ ID NO: 152733 - RNA, 19 nt, Homo sapiens
gcuagaaggaggaaucaga

SEQ ID NO: 152734 - RNA, 19 nt, Homo sapiens
ggaacaaaggucuggaguu

SEQ ID NO: 152735 - RNA, 19 nt, Homo sapiens
ucaaagauauggggauuuu

SEQ ID NO: 152736 - RNA, 19 nt, Homo sapiens
auacacaucucuguccaaa

SEQ ID NO: 152737 - RNA, 19 nt, Homo sapiens
gcgaccaccucaccacuca

SEQ ID NO: 152738 - RNA, 19 nt, Homo sapiens
cauuugcuccuuugucaua

SEQ ID NO: 152739 - RNA, 19 nt, Homo sapiens
aaucuauguuccugaguuu

SEQ ID NO: 152740 - RNA, 19 nt, Homo sapiens
caagacaccgcuccacgaa

SEQ ID NO: 152741 - RNA, 19 nt, Homo sapiens
caggguggcuccuuugaag

SEQ ID NO: 152742 - RNA, 19 nt, Homo sapiens
cguauacagcuuuaaauga

SEQ ID NO: 152743 - RNA, 19 nt, Homo sapiens
gcguguguauguaugugua

SEQ ID NO: 152744 - RNA, 19 nt, Homo sapiens
aaaucuauguuccugaguu

SEQ ID NO: 152745 - RNA, 19 nt, Homo sapiens
acucacauccgcacucaua

SEQ ID NO: 152746 - RNA, 19 nt, Homo sapiens
gaccaucaaggcauucaaa

SEQ ID NO: 152747 - RNA, 19 nt, Homo sapiens
acaagaccgugaccuacuu

SEQ ID NO: 152748 - RNA, 19 nt, Homo sapiens
uugaaaugguguaauguug

SEQ ID NO: 152749 - RNA, 19 nt, Homo sapiens
aaagacaaaccagauguaa

SEQ ID NO: 152750 - RNA, 19 nt, Homo sapiens
ccuggaagcugcguuagga

SEQ ID NO: 152751 - RNA, 19 nt, Homo sapiens
gcugaaggguaaaaucuuu

SEQ ID NO: 152752 - RNA, 19 nt, Homo sapiens
ggucuugacugaauguacu

SEQ ID NO: 152753 - RNA, 19 nt, Homo sapiens
cacccuaccucaccucuuc

SEQ ID NO: 152754 - RNA, 19 nt, Homo sapiens
ggucuuccauccgcucuga

SEQ ID NO: 152755 - RNA, 19 nt, Homo sapiens
caaccggccuagcaagaca

SEQ ID NO: 152756 - RNA, 19 nt, Homo sapiens
gugaaaaggugaaauucuu

SEQ ID NO: 152757 - RNA, 19 nt, Homo sapiens
acacaucucuguccaaaau

SEQ ID NO: 152758 - RNA, 19 nt, Homo sapiens
ugucuucucucaauuacau

SEQ ID NO: 152759 - RNA, 19 nt, Homo sapiens
ccaagccgcugggagaugu

SEQ ID NO: 152760 - RNA, 19 nt, Homo sapiens
ccaacugccugacaaucug

SEQ ID NO: 152761 - RNA, 19 nt, Homo sapiens
guaaggagcgcaccaaagc

SEQ ID NO: 152762 - RNA, 19 nt, Homo sapiens
ucaaggcauucaaagacaa

SEQ ID NO: 152763 - RNA, 19 nt, Homo sapiens
caagauccaccucaagcaa

SEQ ID NO: 152764 - RNA, 19 nt, Homo sapiens
ucaccaacauuucauuugc

SEQ ID NO: 152765 - RNA, 19 nt, Homo sapiens
cguacaggguggcuccuuu

SEQ ID NO: 152766 - RNA, 19 nt, Homo sapiens
gcguauacagcuuuaaaug

SEQ ID NO: 152767 - RNA, 19 nt, Homo sapiens
gaggcacccaagaggauua

SEQ ID NO: 152768 - RNA, 19 nt, Homo sapiens
guaauggacaucggucuga

SEQ ID NO: 152769 - RNA, 19 nt, Homo sapiens
aaaggacucuaguggaaag

SEQ ID NO: 152770 - RNA, 19 nt, Homo sapiens
ccagagagaaggaacaaag

SEQ ID NO: 152771 - RNA, 19 nt, Homo sapiens
guguauguauguguaugua

SEQ ID NO: 152772 - RNA, 19 nt, Homo sapiens
guaaguugcccagagagaa

SEQ ID NO: 152773 - RNA, 19 nt, Homo sapiens
uguguuauguguguggaua

SEQ ID NO: 152774 - RNA, 19 nt, Homo sapiens
guauguguauguauaugca

SEQ ID NO: 152775 - RNA, 19 nt, Homo sapiens
gcugaacugggcuguguuu

SEQ ID NO: 152776 - RNA, 19 nt, Homo sapiens
gcaagcguguguguuuaag

SEQ ID NO: 152777 - RNA, 19 nt, Homo sapiens
gucacugcaugauaauuga

SEQ ID NO: 152778 - RNA, 19 nt, Homo sapiens
ccagcgcgcucaaccucuu

SEQ ID NO: 152779 - RNA, 19 nt, Homo sapiens
ggaccaagauugaggacuu

SEQ ID NO: 152780 - RNA, 19 nt, Homo sapiens
gcgcagcgaugagaagaaa

SEQ ID NO: 152781 - RNA, 19 nt, Homo sapiens
gcacuacccugggauucaa

SEQ ID NO: 152782 - RNA, 19 nt, Homo sapiens
ccgauuggauguaacguuu

SEQ ID NO: 152783 - RNA, 19 nt, Homo sapiens
guaauagggaccaagauug

SEQ ID NO: 152784 - RNA, 19 nt, Homo sapiens
ccugggagcugcuuucugu

SEQ ID NO: 152785 - RNA, 19 nt, Homo sapiens
uaauagggaccaagauuga

SEQ ID NO: 152786 - RNA, 19 nt, Homo sapiens
guacagcagugucuuaucc

SEQ ID NO: 152787 - RNA, 19 nt, Homo sapiens
gcucaagggccucggcuuu

SEQ ID NO: 152788 - RNA, 19 nt, Homo sapiens
guacgcagccucagcuuuc

SEQ ID NO: 152789 - RNA, 19 nt, Homo sapiens
ccucaugucgggcgucuua

SEQ ID NO: 152790 - RNA, 19 nt, Homo sapiens
gagaguuucuggccaguac

SEQ ID NO: 152791 - RNA, 19 nt, Homo sapiens
cuccuucgcuucucucuga

SEQ ID NO: 152792 - RNA, 19 nt, Homo sapiens
gauguaacguuuugcuuug

SEQ ID NO: 152793 - RNA, 19 nt, Homo sapiens
cguaauagggaccaagauu

SEQ ID NO: 152794 - RNA, 19 nt, Homo sapiens
agcgguagcuucuucauuc

SEQ ID NO: 152795 - RNA, 19 nt, Homo sapiens
acgcuacucucaagcaguu

SEQ ID NO: 152796 - RNA, 19 nt, Homo sapiens
ucaagggccucggcuuuua

SEQ ID NO: 152797 - RNA, 19 nt, Homo sapiens
ugagaccacccagugaaua

SEQ ID NO: 152798 - RNA, 19 nt, Homo sapiens
gcuccaccuuagcgaguuu

SEQ ID NO: 152799 - RNA, 19 nt, Homo sapiens
gcgguagcuucuucauuca

SEQ ID NO: 152800 - RNA, 19 nt, Homo sapiens
gagaccacccagugaauag

SEQ ID NO: 152801 - RNA, 19 nt, Homo sapiens
gcaucugccuccgcaacuu

SEQ ID NO: 152802 - RNA, 19 nt, Homo sapiens
gcgccaugcuccaccuuag

SEQ ID NO: 152803 - RNA, 19 nt, Homo sapiens
gcaagagauggguuuaugg

SEQ ID NO: 152804 - RNA, 19 nt, Homo sapiens
gagcaagagauggguuuau

SEQ ID NO: 152805 - RNA, 19 nt, Homo sapiens
ggagcaggcgacuucuuga

SEQ ID NO: 152806 - RNA, 19 nt, Homo sapiens
agaagaaacggcacagcaa

SEQ ID NO: 152807 - RNA, 19 nt, Homo sapiens
ggauguaacguuuugcuuu

SEQ ID NO: 152808 - RNA, 19 nt, Homo sapiens
agcaagagauggguuuaug

SEQ ID NO: 152809 - RNA, 19 nt, Homo sapiens
guaaagcagacgcuacucu

SEQ ID NO: 152810 - RNA, 19 nt, Homo sapiens
cccacgccuuccucuauaa

SEQ ID NO: 152811 - RNA, 19 nt, Homo sapiens
gauuggauguaacguuuug

SEQ ID NO: 152812 - RNA, 19 nt, Homo sapiens
gaacccagcgcugaauugc

SEQ ID NO: 152813 - RNA, 19 nt, Homo sapiens
ggagaguuucuggccagua

SEQ ID NO: 152814 - RNA, 19 nt, Homo sapiens
cgaacccagcgcugaauug

SEQ ID NO: 152815 - RNA, 19 nt, Homo sapiens
uggagcaggcgacuucuug

SEQ ID NO: 152816 - RNA, 19 nt, Homo sapiens
cauccacacgggccacaaa

SEQ ID NO: 152817 - RNA, 19 nt, Homo sapiens
cagcgguagcuucuucauu

SEQ ID NO: 152818 - RNA, 19 nt, Homo sapiens
guacagagcacaauuauua

SEQ ID NO: 152819 - RNA, 19 nt, Homo sapiens
gaaagaggcucaggcauaa

SEQ ID NO: 152820 - RNA, 19 nt, Homo sapiens
ggucaaaucuuuaggaaug

SEQ ID NO: 152821 - RNA, 19 nt, Homo sapiens
ggaaaugguugaaucuuga

SEQ ID NO: 152822 - RNA, 19 nt, Homo sapiens
uaaaugggcugaagauguu

SEQ ID NO: 152823 - RNA, 19 nt, Homo sapiens
gcacagggaacuuagguua

SEQ ID NO: 152824 - RNA, 19 nt, Homo sapiens
gcaaauaaguggucaacuc

SEQ ID NO: 152825 - RNA, 19 nt, Homo sapiens
ggauaaaugugucaucaau

SEQ ID NO: 152826 - RNA, 19 nt, Homo sapiens
gaugugggcuggaaaucua

SEQ ID NO: 152827 - RNA, 19 nt, Homo sapiens
ccaaaugucuaugaacuaa

SEQ ID NO: 152828 - RNA, 19 nt, Homo sapiens
gauucagucuuccagauua

SEQ ID NO: 152829 - RNA, 19 nt, Homo sapiens
ucaggcauauuucuuguua

SEQ ID NO: 152830 - RNA, 19 nt, Homo sapiens
ccaauucugugauagagua

SEQ ID NO: 152831 - RNA, 19 nt, Homo sapiens
caucuaaccuucuaggauu

SEQ ID NO: 152832 - RNA, 19 nt, Homo sapiens
gaugauaaccucugucuug

SEQ ID NO: 152833 - RNA, 19 nt, Homo sapiens
guacaggauucaucuaaug

SEQ ID NO: 152834 - RNA, 19 nt, Homo sapiens
gauuaugccucacaugcua

SEQ ID NO: 152835 - RNA, 19 nt, Homo sapiens
ggucuuuccucuucuguuu

SEQ ID NO: 152836 - RNA, 19 nt, Homo sapiens
ugaaagaggcucaggcaua

SEQ ID NO: 152837 - RNA, 19 nt, Homo sapiens
aggaggagcuguuucuaua

SEQ ID NO: 152838 - RNA, 19 nt, Homo sapiens
gaaaguaguaagucguuaa

SEQ ID NO: 152839 - RNA, 19 nt, Homo sapiens
gaaaggaaagcaaauaagu

SEQ ID NO: 152840 - RNA, 19 nt, Homo sapiens
gcagcuaagucauacauuc

SEQ ID NO: 152841 - RNA, 19 nt, Homo sapiens
caaguuggcuuaccagaag

SEQ ID NO: 152842 - RNA, 19 nt, Homo sapiens
uaaaugcagcuaagucaua

SEQ ID NO: 152843 - RNA, 19 nt, Homo sapiens
gcaugaacuugugugaaua

SEQ ID NO: 152844 - RNA, 19 nt, Homo sapiens
gaaggagcuugguggugua

SEQ ID NO: 152845 - RNA, 19 nt, Homo sapiens
guacaggauuucuuuaugg

SEQ ID NO: 152846 - RNA, 19 nt, Homo sapiens
gcacuugacuuaauuaccu

SEQ ID NO: 152847 - RNA, 19 nt, Homo sapiens
caaaucugguauauccaua

SEQ ID NO: 152848 - RNA, 19 nt, Homo sapiens
gaaauacagagaaaugaga

SEQ ID NO: 152849 - RNA, 19 nt, Homo sapiens
guaaauaaaugggcugaag

SEQ ID NO: 152850 - RNA, 19 nt, Homo sapiens
caacccaaaugucuaugaa

SEQ ID NO: 152851 - RNA, 19 nt, Homo sapiens
cuagagaaauugcagaaau

SEQ ID NO: 152852 - RNA, 19 nt, Homo sapiens
gguaaggguugguaucaau

SEQ ID NO: 152853 - RNA, 19 nt, Homo sapiens
ggucuuugcugaacucuca

SEQ ID NO: 152854 - RNA, 19 nt, Homo sapiens
uaagggaacugaguacuuc

SEQ ID NO: 152855 - RNA, 19 nt, Homo sapiens
gugcaaaccagaagcauuu

SEQ ID NO: 152856 - RNA, 19 nt, Homo sapiens
cuugaacgcugcuuauauu

SEQ ID NO: 152857 - RNA, 19 nt, Homo sapiens
gcuuggugguguagauuua

SEQ ID NO: 152858 - RNA, 19 nt, Homo sapiens
ucagagaguuucagaucaa

SEQ ID NO: 152859 - RNA, 19 nt, Homo sapiens
gauuaaaguucugauggaa

SEQ ID NO: 152860 - RNA, 19 nt, Homo sapiens
gguacaggauuucuuuaug

SEQ ID NO: 152861 - RNA, 19 nt, Homo sapiens
ucuaauggguacaggauuu

SEQ ID NO: 152862 - RNA, 19 nt, Homo sapiens
acaagccucugugauguua

SEQ ID NO: 152863 - RNA, 19 nt, Homo sapiens
gaugaaauacagagaaaug

SEQ ID NO: 152864 - RNA, 19 nt, Homo sapiens
ggagccaagugacuaucua

SEQ ID NO: 152865 - RNA, 19 nt, Homo sapiens
gaggagcuguuucuauauc

SEQ ID NO: 152866 - RNA, 19 nt, Homo sapiens
gaauacaacccaaaugucu

SEQ ID NO: 152867 - RNA, 19 nt, Homo sapiens
gauguuauccuucauugug

SEQ ID NO: 152868 - RNA, 19 nt, Homo sapiens
gcuaagucauacauucauu

SEQ ID NO: 152869 - RNA, 19 nt, Homo sapiens
gauaaaugcagcuaaguca

SEQ ID NO: 152870 - RNA, 19 nt, Homo sapiens
gaagcaguauuugaggaaa

SEQ ID NO: 152871 - RNA, 19 nt, Homo sapiens
gcuagcaacugcaaacaag

SEQ ID NO: 152872 - RNA, 19 nt, Homo sapiens
guucuaugcuuccacaguu

SEQ ID NO: 152873 - RNA, 19 nt, Homo sapiens
gaguacaggauucaucuaa

SEQ ID NO: 152874 - RNA, 19 nt, Homo sapiens
ccuaggacauuuggccuua

SEQ ID NO: 152875 - RNA, 19 nt, Homo sapiens
gugggugaauuauauggua

SEQ ID NO: 152876 - RNA, 19 nt, Homo sapiens
ugacaagccucugugaugu

SEQ ID NO: 152877 - RNA, 19 nt, Homo sapiens
uaacgacucuaauggucaa

SEQ ID NO: 152878 - RNA, 19 nt, Homo sapiens
ggacauguaguagaugaaa

SEQ ID NO: 152879 - RNA, 19 nt, Homo sapiens
uaaaagccauugugauuug

SEQ ID NO: 152880 - RNA, 19 nt, Homo sapiens
ccacuaccauugccacugu

SEQ ID NO: 152881 - RNA, 19 nt, Homo sapiens
gaggcauugucauuucuuu

SEQ ID NO: 152882 - RNA, 19 nt, Homo sapiens
uggaaaugguugaaucuug

SEQ ID NO: 152883 - RNA, 19 nt, Homo sapiens
caaaguaagauuguucuga

SEQ ID NO: 152884 - RNA, 19 nt, Homo sapiens
gaacgcugcuuauauucac

SEQ ID NO: 152885 - RNA, 19 nt, Homo sapiens
gaugugcucugugaauuag

SEQ ID NO: 152886 - RNA, 19 nt, Homo sapiens
uagaucaggugcuggaaga

SEQ ID NO: 152887 - RNA, 19 nt, Homo sapiens
gaauguugaauccuuacua

SEQ ID NO: 152888 - RNA, 19 nt, Homo sapiens
gaaggaggaggagcuguuu

SEQ ID NO: 152889 - RNA, 19 nt, Homo sapiens
guaauggucacauaacaau

SEQ ID NO: 152890 - RNA, 19 nt, Homo sapiens
cuucuaggauuucccaauu

SEQ ID NO: 152891 - RNA, 19 nt, Homo sapiens
uggcaagccuuuccucuuc

SEQ ID NO: 152892 - RNA, 19 nt, Homo sapiens
aaagacaguuggaaauugg

SEQ ID NO: 152893 - RNA, 19 nt, Homo sapiens
uacauacacucaacaaaca

SEQ ID NO: 152894 - RNA, 19 nt, Homo sapiens
guaaggguugguaucaaua

SEQ ID NO: 152895 - RNA, 19 nt, Homo sapiens
ggaagaguuugguuuuaaa

SEQ ID NO: 152896 - RNA, 19 nt, Homo sapiens
ugguguagauuuagucauu

SEQ ID NO: 152897 - RNA, 19 nt, Homo sapiens
cacauaguauugaucagaa

SEQ ID NO: 152898 - RNA, 19 nt, Homo sapiens
guugaauccuuacuacaau

SEQ ID NO: 152899 - RNA, 19 nt, Homo sapiens
gcucagagaguuucagauc

SEQ ID NO: 152900 - RNA, 19 nt, Homo sapiens
gcaaaacccugucucuaca

SEQ ID NO: 152901 - RNA, 19 nt, Homo sapiens
ucacacacauaguauugau

SEQ ID NO: 152902 - RNA, 19 nt, Homo sapiens
guucugaaauacaaagcaa

SEQ ID NO: 152903 - RNA, 19 nt, Homo sapiens
aaucgaauguugaauccuu

SEQ ID NO: 152904 - RNA, 19 nt, Homo sapiens
ggaaucgaauguugaaucc

SEQ ID NO: 152905 - RNA, 19 nt, Homo sapiens
uugaugagauugcuucuuc

SEQ ID NO: 152906 - RNA, 19 nt, Homo sapiens
gaggaggagcuguuucuau

SEQ ID NO: 152907 - RNA, 19 nt, Homo sapiens
gcugggcauucuagauaaa

SEQ ID NO: 152908 - RNA, 19 nt, Homo sapiens
aagcugggcauucuagaua

SEQ ID NO: 152909 - RNA, 19 nt, Homo sapiens
ugauuaaaguucugaugga

SEQ ID NO: 152910 - RNA, 19 nt, Homo sapiens
ugcaugaacuugugugaau

SEQ ID NO: 152911 - RNA, 19 nt, Homo sapiens
cuucagcccuggauguuga

SEQ ID NO: 152912 - RNA, 19 nt, Homo sapiens
gaggaaaugagccugaaga

SEQ ID NO: 152913 - RNA, 19 nt, Homo sapiens
auucagagcuugcccaaca

SEQ ID NO: 152914 - RNA, 19 nt, Homo sapiens
gaaacauggccgaguauac

SEQ ID NO: 152915 - RNA, 19 nt, Homo sapiens
guaagggaacugaguacuu

SEQ ID NO: 152916 - RNA, 19 nt, Homo sapiens
gacaagccauuggguagga

SEQ ID NO: 152917 - RNA, 19 nt, Homo sapiens
aggcauauuucuuguuaga

SEQ ID NO: 152918 - RNA, 19 nt, Homo sapiens
guaaagagguuaugucaca

SEQ ID NO: 152919 - RNA, 19 nt, Homo sapiens
auaaauaccucggacauua

SEQ ID NO: 152920 - RNA, 19 nt, Homo sapiens
aaagagaacugguauucaa

SEQ ID NO: 152921 - RNA, 19 nt, Homo sapiens
gcaggaguaugcucaggua

SEQ ID NO: 152922 - RNA, 19 nt, Homo sapiens
aaagcagacugauuuguuu

SEQ ID NO: 152923 - RNA, 19 nt, Homo sapiens
gaaauucaguuugaugaca

SEQ ID NO: 152924 - RNA, 19 nt, Homo sapiens
gaaugagaaugaaucugaa

SEQ ID NO: 152925 - RNA, 19 nt, Homo sapiens
gauauucccuugagauuuu

SEQ ID NO: 152926 - RNA, 19 nt, Homo sapiens
gagaacugguauucaaaga

SEQ ID NO: 152927 - RNA, 19 nt, Homo sapiens
gcccuggccucuugaugua

SEQ ID NO: 152928 - RNA, 19 nt, Homo sapiens
gcugaauuaucuuaaguga

SEQ ID NO: 152929 - RNA, 19 nt, Homo sapiens
gcaggcggaucucugaaga

SEQ ID NO: 152930 - RNA, 19 nt, Homo sapiens
ggaaauggacggcuagaag

SEQ ID NO: 152931 - RNA, 19 nt, Homo sapiens
ggaguaugcucagguaauc

SEQ ID NO: 152932 - RNA, 19 nt, Homo sapiens
gaccaugucuacuaauuac

SEQ ID NO: 152933 - RNA, 19 nt, Homo sapiens
uaaagcagacugauuuguu

SEQ ID NO: 152934 - RNA, 19 nt, Homo sapiens
gcagacugauuuguuucua

SEQ ID NO: 152935 - RNA, 19 nt, Homo sapiens
gaagucugcaguugaagaa

SEQ ID NO: 152936 - RNA, 19 nt, Homo sapiens
gauaacaaagcugauguaa

SEQ ID NO: 152937 - RNA, 19 nt, Homo sapiens
agaaugagaaugaaucuga

SEQ ID NO: 152938 - RNA, 19 nt, Homo sapiens
cagacugauuuguuucuaa

SEQ ID NO: 152939 - RNA, 19 nt, Homo sapiens
uuaaguagccugugcguau

SEQ ID NO: 152940 - RNA, 19 nt, Homo sapiens
uggagaugaugaugaaauu

SEQ ID NO: 152941 - RNA, 19 nt, Homo sapiens
ggauaacaaagcugaugua

SEQ ID NO: 152942 - RNA, 19 nt, Homo sapiens
uaaguagccugugcguauu

SEQ ID NO: 152943 - RNA, 19 nt, Homo sapiens
gagacuaccaggauaacaa

SEQ ID NO: 152944 - RNA, 19 nt, Homo sapiens
gauaaauaccucggacauu

SEQ ID NO: 152945 - RNA, 19 nt, Homo sapiens
gcccaagaauaaagguaaa

SEQ ID NO: 152946 - RNA, 19 nt, Homo sapiens
uaagcccacuuuguucuuu

SEQ ID NO: 152947 - RNA, 19 nt, Homo sapiens
uguuaaagcagacugauuu

SEQ ID NO: 152948 - RNA, 19 nt, Homo sapiens
ccaccgccaugcccaagaa

SEQ ID NO: 152949 - RNA, 19 nt, Homo sapiens
gaaugcaauuuguuaaagc

SEQ ID NO: 152950 - RNA, 19 nt, Homo sapiens
guaagaaugagaaugaauc

SEQ ID NO: 152951 - RNA, 19 nt, Homo sapiens
uguauagagucauggauau

SEQ ID NO: 152952 - RNA, 19 nt, Homo sapiens
gauguuaagcccacuuugu

SEQ ID NO: 152953 - RNA, 19 nt, Homo sapiens
gaucaugacaaagaagauu

SEQ ID NO: 152954 - RNA, 19 nt, Homo sapiens
ccuggccucuugauguaua

SEQ ID NO: 152955 - RNA, 19 nt, Homo sapiens
uaaauaccucggacauuau

SEQ ID NO: 152956 - RNA, 19 nt, Homo sapiens
ucaguuugaugacauugga

SEQ ID NO: 152957 - RNA, 19 nt, Homo sapiens
ggauaaauaccucggacau

SEQ ID NO: 152958 - RNA, 19 nt, Homo sapiens
auuaagcccuggccucuug

SEQ ID NO: 152959 - RNA, 19 nt, Homo sapiens
gagauguuaagcccacuuu

SEQ ID NO: 152960 - RNA, 19 nt, Homo sapiens
ccaguuaccuagauauucc

SEQ ID NO: 152961 - RNA, 19 nt, Homo sapiens
agacugauuuguuucuaag

SEQ ID NO: 152962 - RNA, 19 nt, Homo sapiens
ggguaagaaugagaaugaa

SEQ ID NO: 152963 - RNA, 19 nt, Homo sapiens
uagauauucccuugagauu

SEQ ID NO: 152964 - RNA, 19 nt, Homo sapiens
gauauuccaguuaccuaga

SEQ ID NO: 152965 - RNA, 19 nt, Homo sapiens
caagaauaaagguaaagga

SEQ ID NO: 152966 - RNA, 19 nt, Homo sapiens
ccgccaugcccaagaauaa

SEQ ID NO: 152967 - RNA, 19 nt, Homo sapiens
gaugaugaagauauugaug

SEQ ID NO: 152968 - RNA, 19 nt, Homo sapiens
guguuucgaugguguaaag

SEQ ID NO: 152969 - RNA, 19 nt, Homo sapiens
guauagagucauggauauu

SEQ ID NO: 152970 - RNA, 19 nt, Homo sapiens
aaaauacaaugcagacgaa

SEQ ID NO: 152971 - RNA, 19 nt, Homo sapiens
gguaagaaugagaaugaau

SEQ ID NO: 152972 - RNA, 19 nt, Homo sapiens
caaugcagacgaagcuaga

SEQ ID NO: 152973 - RNA, 19 nt, Homo sapiens
ggcuagaagcaauguguuu

SEQ ID NO: 152974 - RNA, 19 nt, Homo sapiens
ccacuuuguucuuuuaaug

SEQ ID NO: 152975 - RNA, 19 nt, Homo sapiens
agacuaccaggauaacaaa

SEQ ID NO: 152976 - RNA, 19 nt, Homo sapiens
guguaaagagguuauguca

SEQ ID NO: 152977 - RNA, 19 nt, Homo sapiens
ccaugucuacuaauuacaa

SEQ ID NO: 152978 - RNA, 19 nt, Homo sapiens
uauuccaguuaccuagaua

SEQ ID NO: 152979 - RNA, 19 nt, Homo sapiens
gagcuuauggguagaagac

SEQ ID NO: 152980 - RNA, 19 nt, Homo sapiens
gcuagaagcaauguguuuc

SEQ ID NO: 152981 - RNA, 19 nt, Homo sapiens
ccuaccacuuccaguaaga

SEQ ID NO: 152982 - RNA, 19 nt, Homo sapiens
uaaagguaaaggagguaaa

SEQ ID NO: 152983 - RNA, 19 nt, Homo sapiens
ugaaacugauacauuuggu

SEQ ID NO: 152984 - RNA, 19 nt, Homo sapiens
cuccgagacuaccaggaua

SEQ ID NO: 152985 - RNA, 19 nt, Homo sapiens
uagaagcaauguguuucga

SEQ ID NO: 152986 - RNA, 19 nt, Homo sapiens
guuaaagcagacugauuug

SEQ ID NO: 152987 - RNA, 19 nt, Homo sapiens
uguccuacaauuuggauuu

SEQ ID NO: 152988 - RNA, 19 nt, Homo sapiens
ugaugaagauauugaugac

SEQ ID NO: 152989 - RNA, 19 nt, Homo sapiens
uccuggagaugaugaugaa

SEQ ID NO: 152990 - RNA, 19 nt, Homo sapiens
gagcuuccagagcaugcua

SEQ ID NO: 152991 - RNA, 19 nt, Homo sapiens
gacgcaggcggaucucuga

SEQ ID NO: 152992 - RNA, 19 nt, Homo sapiens
aagaggaugggcaggagua

SEQ ID NO: 152993 - RNA, 19 nt, Homo sapiens
gcagacgaagcuagaaguc

SEQ ID NO: 152994 - RNA, 19 nt, Homo sapiens
ucgaugguguaaagagguu

SEQ ID NO: 152995 - RNA, 19 nt, Homo sapiens
cuagauauucccuugagau

SEQ ID NO: 152996 - RNA, 19 nt, Homo sapiens
gggguaagaaugagaauga

SEQ ID NO: 152997 - RNA, 19 nt, Homo sapiens
uauagagucauggauauuc

SEQ ID NO: 152998 - RNA, 19 nt, Homo sapiens
cuugauguauagagucaug

SEQ ID NO: 152999 - RNA, 19 nt, Homo sapiens
ggagaugaugaugaaauuc

SEQ ID NO: 153000 - RNA, 19 nt, Homo sapiens
aagagaacugguauucaaa

SEQ ID NO: 153001 - RNA, 19 nt, Homo sapiens
ugccuugucucacggaauc

SEQ ID NO: 153002 - RNA, 19 nt, Homo sapiens
agauauucccuugagauuu

SEQ ID NO: 153003 - RNA, 19 nt, Homo sapiens
ccuagauauucccuugaga

SEQ ID NO: 153004 - RNA, 19 nt, Homo sapiens
gggaaauggacggcuagaa

SEQ ID NO: 153005 - RNA, 19 nt, Homo sapiens
ggacggcuagaagcaaugu

SEQ ID NO: 153006 - RNA, 19 nt, Homo sapiens
gaaaugcccuccuaaaugu

SEQ ID NO: 153007 - RNA, 19 nt, Homo sapiens
gaaacagaguccaauuuaa

SEQ ID NO: 153008 - RNA, 19 nt, Homo sapiens
ggaaacagaguccaauuua

SEQ ID NO: 153009 - RNA, 19 nt, Homo sapiens
gggaaguacucauuaauaa

SEQ ID NO: 153010 - RNA, 19 nt, Homo sapiens
gaacaggcuuggcaaagaa

SEQ ID NO: 153011 - RNA, 19 nt, Homo sapiens
gaacgggaaguacucauua

SEQ ID NO: 153012 - RNA, 19 nt, Homo sapiens
gagcuccaguucuuuauaa

SEQ ID NO: 153013 - RNA, 19 nt, Homo sapiens
agccaaagcugaagauuaa

SEQ ID NO: 153014 - RNA, 19 nt, Homo sapiens
uuagaaagcuggcaacaug

SEQ ID NO: 153015 - RNA, 19 nt, Homo sapiens
gaaccuggauguacuuaag

SEQ ID NO: 153016 - RNA, 19 nt, Homo sapiens
uaaaggaucucuauaacag

SEQ ID NO: 153017 - RNA, 19 nt, Homo sapiens
gcaaacaaucccaaucuuu

SEQ ID NO: 153018 - RNA, 19 nt, Homo sapiens
caagagaccuggauauggu

SEQ ID NO: 153019 - RNA, 19 nt, Homo sapiens
uaacagaucagaacaugaa

SEQ ID NO: 153020 - RNA, 19 nt, Homo sapiens
gcaaagaaguaaguuuauc

SEQ ID NO: 153021 - RNA, 19 nt, Homo sapiens
gcaugauucuucuuaguga

SEQ ID NO: 153022 - RNA, 19 nt, Homo sapiens
gggaauauguagaggagaa

SEQ ID NO: 153023 - RNA, 19 nt, Homo sapiens
gaaguggcuuguuaugguu

SEQ ID NO: 153024 - RNA, 19 nt, Homo sapiens
cuacuugccuugaguuuau

SEQ ID NO: 153025 - RNA, 19 nt, Homo sapiens
gguggaagauguagugaug

SEQ ID NO: 153026 - RNA, 19 nt, Homo sapiens
ggagaggcuugaaagagaa

SEQ ID NO: 153027 - RNA, 19 nt, Homo sapiens
gagcagguuugaauuguuc

SEQ ID NO: 153028 - RNA, 19 nt, Homo sapiens
uauaacaggugcuucuuug

SEQ ID NO: 153029 - RNA, 19 nt, Homo sapiens
agacuagacuacucaauau

SEQ ID NO: 153030 - RNA, 19 nt, Homo sapiens
uugcugagguguuagaaua

SEQ ID NO: 153031 - RNA, 19 nt, Homo sapiens
ugagguaccaguuguauuu

SEQ ID NO: 153032 - RNA, 19 nt, Homo sapiens
cagugaaaguugacccuua

SEQ ID NO: 153033 - RNA, 19 nt, Homo sapiens
cacaguagcuccaacacuu

SEQ ID NO: 153034 - RNA, 19 nt, Homo sapiens
ugaaaugcccuccuaaaug

SEQ ID NO: 153035 - RNA, 19 nt, Homo sapiens
cugaauaacuugaagaaca

SEQ ID NO: 153036 - RNA, 19 nt, Homo sapiens
ggauggagaugaugaugca

SEQ ID NO: 153037 - RNA, 19 nt, Homo sapiens
auauugaaguggcuuguua

SEQ ID NO: 153038 - RNA, 19 nt, Homo sapiens
uggcaaagaaguaaguuua

SEQ ID NO: 153039 - RNA, 19 nt, Homo sapiens
uguaggagcaggugaauaa

SEQ ID NO: 153040 - RNA, 19 nt, Homo sapiens
aaacaugcccauuaagauu

SEQ ID NO: 153041 - RNA, 19 nt, Homo sapiens
caacaaacucauccgaauu

SEQ ID NO: 153042 - RNA, 19 nt, Homo sapiens
ucaacaaacucauccgaau

SEQ ID NO: 153043 - RNA, 19 nt, Homo sapiens
caaacaaucccaaucuuuc

SEQ ID NO: 153044 - RNA, 19 nt, Homo sapiens
gggaaacagaguccaauuu

SEQ ID NO: 153045 - RNA, 19 nt, Homo sapiens
ugaaguggcuuguuauggu

SEQ ID NO: 153046 - RNA, 19 nt, Homo sapiens
gcaaucaaaugugaagaca

SEQ ID NO: 153047 - RNA, 19 nt, Homo sapiens
gaugacaaccugugugaga

SEQ ID NO: 153048 - RNA, 19 nt, Homo sapiens
uaaccacagugaaaguuga

SEQ ID NO: 153049 - RNA, 19 nt, Homo sapiens
cgaaguggauggagaugau

SEQ ID NO: 153050 - RNA, 19 nt, Homo sapiens
gaagaacaggcuuggcaaa

SEQ ID NO: 153051 - RNA, 19 nt, Homo sapiens
cauaugaggacaagguaua

SEQ ID NO: 153052 - RNA, 19 nt, Homo sapiens
ggacaaagccuuaaaaugc

SEQ ID NO: 153053 - RNA, 19 nt, Homo sapiens
cagaaaacaugcccauuaa

SEQ ID NO: 153054 - RNA, 19 nt, Homo sapiens
caacauugaaggcaugauu

SEQ ID NO: 153055 - RNA, 19 nt, Homo sapiens
uggagaggcuugaaagaga

SEQ ID NO: 153056 - RNA, 19 nt, Homo sapiens
uagaauacaccaaggauga

SEQ ID NO: 153057 - RNA, 19 nt, Homo sapiens
ucauguugcugagguguua

SEQ ID NO: 153058 - RNA, 19 nt, Homo sapiens
gcagggacaagauacauau

SEQ ID NO: 153059 - RNA, 19 nt, Homo sapiens
caucauuucugucuuuaag

SEQ ID NO: 153060 - RNA, 19 nt, Homo sapiens
ucacacacauaccucagaa

SEQ ID NO: 153061 - RNA, 19 nt, Homo sapiens
ccaaaguggucacagauac

SEQ ID NO: 153062 - RNA, 19 nt, Homo sapiens
gaaaacaugcccauuaaga

SEQ ID NO: 153063 - RNA, 19 nt, Homo sapiens
ggaauacaacaacauugaa

SEQ ID NO: 153064 - RNA, 19 nt, Homo sapiens
ucauuaggguggacaaaga

SEQ ID NO: 153065 - RNA, 19 nt, Homo sapiens
gaaggcguauccguucuau

SEQ ID NO: 153066 - RNA, 19 nt, Homo sapiens
aagacuagacuacucaaua

SEQ ID NO: 153067 - RNA, 19 nt, Homo sapiens
gguaacacauuauauucuc

SEQ ID NO: 153068 - RNA, 19 nt, Homo sapiens
caaccugugugagagaauu

SEQ ID NO: 153069 - RNA, 19 nt, Homo sapiens
aagcaagucuggucucugu

SEQ ID NO: 153070 - RNA, 19 nt, Homo sapiens
gcaagucuggucucuguga

SEQ ID NO: 153071 - RNA, 19 nt, Homo sapiens
uaagagcagguuugaauug

SEQ ID NO: 153072 - RNA, 19 nt, Homo sapiens
caaaagccauaacuugaaa

SEQ ID NO: 153073 - RNA, 19 nt, Homo sapiens
gagagugccaugauugcua

SEQ ID NO: 153074 - RNA, 19 nt, Homo sapiens
ucauuucacuagagacaaa

SEQ ID NO: 153075 - RNA, 19 nt, Homo sapiens
aaacagaguccaauuuaag

SEQ ID NO: 153076 - RNA, 19 nt, Homo sapiens
cgggaaguacucauuaaua

SEQ ID NO: 153077 - RNA, 19 nt, Homo sapiens
caaaugugaagacaaauuc

SEQ ID NO: 153078 - RNA, 19 nt, Homo sapiens
gccagagaauagaucagua

SEQ ID NO: 153079 - RNA, 19 nt, Homo sapiens
uaaagggucuggaaaauag

SEQ ID NO: 153080 - RNA, 19 nt, Homo sapiens
gguaccaguuguauuuaau

SEQ ID NO: 153081 - RNA, 19 nt, Homo sapiens
cuagagcuccaguucuuua

SEQ ID NO: 153082 - RNA, 19 nt, Homo sapiens
guaaauccuagacuugaaa

SEQ ID NO: 153083 - RNA, 19 nt, Homo sapiens
gagaugaugaugcagaaga

SEQ ID NO: 153084 - RNA, 19 nt, Homo sapiens
ccuaagagcagguuugaau

SEQ ID NO: 153085 - RNA, 19 nt, Homo sapiens
aggaagcaaucaaauguga

SEQ ID NO: 153086 - RNA, 19 nt, Homo sapiens
agaacaggcuuggcaaaga

SEQ ID NO: 153087 - RNA, 19 nt, Homo sapiens
ggcaaacaaucccaaucuu

SEQ ID NO: 153088 - RNA, 19 nt, Homo sapiens
guacaagagaccuggauau

SEQ ID NO: 153089 - RNA, 19 nt, Homo sapiens
uagccagcauuccauauug

SEQ ID NO: 153090 - RNA, 19 nt, Homo sapiens
gugaauaaaggaucucuau

SEQ ID NO: 153091 - RNA, 19 nt, Homo sapiens
caaucccaaucuuucuaua

SEQ ID NO: 153092 - RNA, 19 nt, Homo sapiens
uaagggaguggccucauuu

SEQ ID NO: 153093 - RNA, 19 nt, Homo sapiens
acuuaagaguggcauauaa

SEQ ID NO: 153094 - RNA, 19 nt, Homo sapiens
ucacaccacguccuuauug

SEQ ID NO: 153095 - RNA, 19 nt, Homo sapiens
gcaggugaauaaaggaucu

SEQ ID NO: 153096 - RNA, 19 nt, Homo sapiens
uuaagggaguggccucauu

SEQ ID NO: 153097 - RNA, 19 nt, Homo sapiens
aagccaaagcugaagauua

SEQ ID NO: 153098 - RNA, 19 nt, Homo sapiens
ggaaugagugugugguugu

SEQ ID NO: 153099 - RNA, 19 nt, Homo sapiens
ucacuagagacaaaucuuu

SEQ ID NO: 153100 - RNA, 19 nt, Homo sapiens
ggucacagauacagaugag

SEQ ID NO: 153101 - RNA, 19 nt, Homo sapiens
ggucuuugaugacaaguac

SEQ ID NO: 153102 - RNA, 19 nt, Homo sapiens
ugaauaacuugaagaacag

SEQ ID NO: 153103 - RNA, 19 nt, Homo sapiens
gacccuagccagagaauag

SEQ ID NO: 153104 - RNA, 19 nt, Homo sapiens
uggcgucgauggugaguga

SEQ ID NO: 153105 - RNA, 19 nt, Homo sapiens
gccuugaguuuauaauuca

SEQ ID NO: 153106 - RNA, 19 nt, Homo sapiens
gaaagcagaucuugucaua

SEQ ID NO: 153107 - RNA, 19 nt, Homo sapiens
gaacaaaccuuucuaugug

SEQ ID NO: 153108 - RNA, 19 nt, Homo sapiens
gaaagaagauccugacaug

SEQ ID NO: 153109 - RNA, 19 nt, Homo sapiens
gaauaucacugucaagaaa

SEQ ID NO: 153110 - RNA, 19 nt, Homo sapiens
gaaaaugccuucuggaaua

SEQ ID NO: 153111 - RNA, 19 nt, Homo sapiens
gaaccuuucuuacucauuu

SEQ ID NO: 153112 - RNA, 19 nt, Homo sapiens
cuacuuaacugaugaaaga

SEQ ID NO: 153113 - RNA, 19 nt, Homo sapiens
gcagaucugugccauacuu

SEQ ID NO: 153114 - RNA, 19 nt, Homo sapiens
gaaaacggaggaauuauua

SEQ ID NO: 153115 - RNA, 19 nt, Homo sapiens
ggacguugcuggaguucuu

SEQ ID NO: 153116 - RNA, 19 nt, Homo sapiens
gacaaggaguuaauugaau

SEQ ID NO: 153117 - RNA, 19 nt, Homo sapiens
gaagauuuauggaguaagg

SEQ ID NO: 153118 - RNA, 19 nt, Homo sapiens
aagaagcgauuuaguguau

SEQ ID NO: 153119 - RNA, 19 nt, Homo sapiens
ggaucaagccaaacaguaa

SEQ ID NO: 153120 - RNA, 19 nt, Homo sapiens
aaucauacaucuuggagaa

SEQ ID NO: 153121 - RNA, 19 nt, Homo sapiens
ucaucaagcucuaucugua

SEQ ID NO: 153122 - RNA, 19 nt, Homo sapiens
gagauguguuuaaugaaga

SEQ ID NO: 153123 - RNA, 19 nt, Homo sapiens
ggagaaagcagaucuuguc

SEQ ID NO: 153124 - RNA, 19 nt, Homo sapiens
acugagauguguuuaauga

SEQ ID NO: 153125 - RNA, 19 nt, Homo sapiens
aagcagaucuugucauagu

SEQ ID NO: 153126 - RNA, 19 nt, Homo sapiens
gagaauaucacugucaaga

SEQ ID NO: 153127 - RNA, 19 nt, Homo sapiens
guccggcucuuuccacuaa

SEQ ID NO: 153128 - RNA, 19 nt, Homo sapiens
gaagcgauuuaguguauac

SEQ ID NO: 153129 - RNA, 19 nt, Homo sapiens
cugcaugguucacugcuua

SEQ ID NO: 153130 - RNA, 19 nt, Homo sapiens
gagcgacaauauugacuca

SEQ ID NO: 153131 - RNA, 19 nt, Homo sapiens
cgacaaggaguuaauugaa

SEQ ID NO: 153132 - RNA, 19 nt, Homo sapiens
cagcaagacgucccagaua

SEQ ID NO: 153133 - RNA, 19 nt, Homo sapiens
ucauuucagucccaucuaa

SEQ ID NO: 153134 - RNA, 19 nt, Homo sapiens
cuuaaucacucugcuguuu

SEQ ID NO: 153135 - RNA, 19 nt, Homo sapiens
ggacgccuauggacgacaa

SEQ ID NO: 153136 - RNA, 19 nt, Homo sapiens
ccaagaagcgauuuagugu

SEQ ID NO: 153137 - RNA, 19 nt, Homo sapiens
gaucaagccaaacaguaaa

SEQ ID NO: 153138 - RNA, 19 nt, Homo sapiens
aagaaacacuugccgaauc

SEQ ID NO: 153139 - RNA, 19 nt, Homo sapiens
ugagauguguuuaaugaag

SEQ ID NO: 153140 - RNA, 19 nt, Homo sapiens
aaagauggagcgacaauau

SEQ ID NO: 153141 - RNA, 19 nt, Homo sapiens
gaaauucuguauguguaag

SEQ ID NO: 153142 - RNA, 19 nt, Homo sapiens
cugaaauucuguaugugua

SEQ ID NO: 153143 - RNA, 19 nt, Homo sapiens
agcaagacgucccagauaa

SEQ ID NO: 153144 - RNA, 19 nt, Homo sapiens
caucaagcucuaucuguaa

SEQ ID NO: 153145 - RNA, 19 nt, Homo sapiens
ggaggaauuauuaacaaga

SEQ ID NO: 153146 - RNA, 19 nt, Homo sapiens
ugucauaguuggugcugaa

SEQ ID NO: 153147 - RNA, 19 nt, Homo sapiens
caagaagcgauuuagugua

SEQ ID NO: 153148 - RNA, 19 nt, Homo sapiens
gaaacaaaauugcagaucu

SEQ ID NO: 153149 - RNA, 19 nt, Homo sapiens
gcagaucuugucauaguug

SEQ ID NO: 153150 - RNA, 19 nt, Homo sapiens
ggacgacaaggaguuaauu

SEQ ID NO: 153151 - RNA, 19 nt, Homo sapiens
uaaauauguuuggguccua

SEQ ID NO: 153152 - RNA, 19 nt, Homo sapiens
auaauuggcuacuuaacug

SEQ ID NO: 153153 - RNA, 19 nt, Homo sapiens
ugugucagcuauucuaaau

SEQ ID NO: 153154 - RNA, 19 nt, Homo sapiens
ccaaggugcagcuuacgua

SEQ ID NO: 153155 - RNA, 19 nt, Homo sapiens
cauaguuggugcugaagga

SEQ ID NO: 153156 - RNA, 19 nt, Homo sapiens
gugccauacuuucaucaaa

SEQ ID NO: 153157 - RNA, 19 nt, Homo sapiens
gauaauuggcuacuuaacu

SEQ ID NO: 153158 - RNA, 19 nt, Homo sapiens
agacgucccagauaaguuu

SEQ ID NO: 153159 - RNA, 19 nt, Homo sapiens
cagagucacagccugauuu

SEQ ID NO: 153160 - RNA, 19 nt, Homo sapiens
gccaagaagcgauuuagug

SEQ ID NO: 153161 - RNA, 19 nt, Homo sapiens
ucagcaggaucaagccaaa

SEQ ID NO: 153162 - RNA, 19 nt, Homo sapiens
agucucagaugaaagaaga

SEQ ID NO: 153163 - RNA, 19 nt, Homo sapiens
gaucugugccauacuuuca

SEQ ID NO: 153164 - RNA, 19 nt, Homo sapiens
agaaacacuugccgaaucu

SEQ ID NO: 153165 - RNA, 19 nt, Homo sapiens
cuuaacugaugaaagauga

SEQ ID NO: 153166 - RNA, 19 nt, Homo sapiens
caaagauggagcgacaaua

SEQ ID NO: 153167 - RNA, 19 nt, Homo sapiens
gcaagacgucccagauaag

SEQ ID NO: 153168 - RNA, 19 nt, Homo sapiens
auacuccgauuacuccaaa

SEQ ID NO: 153169 - RNA, 19 nt, Homo sapiens
uuaagucucagaugaaaga

SEQ ID NO: 153170 - RNA, 19 nt, Homo sapiens
ucccagauaaguuuaagua

SEQ ID NO: 153171 - RNA, 19 nt, Homo sapiens
ccagagugguccugagagu

SEQ ID NO: 153172 - RNA, 19 nt, Homo sapiens
ucucaccagugccauagaa

SEQ ID NO: 153173 - RNA, 19 nt, Homo sapiens
uuaaucacucugcuguuua

SEQ ID NO: 153174 - RNA, 19 nt, Homo sapiens
uccgauuacuccaaaugua

SEQ ID NO: 153175 - RNA, 19 nt, Homo sapiens
aaauauguuuggguccuaa

SEQ ID NO: 153176 - RNA, 19 nt, Homo sapiens
uaaucacucugcuguuuac

SEQ ID NO: 153177 - RNA, 19 nt, Homo sapiens
aagcacagaacaaaccuuu

SEQ ID NO: 153178 - RNA, 19 nt, Homo sapiens
gauggagcgacaauauuga

SEQ ID NO: 153179 - RNA, 19 nt, Homo sapiens
aaauuguucuuacgguuuc

SEQ ID NO: 153180 - RNA, 19 nt, Homo sapiens
ccucagcagucagcgauga

SEQ ID NO: 153181 - RNA, 19 nt, Homo sapiens
acggaggaauuauuaacaa

SEQ ID NO: 153182 - RNA, 19 nt, Homo sapiens
gagaaagcagaucuuguca

SEQ ID NO: 153183 - RNA, 19 nt, Homo sapiens
agauggagcgacaauauug

SEQ ID NO: 153184 - RNA, 19 nt, Homo sapiens
aggugcagcuuacguaguu

SEQ ID NO: 153185 - RNA, 19 nt, Homo sapiens
aaugccuucuggaauauuu

SEQ ID NO: 153186 - RNA, 19 nt, Homo sapiens
ggaaggcagaaacgauguu

SEQ ID NO: 153187 - RNA, 19 nt, Homo sapiens
ugaaagaugagcccaaguc

SEQ ID NO: 153188 - RNA, 19 nt, Homo sapiens
gucacagccugauuuguca

SEQ ID NO: 153189 - RNA, 19 nt, Homo sapiens
gcugaaggaguuguugaaa

SEQ ID NO: 153190 - RNA, 19 nt, Homo sapiens
augguucacugcuuaagaa

SEQ ID NO: 153191 - RNA, 19 nt, Homo sapiens
cuuuaagucucagaugaaa

SEQ ID NO: 153192 - RNA, 19 nt, Homo sapiens
gacgacaaggaguuaauug

SEQ ID NO: 153193 - RNA, 19 nt, Homo sapiens
ugauuugucagguaagaaa

SEQ ID NO: 153194 - RNA, 19 nt, Homo sapiens
guucacugcuuaagaaaau

SEQ ID NO: 153195 - RNA, 19 nt, Homo sapiens
agaagcgauuuaguguaua

SEQ ID NO: 153196 - RNA, 19 nt, Homo sapiens
ucaaagauggagcgacaau

SEQ ID NO: 153197 - RNA, 19 nt, Homo sapiens
caaucucaccagugccaua

SEQ ID NO: 153198 - RNA, 19 nt, Homo sapiens
ugaaagaagauccugacau

SEQ ID NO: 153199 - RNA, 19 nt, Homo sapiens
agaauaucacugucaagaa

SEQ ID NO: 153200 - RNA, 19 nt, Homo sapiens
uaagaggcaagaaacacuu

SEQ ID NO: 153201 - RNA, 19 nt, Homo sapiens
ccagaaauacaaguuagau

SEQ ID NO: 153202 - RNA, 19 nt, Homo sapiens
aaaugugucagcuauucua

SEQ ID NO: 153203 - RNA, 19 nt, Homo sapiens
caagacgucccagauaagu

SEQ ID NO: 153204 - RNA, 19 nt, Homo sapiens
guugaaaacggaggaauua

SEQ ID NO: 153205 - RNA, 19 nt, Homo sapiens
aggagaauaucacugucaa

SEQ ID NO: 153206 - RNA, 19 nt, Homo sapiens
cgaaugaaauuguccuuua

SEQ ID NO: 153207 - RNA, 19 nt, Homo sapiens
caacaaaccuggcugugaa

SEQ ID NO: 153208 - RNA, 19 nt, Homo sapiens
gaaguuggaauuccucuua

SEQ ID NO: 153209 - RNA, 19 nt, Homo sapiens
guugauagcugguaaugaa

SEQ ID NO: 153210 - RNA, 19 nt, Homo sapiens
gaacauaggaucccuguca

SEQ ID NO: 153211 - RNA, 19 nt, Homo sapiens
ggaugcagcucuucuguug

SEQ ID NO: 153212 - RNA, 19 nt, Homo sapiens
gaagaggagugacaaucaa

SEQ ID NO: 153213 - RNA, 19 nt, Homo sapiens
gaugaugacugaagaauac

SEQ ID NO: 153214 - RNA, 19 nt, Homo sapiens
gaaguaagaccugguauug

SEQ ID NO: 153215 - RNA, 19 nt, Homo sapiens
caagagacuuuacuucaga

SEQ ID NO: 153216 - RNA, 19 nt, Homo sapiens
gguauuguuuccaaagaua

SEQ ID NO: 153217 - RNA, 19 nt, Homo sapiens
caagaaagcagcaaagguu

SEQ ID NO: 153218 - RNA, 19 nt, Homo sapiens
ggaauugauuucacaguuc

SEQ ID NO: 153219 - RNA, 19 nt, Homo sapiens
gcagacaagccacaauuaa

SEQ ID NO: 153220 - RNA, 19 nt, Homo sapiens
gaaugaaauuguccuuuag

SEQ ID NO: 153221 - RNA, 19 nt, Homo sapiens
uaacauagguacaauuggu

SEQ ID NO: 153222 - RNA, 19 nt, Homo sapiens
gaaccuguuugaaauaaag

SEQ ID NO: 153223 - RNA, 19 nt, Homo sapiens
ucacugaaccuguuugaaa

SEQ ID NO: 153224 - RNA, 19 nt, Homo sapiens
guuaaacauucccacauaa

SEQ ID NO: 153225 - RNA, 19 nt, Homo sapiens
gggaauugauuucacaguu

SEQ ID NO: 153226 - RNA, 19 nt, Homo sapiens
ucaugaaacugaagcauau

SEQ ID NO: 153227 - RNA, 19 nt, Homo sapiens
gagcagauccuugcauuug

SEQ ID NO: 153228 - RNA, 19 nt, Homo sapiens
gcauaaugaucugcaauau

SEQ ID NO: 153229 - RNA, 19 nt, Homo sapiens
gaaauccacagucgucaaa

SEQ ID NO: 153230 - RNA, 19 nt, Homo sapiens
caguacaccugacgaguuu

SEQ ID NO: 153231 - RNA, 19 nt, Homo sapiens
aguaagaccugguauuguu

SEQ ID NO: 153232 - RNA, 19 nt, Homo sapiens
gugaguacauaguaaagaa

SEQ ID NO: 153233 - RNA, 19 nt, Homo sapiens
ccaaauaauucuagaugag

SEQ ID NO: 153234 - RNA, 19 nt, Homo sapiens
caccacacuuggcuaauuu

SEQ ID NO: 153235 - RNA, 19 nt, Homo sapiens
gaaguuaucagcagacaag

SEQ ID NO: 153236 - RNA, 19 nt, Homo sapiens
agucagacauguuuccuuu

SEQ ID NO: 153237 - RNA, 19 nt, Homo sapiens
ccaccacacuuggcuaauu

SEQ ID NO: 153238 - RNA, 19 nt, Homo sapiens
uggcagaaguuaaacauuc

SEQ ID NO: 153239 - RNA, 19 nt, Homo sapiens
gcccuuagccgaagaguug

SEQ ID NO: 153240 - RNA, 19 nt, Homo sapiens
agacauguuuccuuuguug

SEQ ID NO: 153241 - RNA, 19 nt, Homo sapiens
gcacaaauucuccuugaag

SEQ ID NO: 153242 - RNA, 19 nt, Homo sapiens
gcauaauguuggauugaau

SEQ ID NO: 153243 - RNA, 19 nt, Homo sapiens
aaacucauguguaaaccaa

SEQ ID NO: 153244 - RNA, 19 nt, Homo sapiens
ccaaagauagugaaggaaa

SEQ ID NO: 153245 - RNA, 19 nt, Homo sapiens
aaaccuggcugugaaguug

SEQ ID NO: 153246 - RNA, 19 nt, Homo sapiens
ucacaaagugcugggauua

SEQ ID NO: 153247 - RNA, 19 nt, Homo sapiens
gaauuccucuuaacaacca

SEQ ID NO: 153248 - RNA, 19 nt, Homo sapiens
gaacggugcagcagugaug

SEQ ID NO: 153249 - RNA, 19 nt, Homo sapiens
caucauacaguuugaaaug

SEQ ID NO: 153250 - RNA, 19 nt, Homo sapiens
gagcuuuaccugagauauu

SEQ ID NO: 153251 - RNA, 19 nt, Homo sapiens
auaaugaucugcaauaugc

SEQ ID NO: 153252 - RNA, 19 nt, Homo sapiens
gcaguacaccugacgaguu

SEQ ID NO: 153253 - RNA, 19 nt, Homo sapiens
caugauucgucuuugagua

SEQ ID NO: 153254 - RNA, 19 nt, Homo sapiens
aguuaaacauucccacaua

SEQ ID NO: 153255 - RNA, 19 nt, Homo sapiens
gcacagagguaggagaaaa

SEQ ID NO: 153256 - RNA, 19 nt, Homo sapiens
gcacugaaggagacaagaa

SEQ ID NO: 153257 - RNA, 19 nt, Homo sapiens
ucagacauguuuccuuugu

SEQ ID NO: 153258 - RNA, 19 nt, Homo sapiens
cacaaauucuccuugaaga

SEQ ID NO: 153259 - RNA, 19 nt, Homo sapiens
cuauagagaucaugaaacu

SEQ ID NO: 153260 - RNA, 19 nt, Homo sapiens
ccacagucgucaaagcuau

SEQ ID NO: 153261 - RNA, 19 nt, Homo sapiens
acaguucguuaccuuagua

SEQ ID NO: 153262 - RNA, 19 nt, Homo sapiens
caaaagcugucuaagaaug

SEQ ID NO: 153263 - RNA, 19 nt, Homo sapiens
gaccugguauuguuuccaa

SEQ ID NO: 153264 - RNA, 19 nt, Homo sapiens
gcagauccuugcauuuguc

SEQ ID NO: 153265 - RNA, 19 nt, Homo sapiens
cggaacaccuggcugcuau

SEQ ID NO: 153266 - RNA, 19 nt, Homo sapiens
ggagugcaguggcgugauc

SEQ ID NO: 153267 - RNA, 19 nt, Homo sapiens
aaggaaaacucauguguaa

SEQ ID NO: 153268 - RNA, 19 nt, Homo sapiens
gccagaauguuauagaucu

SEQ ID NO: 153269 - RNA, 19 nt, Homo sapiens
ggauuuggaaguuggaauu

SEQ ID NO: 153270 - RNA, 19 nt, Homo sapiens
gacaaucaagccaacagua

SEQ ID NO: 153271 - RNA, 19 nt, Homo sapiens
gauaagaagaggagugaca

SEQ ID NO: 153272 - RNA, 19 nt, Homo sapiens
ccaagagacuuuacuucag

SEQ ID NO: 153273 - RNA, 19 nt, Homo sapiens
gcucagcugaaauacaaua

SEQ ID NO: 153274 - RNA, 19 nt, Homo sapiens
ccgaguagcugagauuaca

SEQ ID NO: 153275 - RNA, 19 nt, Homo sapiens
ggcauaauguuggauugaa

SEQ ID NO: 153276 - RNA, 19 nt, Homo sapiens
ucaacaggagggagaguua

SEQ ID NO: 153277 - RNA, 19 nt, Homo sapiens
uaccugagauauucacaga

SEQ ID NO: 153278 - RNA, 19 nt, Homo sapiens
caaucaagcuuggauaugc

SEQ ID NO: 153279 - RNA, 19 nt, Homo sapiens
aaaccagagucaaaaguua

SEQ ID NO: 153280 - RNA, 19 nt, Homo sapiens
acacacauauaucacugaa

SEQ ID NO: 153281 - RNA, 19 nt, Homo sapiens
gagcucccauuauuccaau

SEQ ID NO: 153282 - RNA, 19 nt, Homo sapiens
gucaggaucucaccaccuu

SEQ ID NO: 153283 - RNA, 19 nt, Homo sapiens
cggagaagcuggagugacu

SEQ ID NO: 153284 - RNA, 19 nt, Homo sapiens
gaaagcagcaaagguucaa

SEQ ID NO: 153285 - RNA, 19 nt, Homo sapiens
gcuccaggcggucuuauug

SEQ ID NO: 153286 - RNA, 19 nt, Homo sapiens
guaagaccugguauuguuu

SEQ ID NO: 153287 - RNA, 19 nt, Homo sapiens
ggaaaauacuguuauacca

SEQ ID NO: 153288 - RNA, 19 nt, Homo sapiens
uuuaaugccugaaauccaa

SEQ ID NO: 153289 - RNA, 19 nt, Homo sapiens
cagcagacaagccacaauu

SEQ ID NO: 153290 - RNA, 19 nt, Homo sapiens
gaaggaaaacucaugugua

SEQ ID NO: 153291 - RNA, 19 nt, Homo sapiens
auagagaucaugaaacuga

SEQ ID NO: 153292 - RNA, 19 nt, Homo sapiens
gcccucggccagaauguua

SEQ ID NO: 153293 - RNA, 19 nt, Homo sapiens
cacugaaccuguuugaaau

SEQ ID NO: 153294 - RNA, 19 nt, Homo sapiens
caaggccgauuuggguaaa

SEQ ID NO: 153295 - RNA, 19 nt, Homo sapiens
ugaaguugaugaccuuaag

SEQ ID NO: 153296 - RNA, 19 nt, Homo sapiens
cuagaugaguaacaaagau

SEQ ID NO: 153297 - RNA, 19 nt, Homo sapiens
cugaaccuguuugaaauaa

SEQ ID NO: 153298 - RNA, 19 nt, Homo sapiens
aauaauacauucggaugga

SEQ ID NO: 153299 - RNA, 19 nt, Homo sapiens
acaccuggcugcuauagag

SEQ ID NO: 153300 - RNA, 19 nt, Homo sapiens
acaaagugcugggauuaca

SEQ ID NO: 153301 - RNA, 19 nt, Homo sapiens
gagaguuagugcugucaag

SEQ ID NO: 153302 - RNA, 19 nt, Homo sapiens
gaaguuguuugugaguaca

SEQ ID NO: 153303 - RNA, 19 nt, Homo sapiens
caaagcuauuucuggaguu

SEQ ID NO: 153304 - RNA, 19 nt, Homo sapiens
gauaugcuaaugcuaagau

SEQ ID NO: 153305 - RNA, 19 nt, Homo sapiens
agacaagccacaauuaaca

SEQ ID NO: 153306 - RNA, 19 nt, Homo sapiens
gcacacagcugagcacuua

SEQ ID NO: 153307 - RNA, 19 nt, Homo sapiens
ggaauaaaguugcagauga

SEQ ID NO: 153308 - RNA, 19 nt, Homo sapiens
ggagggaucuggcaacuug

SEQ ID NO: 153309 - RNA, 19 nt, Homo sapiens
gaauaaaguugcagaugau

SEQ ID NO: 153310 - RNA, 19 nt, Homo sapiens
gcagcaaggugcacgaauu

SEQ ID NO: 153311 - RNA, 19 nt, Homo sapiens
ggagaaggauggcgaguuc

SEQ ID NO: 153312 - RNA, 19 nt, Homo sapiens
gaucggagcaggagaguuu

SEQ ID NO: 153313 - RNA, 19 nt, Homo sapiens
gaucaucacugaguacaug

SEQ ID NO: 153314 - RNA, 19 nt, Homo sapiens
gaaguucacuaccgagauc

SEQ ID NO: 153315 - RNA, 19 nt, Homo sapiens
ugaaugacaugccgaucua

SEQ ID NO: 153316 - RNA, 19 nt, Homo sapiens
ggaguuggcuucuuuaucc

SEQ ID NO: 153317 - RNA, 19 nt, Homo sapiens
ggcaggaguuggcuucuuu

SEQ ID NO: 153318 - RNA, 19 nt, Homo sapiens
ggugggaccugaugcagaa

SEQ ID NO: 153319 - RNA, 19 nt, Homo sapiens
ugaaguaccuggccaacau

SEQ ID NO: 153320 - RNA, 19 nt, Homo sapiens
ggauaaguuucuauucugu

SEQ ID NO: 153321 - RNA, 19 nt, Homo sapiens
ucaagacccuggcugacuu

SEQ ID NO: 153322 - RNA, 19 nt, Homo sapiens
caucgcagcuggcaugaag

SEQ ID NO: 153323 - RNA, 19 nt, Homo sapiens
gcugaaagccggcuacaca

SEQ ID NO: 153324 - RNA, 19 nt, Homo sapiens
gagaagguggugcagauga

SEQ ID NO: 153325 - RNA, 19 nt, Homo sapiens
cagagggugucaaacauuc

SEQ ID NO: 153326 - RNA, 19 nt, Homo sapiens
ggacuacggcaccaacuuc

SEQ ID NO: 153327 - RNA, 19 nt, Homo sapiens
gcaaggagacuuucaaccu

SEQ ID NO: 153328 - RNA, 19 nt, Homo sapiens
uaaaguugcagaugauuca

SEQ ID NO: 153329 - RNA, 19 nt, Homo sapiens
ggccugaacugaggagaug

SEQ ID NO: 153330 - RNA, 19 nt, Homo sapiens
guguggagcuuuggcauug

SEQ ID NO: 153331 - RNA, 19 nt, Homo sapiens
gcaggaguuggcuucuuua

SEQ ID NO: 153332 - RNA, 19 nt, Homo sapiens
ucaccaagauugacaccau

SEQ ID NO: 153333 - RNA, 19 nt, Homo sapiens
uaagagggcagacugugaa

SEQ ID NO: 153334 - RNA, 19 nt, Homo sapiens
ggagagaaugugugugugu

SEQ ID NO: 153335 - RNA, 19 nt, Homo sapiens
gcagggcaaggaaguggua

SEQ ID NO: 153336 - RNA, 19 nt, Homo sapiens
guaaacaggguaccucaag

SEQ ID NO: 153337 - RNA, 19 nt, Homo sapiens
gcaacauccucgucaacag

SEQ ID NO: 153338 - RNA, 19 nt, Homo sapiens
caaauacaagcccaugaug

SEQ ID NO: 153339 - RNA, 19 nt, Homo sapiens
gagggcagacugugaacuu

SEQ ID NO: 153340 - RNA, 19 nt, Homo sapiens
ccaaauacaagcccaugau

SEQ ID NO: 153341 - RNA, 19 nt, Homo sapiens
caccaagauugacaccauu

SEQ ID NO: 153342 - RNA, 19 nt, Homo sapiens
ucgagaagguggugcagau

SEQ ID NO: 153343 - RNA, 19 nt, Homo sapiens
acagcaaccuggucugcaa

SEQ ID NO: 153344 - RNA, 19 nt, Homo sapiens
ggcgucaucuccaaauaca

SEQ ID NO: 153345 - RNA, 19 nt, Homo sapiens
ugaagccccugaagacaua

SEQ ID NO: 153346 - RNA, 19 nt, Homo sapiens
uggauaaguuucuauucug

SEQ ID NO: 153347 - RNA, 19 nt, Homo sapiens
gaccaacgacgacaucaag

SEQ ID NO: 153348 - RNA, 19 nt, Homo sapiens
aaauacaagcccaugauga

SEQ ID NO: 153349 - RNA, 19 nt, Homo sapiens
ucacugaguacauggagaa

SEQ ID NO: 153350 - RNA, 19 nt, Homo sapiens
caccuucccuggccacugu

SEQ ID NO: 153351 - RNA, 19 nt, Homo sapiens
agaagcgccuguucaccaa

SEQ ID NO: 153352 - RNA, 19 nt, Homo sapiens
cugaguacauggagaaugg

SEQ ID NO: 153353 - RNA, 19 nt, Homo sapiens
guccgugucuacuacaaga

SEQ ID NO: 153354 - RNA, 19 nt, Homo sapiens
uuucugcucuggaauaaag

SEQ ID NO: 153355 - RNA, 19 nt, Homo sapiens
ucuauucugucaguguuaa

SEQ ID NO: 153356 - RNA, 19 nt, Homo sapiens
gggcagacugugaacuuga

SEQ ID NO: 153357 - RNA, 19 nt, Homo sapiens
ccacuggggacuuuauuua

SEQ ID NO: 153358 - RNA, 19 nt, Homo sapiens
gaaguaccuggccaacaug

SEQ ID NO: 153359 - RNA, 19 nt, Homo sapiens
gaggucacuuaccgcaaga

SEQ ID NO: 153360 - RNA, 19 nt, Homo sapiens
gcucuggaauaaaguugca

SEQ ID NO: 153361 - RNA, 19 nt, Homo sapiens
gcugaggggucucggauga

SEQ ID NO: 153362 - RNA, 19 nt, Homo sapiens
gacgacaucaagaggauug

SEQ ID NO: 153363 - RNA, 19 nt, Homo sapiens
gacccuggcugacuuugac

SEQ ID NO: 153364 - RNA, 19 nt, Homo sapiens
caaagggugggaccugaug

SEQ ID NO: 153365 - RNA, 19 nt, Homo sapiens
aaagccggcuacacagaga

SEQ ID NO: 153366 - RNA, 19 nt, Homo sapiens
ggccugcucgccuggauuu

SEQ ID NO: 153367 - RNA, 19 nt, Homo sapiens
guggagagaaugugugugu

SEQ ID NO: 153368 - RNA, 19 nt, Homo sapiens
cuaagagggcagacuguga

SEQ ID NO: 153369 - RNA, 19 nt, Homo sapiens
acacugccaucgagaaggu

SEQ ID NO: 153370 - RNA, 19 nt, Homo sapiens
uacaagggcaugcugaaga

SEQ ID NO: 153371 - RNA, 19 nt, Homo sapiens
cagcaaggugcacgaauuc

SEQ ID NO: 153372 - RNA, 19 nt, Homo sapiens
gcaaagggugggaccugau

SEQ ID NO: 153373 - RNA, 19 nt, Homo sapiens
caaccacgaggugaugaaa

SEQ ID NO: 153374 - RNA, 19 nt, Homo sapiens
gagcuuuggcauugucaug

SEQ ID NO: 153375 - RNA, 19 nt, Homo sapiens
acaaguuccuucgggagaa

SEQ ID NO: 153376 - RNA, 19 nt, Homo sapiens
aauacaagcccaugaugau

SEQ ID NO: 153377 - RNA, 19 nt, Homo sapiens
ucaagaugcagcaguauac

SEQ ID NO: 153378 - RNA, 19 nt, Homo sapiens
caagacccuggcugacuuu

SEQ ID NO: 153379 - RNA, 19 nt, Homo sapiens
gcuuuggcauugucaugug

SEQ ID NO: 153380 - RNA, 19 nt, Homo sapiens
ugaaagccggcuacacaga

SEQ ID NO: 153381 - RNA, 19 nt, Homo sapiens
gaugacacccuggccugaa

SEQ ID NO: 153382 - RNA, 19 nt, Homo sapiens
acaacuggcuccgcaccaa

SEQ ID NO: 153383 - RNA, 19 nt, Homo sapiens
gcaaggugucugacuuugg

SEQ ID NO: 153384 - RNA, 19 nt, Homo sapiens
gccaaacccuugcuuuccu

SEQ ID NO: 153385 - RNA, 19 nt, Homo sapiens
ucuaccagcucaugaugca

SEQ ID NO: 153386 - RNA, 19 nt, Homo sapiens
ucgcagcuggcaugaagua

SEQ ID NO: 153387 - RNA, 19 nt, Homo sapiens
gcaaggugcacgaauucca

SEQ ID NO: 153388 - RNA, 19 nt, Homo sapiens
acagagggugucaaacauu

SEQ ID NO: 153389 - RNA, 19 nt, Homo sapiens
ucugcaaggugucugacuu

SEQ ID NO: 153390 - RNA, 19 nt, Homo sapiens
gggagaaggauggcgaguu

SEQ ID NO: 153391 - RNA, 19 nt, Homo sapiens
cggaggacguuuacuucuc

SEQ ID NO: 153392 - RNA, 19 nt, Homo sapiens
gacuuucaaccucuacuau

SEQ ID NO: 153393 - RNA, 19 nt, Homo sapiens
ccccaucucucauccuuuu

SEQ ID NO: 153394 - RNA, 19 nt, Homo sapiens
gcuugguuguguugagguu

SEQ ID NO: 153395 - RNA, 19 nt, Homo sapiens
gaugcuugguuguguugag

SEQ ID NO: 153396 - RNA, 19 nt, Homo sapiens
acaagggcaugcugaagac

SEQ ID NO: 153397 - RNA, 19 nt, Homo sapiens
caacugaagccccugaaga

SEQ ID NO: 153398 - RNA, 19 nt, Homo sapiens
gcaacuuggcggugauugg

SEQ ID NO: 153399 - RNA, 19 nt, Homo sapiens
gccacagccuucggacaga

SEQ ID NO: 153400 - RNA, 19 nt, Homo sapiens
gcuacacugccaucgagaa

SEQ ID NO: 153401 - RNA, 19 nt, Homo sapiens
guauacggagcacuucaug

SEQ ID NO: 153402 - RNA, 19 nt, Homo sapiens
acuuauuucugcucuggaa

SEQ ID NO: 153403 - RNA, 19 nt, Homo sapiens
cugucaguguuaaagauuu

SEQ ID NO: 153404 - RNA, 19 nt, Homo sapiens
uuucuauucugucaguguu

SEQ ID NO: 153405 - RNA, 19 nt, Homo sapiens
aagcgccuguucaccaaga

SEQ ID NO: 153406 - RNA, 19 nt, Homo sapiens
ggaugaagcugacgaaaug

SEQ ID NO: 153407 - RNA, 19 nt, Homo sapiens
guaaagguguggcuauuaa

SEQ ID NO: 153408 - RNA, 19 nt, Homo sapiens
gagaguaacuggaaugaga

SEQ ID NO: 153409 - RNA, 19 nt, Homo sapiens
gaacgagacgugauuauga

SEQ ID NO: 153410 - RNA, 19 nt, Homo sapiens
gaagaugcaugcucgagau

SEQ ID NO: 153411 - RNA, 19 nt, Homo sapiens
gcagucaucuucaucaaca

SEQ ID NO: 153412 - RNA, 19 nt, Homo sapiens
agaauuggcucagcagaua

SEQ ID NO: 153413 - RNA, 19 nt, Homo sapiens
ucaaggaccagaucuauga

SEQ ID NO: 153414 - RNA, 19 nt, Homo sapiens
gcagguuucuuuagucauc

SEQ ID NO: 153415 - RNA, 19 nt, Homo sapiens
caaggguuaugaugugauu

SEQ ID NO: 153416 - RNA, 19 nt, Homo sapiens
cuaugugacuuguaugaaa

SEQ ID NO: 153417 - RNA, 19 nt, Homo sapiens
caacagcaacacccaggua

SEQ ID NO: 153418 - RNA, 19 nt, Homo sapiens
caagauguuuguacuggau

SEQ ID NO: 153419 - RNA, 19 nt, Homo sapiens
ugacagcuuugaugacaug

SEQ ID NO: 153420 - RNA, 19 nt, Homo sapiens
uaacuggaaugagauuguu

SEQ ID NO: 153421 - RNA, 19 nt, Homo sapiens
gcucgagauuucacuguau

SEQ ID NO: 153422 - RNA, 19 nt, Homo sapiens
gaugcaugcucgagauuuc

SEQ ID NO: 153423 - RNA, 19 nt, Homo sapiens
ccacaaugccuucugaugu

SEQ ID NO: 153424 - RNA, 19 nt, Homo sapiens
ugagauuguugacagcuuu

SEQ ID NO: 153425 - RNA, 19 nt, Homo sapiens
gaaaugccccucaauguug

SEQ ID NO: 153426 - RNA, 19 nt, Homo sapiens
gaagcugacgaaauguuaa

SEQ ID NO: 153427 - RNA, 19 nt, Homo sapiens
caauguugcugaccucauc

SEQ ID NO: 153428 - RNA, 19 nt, Homo sapiens
cagcagguuucuuuaguca

SEQ ID NO: 153429 - RNA, 19 nt, Homo sapiens
ugaagcugacgaaauguua

SEQ ID NO: 153430 - RNA, 19 nt, Homo sapiens
ggaaaacuauauccacaga

SEQ ID NO: 153431 - RNA, 19 nt, Homo sapiens
gcagcagguuucuuuaguc

SEQ ID NO: 153432 - RNA, 19 nt, Homo sapiens
ggaacgagacgugauuaug

SEQ ID NO: 153433 - RNA, 19 nt, Homo sapiens
gcagcagauugaauuagau

SEQ ID NO: 153434 - RNA, 19 nt, Homo sapiens
gagccauucuaccuuguau

SEQ ID NO: 153435 - RNA, 19 nt, Homo sapiens
gugcugaggugcagaaacu

SEQ ID NO: 153436 - RNA, 19 nt, Homo sapiens
cuauuaacauggugacaga

SEQ ID NO: 153437 - RNA, 19 nt, Homo sapiens
gaagcuggacacacuaugu

SEQ ID NO: 153438 - RNA, 19 nt, Homo sapiens
uaugaaacccugaccauca

SEQ ID NO: 153439 - RNA, 19 nt, Homo sapiens
guugacagcuuugaugaca

SEQ ID NO: 153440 - RNA, 19 nt, Homo sapiens
gcauggagauauggaccaa

SEQ ID NO: 153441 - RNA, 19 nt, Homo sapiens
uaacauggugacagaagaa

SEQ ID NO: 153442 - RNA, 19 nt, Homo sapiens
cagccacaaugccuucuga

SEQ ID NO: 153443 - RNA, 19 nt, Homo sapiens
ggaaaugccccucaauguu

SEQ ID NO: 153444 - RNA, 19 nt, Homo sapiens
acuaugaccuucccaccaa

SEQ ID NO: 153445 - RNA, 19 nt, Homo sapiens
guuaagccguggauucaag

SEQ ID NO: 153446 - RNA, 19 nt, Homo sapiens
cguaaagguguggcuauua

SEQ ID NO: 153447 - RNA, 19 nt, Homo sapiens
gaaggcgucaucgagagua

SEQ ID NO: 153448 - RNA, 19 nt, Homo sapiens
gagaauuggcucagcagau

SEQ ID NO: 153449 - RNA, 19 nt, Homo sapiens
gaggacucuucgagacauu

SEQ ID NO: 153450 - RNA, 19 nt, Homo sapiens
uggacuggcucaccgagaa

SEQ ID NO: 153451 - RNA, 19 nt, Homo sapiens
ugcagcagauugaauuaga

SEQ ID NO: 153452 - RNA, 19 nt, Homo sapiens
cagcaacacccagguaguu

SEQ ID NO: 153453 - RNA, 19 nt, Homo sapiens
aaaggaacgagacgugauu

SEQ ID NO: 153454 - RNA, 19 nt, Homo sapiens
auugagaccuucuacaaca

SEQ ID NO: 153455 - RNA, 19 nt, Homo sapiens
guaacuggaaugagauugu

SEQ ID NO: 153456 - RNA, 19 nt, Homo sapiens
uuaacauggugacagaaga

SEQ ID NO: 153457 - RNA, 19 nt, Homo sapiens
ccguaaagguguggcuauu

SEQ ID NO: 153458 - RNA, 19 nt, Homo sapiens
gaaauguuaagccguggau

SEQ ID NO: 153459 - RNA, 19 nt, Homo sapiens
gccauucuaccuuguauca

SEQ ID NO: 153460 - RNA, 19 nt, Homo sapiens
acauugagaccuucuacaa

SEQ ID NO: 153461 - RNA, 19 nt, Homo sapiens
ggacucuucgagacauuga

SEQ ID NO: 153462 - RNA, 19 nt, Homo sapiens
gaggguauccgccaguucu

SEQ ID NO: 153463 - RNA, 19 nt, Homo sapiens
gauucaaggaccagaucua

SEQ ID NO: 153464 - RNA, 19 nt, Homo sapiens
cagcuuugaugacaugaac

SEQ ID NO: 153465 - RNA, 19 nt, Homo sapiens
caucgagaguaacuggaau

SEQ ID NO: 153466 - RNA, 19 nt, Homo sapiens
gaagguggucauggcacua

SEQ ID NO: 153467 - RNA, 19 nt, Homo sapiens
cuacaacaccuccauugag

SEQ ID NO: 153468 - RNA, 19 nt, Homo sapiens
gaggugaccaagaaguuca

SEQ ID NO: 153469 - RNA, 19 nt, Homo sapiens
cggucgagguggacgguuu

SEQ ID NO: 153470 - RNA, 19 nt, Homo sapiens
ccauucggauucuugucaa

SEQ ID NO: 153471 - RNA, 19 nt, Homo sapiens
gaguuucguucuggcucua

SEQ ID NO: 153472 - RNA, 19 nt, Homo sapiens
gaguaacuggaaugagauu

SEQ ID NO: 153473 - RNA, 19 nt, Homo sapiens
uccaaaagcucaacagcaa

SEQ ID NO: 153474 - RNA, 19 nt, Homo sapiens
ggugacagaagaagacaag

SEQ ID NO: 153475 - RNA, 19 nt, Homo sapiens
gaguuuugauuaccacuga

SEQ ID NO: 153476 - RNA, 19 nt, Homo sapiens
uaugugacuuguaugaaac

SEQ ID NO: 153477 - RNA, 19 nt, Homo sapiens
uggcucagcagauacagaa

SEQ ID NO: 153478 - RNA, 19 nt, Homo sapiens
ucuacaacaccuccauuga

SEQ ID NO: 153479 - RNA, 19 nt, Homo sapiens
ugacagaagaagacaagag

SEQ ID NO: 153480 - RNA, 19 nt, Homo sapiens
ugcagcagguuucuuuagu

SEQ ID NO: 153481 - RNA, 19 nt, Homo sapiens
ugucaagaaggaagaguug

SEQ ID NO: 153482 - RNA, 19 nt, Homo sapiens
gcagcgagccauucuaccu

SEQ ID NO: 153483 - RNA, 19 nt, Homo sapiens
ucauggcacuaggagacua

SEQ ID NO: 153484 - RNA, 19 nt, Homo sapiens
gcgagccauucuaccuugu

SEQ ID NO: 153485 - RNA, 19 nt, Homo sapiens
gccacaaugccuucugaug

SEQ ID NO: 153486 - RNA, 19 nt, Homo sapiens
uggaugaagcugacgaaau

SEQ ID NO: 153487 - RNA, 19 nt, Homo sapiens
ggcacuaggagacuacaug

SEQ ID NO: 153488 - RNA, 19 nt, Homo sapiens
gauucccgauccagagaca

SEQ ID NO: 153489 - RNA, 19 nt, Homo sapiens
agguguggcuauuaacaug

SEQ ID NO: 153490 - RNA, 19 nt, Homo sapiens
aaagguguggcuauuaaca

SEQ ID NO: 153491 - RNA, 19 nt, Homo sapiens
cagcagcgagccauucuac

SEQ ID NO: 153492 - RNA, 19 nt, Homo sapiens
ggaagcuggacacacuaug

SEQ ID NO: 153493 - RNA, 19 nt, Homo sapiens
cgagccauucuaccuugua

SEQ ID NO: 153494 - RNA, 19 nt, Homo sapiens
gcaacacccagguaguuuu

SEQ ID NO: 153495 - RNA, 19 nt, Homo sapiens
ggaaugagauuguugauaa

SEQ ID NO: 153496 - RNA, 19 nt, Homo sapiens
gaagauaccuuucuccaaa

SEQ ID NO: 153497 - RNA, 19 nt, Homo sapiens
caacaagugucuuugguua

SEQ ID NO: 153498 - RNA, 19 nt, Homo sapiens
ggagagagauguuaucaug

SEQ ID NO: 153499 - RNA, 19 nt, Homo sapiens
gaauguggcugaccuuauu

SEQ ID NO: 153500 - RNA, 19 nt, Homo sapiens
ggaaagguguggcuauaaa

SEQ ID NO: 153501 - RNA, 19 nt, Homo sapiens
gcacaugucuuaaugaagu

SEQ ID NO: 153502 - RNA, 19 nt, Homo sapiens
gagaguguuugauauguua

SEQ ID NO: 153503 - RNA, 19 nt, Homo sapiens
uagcauaucugccuuuauu

SEQ ID NO: 153504 - RNA, 19 nt, Homo sapiens
gcauugugcuucuuucuuu

SEQ ID NO: 153505 - RNA, 19 nt, Homo sapiens
gaggaaagguguggcuaua

SEQ ID NO: 153506 - RNA, 19 nt, Homo sapiens
gcuauuauucccuguauua

SEQ ID NO: 153507 - RNA, 19 nt, Homo sapiens
uggcugaccuuauuuaauu

SEQ ID NO: 153508 - RNA, 19 nt, Homo sapiens
gagagcaacuggaaugaga

SEQ ID NO: 153509 - RNA, 19 nt, Homo sapiens
uaaaggguaugaugugauu

SEQ ID NO: 153510 - RNA, 19 nt, Homo sapiens
ugaagcagaugaaauguug

SEQ ID NO: 153511 - RNA, 19 nt, Homo sapiens
gaucacuacugacuuguug

SEQ ID NO: 153512 - RNA, 19 nt, Homo sapiens
gccagagacuucacaguuu

SEQ ID NO: 153513 - RNA, 19 nt, Homo sapiens
gcucauaacggaucagaaa

SEQ ID NO: 153514 - RNA, 19 nt, Homo sapiens
acaagugucuuugguuaua

SEQ ID NO: 153515 - RNA, 19 nt, Homo sapiens
ggaugaagcagaugaaaug

SEQ ID NO: 153516 - RNA, 19 nt, Homo sapiens
ggagaguguuugauauguu

SEQ ID NO: 153517 - RNA, 19 nt, Homo sapiens
gcuauaaacuuuguuacug

SEQ ID NO: 153518 - RNA, 19 nt, Homo sapiens
ggauacacuuugugacuug

SEQ ID NO: 153519 - RNA, 19 nt, Homo sapiens
gggaauauuugaaucuugu

SEQ ID NO: 153520 - RNA, 19 nt, Homo sapiens
gagacuuucuacaauacua

SEQ ID NO: 153521 - RNA, 19 nt, Homo sapiens
aaacacaaguauucagguu

SEQ ID NO: 153522 - RNA, 19 nt, Homo sapiens
gagcuauuauucccuguau

SEQ ID NO: 153523 - RNA, 19 nt, Homo sapiens
ccauauugcacaugucuua

SEQ ID NO: 153524 - RNA, 19 nt, Homo sapiens
ggauugaugugcaacaagu

SEQ ID NO: 153525 - RNA, 19 nt, Homo sapiens
gacccaagcacuaguauug

SEQ ID NO: 153526 - RNA, 19 nt, Homo sapiens
gaagaagacaagaggauuc

SEQ ID NO: 153527 - RNA, 19 nt, Homo sapiens
caacuggaaugagauuguu

SEQ ID NO: 153528 - RNA, 19 nt, Homo sapiens
caugagagauccaauucga

SEQ ID NO: 153529 - RNA, 19 nt, Homo sapiens
cagcagagagcuauuauuc

SEQ ID NO: 153530 - RNA, 19 nt, Homo sapiens
gucauuagccugaguagaa

SEQ ID NO: 153531 - RNA, 19 nt, Homo sapiens
gaaaugguuguauuagaug

SEQ ID NO: 153532 - RNA, 19 nt, Homo sapiens
ucauaacggaucagaaaua

SEQ ID NO: 153533 - RNA, 19 nt, Homo sapiens
caagugucuuugguuauaa

SEQ ID NO: 153534 - RNA, 19 nt, Homo sapiens
ccagagacuucacaguuuc

SEQ ID NO: 153535 - RNA, 19 nt, Homo sapiens
gaggagaugcccaugaaug

SEQ ID NO: 153536 - RNA, 19 nt, Homo sapiens
gaggauucuucgugacauu

SEQ ID NO: 153537 - RNA, 19 nt, Homo sapiens
caaggagacccaagcacua

SEQ ID NO: 153538 - RNA, 19 nt, Homo sapiens
caacagauccaaaagguaa

SEQ ID NO: 153539 - RNA, 19 nt, Homo sapiens
cgugagcucuugugaggaa

SEQ ID NO: 153540 - RNA, 19 nt, Homo sapiens
uggaggagaugcccaugaa

SEQ ID NO: 153541 - RNA, 19 nt, Homo sapiens
gcaacaagugucuuugguu

SEQ ID NO: 153542 - RNA, 19 nt, Homo sapiens
uacgagacacugaccauua

SEQ ID NO: 153543 - RNA, 19 nt, Homo sapiens
gcugaagcaccacauauug

SEQ ID NO: 153544 - RNA, 19 nt, Homo sapiens
ggagacccaagcacuagua

SEQ ID NO: 153545 - RNA, 19 nt, Homo sapiens
agaacuggcucaacagauc

SEQ ID NO: 153546 - RNA, 19 nt, Homo sapiens
caacgugcauugugcuucu

SEQ ID NO: 153547 - RNA, 19 nt, Homo sapiens
gggagaguguuugauaugu

SEQ ID NO: 153548 - RNA, 19 nt, Homo sapiens
gcauaucugccuuuauugu

SEQ ID NO: 153549 - RNA, 19 nt, Homo sapiens
gaaugagauuguugauaac

SEQ ID NO: 153550 - RNA, 19 nt, Homo sapiens
ccaguaaaauugccauauu

SEQ ID NO: 153551 - RNA, 19 nt, Homo sapiens
gaaugcauuuuguuuggua

SEQ ID NO: 153552 - RNA, 19 nt, Homo sapiens
ucugaucacuacugacuug

SEQ ID NO: 153553 - RNA, 19 nt, Homo sapiens
gauguuaucaugagggaau

SEQ ID NO: 153554 - RNA, 19 nt, Homo sapiens
agagagauguuaucaugag

SEQ ID NO: 153555 - RNA, 19 nt, Homo sapiens
gaagcaccacauauuguug

SEQ ID NO: 153556 - RNA, 19 nt, Homo sapiens
gagcaacuggaaugagauu

SEQ ID NO: 153557 - RNA, 19 nt, Homo sapiens
ucauuagccugaguagaaa

SEQ ID NO: 153558 - RNA, 19 nt, Homo sapiens
cauaacggaucagaaauac

SEQ ID NO: 153559 - RNA, 19 nt, Homo sapiens
ccacauauuguuguuggua

SEQ ID NO: 153560 - RNA, 19 nt, Homo sapiens
gcaacuggaaugagauugu

SEQ ID NO: 153561 - RNA, 19 nt, Homo sapiens
ggaggaaagguguggcuau

SEQ ID NO: 153562 - RNA, 19 nt, Homo sapiens
ccacaaugccaacugaugu

SEQ ID NO: 153563 - RNA, 19 nt, Homo sapiens
gcacuuggagacuauaugg

SEQ ID NO: 153564 - RNA, 19 nt, Homo sapiens
uaacggaucagaaauacag

SEQ ID NO: 153565 - RNA, 19 nt, Homo sapiens
gagagagauguuaucauga

SEQ ID NO: 153566 - RNA, 19 nt, Homo sapiens
cagaaggagagagauguua

SEQ ID NO: 153567 - RNA, 19 nt, Homo sapiens
uggacuggcugacugagaa

SEQ ID NO: 153568 - RNA, 19 nt, Homo sapiens
gauuauaacagagaacaug

SEQ ID NO: 153569 - RNA, 19 nt, Homo sapiens
gaaauguugagccgugguu

SEQ ID NO: 153570 - RNA, 19 nt, Homo sapiens
uaaaagauggggucuguaa

SEQ ID NO: 153571 - RNA, 19 nt, Homo sapiens
gaaggagagagauguuauc

SEQ ID NO: 153572 - RNA, 19 nt, Homo sapiens
ggaagaauugacccuugaa

SEQ ID NO: 153573 - RNA, 19 nt, Homo sapiens
aggaagaauugacccuuga

SEQ ID NO: 153574 - RNA, 19 nt, Homo sapiens
uugcacaugucuuaaugaa

SEQ ID NO: 153575 - RNA, 19 nt, Homo sapiens
cagcaagcaauccuaggua

SEQ ID NO: 153576 - RNA, 19 nt, Homo sapiens
ugagagauccaauucgaau

SEQ ID NO: 153577 - RNA, 19 nt, Homo sapiens
guauucagguuguguuugc

SEQ ID NO: 153578 - RNA, 19 nt, Homo sapiens
ugaagcaccacauauuguu

SEQ ID NO: 153579 - RNA, 19 nt, Homo sapiens
ggcaagacagccacauuug

SEQ ID NO: 153580 - RNA, 19 nt, Homo sapiens
uauugcacaugucuuaaug

SEQ ID NO: 153581 - RNA, 19 nt, Homo sapiens
caucuaugcuuacgguuuu

SEQ ID NO: 153582 - RNA, 19 nt, Homo sapiens
agguguggcuauaaacuuu

SEQ ID NO: 153583 - RNA, 19 nt, Homo sapiens
gaauggaaguuggauacac

SEQ ID NO: 153584 - RNA, 19 nt, Homo sapiens
acagccacauuugcuauuu

SEQ ID NO: 153585 - RNA, 19 nt, Homo sapiens
cuguagaaaugguuguauu

SEQ ID NO: 153586 - RNA, 19 nt, Homo sapiens
gagagaggaauggaaguug

SEQ ID NO: 153587 - RNA, 19 nt, Homo sapiens
acuagcauaucugccuuua

SEQ ID NO: 153588 - RNA, 19 nt, Homo sapiens
guagaaaugguuguauuag

SEQ ID NO: 153589 - RNA, 19 nt, Homo sapiens
acauugagacuuucuacaa

SEQ ID NO: 153590 - RNA, 19 nt, Homo sapiens
gaggaauggaaguuggaua

SEQ ID NO: 153591 - RNA, 19 nt, Homo sapiens
gcuucuuucuuugggaaua

SEQ ID NO: 153592 - RNA, 19 nt, Homo sapiens
cuuguuggcucgcgggauu

SEQ ID NO: 153593 - RNA, 19 nt, Homo sapiens
ccgggagaguguuugauau

SEQ ID NO: 153594 - RNA, 19 nt, Homo sapiens
uaucugccuuuauuguguu

SEQ ID NO: 153595 - RNA, 19 nt, Homo sapiens
ggaauucuuucgaggauua

SEQ ID NO: 153596 - RNA, 19 nt, Homo sapiens
ugacacagcugcuagagaa

SEQ ID NO: 153597 - RNA, 19 nt, Homo sapiens
ggaggaagcaccuauguuu

SEQ ID NO: 153598 - RNA, 19 nt, Homo sapiens
gaagaugauuccucugcua

SEQ ID NO: 153599 - RNA, 19 nt, Homo sapiens
ccagagagguugaaagguu

SEQ ID NO: 153600 - RNA, 19 nt, Homo sapiens
gaugauagcuuuggagaca

SEQ ID NO: 153601 - RNA, 19 nt, Homo sapiens
gacccaaacugaaucuaaa

SEQ ID NO: 153602 - RNA, 19 nt, Homo sapiens
uaaaguagaugggaugaau

SEQ ID NO: 153603 - RNA, 19 nt, Homo sapiens
ggaggaagauugccacucu

SEQ ID NO: 153604 - RNA, 19 nt, Homo sapiens
gaugauuccucugcuagua

SEQ ID NO: 153605 - RNA, 19 nt, Homo sapiens
gagaagauuaugccgaaua

SEQ ID NO: 153606 - RNA, 19 nt, Homo sapiens
ggaaggaccaggaaggaaa

SEQ ID NO: 153607 - RNA, 19 nt, Homo sapiens
gauuauaggcgugaugaua

SEQ ID NO: 153608 - RNA, 19 nt, Homo sapiens
gauaggcaguggcagaaga

SEQ ID NO: 153609 - RNA, 19 nt, Homo sapiens
gaaggagucagauaggaaa

SEQ ID NO: 153610 - RNA, 19 nt, Homo sapiens
agaaagagaaguagaagaa

SEQ ID NO: 153611 - RNA, 19 nt, Homo sapiens
ugaaacggaugaccuggaa

SEQ ID NO: 153612 - RNA, 19 nt, Homo sapiens
cagagagguugaaagguuu

SEQ ID NO: 153613 - RNA, 19 nt, Homo sapiens
ccaaagacccaaacugaau

SEQ ID NO: 153614 - RNA, 19 nt, Homo sapiens
ccuaugauguuacagaaga

SEQ ID NO: 153615 - RNA, 19 nt, Homo sapiens
ggagacaaguaucgagauc

SEQ ID NO: 153616 - RNA, 19 nt, Homo sapiens
ggaaggagucagauaggaa

SEQ ID NO: 153617 - RNA, 19 nt, Homo sapiens
ggagagagagugagaaguc

SEQ ID NO: 153618 - RNA, 19 nt, Homo sapiens
gccgggauauggaucgaua

SEQ ID NO: 153619 - RNA, 19 nt, Homo sapiens
caaguaugcugcucucucu

SEQ ID NO: 153620 - RNA, 19 nt, Homo sapiens
ggagaaugcuugggugaag

SEQ ID NO: 153621 - RNA, 19 nt, Homo sapiens
gaagauugccacucuccaa

SEQ ID NO: 153622 - RNA, 19 nt, Homo sapiens
gaucugcaccugagccaaa

SEQ ID NO: 153623 - RNA, 19 nt, Homo sapiens
ggcaaagccuguugacaca

SEQ ID NO: 153624 - RNA, 19 nt, Homo sapiens
acaaguaucgagaucguua

SEQ ID NO: 153625 - RNA, 19 nt, Homo sapiens
ggaaaccuacccuaugaug

SEQ ID NO: 153626 - RNA, 19 nt, Homo sapiens
aaauccagcuucuaaguuc

SEQ ID NO: 153627 - RNA, 19 nt, Homo sapiens
caaagaaaccugaggaaaa

SEQ ID NO: 153628 - RNA, 19 nt, Homo sapiens
gaaggaacaagagaaguug

SEQ ID NO: 153629 - RNA, 19 nt, Homo sapiens
gaguggacguugcugauca

SEQ ID NO: 153630 - RNA, 19 nt, Homo sapiens
gaacccagcaauccagaga

SEQ ID NO: 153631 - RNA, 19 nt, Homo sapiens
aaaccuacccuaugauguu

SEQ ID NO: 153632 - RNA, 19 nt, Homo sapiens
ggagucagauaggaaagau

SEQ ID NO: 153633 - RNA, 19 nt, Homo sapiens
cacccaagcuggcgaagug

SEQ ID NO: 153634 - RNA, 19 nt, Homo sapiens
ggaagacuaucucccuaac

SEQ ID NO: 153635 - RNA, 19 nt, Homo sapiens
gaagaggugaugauagcuu

SEQ ID NO: 153636 - RNA, 19 nt, Homo sapiens
cuacagacagcuuugauga

SEQ ID NO: 153637 - RNA, 19 nt, Homo sapiens
gacaggaagugagucauca

SEQ ID NO: 153638 - RNA, 19 nt, Homo sapiens
guaucgagaucguuaugau

SEQ ID NO: 153639 - RNA, 19 nt, Homo sapiens
ccaaagaaaccugaggaaa

SEQ ID NO: 153640 - RNA, 19 nt, Homo sapiens
uagaagaacggcuacagaa

SEQ ID NO: 153641 - RNA, 19 nt, Homo sapiens
ucgagcugcuucuaucuuu

SEQ ID NO: 153642 - RNA, 19 nt, Homo sapiens
uagaagaggugaugauagc

SEQ ID NO: 153643 - RNA, 19 nt, Homo sapiens
caccacaucuagcagaaau

SEQ ID NO: 153644 - RNA, 19 nt, Homo sapiens
gauugccacucuccaacuu

SEQ ID NO: 153645 - RNA, 19 nt, Homo sapiens
augaaacacucaauaagga

SEQ ID NO: 153646 - RNA, 19 nt, Homo sapiens
aagaggugaugauagcuuu

SEQ ID NO: 153647 - RNA, 19 nt, Homo sapiens
ggacaggaagugagucauc

SEQ ID NO: 153648 - RNA, 19 nt, Homo sapiens
aagaacggcuacagaagga

SEQ ID NO: 153649 - RNA, 19 nt, Homo sapiens
cagaagagucaauuaagga

SEQ ID NO: 153650 - RNA, 19 nt, Homo sapiens
agacagggaugaucguucu

SEQ ID NO: 153651 - RNA, 19 nt, Homo sapiens
agaagauuaugccgaauag

SEQ ID NO: 153652 - RNA, 19 nt, Homo sapiens
gaccaggaaggaaagauga

SEQ ID NO: 153653 - RNA, 19 nt, Homo sapiens
gaaaugcacgaaggagaga

SEQ ID NO: 153654 - RNA, 19 nt, Homo sapiens
ggagcuccagagaugauua

SEQ ID NO: 153655 - RNA, 19 nt, Homo sapiens
aaccuacccuaugauguua

SEQ ID NO: 153656 - RNA, 19 nt, Homo sapiens
aaagaaaccugaggaaaau

SEQ ID NO: 153657 - RNA, 19 nt, Homo sapiens
ggaccaggaaggaaagaug

SEQ ID NO: 153658 - RNA, 19 nt, Homo sapiens
gaucagccccuaaagguaa

SEQ ID NO: 153659 - RNA, 19 nt, Homo sapiens
gaaaccuacccuaugaugu

SEQ ID NO: 153660 - RNA, 19 nt, Homo sapiens
ggaaugagccaaaacuaga

SEQ ID NO: 153661 - RNA, 19 nt, Homo sapiens
gaguacuccugaagaagau

SEQ ID NO: 153662 - RNA, 19 nt, Homo sapiens
cuagguaacaggagaauuc

SEQ ID NO: 153663 - RNA, 19 nt, Homo sapiens
acagaagagucaauuaagg

SEQ ID NO: 153664 - RNA, 19 nt, Homo sapiens
agaaggaacaagagaaguu

SEQ ID NO: 153665 - RNA, 19 nt, Homo sapiens
gagaaagagaaguagaaga

SEQ ID NO: 153666 - RNA, 19 nt, Homo sapiens
gaagagucaauuaaggaau

SEQ ID NO: 153667 - RNA, 19 nt, Homo sapiens
aaucuaaagccucggagua

SEQ ID NO: 153668 - RNA, 19 nt, Homo sapiens
gcuaugaagaccgauauga

SEQ ID NO: 153669 - RNA, 19 nt, Homo sapiens
gaugacuacccaccuagaa

SEQ ID NO: 153670 - RNA, 19 nt, Homo sapiens
aagcaccuauguuuccaaa

SEQ ID NO: 153671 - RNA, 19 nt, Homo sapiens
ucaaccaucugaggaagga

SEQ ID NO: 153672 - RNA, 19 nt, Homo sapiens
agaagucucuagaaaauga

SEQ ID NO: 153673 - RNA, 19 nt, Homo sapiens
uagagaaagagaaguagaa

SEQ ID NO: 153674 - RNA, 19 nt, Homo sapiens
aaaaugagggagaagauua

SEQ ID NO: 153675 - RNA, 19 nt, Homo sapiens
cgaaggagagagagugaga

SEQ ID NO: 153676 - RNA, 19 nt, Homo sapiens
cagggaugaugacuacaga

SEQ ID NO: 153677 - RNA, 19 nt, Homo sapiens
ccuagaagaggugaugaua

SEQ ID NO: 153678 - RNA, 19 nt, Homo sapiens
guugaaagguuuugguuau

SEQ ID NO: 153679 - RNA, 19 nt, Homo sapiens
gagagagagugagaagucu

SEQ ID NO: 153680 - RNA, 19 nt, Homo sapiens
gaggaagcaccuauguuuc

SEQ ID NO: 153681 - RNA, 19 nt, Homo sapiens
ucgcagggaugaugacuac

SEQ ID NO: 153682 - RNA, 19 nt, Homo sapiens
agacagcuuugaugacuac

SEQ ID NO: 153683 - RNA, 19 nt, Homo sapiens
gaacggucgaggacaggaa

SEQ ID NO: 153684 - RNA, 19 nt, Homo sapiens
guuacagaagagucaauua

SEQ ID NO: 153685 - RNA, 19 nt, Homo sapiens
agacccaaacugaaucuaa

SEQ ID NO: 153686 - RNA, 19 nt, Homo sapiens
uuauaggcgugaugauaga

SEQ ID NO: 153687 - RNA, 19 nt, Homo sapiens
cagacagcuuugaugacua

SEQ ID NO: 153688 - RNA, 19 nt, Homo sapiens
gauaaagacagggaugauc

SEQ ID NO: 153689 - RNA, 19 nt, Homo sapiens
uaucagugcagugcguuua

SEQ ID NO: 153690 - RNA, 19 nt, Homo sapiens
guaugcugcucucucuguu

SEQ ID NO: 153691 - RNA, 19 nt, Homo sapiens
gagcagcaguccccuacaa

SEQ ID NO: 153692 - RNA, 19 nt, Homo sapiens
ggaccuccaccacaucuag

SEQ ID NO: 153693 - RNA, 19 nt, Homo sapiens
caaagacccaaacugaauc

SEQ ID NO: 153694 - RNA, 19 nt, Homo sapiens
aggcuaugauucccggaua

SEQ ID NO: 153695 - RNA, 19 nt, Homo sapiens
ggaggacgauggcuaauua

SEQ ID NO: 153696 - RNA, 19 nt, Homo sapiens
gcugauggcugcuagauuu

SEQ ID NO: 153697 - RNA, 19 nt, Homo sapiens
gcaagucucuauauuaugu

SEQ ID NO: 153698 - RNA, 19 nt, Homo sapiens
ccaguugucuaguaauuua

SEQ ID NO: 153699 - RNA, 19 nt, Homo sapiens
ggugaaggauccaggaaua

SEQ ID NO: 153700 - RNA, 19 nt, Homo sapiens
caaagauagugauugguua

SEQ ID NO: 153701 - RNA, 19 nt, Homo sapiens
ggacugcauuuaaauuuga

SEQ ID NO: 153702 - RNA, 19 nt, Homo sapiens
gagaagcuguuacacauau

SEQ ID NO: 153703 - RNA, 19 nt, Homo sapiens
gacgauggcuaauuacauu

SEQ ID NO: 153704 - RNA, 19 nt, Homo sapiens
gcagucccauucauauuaa

SEQ ID NO: 153705 - RNA, 19 nt, Homo sapiens
gcaggcaagucucuauauu

SEQ ID NO: 153706 - RNA, 19 nt, Homo sapiens
gaaccaaagccucuucaaa

SEQ ID NO: 153707 - RNA, 19 nt, Homo sapiens
acacaaagguggaauaaac

SEQ ID NO: 153708 - RNA, 19 nt, Homo sapiens
gaucuauguuugugugauu

SEQ ID NO: 153709 - RNA, 19 nt, Homo sapiens
cagagaagcuguuacacau

SEQ ID NO: 153710 - RNA, 19 nt, Homo sapiens
gcauaaguuuggagcacua

SEQ ID NO: 153711 - RNA, 19 nt, Homo sapiens
gaaggauccaggaauauga

SEQ ID NO: 153712 - RNA, 19 nt, Homo sapiens
gugauaagauagcaauaug

SEQ ID NO: 153713 - RNA, 19 nt, Homo sapiens
acacuucugugccuuauug

SEQ ID NO: 153714 - RNA, 19 nt, Homo sapiens
cauauccaguugucuagua

SEQ ID NO: 153715 - RNA, 19 nt, Homo sapiens
agaguggacugcauuuaaa

SEQ ID NO: 153716 - RNA, 19 nt, Homo sapiens
cggcugaucuccaaguuug

SEQ ID NO: 153717 - RNA, 19 nt, Homo sapiens
aggcaagucucuauauuau

SEQ ID NO: 153718 - RNA, 19 nt, Homo sapiens
caggcaagucucuauauua

SEQ ID NO: 153719 - RNA, 19 nt, Homo sapiens
gauaagauagcaauaugga

SEQ ID NO: 153720 - RNA, 19 nt, Homo sapiens
ccagaacacuauauuaaac

SEQ ID NO: 153721 - RNA, 19 nt, Homo sapiens
cagaguggacugcauuuaa

SEQ ID NO: 153722 - RNA, 19 nt, Homo sapiens
caaguuugauacuguugaa

SEQ ID NO: 153723 - RNA, 19 nt, Homo sapiens
ccaggaauaugacacaaag

SEQ ID NO: 153724 - RNA, 19 nt, Homo sapiens
guacuucuguguucauuuu

SEQ ID NO: 153725 - RNA, 19 nt, Homo sapiens
gcagacacagcuacuaaga

SEQ ID NO: 153726 - RNA, 19 nt, Homo sapiens
ggcccacucuguaauaguu

SEQ ID NO: 153727 - RNA, 19 nt, Homo sapiens
gguauacaaggaaagguua

SEQ ID NO: 153728 - RNA, 19 nt, Homo sapiens
caauauggacuacugaaug

SEQ ID NO: 153729 - RNA, 19 nt, Homo sapiens
agcuaaaggugauaagaua

SEQ ID NO: 153730 - RNA, 19 nt, Homo sapiens
ugucuuugcuguacucuug

SEQ ID NO: 153731 - RNA, 19 nt, Homo sapiens
gagcacuaguuugauuauu

SEQ ID NO: 153732 - RNA, 19 nt, Homo sapiens
cagaauccauaaauguguu

SEQ ID NO: 153733 - RNA, 19 nt, Homo sapiens
aauauggacuacugaaugu

SEQ ID NO: 153734 - RNA, 19 nt, Homo sapiens
gagcuaaaggugauaagau

SEQ ID NO: 153735 - RNA, 19 nt, Homo sapiens
guauguggcgcuguuguua

SEQ ID NO: 153736 - RNA, 19 nt, Homo sapiens
uugcugguuugaaagauua

SEQ ID NO: 153737 - RNA, 19 nt, Homo sapiens
gggaggguauacaaggaaa

SEQ ID NO: 153738 - RNA, 19 nt, Homo sapiens
gagccuaugugggaagaug

SEQ ID NO: 153739 - RNA, 19 nt, Homo sapiens
caugugaacagcauaaguu

SEQ ID NO: 153740 - RNA, 19 nt, Homo sapiens
gugcauucuuugguaauuu

SEQ ID NO: 153741 - RNA, 19 nt, Homo sapiens
gagaaucuuuugaugacua

SEQ ID NO: 153742 - RNA, 19 nt, Homo sapiens
uguggugucuuccauguga

SEQ ID NO: 153743 - RNA, 19 nt, Homo sapiens
gaaaagcagucccauucau

SEQ ID NO: 153744 - RNA, 19 nt, Homo sapiens
ugacacaaagguggaauaa

SEQ ID NO: 153745 - RNA, 19 nt, Homo sapiens
uaacccagaacacuauauu

SEQ ID NO: 153746 - RNA, 19 nt, Homo sapiens
gcaauauggacuacugaau

SEQ ID NO: 153747 - RNA, 19 nt, Homo sapiens
gagacugcgucaagcaauc

SEQ ID NO: 153748 - RNA, 19 nt, Homo sapiens
aaggaaagguuaggacuuc

SEQ ID NO: 153749 - RNA, 19 nt, Homo sapiens
gagacacuucugugccuua

SEQ ID NO: 153750 - RNA, 19 nt, Homo sapiens
ggacgauggcuaauuacau

SEQ ID NO: 153751 - RNA, 19 nt, Homo sapiens
caacuagauuuguccuuuu

SEQ ID NO: 153752 - RNA, 19 nt, Homo sapiens
guggacugcauuuaaauuu

SEQ ID NO: 153753 - RNA, 19 nt, Homo sapiens
ggacuuccuccaaagauag

SEQ ID NO: 153754 - RNA, 19 nt, Homo sapiens
gauggcuaauuacauugaa

SEQ ID NO: 153755 - RNA, 19 nt, Homo sapiens
ggugauaagauagcaauau

SEQ ID NO: 153756 - RNA, 19 nt, Homo sapiens
ugauacuguugaagacuuu

SEQ ID NO: 153757 - RNA, 19 nt, Homo sapiens
ggaaucuaaucaggagguu

SEQ ID NO: 153758 - RNA, 19 nt, Homo sapiens
caaagguggaauaaacauu

SEQ ID NO: 153759 - RNA, 19 nt, Homo sapiens
acccagaacacuauauuaa

SEQ ID NO: 153760 - RNA, 19 nt, Homo sapiens
ccauucauauuaagacagu

SEQ ID NO: 153761 - RNA, 19 nt, Homo sapiens
ucagugaucuauguuugug

SEQ ID NO: 153762 - RNA, 19 nt, Homo sapiens
uggcuagaguuuccacuau

SEQ ID NO: 153763 - RNA, 19 nt, Homo sapiens
cuaaucaggagguugcuaa

SEQ ID NO: 153764 - RNA, 19 nt, Homo sapiens
guuuggagcacuaguuuga

SEQ ID NO: 153765 - RNA, 19 nt, Homo sapiens
ccacuaucccaaucaaaga

SEQ ID NO: 153766 - RNA, 19 nt, Homo sapiens
agaagucucauucgccuuu

SEQ ID NO: 153767 - RNA, 19 nt, Homo sapiens
uggacugcauuuaaauuug

SEQ ID NO: 153768 - RNA, 19 nt, Homo sapiens
agaagcuguuacacauaua

SEQ ID NO: 153769 - RNA, 19 nt, Homo sapiens
gugaacagcauaaguuugg

SEQ ID NO: 153770 - RNA, 19 nt, Homo sapiens
uauccacaauagucagaaa

SEQ ID NO: 153771 - RNA, 19 nt, Homo sapiens
gaagucucauucgccuuug

SEQ ID NO: 153772 - RNA, 19 nt, Homo sapiens
caaggaaagguuaggacuu

SEQ ID NO: 153773 - RNA, 19 nt, Homo sapiens
cccagaacacuauauuaaa

SEQ ID NO: 153774 - RNA, 19 nt, Homo sapiens
ggagcacuaguuugauuau

SEQ ID NO: 153775 - RNA, 19 nt, Homo sapiens
ucuccaaguuugauacugu

SEQ ID NO: 153776 - RNA, 19 nt, Homo sapiens
agcagucccauucauauua

SEQ ID NO: 153777 - RNA, 19 nt, Homo sapiens
aaagcagucccauucauau

SEQ ID NO: 153778 - RNA, 19 nt, Homo sapiens
cagaacagaugggcacucu

SEQ ID NO: 153779 - RNA, 19 nt, Homo sapiens
acacauauagggaggguau

SEQ ID NO: 153780 - RNA, 19 nt, Homo sapiens
gcgcuguuguuaauguuag

SEQ ID NO: 153781 - RNA, 19 nt, Homo sapiens
ugauguauguggcgcuguu

SEQ ID NO: 153782 - RNA, 19 nt, Homo sapiens
uuggagcacuaguuugauu

SEQ ID NO: 153783 - RNA, 19 nt, Homo sapiens
ucaaagaauuacaguacac

SEQ ID NO: 153784 - RNA, 19 nt, Homo sapiens
cauaggagacugcgucaag

SEQ ID NO: 153785 - RNA, 19 nt, Homo sapiens
gguuuguuguuuaagaaga

SEQ ID NO: 153786 - RNA, 19 nt, Homo sapiens
gaagcuguuacacauauag

SEQ ID NO: 153787 - RNA, 19 nt, Homo sapiens
gaaaccaccccuacuccua

SEQ ID NO: 153788 - RNA, 19 nt, Homo sapiens
gcaaaccugcggcugaucu

SEQ ID NO: 153789 - RNA, 19 nt, Homo sapiens
gcauacaguuuucuagcaa

SEQ ID NO: 153790 - RNA, 19 nt, Homo sapiens
guuccuggcccacucugua

SEQ ID NO: 153791 - RNA, 19 nt, Homo sapiens
uagggaggguauacaagga

SEQ ID NO: 153792 - RNA, 19 nt, Homo sapiens
uaaaggugauaagauagca

SEQ ID NO: 153793 - RNA, 19 nt, Homo sapiens
aaacagcagagacgaagug

SEQ ID NO: 153794 - RNA, 19 nt, Homo sapiens
uaaguuuggagcacuaguu

SEQ ID NO: 153795 - RNA, 19 nt, Homo sapiens
gcaauagcccagaagauaa

SEQ ID NO: 153796 - RNA, 19 nt, Homo sapiens
aguuugagauggacauuua

SEQ ID NO: 153797 - RNA, 19 nt, Homo sapiens
gccaggaaguggacaagaa

SEQ ID NO: 153798 - RNA, 19 nt, Homo sapiens
caagggaucugcccaccau

SEQ ID NO: 153799 - RNA, 19 nt, Homo sapiens
cgcaauagcccagaagaua

SEQ ID NO: 153800 - RNA, 19 nt, Homo sapiens
gagauggacauuuaaagca

SEQ ID NO: 153801 - RNA, 19 nt, Homo sapiens
gaagagucacaguuugaga

SEQ ID NO: 153802 - RNA, 19 nt, Homo sapiens
ggagguaccaggaucaucu

SEQ ID NO: 153803 - RNA, 19 nt, Homo sapiens
cagagccaccugcgcaaua

SEQ ID NO: 153804 - RNA, 19 nt, Homo sapiens
caagaacgaacccuuccuu

SEQ ID NO: 153805 - RNA, 19 nt, Homo sapiens
ggaaguggacaagaacgaa

SEQ ID NO: 153806 - RNA, 19 nt, Homo sapiens
gaacccuuccuuccgaaug

SEQ ID NO: 153807 - RNA, 19 nt, Homo sapiens
cagcagauaccuccuugug

SEQ ID NO: 153808 - RNA, 19 nt, Homo sapiens
ccagccaggccuuaugaaa

SEQ ID NO: 153809 - RNA, 19 nt, Homo sapiens
caccagcccuuccagugau

SEQ ID NO: 153810 - RNA, 19 nt, Homo sapiens
gccaucguguggagcacua

SEQ ID NO: 153811 - RNA, 19 nt, Homo sapiens
agccaggccuuaugaaagu

SEQ ID NO: 153812 - RNA, 19 nt, Homo sapiens
agucacaguuugagaugga

SEQ ID NO: 153813 - RNA, 19 nt, Homo sapiens
gagguaccaggaucaucua

SEQ ID NO: 153814 - RNA, 19 nt, Homo sapiens
caauagcccagaagauaag

SEQ ID NO: 153815 - RNA, 19 nt, Homo sapiens
cgaaugaucagcaguucca

SEQ ID NO: 153816 - RNA, 19 nt, Homo sapiens
aacccuuccuuccgaauga

SEQ ID NO: 153817 - RNA, 19 nt, Homo sapiens
ccuugugccuccacugaug

SEQ ID NO: 153818 - RNA, 19 nt, Homo sapiens
caccagccaggccuuauga

SEQ ID NO: 153819 - RNA, 19 nt, Homo sapiens
cagccaggccuuaugaaag

SEQ ID NO: 153820 - RNA, 19 nt, Homo sapiens
gcgcaauagcccagaagau

SEQ ID NO: 153821 - RNA, 19 nt, Homo sapiens
gaagaacguugacccauuu

SEQ ID NO: 153822 - RNA, 19 nt, Homo sapiens
aaagauaccugaaguguug

SEQ ID NO: 153823 - RNA, 19 nt, Homo sapiens
gggaggaacucgaaucauu

SEQ ID NO: 153824 - RNA, 19 nt, Homo sapiens
gcagcuaccucaugacuau

SEQ ID NO: 153825 - RNA, 19 nt, Homo sapiens
ccaauaggaucaacaguga

SEQ ID NO: 153826 - RNA, 19 nt, Homo sapiens
gaaaagacccuguuuguga

SEQ ID NO: 153827 - RNA, 19 nt, Homo sapiens
uaagaugacuacagaccua

SEQ ID NO: 153828 - RNA, 19 nt, Homo sapiens
gcagguccauaccaaguaa

SEQ ID NO: 153829 - RNA, 19 nt, Homo sapiens
guugaugucucaggaauaa

SEQ ID NO: 153830 - RNA, 19 nt, Homo sapiens
caagaaagcaaagugauuu

SEQ ID NO: 153831 - RNA, 19 nt, Homo sapiens
gaggaacucgaaucauuua

SEQ ID NO: 153832 - RNA, 19 nt, Homo sapiens
gggaauuucugguuggauu

SEQ ID NO: 153833 - RNA, 19 nt, Homo sapiens
gcuauggguuguucaagaa

SEQ ID NO: 153834 - RNA, 19 nt, Homo sapiens
gaagagagcccuugguaac

SEQ ID NO: 153835 - RNA, 19 nt, Homo sapiens
aggaaugucuucugucuuu

SEQ ID NO: 153836 - RNA, 19 nt, Homo sapiens
ugaagaacguugacccauu

SEQ ID NO: 153837 - RNA, 19 nt, Homo sapiens
ggaccauucugccuugcua

SEQ ID NO: 153838 - RNA, 19 nt, Homo sapiens
gguaaggccugaucauagu

SEQ ID NO: 153839 - RNA, 19 nt, Homo sapiens
ggaggaaugucuucugucu

SEQ ID NO: 153840 - RNA, 19 nt, Homo sapiens
ggaggaacucgaaucauuu

SEQ ID NO: 153841 - RNA, 19 nt, Homo sapiens
gagaguaacaggccauuug

SEQ ID NO: 153842 - RNA, 19 nt, Homo sapiens
caagucugcuguucuaugu

SEQ ID NO: 153843 - RNA, 19 nt, Homo sapiens
guucuuagauugcaguuuc

SEQ ID NO: 153844 - RNA, 19 nt, Homo sapiens
gaacaaucacgacaggaaa

SEQ ID NO: 153845 - RNA, 19 nt, Homo sapiens
caucaaagauaccugaagu

SEQ ID NO: 153846 - RNA, 19 nt, Homo sapiens
cagcaacacugauacuugu

SEQ ID NO: 153847 - RNA, 19 nt, Homo sapiens
uguagugggugguuuguaa

SEQ ID NO: 153848 - RNA, 19 nt, Homo sapiens
ccucuuaucugagaaguga

SEQ ID NO: 153849 - RNA, 19 nt, Homo sapiens
gcaccugauuuggccaaua

SEQ ID NO: 153850 - RNA, 19 nt, Homo sapiens
ucacuccucuuaucugaga

SEQ ID NO: 153851 - RNA, 19 nt, Homo sapiens
gguaguuguucuuagauug

SEQ ID NO: 153852 - RNA, 19 nt, Homo sapiens
cagaagagagcccuuggua

SEQ ID NO: 153853 - RNA, 19 nt, Homo sapiens
ugaacaacuugaacaauca

SEQ ID NO: 153854 - RNA, 19 nt, Homo sapiens
gggccuaacaccauucaua

SEQ ID NO: 153855 - RNA, 19 nt, Homo sapiens
gauugcaguuucuuauguu

SEQ ID NO: 153856 - RNA, 19 nt, Homo sapiens
gcagcaacacugauacuug

SEQ ID NO: 153857 - RNA, 19 nt, Homo sapiens
gggaagggauacagagcuu

SEQ ID NO: 153858 - RNA, 19 nt, Homo sapiens
cacuagcccuggcaccuua

SEQ ID NO: 153859 - RNA, 19 nt, Homo sapiens
gagcuucaucugaccauuu

SEQ ID NO: 153860 - RNA, 19 nt, Homo sapiens
ggaaggaugucugcagaac

SEQ ID NO: 153861 - RNA, 19 nt, Homo sapiens
ggaacucgaaucauuuaug

SEQ ID NO: 153862 - RNA, 19 nt, Homo sapiens
aggcaagucugcuguucua

SEQ ID NO: 153863 - RNA, 19 nt, Homo sapiens
gaugacuacagaccuauuu

SEQ ID NO: 153864 - RNA, 19 nt, Homo sapiens
ccgcgcagcuaccucauga

SEQ ID NO: 153865 - RNA, 19 nt, Homo sapiens
gcacuuuagcuuccacuug

SEQ ID NO: 153866 - RNA, 19 nt, Homo sapiens
aaggaugucugcagaacuu

SEQ ID NO: 153867 - RNA, 19 nt, Homo sapiens
gagguccacuuccuuucuu

SEQ ID NO: 153868 - RNA, 19 nt, Homo sapiens
gcaagucugcuguucuaug

SEQ ID NO: 153869 - RNA, 19 nt, Homo sapiens
gagaagugaccuuuuauuu

SEQ ID NO: 153870 - RNA, 19 nt, Homo sapiens
agauaaugccuaagaauga

SEQ ID NO: 153871 - RNA, 19 nt, Homo sapiens
ucaagaaagcaaagugauu

SEQ ID NO: 153872 - RNA, 19 nt, Homo sapiens
gguauuauaguucaucuuc

SEQ ID NO: 153873 - RNA, 19 nt, Homo sapiens
gaucccagggugagaguaa

SEQ ID NO: 153874 - RNA, 19 nt, Homo sapiens
ugaagacuccaaaguagaa

SEQ ID NO: 153875 - RNA, 19 nt, Homo sapiens
agaaagagaggaaggaugu

SEQ ID NO: 153876 - RNA, 19 nt, Homo sapiens
caaagauaccugaaguguu

SEQ ID NO: 153877 - RNA, 19 nt, Homo sapiens
aagaaugaccgcugaagaa

SEQ ID NO: 153878 - RNA, 19 nt, Homo sapiens
cagauaaugccuaagaaug

SEQ ID NO: 153879 - RNA, 19 nt, Homo sapiens
ucaaauaucaaccuaccaa

SEQ ID NO: 153880 - RNA, 19 nt, Homo sapiens
cugcaaggauuagaagaaa

SEQ ID NO: 153881 - RNA, 19 nt, Homo sapiens
ggaauuucugguuggauuu

SEQ ID NO: 153882 - RNA, 19 nt, Homo sapiens
aauaaucccgggagaauga

SEQ ID NO: 153883 - RNA, 19 nt, Homo sapiens
uuguggaucugcuuuguuu

SEQ ID NO: 153884 - RNA, 19 nt, Homo sapiens
uagagcagguccauaccaa

SEQ ID NO: 153885 - RNA, 19 nt, Homo sapiens
uuucuugccuuuccuguug

SEQ ID NO: 153886 - RNA, 19 nt, Homo sapiens
uugaacaacuugaacaauc

SEQ ID NO: 153887 - RNA, 19 nt, Homo sapiens
gaaguugauuuucagaaug

SEQ ID NO: 153888 - RNA, 19 nt, Homo sapiens
aauugaagacuccaaagua

SEQ ID NO: 153889 - RNA, 19 nt, Homo sapiens
guucaucuucccauucuuu

SEQ ID NO: 153890 - RNA, 19 nt, Homo sapiens
ccuaacaccauucauauuc

SEQ ID NO: 153891 - RNA, 19 nt, Homo sapiens
aaagacagaagaggcaaua

SEQ ID NO: 153892 - RNA, 19 nt, Homo sapiens
gacccuguuugugaauaua

SEQ ID NO: 153893 - RNA, 19 nt, Homo sapiens
ccacugguguccugggaau

SEQ ID NO: 153894 - RNA, 19 nt, Homo sapiens
gugcauguuuggaguuugu

SEQ ID NO: 153895 - RNA, 19 nt, Homo sapiens
ucugagaagugaccuuuua

SEQ ID NO: 153896 - RNA, 19 nt, Homo sapiens
gaacguugacccauuugag

SEQ ID NO: 153897 - RNA, 19 nt, Homo sapiens
caccuaugguucaguguug

SEQ ID NO: 153898 - RNA, 19 nt, Homo sapiens
ggccuaacaccauucauau

SEQ ID NO: 153899 - RNA, 19 nt, Homo sapiens
caccugauuuggccaauag

SEQ ID NO: 153900 - RNA, 19 nt, Homo sapiens
ugucacuccucuuaucuga

SEQ ID NO: 153901 - RNA, 19 nt, Homo sapiens
guugguaucugagaauauc

SEQ ID NO: 153902 - RNA, 19 nt, Homo sapiens
ugugguaguuguucuuaga

SEQ ID NO: 153903 - RNA, 19 nt, Homo sapiens
uaagaaugaccgcugaaga

SEQ ID NO: 153904 - RNA, 19 nt, Homo sapiens
ucuucugucuuugguauua

SEQ ID NO: 153905 - RNA, 19 nt, Homo sapiens
ggaaugucuucugucuuug

SEQ ID NO: 153906 - RNA, 19 nt, Homo sapiens
aagcagcccuuagaggaaa

SEQ ID NO: 153907 - RNA, 19 nt, Homo sapiens
guuaaacagguuagauuga

SEQ ID NO: 153908 - RNA, 19 nt, Homo sapiens
ccaaaugaugggaagauga

SEQ ID NO: 153909 - RNA, 19 nt, Homo sapiens
uaucugagaauaucuguca

SEQ ID NO: 153910 - RNA, 19 nt, Homo sapiens
cuaccucccucacuuucuu

SEQ ID NO: 153911 - RNA, 19 nt, Homo sapiens
gauaaugccuaagaaugac

SEQ ID NO: 153912 - RNA, 19 nt, Homo sapiens
ggguaaggccugaucauag

SEQ ID NO: 153913 - RNA, 19 nt, Homo sapiens
gagcagguccauaccaagu

SEQ ID NO: 153914 - RNA, 19 nt, Homo sapiens
cuguugagcagcauaauaa

SEQ ID NO: 153915 - RNA, 19 nt, Homo sapiens
ucaaagauaccugaagugu

SEQ ID NO: 153916 - RNA, 19 nt, Homo sapiens
agauugcaguuucuuaugu

SEQ ID NO: 153917 - RNA, 19 nt, Homo sapiens
gaucaacagugaaaagaca

SEQ ID NO: 153918 - RNA, 19 nt, Homo sapiens
cgacaggaaacaugcaguu

SEQ ID NO: 153919 - RNA, 19 nt, Homo sapiens
guuaggaaguugagaaacg

SEQ ID NO: 153920 - RNA, 19 nt, Homo sapiens
gaaguguugguaucugaga

SEQ ID NO: 153921 - RNA, 19 nt, Homo sapiens
ggaagaggcucgggacaua

SEQ ID NO: 153922 - RNA, 19 nt, Homo sapiens
ccacucaucuuauagcuuu

SEQ ID NO: 153923 - RNA, 19 nt, Homo sapiens
ccagagggauugccacaua

SEQ ID NO: 153924 - RNA, 19 nt, Homo sapiens
acaaaugucuguagaagaa

SEQ ID NO: 153925 - RNA, 19 nt, Homo sapiens
gagcauagcccuucagaau

SEQ ID NO: 153926 - RNA, 19 nt, Homo sapiens
gaucauugccacaguguua

SEQ ID NO: 153927 - RNA, 19 nt, Homo sapiens
ugaugugucugaacuaaua

SEQ ID NO: 153928 - RNA, 19 nt, Homo sapiens
ggaauuggcugaggacaug

SEQ ID NO: 153929 - RNA, 19 nt, Homo sapiens
caacuugucucagaauuug

SEQ ID NO: 153930 - RNA, 19 nt, Homo sapiens
ggaaauggaagaagaagaa

SEQ ID NO: 153931 - RNA, 19 nt, Homo sapiens
gaggaugccuucuacaguu

SEQ ID NO: 153932 - RNA, 19 nt, Homo sapiens
gaaggaauuucuaccugaa

SEQ ID NO: 153933 - RNA, 19 nt, Homo sapiens
acauagugcugcagaaaua

SEQ ID NO: 153934 - RNA, 19 nt, Homo sapiens
gggcuuagcuggaaggaau

SEQ ID NO: 153935 - RNA, 19 nt, Homo sapiens
gaugguggcugacacaguu

SEQ ID NO: 153936 - RNA, 19 nt, Homo sapiens
gaacagaagguggaguaua

SEQ ID NO: 153937 - RNA, 19 nt, Homo sapiens
gcaaaccgguuccagaauc

SEQ ID NO: 153938 - RNA, 19 nt, Homo sapiens
gaucaagggucucuuaagg

SEQ ID NO: 153939 - RNA, 19 nt, Homo sapiens
caaagaugaugaugagguu

SEQ ID NO: 153940 - RNA, 19 nt, Homo sapiens
guuaaugaccgaagauaua

SEQ ID NO: 153941 - RNA, 19 nt, Homo sapiens
agaaggaguuugagaaaga

SEQ ID NO: 153942 - RNA, 19 nt, Homo sapiens
gggaacagaaguaugaaua

SEQ ID NO: 153943 - RNA, 19 nt, Homo sapiens
ccacagaaagcacagauaa

SEQ ID NO: 153944 - RNA, 19 nt, Homo sapiens
agacuucacuccauccuuu

SEQ ID NO: 153945 - RNA, 19 nt, Homo sapiens
gaauauaagucagaucagu

SEQ ID NO: 153946 - RNA, 19 nt, Homo sapiens
acagaaagcacagauaaua

SEQ ID NO: 153947 - RNA, 19 nt, Homo sapiens
cuaauaaaguggcugaaga

SEQ ID NO: 153948 - RNA, 19 nt, Homo sapiens
agaagaagaugaggaagaa

SEQ ID NO: 153949 - RNA, 19 nt, Homo sapiens
cgaaagcuguuguugaauc

SEQ ID NO: 153950 - RNA, 19 nt, Homo sapiens
uggagaagcugcugaagga

SEQ ID NO: 153951 - RNA, 19 nt, Homo sapiens
uaccaaggguuguaugaaa

SEQ ID NO: 153952 - RNA, 19 nt, Homo sapiens
agacaaagaugaugaugag

SEQ ID NO: 153953 - RNA, 19 nt, Homo sapiens
caacuucucuguggccuau

SEQ ID NO: 153954 - RNA, 19 nt, Homo sapiens
gaaccacgcaagaucauug

SEQ ID NO: 153955 - RNA, 19 nt, Homo sapiens
caaccugagugagcagaua

SEQ ID NO: 153956 - RNA, 19 nt, Homo sapiens
gaauaucuccaucucaaug

SEQ ID NO: 153957 - RNA, 19 nt, Homo sapiens
uaaggaggcugagauggaa

SEQ ID NO: 153958 - RNA, 19 nt, Homo sapiens
gaauggaucaguauuucaa

SEQ ID NO: 153959 - RNA, 19 nt, Homo sapiens
gaggaaaggauaucacaga

SEQ ID NO: 153960 - RNA, 19 nt, Homo sapiens
gauguuaacagaggcaaua

SEQ ID NO: 153961 - RNA, 19 nt, Homo sapiens
gaaauccaaggcuaucauu

SEQ ID NO: 153962 - RNA, 19 nt, Homo sapiens
uccgaaagcuguuguugaa

SEQ ID NO: 153963 - RNA, 19 nt, Homo sapiens
ggacucaaaggaagacaaa

SEQ ID NO: 153964 - RNA, 19 nt, Homo sapiens
uaagaaccaugaugaagag

SEQ ID NO: 153965 - RNA, 19 nt, Homo sapiens
ggaacagaaguaugaauau

SEQ ID NO: 153966 - RNA, 19 nt, Homo sapiens
ugaggaagaaggagaagua

SEQ ID NO: 153967 - RNA, 19 nt, Homo sapiens
ugucugaacuaauaaagug

SEQ ID NO: 153968 - RNA, 19 nt, Homo sapiens
ggaggagucugaccacaac

SEQ ID NO: 153969 - RNA, 19 nt, Homo sapiens
gaacugguaacacccauuc

SEQ ID NO: 153970 - RNA, 19 nt, Homo sapiens
gaugaagagucccuugagu

SEQ ID NO: 153971 - RNA, 19 nt, Homo sapiens
gcgcugcucuuuagggaau

SEQ ID NO: 153972 - RNA, 19 nt, Homo sapiens
gcugaaaggcgacauagug

SEQ ID NO: 153973 - RNA, 19 nt, Homo sapiens
caugacggcugucugcuau

SEQ ID NO: 153974 - RNA, 19 nt, Homo sapiens
gcauagcccuucagaaucc

SEQ ID NO: 153975 - RNA, 19 nt, Homo sapiens
gcccagagucuuaagauug

SEQ ID NO: 153976 - RNA, 19 nt, Homo sapiens
gaaagacaaagaugaugau

SEQ ID NO: 153977 - RNA, 19 nt, Homo sapiens
gggacacuaugacaacuau

SEQ ID NO: 153978 - RNA, 19 nt, Homo sapiens
ucacagccuucuucaagug

SEQ ID NO: 153979 - RNA, 19 nt, Homo sapiens
gaggaggaguuagagaaga

SEQ ID NO: 153980 - RNA, 19 nt, Homo sapiens
ccauugaccagauccauaa

SEQ ID NO: 153981 - RNA, 19 nt, Homo sapiens
caaguuuauuggagaguug

SEQ ID NO: 153982 - RNA, 19 nt, Homo sapiens
gaaagcuguuguugaaucg

SEQ ID NO: 153983 - RNA, 19 nt, Homo sapiens
gugaguuccugcuugguuu

SEQ ID NO: 153984 - RNA, 19 nt, Homo sapiens
ggaagaagaagaagaugag

SEQ ID NO: 153985 - RNA, 19 nt, Homo sapiens
ggaaauucaugagccuaau

SEQ ID NO: 153986 - RNA, 19 nt, Homo sapiens
cacggugccuguaauuauu

SEQ ID NO: 153987 - RNA, 19 nt, Homo sapiens
gugggugccuguaguguga

SEQ ID NO: 153988 - RNA, 19 nt, Homo sapiens
gaaauaccugugugacgaa

SEQ ID NO: 153989 - RNA, 19 nt, Homo sapiens
cugaggacauggaaauuga

SEQ ID NO: 153990 - RNA, 19 nt, Homo sapiens
aggaauaucuccaucucaa

SEQ ID NO: 153991 - RNA, 19 nt, Homo sapiens
cagaggcaauaaugcauga

SEQ ID NO: 153992 - RNA, 19 nt, Homo sapiens
ugacgcagcuggccaucga

SEQ ID NO: 153993 - RNA, 19 nt, Homo sapiens
ucacaaugcugagaacauc

SEQ ID NO: 153994 - RNA, 19 nt, Homo sapiens
ccagccaacuugucucaga

SEQ ID NO: 153995 - RNA, 19 nt, Homo sapiens
ggaggaaauggaagaagaa

SEQ ID NO: 153996 - RNA, 19 nt, Homo sapiens
ggacauggaaauugacauc

SEQ ID NO: 153997 - RNA, 19 nt, Homo sapiens
gaagaaauccaaggcuauc

SEQ ID NO: 153998 - RNA, 19 nt, Homo sapiens
ccaagaccauugaccagau

SEQ ID NO: 153999 - RNA, 19 nt, Homo sapiens
gaucugcgagggagcaauu

SEQ ID NO: 154000 - RNA, 19 nt, Homo sapiens
gaguuggcccagagucuua

SEQ ID NO: 154001 - RNA, 19 nt, Homo sapiens
ucaaacugcuuaagaacca

SEQ ID NO: 154002 - RNA, 19 nt, Homo sapiens
uaacagaggcaauaaugca

SEQ ID NO: 154003 - RNA, 19 nt, Homo sapiens
gaagagaggagaggaacug

SEQ ID NO: 154004 - RNA, 19 nt, Homo sapiens
uaugaaaucuuggaauugg

SEQ ID NO: 154005 - RNA, 19 nt, Homo sapiens
gcuucccacucaucuuaua

SEQ ID NO: 154006 - RNA, 19 nt, Homo sapiens
gaaauucaugagccuaaug

SEQ ID NO: 154007 - RNA, 19 nt, Homo sapiens
gagauuacaaagccucuga

SEQ ID NO: 154008 - RNA, 19 nt, Homo sapiens
guuaacagaggcaauaaug

SEQ ID NO: 154009 - RNA, 19 nt, Homo sapiens
ucagaaggaguuugagaaa

SEQ ID NO: 154010 - RNA, 19 nt, Homo sapiens
gaugucagaaggaguuuga

SEQ ID NO: 154011 - RNA, 19 nt, Homo sapiens
ugucugcuauucugcaauu

SEQ ID NO: 154012 - RNA, 19 nt, Homo sapiens
gcaaaagcauggguccuaa

SEQ ID NO: 154013 - RNA, 19 nt, Homo sapiens
agaaagcacagauaauaga

SEQ ID NO: 154014 - RNA, 19 nt, Homo sapiens
ccgaauggaucaguauuuc

SEQ ID NO: 154015 - RNA, 19 nt, Homo sapiens
gggcugcucugugagauca

SEQ ID NO: 154016 - RNA, 19 nt, Homo sapiens
ucaaguggcuccgugaagu

SEQ ID NO: 154017 - RNA, 19 nt, Homo sapiens
gagcuguucagggagauua

SEQ ID NO: 154018 - RNA, 19 nt, Homo sapiens
ggcgcuccauccugaauaa

SEQ ID NO: 154019 - RNA, 19 nt, Homo sapiens
uagcaaaccgguuccagaa

SEQ ID NO: 154020 - RNA, 19 nt, Homo sapiens
gggcacagagauauauuau

SEQ ID NO: 154021 - RNA, 19 nt, Homo sapiens
ggaagaagcugacuaaaga

SEQ ID NO: 154022 - RNA, 19 nt, Homo sapiens
gaagaacuccuuaaacuaa

SEQ ID NO: 154023 - RNA, 19 nt, Homo sapiens
gcaguuagcuaaauuacaa

SEQ ID NO: 154024 - RNA, 19 nt, Homo sapiens
gaauuggucccuccuauua

SEQ ID NO: 154025 - RNA, 19 nt, Homo sapiens
guaagaggcauacuaaaua

SEQ ID NO: 154026 - RNA, 19 nt, Homo sapiens
guacauuucuagugaagua

SEQ ID NO: 154027 - RNA, 19 nt, Homo sapiens
gaacagagagccauugcua

SEQ ID NO: 154028 - RNA, 19 nt, Homo sapiens
uaacaucucucccaaacuu

SEQ ID NO: 154029 - RNA, 19 nt, Homo sapiens
caaaucaacucuucaaugg

SEQ ID NO: 154030 - RNA, 19 nt, Homo sapiens
caaagacgaucaaucaaau

SEQ ID NO: 154031 - RNA, 19 nt, Homo sapiens
ggacaaagcccuagaagag

SEQ ID NO: 154032 - RNA, 19 nt, Homo sapiens
guuagaaacugcugaagaa

SEQ ID NO: 154033 - RNA, 19 nt, Homo sapiens
uaagccagcucuaccauaa

SEQ ID NO: 154034 - RNA, 19 nt, Homo sapiens
gcacuucuaugacauggaa

SEQ ID NO: 154035 - RNA, 19 nt, Homo sapiens
gugaacaucuuaaugacua

SEQ ID NO: 154036 - RNA, 19 nt, Homo sapiens
caacaaagcaaggucaaua

SEQ ID NO: 154037 - RNA, 19 nt, Homo sapiens
uagaagcgaugaagauaaa

SEQ ID NO: 154038 - RNA, 19 nt, Homo sapiens
agaacuagcucaaccacua

SEQ ID NO: 154039 - RNA, 19 nt, Homo sapiens
gaaaugcacuuugcucagu

SEQ ID NO: 154040 - RNA, 19 nt, Homo sapiens
cuuaaugacuagcuucuua

SEQ ID NO: 154041 - RNA, 19 nt, Homo sapiens
caaguucuuugaucaguuu

SEQ ID NO: 154042 - RNA, 19 nt, Homo sapiens
ggaagaacuccuuaaacua

SEQ ID NO: 154043 - RNA, 19 nt, Homo sapiens
ggaaacaucaaauucauug

SEQ ID NO: 154044 - RNA, 19 nt, Homo sapiens
gaugguuguugccguaaua

SEQ ID NO: 154045 - RNA, 19 nt, Homo sapiens
caaggacagucgaaggaua

SEQ ID NO: 154046 - RNA, 19 nt, Homo sapiens
gaccaaagacgaucaauca

SEQ ID NO: 154047 - RNA, 19 nt, Homo sapiens
gauaacaucucucccaaac

SEQ ID NO: 154048 - RNA, 19 nt, Homo sapiens
gaauaaggaccgcauguug

SEQ ID NO: 154049 - RNA, 19 nt, Homo sapiens
gauaaaggauuugugaaca

SEQ ID NO: 154050 - RNA, 19 nt, Homo sapiens
aaacuguugugacugaaua

SEQ ID NO: 154051 - RNA, 19 nt, Homo sapiens
gcacuuugcucaguaauac

SEQ ID NO: 154052 - RNA, 19 nt, Homo sapiens
ugacaucccuuuggugaaa

SEQ ID NO: 154053 - RNA, 19 nt, Homo sapiens
gauagaagcgaugaagaua

SEQ ID NO: 154054 - RNA, 19 nt, Homo sapiens
gcucagucguuccuaauga

SEQ ID NO: 154055 - RNA, 19 nt, Homo sapiens
ugaaacaaauggugagaau

SEQ ID NO: 154056 - RNA, 19 nt, Homo sapiens
caucauaaguucucaagca

SEQ ID NO: 154057 - RNA, 19 nt, Homo sapiens
agaaacugcugaagaagaa

SEQ ID NO: 154058 - RNA, 19 nt, Homo sapiens
gaaauguugaugucuauga

SEQ ID NO: 154059 - RNA, 19 nt, Homo sapiens
gcaaagcaccacauucaga

SEQ ID NO: 154060 - RNA, 19 nt, Homo sapiens
agucuaaacucauccuuaa

SEQ ID NO: 154061 - RNA, 19 nt, Homo sapiens
uagcaacacugaauacugu

SEQ ID NO: 154062 - RNA, 19 nt, Homo sapiens
caaaugaggcugucaaugg

SEQ ID NO: 154063 - RNA, 19 nt, Homo sapiens
gauguuaaguaaggaauug

SEQ ID NO: 154064 - RNA, 19 nt, Homo sapiens
cgaaugugcuccuugaugu

SEQ ID NO: 154065 - RNA, 19 nt, Homo sapiens
guagauaaaggauuuguga

SEQ ID NO: 154066 - RNA, 19 nt, Homo sapiens
gaaaugagggcuccuaaac

SEQ ID NO: 154067 - RNA, 19 nt, Homo sapiens
gagaugggaggcaaguuua

SEQ ID NO: 154068 - RNA, 19 nt, Homo sapiens
gcuccuugauguuaaguaa

SEQ ID NO: 154069 - RNA, 19 nt, Homo sapiens
aaaccgaacuagaaauguu

SEQ ID NO: 154070 - RNA, 19 nt, Homo sapiens
cauagucuaccaucaaaua

SEQ ID NO: 154071 - RNA, 19 nt, Homo sapiens
gcuaugauguaacugcauu

SEQ ID NO: 154072 - RNA, 19 nt, Homo sapiens
agaaggaacuguugaagca

SEQ ID NO: 154073 - RNA, 19 nt, Homo sapiens
ccagguagcggaauuggua

SEQ ID NO: 154074 - RNA, 19 nt, Homo sapiens
ccaaagacgaucaaucaaa

SEQ ID NO: 154075 - RNA, 19 nt, Homo sapiens
gaacgagccaaguccuuaa

SEQ ID NO: 154076 - RNA, 19 nt, Homo sapiens
gccaaagccuuaaauugug

SEQ ID NO: 154077 - RNA, 19 nt, Homo sapiens
gaacuguugaagcaaauaa

SEQ ID NO: 154078 - RNA, 19 nt, Homo sapiens
ggacugaguuucuuauucc

SEQ ID NO: 154079 - RNA, 19 nt, Homo sapiens
gaaucuauccuucauaagu

SEQ ID NO: 154080 - RNA, 19 nt, Homo sapiens
agauauaacccaagaguuu

SEQ ID NO: 154081 - RNA, 19 nt, Homo sapiens
gaagauauaacccaagagu

SEQ ID NO: 154082 - RNA, 19 nt, Homo sapiens
ugacuagcuucuuacagua

SEQ ID NO: 154083 - RNA, 19 nt, Homo sapiens
ggugagcauuucagaacua

SEQ ID NO: 154084 - RNA, 19 nt, Homo sapiens
gaacuagaaauguugaugu

SEQ ID NO: 154085 - RNA, 19 nt, Homo sapiens
caaaguauagcucacugua

SEQ ID NO: 154086 - RNA, 19 nt, Homo sapiens
uagaagagccaaaguauag

SEQ ID NO: 154087 - RNA, 19 nt, Homo sapiens
gaugcaaucuucaggaaag

SEQ ID NO: 154088 - RNA, 19 nt, Homo sapiens
gcacgucaguuaggauuuc

SEQ ID NO: 154089 - RNA, 19 nt, Homo sapiens
uacaguacauuucuaguga

SEQ ID NO: 154090 - RNA, 19 nt, Homo sapiens
gcaaguucuuugaucaguu

SEQ ID NO: 154091 - RNA, 19 nt, Homo sapiens
caucaugccucccacacaa

SEQ ID NO: 154092 - RNA, 19 nt, Homo sapiens
gacagugggaccuagauua

SEQ ID NO: 154093 - RNA, 19 nt, Homo sapiens
acgaaucuauccuucauaa

SEQ ID NO: 154094 - RNA, 19 nt, Homo sapiens
gaaaauucauuccgcugua

SEQ ID NO: 154095 - RNA, 19 nt, Homo sapiens
aaacaacuccgcaaacgaa

SEQ ID NO: 154096 - RNA, 19 nt, Homo sapiens
ggcuuuaugugcuagauuu

SEQ ID NO: 154097 - RNA, 19 nt, Homo sapiens
gaaggaaagggacugaguu

SEQ ID NO: 154098 - RNA, 19 nt, Homo sapiens
caaauucauuggagagcuu

SEQ ID NO: 154099 - RNA, 19 nt, Homo sapiens
gcaaacaacuccgcaaacg

SEQ ID NO: 154100 - RNA, 19 nt, Homo sapiens
gaucguuaaugcccuugaa

SEQ ID NO: 154101 - RNA, 19 nt, Homo sapiens
caacuacuacuaucuuuca

SEQ ID NO: 154102 - RNA, 19 nt, Homo sapiens
caaauaaaguuggauccau

SEQ ID NO: 154103 - RNA, 19 nt, Homo sapiens
gggacugaguuucuuauuc

SEQ ID NO: 154104 - RNA, 19 nt, Homo sapiens
guaaucauccugucacuag

SEQ ID NO: 154105 - RNA, 19 nt, Homo sapiens
cuuaauggaucaguacuuu

SEQ ID NO: 154106 - RNA, 19 nt, Homo sapiens
gcaaaacgcucagaaaugg

SEQ ID NO: 154107 - RNA, 19 nt, Homo sapiens
aaguauagcucacuguaug

SEQ ID NO: 154108 - RNA, 19 nt, Homo sapiens
gcaaucuucaggaaaguaa

SEQ ID NO: 154109 - RNA, 19 nt, Homo sapiens
aagaagauauaacccaaga

SEQ ID NO: 154110 - RNA, 19 nt, Homo sapiens
gaagggauagccacaagug

SEQ ID NO: 154111 - RNA, 19 nt, Homo sapiens
uagcagcaugcaauaauua

SEQ ID NO: 154112 - RNA, 19 nt, Homo sapiens
guaacugcauuugaccuaa

SEQ ID NO: 154113 - RNA, 19 nt, Homo sapiens
gaagcugacuaaagaacca

SEQ ID NO: 154114 - RNA, 19 nt, Homo sapiens
gaccgcauguuggagauuu

SEQ ID NO: 154115 - RNA, 19 nt, Homo sapiens
gaaaggacagcuuaaugca

SEQ ID NO: 154116 - RNA, 19 nt, Homo sapiens
cauaggcuguuuuaaguua

SEQ ID NO: 154117 - RNA, 19 nt, Homo sapiens
gauaguauauuagcagcau

SEQ ID NO: 154118 - RNA, 19 nt, Homo sapiens
caagaucgagaaugguuaa

SEQ ID NO: 154119 - RNA, 19 nt, Homo sapiens
gaugacaacuccgcagcaa

SEQ ID NO: 154120 - RNA, 19 nt, Homo sapiens
ucagacgccuccuaauuuc

SEQ ID NO: 154121 - RNA, 19 nt, Homo sapiens
ccaaagaacuugccaaaga

SEQ ID NO: 154122 - RNA, 19 nt, Homo sapiens
caaccuagcuuaacaguau

SEQ ID NO: 154123 - RNA, 19 nt, Homo sapiens
caacguaucccaccaaaua

SEQ ID NO: 154124 - RNA, 19 nt, Homo sapiens
ugaaguaacuggcuccuua

SEQ ID NO: 154125 - RNA, 19 nt, Homo sapiens
gcacuuaacuagcaaccua

SEQ ID NO: 154126 - RNA, 19 nt, Homo sapiens
guaaucgucuucaagguua

SEQ ID NO: 154127 - RNA, 19 nt, Homo sapiens
gaaagaagaggguguuauu

SEQ ID NO: 154128 - RNA, 19 nt, Homo sapiens
guugauaacuuccucauga

SEQ ID NO: 154129 - RNA, 19 nt, Homo sapiens
agaaauaugucuccaaaga

SEQ ID NO: 154130 - RNA, 19 nt, Homo sapiens
aaacuugguuggcuugaua

SEQ ID NO: 154131 - RNA, 19 nt, Homo sapiens
gcagaaagacuggauguaa

SEQ ID NO: 154132 - RNA, 19 nt, Homo sapiens
ccagggaaauuauuacauu

SEQ ID NO: 154133 - RNA, 19 nt, Homo sapiens
ugaacugucuuaaggauuu

SEQ ID NO: 154134 - RNA, 19 nt, Homo sapiens
cgaauaagcugcaagacau

SEQ ID NO: 154135 - RNA, 19 nt, Homo sapiens
cagaaagacuggauguaaa

SEQ ID NO: 154136 - RNA, 19 nt, Homo sapiens
gagcaggauuugaaacuug

SEQ ID NO: 154137 - RNA, 19 nt, Homo sapiens
gagguagacugauaaugaa

SEQ ID NO: 154138 - RNA, 19 nt, Homo sapiens
caaagcagaaccauuuaua

SEQ ID NO: 154139 - RNA, 19 nt, Homo sapiens
gaaaaggccucuaagaaau

SEQ ID NO: 154140 - RNA, 19 nt, Homo sapiens
cauaaacucugcacauuca

SEQ ID NO: 154141 - RNA, 19 nt, Homo sapiens
caaagagauucgugucaaa

SEQ ID NO: 154142 - RNA, 19 nt, Homo sapiens
gcacagacccaguuugaug

SEQ ID NO: 154143 - RNA, 19 nt, Homo sapiens
cgauauugaugccauuuaa

SEQ ID NO: 154144 - RNA, 19 nt, Homo sapiens
gaaacagauuugcauguca

SEQ ID NO: 154145 - RNA, 19 nt, Homo sapiens
uaacuggaauucuguagga

SEQ ID NO: 154146 - RNA, 19 nt, Homo sapiens
gaaauaugucuccaaagaa

SEQ ID NO: 154147 - RNA, 19 nt, Homo sapiens
gaagaggguguuauugauu

SEQ ID NO: 154148 - RNA, 19 nt, Homo sapiens
gcaauggaaucaagacagu

SEQ ID NO: 154149 - RNA, 19 nt, Homo sapiens
aaacauagcauacaagcaa

SEQ ID NO: 154150 - RNA, 19 nt, Homo sapiens
uuaaaccucuuggcaguua

SEQ ID NO: 154151 - RNA, 19 nt, Homo sapiens
gagcacagacccaguuuga

SEQ ID NO: 154152 - RNA, 19 nt, Homo sapiens
cacauaaucugaacuuugu

SEQ ID NO: 154153 - RNA, 19 nt, Homo sapiens
gagggaaugugcuuuguca

SEQ ID NO: 154154 - RNA, 19 nt, Homo sapiens
gaaucgauaggguuaauuu

SEQ ID NO: 154155 - RNA, 19 nt, Homo sapiens
ugaccucaguguccuauaa

SEQ ID NO: 154156 - RNA, 19 nt, Homo sapiens
ugagguagacugauaauga

SEQ ID NO: 154157 - RNA, 19 nt, Homo sapiens
ggguuuaugucuuuauuug

SEQ ID NO: 154158 - RNA, 19 nt, Homo sapiens
ugucaaagcagaaccauuu

SEQ ID NO: 154159 - RNA, 19 nt, Homo sapiens
ggaaaaggccucuaagaaa

SEQ ID NO: 154160 - RNA, 19 nt, Homo sapiens
ccaaagagauucgugucaa

SEQ ID NO: 154161 - RNA, 19 nt, Homo sapiens
cauguuggauggauucauu

SEQ ID NO: 154162 - RNA, 19 nt, Homo sapiens
caaagaacuugccaaagag

SEQ ID NO: 154163 - RNA, 19 nt, Homo sapiens
ugauucaucugacaaagaa

SEQ ID NO: 154164 - RNA, 19 nt, Homo sapiens
ccauauaccuggagggaau

SEQ ID NO: 154165 - RNA, 19 nt, Homo sapiens
ggacacacaagaguugaua

SEQ ID NO: 154166 - RNA, 19 nt, Homo sapiens
caaaggcaauggaaucaag

SEQ ID NO: 154167 - RNA, 19 nt, Homo sapiens
gcuaaaagcauacuucuaa

SEQ ID NO: 154168 - RNA, 19 nt, Homo sapiens
ggacacauuuggaucacau

SEQ ID NO: 154169 - RNA, 19 nt, Homo sapiens
gagaauagugacaguggua

SEQ ID NO: 154170 - RNA, 19 nt, Homo sapiens
aaacagauuugcaugucaa

SEQ ID NO: 154171 - RNA, 19 nt, Homo sapiens
gaucucaugaggcgaauaa

SEQ ID NO: 154172 - RNA, 19 nt, Homo sapiens
aggcugaucugcuuucauu

SEQ ID NO: 154173 - RNA, 19 nt, Homo sapiens
gagaaucgauaggguuaau

SEQ ID NO: 154174 - RNA, 19 nt, Homo sapiens
ugccugaucuaaacucaua

SEQ ID NO: 154175 - RNA, 19 nt, Homo sapiens
caaggaagggugcacuuaa

SEQ ID NO: 154176 - RNA, 19 nt, Homo sapiens
gaugcaaccuagcuuaaca

SEQ ID NO: 154177 - RNA, 19 nt, Homo sapiens
gauguacgaugcagaccuu

SEQ ID NO: 154178 - RNA, 19 nt, Homo sapiens
guucacagguuauccuaau

SEQ ID NO: 154179 - RNA, 19 nt, Homo sapiens
uguaagacuugggauauuu

SEQ ID NO: 154180 - RNA, 19 nt, Homo sapiens
gaagaagaggucaucauca

SEQ ID NO: 154181 - RNA, 19 nt, Homo sapiens
gaagauuagagaacagauu

SEQ ID NO: 154182 - RNA, 19 nt, Homo sapiens
gcugaucugcuuucauuaa

SEQ ID NO: 154183 - RNA, 19 nt, Homo sapiens
ccgcaaggcugaucugcuu

SEQ ID NO: 154184 - RNA, 19 nt, Homo sapiens
guaaauaugaccucagugu

SEQ ID NO: 154185 - RNA, 19 nt, Homo sapiens
acauugaggugguguauuc

SEQ ID NO: 154186 - RNA, 19 nt, Homo sapiens
gagguucuauuauaaaggu

SEQ ID NO: 154187 - RNA, 19 nt, Homo sapiens
ggaagggugcacuuaacua

SEQ ID NO: 154188 - RNA, 19 nt, Homo sapiens
ggaugagccagggaaauua

SEQ ID NO: 154189 - RNA, 19 nt, Homo sapiens
guagacugauaaugaaaug

SEQ ID NO: 154190 - RNA, 19 nt, Homo sapiens
ggauguaaagcaaacuuaa

SEQ ID NO: 154191 - RNA, 19 nt, Homo sapiens
uaacuggcuccuuacuuua

SEQ ID NO: 154192 - RNA, 19 nt, Homo sapiens
ucagugagcagauguaguu

SEQ ID NO: 154193 - RNA, 19 nt, Homo sapiens
gcucaaaggcgucgaaugg

SEQ ID NO: 154194 - RNA, 19 nt, Homo sapiens
gagcagcguuggguuuaug

SEQ ID NO: 154195 - RNA, 19 nt, Homo sapiens
gaucugcuuucauuaacug

SEQ ID NO: 154196 - RNA, 19 nt, Homo sapiens
gcguuggguuuaugucuuu

SEQ ID NO: 154197 - RNA, 19 nt, Homo sapiens
augcagggcuuuagauuug

SEQ ID NO: 154198 - RNA, 19 nt, Homo sapiens
caaauuggcaucugguaau

SEQ ID NO: 154199 - RNA, 19 nt, Homo sapiens
uaacaucaugcuacacuuu

SEQ ID NO: 154200 - RNA, 19 nt, Homo sapiens
agaagaagaugaagaugag

SEQ ID NO: 154201 - RNA, 19 nt, Homo sapiens
gguucugacuguuugagua

SEQ ID NO: 154202 - RNA, 19 nt, Homo sapiens
gcuccuuacuuuaaauguu

SEQ ID NO: 154203 - RNA, 19 nt, Homo sapiens
ugugaguggucuguuauua

SEQ ID NO: 154204 - RNA, 19 nt, Homo sapiens
ccaguuugauguuaagaau

SEQ ID NO: 154205 - RNA, 19 nt, Homo sapiens
gaacauugaggugguguau

SEQ ID NO: 154206 - RNA, 19 nt, Homo sapiens
cgaagaagaagaugaagau

SEQ ID NO: 154207 - RNA, 19 nt, Homo sapiens
ucuccaagauuccacauau

SEQ ID NO: 154208 - RNA, 19 nt, Homo sapiens
caugggcccucuuguucua

SEQ ID NO: 154209 - RNA, 19 nt, Homo sapiens
ugacacacaucauaaacuc

SEQ ID NO: 154210 - RNA, 19 nt, Homo sapiens
ucacauaaucugaacuuug

SEQ ID NO: 154211 - RNA, 19 nt, Homo sapiens
ggacucggacucggguuua

SEQ ID NO: 154212 - RNA, 19 nt, Homo sapiens
gaacucuugcagucguuua

SEQ ID NO: 154213 - RNA, 19 nt, Homo sapiens
gaagggugcacuuaacuag

SEQ ID NO: 154214 - RNA, 19 nt, Homo sapiens
ucaacaggauguaaagcaa

SEQ ID NO: 154215 - RNA, 19 nt, Homo sapiens
gauguuuggcucugaauga

SEQ ID NO: 154216 - RNA, 19 nt, Homo sapiens
augcuacacuuuacacuaa

SEQ ID NO: 154217 - RNA, 19 nt, Homo sapiens
gugagaauccugaaacaga

SEQ ID NO: 154218 - RNA, 19 nt, Homo sapiens
ccuaauagaguaauucuuc

SEQ ID NO: 154219 - RNA, 19 nt, Homo sapiens
uguaagagcaggauuugaa

SEQ ID NO: 154220 - RNA, 19 nt, Homo sapiens
ugaguggucuguuauuaag

SEQ ID NO: 154221 - RNA, 19 nt, Homo sapiens
gaagauaucugcccgucaa

SEQ ID NO: 154222 - RNA, 19 nt, Homo sapiens
gggaagaaauaugaagaua

SEQ ID NO: 154223 - RNA, 19 nt, Homo sapiens
ggaggcagcuguugcaauc

SEQ ID NO: 154224 - RNA, 19 nt, Homo sapiens
gaaguacgacuguggagaa

SEQ ID NO: 154225 - RNA, 19 nt, Homo sapiens
ggacuccuccuacacaauu

SEQ ID NO: 154226 - RNA, 19 nt, Homo sapiens
cauguaagaucgucgagau

SEQ ID NO: 154227 - RNA, 19 nt, Homo sapiens
gggugcugcuugugguuua

SEQ ID NO: 154228 - RNA, 19 nt, Homo sapiens
guacgacuguggagaagag

SEQ ID NO: 154229 - RNA, 19 nt, Homo sapiens
ucaaggccauggcaaaaua

SEQ ID NO: 154230 - RNA, 19 nt, Homo sapiens
ggaaucgaagccucuuaaa

SEQ ID NO: 154231 - RNA, 19 nt, Homo sapiens
uuacugggaagaaauauga

SEQ ID NO: 154232 - RNA, 19 nt, Homo sapiens
uaaaauggcagaugacuug

SEQ ID NO: 154233 - RNA, 19 nt, Homo sapiens
gcucagcauuacguaagaa

SEQ ID NO: 154234 - RNA, 19 nt, Homo sapiens
ccuccuacacaauuuauuu

SEQ ID NO: 154235 - RNA, 19 nt, Homo sapiens
caaucaaggccauggcaaa

SEQ ID NO: 154236 - RNA, 19 nt, Homo sapiens
gcagugauccucugaaccu

SEQ ID NO: 154237 - RNA, 19 nt, Homo sapiens
gcccgucaacucauaauau

SEQ ID NO: 154238 - RNA, 19 nt, Homo sapiens
gcgaagcuguggccuuggu

SEQ ID NO: 154239 - RNA, 19 nt, Homo sapiens
gguauugacaucuuuacug

SEQ ID NO: 154240 - RNA, 19 nt, Homo sapiens
guaagaucgucgagauguc

SEQ ID NO: 154241 - RNA, 19 nt, Homo sapiens
cagaugacuuggacuucga

SEQ ID NO: 154242 - RNA, 19 nt, Homo sapiens
gguugguauugacaucuuu

SEQ ID NO: 154243 - RNA, 19 nt, Homo sapiens
gaaucgaagccucuuaaaa

SEQ ID NO: 154244 - RNA, 19 nt, Homo sapiens
cagcagugauccucugaac

SEQ ID NO: 154245 - RNA, 19 nt, Homo sapiens
ugacuuggacuucgagaca

SEQ ID NO: 154246 - RNA, 19 nt, Homo sapiens
uggaaucgaagccucuuaa

SEQ ID NO: 154247 - RNA, 19 nt, Homo sapiens
ggacuucgagacaggagau

SEQ ID NO: 154248 - RNA, 19 nt, Homo sapiens
gaaugacuuccagcugauu

SEQ ID NO: 154249 - RNA, 19 nt, Homo sapiens
aggcagcuguugcaaucaa

SEQ ID NO: 154250 - RNA, 19 nt, Homo sapiens
ucagccaccuucccaaugc

SEQ ID NO: 154251 - RNA, 19 nt, Homo sapiens
aaucgaagccucuuaaaau

SEQ ID NO: 154252 - RNA, 19 nt, Homo sapiens
gacuccuccuacacaauuu

SEQ ID NO: 154253 - RNA, 19 nt, Homo sapiens
guugguauugacaucuuua

SEQ ID NO: 154254 - RNA, 19 nt, Homo sapiens
gauaucugcccgucaacuc

SEQ ID NO: 154255 - RNA, 19 nt, Homo sapiens
caagguccaucugguuggu

SEQ ID NO: 154256 - RNA, 19 nt, Homo sapiens
ucgucgagaugucuacuuc

SEQ ID NO: 154257 - RNA, 19 nt, Homo sapiens
ggugguggcagcagugauc

SEQ ID NO: 154258 - RNA, 19 nt, Homo sapiens
ccaggauggguaccuauca

SEQ ID NO: 154259 - RNA, 19 nt, Homo sapiens
gcaacaugcugguccuuua

SEQ ID NO: 154260 - RNA, 19 nt, Homo sapiens
gaaagacuauugagccauu

SEQ ID NO: 154261 - RNA, 19 nt, Homo sapiens
gcuuacaucuccuggauaa

SEQ ID NO: 154262 - RNA, 19 nt, Homo sapiens
uaacguggcugccggcuau

SEQ ID NO: 154263 - RNA, 19 nt, Homo sapiens
agacagaacugggugauga

SEQ ID NO: 154264 - RNA, 19 nt, Homo sapiens
ucacccaggucucugcuua

SEQ ID NO: 154265 - RNA, 19 nt, Homo sapiens
caauaggacuugcgaucaa

SEQ ID NO: 154266 - RNA, 19 nt, Homo sapiens
guucuuagaucugcaauag

SEQ ID NO: 154267 - RNA, 19 nt, Homo sapiens
gcuguaaugucuccaggaa

SEQ ID NO: 154268 - RNA, 19 nt, Homo sapiens
gcaagaaggcaguggucua

SEQ ID NO: 154269 - RNA, 19 nt, Homo sapiens
caaguauucucuccaugga

SEQ ID NO: 154270 - RNA, 19 nt, Homo sapiens
uacaucuccuggauaaaua

SEQ ID NO: 154271 - RNA, 19 nt, Homo sapiens
ggagugaccagcuuugugu

SEQ ID NO: 154272 - RNA, 19 nt, Homo sapiens
gcguuacccucaauagcua

SEQ ID NO: 154273 - RNA, 19 nt, Homo sapiens
ucuuagaucugcaauagga

SEQ ID NO: 154274 - RNA, 19 nt, Homo sapiens
ccaggucucugcuuacauc

SEQ ID NO: 154275 - RNA, 19 nt, Homo sapiens
ugucaucgccuccaacuga

SEQ ID NO: 154276 - RNA, 19 nt, Homo sapiens
uggauuaccagaagacuuu

SEQ ID NO: 154277 - RNA, 19 nt, Homo sapiens
ccaggaagccuacagucuu

SEQ ID NO: 154278 - RNA, 19 nt, Homo sapiens
caacagucccugcuacauc

SEQ ID NO: 154279 - RNA, 19 nt, Homo sapiens
caacaugcugguccuuuau

SEQ ID NO: 154280 - RNA, 19 nt, Homo sapiens
caaaaugguucuuagaucu

SEQ ID NO: 154281 - RNA, 19 nt, Homo sapiens
ccaacgaccuucccaaaau

SEQ ID NO: 154282 - RNA, 19 nt, Homo sapiens
ccagagcguuacccucaau

SEQ ID NO: 154283 - RNA, 19 nt, Homo sapiens
ggugugugcugguggagau

SEQ ID NO: 154284 - RNA, 19 nt, Homo sapiens
aggcuuaccugcccucugu

SEQ ID NO: 154285 - RNA, 19 nt, Homo sapiens
gcaagaccaagaccaaugg

SEQ ID NO: 154286 - RNA, 19 nt, Homo sapiens
cauccuggcuaacaacagu

SEQ ID NO: 154287 - RNA, 19 nt, Homo sapiens
uuacaucuccuggauaaau

SEQ ID NO: 154288 - RNA, 19 nt, Homo sapiens
gacuauugagccauugaua

SEQ ID NO: 154289 - RNA, 19 nt, Homo sapiens
aauaggacuugcgaucaaa

SEQ ID NO: 154290 - RNA, 19 nt, Homo sapiens
aacagucccugcuacauca

SEQ ID NO: 154291 - RNA, 19 nt, Homo sapiens
guacgugagugugcagaag

SEQ ID NO: 154292 - RNA, 19 nt, Homo sapiens
ucuccuggauaaauaaugu

SEQ ID NO: 154293 - RNA, 19 nt, Homo sapiens
caacgaccuucccaaaaug

SEQ ID NO: 154294 - RNA, 19 nt, Homo sapiens
ggcaagaccaagaccaaug

SEQ ID NO: 154295 - RNA, 19 nt, Homo sapiens
auugagccauugauagaaa

SEQ ID NO: 154296 - RNA, 19 nt, Homo sapiens
ccaaaaugguucuuagauc

SEQ ID NO: 154297 - RNA, 19 nt, Homo sapiens
caagaaggcaguggucuac

SEQ ID NO: 154298 - RNA, 19 nt, Homo sapiens
cuggauaaauaaugucauc

SEQ ID NO: 154299 - RNA, 19 nt, Homo sapiens
ggagguucccgguaucaca

SEQ ID NO: 154300 - RNA, 19 nt, Homo sapiens
guccaacgaccuucccaaa

SEQ ID NO: 154301 - RNA, 19 nt, Homo sapiens
ggaauuccuggcccucuca

SEQ ID NO: 154302 - RNA, 19 nt, Homo sapiens
cugcuuacaucuccuggau

SEQ ID NO: 154303 - RNA, 19 nt, Homo sapiens
ggacccuuaucagacagaa

SEQ ID NO: 154304 - RNA, 19 nt, Homo sapiens
agaaggcaguggucuacuc

SEQ ID NO: 154305 - RNA, 19 nt, Homo sapiens
gcugcucacugcguggauu

SEQ ID NO: 154306 - RNA, 19 nt, Homo sapiens
aacacauucugaaagacua

SEQ ID NO: 154307 - RNA, 19 nt, Homo sapiens
uggcaaguauucucuccau

SEQ ID NO: 154308 - RNA, 19 nt, Homo sapiens
uccuggcccucucagauuu

SEQ ID NO: 154309 - RNA, 19 nt, Homo sapiens
gucaucgccuccaacugaa

SEQ ID NO: 154310 - RNA, 19 nt, Homo sapiens
gucuggagguucccgguau

SEQ ID NO: 154311 - RNA, 19 nt, Homo sapiens
aaccugagccagaaugaug

SEQ ID NO: 154312 - RNA, 19 nt, Homo sapiens
cccaggaccuuccggaaac

SEQ ID NO: 154313 - RNA, 19 nt, Homo sapiens
agaucguggugcauccaua

SEQ ID NO: 154314 - RNA, 19 nt, Homo sapiens
accauaaccugagccagaa

SEQ ID NO: 154315 - RNA, 19 nt, Homo sapiens
cugcguggauuaccagaag

SEQ ID NO: 154316 - RNA, 19 nt, Homo sapiens
ggcaacaugcugguccuuu

SEQ ID NO: 154317 - RNA, 19 nt, Homo sapiens
cuaacaacagucccugcua

SEQ ID NO: 154318 - RNA, 19 nt, Homo sapiens
aaacacauucugaaagacu

SEQ ID NO: 154319 - RNA, 19 nt, Homo sapiens
gaucguggugcauccauac

SEQ ID NO: 154320 - RNA, 19 nt, Homo sapiens
guaaaacacauucugaaag

SEQ ID NO: 154321 - RNA, 19 nt, Homo sapiens
ggaccuuccggaaaccaau

SEQ ID NO: 154322 - RNA, 19 nt, Homo sapiens
cauacuggaacagcgauaa

SEQ ID NO: 154323 - RNA, 19 nt, Homo sapiens
uaaacuggaucgacucuau

SEQ ID NO: 154324 - RNA, 19 nt, Homo sapiens
gaucgacucuaucauccaa

SEQ ID NO: 154325 - RNA, 19 nt, Homo sapiens
uaaacuugcucaacgacau

SEQ ID NO: 154326 - RNA, 19 nt, Homo sapiens
cagcaggacccacugagaa

SEQ ID NO: 154327 - RNA, 19 nt, Homo sapiens
gggcuaauccacggaauug

SEQ ID NO: 154328 - RNA, 19 nt, Homo sapiens
gugcagcgcaucuucgaaa

SEQ ID NO: 154329 - RNA, 19 nt, Homo sapiens
gcaucuggcacaauaaaca

SEQ ID NO: 154330 - RNA, 19 nt, Homo sapiens
cagcaucuggcacaauaaa

SEQ ID NO: 154331 - RNA, 19 nt, Homo sapiens
gcacugcguggcgaaugua

SEQ ID NO: 154332 - RNA, 19 nt, Homo sapiens
cacaauaaacauucucugu

SEQ ID NO: 154333 - RNA, 19 nt, Homo sapiens
gcgcccaacuucgucaugu

SEQ ID NO: 154334 - RNA, 19 nt, Homo sapiens
ccguaaacuugcucaacga

SEQ ID NO: 154335 - RNA, 19 nt, Homo sapiens
ccagcaggacccacugaga

SEQ ID NO: 154336 - RNA, 19 nt, Homo sapiens
gaaagagacuguagcaaua

SEQ ID NO: 154337 - RNA, 19 nt, Homo sapiens
caggaucucuuuaacagua

SEQ ID NO: 154338 - RNA, 19 nt, Homo sapiens
gcuaguaaaugccaucuau

SEQ ID NO: 154339 - RNA, 19 nt, Homo sapiens
gaaacuggaaggauaaauu

SEQ ID NO: 154340 - RNA, 19 nt, Homo sapiens
ggacuaaaccugagaaucu

SEQ ID NO: 154341 - RNA, 19 nt, Homo sapiens
gcacagcuguccaagacuu

SEQ ID NO: 154342 - RNA, 19 nt, Homo sapiens
ugaagaagauugaggaaca

SEQ ID NO: 154343 - RNA, 19 nt, Homo sapiens
gaccaaacuugugcuagua

SEQ ID NO: 154344 - RNA, 19 nt, Homo sapiens
cagcaggcaucgcaacuuu

SEQ ID NO: 154345 - RNA, 19 nt, Homo sapiens
aagggaaacuggaaggaua

SEQ ID NO: 154346 - RNA, 19 nt, Homo sapiens
gaagauugaggaacaguug

SEQ ID NO: 154347 - RNA, 19 nt, Homo sapiens
cggcauaauuccucaggua

SEQ ID NO: 154348 - RNA, 19 nt, Homo sapiens
ccacgggccugaagaagau

SEQ ID NO: 154349 - RNA, 19 nt, Homo sapiens
gaagaaagagacuguagca

SEQ ID NO: 154350 - RNA, 19 nt, Homo sapiens
gaaagaagccacgacgaau

SEQ ID NO: 154351 - RNA, 19 nt, Homo sapiens
uagcaaggcugaucugucu

SEQ ID NO: 154352 - RNA, 19 nt, Homo sapiens
gaacaguugacuuuggaaa

SEQ ID NO: 154353 - RNA, 19 nt, Homo sapiens
gauaacaugaccaaacuug

SEQ ID NO: 154354 - RNA, 19 nt, Homo sapiens
gaaugcugauaucaacaaa

SEQ ID NO: 154355 - RNA, 19 nt, Homo sapiens
guccaagacuuuccauuuc

SEQ ID NO: 154356 - RNA, 19 nt, Homo sapiens
ggaaggauaaauucaugaa

SEQ ID NO: 154357 - RNA, 19 nt, Homo sapiens
aaacguggagcgucuuaua

SEQ ID NO: 154358 - RNA, 19 nt, Homo sapiens
gaggaacaguugacuuugg

SEQ ID NO: 154359 - RNA, 19 nt, Homo sapiens
gugcugaccuggccagugu

SEQ ID NO: 154360 - RNA, 19 nt, Homo sapiens
ugaaagaagccacgacgaa

SEQ ID NO: 154361 - RNA, 19 nt, Homo sapiens
ccaaacuugugcuaguaaa

SEQ ID NO: 154362 - RNA, 19 nt, Homo sapiens
cagcaugccucugaagaug

SEQ ID NO: 154363 - RNA, 19 nt, Homo sapiens
acaauuuccuuccugaguu

SEQ ID NO: 154364 - RNA, 19 nt, Homo sapiens
agaaagagacuguagcaau

SEQ ID NO: 154365 - RNA, 19 nt, Homo sapiens
ugaccaaacuugugcuagu

SEQ ID NO: 154366 - RNA, 19 nt, Homo sapiens
uaacaugaccaaacuugug

SEQ ID NO: 154367 - RNA, 19 nt, Homo sapiens
ccaagacuuuccauuucaa

SEQ ID NO: 154368 - RNA, 19 nt, Homo sapiens
uaauagagccaauaugucu

SEQ ID NO: 154369 - RNA, 19 nt, Homo sapiens
caaggaagaccauaaacca

SEQ ID NO: 154370 - RNA, 19 nt, Homo sapiens
cgucuuauauucugaaacu

SEQ ID NO: 154371 - RNA, 19 nt, Homo sapiens
gcgaggagcucagcauggu

SEQ ID NO: 154372 - RNA, 19 nt, Homo sapiens
gaagagguucauucaagau

SEQ ID NO: 154373 - RNA, 19 nt, Homo sapiens
gaagaagauugaggaacag

SEQ ID NO: 154374 - RNA, 19 nt, Homo sapiens
cuucgggcaugguugauaa

SEQ ID NO: 154375 - RNA, 19 nt, Homo sapiens
gaugcaaggaagaccauaa

SEQ ID NO: 154376 - RNA, 19 nt, Homo sapiens
ucugaaacuugcuaauaga

SEQ ID NO: 154377 - RNA, 19 nt, Homo sapiens
caauuuccuuccugaguuc

SEQ ID NO: 154378 - RNA, 19 nt, Homo sapiens
uguccaagacuuuccauuu

SEQ ID NO: 154379 - RNA, 19 nt, Homo sapiens
aaacuggaaggauaaauuc

SEQ ID NO: 154380 - RNA, 19 nt, Homo sapiens
ggucaaaggacagacagaa

SEQ ID NO: 154381 - RNA, 19 nt, Homo sapiens
gaacaauccggcuggaaac

SEQ ID NO: 154382 - RNA, 19 nt, Homo sapiens
gucaggagccagagauauu

SEQ ID NO: 154383 - RNA, 19 nt, Homo sapiens
caaaggacagacagaagga

SEQ ID NO: 154384 - RNA, 19 nt, Homo sapiens
ggagagaaaacuuacaauu

SEQ ID NO: 154385 - RNA, 19 nt, Homo sapiens
auagagccaauaugucuua

SEQ ID NO: 154386 - RNA, 19 nt, Homo sapiens
caagucauuuguggaagug

SEQ ID NO: 154387 - RNA, 19 nt, Homo sapiens
caauccggcuggaaacauc

SEQ ID NO: 154388 - RNA, 19 nt, Homo sapiens
agaacaauccggcuggaaa

SEQ ID NO: 154389 - RNA, 19 nt, Homo sapiens
cguggagcgucuuauauuc

SEQ ID NO: 154390 - RNA, 19 nt, Homo sapiens
cauaauuccucagguagca

SEQ ID NO: 154391 - RNA, 19 nt, Homo sapiens
aaagaagccacgacgaaug

SEQ ID NO: 154392 - RNA, 19 nt, Homo sapiens
uccaagacuuuccauuuca

SEQ ID NO: 154393 - RNA, 19 nt, Homo sapiens
cagguagcauccuauucuu

SEQ ID NO: 154394 - RNA, 19 nt, Homo sapiens
ucagguagcauccuauucu

SEQ ID NO: 154395 - RNA, 19 nt, Homo sapiens
gcugaucugucuggcaugu

SEQ ID NO: 154396 - RNA, 19 nt, Homo sapiens
uaagugccgugugcuggaa

SEQ ID NO: 154397 - RNA, 19 nt, Homo sapiens
aaacuugugcuaguaaaug

SEQ ID NO: 154398 - RNA, 19 nt, Homo sapiens
ggagcgucuuauauucuga

SEQ ID NO: 154399 - RNA, 19 nt, Homo sapiens
ucaggagccagagauauuu

SEQ ID NO: 154400 - RNA, 19 nt, Homo sapiens
uugaggaacaguugacuuu

SEQ ID NO: 154401 - RNA, 19 nt, Homo sapiens
cuggaaggauaaauucaug

SEQ ID NO: 154402 - RNA, 19 nt, Homo sapiens
gcuuagugcuuuauuaccu

SEQ ID NO: 154403 - RNA, 19 nt, Homo sapiens
ugaucugucuggcauguca

SEQ ID NO: 154404 - RNA, 19 nt, Homo sapiens
aaauuucacugccgaccau

SEQ ID NO: 154405 - RNA, 19 nt, Homo sapiens
aggaacaguugacuuugga

SEQ ID NO: 154406 - RNA, 19 nt, Homo sapiens
ugaaugcugauaucaacaa

SEQ ID NO: 154407 - RNA, 19 nt, Homo sapiens
agagguucauucaagauuc

SEQ ID NO: 154408 - RNA, 19 nt, Homo sapiens
gcuggaaacaucuucaucu

SEQ ID NO: 154409 - RNA, 19 nt, Homo sapiens
ugcaggaucucuuuaacag

SEQ ID NO: 154410 - RNA, 19 nt, Homo sapiens
gagucugaaugcugauauc

SEQ ID NO: 154411 - RNA, 19 nt, Homo sapiens
acaaacguggagcgucuua

SEQ ID NO: 154412 - RNA, 19 nt, Homo sapiens
ucugaaugcugauaucaac

SEQ ID NO: 154413 - RNA, 19 nt, Homo sapiens
gcaaggaagaccauaaacc

SEQ ID NO: 154414 - RNA, 19 nt, Homo sapiens
cuuccugaguucuugguuu

SEQ ID NO: 154415 - RNA, 19 nt, Homo sapiens
caaacuugugcuaguaaau

SEQ ID NO: 154416 - RNA, 19 nt, Homo sapiens
uugauaacaugaccaaacu

SEQ ID NO: 154417 - RNA, 19 nt, Homo sapiens
caucugcuauggccauggu

SEQ ID NO: 154418 - RNA, 19 nt, Homo sapiens
gagaacaauccggcuggaa

SEQ ID NO: 154419 - RNA, 19 nt, Homo sapiens
ggugugcaggaucucuuua

SEQ ID NO: 154420 - RNA, 19 nt, Homo sapiens
uucugaaacuugcuaauag

SEQ ID NO: 154421 - RNA, 19 nt, Homo sapiens
cuacaucgaggaccuuaag

SEQ ID NO: 154422 - RNA, 19 nt, Homo sapiens
guugauaacaugaccaaac

SEQ ID NO: 154423 - RNA, 19 nt, Homo sapiens
gagcgucuuauauucugaa

SEQ ID NO: 154424 - RNA, 19 nt, Homo sapiens
uagaagaaagagacuguag

SEQ ID NO: 154425 - RNA, 19 nt, Homo sapiens
gagauuuucuuccccuuag

SEQ ID NO: 154426 - RNA, 19 nt, Homo sapiens
gugcaggaucucuuuaaca

SEQ ID NO: 154427 - RNA, 19 nt, Homo sapiens
caagggaaacuggaaggau

SEQ ID NO: 154428 - RNA, 19 nt, Homo sapiens
cauaaaccagugggucaaa

SEQ ID NO: 154429 - RNA, 19 nt, Homo sapiens
ggagauuuucuuccccuua

SEQ ID NO: 154430 - RNA, 19 nt, Homo sapiens
ggaaacuggaaggauaaau

SEQ ID NO: 154431 - RNA, 19 nt, Homo sapiens
gagguucauucaagauucc

SEQ ID NO: 154432 - RNA, 19 nt, Homo sapiens
ugaaugaagagggaacaga

SEQ ID NO: 154433 - RNA, 19 nt, Homo sapiens
agucauuuguggaagugaa

SEQ ID NO: 154434 - RNA, 19 nt, Homo sapiens
gugugcaggaucucuuuaa

SEQ ID NO: 154435 - RNA, 19 nt, Homo sapiens
uggagcgucuuauauucug

SEQ ID NO: 154436 - RNA, 19 nt, Homo sapiens
caauauggcuuauggagua

SEQ ID NO: 154437 - RNA, 19 nt, Homo sapiens
gaacugcaccguuacuuua

SEQ ID NO: 154438 - RNA, 19 nt, Homo sapiens
gccaaucacuguaaaguuu

SEQ ID NO: 154439 - RNA, 19 nt, Homo sapiens
ggaacagggugguguauau

SEQ ID NO: 154440 - RNA, 19 nt, Homo sapiens
gaguaaauauugaggcuuu

SEQ ID NO: 154441 - RNA, 19 nt, Homo sapiens
gacaagagguacaggguuu

SEQ ID NO: 154442 - RNA, 19 nt, Homo sapiens
aaacacaacugucuaaugg

SEQ ID NO: 154443 - RNA, 19 nt, Homo sapiens
gggcagagcuugggauaug

SEQ ID NO: 154444 - RNA, 19 nt, Homo sapiens
gguaauugcugccauggaa

SEQ ID NO: 154445 - RNA, 19 nt, Homo sapiens
gauauggcuuugugaacua

SEQ ID NO: 154446 - RNA, 19 nt, Homo sapiens
guaaaugucuuuguaaguc

SEQ ID NO: 154447 - RNA, 19 nt, Homo sapiens
gcuaauaacccaagccaaa

SEQ ID NO: 154448 - RNA, 19 nt, Homo sapiens
ugggagaacugcaccguua

SEQ ID NO: 154449 - RNA, 19 nt, Homo sapiens
gggauaaaaugacuacuua

SEQ ID NO: 154450 - RNA, 19 nt, Homo sapiens
gaaauagaguccuguaagc

SEQ ID NO: 154451 - RNA, 19 nt, Homo sapiens
cagcaagaccaacuuaaua

SEQ ID NO: 154452 - RNA, 19 nt, Homo sapiens
gagaguauccuguggcaaa

SEQ ID NO: 154453 - RNA, 19 nt, Homo sapiens
ccuguaagcuuguaagaga

SEQ ID NO: 154454 - RNA, 19 nt, Homo sapiens
ucaacuaccuuccucagaa

SEQ ID NO: 154455 - RNA, 19 nt, Homo sapiens
guaagucaguguugagaug

SEQ ID NO: 154456 - RNA, 19 nt, Homo sapiens
guaccagucuccaaacaga

SEQ ID NO: 154457 - RNA, 19 nt, Homo sapiens
gaaacacaacugucuaaug

SEQ ID NO: 154458 - RNA, 19 nt, Homo sapiens
caacaaaggcaaguuaaga

SEQ ID NO: 154459 - RNA, 19 nt, Homo sapiens
aaaggcaaguuaagagaaa

SEQ ID NO: 154460 - RNA, 19 nt, Homo sapiens
gagcauuggugaaauagag

SEQ ID NO: 154461 - RNA, 19 nt, Homo sapiens
gugauacggugcuauaaau

SEQ ID NO: 154462 - RNA, 19 nt, Homo sapiens
guaaagagguuuucuccaa

SEQ ID NO: 154463 - RNA, 19 nt, Homo sapiens
uggacaaucugcucaauau

SEQ ID NO: 154464 - RNA, 19 nt, Homo sapiens
gaacaugacacaggaggaa

SEQ ID NO: 154465 - RNA, 19 nt, Homo sapiens
uuacauaacugccuugaac

SEQ ID NO: 154466 - RNA, 19 nt, Homo sapiens
gaaccugugaguaaauauu

SEQ ID NO: 154467 - RNA, 19 nt, Homo sapiens
gaacagggugguguauauu

SEQ ID NO: 154468 - RNA, 19 nt, Homo sapiens
gcauugcuguuaugucugu

SEQ ID NO: 154469 - RNA, 19 nt, Homo sapiens
cugcaggucuccuuuaaga

SEQ ID NO: 154470 - RNA, 19 nt, Homo sapiens
ucaacacccugaauggauu

SEQ ID NO: 154471 - RNA, 19 nt, Homo sapiens
ggauauggcuuugugaacu

SEQ ID NO: 154472 - RNA, 19 nt, Homo sapiens
guacugcaggucuccuuua

SEQ ID NO: 154473 - RNA, 19 nt, Homo sapiens
caaccaccauaaacaacaa

SEQ ID NO: 154474 - RNA, 19 nt, Homo sapiens
cugauuagcuuuguguuug

SEQ ID NO: 154475 - RNA, 19 nt, Homo sapiens
gaggcuuuguguuguaauu

SEQ ID NO: 154476 - RNA, 19 nt, Homo sapiens
caguuuggcuggaauuaau

SEQ ID NO: 154477 - RNA, 19 nt, Homo sapiens
gcagagaaagcuaucaaca

SEQ ID NO: 154478 - RNA, 19 nt, Homo sapiens
gagcuugggauauggcuuu

SEQ ID NO: 154479 - RNA, 19 nt, Homo sapiens
gcaauaacacagccaaugg

SEQ ID NO: 154480 - RNA, 19 nt, Homo sapiens
gcuacauuauaaacgcuua

SEQ ID NO: 154481 - RNA, 19 nt, Homo sapiens
ccacggagccaaucacugu

SEQ ID NO: 154482 - RNA, 19 nt, Homo sapiens
ugggagcauuggugaaaua

SEQ ID NO: 154483 - RNA, 19 nt, Homo sapiens
guauauaguagaccaaaug

SEQ ID NO: 154484 - RNA, 19 nt, Homo sapiens
gguguaggguuuauucgau

SEQ ID NO: 154485 - RNA, 19 nt, Homo sapiens
cugaauggauugagacuuc

SEQ ID NO: 154486 - RNA, 19 nt, Homo sapiens
uacguagccucaauggaua

SEQ ID NO: 154487 - RNA, 19 nt, Homo sapiens
ccaauaaaugcaaagguuu

SEQ ID NO: 154488 - RNA, 19 nt, Homo sapiens
uagguuucgugcugucuua

SEQ ID NO: 154489 - RNA, 19 nt, Homo sapiens
ggugauacggugcuauaaa

SEQ ID NO: 154490 - RNA, 19 nt, Homo sapiens
auacaacaaaggcaaguua

SEQ ID NO: 154491 - RNA, 19 nt, Homo sapiens
ggugguguauauuugugua

SEQ ID NO: 154492 - RNA, 19 nt, Homo sapiens
caaaggcaaguuaagagaa

SEQ ID NO: 154493 - RNA, 19 nt, Homo sapiens
ggcagaagaagcuaucaaa

SEQ ID NO: 154494 - RNA, 19 nt, Homo sapiens
uguccucaguccauuuaua

SEQ ID NO: 154495 - RNA, 19 nt, Homo sapiens
accaauaaaugcaaagguu

SEQ ID NO: 154496 - RNA, 19 nt, Homo sapiens
aaguucagcuucuaucaga

SEQ ID NO: 154497 - RNA, 19 nt, Homo sapiens
aagaccaacuuaauaguca

SEQ ID NO: 154498 - RNA, 19 nt, Homo sapiens
gaagacagcaagaccaacu

SEQ ID NO: 154499 - RNA, 19 nt, Homo sapiens
gggccaacuugcaauaaca

SEQ ID NO: 154500 - RNA, 19 nt, Homo sapiens
gccuugaaccugugaguaa

SEQ ID NO: 154501 - RNA, 19 nt, Homo sapiens
gcauucuauugccuucuuu

SEQ ID NO: 154502 - RNA, 19 nt, Homo sapiens
acagggugguguauauuug

SEQ ID NO: 154503 - RNA, 19 nt, Homo sapiens
gaagcuaucaaaggccuaa

SEQ ID NO: 154504 - RNA, 19 nt, Homo sapiens
aaacaaugacccagaagga

SEQ ID NO: 154505 - RNA, 19 nt, Homo sapiens
ugacacaggaggaacuaaa

SEQ ID NO: 154506 - RNA, 19 nt, Homo sapiens
agacagcaagaccaacuua

SEQ ID NO: 154507 - RNA, 19 nt, Homo sapiens
ugacuaugacaaacuauga

SEQ ID NO: 154508 - RNA, 19 nt, Homo sapiens
uuagagaugcagcagcuua

SEQ ID NO: 154509 - RNA, 19 nt, Homo sapiens
gacaaucugcucaauaugg

SEQ ID NO: 154510 - RNA, 19 nt, Homo sapiens
caacaaggagaaagacauc

SEQ ID NO: 154511 - RNA, 19 nt, Homo sapiens
ucacaauauggacgcauua

SEQ ID NO: 154512 - RNA, 19 nt, Homo sapiens
cagaagaagcuaucaaagg

SEQ ID NO: 154513 - RNA, 19 nt, Homo sapiens
gcgaauugaggcagaagaa

SEQ ID NO: 154514 - RNA, 19 nt, Homo sapiens
guguaggguuuauucgauu

SEQ ID NO: 154515 - RNA, 19 nt, Homo sapiens
ugaaauagaguccuguaag

SEQ ID NO: 154516 - RNA, 19 nt, Homo sapiens
caacuaccuuccucagaac

SEQ ID NO: 154517 - RNA, 19 nt, Homo sapiens
gcaagaccaacuuaauagu

SEQ ID NO: 154518 - RNA, 19 nt, Homo sapiens
gcaacaaggagaaagacau

SEQ ID NO: 154519 - RNA, 19 nt, Homo sapiens
gcagaagaagcuaucaaag

SEQ ID NO: 154520 - RNA, 19 nt, Homo sapiens
gcuguuaugucuguuuaag

SEQ ID NO: 154521 - RNA, 19 nt, Homo sapiens
uugaaccugugaguaaaua

SEQ ID NO: 154522 - RNA, 19 nt, Homo sapiens
ccugucacauugcauucua

SEQ ID NO: 154523 - RNA, 19 nt, Homo sapiens
gguuuuaccugucacauug

SEQ ID NO: 154524 - RNA, 19 nt, Homo sapiens
uacugcaggucuccuuuaa

SEQ ID NO: 154525 - RNA, 19 nt, Homo sapiens
auacguagccucaauggau

SEQ ID NO: 154526 - RNA, 19 nt, Homo sapiens
ggcgauacguagccucaau

SEQ ID NO: 154527 - RNA, 19 nt, Homo sapiens
ccaaucaggccauccuuuc

SEQ ID NO: 154528 - RNA, 19 nt, Homo sapiens
gcuaucaacacccugaaug

SEQ ID NO: 154529 - RNA, 19 nt, Homo sapiens
gagcacaguuuagguuucg

SEQ ID NO: 154530 - RNA, 19 nt, Homo sapiens
ugaauauggacaagaggua

SEQ ID NO: 154531 - RNA, 19 nt, Homo sapiens
ccucaguccauuuauauau

SEQ ID NO: 154532 - RNA, 19 nt, Homo sapiens
gcagcagcuuacuccugua

SEQ ID NO: 154533 - RNA, 19 nt, Homo sapiens
gcuaucaaaggccuaaaug

SEQ ID NO: 154534 - RNA, 19 nt, Homo sapiens
uaagggagaaagguaauug

SEQ ID NO: 154535 - RNA, 19 nt, Homo sapiens
uugcuguuaugucuguuua

SEQ ID NO: 154536 - RNA, 19 nt, Homo sapiens
caacaagucccacaaauaa

SEQ ID NO: 154537 - RNA, 19 nt, Homo sapiens
gcucagaggugaucaaaga

SEQ ID NO: 154538 - RNA, 19 nt, Homo sapiens
gaucaaagacgccaacuug

SEQ ID NO: 154539 - RNA, 19 nt, Homo sapiens
gcaauuaccaguuucaaug

SEQ ID NO: 154540 - RNA, 19 nt, Homo sapiens
gacaaaaucuuacagguuu

SEQ ID NO: 154541 - RNA, 19 nt, Homo sapiens
ccaacaagucccacaaaua

SEQ ID NO: 154542 - RNA, 19 nt, Homo sapiens
ggacguagaagacauguuc

SEQ ID NO: 154543 - RNA, 19 nt, Homo sapiens
ucaaagacgccaacuugua

SEQ ID NO: 154544 - RNA, 19 nt, Homo sapiens
ucaacuaccucccucagaa

SEQ ID NO: 154545 - RNA, 19 nt, Homo sapiens
gcgcagagauucagguucu

SEQ ID NO: 154546 - RNA, 19 nt, Homo sapiens
cggaauagauaauuaagag

SEQ ID NO: 154547 - RNA, 19 nt, Homo sapiens
gaagaggcaauuaccaguu

SEQ ID NO: 154548 - RNA, 19 nt, Homo sapiens
cagcauuggugaaguugaa

SEQ ID NO: 154549 - RNA, 19 nt, Homo sapiens
caacaagugcaaaggguuu

SEQ ID NO: 154550 - RNA, 19 nt, Homo sapiens
gcagauguuugggccguuu

SEQ ID NO: 154551 - RNA, 19 nt, Homo sapiens
aagaggcaauuaccaguuu

SEQ ID NO: 154552 - RNA, 19 nt, Homo sapiens
gcagagagagcgaucaaca

SEQ ID NO: 154553 - RNA, 19 nt, Homo sapiens
cagcagcauuggugaaguu

SEQ ID NO: 154554 - RNA, 19 nt, Homo sapiens
gacauguucucucgguuug

SEQ ID NO: 154555 - RNA, 19 nt, Homo sapiens
ccauuaaggugucguaugc

SEQ ID NO: 154556 - RNA, 19 nt, Homo sapiens
caaagacgccaacuuguac

SEQ ID NO: 154557 - RNA, 19 nt, Homo sapiens
gaacaugacccaggaugag

SEQ ID NO: 154558 - RNA, 19 nt, Homo sapiens
ggaucagacuacagguuug

SEQ ID NO: 154559 - RNA, 19 nt, Homo sapiens
caugacaaacuaugaagaa

SEQ ID NO: 154560 - RNA, 19 nt, Homo sapiens
caguuucaauggucauaaa

SEQ ID NO: 154561 - RNA, 19 nt, Homo sapiens
gaaggacguagaagacaug

SEQ ID NO: 154562 - RNA, 19 nt, Homo sapiens
gacgccaacuuguacauca

SEQ ID NO: 154563 - RNA, 19 nt, Homo sapiens
gcccaucgcagugaaguuu

SEQ ID NO: 154564 - RNA, 19 nt, Homo sapiens
gaccaugacaaacuaugaa

SEQ ID NO: 154565 - RNA, 19 nt, Homo sapiens
ggacaaaaucuuacagguu

SEQ ID NO: 154566 - RNA, 19 nt, Homo sapiens
gagcucagaggugaucaaa

SEQ ID NO: 154567 - RNA, 19 nt, Homo sapiens
guuaguguacaacucauuu

SEQ ID NO: 154568 - RNA, 19 nt, Homo sapiens
ccagagggguugcguuuau

SEQ ID NO: 154569 - RNA, 19 nt, Homo sapiens
ggaccaugacccagaagga

SEQ ID NO: 154570 - RNA, 19 nt, Homo sapiens
ggaggcagaagaggcaauu

SEQ ID NO: 154571 - RNA, 19 nt, Homo sapiens
caugacccaggaugaguua

SEQ ID NO: 154572 - RNA, 19 nt, Homo sapiens
agacauguucucucgguuu

SEQ ID NO: 154573 - RNA, 19 nt, Homo sapiens
gucuuugucugaaugagaa

SEQ ID NO: 154574 - RNA, 19 nt, Homo sapiens
uaagagugaaggaguugaa

SEQ ID NO: 154575 - RNA, 19 nt, Homo sapiens
aauuaagagugaaggaguu

SEQ ID NO: 154576 - RNA, 19 nt, Homo sapiens
cgcgaaggaugcagagaga

SEQ ID NO: 154577 - RNA, 19 nt, Homo sapiens
uggaucagacuacagguuu

SEQ ID NO: 154578 - RNA, 19 nt, Homo sapiens
gauaauuaagagugaagga

SEQ ID NO: 154579 - RNA, 19 nt, Homo sapiens
cuuacagguuuccuucaaa

SEQ ID NO: 154580 - RNA, 19 nt, Homo sapiens
gcgucaacgugccaggaaa

SEQ ID NO: 154581 - RNA, 19 nt, Homo sapiens
ucuuacagguuuccuucaa

SEQ ID NO: 154582 - RNA, 19 nt, Homo sapiens
gcagaagaggcaauuacca

SEQ ID NO: 154583 - RNA, 19 nt, Homo sapiens
gcguuuauccgguuugaca

SEQ ID NO: 154584 - RNA, 19 nt, Homo sapiens
agaaggacguagaagacau

SEQ ID NO: 154585 - RNA, 19 nt, Homo sapiens
cuaccucccucagaacaug

SEQ ID NO: 154586 - RNA, 19 nt, Homo sapiens
gcaaaacuuauucgggaua

SEQ ID NO: 154587 - RNA, 19 nt, Homo sapiens
gacaucgggagaacgaauu

SEQ ID NO: 154588 - RNA, 19 nt, Homo sapiens
gacccaggaugaguuacga

SEQ ID NO: 154589 - RNA, 19 nt, Homo sapiens
ugaccaugacaaacuauga

SEQ ID NO: 154590 - RNA, 19 nt, Homo sapiens
gaucagacuacagguuugu

SEQ ID NO: 154591 - RNA, 19 nt, Homo sapiens
caaugucuaaugguuauga

SEQ ID NO: 154592 - RNA, 19 nt, Homo sapiens
ggccauagccagccugaac

SEQ ID NO: 154593 - RNA, 19 nt, Homo sapiens
ccagaaggacguagaagac

SEQ ID NO: 154594 - RNA, 19 nt, Homo sapiens
ggugacaucgggagaacga

SEQ ID NO: 154595 - RNA, 19 nt, Homo sapiens
ccacaaauaacucgcucau

SEQ ID NO: 154596 - RNA, 19 nt, Homo sapiens
auaacucgcucaugcuuuu

SEQ ID NO: 154597 - RNA, 19 nt, Homo sapiens
aaauaacucgcucaugcuu

SEQ ID NO: 154598 - RNA, 19 nt, Homo sapiens
ugucuaaugguuaugaaga

SEQ ID NO: 154599 - RNA, 19 nt, Homo sapiens
caaauaacucgcucaugcu

SEQ ID NO: 154600 - RNA, 19 nt, Homo sapiens
uuacagguuuccuucaaaa

SEQ ID NO: 154601 - RNA, 19 nt, Homo sapiens
caacaccaacaagugcaaa

SEQ ID NO: 154602 - RNA, 19 nt, Homo sapiens
gauaaaguagcaggacaca

SEQ ID NO: 154603 - RNA, 19 nt, Homo sapiens
ggcaauuaccaguuucaau

SEQ ID NO: 154604 - RNA, 19 nt, Homo sapiens
gaaguugaaucugcaaaac

SEQ ID NO: 154605 - RNA, 19 nt, Homo sapiens
accaacaagucccacaaau

SEQ ID NO: 154606 - RNA, 19 nt, Homo sapiens
caauuaccaguuucaaugg

SEQ ID NO: 154607 - RNA, 19 nt, Homo sapiens
gaggcagaagaggcaauua

SEQ ID NO: 154608 - RNA, 19 nt, Homo sapiens
guuugucuuugucugaaug

SEQ ID NO: 154609 - RNA, 19 nt, Homo sapiens
guguuugucuuugucugaa

SEQ ID NO: 154610 - RNA, 19 nt, Homo sapiens
aagaccacauggccgaaga

SEQ ID NO: 154611 - RNA, 19 nt, Homo sapiens
gcuggugcauuuucaucua

SEQ ID NO: 154612 - RNA, 19 nt, Homo sapiens
aaaccaacaagucccacaa

SEQ ID NO: 154613 - RNA, 19 nt, Homo sapiens
cgaagaggcuaucaaagga

SEQ ID NO: 154614 - RNA, 19 nt, Homo sapiens
ccucaacggccucaaauua

SEQ ID NO: 154615 - RNA, 19 nt, Homo sapiens
caagaauggucacucagau

SEQ ID NO: 154616 - RNA, 19 nt, Homo sapiens
gcuacggguuugugaacua

SEQ ID NO: 154617 - RNA, 19 nt, Homo sapiens
acacaagaauggucacuca

SEQ ID NO: 154618 - RNA, 19 nt, Homo sapiens
gguaggaggaacagguuua

SEQ ID NO: 154619 - RNA, 19 nt, Homo sapiens
gcagagagagagagagaga

SEQ ID NO: 154620 - RNA, 19 nt, Homo sapiens
gcgaacaacccaagucaga

SEQ ID NO: 154621 - RNA, 19 nt, Homo sapiens
gaacaacccaagucagaag

SEQ ID NO: 154622 - RNA, 19 nt, Homo sapiens
guacaaauggagccacuga

SEQ ID NO: 154623 - RNA, 19 nt, Homo sapiens
gcuggugcaucuucgugua

SEQ ID NO: 154624 - RNA, 19 nt, Homo sapiens
gggagggucugcagggaau

SEQ ID NO: 154625 - RNA, 19 nt, Homo sapiens
gcaaguugguucgggacaa

SEQ ID NO: 154626 - RNA, 19 nt, Homo sapiens
gaacaugacccaggaugag

SEQ ID NO: 154627 - RNA, 19 nt, Homo sapiens
cugcaggucuccuucaaga

SEQ ID NO: 154628 - RNA, 19 nt, Homo sapiens
ucaacggccucaaauuaca

SEQ ID NO: 154629 - RNA, 19 nt, Homo sapiens
guuuccggcuggacaauuu

SEQ ID NO: 154630 - RNA, 19 nt, Homo sapiens
caucgaguccugcaaguug

SEQ ID NO: 154631 - RNA, 19 nt, Homo sapiens
cagcugagcccaucacagu

SEQ ID NO: 154632 - RNA, 19 nt, Homo sapiens
gaccuuggcuacggguuug

SEQ ID NO: 154633 - RNA, 19 nt, Homo sapiens
agaccaaccucaucgucaa

SEQ ID NO: 154634 - RNA, 19 nt, Homo sapiens
ccaagaccaugagccagaa

SEQ ID NO: 154635 - RNA, 19 nt, Homo sapiens
ucaaggucauccgugauuu

SEQ ID NO: 154636 - RNA, 19 nt, Homo sapiens
ggccgaagaggcuaucaaa

SEQ ID NO: 154637 - RNA, 19 nt, Homo sapiens
gaucacaggcagagaccuu

SEQ ID NO: 154638 - RNA, 19 nt, Homo sapiens
aaagagagagagagagaga

SEQ ID NO: 154639 - RNA, 19 nt, Homo sapiens
agaaagagagagagagaga

SEQ ID NO: 154640 - RNA, 19 nt, Homo sapiens
ccaacaagugcaaggguuu

SEQ ID NO: 154641 - RNA, 19 nt, Homo sapiens
gcagacaaagccaucaaca

SEQ ID NO: 154642 - RNA, 19 nt, Homo sapiens
guaggaggaacagguuuaa

SEQ ID NO: 154643 - RNA, 19 nt, Homo sapiens
agagagagagagagaaaga

SEQ ID NO: 154644 - RNA, 19 nt, Homo sapiens
agagagagagagagagaaa

SEQ ID NO: 154645 - RNA, 19 nt, Homo sapiens
aagaauggucacucagaua

SEQ ID NO: 154646 - RNA, 19 nt, Homo sapiens
cagcagagagagagagaga

SEQ ID NO: 154647 - RNA, 19 nt, Homo sapiens
ugaccaugaccaacuauga

SEQ ID NO: 154648 - RNA, 19 nt, Homo sapiens
ccaaccucaucgucaacua

SEQ ID NO: 154649 - RNA, 19 nt, Homo sapiens
ggacaauuugcucaacaug

SEQ ID NO: 154650 - RNA, 19 nt, Homo sapiens
ccaucaagguguccuaugc

SEQ ID NO: 154651 - RNA, 19 nt, Homo sapiens
ccgaagaggcuaucaaagg

SEQ ID NO: 154652 - RNA, 19 nt, Homo sapiens
agacgaagaccaucaaggu

SEQ ID NO: 154653 - RNA, 19 nt, Homo sapiens
ggaagcagaaacaaaauga

SEQ ID NO: 154654 - RNA, 19 nt, Homo sapiens
gcccaucacagucaaguuc

SEQ ID NO: 154655 - RNA, 19 nt, Homo sapiens
acaagaauggucacucaga

SEQ ID NO: 154656 - RNA, 19 nt, Homo sapiens
ggccacuccuugguacaaa

SEQ ID NO: 154657 - RNA, 19 nt, Homo sapiens
agagaaagagagagagaga

SEQ ID NO: 154658 - RNA, 19 nt, Homo sapiens
agagagagagaaagagaga

SEQ ID NO: 154659 - RNA, 19 nt, Homo sapiens
agagagagagagaaagaga

SEQ ID NO: 154660 - RNA, 19 nt, Homo sapiens
gucaaggucauccgugauu

SEQ ID NO: 154661 - RNA, 19 nt, Homo sapiens
gcugagcccaucacaguca

SEQ ID NO: 154662 - RNA, 19 nt, Homo sapiens
gcuaucaaaggacugaaug

SEQ ID NO: 154663 - RNA, 19 nt, Homo sapiens
caaguugguucgggacaag

SEQ ID NO: 154664 - RNA, 19 nt, Homo sapiens
agagagagaaagagagaga

SEQ ID NO: 154665 - RNA, 19 nt, Homo sapiens
ucaacuaccugccccagaa

SEQ ID NO: 154666 - RNA, 19 nt, Homo sapiens
cuacggguuugugaacuau

SEQ ID NO: 154667 - RNA, 19 nt, Homo sapiens
gacaucgaguccugcaagu

SEQ ID NO: 154668 - RNA, 19 nt, Homo sapiens
gcuggaagcagaaacaaaa

SEQ ID NO: 154669 - RNA, 19 nt, Homo sapiens
gcugggcuguucacucucu

SEQ ID NO: 154670 - RNA, 19 nt, Homo sapiens
aggcugggcuguucacucu

SEQ ID NO: 154671 - RNA, 19 nt, Homo sapiens
caaggucauccgugauuuc

SEQ ID NO: 154672 - RNA, 19 nt, Homo sapiens
cagcaagaccaaccucauc

SEQ ID NO: 154673 - RNA, 19 nt, Homo sapiens
aggaugaguucaagagucu

SEQ ID NO: 154674 - RNA, 19 nt, Homo sapiens
agagagagagagagagaga

SEQ ID NO: 154675 - RNA, 19 nt, Homo sapiens
ucaccaacgucaaggucau

SEQ ID NO: 154676 - RNA, 19 nt, Homo sapiens
cgaacaacccaagucagaa

SEQ ID NO: 154677 - RNA, 19 nt, Homo sapiens
cgucuugguuugguucaug

SEQ ID NO: 154678 - RNA, 19 nt, Homo sapiens
aagaccucguggagaauuu

SEQ ID NO: 154679 - RNA, 19 nt, Homo sapiens
ucgugaccaugaccaacua

SEQ ID NO: 154680 - RNA, 19 nt, Homo sapiens
gacccaggaugaguucaag

SEQ ID NO: 154681 - RNA, 19 nt, Homo sapiens
caacaagugcaaggguuuc

SEQ ID NO: 154682 - RNA, 19 nt, Homo sapiens
ccuacggcgucaagagguu

SEQ ID NO: 154683 - RNA, 19 nt, Homo sapiens
uguucacucucucgucuug

SEQ ID NO: 154684 - RNA, 19 nt, Homo sapiens
cggcagcauuggcgacauc

SEQ ID NO: 154685 - RNA, 19 nt, Homo sapiens
caacgggccacuccuuggu

SEQ ID NO: 154686 - RNA, 19 nt, Homo sapiens
gggauucuugaacuugaaa

SEQ ID NO: 154687 - RNA, 19 nt, Homo sapiens
aaagaccucguggagaauu

SEQ ID NO: 154688 - RNA, 19 nt, Homo sapiens
gagagagagagagagagaa

SEQ ID NO: 154689 - RNA, 19 nt, Homo sapiens
agagagaaagagagagaga

SEQ ID NO: 154690 - RNA, 19 nt, Homo sapiens
gccacuccuugguacaaau

SEQ ID NO: 154691 - RNA, 19 nt, Homo sapiens
gaggcuaucaaaggacuga

SEQ ID NO: 154692 - RNA, 19 nt, Homo sapiens
uuacagacgaagaccauca

SEQ ID NO: 154693 - RNA, 19 nt, Homo sapiens
ccaaugaugcagacaaagc

SEQ ID NO: 154694 - RNA, 19 nt, Homo sapiens
gaacaucccuggucacaca

SEQ ID NO: 154695 - RNA, 19 nt, Homo sapiens
gagcauuggugaaauagaa

SEQ ID NO: 154696 - RNA, 19 nt, Homo sapiens
gaauaugacccaagaagaa

SEQ ID NO: 154697 - RNA, 19 nt, Homo sapiens
gcccacaaguccugaauuu

SEQ ID NO: 154698 - RNA, 19 nt, Homo sapiens
caucaacacuuuaaaugga

SEQ ID NO: 154699 - RNA, 19 nt, Homo sapiens
ggacagaguuuaggguaug

SEQ ID NO: 154700 - RNA, 19 nt, Homo sapiens
gaaauagaauccugcaaac

SEQ ID NO: 154701 - RNA, 19 nt, Homo sapiens
gacagaguguugcaaguuu

SEQ ID NO: 154702 - RNA, 19 nt, Homo sapiens
gguucaggcuggacaauuu

SEQ ID NO: 154703 - RNA, 19 nt, Homo sapiens
gguauggauuuguuaacua

SEQ ID NO: 154704 - RNA, 19 nt, Homo sapiens
cgaaagagagagaaacaaa

SEQ ID NO: 154705 - RNA, 19 nt, Homo sapiens
ugaaauagaauccugcaaa

SEQ ID NO: 154706 - RNA, 19 nt, Homo sapiens
gaguuuaggguauggauuu

SEQ ID NO: 154707 - RNA, 19 nt, Homo sapiens
caguguugccuaaguauua

SEQ ID NO: 154708 - RNA, 19 nt, Homo sapiens
gguccgacauccaauacaa

SEQ ID NO: 154709 - RNA, 19 nt, Homo sapiens
ggaacuggguggugcaucu

SEQ ID NO: 154710 - RNA, 19 nt, Homo sapiens
cgggagcauuggugaaaua

SEQ ID NO: 154711 - RNA, 19 nt, Homo sapiens
aaaccaaccucaucgucaa

SEQ ID NO: 154712 - RNA, 19 nt, Homo sapiens
cuggacaauuugcuuaaua

SEQ ID NO: 154713 - RNA, 19 nt, Homo sapiens
caaaugguccgacauccaa

SEQ ID NO: 154714 - RNA, 19 nt, Homo sapiens
guugcaaguuuccuuuaaa

SEQ ID NO: 154715 - RNA, 19 nt, Homo sapiens
gagaaagccaucaacacuu

SEQ ID NO: 154716 - RNA, 19 nt, Homo sapiens
uccaaaggaugcagagaaa

SEQ ID NO: 154717 - RNA, 19 nt, Homo sapiens
gaacaacguaaaggugauu

SEQ ID NO: 154718 - RNA, 19 nt, Homo sapiens
agagagagaaacaaacuuu

SEQ ID NO: 154719 - RNA, 19 nt, Homo sapiens
gcagagaaagccaucaaca

SEQ ID NO: 154720 - RNA, 19 nt, Homo sapiens
ccucaucgucaacuauuua

SEQ ID NO: 154721 - RNA, 19 nt, Homo sapiens
agaaggaacuggagcaacu

SEQ ID NO: 154722 - RNA, 19 nt, Homo sapiens
cuacggaaccgauuacugu

SEQ ID NO: 154723 - RNA, 19 nt, Homo sapiens
auagaauccugcaaacuug

SEQ ID NO: 154724 - RNA, 19 nt, Homo sapiens
aaccacagaugacagcaaa

SEQ ID NO: 154725 - RNA, 19 nt, Homo sapiens
aauagaauccugcaaacuu

SEQ ID NO: 154726 - RNA, 19 nt, Homo sapiens
gguggugcaucuuugucua

SEQ ID NO: 154727 - RNA, 19 nt, Homo sapiens
ccugcaaacuugugagaga

SEQ ID NO: 154728 - RNA, 19 nt, Homo sapiens
gagacagaguguugcaagu

SEQ ID NO: 154729 - RNA, 19 nt, Homo sapiens
gcaagggauucggcuuugu

SEQ ID NO: 154730 - RNA, 19 nt, Homo sapiens
gagcagugaacaacguaaa

SEQ ID NO: 154731 - RNA, 19 nt, Homo sapiens
ggcagaagaagccaucaaa

SEQ ID NO: 154732 - RNA, 19 nt, Homo sapiens
gaagaauucaggagucucu

SEQ ID NO: 154733 - RNA, 19 nt, Homo sapiens
gaaagagagagaaacaaac

SEQ ID NO: 154734 - RNA, 19 nt, Homo sapiens
ggaaaggauuuuauaaugc

SEQ ID NO: 154735 - RNA, 19 nt, Homo sapiens
uaaaggugauucgugacuu

SEQ ID NO: 154736 - RNA, 19 nt, Homo sapiens
ggacaauuugcuuaauaug

SEQ ID NO: 154737 - RNA, 19 nt, Homo sapiens
cggaaccgauuacugugaa

SEQ ID NO: 154738 - RNA, 19 nt, Homo sapiens
cagggaugcuaaccucuau

SEQ ID NO: 154739 - RNA, 19 nt, Homo sapiens
cccagaauaugacccaaga

SEQ ID NO: 154740 - RNA, 19 nt, Homo sapiens
gaggauugaggcagaagaa

SEQ ID NO: 154741 - RNA, 19 nt, Homo sapiens
uaagaggauugaggcagaa

SEQ ID NO: 154742 - RNA, 19 nt, Homo sapiens
gccaucaacacuuuaaaug

SEQ ID NO: 154743 - RNA, 19 nt, Homo sapiens
uuacaaucauccacacugu

SEQ ID NO: 154744 - RNA, 19 nt, Homo sapiens
aaaggugauucgugacuuc

SEQ ID NO: 154745 - RNA, 19 nt, Homo sapiens
gcgcgcacacacacacaua

SEQ ID NO: 154746 - RNA, 19 nt, Homo sapiens
uguugcaaguuuccuuuaa

SEQ ID NO: 154747 - RNA, 19 nt, Homo sapiens
gugcaagggauucggcuuu

SEQ ID NO: 154748 - RNA, 19 nt, Homo sapiens
ucugcgagacccaauauuu

SEQ ID NO: 154749 - RNA, 19 nt, Homo sapiens
cagaagaagccaucaaagg

SEQ ID NO: 154750 - RNA, 19 nt, Homo sapiens
gaucaagucacaggagugu

SEQ ID NO: 154751 - RNA, 19 nt, Homo sapiens
uaucaucaccucacgaauc

SEQ ID NO: 154752 - RNA, 19 nt, Homo sapiens
ccaaaaccaugacccagaa

SEQ ID NO: 154753 - RNA, 19 nt, Homo sapiens
cacuuuaaauggacucaga

SEQ ID NO: 154754 - RNA, 19 nt, Homo sapiens
acacacacauacacgaaag

SEQ ID NO: 154755 - RNA, 19 nt, Homo sapiens
ucaccaugaccaacuauga

SEQ ID NO: 154756 - RNA, 19 nt, Homo sapiens
gacaauuugcuuaauaugg

SEQ ID NO: 154757 - RNA, 19 nt, Homo sapiens
gcagaagaagccaucaaag

SEQ ID NO: 154758 - RNA, 19 nt, Homo sapiens
cacgaauccugguugauca

SEQ ID NO: 154759 - RNA, 19 nt, Homo sapiens
ccucacgaauccugguuga

SEQ ID NO: 154760 - RNA, 19 nt, Homo sapiens
ccaaccucaucgucaacua

SEQ ID NO: 154761 - RNA, 19 nt, Homo sapiens
auaagccaguguugccuaa

SEQ ID NO: 154762 - RNA, 19 nt, Homo sapiens
auucaaccauggacuuuau

SEQ ID NO: 154763 - RNA, 19 nt, Homo sapiens
cgacauccaauacaagcaa

SEQ ID NO: 154764 - RNA, 19 nt, Homo sapiens
gcuggacaauuugcuuaau

SEQ ID NO: 154765 - RNA, 19 nt, Homo sapiens
caaccucaucgucaacuau

SEQ ID NO: 154766 - RNA, 19 nt, Homo sapiens
ucaaccauggacuuuauaa

SEQ ID NO: 154767 - RNA, 19 nt, Homo sapiens
aauauggccuauggcguaa

SEQ ID NO: 154768 - RNA, 19 nt, Homo sapiens
uaacagaagagucgaagcu

SEQ ID NO: 154769 - RNA, 19 nt, Homo sapiens
gaauccugguugaucaagu

SEQ ID NO: 154770 - RNA, 19 nt, Homo sapiens
gcucugcgagacccaauau

SEQ ID NO: 154771 - RNA, 19 nt, Homo sapiens
ggguauggauuuguuaacu

SEQ ID NO: 154772 - RNA, 19 nt, Homo sapiens
ccacaaguccugaauuucc

SEQ ID NO: 154773 - RNA, 19 nt, Homo sapiens
ucacgaauccugguugauc

SEQ ID NO: 154774 - RNA, 19 nt, Homo sapiens
gaaggaacuggagcaacuu

SEQ ID NO: 154775 - RNA, 19 nt, Homo sapiens
aaagagagagaaacaaacu

SEQ ID NO: 154776 - RNA, 19 nt, Homo sapiens
agacagaguguugcaaguu

SEQ ID NO: 154777 - RNA, 19 nt, Homo sapiens
caacaagugcaagggauuc

SEQ ID NO: 154778 - RNA, 19 nt, Homo sapiens
ccaacaagugcaagggauu

SEQ ID NO: 154779 - RNA, 19 nt, Homo sapiens
ggugcuacggaaccgauua

SEQ ID NO: 154780 - RNA, 19 nt, Homo sapiens
ucagggaugcuaaccucua

SEQ ID NO: 154781 - RNA, 19 nt, Homo sapiens
cagaauaugacccaagaag

SEQ ID NO: 154782 - RNA, 19 nt, Homo sapiens
agccaguguugccuaagua

SEQ ID NO: 154783 - RNA, 19 nt, Homo sapiens
ugaacaacguaaaggugau

SEQ ID NO: 154784 - RNA, 19 nt, Homo sapiens
gggaugcuaaccucuaugu

SEQ ID NO: 154785 - RNA, 19 nt, Homo sapiens
agagaaagccaucaacacu

SEQ ID NO: 154786 - RNA, 19 nt, Homo sapiens
caaaggaugcagagaaagc

SEQ ID NO: 154787 - RNA, 19 nt, Homo sapiens
uuuaggguauggauuuguu

SEQ ID NO: 154788 - RNA, 19 nt, Homo sapiens
cauggagccucagguguca

SEQ ID NO: 154789 - RNA, 19 nt, Homo sapiens
agaauaugacccaagaaga

SEQ ID NO: 154790 - RNA, 19 nt, Homo sapiens
ccaacaaagcccacaaguc

SEQ ID NO: 154791 - RNA, 19 nt, Homo sapiens
acagaguguugcaaguuuc

SEQ ID NO: 154792 - RNA, 19 nt, Homo sapiens
gagccucaggugucaaaug

SEQ ID NO: 154793 - RNA, 19 nt, Homo sapiens
gaacuggguggugcaucuu

SEQ ID NO: 154794 - RNA, 19 nt, Homo sapiens
cuaaggagguuucuaauuu

SEQ ID NO: 154795 - RNA, 19 nt, Homo sapiens
gguaagaucugccauaaau

SEQ ID NO: 154796 - RNA, 19 nt, Homo sapiens
gaagagcacucagguacua

SEQ ID NO: 154797 - RNA, 19 nt, Homo sapiens
gaaggcaacaggaaauuua

SEQ ID NO: 154798 - RNA, 19 nt, Homo sapiens
gaaagggaaacacaauuua

SEQ ID NO: 154799 - RNA, 19 nt, Homo sapiens
gggcuaaucuggcugagua

SEQ ID NO: 154800 - RNA, 19 nt, Homo sapiens
gcacaaccaucagaaguuu

SEQ ID NO: 154801 - RNA, 19 nt, Homo sapiens
gaagaucauuugaaagaga

SEQ ID NO: 154802 - RNA, 19 nt, Homo sapiens
ccaaugacaugauuacuga

SEQ ID NO: 154803 - RNA, 19 nt, Homo sapiens
ucaauuauaugcagacuga

SEQ ID NO: 154804 - RNA, 19 nt, Homo sapiens
ggaaagggaaacacaauuu

SEQ ID NO: 154805 - RNA, 19 nt, Homo sapiens
ucacuuagauugacuuuag

SEQ ID NO: 154806 - RNA, 19 nt, Homo sapiens
ggauguugcugaagaagaa

SEQ ID NO: 154807 - RNA, 19 nt, Homo sapiens
ccaaauauaucugugaaga

SEQ ID NO: 154808 - RNA, 19 nt, Homo sapiens
gaacaggcauuuuacacua

SEQ ID NO: 154809 - RNA, 19 nt, Homo sapiens
caugcaggaugaaacauua

SEQ ID NO: 154810 - RNA, 19 nt, Homo sapiens
gaaagagaacacugagaaa

SEQ ID NO: 154811 - RNA, 19 nt, Homo sapiens
caauuuaucuuugggaguu

SEQ ID NO: 154812 - RNA, 19 nt, Homo sapiens
caacagaacgaccuaguau

SEQ ID NO: 154813 - RNA, 19 nt, Homo sapiens
gcuaagugcuaaacagaau

SEQ ID NO: 154814 - RNA, 19 nt, Homo sapiens
gcuuugcgguccauuagua

SEQ ID NO: 154815 - RNA, 19 nt, Homo sapiens
agaaauaagugacccaaca

SEQ ID NO: 154816 - RNA, 19 nt, Homo sapiens
gaaauaagugacccaacaa

SEQ ID NO: 154817 - RNA, 19 nt, Homo sapiens
cagguuauuuccuaaugua

SEQ ID NO: 154818 - RNA, 19 nt, Homo sapiens
caaagauccuguggaaguu

SEQ ID NO: 154819 - RNA, 19 nt, Homo sapiens
gauccaaguuccagcauag

SEQ ID NO: 154820 - RNA, 19 nt, Homo sapiens
gaagaugacaugguuguug

SEQ ID NO: 154821 - RNA, 19 nt, Homo sapiens
acagaacgaccuaguauuu

SEQ ID NO: 154822 - RNA, 19 nt, Homo sapiens
uaaggggaaugcuuuauua

SEQ ID NO: 154823 - RNA, 19 nt, Homo sapiens
gaucugccauaaauucuuc

SEQ ID NO: 154824 - RNA, 19 nt, Homo sapiens
caacuguuucucuuuguua

SEQ ID NO: 154825 - RNA, 19 nt, Homo sapiens
agaacgaccuaguauuuga

SEQ ID NO: 154826 - RNA, 19 nt, Homo sapiens
ugccauaaauucuuccuaa

SEQ ID NO: 154827 - RNA, 19 nt, Homo sapiens
gcagacugacugauucuaa

SEQ ID NO: 154828 - RNA, 19 nt, Homo sapiens
ccaaagauccuguggaagu

SEQ ID NO: 154829 - RNA, 19 nt, Homo sapiens
cagaacagccuaagaggaa

SEQ ID NO: 154830 - RNA, 19 nt, Homo sapiens
cgaccuaguauuugaauuu

SEQ ID NO: 154831 - RNA, 19 nt, Homo sapiens
ggcuuuaguuccucucaua

SEQ ID NO: 154832 - RNA, 19 nt, Homo sapiens
ugaaagagaacacugagaa

SEQ ID NO: 154833 - RNA, 19 nt, Homo sapiens
gcaguugcauacaguaaca

SEQ ID NO: 154834 - RNA, 19 nt, Homo sapiens
ggauccaaguuccagcaua

SEQ ID NO: 154835 - RNA, 19 nt, Homo sapiens
ggaauccucuaaacauuuu

SEQ ID NO: 154836 - RNA, 19 nt, Homo sapiens
gccauaaauucuuccuaaa

SEQ ID NO: 154837 - RNA, 19 nt, Homo sapiens
uaagaucugccauaaauuc

SEQ ID NO: 154838 - RNA, 19 nt, Homo sapiens
gauaaauucuaaggagguu

SEQ ID NO: 154839 - RNA, 19 nt, Homo sapiens
ucagguagcuaugaaacaa

SEQ ID NO: 154840 - RNA, 19 nt, Homo sapiens
ggaaucagcaguugcauac

SEQ ID NO: 154841 - RNA, 19 nt, Homo sapiens
ccaguaccaugcaggauga

SEQ ID NO: 154842 - RNA, 19 nt, Homo sapiens
gagcacucagguacuauua

SEQ ID NO: 154843 - RNA, 19 nt, Homo sapiens
cuaaagcaguguccagguu

SEQ ID NO: 154844 - RNA, 19 nt, Homo sapiens
gaagcaggauaguauaaaa

SEQ ID NO: 154845 - RNA, 19 nt, Homo sapiens
ccaauggauuuacuucuca

SEQ ID NO: 154846 - RNA, 19 nt, Homo sapiens
aaacacagcaggugcaaga

SEQ ID NO: 154847 - RNA, 19 nt, Homo sapiens
ugacaucacccuuacaguu

SEQ ID NO: 154848 - RNA, 19 nt, Homo sapiens
gaccuaguauuugaauuug

SEQ ID NO: 154849 - RNA, 19 nt, Homo sapiens
guaaucacuucaguuauca

SEQ ID NO: 154850 - RNA, 19 nt, Homo sapiens
uguaaucacuucaguuauc

SEQ ID NO: 154851 - RNA, 19 nt, Homo sapiens
gaggucuaaugcuauguuu

SEQ ID NO: 154852 - RNA, 19 nt, Homo sapiens
gcuuaagcauggccaagaa

SEQ ID NO: 154853 - RNA, 19 nt, Homo sapiens
gacaucacccuuacaguug

SEQ ID NO: 154854 - RNA, 19 nt, Homo sapiens
cauagacgaugaugaugau

SEQ ID NO: 154855 - RNA, 19 nt, Homo sapiens
ggaagagcccaaugacaug

SEQ ID NO: 154856 - RNA, 19 nt, Homo sapiens
ccacuaacuagcuauguaa

SEQ ID NO: 154857 - RNA, 19 nt, Homo sapiens
gcuaaaauguugcagagaa

SEQ ID NO: 154858 - RNA, 19 nt, Homo sapiens
ucacccaccuggcacugua

SEQ ID NO: 154859 - RNA, 19 nt, Homo sapiens
gaacgaccuaguauuugaa

SEQ ID NO: 154860 - RNA, 19 nt, Homo sapiens
uauguaaucuugaccucuu

SEQ ID NO: 154861 - RNA, 19 nt, Homo sapiens
uggauuuacuucucaggua

SEQ ID NO: 154862 - RNA, 19 nt, Homo sapiens
ggucagcgcuugguguauc

SEQ ID NO: 154863 - RNA, 19 nt, Homo sapiens
gcaauggaaccgucagugu

SEQ ID NO: 154864 - RNA, 19 nt, Homo sapiens
gaagagcccaaugacauga

SEQ ID NO: 154865 - RNA, 19 nt, Homo sapiens
uggguaagaucugccauaa

SEQ ID NO: 154866 - RNA, 19 nt, Homo sapiens
gaauggcacucccacuaac

SEQ ID NO: 154867 - RNA, 19 nt, Homo sapiens
gggcucuccuccuucaauu

SEQ ID NO: 154868 - RNA, 19 nt, Homo sapiens
cuaacuagcuauguaaucu

SEQ ID NO: 154869 - RNA, 19 nt, Homo sapiens
cugaagaucauuugaaaga

SEQ ID NO: 154870 - RNA, 19 nt, Homo sapiens
ccaacagaacgaccuagua

SEQ ID NO: 154871 - RNA, 19 nt, Homo sapiens
cagaagcaggauaguauaa

SEQ ID NO: 154872 - RNA, 19 nt, Homo sapiens
agacagagcugaggguuuu

SEQ ID NO: 154873 - RNA, 19 nt, Homo sapiens
acccaaagauccuguggaa

SEQ ID NO: 154874 - RNA, 19 nt, Homo sapiens
cccacuaacuagcuaugua

SEQ ID NO: 154875 - RNA, 19 nt, Homo sapiens
ugacaguacugaaagaaaa

SEQ ID NO: 154876 - RNA, 19 nt, Homo sapiens
caucacagcccaugacagu

SEQ ID NO: 154877 - RNA, 19 nt, Homo sapiens
gguacuggaucucagaagu

SEQ ID NO: 154878 - RNA, 19 nt, Homo sapiens
guucagaguauuaggacua

SEQ ID NO: 154879 - RNA, 19 nt, Homo sapiens
ccacuacgccaaauauauc

SEQ ID NO: 154880 - RNA, 19 nt, Homo sapiens
caauaguuaugccggucua

SEQ ID NO: 154881 - RNA, 19 nt, Homo sapiens
ugaaggaacaggcauuuua

SEQ ID NO: 154882 - RNA, 19 nt, Homo sapiens
ggagguuucuaauuuugua

SEQ ID NO: 154883 - RNA, 19 nt, Homo sapiens
gcccaugacaguacugaaa

SEQ ID NO: 154884 - RNA, 19 nt, Homo sapiens
guacuggaucucagaaguu

SEQ ID NO: 154885 - RNA, 19 nt, Homo sapiens
caucagccacuucaaauag

SEQ ID NO: 154886 - RNA, 19 nt, Homo sapiens
uagaugggauuccugaagu

SEQ ID NO: 154887 - RNA, 19 nt, Homo sapiens
cuaaacagaauacugcuau

SEQ ID NO: 154888 - RNA, 19 nt, Homo sapiens
ggcaacaggaaauuuauau

SEQ ID NO: 154889 - RNA, 19 nt, Homo sapiens
acagauccaucagcaggua

SEQ ID NO: 154890 - RNA, 19 nt, Homo sapiens
caguaacacuccaaacagu

SEQ ID NO: 154891 - RNA, 19 nt, Homo sapiens
ggaauucuaaagcugcaaa

SEQ ID NO: 154892 - RNA, 19 nt, Homo sapiens
acucaacuguuucucuuug

SEQ ID NO: 154893 - RNA, 19 nt, Homo sapiens
gugccacucacaacaguua

SEQ ID NO: 154894 - RNA, 19 nt, Homo sapiens
caacugaacccaucaauaa

SEQ ID NO: 154895 - RNA, 19 nt, Homo sapiens
ugaagacucugcuaauaua

SEQ ID NO: 154896 - RNA, 19 nt, Homo sapiens
ggaaaugaacuacauauug

SEQ ID NO: 154897 - RNA, 19 nt, Homo sapiens
gcuaauggcuuguuugugu

SEQ ID NO: 154898 - RNA, 19 nt, Homo sapiens
ucacuacgauaucaaguua

SEQ ID NO: 154899 - RNA, 19 nt, Homo sapiens
caaugggucuccugaguua

SEQ ID NO: 154900 - RNA, 19 nt, Homo sapiens
ggaaauaaauuaccuaucc

SEQ ID NO: 154901 - RNA, 19 nt, Homo sapiens
gacagaggcuuguauauca

SEQ ID NO: 154902 - RNA, 19 nt, Homo sapiens
caagggaagucaucaagaa

SEQ ID NO: 154903 - RNA, 19 nt, Homo sapiens
guacugacauaaacauuug

SEQ ID NO: 154904 - RNA, 19 nt, Homo sapiens
gcacaguauuguuauagaa

SEQ ID NO: 154905 - RNA, 19 nt, Homo sapiens
uaaauuaccuaucccaugu

SEQ ID NO: 154906 - RNA, 19 nt, Homo sapiens
gaaugugaauugaagaaug

SEQ ID NO: 154907 - RNA, 19 nt, Homo sapiens
aaacaucucucuucuccuu

SEQ ID NO: 154908 - RNA, 19 nt, Homo sapiens
aaacaaaggccuuagacua

SEQ ID NO: 154909 - RNA, 19 nt, Homo sapiens
acacuaacauucuguaaga

SEQ ID NO: 154910 - RNA, 19 nt, Homo sapiens
gcaggugcaccauuaauaa

SEQ ID NO: 154911 - RNA, 19 nt, Homo sapiens
ucacuuaacuggugcuaug

SEQ ID NO: 154912 - RNA, 19 nt, Homo sapiens
gaacaaaccagacaugaac

SEQ ID NO: 154913 - RNA, 19 nt, Homo sapiens
gaagaaaccaagagaagga

SEQ ID NO: 154914 - RNA, 19 nt, Homo sapiens
guacagauaagacaauuga

SEQ ID NO: 154915 - RNA, 19 nt, Homo sapiens
gaaagcagcauccucuguu

SEQ ID NO: 154916 - RNA, 19 nt, Homo sapiens
ccaagcagcucacuacgau

SEQ ID NO: 154917 - RNA, 19 nt, Homo sapiens
ucacuuagccuuggcauuu

SEQ ID NO: 154918 - RNA, 19 nt, Homo sapiens
ggccagaugucauuacaga

SEQ ID NO: 154919 - RNA, 19 nt, Homo sapiens
guuguacucuuguuucaaa

SEQ ID NO: 154920 - RNA, 19 nt, Homo sapiens
aaccagacaugaacuauga

SEQ ID NO: 154921 - RNA, 19 nt, Homo sapiens
uaaauggacucagagagaa

SEQ ID NO: 154922 - RNA, 19 nt, Homo sapiens
gacaaucccuacugugaug

SEQ ID NO: 154923 - RNA, 19 nt, Homo sapiens
caacagcgaccucuccaaa

SEQ ID NO: 154924 - RNA, 19 nt, Homo sapiens
gaacacuaacauucuguaa

SEQ ID NO: 154925 - RNA, 19 nt, Homo sapiens
gcuauugcccuuccuguaa

SEQ ID NO: 154926 - RNA, 19 nt, Homo sapiens
gaaauaccaguguucaguu

SEQ ID NO: 154927 - RNA, 19 nt, Homo sapiens
gcaguucagucaguuaaug

SEQ ID NO: 154928 - RNA, 19 nt, Homo sapiens
ugugaagacucugcuaaua

SEQ ID NO: 154929 - RNA, 19 nt, Homo sapiens
gaugccagcuucuacugaa

SEQ ID NO: 154930 - RNA, 19 nt, Homo sapiens
uagcuagaguugugaauau

SEQ ID NO: 154931 - RNA, 19 nt, Homo sapiens
ggacagaggcuuguauauc

SEQ ID NO: 154932 - RNA, 19 nt, Homo sapiens
guaaugagacuaucaaugc

SEQ ID NO: 154933 - RNA, 19 nt, Homo sapiens
ucaggaagcauuaacauug

SEQ ID NO: 154934 - RNA, 19 nt, Homo sapiens
guggacaaauuaacaguug

SEQ ID NO: 154935 - RNA, 19 nt, Homo sapiens
cagaaggacuagugacaug

SEQ ID NO: 154936 - RNA, 19 nt, Homo sapiens
caaucagacuuacuggaaa

SEQ ID NO: 154937 - RNA, 19 nt, Homo sapiens
uguaucaacuccagaauuc

SEQ ID NO: 154938 - RNA, 19 nt, Homo sapiens
gaaguccuguggaaguguu

SEQ ID NO: 154939 - RNA, 19 nt, Homo sapiens
aaauaccaguguucaguuu

SEQ ID NO: 154940 - RNA, 19 nt, Homo sapiens
gauaucaaguuacacuaag

SEQ ID NO: 154941 - RNA, 19 nt, Homo sapiens
gcagaaagucuccugaaag

SEQ ID NO: 154942 - RNA, 19 nt, Homo sapiens
ccagaugucauuacagaaa

SEQ ID NO: 154943 - RNA, 19 nt, Homo sapiens
ggaaauaccaguguucagu

SEQ ID NO: 154944 - RNA, 19 nt, Homo sapiens
cagacuuacuggaaauaaa

SEQ ID NO: 154945 - RNA, 19 nt, Homo sapiens
gggaaagcauaagaacaaa

SEQ ID NO: 154946 - RNA, 19 nt, Homo sapiens
ucgcacaguucucacuuaa

SEQ ID NO: 154947 - RNA, 19 nt, Homo sapiens
aaugcacacuguacagaua

SEQ ID NO: 154948 - RNA, 19 nt, Homo sapiens
ugaguuagguauaaagaag

SEQ ID NO: 154949 - RNA, 19 nt, Homo sapiens
ucagaaagaggauagcaaa

SEQ ID NO: 154950 - RNA, 19 nt, Homo sapiens
ugaacuacauauugagaug

SEQ ID NO: 154951 - RNA, 19 nt, Homo sapiens
caggaagcauuaacauugu

SEQ ID NO: 154952 - RNA, 19 nt, Homo sapiens
cagaaagucuccugaaagc

SEQ ID NO: 154953 - RNA, 19 nt, Homo sapiens
uaaagaagaaaccaagaga

SEQ ID NO: 154954 - RNA, 19 nt, Homo sapiens
uaguggaggugucaacuga

SEQ ID NO: 154955 - RNA, 19 nt, Homo sapiens
uggcauuugugcagacaua

SEQ ID NO: 154956 - RNA, 19 nt, Homo sapiens
uaugguaguuuaagucugu

SEQ ID NO: 154957 - RNA, 19 nt, Homo sapiens
gugaagacucugcuaauau

SEQ ID NO: 154958 - RNA, 19 nt, Homo sapiens
ggaccaagcagcucacuac

SEQ ID NO: 154959 - RNA, 19 nt, Homo sapiens
aaacauaguggucauagau

SEQ ID NO: 154960 - RNA, 19 nt, Homo sapiens
gcucuaauaccuggaguuu

SEQ ID NO: 154961 - RNA, 19 nt, Homo sapiens
cuaauggcuuguuugugua

SEQ ID NO: 154962 - RNA, 19 nt, Homo sapiens
gauggguaaucucauuguu

SEQ ID NO: 154963 - RNA, 19 nt, Homo sapiens
cagacaaucccuacuguga

SEQ ID NO: 154964 - RNA, 19 nt, Homo sapiens
agagaaggguguagcuaga

SEQ ID NO: 154965 - RNA, 19 nt, Homo sapiens
caagaaguccuguggaagu

SEQ ID NO: 154966 - RNA, 19 nt, Homo sapiens
gaaggacagaggcuuguau

SEQ ID NO: 154967 - RNA, 19 nt, Homo sapiens
gggacgagcuuugagauac

SEQ ID NO: 154968 - RNA, 19 nt, Homo sapiens
ucaagcugguggauucaaa

SEQ ID NO: 154969 - RNA, 19 nt, Homo sapiens
acaguuggcucuggccuuu

SEQ ID NO: 154970 - RNA, 19 nt, Homo sapiens
ucugucaguuucuuaauug

SEQ ID NO: 154971 - RNA, 19 nt, Homo sapiens
gcagcucacuacgauauca

SEQ ID NO: 154972 - RNA, 19 nt, Homo sapiens
gcaagggaagucaucaaga

SEQ ID NO: 154973 - RNA, 19 nt, Homo sapiens
ggguguagcuagaguugug

SEQ ID NO: 154974 - RNA, 19 nt, Homo sapiens
caaaggcugucucuaagcu

SEQ ID NO: 154975 - RNA, 19 nt, Homo sapiens
acccagcaaucaccaauuu

SEQ ID NO: 154976 - RNA, 19 nt, Homo sapiens
guacucuuguuucaaagug

SEQ ID NO: 154977 - RNA, 19 nt, Homo sapiens
cagcaauuauuacuguguu

SEQ ID NO: 154978 - RNA, 19 nt, Homo sapiens
acuaagacuuggaacacua

SEQ ID NO: 154979 - RNA, 19 nt, Homo sapiens
gggaaaugaacuacauauu

SEQ ID NO: 154980 - RNA, 19 nt, Homo sapiens
ggacuagugacaugugaga

SEQ ID NO: 154981 - RNA, 19 nt, Homo sapiens
uauucaagcugguggauuc

SEQ ID NO: 154982 - RNA, 19 nt, Homo sapiens
caaccuauuugugggaguu

SEQ ID NO: 154983 - RNA, 19 nt, Homo sapiens
aaaggaaacacaaccuauu

SEQ ID NO: 154984 - RNA, 19 nt, Homo sapiens
auggauaccucuccuauuc

SEQ ID NO: 154985 - RNA, 19 nt, Homo sapiens
ggugucaacugaagagucu

SEQ ID NO: 154986 - RNA, 19 nt, Homo sapiens
guucugcugucacuuggaa

SEQ ID NO: 154987 - RNA, 19 nt, Homo sapiens
uaccagcaauuauuacugu

SEQ ID NO: 154988 - RNA, 19 nt, Homo sapiens
ggaacacuaacauucugua

SEQ ID NO: 154989 - RNA, 19 nt, Homo sapiens
gacuaucaaugccuacuca

SEQ ID NO: 154990 - RNA, 19 nt, Homo sapiens
gaaaauggagacaaaauca

SEQ ID NO: 154991 - RNA, 19 nt, Homo sapiens
guagcuagaguugugaaua

SEQ ID NO: 154992 - RNA, 19 nt, Homo sapiens
aaagugaaaccuguaauga

SEQ ID NO: 154993 - RNA, 19 nt, Homo sapiens
gggaauucuugcaaagguu

SEQ ID NO: 154994 - RNA, 19 nt, Homo sapiens
gcagagaccuccaauaaag

SEQ ID NO: 154995 - RNA, 19 nt, Homo sapiens
ucagagcacucccuaauuu

SEQ ID NO: 154996 - RNA, 19 nt, Homo sapiens
guuugaagcugacuuuaua

SEQ ID NO: 154997 - RNA, 19 nt, Homo sapiens
guuaggaucuuguaaagga

SEQ ID NO: 154998 - RNA, 19 nt, Homo sapiens
gcaaguguaucuccuuuua

SEQ ID NO: 154999 - RNA, 19 nt, Homo sapiens
gagagaagcugauguuuug

SEQ ID NO: 155000 - RNA, 19 nt, Homo sapiens
gagcucaguuggaucauug

SEQ ID NO: 155001 - RNA, 19 nt, Homo sapiens
cgagugaccuugaccuuga

SEQ ID NO: 155002 - RNA, 19 nt, Homo sapiens
ggaagcagcugagacuguu

SEQ ID NO: 155003 - RNA, 19 nt, Homo sapiens
gaacugaggguuggaacua

SEQ ID NO: 155004 - RNA, 19 nt, Homo sapiens
gcugcaaccugugagauua

SEQ ID NO: 155005 - RNA, 19 nt, Homo sapiens
caagugugcuguaaacugu

SEQ ID NO: 155006 - RNA, 19 nt, Homo sapiens
gaucgaauauggucaagag

SEQ ID NO: 155007 - RNA, 19 nt, Homo sapiens
uaauaugaaucccagcuuu

SEQ ID NO: 155008 - RNA, 19 nt, Homo sapiens
ucauugagcugcuggagaa

SEQ ID NO: 155009 - RNA, 19 nt, Homo sapiens
gaagacgcaggcucuauuu

SEQ ID NO: 155010 - RNA, 19 nt, Homo sapiens
gaccugauguucucaagau

SEQ ID NO: 155011 - RNA, 19 nt, Homo sapiens
gcuguaaacuguauaucug

SEQ ID NO: 155012 - RNA, 19 nt, Homo sapiens
ugucuuagcuaccugugua

SEQ ID NO: 155013 - RNA, 19 nt, Homo sapiens
ggaagagguucuccagagu

SEQ ID NO: 155014 - RNA, 19 nt, Homo sapiens
agaaggacaugaacucaga

SEQ ID NO: 155015 - RNA, 19 nt, Homo sapiens
ggagaacguuacaagacuu

SEQ ID NO: 155016 - RNA, 19 nt, Homo sapiens
cuuuauagcugcaagugua

SEQ ID NO: 155017 - RNA, 19 nt, Homo sapiens
uggcuggccuuguggaaua

SEQ ID NO: 155018 - RNA, 19 nt, Homo sapiens
caagaugucuagaauugca

SEQ ID NO: 155019 - RNA, 19 nt, Homo sapiens
gggcaaaggcugacgaaga

SEQ ID NO: 155020 - RNA, 19 nt, Homo sapiens
cgaauauggucaagagguu

SEQ ID NO: 155021 - RNA, 19 nt, Homo sapiens
ggcaaaggcugacgaagag

SEQ ID NO: 155022 - RNA, 19 nt, Homo sapiens
gaguuaggaucuuguaaag

SEQ ID NO: 155023 - RNA, 19 nt, Homo sapiens
cucaagaugucuagaauug

SEQ ID NO: 155024 - RNA, 19 nt, Homo sapiens
caacaugaccuacgagaag

SEQ ID NO: 155025 - RNA, 19 nt, Homo sapiens
aggcagagaccuccaauaa

SEQ ID NO: 155026 - RNA, 19 nt, Homo sapiens
gaaagcugagcaaagagua

SEQ ID NO: 155027 - RNA, 19 nt, Homo sapiens
gcuaccaaguggagaagaa

SEQ ID NO: 155028 - RNA, 19 nt, Homo sapiens
ggucagagcacucccuaau

SEQ ID NO: 155029 - RNA, 19 nt, Homo sapiens
gcaagaaggacaugaacuc

SEQ ID NO: 155030 - RNA, 19 nt, Homo sapiens
cccgaaagcugagcaaaga

SEQ ID NO: 155031 - RNA, 19 nt, Homo sapiens
cgacucgucuacaaguuug

SEQ ID NO: 155032 - RNA, 19 nt, Homo sapiens
ggaccuggaucccacugau

SEQ ID NO: 155033 - RNA, 19 nt, Homo sapiens
ugucagauguacauagaga

SEQ ID NO: 155034 - RNA, 19 nt, Homo sapiens
ggagcugcgucuggucuuu

SEQ ID NO: 155035 - RNA, 19 nt, Homo sapiens
uacaagacuucaugcaaga

SEQ ID NO: 155036 - RNA, 19 nt, Homo sapiens
gccgaugacuugguacuga

SEQ ID NO: 155037 - RNA, 19 nt, Homo sapiens
cagagcacucccuaauuua

SEQ ID NO: 155038 - RNA, 19 nt, Homo sapiens
cgaagacgcaggcucuauu

SEQ ID NO: 155039 - RNA, 19 nt, Homo sapiens
gcgccacccucugcaauug

SEQ ID NO: 155040 - RNA, 19 nt, Homo sapiens
gccauugacuucucacgau

SEQ ID NO: 155041 - RNA, 19 nt, Homo sapiens
ggaugagggugagggcaaa

SEQ ID NO: 155042 - RNA, 19 nt, Homo sapiens
ggaggaaaaugaaggucua

SEQ ID NO: 155043 - RNA, 19 nt, Homo sapiens
cuaccuguguacugaaauu

SEQ ID NO: 155044 - RNA, 19 nt, Homo sapiens
gaugagcucaguuggauca

SEQ ID NO: 155045 - RNA, 19 nt, Homo sapiens
gacaugaacucagaacacu

SEQ ID NO: 155046 - RNA, 19 nt, Homo sapiens
gaaauuugggccuuuggau

SEQ ID NO: 155047 - RNA, 19 nt, Homo sapiens
uguagcaggugugggcuua

SEQ ID NO: 155048 - RNA, 19 nt, Homo sapiens
ggcagagaccuccaauaaa

SEQ ID NO: 155049 - RNA, 19 nt, Homo sapiens
gagcacucccuaauuuaug

SEQ ID NO: 155050 - RNA, 19 nt, Homo sapiens
ggagagaagcugauguuuu

SEQ ID NO: 155051 - RNA, 19 nt, Homo sapiens
aaucagaguuaggaucuug

SEQ ID NO: 155052 - RNA, 19 nt, Homo sapiens
caugagguacuacuacaaa

SEQ ID NO: 155053 - RNA, 19 nt, Homo sapiens
gcaacaugaccuacgagaa

SEQ ID NO: 155054 - RNA, 19 nt, Homo sapiens
agagagagagagagaacua

SEQ ID NO: 155055 - RNA, 19 nt, Homo sapiens
uuagcuaccuguguacuga

SEQ ID NO: 155056 - RNA, 19 nt, Homo sapiens
ccacccuccucuuggaauu

SEQ ID NO: 155057 - RNA, 19 nt, Homo sapiens
acugaggguuggaacuaua

SEQ ID NO: 155058 - RNA, 19 nt, Homo sapiens
gacacuaaaugcagacaac

SEQ ID NO: 155059 - RNA, 19 nt, Homo sapiens
gcgacucgucuacaaguuu

SEQ ID NO: 155060 - RNA, 19 nt, Homo sapiens
gccaugagguacuacuaca

SEQ ID NO: 155061 - RNA, 19 nt, Homo sapiens
ggacaugaacucagaacac

SEQ ID NO: 155062 - RNA, 19 nt, Homo sapiens
gcaaaggaagcagcugaga

SEQ ID NO: 155063 - RNA, 19 nt, Homo sapiens
ccacuccgguagccucaug

SEQ ID NO: 155064 - RNA, 19 nt, Homo sapiens
ccucaaacccagucucaga

SEQ ID NO: 155065 - RNA, 19 nt, Homo sapiens
gaacuauacccgggaccaa

SEQ ID NO: 155066 - RNA, 19 nt, Homo sapiens
guacgacgcaagcgccauu

SEQ ID NO: 155067 - RNA, 19 nt, Homo sapiens
agaguuaggaucuuguaaa

SEQ ID NO: 155068 - RNA, 19 nt, Homo sapiens
uugcauggcuggccuugug

SEQ ID NO: 155069 - RNA, 19 nt, Homo sapiens
cugcaaguguaucuccuuu

SEQ ID NO: 155070 - RNA, 19 nt, Homo sapiens
gguuugaagcugacuuuau

SEQ ID NO: 155071 - RNA, 19 nt, Homo sapiens
caugacaccgcucgaguga

SEQ ID NO: 155072 - RNA, 19 nt, Homo sapiens
caagaaggacaugaacuca

SEQ ID NO: 155073 - RNA, 19 nt, Homo sapiens
guuacaagacuucaugcaa

SEQ ID NO: 155074 - RNA, 19 nt, Homo sapiens
guggagagaagcugauguu

SEQ ID NO: 155075 - RNA, 19 nt, Homo sapiens
gaauagaugguuuugcauu

SEQ ID NO: 155076 - RNA, 19 nt, Homo sapiens
gcaggugugggcuuacaga

SEQ ID NO: 155077 - RNA, 19 nt, Homo sapiens
gccuuuggaucgaauaugg

SEQ ID NO: 155078 - RNA, 19 nt, Homo sapiens
ccaagugugcuguaaacug

SEQ ID NO: 155079 - RNA, 19 nt, Homo sapiens
ggaaggaggaagagguucu

SEQ ID NO: 155080 - RNA, 19 nt, Homo sapiens
ucacuuccagcucuucuga

SEQ ID NO: 155081 - RNA, 19 nt, Homo sapiens
agacgcaggcucuauuuag

SEQ ID NO: 155082 - RNA, 19 nt, Homo sapiens
gauguucucaagaugucua

SEQ ID NO: 155083 - RNA, 19 nt, Homo sapiens
gaaggacaugaacucagaa

SEQ ID NO: 155084 - RNA, 19 nt, Homo sapiens
aaguggagaagaacaagua

SEQ ID NO: 155085 - RNA, 19 nt, Homo sapiens
gcugaugcugggacccuua

SEQ ID NO: 155086 - RNA, 19 nt, Homo sapiens
gcugugcuguggagagaag

SEQ ID NO: 155087 - RNA, 19 nt, Homo sapiens
acagcaacaugaccuacga

SEQ ID NO: 155088 - RNA, 19 nt, Homo sapiens
ggucgaagacgcagguucu

SEQ ID NO: 155089 - RNA, 19 nt, Homo sapiens
guaauaugaaucccagcuu

SEQ ID NO: 155090 - RNA, 19 nt, Homo sapiens
gaacguuacaagacuucau

SEQ ID NO: 155091 - RNA, 19 nt, Homo sapiens
uaaaugcagacaacaccuu

SEQ ID NO: 155092 - RNA, 19 nt, Homo sapiens
uggcggaacuggauuucuc

SEQ ID NO: 155093 - RNA, 19 nt, Homo sapiens
caaagaguacugggacugu

SEQ ID NO: 155094 - RNA, 19 nt, Homo sapiens
gcucuucucuucuuuguua

SEQ ID NO: 155095 - RNA, 19 nt, Homo sapiens
ggaaacaacucuaauaucu

SEQ ID NO: 155096 - RNA, 19 nt, Homo sapiens
gcggaagucuuacucaaua

SEQ ID NO: 155097 - RNA, 19 nt, Homo sapiens
ucuaauaucuggugacuuu

SEQ ID NO: 155098 - RNA, 19 nt, Homo sapiens
ggaaagcauucucuaauuc

SEQ ID NO: 155099 - RNA, 19 nt, Homo sapiens
gagcugaauucauugagua

SEQ ID NO: 155100 - RNA, 19 nt, Homo sapiens
gggaaagcauucucuaauu

SEQ ID NO: 155101 - RNA, 19 nt, Homo sapiens
ggaauuuacuacccuauau

SEQ ID NO: 155102 - RNA, 19 nt, Homo sapiens
ccagugaccugaucuuuga

SEQ ID NO: 155103 - RNA, 19 nt, Homo sapiens
gcaacgggauggaugauga

SEQ ID NO: 155104 - RNA, 19 nt, Homo sapiens
cgaaguaccucaccuguca

SEQ ID NO: 155105 - RNA, 19 nt, Homo sapiens
ccucagagcuagccacaaa

SEQ ID NO: 155106 - RNA, 19 nt, Homo sapiens
gaggaagggucaaccuauu

SEQ ID NO: 155107 - RNA, 19 nt, Homo sapiens
caagaagacugggaaauca

SEQ ID NO: 155108 - RNA, 19 nt, Homo sapiens
guacagaaccauccacuug

SEQ ID NO: 155109 - RNA, 19 nt, Homo sapiens
ugagggagcuccugagaga

SEQ ID NO: 155110 - RNA, 19 nt, Homo sapiens
gacgggaccuugugcauga

SEQ ID NO: 155111 - RNA, 19 nt, Homo sapiens
aaagacagcauggcuauua

SEQ ID NO: 155112 - RNA, 19 nt, Homo sapiens
gcucuaggcuccaaaguac

SEQ ID NO: 155113 - RNA, 19 nt, Homo sapiens
gggcaaggcuaagaaaugu

SEQ ID NO: 155114 - RNA, 19 nt, Homo sapiens
gaaaucaaaggauggcaaa

SEQ ID NO: 155115 - RNA, 19 nt, Homo sapiens
gcacuagggcauaugcuuu

SEQ ID NO: 155116 - RNA, 19 nt, Homo sapiens
cuacuucccucauuaagau

SEQ ID NO: 155117 - RNA, 19 nt, Homo sapiens
uuaaggagaugcccaagga

SEQ ID NO: 155118 - RNA, 19 nt, Homo sapiens
aaacaagccugacaugaac

SEQ ID NO: 155119 - RNA, 19 nt, Homo sapiens
ggaaaucaaagaagagaau

SEQ ID NO: 155120 - RNA, 19 nt, Homo sapiens
caagagcacuagggcauau

SEQ ID NO: 155121 - RNA, 19 nt, Homo sapiens
ccaaacagugcccagcuua

SEQ ID NO: 155122 - RNA, 19 nt, Homo sapiens
ccacggugcugaccaaugg

SEQ ID NO: 155123 - RNA, 19 nt, Homo sapiens
agaaacaccugucccaagu

SEQ ID NO: 155124 - RNA, 19 nt, Homo sapiens
gcaaaggcagcaccaucua

SEQ ID NO: 155125 - RNA, 19 nt, Homo sapiens
gagaggaaagugccaagaa

SEQ ID NO: 155126 - RNA, 19 nt, Homo sapiens
aagcaucccuggcaucaga

SEQ ID NO: 155127 - RNA, 19 nt, Homo sapiens
gaaacaccugucccaagua

SEQ ID NO: 155128 - RNA, 19 nt, Homo sapiens
acaauggcaucauaacaga

SEQ ID NO: 155129 - RNA, 19 nt, Homo sapiens
caaccuauucucucucaaa

SEQ ID NO: 155130 - RNA, 19 nt, Homo sapiens
caacccuacuucccucauu

SEQ ID NO: 155131 - RNA, 19 nt, Homo sapiens
gaacgccaguuuccaagac

SEQ ID NO: 155132 - RNA, 19 nt, Homo sapiens
gaacgagugcagaguagga

SEQ ID NO: 155133 - RNA, 19 nt, Homo sapiens
cuaauucccuuuguucaug

SEQ ID NO: 155134 - RNA, 19 nt, Homo sapiens
gacaugaacuaugagacaa

SEQ ID NO: 155135 - RNA, 19 nt, Homo sapiens
gaaaggcaucuucaaacug

SEQ ID NO: 155136 - RNA, 19 nt, Homo sapiens
gagaaaggcaucuucaaac

SEQ ID NO: 155137 - RNA, 19 nt, Homo sapiens
guaccucaccugucacuga

SEQ ID NO: 155138 - RNA, 19 nt, Homo sapiens
gaaacaacucuaauaucug

SEQ ID NO: 155139 - RNA, 19 nt, Homo sapiens
caaguuugauccuccgaau

SEQ ID NO: 155140 - RNA, 19 nt, Homo sapiens
gggaauuuacuacccuaua

SEQ ID NO: 155141 - RNA, 19 nt, Homo sapiens
agagaaaggcaucuucaaa

SEQ ID NO: 155142 - RNA, 19 nt, Homo sapiens
gcaaggcuaagaaauguca

SEQ ID NO: 155143 - RNA, 19 nt, Homo sapiens
gcucaagcaugggcaccua

SEQ ID NO: 155144 - RNA, 19 nt, Homo sapiens
gaggaaagugccaagaaga

SEQ ID NO: 155145 - RNA, 19 nt, Homo sapiens
gcugacagaugacaaugag

SEQ ID NO: 155146 - RNA, 19 nt, Homo sapiens
gaaccauccacuugaccua

SEQ ID NO: 155147 - RNA, 19 nt, Homo sapiens
acaauaggcugugaugaca

SEQ ID NO: 155148 - RNA, 19 nt, Homo sapiens
ucagugggaugucaauaca

SEQ ID NO: 155149 - RNA, 19 nt, Homo sapiens
cuaagauacuacuaccaaa

SEQ ID NO: 155150 - RNA, 19 nt, Homo sapiens
agaaaggcaucuucaaacu

SEQ ID NO: 155151 - RNA, 19 nt, Homo sapiens
gucaaccgcggaagucuua

SEQ ID NO: 155152 - RNA, 19 nt, Homo sapiens
ccccagagcugaauucauu

SEQ ID NO: 155153 - RNA, 19 nt, Homo sapiens
cagucaggcuggaaucuug

SEQ ID NO: 155154 - RNA, 19 nt, Homo sapiens
ccuggaguuugccguguua

SEQ ID NO: 155155 - RNA, 19 nt, Homo sapiens
uuacuacccuauaugugaa

SEQ ID NO: 155156 - RNA, 19 nt, Homo sapiens
gaauuuacuacccuauaug

SEQ ID NO: 155157 - RNA, 19 nt, Homo sapiens
gggcugacuuggugaugga

SEQ ID NO: 155158 - RNA, 19 nt, Homo sapiens
caaacagugcccagcuuaa

SEQ ID NO: 155159 - RNA, 19 nt, Homo sapiens
ucacuuugcaggccucuuu

SEQ ID NO: 155160 - RNA, 19 nt, Homo sapiens
agccugacaugaacuauga

SEQ ID NO: 155161 - RNA, 19 nt, Homo sapiens
gaaaugucagccacggaaa

SEQ ID NO: 155162 - RNA, 19 nt, Homo sapiens
cuacacagggaauuuacua

SEQ ID NO: 155163 - RNA, 19 nt, Homo sapiens
aacccuacuucccucauua

SEQ ID NO: 155164 - RNA, 19 nt, Homo sapiens
ccagcggccucuacuuuca

SEQ ID NO: 155165 - RNA, 19 nt, Homo sapiens
gguauugucccuucaucaa

SEQ ID NO: 155166 - RNA, 19 nt, Homo sapiens
ccaagaagacugggaaauc

SEQ ID NO: 155167 - RNA, 19 nt, Homo sapiens
cacggaaacaacucuaaua

SEQ ID NO: 155168 - RNA, 19 nt, Homo sapiens
gaaaagacagcauggcuau

SEQ ID NO: 155169 - RNA, 19 nt, Homo sapiens
ugucauugcugccuucauc

SEQ ID NO: 155170 - RNA, 19 nt, Homo sapiens
gagagaaaggcaucuucaa

SEQ ID NO: 155171 - RNA, 19 nt, Homo sapiens
gauccugggcucccucuug

SEQ ID NO: 155172 - RNA, 19 nt, Homo sapiens
uauugucccuucaucaaga

SEQ ID NO: 155173 - RNA, 19 nt, Homo sapiens
cgggauggaugaugauauc

SEQ ID NO: 155174 - RNA, 19 nt, Homo sapiens
aaacaccugucccaaguac

SEQ ID NO: 155175 - RNA, 19 nt, Homo sapiens
aagcagaucuucaguaccu

SEQ ID NO: 155176 - RNA, 19 nt, Homo sapiens
ggaagucuuacucaauaug

SEQ ID NO: 155177 - RNA, 19 nt, Homo sapiens
gcauggcuauuacccuaca

SEQ ID NO: 155178 - RNA, 19 nt, Homo sapiens
gccaaacagugcccagcuu

SEQ ID NO: 155179 - RNA, 19 nt, Homo sapiens
gcauuucagugggauguca

SEQ ID NO: 155180 - RNA, 19 nt, Homo sapiens
caugaacuaugagacaaug

SEQ ID NO: 155181 - RNA, 19 nt, Homo sapiens
caaaggcagcaccaucuau

SEQ ID NO: 155182 - RNA, 19 nt, Homo sapiens
uaacagacgggaccuugug

SEQ ID NO: 155183 - RNA, 19 nt, Homo sapiens
guauuuacuaugcguguuu

SEQ ID NO: 155184 - RNA, 19 nt, Homo sapiens
ggagggcacuguguuuggu

SEQ ID NO: 155185 - RNA, 19 nt, Homo sapiens
caacuaucacccucuccua

SEQ ID NO: 155186 - RNA, 19 nt, Homo sapiens
guacuacugcucccacuca

SEQ ID NO: 155187 - RNA, 19 nt, Homo sapiens
caucuucagugcccagcaa

SEQ ID NO: 155188 - RNA, 19 nt, Homo sapiens
gcucuggagggcucugaua

SEQ ID NO: 155189 - RNA, 19 nt, Homo sapiens
caaccacagucaccuugca

SEQ ID NO: 155190 - RNA, 19 nt, Homo sapiens
ugugaggucuugucuccaa

SEQ ID NO: 155191 - RNA, 19 nt, Homo sapiens
guuggucuguaucuuaguu

SEQ ID NO: 155192 - RNA, 19 nt, Homo sapiens
gagccaggcagaaguuugu

SEQ ID NO: 155193 - RNA, 19 nt, Homo sapiens
ugaccacggugcugaccaa

SEQ ID NO: 155194 - RNA, 19 nt, Homo sapiens
gaagguuaguguacaaauu

SEQ ID NO: 155195 - RNA, 19 nt, Homo sapiens
gcagagcccugagauacua

SEQ ID NO: 155196 - RNA, 19 nt, Homo sapiens
gaaaacaaguggcaucaaa

SEQ ID NO: 155197 - RNA, 19 nt, Homo sapiens
gcccugagauacuacuaua

SEQ ID NO: 155198 - RNA, 19 nt, Homo sapiens
gaagauagggaacaaggaa

SEQ ID NO: 155199 - RNA, 19 nt, Homo sapiens
ccaaaguucucaucuaugg

SEQ ID NO: 155200 - RNA, 19 nt, Homo sapiens
gaagaaaacuguggcauuc

SEQ ID NO: 155201 - RNA, 19 nt, Homo sapiens
cuacaggugucuuuauuuc

SEQ ID NO: 155202 - RNA, 19 nt, Homo sapiens
gcaaggccaccaucaaaga

SEQ ID NO: 155203 - RNA, 19 nt, Homo sapiens
guacgagaccugcuucuau

SEQ ID NO: 155204 - RNA, 19 nt, Homo sapiens
gcaggaagacaagcuauga

SEQ ID NO: 155205 - RNA, 19 nt, Homo sapiens
agaacaagccuccaaaguu

SEQ ID NO: 155206 - RNA, 19 nt, Homo sapiens
gcaaagauguggggacaaa

SEQ ID NO: 155207 - RNA, 19 nt, Homo sapiens
guacuacccugccuuugag

SEQ ID NO: 155208 - RNA, 19 nt, Homo sapiens
ggcuacaggugucuuuauu

SEQ ID NO: 155209 - RNA, 19 nt, Homo sapiens
gagcagagcccugagauac

SEQ ID NO: 155210 - RNA, 19 nt, Homo sapiens
gaagacaagcuaugaucug

SEQ ID NO: 155211 - RNA, 19 nt, Homo sapiens
gacagaaugacauaugaaa

SEQ ID NO: 155212 - RNA, 19 nt, Homo sapiens
gaaagcaaggccaccauca

SEQ ID NO: 155213 - RNA, 19 nt, Homo sapiens
cggaagcccuggcaaagau

SEQ ID NO: 155214 - RNA, 19 nt, Homo sapiens
uaaugacgcugaagaaagc

SEQ ID NO: 155215 - RNA, 19 nt, Homo sapiens
gaacauccgcacacaaggu

SEQ ID NO: 155216 - RNA, 19 nt, Homo sapiens
ccugagauacuacuauaaa

SEQ ID NO: 155217 - RNA, 19 nt, Homo sapiens
cuccaaaguucucaucuau

SEQ ID NO: 155218 - RNA, 19 nt, Homo sapiens
ccuccaaaguucucaucua

SEQ ID NO: 155219 - RNA, 19 nt, Homo sapiens
gcaccuuccugccuaaugc

SEQ ID NO: 155220 - RNA, 19 nt, Homo sapiens
gauagggaacaaggaauuu

SEQ ID NO: 155221 - RNA, 19 nt, Homo sapiens
ccaauugcaucuccuucug

SEQ ID NO: 155222 - RNA, 19 nt, Homo sapiens
gaccgaagguuaguguaca

SEQ ID NO: 155223 - RNA, 19 nt, Homo sapiens
guucucaucuaugggaauu

SEQ ID NO: 155224 - RNA, 19 nt, Homo sapiens
gcuacaggugucuuuauuu

SEQ ID NO: 155225 - RNA, 19 nt, Homo sapiens
caaagacuaugcugauucc

SEQ ID NO: 155226 - RNA, 19 nt, Homo sapiens
aagcaaggccaccaucaaa

SEQ ID NO: 155227 - RNA, 19 nt, Homo sapiens
ucucaucuaugggaauuug

SEQ ID NO: 155228 - RNA, 19 nt, Homo sapiens
uacgagaccugcuucuauc

SEQ ID NO: 155229 - RNA, 19 nt, Homo sapiens
ucaaagacuaugcugauuc

SEQ ID NO: 155230 - RNA, 19 nt, Homo sapiens
ggaagacaagcuaugaucu

SEQ ID NO: 155231 - RNA, 19 nt, Homo sapiens
gcggguugaccgaagguua

SEQ ID NO: 155232 - RNA, 19 nt, Homo sapiens
ggaagauagggaacaagga

SEQ ID NO: 155233 - RNA, 19 nt, Homo sapiens
ucacagucauaguagaaca

SEQ ID NO: 155234 - RNA, 19 nt, Homo sapiens
cagaacauccgcacacaag

SEQ ID NO: 155235 - RNA, 19 nt, Homo sapiens
gcaugacacaggaggaguu

SEQ ID NO: 155236 - RNA, 19 nt, Homo sapiens
ugccuucucuugccuugaa

SEQ ID NO: 155237 - RNA, 19 nt, Homo sapiens
gucguggacugaucuguuc

SEQ ID NO: 155238 - RNA, 19 nt, Homo sapiens
gcugcgaccaguacaaguu

SEQ ID NO: 155239 - RNA, 19 nt, Homo sapiens
gagcgccugccuucucuug

SEQ ID NO: 155240 - RNA, 19 nt, Homo sapiens
ugacagaaugacauaugaa

SEQ ID NO: 155241 - RNA, 19 nt, Homo sapiens
acaggugucuuuauuucca

SEQ ID NO: 155242 - RNA, 19 nt, Homo sapiens
ccgcugcccucacgguaau

SEQ ID NO: 155243 - RNA, 19 nt, Homo sapiens
caaguggcaucaaaaguca

SEQ ID NO: 155244 - RNA, 19 nt, Homo sapiens
augacagaaugacauauga

SEQ ID NO: 155245 - RNA, 19 nt, Homo sapiens
uagaacaagccuccaaagu

SEQ ID NO: 155246 - RNA, 19 nt, Homo sapiens
gauuccaacugcuugaaaa

SEQ ID NO: 155247 - RNA, 19 nt, Homo sapiens
ugagcagagcccugagaua

SEQ ID NO: 155248 - RNA, 19 nt, Homo sapiens
agauagggaacaaggaauu

SEQ ID NO: 155249 - RNA, 19 nt, Homo sapiens
aaagcaaggccaccaucaa

SEQ ID NO: 155250 - RNA, 19 nt, Homo sapiens
uuaaugacgcugaagaaag

SEQ ID NO: 155251 - RNA, 19 nt, Homo sapiens
aguacuacccugccuuuga

SEQ ID NO: 155252 - RNA, 19 nt, Homo sapiens
agaguacuacccugccuuu

SEQ ID NO: 155253 - RNA, 19 nt, Homo sapiens
aaacuguggcauucuggaa

SEQ ID NO: 155254 - RNA, 19 nt, Homo sapiens
ucaucuaugggaauuugua

SEQ ID NO: 155255 - RNA, 19 nt, Homo sapiens
guagaacaagccuccaaag

SEQ ID NO: 155256 - RNA, 19 nt, Homo sapiens
ugucacagucauaguagaa

SEQ ID NO: 155257 - RNA, 19 nt, Homo sapiens
aaugacagaaugacauaug

SEQ ID NO: 155258 - RNA, 19 nt, Homo sapiens
aaucggaagcccuggcaaa

SEQ ID NO: 155259 - RNA, 19 nt, Homo sapiens
acagcaccuuccugccuaa

SEQ ID NO: 155260 - RNA, 19 nt, Homo sapiens
cacccugaauacuggacua

SEQ ID NO: 155261 - RNA, 19 nt, Homo sapiens
ccugaauacuggacuaagc

SEQ ID NO: 155262 - RNA, 19 nt, Homo sapiens
ggaagaauuuguaccauuu

SEQ ID NO: 155263 - RNA, 19 nt, Homo sapiens
gaacgaccuuucuuucuuu

SEQ ID NO: 155264 - RNA, 19 nt, Homo sapiens
ggagucaucucuuccuaua

SEQ ID NO: 155265 - RNA, 19 nt, Homo sapiens
gaaguucgucuacaaguuu

SEQ ID NO: 155266 - RNA, 19 nt, Homo sapiens
gaacaagaccaacaugaau

SEQ ID NO: 155267 - RNA, 19 nt, Homo sapiens
caacaugaauuacgacaag

SEQ ID NO: 155268 - RNA, 19 nt, Homo sapiens
gaugugaguagaagaguua

SEQ ID NO: 155269 - RNA, 19 nt, Homo sapiens
gaaucacacccuuggaaua

SEQ ID NO: 155270 - RNA, 19 nt, Homo sapiens
cgaccuuucuuucuuuauu

SEQ ID NO: 155271 - RNA, 19 nt, Homo sapiens
agucaucucuuccuauauu

SEQ ID NO: 155272 - RNA, 19 nt, Homo sapiens
gcaaggcaauggccacauc

SEQ ID NO: 155273 - RNA, 19 nt, Homo sapiens
acacucgucuccacuguuu

SEQ ID NO: 155274 - RNA, 19 nt, Homo sapiens
cacgugagcuguagggaaa

SEQ ID NO: 155275 - RNA, 19 nt, Homo sapiens
cuccugggcucaccuguua

SEQ ID NO: 155276 - RNA, 19 nt, Homo sapiens
gagaagccauuccuuuguc

SEQ ID NO: 155277 - RNA, 19 nt, Homo sapiens
guagaagaguuaguuuguu

SEQ ID NO: 155278 - RNA, 19 nt, Homo sapiens
acaagaccaacaugaauua

SEQ ID NO: 155279 - RNA, 19 nt, Homo sapiens
ggacuacgcaagaacaaga

SEQ ID NO: 155280 - RNA, 19 nt, Homo sapiens
cauaaagccuguccugucu

SEQ ID NO: 155281 - RNA, 19 nt, Homo sapiens
gccagaaguucgucuacaa

SEQ ID NO: 155282 - RNA, 19 nt, Homo sapiens
acacacagcuuccacaacu

SEQ ID NO: 155283 - RNA, 19 nt, Homo sapiens
ucagacagcuuauccuuuu

SEQ ID NO: 155284 - RNA, 19 nt, Homo sapiens
caagcucuccuuccaguuu

SEQ ID NO: 155285 - RNA, 19 nt, Homo sapiens
ccagaagccaugacuacua

SEQ ID NO: 155286 - RNA, 19 nt, Homo sapiens
guacuacuaugacaagaac

SEQ ID NO: 155287 - RNA, 19 nt, Homo sapiens
ucacacccuuggaauagaa

SEQ ID NO: 155288 - RNA, 19 nt, Homo sapiens
caacuucucuguuuucugu

SEQ ID NO: 155289 - RNA, 19 nt, Homo sapiens
uuccacaacuucucuguuu

SEQ ID NO: 155290 - RNA, 19 nt, Homo sapiens
ggaagaauuacucccaaga

SEQ ID NO: 155291 - RNA, 19 nt, Homo sapiens
gaaagacucaugcucugau

SEQ ID NO: 155292 - RNA, 19 nt, Homo sapiens
gugcacaucccuucuauca

SEQ ID NO: 155293 - RNA, 19 nt, Homo sapiens
ggaugugaguagaagaguu

SEQ ID NO: 155294 - RNA, 19 nt, Homo sapiens
uagaagggcccaaggaaga

SEQ ID NO: 155295 - RNA, 19 nt, Homo sapiens
gcaagaacaagaccaacau

SEQ ID NO: 155296 - RNA, 19 nt, Homo sapiens
cagaagccaugacuacuac

SEQ ID NO: 155297 - RNA, 19 nt, Homo sapiens
uaaauggggcuuuucaaua

SEQ ID NO: 155298 - RNA, 19 nt, Homo sapiens
aggaagaauuuguaccauu

SEQ ID NO: 155299 - RNA, 19 nt, Homo sapiens
caaggaagaguuggaaguu

SEQ ID NO: 155300 - RNA, 19 nt, Homo sapiens
agaaguucgucuacaaguu

SEQ ID NO: 155301 - RNA, 19 nt, Homo sapiens
agaccaacaugaauuacga

SEQ ID NO: 155302 - RNA, 19 nt, Homo sapiens
uuacacgucuccuacuuca

SEQ ID NO: 155303 - RNA, 19 nt, Homo sapiens
gaagaauuacucccaagag

SEQ ID NO: 155304 - RNA, 19 nt, Homo sapiens
aaagacucaugcucugauu

SEQ ID NO: 155305 - RNA, 19 nt, Homo sapiens
ugaaaucggaagagcuuaa

SEQ ID NO: 155306 - RNA, 19 nt, Homo sapiens
gaaugucccuuuuguucuu

SEQ ID NO: 155307 - RNA, 19 nt, Homo sapiens
cacaucaucuccuggacuu

SEQ ID NO: 155308 - RNA, 19 nt, Homo sapiens
ggaugguggugaauucaag

SEQ ID NO: 155309 - RNA, 19 nt, Homo sapiens
ggaggaaugucccuuuugu

SEQ ID NO: 155310 - RNA, 19 nt, Homo sapiens
gaguagaagaguuaguuug

SEQ ID NO: 155311 - RNA, 19 nt, Homo sapiens
caaucgaggucuggcuuga

SEQ ID NO: 155312 - RNA, 19 nt, Homo sapiens
agaacaagaccaacaugaa

SEQ ID NO: 155313 - RNA, 19 nt, Homo sapiens
ggaggagccugaccuaacc

SEQ ID NO: 155314 - RNA, 19 nt, Homo sapiens
gcagcagccggaacgagua

SEQ ID NO: 155315 - RNA, 19 nt, Homo sapiens
uaaagagucccagagaaug

SEQ ID NO: 155316 - RNA, 19 nt, Homo sapiens
gguccaggaagaauuugua

SEQ ID NO: 155317 - RNA, 19 nt, Homo sapiens
gaaaucggaagagcuuaau

SEQ ID NO: 155318 - RNA, 19 nt, Homo sapiens
ccugagaagccauuccuuu

SEQ ID NO: 155319 - RNA, 19 nt, Homo sapiens
ucaaggagaaacauaguuc

SEQ ID NO: 155320 - RNA, 19 nt, Homo sapiens
gagaggguuugugccagaa

SEQ ID NO: 155321 - RNA, 19 nt, Homo sapiens
caagagagaguggguucaa

SEQ ID NO: 155322 - RNA, 19 nt, Homo sapiens
uaaagccuguccugucucu

SEQ ID NO: 155323 - RNA, 19 nt, Homo sapiens
acacgucuccuacuucaau

SEQ ID NO: 155324 - RNA, 19 nt, Homo sapiens
gcugagagagcaaggcaau

SEQ ID NO: 155325 - RNA, 19 nt, Homo sapiens
uguccugucucuauucuag

SEQ ID NO: 155326 - RNA, 19 nt, Homo sapiens
aaauggggcuuuucaauag

SEQ ID NO: 155327 - RNA, 19 nt, Homo sapiens
gaagaaucacacccuugga

SEQ ID NO: 155328 - RNA, 19 nt, Homo sapiens
cauuaucuccuccacagaa

SEQ ID NO: 155329 - RNA, 19 nt, Homo sapiens
ugagaagccauuccuuugu

SEQ ID NO: 155330 - RNA, 19 nt, Homo sapiens
gugaguagaagaguuaguu

SEQ ID NO: 155331 - RNA, 19 nt, Homo sapiens
gggaggagccugaccuaac

SEQ ID NO: 155332 - RNA, 19 nt, Homo sapiens
caagaacaagaccaacaug

SEQ ID NO: 155333 - RNA, 19 nt, Homo sapiens
aacgaccuuucuuucuuua

SEQ ID NO: 155334 - RNA, 19 nt, Homo sapiens
gcaauggccacaucaucuc

SEQ ID NO: 155335 - RNA, 19 nt, Homo sapiens
aagagagaguggguucaaa

SEQ ID NO: 155336 - RNA, 19 nt, Homo sapiens
gucaucucuuccuauauuu

SEQ ID NO: 155337 - RNA, 19 nt, Homo sapiens
aacaagaccaacaugaauu

SEQ ID NO: 155338 - RNA, 19 nt, Homo sapiens
gguacuacuaugacaagaa

SEQ ID NO: 155339 - RNA, 19 nt, Homo sapiens
aaacacacagcuuccacaa

SEQ ID NO: 155340 - RNA, 19 nt, Homo sapiens
aaggaagaguuggaaguug

SEQ ID NO: 155341 - RNA, 19 nt, Homo sapiens
ggccagaaguucgucuaca

SEQ ID NO: 155342 - RNA, 19 nt, Homo sapiens
gggccuugcgguacuacua

SEQ ID NO: 155343 - RNA, 19 nt, Homo sapiens
cugagaagccauuccuuug

SEQ ID NO: 155344 - RNA, 19 nt, Homo sapiens
aagaaucacacccuuggaa

SEQ ID NO: 155345 - RNA, 19 nt, Homo sapiens
gaccuagagcuuccacuca

SEQ ID NO: 155346 - RNA, 19 nt, Homo sapiens
ccuccaccaugccaaaugu

SEQ ID NO: 155347 - RNA, 19 nt, Homo sapiens
ggcaauggccacaucaucu

SEQ ID NO: 155348 - RNA, 19 nt, Homo sapiens
ccaggaagaauuuguacca

SEQ ID NO: 155349 - RNA, 19 nt, Homo sapiens
aagaacaagaccaacauga

SEQ ID NO: 155350 - RNA, 19 nt, Homo sapiens
ccuuacacgucuccuacuu

SEQ ID NO: 155351 - RNA, 19 nt, Homo sapiens
ggauccuugggaagaauua

SEQ ID NO: 155352 - RNA, 19 nt, Homo sapiens
cggccaagcucuccuucca

SEQ ID NO: 155353 - RNA, 19 nt, Homo sapiens
ugaguagaagaguuaguuu

SEQ ID NO: 155354 - RNA, 19 nt, Homo sapiens
ugaaagacucaugcucuga

SEQ ID NO: 155355 - RNA, 19 nt, Homo sapiens
caaggagaaacauaguuca

SEQ ID NO: 155356 - RNA, 19 nt, Homo sapiens
cuacacucgucuccacugu

SEQ ID NO: 155357 - RNA, 19 nt, Homo sapiens
aaucacacccuuggaauag

SEQ ID NO: 155358 - RNA, 19 nt, Homo sapiens
gaagaguuaguuuguuuug

SEQ ID NO: 155359 - RNA, 19 nt, Homo sapiens
ggagccugaccuaaccuuu

SEQ ID NO: 155360 - RNA, 19 nt, Homo sapiens
ccccggagcugccaacauu

SEQ ID NO: 155361 - RNA, 19 nt, Homo sapiens
ccugaaaucggaagagcuu

SEQ ID NO: 155362 - RNA, 19 nt, Homo sapiens
ccaaauggauugcuucuga

SEQ ID NO: 155363 - RNA, 19 nt, Homo sapiens
gaucuccucuuuaauguug

SEQ ID NO: 155364 - RNA, 19 nt, Homo sapiens
acaagaacaucaucaagaa

SEQ ID NO: 155365 - RNA, 19 nt, Homo sapiens
gaacgauggugaauucaag

SEQ ID NO: 155366 - RNA, 19 nt, Homo sapiens
gccaaacgcugccaguauu

SEQ ID NO: 155367 - RNA, 19 nt, Homo sapiens
gcacgagccgcaacgaaua

SEQ ID NO: 155368 - RNA, 19 nt, Homo sapiens
caagcacgcuguuccaguu

SEQ ID NO: 155369 - RNA, 19 nt, Homo sapiens
gcacagacaccaaauggau

SEQ ID NO: 155370 - RNA, 19 nt, Homo sapiens
gacaagaacaucaucaaga

SEQ ID NO: 155371 - RNA, 19 nt, Homo sapiens
gaauaaugcaguaaaggaa

SEQ ID NO: 155372 - RNA, 19 nt, Homo sapiens
ggaauaaugcaguaaagga

SEQ ID NO: 155373 - RNA, 19 nt, Homo sapiens
ucagaaacaugagcauuug

SEQ ID NO: 155374 - RNA, 19 nt, Homo sapiens
gaccaagucuccaucucuu

SEQ ID NO: 155375 - RNA, 19 nt, Homo sapiens
gaugacgucuggccacaau

SEQ ID NO: 155376 - RNA, 19 nt, Homo sapiens
ucagguuugugaccaauaa

SEQ ID NO: 155377 - RNA, 19 nt, Homo sapiens
ggaaaagccuguuuacaca

SEQ ID NO: 155378 - RNA, 19 nt, Homo sapiens
ugacgucuggccacaauua

SEQ ID NO: 155379 - RNA, 19 nt, Homo sapiens
cagagcugcuucuccagua

SEQ ID NO: 155380 - RNA, 19 nt, Homo sapiens
ggacugugaucagguuugu

SEQ ID NO: 155381 - RNA, 19 nt, Homo sapiens
gcgauacuauuaugacaag

SEQ ID NO: 155382 - RNA, 19 nt, Homo sapiens
ccucaaagcagaagaagug

SEQ ID NO: 155383 - RNA, 19 nt, Homo sapiens
caguacugcuuucuucaaa

SEQ ID NO: 155384 - RNA, 19 nt, Homo sapiens
gagcagccuuaguccaguu

SEQ ID NO: 155385 - RNA, 19 nt, Homo sapiens
caacgaauacauccacuca

SEQ ID NO: 155386 - RNA, 19 nt, Homo sapiens
agaaggacauugugaaacu

SEQ ID NO: 155387 - RNA, 19 nt, Homo sapiens
guacugcuuucuucaaacu

SEQ ID NO: 155388 - RNA, 19 nt, Homo sapiens
ugagaaggacauugugaaa

SEQ ID NO: 155389 - RNA, 19 nt, Homo sapiens
guacucguccuucaccauu

SEQ ID NO: 155390 - RNA, 19 nt, Homo sapiens
gggcagaaguuuguguaca

SEQ ID NO: 155391 - RNA, 19 nt, Homo sapiens
gagcccugcgauacuauua

SEQ ID NO: 155392 - RNA, 19 nt, Homo sapiens
cagaagaaguggccaagcu

SEQ ID NO: 155393 - RNA, 19 nt, Homo sapiens
gaucagaaacaugagcauu

SEQ ID NO: 155394 - RNA, 19 nt, Homo sapiens
ucaggacugugaucagguu

SEQ ID NO: 155395 - RNA, 19 nt, Homo sapiens
gcccugcgauacuauuaug

SEQ ID NO: 155396 - RNA, 19 nt, Homo sapiens
gaggagcgagagaaagaaa

SEQ ID NO: 155397 - RNA, 19 nt, Homo sapiens
gaucagguuugugaccaau

SEQ ID NO: 155398 - RNA, 19 nt, Homo sapiens
ggcaguuccuguugcaguu

SEQ ID NO: 155399 - RNA, 19 nt, Homo sapiens
caaucacgcuguggcaguu

SEQ ID NO: 155400 - RNA, 19 nt, Homo sapiens
cacaauuaaggacucauua

SEQ ID NO: 155401 - RNA, 19 nt, Homo sapiens
gaaacaugagcauuugauc

SEQ ID NO: 155402 - RNA, 19 nt, Homo sapiens
gaaggacauugugaaacuc

SEQ ID NO: 155403 - RNA, 19 nt, Homo sapiens
gacaccaaauggauugcuu

SEQ ID NO: 155404 - RNA, 19 nt, Homo sapiens
ccaaacgcugccaguauuu

SEQ ID NO: 155405 - RNA, 19 nt, Homo sapiens
ccacaauuaaggacucauu

SEQ ID NO: 155406 - RNA, 19 nt, Homo sapiens
gaauucaagcuccucaaag

SEQ ID NO: 155407 - RNA, 19 nt, Homo sapiens
ugaauucaagcuccucaaa

SEQ ID NO: 155408 - RNA, 19 nt, Homo sapiens
ccaacuuccugcucucaca

SEQ ID NO: 155409 - RNA, 19 nt, Homo sapiens
gcacaccgccuggggaaua

SEQ ID NO: 155410 - RNA, 19 nt, Homo sapiens
ccucuuuaauguugccaaa

SEQ ID NO: 155411 - RNA, 19 nt, Homo sapiens
ucccggagauccugaagau

SEQ ID NO: 155412 - RNA, 19 nt, Homo sapiens
aagaggagcgagagaaaga

SEQ ID NO: 155413 - RNA, 19 nt, Homo sapiens
aaaucaggaucucauuaca

SEQ ID NO: 155414 - RNA, 19 nt, Homo sapiens
acucguccuucaccauuaa

SEQ ID NO: 155415 - RNA, 19 nt, Homo sapiens
cucgaacgauggugaauuc

SEQ ID NO: 155416 - RNA, 19 nt, Homo sapiens
ggugaucgggcagaaguuu

SEQ ID NO: 155417 - RNA, 19 nt, Homo sapiens
gugagaaggacauugugaa

SEQ ID NO: 155418 - RNA, 19 nt, Homo sapiens
caaaggcuuggaaaucuca

SEQ ID NO: 155419 - RNA, 19 nt, Homo sapiens
ucuucaaacucucagaaau

SEQ ID NO: 155420 - RNA, 19 nt, Homo sapiens
ggccuguacucguccuuca

SEQ ID NO: 155421 - RNA, 19 nt, Homo sapiens
cggagauccugaagaugga

SEQ ID NO: 155422 - RNA, 19 nt, Homo sapiens
uacucguccuucaccauua

SEQ ID NO: 155423 - RNA, 19 nt, Homo sapiens
aaacaugagcauuugaucu

SEQ ID NO: 155424 - RNA, 19 nt, Homo sapiens
acagacaccaaauggauug

SEQ ID NO: 155425 - RNA, 19 nt, Homo sapiens
ccaguacugcuuucuucaa

SEQ ID NO: 155426 - RNA, 19 nt, Homo sapiens
cgaacgauggugaauucaa

SEQ ID NO: 155427 - RNA, 19 nt, Homo sapiens
gagaaggacauugugaaac

SEQ ID NO: 155428 - RNA, 19 nt, Homo sapiens
cgggcuaguuuaccugugu

SEQ ID NO: 155429 - RNA, 19 nt, Homo sapiens
uaaggacucauuaacugau

SEQ ID NO: 155430 - RNA, 19 nt, Homo sapiens
gacgucuggccacaauuaa

SEQ ID NO: 155431 - RNA, 19 nt, Homo sapiens
cuccaguacugcuuucuuc

SEQ ID NO: 155432 - RNA, 19 nt, Homo sapiens
agaaggugaucgggcagaa

SEQ ID NO: 155433 - RNA, 19 nt, Homo sapiens
ugacaagaacaucaucaag

SEQ ID NO: 155434 - RNA, 19 nt, Homo sapiens
guuuaccugugucgugaga

SEQ ID NO: 155435 - RNA, 19 nt, Homo sapiens
cuucaaacucucagaaauc

SEQ ID NO: 155436 - RNA, 19 nt, Homo sapiens
caggaucucauuacaagag

SEQ ID NO: 155437 - RNA, 19 nt, Homo sapiens
gagccgcaacgaauacauc

SEQ ID NO: 155438 - RNA, 19 nt, Homo sapiens
caagaacaucaucaagaag

SEQ ID NO: 155439 - RNA, 19 nt, Homo sapiens
gcuccucaaagcagaagaa

SEQ ID NO: 155440 - RNA, 19 nt, Homo sapiens
aaucaggaucucauuacaa

SEQ ID NO: 155441 - RNA, 19 nt, Homo sapiens
aucaggaucucauuacaag

SEQ ID NO: 155442 - RNA, 19 nt, Homo sapiens
auaaugcaguaaaggaagu

SEQ ID NO: 155443 - RNA, 19 nt, Homo sapiens
cacagacaccaaauggauu

SEQ ID NO: 155444 - RNA, 19 nt, Homo sapiens
aaacgcugccaguauuuca

SEQ ID NO: 155445 - RNA, 19 nt, Homo sapiens
acugugaucagguuuguga

SEQ ID NO: 155446 - RNA, 19 nt, Homo sapiens
cagaaacaugagcauuuga

SEQ ID NO: 155447 - RNA, 19 nt, Homo sapiens
agaaacaugagcauuugau

SEQ ID NO: 155448 - RNA, 19 nt, Homo sapiens
aauucaagcuccucaaagc

SEQ ID NO: 155449 - RNA, 19 nt, Homo sapiens
ccacaugccagugccaauc

SEQ ID NO: 155450 - RNA, 19 nt, Homo sapiens
ucaccgcacagacaccaaa

SEQ ID NO: 155451 - RNA, 19 nt, Homo sapiens
caaacgcugccaguauuuc

SEQ ID NO: 155452 - RNA, 19 nt, Homo sapiens
ugccaaacgcugccaguau

SEQ ID NO: 155453 - RNA, 19 nt, Homo sapiens
gaacauggauccaaugaca

SEQ ID NO: 155454 - RNA, 19 nt, Homo sapiens
gaacaagccuaacaugaau

SEQ ID NO: 155455 - RNA, 19 nt, Homo sapiens
aaacagacauucaacauga

SEQ ID NO: 155456 - RNA, 19 nt, Homo sapiens
gaauaggacucaaguugga

SEQ ID NO: 155457 - RNA, 19 nt, Homo sapiens
caacaugauugcauuugaa

SEQ ID NO: 155458 - RNA, 19 nt, Homo sapiens
gaacgaagaaacagacauu

SEQ ID NO: 155459 - RNA, 19 nt, Homo sapiens
gagaauggagggaaagaua

SEQ ID NO: 155460 - RNA, 19 nt, Homo sapiens
ccaaagauguggagaaugg

SEQ ID NO: 155461 - RNA, 19 nt, Homo sapiens
ggacucaaguuggacuaua

SEQ ID NO: 155462 - RNA, 19 nt, Homo sapiens
cuacaaugcugauaauaga

SEQ ID NO: 155463 - RNA, 19 nt, Homo sapiens
gcaggaaccucccagaaca

SEQ ID NO: 155464 - RNA, 19 nt, Homo sapiens
cuacauacacucuggcuua

SEQ ID NO: 155465 - RNA, 19 nt, Homo sapiens
gaugggcaguuuaagcuuu

SEQ ID NO: 155466 - RNA, 19 nt, Homo sapiens
gcaaggugcuaacacacuu

SEQ ID NO: 155467 - RNA, 19 nt, Homo sapiens
caccaucugucaucaaauu

SEQ ID NO: 155468 - RNA, 19 nt, Homo sapiens
cauacacucuggcuuauau

SEQ ID NO: 155469 - RNA, 19 nt, Homo sapiens
cauuuacucucaacucuuu

SEQ ID NO: 155470 - RNA, 19 nt, Homo sapiens
caaguuggacuauauguau

SEQ ID NO: 155471 - RNA, 19 nt, Homo sapiens
gaagugagcaauugauagu

SEQ ID NO: 155472 - RNA, 19 nt, Homo sapiens
gaaacagacauucaacaug

SEQ ID NO: 155473 - RNA, 19 nt, Homo sapiens
gauucagucuugcuagaaa

SEQ ID NO: 155474 - RNA, 19 nt, Homo sapiens
acacagacauugauucagu

SEQ ID NO: 155475 - RNA, 19 nt, Homo sapiens
aagaaacuauccaagcuuu

SEQ ID NO: 155476 - RNA, 19 nt, Homo sapiens
ccgagaaacuggcagagaa

SEQ ID NO: 155477 - RNA, 19 nt, Homo sapiens
gagggugacugugaaaguu

SEQ ID NO: 155478 - RNA, 19 nt, Homo sapiens
ccucagauacuauuaugua

SEQ ID NO: 155479 - RNA, 19 nt, Homo sapiens
ccaaguauuucuccaucuu

SEQ ID NO: 155480 - RNA, 19 nt, Homo sapiens
gaauggagggaaagauaaa

SEQ ID NO: 155481 - RNA, 19 nt, Homo sapiens
gggugacugugaaaguuua

SEQ ID NO: 155482 - RNA, 19 nt, Homo sapiens
gcagaagccucagaacaag

SEQ ID NO: 155483 - RNA, 19 nt, Homo sapiens
acaagcacaugaucuguug

SEQ ID NO: 155484 - RNA, 19 nt, Homo sapiens
gcuuugugcugaagaaguu

SEQ ID NO: 155485 - RNA, 19 nt, Homo sapiens
gaagaaacuauccaagcuu

SEQ ID NO: 155486 - RNA, 19 nt, Homo sapiens
gauaaagacugagaaucca

SEQ ID NO: 155487 - RNA, 19 nt, Homo sapiens
gaacuccuccaauguaaag

SEQ ID NO: 155488 - RNA, 19 nt, Homo sapiens
cagcagcaguuccaaagau

SEQ ID NO: 155489 - RNA, 19 nt, Homo sapiens
ggauugagggugacuguga

SEQ ID NO: 155490 - RNA, 19 nt, Homo sapiens
agaacaagccuaacaugaa

SEQ ID NO: 155491 - RNA, 19 nt, Homo sapiens
cggcgucgcucauugcuau

SEQ ID NO: 155492 - RNA, 19 nt, Homo sapiens
ccuaugcacuuguggaaug

SEQ ID NO: 155493 - RNA, 19 nt, Homo sapiens
uagccgcaaugacuacaua

SEQ ID NO: 155494 - RNA, 19 nt, Homo sapiens
gacucaaguuggacuauau

SEQ ID NO: 155495 - RNA, 19 nt, Homo sapiens
cgaagaaacagacauucaa

SEQ ID NO: 155496 - RNA, 19 nt, Homo sapiens
uaacacacuuuuccaguuu

SEQ ID NO: 155497 - RNA, 19 nt, Homo sapiens
agccuaacaugaauuauga

SEQ ID NO: 155498 - RNA, 19 nt, Homo sapiens
cacaccaucugucaucaaa

SEQ ID NO: 155499 - RNA, 19 nt, Homo sapiens
cuaaugaugggcaguuuaa

SEQ ID NO: 155500 - RNA, 19 nt, Homo sapiens
guucuacaaugcugauaau

SEQ ID NO: 155501 - RNA, 19 nt, Homo sapiens
gauugagggugacugugaa

SEQ ID NO: 155502 - RNA, 19 nt, Homo sapiens
cuacagaagacauaaccua

SEQ ID NO: 155503 - RNA, 19 nt, Homo sapiens
cgacacagacauugauuca

SEQ ID NO: 155504 - RNA, 19 nt, Homo sapiens
ggucagaaguuuguguaca

SEQ ID NO: 155505 - RNA, 19 nt, Homo sapiens
gcaagaacaagccuaacau

SEQ ID NO: 155506 - RNA, 19 nt, Homo sapiens
gaacaagcacaugaucugu

SEQ ID NO: 155507 - RNA, 19 nt, Homo sapiens
gaacuuccagagaauuugu

SEQ ID NO: 155508 - RNA, 19 nt, Homo sapiens
gcccucagauacuauuaug

SEQ ID NO: 155509 - RNA, 19 nt, Homo sapiens
gccgagcccucagauacua

SEQ ID NO: 155510 - RNA, 19 nt, Homo sapiens
acaagccuaacaugaauua

SEQ ID NO: 155511 - RNA, 19 nt, Homo sapiens
gcaauugauaguucuacaa

SEQ ID NO: 155512 - RNA, 19 nt, Homo sapiens
cauuugaagugagcaauug

SEQ ID NO: 155513 - RNA, 19 nt, Homo sapiens
gaaccgaggaacgaagaaa

SEQ ID NO: 155514 - RNA, 19 nt, Homo sapiens
ugccuuaauuggagucuaa

SEQ ID NO: 155515 - RNA, 19 nt, Homo sapiens
gaaccucccagaacaccuu

SEQ ID NO: 155516 - RNA, 19 nt, Homo sapiens
caagaccucuagccgcaau

SEQ ID NO: 155517 - RNA, 19 nt, Homo sapiens
gaagaaacagacauucaac

SEQ ID NO: 155518 - RNA, 19 nt, Homo sapiens
gagcccaucucucccuaca

SEQ ID NO: 155519 - RNA, 19 nt, Homo sapiens
agaagaaacuauccaagcu

SEQ ID NO: 155520 - RNA, 19 nt, Homo sapiens
agacaucgacacagacauu

SEQ ID NO: 155521 - RNA, 19 nt, Homo sapiens
caagaacaagccuaacaug

SEQ ID NO: 155522 - RNA, 19 nt, Homo sapiens
gagaaccgaggaacgaaga

SEQ ID NO: 155523 - RNA, 19 nt, Homo sapiens
cuaaagaccaggauucagu

SEQ ID NO: 155524 - RNA, 19 nt, Homo sapiens
caucugucaucaaauuugu

SEQ ID NO: 155525 - RNA, 19 nt, Homo sapiens
gcauuugaagugagcaauu

SEQ ID NO: 155526 - RNA, 19 nt, Homo sapiens
ucacagacacccaucauac

SEQ ID NO: 155527 - RNA, 19 nt, Homo sapiens
gaagucagcagcaguucca

SEQ ID NO: 155528 - RNA, 19 nt, Homo sapiens
ucaaguuggacuauaugua

SEQ ID NO: 155529 - RNA, 19 nt, Homo sapiens
uguuggaccucuaaugaug

SEQ ID NO: 155530 - RNA, 19 nt, Homo sapiens
cauucaacaugauugcauu

SEQ ID NO: 155531 - RNA, 19 nt, Homo sapiens
cgagaaacuggcagagaaa

SEQ ID NO: 155532 - RNA, 19 nt, Homo sapiens
ccucagaacaagcacauga

SEQ ID NO: 155533 - RNA, 19 nt, Homo sapiens
uugaacuccuccaauguaa

SEQ ID NO: 155534 - RNA, 19 nt, Homo sapiens
ucuuugaacuccuccaaug

SEQ ID NO: 155535 - RNA, 19 nt, Homo sapiens
caaugcugauaauagacua

SEQ ID NO: 155536 - RNA, 19 nt, Homo sapiens
cuaacguaaugacugcuuu

SEQ ID NO: 155537 - RNA, 19 nt, Homo sapiens
aagaacaagccuaacauga

SEQ ID NO: 155538 - RNA, 19 nt, Homo sapiens
agaauggagggaaagauaa

SEQ ID NO: 155539 - RNA, 19 nt, Homo sapiens
gcucauugcuauggacagu

SEQ ID NO: 155540 - RNA, 19 nt, Homo sapiens
gcacuuguggaaugagaga

SEQ ID NO: 155541 - RNA, 19 nt, Homo sapiens
ugaauggucagaaguuugu

SEQ ID NO: 155542 - RNA, 19 nt, Homo sapiens
ggagaggcgcaucguguuc

SEQ ID NO: 155543 - RNA, 19 nt, Homo sapiens
caugauugcauuugaagug

SEQ ID NO: 155544 - RNA, 19 nt, Homo sapiens
gcacccacccuugugauca

SEQ ID NO: 155545 - RNA, 19 nt, Homo sapiens
ugcagaagccucagaacaa

SEQ ID NO: 155546 - RNA, 19 nt, Homo sapiens
agugagcaauugauaguuc

SEQ ID NO: 155547 - RNA, 19 nt, Homo sapiens
acccagacaucgacacaga

SEQ ID NO: 155548 - RNA, 19 nt, Homo sapiens
guauuucuccaucuucaga

SEQ ID NO: 155549 - RNA, 19 nt, Homo sapiens
gcugccaccauuucaauug

SEQ ID NO: 155550 - RNA, 19 nt, Homo sapiens
gcucuccaguauccacuuc

SEQ ID NO: 155551 - RNA, 19 nt, Homo sapiens
ggauucagucuugcuagaa

SEQ ID NO: 155552 - RNA, 19 nt, Homo sapiens
ucuguuggaccucuaauga

SEQ ID NO: 155553 - RNA, 19 nt, Homo sapiens
gaacauggauccaaugaca

SEQ ID NO: 155554 - RNA, 19 nt, Homo sapiens
ucacacaccucauuauuaa

SEQ ID NO: 155555 - RNA, 19 nt, Homo sapiens
gaacaagccuaacaugaau

SEQ ID NO: 155556 - RNA, 19 nt, Homo sapiens
ccaaagaacucauccaugu

SEQ ID NO: 155557 - RNA, 19 nt, Homo sapiens
uuagaaagguuauguguga

SEQ ID NO: 155558 - RNA, 19 nt, Homo sapiens
gugauaaucucaaguuaga

SEQ ID NO: 155559 - RNA, 19 nt, Homo sapiens
gagaauggagggaaagaua

SEQ ID NO: 155560 - RNA, 19 nt, Homo sapiens
ccaaagauguggagaaugg

SEQ ID NO: 155561 - RNA, 19 nt, Homo sapiens
gcaccagaaucucagaauu

SEQ ID NO: 155562 - RNA, 19 nt, Homo sapiens
gcaggaaccucccagaaca

SEQ ID NO: 155563 - RNA, 19 nt, Homo sapiens
caaacaugcuggugucuug

SEQ ID NO: 155564 - RNA, 19 nt, Homo sapiens
guagcuugcucgcucuuua

SEQ ID NO: 155565 - RNA, 19 nt, Homo sapiens
guaacaaguugguacaguu

SEQ ID NO: 155566 - RNA, 19 nt, Homo sapiens
cuacauacacucuggcuua

SEQ ID NO: 155567 - RNA, 19 nt, Homo sapiens
caccauugcuuucauuuau

SEQ ID NO: 155568 - RNA, 19 nt, Homo sapiens
gaugggcaguuuaagcuuu

SEQ ID NO: 155569 - RNA, 19 nt, Homo sapiens
uuaacuugcucaucucaua

SEQ ID NO: 155570 - RNA, 19 nt, Homo sapiens
caccaucugucaucaaauu

SEQ ID NO: 155571 - RNA, 19 nt, Homo sapiens
cauacacucuggcuuauau

SEQ ID NO: 155572 - RNA, 19 nt, Homo sapiens
cauuuacucucaacucuuu

SEQ ID NO: 155573 - RNA, 19 nt, Homo sapiens
aaagaacucauccauguaa

SEQ ID NO: 155574 - RNA, 19 nt, Homo sapiens
gauucagucuugcuagaaa

SEQ ID NO: 155575 - RNA, 19 nt, Homo sapiens
acacagacauugauucagu

SEQ ID NO: 155576 - RNA, 19 nt, Homo sapiens
aagaaacuauccaagcuuu

SEQ ID NO: 155577 - RNA, 19 nt, Homo sapiens
ccgagaaacuggcagagaa

SEQ ID NO: 155578 - RNA, 19 nt, Homo sapiens
auucauugcucuacaagua

SEQ ID NO: 155579 - RNA, 19 nt, Homo sapiens
gagggugacugugaaaguu

SEQ ID NO: 155580 - RNA, 19 nt, Homo sapiens
ccucagauacuauuaugua

SEQ ID NO: 155581 - RNA, 19 nt, Homo sapiens
ccaaguauuucuccaucuu

SEQ ID NO: 155582 - RNA, 19 nt, Homo sapiens
gaauggagggaaagauaaa

SEQ ID NO: 155583 - RNA, 19 nt, Homo sapiens
gcagaagccucagaacaag

SEQ ID NO: 155584 - RNA, 19 nt, Homo sapiens
gggugacugugaaaguuua

SEQ ID NO: 155585 - RNA, 19 nt, Homo sapiens
accagaaucucagaauuua

SEQ ID NO: 155586 - RNA, 19 nt, Homo sapiens
caaguuugcuuucuguuac

SEQ ID NO: 155587 - RNA, 19 nt, Homo sapiens
acaagcacaugaucuguug

SEQ ID NO: 155588 - RNA, 19 nt, Homo sapiens
caaagaacucauccaugua

SEQ ID NO: 155589 - RNA, 19 nt, Homo sapiens
caccagaaucucagaauuu

SEQ ID NO: 155590 - RNA, 19 nt, Homo sapiens
gaaaguacacacacucucu

SEQ ID NO: 155591 - RNA, 19 nt, Homo sapiens
ucaaguuugcuuucuguua

SEQ ID NO: 155592 - RNA, 19 nt, Homo sapiens
gaagaaacuauccaagcuu

SEQ ID NO: 155593 - RNA, 19 nt, Homo sapiens
gauaaagacugagaaucca

SEQ ID NO: 155594 - RNA, 19 nt, Homo sapiens
gaacuccuccaauguaaag

SEQ ID NO: 155595 - RNA, 19 nt, Homo sapiens
cagcagcaguuccaaagau

SEQ ID NO: 155596 - RNA, 19 nt, Homo sapiens
ggauugagggugacuguga

SEQ ID NO: 155597 - RNA, 19 nt, Homo sapiens
agaacaagccuaacaugaa

SEQ ID NO: 155598 - RNA, 19 nt, Homo sapiens
cggcgucgcucauugcuau

SEQ ID NO: 155599 - RNA, 19 nt, Homo sapiens
cagugauaaucucaaguua

SEQ ID NO: 155600 - RNA, 19 nt, Homo sapiens
uagccgcaaugacuacaua

SEQ ID NO: 155601 - RNA, 19 nt, Homo sapiens
acucguuggugucuuauaa

SEQ ID NO: 155602 - RNA, 19 nt, Homo sapiens
agccuaacaugaauuauga

SEQ ID NO: 155603 - RNA, 19 nt, Homo sapiens
uaaagaaaguacacacacu

SEQ ID NO: 155604 - RNA, 19 nt, Homo sapiens
cacaccaucugucaucaaa

SEQ ID NO: 155605 - RNA, 19 nt, Homo sapiens
cuaaugaugggcaguuuaa

SEQ ID NO: 155606 - RNA, 19 nt, Homo sapiens
ucuauuuccuccuaaagaa

SEQ ID NO: 155607 - RNA, 19 nt, Homo sapiens
gauugagggugacugugaa

SEQ ID NO: 155608 - RNA, 19 nt, Homo sapiens
aaacagugauaaucucaag

SEQ ID NO: 155609 - RNA, 19 nt, Homo sapiens
cgacacagacauugauuca

SEQ ID NO: 155610 - RNA, 19 nt, Homo sapiens
ggucagaaguuuguguaca

SEQ ID NO: 155611 - RNA, 19 nt, Homo sapiens
gcaagaacaagccuaacau

SEQ ID NO: 155612 - RNA, 19 nt, Homo sapiens
gaacaagcacaugaucugu

SEQ ID NO: 155613 - RNA, 19 nt, Homo sapiens
gaacuuccagagaauuugu

SEQ ID NO: 155614 - RNA, 19 nt, Homo sapiens
gcccucagauacuauuaug

SEQ ID NO: 155615 - RNA, 19 nt, Homo sapiens
gccgagcccucagauacua

SEQ ID NO: 155616 - RNA, 19 nt, Homo sapiens
acaagccuaacaugaauua

SEQ ID NO: 155617 - RNA, 19 nt, Homo sapiens
gaauuuaccaccaaagaac

SEQ ID NO: 155618 - RNA, 19 nt, Homo sapiens
guacaguuacuuuagcuau

SEQ ID NO: 155619 - RNA, 19 nt, Homo sapiens
gcucaucucauagaacauu

SEQ ID NO: 155620 - RNA, 19 nt, Homo sapiens
uuacuuagguuugucuuag

SEQ ID NO: 155621 - RNA, 19 nt, Homo sapiens
gaaccucccagaacaccuu

SEQ ID NO: 155622 - RNA, 19 nt, Homo sapiens
caagaccucuagccgcaau

SEQ ID NO: 155623 - RNA, 19 nt, Homo sapiens
aaaacucguuggugucuua

SEQ ID NO: 155624 - RNA, 19 nt, Homo sapiens
ucauugcucuacaaguaaa

SEQ ID NO: 155625 - RNA, 19 nt, Homo sapiens
gagcccaucucucccuaca

SEQ ID NO: 155626 - RNA, 19 nt, Homo sapiens
agaagaaacuauccaagcu

SEQ ID NO: 155627 - RNA, 19 nt, Homo sapiens
acucauccauguaaccaaa

SEQ ID NO: 155628 - RNA, 19 nt, Homo sapiens
ucucagaauuuaccaccaa

SEQ ID NO: 155629 - RNA, 19 nt, Homo sapiens
caagaacaagccuaacaug

SEQ ID NO: 155630 - RNA, 19 nt, Homo sapiens
ucaccauugcuuucauuua

SEQ ID NO: 155631 - RNA, 19 nt, Homo sapiens
agacaucgacacagacauu

SEQ ID NO: 155632 - RNA, 19 nt, Homo sapiens
cuaaagaccaggauucagu

SEQ ID NO: 155633 - RNA, 19 nt, Homo sapiens
caucugucaucaaauuugu

SEQ ID NO: 155634 - RNA, 19 nt, Homo sapiens
gugucuugguuacccauua

SEQ ID NO: 155635 - RNA, 19 nt, Homo sapiens
gaagucagcagcaguucca

SEQ ID NO: 155636 - RNA, 19 nt, Homo sapiens
ccucagaacaagcacauga

SEQ ID NO: 155637 - RNA, 19 nt, Homo sapiens
cgagaaacuggcagagaaa

SEQ ID NO: 155638 - RNA, 19 nt, Homo sapiens
uugaacuccuccaauguaa

SEQ ID NO: 155639 - RNA, 19 nt, Homo sapiens
ucuuugaacuccuccaaug

SEQ ID NO: 155640 - RNA, 19 nt, Homo sapiens
uguuggaccucuaaugaug

SEQ ID NO: 155641 - RNA, 19 nt, Homo sapiens
cagaauuuaccaccaaaga

SEQ ID NO: 155642 - RNA, 19 nt, Homo sapiens
aagaacaagccuaacauga

SEQ ID NO: 155643 - RNA, 19 nt, Homo sapiens
cuaacguaaugacugcuuu

SEQ ID NO: 155644 - RNA, 19 nt, Homo sapiens
agaauggagggaaagauaa

SEQ ID NO: 155645 - RNA, 19 nt, Homo sapiens
gaacucauccauguaacca

SEQ ID NO: 155646 - RNA, 19 nt, Homo sapiens
gcucauugcuauggacagu

SEQ ID NO: 155647 - RNA, 19 nt, Homo sapiens
ugaauggucagaaguuugu

SEQ ID NO: 155648 - RNA, 19 nt, Homo sapiens
cuggugugauguugaguaa

SEQ ID NO: 155649 - RNA, 19 nt, Homo sapiens
guccugagaaccauaagaa

SEQ ID NO: 155650 - RNA, 19 nt, Homo sapiens
ggagaggcgcaucguguuc

SEQ ID NO: 155651 - RNA, 19 nt, Homo sapiens
ugacuggugugauguugag

SEQ ID NO: 155652 - RNA, 19 nt, Homo sapiens
acagugauaaucucaaguu

SEQ ID NO: 155653 - RNA, 19 nt, Homo sapiens
gcccaaggcuccaggugua

SEQ ID NO: 155654 - RNA, 19 nt, Homo sapiens
gaaacugcccuauggcuau

SEQ ID NO: 155655 - RNA, 19 nt, Homo sapiens
uaaagcagcagcaaaguuc

SEQ ID NO: 155656 - RNA, 19 nt, Homo sapiens
agccaaagcugcugccaaa

SEQ ID NO: 155657 - RNA, 19 nt, Homo sapiens
cccaggaguugguggcuua

SEQ ID NO: 155658 - RNA, 19 nt, Homo sapiens
uaaagcagccaaauaugga

SEQ ID NO: 155659 - RNA, 19 nt, Homo sapiens
caagcugccugguggcuau

SEQ ID NO: 155660 - RNA, 19 nt, Homo sapiens
uuggaggcauuccuacuua

SEQ ID NO: 155661 - RNA, 19 nt, Homo sapiens
ggaguuggaggcauuccua

SEQ ID NO: 155662 - RNA, 19 nt, Homo sapiens
ccgcuaaagcagcuaaaua

SEQ ID NO: 155663 - RNA, 19 nt, Homo sapiens
ggccauuccugguggaguu

SEQ ID NO: 155664 - RNA, 19 nt, Homo sapiens
ccgcuaaagcagccaaaua

SEQ ID NO: 155665 - RNA, 19 nt, Homo sapiens
ccgcuaaggcagccaagua

SEQ ID NO: 155666 - RNA, 19 nt, Homo sapiens
cccaggaguuggacccuuu

SEQ ID NO: 155667 - RNA, 19 nt, Homo sapiens
uggcaucccuggacuugga

SEQ ID NO: 155668 - RNA, 19 nt, Homo sapiens
cgccaaggcugccaaguac

SEQ ID NO: 155669 - RNA, 19 nt, Homo sapiens
gcuaaagcagccaaauaug

SEQ ID NO: 155670 - RNA, 19 nt, Homo sapiens
ccgccaaggcugccaagua

SEQ ID NO: 155671 - RNA, 19 nt, Homo sapiens
cuaaagcagccaaauaugg

SEQ ID NO: 155672 - RNA, 19 nt, Homo sapiens
cagcagcagcggcagcuaa

SEQ ID NO: 155673 - RNA, 19 nt, Homo sapiens
gcuauggacugcccuacac

SEQ ID NO: 155674 - RNA, 19 nt, Homo sapiens
guugguggcuuaggagugu

SEQ ID NO: 155675 - RNA, 19 nt, Homo sapiens
cauuggcccugguggaguu

SEQ ID NO: 155676 - RNA, 19 nt, Homo sapiens
cuaaagcagcagcaaaguu

SEQ ID NO: 155677 - RNA, 19 nt, Homo sapiens
gagugaagccugggaaagu

SEQ ID NO: 155678 - RNA, 19 nt, Homo sapiens
agaccuggcuucggauugu

SEQ ID NO: 155679 - RNA, 19 nt, Homo sapiens
cgcuaaagcagccaaauau

SEQ ID NO: 155680 - RNA, 19 nt, Homo sapiens
agucggaguuggaggcauu

SEQ ID NO: 155681 - RNA, 19 nt, Homo sapiens
caaggcugguuacccaaca

SEQ ID NO: 155682 - RNA, 19 nt, Homo sapiens
gcuuguggccggaagagaa

SEQ ID NO: 155683 - RNA, 19 nt, Homo sapiens
aaacugcccuauggcuaug

SEQ ID NO: 155684 - RNA, 19 nt, Homo sapiens
ucgcaggugucccuagugu

SEQ ID NO: 155685 - RNA, 19 nt, Homo sapiens
cagcuaaagcagcagcaaa

SEQ ID NO: 155686 - RNA, 19 nt, Homo sapiens
guuggaggcauuccuacuu

SEQ ID NO: 155687 - RNA, 19 nt, Homo sapiens
caagaccuggcuucggauu

SEQ ID NO: 155688 - RNA, 19 nt, Homo sapiens
ggagugaagccugggaaag

SEQ ID NO: 155689 - RNA, 19 nt, Homo sapiens
gcuaaggcagccaaguaug

SEQ ID NO: 155690 - RNA, 19 nt, Homo sapiens
gcaaaggcagccaaauacg

SEQ ID NO: 155691 - RNA, 19 nt, Homo sapiens
ccaaagcugcugccaaagc

SEQ ID NO: 155692 - RNA, 19 nt, Homo sapiens
gcuggcaucccuggacuug

SEQ ID NO: 155693 - RNA, 19 nt, Homo sapiens
gguggugucccaggaguug

SEQ ID NO: 155694 - RNA, 19 nt, Homo sapiens
uaaggcagccaaguaugga

SEQ ID NO: 155695 - RNA, 19 nt, Homo sapiens
cuaaggcagccaaguaugg

SEQ ID NO: 155696 - RNA, 19 nt, Homo sapiens
aggaguugguggcuuagga

SEQ ID NO: 155697 - RNA, 19 nt, Homo sapiens
gaaaucacaucucuacuuu

SEQ ID NO: 155698 - RNA, 19 nt, Homo sapiens
gaaggaagcucccauuaau

SEQ ID NO: 155699 - RNA, 19 nt, Homo sapiens
gggaauguaucucaaauuu

SEQ ID NO: 155700 - RNA, 19 nt, Homo sapiens
ggaauuaucugagcucuau

SEQ ID NO: 155701 - RNA, 19 nt, Homo sapiens
guaacuggguauauucuua

SEQ ID NO: 155702 - RNA, 19 nt, Homo sapiens
gaaaggaccuaccaaagca

SEQ ID NO: 155703 - RNA, 19 nt, Homo sapiens
ggacuggucuguaaacuca

SEQ ID NO: 155704 - RNA, 19 nt, Homo sapiens
gaaaggcgaugugaucuug

SEQ ID NO: 155705 - RNA, 19 nt, Homo sapiens
gcaaguaaaugaauggaau

SEQ ID NO: 155706 - RNA, 19 nt, Homo sapiens
ggcaugagaugauauugua

SEQ ID NO: 155707 - RNA, 19 nt, Homo sapiens
gaaccacgauggcuguuga

SEQ ID NO: 155708 - RNA, 19 nt, Homo sapiens
caugacaacugcaucuaua

SEQ ID NO: 155709 - RNA, 19 nt, Homo sapiens
gagauaagauugaguucug

SEQ ID NO: 155710 - RNA, 19 nt, Homo sapiens
gaugugaagugcucuaaug

SEQ ID NO: 155711 - RNA, 19 nt, Homo sapiens
aagaaggccuuauccauuu

SEQ ID NO: 155712 - RNA, 19 nt, Homo sapiens
gagaugauauuguacuugu

SEQ ID NO: 155713 - RNA, 19 nt, Homo sapiens
ucacacagauggaaacgaa

SEQ ID NO: 155714 - RNA, 19 nt, Homo sapiens
ggaggugguuuguguuuga

SEQ ID NO: 155715 - RNA, 19 nt, Homo sapiens
gaaaggcuccaccaaggua

SEQ ID NO: 155716 - RNA, 19 nt, Homo sapiens
caagaaggccuuauccauu

SEQ ID NO: 155717 - RNA, 19 nt, Homo sapiens
gcagaaauuugucaagaag

SEQ ID NO: 155718 - RNA, 19 nt, Homo sapiens
ccauaaaccugcagagaga

SEQ ID NO: 155719 - RNA, 19 nt, Homo sapiens
caguaaacaccauguauua

SEQ ID NO: 155720 - RNA, 19 nt, Homo sapiens
aaacggagguggcagaaau

SEQ ID NO: 155721 - RNA, 19 nt, Homo sapiens
ggacggaaccgacaucaau

SEQ ID NO: 155722 - RNA, 19 nt, Homo sapiens
uggcacaacucgaaacuuu

SEQ ID NO: 155723 - RNA, 19 nt, Homo sapiens
aaacggagauuccagaaca

SEQ ID NO: 155724 - RNA, 19 nt, Homo sapiens
cgaauaagcuaugcaguuc

SEQ ID NO: 155725 - RNA, 19 nt, Homo sapiens
guacaaaucgaauaagcua

SEQ ID NO: 155726 - RNA, 19 nt, Homo sapiens
agaaguaacuggguauauu

SEQ ID NO: 155727 - RNA, 19 nt, Homo sapiens
gaagagugaauaacugauu

SEQ ID NO: 155728 - RNA, 19 nt, Homo sapiens
gcagaagaaggcuauguaa

SEQ ID NO: 155729 - RNA, 19 nt, Homo sapiens
aaagaacagugaaagcaaa

SEQ ID NO: 155730 - RNA, 19 nt, Homo sapiens
gaccagcucuucugaacga

SEQ ID NO: 155731 - RNA, 19 nt, Homo sapiens
guaagcaagucguaagugu

SEQ ID NO: 155732 - RNA, 19 nt, Homo sapiens
ccacaacgaugacgugaag

SEQ ID NO: 155733 - RNA, 19 nt, Homo sapiens
gcccaaagaucaaguggau

SEQ ID NO: 155734 - RNA, 19 nt, Homo sapiens
ggucauuccagcuucauua

SEQ ID NO: 155735 - RNA, 19 nt, Homo sapiens
cuauggcacugguuguuua

SEQ ID NO: 155736 - RNA, 19 nt, Homo sapiens
cgacaucaaugccgucugu

SEQ ID NO: 155737 - RNA, 19 nt, Homo sapiens
caccuggacuggucuguaa

SEQ ID NO: 155738 - RNA, 19 nt, Homo sapiens
ggagauuccagaacaguuu

SEQ ID NO: 155739 - RNA, 19 nt, Homo sapiens
gaacauuacugaggaacag

SEQ ID NO: 155740 - RNA, 19 nt, Homo sapiens
ggcagaaauuugucaagaa

SEQ ID NO: 155741 - RNA, 19 nt, Homo sapiens
ccaaguagaccaagucaga

SEQ ID NO: 155742 - RNA, 19 nt, Homo sapiens
acacaggcguuuccaaguu

SEQ ID NO: 155743 - RNA, 19 nt, Homo sapiens
uaagcagacucuacuccua

SEQ ID NO: 155744 - RNA, 19 nt, Homo sapiens
gaaguaacuggguauauuc

SEQ ID NO: 155745 - RNA, 19 nt, Homo sapiens
gaagcucccauuaauaaga

SEQ ID NO: 155746 - RNA, 19 nt, Homo sapiens
gcagucaccuguauugcau

SEQ ID NO: 155747 - RNA, 19 nt, Homo sapiens
caaggagccuguauucagu

SEQ ID NO: 155748 - RNA, 19 nt, Homo sapiens
guauaggauucuagcaauu

SEQ ID NO: 155749 - RNA, 19 nt, Homo sapiens
gaagugcucuaaugaagcu

SEQ ID NO: 155750 - RNA, 19 nt, Homo sapiens
gggauucugugacauugaa

SEQ ID NO: 155751 - RNA, 19 nt, Homo sapiens
ggucgagacugccguaaca

SEQ ID NO: 155752 - RNA, 19 nt, Homo sapiens
gaagaaggcuauguaaaau

SEQ ID NO: 155753 - RNA, 19 nt, Homo sapiens
gcgguuccguguucacuuu

SEQ ID NO: 155754 - RNA, 19 nt, Homo sapiens
gaaagacacaagcaucaug

SEQ ID NO: 155755 - RNA, 19 nt, Homo sapiens
gaagacagccaccucaucu

SEQ ID NO: 155756 - RNA, 19 nt, Homo sapiens
caaugucgauuuccucugu

SEQ ID NO: 155757 - RNA, 19 nt, Homo sapiens
caccauguauuauugaaga

SEQ ID NO: 155758 - RNA, 19 nt, Homo sapiens
cacgauggcuguugaggaa

SEQ ID NO: 155759 - RNA, 19 nt, Homo sapiens
gcacauugaauaccaacaa

SEQ ID NO: 155760 - RNA, 19 nt, Homo sapiens
acacagugcacauugaaua

SEQ ID NO: 155761 - RNA, 19 nt, Homo sapiens
gacaccaacaucauaguua

SEQ ID NO: 155762 - RNA, 19 nt, Homo sapiens
gauccacggucaacaaugg

SEQ ID NO: 155763 - RNA, 19 nt, Homo sapiens
uagagugacugaugaagug

SEQ ID NO: 155764 - RNA, 19 nt, Homo sapiens
gcagccaugucaccaaugu

SEQ ID NO: 155765 - RNA, 19 nt, Homo sapiens
ugacaacugcaucuauaua

SEQ ID NO: 155766 - RNA, 19 nt, Homo sapiens
gauagcaacaggacaaguu

SEQ ID NO: 155767 - RNA, 19 nt, Homo sapiens
gcacaguaaacaccaugua

SEQ ID NO: 155768 - RNA, 19 nt, Homo sapiens
caaggcaaguaaaugaaug

SEQ ID NO: 155769 - RNA, 19 nt, Homo sapiens
cuggguauauucuuaguaa

SEQ ID NO: 155770 - RNA, 19 nt, Homo sapiens
gccauaggcucacaugaca

SEQ ID NO: 155771 - RNA, 19 nt, Homo sapiens
cauaguuacuuguggagaa

SEQ ID NO: 155772 - RNA, 19 nt, Homo sapiens
ggagguggcagaaauuugu

SEQ ID NO: 155773 - RNA, 19 nt, Homo sapiens
ggaaaggaccuaccaaagc

SEQ ID NO: 155774 - RNA, 19 nt, Homo sapiens
aggaagcucccauuaauaa

SEQ ID NO: 155775 - RNA, 19 nt, Homo sapiens
gugaagugcucuaaugaag

SEQ ID NO: 155776 - RNA, 19 nt, Homo sapiens
uauauuacuuggcaugaga

SEQ ID NO: 155777 - RNA, 19 nt, Homo sapiens
agaagaaacuccugucaac

SEQ ID NO: 155778 - RNA, 19 nt, Homo sapiens
gagaagaaacuccugucaa

SEQ ID NO: 155779 - RNA, 19 nt, Homo sapiens
gaaacuacaagagacauug

SEQ ID NO: 155780 - RNA, 19 nt, Homo sapiens
agaaggaagcucccauuaa

SEQ ID NO: 155781 - RNA, 19 nt, Homo sapiens
gcauuacgcuggccacaac

SEQ ID NO: 155782 - RNA, 19 nt, Homo sapiens
ccaaagaucaaguggauuc

SEQ ID NO: 155783 - RNA, 19 nt, Homo sapiens
cacaggcguuuccaaguuu

SEQ ID NO: 155784 - RNA, 19 nt, Homo sapiens
gguugcaacguuuacauua

SEQ ID NO: 155785 - RNA, 19 nt, Homo sapiens
ccaaaguuguccucugugu

SEQ ID NO: 155786 - RNA, 19 nt, Homo sapiens
ggacaccaacaucauaguu

SEQ ID NO: 155787 - RNA, 19 nt, Homo sapiens
cauccguggugguguuaua

SEQ ID NO: 155788 - RNA, 19 nt, Homo sapiens
guacuuguauaggauucua

SEQ ID NO: 155789 - RNA, 19 nt, Homo sapiens
ucagaagagugaauaacug

SEQ ID NO: 155790 - RNA, 19 nt, Homo sapiens
gcacuguguuaccaaagau

SEQ ID NO: 155791 - RNA, 19 nt, Homo sapiens
guaacaaccuguacuugcu

SEQ ID NO: 155792 - RNA, 19 nt, Homo sapiens
gaagaguaauaaacagacu

SEQ ID NO: 155793 - RNA, 19 nt, Homo sapiens
aaucagcgguuccguguuc

SEQ ID NO: 155794 - RNA, 19 nt, Homo sapiens
gacaacugcaucuauauau

SEQ ID NO: 155795 - RNA, 19 nt, Homo sapiens
uagaaggaagcucccauua

SEQ ID NO: 155796 - RNA, 19 nt, Homo sapiens
caucugggauucugugaca

SEQ ID NO: 155797 - RNA, 19 nt, Homo sapiens
gaagaggagugcaaggaua

SEQ ID NO: 155798 - RNA, 19 nt, Homo sapiens
guaguaggaucaacucgua

SEQ ID NO: 155799 - RNA, 19 nt, Homo sapiens
gcacgggccuguaguagga

SEQ ID NO: 155800 - RNA, 19 nt, Homo sapiens
ugacaugcauuccuccuuu

SEQ ID NO: 155801 - RNA, 19 nt, Homo sapiens
gaucaacucguaggcuuua

SEQ ID NO: 155802 - RNA, 19 nt, Homo sapiens
uagcuucucugacuugaau

SEQ ID NO: 155803 - RNA, 19 nt, Homo sapiens
ggacaacuacgcagaucuu

SEQ ID NO: 155804 - RNA, 19 nt, Homo sapiens
gaccuguccuauuauccua

SEQ ID NO: 155805 - RNA, 19 nt, Homo sapiens
acaaugacgacuacuauga

SEQ ID NO: 155806 - RNA, 19 nt, Homo sapiens
gcacuaccgcccuguuuca

SEQ ID NO: 155807 - RNA, 19 nt, Homo sapiens
acgcagaucuuucggauac

SEQ ID NO: 155808 - RNA, 19 nt, Homo sapiens
gaucguccucuucuucauu

SEQ ID NO: 155809 - RNA, 19 nt, Homo sapiens
caaugacgacuacuaugaa

SEQ ID NO: 155810 - RNA, 19 nt, Homo sapiens
gggaugcagauauguauga

SEQ ID NO: 155811 - RNA, 19 nt, Homo sapiens
auaccgagcugaccaccuu

SEQ ID NO: 155812 - RNA, 19 nt, Homo sapiens
cuucagagcuaggucuuug

SEQ ID NO: 155813 - RNA, 19 nt, Homo sapiens
cuacaaugacgacuacuau

SEQ ID NO: 155814 - RNA, 19 nt, Homo sapiens
gggcuacaaugacgacuac

SEQ ID NO: 155815 - RNA, 19 nt, Homo sapiens
gcuacaaugacgacuacua

SEQ ID NO: 155816 - RNA, 19 nt, Homo sapiens
ucuuauagcuucucugacu

SEQ ID NO: 155817 - RNA, 19 nt, Homo sapiens
gcaggggcuuuauguguuu

SEQ ID NO: 155818 - RNA, 19 nt, Homo sapiens
caacuacgcagaucuuucg

SEQ ID NO: 155819 - RNA, 19 nt, Homo sapiens
ccaggugcaugaugacgau

SEQ ID NO: 155820 - RNA, 19 nt, Homo sapiens
ugacuugaauucgacuaga

SEQ ID NO: 155821 - RNA, 19 nt, Homo sapiens
ccaaaggccacccugacuu

SEQ ID NO: 155822 - RNA, 19 nt, Homo sapiens
ggaugcagauauguaugau

SEQ ID NO: 155823 - RNA, 19 nt, Homo sapiens
gagcaagggcuacaaugac

SEQ ID NO: 155824 - RNA, 19 nt, Homo sapiens
ggaucaacucguaggcuuu

SEQ ID NO: 155825 - RNA, 19 nt, Homo sapiens
ccucuuauagcuucucuga

SEQ ID NO: 155826 - RNA, 19 nt, Homo sapiens
agagcaagggcuacaauga

SEQ ID NO: 155827 - RNA, 19 nt, Homo sapiens
cacccgccauggacaacua

SEQ ID NO: 155828 - RNA, 19 nt, Homo sapiens
caucaucuuccucuucaug

SEQ ID NO: 155829 - RNA, 19 nt, Homo sapiens
gacuugaauucgacuagag

SEQ ID NO: 155830 - RNA, 19 nt, Homo sapiens
gcuguccgccagucaguga

SEQ ID NO: 155831 - RNA, 19 nt, Homo sapiens
cuucuucauuuaccacuuc

SEQ ID NO: 155832 - RNA, 19 nt, Homo sapiens
ggugcaugaugacgaucuu

SEQ ID NO: 155833 - RNA, 19 nt, Homo sapiens
ucccagaugcugacgcuuu

SEQ ID NO: 155834 - RNA, 19 nt, Homo sapiens
ggcaggggcuuuauguguu

SEQ ID NO: 155835 - RNA, 19 nt, Homo sapiens
cucaucaucuuccucuuca

SEQ ID NO: 155836 - RNA, 19 nt, Homo sapiens
gacaacuacgcagaucuuu

SEQ ID NO: 155837 - RNA, 19 nt, Homo sapiens
cccagaugcugacgcuuuc

SEQ ID NO: 155838 - RNA, 19 nt, Homo sapiens
ugacgacuacuaugaagag

SEQ ID NO: 155839 - RNA, 19 nt, Homo sapiens
aggccacccugacuuuguu

SEQ ID NO: 155840 - RNA, 19 nt, Homo sapiens
ccagagcaagggcuacaau

SEQ ID NO: 155841 - RNA, 19 nt, Homo sapiens
gacaugcauuccuccuuuu

SEQ ID NO: 155842 - RNA, 19 nt, Homo sapiens
ugaagaggagugcaaggau

SEQ ID NO: 155843 - RNA, 19 nt, Homo sapiens
uauagcuucucugacuuga

SEQ ID NO: 155844 - RNA, 19 nt, Homo sapiens
cagggaggcagcagacuca

SEQ ID NO: 155845 - RNA, 19 nt, Homo sapiens
gugacuucauucccagaug

SEQ ID NO: 155846 - RNA, 19 nt, Homo sapiens
gacgacuacuaugaagaga

SEQ ID NO: 155847 - RNA, 19 nt, Homo sapiens
aaugacgacuacuaugaag

SEQ ID NO: 155848 - RNA, 19 nt, Homo sapiens
gaaugaaccugaaagcaaa

SEQ ID NO: 155849 - RNA, 19 nt, Homo sapiens
gcggagagguauuugauua

SEQ ID NO: 155850 - RNA, 19 nt, Homo sapiens
ucacgaagaugaugaacua

SEQ ID NO: 155851 - RNA, 19 nt, Homo sapiens
ggaaagagguagcugugaa

SEQ ID NO: 155852 - RNA, 19 nt, Homo sapiens
ggaacaagcuggacaccuu

SEQ ID NO: 155853 - RNA, 19 nt, Homo sapiens
gaaacuauuccgcgaagua

SEQ ID NO: 155854 - RNA, 19 nt, Homo sapiens
gauaugaacaucaagauug

SEQ ID NO: 155855 - RNA, 19 nt, Homo sapiens
gaaccugaaugaaccugaa

SEQ ID NO: 155856 - RNA, 19 nt, Homo sapiens
gaaugugggucacgaagau

SEQ ID NO: 155857 - RNA, 19 nt, Homo sapiens
aaagaucgauggaugaaug

SEQ ID NO: 155858 - RNA, 19 nt, Homo sapiens
gagaggcacuuuagagcaa

SEQ ID NO: 155859 - RNA, 19 nt, Homo sapiens
gcaaugaauucaccuuugg

SEQ ID NO: 155860 - RNA, 19 nt, Homo sapiens
caaguucaccuccaaguuu

SEQ ID NO: 155861 - RNA, 19 nt, Homo sapiens
caucaagauugcagacuuu

SEQ ID NO: 155862 - RNA, 19 nt, Homo sapiens
gagcaaaucaugaaagauc

SEQ ID NO: 155863 - RNA, 19 nt, Homo sapiens
gcucuuggaugcugauaug

SEQ ID NO: 155864 - RNA, 19 nt, Homo sapiens
gaaguuuauuguccauaga

SEQ ID NO: 155865 - RNA, 19 nt, Homo sapiens
gaaguuggcccgacacauc

SEQ ID NO: 155866 - RNA, 19 nt, Homo sapiens
gaagaucauugacaagacu

SEQ ID NO: 155867 - RNA, 19 nt, Homo sapiens
cgaagaugaugaacuaaag

SEQ ID NO: 155868 - RNA, 19 nt, Homo sapiens
uagagcaaaucaugaaaga

SEQ ID NO: 155869 - RNA, 19 nt, Homo sapiens
gugaaaaccugcuuaagaa

SEQ ID NO: 155870 - RNA, 19 nt, Homo sapiens
ugacaagacucaacugaac

SEQ ID NO: 155871 - RNA, 19 nt, Homo sapiens
gaauucaccuuugggaaca

SEQ ID NO: 155872 - RNA, 19 nt, Homo sapiens
gacuuuggcuucagcaaug

SEQ ID NO: 155873 - RNA, 19 nt, Homo sapiens
augaugaacuaaagccuua

SEQ ID NO: 155874 - RNA, 19 nt, Homo sapiens
ugaaugaaccugaaagcaa

SEQ ID NO: 155875 - RNA, 19 nt, Homo sapiens
gggagcaucuucagcaagu

SEQ ID NO: 155876 - RNA, 19 nt, Homo sapiens
aaacauugccuccaaaaua

SEQ ID NO: 155877 - RNA, 19 nt, Homo sapiens
gcacaaaucgaagcaggaa

SEQ ID NO: 155878 - RNA, 19 nt, Homo sapiens
gcaguacugucaccagaag

SEQ ID NO: 155879 - RNA, 19 nt, Homo sapiens
gcaccuccauggccuucaa

SEQ ID NO: 155880 - RNA, 19 nt, Homo sapiens
cacagaguauuucgccuaa

SEQ ID NO: 155881 - RNA, 19 nt, Homo sapiens
aaucaucccaacauaguua

SEQ ID NO: 155882 - RNA, 19 nt, Homo sapiens
gaaacuaccggcuccucaa

SEQ ID NO: 155883 - RNA, 19 nt, Homo sapiens
gcaaguucaccuccaaguu

SEQ ID NO: 155884 - RNA, 19 nt, Homo sapiens
gcaguaaguccaacaugau

SEQ ID NO: 155885 - RNA, 19 nt, Homo sapiens
acaaaucgaagcaggaauu

SEQ ID NO: 155886 - RNA, 19 nt, Homo sapiens
caagagaggcacuuuagag

SEQ ID NO: 155887 - RNA, 19 nt, Homo sapiens
gcaagagaggcacuuuaga

SEQ ID NO: 155888 - RNA, 19 nt, Homo sapiens
ggaguuauccucuauacac

SEQ ID NO: 155889 - RNA, 19 nt, Homo sapiens
uauuguccauagagacuua

SEQ ID NO: 155890 - RNA, 19 nt, Homo sapiens
agagguagcugugaagauc

SEQ ID NO: 155891 - RNA, 19 nt, Homo sapiens
ccucuaauucuuacucuaa

SEQ ID NO: 155892 - RNA, 19 nt, Homo sapiens
cagcaagagaggcacuuua

SEQ ID NO: 155893 - RNA, 19 nt, Homo sapiens
cggccuggcugcuuagcua

SEQ ID NO: 155894 - RNA, 19 nt, Homo sapiens
guguggagccuaggaguua

SEQ ID NO: 155895 - RNA, 19 nt, Homo sapiens
cguauuccauucuacaugu

SEQ ID NO: 155896 - RNA, 19 nt, Homo sapiens
gcugugggcucugcugaau

SEQ ID NO: 155897 - RNA, 19 nt, Homo sapiens
gaaagagguagcugugaag

SEQ ID NO: 155898 - RNA, 19 nt, Homo sapiens
cgccugcucuggcugagua

SEQ ID NO: 155899 - RNA, 19 nt, Homo sapiens
cagaguauuucgccuaaac

SEQ ID NO: 155900 - RNA, 19 nt, Homo sapiens
cagaaaaccugcucuugga

SEQ ID NO: 155901 - RNA, 19 nt, Homo sapiens
gaagugauugagacugaga

SEQ ID NO: 155902 - RNA, 19 nt, Homo sapiens
uugaagugauugagacuga

SEQ ID NO: 155903 - RNA, 19 nt, Homo sapiens
ggagauggaggugugcaaa

SEQ ID NO: 155904 - RNA, 19 nt, Homo sapiens
agaaguuuauuguccauag

SEQ ID NO: 155905 - RNA, 19 nt, Homo sapiens
aaacuauuccgcgaaguaa

SEQ ID NO: 155906 - RNA, 19 nt, Homo sapiens
cagcaaugaauucaccuuu

SEQ ID NO: 155907 - RNA, 19 nt, Homo sapiens
ugaaucaucccaacauagu

SEQ ID NO: 155908 - RNA, 19 nt, Homo sapiens
gugaagaucauugacaaga

SEQ ID NO: 155909 - RNA, 19 nt, Homo sapiens
agcaguaaguccaacauga

SEQ ID NO: 155910 - RNA, 19 nt, Homo sapiens
gcgguugcacagaguauuu

SEQ ID NO: 155911 - RNA, 19 nt, Homo sapiens
ucagcaaguucaccuccaa

SEQ ID NO: 155912 - RNA, 19 nt, Homo sapiens
gcggaucccugccuuuuga

SEQ ID NO: 155913 - RNA, 19 nt, Homo sapiens
agaaaacgcucuaccuugu

SEQ ID NO: 155914 - RNA, 19 nt, Homo sapiens
uuugaaucaucccaacaua

SEQ ID NO: 155915 - RNA, 19 nt, Homo sapiens
ccauggagcccaacgagau

SEQ ID NO: 155916 - RNA, 19 nt, Homo sapiens
ugggacaccuugacuccaa

SEQ ID NO: 155917 - RNA, 19 nt, Homo sapiens
ugaaagaucgauggaugaa

SEQ ID NO: 155918 - RNA, 19 nt, Homo sapiens
gaaaaccugcuuaagaaau

SEQ ID NO: 155919 - RNA, 19 nt, Homo sapiens
acaucaagauugcagacuu

SEQ ID NO: 155920 - RNA, 19 nt, Homo sapiens
gaaucaucccaacauaguu

SEQ ID NO: 155921 - RNA, 19 nt, Homo sapiens
cgccuaaaccaagaaauuu

SEQ ID NO: 155922 - RNA, 19 nt, Homo sapiens
gagcaucuucagcaaguuc

SEQ ID NO: 155923 - RNA, 19 nt, Homo sapiens
gcgacaccaucacccugaa

SEQ ID NO: 155924 - RNA, 19 nt, Homo sapiens
guacugucaccagaaguuu

SEQ ID NO: 155925 - RNA, 19 nt, Homo sapiens
caaauuccgccagauagug

SEQ ID NO: 155926 - RNA, 19 nt, Homo sapiens
ucgccuaaaccaagaaauu

SEQ ID NO: 155927 - RNA, 19 nt, Homo sapiens
guaacaacgcagaaaauaa

SEQ ID NO: 155928 - RNA, 19 nt, Homo sapiens
caguaaguccaacaugauu

SEQ ID NO: 155929 - RNA, 19 nt, Homo sapiens
gcgauggauuggugugucu

SEQ ID NO: 155930 - RNA, 19 nt, Homo sapiens
aaguucaccuccaaguuug

SEQ ID NO: 155931 - RNA, 19 nt, Homo sapiens
gaguuauccucuauacacu

SEQ ID NO: 155932 - RNA, 19 nt, Homo sapiens
agcaaugaauucaccuuug

SEQ ID NO: 155933 - RNA, 19 nt, Homo sapiens
cauggcaggaugaaagaaa

SEQ ID NO: 155934 - RNA, 19 nt, Homo sapiens
cccuggcccuucucaguuu

SEQ ID NO: 155935 - RNA, 19 nt, Homo sapiens
agacugcagcgauggauug

SEQ ID NO: 155936 - RNA, 19 nt, Homo sapiens
gagauacaacgaggugaug

SEQ ID NO: 155937 - RNA, 19 nt, Homo sapiens
gccacucccugacuacaag

SEQ ID NO: 155938 - RNA, 19 nt, Homo sapiens
cugugaagaucauugacaa

SEQ ID NO: 155939 - RNA, 19 nt, Homo sapiens
gaaagaucgauggaugaau

SEQ ID NO: 155940 - RNA, 19 nt, Homo sapiens
cgaaguaagaauaaugaag

SEQ ID NO: 155941 - RNA, 19 nt, Homo sapiens
aaacccagucucucugcua

SEQ ID NO: 155942 - RNA, 19 nt, Homo sapiens
gcaaaucaugaaagaucga

SEQ ID NO: 155943 - RNA, 19 nt, Homo sapiens
ccagaaguuuauuguccau

SEQ ID NO: 155944 - RNA, 19 nt, Homo sapiens
ugaagaucauugacaagac

SEQ ID NO: 155945 - RNA, 19 nt, Homo sapiens
uaacaacgcagaaaauaag

SEQ ID NO: 155946 - RNA, 19 nt, Homo sapiens
cagaguaacaacgcagaaa

SEQ ID NO: 155947 - RNA, 19 nt, Homo sapiens
ccaaauuccgccagauagu

SEQ ID NO: 155948 - RNA, 19 nt, Homo sapiens
gaaugaaccugaaagcaaa

SEQ ID NO: 155949 - RNA, 19 nt, Homo sapiens
gcggagagguauuugauua

SEQ ID NO: 155950 - RNA, 19 nt, Homo sapiens
ucacgaagaugaugaacua

SEQ ID NO: 155951 - RNA, 19 nt, Homo sapiens
ggaaagagguagcugugaa

SEQ ID NO: 155952 - RNA, 19 nt, Homo sapiens
ggaacaagcuggacaccuu

SEQ ID NO: 155953 - RNA, 19 nt, Homo sapiens
gaaacuauuccgcgaagua

SEQ ID NO: 155954 - RNA, 19 nt, Homo sapiens
gauaugaacaucaagauug

SEQ ID NO: 155955 - RNA, 19 nt, Homo sapiens
gaaccugaaugaaccugaa

SEQ ID NO: 155956 - RNA, 19 nt, Homo sapiens
gaaugugggucacgaagau

SEQ ID NO: 155957 - RNA, 19 nt, Homo sapiens
aaagaucgauggaugaaug

SEQ ID NO: 155958 - RNA, 19 nt, Homo sapiens
gagaggcacuuuagagcaa

SEQ ID NO: 155959 - RNA, 19 nt, Homo sapiens
gcaaugaauucaccuuugg

SEQ ID NO: 155960 - RNA, 19 nt, Homo sapiens
caaguucaccuccaaguuu

SEQ ID NO: 155961 - RNA, 19 nt, Homo sapiens
caucaagauugcagacuuu

SEQ ID NO: 155962 - RNA, 19 nt, Homo sapiens
gagcaaaucaugaaagauc

SEQ ID NO: 155963 - RNA, 19 nt, Homo sapiens
gcucuuggaugcugauaug

SEQ ID NO: 155964 - RNA, 19 nt, Homo sapiens
gaaguuuauuguccauaga

SEQ ID NO: 155965 - RNA, 19 nt, Homo sapiens
gaaguuggcccgacacauc

SEQ ID NO: 155966 - RNA, 19 nt, Homo sapiens
gaagaucauugacaagacu

SEQ ID NO: 155967 - RNA, 19 nt, Homo sapiens
cgaagaugaugaacuaaag

SEQ ID NO: 155968 - RNA, 19 nt, Homo sapiens
uagagcaaaucaugaaaga

SEQ ID NO: 155969 - RNA, 19 nt, Homo sapiens
gugaaaaccugcuuaagaa

SEQ ID NO: 155970 - RNA, 19 nt, Homo sapiens
ugacaagacucaacugaac

SEQ ID NO: 155971 - RNA, 19 nt, Homo sapiens
ccacggagaguaacuguga

SEQ ID NO: 155972 - RNA, 19 nt, Homo sapiens
gaauucaccuuugggaaca

SEQ ID NO: 155973 - RNA, 19 nt, Homo sapiens
gacuuuggcuucagcaaug

SEQ ID NO: 155974 - RNA, 19 nt, Homo sapiens
augaugaacuaaagccuua

SEQ ID NO: 155975 - RNA, 19 nt, Homo sapiens
ugaaugaaccugaaagcaa

SEQ ID NO: 155976 - RNA, 19 nt, Homo sapiens
gggagcaucuucagcaagu

SEQ ID NO: 155977 - RNA, 19 nt, Homo sapiens
aaacauugccuccaaaaua

SEQ ID NO: 155978 - RNA, 19 nt, Homo sapiens
gcacaaaucgaagcaggaa

SEQ ID NO: 155979 - RNA, 19 nt, Homo sapiens
gcaguacugucaccagaag

SEQ ID NO: 155980 - RNA, 19 nt, Homo sapiens
gcaccuccauggccuucaa

SEQ ID NO: 155981 - RNA, 19 nt, Homo sapiens
cacagaguauuucgccuaa

SEQ ID NO: 155982 - RNA, 19 nt, Homo sapiens
aaucaucccaacauaguua

SEQ ID NO: 155983 - RNA, 19 nt, Homo sapiens
gaaacuaccggcuccucaa

SEQ ID NO: 155984 - RNA, 19 nt, Homo sapiens
gcaaguucaccuccaaguu

SEQ ID NO: 155985 - RNA, 19 nt, Homo sapiens
gcaguaaguccaacaugau

SEQ ID NO: 155986 - RNA, 19 nt, Homo sapiens
gcaaagacagccuaaccau

SEQ ID NO: 155987 - RNA, 19 nt, Homo sapiens
acaaaucgaagcaggaauu

SEQ ID NO: 155988 - RNA, 19 nt, Homo sapiens
caagagaggcacuuuagag

SEQ ID NO: 155989 - RNA, 19 nt, Homo sapiens
gcaagagaggcacuuuaga

SEQ ID NO: 155990 - RNA, 19 nt, Homo sapiens
ggaguuauccucuauacac

SEQ ID NO: 155991 - RNA, 19 nt, Homo sapiens
uauuguccauagagacuua

SEQ ID NO: 155992 - RNA, 19 nt, Homo sapiens
agagguagcugugaagauc

SEQ ID NO: 155993 - RNA, 19 nt, Homo sapiens
ccucuaauucuuacucuaa

SEQ ID NO: 155994 - RNA, 19 nt, Homo sapiens
cagcaagagaggcacuuua

SEQ ID NO: 155995 - RNA, 19 nt, Homo sapiens
cggccuggcugcuuagcua

SEQ ID NO: 155996 - RNA, 19 nt, Homo sapiens
guguggagccuaggaguua

SEQ ID NO: 155997 - RNA, 19 nt, Homo sapiens
gcugugggcucugcugaau

SEQ ID NO: 155998 - RNA, 19 nt, Homo sapiens
cguauuccauucuacaugu

SEQ ID NO: 155999 - RNA, 19 nt, Homo sapiens
cgccugcucuggcugagua

SEQ ID NO: 156000 - RNA, 19 nt, Homo sapiens
gaaagagguagcugugaag

SEQ ID NO: 156001 - RNA, 19 nt, Homo sapiens
cagaguauuucgccuaaac

SEQ ID NO: 156002 - RNA, 19 nt, Homo sapiens
cagaaaaccugcucuugga

SEQ ID NO: 156003 - RNA, 19 nt, Homo sapiens
gaagugauugagacugaga

SEQ ID NO: 156004 - RNA, 19 nt, Homo sapiens
uugaagugauugagacuga

SEQ ID NO: 156005 - RNA, 19 nt, Homo sapiens
ggagauggaggugugcaaa

SEQ ID NO: 156006 - RNA, 19 nt, Homo sapiens
agaaguuuauuguccauag

SEQ ID NO: 156007 - RNA, 19 nt, Homo sapiens
aaacuauuccgcgaaguaa

SEQ ID NO: 156008 - RNA, 19 nt, Homo sapiens
cagcaaugaauucaccuuu

SEQ ID NO: 156009 - RNA, 19 nt, Homo sapiens
ugaaucaucccaacauagu

SEQ ID NO: 156010 - RNA, 19 nt, Homo sapiens
gugaagaucauugacaaga

SEQ ID NO: 156011 - RNA, 19 nt, Homo sapiens
agcaguaaguccaacauga

SEQ ID NO: 156012 - RNA, 19 nt, Homo sapiens
gcgguugcacagaguauuu

SEQ ID NO: 156013 - RNA, 19 nt, Homo sapiens
ucagcaaguucaccuccaa

SEQ ID NO: 156014 - RNA, 19 nt, Homo sapiens
gcggaucccugccuuuuga

SEQ ID NO: 156015 - RNA, 19 nt, Homo sapiens
agaaaacgcucuaccuugu

SEQ ID NO: 156016 - RNA, 19 nt, Homo sapiens
uuugaaucaucccaacaua

SEQ ID NO: 156017 - RNA, 19 nt, Homo sapiens
ccauggagcccaacgagau

SEQ ID NO: 156018 - RNA, 19 nt, Homo sapiens
ugaaagaucgauggaugaa

SEQ ID NO: 156019 - RNA, 19 nt, Homo sapiens
gaaaaccugcuuaagaaau

SEQ ID NO: 156020 - RNA, 19 nt, Homo sapiens
acaucaagauugcagacuu

SEQ ID NO: 156021 - RNA, 19 nt, Homo sapiens
gaaucaucccaacauaguu

SEQ ID NO: 156022 - RNA, 19 nt, Homo sapiens
ugggacaccuugacuccaa

SEQ ID NO: 156023 - RNA, 19 nt, Homo sapiens
cgccuaaaccaagaaauuu

SEQ ID NO: 156024 - RNA, 19 nt, Homo sapiens
gagcaucuucagcaaguuc

SEQ ID NO: 156025 - RNA, 19 nt, Homo sapiens
gcgacaccaucacccugaa

SEQ ID NO: 156026 - RNA, 19 nt, Homo sapiens
guacugucaccagaaguuu

SEQ ID NO: 156027 - RNA, 19 nt, Homo sapiens
caaauuccgccagauagug

SEQ ID NO: 156028 - RNA, 19 nt, Homo sapiens
caguaaguccaacaugauu

SEQ ID NO: 156029 - RNA, 19 nt, Homo sapiens
ucgccuaaaccaagaaauu

SEQ ID NO: 156030 - RNA, 19 nt, Homo sapiens
guaacaacgcagaaaauaa

SEQ ID NO: 156031 - RNA, 19 nt, Homo sapiens
gcgauggauuggugugucu

SEQ ID NO: 156032 - RNA, 19 nt, Homo sapiens
aaguucaccuccaaguuug

SEQ ID NO: 156033 - RNA, 19 nt, Homo sapiens
gaguuauccucuauacacu

SEQ ID NO: 156034 - RNA, 19 nt, Homo sapiens
agcaaugaauucaccuuug

SEQ ID NO: 156035 - RNA, 19 nt, Homo sapiens
cauggcaggaugaaagaaa

SEQ ID NO: 156036 - RNA, 19 nt, Homo sapiens
cccuggcccuucucaguuu

SEQ ID NO: 156037 - RNA, 19 nt, Homo sapiens
agacugcagcgauggauug

SEQ ID NO: 156038 - RNA, 19 nt, Homo sapiens
gagauacaacgaggugaug

SEQ ID NO: 156039 - RNA, 19 nt, Homo sapiens
gccacucccugacuacaag

SEQ ID NO: 156040 - RNA, 19 nt, Homo sapiens
cugugaagaucauugacaa

SEQ ID NO: 156041 - RNA, 19 nt, Homo sapiens
gaaagaucgauggaugaau

SEQ ID NO: 156042 - RNA, 19 nt, Homo sapiens
cgaaguaagaauaaugaag

SEQ ID NO: 156043 - RNA, 19 nt, Homo sapiens
aaacccagucucucugcua

SEQ ID NO: 156044 - RNA, 19 nt, Homo sapiens
gcaaaucaugaaagaucga

SEQ ID NO: 156045 - RNA, 19 nt, Homo sapiens
ccagaaguuuauuguccau

SEQ ID NO: 156046 - RNA, 19 nt, Homo sapiens
ugaagaucauugacaagac

SEQ ID NO: 156047 - RNA, 19 nt, Homo sapiens
uaacaacgcagaaaauaag

SEQ ID NO: 156048 - RNA, 19 nt, Homo sapiens
gaaaggugcuauauaauug

SEQ ID NO: 156049 - RNA, 19 nt, Homo sapiens
ggugaaaggugcuauauaa

SEQ ID NO: 156050 - RNA, 19 nt, Homo sapiens
guauugggcuucuucguua

SEQ ID NO: 156051 - RNA, 19 nt, Homo sapiens
gaaaguaguuggcuaguac

SEQ ID NO: 156052 - RNA, 19 nt, Homo sapiens
ccacaucgcuacuguuauu

SEQ ID NO: 156053 - RNA, 19 nt, Homo sapiens
guuuauaacucuagggaua

SEQ ID NO: 156054 - RNA, 19 nt, Homo sapiens
gggcagaucuuuucuuuaa

SEQ ID NO: 156055 - RNA, 19 nt, Homo sapiens
ggagguugcuguacaggaa

SEQ ID NO: 156056 - RNA, 19 nt, Homo sapiens
ucucuuugcucacaaguua

SEQ ID NO: 156057 - RNA, 19 nt, Homo sapiens
gaacagagugccugcauuc

SEQ ID NO: 156058 - RNA, 19 nt, Homo sapiens
caaagggaauacucacauu

SEQ ID NO: 156059 - RNA, 19 nt, Homo sapiens
ggucaaaucccaaaccauu

SEQ ID NO: 156060 - RNA, 19 nt, Homo sapiens
guaguuggcuaguacuuug

SEQ ID NO: 156061 - RNA, 19 nt, Homo sapiens
ggaggaagccguugaaucu

SEQ ID NO: 156062 - RNA, 19 nt, Homo sapiens
uaaaccauguauucccuua

SEQ ID NO: 156063 - RNA, 19 nt, Homo sapiens
ggaaagagaguuuguaagg

SEQ ID NO: 156064 - RNA, 19 nt, Homo sapiens
gaggaaagagaguuuguaa

SEQ ID NO: 156065 - RNA, 19 nt, Homo sapiens
ugagacaucuugccuacuu

SEQ ID NO: 156066 - RNA, 19 nt, Homo sapiens
gaaagagaguuuguaaggu

SEQ ID NO: 156067 - RNA, 19 nt, Homo sapiens
cagcagaggaaacuuauaa

SEQ ID NO: 156068 - RNA, 19 nt, Homo sapiens
gcacaauccuauuacucuu

SEQ ID NO: 156069 - RNA, 19 nt, Homo sapiens
gagcagauacugucuuugu

SEQ ID NO: 156070 - RNA, 19 nt, Homo sapiens
uauuaagccuaccguauuu

SEQ ID NO: 156071 - RNA, 19 nt, Homo sapiens
guauuaagccuaccguauu

SEQ ID NO: 156072 - RNA, 19 nt, Homo sapiens
caucuacacuagucauuau

SEQ ID NO: 156073 - RNA, 19 nt, Homo sapiens
gugcaggccuucaugauuc

SEQ ID NO: 156074 - RNA, 19 nt, Homo sapiens
auagaaggcugucuuagug

SEQ ID NO: 156075 - RNA, 19 nt, Homo sapiens
gaaaaucccaugagauaaa

SEQ ID NO: 156076 - RNA, 19 nt, Homo sapiens
ggaaguggagguugcugua

SEQ ID NO: 156077 - RNA, 19 nt, Homo sapiens
uacgguagaugcaucagua

SEQ ID NO: 156078 - RNA, 19 nt, Homo sapiens
ggaauucagugacaaaaug

SEQ ID NO: 156079 - RNA, 19 nt, Homo sapiens
uaaaauagcgguacaaguu

SEQ ID NO: 156080 - RNA, 19 nt, Homo sapiens
ggauuguucuaguacugua

SEQ ID NO: 156081 - RNA, 19 nt, Homo sapiens
gugggaagaugaacuuugu

SEQ ID NO: 156082 - RNA, 19 nt, Homo sapiens
gagaaucugagacaucuug

SEQ ID NO: 156083 - RNA, 19 nt, Homo sapiens
gaacuaugacuggaguaaa

SEQ ID NO: 156084 - RNA, 19 nt, Homo sapiens
ucagugcggucacauacuu

SEQ ID NO: 156085 - RNA, 19 nt, Homo sapiens
gggagaaucugagacaucu

SEQ ID NO: 156086 - RNA, 19 nt, Homo sapiens
gcuccuaggcucaguggua

SEQ ID NO: 156087 - RNA, 19 nt, Homo sapiens
agaaaguaguuggcuagua

SEQ ID NO: 156088 - RNA, 19 nt, Homo sapiens
aacauuagcugcagugaca

SEQ ID NO: 156089 - RNA, 19 nt, Homo sapiens
guccacaucgcuacuguua

SEQ ID NO: 156090 - RNA, 19 nt, Homo sapiens
gaaguaguauguuauuccu

SEQ ID NO: 156091 - RNA, 19 nt, Homo sapiens
ggaggaggaaagagaguuu

SEQ ID NO: 156092 - RNA, 19 nt, Homo sapiens
caucaucggcguucucuau

SEQ ID NO: 156093 - RNA, 19 nt, Homo sapiens
ucuaucaucuucuguguca

SEQ ID NO: 156094 - RNA, 19 nt, Homo sapiens
gagacaucuugccuacuuu

SEQ ID NO: 156095 - RNA, 19 nt, Homo sapiens
gaccuacugcacugaguua

SEQ ID NO: 156096 - RNA, 19 nt, Homo sapiens
ccacggcuauuccuacauc

SEQ ID NO: 156097 - RNA, 19 nt, Homo sapiens
gaacucucuuugcucacaa

SEQ ID NO: 156098 - RNA, 19 nt, Homo sapiens
gcaccucuauacaggacuu

SEQ ID NO: 156099 - RNA, 19 nt, Homo sapiens
ggaggaaagagaguuugua

SEQ ID NO: 156100 - RNA, 19 nt, Homo sapiens
gagggcaagccaccaaauu

SEQ ID NO: 156101 - RNA, 19 nt, Homo sapiens
gaguuguuaugccaugauu

SEQ ID NO: 156102 - RNA, 19 nt, Homo sapiens
gaggaaguuuugucuaauu

SEQ ID NO: 156103 - RNA, 19 nt, Homo sapiens
agauggacauggcucauug

SEQ ID NO: 156104 - RNA, 19 nt, Homo sapiens
aaauaaggccggacgaguu

SEQ ID NO: 156105 - RNA, 19 nt, Homo sapiens
aggcagcucuucuggaguu

SEQ ID NO: 156106 - RNA, 19 nt, Homo sapiens
uaucugguccugagaaaga

SEQ ID NO: 156107 - RNA, 19 nt, Homo sapiens
cauguauucccuuaucuuu

SEQ ID NO: 156108 - RNA, 19 nt, Homo sapiens
aguauguuauuccugguua

SEQ ID NO: 156109 - RNA, 19 nt, Homo sapiens
ccuauuacucuuccucuaa

SEQ ID NO: 156110 - RNA, 19 nt, Homo sapiens
caccagcagaggaaacuua

SEQ ID NO: 156111 - RNA, 19 nt, Homo sapiens
gguacaaguucuggcaaga

SEQ ID NO: 156112 - RNA, 19 nt, Homo sapiens
gucaaaucccaaaccauua

SEQ ID NO: 156113 - RNA, 19 nt, Homo sapiens
gauucucucuaucaucuuc

SEQ ID NO: 156114 - RNA, 19 nt, Homo sapiens
caucgcuacuguuauuaug

SEQ ID NO: 156115 - RNA, 19 nt, Homo sapiens
ugacuggaguaaaccaugu

SEQ ID NO: 156116 - RNA, 19 nt, Homo sapiens
agacauauccaaagggaau

SEQ ID NO: 156117 - RNA, 19 nt, Homo sapiens
gacaccaccuggagugauc

SEQ ID NO: 156118 - RNA, 19 nt, Homo sapiens
aaagggaauacucacauuu

SEQ ID NO: 156119 - RNA, 19 nt, Homo sapiens
agggcaagccaccaaauua

SEQ ID NO: 156120 - RNA, 19 nt, Homo sapiens
ggugcuauauaauugugaa

SEQ ID NO: 156121 - RNA, 19 nt, Homo sapiens
caacaggcccuugggugaa

SEQ ID NO: 156122 - RNA, 19 nt, Homo sapiens
gugaacaauucggugguaa

SEQ ID NO: 156123 - RNA, 19 nt, Homo sapiens
gaggucaaaucccaaacca

SEQ ID NO: 156124 - RNA, 19 nt, Homo sapiens
ggaggaggaagccguugaa

SEQ ID NO: 156125 - RNA, 19 nt, Homo sapiens
gauucugauucccuucaaa

SEQ ID NO: 156126 - RNA, 19 nt, Homo sapiens
guauguuauuccugguuaa

SEQ ID NO: 156127 - RNA, 19 nt, Homo sapiens
gggugaaaggugcuauaua

SEQ ID NO: 156128 - RNA, 19 nt, Homo sapiens
ggugaggcauggcaauucu

SEQ ID NO: 156129 - RNA, 19 nt, Homo sapiens
guauacaacaggagagaga

SEQ ID NO: 156130 - RNA, 19 nt, Homo sapiens
gauauuuagcucuguggaa

SEQ ID NO: 156131 - RNA, 19 nt, Homo sapiens
gagauggacauggcucauu

SEQ ID NO: 156132 - RNA, 19 nt, Homo sapiens
gagccauugucccucuuug

SEQ ID NO: 156133 - RNA, 19 nt, Homo sapiens
aaacaucacauuccagucu

SEQ ID NO: 156134 - RNA, 19 nt, Homo sapiens
gggaagaugaacuuuguca

SEQ ID NO: 156135 - RNA, 19 nt, Homo sapiens
gcagucaguguuucuuuua

SEQ ID NO: 156136 - RNA, 19 nt, Homo sapiens
uggaguuucucuaaaguca

SEQ ID NO: 156137 - RNA, 19 nt, Homo sapiens
ccaucuacacuagucauua

SEQ ID NO: 156138 - RNA, 19 nt, Homo sapiens
uggaguaaaccauguauuc

SEQ ID NO: 156139 - RNA, 19 nt, Homo sapiens
uauagaaggcugucuuagu

SEQ ID NO: 156140 - RNA, 19 nt, Homo sapiens
gauuauagaaggcugucuu

SEQ ID NO: 156141 - RNA, 19 nt, Homo sapiens
ugugguaccuagucagaug

SEQ ID NO: 156142 - RNA, 19 nt, Homo sapiens
gaacaauucggugguaaaa

SEQ ID NO: 156143 - RNA, 19 nt, Homo sapiens
cccaucagcugccacaaca

SEQ ID NO: 156144 - RNA, 19 nt, Homo sapiens
uaucaucuucugugucauu

SEQ ID NO: 156145 - RNA, 19 nt, Homo sapiens
aagaugcccucaagacagu

SEQ ID NO: 156146 - RNA, 19 nt, Homo sapiens
cagugaagaugcccucaag

SEQ ID NO: 156147 - RNA, 19 nt, Homo sapiens
agaacagagugccugcauu

SEQ ID NO: 156148 - RNA, 19 nt, Homo sapiens
ggagagagguuuguccuaa

SEQ ID NO: 156149 - RNA, 19 nt, Homo sapiens
gagaauauguaccaacaac

SEQ ID NO: 156150 - RNA, 19 nt, Homo sapiens
agacaggcgugaagacauu

SEQ ID NO: 156151 - RNA, 19 nt, Homo sapiens
cagcuaaugucaugucugu

SEQ ID NO: 156152 - RNA, 19 nt, Homo sapiens
aaugacagcuuucaagagu

SEQ ID NO: 156153 - RNA, 19 nt, Homo sapiens
guaccaacaacacgaauug

SEQ ID NO: 156154 - RNA, 19 nt, Homo sapiens
caucaucgccuuccacauc

SEQ ID NO: 156155 - RNA, 19 nt, Homo sapiens
ugauugcggccuccauuua

SEQ ID NO: 156156 - RNA, 19 nt, Homo sapiens
gcuaaugucaugucugugu

SEQ ID NO: 156157 - RNA, 19 nt, Homo sapiens
ugacagcuuucaagaguac

SEQ ID NO: 156158 - RNA, 19 nt, Homo sapiens
ucaaugacagcuuucaaga

SEQ ID NO: 156159 - RNA, 19 nt, Homo sapiens
uggagaauauguaccaaca

SEQ ID NO: 156160 - RNA, 19 nt, Homo sapiens
guggguaggagaugaguuu

SEQ ID NO: 156161 - RNA, 19 nt, Homo sapiens
gagagagguuuguccuaac

SEQ ID NO: 156162 - RNA, 19 nt, Homo sapiens
gauugcggccuccauuuau

SEQ ID NO: 156163 - RNA, 19 nt, Homo sapiens
gaaggcagcuacggcuacu

SEQ ID NO: 156164 - RNA, 19 nt, Homo sapiens
gcaguacagaauccacauu

SEQ ID NO: 156165 - RNA, 19 nt, Homo sapiens
ugaggaagcgcaaauagag

SEQ ID NO: 156166 - RNA, 19 nt, Homo sapiens
gcagcuacggcuacuccua

SEQ ID NO: 156167 - RNA, 19 nt, Homo sapiens
ucauccagcuaaugucaug

SEQ ID NO: 156168 - RNA, 19 nt, Homo sapiens
ggcaugauguaccugauac

SEQ ID NO: 156169 - RNA, 19 nt, Homo sapiens
gaagcagggagagagguuu

SEQ ID NO: 156170 - RNA, 19 nt, Homo sapiens
gaauauguaccaacaacac

SEQ ID NO: 156171 - RNA, 19 nt, Homo sapiens
uguuggugcuucuugcuuu

SEQ ID NO: 156172 - RNA, 19 nt, Homo sapiens
cacauucagauaaccauuu

SEQ ID NO: 156173 - RNA, 19 nt, Homo sapiens
cggccuccauuuauacaga

SEQ ID NO: 156174 - RNA, 19 nt, Homo sapiens
caucauccagcuaauguca

SEQ ID NO: 156175 - RNA, 19 nt, Homo sapiens
ggagaauauguaccaacaa

SEQ ID NO: 156176 - RNA, 19 nt, Homo sapiens
gcuucuugcuuucaucauc

SEQ ID NO: 156177 - RNA, 19 nt, Homo sapiens
gaugucuggagaauaugua

SEQ ID NO: 156178 - RNA, 19 nt, Homo sapiens
cggcaugauguaccugaua

SEQ ID NO: 156179 - RNA, 19 nt, Homo sapiens
gggagagagguuuguccua

SEQ ID NO: 156180 - RNA, 19 nt, Homo sapiens
auugcggccuccauuuaua

SEQ ID NO: 156181 - RNA, 19 nt, Homo sapiens
gcaucgccuucuucaucuu

SEQ ID NO: 156182 - RNA, 19 nt, Homo sapiens
cugcaucgccuucuucauc

SEQ ID NO: 156183 - RNA, 19 nt, Homo sapiens
caugauugcggccuccauu

SEQ ID NO: 156184 - RNA, 19 nt, Homo sapiens
ggaagcgcaaauagaguuc

SEQ ID NO: 156185 - RNA, 19 nt, Homo sapiens
cgaauugcacagucaucaa

SEQ ID NO: 156186 - RNA, 19 nt, Homo sapiens
gaggaagcgcaaauagagu

SEQ ID NO: 156187 - RNA, 19 nt, Homo sapiens
ccacauucagauaaccauu

SEQ ID NO: 156188 - RNA, 19 nt, Homo sapiens
caucaaugacagcuuucaa

SEQ ID NO: 156189 - RNA, 19 nt, Homo sapiens
caaugacagcuuucaagag

SEQ ID NO: 156190 - RNA, 19 nt, Homo sapiens
gagaagagacgcagaagga

SEQ ID NO: 156191 - RNA, 19 nt, Homo sapiens
ggaaagagucccugaaucu

SEQ ID NO: 156192 - RNA, 19 nt, Homo sapiens
gcaguaaugucagcgagaa

SEQ ID NO: 156193 - RNA, 19 nt, Homo sapiens
cuucacauccucauucuua

SEQ ID NO: 156194 - RNA, 19 nt, Homo sapiens
ggaggaaggcggugagaga

SEQ ID NO: 156195 - RNA, 19 nt, Homo sapiens
ggagagaagagacgcagaa

SEQ ID NO: 156196 - RNA, 19 nt, Homo sapiens
aaacaugggccugcaguaa

SEQ ID NO: 156197 - RNA, 19 nt, Homo sapiens
ggagagcgagcgagagaga

SEQ ID NO: 156198 - RNA, 19 nt, Homo sapiens
ucacauccucauucuuaua

SEQ ID NO: 156199 - RNA, 19 nt, Homo sapiens
ggucucagcccuucacauc

SEQ ID NO: 156200 - RNA, 19 nt, Homo sapiens
acaugggccugcaguaaug

SEQ ID NO: 156201 - RNA, 19 nt, Homo sapiens
gaacaacgacaccaaaaca

SEQ ID NO: 156202 - RNA, 19 nt, Homo sapiens
cgacuccagcucugacuuu

SEQ ID NO: 156203 - RNA, 19 nt, Homo sapiens
gaaagagucccugaaucuc

SEQ ID NO: 156204 - RNA, 19 nt, Homo sapiens
caucaucuacauccaccua

SEQ ID NO: 156205 - RNA, 19 nt, Homo sapiens
gaaaggguucuggauugga

SEQ ID NO: 156206 - RNA, 19 nt, Homo sapiens
gugaaaggagggaggagaa

SEQ ID NO: 156207 - RNA, 19 nt, Homo sapiens
cauccucauucuuauacug

SEQ ID NO: 156208 - RNA, 19 nt, Homo sapiens
ggucagcggcaucaucuac

SEQ ID NO: 156209 - RNA, 19 nt, Homo sapiens
gcaggagggagagaagaga

SEQ ID NO: 156210 - RNA, 19 nt, Homo sapiens
guggaacaacgacaccaaa

SEQ ID NO: 156211 - RNA, 19 nt, Homo sapiens
gcccuucacauccucauuc

SEQ ID NO: 156212 - RNA, 19 nt, Homo sapiens
agagcgagcgagagagaaa

SEQ ID NO: 156213 - RNA, 19 nt, Homo sapiens
aaggagagcgagcgagaga

SEQ ID NO: 156214 - RNA, 19 nt, Homo sapiens
ucagcggcaucaucuacau

SEQ ID NO: 156215 - RNA, 19 nt, Homo sapiens
ccaugucacuccucuugcu

SEQ ID NO: 156216 - RNA, 19 nt, Homo sapiens
gcaaagauauugaugaaug

SEQ ID NO: 156217 - RNA, 19 nt, Homo sapiens
ggagugcgaugcaaagaua

SEQ ID NO: 156218 - RNA, 19 nt, Homo sapiens
ccaauacgguggacaguua

SEQ ID NO: 156219 - RNA, 19 nt, Homo sapiens
ugacagaacuacagcauaa

SEQ ID NO: 156220 - RNA, 19 nt, Homo sapiens
gagcaaaguuaucaacaaa

SEQ ID NO: 156221 - RNA, 19 nt, Homo sapiens
gcaaaguuaucaacaaaga

SEQ ID NO: 156222 - RNA, 19 nt, Homo sapiens
ggaguggaauguagagaua

SEQ ID NO: 156223 - RNA, 19 nt, Homo sapiens
gaacagacccaaauucaau

SEQ ID NO: 156224 - RNA, 19 nt, Homo sapiens
gguaauaacuguagagaca

SEQ ID NO: 156225 - RNA, 19 nt, Homo sapiens
gaauacaacugagagcuuu

SEQ ID NO: 156226 - RNA, 19 nt, Homo sapiens
gcaugacacuggcaucuuu

SEQ ID NO: 156227 - RNA, 19 nt, Homo sapiens
ggacuaaauucaccaagga

SEQ ID NO: 156228 - RNA, 19 nt, Homo sapiens
ccagaaagauggcaacuuc

SEQ ID NO: 156229 - RNA, 19 nt, Homo sapiens
ccaaaggguucucuucaaa

SEQ ID NO: 156230 - RNA, 19 nt, Homo sapiens
gaaaucucuucucagcuua

SEQ ID NO: 156231 - RNA, 19 nt, Homo sapiens
gugaagauauugaugaaug

SEQ ID NO: 156232 - RNA, 19 nt, Homo sapiens
gcaguggacaguugaauuu

SEQ ID NO: 156233 - RNA, 19 nt, Homo sapiens
caaguuggauucaucucua

SEQ ID NO: 156234 - RNA, 19 nt, Homo sapiens
ugaaaucucuucucagcuu

SEQ ID NO: 156235 - RNA, 19 nt, Homo sapiens
gaucggguguuccacaauu

SEQ ID NO: 156236 - RNA, 19 nt, Homo sapiens
gaagaugugauacccgaua

SEQ ID NO: 156237 - RNA, 19 nt, Homo sapiens
gaacaccuggcuaccauuu

SEQ ID NO: 156238 - RNA, 19 nt, Homo sapiens
gaugaauucucgagucguu

SEQ ID NO: 156239 - RNA, 19 nt, Homo sapiens
caacaaagaaugcagugaa

SEQ ID NO: 156240 - RNA, 19 nt, Homo sapiens
gugaagacgugaaugaaug

SEQ ID NO: 156241 - RNA, 19 nt, Homo sapiens
cagaggcuuuccaguguua

SEQ ID NO: 156242 - RNA, 19 nt, Homo sapiens
gagaacagacccaaauuca

SEQ ID NO: 156243 - RNA, 19 nt, Homo sapiens
ccagaaggcucccagaaag

SEQ ID NO: 156244 - RNA, 19 nt, Homo sapiens
ucaauggcaugaccaagaa

SEQ ID NO: 156245 - RNA, 19 nt, Homo sapiens
ugucauggcuuaccuguuc

SEQ ID NO: 156246 - RNA, 19 nt, Homo sapiens
gccgaagucucaacgcuaa

SEQ ID NO: 156247 - RNA, 19 nt, Homo sapiens
gaaagacggcuucucagau

SEQ ID NO: 156248 - RNA, 19 nt, Homo sapiens
gaugugauacccgauaaua

SEQ ID NO: 156249 - RNA, 19 nt, Homo sapiens
guacaagugcagcuguuua

SEQ ID NO: 156250 - RNA, 19 nt, Homo sapiens
cauaaugacuggagagaag

SEQ ID NO: 156251 - RNA, 19 nt, Homo sapiens
ggauucaucucuagaaacu

SEQ ID NO: 156252 - RNA, 19 nt, Homo sapiens
gcacaguuauagugaucaa

SEQ ID NO: 156253 - RNA, 19 nt, Homo sapiens
uguaugcacugaugagaaa

SEQ ID NO: 156254 - RNA, 19 nt, Homo sapiens
gggccaguuugcacaguua

SEQ ID NO: 156255 - RNA, 19 nt, Homo sapiens
acacaagacugacaacaag

SEQ ID NO: 156256 - RNA, 19 nt, Homo sapiens
uggcaggugucauggcuua

SEQ ID NO: 156257 - RNA, 19 nt, Homo sapiens
ggcagaggcuuuccagugu

SEQ ID NO: 156258 - RNA, 19 nt, Homo sapiens
gagaggcccaucuguguuu

SEQ ID NO: 156259 - RNA, 19 nt, Homo sapiens
aaagacggcuucucagauc

SEQ ID NO: 156260 - RNA, 19 nt, Homo sapiens
aaaggguucucuucaaaug

SEQ ID NO: 156261 - RNA, 19 nt, Homo sapiens
gcugcuggcugaauacaga

SEQ ID NO: 156262 - RNA, 19 nt, Homo sapiens
gagaucaagcugaagauga

SEQ ID NO: 156263 - RNA, 19 nt, Homo sapiens
gacauugagagcaaaguua

SEQ ID NO: 156264 - RNA, 19 nt, Homo sapiens
gccaaaggguucucuucaa

SEQ ID NO: 156265 - RNA, 19 nt, Homo sapiens
gcagaggcuuuccaguguu

SEQ ID NO: 156266 - RNA, 19 nt, Homo sapiens
ggaagcuucugagacauau

SEQ ID NO: 156267 - RNA, 19 nt, Homo sapiens
gaauguagagauauugaug

SEQ ID NO: 156268 - RNA, 19 nt, Homo sapiens
gaaugaaugugcagaucca

SEQ ID NO: 156269 - RNA, 19 nt, Homo sapiens
ugaagguggugaauuacuu

SEQ ID NO: 156270 - RNA, 19 nt, Homo sapiens
agaucaagcugaagaugaa

SEQ ID NO: 156271 - RNA, 19 nt, Homo sapiens
ccucugagaucaagcugaa

SEQ ID NO: 156272 - RNA, 19 nt, Homo sapiens
gaccguaguuucucugaag

SEQ ID NO: 156273 - RNA, 19 nt, Homo sapiens
ggacauccuuuggcugugu

SEQ ID NO: 156274 - RNA, 19 nt, Homo sapiens
cggaauacuuagacauuga

SEQ ID NO: 156275 - RNA, 19 nt, Homo sapiens
guuggaaacuacucuuguu

SEQ ID NO: 156276 - RNA, 19 nt, Homo sapiens
ccuggaagcuucugagaca

SEQ ID NO: 156277 - RNA, 19 nt, Homo sapiens
uaugccaccugcaccaaua

SEQ ID NO: 156278 - RNA, 19 nt, Homo sapiens
aaucgcugcuggcugaaua

SEQ ID NO: 156279 - RNA, 19 nt, Homo sapiens
gcggaauacuuagacauug

SEQ ID NO: 156280 - RNA, 19 nt, Homo sapiens
gaauuucacagaccaagga

SEQ ID NO: 156281 - RNA, 19 nt, Homo sapiens
uauaccaucugcagcugua

SEQ ID NO: 156282 - RNA, 19 nt, Homo sapiens
gacaaagugugugaaaaua

SEQ ID NO: 156283 - RNA, 19 nt, Homo sapiens
gaaaugugccccaucaauu

SEQ ID NO: 156284 - RNA, 19 nt, Homo sapiens
caaagcaucgugugaagau

SEQ ID NO: 156285 - RNA, 19 nt, Homo sapiens
cauaagacccacacggaaa

SEQ ID NO: 156286 - RNA, 19 nt, Homo sapiens
cacaaaggguaauaacugu

SEQ ID NO: 156287 - RNA, 19 nt, Homo sapiens
ucgccugucugacugauuu

SEQ ID NO: 156288 - RNA, 19 nt, Homo sapiens
cagcuuaacauggaaauga

SEQ ID NO: 156289 - RNA, 19 nt, Homo sapiens
aaagacaccagguuacuga

SEQ ID NO: 156290 - RNA, 19 nt, Homo sapiens
agaaugcagugaagagaau

SEQ ID NO: 156291 - RNA, 19 nt, Homo sapiens
cuucucagcuuaacaugga

SEQ ID NO: 156292 - RNA, 19 nt, Homo sapiens
ccacagggcuauggaaugc

SEQ ID NO: 156293 - RNA, 19 nt, Homo sapiens
ggagaacguucagccaaag

SEQ ID NO: 156294 - RNA, 19 nt, Homo sapiens
gugaagagaaugugacguu

SEQ ID NO: 156295 - RNA, 19 nt, Homo sapiens
agagcaaaguuaucaacaa

SEQ ID NO: 156296 - RNA, 19 nt, Homo sapiens
auaagcagauccagcaaug

SEQ ID NO: 156297 - RNA, 19 nt, Homo sapiens
aggguucucuucaaaugua

SEQ ID NO: 156298 - RNA, 19 nt, Homo sapiens
gcagcuguuuagaugguuu

SEQ ID NO: 156299 - RNA, 19 nt, Homo sapiens
gaauacaagagguggauca

SEQ ID NO: 156300 - RNA, 19 nt, Homo sapiens
ggcaauuucuccuguacug

SEQ ID NO: 156301 - RNA, 19 nt, Homo sapiens
gcuaaaagacaccagguua

SEQ ID NO: 156302 - RNA, 19 nt, Homo sapiens
acacaaaggguaauaacug

SEQ ID NO: 156303 - RNA, 19 nt, Homo sapiens
gcuguaaucagauggcaaa

SEQ ID NO: 156304 - RNA, 19 nt, Homo sapiens
uggagaacguucagccaaa

SEQ ID NO: 156305 - RNA, 19 nt, Homo sapiens
uggaaacccucagcaaaug

SEQ ID NO: 156306 - RNA, 19 nt, Homo sapiens
gugugaagauauugaugaa

SEQ ID NO: 156307 - RNA, 19 nt, Homo sapiens
caacuuguaauaacacugu

SEQ ID NO: 156308 - RNA, 19 nt, Homo sapiens
gaugcaaagauauugauga

SEQ ID NO: 156309 - RNA, 19 nt, Homo sapiens
ccaaacacaaaggguaaua

SEQ ID NO: 156310 - RNA, 19 nt, Homo sapiens
caaacacaaaggguaauaa

SEQ ID NO: 156311 - RNA, 19 nt, Homo sapiens
uaaaugagcgcuucuucca

SEQ ID NO: 156312 - RNA, 19 nt, Homo sapiens
uggaaucgguuuuaaauga

SEQ ID NO: 156313 - RNA, 19 nt, Homo sapiens
agagggaaccgcagugaaa

SEQ ID NO: 156314 - RNA, 19 nt, Homo sapiens
gaaccucucaauaaaugau

SEQ ID NO: 156315 - RNA, 19 nt, Homo sapiens
aagagaaugugacguugga

SEQ ID NO: 156316 - RNA, 19 nt, Homo sapiens
gaacaagaccgaauggaua

SEQ ID NO: 156317 - RNA, 19 nt, Homo sapiens
cacaaaggcugaugucuua

SEQ ID NO: 156318 - RNA, 19 nt, Homo sapiens
gaauaucagucgaaacuuu

SEQ ID NO: 156319 - RNA, 19 nt, Homo sapiens
ccacagaauuugcuaauau

SEQ ID NO: 156320 - RNA, 19 nt, Homo sapiens
ggaaaugucucgggacuug

SEQ ID NO: 156321 - RNA, 19 nt, Homo sapiens
gaucaggccuucuuugguu

SEQ ID NO: 156322 - RNA, 19 nt, Homo sapiens
caucagagcuaacuuugaa

SEQ ID NO: 156323 - RNA, 19 nt, Homo sapiens
ggacagaguugaucagucu

SEQ ID NO: 156324 - RNA, 19 nt, Homo sapiens
gaaauuccucauuggauua

SEQ ID NO: 156325 - RNA, 19 nt, Homo sapiens
ggacuuugguaauugguuu

SEQ ID NO: 156326 - RNA, 19 nt, Homo sapiens
gcaaugaggucggguuuua

SEQ ID NO: 156327 - RNA, 19 nt, Homo sapiens
ccagaaagacuaugugaaa

SEQ ID NO: 156328 - RNA, 19 nt, Homo sapiens
acagagagauuacuccaaa

SEQ ID NO: 156329 - RNA, 19 nt, Homo sapiens
gaaauuugguguggaacaa

SEQ ID NO: 156330 - RNA, 19 nt, Homo sapiens
gaaguuaacccggagcuaa

SEQ ID NO: 156331 - RNA, 19 nt, Homo sapiens
gcugaugucuuaacuguca

SEQ ID NO: 156332 - RNA, 19 nt, Homo sapiens
caaguaacaucagagcuaa

SEQ ID NO: 156333 - RNA, 19 nt, Homo sapiens
uaagagcgccguuggcuuu

SEQ ID NO: 156334 - RNA, 19 nt, Homo sapiens
agaaagauguggaaagcuu

SEQ ID NO: 156335 - RNA, 19 nt, Homo sapiens
cacaggagcugccauguca

SEQ ID NO: 156336 - RNA, 19 nt, Homo sapiens
uaacaucagagcuaacuuu

SEQ ID NO: 156337 - RNA, 19 nt, Homo sapiens
ggaauauacacauugcuuu

SEQ ID NO: 156338 - RNA, 19 nt, Homo sapiens
ccaggagcauaucaacaua

SEQ ID NO: 156339 - RNA, 19 nt, Homo sapiens
gaaagaaagauguggaaag

SEQ ID NO: 156340 - RNA, 19 nt, Homo sapiens
gagauuacuccaaagguuu

SEQ ID NO: 156341 - RNA, 19 nt, Homo sapiens
ccacgaauaucagucgaaa

SEQ ID NO: 156342 - RNA, 19 nt, Homo sapiens
uaggaggacuuugguaauu

SEQ ID NO: 156343 - RNA, 19 nt, Homo sapiens
agaaggaucggauggauaa

SEQ ID NO: 156344 - RNA, 19 nt, Homo sapiens
gaagcaugccucccagaaa

SEQ ID NO: 156345 - RNA, 19 nt, Homo sapiens
gcagaaggaucggauggau

SEQ ID NO: 156346 - RNA, 19 nt, Homo sapiens
gcaagacuacuccaaagga

SEQ ID NO: 156347 - RNA, 19 nt, Homo sapiens
caaguuugguguccagaug

SEQ ID NO: 156348 - RNA, 19 nt, Homo sapiens
ggagaaggaacuugaaaca

SEQ ID NO: 156349 - RNA, 19 nt, Homo sapiens
ugaaugaugugagugagaa

SEQ ID NO: 156350 - RNA, 19 nt, Homo sapiens
ccacucacuuuguaggaaa

SEQ ID NO: 156351 - RNA, 19 nt, Homo sapiens
gaacccuccuccugucaau

SEQ ID NO: 156352 - RNA, 19 nt, Homo sapiens
uaagaaugcgucaaccuuu

SEQ ID NO: 156353 - RNA, 19 nt, Homo sapiens
ggaacaagaccgaauggau

SEQ ID NO: 156354 - RNA, 19 nt, Homo sapiens
gggcuuggcuuuucacaaa

SEQ ID NO: 156355 - RNA, 19 nt, Homo sapiens
gaaaggguuuggaggaaaa

SEQ ID NO: 156356 - RNA, 19 nt, Homo sapiens
gagcauaucaacauacaca

SEQ ID NO: 156357 - RNA, 19 nt, Homo sapiens
ggagcaagccagagccaaa

SEQ ID NO: 156358 - RNA, 19 nt, Homo sapiens
gagggagaaugucuuucaa

SEQ ID NO: 156359 - RNA, 19 nt, Homo sapiens
gccacagaauuugcuaaua

SEQ ID NO: 156360 - RNA, 19 nt, Homo sapiens
ggacagcaccuacgaugag

SEQ ID NO: 156361 - RNA, 19 nt, Homo sapiens
gcauggaggccgcugacua

SEQ ID NO: 156362 - RNA, 19 nt, Homo sapiens
gggaucaccaggagaaauu

SEQ ID NO: 156363 - RNA, 19 nt, Homo sapiens
agagauuacuccaaagguu

SEQ ID NO: 156364 - RNA, 19 nt, Homo sapiens
aaacagaauuucgugaaca

SEQ ID NO: 156365 - RNA, 19 nt, Homo sapiens
ggaugcggcuuccuucaag

SEQ ID NO: 156366 - RNA, 19 nt, Homo sapiens
aaaccucgcuaaggagaaa

SEQ ID NO: 156367 - RNA, 19 nt, Homo sapiens
ugaaaggguuuggaggaaa

SEQ ID NO: 156368 - RNA, 19 nt, Homo sapiens
gaagcacgagucccagaaa

SEQ ID NO: 156369 - RNA, 19 nt, Homo sapiens
ucacaaaggcugaugucuu

SEQ ID NO: 156370 - RNA, 19 nt, Homo sapiens
acaaguaacaucagagcua

SEQ ID NO: 156371 - RNA, 19 nt, Homo sapiens
caagacuacuccaaaggau

SEQ ID NO: 156372 - RNA, 19 nt, Homo sapiens
ggaggcaaauucgguguuc

SEQ ID NO: 156373 - RNA, 19 nt, Homo sapiens
gugaaaggguuuggaggaa

SEQ ID NO: 156374 - RNA, 19 nt, Homo sapiens
ucagucugcuguaggcuuu

SEQ ID NO: 156375 - RNA, 19 nt, Homo sapiens
ucaguaguuugaucaguug

SEQ ID NO: 156376 - RNA, 19 nt, Homo sapiens
cagcaagacuacuccaaag

SEQ ID NO: 156377 - RNA, 19 nt, Homo sapiens
aaagaaagauguggaaagc

SEQ ID NO: 156378 - RNA, 19 nt, Homo sapiens
ggaaagaaagauguggaaa

SEQ ID NO: 156379 - RNA, 19 nt, Homo sapiens
ucagggagcucgcauucuc

SEQ ID NO: 156380 - RNA, 19 nt, Homo sapiens
ggaggacuuugguaauugg

SEQ ID NO: 156381 - RNA, 19 nt, Homo sapiens
aagaaugcgucaaccuuug

SEQ ID NO: 156382 - RNA, 19 nt, Homo sapiens
caagagcaucagacccuua

SEQ ID NO: 156383 - RNA, 19 nt, Homo sapiens
gcaacuuauuguaucugaa

SEQ ID NO: 156384 - RNA, 19 nt, Homo sapiens
gagcaaugaggucggguuu

SEQ ID NO: 156385 - RNA, 19 nt, Homo sapiens
aaagacuacuccagugguu

SEQ ID NO: 156386 - RNA, 19 nt, Homo sapiens
ucacugaguccuugaaauc

SEQ ID NO: 156387 - RNA, 19 nt, Homo sapiens
gaugggaaaucugccuaug

SEQ ID NO: 156388 - RNA, 19 nt, Homo sapiens
ggagaggacugggccugau

SEQ ID NO: 156389 - RNA, 19 nt, Homo sapiens
caaaacaaguaacaucaga

SEQ ID NO: 156390 - RNA, 19 nt, Homo sapiens
agacagacaagacaaaugu

SEQ ID NO: 156391 - RNA, 19 nt, Homo sapiens
cauccuugcuuuaccacaa

SEQ ID NO: 156392 - RNA, 19 nt, Homo sapiens
gagcucgcauucucuugug

SEQ ID NO: 156393 - RNA, 19 nt, Homo sapiens
gggaauauacacauugcuu

SEQ ID NO: 156394 - RNA, 19 nt, Homo sapiens
aggagaagcuggccaagca

SEQ ID NO: 156395 - RNA, 19 nt, Homo sapiens
gaagcacgagucacagaga

SEQ ID NO: 156396 - RNA, 19 nt, Homo sapiens
gagaagcacgagucacaga

SEQ ID NO: 156397 - RNA, 19 nt, Homo sapiens
gaagugcagaugagugugu

SEQ ID NO: 156398 - RNA, 19 nt, Homo sapiens
ggaaaucugccuaugucau

SEQ ID NO: 156399 - RNA, 19 nt, Homo sapiens
ccagcaagacuacuccaaa

SEQ ID NO: 156400 - RNA, 19 nt, Homo sapiens
uaaacagaauuucgugaac

SEQ ID NO: 156401 - RNA, 19 nt, Homo sapiens
aagcaugccucccagaaag

SEQ ID NO: 156402 - RNA, 19 nt, Homo sapiens
uaucugaauuccuguagca

SEQ ID NO: 156403 - RNA, 19 nt, Homo sapiens
gcagaugaguguguguucu

SEQ ID NO: 156404 - RNA, 19 nt, Homo sapiens
caauuucaguaguuugauc

SEQ ID NO: 156405 - RNA, 19 nt, Homo sapiens
ugggaaaucugccuauguc

SEQ ID NO: 156406 - RNA, 19 nt, Homo sapiens
cuacagaucaggccuucuu

SEQ ID NO: 156407 - RNA, 19 nt, Homo sapiens
gaucucauuugacccugau

SEQ ID NO: 156408 - RNA, 19 nt, Homo sapiens
gcugagggagaaugucuuu

SEQ ID NO: 156409 - RNA, 19 nt, Homo sapiens
gcacaggagcugccauguc

SEQ ID NO: 156410 - RNA, 19 nt, Homo sapiens
gaucggauggauaagaaug

SEQ ID NO: 156411 - RNA, 19 nt, Homo sapiens
cagaaggaucggauggaua

SEQ ID NO: 156412 - RNA, 19 nt, Homo sapiens
cagaaagacuaugugaaag

SEQ ID NO: 156413 - RNA, 19 nt, Homo sapiens
uacacaagcugagggagaa

SEQ ID NO: 156414 - RNA, 19 nt, Homo sapiens
gcucuucccagccaacuau

SEQ ID NO: 156415 - RNA, 19 nt, Homo sapiens
cagaggcugucuaugaaag

SEQ ID NO: 156416 - RNA, 19 nt, Homo sapiens
gaacaagaccgaauggaua

SEQ ID NO: 156417 - RNA, 19 nt, Homo sapiens
cacaaaggcugaugucuua

SEQ ID NO: 156418 - RNA, 19 nt, Homo sapiens
gaauaucagucgaaacuuu

SEQ ID NO: 156419 - RNA, 19 nt, Homo sapiens
ccacagaauuugcuaauau

SEQ ID NO: 156420 - RNA, 19 nt, Homo sapiens
ggaaaugucucgggacuug

SEQ ID NO: 156421 - RNA, 19 nt, Homo sapiens
gaucaggccuucuuugguu

SEQ ID NO: 156422 - RNA, 19 nt, Homo sapiens
caucagagcuaacuuugaa

SEQ ID NO: 156423 - RNA, 19 nt, Homo sapiens
ggacagaguugaucagucu

SEQ ID NO: 156424 - RNA, 19 nt, Homo sapiens
gaaauuccucauuggauua

SEQ ID NO: 156425 - RNA, 19 nt, Homo sapiens
ggacuuugguaauugguuu

SEQ ID NO: 156426 - RNA, 19 nt, Homo sapiens
gcaaugaggucggguuuua

SEQ ID NO: 156427 - RNA, 19 nt, Homo sapiens
ccagaaagacuaugugaaa

SEQ ID NO: 156428 - RNA, 19 nt, Homo sapiens
acagagagauuacuccaaa

SEQ ID NO: 156429 - RNA, 19 nt, Homo sapiens
gaaauuugguguggaacaa

SEQ ID NO: 156430 - RNA, 19 nt, Homo sapiens
gaaguuaacccggagcuaa

SEQ ID NO: 156431 - RNA, 19 nt, Homo sapiens
gcugaugucuuaacuguca

SEQ ID NO: 156432 - RNA, 19 nt, Homo sapiens
caaguaacaucagagcuaa

SEQ ID NO: 156433 - RNA, 19 nt, Homo sapiens
uaagagcgccguuggcuuu

SEQ ID NO: 156434 - RNA, 19 nt, Homo sapiens
agaaagauguggaaagcuu

SEQ ID NO: 156435 - RNA, 19 nt, Homo sapiens
cacaggagcugccauguca

SEQ ID NO: 156436 - RNA, 19 nt, Homo sapiens
uaacaucagagcuaacuuu

SEQ ID NO: 156437 - RNA, 19 nt, Homo sapiens
ggaauauacacauugcuuu

SEQ ID NO: 156438 - RNA, 19 nt, Homo sapiens
ccaggagcauaucaacaua

SEQ ID NO: 156439 - RNA, 19 nt, Homo sapiens
gaaagaaagauguggaaag

SEQ ID NO: 156440 - RNA, 19 nt, Homo sapiens
gagauuacuccaaagguuu

SEQ ID NO: 156441 - RNA, 19 nt, Homo sapiens
ccacgaauaucagucgaaa

SEQ ID NO: 156442 - RNA, 19 nt, Homo sapiens
uaggaggacuuugguaauu

SEQ ID NO: 156443 - RNA, 19 nt, Homo sapiens
agaaggaucggauggauaa

SEQ ID NO: 156444 - RNA, 19 nt, Homo sapiens
gaagcaugccucccagaaa

SEQ ID NO: 156445 - RNA, 19 nt, Homo sapiens
gcagaaggaucggauggau

SEQ ID NO: 156446 - RNA, 19 nt, Homo sapiens
caaguuugguguccagaug

SEQ ID NO: 156447 - RNA, 19 nt, Homo sapiens
ggagaaggaacuugaaaca

SEQ ID NO: 156448 - RNA, 19 nt, Homo sapiens
ugaaugaugugagugagaa

SEQ ID NO: 156449 - RNA, 19 nt, Homo sapiens
ccacucacuuuguaggaaa

SEQ ID NO: 156450 - RNA, 19 nt, Homo sapiens
gaacccuccuccugucaau

SEQ ID NO: 156451 - RNA, 19 nt, Homo sapiens
uaagaaugcgucaaccuuu

SEQ ID NO: 156452 - RNA, 19 nt, Homo sapiens
ggaacaagaccgaauggau

SEQ ID NO: 156453 - RNA, 19 nt, Homo sapiens
gggcuuggcuuuucacaaa

SEQ ID NO: 156454 - RNA, 19 nt, Homo sapiens
gaaaggguuuggaggaaaa

SEQ ID NO: 156455 - RNA, 19 nt, Homo sapiens
gagcauaucaacauacaca

SEQ ID NO: 156456 - RNA, 19 nt, Homo sapiens
ggagcaagccagagccaaa

SEQ ID NO: 156457 - RNA, 19 nt, Homo sapiens
gagggagaaugucuuucaa

SEQ ID NO: 156458 - RNA, 19 nt, Homo sapiens
gccacagaauuugcuaaua

SEQ ID NO: 156459 - RNA, 19 nt, Homo sapiens
ggacagcaccuacgaugag

SEQ ID NO: 156460 - RNA, 19 nt, Homo sapiens
gcauggaggccgcugacua

SEQ ID NO: 156461 - RNA, 19 nt, Homo sapiens
gggaucaccaggagaaauu

SEQ ID NO: 156462 - RNA, 19 nt, Homo sapiens
agagauuacuccaaagguu

SEQ ID NO: 156463 - RNA, 19 nt, Homo sapiens
aaacagaauuucgugaaca

SEQ ID NO: 156464 - RNA, 19 nt, Homo sapiens
ggaugcggcuuccuucaag

SEQ ID NO: 156465 - RNA, 19 nt, Homo sapiens
aaaccucgcuaaggagaaa

SEQ ID NO: 156466 - RNA, 19 nt, Homo sapiens
ugaaaggguuuggaggaaa

SEQ ID NO: 156467 - RNA, 19 nt, Homo sapiens
gaagcacgagucccagaaa

SEQ ID NO: 156468 - RNA, 19 nt, Homo sapiens
ucacaaaggcugaugucuu

SEQ ID NO: 156469 - RNA, 19 nt, Homo sapiens
acaaguaacaucagagcua

SEQ ID NO: 156470 - RNA, 19 nt, Homo sapiens
gugaaaggguuuggaggaa

SEQ ID NO: 156471 - RNA, 19 nt, Homo sapiens
ucagucugcuguaggcuuu

SEQ ID NO: 156472 - RNA, 19 nt, Homo sapiens
ucaguaguuugaucaguug

SEQ ID NO: 156473 - RNA, 19 nt, Homo sapiens
aaagaaagauguggaaagc

SEQ ID NO: 156474 - RNA, 19 nt, Homo sapiens
ggaaagaaagauguggaaa

SEQ ID NO: 156475 - RNA, 19 nt, Homo sapiens
ucagggagcucgcauucuc

SEQ ID NO: 156476 - RNA, 19 nt, Homo sapiens
ggaggacuuugguaauugg

SEQ ID NO: 156477 - RNA, 19 nt, Homo sapiens
aagaaugcgucaaccuuug

SEQ ID NO: 156478 - RNA, 19 nt, Homo sapiens
caagagcaucagacccuua

SEQ ID NO: 156479 - RNA, 19 nt, Homo sapiens
gcaacuuauuguaucugaa

SEQ ID NO: 156480 - RNA, 19 nt, Homo sapiens
gagcaaugaggucggguuu

SEQ ID NO: 156481 - RNA, 19 nt, Homo sapiens
aaagacuacuccagugguu

SEQ ID NO: 156482 - RNA, 19 nt, Homo sapiens
ucacugaguccuugaaauc

SEQ ID NO: 156483 - RNA, 19 nt, Homo sapiens
gaugggaaaucugccuaug

SEQ ID NO: 156484 - RNA, 19 nt, Homo sapiens
ggagaggacugggccugau

SEQ ID NO: 156485 - RNA, 19 nt, Homo sapiens
caaaacaaguaacaucaga

SEQ ID NO: 156486 - RNA, 19 nt, Homo sapiens
agacagacaagacaaaugu

SEQ ID NO: 156487 - RNA, 19 nt, Homo sapiens
cauccuugcuuuaccacaa

SEQ ID NO: 156488 - RNA, 19 nt, Homo sapiens
gagcucgcauucucuugug

SEQ ID NO: 156489 - RNA, 19 nt, Homo sapiens
gggaauauacacauugcuu

SEQ ID NO: 156490 - RNA, 19 nt, Homo sapiens
gaagcacgagucacagaga

SEQ ID NO: 156491 - RNA, 19 nt, Homo sapiens
gagaagcacgagucacaga

SEQ ID NO: 156492 - RNA, 19 nt, Homo sapiens
gaagugcagaugagugugu

SEQ ID NO: 156493 - RNA, 19 nt, Homo sapiens
ggaaaucugccuaugucau

SEQ ID NO: 156494 - RNA, 19 nt, Homo sapiens
uaaacagaauuucgugaac

SEQ ID NO: 156495 - RNA, 19 nt, Homo sapiens
aagcaugccucccagaaag

SEQ ID NO: 156496 - RNA, 19 nt, Homo sapiens
uaucugaauuccuguagca

SEQ ID NO: 156497 - RNA, 19 nt, Homo sapiens
gcagaugaguguguguucu

SEQ ID NO: 156498 - RNA, 19 nt, Homo sapiens
caauuucaguaguuugauc

SEQ ID NO: 156499 - RNA, 19 nt, Homo sapiens
ugggaaaucugccuauguc

SEQ ID NO: 156500 - RNA, 19 nt, Homo sapiens
cuacagaucaggccuucuu

SEQ ID NO: 156501 - RNA, 19 nt, Homo sapiens
gaucucauuugacccugau

SEQ ID NO: 156502 - RNA, 19 nt, Homo sapiens
gcugagggagaaugucuuu

SEQ ID NO: 156503 - RNA, 19 nt, Homo sapiens
gcacaggagcugccauguc

SEQ ID NO: 156504 - RNA, 19 nt, Homo sapiens
gaucggauggauaagaaug

SEQ ID NO: 156505 - RNA, 19 nt, Homo sapiens
cagaaggaucggauggaua

SEQ ID NO: 156506 - RNA, 19 nt, Homo sapiens
cagaaagacuaugugaaag

SEQ ID NO: 156507 - RNA, 19 nt, Homo sapiens
gcucuucccagccaacuau

SEQ ID NO: 156508 - RNA, 19 nt, Homo sapiens
cagaggcugucuaugaaag

SEQ ID NO: 156509 - RNA, 19 nt, Homo sapiens
aaagacuacuccaaaggau

SEQ ID NO: 156510 - RNA, 19 nt, Homo sapiens
uacacaagcugagggagaa

SEQ ID NO: 156511 - RNA, 19 nt, Homo sapiens
uuaaggagaaggaacuuga

SEQ ID NO: 156512 - RNA, 19 nt, Homo sapiens
aggcugaugucuuaacugu

SEQ ID NO: 156513 - RNA, 19 nt, Homo sapiens
acaaggacaaaguggauaa

SEQ ID NO: 156514 - RNA, 19 nt, Homo sapiens
aacaagaccgaauggauaa

SEQ ID NO: 156515 - RNA, 19 nt, Homo sapiens
ggaaauuugguguggaaca

SEQ ID NO: 156516 - RNA, 19 nt, Homo sapiens
gacaaaugcuuccuuaaug

SEQ ID NO: 156517 - RNA, 19 nt, Homo sapiens
gaacacgccuuugagaaga

SEQ ID NO: 156518 - RNA, 19 nt, Homo sapiens
gaucauagacuuacuaaag

SEQ ID NO: 156519 - RNA, 19 nt, Homo sapiens
caagaaaugugcagucugu

SEQ ID NO: 156520 - RNA, 19 nt, Homo sapiens
gaaguaggcucagcgauag

SEQ ID NO: 156521 - RNA, 19 nt, Homo sapiens
ggcagaagcuggaggaaga

SEQ ID NO: 156522 - RNA, 19 nt, Homo sapiens
gaaaugugcagucuguaaa

SEQ ID NO: 156523 - RNA, 19 nt, Homo sapiens
gacauucccuuuccuaaca

SEQ ID NO: 156524 - RNA, 19 nt, Homo sapiens
ugaaaugcauguagcaguu

SEQ ID NO: 156525 - RNA, 19 nt, Homo sapiens
gcacugaguuucuauucca

SEQ ID NO: 156526 - RNA, 19 nt, Homo sapiens
gcaaacuucuccuuucagu

SEQ ID NO: 156527 - RNA, 19 nt, Homo sapiens
gaugcaaacuucuccuuuc

SEQ ID NO: 156528 - RNA, 19 nt, Homo sapiens
ugaaguaggcucagcgaua

SEQ ID NO: 156529 - RNA, 19 nt, Homo sapiens
cuaaagagagugacaaaug

SEQ ID NO: 156530 - RNA, 19 nt, Homo sapiens
uaaagaggcagcugaguga

SEQ ID NO: 156531 - RNA, 19 nt, Homo sapiens
aaagggacgcaccauauua

SEQ ID NO: 156532 - RNA, 19 nt, Homo sapiens
caagaaguaugucaauguc

SEQ ID NO: 156533 - RNA, 19 nt, Homo sapiens
ccuaacauccugaggcuua

SEQ ID NO: 156534 - RNA, 19 nt, Homo sapiens
gacgugaccucagaugauu

SEQ ID NO: 156535 - RNA, 19 nt, Homo sapiens
caagaugauuggcagguau

SEQ ID NO: 156536 - RNA, 19 nt, Homo sapiens
aaauagacgugaccucaga

SEQ ID NO: 156537 - RNA, 19 nt, Homo sapiens
acaaaugcuuccuuaaugu

SEQ ID NO: 156538 - RNA, 19 nt, Homo sapiens
gaccgaaaaugaauuguaa

SEQ ID NO: 156539 - RNA, 19 nt, Homo sapiens
ggagagagagaaagagaga

SEQ ID NO: 156540 - RNA, 19 nt, Homo sapiens
uaaagagagugacaaaugc

SEQ ID NO: 156541 - RNA, 19 nt, Homo sapiens
gauaccuucugaugucaaa

SEQ ID NO: 156542 - RNA, 19 nt, Homo sapiens
gcagguauuccguuuauca

SEQ ID NO: 156543 - RNA, 19 nt, Homo sapiens
ugacaaaugcuuccuuaau

SEQ ID NO: 156544 - RNA, 19 nt, Homo sapiens
cauauuaaccgguggagaa

SEQ ID NO: 156545 - RNA, 19 nt, Homo sapiens
gcacucagcuacgcuaacu

SEQ ID NO: 156546 - RNA, 19 nt, Homo sapiens
ggcgaaugguguuuaaaga

SEQ ID NO: 156547 - RNA, 19 nt, Homo sapiens
agaaguaugucaaugucaa

SEQ ID NO: 156548 - RNA, 19 nt, Homo sapiens
agugacaaaugcuuccuua

SEQ ID NO: 156549 - RNA, 19 nt, Homo sapiens
gaaauuggccgaguucaac

SEQ ID NO: 156550 - RNA, 19 nt, Homo sapiens
ggagggagagagagaaaga

SEQ ID NO: 156551 - RNA, 19 nt, Homo sapiens
ggaagaaggcucagauucg

SEQ ID NO: 156552 - RNA, 19 nt, Homo sapiens
ggaacacgccuuugagaag

SEQ ID NO: 156553 - RNA, 19 nt, Homo sapiens
guaaaaguaugguuucaga

SEQ ID NO: 156554 - RNA, 19 nt, Homo sapiens
ccaagaaguaugucaaugu

SEQ ID NO: 156555 - RNA, 19 nt, Homo sapiens
guucaaccauucacugcaa

SEQ ID NO: 156556 - RNA, 19 nt, Homo sapiens
gaacgugcacucugacaag

SEQ ID NO: 156557 - RNA, 19 nt, Homo sapiens
caagaucauagacuuacua

SEQ ID NO: 156558 - RNA, 19 nt, Homo sapiens
cuaacacacuauauacuuc

SEQ ID NO: 156559 - RNA, 19 nt, Homo sapiens
guuuaucacaguccacuua

SEQ ID NO: 156560 - RNA, 19 nt, Homo sapiens
acaacgcgcuggcccgaaa

SEQ ID NO: 156561 - RNA, 19 nt, Homo sapiens
uggcagguauuccguuuau

SEQ ID NO: 156562 - RNA, 19 nt, Homo sapiens
acagagagaaggagaaaga

SEQ ID NO: 156563 - RNA, 19 nt, Homo sapiens
ccacagaaacggacaacau

SEQ ID NO: 156564 - RNA, 19 nt, Homo sapiens
ggaaugcggcgaagacucu

SEQ ID NO: 156565 - RNA, 19 nt, Homo sapiens
ucacggaaacucagguaaa

SEQ ID NO: 156566 - RNA, 19 nt, Homo sapiens
gaguuucuauuccaagauc

SEQ ID NO: 156567 - RNA, 19 nt, Homo sapiens
ggagaaauuggccgaguuc

SEQ ID NO: 156568 - RNA, 19 nt, Homo sapiens
agaaaugugcagucuguaa

SEQ ID NO: 156569 - RNA, 19 nt, Homo sapiens
caaccaggcacaggacuuu

SEQ ID NO: 156570 - RNA, 19 nt, Homo sapiens
caaugccuauuccaaacuu

SEQ ID NO: 156571 - RNA, 19 nt, Homo sapiens
ggaggaagaaggcucagau

SEQ ID NO: 156572 - RNA, 19 nt, Homo sapiens
cuuaaugucuucuauacca

SEQ ID NO: 156573 - RNA, 19 nt, Homo sapiens
acaagaugauuggcaggua

SEQ ID NO: 156574 - RNA, 19 nt, Homo sapiens
aaagagagagaaagagaga

SEQ ID NO: 156575 - RNA, 19 nt, Homo sapiens
agaaagagagagaaagaga

SEQ ID NO: 156576 - RNA, 19 nt, Homo sapiens
gaggaagaaggcucagauu

SEQ ID NO: 156577 - RNA, 19 nt, Homo sapiens
gaaaugcauguagcaguug

SEQ ID NO: 156578 - RNA, 19 nt, Homo sapiens
ucccacaccuguuucaaau

SEQ ID NO: 156579 - RNA, 19 nt, Homo sapiens
agggagagguggagaagga

SEQ ID NO: 156580 - RNA, 19 nt, Homo sapiens
ccauaaauccguuccucaa

SEQ ID NO: 156581 - RNA, 19 nt, Homo sapiens
agagaaagagagagaaaga

SEQ ID NO: 156582 - RNA, 19 nt, Homo sapiens
aaagagagagagagagaga

SEQ ID NO: 156583 - RNA, 19 nt, Homo sapiens
agaaagagagagagagaga

SEQ ID NO: 156584 - RNA, 19 nt, Homo sapiens
aagcgacccucgucuaaag

SEQ ID NO: 156585 - RNA, 19 nt, Homo sapiens
cauacacguucaccgagaa

SEQ ID NO: 156586 - RNA, 19 nt, Homo sapiens
acaagcgacccucgucuaa

SEQ ID NO: 156587 - RNA, 19 nt, Homo sapiens
uuucagaaccgaagaacaa

SEQ ID NO: 156588 - RNA, 19 nt, Homo sapiens
gaaguaugucaaugucaau

SEQ ID NO: 156589 - RNA, 19 nt, Homo sapiens
ggacauucccuuuccuaac

SEQ ID NO: 156590 - RNA, 19 nt, Homo sapiens
gauugugcaagcuaaauga

SEQ ID NO: 156591 - RNA, 19 nt, Homo sapiens
ccacaccuguuucaaaucc

SEQ ID NO: 156592 - RNA, 19 nt, Homo sapiens
agagagagagagagagaaa

SEQ ID NO: 156593 - RNA, 19 nt, Homo sapiens
cgauagugguccucuuaca

SEQ ID NO: 156594 - RNA, 19 nt, Homo sapiens
gaggcuccuucaucaacaa

SEQ ID NO: 156595 - RNA, 19 nt, Homo sapiens
cacuauauacuuccaagaa

SEQ ID NO: 156596 - RNA, 19 nt, Homo sapiens
aaaagaaucaggacuugua

SEQ ID NO: 156597 - RNA, 19 nt, Homo sapiens
uuugauaccuucugauguc

SEQ ID NO: 156598 - RNA, 19 nt, Homo sapiens
caagauggcagaggaugga

SEQ ID NO: 156599 - RNA, 19 nt, Homo sapiens
aagggacgcaccauauuaa

SEQ ID NO: 156600 - RNA, 19 nt, Homo sapiens
uggagaaauuggccgaguu

SEQ ID NO: 156601 - RNA, 19 nt, Homo sapiens
gggcgaaugguguuuaaag

SEQ ID NO: 156602 - RNA, 19 nt, Homo sapiens
ggagagguggagaaggaaa

SEQ ID NO: 156603 - RNA, 19 nt, Homo sapiens
aaacccugaugcaaacuuc

SEQ ID NO: 156604 - RNA, 19 nt, Homo sapiens
aaagagggagggagagaga

SEQ ID NO: 156605 - RNA, 19 nt, Homo sapiens
caagcgacccucgucuaaa

SEQ ID NO: 156606 - RNA, 19 nt, Homo sapiens
cuaacauccugaggcuuaa

SEQ ID NO: 156607 - RNA, 19 nt, Homo sapiens
aauccacgccugcaaauuc

SEQ ID NO: 156608 - RNA, 19 nt, Homo sapiens
ugcagucuguaaacacuuu

SEQ ID NO: 156609 - RNA, 19 nt, Homo sapiens
cacagaaacggacaacaug

SEQ ID NO: 156610 - RNA, 19 nt, Homo sapiens
ucauagacuuacuaaagag

SEQ ID NO: 156611 - RNA, 19 nt, Homo sapiens
ugugcaagcuaaaugaagu

SEQ ID NO: 156612 - RNA, 19 nt, Homo sapiens
agagaaagagagagagaga

SEQ ID NO: 156613 - RNA, 19 nt, Homo sapiens
agagagaaagagagagaaa

SEQ ID NO: 156614 - RNA, 19 nt, Homo sapiens
acacagagagaaggagaaa

SEQ ID NO: 156615 - RNA, 19 nt, Homo sapiens
cagaaacggacaacaugga

SEQ ID NO: 156616 - RNA, 19 nt, Homo sapiens
gaagauggcuagacuuuaa

SEQ ID NO: 156617 - RNA, 19 nt, Homo sapiens
ccaggaagcugaagaagaa

SEQ ID NO: 156618 - RNA, 19 nt, Homo sapiens
ggagacuuguugagaaaua

SEQ ID NO: 156619 - RNA, 19 nt, Homo sapiens
uaagauccauucucuauuc

SEQ ID NO: 156620 - RNA, 19 nt, Homo sapiens
gauccgagcugucagagau

SEQ ID NO: 156621 - RNA, 19 nt, Homo sapiens
gcauuucucuaacaaguug

SEQ ID NO: 156622 - RNA, 19 nt, Homo sapiens
ccaaaccgcuuacgaccuu

SEQ ID NO: 156623 - RNA, 19 nt, Homo sapiens
gcaaagauccgagcuguca

SEQ ID NO: 156624 - RNA, 19 nt, Homo sapiens
gcgagaguguguuuccuuu

SEQ ID NO: 156625 - RNA, 19 nt, Homo sapiens
gaaagagagccucagaaug

SEQ ID NO: 156626 - RNA, 19 nt, Homo sapiens
gagcgcagggcaccaaaua

SEQ ID NO: 156627 - RNA, 19 nt, Homo sapiens
aaagagagccucagaaugg

SEQ ID NO: 156628 - RNA, 19 nt, Homo sapiens
cuuacgaccuuguauauau

SEQ ID NO: 156629 - RNA, 19 nt, Homo sapiens
ggaagauggcuagacuuua

SEQ ID NO: 156630 - RNA, 19 nt, Homo sapiens
ggagagacagcgagaucua

SEQ ID NO: 156631 - RNA, 19 nt, Homo sapiens
ccaagugucuccauaucug

SEQ ID NO: 156632 - RNA, 19 nt, Homo sapiens
ggcuagacuuuaaauacua

SEQ ID NO: 156633 - RNA, 19 nt, Homo sapiens
gcagcagccucucguaugg

SEQ ID NO: 156634 - RNA, 19 nt, Homo sapiens
gaacagcagccggaaccua

SEQ ID NO: 156635 - RNA, 19 nt, Homo sapiens
guguagcgaucucuauuug

SEQ ID NO: 156636 - RNA, 19 nt, Homo sapiens
caacccggcuauccuacuu

SEQ ID NO: 156637 - RNA, 19 nt, Homo sapiens
gcaccgcaccaccaacuuu

SEQ ID NO: 156638 - RNA, 19 nt, Homo sapiens
gaauggacaaugacguuga

SEQ ID NO: 156639 - RNA, 19 nt, Homo sapiens
cgagagagacagaaagaga

SEQ ID NO: 156640 - RNA, 19 nt, Homo sapiens
aaaccuguagucugaaaua

SEQ ID NO: 156641 - RNA, 19 nt, Homo sapiens
ccggagacuuguugagaaa

SEQ ID NO: 156642 - RNA, 19 nt, Homo sapiens
gcaccaggaagcugaagaa

SEQ ID NO: 156643 - RNA, 19 nt, Homo sapiens
gacccauaauccugcauuu

SEQ ID NO: 156644 - RNA, 19 nt, Homo sapiens
agaaaccuguagucugaaa

SEQ ID NO: 156645 - RNA, 19 nt, Homo sapiens
aaacugcgaacuccuuaaa

SEQ ID NO: 156646 - RNA, 19 nt, Homo sapiens
cgaaacugcgaacuccuua

SEQ ID NO: 156647 - RNA, 19 nt, Homo sapiens
gagaguguguuuccuuucg

SEQ ID NO: 156648 - RNA, 19 nt, Homo sapiens
agaaagagagccucagaau

SEQ ID NO: 156649 - RNA, 19 nt, Homo sapiens
gaaaagagcgagagagaca

SEQ ID NO: 156650 - RNA, 19 nt, Homo sapiens
gcgccaagaucaagaaagc

SEQ ID NO: 156651 - RNA, 19 nt, Homo sapiens
gaaacugcgaacuccuuaa

SEQ ID NO: 156652 - RNA, 19 nt, Homo sapiens
agaagaagaagaacgagaa

SEQ ID NO: 156653 - RNA, 19 nt, Homo sapiens
ccacagacugcgagacuga

SEQ ID NO: 156654 - RNA, 19 nt, Homo sapiens
guagcgaucucuauuugcu

SEQ ID NO: 156655 - RNA, 19 nt, Homo sapiens
aaagcucuaucuagccaaa

SEQ ID NO: 156656 - RNA, 19 nt, Homo sapiens
ugaagaagaagaagaacga

SEQ ID NO: 156657 - RNA, 19 nt, Homo sapiens
ggaagcugaagaagaagaa

SEQ ID NO: 156658 - RNA, 19 nt, Homo sapiens
gaaagccacaggcaucaag

SEQ ID NO: 156659 - RNA, 19 nt, Homo sapiens
ucggacaggugcuaucgaa

SEQ ID NO: 156660 - RNA, 19 nt, Homo sapiens
agaagaagaacgagaagga

SEQ ID NO: 156661 - RNA, 19 nt, Homo sapiens
ggacaggugcuaucgaaaa

SEQ ID NO: 156662 - RNA, 19 nt, Homo sapiens
cagaauggacaaugacguu

SEQ ID NO: 156663 - RNA, 19 nt, Homo sapiens
caaguuguuuauggaguug

SEQ ID NO: 156664 - RNA, 19 nt, Homo sapiens
caaauuagagagggagaga

SEQ ID NO: 156665 - RNA, 19 nt, Homo sapiens
gacgcgcucucccugcaaa

SEQ ID NO: 156666 - RNA, 19 nt, Homo sapiens
gaagaagaagaacgagaag

SEQ ID NO: 156667 - RNA, 19 nt, Homo sapiens
gauggcuagacuuuaaaua

SEQ ID NO: 156668 - RNA, 19 nt, Homo sapiens
aagcaaaggcgauuaaagg

SEQ ID NO: 156669 - RNA, 19 nt, Homo sapiens
gcuuacgaccuuguauaua

SEQ ID NO: 156670 - RNA, 19 nt, Homo sapiens
uaucuagccaaaccgcuua

SEQ ID NO: 156671 - RNA, 19 nt, Homo sapiens
gagcagcugcagagacuca

SEQ ID NO: 156672 - RNA, 19 nt, Homo sapiens
ccucacuacugccuaggaa

SEQ ID NO: 156673 - RNA, 19 nt, Homo sapiens
gcuacaagccaaagauuuu

SEQ ID NO: 156674 - RNA, 19 nt, Homo sapiens
aggaagauggcuagacuuu

SEQ ID NO: 156675 - RNA, 19 nt, Homo sapiens
aauggacaaugacguugaa

SEQ ID NO: 156676 - RNA, 19 nt, Homo sapiens
gauaagaacgagcgaucca

SEQ ID NO: 156677 - RNA, 19 nt, Homo sapiens
gagagacagcgagaucuau

SEQ ID NO: 156678 - RNA, 19 nt, Homo sapiens
ucuggaugucuacaaauua

SEQ ID NO: 156679 - RNA, 19 nt, Homo sapiens
uggcuagacuuuaaauacu

SEQ ID NO: 156680 - RNA, 19 nt, Homo sapiens
ucacuacugccuaggaaga

SEQ ID NO: 156681 - RNA, 19 nt, Homo sapiens
ucuauuugcuggacauuuu

SEQ ID NO: 156682 - RNA, 19 nt, Homo sapiens
gauuauuuauccgcaaagu

SEQ ID NO: 156683 - RNA, 19 nt, Homo sapiens
ccgcuuacgaccuuguaua

SEQ ID NO: 156684 - RNA, 19 nt, Homo sapiens
ucacgugcuuccgguuuga

SEQ ID NO: 156685 - RNA, 19 nt, Homo sapiens
caaagacgagagcgaguag

SEQ ID NO: 156686 - RNA, 19 nt, Homo sapiens
acaaagacgagagcgagua

SEQ ID NO: 156687 - RNA, 19 nt, Homo sapiens
aggcggaguuccaggcaaa

SEQ ID NO: 156688 - RNA, 19 nt, Homo sapiens
ccgagcagcugcagagacu

SEQ ID NO: 156689 - RNA, 19 nt, Homo sapiens
cuggaugucuacaaauuag

SEQ ID NO: 156690 - RNA, 19 nt, Homo sapiens
cugcauuucucuaacaagu

SEQ ID NO: 156691 - RNA, 19 nt, Homo sapiens
gccucagaauggacaauga

SEQ ID NO: 156692 - RNA, 19 nt, Homo sapiens
caacgagucccagaucaag

SEQ ID NO: 156693 - RNA, 19 nt, Homo sapiens
aacagcagccggaaccuaa

SEQ ID NO: 156694 - RNA, 19 nt, Homo sapiens
ggccgagcauggaagaaca

SEQ ID NO: 156695 - RNA, 19 nt, Homo sapiens
auaucuggaugucuacaaa

SEQ ID NO: 156696 - RNA, 19 nt, Homo sapiens
gcucacagacccauaaucc

SEQ ID NO: 156697 - RNA, 19 nt, Homo sapiens
ggcccugacucacgugcuu

SEQ ID NO: 156698 - RNA, 19 nt, Homo sapiens
auagccaagugucuccaua

SEQ ID NO: 156699 - RNA, 19 nt, Homo sapiens
gagacuuguugagaaauac

SEQ ID NO: 156700 - RNA, 19 nt, Homo sapiens
ccauaauccugcauuucuc

SEQ ID NO: 156701 - RNA, 19 nt, Homo sapiens
cgaacuccuuaaagcucua

SEQ ID NO: 156702 - RNA, 19 nt, Homo sapiens
cauucucuauucccaguau

SEQ ID NO: 156703 - RNA, 19 nt, Homo sapiens
cagaaagagagccucagaa

SEQ ID NO: 156704 - RNA, 19 nt, Homo sapiens
caaaucauugaaucugguu

SEQ ID NO: 156705 - RNA, 19 nt, Homo sapiens
aaccuguagucugaaauaa

SEQ ID NO: 156706 - RNA, 19 nt, Homo sapiens
acagaaagagagccucaga

SEQ ID NO: 156707 - RNA, 19 nt, Homo sapiens
caggcaaaccgcuacauca

SEQ ID NO: 156708 - RNA, 19 nt, Homo sapiens
gaagucaaaccccucacua

SEQ ID NO: 156709 - RNA, 19 nt, Homo sapiens
ggccagacgccugagcuuu

SEQ ID NO: 156710 - RNA, 19 nt, Homo sapiens
uccggagacuuguugagaa

SEQ ID NO: 156711 - RNA, 19 nt, Homo sapiens
gaacgagaaggaggacaag

SEQ ID NO: 156712 - RNA, 19 nt, Homo sapiens
cggcaacccggcuauccua

SEQ ID NO: 156713 - RNA, 19 nt, Homo sapiens
aagugugccugggugauuu

SEQ ID NO: 156714 - RNA, 19 nt, Homo sapiens
cguguagcgaucucuauuu

SEQ ID NO: 156715 - RNA, 19 nt, Homo sapiens
aaagauccgagcugucaga

SEQ ID NO: 156716 - RNA, 19 nt, Homo sapiens
ggaagaaaguguguaaaua

SEQ ID NO: 156717 - RNA, 19 nt, Homo sapiens
uagcuaagguucugaaaua

SEQ ID NO: 156718 - RNA, 19 nt, Homo sapiens
ccaaguaccuauauaugua

SEQ ID NO: 156719 - RNA, 19 nt, Homo sapiens
gcacacacacgcacacuua

SEQ ID NO: 156720 - RNA, 19 nt, Homo sapiens
acaggaagcugccggguua

SEQ ID NO: 156721 - RNA, 19 nt, Homo sapiens
gcaaggaauugugggauuu

SEQ ID NO: 156722 - RNA, 19 nt, Homo sapiens
ggacuuggcucuguugaau

SEQ ID NO: 156723 - RNA, 19 nt, Homo sapiens
gaaggaagaaaguguguaa

SEQ ID NO: 156724 - RNA, 19 nt, Homo sapiens
gaaacucaaugaaaugaca

SEQ ID NO: 156725 - RNA, 19 nt, Homo sapiens
ccacaguucugaaacaugu

SEQ ID NO: 156726 - RNA, 19 nt, Homo sapiens
gcuccuauuuggucuauga

SEQ ID NO: 156727 - RNA, 19 nt, Homo sapiens
gccgaaggcugauuuggaa

SEQ ID NO: 156728 - RNA, 19 nt, Homo sapiens
ggcagcucauuuaauauua

SEQ ID NO: 156729 - RNA, 19 nt, Homo sapiens
gcaaaguugguuucuguuu

SEQ ID NO: 156730 - RNA, 19 nt, Homo sapiens
cuaagguucugaaauauuc

SEQ ID NO: 156731 - RNA, 19 nt, Homo sapiens
ggccauggcucacuguuuc

SEQ ID NO: 156732 - RNA, 19 nt, Homo sapiens
gagaaccagugugggauuu

SEQ ID NO: 156733 - RNA, 19 nt, Homo sapiens
auaaagggccaguguauaa

SEQ ID NO: 156734 - RNA, 19 nt, Homo sapiens
agucuuagcugaacaguca

SEQ ID NO: 156735 - RNA, 19 nt, Homo sapiens
gaagaagaacccgaacaaa

SEQ ID NO: 156736 - RNA, 19 nt, Homo sapiens
ggaaagaccaauccaacug

SEQ ID NO: 156737 - RNA, 19 nt, Homo sapiens
agaagaacccgaacaaaga

SEQ ID NO: 156738 - RNA, 19 nt, Homo sapiens
cgaguggccuggaaauuuc

SEQ ID NO: 156739 - RNA, 19 nt, Homo sapiens
cucggcagcucauuuaaua

SEQ ID NO: 156740 - RNA, 19 nt, Homo sapiens
aagcaaaguugguuucugu

SEQ ID NO: 156741 - RNA, 19 nt, Homo sapiens
agucacagaucaagauuug

SEQ ID NO: 156742 - RNA, 19 nt, Homo sapiens
caacugugcuuaucaaaau

SEQ ID NO: 156743 - RNA, 19 nt, Homo sapiens
ugaaacauguggcuaccuu

SEQ ID NO: 156744 - RNA, 19 nt, Homo sapiens
caucaucuaucuuccuuuc

SEQ ID NO: 156745 - RNA, 19 nt, Homo sapiens
gaauaaccaucugcugcuu

SEQ ID NO: 156746 - RNA, 19 nt, Homo sapiens
gaaagaccaauccaacugu

SEQ ID NO: 156747 - RNA, 19 nt, Homo sapiens
acugugaaccgaauaaaua

SEQ ID NO: 156748 - RNA, 19 nt, Homo sapiens
gaacacacacacacacaca

SEQ ID NO: 156749 - RNA, 19 nt, Homo sapiens
acacgcacacuuacaauaa

SEQ ID NO: 156750 - RNA, 19 nt, Homo sapiens
uuacaacugugcuuaucaa

SEQ ID NO: 156751 - RNA, 19 nt, Homo sapiens
ccuaagcuccauuauauga

SEQ ID NO: 156752 - RNA, 19 nt, Homo sapiens
gcgcuaaacaaugcaauaa

SEQ ID NO: 156753 - RNA, 19 nt, Homo sapiens
gcuaagguucugaaauauu

SEQ ID NO: 156754 - RNA, 19 nt, Homo sapiens
gcacgguggcgccaagaaa

SEQ ID NO: 156755 - RNA, 19 nt, Homo sapiens
uaacccaguucguggauuc

SEQ ID NO: 156756 - RNA, 19 nt, Homo sapiens
uaucucggcagcucauuua

SEQ ID NO: 156757 - RNA, 19 nt, Homo sapiens
caaaguugguuucuguuuu

SEQ ID NO: 156758 - RNA, 19 nt, Homo sapiens
gaagcaaaguugguuucug

SEQ ID NO: 156759 - RNA, 19 nt, Homo sapiens
ggauuucucccuucgcaaa

SEQ ID NO: 156760 - RNA, 19 nt, Homo sapiens
gccacacugucuucuguuu

SEQ ID NO: 156761 - RNA, 19 nt, Homo sapiens
gguaaacaauauggaaauc

SEQ ID NO: 156762 - RNA, 19 nt, Homo sapiens
ccuccaggaucuagaagaa

SEQ ID NO: 156763 - RNA, 19 nt, Homo sapiens
cuccgaggcuccuggauuu

SEQ ID NO: 156764 - RNA, 19 nt, Homo sapiens
gaaccagugugggauuuac

SEQ ID NO: 156765 - RNA, 19 nt, Homo sapiens
ugucuucuguuuaguguau

SEQ ID NO: 156766 - RNA, 19 nt, Homo sapiens
ccacacugucuucuguuua

SEQ ID NO: 156767 - RNA, 19 nt, Homo sapiens
ccaccaaguaccuauauau

SEQ ID NO: 156768 - RNA, 19 nt, Homo sapiens
guggcuaccuugucuuuca

SEQ ID NO: 156769 - RNA, 19 nt, Homo sapiens
cauaaagggccaguguaua

SEQ ID NO: 156770 - RNA, 19 nt, Homo sapiens
gcaagucggacagcgagua

SEQ ID NO: 156771 - RNA, 19 nt, Homo sapiens
gaagaacccgaacaaagag

SEQ ID NO: 156772 - RNA, 19 nt, Homo sapiens
aaggaaagcggaccacaaa

SEQ ID NO: 156773 - RNA, 19 nt, Homo sapiens
aaucagaguagagaaguua

SEQ ID NO: 156774 - RNA, 19 nt, Homo sapiens
uugcugaaguccaaagauu

SEQ ID NO: 156775 - RNA, 19 nt, Homo sapiens
gggccaguguauaaagauu

SEQ ID NO: 156776 - RNA, 19 nt, Homo sapiens
gcaggaagcaaaguugguu

SEQ ID NO: 156777 - RNA, 19 nt, Homo sapiens
ggccaguguauaaagauua

SEQ ID NO: 156778 - RNA, 19 nt, Homo sapiens
ggagaaccagugugggauu

SEQ ID NO: 156779 - RNA, 19 nt, Homo sapiens
ccgaguggccuggaaauuu

SEQ ID NO: 156780 - RNA, 19 nt, Homo sapiens
ggcaucaucuaucuuccuu

SEQ ID NO: 156781 - RNA, 19 nt, Homo sapiens
uaagcuccauuauaugaca

SEQ ID NO: 156782 - RNA, 19 nt, Homo sapiens
ccccuaagcuccauuauau

SEQ ID NO: 156783 - RNA, 19 nt, Homo sapiens
ugaacagcauggaggagaa

SEQ ID NO: 156784 - RNA, 19 nt, Homo sapiens
cggcagcucauuuaauauu

SEQ ID NO: 156785 - RNA, 19 nt, Homo sapiens
auaccagcauuaauaguga

SEQ ID NO: 156786 - RNA, 19 nt, Homo sapiens
ggaucuagaagaaggaaga

SEQ ID NO: 156787 - RNA, 19 nt, Homo sapiens
uaaagggccaguguauaaa

SEQ ID NO: 156788 - RNA, 19 nt, Homo sapiens
caaucagaguagagaaguu

SEQ ID NO: 156789 - RNA, 19 nt, Homo sapiens
caaggaaagcggaccacaa

SEQ ID NO: 156790 - RNA, 19 nt, Homo sapiens
agggugaacuucgcucuuu

SEQ ID NO: 156791 - RNA, 19 nt, Homo sapiens
uauaugacauuggacacuu

SEQ ID NO: 156792 - RNA, 19 nt, Homo sapiens
ucauaaagggccaguguau

SEQ ID NO: 156793 - RNA, 19 nt, Homo sapiens
agaagaagaacccgaacaa

SEQ ID NO: 156794 - RNA, 19 nt, Homo sapiens
agugugggauuuacuguga

SEQ ID NO: 156795 - RNA, 19 nt, Homo sapiens
cacacugucuucuguuuag

SEQ ID NO: 156796 - RNA, 19 nt, Homo sapiens
aagaagaacccgaacaaag

SEQ ID NO: 156797 - RNA, 19 nt, Homo sapiens
cagccagggucccagaaau

SEQ ID NO: 156798 - RNA, 19 nt, Homo sapiens
caaauggagccgcauacug

SEQ ID NO: 156799 - RNA, 19 nt, Homo sapiens
gaaaaccaaagaagaagaa

SEQ ID NO: 156800 - RNA, 19 nt, Homo sapiens
cuuaggaaacucaaugaaa

SEQ ID NO: 156801 - RNA, 19 nt, Homo sapiens
ccuauuuggucuaugacuu

SEQ ID NO: 156802 - RNA, 19 nt, Homo sapiens
gggugaacuucgcucuuug

SEQ ID NO: 156803 - RNA, 19 nt, Homo sapiens
caauccaacuguccaucug

SEQ ID NO: 156804 - RNA, 19 nt, Homo sapiens
gaacagcauggaggagaau

SEQ ID NO: 156805 - RNA, 19 nt, Homo sapiens
ggaccacugcgacugucua

SEQ ID NO: 156806 - RNA, 19 nt, Homo sapiens
ugacuucugccacuuuguu

SEQ ID NO: 156807 - RNA, 19 nt, Homo sapiens
ugcaaggaauugugggauu

SEQ ID NO: 156808 - RNA, 19 nt, Homo sapiens
aaugaaaugacaugccuuu

SEQ ID NO: 156809 - RNA, 19 nt, Homo sapiens
ucaauauauuucccaccaa

SEQ ID NO: 156810 - RNA, 19 nt, Homo sapiens
uaugacuucugccacuuug

SEQ ID NO: 156811 - RNA, 19 nt, Homo sapiens
caacugugaaccgaauaaa

SEQ ID NO: 156812 - RNA, 19 nt, Homo sapiens
ggccgaaggcugauuugga

SEQ ID NO: 156813 - RNA, 19 nt, Homo sapiens
gagggccgaaggcugauuu

SEQ ID NO: 156814 - RNA, 19 nt, Homo sapiens
caccaaguaccuauauaug

SEQ ID NO: 156815 - RNA, 19 nt, Homo sapiens
uauaccagcauuaauagug

SEQ ID NO: 156816 - RNA, 19 nt, Homo sapiens
ggaacaaccuggagaaaua

SEQ ID NO: 156817 - RNA, 19 nt, Homo sapiens
gaugggaaauccuacguaa

SEQ ID NO: 156818 - RNA, 19 nt, Homo sapiens
gaagggaggucacgcuauc

SEQ ID NO: 156819 - RNA, 19 nt, Homo sapiens
gacagaggcugaugggaaa

SEQ ID NO: 156820 - RNA, 19 nt, Homo sapiens
cgacgcggcuccuuuaaga

SEQ ID NO: 156821 - RNA, 19 nt, Homo sapiens
ggaaauccuacguaaagua

SEQ ID NO: 156822 - RNA, 19 nt, Homo sapiens
aaauauagccgcagcuuga

SEQ ID NO: 156823 - RNA, 19 nt, Homo sapiens
aaauugagcuccgcaccua

SEQ ID NO: 156824 - RNA, 19 nt, Homo sapiens
gaacaaccuggagaaauau

SEQ ID NO: 156825 - RNA, 19 nt, Homo sapiens
gaaauccuacguaaaguac

SEQ ID NO: 156826 - RNA, 19 nt, Homo sapiens
ccacacacuucuucaaggu

SEQ ID NO: 156827 - RNA, 19 nt, Homo sapiens
ggcagcaggugggcaaauu

SEQ ID NO: 156828 - RNA, 19 nt, Homo sapiens
ccaacgcaccuguggauga

SEQ ID NO: 156829 - RNA, 19 nt, Homo sapiens
caacgcaccuguggaugag

SEQ ID NO: 156830 - RNA, 19 nt, Homo sapiens
ucaagagccgcgagucgua

SEQ ID NO: 156831 - RNA, 19 nt, Homo sapiens
cgggcgaguuggccaagua

SEQ ID NO: 156832 - RNA, 19 nt, Homo sapiens
agucguacgugcugugcua

SEQ ID NO: 156833 - RNA, 19 nt, Homo sapiens
gggaaauccuacguaaagu

SEQ ID NO: 156834 - RNA, 19 nt, Homo sapiens
ggaagggaggucacgcuau

SEQ ID NO: 156835 - RNA, 19 nt, Homo sapiens
guauuaaagguggugauuu

SEQ ID NO: 156836 - RNA, 19 nt, Homo sapiens
gcagcaggugggcaaauug

SEQ ID NO: 156837 - RNA, 19 nt, Homo sapiens
ugggaaauccuacguaaag

SEQ ID NO: 156838 - RNA, 19 nt, Homo sapiens
cagcaggugggcaaauuga

SEQ ID NO: 156839 - RNA, 19 nt, Homo sapiens
gcacagggccacucuuccu

SEQ ID NO: 156840 - RNA, 19 nt, Homo sapiens
gcuccgcaccuacgugaug

SEQ ID NO: 156841 - RNA, 19 nt, Homo sapiens
gcccaacgcaccuguggau

SEQ ID NO: 156842 - RNA, 19 nt, Homo sapiens
ccauggacgacacguucua

SEQ ID NO: 156843 - RNA, 19 nt, Homo sapiens
gaacugagcugggcaggaa

SEQ ID NO: 156844 - RNA, 19 nt, Homo sapiens
ccacagagcugccauccuu

SEQ ID NO: 156845 - RNA, 19 nt, Homo sapiens
gaacuugccuaacuaacug

SEQ ID NO: 156846 - RNA, 19 nt, Homo sapiens
ccaagucccugucauuuga

SEQ ID NO: 156847 - RNA, 19 nt, Homo sapiens
ggacaggggugacaaguuu

SEQ ID NO: 156848 - RNA, 19 nt, Homo sapiens
cagaaacaguccauuguga

SEQ ID NO: 156849 - RNA, 19 nt, Homo sapiens
gaagggagaacuugaaaca

SEQ ID NO: 156850 - RNA, 19 nt, Homo sapiens
gaggugacauauaccacua

SEQ ID NO: 156851 - RNA, 19 nt, Homo sapiens
caaguaugaucagcaauga

SEQ ID NO: 156852 - RNA, 19 nt, Homo sapiens
ccauaggacugucuucaug

SEQ ID NO: 156853 - RNA, 19 nt, Homo sapiens
caauaaaucagaccaugaa

SEQ ID NO: 156854 - RNA, 19 nt, Homo sapiens
gcaaguaugaucagcaaug

SEQ ID NO: 156855 - RNA, 19 nt, Homo sapiens
gagaauacuccuucaagau

SEQ ID NO: 156856 - RNA, 19 nt, Homo sapiens
gcaaugaggcgguggucaa

SEQ ID NO: 156857 - RNA, 19 nt, Homo sapiens
gaauacuccuucaagaucu

SEQ ID NO: 156858 - RNA, 19 nt, Homo sapiens
cagcaaguaugaucagcaa

SEQ ID NO: 156859 - RNA, 19 nt, Homo sapiens
agggagaacuugaaacaga

SEQ ID NO: 156860 - RNA, 19 nt, Homo sapiens
ccaugacccugguacuaaa

SEQ ID NO: 156861 - RNA, 19 nt, Homo sapiens
gggagaacuugaaacagau

SEQ ID NO: 156862 - RNA, 19 nt, Homo sapiens
gcagaaacaguccauugug

SEQ ID NO: 156863 - RNA, 19 nt, Homo sapiens
uucaagaucuuuccagaga

SEQ ID NO: 156864 - RNA, 19 nt, Homo sapiens
ccaaugccauccuugaagu

SEQ ID NO: 156865 - RNA, 19 nt, Homo sapiens
caccugaacuugccuaacu

SEQ ID NO: 156866 - RNA, 19 nt, Homo sapiens
gcaggaagggagaacuuga

SEQ ID NO: 156867 - RNA, 19 nt, Homo sapiens
ccaauaaaucagaccauga

SEQ ID NO: 156868 - RNA, 19 nt, Homo sapiens
gccaugacccugguacuaa

SEQ ID NO: 156869 - RNA, 19 nt, Homo sapiens
gaucuggaccacuggagaa

SEQ ID NO: 156870 - RNA, 19 nt, Homo sapiens
cauuugaagugcaccauca

SEQ ID NO: 156871 - RNA, 19 nt, Homo sapiens
aaacauucguggcuucaag

SEQ ID NO: 156872 - RNA, 19 nt, Homo sapiens
cuaaagaaagagcuuguug

SEQ ID NO: 156873 - RNA, 19 nt, Homo sapiens
gagcacuggugugaacuca

SEQ ID NO: 156874 - RNA, 19 nt, Homo sapiens
ggagaacuugaaacagauu

SEQ ID NO: 156875 - RNA, 19 nt, Homo sapiens
caacauggacagccucucu

SEQ ID NO: 156876 - RNA, 19 nt, Homo sapiens
ucacgggccugaccuucug

SEQ ID NO: 156877 - RNA, 19 nt, Homo sapiens
gcaggugucagcaaguaug

SEQ ID NO: 156878 - RNA, 19 nt, Homo sapiens
gccaagggcaacuguguga

SEQ ID NO: 156879 - RNA, 19 nt, Homo sapiens
ucaagaucuuuccagagaa

SEQ ID NO: 156880 - RNA, 19 nt, Homo sapiens
agaauacuccuucaagauc

SEQ ID NO: 156881 - RNA, 19 nt, Homo sapiens
ccacuagccaggucucgaa

SEQ ID NO: 156882 - RNA, 19 nt, Homo sapiens
cgaguuccugcuccaguua

SEQ ID NO: 156883 - RNA, 19 nt, Homo sapiens
cuucugguccucaguguaa

SEQ ID NO: 156884 - RNA, 19 nt, Homo sapiens
ccaggagacagaccacuug

SEQ ID NO: 156885 - RNA, 19 nt, Homo sapiens
gcugggagcacugguguga

SEQ ID NO: 156886 - RNA, 19 nt, Homo sapiens
augaggcgguggucaauau

SEQ ID NO: 156887 - RNA, 19 nt, Homo sapiens
gagcuuguugcgcauuuga

SEQ ID NO: 156888 - RNA, 19 nt, Homo sapiens
ggccagcauugucucacuu

SEQ ID NO: 156889 - RNA, 19 nt, Homo sapiens
ccacugcacuuggccuaca

SEQ ID NO: 156890 - RNA, 19 nt, Homo sapiens
gcugcacucugguacaucu

SEQ ID NO: 156891 - RNA, 19 nt, Homo sapiens
ccgaguuccugcuccaguu

SEQ ID NO: 156892 - RNA, 19 nt, Homo sapiens
gaccaggaaguccauagga

SEQ ID NO: 156893 - RNA, 19 nt, Homo sapiens
ggacggugacggugaaggu

SEQ ID NO: 156894 - RNA, 19 nt, Homo sapiens
ggucauaccacagccuuca

SEQ ID NO: 156895 - RNA, 19 nt, Homo sapiens
cacaguacccauacccaaa

SEQ ID NO: 156896 - RNA, 19 nt, Homo sapiens
agcauugucucacuucaug

SEQ ID NO: 156897 - RNA, 19 nt, Homo sapiens
ucacugcugcacucuggua

SEQ ID NO: 156898 - RNA, 19 nt, Homo sapiens
gugcugggcaucaccuuug

SEQ ID NO: 156899 - RNA, 19 nt, Homo sapiens
uaaaucagaccaugaaacc

SEQ ID NO: 156900 - RNA, 19 nt, Homo sapiens
gcccagaggguggcaagaa

SEQ ID NO: 156901 - RNA, 19 nt, Homo sapiens
caggaagggagaacuugaa

SEQ ID NO: 156902 - RNA, 19 nt, Homo sapiens
gggcaggaagggagaacuu

SEQ ID NO: 156903 - RNA, 19 nt, Homo sapiens
aagagcuuguugcgcauuu

SEQ ID NO: 156904 - RNA, 19 nt, Homo sapiens
ugacccugguacuaaagaa

SEQ ID NO: 156905 - RNA, 19 nt, Homo sapiens
aaggugcacugccucaaca

SEQ ID NO: 156906 - RNA, 19 nt, Homo sapiens
augcaggugucagcaagua

SEQ ID NO: 156907 - RNA, 19 nt, Homo sapiens
gccacuggacacaggauaa

SEQ ID NO: 156908 - RNA, 19 nt, Homo sapiens
cuucuacacaguacccaua

SEQ ID NO: 156909 - RNA, 19 nt, Homo sapiens
ccacuugccacgcuguugu

SEQ ID NO: 156910 - RNA, 19 nt, Homo sapiens
ggaggcaccguggaacuca

SEQ ID NO: 156911 - RNA, 19 nt, Homo sapiens
ugagggaggcaccguggaa

SEQ ID NO: 156912 - RNA, 19 nt, Homo sapiens
gacccugguacuaaagaaa

SEQ ID NO: 156913 - RNA, 19 nt, Homo sapiens
cuccaggcauccaagcaaa

SEQ ID NO: 156914 - RNA, 19 nt, Homo sapiens
gcacucugguacaucuacu

SEQ ID NO: 156915 - RNA, 19 nt, Homo sapiens
ugaacuugccuaacuaacu

SEQ ID NO: 156916 - RNA, 19 nt, Homo sapiens
acauggacagccucucuuu

SEQ ID NO: 156917 - RNA, 19 nt, Homo sapiens
cuggaccacuggagaauac

SEQ ID NO: 156918 - RNA, 19 nt, Homo sapiens
cgacgccaaccacaacaug

SEQ ID NO: 156919 - RNA, 19 nt, Homo sapiens
ucagcuuccuccuccacuu

SEQ ID NO: 156920 - RNA, 19 nt, Homo sapiens
ggugucagcaaguaugauc

SEQ ID NO: 156921 - RNA, 19 nt, Homo sapiens
gagcagagguuuaccacaa

SEQ ID NO: 156922 - RNA, 19 nt, Homo sapiens
ggaaagaugccaccaaugu

SEQ ID NO: 156923 - RNA, 19 nt, Homo sapiens
gaagacugcuauugggaaa

SEQ ID NO: 156924 - RNA, 19 nt, Homo sapiens
gcaacaagcuggccaugca

SEQ ID NO: 156925 - RNA, 19 nt, Homo sapiens
ggagaaauaugggaaagau

SEQ ID NO: 156926 - RNA, 19 nt, Homo sapiens
ccaacauccuggagaauaa

SEQ ID NO: 156927 - RNA, 19 nt, Homo sapiens
ugaagaaugucaucaagga

SEQ ID NO: 156928 - RNA, 19 nt, Homo sapiens
cgagauggauggaacagaa

SEQ ID NO: 156929 - RNA, 19 nt, Homo sapiens
aaagcuggcuacacugaua

SEQ ID NO: 156930 - RNA, 19 nt, Homo sapiens
ggaaagcuggcuacacuga

SEQ ID NO: 156931 - RNA, 19 nt, Homo sapiens
ugauaagacucgcuauaug

SEQ ID NO: 156932 - RNA, 19 nt, Homo sapiens
ugacuuggcuggcaacucu

SEQ ID NO: 156933 - RNA, 19 nt, Homo sapiens
gaaacugaacgucacagaa

SEQ ID NO: 156934 - RNA, 19 nt, Homo sapiens
gcaacugccuccugcucaa

SEQ ID NO: 156935 - RNA, 19 nt, Homo sapiens
guacaaguccuucaucaag

SEQ ID NO: 156936 - RNA, 19 nt, Homo sapiens
gaagauugacaaacugaug

SEQ ID NO: 156937 - RNA, 19 nt, Homo sapiens
cuucaucgcugaccugguu

SEQ ID NO: 156938 - RNA, 19 nt, Homo sapiens
gaacgucacagaacaagag

SEQ ID NO: 156939 - RNA, 19 nt, Homo sapiens
gaaucccacuguugagguu

SEQ ID NO: 156940 - RNA, 19 nt, Homo sapiens
gcucaaagucaaccagauu

SEQ ID NO: 156941 - RNA, 19 nt, Homo sapiens
gaaagaugccaccaaugug

SEQ ID NO: 156942 - RNA, 19 nt, Homo sapiens
gauaagacucgcuauaugg

SEQ ID NO: 156943 - RNA, 19 nt, Homo sapiens
acaaccagcuccucagaau

SEQ ID NO: 156944 - RNA, 19 nt, Homo sapiens
gcuagaaguucaccauguc

SEQ ID NO: 156945 - RNA, 19 nt, Homo sapiens
aagagaagauugacaaacu

SEQ ID NO: 156946 - RNA, 19 nt, Homo sapiens
gcaaagcuggugccguuga

SEQ ID NO: 156947 - RNA, 19 nt, Homo sapiens
gagaagauugacaaacuga

SEQ ID NO: 156948 - RNA, 19 nt, Homo sapiens
gaacaagagaagauugaca

SEQ ID NO: 156949 - RNA, 19 nt, Homo sapiens
caaaggcuguugagcacau

SEQ ID NO: 156950 - RNA, 19 nt, Homo sapiens
gaaguucaccaugucuauu

SEQ ID NO: 156951 - RNA, 19 nt, Homo sapiens
uggcaacucugaagucauc

SEQ ID NO: 156952 - RNA, 19 nt, Homo sapiens
uggcugaccuguacaaguc

SEQ ID NO: 156953 - RNA, 19 nt, Homo sapiens
aguaugaccuggacuucaa

SEQ ID NO: 156954 - RNA, 19 nt, Homo sapiens
ucacagaacaagagaagau

SEQ ID NO: 156955 - RNA, 19 nt, Homo sapiens
gcauuggagcagagguuua

SEQ ID NO: 156956 - RNA, 19 nt, Homo sapiens
gcacugggcagaucaagac

SEQ ID NO: 156957 - RNA, 19 nt, Homo sapiens
ggcuagaaguucaccaugu

SEQ ID NO: 156958 - RNA, 19 nt, Homo sapiens
ugggaaagaugccaccaau

SEQ ID NO: 156959 - RNA, 19 nt, Homo sapiens
ccaugucuauucucaagau

SEQ ID NO: 156960 - RNA, 19 nt, Homo sapiens
guacaaccagcuccucaga

SEQ ID NO: 156961 - RNA, 19 nt, Homo sapiens
ugggaaagcuggcuacacu

SEQ ID NO: 156962 - RNA, 19 nt, Homo sapiens
cagaacaagagaagauuga

SEQ ID NO: 156963 - RNA, 19 nt, Homo sapiens
ucguaccgcuuccuuagaa

SEQ ID NO: 156964 - RNA, 19 nt, Homo sapiens
caccaugucuauucucaag

SEQ ID NO: 156965 - RNA, 19 nt, Homo sapiens
agaaugucaucaaggagaa

SEQ ID NO: 156966 - RNA, 19 nt, Homo sapiens
gcuggcaacucugaaguca

SEQ ID NO: 156967 - RNA, 19 nt, Homo sapiens
uaucgaagaucccuuugac

SEQ ID NO: 156968 - RNA, 19 nt, Homo sapiens
gagcuccgggacaaugaua

SEQ ID NO: 156969 - RNA, 19 nt, Homo sapiens
aaccagcuccucagaauug

SEQ ID NO: 156970 - RNA, 19 nt, Homo sapiens
ggcaggaacuucagaaacc

SEQ ID NO: 156971 - RNA, 19 nt, Homo sapiens
caaggagaaauaugggaaa

SEQ ID NO: 156972 - RNA, 19 nt, Homo sapiens
gagauggauggaacagaaa

SEQ ID NO: 156973 - RNA, 19 nt, Homo sapiens
caacauccuggagaauaaa

SEQ ID NO: 156974 - RNA, 19 nt, Homo sapiens
ggcguucaaugucaucaau

SEQ ID NO: 156975 - RNA, 19 nt, Homo sapiens
acaaacugaugaucgagau

SEQ ID NO: 156976 - RNA, 19 nt, Homo sapiens
aaugauaagacucgcuaua

SEQ ID NO: 156977 - RNA, 19 nt, Homo sapiens
agagaagauugacaaacug

SEQ ID NO: 156978 - RNA, 19 nt, Homo sapiens
caaccagcuccucagaauu

SEQ ID NO: 156979 - RNA, 19 nt, Homo sapiens
gucauggugucucaucguu

SEQ ID NO: 156980 - RNA, 19 nt, Homo sapiens
accacaaccugaagaaugu

SEQ ID NO: 156981 - RNA, 19 nt, Homo sapiens
uaccacaaccugaagaaug

SEQ ID NO: 156982 - RNA, 19 nt, Homo sapiens
cccaacauccuggagaaua

SEQ ID NO: 156983 - RNA, 19 nt, Homo sapiens
ccugaagaaugucaucaag

SEQ ID NO: 156984 - RNA, 19 nt, Homo sapiens
ggauggaacagaaaauaaa

SEQ ID NO: 156985 - RNA, 19 nt, Homo sapiens
aaacugaacgucacagaac

SEQ ID NO: 156986 - RNA, 19 nt, Homo sapiens
gagcacaucaauaaaacua

SEQ ID NO: 156987 - RNA, 19 nt, Homo sapiens
gugcaggaauccagguagu

SEQ ID NO: 156988 - RNA, 19 nt, Homo sapiens
gaaagcuggcuacacugau

SEQ ID NO: 156989 - RNA, 19 nt, Homo sapiens
gccuggagcugcugaagac

SEQ ID NO: 156990 - RNA, 19 nt, Homo sapiens
aagccucagugacccauga

SEQ ID NO: 156991 - RNA, 19 nt, Homo sapiens
cuucaacugguaucuauga

SEQ ID NO: 156992 - RNA, 19 nt, Homo sapiens
ucaggucugggaaguauga

SEQ ID NO: 156993 - RNA, 19 nt, Homo sapiens
gggaagccaugcgcauugg

SEQ ID NO: 156994 - RNA, 19 nt, Homo sapiens
caaagcuggugccguugag

SEQ ID NO: 156995 - RNA, 19 nt, Homo sapiens
gagaaauaugggaaagaug

SEQ ID NO: 156996 - RNA, 19 nt, Homo sapiens
cccaguggcuagaaguuca

SEQ ID NO: 156997 - RNA, 19 nt, Homo sapiens
gcugugcacugggcagauc

SEQ ID NO: 156998 - RNA, 19 nt, Homo sapiens
caacugccuccugcucaaa

SEQ ID NO: 156999 - RNA, 19 nt, Homo sapiens
caauggcgguucucaugcu

SEQ ID NO: 157000 - RNA, 19 nt, Homo sapiens
acagugaccaacccaaaga

SEQ ID NO: 157001 - RNA, 19 nt, Homo sapiens
cggguuugcucccaacauc

SEQ ID NO: 157002 - RNA, 19 nt, Homo sapiens
gagacccaguggcuagaag

SEQ ID NO: 157003 - RNA, 19 nt, Homo sapiens
aacaagagaagauugacaa

SEQ ID NO: 157004 - RNA, 19 nt, Homo sapiens
ugaacgagaaguccugcaa

SEQ ID NO: 157005 - RNA, 19 nt, Homo sapiens
gagcugcugaagacugcua

SEQ ID NO: 157006 - RNA, 19 nt, Homo sapiens
gcgcauuggagcagagguu

SEQ ID NO: 157007 - RNA, 19 nt, Homo sapiens
uugacaaacugaugaucga

SEQ ID NO: 157008 - RNA, 19 nt, Homo sapiens
cgccugcccugguuagcaa

SEQ ID NO: 157009 - RNA, 19 nt, Homo sapiens
guucguaccgcuuccuuag

SEQ ID NO: 157010 - RNA, 19 nt, Homo sapiens
ugcuucaacugguaucuau

SEQ ID NO: 157011 - RNA, 19 nt, Homo sapiens
gcccaguggugcuucaacu

SEQ ID NO: 157012 - RNA, 19 nt, Homo sapiens
aagauugacaaacugauga

SEQ ID NO: 157013 - RNA, 19 nt, Homo sapiens
caagaaacugaacgucaca

SEQ ID NO: 157014 - RNA, 19 nt, Homo sapiens
ggacuacccaguggugucu

SEQ ID NO: 157015 - RNA, 19 nt, Homo sapiens
gggaaagaugccaccaaug

SEQ ID NO: 157016 - RNA, 19 nt, Homo sapiens
gaaugucaucaaggagaaa

SEQ ID NO: 157017 - RNA, 19 nt, Homo sapiens
acaagagaagauugacaaa

SEQ ID NO: 157018 - RNA, 19 nt, Homo sapiens
cugguuagcaagaaacuga

SEQ ID NO: 157019 - RNA, 19 nt, Homo sapiens
agaaguucaccaugucuau

SEQ ID NO: 157020 - RNA, 19 nt, Homo sapiens
ugaccaacccaaagaggau

SEQ ID NO: 157021 - RNA, 19 nt, Homo sapiens
ggacauaacuuccguaauc

SEQ ID NO: 157022 - RNA, 19 nt, Homo sapiens
gaucacgccuggcuaauaa

SEQ ID NO: 157023 - RNA, 19 nt, Homo sapiens
gaaaugugaaugaggauua

SEQ ID NO: 157024 - RNA, 19 nt, Homo sapiens
gcccagaacuucccugauu

SEQ ID NO: 157025 - RNA, 19 nt, Homo sapiens
ggaacgaugugucuguauu

SEQ ID NO: 157026 - RNA, 19 nt, Homo sapiens
gcaacaagcuggccaugca

SEQ ID NO: 157027 - RNA, 19 nt, Homo sapiens
gaaccuugcuguccugauc

SEQ ID NO: 157028 - RNA, 19 nt, Homo sapiens
ccacugauccuucccgaua

SEQ ID NO: 157029 - RNA, 19 nt, Homo sapiens
gcugagggauggagacaaa

SEQ ID NO: 157030 - RNA, 19 nt, Homo sapiens
gaacgaugugucuguauuu

SEQ ID NO: 157031 - RNA, 19 nt, Homo sapiens
ccacgugucuuccacuuug

SEQ ID NO: 157032 - RNA, 19 nt, Homo sapiens
agacaaacagcguuacuua

SEQ ID NO: 157033 - RNA, 19 nt, Homo sapiens
cugaacgucuggcuaaaua

SEQ ID NO: 157034 - RNA, 19 nt, Homo sapiens
gcaaggaugccaccaaugu

SEQ ID NO: 157035 - RNA, 19 nt, Homo sapiens
gcaaauaugacuuggacuu

SEQ ID NO: 157036 - RNA, 19 nt, Homo sapiens
ggacaaauacggcaaggau

SEQ ID NO: 157037 - RNA, 19 nt, Homo sapiens
gaaggaagccaucgacaag

SEQ ID NO: 157038 - RNA, 19 nt, Homo sapiens
ggacugagaacaaauccaa

SEQ ID NO: 157039 - RNA, 19 nt, Homo sapiens
ggaugggacugagaacaaa

SEQ ID NO: 157040 - RNA, 19 nt, Homo sapiens
uggcuuaccugaccucuug

SEQ ID NO: 157041 - RNA, 19 nt, Homo sapiens
gcaacugucugcugcucaa

SEQ ID NO: 157042 - RNA, 19 nt, Homo sapiens
gugcagaggucuaccauac

SEQ ID NO: 157043 - RNA, 19 nt, Homo sapiens
ugacaucaguuccuuugug

SEQ ID NO: 157044 - RNA, 19 nt, Homo sapiens
ggugggaggucuugcuaga

SEQ ID NO: 157045 - RNA, 19 nt, Homo sapiens
acaaccagcucaugagaau

SEQ ID NO: 157046 - RNA, 19 nt, Homo sapiens
caaguucacagccaaugua

SEQ ID NO: 157047 - RNA, 19 nt, Homo sapiens
ggagguggaucucuauacu

SEQ ID NO: 157048 - RNA, 19 nt, Homo sapiens
gacaucaguuccuuugugu

SEQ ID NO: 157049 - RNA, 19 nt, Homo sapiens
gaagaaugaucagcaucug

SEQ ID NO: 157050 - RNA, 19 nt, Homo sapiens
ggugaugaccugacaguga

SEQ ID NO: 157051 - RNA, 19 nt, Homo sapiens
ucaagggagucaucaagga

SEQ ID NO: 157052 - RNA, 19 nt, Homo sapiens
gaaacuggacaaccugaug

SEQ ID NO: 157053 - RNA, 19 nt, Homo sapiens
guccugaucugugauaguu

SEQ ID NO: 157054 - RNA, 19 nt, Homo sapiens
gaacgucuggcuaaauaca

SEQ ID NO: 157055 - RNA, 19 nt, Homo sapiens
gaaacuagaaaugugaaug

SEQ ID NO: 157056 - RNA, 19 nt, Homo sapiens
gcagaggucuaccauacac

SEQ ID NO: 157057 - RNA, 19 nt, Homo sapiens
ggaagaaugaucagcaucu

SEQ ID NO: 157058 - RNA, 19 nt, Homo sapiens
gccaucauguccauagaga

SEQ ID NO: 157059 - RNA, 19 nt, Homo sapiens
ugagaacaaauccaaguuu

SEQ ID NO: 157060 - RNA, 19 nt, Homo sapiens
gaucaaugguggcucucau

SEQ ID NO: 157061 - RNA, 19 nt, Homo sapiens
ggcuguagaucccaagaug

SEQ ID NO: 157062 - RNA, 19 nt, Homo sapiens
ucucuucccucagaaacua

SEQ ID NO: 157063 - RNA, 19 nt, Homo sapiens
caguggagguggaucucua

SEQ ID NO: 157064 - RNA, 19 nt, Homo sapiens
cauaugagccgugaacugu

SEQ ID NO: 157065 - RNA, 19 nt, Homo sapiens
guuccgcacuuuccacuuc

SEQ ID NO: 157066 - RNA, 19 nt, Homo sapiens
ucagaaacuagaaauguga

SEQ ID NO: 157067 - RNA, 19 nt, Homo sapiens
gcacaggccagaucaagac

SEQ ID NO: 157068 - RNA, 19 nt, Homo sapiens
gagagacugaggacacauu

SEQ ID NO: 157069 - RNA, 19 nt, Homo sapiens
ggacccauuugaccaggau

SEQ ID NO: 157070 - RNA, 19 nt, Homo sapiens
aaauaugacuuggacuuca

SEQ ID NO: 157071 - RNA, 19 nt, Homo sapiens
aggcaaagguguccugaag

SEQ ID NO: 157072 - RNA, 19 nt, Homo sapiens
ugggaggucuugcuagaau

SEQ ID NO: 157073 - RNA, 19 nt, Homo sapiens
ucaugagaauugaggaaga

SEQ ID NO: 157074 - RNA, 19 nt, Homo sapiens
ccaauauccuggagaacag

SEQ ID NO: 157075 - RNA, 19 nt, Homo sapiens
cgaugugucuguauuucau

SEQ ID NO: 157076 - RNA, 19 nt, Homo sapiens
ucauucaucccauuaauca

SEQ ID NO: 157077 - RNA, 19 nt, Homo sapiens
aaauacaaccagcucauga

SEQ ID NO: 157078 - RNA, 19 nt, Homo sapiens
agucaucgcucaggagaga

SEQ ID NO: 157079 - RNA, 19 nt, Homo sapiens
caauguagggauccagauu

SEQ ID NO: 157080 - RNA, 19 nt, Homo sapiens
ggaucucuauacugccaaa

SEQ ID NO: 157081 - RNA, 19 nt, Homo sapiens
ugacagugaccaacccaaa

SEQ ID NO: 157082 - RNA, 19 nt, Homo sapiens
ccauugaggacccauuuga

SEQ ID NO: 157083 - RNA, 19 nt, Homo sapiens
aauaugacuuggacuucaa

SEQ ID NO: 157084 - RNA, 19 nt, Homo sapiens
ccagaacuucccugauuga

SEQ ID NO: 157085 - RNA, 19 nt, Homo sapiens
gagcaccuccauuaaaguc

SEQ ID NO: 157086 - RNA, 19 nt, Homo sapiens
caucaguuccuuugugugu

SEQ ID NO: 157087 - RNA, 19 nt, Homo sapiens
gaaugggaagggucauaga

SEQ ID NO: 157088 - RNA, 19 nt, Homo sapiens
caaauaugacuuggacuuc

SEQ ID NO: 157089 - RNA, 19 nt, Homo sapiens
ugaaggaagccaucgacaa

SEQ ID NO: 157090 - RNA, 19 nt, Homo sapiens
gaaugaucagcaucuguga

SEQ ID NO: 157091 - RNA, 19 nt, Homo sapiens
cccagaacuucccugauug

SEQ ID NO: 157092 - RNA, 19 nt, Homo sapiens
ccugaucugugauaguuca

SEQ ID NO: 157093 - RNA, 19 nt, Homo sapiens
gaucggcucggucacugaa

SEQ ID NO: 157094 - RNA, 19 nt, Homo sapiens
gacaaacagcguuacuuag

SEQ ID NO: 157095 - RNA, 19 nt, Homo sapiens
gaucguuauuggcauggau

SEQ ID NO: 157096 - RNA, 19 nt, Homo sapiens
ggucuaccauacacucaag

SEQ ID NO: 157097 - RNA, 19 nt, Homo sapiens
cgagaucccagccaucaug

SEQ ID NO: 157098 - RNA, 19 nt, Homo sapiens
gcauaugagccgugaacug

SEQ ID NO: 157099 - RNA, 19 nt, Homo sapiens
ccucagaaacuagaaaugu

SEQ ID NO: 157100 - RNA, 19 nt, Homo sapiens
gagacaaacagcguuacuu

SEQ ID NO: 157101 - RNA, 19 nt, Homo sapiens
ugaucacgccuggcuaaua

SEQ ID NO: 157102 - RNA, 19 nt, Homo sapiens
ccucuacgggcaucuauga

SEQ ID NO: 157103 - RNA, 19 nt, Homo sapiens
cauuugaccaggaugauug

SEQ ID NO: 157104 - RNA, 19 nt, Homo sapiens
aagagaaacuggacaaccu

SEQ ID NO: 157105 - RNA, 19 nt, Homo sapiens
ugggaagggucauagaaag

SEQ ID NO: 157106 - RNA, 19 nt, Homo sapiens
gggaccaugugucacuugu

SEQ ID NO: 157107 - RNA, 19 nt, Homo sapiens
uuggugugcugagguguua

SEQ ID NO: 157108 - RNA, 19 nt, Homo sapiens
aaccagcucaugagaauug

SEQ ID NO: 157109 - RNA, 19 nt, Homo sapiens
uaaauacaaccagcucaug

SEQ ID NO: 157110 - RNA, 19 nt, Homo sapiens
acaaacagcguuacuuagg

SEQ ID NO: 157111 - RNA, 19 nt, Homo sapiens
gauccuucccgauacauca

SEQ ID NO: 157112 - RNA, 19 nt, Homo sapiens
guuauuggcauggauguug

SEQ ID NO: 157113 - RNA, 19 nt, Homo sapiens
gggaggucuugcuagaaug

SEQ ID NO: 157114 - RNA, 19 nt, Homo sapiens
gagggaccaugugucacuu

SEQ ID NO: 157115 - RNA, 19 nt, Homo sapiens
agagagggaccauguguca

SEQ ID NO: 157116 - RNA, 19 nt, Homo sapiens
cuucaagucucccacugau

SEQ ID NO: 157117 - RNA, 19 nt, Homo sapiens
caucauguccauagagaag

SEQ ID NO: 157118 - RNA, 19 nt, Homo sapiens
gccgugaacugugcauagu

SEQ ID NO: 157119 - RNA, 19 nt, Homo sapiens
cggaaaagaucguuauugg

SEQ ID NO: 157120 - RNA, 19 nt, Homo sapiens
gcucuugucccacgugucu

SEQ ID NO: 157121 - RNA, 19 nt, Homo sapiens
gagaauaaguccaaguuug

SEQ ID NO: 157122 - RNA, 19 nt, Homo sapiens
gaaacaagcuggccaugca

SEQ ID NO: 157123 - RNA, 19 nt, Homo sapiens
gaagaaggccugcaacugu

SEQ ID NO: 157124 - RNA, 19 nt, Homo sapiens
gcaacugucugcugcugaa

SEQ ID NO: 157125 - RNA, 19 nt, Homo sapiens
ggaaggaugccaccaaugu

SEQ ID NO: 157126 - RNA, 19 nt, Homo sapiens
cggagcgucuggccaaaua

SEQ ID NO: 157127 - RNA, 19 nt, Homo sapiens
ugggaacccugaccucaua

SEQ ID NO: 157128 - RNA, 19 nt, Homo sapiens
acucggagcuccauccaaa

SEQ ID NO: 157129 - RNA, 19 nt, Homo sapiens
uagaugggaccgagaauaa

SEQ ID NO: 157130 - RNA, 19 nt, Homo sapiens
caaauacaaccaacucaug

SEQ ID NO: 157131 - RNA, 19 nt, Homo sapiens
ucggagagcuguauaagag

SEQ ID NO: 157132 - RNA, 19 nt, Homo sapiens
agaccugcuuccugaaaua

SEQ ID NO: 157133 - RNA, 19 nt, Homo sapiens
gugccagccuucaauguga

SEQ ID NO: 157134 - RNA, 19 nt, Homo sapiens
ccaacauccuggagaacaa

SEQ ID NO: 157135 - RNA, 19 nt, Homo sapiens
caaugugggugaugaaggu

SEQ ID NO: 157136 - RNA, 19 nt, Homo sapiens
ggcagcaucugaguucuau

SEQ ID NO: 157137 - RNA, 19 nt, Homo sapiens
acuaagagacggagacaaa

SEQ ID NO: 157138 - RNA, 19 nt, Homo sapiens
cuaugaggcucuggaacua

SEQ ID NO: 157139 - RNA, 19 nt, Homo sapiens
gcacaggacagaucaagac

SEQ ID NO: 157140 - RNA, 19 nt, Homo sapiens
gggugaacauccagauugu

SEQ ID NO: 157141 - RNA, 19 nt, Homo sapiens
aaauacaaccaacucauga

SEQ ID NO: 157142 - RNA, 19 nt, Homo sapiens
gcaaugggaaguacgaucu

SEQ ID NO: 157143 - RNA, 19 nt, Homo sapiens
gaaggaugccaccaaugug

SEQ ID NO: 157144 - RNA, 19 nt, Homo sapiens
caaggaagccaugcgcauu

SEQ ID NO: 157145 - RNA, 19 nt, Homo sapiens
ggacgcaaguuccguaacc

SEQ ID NO: 157146 - RNA, 19 nt, Homo sapiens
gaacuaagagacggagaca

SEQ ID NO: 157147 - RNA, 19 nt, Homo sapiens
ugaaggcuguggagaacau

SEQ ID NO: 157148 - RNA, 19 nt, Homo sapiens
acaaccaacucaugaggau

SEQ ID NO: 157149 - RNA, 19 nt, Homo sapiens
ggucaucaaggccaaguau

SEQ ID NO: 157150 - RNA, 19 nt, Homo sapiens
cgagaauaaguccaaguuu

SEQ ID NO: 157151 - RNA, 19 nt, Homo sapiens
cacccaacauccuggagaa

SEQ ID NO: 157152 - RNA, 19 nt, Homo sapiens
gaugggaccgagaauaagu

SEQ ID NO: 157153 - RNA, 19 nt, Homo sapiens
gaccugcuuccugaaauaa

SEQ ID NO: 157154 - RNA, 19 nt, Homo sapiens
agagcuuuaucaagaacua

SEQ ID NO: 157155 - RNA, 19 nt, Homo sapiens
ccagaccugcuuccugaaa

SEQ ID NO: 157156 - RNA, 19 nt, Homo sapiens
gauccaggcgugcaaacug

SEQ ID NO: 157157 - RNA, 19 nt, Homo sapiens
cagaccugcuuccugaaau

SEQ ID NO: 157158 - RNA, 19 nt, Homo sapiens
gagaagaaggccugcaacu

SEQ ID NO: 157159 - RNA, 19 nt, Homo sapiens
caggaugacugggccacuu

SEQ ID NO: 157160 - RNA, 19 nt, Homo sapiens
uaagagcuuuaucaagaac

SEQ ID NO: 157161 - RNA, 19 nt, Homo sapiens
gcacaucacuggggagaag

SEQ ID NO: 157162 - RNA, 19 nt, Homo sapiens
ccgagaauaaguccaaguu

SEQ ID NO: 157163 - RNA, 19 nt, Homo sapiens
cuagaugggaccgagaaua

SEQ ID NO: 157164 - RNA, 19 nt, Homo sapiens
ccaaauacaaccaacucau

SEQ ID NO: 157165 - RNA, 19 nt, Homo sapiens
ggagacugaggacacauuc

SEQ ID NO: 157166 - RNA, 19 nt, Homo sapiens
gggagacugaggacacauu

SEQ ID NO: 157167 - RNA, 19 nt, Homo sapiens
ugggaaggaugccaccaau

SEQ ID NO: 157168 - RNA, 19 nt, Homo sapiens
auucauugcugaccuugug

SEQ ID NO: 157169 - RNA, 19 nt, Homo sapiens
augcaggaguucaugauuc

SEQ ID NO: 157170 - RNA, 19 nt, Homo sapiens
gcccugcucugcugcaaaa

SEQ ID NO: 157171 - RNA, 19 nt, Homo sapiens
ccaggucgggugaaucuuc

SEQ ID NO: 157172 - RNA, 19 nt, Homo sapiens
ggccaaguaugggaaggau

SEQ ID NO: 157173 - RNA, 19 nt, Homo sapiens
cacauucauugcugaccuu

SEQ ID NO: 157174 - RNA, 19 nt, Homo sapiens
ucugaguucuaucgcaaug

SEQ ID NO: 157175 - RNA, 19 nt, Homo sapiens
gagcgucuggccaaauaca

SEQ ID NO: 157176 - RNA, 19 nt, Homo sapiens
gacugaggacacauucauu

SEQ ID NO: 157177 - RNA, 19 nt, Homo sapiens
caucccaggucgggugaau

SEQ ID NO: 157178 - RNA, 19 nt, Homo sapiens
aaugggaaguacgaucuug

SEQ ID NO: 157179 - RNA, 19 nt, Homo sapiens
caacauccuggagaacaau

SEQ ID NO: 157180 - RNA, 19 nt, Homo sapiens
ccugaaggcuguggagaac

SEQ ID NO: 157181 - RNA, 19 nt, Homo sapiens
ugcaggaguucaugauucu

SEQ ID NO: 157182 - RNA, 19 nt, Homo sapiens
uaagagacggagacaaagg

SEQ ID NO: 157183 - RNA, 19 nt, Homo sapiens
aaggaagccaugcgcauug

SEQ ID NO: 157184 - RNA, 19 nt, Homo sapiens
gaacccugaccucauacuc

SEQ ID NO: 157185 - RNA, 19 nt, Homo sapiens
gagaauaaguccaaguuug

SEQ ID NO: 157186 - RNA, 19 nt, Homo sapiens
gaaacaagcuggccaugca

SEQ ID NO: 157187 - RNA, 19 nt, Homo sapiens
gaagaaggccugcaacugu

SEQ ID NO: 157188 - RNA, 19 nt, Homo sapiens
gcaacugucugcugcugaa

SEQ ID NO: 157189 - RNA, 19 nt, Homo sapiens
ggaaggaugccaccaaugu

SEQ ID NO: 157190 - RNA, 19 nt, Homo sapiens
cggagcgucuggccaaaua

SEQ ID NO: 157191 - RNA, 19 nt, Homo sapiens
ugggaacccugaccucaua

SEQ ID NO: 157192 - RNA, 19 nt, Homo sapiens
acucggagcuccauccaaa

SEQ ID NO: 157193 - RNA, 19 nt, Homo sapiens
uagaugggaccgagaauaa

SEQ ID NO: 157194 - RNA, 19 nt, Homo sapiens
caaauacaaccaacucaug

SEQ ID NO: 157195 - RNA, 19 nt, Homo sapiens
ucggagagcuguauaagag

SEQ ID NO: 157196 - RNA, 19 nt, Homo sapiens
agaccugcuuccugaaaua

SEQ ID NO: 157197 - RNA, 19 nt, Homo sapiens
gugccagccuucaauguga

SEQ ID NO: 157198 - RNA, 19 nt, Homo sapiens
ccaacauccuggagaacaa

SEQ ID NO: 157199 - RNA, 19 nt, Homo sapiens
caaugugggugaugaaggu

SEQ ID NO: 157200 - RNA, 19 nt, Homo sapiens
ggcagcaucugaguucuau

SEQ ID NO: 157201 - RNA, 19 nt, Homo sapiens
acuaagagacggagacaaa

SEQ ID NO: 157202 - RNA, 19 nt, Homo sapiens
cuaugaggcucuggaacua

SEQ ID NO: 157203 - RNA, 19 nt, Homo sapiens
gcacaggacagaucaagac

SEQ ID NO: 157204 - RNA, 19 nt, Homo sapiens
gggugaacauccagauugu

SEQ ID NO: 157205 - RNA, 19 nt, Homo sapiens
aaauacaaccaacucauga

SEQ ID NO: 157206 - RNA, 19 nt, Homo sapiens
gcaaugggaaguacgaucu

SEQ ID NO: 157207 - RNA, 19 nt, Homo sapiens
gaaggaugccaccaaugug

SEQ ID NO: 157208 - RNA, 19 nt, Homo sapiens
caaggaagccaugcgcauu

SEQ ID NO: 157209 - RNA, 19 nt, Homo sapiens
ggacgcaaguuccguaacc

SEQ ID NO: 157210 - RNA, 19 nt, Homo sapiens
gaacuaagagacggagaca

SEQ ID NO: 157211 - RNA, 19 nt, Homo sapiens
ugaaggcuguggagaacau

SEQ ID NO: 157212 - RNA, 19 nt, Homo sapiens
acaaccaacucaugaggau

SEQ ID NO: 157213 - RNA, 19 nt, Homo sapiens
ggucaucaaggccaaguau

SEQ ID NO: 157214 - RNA, 19 nt, Homo sapiens
cgagaauaaguccaaguuu

SEQ ID NO: 157215 - RNA, 19 nt, Homo sapiens
cacccaacauccuggagaa

SEQ ID NO: 157216 - RNA, 19 nt, Homo sapiens
gaugggaccgagaauaagu

SEQ ID NO: 157217 - RNA, 19 nt, Homo sapiens
gaccugcuuccugaaauaa

SEQ ID NO: 157218 - RNA, 19 nt, Homo sapiens
agagcuuuaucaagaacua

SEQ ID NO: 157219 - RNA, 19 nt, Homo sapiens
ccagaccugcuuccugaaa

SEQ ID NO: 157220 - RNA, 19 nt, Homo sapiens
gauccaggcgugcaaacug

SEQ ID NO: 157221 - RNA, 19 nt, Homo sapiens
cagaccugcuuccugaaau

SEQ ID NO: 157222 - RNA, 19 nt, Homo sapiens
gagaagaaggccugcaacu

SEQ ID NO: 157223 - RNA, 19 nt, Homo sapiens
caggaugacugggccacuu

SEQ ID NO: 157224 - RNA, 19 nt, Homo sapiens
uaagagcuuuaucaagaac

SEQ ID NO: 157225 - RNA, 19 nt, Homo sapiens
gcacaucacuggggagaag

SEQ ID NO: 157226 - RNA, 19 nt, Homo sapiens
ccgagaauaaguccaaguu

SEQ ID NO: 157227 - RNA, 19 nt, Homo sapiens
cuagaugggaccgagaaua

SEQ ID NO: 157228 - RNA, 19 nt, Homo sapiens
ccaaauacaaccaacucau

SEQ ID NO: 157229 - RNA, 19 nt, Homo sapiens
ggagacugaggacacauuc

SEQ ID NO: 157230 - RNA, 19 nt, Homo sapiens
gggagacugaggacacauu

SEQ ID NO: 157231 - RNA, 19 nt, Homo sapiens
ugggaaggaugccaccaau

SEQ ID NO: 157232 - RNA, 19 nt, Homo sapiens
auucauugcugaccuugug

SEQ ID NO: 157233 - RNA, 19 nt, Homo sapiens
augcaggaguucaugauuc

SEQ ID NO: 157234 - RNA, 19 nt, Homo sapiens
gcccugcucugcugcaaaa

SEQ ID NO: 157235 - RNA, 19 nt, Homo sapiens
ggccaaguaugggaaggau

SEQ ID NO: 157236 - RNA, 19 nt, Homo sapiens
cacauucauugcugaccuu

SEQ ID NO: 157237 - RNA, 19 nt, Homo sapiens
ucugaguucuaucgcaaug

SEQ ID NO: 157238 - RNA, 19 nt, Homo sapiens
gagcgucuggccaaauaca

SEQ ID NO: 157239 - RNA, 19 nt, Homo sapiens
gacugaggacacauucauu

SEQ ID NO: 157240 - RNA, 19 nt, Homo sapiens
ccugaaggcuguggagaac

SEQ ID NO: 157241 - RNA, 19 nt, Homo sapiens
aaugggaaguacgaucuug

SEQ ID NO: 157242 - RNA, 19 nt, Homo sapiens
caacauccuggagaacaau

SEQ ID NO: 157243 - RNA, 19 nt, Homo sapiens
ugcaggaguucaugauucu

SEQ ID NO: 157244 - RNA, 19 nt, Homo sapiens
uaagagacggagacaaagg

SEQ ID NO: 157245 - RNA, 19 nt, Homo sapiens
aaggaagccaugcgcauug

SEQ ID NO: 157246 - RNA, 19 nt, Homo sapiens
gaacccugaccucauacuc

SEQ ID NO: 157247 - RNA, 19 nt, Homo sapiens
gaacaaugcuuccucguua

SEQ ID NO: 157248 - RNA, 19 nt, Homo sapiens
gagcucaacuucuagauua

SEQ ID NO: 157249 - RNA, 19 nt, Homo sapiens
aaacgaaccugcuuuauga

SEQ ID NO: 157250 - RNA, 19 nt, Homo sapiens
gaacuacacucuugagcaa

SEQ ID NO: 157251 - RNA, 19 nt, Homo sapiens
gaagaauacuuugcuauga

SEQ ID NO: 157252 - RNA, 19 nt, Homo sapiens
gaagauguauuaccuguuc

SEQ ID NO: 157253 - RNA, 19 nt, Homo sapiens
gcaaaugcgugaccaaaug

SEQ ID NO: 157254 - RNA, 19 nt, Homo sapiens
ggcaagagcucaacuucua

SEQ ID NO: 157255 - RNA, 19 nt, Homo sapiens
gaaagucucugacguuagu

SEQ ID NO: 157256 - RNA, 19 nt, Homo sapiens
ggaagaacauggccuggaa

SEQ ID NO: 157257 - RNA, 19 nt, Homo sapiens
gaugauaaauggacucgaa

SEQ ID NO: 157258 - RNA, 19 nt, Homo sapiens
caacagauauacacucaau

SEQ ID NO: 157259 - RNA, 19 nt, Homo sapiens
gugcaagucuuauugauga

SEQ ID NO: 157260 - RNA, 19 nt, Homo sapiens
ggugguggguguaggauua

SEQ ID NO: 157261 - RNA, 19 nt, Homo sapiens
gaaacgaaccugcuuuaug

SEQ ID NO: 157262 - RNA, 19 nt, Homo sapiens
gagaguaauuucagcugua

SEQ ID NO: 157263 - RNA, 19 nt, Homo sapiens
cuacagcgcucuccuugaa

SEQ ID NO: 157264 - RNA, 19 nt, Homo sapiens
gaaacagacuggcaaaugc

SEQ ID NO: 157265 - RNA, 19 nt, Homo sapiens
gagaaacgaaccugcuuua

SEQ ID NO: 157266 - RNA, 19 nt, Homo sapiens
gcagaucgugcaagucuua

SEQ ID NO: 157267 - RNA, 19 nt, Homo sapiens
caagcaguguguuauuuaa

SEQ ID NO: 157268 - RNA, 19 nt, Homo sapiens
gaaauauugugaccaugga

SEQ ID NO: 157269 - RNA, 19 nt, Homo sapiens
ucaagaacaucacacagaa

SEQ ID NO: 157270 - RNA, 19 nt, Homo sapiens
gaagacuuguggcuaaaug

SEQ ID NO: 157271 - RNA, 19 nt, Homo sapiens
caucagugguuuggaaaua

SEQ ID NO: 157272 - RNA, 19 nt, Homo sapiens
uaagguggcuuugaacuug

SEQ ID NO: 157273 - RNA, 19 nt, Homo sapiens
gaccaaauguuacuugaag

SEQ ID NO: 157274 - RNA, 19 nt, Homo sapiens
gauauacacucaauaacag

SEQ ID NO: 157275 - RNA, 19 nt, Homo sapiens
aaagagcuauauccuauga

SEQ ID NO: 157276 - RNA, 19 nt, Homo sapiens
gaaagaagagucaguggau

SEQ ID NO: 157277 - RNA, 19 nt, Homo sapiens
gagagugguuaauguauuc

SEQ ID NO: 157278 - RNA, 19 nt, Homo sapiens
ggaauuggauacaacucaa

SEQ ID NO: 157279 - RNA, 19 nt, Homo sapiens
ggacacgaaccuuauuaaa

SEQ ID NO: 157280 - RNA, 19 nt, Homo sapiens
aagaaagucucugacguua

SEQ ID NO: 157281 - RNA, 19 nt, Homo sapiens
gaacauggccuggaauugg

SEQ ID NO: 157282 - RNA, 19 nt, Homo sapiens
cauggaauaucccaguuaa

SEQ ID NO: 157283 - RNA, 19 nt, Homo sapiens
gauggaauauccuauagca

SEQ ID NO: 157284 - RNA, 19 nt, Homo sapiens
gagaccaugucacaaaguu

SEQ ID NO: 157285 - RNA, 19 nt, Homo sapiens
ggaccagacagauggguua

SEQ ID NO: 157286 - RNA, 19 nt, Homo sapiens
gaugucagauguacuugga

SEQ ID NO: 157287 - RNA, 19 nt, Homo sapiens
caagggaucuucuauuuug

SEQ ID NO: 157288 - RNA, 19 nt, Homo sapiens
caauuugacucuguaaaga

SEQ ID NO: 157289 - RNA, 19 nt, Homo sapiens
gaaacaccaucagagaaug

SEQ ID NO: 157290 - RNA, 19 nt, Homo sapiens
caacauagaaacaccauca

SEQ ID NO: 157291 - RNA, 19 nt, Homo sapiens
gauacugcauucaaacgaa

SEQ ID NO: 157292 - RNA, 19 nt, Homo sapiens
agagaagccuugaacaaug

SEQ ID NO: 157293 - RNA, 19 nt, Homo sapiens
agcaagggaucuucuauuu

SEQ ID NO: 157294 - RNA, 19 nt, Homo sapiens
gaacuccucuaauccuagu

SEQ ID NO: 157295 - RNA, 19 nt, Homo sapiens
gacaaccccugaugaaaua

SEQ ID NO: 157296 - RNA, 19 nt, Homo sapiens
gaauaucccaguuaaaugg

SEQ ID NO: 157297 - RNA, 19 nt, Homo sapiens
gaggaugauucuuugaugu

SEQ ID NO: 157298 - RNA, 19 nt, Homo sapiens
aggauuugcuucuuucuuu

SEQ ID NO: 157299 - RNA, 19 nt, Homo sapiens
ggaaucagccucaucaaac

SEQ ID NO: 157300 - RNA, 19 nt, Homo sapiens
uaaauggacucgaacaacu

SEQ ID NO: 157301 - RNA, 19 nt, Homo sapiens
ugagagugguuaauguauu

SEQ ID NO: 157302 - RNA, 19 nt, Homo sapiens
ucuaagagauacugcauuc

SEQ ID NO: 157303 - RNA, 19 nt, Homo sapiens
ggagguguuucgaguacaa

SEQ ID NO: 157304 - RNA, 19 nt, Homo sapiens
gaacguuacucuuuuguca

SEQ ID NO: 157305 - RNA, 19 nt, Homo sapiens
ggaauaucccaguuaaaug

SEQ ID NO: 157306 - RNA, 19 nt, Homo sapiens
aagagucaguggaugauaa

SEQ ID NO: 157307 - RNA, 19 nt, Homo sapiens
gaucaugaaccaacagaug

SEQ ID NO: 157308 - RNA, 19 nt, Homo sapiens
ucauggaacuacacucuug

SEQ ID NO: 157309 - RNA, 19 nt, Homo sapiens
gaaugaugcuggagaccau

SEQ ID NO: 157310 - RNA, 19 nt, Homo sapiens
cagaaaccuuggccgaauu

SEQ ID NO: 157311 - RNA, 19 nt, Homo sapiens
gaaggaaucacuuugaacu

SEQ ID NO: 157312 - RNA, 19 nt, Homo sapiens
cgaaacauguggccauucu

SEQ ID NO: 157313 - RNA, 19 nt, Homo sapiens
gaucuugguuauacaugga

SEQ ID NO: 157314 - RNA, 19 nt, Homo sapiens
ggauaaaaccagagaauuu

SEQ ID NO: 157315 - RNA, 19 nt, Homo sapiens
ggaguaaaccaugcagaaa

SEQ ID NO: 157316 - RNA, 19 nt, Homo sapiens
gugcaucagugguuuggaa

SEQ ID NO: 157317 - RNA, 19 nt, Homo sapiens
gcacacagccgaauaugcu

SEQ ID NO: 157318 - RNA, 19 nt, Homo sapiens
acggagcacuuucaaauau

SEQ ID NO: 157319 - RNA, 19 nt, Homo sapiens
caaagaauacggagcacuu

SEQ ID NO: 157320 - RNA, 19 nt, Homo sapiens
ucacccaucccaaagaaua

SEQ ID NO: 157321 - RNA, 19 nt, Homo sapiens
uauaacagcuaugggaaga

SEQ ID NO: 157322 - RNA, 19 nt, Homo sapiens
gagaagccuugaacaaugc

SEQ ID NO: 157323 - RNA, 19 nt, Homo sapiens
agagcuauauccuaugauu

SEQ ID NO: 157324 - RNA, 19 nt, Homo sapiens
aagaaggaaucacuuugaa

SEQ ID NO: 157325 - RNA, 19 nt, Homo sapiens
uaagagauacugcauucaa

SEQ ID NO: 157326 - RNA, 19 nt, Homo sapiens
ggauuugcuucuuucuuug

SEQ ID NO: 157327 - RNA, 19 nt, Homo sapiens
ugggaagacuuguggcuaa

SEQ ID NO: 157328 - RNA, 19 nt, Homo sapiens
acuacacucuugagcaaua

SEQ ID NO: 157329 - RNA, 19 nt, Homo sapiens
ugaagaugauaaagagcua

SEQ ID NO: 157330 - RNA, 19 nt, Homo sapiens
uaaccuacaucauuagcau

SEQ ID NO: 157331 - RNA, 19 nt, Homo sapiens
gaucgugcaagucuuauug

SEQ ID NO: 157332 - RNA, 19 nt, Homo sapiens
ggaaaaccucuuacaauuu

SEQ ID NO: 157333 - RNA, 19 nt, Homo sapiens
caggauguguuuacaguca

SEQ ID NO: 157334 - RNA, 19 nt, Homo sapiens
aaagaaagucucugacguu

SEQ ID NO: 157335 - RNA, 19 nt, Homo sapiens
acaagcaguguguuauuua

SEQ ID NO: 157336 - RNA, 19 nt, Homo sapiens
uguauuaccuguucaagag

SEQ ID NO: 157337 - RNA, 19 nt, Homo sapiens
gggaagacuuguggcuaaa

SEQ ID NO: 157338 - RNA, 19 nt, Homo sapiens
aagagauacugcauucaaa

SEQ ID NO: 157339 - RNA, 19 nt, Homo sapiens
cccaugaacuugugcauca

SEQ ID NO: 157340 - RNA, 19 nt, Homo sapiens
caacagaugccaggaaauc

SEQ ID NO: 157341 - RNA, 19 nt, Homo sapiens
caacucaacugggacuauc

SEQ ID NO: 157342 - RNA, 19 nt, Homo sapiens
uaucacccaucccaaagaa

SEQ ID NO: 157343 - RNA, 19 nt, Homo sapiens
caguggagauggccuguau

SEQ ID NO: 157344 - RNA, 19 nt, Homo sapiens
ggauguguuuacagucauu

SEQ ID NO: 157345 - RNA, 19 nt, Homo sapiens
gaacucuggcaaugagauu

SEQ ID NO: 157346 - RNA, 19 nt, Homo sapiens
caagaugggagacagagaa

SEQ ID NO: 157347 - RNA, 19 nt, Homo sapiens
aagccaagaugaagaauaa

SEQ ID NO: 157348 - RNA, 19 nt, Homo sapiens
cagaagcccuuuccuguug

SEQ ID NO: 157349 - RNA, 19 nt, Homo sapiens
gaagguauucugccugaga

SEQ ID NO: 157350 - RNA, 19 nt, Homo sapiens
gcagaagcccuuuccuguu

SEQ ID NO: 157351 - RNA, 19 nt, Homo sapiens
ugaagagacuccagaaagg

SEQ ID NO: 157352 - RNA, 19 nt, Homo sapiens
gaaacaagaagaagagaac

SEQ ID NO: 157353 - RNA, 19 nt, Homo sapiens
ccaaagccaagaugaagaa

SEQ ID NO: 157354 - RNA, 19 nt, Homo sapiens
aaauaacaguugggagaaa

SEQ ID NO: 157355 - RNA, 19 nt, Homo sapiens
caaagcuaaaggccaaaua

SEQ ID NO: 157356 - RNA, 19 nt, Homo sapiens
gggagaaauaucaaugaaa

SEQ ID NO: 157357 - RNA, 19 nt, Homo sapiens
gcuccgacuuccucaugaa

SEQ ID NO: 157358 - RNA, 19 nt, Homo sapiens
ugggagaaauaucaaugaa

SEQ ID NO: 157359 - RNA, 19 nt, Homo sapiens
caaauaacaguugggagaa

SEQ ID NO: 157360 - RNA, 19 nt, Homo sapiens
ugacugagcaacccuagug

SEQ ID NO: 157361 - RNA, 19 nt, Homo sapiens
caaauacccaagccuagga

SEQ ID NO: 157362 - RNA, 19 nt, Homo sapiens
gcaggagaaagaagguauu

SEQ ID NO: 157363 - RNA, 19 nt, Homo sapiens
gugcaggaccagacaagaa

SEQ ID NO: 157364 - RNA, 19 nt, Homo sapiens
gcugaagaggcaaagcuaa

SEQ ID NO: 157365 - RNA, 19 nt, Homo sapiens
gcaggacacgcaggagaaa

SEQ ID NO: 157366 - RNA, 19 nt, Homo sapiens
aauaacaguugggagaaau

SEQ ID NO: 157367 - RNA, 19 nt, Homo sapiens
ggacacgcaggagaaagaa

SEQ ID NO: 157368 - RNA, 19 nt, Homo sapiens
aaagccaagaugaagaaua

SEQ ID NO: 157369 - RNA, 19 nt, Homo sapiens
gaagaggcaaagcuaaagg

SEQ ID NO: 157370 - RNA, 19 nt, Homo sapiens
ccagaaacaagaagaagag

SEQ ID NO: 157371 - RNA, 19 nt, Homo sapiens
uaacaguugggagaaauau

SEQ ID NO: 157372 - RNA, 19 nt, Homo sapiens
caugaagagacuccagaaa

SEQ ID NO: 157373 - RNA, 19 nt, Homo sapiens
cugaagaggcaaagcuaaa

SEQ ID NO: 157374 - RNA, 19 nt, Homo sapiens
acaguugggagaaauauca

SEQ ID NO: 157375 - RNA, 19 nt, Homo sapiens
gcaaagcuaaaggccaaau

SEQ ID NO: 157376 - RNA, 19 nt, Homo sapiens
gccaaagccaagaugaaga

SEQ ID NO: 157377 - RNA, 19 nt, Homo sapiens
ggccaaagccaagaugaag

SEQ ID NO: 157378 - RNA, 19 nt, Homo sapiens
cgaagcagcagcgcagguu

SEQ ID NO: 157379 - RNA, 19 nt, Homo sapiens
guggccaaguugaaugaug

SEQ ID NO: 157380 - RNA, 19 nt, Homo sapiens
agaaacaagaagaagagaa

SEQ ID NO: 157381 - RNA, 19 nt, Homo sapiens
ccaagaugaagaauaagca

SEQ ID NO: 157382 - RNA, 19 nt, Homo sapiens
uacccaagccuaggacaaa

SEQ ID NO: 157383 - RNA, 19 nt, Homo sapiens
gaagcccuuuccuguuggu

SEQ ID NO: 157384 - RNA, 19 nt, Homo sapiens
ccaugucccagaaacaaga

SEQ ID NO: 157385 - RNA, 19 nt, Homo sapiens
gcucgucaccagcaagcuu

SEQ ID NO: 157386 - RNA, 19 nt, Homo sapiens
aauaagcagcugccaagug

SEQ ID NO: 157387 - RNA, 19 nt, Homo sapiens
guugggagaaauaucaaug

SEQ ID NO: 157388 - RNA, 19 nt, Homo sapiens
ggagaggcagaagcccuuu

SEQ ID NO: 157389 - RNA, 19 nt, Homo sapiens
gaaaccaggugccuucaga

SEQ ID NO: 157390 - RNA, 19 nt, Homo sapiens
gaaagccacucuaucaaag

SEQ ID NO: 157391 - RNA, 19 nt, Homo sapiens
gaacgcugcucccguggaa

SEQ ID NO: 157392 - RNA, 19 nt, Homo sapiens
ccucacagcuguauucaug

SEQ ID NO: 157393 - RNA, 19 nt, Homo sapiens
gaggcucucugauuuaaau

SEQ ID NO: 157394 - RNA, 19 nt, Homo sapiens
uaucaaagccauccugaaa

SEQ ID NO: 157395 - RNA, 19 nt, Homo sapiens
gccaugaucugcgcuauug

SEQ ID NO: 157396 - RNA, 19 nt, Homo sapiens
gcucugcccuucuuuguca

SEQ ID NO: 157397 - RNA, 19 nt, Homo sapiens
gagaacaccaucaccauga

SEQ ID NO: 157398 - RNA, 19 nt, Homo sapiens
gacaaaggauggacagaag

SEQ ID NO: 157399 - RNA, 19 nt, Homo sapiens
agaggaaucuggaguuuca

SEQ ID NO: 157400 - RNA, 19 nt, Homo sapiens
aaagaggaaucuggaguuu

SEQ ID NO: 157401 - RNA, 19 nt, Homo sapiens
ucaagaucgugcucauuaa

SEQ ID NO: 157402 - RNA, 19 nt, Homo sapiens
gaccugauauacuccauuc

SEQ ID NO: 157403 - RNA, 19 nt, Homo sapiens
caucuucacuaucaccauu

SEQ ID NO: 157404 - RNA, 19 nt, Homo sapiens
ucaccuaccucaacuccuu

SEQ ID NO: 157405 - RNA, 19 nt, Homo sapiens
cugcugcugugcaacauua

SEQ ID NO: 157406 - RNA, 19 nt, Homo sapiens
ugaaagccacucuaucaaa

SEQ ID NO: 157407 - RNA, 19 nt, Homo sapiens
ugacggccacucaguauuu

SEQ ID NO: 157408 - RNA, 19 nt, Homo sapiens
caaagaggaaucuggaguu

SEQ ID NO: 157409 - RNA, 19 nt, Homo sapiens
gaaagugccuucggcuacu

SEQ ID NO: 157410 - RNA, 19 nt, Homo sapiens
gguuugaccugauauacuc

SEQ ID NO: 157411 - RNA, 19 nt, Homo sapiens
uguaugguuugaccugaua

SEQ ID NO: 157412 - RNA, 19 nt, Homo sapiens
aaugaaagccacucuauca

SEQ ID NO: 157413 - RNA, 19 nt, Homo sapiens
ccaaugaaagccacucuau

SEQ ID NO: 157414 - RNA, 19 nt, Homo sapiens
ucagugccaucuucaacaa

SEQ ID NO: 157415 - RNA, 19 nt, Homo sapiens
caugcacccuguacaguug

SEQ ID NO: 157416 - RNA, 19 nt, Homo sapiens
ggaccucauuagcaaagga

SEQ ID NO: 157417 - RNA, 19 nt, Homo sapiens
gguguagccucggcauuug

SEQ ID NO: 157418 - RNA, 19 nt, Homo sapiens
cuaacugacuucugcuuuc

SEQ ID NO: 157419 - RNA, 19 nt, Homo sapiens
gaugcucacuccaaagucu

SEQ ID NO: 157420 - RNA, 19 nt, Homo sapiens
ggaauucuaccgcuacuac

SEQ ID NO: 157421 - RNA, 19 nt, Homo sapiens
ggcauuugcuugaguuucu

SEQ ID NO: 157422 - RNA, 19 nt, Homo sapiens
gcucauuaauucauuuggu

SEQ ID NO: 157423 - RNA, 19 nt, Homo sapiens
ccacucaguauuucacaaa

SEQ ID NO: 157424 - RNA, 19 nt, Homo sapiens
caaaggagaggagccaaga

SEQ ID NO: 157425 - RNA, 19 nt, Homo sapiens
ggguguagccucggcauuu

SEQ ID NO: 157426 - RNA, 19 nt, Homo sapiens
caaaggauggacagaagga

SEQ ID NO: 157427 - RNA, 19 nt, Homo sapiens
ugacaaaggauggacagaa

SEQ ID NO: 157428 - RNA, 19 nt, Homo sapiens
cugggaacguuacuucauu

SEQ ID NO: 157429 - RNA, 19 nt, Homo sapiens
caagaucgugcucauuaau

SEQ ID NO: 157430 - RNA, 19 nt, Homo sapiens
gagccucacagcuguauuc

SEQ ID NO: 157431 - RNA, 19 nt, Homo sapiens
ucauuccuguguccuguuu

SEQ ID NO: 157432 - RNA, 19 nt, Homo sapiens
acucucagcccaccaauga

SEQ ID NO: 157433 - RNA, 19 nt, Homo sapiens
gccaagagcaggcaaagag

SEQ ID NO: 157434 - RNA, 19 nt, Homo sapiens
gagaugaggagggagagaa

SEQ ID NO: 157435 - RNA, 19 nt, Homo sapiens
aucaagaucgugcucauua

SEQ ID NO: 157436 - RNA, 19 nt, Homo sapiens
cuguacaguugccacguua

SEQ ID NO: 157437 - RNA, 19 nt, Homo sapiens
agaucgugcucauuaauuc

SEQ ID NO: 157438 - RNA, 19 nt, Homo sapiens
caaaccgccuggacauguc

SEQ ID NO: 157439 - RNA, 19 nt, Homo sapiens
gggagcaggagaccaaguu

SEQ ID NO: 157440 - RNA, 19 nt, Homo sapiens
ccgcaggccugggaauuuc

SEQ ID NO: 157441 - RNA, 19 nt, Homo sapiens
uaucaccauugggauguuu

SEQ ID NO: 157442 - RNA, 19 nt, Homo sapiens
agccugugcuguuaucauu

SEQ ID NO: 157443 - RNA, 19 nt, Homo sapiens
ucugaccguuguaugguuu

SEQ ID NO: 157444 - RNA, 19 nt, Homo sapiens
uguccuguuucuugacuuu

SEQ ID NO: 157445 - RNA, 19 nt, Homo sapiens
ucaccagccucaggacaga

SEQ ID NO: 157446 - RNA, 19 nt, Homo sapiens
gaacaccaucaccaugaca

SEQ ID NO: 157447 - RNA, 19 nt, Homo sapiens
uggaugcucugcccuucuu

SEQ ID NO: 157448 - RNA, 19 nt, Homo sapiens
ucacaaaccgccuggacau

SEQ ID NO: 157449 - RNA, 19 nt, Homo sapiens
ccuguguccuguuucuuga

SEQ ID NO: 157450 - RNA, 19 nt, Homo sapiens
gccuucggcuacuuuauca

SEQ ID NO: 157451 - RNA, 19 nt, Homo sapiens
cuaccugacuguggucuuc

SEQ ID NO: 157452 - RNA, 19 nt, Homo sapiens
ucaugacggccacucagua

SEQ ID NO: 157453 - RNA, 19 nt, Homo sapiens
gcagcaccugggaacguua

SEQ ID NO: 157454 - RNA, 19 nt, Homo sapiens
ucucagcccaccaaugaaa

SEQ ID NO: 157455 - RNA, 19 nt, Homo sapiens
ucaacuccuuccugcauca

SEQ ID NO: 157456 - RNA, 19 nt, Homo sapiens
ccuguacaguugccacguu

SEQ ID NO: 157457 - RNA, 19 nt, Homo sapiens
ugacugaucccugcuugug

SEQ ID NO: 157458 - RNA, 19 nt, Homo sapiens
caugacggccacucaguau

SEQ ID NO: 157459 - RNA, 19 nt, Homo sapiens
gaucgugcucauuaauuca

SEQ ID NO: 157460 - RNA, 19 nt, Homo sapiens
acaaugucaugacccuaug

SEQ ID NO: 157461 - RNA, 19 nt, Homo sapiens
gacggccacucaguauuuc

SEQ ID NO: 157462 - RNA, 19 nt, Homo sapiens
caaugaaagccacucuauc

SEQ ID NO: 157463 - RNA, 19 nt, Homo sapiens
ggagcaggagaccaaguug

SEQ ID NO: 157464 - RNA, 19 nt, Homo sapiens
cugcugguguuucugauca

SEQ ID NO: 157465 - RNA, 19 nt, Homo sapiens
ugaguggucuggcgguuuu

SEQ ID NO: 157466 - RNA, 19 nt, Homo sapiens
ugcuucaucuucacuauca

SEQ ID NO: 157467 - RNA, 19 nt, Homo sapiens
aguuggaccucauuagcaa

SEQ ID NO: 157468 - RNA, 19 nt, Homo sapiens
aagaucgugcucauuaauu

SEQ ID NO: 157469 - RNA, 19 nt, Homo sapiens
ugggaacguuacuucauuc

SEQ ID NO: 157470 - RNA, 19 nt, Homo sapiens
gaaucuggaguuucagucu

SEQ ID NO: 157471 - RNA, 19 nt, Homo sapiens
ucaugcacccuguacaguu

SEQ ID NO: 157472 - RNA, 19 nt, Homo sapiens
ucuccacucuuggcucuga

SEQ ID NO: 157473 - RNA, 19 nt, Homo sapiens
gaccgcaggagccaucaug

SEQ ID NO: 157474 - RNA, 19 nt, Homo sapiens
cgugcucauuaauucauuu

SEQ ID NO: 157475 - RNA, 19 nt, Homo sapiens
caucuucaacaaugucaug

SEQ ID NO: 157476 - RNA, 19 nt, Homo sapiens
caaguuggaccucauuagc

SEQ ID NO: 157477 - RNA, 19 nt, Homo sapiens
acaaaccgccuggacaugu

SEQ ID NO: 157478 - RNA, 19 nt, Homo sapiens
uaacugacuucugcuuucc

SEQ ID NO: 157479 - RNA, 19 nt, Homo sapiens
gagcaggcaaagaggaauc

SEQ ID NO: 157480 - RNA, 19 nt, Homo sapiens
gaugcucugcccuucuuug

SEQ ID NO: 157481 - RNA, 19 nt, Homo sapiens
agugccaucuucaacaaug

SEQ ID NO: 157482 - RNA, 19 nt, Homo sapiens
cuuggucacugcugaacug

SEQ ID NO: 157483 - RNA, 19 nt, Homo sapiens
gccacucaguauuucacaa

SEQ ID NO: 157484 - RNA, 19 nt, Homo sapiens
ucuaacugacuucugcuuu

SEQ ID NO: 157485 - RNA, 19 nt, Homo sapiens
ggagccaagagcaggcaaa

SEQ ID NO: 157486 - RNA, 19 nt, Homo sapiens
gaauguguccuuggucacu

SEQ ID NO: 157487 - RNA, 19 nt, Homo sapiens
gcuacuaccagcagcucaa

SEQ ID NO: 157488 - RNA, 19 nt, Homo sapiens
guuauucaccuaccucaac

SEQ ID NO: 157489 - RNA, 19 nt, Homo sapiens
gaagauagauuaacaagug

SEQ ID NO: 157490 - RNA, 19 nt, Homo sapiens
gaaauuagguuacacaaca

SEQ ID NO: 157491 - RNA, 19 nt, Homo sapiens
gaagaaagaugcaucagau

SEQ ID NO: 157492 - RNA, 19 nt, Homo sapiens
gaacauggcuccacaacca

SEQ ID NO: 157493 - RNA, 19 nt, Homo sapiens
ggacuacccuaucaaguaa

SEQ ID NO: 157494 - RNA, 19 nt, Homo sapiens
gaaacuaggccuuggcuua

SEQ ID NO: 157495 - RNA, 19 nt, Homo sapiens
gcacaaaugucuaguucuu

SEQ ID NO: 157496 - RNA, 19 nt, Homo sapiens
cgacuuaccagaugaauua

SEQ ID NO: 157497 - RNA, 19 nt, Homo sapiens
ggaaguggaucaaccagaa

SEQ ID NO: 157498 - RNA, 19 nt, Homo sapiens
gaucccagcuccauagaaa

SEQ ID NO: 157499 - RNA, 19 nt, Homo sapiens
gauuaugacuuguguauca

SEQ ID NO: 157500 - RNA, 19 nt, Homo sapiens
auaaacagcugucagaauu

SEQ ID NO: 157501 - RNA, 19 nt, Homo sapiens
gaugauauuuggcuuaugu

SEQ ID NO: 157502 - RNA, 19 nt, Homo sapiens
gaccagaauucaaugcuuu

SEQ ID NO: 157503 - RNA, 19 nt, Homo sapiens
ggugaacucuccuauaaug

SEQ ID NO: 157504 - RNA, 19 nt, Homo sapiens
uaaacaagcuacugaagau

SEQ ID NO: 157505 - RNA, 19 nt, Homo sapiens
caucacggguauacaaaua

SEQ ID NO: 157506 - RNA, 19 nt, Homo sapiens
ccggugaacucuccuauaa

SEQ ID NO: 157507 - RNA, 19 nt, Homo sapiens
gagacacgcuggcacugua

SEQ ID NO: 157508 - RNA, 19 nt, Homo sapiens
gauaaugccuaaucaaguc

SEQ ID NO: 157509 - RNA, 19 nt, Homo sapiens
gacaagggauaaugccuaa

SEQ ID NO: 157510 - RNA, 19 nt, Homo sapiens
gaugaacaguccaguaaau

SEQ ID NO: 157511 - RNA, 19 nt, Homo sapiens
guaugaaucugcaaacaau

SEQ ID NO: 157512 - RNA, 19 nt, Homo sapiens
ccugagggaugauagaaua

SEQ ID NO: 157513 - RNA, 19 nt, Homo sapiens
cuaauucucucuccaauca

SEQ ID NO: 157514 - RNA, 19 nt, Homo sapiens
gcaugcauguucaagagua

SEQ ID NO: 157515 - RNA, 19 nt, Homo sapiens
gcaaagccuuggauacugu

SEQ ID NO: 157516 - RNA, 19 nt, Homo sapiens
gggaguaaauggaggugua

SEQ ID NO: 157517 - RNA, 19 nt, Homo sapiens
acagagcaguccuggauua

SEQ ID NO: 157518 - RNA, 19 nt, Homo sapiens
gagcacgacuuaccagaug

SEQ ID NO: 157519 - RNA, 19 nt, Homo sapiens
gggaaugaauguaacaaau

SEQ ID NO: 157520 - RNA, 19 nt, Homo sapiens
ucuauaagauccagaaaga

SEQ ID NO: 157521 - RNA, 19 nt, Homo sapiens
aagcaaacaugcaagauga

SEQ ID NO: 157522 - RNA, 19 nt, Homo sapiens
caagugagggagaugauua

SEQ ID NO: 157523 - RNA, 19 nt, Homo sapiens
caaagaaccagcagaauca

SEQ ID NO: 157524 - RNA, 19 nt, Homo sapiens
ccaaguaugccaacucuaa

SEQ ID NO: 157525 - RNA, 19 nt, Homo sapiens
ugugauggcuguuuaaaga

SEQ ID NO: 157526 - RNA, 19 nt, Homo sapiens
gagaaguguuucaaugaga

SEQ ID NO: 157527 - RNA, 19 nt, Homo sapiens
gcaaagaaccagcagaauc

SEQ ID NO: 157528 - RNA, 19 nt, Homo sapiens
aaucaacucuacagaauug

SEQ ID NO: 157529 - RNA, 19 nt, Homo sapiens
gugcaaagauguucauucu

SEQ ID NO: 157530 - RNA, 19 nt, Homo sapiens
ggaaauaugggacagauag

SEQ ID NO: 157531 - RNA, 19 nt, Homo sapiens
guucaauaaugccugguua

SEQ ID NO: 157532 - RNA, 19 nt, Homo sapiens
gaugaugccucgaauaacu

SEQ ID NO: 157533 - RNA, 19 nt, Homo sapiens
cuagagacaccuuguauuu

SEQ ID NO: 157534 - RNA, 19 nt, Homo sapiens
uaaaucagaugccgacaca

SEQ ID NO: 157535 - RNA, 19 nt, Homo sapiens
uaacuuaucuccauuugcu

SEQ ID NO: 157536 - RNA, 19 nt, Homo sapiens
caacagagcaguccuggau

SEQ ID NO: 157537 - RNA, 19 nt, Homo sapiens
auacauaucuuaccucgau

SEQ ID NO: 157538 - RNA, 19 nt, Homo sapiens
agaggucacuguuagagua

SEQ ID NO: 157539 - RNA, 19 nt, Homo sapiens
gaagagagaagcacugagu

SEQ ID NO: 157540 - RNA, 19 nt, Homo sapiens
ucgaauaacuccacaaucu

SEQ ID NO: 157541 - RNA, 19 nt, Homo sapiens
cagaugaugccucgaauaa

SEQ ID NO: 157542 - RNA, 19 nt, Homo sapiens
ccagaaagaacuagaagaa

SEQ ID NO: 157543 - RNA, 19 nt, Homo sapiens
cgacagggaugcagcaaca

SEQ ID NO: 157544 - RNA, 19 nt, Homo sapiens
ggaagaaagcauuaaggaa

SEQ ID NO: 157545 - RNA, 19 nt, Homo sapiens
gagagaagcacugaguuaa

SEQ ID NO: 157546 - RNA, 19 nt, Homo sapiens
ugagggagaugauuauauc

SEQ ID NO: 157547 - RNA, 19 nt, Homo sapiens
ucacagggaaugaauguaa

SEQ ID NO: 157548 - RNA, 19 nt, Homo sapiens
ggaauacuaccaccuucua

SEQ ID NO: 157549 - RNA, 19 nt, Homo sapiens
caaacaaucgagcggaaua

SEQ ID NO: 157550 - RNA, 19 nt, Homo sapiens
gggcaugaauccuggaaug

SEQ ID NO: 157551 - RNA, 19 nt, Homo sapiens
caacagguaugaugaacag

SEQ ID NO: 157552 - RNA, 19 nt, Homo sapiens
ggaccagaauucaaugcuu

SEQ ID NO: 157553 - RNA, 19 nt, Homo sapiens
caacagaugcaacaaggaa

SEQ ID NO: 157554 - RNA, 19 nt, Homo sapiens
cuaacgaccucucacagaa

SEQ ID NO: 157555 - RNA, 19 nt, Homo sapiens
aauaagagcagccugagua

SEQ ID NO: 157556 - RNA, 19 nt, Homo sapiens
ggaagaaagaugcaucaga

SEQ ID NO: 157557 - RNA, 19 nt, Homo sapiens
gaggaagaccagccaagua

SEQ ID NO: 157558 - RNA, 19 nt, Homo sapiens
gaugcagcuucuaaacaua

SEQ ID NO: 157559 - RNA, 19 nt, Homo sapiens
ggaaauggcaaugcagauu

SEQ ID NO: 157560 - RNA, 19 nt, Homo sapiens
guucauuucuuccguccua

SEQ ID NO: 157561 - RNA, 19 nt, Homo sapiens
gcuaaaagguugccaucua

SEQ ID NO: 157562 - RNA, 19 nt, Homo sapiens
caagcucucugaggucuuu

SEQ ID NO: 157563 - RNA, 19 nt, Homo sapiens
gccagcagaucccuaauuc

SEQ ID NO: 157564 - RNA, 19 nt, Homo sapiens
gcuguuggcugcauucauc

SEQ ID NO: 157565 - RNA, 19 nt, Homo sapiens
gcagcggacuggugugguu

SEQ ID NO: 157566 - RNA, 19 nt, Homo sapiens
ggagagagggcgagagaga

SEQ ID NO: 157567 - RNA, 19 nt, Homo sapiens
guccaugacuacaaggaua

SEQ ID NO: 157568 - RNA, 19 nt, Homo sapiens
ggagaguauacauaucuua

SEQ ID NO: 157569 - RNA, 19 nt, Homo sapiens
gagaagcacugaguuaaaa

SEQ ID NO: 157570 - RNA, 19 nt, Homo sapiens
gaaucaauuuggccagaug

SEQ ID NO: 157571 - RNA, 19 nt, Homo sapiens
aaauggagguguaggaguu

SEQ ID NO: 157572 - RNA, 19 nt, Homo sapiens
caugaauccuggaauguug

SEQ ID NO: 157573 - RNA, 19 nt, Homo sapiens
gagcaguccuggauuaggu

SEQ ID NO: 157574 - RNA, 19 nt, Homo sapiens
ugacuuggagcacgacuua

SEQ ID NO: 157575 - RNA, 19 nt, Homo sapiens
ggguuaauguuacuuugaa

SEQ ID NO: 157576 - RNA, 19 nt, Homo sapiens
gaaauggcaaugcagauuc

SEQ ID NO: 157577 - RNA, 19 nt, Homo sapiens
gcaaugaaagcacagaugu

SEQ ID NO: 157578 - RNA, 19 nt, Homo sapiens
gcacgaacuaggaaagaaa

SEQ ID NO: 157579 - RNA, 19 nt, Homo sapiens
uuaaucagcuucagacaag

SEQ ID NO: 157580 - RNA, 19 nt, Homo sapiens
gaaaacaccagcaaugaaa

SEQ ID NO: 157581 - RNA, 19 nt, Homo sapiens
uagagaaucgugugaauga

SEQ ID NO: 157582 - RNA, 19 nt, Homo sapiens
gaauugcugcgaucuggua

SEQ ID NO: 157583 - RNA, 19 nt, Homo sapiens
gcuuguaucuccgaaagaa

SEQ ID NO: 157584 - RNA, 19 nt, Homo sapiens
ugaagaaauugaugguguu

SEQ ID NO: 157585 - RNA, 19 nt, Homo sapiens
caggagaggucacuguuag

SEQ ID NO: 157586 - RNA, 19 nt, Homo sapiens
cgucugugauggcuguuua

SEQ ID NO: 157587 - RNA, 19 nt, Homo sapiens
uaacaagugcaaaggaauu

SEQ ID NO: 157588 - RNA, 19 nt, Homo sapiens
ccaagcgacugcaggaaug

SEQ ID NO: 157589 - RNA, 19 nt, Homo sapiens
ucacagaacugauugguua

SEQ ID NO: 157590 - RNA, 19 nt, Homo sapiens
gcaaagacauguccacaga

SEQ ID NO: 157591 - RNA, 19 nt, Homo sapiens
gcaaauguacccaaugaua

SEQ ID NO: 157592 - RNA, 19 nt, Homo sapiens
gagcgggacuucuucauga

SEQ ID NO: 157593 - RNA, 19 nt, Homo sapiens
agacggagguguucuauga

SEQ ID NO: 157594 - RNA, 19 nt, Homo sapiens
gcgcaaauguacccaauga

SEQ ID NO: 157595 - RNA, 19 nt, Homo sapiens
ggacaaggccuccaucaug

SEQ ID NO: 157596 - RNA, 19 nt, Homo sapiens
ggugggagcugcccuuuga

SEQ ID NO: 157597 - RNA, 19 nt, Homo sapiens
ucaaugagcuggacuugga

SEQ ID NO: 157598 - RNA, 19 nt, Homo sapiens
ugagugagauugagaagaa

SEQ ID NO: 157599 - RNA, 19 nt, Homo sapiens
caacugcccuccucacaau

SEQ ID NO: 157600 - RNA, 19 nt, Homo sapiens
caaauguacccaaugauaa

SEQ ID NO: 157601 - RNA, 19 nt, Homo sapiens
ucuaugagcuggcccauga

SEQ ID NO: 157602 - RNA, 19 nt, Homo sapiens
gagcuaacaggacauagua

SEQ ID NO: 157603 - RNA, 19 nt, Homo sapiens
gauaacgaccugaagauug

SEQ ID NO: 157604 - RNA, 19 nt, Homo sapiens
aagaguaacuuccuauuca

SEQ ID NO: 157605 - RNA, 19 nt, Homo sapiens
ggcagcaccucacauuuga

SEQ ID NO: 157606 - RNA, 19 nt, Homo sapiens
gcaaggagacggagguguu

SEQ ID NO: 157607 - RNA, 19 nt, Homo sapiens
ucaacuacguccugaguga

SEQ ID NO: 157608 - RNA, 19 nt, Homo sapiens
gaacugaccagauaugacu

SEQ ID NO: 157609 - RNA, 19 nt, Homo sapiens
gcaguacccagacggauuu

SEQ ID NO: 157610 - RNA, 19 nt, Homo sapiens
auaacgaccugaagauuga

SEQ ID NO: 157611 - RNA, 19 nt, Homo sapiens
ugaaagccuuggaggguuu

SEQ ID NO: 157612 - RNA, 19 nt, Homo sapiens
gccaucaucucucuggauu

SEQ ID NO: 157613 - RNA, 19 nt, Homo sapiens
cauaguaucuuugacuuca

SEQ ID NO: 157614 - RNA, 19 nt, Homo sapiens
gacccaagauggcgacaug

SEQ ID NO: 157615 - RNA, 19 nt, Homo sapiens
aaugauaaguucacccaaa

SEQ ID NO: 157616 - RNA, 19 nt, Homo sapiens
caucaucucucuggauuuc

SEQ ID NO: 157617 - RNA, 19 nt, Homo sapiens
caccaagggucagguagua

SEQ ID NO: 157618 - RNA, 19 nt, Homo sapiens
ccacagagcgggacuucuu

SEQ ID NO: 157619 - RNA, 19 nt, Homo sapiens
gacauaguaucuuugacuu

SEQ ID NO: 157620 - RNA, 19 nt, Homo sapiens
ggaaacggaugaagaaccu

SEQ ID NO: 157621 - RNA, 19 nt, Homo sapiens
ccaauagcccugaagacua

SEQ ID NO: 157622 - RNA, 19 nt, Homo sapiens
gagcgcaaauguacccaau

SEQ ID NO: 157623 - RNA, 19 nt, Homo sapiens
gguaguaaguggccaguac

SEQ ID NO: 157624 - RNA, 19 nt, Homo sapiens
caucaugugugaaccaauc

SEQ ID NO: 157625 - RNA, 19 nt, Homo sapiens
ggacauaguaucuuugacu

SEQ ID NO: 157626 - RNA, 19 nt, Homo sapiens
caucaugugugucaacuac

SEQ ID NO: 157627 - RNA, 19 nt, Homo sapiens
aagcuccucuccucaguuu

SEQ ID NO: 157628 - RNA, 19 nt, Homo sapiens
ugcccgaacugaccagaua

SEQ ID NO: 157629 - RNA, 19 nt, Homo sapiens
ccacugagcgcaaauguac

SEQ ID NO: 157630 - RNA, 19 nt, Homo sapiens
agcgacagcuggaguauga

SEQ ID NO: 157631 - RNA, 19 nt, Homo sapiens
ccagauccaccauuacauu

SEQ ID NO: 157632 - RNA, 19 nt, Homo sapiens
ggauaacgaccugaagauu

SEQ ID NO: 157633 - RNA, 19 nt, Homo sapiens
ugaagacuauuacacaucu

SEQ ID NO: 157634 - RNA, 19 nt, Homo sapiens
agauugaagugauugagaa

SEQ ID NO: 157635 - RNA, 19 nt, Homo sapiens
aacaggacauaguaucuuu

SEQ ID NO: 157636 - RNA, 19 nt, Homo sapiens
gaagaaugacgugguguuc

SEQ ID NO: 157637 - RNA, 19 nt, Homo sapiens
acacaucuuuggauaacga

SEQ ID NO: 157638 - RNA, 19 nt, Homo sapiens
ugaacagcaucuuugauag

SEQ ID NO: 157639 - RNA, 19 nt, Homo sapiens
ccgcucagccuaugaauuc

SEQ ID NO: 157640 - RNA, 19 nt, Homo sapiens
gccaaggaccaaugcagua

SEQ ID NO: 157641 - RNA, 19 nt, Homo sapiens
ccugaagauugaagugauu

SEQ ID NO: 157642 - RNA, 19 nt, Homo sapiens
gacagaaucacagaacuga

SEQ ID NO: 157643 - RNA, 19 nt, Homo sapiens
gcacgggccaggugaaagu

SEQ ID NO: 157644 - RNA, 19 nt, Homo sapiens
gggaucagcgcacagaguu

SEQ ID NO: 157645 - RNA, 19 nt, Homo sapiens
augaacagcaucuuugaua

SEQ ID NO: 157646 - RNA, 19 nt, Homo sapiens
gcuggaguaugaagagcaa

SEQ ID NO: 157647 - RNA, 19 nt, Homo sapiens
guaacuuccuauucaccaa

SEQ ID NO: 157648 - RNA, 19 nt, Homo sapiens
gaccaagagucaccagaac

SEQ ID NO: 157649 - RNA, 19 nt, Homo sapiens
ccagacggauuucaaugag

SEQ ID NO: 157650 - RNA, 19 nt, Homo sapiens
gaacagcaucuuugauagc

SEQ ID NO: 157651 - RNA, 19 nt, Homo sapiens
ccaagagucaccagaacuu

SEQ ID NO: 157652 - RNA, 19 nt, Homo sapiens
gugaaagucuacaacaacu

SEQ ID NO: 157653 - RNA, 19 nt, Homo sapiens
gaaaacaucagcaaguuca

SEQ ID NO: 157654 - RNA, 19 nt, Homo sapiens
cagauccaccauuacauuu

SEQ ID NO: 157655 - RNA, 19 nt, Homo sapiens
gcccauguccuccaucuuc

SEQ ID NO: 157656 - RNA, 19 nt, Homo sapiens
gccaugaacagcaucuuug

SEQ ID NO: 157657 - RNA, 19 nt, Homo sapiens
gcgcuagacuccgagaaca

SEQ ID NO: 157658 - RNA, 19 nt, Homo sapiens
cagcugacaaggagaagaa

SEQ ID NO: 157659 - RNA, 19 nt, Homo sapiens
ggccaugaacagcaucuuu

SEQ ID NO: 157660 - RNA, 19 nt, Homo sapiens
ccgagaacaugaccaagag

SEQ ID NO: 157661 - RNA, 19 nt, Homo sapiens
uaacaggacauaguaucuu

SEQ ID NO: 157662 - RNA, 19 nt, Homo sapiens
ggagcuaacaggacauagu

SEQ ID NO: 157663 - RNA, 19 nt, Homo sapiens
uggcagcaccucacauuug

SEQ ID NO: 157664 - RNA, 19 nt, Homo sapiens
caaggucugcaaaggguuu

SEQ ID NO: 157665 - RNA, 19 nt, Homo sapiens
uuacacaucuuuggauaac

SEQ ID NO: 157666 - RNA, 19 nt, Homo sapiens
gauccaccauuacauuuug

SEQ ID NO: 157667 - RNA, 19 nt, Homo sapiens
ucagugccaugacaaacau

SEQ ID NO: 157668 - RNA, 19 nt, Homo sapiens
guacccagacggauuucaa

SEQ ID NO: 157669 - RNA, 19 nt, Homo sapiens
gauaugacugugaggugaa

SEQ ID NO: 157670 - RNA, 19 nt, Homo sapiens
gacaaugacagcugacaag

SEQ ID NO: 157671 - RNA, 19 nt, Homo sapiens
caggacauaguaucuuuga

SEQ ID NO: 157672 - RNA, 19 nt, Homo sapiens
cagaaaacaucagcaaguu

SEQ ID NO: 157673 - RNA, 19 nt, Homo sapiens
uguccuccaucuucuuuga

SEQ ID NO: 157674 - RNA, 19 nt, Homo sapiens
gagacacuggcacccuaua

SEQ ID NO: 157675 - RNA, 19 nt, Homo sapiens
ccaugaacagcaucuuuga

SEQ ID NO: 157676 - RNA, 19 nt, Homo sapiens
gcuaacaggacauaguauc

SEQ ID NO: 157677 - RNA, 19 nt, Homo sapiens
uuacacagguggagcuaac

SEQ ID NO: 157678 - RNA, 19 nt, Homo sapiens
gaagcgacagcuggaguau

SEQ ID NO: 157679 - RNA, 19 nt, Homo sapiens
ugaagcgacagcuggagua

SEQ ID NO: 157680 - RNA, 19 nt, Homo sapiens
gaccugaagauugaaguga

SEQ ID NO: 157681 - RNA, 19 nt, Homo sapiens
ugacagcugacaaggagaa

SEQ ID NO: 157682 - RNA, 19 nt, Homo sapiens
gcaccaagggucagguagu

SEQ ID NO: 157683 - RNA, 19 nt, Homo sapiens
gcucagccuaugaauucua

SEQ ID NO: 157684 - RNA, 19 nt, Homo sapiens
ggugaaagucuacaacaac

SEQ ID NO: 157685 - RNA, 19 nt, Homo sapiens
ggagacggagguguucuau

SEQ ID NO: 157686 - RNA, 19 nt, Homo sapiens
ugguagcccucuccaacaa

SEQ ID NO: 157687 - RNA, 19 nt, Homo sapiens
acaagccacugagcgcaaa

SEQ ID NO: 157688 - RNA, 19 nt, Homo sapiens
gcccuuugaugccggacaa

SEQ ID NO: 157689 - RNA, 19 nt, Homo sapiens
aaacacagccucaccauua

SEQ ID NO: 157690 - RNA, 19 nt, Homo sapiens
gaagaaagcccucaaucaa

SEQ ID NO: 157691 - RNA, 19 nt, Homo sapiens
ggaggaaucuugucaaaca

SEQ ID NO: 157692 - RNA, 19 nt, Homo sapiens
gcaaagaaguagagucaga

SEQ ID NO: 157693 - RNA, 19 nt, Homo sapiens
ggaagaaggcaaagaagua

SEQ ID NO: 157694 - RNA, 19 nt, Homo sapiens
cagaagacauaacaagaua

SEQ ID NO: 157695 - RNA, 19 nt, Homo sapiens
ggugaaagcuucuaaugga

SEQ ID NO: 157696 - RNA, 19 nt, Homo sapiens
gaaagucuguguagaacau

SEQ ID NO: 157697 - RNA, 19 nt, Homo sapiens
ccaaagugcugaagauuuc

SEQ ID NO: 157698 - RNA, 19 nt, Homo sapiens
ccaagaccaucacuuauga

SEQ ID NO: 157699 - RNA, 19 nt, Homo sapiens
cgagauugcugaugaguga

SEQ ID NO: 157700 - RNA, 19 nt, Homo sapiens
ugaaugggauaaacgcuua

SEQ ID NO: 157701 - RNA, 19 nt, Homo sapiens
uuaauugggugguuuguaa

SEQ ID NO: 157702 - RNA, 19 nt, Homo sapiens
ccaaagacgucccuauugu

SEQ ID NO: 157703 - RNA, 19 nt, Homo sapiens
gcuaagaaauuauggaaag

SEQ ID NO: 157704 - RNA, 19 nt, Homo sapiens
cuucagacuuucaagauua

SEQ ID NO: 157705 - RNA, 19 nt, Homo sapiens
ugacacaguuuaugaaugu

SEQ ID NO: 157706 - RNA, 19 nt, Homo sapiens
ccgagcagcuaagaaauua

SEQ ID NO: 157707 - RNA, 19 nt, Homo sapiens
cuaguggccuucugguuua

SEQ ID NO: 157708 - RNA, 19 nt, Homo sapiens
ggacaagauuugcuuaaac

SEQ ID NO: 157709 - RNA, 19 nt, Homo sapiens
gcaagcuagugcucuaauu

SEQ ID NO: 157710 - RNA, 19 nt, Homo sapiens
cacaggagaugcugauauu

SEQ ID NO: 157711 - RNA, 19 nt, Homo sapiens
caagagcaguaugaaagua

SEQ ID NO: 157712 - RNA, 19 nt, Homo sapiens
gaagagugcuccaaaauag

SEQ ID NO: 157713 - RNA, 19 nt, Homo sapiens
ggaaggagaaggacuugaa

SEQ ID NO: 157714 - RNA, 19 nt, Homo sapiens
gcgcuaggauccaaauuuc

SEQ ID NO: 157715 - RNA, 19 nt, Homo sapiens
gaaggaagagggugaggaa

SEQ ID NO: 157716 - RNA, 19 nt, Homo sapiens
agaccgagauugcugauga

SEQ ID NO: 157717 - RNA, 19 nt, Homo sapiens
agaccaagaccaucacuua

SEQ ID NO: 157718 - RNA, 19 nt, Homo sapiens
gcacagaaggaaacaguga

SEQ ID NO: 157719 - RNA, 19 nt, Homo sapiens
ggauuccgccaaagaaaua

SEQ ID NO: 157720 - RNA, 19 nt, Homo sapiens
gggacaagauuugcuuaaa

SEQ ID NO: 157721 - RNA, 19 nt, Homo sapiens
gaaaguaccaucggauuca

SEQ ID NO: 157722 - RNA, 19 nt, Homo sapiens
agaaagagauagaauuugg

SEQ ID NO: 157723 - RNA, 19 nt, Homo sapiens
gaaguagagucagauaaag

SEQ ID NO: 157724 - RNA, 19 nt, Homo sapiens
gaagguggcguccuagaug

SEQ ID NO: 157725 - RNA, 19 nt, Homo sapiens
gaaauuauggaaagucugu

SEQ ID NO: 157726 - RNA, 19 nt, Homo sapiens
ggagauaauuggugugaac

SEQ ID NO: 157727 - RNA, 19 nt, Homo sapiens
uaacaucaaugggcaaauc

SEQ ID NO: 157728 - RNA, 19 nt, Homo sapiens
gaacacaaggugaaagcuu

SEQ ID NO: 157729 - RNA, 19 nt, Homo sapiens
caggaggaaucuugucaaa

SEQ ID NO: 157730 - RNA, 19 nt, Homo sapiens
agugaaggcugaagugaaa

SEQ ID NO: 157731 - RNA, 19 nt, Homo sapiens
uguagaacaucacacguuu

SEQ ID NO: 157732 - RNA, 19 nt, Homo sapiens
acaguuaacagaagacaua

SEQ ID NO: 157733 - RNA, 19 nt, Homo sapiens
ucagagacacguauugaaa

SEQ ID NO: 157734 - RNA, 19 nt, Homo sapiens
aaagugaaaucccaaccaa

SEQ ID NO: 157735 - RNA, 19 nt, Homo sapiens
gaguugaucuucauaaagc

SEQ ID NO: 157736 - RNA, 19 nt, Homo sapiens
gaucuucauucauuaagca

SEQ ID NO: 157737 - RNA, 19 nt, Homo sapiens
gaagcuaaccugccauagu

SEQ ID NO: 157738 - RNA, 19 nt, Homo sapiens
ccacgaaaaugauaaagaa

SEQ ID NO: 157739 - RNA, 19 nt, Homo sapiens
gaaccacggccuagugaau

SEQ ID NO: 157740 - RNA, 19 nt, Homo sapiens
gcucagaccaggcaagcua

SEQ ID NO: 157741 - RNA, 19 nt, Homo sapiens
ucuaagacauggcuggauu

SEQ ID NO: 157742 - RNA, 19 nt, Homo sapiens
gaauuuggaaccagucuug

SEQ ID NO: 157743 - RNA, 19 nt, Homo sapiens
uuacaaagauaagcugaga

SEQ ID NO: 157744 - RNA, 19 nt, Homo sapiens
aaacucaggccaacaagaa

SEQ ID NO: 157745 - RNA, 19 nt, Homo sapiens
cagaggacuuucacgacua

SEQ ID NO: 157746 - RNA, 19 nt, Homo sapiens
gaacaaggagcggacauca

SEQ ID NO: 157747 - RNA, 19 nt, Homo sapiens
gagacacuccuacacauga

SEQ ID NO: 157748 - RNA, 19 nt, Homo sapiens
gagcaagagcaguaugaaa

SEQ ID NO: 157749 - RNA, 19 nt, Homo sapiens
gaaacaugcuaagggacaa

SEQ ID NO: 157750 - RNA, 19 nt, Homo sapiens
gaaacacagccucaccauu

SEQ ID NO: 157751 - RNA, 19 nt, Homo sapiens
agaaguagagucagauaaa

SEQ ID NO: 157752 - RNA, 19 nt, Homo sapiens
gaguuuauaccaagagauu

SEQ ID NO: 157753 - RNA, 19 nt, Homo sapiens
ccagagaagaguuuaguga

SEQ ID NO: 157754 - RNA, 19 nt, Homo sapiens
ggaaggaguagauaucauc

SEQ ID NO: 157755 - RNA, 19 nt, Homo sapiens
ggacuuggaaggaguagau

SEQ ID NO: 157756 - RNA, 19 nt, Homo sapiens
ucauggaacugcauaaguc

SEQ ID NO: 157757 - RNA, 19 nt, Homo sapiens
cagcacaguuaacagaaga

SEQ ID NO: 157758 - RNA, 19 nt, Homo sapiens
gggauaacgcaaccucuaa

SEQ ID NO: 157759 - RNA, 19 nt, Homo sapiens
aaacagacccaucuuugga

SEQ ID NO: 157760 - RNA, 19 nt, Homo sapiens
cgacuauucuccucguuuc

SEQ ID NO: 157761 - RNA, 19 nt, Homo sapiens
aagcuaaccugccauaguc

SEQ ID NO: 157762 - RNA, 19 nt, Homo sapiens
caggagaugcugauauuga

SEQ ID NO: 157763 - RNA, 19 nt, Homo sapiens
gagagcaagagcaguauga

SEQ ID NO: 157764 - RNA, 19 nt, Homo sapiens
ggucuagccauuugggaua

SEQ ID NO: 157765 - RNA, 19 nt, Homo sapiens
gacaagauuugcuuaaacg

SEQ ID NO: 157766 - RNA, 19 nt, Homo sapiens
gaagaaggcaaagaaguag

SEQ ID NO: 157767 - RNA, 19 nt, Homo sapiens
gagcagcuaagaaauuaug

SEQ ID NO: 157768 - RNA, 19 nt, Homo sapiens
uaacagaagacauaacaag

SEQ ID NO: 157769 - RNA, 19 nt, Homo sapiens
aagaaagcccucaaucaaa

SEQ ID NO: 157770 - RNA, 19 nt, Homo sapiens
cgaggaagaaggcaaagaa

SEQ ID NO: 157771 - RNA, 19 nt, Homo sapiens
gagcggacaucagaaagca

SEQ ID NO: 157772 - RNA, 19 nt, Homo sapiens
caagcuagugcucuaauug

SEQ ID NO: 157773 - RNA, 19 nt, Homo sapiens
cugcaagguuucuuuguug

SEQ ID NO: 157774 - RNA, 19 nt, Homo sapiens
agaaagcccucaaucaaaa

SEQ ID NO: 157775 - RNA, 19 nt, Homo sapiens
cuuuggaucuucauucauu

SEQ ID NO: 157776 - RNA, 19 nt, Homo sapiens
gaaagagauagaauuugga

SEQ ID NO: 157777 - RNA, 19 nt, Homo sapiens
uaacgcaaccucuaagaca

SEQ ID NO: 157778 - RNA, 19 nt, Homo sapiens
gcacugcaagguuucuuug

SEQ ID NO: 157779 - RNA, 19 nt, Homo sapiens
gaagaacucagagaagauc

SEQ ID NO: 157780 - RNA, 19 nt, Homo sapiens
aggaagaacucagagaaga

SEQ ID NO: 157781 - RNA, 19 nt, Homo sapiens
ugaaggaggucagaaagag

SEQ ID NO: 157782 - RNA, 19 nt, Homo sapiens
acaaggagcggacaucaga

SEQ ID NO: 157783 - RNA, 19 nt, Homo sapiens
gcaagagcaguaugaaagu

SEQ ID NO: 157784 - RNA, 19 nt, Homo sapiens
uggaguugaucuucauaaa

SEQ ID NO: 157785 - RNA, 19 nt, Homo sapiens
cgucugcccuguuccuuug

SEQ ID NO: 157786 - RNA, 19 nt, Homo sapiens
gaaggaggucagaaagaga

SEQ ID NO: 157787 - RNA, 19 nt, Homo sapiens
gaaaagagaauugugauca

SEQ ID NO: 157788 - RNA, 19 nt, Homo sapiens
uaaugccaaugcugugaaa

SEQ ID NO: 157789 - RNA, 19 nt, Homo sapiens
gaggaacacuggauucuua

SEQ ID NO: 157790 - RNA, 19 nt, Homo sapiens
ccaagaagcuuuccaugua

SEQ ID NO: 157791 - RNA, 19 nt, Homo sapiens
gcagaugacucuccuuuga

SEQ ID NO: 157792 - RNA, 19 nt, Homo sapiens
caacaucacucgaaauaau

SEQ ID NO: 157793 - RNA, 19 nt, Homo sapiens
gaaauccacuucuuagaga

SEQ ID NO: 157794 - RNA, 19 nt, Homo sapiens
cagaagacaucacaagaua

SEQ ID NO: 157795 - RNA, 19 nt, Homo sapiens
guaugaagcugacauucua

SEQ ID NO: 157796 - RNA, 19 nt, Homo sapiens
gaacucaucuuugcaggaa

SEQ ID NO: 157797 - RNA, 19 nt, Homo sapiens
gagaagcgaaucaucauua

SEQ ID NO: 157798 - RNA, 19 nt, Homo sapiens
aaacagugcugguaaguau

SEQ ID NO: 157799 - RNA, 19 nt, Homo sapiens
gaaagaagcaacacagaug

SEQ ID NO: 157800 - RNA, 19 nt, Homo sapiens
ggacucugcugcugaaguu

SEQ ID NO: 157801 - RNA, 19 nt, Homo sapiens
ucaagaagcucccaucaca

SEQ ID NO: 157802 - RNA, 19 nt, Homo sapiens
gaagggaaguagacauugu

SEQ ID NO: 157803 - RNA, 19 nt, Homo sapiens
gugaagagauccuggcauu

SEQ ID NO: 157804 - RNA, 19 nt, Homo sapiens
gucaacagcugaacucuga

SEQ ID NO: 157805 - RNA, 19 nt, Homo sapiens
ccaauggccugcucaucua

SEQ ID NO: 157806 - RNA, 19 nt, Homo sapiens
ccaaggagaucaagaagca

SEQ ID NO: 157807 - RNA, 19 nt, Homo sapiens
gaauuucucaguuccauuu

SEQ ID NO: 157808 - RNA, 19 nt, Homo sapiens
gaagagauccuggcauuuc

SEQ ID NO: 157809 - RNA, 19 nt, Homo sapiens
ggaguaacuucuauaucaa

SEQ ID NO: 157810 - RNA, 19 nt, Homo sapiens
gcaauuccauuuguucuuc

SEQ ID NO: 157811 - RNA, 19 nt, Homo sapiens
caagaggaguaacuucuau

SEQ ID NO: 157812 - RNA, 19 nt, Homo sapiens
gaacaccuacauuuccuuu

SEQ ID NO: 157813 - RNA, 19 nt, Homo sapiens
uguagaagaugguggcuuu

SEQ ID NO: 157814 - RNA, 19 nt, Homo sapiens
guacggaugugcuuugaag

SEQ ID NO: 157815 - RNA, 19 nt, Homo sapiens
ccacuugaaugcaaaggaa

SEQ ID NO: 157816 - RNA, 19 nt, Homo sapiens
aaccaaagcugucguauac

SEQ ID NO: 157817 - RNA, 19 nt, Homo sapiens
aggaguaacuucuauauca

SEQ ID NO: 157818 - RNA, 19 nt, Homo sapiens
cggaugugcuuugaaguua

SEQ ID NO: 157819 - RNA, 19 nt, Homo sapiens
gcagacaaauugaagaacu

SEQ ID NO: 157820 - RNA, 19 nt, Homo sapiens
caucugaacaccuacauuu

SEQ ID NO: 157821 - RNA, 19 nt, Homo sapiens
ggccugaccuucugugaug

SEQ ID NO: 157822 - RNA, 19 nt, Homo sapiens
ccagaagauugccaagaaa

SEQ ID NO: 157823 - RNA, 19 nt, Homo sapiens
ugagccagcuuuauauuuc

SEQ ID NO: 157824 - RNA, 19 nt, Homo sapiens
gcuuuaaccugacugucua

SEQ ID NO: 157825 - RNA, 19 nt, Homo sapiens
cggguucaguguaguaaua

SEQ ID NO: 157826 - RNA, 19 nt, Homo sapiens
gaaagaaagaggaggaaca

SEQ ID NO: 157827 - RNA, 19 nt, Homo sapiens
aggcuuagcuuguggaguu

SEQ ID NO: 157828 - RNA, 19 nt, Homo sapiens
gcagcacacuuuccauaca

SEQ ID NO: 157829 - RNA, 19 nt, Homo sapiens
cauaagaccuuggcuugga

SEQ ID NO: 157830 - RNA, 19 nt, Homo sapiens
guaauaaccaacuccauau

SEQ ID NO: 157831 - RNA, 19 nt, Homo sapiens
gcuccuaacucaccaugug

SEQ ID NO: 157832 - RNA, 19 nt, Homo sapiens
gagcuugugcccagaaauu

SEQ ID NO: 157833 - RNA, 19 nt, Homo sapiens
ggaaguagacauuguaugc

SEQ ID NO: 157834 - RNA, 19 nt, Homo sapiens
uaaccaaagcugucguaua

SEQ ID NO: 157835 - RNA, 19 nt, Homo sapiens
ugagaaagccaaugagaga

SEQ ID NO: 157836 - RNA, 19 nt, Homo sapiens
gcaucgagcaucauacauu

SEQ ID NO: 157837 - RNA, 19 nt, Homo sapiens
cccagaagauugccaagaa

SEQ ID NO: 157838 - RNA, 19 nt, Homo sapiens
caccugagccagcuuuaua

SEQ ID NO: 157839 - RNA, 19 nt, Homo sapiens
aaagaaagcaagaacagaa

SEQ ID NO: 157840 - RNA, 19 nt, Homo sapiens
guucugcacguuacaguua

SEQ ID NO: 157841 - RNA, 19 nt, Homo sapiens
gcaagcacauuccaagacu

SEQ ID NO: 157842 - RNA, 19 nt, Homo sapiens
gaggccaacuccaaugaga

SEQ ID NO: 157843 - RNA, 19 nt, Homo sapiens
gcacagcaaagcaagagaa

SEQ ID NO: 157844 - RNA, 19 nt, Homo sapiens
uugaagaacuggugggauu

SEQ ID NO: 157845 - RNA, 19 nt, Homo sapiens
gagcacaauuggcuuuaag

SEQ ID NO: 157846 - RNA, 19 nt, Homo sapiens
gagaaugccaagaagcuuu

SEQ ID NO: 157847 - RNA, 19 nt, Homo sapiens
gcucucagccauuguagaa

SEQ ID NO: 157848 - RNA, 19 nt, Homo sapiens
uguaauaaccaacuccaua

SEQ ID NO: 157849 - RNA, 19 nt, Homo sapiens
gaacacuggauucuuacuu

SEQ ID NO: 157850 - RNA, 19 nt, Homo sapiens
gacguacugucacugauga

SEQ ID NO: 157851 - RNA, 19 nt, Homo sapiens
gaaggagcccaacagcaaa

SEQ ID NO: 157852 - RNA, 19 nt, Homo sapiens
ugaaggagcccaacagcaa

SEQ ID NO: 157853 - RNA, 19 nt, Homo sapiens
gcugugaccucccuucuac

SEQ ID NO: 157854 - RNA, 19 nt, Homo sapiens
ggucuaggaacucaucuuu

SEQ ID NO: 157855 - RNA, 19 nt, Homo sapiens
ggcagacccugaaagauca

SEQ ID NO: 157856 - RNA, 19 nt, Homo sapiens
gggcagacccugaaagauc

SEQ ID NO: 157857 - RNA, 19 nt, Homo sapiens
gacgagcaauuccauuugu

SEQ ID NO: 157858 - RNA, 19 nt, Homo sapiens
ggacaagaagccacaggaa

SEQ ID NO: 157859 - RNA, 19 nt, Homo sapiens
cagcaucaaugagcucaaa

SEQ ID NO: 157860 - RNA, 19 nt, Homo sapiens
cucaagaucuccuacaaga

SEQ ID NO: 157861 - RNA, 19 nt, Homo sapiens
gagggaggauccuuguugu

SEQ ID NO: 157862 - RNA, 19 nt, Homo sapiens
ccacugcacugcgaauuuc

SEQ ID NO: 157863 - RNA, 19 nt, Homo sapiens
gaugugcuuugaaguuaug

SEQ ID NO: 157864 - RNA, 19 nt, Homo sapiens
agaugacucuccuuugaaa

SEQ ID NO: 157865 - RNA, 19 nt, Homo sapiens
caucgagcaucauacauuc

SEQ ID NO: 157866 - RNA, 19 nt, Homo sapiens
guuccuagaucucacugaa

SEQ ID NO: 157867 - RNA, 19 nt, Homo sapiens
gaagggaaaagcauauaua

SEQ ID NO: 157868 - RNA, 19 nt, Homo sapiens
acaaccaccuggccauuga

SEQ ID NO: 157869 - RNA, 19 nt, Homo sapiens
caagaagcuuuccauguac

SEQ ID NO: 157870 - RNA, 19 nt, Homo sapiens
gaagacaucacaagauacu

SEQ ID NO: 157871 - RNA, 19 nt, Homo sapiens
gaaacugcaugagcaacau

SEQ ID NO: 157872 - RNA, 19 nt, Homo sapiens
uggcucagcuccuaacuca

SEQ ID NO: 157873 - RNA, 19 nt, Homo sapiens
gagccagcuuuauauuuca

SEQ ID NO: 157874 - RNA, 19 nt, Homo sapiens
ggaugugcuuugaaguuau

SEQ ID NO: 157875 - RNA, 19 nt, Homo sapiens
ccucaacucucaaugucuu

SEQ ID NO: 157876 - RNA, 19 nt, Homo sapiens
gaagauugccaagaaauac

SEQ ID NO: 157877 - RNA, 19 nt, Homo sapiens
ccacgaugauuguagaagu

SEQ ID NO: 157878 - RNA, 19 nt, Homo sapiens
ucacacccuucucuccuuu

SEQ ID NO: 157879 - RNA, 19 nt, Homo sapiens
ugagcaacaucacucgaaa

SEQ ID NO: 157880 - RNA, 19 nt, Homo sapiens
cacaggaacccuucaagaa

SEQ ID NO: 157881 - RNA, 19 nt, Homo sapiens
gggaguaugagcaauuuga

SEQ ID NO: 157882 - RNA, 19 nt, Homo sapiens
ggcccaagauccucaagau

SEQ ID NO: 157883 - RNA, 19 nt, Homo sapiens
gacagaagacaucacaaga

SEQ ID NO: 157884 - RNA, 19 nt, Homo sapiens
uagcagcacacuuuccaua

SEQ ID NO: 157885 - RNA, 19 nt, Homo sapiens
agaagauugccaagaaaua

SEQ ID NO: 157886 - RNA, 19 nt, Homo sapiens
ugacucuccuuugaaauga

SEQ ID NO: 157887 - RNA, 19 nt, Homo sapiens
aacacuggauucuuacuuu

SEQ ID NO: 157888 - RNA, 19 nt, Homo sapiens
cagacgagcaauuccauuu

SEQ ID NO: 157889 - RNA, 19 nt, Homo sapiens
ccagaagccugaagaauua

SEQ ID NO: 157890 - RNA, 19 nt, Homo sapiens
gaaacucugugacuaauuu

SEQ ID NO: 157891 - RNA, 19 nt, Homo sapiens
gauagggacuuauuaacua

SEQ ID NO: 157892 - RNA, 19 nt, Homo sapiens
guagaacucuugcuuugua

SEQ ID NO: 157893 - RNA, 19 nt, Homo sapiens
gcaguaacuucuacauuaa

SEQ ID NO: 157894 - RNA, 19 nt, Homo sapiens
gaacaggucuuagauaaag

SEQ ID NO: 157895 - RNA, 19 nt, Homo sapiens
ggacagaaaucuccaccaa

SEQ ID NO: 157896 - RNA, 19 nt, Homo sapiens
aaacagagaugguaacaau

SEQ ID NO: 157897 - RNA, 19 nt, Homo sapiens
cagaagaaaugaaugguaa

SEQ ID NO: 157898 - RNA, 19 nt, Homo sapiens
ggaaagcccugagcagaaa

SEQ ID NO: 157899 - RNA, 19 nt, Homo sapiens
cgcaguaacuucuacauua

SEQ ID NO: 157900 - RNA, 19 nt, Homo sapiens
gaaauaaagagacaacuga

SEQ ID NO: 157901 - RNA, 19 nt, Homo sapiens
gaacucuugcuuuguauua

SEQ ID NO: 157902 - RNA, 19 nt, Homo sapiens
gaagagccacagaaaguua

SEQ ID NO: 157903 - RNA, 19 nt, Homo sapiens
ggacaaguguuauuugaca

SEQ ID NO: 157904 - RNA, 19 nt, Homo sapiens
gaugcagccuacugaauua

SEQ ID NO: 157905 - RNA, 19 nt, Homo sapiens
gauaguggcuuuccuucuu

SEQ ID NO: 157906 - RNA, 19 nt, Homo sapiens
cuaaggagcuggaagagaa

SEQ ID NO: 157907 - RNA, 19 nt, Homo sapiens
guaaggugcuguucacuug

SEQ ID NO: 157908 - RNA, 19 nt, Homo sapiens
ggagaauaaugaagaaguu

SEQ ID NO: 157909 - RNA, 19 nt, Homo sapiens
ggagaggugucccauguug

SEQ ID NO: 157910 - RNA, 19 nt, Homo sapiens
gaagugagaagcccaacua

SEQ ID NO: 157911 - RNA, 19 nt, Homo sapiens
cggcagagcuggaacaguu

SEQ ID NO: 157912 - RNA, 19 nt, Homo sapiens
agaaauggcucagaagaaa

SEQ ID NO: 157913 - RNA, 19 nt, Homo sapiens
gaacagaugcaaccaagga

SEQ ID NO: 157914 - RNA, 19 nt, Homo sapiens
gaacaggagggaagagaaa

SEQ ID NO: 157915 - RNA, 19 nt, Homo sapiens
cgaaggcgcucuuaagcaa

SEQ ID NO: 157916 - RNA, 19 nt, Homo sapiens
gggcagagguugggaaaga

SEQ ID NO: 157917 - RNA, 19 nt, Homo sapiens
caagggaguucacaugaga

SEQ ID NO: 157918 - RNA, 19 nt, Homo sapiens
gaagaaauggcucagaaga

SEQ ID NO: 157919 - RNA, 19 nt, Homo sapiens
ggguagaacucuugcuuug

SEQ ID NO: 157920 - RNA, 19 nt, Homo sapiens
ggaccaaagucuuaugaag

SEQ ID NO: 157921 - RNA, 19 nt, Homo sapiens
cacaggagauggagauauu

SEQ ID NO: 157922 - RNA, 19 nt, Homo sapiens
gaaaugaaugguaaagaga

SEQ ID NO: 157923 - RNA, 19 nt, Homo sapiens
aaacaucaggcuagcauua

SEQ ID NO: 157924 - RNA, 19 nt, Homo sapiens
aagaagagguggaggaaga

SEQ ID NO: 157925 - RNA, 19 nt, Homo sapiens
ucaauugacugaagauauc

SEQ ID NO: 157926 - RNA, 19 nt, Homo sapiens
gcugugaccuggagaaaca

SEQ ID NO: 157927 - RNA, 19 nt, Homo sapiens
uaguuacgaugccagauua

SEQ ID NO: 157928 - RNA, 19 nt, Homo sapiens
gagcaggccuaucucuuuc

SEQ ID NO: 157929 - RNA, 19 nt, Homo sapiens
aaaggaaacucugugacua

SEQ ID NO: 157930 - RNA, 19 nt, Homo sapiens
ccaccucccugucuucuga

SEQ ID NO: 157931 - RNA, 19 nt, Homo sapiens
gaacucaagcgcaauuuua

SEQ ID NO: 157932 - RNA, 19 nt, Homo sapiens
ggagagagaagagaaggua

SEQ ID NO: 157933 - RNA, 19 nt, Homo sapiens
gcaaaagucauauaccuua

SEQ ID NO: 157934 - RNA, 19 nt, Homo sapiens
gcacaaaccaucacaucug

SEQ ID NO: 157935 - RNA, 19 nt, Homo sapiens
gggaggaacaggaguauga

SEQ ID NO: 157936 - RNA, 19 nt, Homo sapiens
ccaaggaagugcagaccaa

SEQ ID NO: 157937 - RNA, 19 nt, Homo sapiens
ggccaaagauggaggagau

SEQ ID NO: 157938 - RNA, 19 nt, Homo sapiens
gaacaggaguaugaagaag

SEQ ID NO: 157939 - RNA, 19 nt, Homo sapiens
gcaucgaccucagugaauu

SEQ ID NO: 157940 - RNA, 19 nt, Homo sapiens
uaagggugaugcugaagaa

SEQ ID NO: 157941 - RNA, 19 nt, Homo sapiens
caagaguggugguacacaa

SEQ ID NO: 157942 - RNA, 19 nt, Homo sapiens
cacaaaccaucacaucuga

SEQ ID NO: 157943 - RNA, 19 nt, Homo sapiens
gaaagacgaaagaguaauc

SEQ ID NO: 157944 - RNA, 19 nt, Homo sapiens
gaaaggaaacucugugacu

SEQ ID NO: 157945 - RNA, 19 nt, Homo sapiens
ccaaaaccaucacauauga

SEQ ID NO: 157946 - RNA, 19 nt, Homo sapiens
acagagaugguaacaauuu

SEQ ID NO: 157947 - RNA, 19 nt, Homo sapiens
gcagaccaaugagcugaaa

SEQ ID NO: 157948 - RNA, 19 nt, Homo sapiens
cagaagaaacaagagauua

SEQ ID NO: 157949 - RNA, 19 nt, Homo sapiens
gcaacuaccugcuuuuaau

SEQ ID NO: 157950 - RNA, 19 nt, Homo sapiens
acaagcaggugccagugua

SEQ ID NO: 157951 - RNA, 19 nt, Homo sapiens
ggaacaggaguaugaagaa

SEQ ID NO: 157952 - RNA, 19 nt, Homo sapiens
ucauugaauucucacagua

SEQ ID NO: 157953 - RNA, 19 nt, Homo sapiens
gggaaagacgaaagaguaa

SEQ ID NO: 157954 - RNA, 19 nt, Homo sapiens
ucacaugagacucugaaua

SEQ ID NO: 157955 - RNA, 19 nt, Homo sapiens
uacccaagcuguuguugaa

SEQ ID NO: 157956 - RNA, 19 nt, Homo sapiens
cuuagugcuuucuuucuua

SEQ ID NO: 157957 - RNA, 19 nt, Homo sapiens
aaaccuuagugcuuucuuu

SEQ ID NO: 157958 - RNA, 19 nt, Homo sapiens
gagaagaagcagaggaaga

SEQ ID NO: 157959 - RNA, 19 nt, Homo sapiens
cacaugagacucugaauau

SEQ ID NO: 157960 - RNA, 19 nt, Homo sapiens
gcauugccgugguacaaga

SEQ ID NO: 157961 - RNA, 19 nt, Homo sapiens
uaaagugacccucuuagau

SEQ ID NO: 157962 - RNA, 19 nt, Homo sapiens
aaacacaggaagacaaauu

SEQ ID NO: 157963 - RNA, 19 nt, Homo sapiens
agaaaugaaugguaaagag

SEQ ID NO: 157964 - RNA, 19 nt, Homo sapiens
gcguggagcaucauacuuu

SEQ ID NO: 157965 - RNA, 19 nt, Homo sapiens
ggacuucucauuuacaaag

SEQ ID NO: 157966 - RNA, 19 nt, Homo sapiens
gugaacaccucaaucucuu

SEQ ID NO: 157967 - RNA, 19 nt, Homo sapiens
ggaagacaaauuagaagga

SEQ ID NO: 157968 - RNA, 19 nt, Homo sapiens
gaacagagacaggcuaagg

SEQ ID NO: 157969 - RNA, 19 nt, Homo sapiens
gaugccagauuagauuuau

SEQ ID NO: 157970 - RNA, 19 nt, Homo sapiens
gaauuucacagggauguuu

SEQ ID NO: 157971 - RNA, 19 nt, Homo sapiens
gagaaacgcauugugauca

SEQ ID NO: 157972 - RNA, 19 nt, Homo sapiens
aaacaagaauugagaaacg

SEQ ID NO: 157973 - RNA, 19 nt, Homo sapiens
aaagaguaaucacagaaga

SEQ ID NO: 157974 - RNA, 19 nt, Homo sapiens
gugagaagcccaacuaaag

SEQ ID NO: 157975 - RNA, 19 nt, Homo sapiens
gccagcacccucauagaua

SEQ ID NO: 157976 - RNA, 19 nt, Homo sapiens
aaagacagacugcgaauca

SEQ ID NO: 157977 - RNA, 19 nt, Homo sapiens
caagggacaaguguuauuu

SEQ ID NO: 157978 - RNA, 19 nt, Homo sapiens
guaaagugacccucuuaga

SEQ ID NO: 157979 - RNA, 19 nt, Homo sapiens
gggugaugcugaagaaaug

SEQ ID NO: 157980 - RNA, 19 nt, Homo sapiens
ggguauuucucgguucaua

SEQ ID NO: 157981 - RNA, 19 nt, Homo sapiens
gaagagagagaaggaaaca

SEQ ID NO: 157982 - RNA, 19 nt, Homo sapiens
aaagugacccucuuagaug

SEQ ID NO: 157983 - RNA, 19 nt, Homo sapiens
gaagagaagguaaaagaaa

SEQ ID NO: 157984 - RNA, 19 nt, Homo sapiens
gagacccgauagggacuua

SEQ ID NO: 157985 - RNA, 19 nt, Homo sapiens
gcugaaagccaaaguaguc

SEQ ID NO: 157986 - RNA, 19 nt, Homo sapiens
uaaacaacacucaacuuug

SEQ ID NO: 157987 - RNA, 19 nt, Homo sapiens
agagaagaguguacacgaa

SEQ ID NO: 157988 - RNA, 19 nt, Homo sapiens
gaaagaguaaucacagaag

SEQ ID NO: 157989 - RNA, 19 nt, Homo sapiens
gcaagaggcuucaagguuu

SEQ ID NO: 157990 - RNA, 19 nt, Homo sapiens
gaaguggacugcaacaugu

SEQ ID NO: 157991 - RNA, 19 nt, Homo sapiens
gaaccuaaccaacuauaaa

SEQ ID NO: 157992 - RNA, 19 nt, Homo sapiens
caacaaaagugccuucaua

SEQ ID NO: 157993 - RNA, 19 nt, Homo sapiens
caagccacauucccaauuu

SEQ ID NO: 157994 - RNA, 19 nt, Homo sapiens
ggacaucacucagaacuac

SEQ ID NO: 157995 - RNA, 19 nt, Homo sapiens
gaacggagaaggccagaga

SEQ ID NO: 157996 - RNA, 19 nt, Homo sapiens
gagaacaccuuccuuagac

SEQ ID NO: 157997 - RNA, 19 nt, Homo sapiens
ggaagacauugccauuugu

SEQ ID NO: 157998 - RNA, 19 nt, Homo sapiens
gcgaggacaucacucagaa

SEQ ID NO: 157999 - RNA, 19 nt, Homo sapiens
gaccacaccuugccaucaa

SEQ ID NO: 158000 - RNA, 19 nt, Homo sapiens
gaagacauugccauuugua

SEQ ID NO: 158001 - RNA, 19 nt, Homo sapiens
caaaagugccuucauauuu

SEQ ID NO: 158002 - RNA, 19 nt, Homo sapiens
ggaaguggacugcaacaug

SEQ ID NO: 158003 - RNA, 19 nt, Homo sapiens
gccaagcucuggaggaaga

SEQ ID NO: 158004 - RNA, 19 nt, Homo sapiens
gagcagccuuccaagauca

SEQ ID NO: 158005 - RNA, 19 nt, Homo sapiens
gagagcagccuuccaagau

SEQ ID NO: 158006 - RNA, 19 nt, Homo sapiens
caagaggcuucaagguuug

SEQ ID NO: 158007 - RNA, 19 nt, Homo sapiens
cagugacgcugguuaauca

SEQ ID NO: 158008 - RNA, 19 nt, Homo sapiens
ucacucagaacuacaagua

SEQ ID NO: 158009 - RNA, 19 nt, Homo sapiens
gagaggagcuacagauucc

SEQ ID NO: 158010 - RNA, 19 nt, Homo sapiens
aggaagacauugccauuug

SEQ ID NO: 158011 - RNA, 19 nt, Homo sapiens
gaacuacaaguauccugaa

SEQ ID NO: 158012 - RNA, 19 nt, Homo sapiens
gaaaauggaacgugagaaa

SEQ ID NO: 158013 - RNA, 19 nt, Homo sapiens
gauaugggacuccuguuug

SEQ ID NO: 158014 - RNA, 19 nt, Homo sapiens
ugagaccacugaagcaaga

SEQ ID NO: 158015 - RNA, 19 nt, Homo sapiens
gcaacaacaucagcaccaa

SEQ ID NO: 158016 - RNA, 19 nt, Homo sapiens
uaugauggauggcagauuc

SEQ ID NO: 158017 - RNA, 19 nt, Homo sapiens
gaagacagaaagcccagaa

SEQ ID NO: 158018 - RNA, 19 nt, Homo sapiens
gagagaggagcuacagauu

SEQ ID NO: 158019 - RNA, 19 nt, Homo sapiens
gaacuaucagcuuaaacuu

SEQ ID NO: 158020 - RNA, 19 nt, Homo sapiens
cgagaacaccuuccuuaga

SEQ ID NO: 158021 - RNA, 19 nt, Homo sapiens
ggccuguucuucuccaauu

SEQ ID NO: 158022 - RNA, 19 nt, Homo sapiens
gaagcaacaguuugagaga

SEQ ID NO: 158023 - RNA, 19 nt, Homo sapiens
gguccaggcuguacacuac

SEQ ID NO: 158024 - RNA, 19 nt, Homo sapiens
gcgcauggaguacuuguug

SEQ ID NO: 158025 - RNA, 19 nt, Homo sapiens
ggagagcagccuuccaaga

SEQ ID NO: 158026 - RNA, 19 nt, Homo sapiens
uaucaagagcugugacuuu

SEQ ID NO: 158027 - RNA, 19 nt, Homo sapiens
uaaaggaagugggauggau

SEQ ID NO: 158028 - RNA, 19 nt, Homo sapiens
guucuacaaucuaaaccaa

SEQ ID NO: 158029 - RNA, 19 nt, Homo sapiens
uccagaaccuaaccaacua

SEQ ID NO: 158030 - RNA, 19 nt, Homo sapiens
ggagagaagaaacauguca

SEQ ID NO: 158031 - RNA, 19 nt, Homo sapiens
gcuuaaacuuccagcucua

SEQ ID NO: 158032 - RNA, 19 nt, Homo sapiens
ccucauguguggucuggaa

SEQ ID NO: 158033 - RNA, 19 nt, Homo sapiens
gcaaggacaagcagguaga

SEQ ID NO: 158034 - RNA, 19 nt, Homo sapiens
cuccagaacucccuagaug

SEQ ID NO: 158035 - RNA, 19 nt, Homo sapiens
gaaagcagagcaguaucaa

SEQ ID NO: 158036 - RNA, 19 nt, Homo sapiens
gagagucgagaaagagaaa

SEQ ID NO: 158037 - RNA, 19 nt, Homo sapiens
ggacacuggaguugacuga

SEQ ID NO: 158038 - RNA, 19 nt, Homo sapiens
gagcaaggacaagcaggua

SEQ ID NO: 158039 - RNA, 19 nt, Homo sapiens
ccagaauggucucaucuac

SEQ ID NO: 158040 - RNA, 19 nt, Homo sapiens
acaagcagguagagaagug

SEQ ID NO: 158041 - RNA, 19 nt, Homo sapiens
caccaugugugccaaguuc

SEQ ID NO: 158042 - RNA, 19 nt, Homo sapiens
caacacacucugaauccaa

SEQ ID NO: 158043 - RNA, 19 nt, Homo sapiens
ccaagggugugggcaguga

SEQ ID NO: 158044 - RNA, 19 nt, Homo sapiens
ugacugacuccaacacaaa

SEQ ID NO: 158045 - RNA, 19 nt, Homo sapiens
cagcagagagggaguagga

SEQ ID NO: 158046 - RNA, 19 nt, Homo sapiens
aaauggaacgugagaaaga

SEQ ID NO: 158047 - RNA, 19 nt, Homo sapiens
caagagcugugacuuucag

SEQ ID NO: 158048 - RNA, 19 nt, Homo sapiens
gacagaaagcccagaagga

SEQ ID NO: 158049 - RNA, 19 nt, Homo sapiens
gcuauuuccagauucuuaa

SEQ ID NO: 158050 - RNA, 19 nt, Homo sapiens
ugccauaaaugccucaugu

SEQ ID NO: 158051 - RNA, 19 nt, Homo sapiens
ggacaagcagguagagaag

SEQ ID NO: 158052 - RNA, 19 nt, Homo sapiens
gauaaaaugaacaggguua

SEQ ID NO: 158053 - RNA, 19 nt, Homo sapiens
cagagaaagcagagcagua

SEQ ID NO: 158054 - RNA, 19 nt, Homo sapiens
uggagagagucgagaaaga

SEQ ID NO: 158055 - RNA, 19 nt, Homo sapiens
gcauggaguacuuguugaa

SEQ ID NO: 158056 - RNA, 19 nt, Homo sapiens
caacuccucuugggucagu

SEQ ID NO: 158057 - RNA, 19 nt, Homo sapiens
agagaaagcagagcaguau

SEQ ID NO: 158058 - RNA, 19 nt, Homo sapiens
gcagugcagcuggcaauug

SEQ ID NO: 158059 - RNA, 19 nt, Homo sapiens
gggaguaggagagaagaaa

SEQ ID NO: 158060 - RNA, 19 nt, Homo sapiens
ccauaaaugccucaugugu

SEQ ID NO: 158061 - RNA, 19 nt, Homo sapiens
gcaacacacucugaaucca

SEQ ID NO: 158062 - RNA, 19 nt, Homo sapiens
cccgagaacaccuuccuua

SEQ ID NO: 158063 - RNA, 19 nt, Homo sapiens
gagagagucgagaaagaga

SEQ ID NO: 158064 - RNA, 19 nt, Homo sapiens
acucagaacuacaaguauc

SEQ ID NO: 158065 - RNA, 19 nt, Homo sapiens
caucaccuguuuucauuaa

SEQ ID NO: 158066 - RNA, 19 nt, Homo sapiens
gcucagugccaaccuggaa

SEQ ID NO: 158067 - RNA, 19 nt, Homo sapiens
ggagagagucgagaaagag

SEQ ID NO: 158068 - RNA, 19 nt, Homo sapiens
gagagggaguaggagagaa

SEQ ID NO: 158069 - RNA, 19 nt, Homo sapiens
cccaagugcuccuaaugga

SEQ ID NO: 158070 - RNA, 19 nt, Homo sapiens
ccaagccacauucccaauu

SEQ ID NO: 158071 - RNA, 19 nt, Homo sapiens
ggauggaugcccuggguau

SEQ ID NO: 158072 - RNA, 19 nt, Homo sapiens
ccuccuggcacaagagaua

SEQ ID NO: 158073 - RNA, 19 nt, Homo sapiens
ucaggaagacauugccauu

SEQ ID NO: 158074 - RNA, 19 nt, Homo sapiens
caaucuaaaccaaacaugu

SEQ ID NO: 158075 - RNA, 19 nt, Homo sapiens
cuacaacgguguccuugcu

SEQ ID NO: 158076 - RNA, 19 nt, Homo sapiens
uaggagagaagaaacaugu

SEQ ID NO: 158077 - RNA, 19 nt, Homo sapiens
gguguuggcugcuguugcu

SEQ ID NO: 158078 - RNA, 19 nt, Homo sapiens
gaggccgaccuguguauga

SEQ ID NO: 158079 - RNA, 19 nt, Homo sapiens
cagaaccuaaccaacuaua

SEQ ID NO: 158080 - RNA, 19 nt, Homo sapiens
cagugcagcuggcaauugg

SEQ ID NO: 158081 - RNA, 19 nt, Homo sapiens
cgacccaagugcuccuaau

SEQ ID NO: 158082 - RNA, 19 nt, Homo sapiens
gugggcgucuucucauaga

SEQ ID NO: 158083 - RNA, 19 nt, Homo sapiens
aaccaaacaugugcuagga

SEQ ID NO: 158084 - RNA, 19 nt, Homo sapiens
agaaagcagagcaguauca

SEQ ID NO: 158085 - RNA, 19 nt, Homo sapiens
caggaagacauugccauuu

SEQ ID NO: 158086 - RNA, 19 nt, Homo sapiens
uagcugcuuugcucaggaa

SEQ ID NO: 158087 - RNA, 19 nt, Homo sapiens
ggccagagaggcagaaucu

SEQ ID NO: 158088 - RNA, 19 nt, Homo sapiens
cggugggcgucuucucaua

SEQ ID NO: 158089 - RNA, 19 nt, Homo sapiens
ggaaugagcucaagaagaa

SEQ ID NO: 158090 - RNA, 19 nt, Homo sapiens
gaagaucuaucccuaugaa

SEQ ID NO: 158091 - RNA, 19 nt, Homo sapiens
gcagugagcuauggacuuu

SEQ ID NO: 158092 - RNA, 19 nt, Homo sapiens
ugacuugccucguuucaua

SEQ ID NO: 158093 - RNA, 19 nt, Homo sapiens
ccacguggauauaaugaua

SEQ ID NO: 158094 - RNA, 19 nt, Homo sapiens
caagaagccucccaucuau

SEQ ID NO: 158095 - RNA, 19 nt, Homo sapiens
gcacacagaguucauguuu

SEQ ID NO: 158096 - RNA, 19 nt, Homo sapiens
ggacucugcuuggaauuaa

SEQ ID NO: 158097 - RNA, 19 nt, Homo sapiens
gagccucacuucacuuauu

SEQ ID NO: 158098 - RNA, 19 nt, Homo sapiens
ggaggaagaugacgacucu

SEQ ID NO: 158099 - RNA, 19 nt, Homo sapiens
ugacaucccuuuccacugu

SEQ ID NO: 158100 - RNA, 19 nt, Homo sapiens
gaggaacucaguaagguua

SEQ ID NO: 158101 - RNA, 19 nt, Homo sapiens
gaaauagggugggcuccuu

SEQ ID NO: 158102 - RNA, 19 nt, Homo sapiens
cagaagaucuaucccuaug

SEQ ID NO: 158103 - RNA, 19 nt, Homo sapiens
uaagguuacuuccaacuug

SEQ ID NO: 158104 - RNA, 19 nt, Homo sapiens
ggaacucccugcccugugu

SEQ ID NO: 158105 - RNA, 19 nt, Homo sapiens
gagaggaacucaguaaggu

SEQ ID NO: 158106 - RNA, 19 nt, Homo sapiens
acaagaagccucccaucua

SEQ ID NO: 158107 - RNA, 19 nt, Homo sapiens
gaucuaucccuaugaaaug

SEQ ID NO: 158108 - RNA, 19 nt, Homo sapiens
ggacuucucaaggguauuu

SEQ ID NO: 158109 - RNA, 19 nt, Homo sapiens
ggcccgaccucaugaucua

SEQ ID NO: 158110 - RNA, 19 nt, Homo sapiens
gaagacaggaggaagaaag

SEQ ID NO: 158111 - RNA, 19 nt, Homo sapiens
ggaacgcgccagcugcuuu

SEQ ID NO: 158112 - RNA, 19 nt, Homo sapiens
caucgaggaucucaucauc

SEQ ID NO: 158113 - RNA, 19 nt, Homo sapiens
agaagccucccaucuauaa

SEQ ID NO: 158114 - RNA, 19 nt, Homo sapiens
acacagaguucauguuugc

SEQ ID NO: 158115 - RNA, 19 nt, Homo sapiens
gaggacuucucaaggguau

SEQ ID NO: 158116 - RNA, 19 nt, Homo sapiens
gaucggaugcggcuugaga

SEQ ID NO: 158117 - RNA, 19 nt, Homo sapiens
gaccggacacccuuccaua

SEQ ID NO: 158118 - RNA, 19 nt, Homo sapiens
cagcugcucuucuacagau

SEQ ID NO: 158119 - RNA, 19 nt, Homo sapiens
ggaccagccugccccauuu

SEQ ID NO: 158120 - RNA, 19 nt, Homo sapiens
gagaagacaggaggaagaa

SEQ ID NO: 158121 - RNA, 19 nt, Homo sapiens
caucgagucauccaaguuu

SEQ ID NO: 158122 - RNA, 19 nt, Homo sapiens
uggccaagauggacaauca

SEQ ID NO: 158123 - RNA, 19 nt, Homo sapiens
gcagaagaucuaucccuau

SEQ ID NO: 158124 - RNA, 19 nt, Homo sapiens
cagggaacgucuaaaucuu

SEQ ID NO: 158125 - RNA, 19 nt, Homo sapiens
gcauggaacggcugcagaa

SEQ ID NO: 158126 - RNA, 19 nt, Homo sapiens
agagagaggaacucaguaa

SEQ ID NO: 158127 - RNA, 19 nt, Homo sapiens
gggacucugcuuggaauua

SEQ ID NO: 158128 - RNA, 19 nt, Homo sapiens
gaucuacgagccucacuuc

SEQ ID NO: 158129 - RNA, 19 nt, Homo sapiens
cugcagaagcaaccacuua

SEQ ID NO: 158130 - RNA, 19 nt, Homo sapiens
gggcuccuuuccucaggua

SEQ ID NO: 158131 - RNA, 19 nt, Homo sapiens
uggaugacuugccucguuu

SEQ ID NO: 158132 - RNA, 19 nt, Homo sapiens
ucagggagcgucagagaga

SEQ ID NO: 158133 - RNA, 19 nt, Homo sapiens
cgagaagacaggaggaaga

SEQ ID NO: 158134 - RNA, 19 nt, Homo sapiens
ggaagcggccaggcagaaa

SEQ ID NO: 158135 - RNA, 19 nt, Homo sapiens
gaacgcgccagcugcuuuc

SEQ ID NO: 158136 - RNA, 19 nt, Homo sapiens
ccagggaacgucuaaaucu

SEQ ID NO: 158137 - RNA, 19 nt, Homo sapiens
ucaaggguauuugccaugu

SEQ ID NO: 158138 - RNA, 19 nt, Homo sapiens
acucccagcugcucuucua

SEQ ID NO: 158139 - RNA, 19 nt, Homo sapiens
uggaacggcugcagaagca

SEQ ID NO: 158140 - RNA, 19 nt, Homo sapiens
gaagcggaaugagcucaag

SEQ ID NO: 158141 - RNA, 19 nt, Homo sapiens
gcaagcuggcucuguggaa

SEQ ID NO: 158142 - RNA, 19 nt, Homo sapiens
ggaagaggaggaggaggaa

SEQ ID NO: 158143 - RNA, 19 nt, Homo sapiens
cuacgagccucacuucacu

SEQ ID NO: 158144 - RNA, 19 nt, Homo sapiens
aaugggaauuccagcacua

SEQ ID NO: 158145 - RNA, 19 nt, Homo sapiens
uuggaugacuugccucguu

SEQ ID NO: 158146 - RNA, 19 nt, Homo sapiens
ucagagagaggaacucagu

SEQ ID NO: 158147 - RNA, 19 nt, Homo sapiens
auuccaacaucuacaagaa

SEQ ID NO: 158148 - RNA, 19 nt, Homo sapiens
acucacuccugacagcuuu

SEQ ID NO: 158149 - RNA, 19 nt, Homo sapiens
gaacagcuggagggaagau

SEQ ID NO: 158150 - RNA, 19 nt, Homo sapiens
cacacagaguucauguuug

SEQ ID NO: 158151 - RNA, 19 nt, Homo sapiens
gucuaagccuggagaguca

SEQ ID NO: 158152 - RNA, 19 nt, Homo sapiens
aagaagagauggaaaaguc

SEQ ID NO: 158153 - RNA, 19 nt, Homo sapiens
ucaagaagaaggccucucu

SEQ ID NO: 158154 - RNA, 19 nt, Homo sapiens
cggaaugagcucaagaaga

SEQ ID NO: 158155 - RNA, 19 nt, Homo sapiens
ggaggaagaaagggagaga

SEQ ID NO: 158156 - RNA, 19 nt, Homo sapiens
ccgguuggcugucuugaac

SEQ ID NO: 158157 - RNA, 19 nt, Homo sapiens
caccagggaacgucuaaau

SEQ ID NO: 158158 - RNA, 19 nt, Homo sapiens
gacucugcuuggaauuaaa

SEQ ID NO: 158159 - RNA, 19 nt, Homo sapiens
ggaagcggaaugagcucaa

SEQ ID NO: 158160 - RNA, 19 nt, Homo sapiens
aagaagccucccaucuaua

SEQ ID NO: 158161 - RNA, 19 nt, Homo sapiens
gaagcggccaggcagaaag

SEQ ID NO: 158162 - RNA, 19 nt, Homo sapiens
ccagaggugagaggaauga

SEQ ID NO: 158163 - RNA, 19 nt, Homo sapiens
ugaaagaagagauggaaaa

SEQ ID NO: 158164 - RNA, 19 nt, Homo sapiens
gagagaggaacucaguaag

SEQ ID NO: 158165 - RNA, 19 nt, Homo sapiens
ccgcccagauuccaacauc

SEQ ID NO: 158166 - RNA, 19 nt, Homo sapiens
cgccuggaaucaucucuca

SEQ ID NO: 158167 - RNA, 19 nt, Homo sapiens
aggccucucucuucugaug

SEQ ID NO: 158168 - RNA, 19 nt, Homo sapiens
acaaggccauccuggacau

SEQ ID NO: 158169 - RNA, 19 nt, Homo sapiens
gauuccaacaucuacaaga

SEQ ID NO: 158170 - RNA, 19 nt, Homo sapiens
uugccucguuucauaauuc

SEQ ID NO: 158171 - RNA, 19 nt, Homo sapiens
cauguccccugaagaguuu

SEQ ID NO: 158172 - RNA, 19 nt, Homo sapiens
gacuugccucguuucauaa

SEQ ID NO: 158173 - RNA, 19 nt, Homo sapiens
agaucuaucccuaugaaau

SEQ ID NO: 158174 - RNA, 19 nt, Homo sapiens
gcuacaguccacagaguuc

SEQ ID NO: 158175 - RNA, 19 nt, Homo sapiens
cggcuacaguccacagagu

SEQ ID NO: 158176 - RNA, 19 nt, Homo sapiens
aagaggaggaggaggaaga

SEQ ID NO: 158177 - RNA, 19 nt, Homo sapiens
acgagccucacuucacuua

SEQ ID NO: 158178 - RNA, 19 nt, Homo sapiens
aaauagggugggcuccuuu

SEQ ID NO: 158179 - RNA, 19 nt, Homo sapiens
caaggguauuugccauguc

SEQ ID NO: 158180 - RNA, 19 nt, Homo sapiens
aggaggaggaggaagauga

SEQ ID NO: 158181 - RNA, 19 nt, Homo sapiens
cauaauucacuuacugucu

SEQ ID NO: 158182 - RNA, 19 nt, Homo sapiens
cagagagaggaacucagua

SEQ ID NO: 158183 - RNA, 19 nt, Homo sapiens
uagagaggcuuuaaacuua

SEQ ID NO: 158184 - RNA, 19 nt, Homo sapiens
ccaaucagcugaaauuaaa

SEQ ID NO: 158185 - RNA, 19 nt, Homo sapiens
gcaagaaccugggcuguaa

SEQ ID NO: 158186 - RNA, 19 nt, Homo sapiens
caaauuagccuuuaacuca

SEQ ID NO: 158187 - RNA, 19 nt, Homo sapiens
aaacuuaccuuacucauuc

SEQ ID NO: 158188 - RNA, 19 nt, Homo sapiens
gagaagaaauugcacacaa

SEQ ID NO: 158189 - RNA, 19 nt, Homo sapiens
gaauaauccuuacuugaga

SEQ ID NO: 158190 - RNA, 19 nt, Homo sapiens
ggaccaaauuagccuuuaa

SEQ ID NO: 158191 - RNA, 19 nt, Homo sapiens
ggaauucacaguauauuga

SEQ ID NO: 158192 - RNA, 19 nt, Homo sapiens
ggcagauacugucaacuua

SEQ ID NO: 158193 - RNA, 19 nt, Homo sapiens
uugaauagcugaaggacua

SEQ ID NO: 158194 - RNA, 19 nt, Homo sapiens
gcuaaaugcuuugcagaaa

SEQ ID NO: 158195 - RNA, 19 nt, Homo sapiens
ggugacauuuguaacauuu

SEQ ID NO: 158196 - RNA, 19 nt, Homo sapiens
agaaggagcucuaggaaca

SEQ ID NO: 158197 - RNA, 19 nt, Homo sapiens
ucagugcacuuacauuuga

SEQ ID NO: 158198 - RNA, 19 nt, Homo sapiens
gcaaaugucugugaaucug

SEQ ID NO: 158199 - RNA, 19 nt, Homo sapiens
gaaauagccaagacuaaug

SEQ ID NO: 158200 - RNA, 19 nt, Homo sapiens
uggaugguguggucuauua

SEQ ID NO: 158201 - RNA, 19 nt, Homo sapiens
gguaaucuguuagucuuaa

SEQ ID NO: 158202 - RNA, 19 nt, Homo sapiens
caaccuggacuucugcuua

SEQ ID NO: 158203 - RNA, 19 nt, Homo sapiens
ggagagucuuaauuaauug

SEQ ID NO: 158204 - RNA, 19 nt, Homo sapiens
caaacccauucauuacaua

SEQ ID NO: 158205 - RNA, 19 nt, Homo sapiens
ggaaauagccaagacuaau

SEQ ID NO: 158206 - RNA, 19 nt, Homo sapiens
gguuagaucccucuuguuu

SEQ ID NO: 158207 - RNA, 19 nt, Homo sapiens
gaaauuucccuaauguuca

SEQ ID NO: 158208 - RNA, 19 nt, Homo sapiens
caccauugcugcugagaaa

SEQ ID NO: 158209 - RNA, 19 nt, Homo sapiens
gcacacaacaugcagucua

SEQ ID NO: 158210 - RNA, 19 nt, Homo sapiens
aaacuacucugaggaaugu

SEQ ID NO: 158211 - RNA, 19 nt, Homo sapiens
uaaaugaccuugacuuuuc

SEQ ID NO: 158212 - RNA, 19 nt, Homo sapiens
gacaacaaauucuuagucu

SEQ ID NO: 158213 - RNA, 19 nt, Homo sapiens
ucuaaugacugggcagaua

SEQ ID NO: 158214 - RNA, 19 nt, Homo sapiens
ggaaauuaaggaugugaaa

SEQ ID NO: 158215 - RNA, 19 nt, Homo sapiens
uaacauuuccucuuugaga

SEQ ID NO: 158216 - RNA, 19 nt, Homo sapiens
uaacugugguacacuguga

SEQ ID NO: 158217 - RNA, 19 nt, Homo sapiens
guaaaugauuccuccuugu

SEQ ID NO: 158218 - RNA, 19 nt, Homo sapiens
guuuggagagucuuaauua

SEQ ID NO: 158219 - RNA, 19 nt, Homo sapiens
ccaaagugcuggauuacag

SEQ ID NO: 158220 - RNA, 19 nt, Homo sapiens
gggcagcaauggccgagaa

SEQ ID NO: 158221 - RNA, 19 nt, Homo sapiens
uaacuucaggaaaccauua

SEQ ID NO: 158222 - RNA, 19 nt, Homo sapiens
agagauaacuucaggaaac

SEQ ID NO: 158223 - RNA, 19 nt, Homo sapiens
ucagaauaauccuuacuug

SEQ ID NO: 158224 - RNA, 19 nt, Homo sapiens
ggaccuugcggauggauuu

SEQ ID NO: 158225 - RNA, 19 nt, Homo sapiens
gguacacugugaaauaugu

SEQ ID NO: 158226 - RNA, 19 nt, Homo sapiens
ugucagaacuagaggaaau

SEQ ID NO: 158227 - RNA, 19 nt, Homo sapiens
gaaagaauuguuagcuugu

SEQ ID NO: 158228 - RNA, 19 nt, Homo sapiens
gugaaagaauuguuagcuu

SEQ ID NO: 158229 - RNA, 19 nt, Homo sapiens
gcugaguuauugaggauug

SEQ ID NO: 158230 - RNA, 19 nt, Homo sapiens
gggcagauacugucaacuu

SEQ ID NO: 158231 - RNA, 19 nt, Homo sapiens
guauaaggaauucacagua

SEQ ID NO: 158232 - RNA, 19 nt, Homo sapiens
gaggaaauagccaagacua

SEQ ID NO: 158233 - RNA, 19 nt, Homo sapiens
gcagaaagugaugaccuua

SEQ ID NO: 158234 - RNA, 19 nt, Homo sapiens
gaagaaauugcacacaaca

SEQ ID NO: 158235 - RNA, 19 nt, Homo sapiens
ggacaacaaauucuuaguc

SEQ ID NO: 158236 - RNA, 19 nt, Homo sapiens
guucuccugucuccagaua

SEQ ID NO: 158237 - RNA, 19 nt, Homo sapiens
guuaaacucagugcacuua

SEQ ID NO: 158238 - RNA, 19 nt, Homo sapiens
uaagagauaacuucaggaa

SEQ ID NO: 158239 - RNA, 19 nt, Homo sapiens
acugagagauuggugauuu

SEQ ID NO: 158240 - RNA, 19 nt, Homo sapiens
cagaauguauagcaguuau

SEQ ID NO: 158241 - RNA, 19 nt, Homo sapiens
gggaccaaauuagccuuua

SEQ ID NO: 158242 - RNA, 19 nt, Homo sapiens
uaugauguaugacuugaug

SEQ ID NO: 158243 - RNA, 19 nt, Homo sapiens
cguuauaacuuucccaauc

SEQ ID NO: 158244 - RNA, 19 nt, Homo sapiens
gauuacaaacccauucauu

SEQ ID NO: 158245 - RNA, 19 nt, Homo sapiens
uaaaugauuccuccuuguu

SEQ ID NO: 158246 - RNA, 19 nt, Homo sapiens
cagccguguuucagaauaa

SEQ ID NO: 158247 - RNA, 19 nt, Homo sapiens
gagagauuggugauuuaua

SEQ ID NO: 158248 - RNA, 19 nt, Homo sapiens
cugagagauuggugauuua

SEQ ID NO: 158249 - RNA, 19 nt, Homo sapiens
uagauugggucgcauuuua

SEQ ID NO: 158250 - RNA, 19 nt, Homo sapiens
ggaauguucugggcaccaa

SEQ ID NO: 158251 - RNA, 19 nt, Homo sapiens
gcacugacagcuucaucaa

SEQ ID NO: 158252 - RNA, 19 nt, Homo sapiens
cagcugaaauuaaaucacu

SEQ ID NO: 158253 - RNA, 19 nt, Homo sapiens
guuauaacuuucccaaucu

SEQ ID NO: 158254 - RNA, 19 nt, Homo sapiens
uguaacauuuccucuuuga

SEQ ID NO: 158255 - RNA, 19 nt, Homo sapiens
gugguacacugugaaauau

SEQ ID NO: 158256 - RNA, 19 nt, Homo sapiens
cagaauaauccuuacuuga

SEQ ID NO: 158257 - RNA, 19 nt, Homo sapiens
ugaaauuucccuaauguuc

SEQ ID NO: 158258 - RNA, 19 nt, Homo sapiens
ggagugcaauagcaugauc

SEQ ID NO: 158259 - RNA, 19 nt, Homo sapiens
gcuuuaaacuuaccuuacu

SEQ ID NO: 158260 - RNA, 19 nt, Homo sapiens
ccagccguguuucagaaua

SEQ ID NO: 158261 - RNA, 19 nt, Homo sapiens
caccaugcccagcuaauuu

SEQ ID NO: 158262 - RNA, 19 nt, Homo sapiens
ggucauaugugccuuaccu

SEQ ID NO: 158263 - RNA, 19 nt, Homo sapiens
agaaagugaugaccuuaca

SEQ ID NO: 158264 - RNA, 19 nt, Homo sapiens
ggacaugagaacuauuuca

SEQ ID NO: 158265 - RNA, 19 nt, Homo sapiens
uaaacucagugcacuuaca

SEQ ID NO: 158266 - RNA, 19 nt, Homo sapiens
ggcucuagcugaguuauug

SEQ ID NO: 158267 - RNA, 19 nt, Homo sapiens
uggaugugcauaaagauua

SEQ ID NO: 158268 - RNA, 19 nt, Homo sapiens
ccuaaaugaccuugacuuu

SEQ ID NO: 158269 - RNA, 19 nt, Homo sapiens
guacccaauucaagcuuau

SEQ ID NO: 158270 - RNA, 19 nt, Homo sapiens
cagauacugucaacuuaca

SEQ ID NO: 158271 - RNA, 19 nt, Homo sapiens
ugugguacacugugaaaua

SEQ ID NO: 158272 - RNA, 19 nt, Homo sapiens
uuucugagauggaguuuca

SEQ ID NO: 158273 - RNA, 19 nt, Homo sapiens
uagguuagaucccucuugu

SEQ ID NO: 158274 - RNA, 19 nt, Homo sapiens
uagauaugcugcaaggaau

SEQ ID NO: 158275 - RNA, 19 nt, Homo sapiens
cauggacaacaaauucuua

SEQ ID NO: 158276 - RNA, 19 nt, Homo sapiens
aaaguggacaugagaacua

SEQ ID NO: 158277 - RNA, 19 nt, Homo sapiens
acauuacucuaacccuuaa

SEQ ID NO: 158278 - RNA, 19 nt, Homo sapiens
gagaguagccauuuucuug

SEQ ID NO: 158279 - RNA, 19 nt, Homo sapiens
gcuuguaaauacugagaga

SEQ ID NO: 158280 - RNA, 19 nt, Homo sapiens
uagggaagccuugaaacua

SEQ ID NO: 158281 - RNA, 19 nt, Homo sapiens
caucaaaguggacaugaga

SEQ ID NO: 158282 - RNA, 19 nt, Homo sapiens
cauucucuaugauguauga

SEQ ID NO: 158283 - RNA, 19 nt, Homo sapiens
gaccagagcuucaccauuc

SEQ ID NO: 158284 - RNA, 19 nt, Homo sapiens
gcaagacuguggccauuaa

SEQ ID NO: 158285 - RNA, 19 nt, Homo sapiens
gggcgaaccugaccuauga

SEQ ID NO: 158286 - RNA, 19 nt, Homo sapiens
gcugaagccuuauguggua

SEQ ID NO: 158287 - RNA, 19 nt, Homo sapiens
gauuguagccgucaucuuu

SEQ ID NO: 158288 - RNA, 19 nt, Homo sapiens
gaacagcaacagauacuga

SEQ ID NO: 158289 - RNA, 19 nt, Homo sapiens
ucacagaauuuauggagaa

SEQ ID NO: 158290 - RNA, 19 nt, Homo sapiens
ggacugaucccuccucuca

SEQ ID NO: 158291 - RNA, 19 nt, Homo sapiens
ggcaugaacuaccucagua

SEQ ID NO: 158292 - RNA, 19 nt, Homo sapiens
ccacauacaucgucagagu

SEQ ID NO: 158293 - RNA, 19 nt, Homo sapiens
ccagaaacaucuuggugaa

SEQ ID NO: 158294 - RNA, 19 nt, Homo sapiens
gaugucagauacaguguga

SEQ ID NO: 158295 - RNA, 19 nt, Homo sapiens
gaucaucacagaauuuaug

SEQ ID NO: 158296 - RNA, 19 nt, Homo sapiens
caaggaaguuacucugaug

SEQ ID NO: 158297 - RNA, 19 nt, Homo sapiens
gaaacaucuuggugaauca

SEQ ID NO: 158298 - RNA, 19 nt, Homo sapiens
aagcugugcugaagccuua

SEQ ID NO: 158299 - RNA, 19 nt, Homo sapiens
gaaagaaccgaggcaacua

SEQ ID NO: 158300 - RNA, 19 nt, Homo sapiens
ugaacuaccucaguaauca

SEQ ID NO: 158301 - RNA, 19 nt, Homo sapiens
gcaaucaggagguuaugaa

SEQ ID NO: 158302 - RNA, 19 nt, Homo sapiens
caacuacaccuuuaaugug

SEQ ID NO: 158303 - RNA, 19 nt, Homo sapiens
gaugggaucccguaucgaa

SEQ ID NO: 158304 - RNA, 19 nt, Homo sapiens
cauaggagaaggagaguuu

SEQ ID NO: 158305 - RNA, 19 nt, Homo sapiens
ugacucgccuccuggauga

SEQ ID NO: 158306 - RNA, 19 nt, Homo sapiens
ccaaggaaguuacucugau

SEQ ID NO: 158307 - RNA, 19 nt, Homo sapiens
ugugguaccuccaggcaua

SEQ ID NO: 158308 - RNA, 19 nt, Homo sapiens
uaccagcgcuguccugaga

SEQ ID NO: 158309 - RNA, 19 nt, Homo sapiens
gaagaacugcugggcauau

SEQ ID NO: 158310 - RNA, 19 nt, Homo sapiens
cagggagccuuggacuuua

SEQ ID NO: 158311 - RNA, 19 nt, Homo sapiens
gaugagcaaucaggagguu

SEQ ID NO: 158312 - RNA, 19 nt, Homo sapiens
agaaacaucuuggugaauc

SEQ ID NO: 158313 - RNA, 19 nt, Homo sapiens
gugcgggacugcaagaguu

SEQ ID NO: 158314 - RNA, 19 nt, Homo sapiens
ggagugaacagcaacagau

SEQ ID NO: 158315 - RNA, 19 nt, Homo sapiens
cccggaggcuggucuaauu

SEQ ID NO: 158316 - RNA, 19 nt, Homo sapiens
gagugaacagcaacagaua

SEQ ID NO: 158317 - RNA, 19 nt, Homo sapiens
ugagacuggugaagaaaga

SEQ ID NO: 158318 - RNA, 19 nt, Homo sapiens
ccaacuacaccuuuaaugu

SEQ ID NO: 158319 - RNA, 19 nt, Homo sapiens
uaugccaacuacaccuuua

SEQ ID NO: 158320 - RNA, 19 nt, Homo sapiens
gcggaccauugccaacuuu

SEQ ID NO: 158321 - RNA, 19 nt, Homo sapiens
guguggagcuuugggauug

SEQ ID NO: 158322 - RNA, 19 nt, Homo sapiens
gcugcaaggugucugacuu

SEQ ID NO: 158323 - RNA, 19 nt, Homo sapiens
gcaugaacuaccucaguaa

SEQ ID NO: 158324 - RNA, 19 nt, Homo sapiens
uggaaggcgucgucacaaa

SEQ ID NO: 158325 - RNA, 19 nt, Homo sapiens
aaagauggguggagugaac

SEQ ID NO: 158326 - RNA, 19 nt, Homo sapiens
gcgcauucuuugcaguauu

SEQ ID NO: 158327 - RNA, 19 nt, Homo sapiens
acagggagccuuggacuuu

SEQ ID NO: 158328 - RNA, 19 nt, Homo sapiens
cauagcaucuggcaugaac

SEQ ID NO: 158329 - RNA, 19 nt, Homo sapiens
ugacuuugauggcacauac

SEQ ID NO: 158330 - RNA, 19 nt, Homo sapiens
cagaauuuauggagaaugc

SEQ ID NO: 158331 - RNA, 19 nt, Homo sapiens
cccacaaccugccagacua

SEQ ID NO: 158332 - RNA, 19 nt, Homo sapiens
cagaugggaucccguaucg

SEQ ID NO: 158333 - RNA, 19 nt, Homo sapiens
ggaccauugccaacuuuga

SEQ ID NO: 158334 - RNA, 19 nt, Homo sapiens
gcuuugggauugugaugug

SEQ ID NO: 158335 - RNA, 19 nt, Homo sapiens
caguuuagccacccgcaua

SEQ ID NO: 158336 - RNA, 19 nt, Homo sapiens
gauacagugugagguguuc

SEQ ID NO: 158337 - RNA, 19 nt, Homo sapiens
ugagagcggccauuacaga

SEQ ID NO: 158338 - RNA, 19 nt, Homo sapiens
ggaaggcgucgucacaaag

SEQ ID NO: 158339 - RNA, 19 nt, Homo sapiens
caauggccuugaaccuuau

SEQ ID NO: 158340 - RNA, 19 nt, Homo sapiens
gagguuaugaagagcauug

SEQ ID NO: 158341 - RNA, 19 nt, Homo sapiens
ggagaaugcagcccuggau

SEQ ID NO: 158342 - RNA, 19 nt, Homo sapiens
cuaccucgcuuuccacaac

SEQ ID NO: 158343 - RNA, 19 nt, Homo sapiens
ggcauagcaucuggcauga

SEQ ID NO: 158344 - RNA, 19 nt, Homo sapiens
guaccaggacugcccaaug

SEQ ID NO: 158345 - RNA, 19 nt, Homo sapiens
uagcaucuggcaugaacua

SEQ ID NO: 158346 - RNA, 19 nt, Homo sapiens
gaggacaagcugugcugaa

SEQ ID NO: 158347 - RNA, 19 nt, Homo sapiens
gcugaaccaggaugaagaa

SEQ ID NO: 158348 - RNA, 19 nt, Homo sapiens
cugaggaccugacgcagau

SEQ ID NO: 158349 - RNA, 19 nt, Homo sapiens
gccaaggaaguuacucuga

SEQ ID NO: 158350 - RNA, 19 nt, Homo sapiens
aagcgaaagccgaucauga

SEQ ID NO: 158351 - RNA, 19 nt, Homo sapiens
ugaagaacgguaccagaug

SEQ ID NO: 158352 - RNA, 19 nt, Homo sapiens
uaccaggacugcccaaugc

SEQ ID NO: 158353 - RNA, 19 nt, Homo sapiens
ccacuggcuucgcuccaau

SEQ ID NO: 158354 - RNA, 19 nt, Homo sapiens
gcaugcagagucacuguca

SEQ ID NO: 158355 - RNA, 19 nt, Homo sapiens
cuacaccuuuaauguggaa

SEQ ID NO: 158356 - RNA, 19 nt, Homo sapiens
ugaccaggaugugggcauu

SEQ ID NO: 158357 - RNA, 19 nt, Homo sapiens
ugugggaggugcugagcuu

SEQ ID NO: 158358 - RNA, 19 nt, Homo sapiens
cagcaacagauacugaaug

SEQ ID NO: 158359 - RNA, 19 nt, Homo sapiens
cugcaagacuguggccauu

SEQ ID NO: 158360 - RNA, 19 nt, Homo sapiens
cgcauucuuugcaguauuc

SEQ ID NO: 158361 - RNA, 19 nt, Homo sapiens
gggaggugcugagcuuugg

SEQ ID NO: 158362 - RNA, 19 nt, Homo sapiens
gacgccaggaugucagaua

SEQ ID NO: 158363 - RNA, 19 nt, Homo sapiens
gcaaggugucugacuuugg

SEQ ID NO: 158364 - RNA, 19 nt, Homo sapiens
cuaccucaguaaucacaau

SEQ ID NO: 158365 - RNA, 19 nt, Homo sapiens
gcaaggacgcagagacacu

SEQ ID NO: 158366 - RNA, 19 nt, Homo sapiens
ccuccuggaugacuuugau

SEQ ID NO: 158367 - RNA, 19 nt, Homo sapiens
ccugugagagcggccauua

SEQ ID NO: 158368 - RNA, 19 nt, Homo sapiens
gaacugcugggcauaugac

SEQ ID NO: 158369 - RNA, 19 nt, Homo sapiens
ucaaccuucuguacaugga

SEQ ID NO: 158370 - RNA, 19 nt, Homo sapiens
ggacugcccaaugcaagga

SEQ ID NO: 158371 - RNA, 19 nt, Homo sapiens
cauggagagugaccaggau

SEQ ID NO: 158372 - RNA, 19 nt, Homo sapiens
ugugagguguucccagugu

SEQ ID NO: 158373 - RNA, 19 nt, Homo sapiens
cugaguggcucgaguccau

SEQ ID NO: 158374 - RNA, 19 nt, Homo sapiens
aagaacugcugggcauaug

SEQ ID NO: 158375 - RNA, 19 nt, Homo sapiens
uaucgaaccgucucugagu

SEQ ID NO: 158376 - RNA, 19 nt, Homo sapiens
ugagcaaucaggagguuau

SEQ ID NO: 158377 - RNA, 19 nt, Homo sapiens
ggaggaaagaucccuaucc

SEQ ID NO: 158378 - RNA, 19 nt, Homo sapiens
ccuucaaccuucuguacau

SEQ ID NO: 158379 - RNA, 19 nt, Homo sapiens
guccugagacccugaaugg

SEQ ID NO: 158380 - RNA, 19 nt, Homo sapiens
guguggcccuggugucugu

SEQ ID NO: 158381 - RNA, 19 nt, Homo sapiens
aggcacaucuggagcaacu

SEQ ID NO: 158382 - RNA, 19 nt, Homo sapiens
gaaacccagggaggaaaga

SEQ ID NO: 158383 - RNA, 19 nt, Homo sapiens
gaucggaccuccagaaaua

SEQ ID NO: 158384 - RNA, 19 nt, Homo sapiens
ucacagggauuuagacuua

SEQ ID NO: 158385 - RNA, 19 nt, Homo sapiens
caaaugcucucucaaauug

SEQ ID NO: 158386 - RNA, 19 nt, Homo sapiens
gaacucagcucagaagauu

SEQ ID NO: 158387 - RNA, 19 nt, Homo sapiens
gcaagaggcacaaauguua

SEQ ID NO: 158388 - RNA, 19 nt, Homo sapiens
ggaaagauguuaccuucaa

SEQ ID NO: 158389 - RNA, 19 nt, Homo sapiens
caauguaaauggccucuua

SEQ ID NO: 158390 - RNA, 19 nt, Homo sapiens
caaacuaucuggccauauu

SEQ ID NO: 158391 - RNA, 19 nt, Homo sapiens
ggagagaaguggaauccua

SEQ ID NO: 158392 - RNA, 19 nt, Homo sapiens
ggaaggaguuguuaccaaa

SEQ ID NO: 158393 - RNA, 19 nt, Homo sapiens
gaaugugguuucaaucuaa

SEQ ID NO: 158394 - RNA, 19 nt, Homo sapiens
gagaaugguuccuuggaua

SEQ ID NO: 158395 - RNA, 19 nt, Homo sapiens
gagcaucaguuuacaaaga

SEQ ID NO: 158396 - RNA, 19 nt, Homo sapiens
gaaguggaauccuauauag

SEQ ID NO: 158397 - RNA, 19 nt, Homo sapiens
ggauugaacuucuuugaau

SEQ ID NO: 158398 - RNA, 19 nt, Homo sapiens
caacacagaggaauuuaua

SEQ ID NO: 158399 - RNA, 19 nt, Homo sapiens
aaacauaaguguacgauuc

SEQ ID NO: 158400 - RNA, 19 nt, Homo sapiens
ccaaaucucucaaaucugu

SEQ ID NO: 158401 - RNA, 19 nt, Homo sapiens
ccaauaagacacucaaaua

SEQ ID NO: 158402 - RNA, 19 nt, Homo sapiens
gaaacaaguuauaccauuc

SEQ ID NO: 158403 - RNA, 19 nt, Homo sapiens
gaacuagcauauagccauu

SEQ ID NO: 158404 - RNA, 19 nt, Homo sapiens
gaaacgcaaucaaagaaug

SEQ ID NO: 158405 - RNA, 19 nt, Homo sapiens
gaacaacagacccaaguuu

SEQ ID NO: 158406 - RNA, 19 nt, Homo sapiens
ugaagaaucuggcuauguu

SEQ ID NO: 158407 - RNA, 19 nt, Homo sapiens
gaucaucaguagcauuaaa

SEQ ID NO: 158408 - RNA, 19 nt, Homo sapiens
gaaaguagagguuguauac

SEQ ID NO: 158409 - RNA, 19 nt, Homo sapiens
uaauagaaguugaggauug

SEQ ID NO: 158410 - RNA, 19 nt, Homo sapiens
guggauaucuagcuaguaa

SEQ ID NO: 158411 - RNA, 19 nt, Homo sapiens
cagaauaguuggucaucua

SEQ ID NO: 158412 - RNA, 19 nt, Homo sapiens
gacaauaauucuggagaua

SEQ ID NO: 158413 - RNA, 19 nt, Homo sapiens
gaaauagcaucucuuuguc

SEQ ID NO: 158414 - RNA, 19 nt, Homo sapiens
aaauguggguggaauauaa

SEQ ID NO: 158415 - RNA, 19 nt, Homo sapiens
gcaggugugagaauaauua

SEQ ID NO: 158416 - RNA, 19 nt, Homo sapiens
gagaugaaguuuguaguug

SEQ ID NO: 158417 - RNA, 19 nt, Homo sapiens
gugaagaacuagcauauag

SEQ ID NO: 158418 - RNA, 19 nt, Homo sapiens
ggcaauauguguuuauguu

SEQ ID NO: 158419 - RNA, 19 nt, Homo sapiens
gaaguuccaaguccaauaa

SEQ ID NO: 158420 - RNA, 19 nt, Homo sapiens
gcacaaauguuaccaucag

SEQ ID NO: 158421 - RNA, 19 nt, Homo sapiens
cuacuagaauucuguauug

SEQ ID NO: 158422 - RNA, 19 nt, Homo sapiens
gcaauauuccuuagucaaa

SEQ ID NO: 158423 - RNA, 19 nt, Homo sapiens
caauuuaacuagacacaga

SEQ ID NO: 158424 - RNA, 19 nt, Homo sapiens
ccucaagccugacacuaua

SEQ ID NO: 158425 - RNA, 19 nt, Homo sapiens
uaaauggccucuuacuaau

SEQ ID NO: 158426 - RNA, 19 nt, Homo sapiens
ggauaucuagcuaguaaua

SEQ ID NO: 158427 - RNA, 19 nt, Homo sapiens
ggccauauuuacuaccuua

SEQ ID NO: 158428 - RNA, 19 nt, Homo sapiens
ucugggaggugaugucuua

SEQ ID NO: 158429 - RNA, 19 nt, Homo sapiens
aaaguuggcuacacagaaa

SEQ ID NO: 158430 - RNA, 19 nt, Homo sapiens
ggacaugguggcuuuguuu

SEQ ID NO: 158431 - RNA, 19 nt, Homo sapiens
agaagaagaucaucaguag

SEQ ID NO: 158432 - RNA, 19 nt, Homo sapiens
ucucaaaucuuggcaauau

SEQ ID NO: 158433 - RNA, 19 nt, Homo sapiens
uguguaagguuucugauuu

SEQ ID NO: 158434 - RNA, 19 nt, Homo sapiens
cagaauacauggagaaugg

SEQ ID NO: 158435 - RNA, 19 nt, Homo sapiens
uaacuacaccuuugagauu

SEQ ID NO: 158436 - RNA, 19 nt, Homo sapiens
caacaaaacccaugcauuu

SEQ ID NO: 158437 - RNA, 19 nt, Homo sapiens
ucaggaagaugguucaaug

SEQ ID NO: 158438 - RNA, 19 nt, Homo sapiens
ggaacugcauugacuuuca

SEQ ID NO: 158439 - RNA, 19 nt, Homo sapiens
gauagcaucuggcaugaag

SEQ ID NO: 158440 - RNA, 19 nt, Homo sapiens
acaauuggcugagaacaaa

SEQ ID NO: 158441 - RNA, 19 nt, Homo sapiens
auagaaugcugcacuaauu

SEQ ID NO: 158442 - RNA, 19 nt, Homo sapiens
gaaaguuggcuacacagaa

SEQ ID NO: 158443 - RNA, 19 nt, Homo sapiens
gagcugggcuggaucucuu

SEQ ID NO: 158444 - RNA, 19 nt, Homo sapiens
acacaauucuuacccugua

SEQ ID NO: 158445 - RNA, 19 nt, Homo sapiens
gaugaaguuuguaguuguu

SEQ ID NO: 158446 - RNA, 19 nt, Homo sapiens
gaacuugcaaggagacauu

SEQ ID NO: 158447 - RNA, 19 nt, Homo sapiens
gaacauuacacacccauca

SEQ ID NO: 158448 - RNA, 19 nt, Homo sapiens
ucaaucaagccauguauaa

SEQ ID NO: 158449 - RNA, 19 nt, Homo sapiens
cacaagugcucaucuguug

SEQ ID NO: 158450 - RNA, 19 nt, Homo sapiens
ccaaucaggauguaauuaa

SEQ ID NO: 158451 - RNA, 19 nt, Homo sapiens
gaggucaaauacuaugaaa

SEQ ID NO: 158452 - RNA, 19 nt, Homo sapiens
gcaagaaccugaacauccu

SEQ ID NO: 158453 - RNA, 19 nt, Homo sapiens
gccaaaugcucucucaaau

SEQ ID NO: 158454 - RNA, 19 nt, Homo sapiens
ggacaucaccagaagcuau

SEQ ID NO: 158455 - RNA, 19 nt, Homo sapiens
ggagaaugguuccuuggau

SEQ ID NO: 158456 - RNA, 19 nt, Homo sapiens
agaaauagcaucucuuugu

SEQ ID NO: 158457 - RNA, 19 nt, Homo sapiens
ccagaaauagcaucucuuu

SEQ ID NO: 158458 - RNA, 19 nt, Homo sapiens
gcuaaugaaacacagcuua

SEQ ID NO: 158459 - RNA, 19 nt, Homo sapiens
gcugagcuguuuauagaga

SEQ ID NO: 158460 - RNA, 19 nt, Homo sapiens
ggauguaauuaaagcugua

SEQ ID NO: 158461 - RNA, 19 nt, Homo sapiens
ggugugcaguggucgcuua

SEQ ID NO: 158462 - RNA, 19 nt, Homo sapiens
uuacaaagauugacaccau

SEQ ID NO: 158463 - RNA, 19 nt, Homo sapiens
gagagcaucaguuuacaaa

SEQ ID NO: 158464 - RNA, 19 nt, Homo sapiens
ccacaacuccuacaugaug

SEQ ID NO: 158465 - RNA, 19 nt, Homo sapiens
cuugaccucucauaaauuu

SEQ ID NO: 158466 - RNA, 19 nt, Homo sapiens
caaaucaggcuacuagaau

SEQ ID NO: 158467 - RNA, 19 nt, Homo sapiens
uugcugagcuguuuauaga

SEQ ID NO: 158468 - RNA, 19 nt, Homo sapiens
ucaaaucuguuaucccaau

SEQ ID NO: 158469 - RNA, 19 nt, Homo sapiens
acaguaacuugguguguaa

SEQ ID NO: 158470 - RNA, 19 nt, Homo sapiens
ccaccaacauauccauuga

SEQ ID NO: 158471 - RNA, 19 nt, Homo sapiens
acuguaugcucacaacuua

SEQ ID NO: 158472 - RNA, 19 nt, Homo sapiens
aaccaaaucucucaaaucu

SEQ ID NO: 158473 - RNA, 19 nt, Homo sapiens
gcagccagacuccuccuua

SEQ ID NO: 158474 - RNA, 19 nt, Homo sapiens
gagcagauuguuaguauuc

SEQ ID NO: 158475 - RNA, 19 nt, Homo sapiens
ucaccuguccugacgauua

SEQ ID NO: 158476 - RNA, 19 nt, Homo sapiens
ggacuuaccaggugugcaa

SEQ ID NO: 158477 - RNA, 19 nt, Homo sapiens
ccaaaugcucucucaaauu

SEQ ID NO: 158478 - RNA, 19 nt, Homo sapiens
guaaaauggugaagaacua

SEQ ID NO: 158479 - RNA, 19 nt, Homo sapiens
cuaaugggaucauauugga

SEQ ID NO: 158480 - RNA, 19 nt, Homo sapiens
ggcauuggaugguaauaug

SEQ ID NO: 158481 - RNA, 19 nt, Homo sapiens
caacaauucuaaggaggaa

SEQ ID NO: 158482 - RNA, 19 nt, Homo sapiens
gcucacaacuuaguguaau

SEQ ID NO: 158483 - RNA, 19 nt, Homo sapiens
gaaguuaccuuauuggauu

SEQ ID NO: 158484 - RNA, 19 nt, Homo sapiens
gaaauuaguuuaccucauc

SEQ ID NO: 158485 - RNA, 19 nt, Homo sapiens
cuaaagaagucacaagaua

SEQ ID NO: 158486 - RNA, 19 nt, Homo sapiens
gaacaucauucacuuggaa

SEQ ID NO: 158487 - RNA, 19 nt, Homo sapiens
ggucugggaugaaguauuu

SEQ ID NO: 158488 - RNA, 19 nt, Homo sapiens
gaaugaaguuaccuuauug

SEQ ID NO: 158489 - RNA, 19 nt, Homo sapiens
gaacuuggguggauagcaa

SEQ ID NO: 158490 - RNA, 19 nt, Homo sapiens
gagauuaaauucaccuuga

SEQ ID NO: 158491 - RNA, 19 nt, Homo sapiens
gcaauugccuaucguaaau

SEQ ID NO: 158492 - RNA, 19 nt, Homo sapiens
cgaaugaaguuaccuuauu

SEQ ID NO: 158493 - RNA, 19 nt, Homo sapiens
cagaauaacuggcuacgaa

SEQ ID NO: 158494 - RNA, 19 nt, Homo sapiens
ggagagacuuccugaguga

SEQ ID NO: 158495 - RNA, 19 nt, Homo sapiens
uauaggaguuggugaauuu

SEQ ID NO: 158496 - RNA, 19 nt, Homo sapiens
ugaauucucugcuguggua

SEQ ID NO: 158497 - RNA, 19 nt, Homo sapiens
guacgaagaucccaaccaa

SEQ ID NO: 158498 - RNA, 19 nt, Homo sapiens
gaagucaaguauuaugaga

SEQ ID NO: 158499 - RNA, 19 nt, Homo sapiens
gagaggcccuauugggaua

SEQ ID NO: 158500 - RNA, 19 nt, Homo sapiens
ggacauuggugacagaauc

SEQ ID NO: 158501 - RNA, 19 nt, Homo sapiens
gaaucaagguguaagaaca

SEQ ID NO: 158502 - RNA, 19 nt, Homo sapiens
caacaacucagaagagaaa

SEQ ID NO: 158503 - RNA, 19 nt, Homo sapiens
caaagagcguuucaucaga

SEQ ID NO: 158504 - RNA, 19 nt, Homo sapiens
ggguguauauugagauuaa

SEQ ID NO: 158505 - RNA, 19 nt, Homo sapiens
gcucagaggguguauauug

SEQ ID NO: 158506 - RNA, 19 nt, Homo sapiens
gauggcagauuuacaguca

SEQ ID NO: 158507 - RNA, 19 nt, Homo sapiens
ccucauccaugcacuuuaa

SEQ ID NO: 158508 - RNA, 19 nt, Homo sapiens
gaagagaaacauuugaauc

SEQ ID NO: 158509 - RNA, 19 nt, Homo sapiens
caacgaugcugccucuaug

SEQ ID NO: 158510 - RNA, 19 nt, Homo sapiens
cgagacaucugugaacuug

SEQ ID NO: 158511 - RNA, 19 nt, Homo sapiens
gaacccaaaugcagcagau

SEQ ID NO: 158512 - RNA, 19 nt, Homo sapiens
ugaggaaggcuaucgguua

SEQ ID NO: 158513 - RNA, 19 nt, Homo sapiens
gauuaaagccauugaggaa

SEQ ID NO: 158514 - RNA, 19 nt, Homo sapiens
ggguaauccuggaauauga

SEQ ID NO: 158515 - RNA, 19 nt, Homo sapiens
uggaguagcccucagaaua

SEQ ID NO: 158516 - RNA, 19 nt, Homo sapiens
ucugaaagcugguuauaca

SEQ ID NO: 158517 - RNA, 19 nt, Homo sapiens
gcagcaccaucauccauug

SEQ ID NO: 158518 - RNA, 19 nt, Homo sapiens
cguuuaaccuguacuacua

SEQ ID NO: 158519 - RNA, 19 nt, Homo sapiens
guucgaggcuccuguguca

SEQ ID NO: 158520 - RNA, 19 nt, Homo sapiens
gaggguguauauugagauu

SEQ ID NO: 158521 - RNA, 19 nt, Homo sapiens
uaacagaguacauggagaa

SEQ ID NO: 158522 - RNA, 19 nt, Homo sapiens
gaucauaacagaguacaug

SEQ ID NO: 158523 - RNA, 19 nt, Homo sapiens
ggaagugaguaucauggau

SEQ ID NO: 158524 - RNA, 19 nt, Homo sapiens
gagcgacaggccuaaauuu

SEQ ID NO: 158525 - RNA, 19 nt, Homo sapiens
cagaguacauggagaaugg

SEQ ID NO: 158526 - RNA, 19 nt, Homo sapiens
ggaugaaguauuuaucuga

SEQ ID NO: 158527 - RNA, 19 nt, Homo sapiens
guaaugaucauaacagagu

SEQ ID NO: 158528 - RNA, 19 nt, Homo sapiens
agaagcggaugaagagaaa

SEQ ID NO: 158529 - RNA, 19 nt, Homo sapiens
ggaauaugaagucaaguau

SEQ ID NO: 158530 - RNA, 19 nt, Homo sapiens
caaccaagcagcaccauca

SEQ ID NO: 158531 - RNA, 19 nt, Homo sapiens
ccaauuacaccuuugaaau

SEQ ID NO: 158532 - RNA, 19 nt, Homo sapiens
caucagagagaaccaguuu

SEQ ID NO: 158533 - RNA, 19 nt, Homo sapiens
gaggaaggcuaucgguuac

SEQ ID NO: 158534 - RNA, 19 nt, Homo sapiens
guauaaggauaacuucaca

SEQ ID NO: 158535 - RNA, 19 nt, Homo sapiens
uggaaggcguggucacuaa

SEQ ID NO: 158536 - RNA, 19 nt, Homo sapiens
caguaaagccaaacaagaa

SEQ ID NO: 158537 - RNA, 19 nt, Homo sapiens
gcacuuuaauugaagaacu

SEQ ID NO: 158538 - RNA, 19 nt, Homo sapiens
gcuauggaaucguuaugug

SEQ ID NO: 158539 - RNA, 19 nt, Homo sapiens
caagugauguauggagcua

SEQ ID NO: 158540 - RNA, 19 nt, Homo sapiens
gaagcaauugccuaucgua

SEQ ID NO: 158541 - RNA, 19 nt, Homo sapiens
cauccugcauuaagauuga

SEQ ID NO: 158542 - RNA, 19 nt, Homo sapiens
cgacaaagagcguuucauc

SEQ ID NO: 158543 - RNA, 19 nt, Homo sapiens
gggagaacuuggguggaua

SEQ ID NO: 158544 - RNA, 19 nt, Homo sapiens
ccuccuagcucauaccaau

SEQ ID NO: 158545 - RNA, 19 nt, Homo sapiens
ccuauaaugugguaugcaa

SEQ ID NO: 158546 - RNA, 19 nt, Homo sapiens
ggaguagcccucagaauac

SEQ ID NO: 158547 - RNA, 19 nt, Homo sapiens
agacaucugugaacuugga

SEQ ID NO: 158548 - RNA, 19 nt, Homo sapiens
uaccaagugugcaauguga

SEQ ID NO: 158549 - RNA, 19 nt, Homo sapiens
ggcaagaauugguaucaca

SEQ ID NO: 158550 - RNA, 19 nt, Homo sapiens
ggaugaagagaaacauuug

SEQ ID NO: 158551 - RNA, 19 nt, Homo sapiens
gaacccagccagaauaacu

SEQ ID NO: 158552 - RNA, 19 nt, Homo sapiens
gcagaugcacggcagaaug

SEQ ID NO: 158553 - RNA, 19 nt, Homo sapiens
ggacugcgccagaagcaau

SEQ ID NO: 158554 - RNA, 19 nt, Homo sapiens
cacuaaauguaaaccagua

SEQ ID NO: 158555 - RNA, 19 nt, Homo sapiens
gcagugggcgucucaaagu

SEQ ID NO: 158556 - RNA, 19 nt, Homo sapiens
caauuacaccuuugaaauc

SEQ ID NO: 158557 - RNA, 19 nt, Homo sapiens
gaaccuaccaagugugcaa

SEQ ID NO: 158558 - RNA, 19 nt, Homo sapiens
ggagcgacaggccuaaauu

SEQ ID NO: 158559 - RNA, 19 nt, Homo sapiens
ggauauguccaaucaagau

SEQ ID NO: 158560 - RNA, 19 nt, Homo sapiens
gggaugaaguauuuaucug

SEQ ID NO: 158561 - RNA, 19 nt, Homo sapiens
ccucucacuuccuauguuu

SEQ ID NO: 158562 - RNA, 19 nt, Homo sapiens
ucauaccaauuacaccuuu

SEQ ID NO: 158563 - RNA, 19 nt, Homo sapiens
gcaaggagacguuuaaccu

SEQ ID NO: 158564 - RNA, 19 nt, Homo sapiens
gauccaagcuccccugaau

SEQ ID NO: 158565 - RNA, 19 nt, Homo sapiens
ugugggaagugaugucgua

SEQ ID NO: 158566 - RNA, 19 nt, Homo sapiens
ugaacccucucacuuccua

SEQ ID NO: 158567 - RNA, 19 nt, Homo sapiens
gagagaaccaguuugucaa

SEQ ID NO: 158568 - RNA, 19 nt, Homo sapiens
caguaaugaucauaacaga

SEQ ID NO: 158569 - RNA, 19 nt, Homo sapiens
gguccaggcuaaagaaguc

SEQ ID NO: 158570 - RNA, 19 nt, Homo sapiens
cagaagcaauugccuaucg

SEQ ID NO: 158571 - RNA, 19 nt, Homo sapiens
ucugcaaagugucugauuu

SEQ ID NO: 158572 - RNA, 19 nt, Homo sapiens
uggcagauuuacagucauu

SEQ ID NO: 158573 - RNA, 19 nt, Homo sapiens
caggaacacagauaucaaa

SEQ ID NO: 158574 - RNA, 19 nt, Homo sapiens
gcaccaucauccauugcuu

SEQ ID NO: 158575 - RNA, 19 nt, Homo sapiens
gacaaagagcguuucauca

SEQ ID NO: 158576 - RNA, 19 nt, Homo sapiens
ugaaucagacaacgacaaa

SEQ ID NO: 158577 - RNA, 19 nt, Homo sapiens
uccaugcacuuuaauugaa

SEQ ID NO: 158578 - RNA, 19 nt, Homo sapiens
ggaaggagggugggaggaa

SEQ ID NO: 158579 - RNA, 19 nt, Homo sapiens
ggaaggcguggucacuaaa

SEQ ID NO: 158580 - RNA, 19 nt, Homo sapiens
gaauggaguagcccucaga

SEQ ID NO: 158581 - RNA, 19 nt, Homo sapiens
gucaacaacucagaagaga

SEQ ID NO: 158582 - RNA, 19 nt, Homo sapiens
gggcucagaggguguauau

SEQ ID NO: 158583 - RNA, 19 nt, Homo sapiens
ggaaagacgugucauauua

SEQ ID NO: 158584 - RNA, 19 nt, Homo sapiens
gagaauggcucuuuagaua

SEQ ID NO: 158585 - RNA, 19 nt, Homo sapiens
gaacauagcccacuaggau

SEQ ID NO: 158586 - RNA, 19 nt, Homo sapiens
gaacagccuucaagaaaug

SEQ ID NO: 158587 - RNA, 19 nt, Homo sapiens
gagaccagcuacacgauua

SEQ ID NO: 158588 - RNA, 19 nt, Homo sapiens
gcaacgaagugaauuuauu

SEQ ID NO: 158589 - RNA, 19 nt, Homo sapiens
gaugaaagcuuuacagaac

SEQ ID NO: 158590 - RNA, 19 nt, Homo sapiens
gcaaagugauggaacagaa

SEQ ID NO: 158591 - RNA, 19 nt, Homo sapiens
ggaaugccaucucaaaugu

SEQ ID NO: 158592 - RNA, 19 nt, Homo sapiens
gaaggaaagacgugucaua

SEQ ID NO: 158593 - RNA, 19 nt, Homo sapiens
guaugugucuguaaaugua

SEQ ID NO: 158594 - RNA, 19 nt, Homo sapiens
gcccaaguuugaugaaaua

SEQ ID NO: 158595 - RNA, 19 nt, Homo sapiens
gcaaccagaacuaauauuu

SEQ ID NO: 158596 - RNA, 19 nt, Homo sapiens
gaauggcucuuuagauaca

SEQ ID NO: 158597 - RNA, 19 nt, Homo sapiens
ccagaaacaucuuaaucaa

SEQ ID NO: 158598 - RNA, 19 nt, Homo sapiens
aaacagcacugagauuuau

SEQ ID NO: 158599 - RNA, 19 nt, Homo sapiens
caucauguaucaccauuga

SEQ ID NO: 158600 - RNA, 19 nt, Homo sapiens
caaucaagcuguccacgaa

SEQ ID NO: 158601 - RNA, 19 nt, Homo sapiens
guaaacagcacugagauuu

SEQ ID NO: 158602 - RNA, 19 nt, Homo sapiens
gaaguaccuuucugacaug

SEQ ID NO: 158603 - RNA, 19 nt, Homo sapiens
ggagaaacaucaaggaaaa

SEQ ID NO: 158604 - RNA, 19 nt, Homo sapiens
ucucaauccucuuucuuua

SEQ ID NO: 158605 - RNA, 19 nt, Homo sapiens
aaacaccucugucaugaug

SEQ ID NO: 158606 - RNA, 19 nt, Homo sapiens
gaaagacgugucauauuau

SEQ ID NO: 158607 - RNA, 19 nt, Homo sapiens
ggcaggauaugaagagaaa

SEQ ID NO: 158608 - RNA, 19 nt, Homo sapiens
uggacaagcugauacguaa

SEQ ID NO: 158609 - RNA, 19 nt, Homo sapiens
ggagauagaagcaucaugu

SEQ ID NO: 158610 - RNA, 19 nt, Homo sapiens
ggaagagauuggugaagug

SEQ ID NO: 158611 - RNA, 19 nt, Homo sapiens
gcauugcucugguuucugu

SEQ ID NO: 158612 - RNA, 19 nt, Homo sapiens
ggaggaggcucggagaaga

SEQ ID NO: 158613 - RNA, 19 nt, Homo sapiens
ugugggaaguugugucuua

SEQ ID NO: 158614 - RNA, 19 nt, Homo sapiens
ggaaugaaguaccuuucug

SEQ ID NO: 158615 - RNA, 19 nt, Homo sapiens
gagaggagccagaagcaaa

SEQ ID NO: 158616 - RNA, 19 nt, Homo sapiens
ugaagacgcugguuaaugc

SEQ ID NO: 158617 - RNA, 19 nt, Homo sapiens
ugaaguaccuuucugacau

SEQ ID NO: 158618 - RNA, 19 nt, Homo sapiens
aaugccaucucaaauguua

SEQ ID NO: 158619 - RNA, 19 nt, Homo sapiens
caacgaagugaauuuauug

SEQ ID NO: 158620 - RNA, 19 nt, Homo sapiens
gaaaauggauacaguucaa

SEQ ID NO: 158621 - RNA, 19 nt, Homo sapiens
gaaauagcaggcccaaguu

SEQ ID NO: 158622 - RNA, 19 nt, Homo sapiens
gauuaaagcgguagaggaa

SEQ ID NO: 158623 - RNA, 19 nt, Homo sapiens
guuuaugucuuccaaauuc

SEQ ID NO: 158624 - RNA, 19 nt, Homo sapiens
cauaauacaccaaaugcua

SEQ ID NO: 158625 - RNA, 19 nt, Homo sapiens
cagaauaacuggcuuuuga

SEQ ID NO: 158626 - RNA, 19 nt, Homo sapiens
gcucgcugcucuccuguuu

SEQ ID NO: 158627 - RNA, 19 nt, Homo sapiens
gaaugaaguaccuuucuga

SEQ ID NO: 158628 - RNA, 19 nt, Homo sapiens
cagaguauauggagaaugg

SEQ ID NO: 158629 - RNA, 19 nt, Homo sapiens
ggcaguaugugucuguaaa

SEQ ID NO: 158630 - RNA, 19 nt, Homo sapiens
uguaggaccucuaagcaaa

SEQ ID NO: 158631 - RNA, 19 nt, Homo sapiens
gggaagagauuggugaagu

SEQ ID NO: 158632 - RNA, 19 nt, Homo sapiens
caaguuugaugaaauaguc

SEQ ID NO: 158633 - RNA, 19 nt, Homo sapiens
ggaaguugcugcgaaugug

SEQ ID NO: 158634 - RNA, 19 nt, Homo sapiens
gaacagaaucagaauaacu

SEQ ID NO: 158635 - RNA, 19 nt, Homo sapiens
cgaagugaauuuauuggau

SEQ ID NO: 158636 - RNA, 19 nt, Homo sapiens
ugucuggaguuauggaaua

SEQ ID NO: 158637 - RNA, 19 nt, Homo sapiens
uauggagaauggcucuuua

SEQ ID NO: 158638 - RNA, 19 nt, Homo sapiens
ucacacaaacuauaccuuu

SEQ ID NO: 158639 - RNA, 19 nt, Homo sapiens
gauccgugguuccuacauu

SEQ ID NO: 158640 - RNA, 19 nt, Homo sapiens
cgaaauagcaggcccaagu

SEQ ID NO: 158641 - RNA, 19 nt, Homo sapiens
acaguaaccuugugugcaa

SEQ ID NO: 158642 - RNA, 19 nt, Homo sapiens
ccaauggaaucauccuaga

SEQ ID NO: 158643 - RNA, 19 nt, Homo sapiens
gcacuagcaaccagaacua

SEQ ID NO: 158644 - RNA, 19 nt, Homo sapiens
gcacucagcgcgcagcuau

SEQ ID NO: 158645 - RNA, 19 nt, Homo sapiens
ggagaugaccaaucaagau

SEQ ID NO: 158646 - RNA, 19 nt, Homo sapiens
gagcugauucuucccaauu

SEQ ID NO: 158647 - RNA, 19 nt, Homo sapiens
ugagucagaugaucagaau

SEQ ID NO: 158648 - RNA, 19 nt, Homo sapiens
guaaaugucgcuucuucaa

SEQ ID NO: 158649 - RNA, 19 nt, Homo sapiens
agaagaagaucaugaacag

SEQ ID NO: 158650 - RNA, 19 nt, Homo sapiens
ugaauuuggugaaguuugu

SEQ ID NO: 158651 - RNA, 19 nt, Homo sapiens
gugcagaccuggguucuuc

SEQ ID NO: 158652 - RNA, 19 nt, Homo sapiens
uaccaaguaugcaaaguga

SEQ ID NO: 158653 - RNA, 19 nt, Homo sapiens
ucaauccucuuucuuuauc

SEQ ID NO: 158654 - RNA, 19 nt, Homo sapiens
gugaauggcuagaggcaau

SEQ ID NO: 158655 - RNA, 19 nt, Homo sapiens
gaugaaauagucaacaugu

SEQ ID NO: 158656 - RNA, 19 nt, Homo sapiens
gggcacacauaaugacuca

SEQ ID NO: 158657 - RNA, 19 nt, Homo sapiens
caucauccauuuagaaggu

SEQ ID NO: 158658 - RNA, 19 nt, Homo sapiens
gagauagaagcaucaugua

SEQ ID NO: 158659 - RNA, 19 nt, Homo sapiens
ggaagaagggugcaucagu

SEQ ID NO: 158660 - RNA, 19 nt, Homo sapiens
gggagaaacaucaaggaaa

SEQ ID NO: 158661 - RNA, 19 nt, Homo sapiens
gaccugggauggauugcuu

SEQ ID NO: 158662 - RNA, 19 nt, Homo sapiens
cagcaacgaagugaauuua

SEQ ID NO: 158663 - RNA, 19 nt, Homo sapiens
aaaugucgcuucuucaagu

SEQ ID NO: 158664 - RNA, 19 nt, Homo sapiens
cugcagaguaucuaauuua

SEQ ID NO: 158665 - RNA, 19 nt, Homo sapiens
gagaauuaccuguggcuau

SEQ ID NO: 158666 - RNA, 19 nt, Homo sapiens
uggaacagaaucagaauaa

SEQ ID NO: 158667 - RNA, 19 nt, Homo sapiens
cuagcaaccagaacuaaua

SEQ ID NO: 158668 - RNA, 19 nt, Homo sapiens
ggagaauggcucuuuagau

SEQ ID NO: 158669 - RNA, 19 nt, Homo sapiens
uauuggagcaggugaauuu

SEQ ID NO: 158670 - RNA, 19 nt, Homo sapiens
guaaauguaaccacaaauc

SEQ ID NO: 158671 - RNA, 19 nt, Homo sapiens
gaauggaguguccgacuug

SEQ ID NO: 158672 - RNA, 19 nt, Homo sapiens
gaucuuggugaccguguua

SEQ ID NO: 158673 - RNA, 19 nt, Homo sapiens
gaagggugcaucagugaau

SEQ ID NO: 158674 - RNA, 19 nt, Homo sapiens
gaugaccaaucaagaugug

SEQ ID NO: 158675 - RNA, 19 nt, Homo sapiens
gagaugaccaaucaagaug

SEQ ID NO: 158676 - RNA, 19 nt, Homo sapiens
gccagaaacaucuuaauca

SEQ ID NO: 158677 - RNA, 19 nt, Homo sapiens
gaaaagcaacgcagagauu

SEQ ID NO: 158678 - RNA, 19 nt, Homo sapiens
gcugcucucuaucaguuaa

SEQ ID NO: 158679 - RNA, 19 nt, Homo sapiens
gggaaguugugucuuaugg

SEQ ID NO: 158680 - RNA, 19 nt, Homo sapiens
ggucagucaauacauuaua

SEQ ID NO: 158681 - RNA, 19 nt, Homo sapiens
ugacagaguauauggagaa

SEQ ID NO: 158682 - RNA, 19 nt, Homo sapiens
auagaagcaucauguauca

SEQ ID NO: 158683 - RNA, 19 nt, Homo sapiens
caagauaacugaaaccuaa

SEQ ID NO: 158684 - RNA, 19 nt, Homo sapiens
gcagaacuauccaguguua

SEQ ID NO: 158685 - RNA, 19 nt, Homo sapiens
gaaaagagauguugcagua

SEQ ID NO: 158686 - RNA, 19 nt, Homo sapiens
gccaagagcucugauauuu

SEQ ID NO: 158687 - RNA, 19 nt, Homo sapiens
gaaauagcaugauugaaga

SEQ ID NO: 158688 - RNA, 19 nt, Homo sapiens
cuagaugccuccuguauua

SEQ ID NO: 158689 - RNA, 19 nt, Homo sapiens
agaagaagguuaucguuua

SEQ ID NO: 158690 - RNA, 19 nt, Homo sapiens
gaaagaaagaugaagcuua

SEQ ID NO: 158691 - RNA, 19 nt, Homo sapiens
uagcaaagcugaccaagaa

SEQ ID NO: 158692 - RNA, 19 nt, Homo sapiens
ugaaggaucuggcuuguuu

SEQ ID NO: 158693 - RNA, 19 nt, Homo sapiens
gaaaguugguuacacagaa

SEQ ID NO: 158694 - RNA, 19 nt, Homo sapiens
gaacuuagcuaucuuucca

SEQ ID NO: 158695 - RNA, 19 nt, Homo sapiens
gagaauggcuacaagcuau

SEQ ID NO: 158696 - RNA, 19 nt, Homo sapiens
gaugugaccuacagaauau

SEQ ID NO: 158697 - RNA, 19 nt, Homo sapiens
gaagcugucuauacaacua

SEQ ID NO: 158698 - RNA, 19 nt, Homo sapiens
gaaacaugaugggcaauuu

SEQ ID NO: 158699 - RNA, 19 nt, Homo sapiens
aaauggaguuucugacuua

SEQ ID NO: 158700 - RNA, 19 nt, Homo sapiens
aagaagugcugguccauua

SEQ ID NO: 158701 - RNA, 19 nt, Homo sapiens
gaagagcuuuacuuucauu

SEQ ID NO: 158702 - RNA, 19 nt, Homo sapiens
caaauuugcugcacagaau

SEQ ID NO: 158703 - RNA, 19 nt, Homo sapiens
gcacugugguuauagcaaa

SEQ ID NO: 158704 - RNA, 19 nt, Homo sapiens
gaaaauagcagugacaaua

SEQ ID NO: 158705 - RNA, 19 nt, Homo sapiens
caacagcaaucucguuugu

SEQ ID NO: 158706 - RNA, 19 nt, Homo sapiens
guaauagaguucauggaaa

SEQ ID NO: 158707 - RNA, 19 nt, Homo sapiens
aaauagagcuguccaucaa

SEQ ID NO: 158708 - RNA, 19 nt, Homo sapiens
gaacggaccuacucaacag

SEQ ID NO: 158709 - RNA, 19 nt, Homo sapiens
gggaagaaauuagugguuu

SEQ ID NO: 158710 - RNA, 19 nt, Homo sapiens
gcuacaagcuauuaagaug

SEQ ID NO: 158711 - RNA, 19 nt, Homo sapiens
agaugaagcuuaacacuga

SEQ ID NO: 158712 - RNA, 19 nt, Homo sapiens
gagaaaaccucuauguaaa

SEQ ID NO: 158713 - RNA, 19 nt, Homo sapiens
ggaacaaacagcauuuaaa

SEQ ID NO: 158714 - RNA, 19 nt, Homo sapiens
gaacagauaguuggaauuc

SEQ ID NO: 158715 - RNA, 19 nt, Homo sapiens
gaagaaacgaugugaccua

SEQ ID NO: 158716 - RNA, 19 nt, Homo sapiens
ggaagaaauuagugguuug

SEQ ID NO: 158717 - RNA, 19 nt, Homo sapiens
acagcaaucucguuuguaa

SEQ ID NO: 158718 - RNA, 19 nt, Homo sapiens
gauaugcauuucucccuuu

SEQ ID NO: 158719 - RNA, 19 nt, Homo sapiens
acagauaguuggaauucua

SEQ ID NO: 158720 - RNA, 19 nt, Homo sapiens
gaagaagguuaucguuuac

SEQ ID NO: 158721 - RNA, 19 nt, Homo sapiens
ggagaaggcacugugguua

SEQ ID NO: 158722 - RNA, 19 nt, Homo sapiens
ugagagagauuggaccuuu

SEQ ID NO: 158723 - RNA, 19 nt, Homo sapiens
ugugggaaguuaugucuua

SEQ ID NO: 158724 - RNA, 19 nt, Homo sapiens
gcagcucccucgcaaguga

SEQ ID NO: 158725 - RNA, 19 nt, Homo sapiens
gggauucuaucuugccuuu

SEQ ID NO: 158726 - RNA, 19 nt, Homo sapiens
gaacuugcaaggaaacauu

SEQ ID NO: 158727 - RNA, 19 nt, Homo sapiens
gcacagaauaucaccauug

SEQ ID NO: 158728 - RNA, 19 nt, Homo sapiens
gaaacgaugugaccuacag

SEQ ID NO: 158729 - RNA, 19 nt, Homo sapiens
aaacagaguuggaguggau

SEQ ID NO: 158730 - RNA, 19 nt, Homo sapiens
gaaggcaagucucugaaag

SEQ ID NO: 158731 - RNA, 19 nt, Homo sapiens
ggaaaccagucaugauagu

SEQ ID NO: 158732 - RNA, 19 nt, Homo sapiens
aaagaaggcuccuccagau

SEQ ID NO: 158733 - RNA, 19 nt, Homo sapiens
gaucuucagugcucucguu

SEQ ID NO: 158734 - RNA, 19 nt, Homo sapiens
gaacacugaugcaagaaac

SEQ ID NO: 158735 - RNA, 19 nt, Homo sapiens
gaagagaagauuuaagaag

SEQ ID NO: 158736 - RNA, 19 nt, Homo sapiens
guaaagaucagacaacaca

SEQ ID NO: 158737 - RNA, 19 nt, Homo sapiens
gaacaguacuggccuucag

SEQ ID NO: 158738 - RNA, 19 nt, Homo sapiens
gcaauauucuugucaacag

SEQ ID NO: 158739 - RNA, 19 nt, Homo sapiens
agaaggcacugugguuaua

SEQ ID NO: 158740 - RNA, 19 nt, Homo sapiens
caagugagcggaguaauga

SEQ ID NO: 158741 - RNA, 19 nt, Homo sapiens
uaaauggaguuucugacuu

SEQ ID NO: 158742 - RNA, 19 nt, Homo sapiens
cuacagcugucuccaguga

SEQ ID NO: 158743 - RNA, 19 nt, Homo sapiens
agaggaagcuacagguaaa

SEQ ID NO: 158744 - RNA, 19 nt, Homo sapiens
gauucuaucuugccuuuca

SEQ ID NO: 158745 - RNA, 19 nt, Homo sapiens
uaacagucuuccuggagua

SEQ ID NO: 158746 - RNA, 19 nt, Homo sapiens
gaauaucaccauugcaguu

SEQ ID NO: 158747 - RNA, 19 nt, Homo sapiens
guccaaacaugaaaggaaa

SEQ ID NO: 158748 - RNA, 19 nt, Homo sapiens
gugaagagaagauuuaaga

SEQ ID NO: 158749 - RNA, 19 nt, Homo sapiens
ccaauggagucaucacaga

SEQ ID NO: 158750 - RNA, 19 nt, Homo sapiens
uuauaacucugaagcauga

SEQ ID NO: 158751 - RNA, 19 nt, Homo sapiens
gacacuggcaggaauauaa

SEQ ID NO: 158752 - RNA, 19 nt, Homo sapiens
gaugggcaauuuacaguca

SEQ ID NO: 158753 - RNA, 19 nt, Homo sapiens
aaacaugaugggcaauuua

SEQ ID NO: 158754 - RNA, 19 nt, Homo sapiens
gcaagugagcggaguaaug

SEQ ID NO: 158755 - RNA, 19 nt, Homo sapiens
agaagcaccuauagacuug

SEQ ID NO: 158756 - RNA, 19 nt, Homo sapiens
gaauggcuacaagcuauua

SEQ ID NO: 158757 - RNA, 19 nt, Homo sapiens
ggacaugucaaaucaagau

SEQ ID NO: 158758 - RNA, 19 nt, Homo sapiens
gauuagaggauaacuaugu

SEQ ID NO: 158759 - RNA, 19 nt, Homo sapiens
ggaguaacauuggauacau

SEQ ID NO: 158760 - RNA, 19 nt, Homo sapiens
cuacaagucuuccucucaa

SEQ ID NO: 158761 - RNA, 19 nt, Homo sapiens
caaaggcaaugcacaaagg

SEQ ID NO: 158762 - RNA, 19 nt, Homo sapiens
gaaugcaguccaaacauga

SEQ ID NO: 158763 - RNA, 19 nt, Homo sapiens
uuagaaagcuguuuauagc

SEQ ID NO: 158764 - RNA, 19 nt, Homo sapiens
gauuuaagaagcaccuaua

SEQ ID NO: 158765 - RNA, 19 nt, Homo sapiens
ggaugacuauugaggaugu

SEQ ID NO: 158766 - RNA, 19 nt, Homo sapiens
ggagaauggcuacaagcua

SEQ ID NO: 158767 - RNA, 19 nt, Homo sapiens
ugaaugcaguccaaacaug

SEQ ID NO: 158768 - RNA, 19 nt, Homo sapiens
aagcagaacuauccagugu

SEQ ID NO: 158769 - RNA, 19 nt, Homo sapiens
agaaauagcaugauugaag

SEQ ID NO: 158770 - RNA, 19 nt, Homo sapiens
gaagugcugguccauuauu

SEQ ID NO: 158771 - RNA, 19 nt, Homo sapiens
gcauagcuuugguuucugu

SEQ ID NO: 158772 - RNA, 19 nt, Homo sapiens
gagagagauuggaccuuug

SEQ ID NO: 158773 - RNA, 19 nt, Homo sapiens
caccauugcugcagaugaa

SEQ ID NO: 158774 - RNA, 19 nt, Homo sapiens
gcaauaaugauccauacau

SEQ ID NO: 158775 - RNA, 19 nt, Homo sapiens
gauauuguuugcuaauugg

SEQ ID NO: 158776 - RNA, 19 nt, Homo sapiens
ggaacuggcauucaagugu

SEQ ID NO: 158777 - RNA, 19 nt, Homo sapiens
cgaugugaccuacagaaua

SEQ ID NO: 158778 - RNA, 19 nt, Homo sapiens
acaacuggcugcggacuaa

SEQ ID NO: 158779 - RNA, 19 nt, Homo sapiens
uauauccucuucuguugaa

SEQ ID NO: 158780 - RNA, 19 nt, Homo sapiens
gauuucagacuauuccuuu

SEQ ID NO: 158781 - RNA, 19 nt, Homo sapiens
acagugaagagaagauuua

SEQ ID NO: 158782 - RNA, 19 nt, Homo sapiens
uugaggaugugaugaguuu

SEQ ID NO: 158783 - RNA, 19 nt, Homo sapiens
gagcugggcuucuacaagu

SEQ ID NO: 158784 - RNA, 19 nt, Homo sapiens
acaaggagaugcagagcua

SEQ ID NO: 158785 - RNA, 19 nt, Homo sapiens
gagcuguucuuccuuccua

SEQ ID NO: 158786 - RNA, 19 nt, Homo sapiens
gaagaugcacuaucagaau

SEQ ID NO: 158787 - RNA, 19 nt, Homo sapiens
gaugguggaugauguguca

SEQ ID NO: 158788 - RNA, 19 nt, Homo sapiens
gaucucaugugaacagugu

SEQ ID NO: 158789 - RNA, 19 nt, Homo sapiens
uaaauucugccucaucuuu

SEQ ID NO: 158790 - RNA, 19 nt, Homo sapiens
ccaccaggguauguaaaua

SEQ ID NO: 158791 - RNA, 19 nt, Homo sapiens
gagaagaugcacuaucaga

SEQ ID NO: 158792 - RNA, 19 nt, Homo sapiens
gcccaggucuccucacuca

SEQ ID NO: 158793 - RNA, 19 nt, Homo sapiens
aggagaagaugcacuauca

SEQ ID NO: 158794 - RNA, 19 nt, Homo sapiens
aaccugaucuccaguguga

SEQ ID NO: 158795 - RNA, 19 nt, Homo sapiens
cauccugacucuugaacuu

SEQ ID NO: 158796 - RNA, 19 nt, Homo sapiens
gggcaggcaccuucucuuu

SEQ ID NO: 158797 - RNA, 19 nt, Homo sapiens
gaaagccaguuccucaaaa

SEQ ID NO: 158798 - RNA, 19 nt, Homo sapiens
ugaaugaggagguguguga

SEQ ID NO: 158799 - RNA, 19 nt, Homo sapiens
ucucagaccugggcuaugu

SEQ ID NO: 158800 - RNA, 19 nt, Homo sapiens
gagcgaggcguccaucaug

SEQ ID NO: 158801 - RNA, 19 nt, Homo sapiens
ccaggucuccucacucaaa

SEQ ID NO: 158802 - RNA, 19 nt, Homo sapiens
guuaugagcgugugcuuau

SEQ ID NO: 158803 - RNA, 19 nt, Homo sapiens
gauugugacugaguacaug

SEQ ID NO: 158804 - RNA, 19 nt, Homo sapiens
gaucaaguacuacgagaag

SEQ ID NO: 158805 - RNA, 19 nt, Homo sapiens
ccugugagcugggcuucua

SEQ ID NO: 158806 - RNA, 19 nt, Homo sapiens
gaccagaggauccuaucuu

SEQ ID NO: 158807 - RNA, 19 nt, Homo sapiens
ggacgugugcauguuauga

SEQ ID NO: 158808 - RNA, 19 nt, Homo sapiens
gggacacacccaagaugua

SEQ ID NO: 158809 - RNA, 19 nt, Homo sapiens
ucucuacaccucuauauau

SEQ ID NO: 158810 - RNA, 19 nt, Homo sapiens
gaacagugugugaucaagu

SEQ ID NO: 158811 - RNA, 19 nt, Homo sapiens
gcaggcaccuucucuuuuc

SEQ ID NO: 158812 - RNA, 19 nt, Homo sapiens
gaagauccugggcagcauu

SEQ ID NO: 158813 - RNA, 19 nt, Homo sapiens
aagaugcacuaucagaaug

SEQ ID NO: 158814 - RNA, 19 nt, Homo sapiens
gcgcgucuaugcugagauc

SEQ ID NO: 158815 - RNA, 19 nt, Homo sapiens
ccugacaccugcccuuugu

SEQ ID NO: 158816 - RNA, 19 nt, Homo sapiens
cugcucaucugcaagaaga

SEQ ID NO: 158817 - RNA, 19 nt, Homo sapiens
gugaaugggacaucaguga

SEQ ID NO: 158818 - RNA, 19 nt, Homo sapiens
uggcagagcacaugagaug

SEQ ID NO: 158819 - RNA, 19 nt, Homo sapiens
ucucaccgcugcuucaaca

SEQ ID NO: 158820 - RNA, 19 nt, Homo sapiens
aauaaauucugccucaucu

SEQ ID NO: 158821 - RNA, 19 nt, Homo sapiens
ggucuucaaagcacauaaa

SEQ ID NO: 158822 - RNA, 19 nt, Homo sapiens
ggguggaagugcccuggaa

SEQ ID NO: 158823 - RNA, 19 nt, Homo sapiens
acagcaaccuggucugcaa

SEQ ID NO: 158824 - RNA, 19 nt, Homo sapiens
gacgggcaguucaccauca

SEQ ID NO: 158825 - RNA, 19 nt, Homo sapiens
uggaguaugagaucaagua

SEQ ID NO: 158826 - RNA, 19 nt, Homo sapiens
gagcgggacacacccaaga

SEQ ID NO: 158827 - RNA, 19 nt, Homo sapiens
ugacugaguacauggagaa

SEQ ID NO: 158828 - RNA, 19 nt, Homo sapiens
acugugaccucagcuacua

SEQ ID NO: 158829 - RNA, 19 nt, Homo sapiens
ggacacacccaagauguac

SEQ ID NO: 158830 - RNA, 19 nt, Homo sapiens
agaaagccaguuccucaaa

SEQ ID NO: 158831 - RNA, 19 nt, Homo sapiens
ccagcucucuacaccucua

SEQ ID NO: 158832 - RNA, 19 nt, Homo sapiens
agcgugugcuuauccguua

SEQ ID NO: 158833 - RNA, 19 nt, Homo sapiens
gauugucaguguccucgau

SEQ ID NO: 158834 - RNA, 19 nt, Homo sapiens
cuauauagccgagcuguuc

SEQ ID NO: 158835 - RNA, 19 nt, Homo sapiens
cucuacaccucuauauauu

SEQ ID NO: 158836 - RNA, 19 nt, Homo sapiens
caccaggguauguaaauau

SEQ ID NO: 158837 - RNA, 19 nt, Homo sapiens
ccucuaggauccacaucga

SEQ ID NO: 158838 - RNA, 19 nt, Homo sapiens
ggaucgaggccgucaaugg

SEQ ID NO: 158839 - RNA, 19 nt, Homo sapiens
cacaugaacuacuccuucu

SEQ ID NO: 158840 - RNA, 19 nt, Homo sapiens
gcucagcagccuccucuag

SEQ ID NO: 158841 - RNA, 19 nt, Homo sapiens
acacguaccagguuugcaa

SEQ ID NO: 158842 - RNA, 19 nt, Homo sapiens
agaagaugcacuaucagaa

SEQ ID NO: 158843 - RNA, 19 nt, Homo sapiens
gaggagaagaugcacuauc

SEQ ID NO: 158844 - RNA, 19 nt, Homo sapiens
uaugacaccaggaccauug

SEQ ID NO: 158845 - RNA, 19 nt, Homo sapiens
ggaaacauggucagaacac

SEQ ID NO: 158846 - RNA, 19 nt, Homo sapiens
ccucgcuucucccagauug

SEQ ID NO: 158847 - RNA, 19 nt, Homo sapiens
gagcuucggcguggucaug

SEQ ID NO: 158848 - RNA, 19 nt, Homo sapiens
augcugagaucaaguuuac

SEQ ID NO: 158849 - RNA, 19 nt, Homo sapiens
cuccgcaucuacuauaaga

SEQ ID NO: 158850 - RNA, 19 nt, Homo sapiens
agacuaaggccuggagaga

SEQ ID NO: 158851 - RNA, 19 nt, Homo sapiens
cagaggauccuaucuucuc

SEQ ID NO: 158852 - RNA, 19 nt, Homo sapiens
ucucccagauugucagugu

SEQ ID NO: 158853 - RNA, 19 nt, Homo sapiens
ggagguggagaccgggaaa

SEQ ID NO: 158854 - RNA, 19 nt, Homo sapiens
gagcuacuccacccucaag

SEQ ID NO: 158855 - RNA, 19 nt, Homo sapiens
gcacacaagaaagccaguu

SEQ ID NO: 158856 - RNA, 19 nt, Homo sapiens
gcucucuacaccucuauau

SEQ ID NO: 158857 - RNA, 19 nt, Homo sapiens
agaggauccuaucuucuca

SEQ ID NO: 158858 - RNA, 19 nt, Homo sapiens
gggugaugguggaugaugu

SEQ ID NO: 158859 - RNA, 19 nt, Homo sapiens
ggaggcacaugugggugau

SEQ ID NO: 158860 - RNA, 19 nt, Homo sapiens
aacagugugugaucaagug

SEQ ID NO: 158861 - RNA, 19 nt, Homo sapiens
gaugcacuaucagaaugga

SEQ ID NO: 158862 - RNA, 19 nt, Homo sapiens
ucaaguacuacgagaagga

SEQ ID NO: 158863 - RNA, 19 nt, Homo sapiens
ucucuccgcaucuacuaua

SEQ ID NO: 158864 - RNA, 19 nt, Homo sapiens
uauggaagucggaaacaug

SEQ ID NO: 158865 - RNA, 19 nt, Homo sapiens
ucucccuccugcaauaauu

SEQ ID NO: 158866 - RNA, 19 nt, Homo sapiens
ugugggugaugguggauga

SEQ ID NO: 158867 - RNA, 19 nt, Homo sapiens
ucugcaaggugucugacuu

SEQ ID NO: 158868 - RNA, 19 nt, Homo sapiens
gaaugggacaucagugacu

SEQ ID NO: 158869 - RNA, 19 nt, Homo sapiens
ucggaaacauggucagaac

SEQ ID NO: 158870 - RNA, 19 nt, Homo sapiens
accagaggauccuaucuuc

SEQ ID NO: 158871 - RNA, 19 nt, Homo sapiens
cggcaccucugauguacag

SEQ ID NO: 158872 - RNA, 19 nt, Homo sapiens
ggaucugccugacgcucau

SEQ ID NO: 158873 - RNA, 19 nt, Homo sapiens
uagccgagcuguucuuccu

SEQ ID NO: 158874 - RNA, 19 nt, Homo sapiens
caggguauguaaauaucuc

SEQ ID NO: 158875 - RNA, 19 nt, Homo sapiens
gcgugugcuuauccguuaa

SEQ ID NO: 158876 - RNA, 19 nt, Homo sapiens
gcucgacuguuggcacaag

SEQ ID NO: 158877 - RNA, 19 nt, Homo sapiens
ugaaccugaucuccagugu

SEQ ID NO: 158878 - RNA, 19 nt, Homo sapiens
cccucucccuccugcaaua

SEQ ID NO: 158879 - RNA, 19 nt, Homo sapiens
cuaccaugucagaauauuu

SEQ ID NO: 158880 - RNA, 19 nt, Homo sapiens
cgucuaugcugagaucaag

SEQ ID NO: 158881 - RNA, 19 nt, Homo sapiens
gcaucuacuauaagaagug

SEQ ID NO: 158882 - RNA, 19 nt, Homo sapiens
ggucuggguccucccucua

SEQ ID NO: 158883 - RNA, 19 nt, Homo sapiens
gcgauaagcuccagcauua

SEQ ID NO: 158884 - RNA, 19 nt, Homo sapiens
caacagaagugaagacaaa

SEQ ID NO: 158885 - RNA, 19 nt, Homo sapiens
gaaacgggcuuauagcaaa

SEQ ID NO: 158886 - RNA, 19 nt, Homo sapiens
ggaugaagaucuacauuga

SEQ ID NO: 158887 - RNA, 19 nt, Homo sapiens
gaacagcauucauucuaug

SEQ ID NO: 158888 - RNA, 19 nt, Homo sapiens
gagagacccuauugggaua

SEQ ID NO: 158889 - RNA, 19 nt, Homo sapiens
gcacgucucugucaacauc

SEQ ID NO: 158890 - RNA, 19 nt, Homo sapiens
gagcacaucucuggugauu

SEQ ID NO: 158891 - RNA, 19 nt, Homo sapiens
cagaagaccuccugagaau

SEQ ID NO: 158892 - RNA, 19 nt, Homo sapiens
ucacagaguucauggagaa

SEQ ID NO: 158893 - RNA, 19 nt, Homo sapiens
cagaagcaguguuccauuu

SEQ ID NO: 158894 - RNA, 19 nt, Homo sapiens
gcacaucucuggugauugc

SEQ ID NO: 158895 - RNA, 19 nt, Homo sapiens
gaagaccuccugagaauag

SEQ ID NO: 158896 - RNA, 19 nt, Homo sapiens
ccaaggagauugauguauc

SEQ ID NO: 158897 - RNA, 19 nt, Homo sapiens
gggaauggauggugccuau

SEQ ID NO: 158898 - RNA, 19 nt, Homo sapiens
gggaugaugugaccuacaa

SEQ ID NO: 158899 - RNA, 19 nt, Homo sapiens
caacggcaauggcaugaga

SEQ ID NO: 158900 - RNA, 19 nt, Homo sapiens
gaaggcugaugaagguaaa

SEQ ID NO: 158901 - RNA, 19 nt, Homo sapiens
gcagcagccucccuaaugu

SEQ ID NO: 158902 - RNA, 19 nt, Homo sapiens
ugaaguaccuggcugagau

SEQ ID NO: 158903 - RNA, 19 nt, Homo sapiens
uggcugagaugaauuaugu

SEQ ID NO: 158904 - RNA, 19 nt, Homo sapiens
gaagaaagggaaggaggua

SEQ ID NO: 158905 - RNA, 19 nt, Homo sapiens
gacagaagcauguuugaga

SEQ ID NO: 158906 - RNA, 19 nt, Homo sapiens
gcaggaaacgggcuuauag

SEQ ID NO: 158907 - RNA, 19 nt, Homo sapiens
gaauggauggugccuauug

SEQ ID NO: 158908 - RNA, 19 nt, Homo sapiens
caaguucaguggcaagaug

SEQ ID NO: 158909 - RNA, 19 nt, Homo sapiens
caacuuguauuacuaugag

SEQ ID NO: 158910 - RNA, 19 nt, Homo sapiens
gagauguaccuucaauuga

SEQ ID NO: 158911 - RNA, 19 nt, Homo sapiens
gaagcagcgucgggacuuu

SEQ ID NO: 158912 - RNA, 19 nt, Homo sapiens
gcaccugucggaccgguua

SEQ ID NO: 158913 - RNA, 19 nt, Homo sapiens
ggaaacgggcuuauagcaa

SEQ ID NO: 158914 - RNA, 19 nt, Homo sapiens
guaccuggcugagaugaau

SEQ ID NO: 158915 - RNA, 19 nt, Homo sapiens
ggcccuggauuaucuacua

SEQ ID NO: 158916 - RNA, 19 nt, Homo sapiens
gugggaaaccaaauauaua

SEQ ID NO: 158917 - RNA, 19 nt, Homo sapiens
ggaauguacuggagagacu

SEQ ID NO: 158918 - RNA, 19 nt, Homo sapiens
gagauccgguacuaugaga

SEQ ID NO: 158919 - RNA, 19 nt, Homo sapiens
caacaucaccacaaaccaa

SEQ ID NO: 158920 - RNA, 19 nt, Homo sapiens
ugacgacaauguggaguuu

SEQ ID NO: 158921 - RNA, 19 nt, Homo sapiens
ggaaggcugaugaagguaa

SEQ ID NO: 158922 - RNA, 19 nt, Homo sapiens
ggcaugagaacucuuguuu

SEQ ID NO: 158923 - RNA, 19 nt, Homo sapiens
acaguaaccuggugugcaa

SEQ ID NO: 158924 - RNA, 19 nt, Homo sapiens
gcagaggcgucucccaucu

SEQ ID NO: 158925 - RNA, 19 nt, Homo sapiens
agaagaagauccugaacag

SEQ ID NO: 158926 - RNA, 19 nt, Homo sapiens
ggaagaucccugugagaug

SEQ ID NO: 158927 - RNA, 19 nt, Homo sapiens
gaaguggacgugcccauca

SEQ ID NO: 158928 - RNA, 19 nt, Homo sapiens
gaagguaaacacagaaguc

SEQ ID NO: 158929 - RNA, 19 nt, Homo sapiens
gcgaaaggauaccgagaag

SEQ ID NO: 158930 - RNA, 19 nt, Homo sapiens
ggacuuugacccuccagaa

SEQ ID NO: 158931 - RNA, 19 nt, Homo sapiens
ugaugaagguaaacacaga

SEQ ID NO: 158932 - RNA, 19 nt, Homo sapiens
aaacccagcuccugagucu

SEQ ID NO: 158933 - RNA, 19 nt, Homo sapiens
ggccaucucuaucgucugu

SEQ ID NO: 158934 - RNA, 19 nt, Homo sapiens
ccaucaaacucuacugcaa

SEQ ID NO: 158935 - RNA, 19 nt, Homo sapiens
guagagggaagaaacagaa

SEQ ID NO: 158936 - RNA, 19 nt, Homo sapiens
gcaauggcaugagaacucu

SEQ ID NO: 158937 - RNA, 19 nt, Homo sapiens
gggaugaagaucuacauug

SEQ ID NO: 158938 - RNA, 19 nt, Homo sapiens
gauaagcuccagcauuaca

SEQ ID NO: 158939 - RNA, 19 nt, Homo sapiens
cgaccauccuaacaucauu

SEQ ID NO: 158940 - RNA, 19 nt, Homo sapiens
gcuaugagccugagaacag

SEQ ID NO: 158941 - RNA, 19 nt, Homo sapiens
agagauguaccuucaauug

SEQ ID NO: 158942 - RNA, 19 nt, Homo sapiens
gcauuuccaucagugaaga

SEQ ID NO: 158943 - RNA, 19 nt, Homo sapiens
ggaacauucuggucaacag

SEQ ID NO: 158944 - RNA, 19 nt, Homo sapiens
ggccuggcaugguauaugu

SEQ ID NO: 158945 - RNA, 19 nt, Homo sapiens
acuaugagauccgguacua

SEQ ID NO: 158946 - RNA, 19 nt, Homo sapiens
ucaacacccuagauaagau

SEQ ID NO: 158947 - RNA, 19 nt, Homo sapiens
ggauauguccaaccaagau

SEQ ID NO: 158948 - RNA, 19 nt, Homo sapiens
ugugggaagucaugucauu

SEQ ID NO: 158949 - RNA, 19 nt, Homo sapiens
gaccaacacagcaaggauu

SEQ ID NO: 158950 - RNA, 19 nt, Homo sapiens
agaaggaacacaaugaguu

SEQ ID NO: 158951 - RNA, 19 nt, Homo sapiens
ugagaugaauuaugugcau

SEQ ID NO: 158952 - RNA, 19 nt, Homo sapiens
gaucaucacagaguucaug

SEQ ID NO: 158953 - RNA, 19 nt, Homo sapiens
cgauggcccuggauuaucu

SEQ ID NO: 158954 - RNA, 19 nt, Homo sapiens
acacagaagucaggagcuu

SEQ ID NO: 158955 - RNA, 19 nt, Homo sapiens
ccacacucguuucccuuug

SEQ ID NO: 158956 - RNA, 19 nt, Homo sapiens
gcgagagcgcgaaaggaua

SEQ ID NO: 158957 - RNA, 19 nt, Homo sapiens
acagaagcauguuugagau

SEQ ID NO: 158958 - RNA, 19 nt, Homo sapiens
gggaagucaugucauuugg

SEQ ID NO: 158959 - RNA, 19 nt, Homo sapiens
gagcccaaccagaacaauu

SEQ ID NO: 158960 - RNA, 19 nt, Homo sapiens
gaagaaacagaagcagugu

SEQ ID NO: 158961 - RNA, 19 nt, Homo sapiens
ugauccagcuuguggguau

SEQ ID NO: 158962 - RNA, 19 nt, Homo sapiens
gcaauguuaucuccaucgu

SEQ ID NO: 158963 - RNA, 19 nt, Homo sapiens
gcuccugagucuccagaug

SEQ ID NO: 158964 - RNA, 19 nt, Homo sapiens
cuaggaacauucuggucaa

SEQ ID NO: 158965 - RNA, 19 nt, Homo sapiens
ugacugacgaugauuacaa

SEQ ID NO: 158966 - RNA, 19 nt, Homo sapiens
uaugagauccgguacuaug

SEQ ID NO: 158967 - RNA, 19 nt, Homo sapiens
cgugggaaaccaaauauau

SEQ ID NO: 158968 - RNA, 19 nt, Homo sapiens
gaagauccugaacagcauu

SEQ ID NO: 158969 - RNA, 19 nt, Homo sapiens
gauguuguucugucaguug

SEQ ID NO: 158970 - RNA, 19 nt, Homo sapiens
ggagguagagggaagaaac

SEQ ID NO: 158971 - RNA, 19 nt, Homo sapiens
uagcaggcaaucuccauuu

SEQ ID NO: 158972 - RNA, 19 nt, Homo sapiens
gucaguggcuacgaugaaa

SEQ ID NO: 158973 - RNA, 19 nt, Homo sapiens
guucgaccauccuaacauc

SEQ ID NO: 158974 - RNA, 19 nt, Homo sapiens
gacugacgaugauuacaag

SEQ ID NO: 158975 - RNA, 19 nt, Homo sapiens
ccuacaacaucaucugcaa

SEQ ID NO: 158976 - RNA, 19 nt, Homo sapiens
ggaguuugccaaggagauu

SEQ ID NO: 158977 - RNA, 19 nt, Homo sapiens
gaagcaguguuccauuuuc

SEQ ID NO: 158978 - RNA, 19 nt, Homo sapiens
caugucauuuggagagaga

SEQ ID NO: 158979 - RNA, 19 nt, Homo sapiens
gugcaagguguccgacuuu

SEQ ID NO: 158980 - RNA, 19 nt, Homo sapiens
agaagucaguggcuacgau

SEQ ID NO: 158981 - RNA, 19 nt, Homo sapiens
gaagcuguccgggaguuug

SEQ ID NO: 158982 - RNA, 19 nt, Homo sapiens
uaucgucuguagcaggaaa

SEQ ID NO: 158983 - RNA, 19 nt, Homo sapiens
gagagaaagugugugauuu

SEQ ID NO: 158984 - RNA, 19 nt, Homo sapiens
ccaucaagcucuacuguaa

SEQ ID NO: 158985 - RNA, 19 nt, Homo sapiens
acuaugagcugcaguacua

SEQ ID NO: 158986 - RNA, 19 nt, Homo sapiens
guacaacgccacagccaua

SEQ ID NO: 158987 - RNA, 19 nt, Homo sapiens
gagcgaagccuccaucaug

SEQ ID NO: 158988 - RNA, 19 nt, Homo sapiens
caaccaggauguaaucaau

SEQ ID NO: 158989 - RNA, 19 nt, Homo sapiens
uaaagaggauucucauaag

SEQ ID NO: 158990 - RNA, 19 nt, Homo sapiens
ggagagaaagugugugauu

SEQ ID NO: 158991 - RNA, 19 nt, Homo sapiens
ggaaagcaaugacuguucu

SEQ ID NO: 158992 - RNA, 19 nt, Homo sapiens
gcaugaagaucuacaucga

SEQ ID NO: 158993 - RNA, 19 nt, Homo sapiens
cggacaagcugcaacacua

SEQ ID NO: 158994 - RNA, 19 nt, Homo sapiens
gcagagcaaucaguuagug

SEQ ID NO: 158995 - RNA, 19 nt, Homo sapiens
ggccuggucuuccucauug

SEQ ID NO: 158996 - RNA, 19 nt, Homo sapiens
gaagguggauaccauugca

SEQ ID NO: 158997 - RNA, 19 nt, Homo sapiens
gaugaaagggacagauuga

SEQ ID NO: 158998 - RNA, 19 nt, Homo sapiens
ugaaguaccuggcagacau

SEQ ID NO: 158999 - RNA, 19 nt, Homo sapiens
caggagaaguugccacuca

SEQ ID NO: 159000 - RNA, 19 nt, Homo sapiens
agacaagcauccaggagaa

SEQ ID NO: 159001 - RNA, 19 nt, Homo sapiens
gagcugcaguacuaugaga

SEQ ID NO: 159002 - RNA, 19 nt, Homo sapiens
cacgagacgucaccaagaa

SEQ ID NO: 159003 - RNA, 19 nt, Homo sapiens
caucgcagcuggcaugaag

SEQ ID NO: 159004 - RNA, 19 nt, Homo sapiens
ucaccgaguucauggagaa

SEQ ID NO: 159005 - RNA, 19 nt, Homo sapiens
gaugggcaguucacaguca

SEQ ID NO: 159006 - RNA, 19 nt, Homo sapiens
ccaaugaaagacacuguuu

SEQ ID NO: 159007 - RNA, 19 nt, Homo sapiens
ucaacacgcuagacaagau

SEQ ID NO: 159008 - RNA, 19 nt, Homo sapiens
ggacaugaccaaccaggau

SEQ ID NO: 159009 - RNA, 19 nt, Homo sapiens
ccaaggaaauugacaucuc

SEQ ID NO: 159010 - RNA, 19 nt, Homo sapiens
gaucaucaccgaguucaug

SEQ ID NO: 159011 - RNA, 19 nt, Homo sapiens
gaaguugccacucaucauc

SEQ ID NO: 159012 - RNA, 19 nt, Homo sapiens
ccuucaaccucuauuacua

SEQ ID NO: 159013 - RNA, 19 nt, Homo sapiens
guacuucccaggcaaauag

SEQ ID NO: 159014 - RNA, 19 nt, Homo sapiens
gggcgcagaugaaccagau

SEQ ID NO: 159015 - RNA, 19 nt, Homo sapiens
aaggagagcuucgccaaug

SEQ ID NO: 159016 - RNA, 19 nt, Homo sapiens
aaauugacaucuccugugu

SEQ ID NO: 159017 - RNA, 19 nt, Homo sapiens
ugaccgagccacgcauuua

SEQ ID NO: 159018 - RNA, 19 nt, Homo sapiens
gaaggugcuuucugcuuac

SEQ ID NO: 159019 - RNA, 19 nt, Homo sapiens
uagaaacuccaaugaaaga

SEQ ID NO: 159020 - RNA, 19 nt, Homo sapiens
ccagugauguguggagcua

SEQ ID NO: 159021 - RNA, 19 nt, Homo sapiens
gcgugauccuggacuauga

SEQ ID NO: 159022 - RNA, 19 nt, Homo sapiens
gcugugauuuccaguguca

SEQ ID NO: 159023 - RNA, 19 nt, Homo sapiens
caagcagagcaaucaguua

SEQ ID NO: 159024 - RNA, 19 nt, Homo sapiens
ugugggaggugauguccua

SEQ ID NO: 159025 - RNA, 19 nt, Homo sapiens
ggaguuugccaaggaaauu

SEQ ID NO: 159026 - RNA, 19 nt, Homo sapiens
caaccucuauuacuaugag

SEQ ID NO: 159027 - RNA, 19 nt, Homo sapiens
gaccuuugcugggccuaaa

SEQ ID NO: 159028 - RNA, 19 nt, Homo sapiens
ggugcuuucugcuuacuga

SEQ ID NO: 159029 - RNA, 19 nt, Homo sapiens
ggagauucaugcgaugugu

SEQ ID NO: 159030 - RNA, 19 nt, Homo sapiens
ugaacacgauccgcacgua

SEQ ID NO: 159031 - RNA, 19 nt, Homo sapiens
gagccacgcauuuacauca

SEQ ID NO: 159032 - RNA, 19 nt, Homo sapiens
caacacagacacccaagca

SEQ ID NO: 159033 - RNA, 19 nt, Homo sapiens
cccaaucuaucuaguacuu

SEQ ID NO: 159034 - RNA, 19 nt, Homo sapiens
agaggauucucauaaggaa

SEQ ID NO: 159035 - RNA, 19 nt, Homo sapiens
gggaggugauguccuaugg

SEQ ID NO: 159036 - RNA, 19 nt, Homo sapiens
gcaaaacgaugggcaguuc

SEQ ID NO: 159037 - RNA, 19 nt, Homo sapiens
gaccucgucuacaacauca

SEQ ID NO: 159038 - RNA, 19 nt, Homo sapiens
gacaugcccugcacaacca

SEQ ID NO: 159039 - RNA, 19 nt, Homo sapiens
uaaugacaaugaagugaca

SEQ ID NO: 159040 - RNA, 19 nt, Homo sapiens
gcaacauccucgucaacag

SEQ ID NO: 159041 - RNA, 19 nt, Homo sapiens
caucguguguaacagaaga

SEQ ID NO: 159042 - RNA, 19 nt, Homo sapiens
gagacuggagugagauuug

SEQ ID NO: 159043 - RNA, 19 nt, Homo sapiens
gacacuguuucuccuguug

SEQ ID NO: 159044 - RNA, 19 nt, Homo sapiens
gaaacuccaaugaaagaca

SEQ ID NO: 159045 - RNA, 19 nt, Homo sapiens
ccaagcagagcaaucaguu

SEQ ID NO: 159046 - RNA, 19 nt, Homo sapiens
ccaggacuguugaugaaag

SEQ ID NO: 159047 - RNA, 19 nt, Homo sapiens
aaagaggauucucauaagg

SEQ ID NO: 159048 - RNA, 19 nt, Homo sapiens
gcgggaaauacaaggaaua

SEQ ID NO: 159049 - RNA, 19 nt, Homo sapiens
gacgucgugucucagauga

SEQ ID NO: 159050 - RNA, 19 nt, Homo sapiens
gagcuacggcauugucaug

SEQ ID NO: 159051 - RNA, 19 nt, Homo sapiens
guacgcaccacgccagcua

SEQ ID NO: 159052 - RNA, 19 nt, Homo sapiens
cuuacugacuuaggcaaua

SEQ ID NO: 159053 - RNA, 19 nt, Homo sapiens
ugucucagaugaugaugga

SEQ ID NO: 159054 - RNA, 19 nt, Homo sapiens
acagcaaccuggucugcaa

SEQ ID NO: 159055 - RNA, 19 nt, Homo sapiens
cuacaccaguggccacaug

SEQ ID NO: 159056 - RNA, 19 nt, Homo sapiens
gagaaguugccacucauca

SEQ ID NO: 159057 - RNA, 19 nt, Homo sapiens
ucccuucccuggagagaaa

SEQ ID NO: 159058 - RNA, 19 nt, Homo sapiens
gccaggacccggaucauuc

SEQ ID NO: 159059 - RNA, 19 nt, Homo sapiens
cuccaggacuguugaugaa

SEQ ID NO: 159060 - RNA, 19 nt, Homo sapiens
ccacugggcaaacagaaga

SEQ ID NO: 159061 - RNA, 19 nt, Homo sapiens
gugaguggcuacgaugaga

SEQ ID NO: 159062 - RNA, 19 nt, Homo sapiens
ccacgagacgucaccaaga

SEQ ID NO: 159063 - RNA, 19 nt, Homo sapiens
ucaucgccaucguguguaa

SEQ ID NO: 159064 - RNA, 19 nt, Homo sapiens
acuaugaggcugacuuuga

SEQ ID NO: 159065 - RNA, 19 nt, Homo sapiens
uaugcacauuucuggauuu

SEQ ID NO: 159066 - RNA, 19 nt, Homo sapiens
gauccugcaucuggguuug

SEQ ID NO: 159067 - RNA, 19 nt, Homo sapiens
gcaacucaaacgacggaaa

SEQ ID NO: 159068 - RNA, 19 nt, Homo sapiens
gacaagaugauccgcaauc

SEQ ID NO: 159069 - RNA, 19 nt, Homo sapiens
gccaucguguguaacagaa

SEQ ID NO: 159070 - RNA, 19 nt, Homo sapiens
gggugaagguggauaccau

SEQ ID NO: 159071 - RNA, 19 nt, Homo sapiens
cgggacagauggacagaca

SEQ ID NO: 159072 - RNA, 19 nt, Homo sapiens
uaaggaaagcaaugacugu

SEQ ID NO: 159073 - RNA, 19 nt, Homo sapiens
gaacaguauccaggugaug

SEQ ID NO: 159074 - RNA, 19 nt, Homo sapiens
gcuacggcauugucaugug

SEQ ID NO: 159075 - RNA, 19 nt, Homo sapiens
gagcaaucaguuagugaau

SEQ ID NO: 159076 - RNA, 19 nt, Homo sapiens
caucuggguuuguuuacag

SEQ ID NO: 159077 - RNA, 19 nt, Homo sapiens
gcaucuggguuuguuuaca

SEQ ID NO: 159078 - RNA, 19 nt, Homo sapiens
caagaaaacaugcaacuca

SEQ ID NO: 159079 - RNA, 19 nt, Homo sapiens
cgucgugucucagaugaug

SEQ ID NO: 159080 - RNA, 19 nt, Homo sapiens
caaguucggccaaauuguc

SEQ ID NO: 159081 - RNA, 19 nt, Homo sapiens
gcccaaguucggccaaauu

SEQ ID NO: 159082 - RNA, 19 nt, Homo sapiens
gaaguaccuggcagacaug

SEQ ID NO: 159083 - RNA, 19 nt, Homo sapiens
ccaucaagcucuacuguaa

SEQ ID NO: 159084 - RNA, 19 nt, Homo sapiens
acuaugagcugcaguacua

SEQ ID NO: 159085 - RNA, 19 nt, Homo sapiens
guacaacgccacagccaua

SEQ ID NO: 159086 - RNA, 19 nt, Homo sapiens
gagcgaagccuccaucaug

SEQ ID NO: 159087 - RNA, 19 nt, Homo sapiens
caaccaggauguaaucaau

SEQ ID NO: 159088 - RNA, 19 nt, Homo sapiens
uaaagaggauucucauaag

SEQ ID NO: 159089 - RNA, 19 nt, Homo sapiens
ggaaagcaaugacuguucu

SEQ ID NO: 159090 - RNA, 19 nt, Homo sapiens
gcaugaagaucuacaucga

SEQ ID NO: 159091 - RNA, 19 nt, Homo sapiens
cggacaagcugcaacacua

SEQ ID NO: 159092 - RNA, 19 nt, Homo sapiens
ggccuggucuuccucauug

SEQ ID NO: 159093 - RNA, 19 nt, Homo sapiens
gaagguggauaccauugca

SEQ ID NO: 159094 - RNA, 19 nt, Homo sapiens
ugaaguaccuggcagacau

SEQ ID NO: 159095 - RNA, 19 nt, Homo sapiens
caggagaaguugccacuca

SEQ ID NO: 159096 - RNA, 19 nt, Homo sapiens
agacaagcauccaggagaa

SEQ ID NO: 159097 - RNA, 19 nt, Homo sapiens
gagcugcaguacuaugaga

SEQ ID NO: 159098 - RNA, 19 nt, Homo sapiens
cacgagacgucaccaagaa

SEQ ID NO: 159099 - RNA, 19 nt, Homo sapiens
caucgcagcuggcaugaag

SEQ ID NO: 159100 - RNA, 19 nt, Homo sapiens
ucaccgaguucauggagaa

SEQ ID NO: 159101 - RNA, 19 nt, Homo sapiens
gaugggcaguucacaguca

SEQ ID NO: 159102 - RNA, 19 nt, Homo sapiens
ccaaugaaagacacuguuu

SEQ ID NO: 159103 - RNA, 19 nt, Homo sapiens
ucaacacgcuagacaagau

SEQ ID NO: 159104 - RNA, 19 nt, Homo sapiens
ggacaugaccaaccaggau

SEQ ID NO: 159105 - RNA, 19 nt, Homo sapiens
ccaaggaaauugacaucuc

SEQ ID NO: 159106 - RNA, 19 nt, Homo sapiens
gaucaucaccgaguucaug

SEQ ID NO: 159107 - RNA, 19 nt, Homo sapiens
gaaguugccacucaucauc

SEQ ID NO: 159108 - RNA, 19 nt, Homo sapiens
ccuucaaccucuauuacua

SEQ ID NO: 159109 - RNA, 19 nt, Homo sapiens
gggcgcagaugaaccagau

SEQ ID NO: 159110 - RNA, 19 nt, Homo sapiens
aaggagagcuucgccaaug

SEQ ID NO: 159111 - RNA, 19 nt, Homo sapiens
aaauugacaucuccugugu

SEQ ID NO: 159112 - RNA, 19 nt, Homo sapiens
ugaccgagccacgcauuua

SEQ ID NO: 159113 - RNA, 19 nt, Homo sapiens
uagaaacuccaaugaaaga

SEQ ID NO: 159114 - RNA, 19 nt, Homo sapiens
ccagugauguguggagcua

SEQ ID NO: 159115 - RNA, 19 nt, Homo sapiens
gcgugauccuggacuauga

SEQ ID NO: 159116 - RNA, 19 nt, Homo sapiens
gcugugauuuccaguguca

SEQ ID NO: 159117 - RNA, 19 nt, Homo sapiens
ugugggaggugauguccua

SEQ ID NO: 159118 - RNA, 19 nt, Homo sapiens
ggaguuugccaaggaaauu

SEQ ID NO: 159119 - RNA, 19 nt, Homo sapiens
caaccucuauuacuaugag

SEQ ID NO: 159120 - RNA, 19 nt, Homo sapiens
ggagauucaugcgaugugu

SEQ ID NO: 159121 - RNA, 19 nt, Homo sapiens
ugaacacgauccgcacgua

SEQ ID NO: 159122 - RNA, 19 nt, Homo sapiens
gagccacgcauuuacauca

SEQ ID NO: 159123 - RNA, 19 nt, Homo sapiens
agaggauucucauaaggaa

SEQ ID NO: 159124 - RNA, 19 nt, Homo sapiens
gggaggugauguccuaugg

SEQ ID NO: 159125 - RNA, 19 nt, Homo sapiens
gcaaaacgaugggcaguuc

SEQ ID NO: 159126 - RNA, 19 nt, Homo sapiens
gaccucgucuacaacauca

SEQ ID NO: 159127 - RNA, 19 nt, Homo sapiens
gacaugcccugcacaacca

SEQ ID NO: 159128 - RNA, 19 nt, Homo sapiens
uaaugacaaugaagugaca

SEQ ID NO: 159129 - RNA, 19 nt, Homo sapiens
gcaacauccucgucaacag

SEQ ID NO: 159130 - RNA, 19 nt, Homo sapiens
gacacuguuucuccuguug

SEQ ID NO: 159131 - RNA, 19 nt, Homo sapiens
gaaacuccaaugaaagaca

SEQ ID NO: 159132 - RNA, 19 nt, Homo sapiens
aaagaggauucucauaagg

SEQ ID NO: 159133 - RNA, 19 nt, Homo sapiens
gcgggaaauacaaggaaua

SEQ ID NO: 159134 - RNA, 19 nt, Homo sapiens
gacgucgugucucagauga

SEQ ID NO: 159135 - RNA, 19 nt, Homo sapiens
gagcuacggcauugucaug

SEQ ID NO: 159136 - RNA, 19 nt, Homo sapiens
guacgcaccacgccagcua

SEQ ID NO: 159137 - RNA, 19 nt, Homo sapiens
ugucucagaugaugaugga

SEQ ID NO: 159138 - RNA, 19 nt, Homo sapiens
acagcaaccuggucugcaa

SEQ ID NO: 159139 - RNA, 19 nt, Homo sapiens
cuacaccaguggccacaug

SEQ ID NO: 159140 - RNA, 19 nt, Homo sapiens
gagaaguugccacucauca

SEQ ID NO: 159141 - RNA, 19 nt, Homo sapiens
ccacugggcaaacagaaga

SEQ ID NO: 159142 - RNA, 19 nt, Homo sapiens
gugaguggcuacgaugaga

SEQ ID NO: 159143 - RNA, 19 nt, Homo sapiens
ccacgagacgucaccaaga

SEQ ID NO: 159144 - RNA, 19 nt, Homo sapiens
ucaucgccaucguguguaa

SEQ ID NO: 159145 - RNA, 19 nt, Homo sapiens
acuaugaggcugacuuuga

SEQ ID NO: 159146 - RNA, 19 nt, Homo sapiens
gauccugcaucuggguuug

SEQ ID NO: 159147 - RNA, 19 nt, Homo sapiens
gcaacucaaacgacggaaa

SEQ ID NO: 159148 - RNA, 19 nt, Homo sapiens
gacaagaugauccgcaauc

SEQ ID NO: 159149 - RNA, 19 nt, Homo sapiens
gggugaagguggauaccau

SEQ ID NO: 159150 - RNA, 19 nt, Homo sapiens
cgggacagauggacagaca

SEQ ID NO: 159151 - RNA, 19 nt, Homo sapiens
uaaggaaagcaaugacugu

SEQ ID NO: 159152 - RNA, 19 nt, Homo sapiens
gaacaguauccaggugaug

SEQ ID NO: 159153 - RNA, 19 nt, Homo sapiens
gcuacggcauugucaugug

SEQ ID NO: 159154 - RNA, 19 nt, Homo sapiens
caucuggguuuguuuacag

SEQ ID NO: 159155 - RNA, 19 nt, Homo sapiens
gcaucuggguuuguuuaca

SEQ ID NO: 159156 - RNA, 19 nt, Homo sapiens
caagaaaacaugcaacuca

SEQ ID NO: 159157 - RNA, 19 nt, Homo sapiens
cgucgugucucagaugaug

SEQ ID NO: 159158 - RNA, 19 nt, Homo sapiens
caaguucggccaaauuguc

SEQ ID NO: 159159 - RNA, 19 nt, Homo sapiens
gcccaaguucggccaaauu

SEQ ID NO: 159160 - RNA, 19 nt, Homo sapiens
gaaguaccuggcagacaug

SEQ ID NO: 159161 - RNA, 19 nt, Homo sapiens
gagggugucgugaccaaga

SEQ ID NO: 159162 - RNA, 19 nt, Homo sapiens
gaagccgaguaccagacaa

SEQ ID NO: 159163 - RNA, 19 nt, Homo sapiens
ggaccucgucuacaacauc

SEQ ID NO: 159164 - RNA, 19 nt, Homo sapiens
ugggcaaacagaagaauuu

SEQ ID NO: 159165 - RNA, 19 nt, Homo sapiens
gaaagcaaugacuguucuu

SEQ ID NO: 159166 - RNA, 19 nt, Homo sapiens
aaacaugcaacucaaacga

SEQ ID NO: 159167 - RNA, 19 nt, Homo sapiens
gaccaaccaggauguaauc

SEQ ID NO: 159168 - RNA, 19 nt, Homo sapiens
guguggagcuacggcauug

SEQ ID NO: 159169 - RNA, 19 nt, Homo sapiens
gcgggaguuugccaaggaa

SEQ ID NO: 159170 - RNA, 19 nt, Homo sapiens
ucuacaacaucaucugcaa

SEQ ID NO: 159171 - RNA, 19 nt, Homo sapiens
gagaaccccucugggaaaa

SEQ ID NO: 159172 - RNA, 19 nt, Homo sapiens
gcgcagaugaaccagauuc

SEQ ID NO: 159173 - RNA, 19 nt, Homo sapiens
ggacaagcugcaacacuac

SEQ ID NO: 159174 - RNA, 19 nt, Homo sapiens
ugacagaagccgaguacca

SEQ ID NO: 159175 - RNA, 19 nt, Homo sapiens
ccaguacaccuucgagauc

SEQ ID NO: 159176 - RNA, 19 nt, Homo sapiens
acagacagccacccugaga

SEQ ID NO: 159177 - RNA, 19 nt, Homo sapiens
ccaggugugcaacguguuu

SEQ ID NO: 159178 - RNA, 19 nt, Homo sapiens
agaccuucaaccucuauua

SEQ ID NO: 159179 - RNA, 19 nt, Homo sapiens
gcggcaagauguacuucca

SEQ ID NO: 159180 - RNA, 19 nt, Homo sapiens
uggcuacggaccaaguuua

SEQ ID NO: 159181 - RNA, 19 nt, Homo sapiens
ggguuuguuuacagcaauu

SEQ ID NO: 159182 - RNA, 19 nt, Homo sapiens
cugcaucuggguuuguuua

SEQ ID NO: 159183 - RNA, 19 nt, Homo sapiens
ccaaaccucuucauauuga

SEQ ID NO: 159184 - RNA, 19 nt, Homo sapiens
ggaaugaagguuuauauug

SEQ ID NO: 159185 - RNA, 19 nt, Homo sapiens
gcacuggccugcacagaga

SEQ ID NO: 159186 - RNA, 19 nt, Homo sapiens
ggugugaucuccaauguga

SEQ ID NO: 159187 - RNA, 19 nt, Homo sapiens
gggaugaccuccuguacaa

SEQ ID NO: 159188 - RNA, 19 nt, Homo sapiens
cagaagaccugcuccguau

SEQ ID NO: 159189 - RNA, 19 nt, Homo sapiens
gaauaaaggcaauaagaug

SEQ ID NO: 159190 - RNA, 19 nt, Homo sapiens
gagaugaaguacuuugaga

SEQ ID NO: 159191 - RNA, 19 nt, Homo sapiens
gaucggagcuggggaauuu

SEQ ID NO: 159192 - RNA, 19 nt, Homo sapiens
gagcaugggugagcgugua

SEQ ID NO: 159193 - RNA, 19 nt, Homo sapiens
gauccuaccuacaccaguu

SEQ ID NO: 159194 - RNA, 19 nt, Homo sapiens
gaagaccugcuccguauug

SEQ ID NO: 159195 - RNA, 19 nt, Homo sapiens
ugaaguaccuguccgagau

SEQ ID NO: 159196 - RNA, 19 nt, Homo sapiens
gaaugaaaccucacugauc

SEQ ID NO: 159197 - RNA, 19 nt, Homo sapiens
aagaagauccugagcagua

SEQ ID NO: 159198 - RNA, 19 nt, Homo sapiens
caaaauggguaacaucuga

SEQ ID NO: 159199 - RNA, 19 nt, Homo sapiens
cagaauaaaggcaauaaga

SEQ ID NO: 159200 - RNA, 19 nt, Homo sapiens
gaggugugaucuccaaugu

SEQ ID NO: 159201 - RNA, 19 nt, Homo sapiens
ggacaucucauccagaaag

SEQ ID NO: 159202 - RNA, 19 nt, Homo sapiens
uauugaagauggauuagga

SEQ ID NO: 159203 - RNA, 19 nt, Homo sapiens
gcucaacgaugggcaguuc

SEQ ID NO: 159204 - RNA, 19 nt, Homo sapiens
gcugaggaguugcccuuug

SEQ ID NO: 159205 - RNA, 19 nt, Homo sapiens
uguccgagaugaacuaugu

SEQ ID NO: 159206 - RNA, 19 nt, Homo sapiens
ugaaguacuuugagaagag

SEQ ID NO: 159207 - RNA, 19 nt, Homo sapiens
gaaccucaggcccaaauuc

SEQ ID NO: 159208 - RNA, 19 nt, Homo sapiens
ccagagaugggauguguga

SEQ ID NO: 159209 - RNA, 19 nt, Homo sapiens
gaaaguggacaccauugca

SEQ ID NO: 159210 - RNA, 19 nt, Homo sapiens
ccuucaaccucuucuacua

SEQ ID NO: 159211 - RNA, 19 nt, Homo sapiens
gacaugcggcugcagauga

SEQ ID NO: 159212 - RNA, 19 nt, Homo sapiens
ugugggaggucaugagcua

SEQ ID NO: 159213 - RNA, 19 nt, Homo sapiens
gcaacauccuugucaacag

SEQ ID NO: 159214 - RNA, 19 nt, Homo sapiens
ggcaucgccuccacaguga

SEQ ID NO: 159215 - RNA, 19 nt, Homo sapiens
gaugaccuccuguacaaug

SEQ ID NO: 159216 - RNA, 19 nt, Homo sapiens
gaucuccaaugugaaugaa

SEQ ID NO: 159217 - RNA, 19 nt, Homo sapiens
gcaccugccacaauaacuu

SEQ ID NO: 159218 - RNA, 19 nt, Homo sapiens
cccaaauucucccagauug

SEQ ID NO: 159219 - RNA, 19 nt, Homo sapiens
ucacugaguucauggaaaa

SEQ ID NO: 159220 - RNA, 19 nt, Homo sapiens
ugaaucccauccgcacaua

SEQ ID NO: 159221 - RNA, 19 nt, Homo sapiens
ucaauacccuggacaagcu

SEQ ID NO: 159222 - RNA, 19 nt, Homo sapiens
gcagcagccucacccuauc

SEQ ID NO: 159223 - RNA, 19 nt, Homo sapiens
ccaccucgcuggucauugc

SEQ ID NO: 159224 - RNA, 19 nt, Homo sapiens
gacaagcucauccgcaaug

SEQ ID NO: 159225 - RNA, 19 nt, Homo sapiens
gcccaaauucucccagauu

SEQ ID NO: 159226 - RNA, 19 nt, Homo sapiens
acuacgagaugaaguacuu

SEQ ID NO: 159227 - RNA, 19 nt, Homo sapiens
gaugaaguacuuugagaag

SEQ ID NO: 159228 - RNA, 19 nt, Homo sapiens
cagcuugcaccuccaguuu

SEQ ID NO: 159229 - RNA, 19 nt, Homo sapiens
ggacaugagcaaccaggau

SEQ ID NO: 159230 - RNA, 19 nt, Homo sapiens
cuagugaugucuggagcua

SEQ ID NO: 159231 - RNA, 19 nt, Homo sapiens
acagcaaccuggucugcaa

SEQ ID NO: 159232 - RNA, 19 nt, Homo sapiens
cuccuggaaugaagguuua

SEQ ID NO: 159233 - RNA, 19 nt, Homo sapiens
cauaccagguguguaaugu

SEQ ID NO: 159234 - RNA, 19 nt, Homo sapiens
ggagaaccccuacgugaaa

SEQ ID NO: 159235 - RNA, 19 nt, Homo sapiens
gcuacggaauugucaugug

SEQ ID NO: 159236 - RNA, 19 nt, Homo sapiens
cagcugggcuugucuucgu

SEQ ID NO: 159237 - RNA, 19 nt, Homo sapiens
ccacacgcgcuacaccuuu

SEQ ID NO: 159238 - RNA, 19 nt, Homo sapiens
ccccaaaccucuucauauu

SEQ ID NO: 159239 - RNA, 19 nt, Homo sapiens
ggaaaugugacaccaccau

SEQ ID NO: 159240 - RNA, 19 nt, Homo sapiens
caaccucacacuugucugu

SEQ ID NO: 159241 - RNA, 19 nt, Homo sapiens
agaagauccugagcaguau

SEQ ID NO: 159242 - RNA, 19 nt, Homo sapiens
acacuugucuguucuucag

SEQ ID NO: 159243 - RNA, 19 nt, Homo sapiens
agguuuauauugacccuuu

SEQ ID NO: 159244 - RNA, 19 nt, Homo sapiens
acagugaccagccagauga

SEQ ID NO: 159245 - RNA, 19 nt, Homo sapiens
acaugcggcugcagaugaa

SEQ ID NO: 159246 - RNA, 19 nt, Homo sapiens
acacaaccuucacgacagu

SEQ ID NO: 159247 - RNA, 19 nt, Homo sapiens
gagcuacggaauugucaug

SEQ ID NO: 159248 - RNA, 19 nt, Homo sapiens
gcucgcaacauccuuguca

SEQ ID NO: 159249 - RNA, 19 nt, Homo sapiens
gaaguaccuguccgagaug

SEQ ID NO: 159250 - RNA, 19 nt, Homo sapiens
ggcagcagccucacccuau

SEQ ID NO: 159251 - RNA, 19 nt, Homo sapiens
aaugucaucugcaagaagu

SEQ ID NO: 159252 - RNA, 19 nt, Homo sapiens
cacucaagcucuacugcaa

SEQ ID NO: 159253 - RNA, 19 nt, Homo sapiens
caaauucucccagauuguc

SEQ ID NO: 159254 - RNA, 19 nt, Homo sapiens
gcuccuggaaugaagguuu

SEQ ID NO: 159255 - RNA, 19 nt, Homo sapiens
gaugacaacguggaguuug

SEQ ID NO: 159256 - RNA, 19 nt, Homo sapiens
uguacaaugucaucugcaa

SEQ ID NO: 159257 - RNA, 19 nt, Homo sapiens
caucugcaccugccacaau

SEQ ID NO: 159258 - RNA, 19 nt, Homo sapiens
uggaagagacccucaugga

SEQ ID NO: 159259 - RNA, 19 nt, Homo sapiens
gucuggagcuacggaauug

SEQ ID NO: 159260 - RNA, 19 nt, Homo sapiens
gugccguggucgacugaaa

SEQ ID NO: 159261 - RNA, 19 nt, Homo sapiens
ccuacgaggacccuaauga

SEQ ID NO: 159262 - RNA, 19 nt, Homo sapiens
cagcgacacggcucugauu

SEQ ID NO: 159263 - RNA, 19 nt, Homo sapiens
cacacgcgcuacaccuuug

SEQ ID NO: 159264 - RNA, 19 nt, Homo sapiens
acaaugucaucugcaagaa

SEQ ID NO: 159265 - RNA, 19 nt, Homo sapiens
gaccuccuguacaauguca

SEQ ID NO: 159266 - RNA, 19 nt, Homo sapiens
ggacaugcggcugcagaug

SEQ ID NO: 159267 - RNA, 19 nt, Homo sapiens
ugaaugaaaccucacugau

SEQ ID NO: 159268 - RNA, 19 nt, Homo sapiens
gcuggaaguuugggaaagg

SEQ ID NO: 159269 - RNA, 19 nt, Homo sapiens
ggacaagcucauccgcaau

SEQ ID NO: 159270 - RNA, 19 nt, Homo sapiens
gacaucucauccagaaagu

SEQ ID NO: 159271 - RNA, 19 nt, Homo sapiens
aagcgaggccuccaucaug

SEQ ID NO: 159272 - RNA, 19 nt, Homo sapiens
guaaugugcgcgagucaag

SEQ ID NO: 159273 - RNA, 19 nt, Homo sapiens
ccaguuugcacagggauuu

SEQ ID NO: 159274 - RNA, 19 nt, Homo sapiens
gcaaccuggucugcaaagu

SEQ ID NO: 159275 - RNA, 19 nt, Homo sapiens
uacaaugucaucugcaaga

SEQ ID NO: 159276 - RNA, 19 nt, Homo sapiens
gcagaauaaaggcaauaag

SEQ ID NO: 159277 - RNA, 19 nt, Homo sapiens
cagcagaauaaaggcaaua

SEQ ID NO: 159278 - RNA, 19 nt, Homo sapiens
cgcccuuggugcugucaua

SEQ ID NO: 159279 - RNA, 19 nt, Homo sapiens
caaccuggucugcaaaguc

SEQ ID NO: 159280 - RNA, 19 nt, Homo sapiens
uuccaaggcuggcuucuac

SEQ ID NO: 159281 - RNA, 19 nt, Homo sapiens
ucacacuugucuguucuuc

SEQ ID NO: 159282 - RNA, 19 nt, Homo sapiens
cccaaaccucuucauauug

SEQ ID NO: 159283 - RNA, 19 nt, Homo sapiens
ccaccaaacucaaucauuu

SEQ ID NO: 159284 - RNA, 19 nt, Homo sapiens
gagggaaccuguuucacua

SEQ ID NO: 159285 - RNA, 19 nt, Homo sapiens
ggacaaacacggacaguau

SEQ ID NO: 159286 - RNA, 19 nt, Homo sapiens
ggacuucaccuauaccuuu

SEQ ID NO: 159287 - RNA, 19 nt, Homo sapiens
ucacagaguucauggagaa

SEQ ID NO: 159288 - RNA, 19 nt, Homo sapiens
gaagagacccugcugaaca

SEQ ID NO: 159289 - RNA, 19 nt, Homo sapiens
guacuaaggucuacaucga

SEQ ID NO: 159290 - RNA, 19 nt, Homo sapiens
ggaaacugcugaucugaag

SEQ ID NO: 159291 - RNA, 19 nt, Homo sapiens
ggagagaagcagaauauuc

SEQ ID NO: 159292 - RNA, 19 nt, Homo sapiens
guacugaccugcaggaacu

SEQ ID NO: 159293 - RNA, 19 nt, Homo sapiens
gugaggaguuggcaauuug

SEQ ID NO: 159294 - RNA, 19 nt, Homo sapiens
ggugaggaguuggcaauuu

SEQ ID NO: 159295 - RNA, 19 nt, Homo sapiens
gcagagcaaugggagagaa

SEQ ID NO: 159296 - RNA, 19 nt, Homo sapiens
gcugcugccuucauauuga

SEQ ID NO: 159297 - RNA, 19 nt, Homo sapiens
gagcgaggccuccaucaug

SEQ ID NO: 159298 - RNA, 19 nt, Homo sapiens
gaacagugccuuggucauc

SEQ ID NO: 159299 - RNA, 19 nt, Homo sapiens
gccaauagccacucuaaca

SEQ ID NO: 159300 - RNA, 19 nt, Homo sapiens
ggacuacgaggucaaauac

SEQ ID NO: 159301 - RNA, 19 nt, Homo sapiens
ugugggaggugaugucauu

SEQ ID NO: 159302 - RNA, 19 nt, Homo sapiens
gcuaaacgacggacaguuc

SEQ ID NO: 159303 - RNA, 19 nt, Homo sapiens
ggggagaccugacuuuuga

SEQ ID NO: 159304 - RNA, 19 nt, Homo sapiens
gcgcccagcugacugugaa

SEQ ID NO: 159305 - RNA, 19 nt, Homo sapiens
gagggguucuuaaauuaua

SEQ ID NO: 159306 - RNA, 19 nt, Homo sapiens
cccaagcuguguccuauga

SEQ ID NO: 159307 - RNA, 19 nt, Homo sapiens
gagagaagcagaauauucg

SEQ ID NO: 159308 - RNA, 19 nt, Homo sapiens
gaggucaaauaccaugaga

SEQ ID NO: 159309 - RNA, 19 nt, Homo sapiens
cguccggacuucaccuaua

SEQ ID NO: 159310 - RNA, 19 nt, Homo sapiens
ggucaaauaccaugagaag

SEQ ID NO: 159311 - RNA, 19 nt, Homo sapiens
gggaaccuguuucacuaug

SEQ ID NO: 159312 - RNA, 19 nt, Homo sapiens
ggacaccgccuccccauuu

SEQ ID NO: 159313 - RNA, 19 nt, Homo sapiens
ggagagcuguguggcaauc

SEQ ID NO: 159314 - RNA, 19 nt, Homo sapiens
ggagggaaccuguuucacu

SEQ ID NO: 159315 - RNA, 19 nt, Homo sapiens
ggaagaaggagagcugugu

SEQ ID NO: 159316 - RNA, 19 nt, Homo sapiens
cagaauauucggacaaaca

SEQ ID NO: 159317 - RNA, 19 nt, Homo sapiens
gagcagcuggcccugauug

SEQ ID NO: 159318 - RNA, 19 nt, Homo sapiens
gaucugaagugggugacau

SEQ ID NO: 159319 - RNA, 19 nt, Homo sapiens
gacggacaguucacaguca

SEQ ID NO: 159320 - RNA, 19 nt, Homo sapiens
caucggacaugguacuaag

SEQ ID NO: 159321 - RNA, 19 nt, Homo sapiens
ccuuugaggucacugcauu

SEQ ID NO: 159322 - RNA, 19 nt, Homo sapiens
agacccugcugaacacaaa

SEQ ID NO: 159323 - RNA, 19 nt, Homo sapiens
gcaccuacgaaguguguga

SEQ ID NO: 159324 - RNA, 19 nt, Homo sapiens
uggagggguucuuaaauua

SEQ ID NO: 159325 - RNA, 19 nt, Homo sapiens
gggaggugaugucauuugg

SEQ ID NO: 159326 - RNA, 19 nt, Homo sapiens
acagcaaccucgucugcaa

SEQ ID NO: 159327 - RNA, 19 nt, Homo sapiens
uaucucaucggacauggua

SEQ ID NO: 159328 - RNA, 19 nt, Homo sapiens
gacuucaccuauaccuuug

SEQ ID NO: 159329 - RNA, 19 nt, Homo sapiens
caagcuguguccuaugaag

SEQ ID NO: 159330 - RNA, 19 nt, Homo sapiens
ggaaccuguuucacuaugg

SEQ ID NO: 159331 - RNA, 19 nt, Homo sapiens
gcggcagccucacuacuca

SEQ ID NO: 159332 - RNA, 19 nt, Homo sapiens
ucaugauucucacagaguu

SEQ ID NO: 159333 - RNA, 19 nt, Homo sapiens
gauuggugcaggugaguuu

SEQ ID NO: 159334 - RNA, 19 nt, Homo sapiens
gaacgggguauccuccuua

SEQ ID NO: 159335 - RNA, 19 nt, Homo sapiens
gcuggacuguuggcagaaa

SEQ ID NO: 159336 - RNA, 19 nt, Homo sapiens
ucacuuaugaagacccuaa

SEQ ID NO: 159337 - RNA, 19 nt, Homo sapiens
ugaggucacugcauugaac

SEQ ID NO: 159338 - RNA, 19 nt, Homo sapiens
ucaccgucuucuacuauga

SEQ ID NO: 159339 - RNA, 19 nt, Homo sapiens
guuacgggauugugaugug

SEQ ID NO: 159340 - RNA, 19 nt, Homo sapiens
ugggagagaagcagaauau

SEQ ID NO: 159341 - RNA, 19 nt, Homo sapiens
gucauaacuuuguguugga

SEQ ID NO: 159342 - RNA, 19 nt, Homo sapiens
ccgcuggauugcacuuuga

SEQ ID NO: 159343 - RNA, 19 nt, Homo sapiens
gcaacauccuagucaacag

SEQ ID NO: 159344 - RNA, 19 nt, Homo sapiens
uagccacucuaacaccauu

SEQ ID NO: 159345 - RNA, 19 nt, Homo sapiens
cagccaauagccacucuaa

SEQ ID NO: 159346 - RNA, 19 nt, Homo sapiens
ccgggaaggugaaugucaa

SEQ ID NO: 159347 - RNA, 19 nt, Homo sapiens
cugaggaccugcuccgaau

SEQ ID NO: 159348 - RNA, 19 nt, Homo sapiens
ucagcgcccuggacaagau

SEQ ID NO: 159349 - RNA, 19 nt, Homo sapiens
caaccucgucugcaaagug

SEQ ID NO: 159350 - RNA, 19 nt, Homo sapiens
gcucgcaacauccuaguca

SEQ ID NO: 159351 - RNA, 19 nt, Homo sapiens
gacaugguacuaaggucua

SEQ ID NO: 159352 - RNA, 19 nt, Homo sapiens
caagauugaagaggugauu

SEQ ID NO: 159353 - RNA, 19 nt, Homo sapiens
aaacacggacaguaucuca

SEQ ID NO: 159354 - RNA, 19 nt, Homo sapiens
gaaaagggcgguaguuggu

SEQ ID NO: 159355 - RNA, 19 nt, Homo sapiens
gguuuguagucccaacuug

SEQ ID NO: 159356 - RNA, 19 nt, Homo sapiens
uggaagagacccugcugaa

SEQ ID NO: 159357 - RNA, 19 nt, Homo sapiens
ggccgcagcuuuggaagag

SEQ ID NO: 159358 - RNA, 19 nt, Homo sapiens
gaccuucaccgucuucuac

SEQ ID NO: 159359 - RNA, 19 nt, Homo sapiens
cugugaaccugacucgauu

SEQ ID NO: 159360 - RNA, 19 nt, Homo sapiens
ggaguuacgggauugugau

SEQ ID NO: 159361 - RNA, 19 nt, Homo sapiens
cuuaugaagacccuaauga

SEQ ID NO: 159362 - RNA, 19 nt, Homo sapiens
gacaaacacggacaguauc

SEQ ID NO: 159363 - RNA, 19 nt, Homo sapiens
uggacuacgaggucaaaua

SEQ ID NO: 159364 - RNA, 19 nt, Homo sapiens
cuacgaagugugugaagug

SEQ ID NO: 159365 - RNA, 19 nt, Homo sapiens
cccaucaucaugucuguuu

SEQ ID NO: 159366 - RNA, 19 nt, Homo sapiens
gccaguguccagcacauga

SEQ ID NO: 159367 - RNA, 19 nt, Homo sapiens
cagccucacuacucagcuu

SEQ ID NO: 159368 - RNA, 19 nt, Homo sapiens
gcgguaccuugccgagaug

SEQ ID NO: 159369 - RNA, 19 nt, Homo sapiens
aaacugcugaucugaagug

SEQ ID NO: 159370 - RNA, 19 nt, Homo sapiens
ggaagagacccugcugaac

SEQ ID NO: 159371 - RNA, 19 nt, Homo sapiens
guccggacuucaccuauac

SEQ ID NO: 159372 - RNA, 19 nt, Homo sapiens
ugagggaauuugcaaaaga

SEQ ID NO: 159373 - RNA, 19 nt, Homo sapiens
ggccuccuuugcccaaguu

SEQ ID NO: 159374 - RNA, 19 nt, Homo sapiens
gcugucaccaccaaacuca

SEQ ID NO: 159375 - RNA, 19 nt, Homo sapiens
cagcaaccucgucugcaaa

SEQ ID NO: 159376 - RNA, 19 nt, Homo sapiens
agcagaauauucggacaaa

SEQ ID NO: 159377 - RNA, 19 nt, Homo sapiens
gaaacggacgccggugcuu

SEQ ID NO: 159378 - RNA, 19 nt, Homo sapiens
aaaaggaagugcccaacau

SEQ ID NO: 159379 - RNA, 19 nt, Homo sapiens
ggaaggugaaugucaagac

SEQ ID NO: 159380 - RNA, 19 nt, Homo sapiens
ggaacugagcggccuggau

SEQ ID NO: 159381 - RNA, 19 nt, Homo sapiens
gcgcaccuacgaagugugu

SEQ ID NO: 159382 - RNA, 19 nt, Homo sapiens
ucaggaagcagagcaaugg

SEQ ID NO: 159383 - RNA, 19 nt, Homo sapiens
gagaguaaaugaagagaaa

SEQ ID NO: 159384 - RNA, 19 nt, Homo sapiens
ggaagucgauccugcuuau

SEQ ID NO: 159385 - RNA, 19 nt, Homo sapiens
ggaccaagguggacacaau

SEQ ID NO: 159386 - RNA, 19 nt, Homo sapiens
acacguacccuacaucuua

SEQ ID NO: 159387 - RNA, 19 nt, Homo sapiens
gggaagaaauaaagggauu

SEQ ID NO: 159388 - RNA, 19 nt, Homo sapiens
ggaacauccuggacuauca

SEQ ID NO: 159389 - RNA, 19 nt, Homo sapiens
gaaagaagggaauuugcaa

SEQ ID NO: 159390 - RNA, 19 nt, Homo sapiens
ugugggaagugaugaguua

SEQ ID NO: 159391 - RNA, 19 nt, Homo sapiens
cgggagaccuucacccuuu

SEQ ID NO: 159392 - RNA, 19 nt, Homo sapiens
gggagaccuucacccuuua

SEQ ID NO: 159393 - RNA, 19 nt, Homo sapiens
gcaccgggcaggacaauug

SEQ ID NO: 159394 - RNA, 19 nt, Homo sapiens
ggaggagaguaaaugaaga

SEQ ID NO: 159395 - RNA, 19 nt, Homo sapiens
gccgaaagccugcagauga

SEQ ID NO: 159396 - RNA, 19 nt, Homo sapiens
gaagggaggagaguaaaug

SEQ ID NO: 159397 - RNA, 19 nt, Homo sapiens
gauuauaguccacccaauu

SEQ ID NO: 159398 - RNA, 19 nt, Homo sapiens
gcacauggaaagcauacaa

SEQ ID NO: 159399 - RNA, 19 nt, Homo sapiens
gggaugagguccacuucga

SEQ ID NO: 159400 - RNA, 19 nt, Homo sapiens
gaggaagggaggagaguaa

SEQ ID NO: 159401 - RNA, 19 nt, Homo sapiens
ggaagaaauaaagggauua

SEQ ID NO: 159402 - RNA, 19 nt, Homo sapiens
gggcuggacugcaacugaa

SEQ ID NO: 159403 - RNA, 19 nt, Homo sapiens
agaaagaacuggaauaacc

SEQ ID NO: 159404 - RNA, 19 nt, Homo sapiens
gcugggaaguccaagauca

SEQ ID NO: 159405 - RNA, 19 nt, Homo sapiens
ggaaagaagggaauuugca

SEQ ID NO: 159406 - RNA, 19 nt, Homo sapiens
ccauuggacuggagugcua

SEQ ID NO: 159407 - RNA, 19 nt, Homo sapiens
agacugcccucuucuuugu

SEQ ID NO: 159408 - RNA, 19 nt, Homo sapiens
uggauuacaucuacuuaug

SEQ ID NO: 159409 - RNA, 19 nt, Homo sapiens
gguacuaaaugcaauagag

SEQ ID NO: 159410 - RNA, 19 nt, Homo sapiens
ggagguacuaaaugcaaua

SEQ ID NO: 159411 - RNA, 19 nt, Homo sapiens
agagaaagaacuggaauaa

SEQ ID NO: 159412 - RNA, 19 nt, Homo sapiens
gagcaggagguacuaaaug

SEQ ID NO: 159413 - RNA, 19 nt, Homo sapiens
gcaaggcucagcacucaug

SEQ ID NO: 159414 - RNA, 19 nt, Homo sapiens
cccaggagcuuugguuuga

SEQ ID NO: 159415 - RNA, 19 nt, Homo sapiens
gaugucccauggcuacuga

SEQ ID NO: 159416 - RNA, 19 nt, Homo sapiens
gaagagaaagaacuggaau

SEQ ID NO: 159417 - RNA, 19 nt, Homo sapiens
aggcuguccuccuggauua

SEQ ID NO: 159418 - RNA, 19 nt, Homo sapiens
ggacaccaccggagagaca

SEQ ID NO: 159419 - RNA, 19 nt, Homo sapiens
ggaauaaccccuugcagaa

SEQ ID NO: 159420 - RNA, 19 nt, Homo sapiens
aagccucucuucuagguuu

SEQ ID NO: 159421 - RNA, 19 nt, Homo sapiens
ggaggugccaagccuguuu

SEQ ID NO: 159422 - RNA, 19 nt, Homo sapiens
cagagaggccugacugaga

SEQ ID NO: 159423 - RNA, 19 nt, Homo sapiens
gggaagugaugaguuaugg

SEQ ID NO: 159424 - RNA, 19 nt, Homo sapiens
acuaucagcuccgcuacua

SEQ ID NO: 159425 - RNA, 19 nt, Homo sapiens
gggaccugcucuucaaugu

SEQ ID NO: 159426 - RNA, 19 nt, Homo sapiens
ucagacugcccucuucuuu

SEQ ID NO: 159427 - RNA, 19 nt, Homo sapiens
cuacuuauguuggacacuu

SEQ ID NO: 159428 - RNA, 19 nt, Homo sapiens
ccucagggcccaaguuguu

SEQ ID NO: 159429 - RNA, 19 nt, Homo sapiens
gcuggugaauagccacuug

SEQ ID NO: 159430 - RNA, 19 nt, Homo sapiens
gauccugcuuauaucaaga

SEQ ID NO: 159431 - RNA, 19 nt, Homo sapiens
gaguaaaugaagagaaaga

SEQ ID NO: 159432 - RNA, 19 nt, Homo sapiens
gaagucgauccugcuuaua

SEQ ID NO: 159433 - RNA, 19 nt, Homo sapiens
ucagacacgaggagagaua

SEQ ID NO: 159434 - RNA, 19 nt, Homo sapiens
gaccaagguggacacaauu

SEQ ID NO: 159435 - RNA, 19 nt, Homo sapiens
acaauugguugcagacaca

SEQ ID NO: 159436 - RNA, 19 nt, Homo sapiens
ggagaguaaaugaagagaa

SEQ ID NO: 159437 - RNA, 19 nt, Homo sapiens
cggaaagacucuccuuggu

SEQ ID NO: 159438 - RNA, 19 nt, Homo sapiens
ggcaugguguguagccuau

SEQ ID NO: 159439 - RNA, 19 nt, Homo sapiens
gauagagaaccgccaaucu

SEQ ID NO: 159440 - RNA, 19 nt, Homo sapiens
agugaugucuggagcuuug

SEQ ID NO: 159441 - RNA, 19 nt, Homo sapiens
ucauggugcugacggaguu

SEQ ID NO: 159442 - RNA, 19 nt, Homo sapiens
gggaagucgauccugcuua

SEQ ID NO: 159443 - RNA, 19 nt, Homo sapiens
gcacauucgacuccacuuc

SEQ ID NO: 159444 - RNA, 19 nt, Homo sapiens
ggaagggaggagaguaaau

SEQ ID NO: 159445 - RNA, 19 nt, Homo sapiens
ggaggaagggaggagagua

SEQ ID NO: 159446 - RNA, 19 nt, Homo sapiens
gcugguggcugcauuugac

SEQ ID NO: 159447 - RNA, 19 nt, Homo sapiens
gcacacguacccuacaucu

SEQ ID NO: 159448 - RNA, 19 nt, Homo sapiens
gacugagagccgaguguua

SEQ ID NO: 159449 - RNA, 19 nt, Homo sapiens
gggaggagaguaaaugaag

SEQ ID NO: 159450 - RNA, 19 nt, Homo sapiens
ggucugagaaugacgauac

SEQ ID NO: 159451 - RNA, 19 nt, Homo sapiens
gcccuggacuuuccuuguc

SEQ ID NO: 159452 - RNA, 19 nt, Homo sapiens
gggcacacguacccuacau

SEQ ID NO: 159453 - RNA, 19 nt, Homo sapiens
cuguuugucuucauuguga

SEQ ID NO: 159454 - RNA, 19 nt, Homo sapiens
ggauuauaguccacccaau

SEQ ID NO: 159455 - RNA, 19 nt, Homo sapiens
gggcccaaguuguuugcuu

SEQ ID NO: 159456 - RNA, 19 nt, Homo sapiens
gacaggcucuuuuggagaa

SEQ ID NO: 159457 - RNA, 19 nt, Homo sapiens
gaccuucacccuuuacuac

SEQ ID NO: 159458 - RNA, 19 nt, Homo sapiens
aaagaagggaauuugcaaa

SEQ ID NO: 159459 - RNA, 19 nt, Homo sapiens
agugaugaguuauggagaa

SEQ ID NO: 159460 - RNA, 19 nt, Homo sapiens
ugcaguaccuguccagcuu

SEQ ID NO: 159461 - RNA, 19 nt, Homo sapiens
gacucggggugaaguauua

SEQ ID NO: 159462 - RNA, 19 nt, Homo sapiens
uaucagcuccgcuacuaug

SEQ ID NO: 159463 - RNA, 19 nt, Homo sapiens
gcagggaugagguccacuu

SEQ ID NO: 159464 - RNA, 19 nt, Homo sapiens
gcaacugaacgucaaagag

SEQ ID NO: 159465 - RNA, 19 nt, Homo sapiens
ggucauugcacauggaaag

SEQ ID NO: 159466 - RNA, 19 nt, Homo sapiens
gcaguaccuguccagcuuu

SEQ ID NO: 159467 - RNA, 19 nt, Homo sapiens
ccgcagugcugggucaguu

SEQ ID NO: 159468 - RNA, 19 nt, Homo sapiens
gaggggaccugcucuucaa

SEQ ID NO: 159469 - RNA, 19 nt, Homo sapiens
uaagucuucugcugggaau

SEQ ID NO: 159470 - RNA, 19 nt, Homo sapiens
gugcuccgauccuuugcuu

SEQ ID NO: 159471 - RNA, 19 nt, Homo sapiens
gacugcaacugaacgucaa

SEQ ID NO: 159472 - RNA, 19 nt, Homo sapiens
aagagaaagaacuggaaua

SEQ ID NO: 159473 - RNA, 19 nt, Homo sapiens
cggccaacgggaagaaaua

SEQ ID NO: 159474 - RNA, 19 nt, Homo sapiens
caguggaggucugagaaug

SEQ ID NO: 159475 - RNA, 19 nt, Homo sapiens
ccacccaauucacagacuu

SEQ ID NO: 159476 - RNA, 19 nt, Homo sapiens
gcauacaacauccagugau

SEQ ID NO: 159477 - RNA, 19 nt, Homo sapiens
cuucgacccucgccagaga

SEQ ID NO: 159478 - RNA, 19 nt, Homo sapiens
gccagaggaggauggagua

SEQ ID NO: 159479 - RNA, 19 nt, Homo sapiens
auacucaugugggaaguga

SEQ ID NO: 159480 - RNA, 19 nt, Homo sapiens
ggccaacgggaagaaauaa

SEQ ID NO: 159481 - RNA, 19 nt, Homo sapiens
caagauugaggaggucauu

SEQ ID NO: 159482 - RNA, 19 nt, Homo sapiens
ugaccaggcagaagacgaa

SEQ ID NO: 159483 - RNA, 19 nt, Homo sapiens
caacauggcuuugaugaua

SEQ ID NO: 159484 - RNA, 19 nt, Homo sapiens
gaacauggcuuugguuuua

SEQ ID NO: 159485 - RNA, 19 nt, Homo sapiens
ugaagaaagucaucuccua

SEQ ID NO: 159486 - RNA, 19 nt, Homo sapiens
gaggaaacuuugccacuug

SEQ ID NO: 159487 - RNA, 19 nt, Homo sapiens
caagugcccuccaggcuuu

SEQ ID NO: 159488 - RNA, 19 nt, Homo sapiens
ugaaaggccugcacuugaa

SEQ ID NO: 159489 - RNA, 19 nt, Homo sapiens
ucccugaucugcacuaaua

SEQ ID NO: 159490 - RNA, 19 nt, Homo sapiens
ccaacuaccugaagaaagu

SEQ ID NO: 159491 - RNA, 19 nt, Homo sapiens
caacagauacccucacuuc

SEQ ID NO: 159492 - RNA, 19 nt, Homo sapiens
ggaaaguugcacauuuaua

SEQ ID NO: 159493 - RNA, 19 nt, Homo sapiens
gaagauaccccuuuucuga

SEQ ID NO: 159494 - RNA, 19 nt, Homo sapiens
ggaagaagcagguggagau

SEQ ID NO: 159495 - RNA, 19 nt, Homo sapiens
ggacagcugcuuccacuau

SEQ ID NO: 159496 - RNA, 19 nt, Homo sapiens
ggggaaaguugcacauuua

SEQ ID NO: 159497 - RNA, 19 nt, Homo sapiens
acccaaagcucaucuccua

SEQ ID NO: 159498 - RNA, 19 nt, Homo sapiens
gcacauuuauauccuagag

SEQ ID NO: 159499 - RNA, 19 nt, Homo sapiens
caaagcucaucuccuauuc

SEQ ID NO: 159500 - RNA, 19 nt, Homo sapiens
ccaaagcucaucuccuauu

SEQ ID NO: 159501 - RNA, 19 nt, Homo sapiens
gugaaaggccugcacuuga

SEQ ID NO: 159502 - RNA, 19 nt, Homo sapiens
uagaaauccuccucacuuc

SEQ ID NO: 159503 - RNA, 19 nt, Homo sapiens
gggucuggcugccuauauu

SEQ ID NO: 159504 - RNA, 19 nt, Homo sapiens
cagauacccucacuucaag

SEQ ID NO: 159505 - RNA, 19 nt, Homo sapiens
gcaggacugugcaauuguc

SEQ ID NO: 159506 - RNA, 19 nt, Homo sapiens
uggcaggacugugcaauug

SEQ ID NO: 159507 - RNA, 19 nt, Homo sapiens
gaagaagcagguggagauu

SEQ ID NO: 159508 - RNA, 19 nt, Homo sapiens
cuagaaauccuccucacuu

SEQ ID NO: 159509 - RNA, 19 nt, Homo sapiens
cguaggcucugcucugaau

SEQ ID NO: 159510 - RNA, 19 nt, Homo sapiens
ggacugugcaauugucaga

SEQ ID NO: 159511 - RNA, 19 nt, Homo sapiens
ggaugacccagaagcauga

SEQ ID NO: 159512 - RNA, 19 nt, Homo sapiens
acagauacccucacuucaa

SEQ ID NO: 159513 - RNA, 19 nt, Homo sapiens
caucuccuauuccuacaug

SEQ ID NO: 159514 - RNA, 19 nt, Homo sapiens
gacagcugcuuccacuaug

SEQ ID NO: 159515 - RNA, 19 nt, Homo sapiens
gaggauggaggccuggaaa

SEQ ID NO: 159516 - RNA, 19 nt, Homo sapiens
agaggaaacuuugccacuu

SEQ ID NO: 159517 - RNA, 19 nt, Homo sapiens
aacauggcuuugaugauaa

SEQ ID NO: 159518 - RNA, 19 nt, Homo sapiens
uacccucacuucaagacua

SEQ ID NO: 159519 - RNA, 19 nt, Homo sapiens
ugaggagauccacgacuua

SEQ ID NO: 159520 - RNA, 19 nt, Homo sapiens
aaacuuugccacuugaaga

SEQ ID NO: 159521 - RNA, 19 nt, Homo sapiens
gaaauccuccucacuucag

SEQ ID NO: 159522 - RNA, 19 nt, Homo sapiens
gauggaggccuggaaagga

SEQ ID NO: 159523 - RNA, 19 nt, Homo sapiens
agaaagucaucuccuacug

SEQ ID NO: 159524 - RNA, 19 nt, Homo sapiens
ggaucgauaaguuccguuu

SEQ ID NO: 159525 - RNA, 19 nt, Homo sapiens
gacagcauccgcccuuuca

SEQ ID NO: 159526 - RNA, 19 nt, Homo sapiens
gcuuugccaucuacugguu

SEQ ID NO: 159527 - RNA, 19 nt, Homo sapiens
gggaaaguugcacauuuau

SEQ ID NO: 159528 - RNA, 19 nt, Homo sapiens
accagaggaucgauaaguu

SEQ ID NO: 159529 - RNA, 19 nt, Homo sapiens
guucaucucccgggacaaa

SEQ ID NO: 159530 - RNA, 19 nt, Homo sapiens
acauggcuuugaugauaaa

SEQ ID NO: 159531 - RNA, 19 nt, Homo sapiens
gcaacauggcuuugaugau

SEQ ID NO: 159532 - RNA, 19 nt, Homo sapiens
ggacaacaggcaccaucau

SEQ ID NO: 159533 - RNA, 19 nt, Homo sapiens
gaaacuuugccacuugaag

SEQ ID NO: 159534 - RNA, 19 nt, Homo sapiens
uggacgaccugcugaccaa

SEQ ID NO: 159535 - RNA, 19 nt, Homo sapiens
gaucaucccacuccugacu

SEQ ID NO: 159536 - RNA, 19 nt, Homo sapiens
gugcugggcuuugccaucu

SEQ ID NO: 159537 - RNA, 19 nt, Homo sapiens
caacaggcaccaucaucuc

SEQ ID NO: 159538 - RNA, 19 nt, Homo sapiens
gacaacaggcaccaucauc

SEQ ID NO: 159539 - RNA, 19 nt, Homo sapiens
ucacaggcccuuagagcau

SEQ ID NO: 159540 - RNA, 19 nt, Homo sapiens
uggcuuugaugauaaacga

SEQ ID NO: 159541 - RNA, 19 nt, Homo sapiens
gcacuugaacauggcuuug

SEQ ID NO: 159542 - RNA, 19 nt, Homo sapiens
guugcacauuuauauccua

SEQ ID NO: 159543 - RNA, 19 nt, Homo sapiens
ccagaggaucgauaaguuc

SEQ ID NO: 159544 - RNA, 19 nt, Homo sapiens
aggaaacuuugccacuuga

SEQ ID NO: 159545 - RNA, 19 nt, Homo sapiens
gucaugcucuacuggacaa

SEQ ID NO: 159546 - RNA, 19 nt, Homo sapiens
ggucccugaucugcacuaa

SEQ ID NO: 159547 - RNA, 19 nt, Homo sapiens
ccugagcgaugagcacguu

SEQ ID NO: 159548 - RNA, 19 nt, Homo sapiens
ucaucccacuccugacuga

SEQ ID NO: 159549 - RNA, 19 nt, Homo sapiens
ccuacuggcggaaugaauu

SEQ ID NO: 159550 - RNA, 19 nt, Homo sapiens
ggugaaagcacugggaucu

SEQ ID NO: 159551 - RNA, 19 nt, Homo sapiens
augaggagauccacgacuu

SEQ ID NO: 159552 - RNA, 19 nt, Homo sapiens
gagggagagcggcuacaug

SEQ ID NO: 159553 - RNA, 19 nt, Homo sapiens
cgugaaaggccugcacuug

SEQ ID NO: 159554 - RNA, 19 nt, Homo sapiens
caacuccaacuaccugaag

SEQ ID NO: 159555 - RNA, 19 nt, Homo sapiens
guaaucagagggugagaac

SEQ ID NO: 159556 - RNA, 19 nt, Homo sapiens
ggagauccacgacuuacac

SEQ ID NO: 159557 - RNA, 19 nt, Homo sapiens
cccaggacauccgcaaguu

SEQ ID NO: 159558 - RNA, 19 nt, Homo sapiens
ggaggauggaggccuggaa

SEQ ID NO: 159559 - RNA, 19 nt, Homo sapiens
ggaaacuuugccacuugaa

SEQ ID NO: 159560 - RNA, 19 nt, Homo sapiens
auggaggccuggaaaggaa

SEQ ID NO: 159561 - RNA, 19 nt, Homo sapiens
gaaaggccugcacuugaac

SEQ ID NO: 159562 - RNA, 19 nt, Homo sapiens
acccucacuucaagacuaa

SEQ ID NO: 159563 - RNA, 19 nt, Homo sapiens
ggccaccgccaggaucuuu

SEQ ID NO: 159564 - RNA, 19 nt, Homo sapiens
uuacaccagaggaucgaua

SEQ ID NO: 159565 - RNA, 19 nt, Homo sapiens
gcugggcuuugccaucuac

SEQ ID NO: 159566 - RNA, 19 nt, Homo sapiens
ggauggaggccuggaaagg

SEQ ID NO: 159567 - RNA, 19 nt, Homo sapiens
ggucuggcugccuauauuc

SEQ ID NO: 159568 - RNA, 19 nt, Homo sapiens
gccaucuacugguucaucu

SEQ ID NO: 159569 - RNA, 19 nt, Homo sapiens
gggauguggagcugcugua

SEQ ID NO: 159570 - RNA, 19 nt, Homo sapiens
cgacagcauccgcccuuuc

SEQ ID NO: 159571 - RNA, 19 nt, Homo sapiens
gcauggaaguguuauguaa

SEQ ID NO: 159572 - RNA, 19 nt, Homo sapiens
ugaaucagauccucauuaa

SEQ ID NO: 159573 - RNA, 19 nt, Homo sapiens
ugaaagaacuggagaaagu

SEQ ID NO: 159574 - RNA, 19 nt, Homo sapiens
guacauggcucucuucuac

SEQ ID NO: 159575 - RNA, 19 nt, Homo sapiens
gaaaggcuauggagaguca

SEQ ID NO: 159576 - RNA, 19 nt, Homo sapiens
gaauccagcuucucaauac

SEQ ID NO: 159577 - RNA, 19 nt, Homo sapiens
uuaaguggcuggauucuga

SEQ ID NO: 159578 - RNA, 19 nt, Homo sapiens
gcacuuugacuuccugaua

SEQ ID NO: 159579 - RNA, 19 nt, Homo sapiens
caaccgaggugaaucagau

SEQ ID NO: 159580 - RNA, 19 nt, Homo sapiens
ggacgaccgugcugagaga

SEQ ID NO: 159581 - RNA, 19 nt, Homo sapiens
gaagaaaacugcaggaagu

SEQ ID NO: 159582 - RNA, 19 nt, Homo sapiens
ggauaccacucauggaaga

SEQ ID NO: 159583 - RNA, 19 nt, Homo sapiens
ugggaugccuuacucaaua

SEQ ID NO: 159584 - RNA, 19 nt, Homo sapiens
uaucaaagccaacccagua

SEQ ID NO: 159585 - RNA, 19 nt, Homo sapiens
ggaauccagcuucucaaua

SEQ ID NO: 159586 - RNA, 19 nt, Homo sapiens
aagcuaagaugacuaugaa

SEQ ID NO: 159587 - RNA, 19 nt, Homo sapiens
ccagagaaaucagguguga

SEQ ID NO: 159588 - RNA, 19 nt, Homo sapiens
gaagccagcccgugacuug

SEQ ID NO: 159589 - RNA, 19 nt, Homo sapiens
gcacauggaggacuggauu

SEQ ID NO: 159590 - RNA, 19 nt, Homo sapiens
gggaugccuuacucaauaa

SEQ ID NO: 159591 - RNA, 19 nt, Homo sapiens
caaagccaacccaguauuu

SEQ ID NO: 159592 - RNA, 19 nt, Homo sapiens
gaaaggagagaucacacuu

SEQ ID NO: 159593 - RNA, 19 nt, Homo sapiens
ccaacccaguauuugauua

SEQ ID NO: 159594 - RNA, 19 nt, Homo sapiens
gggcaccauucuuaguaua

SEQ ID NO: 159595 - RNA, 19 nt, Homo sapiens
ucgcgcaucucccagguua

SEQ ID NO: 159596 - RNA, 19 nt, Homo sapiens
ugagggcgguggccaguuu

SEQ ID NO: 159597 - RNA, 19 nt, Homo sapiens
ccucagaucuacaaguuuc

SEQ ID NO: 159598 - RNA, 19 nt, Homo sapiens
gugaaucagauccucauua

SEQ ID NO: 159599 - RNA, 19 nt, Homo sapiens
caauaaagcuaagaugacu

SEQ ID NO: 159600 - RNA, 19 nt, Homo sapiens
gaaugcaucgucccuuuau

SEQ ID NO: 159601 - RNA, 19 nt, Homo sapiens
auacagagguggccuuaca

SEQ ID NO: 159602 - RNA, 19 nt, Homo sapiens
ggacggaagauccugauuc

SEQ ID NO: 159603 - RNA, 19 nt, Homo sapiens
gaagaaaggauucacuacu

SEQ ID NO: 159604 - RNA, 19 nt, Homo sapiens
gaggaaauccaguucuaug

SEQ ID NO: 159605 - RNA, 19 nt, Homo sapiens
aagaaaggauucacuacug

SEQ ID NO: 159606 - RNA, 19 nt, Homo sapiens
aaucagauccucauuaagu

SEQ ID NO: 159607 - RNA, 19 nt, Homo sapiens
aaggagagaucacacuuuc

SEQ ID NO: 159608 - RNA, 19 nt, Homo sapiens
ggaaauccaguucuaugug

SEQ ID NO: 159609 - RNA, 19 nt, Homo sapiens
gauggucacugaggaggaa

SEQ ID NO: 159610 - RNA, 19 nt, Homo sapiens
ugaaugaugcuuuccagaa

SEQ ID NO: 159611 - RNA, 19 nt, Homo sapiens
aaucagccguucauuuaga

SEQ ID NO: 159612 - RNA, 19 nt, Homo sapiens
aggcugaacuggaacagaa

SEQ ID NO: 159613 - RNA, 19 nt, Homo sapiens
gguggugauuucucuuuga

SEQ ID NO: 159614 - RNA, 19 nt, Homo sapiens
gaugguaaccuuccuggau

SEQ ID NO: 159615 - RNA, 19 nt, Homo sapiens
ggacaugaaaggcuaugga

SEQ ID NO: 159616 - RNA, 19 nt, Homo sapiens
gagaguugguauucuugga

SEQ ID NO: 159617 - RNA, 19 nt, Homo sapiens
gagguggccuuacacacau

SEQ ID NO: 159618 - RNA, 19 nt, Homo sapiens
aaccucagaucuacaaguu

SEQ ID NO: 159619 - RNA, 19 nt, Homo sapiens
gcaccauucuuaguauaca

SEQ ID NO: 159620 - RNA, 19 nt, Homo sapiens
gagcugaagaugcacuuug

SEQ ID NO: 159621 - RNA, 19 nt, Homo sapiens
uggcccagcugauguguga

SEQ ID NO: 159622 - RNA, 19 nt, Homo sapiens
gccacuacccggcuuauga

SEQ ID NO: 159623 - RNA, 19 nt, Homo sapiens
cagcaaaucccaacauguc

SEQ ID NO: 159624 - RNA, 19 nt, Homo sapiens
gcgguggccaguuugaaua

SEQ ID NO: 159625 - RNA, 19 nt, Homo sapiens
gaaagaacuggagaaagug

SEQ ID NO: 159626 - RNA, 19 nt, Homo sapiens
ugaaugcaucgucccuuua

SEQ ID NO: 159627 - RNA, 19 nt, Homo sapiens
cagcaggugugccauccuu

SEQ ID NO: 159628 - RNA, 19 nt, Homo sapiens
aggaggaaauccaguucua

SEQ ID NO: 159629 - RNA, 19 nt, Homo sapiens
augguaaccuuccuggaua

SEQ ID NO: 159630 - RNA, 19 nt, Homo sapiens
gugcagcaguucaagaagu

SEQ ID NO: 159631 - RNA, 19 nt, Homo sapiens
ggcugaggcugaacuggaa

SEQ ID NO: 159632 - RNA, 19 nt, Homo sapiens
gauggcagcauuguucuga

SEQ ID NO: 159633 - RNA, 19 nt, Homo sapiens
aaacugggccucucucaag

SEQ ID NO: 159634 - RNA, 19 nt, Homo sapiens
uaaccuuccuggauaaacu

SEQ ID NO: 159635 - RNA, 19 nt, Homo sapiens
aaagcuaagaugacuauga

SEQ ID NO: 159636 - RNA, 19 nt, Homo sapiens
ugacacggcccugaaagaa

SEQ ID NO: 159637 - RNA, 19 nt, Homo sapiens
ugugugagcugaagaugca

SEQ ID NO: 159638 - RNA, 19 nt, Homo sapiens
ggaggaaauccaguucuau

SEQ ID NO: 159639 - RNA, 19 nt, Homo sapiens
ccacuacccggcuuaugaa

SEQ ID NO: 159640 - RNA, 19 nt, Homo sapiens
guggcaugcugguguggua

SEQ ID NO: 159641 - RNA, 19 nt, Homo sapiens
ggaagaaaggauucacuac

SEQ ID NO: 159642 - RNA, 19 nt, Homo sapiens
guauacagagguggccuua

SEQ ID NO: 159643 - RNA, 19 nt, Homo sapiens
cuacugccauccucaccaa

SEQ ID NO: 159644 - RNA, 19 nt, Homo sapiens
ccgguggucucaaagaugu

SEQ ID NO: 159645 - RNA, 19 nt, Homo sapiens
aaacugguaccgaaacaug

SEQ ID NO: 159646 - RNA, 19 nt, Homo sapiens
ggagaaagugaccggaauc

SEQ ID NO: 159647 - RNA, 19 nt, Homo sapiens
gaaccucagaucuacaagu

SEQ ID NO: 159648 - RNA, 19 nt, Homo sapiens
gcuccgagaccgcuaaagu

SEQ ID NO: 159649 - RNA, 19 nt, Homo sapiens
uuugaccaaugcauaguuu

SEQ ID NO: 159650 - RNA, 19 nt, Homo sapiens
augaaugcaucgucccuuu

SEQ ID NO: 159651 - RNA, 19 nt, Homo sapiens
cuacccggcuuaugaaagg

SEQ ID NO: 159652 - RNA, 19 nt, Homo sapiens
acacggcccugaaagaacu

SEQ ID NO: 159653 - RNA, 19 nt, Homo sapiens
gaccagagggugccacuac

SEQ ID NO: 159654 - RNA, 19 nt, Homo sapiens
gcucucaugcucaggaaga

SEQ ID NO: 159655 - RNA, 19 nt, Homo sapiens
augcauaguuuggcagaaa

SEQ ID NO: 159656 - RNA, 19 nt, Homo sapiens
cuaaacugguaccgaaaca

SEQ ID NO: 159657 - RNA, 19 nt, Homo sapiens
ucaaagccaacccaguauu

SEQ ID NO: 159658 - RNA, 19 nt, Homo sapiens
caucugcuccucccgaaau

SEQ ID NO: 159659 - RNA, 19 nt, Homo sapiens
uggagaaagugaccggaau

SEQ ID NO: 159660 - RNA, 19 nt, Homo sapiens
cucauuaaguggcuggauu

SEQ ID NO: 159661 - RNA, 19 nt, Homo sapiens
cccgagaguugguauucuu

SEQ ID NO: 159662 - RNA, 19 nt, Homo sapiens
gcuaagaugacuaugaaaa

SEQ ID NO: 159663 - RNA, 19 nt, Homo sapiens
ugaagggguuugcagaaaa

SEQ ID NO: 159664 - RNA, 19 nt, Homo sapiens
accgaaacauggaaaggaa

SEQ ID NO: 159665 - RNA, 19 nt, Homo sapiens
ugguaaccuuccuggauaa

SEQ ID NO: 159666 - RNA, 19 nt, Homo sapiens
cacuuugacuuccugauag

SEQ ID NO: 159667 - RNA, 19 nt, Homo sapiens
aaagaacuggagaaaguga

SEQ ID NO: 159668 - RNA, 19 nt, Homo sapiens
gcccgugacuugggaaugg

SEQ ID NO: 159669 - RNA, 19 nt, Homo sapiens
ugaagaugcacuuugacuu

SEQ ID NO: 159670 - RNA, 19 nt, Homo sapiens
ugauuucucuuugaccaau

SEQ ID NO: 159671 - RNA, 19 nt, Homo sapiens
gacaagcucucaaugaaau

SEQ ID NO: 159672 - RNA, 19 nt, Homo sapiens
guuaaaggcuauugaacaa

SEQ ID NO: 159673 - RNA, 19 nt, Homo sapiens
gaaaugaucaacaacauag

SEQ ID NO: 159674 - RNA, 19 nt, Homo sapiens
gaaccggacuucaguggau

SEQ ID NO: 159675 - RNA, 19 nt, Homo sapiens
caucuucacuuccgacauu

SEQ ID NO: 159676 - RNA, 19 nt, Homo sapiens
uagacaagcucucaaugaa

SEQ ID NO: 159677 - RNA, 19 nt, Homo sapiens
uugaagaucugaacaaaga

SEQ ID NO: 159678 - RNA, 19 nt, Homo sapiens
aagaagagcuugaagaucu

SEQ ID NO: 159679 - RNA, 19 nt, Homo sapiens
caagauuccugcugcaaug

SEQ ID NO: 159680 - RNA, 19 nt, Homo sapiens
gaaaucgagucacgucaca

SEQ ID NO: 159681 - RNA, 19 nt, Homo sapiens
gguugucuaucgucuauuu

SEQ ID NO: 159682 - RNA, 19 nt, Homo sapiens
gaagaucugaacaaagaaa

SEQ ID NO: 159683 - RNA, 19 nt, Homo sapiens
gauaauuauugcuguguca

SEQ ID NO: 159684 - RNA, 19 nt, Homo sapiens
agaacacgcuaaagaagaa

SEQ ID NO: 159685 - RNA, 19 nt, Homo sapiens
gaucaacaacauagaaaga

SEQ ID NO: 159686 - RNA, 19 nt, Homo sapiens
uaaaggcuauugaacaaag

SEQ ID NO: 159687 - RNA, 19 nt, Homo sapiens
caagaaaacugcgaauaaa

SEQ ID NO: 159688 - RNA, 19 nt, Homo sapiens
gggaaauugauguucauua

SEQ ID NO: 159689 - RNA, 19 nt, Homo sapiens
gcuugaagaucugaacaaa

SEQ ID NO: 159690 - RNA, 19 nt, Homo sapiens
gaaugaugauggagacaca

SEQ ID NO: 159691 - RNA, 19 nt, Homo sapiens
gagcaaggcaagaaggaaa

SEQ ID NO: 159692 - RNA, 19 nt, Homo sapiens
caucaaaccaccaagauuc

SEQ ID NO: 159693 - RNA, 19 nt, Homo sapiens
caaguuaaaggcuauugaa

SEQ ID NO: 159694 - RNA, 19 nt, Homo sapiens
uaaaauugcagccaaguua

SEQ ID NO: 159695 - RNA, 19 nt, Homo sapiens
gaaugccacagacuaugua

SEQ ID NO: 159696 - RNA, 19 nt, Homo sapiens
gugaaaugaucaacaacau

SEQ ID NO: 159697 - RNA, 19 nt, Homo sapiens
uggaagccauggcggagua

SEQ ID NO: 159698 - RNA, 19 nt, Homo sapiens
gaucugaacaaagaaauca

SEQ ID NO: 159699 - RNA, 19 nt, Homo sapiens
caccaaacccggaaggaaa

SEQ ID NO: 159700 - RNA, 19 nt, Homo sapiens
gcaccaaacccggaaggaa

SEQ ID NO: 159701 - RNA, 19 nt, Homo sapiens
gagaguugcaugagauguu

SEQ ID NO: 159702 - RNA, 19 nt, Homo sapiens
cuagacaagcucucaauga

SEQ ID NO: 159703 - RNA, 19 nt, Homo sapiens
ggugcugucucggaaguuu

SEQ ID NO: 159704 - RNA, 19 nt, Homo sapiens
aaccacagcaucauucuuu

SEQ ID NO: 159705 - RNA, 19 nt, Homo sapiens
gcuugucguuggaauaugu

SEQ ID NO: 159706 - RNA, 19 nt, Homo sapiens
gaugauggagacacaguug

SEQ ID NO: 159707 - RNA, 19 nt, Homo sapiens
uaggaagaaugaugaugga

SEQ ID NO: 159708 - RNA, 19 nt, Homo sapiens
ucaagaaaacugcgaauaa

SEQ ID NO: 159709 - RNA, 19 nt, Homo sapiens
guagaacacgcuaaagaag

SEQ ID NO: 159710 - RNA, 19 nt, Homo sapiens
acaaggacaucaugaagcu

SEQ ID NO: 159711 - RNA, 19 nt, Homo sapiens
agacaagcucucaaugaaa

SEQ ID NO: 159712 - RNA, 19 nt, Homo sapiens
aaaucagcauccugucauu

SEQ ID NO: 159713 - RNA, 19 nt, Homo sapiens
caaaucagcauccugucau

SEQ ID NO: 159714 - RNA, 19 nt, Homo sapiens
uaucagagcaaggcaagaa

SEQ ID NO: 159715 - RNA, 19 nt, Homo sapiens
uagaacacgcuaaagaaga

SEQ ID NO: 159716 - RNA, 19 nt, Homo sapiens
uguagaacacgcuaaagaa

SEQ ID NO: 159717 - RNA, 19 nt, Homo sapiens
ccaaaucagcauccuguca

SEQ ID NO: 159718 - RNA, 19 nt, Homo sapiens
cuuccgacauuauaucaga

SEQ ID NO: 159719 - RNA, 19 nt, Homo sapiens
ccacagacgacgagcuaga

SEQ ID NO: 159720 - RNA, 19 nt, Homo sapiens
ggugaaaugaucaacaaca

SEQ ID NO: 159721 - RNA, 19 nt, Homo sapiens
agggugaaaugaucaacaa

SEQ ID NO: 159722 - RNA, 19 nt, Homo sapiens
uucaguggaucuucggaua

SEQ ID NO: 159723 - RNA, 19 nt, Homo sapiens
ccacagacuauguagaaca

SEQ ID NO: 159724 - RNA, 19 nt, Homo sapiens
gaccagcauccgagaguug

SEQ ID NO: 159725 - RNA, 19 nt, Homo sapiens
gcgggaagccauccaucuu

SEQ ID NO: 159726 - RNA, 19 nt, Homo sapiens
caccacagacgacgagcua

SEQ ID NO: 159727 - RNA, 19 nt, Homo sapiens
guuuauugauucucacaca

SEQ ID NO: 159728 - RNA, 19 nt, Homo sapiens
ucacaaggacaucaugaag

SEQ ID NO: 159729 - RNA, 19 nt, Homo sapiens
acaaauuacuagacaagcu

SEQ ID NO: 159730 - RNA, 19 nt, Homo sapiens
ccauggcggaguacaauga

SEQ ID NO: 159731 - RNA, 19 nt, Homo sapiens
gaagagcuugaagaucuga

SEQ ID NO: 159732 - RNA, 19 nt, Homo sapiens
gaacacgcuaaagaagaaa

SEQ ID NO: 159733 - RNA, 19 nt, Homo sapiens
ugccacagacuauguagaa

SEQ ID NO: 159734 - RNA, 19 nt, Homo sapiens
gauggagacacaguuguug

SEQ ID NO: 159735 - RNA, 19 nt, Homo sapiens
ucacaaauuacuagacaag

SEQ ID NO: 159736 - RNA, 19 nt, Homo sapiens
ccaaguuaaaggcuauuga

SEQ ID NO: 159737 - RNA, 19 nt, Homo sapiens
aaauugcagccaaguuaaa

SEQ ID NO: 159738 - RNA, 19 nt, Homo sapiens
acacaucaaaccaccaaga

SEQ ID NO: 159739 - RNA, 19 nt, Homo sapiens
ucacacaucaaaccaccaa

SEQ ID NO: 159740 - RNA, 19 nt, Homo sapiens
caucagguggaggagauua

SEQ ID NO: 159741 - RNA, 19 nt, Homo sapiens
uaugaaugccacagacuau

SEQ ID NO: 159742 - RNA, 19 nt, Homo sapiens
gagaccagcauccgagagu

SEQ ID NO: 159743 - RNA, 19 nt, Homo sapiens
cuucacuuccgacauuaua

SEQ ID NO: 159744 - RNA, 19 nt, Homo sapiens
uaaaagaagagcuugaaga

SEQ ID NO: 159745 - RNA, 19 nt, Homo sapiens
cugcugcaaugaaccaaau

SEQ ID NO: 159746 - RNA, 19 nt, Homo sapiens
ccaagauuccugcugcaau

SEQ ID NO: 159747 - RNA, 19 nt, Homo sapiens
cugguugucuaucgucuau

SEQ ID NO: 159748 - RNA, 19 nt, Homo sapiens
ugucagugguucugguugu

SEQ ID NO: 159749 - RNA, 19 nt, Homo sapiens
ugaaugccacagacuaugu

SEQ ID NO: 159750 - RNA, 19 nt, Homo sapiens
gaccugacggcguguagga

SEQ ID NO: 159751 - RNA, 19 nt, Homo sapiens
auacgaagaacccagcauu

SEQ ID NO: 159752 - RNA, 19 nt, Homo sapiens
gacucagggugaaaugauc

SEQ ID NO: 159753 - RNA, 19 nt, Homo sapiens
ggagacucagggugaaaug

SEQ ID NO: 159754 - RNA, 19 nt, Homo sapiens
cagauucacaaauuacuag

SEQ ID NO: 159755 - RNA, 19 nt, Homo sapiens
gacauuauaucagauucac

SEQ ID NO: 159756 - RNA, 19 nt, Homo sapiens
acgacgagcuagaagagau

SEQ ID NO: 159757 - RNA, 19 nt, Homo sapiens
cagugguucugguugucua

SEQ ID NO: 159758 - RNA, 19 nt, Homo sapiens
cuauguagaacacgcuaaa

SEQ ID NO: 159759 - RNA, 19 nt, Homo sapiens
gagacucagggugaaauga

SEQ ID NO: 159760 - RNA, 19 nt, Homo sapiens
agaguugcaugagauguuc

SEQ ID NO: 159761 - RNA, 19 nt, Homo sapiens
ugauggagacacaguuguu

SEQ ID NO: 159762 - RNA, 19 nt, Homo sapiens
agaagagcuugaagaucug

SEQ ID NO: 159763 - RNA, 19 nt, Homo sapiens
agccauccaucuucacuuc

SEQ ID NO: 159764 - RNA, 19 nt, Homo sapiens
cggcguguaggaagaauga

SEQ ID NO: 159765 - RNA, 19 nt, Homo sapiens
cguguaggaagaaugauga

SEQ ID NO: 159766 - RNA, 19 nt, Homo sapiens
cgacauuauaucagauuca

SEQ ID NO: 159767 - RNA, 19 nt, Homo sapiens
gucguuggaauauguugua

SEQ ID NO: 159768 - RNA, 19 nt, Homo sapiens
uaucgucuauuuggcuugu

SEQ ID NO: 159769 - RNA, 19 nt, Homo sapiens
uuaugaaugccacagacua

SEQ ID NO: 159770 - RNA, 19 nt, Homo sapiens
uccgagaguugcaugagau

SEQ ID NO: 159771 - RNA, 19 nt, Homo sapiens
ggaaauggcuucauaguga

SEQ ID NO: 159772 - RNA, 19 nt, Homo sapiens
gcaaugagcugccugauga

SEQ ID NO: 159773 - RNA, 19 nt, Homo sapiens
gaugaaaucuugcaaguuu

SEQ ID NO: 159774 - RNA, 19 nt, Homo sapiens
uaacagacauacagaauug

SEQ ID NO: 159775 - RNA, 19 nt, Homo sapiens
gaauauagcuguggacaau

SEQ ID NO: 159776 - RNA, 19 nt, Homo sapiens
gaaguuacacagcaauuua

SEQ ID NO: 159777 - RNA, 19 nt, Homo sapiens
ugaaguagcuacaaaguau

SEQ ID NO: 159778 - RNA, 19 nt, Homo sapiens
ugaccaagguguauaguaa

SEQ ID NO: 159779 - RNA, 19 nt, Homo sapiens
guacauuguucuacuguuu

SEQ ID NO: 159780 - RNA, 19 nt, Homo sapiens
gaaguggacagccuaauuu

SEQ ID NO: 159781 - RNA, 19 nt, Homo sapiens
gaacccaaaugaugucuuc

SEQ ID NO: 159782 - RNA, 19 nt, Homo sapiens
gaugaugagucccaaggua

SEQ ID NO: 159783 - RNA, 19 nt, Homo sapiens
cagcuuggcuucaguguga

SEQ ID NO: 159784 - RNA, 19 nt, Homo sapiens
gaauugggcuaagauagaa

SEQ ID NO: 159785 - RNA, 19 nt, Homo sapiens
ugacuuacguuccuuaugu

SEQ ID NO: 159786 - RNA, 19 nt, Homo sapiens
ggcaggcucugucaguuua

SEQ ID NO: 159787 - RNA, 19 nt, Homo sapiens
gcacugacuucauuuccuu

SEQ ID NO: 159788 - RNA, 19 nt, Homo sapiens
cuaacuuucuuucgcauua

SEQ ID NO: 159789 - RNA, 19 nt, Homo sapiens
gaaaugggcacuguugauu

SEQ ID NO: 159790 - RNA, 19 nt, Homo sapiens
caucauguguucagaauuc

SEQ ID NO: 159791 - RNA, 19 nt, Homo sapiens
gcaguucagugugagauuu

SEQ ID NO: 159792 - RNA, 19 nt, Homo sapiens
ggagagaauugggcuaaga

SEQ ID NO: 159793 - RNA, 19 nt, Homo sapiens
gagccgagaucacgccauu

SEQ ID NO: 159794 - RNA, 19 nt, Homo sapiens
caugagcucugacuucuug

SEQ ID NO: 159795 - RNA, 19 nt, Homo sapiens
ggaaguggacagccuaauu

SEQ ID NO: 159796 - RNA, 19 nt, Homo sapiens
gagaaucaugugugacuua

SEQ ID NO: 159797 - RNA, 19 nt, Homo sapiens
gcugaugauucacauguuu

SEQ ID NO: 159798 - RNA, 19 nt, Homo sapiens
ggacaugauuuuccauuuu

SEQ ID NO: 159799 - RNA, 19 nt, Homo sapiens
gaaaauggcccugcguuua

SEQ ID NO: 159800 - RNA, 19 nt, Homo sapiens
gaagauggauacgugacaa

SEQ ID NO: 159801 - RNA, 19 nt, Homo sapiens
ccagacagaggcauaauaa

SEQ ID NO: 159802 - RNA, 19 nt, Homo sapiens
uaccaugccuggcugauuu

SEQ ID NO: 159803 - RNA, 19 nt, Homo sapiens
gggcuaagauagaaaauaa

SEQ ID NO: 159804 - RNA, 19 nt, Homo sapiens
ggauguggcucuccagcuu

SEQ ID NO: 159805 - RNA, 19 nt, Homo sapiens
gagaugaguacgcccuuua

SEQ ID NO: 159806 - RNA, 19 nt, Homo sapiens
ccggacaacuugaaugaaa

SEQ ID NO: 159807 - RNA, 19 nt, Homo sapiens
ggacuccuuuggaauauag

SEQ ID NO: 159808 - RNA, 19 nt, Homo sapiens
gaaaaggcuucgugaaaug

SEQ ID NO: 159809 - RNA, 19 nt, Homo sapiens
acacagcaauuuagcaaug

SEQ ID NO: 159810 - RNA, 19 nt, Homo sapiens
gcagagacgccuuggaguu

SEQ ID NO: 159811 - RNA, 19 nt, Homo sapiens
cauacuguguugcucauuu

SEQ ID NO: 159812 - RNA, 19 nt, Homo sapiens
gagacgccuuggaguuuaa

SEQ ID NO: 159813 - RNA, 19 nt, Homo sapiens
gaacuucgcacagccagaa

SEQ ID NO: 159814 - RNA, 19 nt, Homo sapiens
gagguugagugacugaaga

SEQ ID NO: 159815 - RNA, 19 nt, Homo sapiens
ucagugcgcuuucucuuuc

SEQ ID NO: 159816 - RNA, 19 nt, Homo sapiens
ggaaaaggcuucgugaaau

SEQ ID NO: 159817 - RNA, 19 nt, Homo sapiens
caagcaccuuugaaaugua

SEQ ID NO: 159818 - RNA, 19 nt, Homo sapiens
gguagugacuccuguagca

SEQ ID NO: 159819 - RNA, 19 nt, Homo sapiens
guucuaaccuaccacaugu

SEQ ID NO: 159820 - RNA, 19 nt, Homo sapiens
uaacaggaauucuggaacu

SEQ ID NO: 159821 - RNA, 19 nt, Homo sapiens
uaaaucaugguaccuguuu

SEQ ID NO: 159822 - RNA, 19 nt, Homo sapiens
ccgcugcacugacuucauu

SEQ ID NO: 159823 - RNA, 19 nt, Homo sapiens
aagacuggguaguuuauaa

SEQ ID NO: 159824 - RNA, 19 nt, Homo sapiens
gugaaauccuucucuauac

SEQ ID NO: 159825 - RNA, 19 nt, Homo sapiens
guacaagcgacauucauga

SEQ ID NO: 159826 - RNA, 19 nt, Homo sapiens
uaucucaccuccacuagga

SEQ ID NO: 159827 - RNA, 19 nt, Homo sapiens
agaauucgauuuggaguug

SEQ ID NO: 159828 - RNA, 19 nt, Homo sapiens
guucagaauucgauuugga

SEQ ID NO: 159829 - RNA, 19 nt, Homo sapiens
uuaaacacauccagcaaau

SEQ ID NO: 159830 - RNA, 19 nt, Homo sapiens
gcuggugcuuuaacuauau

SEQ ID NO: 159831 - RNA, 19 nt, Homo sapiens
uuugauugcuggugcuuua

SEQ ID NO: 159832 - RNA, 19 nt, Homo sapiens
caugguaccuguuuuaaaa

SEQ ID NO: 159833 - RNA, 19 nt, Homo sapiens
ggagaugaguacgcccuuu

SEQ ID NO: 159834 - RNA, 19 nt, Homo sapiens
gguagaaguuacacagcaa

SEQ ID NO: 159835 - RNA, 19 nt, Homo sapiens
ggccaaggcaggagaauug

SEQ ID NO: 159836 - RNA, 19 nt, Homo sapiens
ucauaugccgugugucuua

SEQ ID NO: 159837 - RNA, 19 nt, Homo sapiens
uaagaagacucagcagcuu

SEQ ID NO: 159838 - RNA, 19 nt, Homo sapiens
guagaagaauugcuugaac

SEQ ID NO: 159839 - RNA, 19 nt, Homo sapiens
cauuugaggucaggaguuu

SEQ ID NO: 159840 - RNA, 19 nt, Homo sapiens
acaagcaccuuugaaaugu

SEQ ID NO: 159841 - RNA, 19 nt, Homo sapiens
cauauuggacccauaagaa

SEQ ID NO: 159842 - RNA, 19 nt, Homo sapiens
agaguuacagcaaguguua

SEQ ID NO: 159843 - RNA, 19 nt, Homo sapiens
agacaggguuucaccaugu

SEQ ID NO: 159844 - RNA, 19 nt, Homo sapiens
gacagcaacgggauucuuu

SEQ ID NO: 159845 - RNA, 19 nt, Homo sapiens
gcagaacuggugcugguuu

SEQ ID NO: 159846 - RNA, 19 nt, Homo sapiens
uaaacgaggugaguuacau

SEQ ID NO: 159847 - RNA, 19 nt, Homo sapiens
guagauuucaagacaagua

SEQ ID NO: 159848 - RNA, 19 nt, Homo sapiens
agagacgccuuggaguuua

SEQ ID NO: 159849 - RNA, 19 nt, Homo sapiens
aggcuaagguagaagaauu

SEQ ID NO: 159850 - RNA, 19 nt, Homo sapiens
gaaaccccaucucuacuaa

SEQ ID NO: 159851 - RNA, 19 nt, Homo sapiens
agugaaauccuucucuaua

SEQ ID NO: 159852 - RNA, 19 nt, Homo sapiens
cgacauucaugagcucuga

SEQ ID NO: 159853 - RNA, 19 nt, Homo sapiens
cauaauaaagugacugaug

SEQ ID NO: 159854 - RNA, 19 nt, Homo sapiens
caagguacauuguucuacu

SEQ ID NO: 159855 - RNA, 19 nt, Homo sapiens
gaaaccccaucucuacuaa

SEQ ID NO: 159856 - RNA, 19 nt, Homo sapiens
ucaauccgguggacuggaa

SEQ ID NO: 159857 - RNA, 19 nt, Homo sapiens
cgaggcgcguggaucauuu

SEQ ID NO: 159858 - RNA, 19 nt, Homo sapiens
cuggguaguuuauaaagaa

SEQ ID NO: 159859 - RNA, 19 nt, Homo sapiens
ugaaugaaaugggcacugu

SEQ ID NO: 159860 - RNA, 19 nt, Homo sapiens
ggacaacuugaaugaaaug

SEQ ID NO: 159861 - RNA, 19 nt, Homo sapiens
gacagaggcauaauaaagu

SEQ ID NO: 159862 - RNA, 19 nt, Homo sapiens
cacaagcaccuuugaaaug

SEQ ID NO: 159863 - RNA, 19 nt, Homo sapiens
cacccaaucuagacccuaa

SEQ ID NO: 159864 - RNA, 19 nt, Homo sapiens
ccggacauuugacuuguuu

SEQ ID NO: 159865 - RNA, 19 nt, Homo sapiens
ggccacgcgugcagucuuu

SEQ ID NO: 159866 - RNA, 19 nt, Homo sapiens
caggugacccggauagaaa

SEQ ID NO: 159867 - RNA, 19 nt, Homo sapiens
ggccuuaacuccaccugau

SEQ ID NO: 159868 - RNA, 19 nt, Homo sapiens
ccagauggcacagcacuuu

SEQ ID NO: 159869 - RNA, 19 nt, Homo sapiens
gccaccagcuguccucuuc

SEQ ID NO: 159870 - RNA, 19 nt, Homo sapiens
cgaggcagguggaucacuu

SEQ ID NO: 159871 - RNA, 19 nt, Homo sapiens
gagagcagcuuuaaacuca

SEQ ID NO: 159872 - RNA, 19 nt, Homo sapiens
gagcaacucugagaucuaa

SEQ ID NO: 159873 - RNA, 19 nt, Homo sapiens
cagaggaacuguccagaga

SEQ ID NO: 159874 - RNA, 19 nt, Homo sapiens
ccaaggaggccgagaauau

SEQ ID NO: 159875 - RNA, 19 nt, Homo sapiens
ggaggcgauuuaccuguuu

SEQ ID NO: 159876 - RNA, 19 nt, Homo sapiens
gaacacugcagcuugaaug

SEQ ID NO: 159877 - RNA, 19 nt, Homo sapiens
gcccagagcaggaagcauu

SEQ ID NO: 159878 - RNA, 19 nt, Homo sapiens
caccacgccucaucuguga

SEQ ID NO: 159879 - RNA, 19 nt, Homo sapiens
ugaaugagaauaucacugu

SEQ ID NO: 159880 - RNA, 19 nt, Homo sapiens
aggaugaccuggagaacuu

SEQ ID NO: 159881 - RNA, 19 nt, Homo sapiens
gcagcugcauguggauaaa

SEQ ID NO: 159882 - RNA, 19 nt, Homo sapiens
gccgaguccuggagaggua

SEQ ID NO: 159883 - RNA, 19 nt, Homo sapiens
ucagagagcagcuuuaaac

SEQ ID NO: 159884 - RNA, 19 nt, Homo sapiens
gaagacgccugagcucacu

SEQ ID NO: 159885 - RNA, 19 nt, Homo sapiens
ccaccucccucaccaacau

SEQ ID NO: 159886 - RNA, 19 nt, Homo sapiens
cacugcagcuugaaugaga

SEQ ID NO: 159887 - RNA, 19 nt, Homo sapiens
gcagcaggccguagaaguc

SEQ ID NO: 159888 - RNA, 19 nt, Homo sapiens
gcuccacuccgaacaauca

SEQ ID NO: 159889 - RNA, 19 nt, Homo sapiens
gcagcuugaaugagaauau

SEQ ID NO: 159890 - RNA, 19 nt, Homo sapiens
aaucacugcugacacuuuc

SEQ ID NO: 159891 - RNA, 19 nt, Homo sapiens
ggaacuguccagagagcaa

SEQ ID NO: 159892 - RNA, 19 nt, Homo sapiens
uggaggcgauuuaccuguu

SEQ ID NO: 159893 - RNA, 19 nt, Homo sapiens
caaucacugcugacacuuu

SEQ ID NO: 159894 - RNA, 19 nt, Homo sapiens
ccagacaccaaaguuaauu

SEQ ID NO: 159895 - RNA, 19 nt, Homo sapiens
caaggaggccgagaauauc

SEQ ID NO: 159896 - RNA, 19 nt, Homo sapiens
gcauucagagagcagcuuu

SEQ ID NO: 159897 - RNA, 19 nt, Homo sapiens
caaccucauugacaagaac

SEQ ID NO: 159898 - RNA, 19 nt, Homo sapiens
ucccagacaccaaaguuaa

SEQ ID NO: 159899 - RNA, 19 nt, Homo sapiens
cagcuugaaugagaauauc

SEQ ID NO: 159900 - RNA, 19 nt, Homo sapiens
ucauugacaagaacugaaa

SEQ ID NO: 159901 - RNA, 19 nt, Homo sapiens
gucccagacaccaaaguua

SEQ ID NO: 159902 - RNA, 19 nt, Homo sapiens
ugccagcaaugacaucuca

SEQ ID NO: 159903 - RNA, 19 nt, Homo sapiens
ggaugaccuggagaacuua

SEQ ID NO: 159904 - RNA, 19 nt, Homo sapiens
ucacucggcacccugcaaa

SEQ ID NO: 159905 - RNA, 19 nt, Homo sapiens
aacaaucacugcugacacu

SEQ ID NO: 159906 - RNA, 19 nt, Homo sapiens
cagacaccaaaguuaauuu

SEQ ID NO: 159907 - RNA, 19 nt, Homo sapiens
gcugacacuuuccgcaaac

SEQ ID NO: 159908 - RNA, 19 nt, Homo sapiens
caagaacugaaaccaccaa

SEQ ID NO: 159909 - RNA, 19 nt, Homo sapiens
caaguuuuguguauucuuc

SEQ ID NO: 159910 - RNA, 19 nt, Homo sapiens
gcaacucugagaucuaagg

SEQ ID NO: 159911 - RNA, 19 nt, Homo sapiens
ccaaaguuaauuucuaugc

SEQ ID NO: 159912 - RNA, 19 nt, Homo sapiens
gaugucacagggccaacuu

SEQ ID NO: 159913 - RNA, 19 nt, Homo sapiens
agacaccaaaguuaauuuc

SEQ ID NO: 159914 - RNA, 19 nt, Homo sapiens
gccaaggaggccgagaaua

SEQ ID NO: 159915 - RNA, 19 nt, Homo sapiens
gguggcaagcugugacuuc

SEQ ID NO: 159916 - RNA, 19 nt, Homo sapiens
ccacaaccuugcaguauuu

SEQ ID NO: 159917 - RNA, 19 nt, Homo sapiens
ccacaucaaugaaguagug

SEQ ID NO: 159918 - RNA, 19 nt, Homo sapiens
gagaaccagugcagacuca

SEQ ID NO: 159919 - RNA, 19 nt, Homo sapiens
gaugaaggcucagaagcau

SEQ ID NO: 159920 - RNA, 19 nt, Homo sapiens
ccuaccagcucgaggauga

SEQ ID NO: 159921 - RNA, 19 nt, Homo sapiens
ggacauaguggccauggau

SEQ ID NO: 159922 - RNA, 19 nt, Homo sapiens
gcggugcgcuucugguguu

SEQ ID NO: 159923 - RNA, 19 nt, Homo sapiens
gcaacuacagcuucuccua

SEQ ID NO: 159924 - RNA, 19 nt, Homo sapiens
agugcagacucaagacuua

SEQ ID NO: 159925 - RNA, 19 nt, Homo sapiens
uggaggacuugguguguuu

SEQ ID NO: 159926 - RNA, 19 nt, Homo sapiens
gcccagagagcgaguuuga

SEQ ID NO: 159927 - RNA, 19 nt, Homo sapiens
gcaggggcauugcugauuu

SEQ ID NO: 159928 - RNA, 19 nt, Homo sapiens
acucaagacuuauggaaca

SEQ ID NO: 159929 - RNA, 19 nt, Homo sapiens
ggaugaaggcucagaagca

SEQ ID NO: 159930 - RNA, 19 nt, Homo sapiens
gcuauguggcuugcucuua

SEQ ID NO: 159931 - RNA, 19 nt, Homo sapiens
gagcggccacguaguguug

SEQ ID NO: 159932 - RNA, 19 nt, Homo sapiens
acaccaggcugcagaugau

SEQ ID NO: 159933 - RNA, 19 nt, Homo sapiens
cuauguggcuugcucuuag

SEQ ID NO: 159934 - RNA, 19 nt, Homo sapiens
ugacccagcuguggacugu

SEQ ID NO: 159935 - RNA, 19 nt, Homo sapiens
aaaccacaaccuugcagua

SEQ ID NO: 159936 - RNA, 19 nt, Homo sapiens
ccagagagcgaguuugaag

SEQ ID NO: 159937 - RNA, 19 nt, Homo sapiens
caucugcuuuggccucgaa

SEQ ID NO: 159938 - RNA, 19 nt, Homo sapiens
gacaccaggcugcagauga

SEQ ID NO: 159939 - RNA, 19 nt, Homo sapiens
acucuggcaucucaacuga

SEQ ID NO: 159940 - RNA, 19 nt, Homo sapiens
ugacgagagcggccacgua

SEQ ID NO: 159941 - RNA, 19 nt, Homo sapiens
gagcccagagagcgaguuu

SEQ ID NO: 159942 - RNA, 19 nt, Homo sapiens
accacaaccuugcaguauu

SEQ ID NO: 159943 - RNA, 19 nt, Homo sapiens
gaaccagugcagacucaag

SEQ ID NO: 159944 - RNA, 19 nt, Homo sapiens
gggcauugcugauuuuguc

SEQ ID NO: 159945 - RNA, 19 nt, Homo sapiens
caggucggcucccuuuguc

SEQ ID NO: 159946 - RNA, 19 nt, Homo sapiens
ccaggucggcucccuuugu

SEQ ID NO: 159947 - RNA, 19 nt, Homo sapiens
cauaguggccauggaugaa

SEQ ID NO: 159948 - RNA, 19 nt, Homo sapiens
gauaucaccgugucaucca

SEQ ID NO: 159949 - RNA, 19 nt, Homo sapiens
agacucaagacuuauggaa

SEQ ID NO: 159950 - RNA, 19 nt, Homo sapiens
acuccaacccuuaugagaa

SEQ ID NO: 159951 - RNA, 19 nt, Homo sapiens
caaugaaguagugcuccua

SEQ ID NO: 159952 - RNA, 19 nt, Homo sapiens
cauccacaucaaugaagua

SEQ ID NO: 159953 - RNA, 19 nt, Homo sapiens
ccaauaugacucagagaac

SEQ ID NO: 159954 - RNA, 19 nt, Homo sapiens
caacauggguuuaguauua

SEQ ID NO: 159955 - RNA, 19 nt, Homo sapiens
guaaacaacuccaguaaua

SEQ ID NO: 159956 - RNA, 19 nt, Homo sapiens
guaaaucucuguaugauga

SEQ ID NO: 159957 - RNA, 19 nt, Homo sapiens
gaagaaagcuccaguucau

SEQ ID NO: 159958 - RNA, 19 nt, Homo sapiens
gaaaguaaaucucuguaug

SEQ ID NO: 159959 - RNA, 19 nt, Homo sapiens
gcagauacuugacuuauau

SEQ ID NO: 159960 - RNA, 19 nt, Homo sapiens
gaagagggaugacaguuga

SEQ ID NO: 159961 - RNA, 19 nt, Homo sapiens
gaacauacuuaguuggaaa

SEQ ID NO: 159962 - RNA, 19 nt, Homo sapiens
gcaagaacccugccaagua

SEQ ID NO: 159963 - RNA, 19 nt, Homo sapiens
ggaggaacaucacaucauu

SEQ ID NO: 159964 - RNA, 19 nt, Homo sapiens
agauauagcuguucaagaa

SEQ ID NO: 159965 - RNA, 19 nt, Homo sapiens
gaagagcugucaguuugua

SEQ ID NO: 159966 - RNA, 19 nt, Homo sapiens
caaguauucuggaaaguaa

SEQ ID NO: 159967 - RNA, 19 nt, Homo sapiens
ugacagagaugagcaguuu

SEQ ID NO: 159968 - RNA, 19 nt, Homo sapiens
ggaaacugaucaugagauu

SEQ ID NO: 159969 - RNA, 19 nt, Homo sapiens
ggaggagacuauacaacua

SEQ ID NO: 159970 - RNA, 19 nt, Homo sapiens
ucacaugguuugucaauga

SEQ ID NO: 159971 - RNA, 19 nt, Homo sapiens
ugacuuauaugcucaggua

SEQ ID NO: 159972 - RNA, 19 nt, Homo sapiens
caccuucucugaauaauaa

SEQ ID NO: 159973 - RNA, 19 nt, Homo sapiens
gaaguugggccacgugaua

SEQ ID NO: 159974 - RNA, 19 nt, Homo sapiens
cagagaagcuaauucaaga

SEQ ID NO: 159975 - RNA, 19 nt, Homo sapiens
gaauaagccucagaaacaa

SEQ ID NO: 159976 - RNA, 19 nt, Homo sapiens
guacaagucuuugauagga

SEQ ID NO: 159977 - RNA, 19 nt, Homo sapiens
gcucagggcuccucacguu

SEQ ID NO: 159978 - RNA, 19 nt, Homo sapiens
ggaagacuuucagaagaua

SEQ ID NO: 159979 - RNA, 19 nt, Homo sapiens
ccaaugcacuuucugaaga

SEQ ID NO: 159980 - RNA, 19 nt, Homo sapiens
uauugaagcuuuaggcaua

SEQ ID NO: 159981 - RNA, 19 nt, Homo sapiens
agacuaaacuucaagcuau

SEQ ID NO: 159982 - RNA, 19 nt, Homo sapiens
ggacaaagauaagaagaag

SEQ ID NO: 159983 - RNA, 19 nt, Homo sapiens
caagaaagcaccaaaggaa

SEQ ID NO: 159984 - RNA, 19 nt, Homo sapiens
caaaggaaaugccaacauc

SEQ ID NO: 159985 - RNA, 19 nt, Homo sapiens
gcaagauguugggaaauuu

SEQ ID NO: 159986 - RNA, 19 nt, Homo sapiens
gcucuaaucugauggaaca

SEQ ID NO: 159987 - RNA, 19 nt, Homo sapiens
gagcugaggacaaagauaa

SEQ ID NO: 159988 - RNA, 19 nt, Homo sapiens
ggaagauguugcaauguug

SEQ ID NO: 159989 - RNA, 19 nt, Homo sapiens
caagaacuccuucagcuaa

SEQ ID NO: 159990 - RNA, 19 nt, Homo sapiens
gauacuagauucuggaaag

SEQ ID NO: 159991 - RNA, 19 nt, Homo sapiens
uuauauggcucuaaucuga

SEQ ID NO: 159992 - RNA, 19 nt, Homo sapiens
aagaagcgcugauugcaaa

SEQ ID NO: 159993 - RNA, 19 nt, Homo sapiens
gauggaacauacugagauu

SEQ ID NO: 159994 - RNA, 19 nt, Homo sapiens
ggugagaugguuacauuua

SEQ ID NO: 159995 - RNA, 19 nt, Homo sapiens
gaauauagucggcuaaauc

SEQ ID NO: 159996 - RNA, 19 nt, Homo sapiens
ggaggugguucguaagcua

SEQ ID NO: 159997 - RNA, 19 nt, Homo sapiens
ugagaagaaucuacaaaug

SEQ ID NO: 159998 - RNA, 19 nt, Homo sapiens
ggacaacauggguuuagua

SEQ ID NO: 159999 - RNA, 19 nt, Homo sapiens
caacuacaauagaagcauu

SEQ ID NO: 160000 - RNA, 19 nt, Homo sapiens
gaagaacuccuggcaauuc

SEQ ID NO: 160001 - RNA, 19 nt, Homo sapiens
gaacaacagaauaccauga

SEQ ID NO: 160002 - RNA, 19 nt, Homo sapiens
gagaagaaucuacaaaugu

SEQ ID NO: 160003 - RNA, 19 nt, Homo sapiens
caagaacccugccaaguac

SEQ ID NO: 160004 - RNA, 19 nt, Homo sapiens
ggcaauuccuguuguuaaa

SEQ ID NO: 160005 - RNA, 19 nt, Homo sapiens
gcaaguauucuggaaagua

SEQ ID NO: 160006 - RNA, 19 nt, Homo sapiens
gaacauggagugggacaaa

SEQ ID NO: 160007 - RNA, 19 nt, Homo sapiens
cuacaaaugugggaagaaa

SEQ ID NO: 160008 - RNA, 19 nt, Homo sapiens
agaugugguucgugaauua

SEQ ID NO: 160009 - RNA, 19 nt, Homo sapiens
ugaaagaaguagccaaaca

SEQ ID NO: 160010 - RNA, 19 nt, Homo sapiens
ugagagauccaacccuuua

SEQ ID NO: 160011 - RNA, 19 nt, Homo sapiens
ucaaguagauauagcuguu

SEQ ID NO: 160012 - RNA, 19 nt, Homo sapiens
aaacuggccaggaauauaa

SEQ ID NO: 160013 - RNA, 19 nt, Homo sapiens
ggagaaaacuggccaggaa

SEQ ID NO: 160014 - RNA, 19 nt, Homo sapiens
uagaguggcuguucaagga

SEQ ID NO: 160015 - RNA, 19 nt, Homo sapiens
caacaccuucucugaauaa

SEQ ID NO: 160016 - RNA, 19 nt, Homo sapiens
ucauaucucuugaugcaaa

SEQ ID NO: 160017 - RNA, 19 nt, Homo sapiens
gcacuaccagguuaacuuu

SEQ ID NO: 160018 - RNA, 19 nt, Homo sapiens
ggaaagauuguucagauuc

SEQ ID NO: 160019 - RNA, 19 nt, Homo sapiens
gaacaucacaucauuuagg

SEQ ID NO: 160020 - RNA, 19 nt, Homo sapiens
aaaugaagcuguagaaugc

SEQ ID NO: 160021 - RNA, 19 nt, Homo sapiens
gcugaaauaggacagaaua

SEQ ID NO: 160022 - RNA, 19 nt, Homo sapiens
gaugaaagaaguagccaaa

SEQ ID NO: 160023 - RNA, 19 nt, Homo sapiens
gaagugaucccagugaaug

SEQ ID NO: 160024 - RNA, 19 nt, Homo sapiens
aaacugaucaugagauuug

SEQ ID NO: 160025 - RNA, 19 nt, Homo sapiens
aaagcaagauguugggaaa

SEQ ID NO: 160026 - RNA, 19 nt, Homo sapiens
cugaagaccuuaagacuca

SEQ ID NO: 160027 - RNA, 19 nt, Homo sapiens
gagcugauuuacgagauaa

SEQ ID NO: 160028 - RNA, 19 nt, Homo sapiens
agaauaagccucagaaaca

SEQ ID NO: 160029 - RNA, 19 nt, Homo sapiens
ugauaggaguagaguauaa

SEQ ID NO: 160030 - RNA, 19 nt, Homo sapiens
gauaauuauucuccagguu

SEQ ID NO: 160031 - RNA, 19 nt, Homo sapiens
gaggugggcucucaucaag

SEQ ID NO: 160032 - RNA, 19 nt, Homo sapiens
uaaaugaagcuguagaaug

SEQ ID NO: 160033 - RNA, 19 nt, Homo sapiens
guucagugcuacaaaauua

SEQ ID NO: 160034 - RNA, 19 nt, Homo sapiens
ccaacaccuucucugaaua

SEQ ID NO: 160035 - RNA, 19 nt, Homo sapiens
gaaagguuaccgucagauu

SEQ ID NO: 160036 - RNA, 19 nt, Homo sapiens
gaguuuagcagauuuaugu

SEQ ID NO: 160037 - RNA, 19 nt, Homo sapiens
gauuauuccuuguggcauu

SEQ ID NO: 160038 - RNA, 19 nt, Homo sapiens
aaacccuccugcugaaaua

SEQ ID NO: 160039 - RNA, 19 nt, Homo sapiens
gacaaaaucugggcguuua

SEQ ID NO: 160040 - RNA, 19 nt, Homo sapiens
agaagaaucuacaaaugug

SEQ ID NO: 160041 - RNA, 19 nt, Homo sapiens
caaguacuacaccuuauuu

SEQ ID NO: 160042 - RNA, 19 nt, Homo sapiens
augaagagcugucaguuug

SEQ ID NO: 160043 - RNA, 19 nt, Homo sapiens
cguuagagcugauuuacga

SEQ ID NO: 160044 - RNA, 19 nt, Homo sapiens
gcauuuauaucugcuagug

SEQ ID NO: 160045 - RNA, 19 nt, Homo sapiens
caaagccagugcuaggaaa

SEQ ID NO: 160046 - RNA, 19 nt, Homo sapiens
gcagagaagcuaauucaag

SEQ ID NO: 160047 - RNA, 19 nt, Homo sapiens
acagagaccugcccaucaa

SEQ ID NO: 160048 - RNA, 19 nt, Homo sapiens
gaggauucuucauauguga

SEQ ID NO: 160049 - RNA, 19 nt, Homo sapiens
uggaagauguugcaauguu

SEQ ID NO: 160050 - RNA, 19 nt, Homo sapiens
ggaguucccauuagacuug

SEQ ID NO: 160051 - RNA, 19 nt, Homo sapiens
gaagaaagacggaaaagga

SEQ ID NO: 160052 - RNA, 19 nt, Homo sapiens
ucaaagugcauuagagaaa

SEQ ID NO: 160053 - RNA, 19 nt, Homo sapiens
aaaggaagauguagaugca

SEQ ID NO: 160054 - RNA, 19 nt, Homo sapiens
ggacacaauugauuucuua

SEQ ID NO: 160055 - RNA, 19 nt, Homo sapiens
agaaugaacuggagaauuu

SEQ ID NO: 160056 - RNA, 19 nt, Homo sapiens
ggagaucgcugcucuuuag

SEQ ID NO: 160057 - RNA, 19 nt, Homo sapiens
ggugaaguuuccuuaauua

SEQ ID NO: 160058 - RNA, 19 nt, Homo sapiens
aaacacaacccaagaaaua

SEQ ID NO: 160059 - RNA, 19 nt, Homo sapiens
ggaacaagaucuuuaucaa

SEQ ID NO: 160060 - RNA, 19 nt, Homo sapiens
gcuagccucugcuuacuua

SEQ ID NO: 160061 - RNA, 19 nt, Homo sapiens
gcaaagagccaacccagaa

SEQ ID NO: 160062 - RNA, 19 nt, Homo sapiens
gcaaauauaacacgucaaa

SEQ ID NO: 160063 - RNA, 19 nt, Homo sapiens
aaacugaagucucauauuc

SEQ ID NO: 160064 - RNA, 19 nt, Homo sapiens
gaacaaaggaagaauuaug

SEQ ID NO: 160065 - RNA, 19 nt, Homo sapiens
gauugcaacuccuuguaua

SEQ ID NO: 160066 - RNA, 19 nt, Homo sapiens
ugaaugaacuguaaaguac

SEQ ID NO: 160067 - RNA, 19 nt, Homo sapiens
gaacucauccacagacuga

SEQ ID NO: 160068 - RNA, 19 nt, Homo sapiens
gcacaggauuugcuucuag

SEQ ID NO: 160069 - RNA, 19 nt, Homo sapiens
gggaggaacuuggaugaaa

SEQ ID NO: 160070 - RNA, 19 nt, Homo sapiens
gaagaaacaccugagauga

SEQ ID NO: 160071 - RNA, 19 nt, Homo sapiens
gaaggaagcagucacuaau

SEQ ID NO: 160072 - RNA, 19 nt, Homo sapiens
gugaugagguuaaggcaaa

SEQ ID NO: 160073 - RNA, 19 nt, Homo sapiens
gcuggaaagucugcaauaa

SEQ ID NO: 160074 - RNA, 19 nt, Homo sapiens
aaagauaccuaaccuucaa

SEQ ID NO: 160075 - RNA, 19 nt, Homo sapiens
ugacagagaugugcaaauc

SEQ ID NO: 160076 - RNA, 19 nt, Homo sapiens
ggaagaaacaccugagaug

SEQ ID NO: 160077 - RNA, 19 nt, Homo sapiens
ggucauauuucuaaucauc

SEQ ID NO: 160078 - RNA, 19 nt, Homo sapiens
gaggucaugucuucucaaa

SEQ ID NO: 160079 - RNA, 19 nt, Homo sapiens
cauacucaauggaagaaua

SEQ ID NO: 160080 - RNA, 19 nt, Homo sapiens
gaaguuuccuuaauuagac

SEQ ID NO: 160081 - RNA, 19 nt, Homo sapiens
gcugugagccugauugauu

SEQ ID NO: 160082 - RNA, 19 nt, Homo sapiens
gaacgugccaguuaucaau

SEQ ID NO: 160083 - RNA, 19 nt, Homo sapiens
ucaaaggucccagcaaaua

SEQ ID NO: 160084 - RNA, 19 nt, Homo sapiens
caagaaauaugccaaaucc

SEQ ID NO: 160085 - RNA, 19 nt, Homo sapiens
ccacagagcauuccagugu

SEQ ID NO: 160086 - RNA, 19 nt, Homo sapiens
caacuuuucucucucaaua

SEQ ID NO: 160087 - RNA, 19 nt, Homo sapiens
ugucaaaggucccagcaaa

SEQ ID NO: 160088 - RNA, 19 nt, Homo sapiens
aggaagcagucacuaauuu

SEQ ID NO: 160089 - RNA, 19 nt, Homo sapiens
aggcaaaccuaauuaguga

SEQ ID NO: 160090 - RNA, 19 nt, Homo sapiens
gaaagauaccuaaccuuca

SEQ ID NO: 160091 - RNA, 19 nt, Homo sapiens
caccauauguuccacgauu

SEQ ID NO: 160092 - RNA, 19 nt, Homo sapiens
gaaagauuccacauagaga

SEQ ID NO: 160093 - RNA, 19 nt, Homo sapiens
ugucaaguauuucugguaa

SEQ ID NO: 160094 - RNA, 19 nt, Homo sapiens
ugaauaaggacacaauuga

SEQ ID NO: 160095 - RNA, 19 nt, Homo sapiens
uaccuaaccuucaacaaau

SEQ ID NO: 160096 - RNA, 19 nt, Homo sapiens
gcgagagucuauagccaaa

SEQ ID NO: 160097 - RNA, 19 nt, Homo sapiens
gauccaccuuauacucaua

SEQ ID NO: 160098 - RNA, 19 nt, Homo sapiens
caauggaacaagaucuuua

SEQ ID NO: 160099 - RNA, 19 nt, Homo sapiens
gaacaagccagaucuucau

SEQ ID NO: 160100 - RNA, 19 nt, Homo sapiens
gagccugauugauuuagaa

SEQ ID NO: 160101 - RNA, 19 nt, Homo sapiens
ugucauggcucuguugauu

SEQ ID NO: 160102 - RNA, 19 nt, Homo sapiens
gaauauggugucugucauu

SEQ ID NO: 160103 - RNA, 19 nt, Homo sapiens
ggaggaacuuggaugaaag

SEQ ID NO: 160104 - RNA, 19 nt, Homo sapiens
gagagucuauagccaaauc

SEQ ID NO: 160105 - RNA, 19 nt, Homo sapiens
caagaaagguaaaaggaaa

SEQ ID NO: 160106 - RNA, 19 nt, Homo sapiens
ccuuggacaugcaaauaua

SEQ ID NO: 160107 - RNA, 19 nt, Homo sapiens
gagccacaauggaacaaga

SEQ ID NO: 160108 - RNA, 19 nt, Homo sapiens
ggaauguacccaucucaga

SEQ ID NO: 160109 - RNA, 19 nt, Homo sapiens
ggugugcauuacaguauuu

SEQ ID NO: 160110 - RNA, 19 nt, Homo sapiens
ggaagcagucacuaauuug

SEQ ID NO: 160111 - RNA, 19 nt, Homo sapiens
gauggaguauggcccaaga

SEQ ID NO: 160112 - RNA, 19 nt, Homo sapiens
gaacaagaucuuuaucaac

SEQ ID NO: 160113 - RNA, 19 nt, Homo sapiens
gaacggcagcuguggaugu

SEQ ID NO: 160114 - RNA, 19 nt, Homo sapiens
agaaacaccugagaugaug

SEQ ID NO: 160115 - RNA, 19 nt, Homo sapiens
guuaaggcaaaccuaauua

SEQ ID NO: 160116 - RNA, 19 nt, Homo sapiens
gauggaauaaggaaauuga

SEQ ID NO: 160117 - RNA, 19 nt, Homo sapiens
caaaggaaguagucugcau

SEQ ID NO: 160118 - RNA, 19 nt, Homo sapiens
ggucaugucuucucaaaau

SEQ ID NO: 160119 - RNA, 19 nt, Homo sapiens
gugaagacgugguuacagu

SEQ ID NO: 160120 - RNA, 19 nt, Homo sapiens
gaaagaugcuaugaucacu

SEQ ID NO: 160121 - RNA, 19 nt, Homo sapiens
ugagucagcuggaaagucu

SEQ ID NO: 160122 - RNA, 19 nt, Homo sapiens
cgagaacacacaagugaaa

SEQ ID NO: 160123 - RNA, 19 nt, Homo sapiens
auaaaucuauggagcauuc

SEQ ID NO: 160124 - RNA, 19 nt, Homo sapiens
ggacaugcaaauauaaauc

SEQ ID NO: 160125 - RNA, 19 nt, Homo sapiens
guuauucacugcaacaaag

SEQ ID NO: 160126 - RNA, 19 nt, Homo sapiens
uggaggaagugcaagauga

SEQ ID NO: 160127 - RNA, 19 nt, Homo sapiens
caagugaaagacacaauga

SEQ ID NO: 160128 - RNA, 19 nt, Homo sapiens
caaugcagacccuaguaua

SEQ ID NO: 160129 - RNA, 19 nt, Homo sapiens
gcaacuccuuguauagcuu

SEQ ID NO: 160130 - RNA, 19 nt, Homo sapiens
aaaggucccagcaaauaua

SEQ ID NO: 160131 - RNA, 19 nt, Homo sapiens
uagcaacauuuacacaaga

SEQ ID NO: 160132 - RNA, 19 nt, Homo sapiens
guagcaacauuuacacaag

SEQ ID NO: 160133 - RNA, 19 nt, Homo sapiens
gccaagcugugaugcauuc

SEQ ID NO: 160134 - RNA, 19 nt, Homo sapiens
gugaaagauuccacauaga

SEQ ID NO: 160135 - RNA, 19 nt, Homo sapiens
uuaagucucuucucugaca

SEQ ID NO: 160136 - RNA, 19 nt, Homo sapiens
ugauagugguggaguuauu

SEQ ID NO: 160137 - RNA, 19 nt, Homo sapiens
gcuucuaggcccauuauuu

SEQ ID NO: 160138 - RNA, 19 nt, Homo sapiens
ugaaggaagcagucacuaa

SEQ ID NO: 160139 - RNA, 19 nt, Homo sapiens
gaaauuaugaaccacucaa

SEQ ID NO: 160140 - RNA, 19 nt, Homo sapiens
gaauaaggacacaauugau

SEQ ID NO: 160141 - RNA, 19 nt, Homo sapiens
gcaaaucuuaaaccacauu

SEQ ID NO: 160142 - RNA, 19 nt, Homo sapiens
gaugauggcagcccgcauu

SEQ ID NO: 160143 - RNA, 19 nt, Homo sapiens
ccagguggauguuagaagu

SEQ ID NO: 160144 - RNA, 19 nt, Homo sapiens
gaugauggaauaaggaaau

SEQ ID NO: 160145 - RNA, 19 nt, Homo sapiens
gaagcagucacuaauuugu

SEQ ID NO: 160146 - RNA, 19 nt, Homo sapiens
ggaggaagugcaagaugaa

SEQ ID NO: 160147 - RNA, 19 nt, Homo sapiens
caaaggucccagcaaauau

SEQ ID NO: 160148 - RNA, 19 nt, Homo sapiens
ugugagaccuccagaaucu

SEQ ID NO: 160149 - RNA, 19 nt, Homo sapiens
gaaagugcaaucagugaca

SEQ ID NO: 160150 - RNA, 19 nt, Homo sapiens
gaagauauugaaagugcaa

SEQ ID NO: 160151 - RNA, 19 nt, Homo sapiens
ucggaaagaugcuaugauc

SEQ ID NO: 160152 - RNA, 19 nt, Homo sapiens
uggaaagucugcaauaaac

SEQ ID NO: 160153 - RNA, 19 nt, Homo sapiens
ggaaguagucugcauuggu

SEQ ID NO: 160154 - RNA, 19 nt, Homo sapiens
gaagagaccugccagauua

SEQ ID NO: 160155 - RNA, 19 nt, Homo sapiens
gaaauagacugugaaguaa

SEQ ID NO: 160156 - RNA, 19 nt, Homo sapiens
caacugaucucuucucuga

SEQ ID NO: 160157 - RNA, 19 nt, Homo sapiens
ccaccaagauuucaugaua

SEQ ID NO: 160158 - RNA, 19 nt, Homo sapiens
gaaagaaccugugccaaug

SEQ ID NO: 160159 - RNA, 19 nt, Homo sapiens
ggccaaauaugaugcaaua

SEQ ID NO: 160160 - RNA, 19 nt, Homo sapiens
ugaaauagacugugaagua

SEQ ID NO: 160161 - RNA, 19 nt, Homo sapiens
gaucggaacuccaacaaga

SEQ ID NO: 160162 - RNA, 19 nt, Homo sapiens
gcaaagguauccugaacaa

SEQ ID NO: 160163 - RNA, 19 nt, Homo sapiens
gcaagaaacagcagaauug

SEQ ID NO: 160164 - RNA, 19 nt, Homo sapiens
aaacggagcuacagauuau

SEQ ID NO: 160165 - RNA, 19 nt, Homo sapiens
ugucaaaggucaacaauga

SEQ ID NO: 160166 - RNA, 19 nt, Homo sapiens
gcacagauuuacuccacua

SEQ ID NO: 160167 - RNA, 19 nt, Homo sapiens
uaucagaccucuucauguu

SEQ ID NO: 160168 - RNA, 19 nt, Homo sapiens
ccacacagcauucuuguaa

SEQ ID NO: 160169 - RNA, 19 nt, Homo sapiens
gcaggaacaagaagacuua

SEQ ID NO: 160170 - RNA, 19 nt, Homo sapiens
gaacuggaagguacuuuaa

SEQ ID NO: 160171 - RNA, 19 nt, Homo sapiens
gagaaggaagauacuauua

SEQ ID NO: 160172 - RNA, 19 nt, Homo sapiens
ggaaauuaguucaaugcaa

SEQ ID NO: 160173 - RNA, 19 nt, Homo sapiens
ugaauuaacuagucaggaa

SEQ ID NO: 160174 - RNA, 19 nt, Homo sapiens
aaucgcagaucuccacuua

SEQ ID NO: 160175 - RNA, 19 nt, Homo sapiens
ggagguccgugaaauauuc

SEQ ID NO: 160176 - RNA, 19 nt, Homo sapiens
ucaguguguuugcuaauua

SEQ ID NO: 160177 - RNA, 19 nt, Homo sapiens
gaugaaaucuuccugaaaa

SEQ ID NO: 160178 - RNA, 19 nt, Homo sapiens
cagaauggauuggaaguuu

SEQ ID NO: 160179 - RNA, 19 nt, Homo sapiens
ggaaagauuugggauuuag

SEQ ID NO: 160180 - RNA, 19 nt, Homo sapiens
ccaggaaucuccagcaaga

SEQ ID NO: 160181 - RNA, 19 nt, Homo sapiens
gaagauaaggccaaauaug

SEQ ID NO: 160182 - RNA, 19 nt, Homo sapiens
ccagugagguucuuaaagu

SEQ ID NO: 160183 - RNA, 19 nt, Homo sapiens
ggaacaagaagacuuagaa

SEQ ID NO: 160184 - RNA, 19 nt, Homo sapiens
gaaaagauccaucaacaaa

SEQ ID NO: 160185 - RNA, 19 nt, Homo sapiens
caaaugaaacugauggaaa

SEQ ID NO: 160186 - RNA, 19 nt, Homo sapiens
ugagugauauugaccauga

SEQ ID NO: 160187 - RNA, 19 nt, Homo sapiens
ucagaccucuucauguuaa

SEQ ID NO: 160188 - RNA, 19 nt, Homo sapiens
caaauuggcuaaagugcau

SEQ ID NO: 160189 - RNA, 19 nt, Homo sapiens
caagugagguucaggaucu

SEQ ID NO: 160190 - RNA, 19 nt, Homo sapiens
gaugauagccagugagguu

SEQ ID NO: 160191 - RNA, 19 nt, Homo sapiens
caaauuggauucuccugau

SEQ ID NO: 160192 - RNA, 19 nt, Homo sapiens
gcaacguagugauuacaaa

SEQ ID NO: 160193 - RNA, 19 nt, Homo sapiens
caaguccuguugcagauuu

SEQ ID NO: 160194 - RNA, 19 nt, Homo sapiens
ucagaagcaugaagaauuc

SEQ ID NO: 160195 - RNA, 19 nt, Homo sapiens
gguuugagauuccuguaaa

SEQ ID NO: 160196 - RNA, 19 nt, Homo sapiens
aagaagauaugaucgaaug

SEQ ID NO: 160197 - RNA, 19 nt, Homo sapiens
ccugaucccuuuaaacuga

SEQ ID NO: 160198 - RNA, 19 nt, Homo sapiens
ggagaauacuaaucugcaa

SEQ ID NO: 160199 - RNA, 19 nt, Homo sapiens
aaacugaccuaguggacaa

SEQ ID NO: 160200 - RNA, 19 nt, Homo sapiens
ggaggagaguguagaguca

SEQ ID NO: 160201 - RNA, 19 nt, Homo sapiens
auaaagauauggacggauu

SEQ ID NO: 160202 - RNA, 19 nt, Homo sapiens
ggauuucugucuggugaua

SEQ ID NO: 160203 - RNA, 19 nt, Homo sapiens
agaggaagauccauuuaau

SEQ ID NO: 160204 - RNA, 19 nt, Homo sapiens
gacuacagcuguuacugaa

SEQ ID NO: 160205 - RNA, 19 nt, Homo sapiens
uaaacggagcuacagauua

SEQ ID NO: 160206 - RNA, 19 nt, Homo sapiens
ucaaggaagucagaaagaa

SEQ ID NO: 160207 - RNA, 19 nt, Homo sapiens
ggaacuagauacucuuaac

SEQ ID NO: 160208 - RNA, 19 nt, Homo sapiens
guauugaucuguguuaauc

SEQ ID NO: 160209 - RNA, 19 nt, Homo sapiens
uggacaagcugaauuugaa

SEQ ID NO: 160210 - RNA, 19 nt, Homo sapiens
ccucaugugugaaauaaau

SEQ ID NO: 160211 - RNA, 19 nt, Homo sapiens
gcagaggcuugcccgacua

SEQ ID NO: 160212 - RNA, 19 nt, Homo sapiens
ucugaaagcugaauuaacu

SEQ ID NO: 160213 - RNA, 19 nt, Homo sapiens
ggagaaggaagauacuauu

SEQ ID NO: 160214 - RNA, 19 nt, Homo sapiens
gaaaagggaugcuguaggu

SEQ ID NO: 160215 - RNA, 19 nt, Homo sapiens
gaggguaagggaaagaaua

SEQ ID NO: 160216 - RNA, 19 nt, Homo sapiens
ugagauaucagaagcauga

SEQ ID NO: 160217 - RNA, 19 nt, Homo sapiens
uaaaucagcaggaacaaga

SEQ ID NO: 160218 - RNA, 19 nt, Homo sapiens
gcuacuaccacuaccaaua

SEQ ID NO: 160219 - RNA, 19 nt, Homo sapiens
ugaaauaguugaccuacag

SEQ ID NO: 160220 - RNA, 19 nt, Homo sapiens
aagauaaggccaaauauga

SEQ ID NO: 160221 - RNA, 19 nt, Homo sapiens
gaaggcucauuuacuugaa

SEQ ID NO: 160222 - RNA, 19 nt, Homo sapiens
ggagaaaauuuaucaccua

SEQ ID NO: 160223 - RNA, 19 nt, Homo sapiens
ugggauacauuuacuguga

SEQ ID NO: 160224 - RNA, 19 nt, Homo sapiens
ggauauccuuggaagaguu

SEQ ID NO: 160225 - RNA, 19 nt, Homo sapiens
ugaagaagauaugaucgaa

SEQ ID NO: 160226 - RNA, 19 nt, Homo sapiens
caaagguucagauccauuu

SEQ ID NO: 160227 - RNA, 19 nt, Homo sapiens
aaucagggcuuccagacuu

SEQ ID NO: 160228 - RNA, 19 nt, Homo sapiens
cuuaaucagucagaaguua

SEQ ID NO: 160229 - RNA, 19 nt, Homo sapiens
uaaguuaccuguggauauc

SEQ ID NO: 160230 - RNA, 19 nt, Homo sapiens
guucuuaguggguuaauuu

SEQ ID NO: 160231 - RNA, 19 nt, Homo sapiens
gugggaauccuguauauga

SEQ ID NO: 160232 - RNA, 19 nt, Homo sapiens
gcuucugccuucuggaaua

SEQ ID NO: 160233 - RNA, 19 nt, Homo sapiens
acaaauucaccuucacuua

SEQ ID NO: 160234 - RNA, 19 nt, Homo sapiens
ugaaacugauggaaaugaa

SEQ ID NO: 160235 - RNA, 19 nt, Homo sapiens
caaauucaccuucacuuag

SEQ ID NO: 160236 - RNA, 19 nt, Homo sapiens
cuacuaccacuaccaauaa

SEQ ID NO: 160237 - RNA, 19 nt, Homo sapiens
ccaaagaucggaacuccaa

SEQ ID NO: 160238 - RNA, 19 nt, Homo sapiens
aaacaucggucaaaaguga

SEQ ID NO: 160239 - RNA, 19 nt, Homo sapiens
cagccaaccuuaaugaaca

SEQ ID NO: 160240 - RNA, 19 nt, Homo sapiens
cagcagcaccuacaagauu

SEQ ID NO: 160241 - RNA, 19 nt, Homo sapiens
gaaguucaaagggagaaua

SEQ ID NO: 160242 - RNA, 19 nt, Homo sapiens
ggaagauacuauuaaacag

SEQ ID NO: 160243 - RNA, 19 nt, Homo sapiens
gcuauuaaggaacuagaua

SEQ ID NO: 160244 - RNA, 19 nt, Homo sapiens
gaaccauuauagccucaga

SEQ ID NO: 160245 - RNA, 19 nt, Homo sapiens
uuacaucgguagaaacguu

SEQ ID NO: 160246 - RNA, 19 nt, Homo sapiens
aaacagccaaccuuaauga

SEQ ID NO: 160247 - RNA, 19 nt, Homo sapiens
gaaacagccaaccuuaaug

SEQ ID NO: 160248 - RNA, 19 nt, Homo sapiens
uugccuagccuauaaauaa

SEQ ID NO: 160249 - RNA, 19 nt, Homo sapiens
caaccuuaaugaacauguu

SEQ ID NO: 160250 - RNA, 19 nt, Homo sapiens
caagugggaauccuguaua

SEQ ID NO: 160251 - RNA, 19 nt, Homo sapiens
caaggaagucagaaagaaa

SEQ ID NO: 160252 - RNA, 19 nt, Homo sapiens
ugacagagaugaguuugca

SEQ ID NO: 160253 - RNA, 19 nt, Homo sapiens
gauaucagaagcaugaaga

SEQ ID NO: 160254 - RNA, 19 nt, Homo sapiens
gacacuacaugaugacuca

SEQ ID NO: 160255 - RNA, 19 nt, Homo sapiens
ugacucaaggccaauaaua

SEQ ID NO: 160256 - RNA, 19 nt, Homo sapiens
gacucaaggccaauaauaa

SEQ ID NO: 160257 - RNA, 19 nt, Homo sapiens
acacguaaccuaugucaga

SEQ ID NO: 160258 - RNA, 19 nt, Homo sapiens
gggaagacgcccauugaga

SEQ ID NO: 160259 - RNA, 19 nt, Homo sapiens
guacugccgucucaagaag

SEQ ID NO: 160260 - RNA, 19 nt, Homo sapiens
gacauuuccuaccugcaaa

SEQ ID NO: 160261 - RNA, 19 nt, Homo sapiens
ggccaauaauaaagacauu

SEQ ID NO: 160262 - RNA, 19 nt, Homo sapiens
gucagacacuacaugauga

SEQ ID NO: 160263 - RNA, 19 nt, Homo sapiens
gaagacgcccauugagaca

SEQ ID NO: 160264 - RNA, 19 nt, Homo sapiens
acucaaggccaauaauaaa

SEQ ID NO: 160265 - RNA, 19 nt, Homo sapiens
ucaaggccaauaauaaaga

SEQ ID NO: 160266 - RNA, 19 nt, Homo sapiens
uggcuucccuggcaugaug

SEQ ID NO: 160267 - RNA, 19 nt, Homo sapiens
uugagacacugaucagaga

SEQ ID NO: 160268 - RNA, 19 nt, Homo sapiens
gaugacucaaggccaauaa

SEQ ID NO: 160269 - RNA, 19 nt, Homo sapiens
auaaagacauuuccuaccu

SEQ ID NO: 160270 - RNA, 19 nt, Homo sapiens
uugagagccugcaggagaa

SEQ ID NO: 160271 - RNA, 19 nt, Homo sapiens
ucaaggccaucgcgcucuu

SEQ ID NO: 160272 - RNA, 19 nt, Homo sapiens
agacauuuccuaccugcaa

SEQ ID NO: 160273 - RNA, 19 nt, Homo sapiens
caaggccaauaauaaagac

SEQ ID NO: 160274 - RNA, 19 nt, Homo sapiens
ucucccagcuguucuucau

SEQ ID NO: 160275 - RNA, 19 nt, Homo sapiens
ccucuggacacguaaccua

SEQ ID NO: 160276 - RNA, 19 nt, Homo sapiens
acugugaaauguuugucuu

SEQ ID NO: 160277 - RNA, 19 nt, Homo sapiens
cagccgguguccgaacuga

SEQ ID NO: 160278 - RNA, 19 nt, Homo sapiens
ugccaguacugccgucuca

SEQ ID NO: 160279 - RNA, 19 nt, Homo sapiens
cuggacacguaaccuaugu

SEQ ID NO: 160280 - RNA, 19 nt, Homo sapiens
uggcuucucuccucagacu

SEQ ID NO: 160281 - RNA, 19 nt, Homo sapiens
uggaagagaucacagguua

SEQ ID NO: 160282 - RNA, 19 nt, Homo sapiens
gaacagcaauggugucagu

SEQ ID NO: 160283 - RNA, 19 nt, Homo sapiens
gagaauggguguuguaugg

SEQ ID NO: 160284 - RNA, 19 nt, Homo sapiens
gcucaucgcucacaaccaa

SEQ ID NO: 160285 - RNA, 19 nt, Homo sapiens
ggucaaauguuggaugauu

SEQ ID NO: 160286 - RNA, 19 nt, Homo sapiens
ucacagagaucuugaaagg

SEQ ID NO: 160287 - RNA, 19 nt, Homo sapiens
ggagagaguucugaggauu

SEQ ID NO: 160288 - RNA, 19 nt, Homo sapiens
ugugggagcugaugacuuu

SEQ ID NO: 160289 - RNA, 19 nt, Homo sapiens
gaacugguguaugcagauu

SEQ ID NO: 160290 - RNA, 19 nt, Homo sapiens
gcaguuaccagugccaaua

SEQ ID NO: 160291 - RNA, 19 nt, Homo sapiens
agagugauguguggaguua

SEQ ID NO: 160292 - RNA, 19 nt, Homo sapiens
uagggaagcuggccugaga

SEQ ID NO: 160293 - RNA, 19 nt, Homo sapiens
gggaguuggugucugaauu

SEQ ID NO: 160294 - RNA, 19 nt, Homo sapiens
ggagacccgcugaacaaua

SEQ ID NO: 160295 - RNA, 19 nt, Homo sapiens
cuaagggagugucuaagaa

SEQ ID NO: 160296 - RNA, 19 nt, Homo sapiens
gcaaggugcccaucaagug

SEQ ID NO: 160297 - RNA, 19 nt, Homo sapiens
gagacccgcugaacaauac

SEQ ID NO: 160298 - RNA, 19 nt, Homo sapiens
ggaacgugcuggucaagag

SEQ ID NO: 160299 - RNA, 19 nt, Homo sapiens
ggacgaauucugcacaaug

SEQ ID NO: 160300 - RNA, 19 nt, Homo sapiens
gggagugucuaagaacaaa

SEQ ID NO: 160301 - RNA, 19 nt, Homo sapiens
gaacaaaagcgacccauuc

SEQ ID NO: 160302 - RNA, 19 nt, Homo sapiens
gaugauugacucugaaugu

SEQ ID NO: 160303 - RNA, 19 nt, Homo sapiens
ucaccuaccugcccaccaa

SEQ ID NO: 160304 - RNA, 19 nt, Homo sapiens
gacgaauucugcacaaugg

SEQ ID NO: 160305 - RNA, 19 nt, Homo sapiens
ugagcuaccuggaggaugu

SEQ ID NO: 160306 - RNA, 19 nt, Homo sapiens
cuacaacacagacacguuu

SEQ ID NO: 160307 - RNA, 19 nt, Homo sapiens
ggacaccuacggcagagaa

SEQ ID NO: 160308 - RNA, 19 nt, Homo sapiens
agacgaagcauacgugaug

SEQ ID NO: 160309 - RNA, 19 nt, Homo sapiens
cugaggcccugcccaauga

SEQ ID NO: 160310 - RNA, 19 nt, Homo sapiens
ggaguuauggugugacugu

SEQ ID NO: 160311 - RNA, 19 nt, Homo sapiens
agacggagcugaggaaggu

SEQ ID NO: 160312 - RNA, 19 nt, Homo sapiens
cggcagagaacccagagua

SEQ ID NO: 160313 - RNA, 19 nt, Homo sapiens
ggaguuggugucugaauuc

SEQ ID NO: 160314 - RNA, 19 nt, Homo sapiens
guuggaugauugacucuga

SEQ ID NO: 160315 - RNA, 19 nt, Homo sapiens
gugccaauauccaggaguu

SEQ ID NO: 160316 - RNA, 19 nt, Homo sapiens
gucaaauguuggaugauug

SEQ ID NO: 160317 - RNA, 19 nt, Homo sapiens
ggucaagagucccaaccau

SEQ ID NO: 160318 - RNA, 19 nt, Homo sapiens
cagaagauccggaaguaca

SEQ ID NO: 160319 - RNA, 19 nt, Homo sapiens
ggaggaaugccgaguacug

SEQ ID NO: 160320 - RNA, 19 nt, Homo sapiens
acacccacuuuguccauuu

SEQ ID NO: 160321 - RNA, 19 nt, Homo sapiens
cagcccagcuuggcccuuu

SEQ ID NO: 160322 - RNA, 19 nt, Homo sapiens
gagagaguucugaggauug

SEQ ID NO: 160323 - RNA, 19 nt, Homo sapiens
gggagagaguucugaggau

SEQ ID NO: 160324 - RNA, 19 nt, Homo sapiens
uauccaggcuuuguacaga

SEQ ID NO: 160325 - RNA, 19 nt, Homo sapiens
gguggaugcugaggaguau

SEQ ID NO: 160326 - RNA, 19 nt, Homo sapiens
gcccuauggcugccucuua

SEQ ID NO: 160327 - RNA, 19 nt, Homo sapiens
ucgacaaccucuauuacug

SEQ ID NO: 160328 - RNA, 19 nt, Homo sapiens
ucaagagucccaaccaugu

SEQ ID NO: 160329 - RNA, 19 nt, Homo sapiens
ccaaagccaacaaagaaau

SEQ ID NO: 160330 - RNA, 19 nt, Homo sapiens
gcagaugcggauccugaaa

SEQ ID NO: 160331 - RNA, 19 nt, Homo sapiens
gcuauggucugggcaugga

SEQ ID NO: 160332 - RNA, 19 nt, Homo sapiens
cagcaauggugucaguauc

SEQ ID NO: 160333 - RNA, 19 nt, Homo sapiens
gaaagggccaagacucucu

SEQ ID NO: 160334 - RNA, 19 nt, Homo sapiens
agcagaagauccggaagua

SEQ ID NO: 160335 - RNA, 19 nt, Homo sapiens
uuccagaaccugcaaguaa

SEQ ID NO: 160336 - RNA, 19 nt, Homo sapiens
gaacagcacuggggagucu

SEQ ID NO: 160337 - RNA, 19 nt, Homo sapiens
ugagacugauggcuacguu

SEQ ID NO: 160338 - RNA, 19 nt, Homo sapiens
guguggaccuggaugacaa

SEQ ID NO: 160339 - RNA, 19 nt, Homo sapiens
ccuguucuccgauguguaa

SEQ ID NO: 160340 - RNA, 19 nt, Homo sapiens
cuucgaagccucacagaga

SEQ ID NO: 160341 - RNA, 19 nt, Homo sapiens
gcaauggugucaguaucca

SEQ ID NO: 160342 - RNA, 19 nt, Homo sapiens
ccuaagggagugucuaaga

SEQ ID NO: 160343 - RNA, 19 nt, Homo sapiens
caccgcagcucaucuacca

SEQ ID NO: 160344 - RNA, 19 nt, Homo sapiens
cugcugaacugguguaugc

SEQ ID NO: 160345 - RNA, 19 nt, Homo sapiens
gcgaggcacccagcucuuu

SEQ ID NO: 160346 - RNA, 19 nt, Homo sapiens
ggagaauggguguuguaug

SEQ ID NO: 160347 - RNA, 19 nt, Homo sapiens
uccagaaccugcaaguaau

SEQ ID NO: 160348 - RNA, 19 nt, Homo sapiens
ggacccagccuccaacacu

SEQ ID NO: 160349 - RNA, 19 nt, Homo sapiens
gugcuuuucuguuuaguuu

SEQ ID NO: 160350 - RNA, 19 nt, Homo sapiens
caaaagcgacccauucaga

SEQ ID NO: 160351 - RNA, 19 nt, Homo sapiens
ggcuggcuccgauguauuu

SEQ ID NO: 160352 - RNA, 19 nt, Homo sapiens
gcuuuguggucauccagaa

SEQ ID NO: 160353 - RNA, 19 nt, Homo sapiens
aaccugaccucuccuacau

SEQ ID NO: 160354 - RNA, 19 nt, Homo sapiens
gagucuuuguggauucuga

SEQ ID NO: 160355 - RNA, 19 nt, Homo sapiens
gccagguggugcagggaaa

SEQ ID NO: 160356 - RNA, 19 nt, Homo sapiens
cgagaggugagggcaguua

SEQ ID NO: 160357 - RNA, 19 nt, Homo sapiens
ugaucauggucaaauguug

SEQ ID NO: 160358 - RNA, 19 nt, Homo sapiens
agaugcggauccugaaaga

SEQ ID NO: 160359 - RNA, 19 nt, Homo sapiens
ucacacugauagacaccaa

SEQ ID NO: 160360 - RNA, 19 nt, Homo sapiens
gaaaggaggggucuugauc

SEQ ID NO: 160361 - RNA, 19 nt, Homo sapiens
gauccuggguacugaaagc

SEQ ID NO: 160362 - RNA, 19 nt, Homo sapiens
gaacgugcuggucaagagu

SEQ ID NO: 160363 - RNA, 19 nt, Homo sapiens
caaagccaacaaagaaauc

SEQ ID NO: 160364 - RNA, 19 nt, Homo sapiens
ggccagaggacgagugugu

SEQ ID NO: 160365 - RNA, 19 nt, Homo sapiens
agaauggggucgucaaaga

SEQ ID NO: 160366 - RNA, 19 nt, Homo sapiens
gcuggaggacgaugacaug

SEQ ID NO: 160367 - RNA, 19 nt, Homo sapiens
cauccagaaugaggacuug

SEQ ID NO: 160368 - RNA, 19 nt, Homo sapiens
aaucuuagacgaagcauac

SEQ ID NO: 160369 - RNA, 19 nt, Homo sapiens
gcuuggaucuggcgcuuuu

SEQ ID NO: 160370 - RNA, 19 nt, Homo sapiens
gccaauauccaggaguuug

SEQ ID NO: 160371 - RNA, 19 nt, Homo sapiens
gcucuuugaggacaacuau

SEQ ID NO: 160372 - RNA, 19 nt, Homo sapiens
ccucacagagaucuugaaa

SEQ ID NO: 160373 - RNA, 19 nt, Homo sapiens
agacugucccugaaaccua

SEQ ID NO: 160374 - RNA, 19 nt, Homo sapiens
agugauguguggaguuaug

SEQ ID NO: 160375 - RNA, 19 nt, Homo sapiens
gaggcacccagcucuuuga

SEQ ID NO: 160376 - RNA, 19 nt, Homo sapiens
agagaguucugaggauugu

SEQ ID NO: 160377 - RNA, 19 nt, Homo sapiens
cagagacugucccugaaac

SEQ ID NO: 160378 - RNA, 19 nt, Homo sapiens
aaagcgacccauucagaga

SEQ ID NO: 160379 - RNA, 19 nt, Homo sapiens
gaagaauggggucgucaaa

SEQ ID NO: 160380 - RNA, 19 nt, Homo sapiens
gcaccggcacagacaugaa

SEQ ID NO: 160381 - RNA, 19 nt, Homo sapiens
gaacuaggcucuuaugugu

SEQ ID NO: 160382 - RNA, 19 nt, Homo sapiens
ggaccgagaugcugagaua

SEQ ID NO: 160383 - RNA, 19 nt, Homo sapiens
gaucaaacauccuguguca

SEQ ID NO: 160384 - RNA, 19 nt, Homo sapiens
uuaaagaacuagccaauga

SEQ ID NO: 160385 - RNA, 19 nt, Homo sapiens
gagaaagugucaaugugua

SEQ ID NO: 160386 - RNA, 19 nt, Homo sapiens
gagcaacauugauggauuu

SEQ ID NO: 160387 - RNA, 19 nt, Homo sapiens
gcucaugccuguaaucuca

SEQ ID NO: 160388 - RNA, 19 nt, Homo sapiens
gcaaggguaugaagagaug

SEQ ID NO: 160389 - RNA, 19 nt, Homo sapiens
ggagauagcgccuaccauu

SEQ ID NO: 160390 - RNA, 19 nt, Homo sapiens
gacuagacaucaagcauaa

SEQ ID NO: 160391 - RNA, 19 nt, Homo sapiens
caacauugauggauuugug

SEQ ID NO: 160392 - RNA, 19 nt, Homo sapiens
cagcuuagccaacauagua

SEQ ID NO: 160393 - RNA, 19 nt, Homo sapiens
cuggagauaugaaggauua

SEQ ID NO: 160394 - RNA, 19 nt, Homo sapiens
gggcguaucuauauaagug

SEQ ID NO: 160395 - RNA, 19 nt, Homo sapiens
gaagaacgauaagcuuugu

SEQ ID NO: 160396 - RNA, 19 nt, Homo sapiens
gagaagaacgauaagcuuu

SEQ ID NO: 160397 - RNA, 19 nt, Homo sapiens
cagagaagcucaaugucuu

SEQ ID NO: 160398 - RNA, 19 nt, Homo sapiens
aagaggaugucaacgguua

SEQ ID NO: 160399 - RNA, 19 nt, Homo sapiens
ggauggcccuugagaguau

SEQ ID NO: 160400 - RNA, 19 nt, Homo sapiens
gaacauucgcccaaccuuu

SEQ ID NO: 160401 - RNA, 19 nt, Homo sapiens
gcacaacuccagaugaaga

SEQ ID NO: 160402 - RNA, 19 nt, Homo sapiens
ggucuacgaugggaaguuu

SEQ ID NO: 160403 - RNA, 19 nt, Homo sapiens
gaaacgugcuacucaaguc

SEQ ID NO: 160404 - RNA, 19 nt, Homo sapiens
caagauggaaguagauaaa

SEQ ID NO: 160405 - RNA, 19 nt, Homo sapiens
cuagaaagacagaagcuua

SEQ ID NO: 160406 - RNA, 19 nt, Homo sapiens
gaugauugaugagaacauu

SEQ ID NO: 160407 - RNA, 19 nt, Homo sapiens
uaccagaccugcuagagaa

SEQ ID NO: 160408 - RNA, 19 nt, Homo sapiens
ggucaucucugcagcuugu

SEQ ID NO: 160409 - RNA, 19 nt, Homo sapiens
guagccagcugugcacuuu

SEQ ID NO: 160410 - RNA, 19 nt, Homo sapiens
cacgguaucuggucauaaa

SEQ ID NO: 160411 - RNA, 19 nt, Homo sapiens
gcuugucacucaauauuug

SEQ ID NO: 160412 - RNA, 19 nt, Homo sapiens
guacccagauguucagaau

SEQ ID NO: 160413 - RNA, 19 nt, Homo sapiens
uacgggagaucacagguua

SEQ ID NO: 160414 - RNA, 19 nt, Homo sapiens
gagccaggcaucauacuaa

SEQ ID NO: 160415 - RNA, 19 nt, Homo sapiens
ggaccaugcccacauugua

SEQ ID NO: 160416 - RNA, 19 nt, Homo sapiens
gagggugaaucaaucaaga

SEQ ID NO: 160417 - RNA, 19 nt, Homo sapiens
auucagcacuuaacuauga

SEQ ID NO: 160418 - RNA, 19 nt, Homo sapiens
agaaagagguuaggaguag

SEQ ID NO: 160419 - RNA, 19 nt, Homo sapiens
gcacucagggagcauuuaa

SEQ ID NO: 160420 - RNA, 19 nt, Homo sapiens
acaagaagcuagaggaagu

SEQ ID NO: 160421 - RNA, 19 nt, Homo sapiens
ccaaugaguucaccaggau

SEQ ID NO: 160422 - RNA, 19 nt, Homo sapiens
ggucaaguguuggaugauu

SEQ ID NO: 160423 - RNA, 19 nt, Homo sapiens
ugacucagcucaccgagau

SEQ ID NO: 160424 - RNA, 19 nt, Homo sapiens
gagguuaggaguagauauu

SEQ ID NO: 160425 - RNA, 19 nt, Homo sapiens
gagcaaggguaugaagaga

SEQ ID NO: 160426 - RNA, 19 nt, Homo sapiens
gaaauacacacaccagagu

SEQ ID NO: 160427 - RNA, 19 nt, Homo sapiens
gaccaugcccacauuguaa

SEQ ID NO: 160428 - RNA, 19 nt, Homo sapiens
ugagaaggcuaacaaaguc

SEQ ID NO: 160429 - RNA, 19 nt, Homo sapiens
gaagacugccagacauuga

SEQ ID NO: 160430 - RNA, 19 nt, Homo sapiens
gcagaggaaaguguaauuu

SEQ ID NO: 160431 - RNA, 19 nt, Homo sapiens
ggaacuaggcucuuaugug

SEQ ID NO: 160432 - RNA, 19 nt, Homo sapiens
cagaugaagacuaugaaua

SEQ ID NO: 160433 - RNA, 19 nt, Homo sapiens
ggagaaagugucaaugugu

SEQ ID NO: 160434 - RNA, 19 nt, Homo sapiens
gaagagcgacuagacauca

SEQ ID NO: 160435 - RNA, 19 nt, Homo sapiens
ccuguaaucucagcacuuu

SEQ ID NO: 160436 - RNA, 19 nt, Homo sapiens
gcuauggugugacaguuug

SEQ ID NO: 160437 - RNA, 19 nt, Homo sapiens
gaucauaugcuggccauug

SEQ ID NO: 160438 - RNA, 19 nt, Homo sapiens
gacaaacacuggugcugau

SEQ ID NO: 160439 - RNA, 19 nt, Homo sapiens
cgacuagacaucaagcaua

SEQ ID NO: 160440 - RNA, 19 nt, Homo sapiens
uacauuaucucacuuaguc

SEQ ID NO: 160441 - RNA, 19 nt, Homo sapiens
gaaagagguuaggaguaga

SEQ ID NO: 160442 - RNA, 19 nt, Homo sapiens
augcacaacuucaguguuu

SEQ ID NO: 160443 - RNA, 19 nt, Homo sapiens
agaagaagaugaagaugag

SEQ ID NO: 160444 - RNA, 19 nt, Homo sapiens
ugucaacgguuaugucaug

SEQ ID NO: 160445 - RNA, 19 nt, Homo sapiens
ggccaagacuccaauuaag

SEQ ID NO: 160446 - RNA, 19 nt, Homo sapiens
cgagcaacauugauggauu

SEQ ID NO: 160447 - RNA, 19 nt, Homo sapiens
gcaguggauucgagaagug

SEQ ID NO: 160448 - RNA, 19 nt, Homo sapiens
uugaggagcuggguuauga

SEQ ID NO: 160449 - RNA, 19 nt, Homo sapiens
aagaugaggaguaugaaua

SEQ ID NO: 160450 - RNA, 19 nt, Homo sapiens
acccagauguucagaauga

SEQ ID NO: 160451 - RNA, 19 nt, Homo sapiens
gcucuuaugugugccuuug

SEQ ID NO: 160452 - RNA, 19 nt, Homo sapiens
gaaggauuacucuccauau

SEQ ID NO: 160453 - RNA, 19 nt, Homo sapiens
ccagacaauuccauucaau

SEQ ID NO: 160454 - RNA, 19 nt, Homo sapiens
ggagcuggguuaugaguac

SEQ ID NO: 160455 - RNA, 19 nt, Homo sapiens
ucaagacuguuuaggacaa

SEQ ID NO: 160456 - RNA, 19 nt, Homo sapiens
uuaaguggauggcccuuga

SEQ ID NO: 160457 - RNA, 19 nt, Homo sapiens
caucugugcuccucagugu

SEQ ID NO: 160458 - RNA, 19 nt, Homo sapiens
cuaaacuucaccuacauua

SEQ ID NO: 160459 - RNA, 19 nt, Homo sapiens
auacuaaacuucaccuaca

SEQ ID NO: 160460 - RNA, 19 nt, Homo sapiens
ugacagugauagcaggauu

SEQ ID NO: 160461 - RNA, 19 nt, Homo sapiens
gagaccagcuuagccaaca

SEQ ID NO: 160462 - RNA, 19 nt, Homo sapiens
uaucucacuuaguccuuua

SEQ ID NO: 160463 - RNA, 19 nt, Homo sapiens
gguuaggaguagauauuga

SEQ ID NO: 160464 - RNA, 19 nt, Homo sapiens
uagaaagacagaagcuuaa

SEQ ID NO: 160465 - RNA, 19 nt, Homo sapiens
guacugaagaagaagauga

SEQ ID NO: 160466 - RNA, 19 nt, Homo sapiens
gguuaugucaugccagaua

SEQ ID NO: 160467 - RNA, 19 nt, Homo sapiens
ugaaguaccagaccugcua

SEQ ID NO: 160468 - RNA, 19 nt, Homo sapiens
ugaagaagaagaugaagau

SEQ ID NO: 160469 - RNA, 19 nt, Homo sapiens
gaggccaagacuccaauua

SEQ ID NO: 160470 - RNA, 19 nt, Homo sapiens
acaauggcuuugacaguga

SEQ ID NO: 160471 - RNA, 19 nt, Homo sapiens
aaacuucaccuacauuauc

SEQ ID NO: 160472 - RNA, 19 nt, Homo sapiens
gcugugcacuuucuucucu

SEQ ID NO: 160473 - RNA, 19 nt, Homo sapiens
aggcacaacuccagaugaa

SEQ ID NO: 160474 - RNA, 19 nt, Homo sapiens
gaagaugaggaguaugaau

SEQ ID NO: 160475 - RNA, 19 nt, Homo sapiens
aacauucgcccaaccuuua

SEQ ID NO: 160476 - RNA, 19 nt, Homo sapiens
gagcuauggugugacaguu

SEQ ID NO: 160477 - RNA, 19 nt, Homo sapiens
gugcugggcguaucuauau

SEQ ID NO: 160478 - RNA, 19 nt, Homo sapiens
aaacaauucugugacauac

SEQ ID NO: 160479 - RNA, 19 nt, Homo sapiens
ccaggagucugcaguuucu

SEQ ID NO: 160480 - RNA, 19 nt, Homo sapiens
gaagcuagaggaaguagag

SEQ ID NO: 160481 - RNA, 19 nt, Homo sapiens
gaggaaagaugccaauuaa

SEQ ID NO: 160482 - RNA, 19 nt, Homo sapiens
gcaggaaacaucuauauua

SEQ ID NO: 160483 - RNA, 19 nt, Homo sapiens
gaucacaacugcugcuuaa

SEQ ID NO: 160484 - RNA, 19 nt, Homo sapiens
ggaagcaaccagcaaauua

SEQ ID NO: 160485 - RNA, 19 nt, Homo sapiens
gaaauguaguuugcacuua

SEQ ID NO: 160486 - RNA, 19 nt, Homo sapiens
gaacugaugugugcauauu

SEQ ID NO: 160487 - RNA, 19 nt, Homo sapiens
auacagagaugcaaugaua

SEQ ID NO: 160488 - RNA, 19 nt, Homo sapiens
ccucaaagauaccuaguua

SEQ ID NO: 160489 - RNA, 19 nt, Homo sapiens
gacaguagaccuaaauuua

SEQ ID NO: 160490 - RNA, 19 nt, Homo sapiens
ggaaggaucugcauagagu

SEQ ID NO: 160491 - RNA, 19 nt, Homo sapiens
ggaaacaucuauauuacug

SEQ ID NO: 160492 - RNA, 19 nt, Homo sapiens
gaaauggccacuacuuuaa

SEQ ID NO: 160493 - RNA, 19 nt, Homo sapiens
ggaaagaugccaauuaaau

SEQ ID NO: 160494 - RNA, 19 nt, Homo sapiens
gaagaggauuuggaagaua

SEQ ID NO: 160495 - RNA, 19 nt, Homo sapiens
gaaagaaacugagcugaag

SEQ ID NO: 160496 - RNA, 19 nt, Homo sapiens
ccaguaacauugacaaauu

SEQ ID NO: 160497 - RNA, 19 nt, Homo sapiens
gauaaagacuguggaaaug

SEQ ID NO: 160498 - RNA, 19 nt, Homo sapiens
ggaggaaagaugccaauua

SEQ ID NO: 160499 - RNA, 19 nt, Homo sapiens
gauugcagcuggaguaauu

SEQ ID NO: 160500 - RNA, 19 nt, Homo sapiens
gaacuuggauuaaagaacu

SEQ ID NO: 160501 - RNA, 19 nt, Homo sapiens
gaaagggaggcuaauauuu

SEQ ID NO: 160502 - RNA, 19 nt, Homo sapiens
gggaaagacugaaagagaa

SEQ ID NO: 160503 - RNA, 19 nt, Homo sapiens
gcacaaggauaacauugga

SEQ ID NO: 160504 - RNA, 19 nt, Homo sapiens
gaaauuuguucaguucgua

SEQ ID NO: 160505 - RNA, 19 nt, Homo sapiens
gagcuaagauaaagacugu

SEQ ID NO: 160506 - RNA, 19 nt, Homo sapiens
gaagcaaccagcaaauuaa

SEQ ID NO: 160507 - RNA, 19 nt, Homo sapiens
gagcaagaauugacucgaa

SEQ ID NO: 160508 - RNA, 19 nt, Homo sapiens
gaaagaugccaauuaaaug

SEQ ID NO: 160509 - RNA, 19 nt, Homo sapiens
gaacuugacagaaauccua

SEQ ID NO: 160510 - RNA, 19 nt, Homo sapiens
ugaaauggccacuacuuua

SEQ ID NO: 160511 - RNA, 19 nt, Homo sapiens
ugaaacagcuagagaagga

SEQ ID NO: 160512 - RNA, 19 nt, Homo sapiens
ucagagagauaacagguuu

SEQ ID NO: 160513 - RNA, 19 nt, Homo sapiens
guacacauauggagcauuc

SEQ ID NO: 160514 - RNA, 19 nt, Homo sapiens
gaagaaacacacuggauug

SEQ ID NO: 160515 - RNA, 19 nt, Homo sapiens
guacaaagugcucucauuu

SEQ ID NO: 160516 - RNA, 19 nt, Homo sapiens
ugacagaaauccuaaaugg

SEQ ID NO: 160517 - RNA, 19 nt, Homo sapiens
gaauaggagugaaauugga

SEQ ID NO: 160518 - RNA, 19 nt, Homo sapiens
ggucaaauguuggaugauu

SEQ ID NO: 160519 - RNA, 19 nt, Homo sapiens
ucacagaauuuaagcaaga

SEQ ID NO: 160520 - RNA, 19 nt, Homo sapiens
agacacaccugcuccaauu

SEQ ID NO: 160521 - RNA, 19 nt, Homo sapiens
ggaagaaacacacuggauu

SEQ ID NO: 160522 - RNA, 19 nt, Homo sapiens
gaaccacaauguuucuuca

SEQ ID NO: 160523 - RNA, 19 nt, Homo sapiens
caaggaaauuuguucaguu

SEQ ID NO: 160524 - RNA, 19 nt, Homo sapiens
caaacuagcugucacuuuu

SEQ ID NO: 160525 - RNA, 19 nt, Homo sapiens
gagaugcaaugauaguuau

SEQ ID NO: 160526 - RNA, 19 nt, Homo sapiens
gaagauuccuguggcuauu

SEQ ID NO: 160527 - RNA, 19 nt, Homo sapiens
cagacuaccugcaggagua

SEQ ID NO: 160528 - RNA, 19 nt, Homo sapiens
ggucugacauuugcuguuu

SEQ ID NO: 160529 - RNA, 19 nt, Homo sapiens
gaaauucacccaucagagu

SEQ ID NO: 160530 - RNA, 19 nt, Homo sapiens
ggauggcucuggaguguau

SEQ ID NO: 160531 - RNA, 19 nt, Homo sapiens
acacaaacauucaaagcuu

SEQ ID NO: 160532 - RNA, 19 nt, Homo sapiens
gcaaggaaauuuguucagu

SEQ ID NO: 160533 - RNA, 19 nt, Homo sapiens
gaaauugagaauccaguuu

SEQ ID NO: 160534 - RNA, 19 nt, Homo sapiens
gauggaaacuuuggacuuc

SEQ ID NO: 160535 - RNA, 19 nt, Homo sapiens
cacaaacauucaaagcuua

SEQ ID NO: 160536 - RNA, 19 nt, Homo sapiens
cauggaauuucuaguauga

SEQ ID NO: 160537 - RNA, 19 nt, Homo sapiens
gcucuggaguguauacauu

SEQ ID NO: 160538 - RNA, 19 nt, Homo sapiens
ccagauagcuaagggaaug

SEQ ID NO: 160539 - RNA, 19 nt, Homo sapiens
caagaucaaugggaauuug

SEQ ID NO: 160540 - RNA, 19 nt, Homo sapiens
gauagugucugaaauugag

SEQ ID NO: 160541 - RNA, 19 nt, Homo sapiens
gaaugaaacagcuagagaa

SEQ ID NO: 160542 - RNA, 19 nt, Homo sapiens
agaauugacucgaauagga

SEQ ID NO: 160543 - RNA, 19 nt, Homo sapiens
ggacgggccauuccacuuu

SEQ ID NO: 160544 - RNA, 19 nt, Homo sapiens
acaaagugcucucauuuua

SEQ ID NO: 160545 - RNA, 19 nt, Homo sapiens
ggaaugcgaguaaggauug

SEQ ID NO: 160546 - RNA, 19 nt, Homo sapiens
gaagauggccuccucacau

SEQ ID NO: 160547 - RNA, 19 nt, Homo sapiens
ccucuaugauggugaauuu

SEQ ID NO: 160548 - RNA, 19 nt, Homo sapiens
ggaauuugaucuuucuagu

SEQ ID NO: 160549 - RNA, 19 nt, Homo sapiens
gagcacaauuucaaugcaa

SEQ ID NO: 160550 - RNA, 19 nt, Homo sapiens
gcaaccagcaaauuaacua

SEQ ID NO: 160551 - RNA, 19 nt, Homo sapiens
gcagauacucagaaaugua

SEQ ID NO: 160552 - RNA, 19 nt, Homo sapiens
gaccgauuccuuuauauuu

SEQ ID NO: 160553 - RNA, 19 nt, Homo sapiens
cugaauaccucucugaguu

SEQ ID NO: 160554 - RNA, 19 nt, Homo sapiens
ggaacgguuuauaaaggua

SEQ ID NO: 160555 - RNA, 19 nt, Homo sapiens
cagaaaagcugaaaauugu

SEQ ID NO: 160556 - RNA, 19 nt, Homo sapiens
uaagaaggaaugcgaguaa

SEQ ID NO: 160557 - RNA, 19 nt, Homo sapiens
gcaagaauugacucgaaua

SEQ ID NO: 160558 - RNA, 19 nt, Homo sapiens
gcuauggaguuacuauaug

SEQ ID NO: 160559 - RNA, 19 nt, Homo sapiens
gaaaagagccuugagaaga

SEQ ID NO: 160560 - RNA, 19 nt, Homo sapiens
caagauggaaguagaagaa

SEQ ID NO: 160561 - RNA, 19 nt, Homo sapiens
cuggagaauuuacgcauua

SEQ ID NO: 160562 - RNA, 19 nt, Homo sapiens
gaagggaaacuaagagaca

SEQ ID NO: 160563 - RNA, 19 nt, Homo sapiens
acugaugugugcauauuua

SEQ ID NO: 160564 - RNA, 19 nt, Homo sapiens
gcaaugcugccuacuauca

SEQ ID NO: 160565 - RNA, 19 nt, Homo sapiens
gagacaaacccaaacaaga

SEQ ID NO: 160566 - RNA, 19 nt, Homo sapiens
guuuggagcuauggaguua

SEQ ID NO: 160567 - RNA, 19 nt, Homo sapiens
gacgggccauuccacuuua

SEQ ID NO: 160568 - RNA, 19 nt, Homo sapiens
caaguaugcugauccagau

SEQ ID NO: 160569 - RNA, 19 nt, Homo sapiens
gacaguggagcauguguua

SEQ ID NO: 160570 - RNA, 19 nt, Homo sapiens
guaacucuuugcacauaaa

SEQ ID NO: 160571 - RNA, 19 nt, Homo sapiens
ggaaagacugaaagagaaa

SEQ ID NO: 160572 - RNA, 19 nt, Homo sapiens
agacaaacccaaacaagaa

SEQ ID NO: 160573 - RNA, 19 nt, Homo sapiens
gaugacuccugcuguaaug

SEQ ID NO: 160574 - RNA, 19 nt, Homo sapiens
gaggaaggaucugcauaga

SEQ ID NO: 160575 - RNA, 19 nt, Homo sapiens
gaaaucagcgcaggaaaca

SEQ ID NO: 160576 - RNA, 19 nt, Homo sapiens
cagagaaacugaacgucuu

SEQ ID NO: 160577 - RNA, 19 nt, Homo sapiens
uaaagcagaugguugaaac

SEQ ID NO: 160578 - RNA, 19 nt, Homo sapiens
gaagaacaacauacuguca

SEQ ID NO: 160579 - RNA, 19 nt, Homo sapiens
gacagcaaguucuuucaga

SEQ ID NO: 160580 - RNA, 19 nt, Homo sapiens
caucaccucucuacaguuc

SEQ ID NO: 160581 - RNA, 19 nt, Homo sapiens
gagaagaucuggccuuaug

SEQ ID NO: 160582 - RNA, 19 nt, Homo sapiens
ucaaggagcuggcuaagau

SEQ ID NO: 160583 - RNA, 19 nt, Homo sapiens
gcacgagcccuucuugaaa

SEQ ID NO: 160584 - RNA, 19 nt, Homo sapiens
cgacguaauucccgacuau

SEQ ID NO: 160585 - RNA, 19 nt, Homo sapiens
aagagaagaucuggccuua

SEQ ID NO: 160586 - RNA, 19 nt, Homo sapiens
gcucaucgccgcaucaaga

SEQ ID NO: 160587 - RNA, 19 nt, Homo sapiens
gcaaucccguacugaaguu

SEQ ID NO: 160588 - RNA, 19 nt, Homo sapiens
gcaaggaagaaauuuguga

SEQ ID NO: 160589 - RNA, 19 nt, Homo sapiens
cagcggaccuccugaugga

SEQ ID NO: 160590 - RNA, 19 nt, Homo sapiens
ggcgguaccuggagaccua

SEQ ID NO: 160591 - RNA, 19 nt, Homo sapiens
ggaagaaauuugugauacc

SEQ ID NO: 160592 - RNA, 19 nt, Homo sapiens
ggagcuggcuaagaugugu

SEQ ID NO: 160593 - RNA, 19 nt, Homo sapiens
cgaucccucugcagucuuu

SEQ ID NO: 160594 - RNA, 19 nt, Homo sapiens
caaggccuaugagcagaaa

SEQ ID NO: 160595 - RNA, 19 nt, Homo sapiens
ccagguggaugugaaagau

SEQ ID NO: 160596 - RNA, 19 nt, Homo sapiens
cagcaaggaagaaauuugu

SEQ ID NO: 160597 - RNA, 19 nt, Homo sapiens
cacgagcccuucuugaaag

SEQ ID NO: 160598 - RNA, 19 nt, Homo sapiens
gcccggaggcuguuugaug

SEQ ID NO: 160599 - RNA, 19 nt, Homo sapiens
cgccgaauaugccaucuca

SEQ ID NO: 160600 - RNA, 19 nt, Homo sapiens
gcgacguaauucccgacua

SEQ ID NO: 160601 - RNA, 19 nt, Homo sapiens
uccaacagcaucauuguga

SEQ ID NO: 160602 - RNA, 19 nt, Homo sapiens
cccggaggcuguuugaugu

SEQ ID NO: 160603 - RNA, 19 nt, Homo sapiens
cgugaagucagucaacaaa

SEQ ID NO: 160604 - RNA, 19 nt, Homo sapiens
gcacccagacuacauccau

SEQ ID NO: 160605 - RNA, 19 nt, Homo sapiens
gagcccuucuugaaaguac

SEQ ID NO: 160606 - RNA, 19 nt, Homo sapiens
caaggaagaaauuugugau

SEQ ID NO: 160607 - RNA, 19 nt, Homo sapiens
agaccuacaaggccuauga

SEQ ID NO: 160608 - RNA, 19 nt, Homo sapiens
ccgaauaugccaucucaca

SEQ ID NO: 160609 - RNA, 19 nt, Homo sapiens
ucagaccuacgccgaauau

SEQ ID NO: 160610 - RNA, 19 nt, Homo sapiens
aggaagaaauuugugauac

SEQ ID NO: 160611 - RNA, 19 nt, Homo sapiens
cugggaauuuggcgacgua

SEQ ID NO: 160612 - RNA, 19 nt, Homo sapiens
ccagcaaggaagaaauuug

SEQ ID NO: 160613 - RNA, 19 nt, Homo sapiens
ccucagaccuacgccgaau

SEQ ID NO: 160614 - RNA, 19 nt, Homo sapiens
caucgccgcaucaagagaa

SEQ ID NO: 160615 - RNA, 19 nt, Homo sapiens
ggaguggccaagcccuuau

SEQ ID NO: 160616 - RNA, 19 nt, Homo sapiens
uuauuccgaucuacacaga

SEQ ID NO: 160617 - RNA, 19 nt, Homo sapiens
ucugcagucuuucccuuga

SEQ ID NO: 160618 - RNA, 19 nt, Homo sapiens
agacccuccugaccacauu

SEQ ID NO: 160619 - RNA, 19 nt, Homo sapiens
ggaccacaggcuccagaug

SEQ ID NO: 160620 - RNA, 19 nt, Homo sapiens
gggcaaucccguacugaag

SEQ ID NO: 160621 - RNA, 19 nt, Homo sapiens
ccaguguaauaauaaaucg

SEQ ID NO: 160622 - RNA, 19 nt, Homo sapiens
ggcaaucccguacugaagu

SEQ ID NO: 160623 - RNA, 19 nt, Homo sapiens
caggagagacgcccaacca

SEQ ID NO: 160624 - RNA, 19 nt, Homo sapiens
cgccagcaaggaagaaauu

SEQ ID NO: 160625 - RNA, 19 nt, Homo sapiens
cuugaaaguacccugauga

SEQ ID NO: 160626 - RNA, 19 nt, Homo sapiens
uggaguggccaagcccuua

SEQ ID NO: 160627 - RNA, 19 nt, Homo sapiens
ggaacaagcugcucuuuau

SEQ ID NO: 160628 - RNA, 19 nt, Homo sapiens
gccaucagcuccaaauuug

SEQ ID NO: 160629 - RNA, 19 nt, Homo sapiens
gccaaaggcuucaccauca

SEQ ID NO: 160630 - RNA, 19 nt, Homo sapiens
gaacugugccagagauuga

SEQ ID NO: 160631 - RNA, 19 nt, Homo sapiens
gaacaagcugcucuuuauu

SEQ ID NO: 160632 - RNA, 19 nt, Homo sapiens
gaucauggcauaccagaga

SEQ ID NO: 160633 - RNA, 19 nt, Homo sapiens
ccaauguggugguuuauag

SEQ ID NO: 160634 - RNA, 19 nt, Homo sapiens
acacagagccgcauucuca

SEQ ID NO: 160635 - RNA, 19 nt, Homo sapiens
gaaggugauugaagagcuu

SEQ ID NO: 160636 - RNA, 19 nt, Homo sapiens
cgacgaggcccacaacauu

SEQ ID NO: 160637 - RNA, 19 nt, Homo sapiens
ugaccaaacucaucuacug

SEQ ID NO: 160638 - RNA, 19 nt, Homo sapiens
acaagcugcucuuuauuga

SEQ ID NO: 160639 - RNA, 19 nt, Homo sapiens
caagaacugugccagagau

SEQ ID NO: 160640 - RNA, 19 nt, Homo sapiens
ugaggcggcugcuggagua

SEQ ID NO: 160641 - RNA, 19 nt, Homo sapiens
aagcugcucuuuauugaga

SEQ ID NO: 160642 - RNA, 19 nt, Homo sapiens
ggccaucagcuccaaauuu

SEQ ID NO: 160643 - RNA, 19 nt, Homo sapiens
ucaccgaccuugcugacuu

SEQ ID NO: 160644 - RNA, 19 nt, Homo sapiens
caaccuggaugaccugaag

SEQ ID NO: 160645 - RNA, 19 nt, Homo sapiens
ggacgucgaugggaaaugc

SEQ ID NO: 160646 - RNA, 19 nt, Homo sapiens
gaaggacgucgaugggaaa

SEQ ID NO: 160647 - RNA, 19 nt, Homo sapiens
cauacuuccuugcucgaua

SEQ ID NO: 160648 - RNA, 19 nt, Homo sapiens
gcaaggccgucguggucuu

SEQ ID NO: 160649 - RNA, 19 nt, Homo sapiens
gggaggauauugcugugau

SEQ ID NO: 160650 - RNA, 19 nt, Homo sapiens
uugagaaggugauugaaga

SEQ ID NO: 160651 - RNA, 19 nt, Homo sapiens
aaacucaucuacugcucaa

SEQ ID NO: 160652 - RNA, 19 nt, Homo sapiens
gagaacauccagaggaaca

SEQ ID NO: 160653 - RNA, 19 nt, Homo sapiens
gaucaucggccguggcaau

SEQ ID NO: 160654 - RNA, 19 nt, Homo sapiens
uggagcagcuagaaucaga

SEQ ID NO: 160655 - RNA, 19 nt, Homo sapiens
ggccaucaaacccguauuu

SEQ ID NO: 160656 - RNA, 19 nt, Homo sapiens
ugaagaggauagagcagau

SEQ ID NO: 160657 - RNA, 19 nt, Homo sapiens
uugcagaccugguguccaa

SEQ ID NO: 160658 - RNA, 19 nt, Homo sapiens
agaagacggugcucaggau

SEQ ID NO: 160659 - RNA, 19 nt, Homo sapiens
gaaaugccacagccucaca

SEQ ID NO: 160660 - RNA, 19 nt, Homo sapiens
ugccagagauugagaaggu

SEQ ID NO: 160661 - RNA, 19 nt, Homo sapiens
gaagaggauagagcagauu

SEQ ID NO: 160662 - RNA, 19 nt, Homo sapiens
gcugugauccggaacuaug

SEQ ID NO: 160663 - RNA, 19 nt, Homo sapiens
ccaaaggcuucaccaucau

SEQ ID NO: 160664 - RNA, 19 nt, Homo sapiens
gugucgcccuggagaagua

SEQ ID NO: 160665 - RNA, 19 nt, Homo sapiens
ucacagaugccaaccucaa

SEQ ID NO: 160666 - RNA, 19 nt, Homo sapiens
gcaaaguguccgagggaau

SEQ ID NO: 160667 - RNA, 19 nt, Homo sapiens
ggaggauauugcugugauc

SEQ ID NO: 160668 - RNA, 19 nt, Homo sapiens
ggaggugaccaaacucauc

SEQ ID NO: 160669 - RNA, 19 nt, Homo sapiens
guguccagguggccaagua

SEQ ID NO: 160670 - RNA, 19 nt, Homo sapiens
aggaacaagcugcucuuua

SEQ ID NO: 160671 - RNA, 19 nt, Homo sapiens
uugagaacauccagaggaa

SEQ ID NO: 160672 - RNA, 19 nt, Homo sapiens
gacgaggcccacaacauug

SEQ ID NO: 160673 - RNA, 19 nt, Homo sapiens
augccaauguggugguuua

SEQ ID NO: 160674 - RNA, 19 nt, Homo sapiens
gaggaacaagcugcucuuu

SEQ ID NO: 160675 - RNA, 19 nt, Homo sapiens
aggagacgcugaagaggau

SEQ ID NO: 160676 - RNA, 19 nt, Homo sapiens
caggagcaccucacagaug

SEQ ID NO: 160677 - RNA, 19 nt, Homo sapiens
caaaguguccgagggaauc

SEQ ID NO: 160678 - RNA, 19 nt, Homo sapiens
ccgagggaaucgacuuugu

SEQ ID NO: 160679 - RNA, 19 nt, Homo sapiens
aacaagcugcucuuuauug

SEQ ID NO: 160680 - RNA, 19 nt, Homo sapiens
ggagaucaccgaccuugcu

SEQ ID NO: 160681 - RNA, 19 nt, Homo sapiens
cagaggagacgcugaagag

SEQ ID NO: 160682 - RNA, 19 nt, Homo sapiens
cacccuccuugcuaacuuu

SEQ ID NO: 160683 - RNA, 19 nt, Homo sapiens
uggacgggcuccuggucua

SEQ ID NO: 160684 - RNA, 19 nt, Homo sapiens
uggcauaccagagagcaua

SEQ ID NO: 160685 - RNA, 19 nt, Homo sapiens
ugucagcaccuacgccaaa

SEQ ID NO: 160686 - RNA, 19 nt, Homo sapiens
gccaauguggugguuuaua

SEQ ID NO: 160687 - RNA, 19 nt, Homo sapiens
agauugagaaggugauuga

SEQ ID NO: 160688 - RNA, 19 nt, Homo sapiens
gagcguuuccagucuguca

SEQ ID NO: 160689 - RNA, 19 nt, Homo sapiens
ucacccuccuugcuaacuu

SEQ ID NO: 160690 - RNA, 19 nt, Homo sapiens
agacggugcucaggaucaa

SEQ ID NO: 160691 - RNA, 19 nt, Homo sapiens
gaacauccagaggaacaag

SEQ ID NO: 160692 - RNA, 19 nt, Homo sapiens
gcaugccaauguggugguu

SEQ ID NO: 160693 - RNA, 19 nt, Homo sapiens
caccguggccuccugguau

SEQ ID NO: 160694 - RNA, 19 nt, Homo sapiens
ccgcucacccuccuugcua

SEQ ID NO: 160695 - RNA, 19 nt, Homo sapiens
gacagaaccccgaccauug

SEQ ID NO: 160696 - RNA, 19 nt, Homo sapiens
gugcucaggaucaaagaga

SEQ ID NO: 160697 - RNA, 19 nt, Homo sapiens
cuggagacccugcagaaga

SEQ ID NO: 160698 - RNA, 19 nt, Homo sapiens
gaggugaccaaacucaucu

SEQ ID NO: 160699 - RNA, 19 nt, Homo sapiens
cuuccuugcucgauacuca

SEQ ID NO: 160700 - RNA, 19 nt, Homo sapiens
ucaagaacugugccagaga

SEQ ID NO: 160701 - RNA, 19 nt, Homo sapiens
gggcgcaguaccagcauga

SEQ ID NO: 160702 - RNA, 19 nt, Homo sapiens
ccgagcaguucuccuacau

SEQ ID NO: 160703 - RNA, 19 nt, Homo sapiens
gaagcaggagggcgagaag

SEQ ID NO: 160704 - RNA, 19 nt, Homo sapiens
gggccauccugcugucagu

SEQ ID NO: 160705 - RNA, 19 nt, Homo sapiens
gucugccucugcccuauga

SEQ ID NO: 160706 - RNA, 19 nt, Homo sapiens
ggucccugcugcauacucu

SEQ ID NO: 160707 - RNA, 19 nt, Homo sapiens
gcaccgggaagacaguauc

SEQ ID NO: 160708 - RNA, 19 nt, Homo sapiens
cgggaccaguuccagauuc

SEQ ID NO: 160709 - RNA, 19 nt, Homo sapiens
ccagcuaccaguacaugga

SEQ ID NO: 160710 - RNA, 19 nt, Homo sapiens
caucagcuccaaauuugag

SEQ ID NO: 160711 - RNA, 19 nt, Homo sapiens
uaacuuugccacccuuguc

SEQ ID NO: 160712 - RNA, 19 nt, Homo sapiens
caccgaccuugcugacuuc

SEQ ID NO: 160713 - RNA, 19 nt, Homo sapiens
cgagggaaucgacuuugug

SEQ ID NO: 160714 - RNA, 19 nt, Homo sapiens
ggucauagcucaagaauug

SEQ ID NO: 160715 - RNA, 19 nt, Homo sapiens
gcacguagcauuuacauua

SEQ ID NO: 160716 - RNA, 19 nt, Homo sapiens
gaacaucugugcccgauuu

SEQ ID NO: 160717 - RNA, 19 nt, Homo sapiens
ccaguuaacuuacucuuua

SEQ ID NO: 160718 - RNA, 19 nt, Homo sapiens
aaauauagguccuguguua

SEQ ID NO: 160719 - RNA, 19 nt, Homo sapiens
guaaauggcuucuucuaga

SEQ ID NO: 160720 - RNA, 19 nt, Homo sapiens
ggacuugucuccaugugua

SEQ ID NO: 160721 - RNA, 19 nt, Homo sapiens
caaccaaggccacauaaua

SEQ ID NO: 160722 - RNA, 19 nt, Homo sapiens
gggcuuugcugaauucuaa

SEQ ID NO: 160723 - RNA, 19 nt, Homo sapiens
gaggagagucugaauauuu

SEQ ID NO: 160724 - RNA, 19 nt, Homo sapiens
ucacacgacugucaucuaa

SEQ ID NO: 160725 - RNA, 19 nt, Homo sapiens
gagaauugguauacuggua

SEQ ID NO: 160726 - RNA, 19 nt, Homo sapiens
gaaggaauaugagagaguu

SEQ ID NO: 160727 - RNA, 19 nt, Homo sapiens
uaaaguaugacccacauua

SEQ ID NO: 160728 - RNA, 19 nt, Homo sapiens
gugaauagguuauaugcaa

SEQ ID NO: 160729 - RNA, 19 nt, Homo sapiens
gguaaacgaaggcauaaua

SEQ ID NO: 160730 - RNA, 19 nt, Homo sapiens
ccaccaaccuuuaagcaaa

SEQ ID NO: 160731 - RNA, 19 nt, Homo sapiens
caauguaacuccacuguuc

SEQ ID NO: 160732 - RNA, 19 nt, Homo sapiens
ccaggaauauuaaguucua

SEQ ID NO: 160733 - RNA, 19 nt, Homo sapiens
uuucauagcuucacaaugu

SEQ ID NO: 160734 - RNA, 19 nt, Homo sapiens
uauguugggucaaguguua

SEQ ID NO: 160735 - RNA, 19 nt, Homo sapiens
guaaugacuuguacaaaca

SEQ ID NO: 160736 - RNA, 19 nt, Homo sapiens
uaauacagcucaguaaaug

SEQ ID NO: 160737 - RNA, 19 nt, Homo sapiens
ccacuguucuccugaauau

SEQ ID NO: 160738 - RNA, 19 nt, Homo sapiens
caaguaauuuccugagcua

SEQ ID NO: 160739 - RNA, 19 nt, Homo sapiens
guaaagaaccaaagaagga

SEQ ID NO: 160740 - RNA, 19 nt, Homo sapiens
gcucaagugucaauaacaa

SEQ ID NO: 160741 - RNA, 19 nt, Homo sapiens
uaaaucagcugcaauccau

SEQ ID NO: 160742 - RNA, 19 nt, Homo sapiens
guuaaacacuacacauuug

SEQ ID NO: 160743 - RNA, 19 nt, Homo sapiens
gauaauugguuugacugua

SEQ ID NO: 160744 - RNA, 19 nt, Homo sapiens
gaucuuggcuguuucaaaa

SEQ ID NO: 160745 - RNA, 19 nt, Homo sapiens
ucagugaucuuggcuguuu

SEQ ID NO: 160746 - RNA, 19 nt, Homo sapiens
caauauauucugaccguua

SEQ ID NO: 160747 - RNA, 19 nt, Homo sapiens
gcaccaugguaucauauau

SEQ ID NO: 160748 - RNA, 19 nt, Homo sapiens
gcccuggcccuuacuauua

SEQ ID NO: 160749 - RNA, 19 nt, Homo sapiens
gcaaauauagguccugugu

SEQ ID NO: 160750 - RNA, 19 nt, Homo sapiens
ccaggagaguccagugaua

SEQ ID NO: 160751 - RNA, 19 nt, Homo sapiens
gcucaagaauuguuagcaa

SEQ ID NO: 160752 - RNA, 19 nt, Homo sapiens
gaaccaaagcaaccacaaa

SEQ ID NO: 160753 - RNA, 19 nt, Homo sapiens
guaaacgaaggcauaauaa

SEQ ID NO: 160754 - RNA, 19 nt, Homo sapiens
ugacaugaauggcuauugu

SEQ ID NO: 160755 - RNA, 19 nt, Homo sapiens
uauuaacgcuuacuagaug

SEQ ID NO: 160756 - RNA, 19 nt, Homo sapiens
guacacagugggaagauuu

SEQ ID NO: 160757 - RNA, 19 nt, Homo sapiens
cagcugcaauccauuuauu

SEQ ID NO: 160758 - RNA, 19 nt, Homo sapiens
gugcucugcuaaccauuua

SEQ ID NO: 160759 - RNA, 19 nt, Homo sapiens
uaccaugguuugauaugua

SEQ ID NO: 160760 - RNA, 19 nt, Homo sapiens
cagacuauuugcuaaugua

SEQ ID NO: 160761 - RNA, 19 nt, Homo sapiens
gaccgugauucuuauuauu

SEQ ID NO: 160762 - RNA, 19 nt, Homo sapiens
gcuuugaccgugauucuua

SEQ ID NO: 160763 - RNA, 19 nt, Homo sapiens
gaagagccauuuugguaaa

SEQ ID NO: 160764 - RNA, 19 nt, Homo sapiens
ucauagaauugcagucauu

SEQ ID NO: 160765 - RNA, 19 nt, Homo sapiens
ucacucaggucucagcuau

SEQ ID NO: 160766 - RNA, 19 nt, Homo sapiens
uaacuaguacucaagguuu

SEQ ID NO: 160767 - RNA, 19 nt, Homo sapiens
gauggagucucgcucuguu

SEQ ID NO: 160768 - RNA, 19 nt, Homo sapiens
caguauuucugguguauau

SEQ ID NO: 160769 - RNA, 19 nt, Homo sapiens
gcuccaauauccauucugu

SEQ ID NO: 160770 - RNA, 19 nt, Homo sapiens
acucaggucucagcuauaa

SEQ ID NO: 160771 - RNA, 19 nt, Homo sapiens
caagaauuguuagcaaaug

SEQ ID NO: 160772 - RNA, 19 nt, Homo sapiens
gcauugaacaucuugcauu

SEQ ID NO: 160773 - RNA, 19 nt, Homo sapiens
ucaaagugaugggagaauu

SEQ ID NO: 160774 - RNA, 19 nt, Homo sapiens
ugaggauggugcugaguaa

SEQ ID NO: 160775 - RNA, 19 nt, Homo sapiens
ggucucagcuauaauucug

SEQ ID NO: 160776 - RNA, 19 nt, Homo sapiens
aaacaguauuucuggugua

SEQ ID NO: 160777 - RNA, 19 nt, Homo sapiens
ggaguaaugacuuguacaa

SEQ ID NO: 160778 - RNA, 19 nt, Homo sapiens
uaucugacccacuuuguaa

SEQ ID NO: 160779 - RNA, 19 nt, Homo sapiens
gaucauagaauugcaguca

SEQ ID NO: 160780 - RNA, 19 nt, Homo sapiens
cagugugccugguuaauau

SEQ ID NO: 160781 - RNA, 19 nt, Homo sapiens
uauccauucuguagacuuu

SEQ ID NO: 160782 - RNA, 19 nt, Homo sapiens
guguauccaugcauuauau

SEQ ID NO: 160783 - RNA, 19 nt, Homo sapiens
caucgaaugcuaaaccuuu

SEQ ID NO: 160784 - RNA, 19 nt, Homo sapiens
gggagucuauggucucuuc

SEQ ID NO: 160785 - RNA, 19 nt, Homo sapiens
gaauggcuauuguuugcau

SEQ ID NO: 160786 - RNA, 19 nt, Homo sapiens
cauguugucuuaagaugga

SEQ ID NO: 160787 - RNA, 19 nt, Homo sapiens
gacagacuauuugcuaaug

SEQ ID NO: 160788 - RNA, 19 nt, Homo sapiens
gaacauaaaguuguauugc

SEQ ID NO: 160789 - RNA, 19 nt, Homo sapiens
aaccaaggccacauaauaa

SEQ ID NO: 160790 - RNA, 19 nt, Homo sapiens
aaacuuaugggcagggaua

SEQ ID NO: 160791 - RNA, 19 nt, Homo sapiens
uaacaaaguguagcucuga

SEQ ID NO: 160792 - RNA, 19 nt, Homo sapiens
gcuaaucccuaaaauaguu

SEQ ID NO: 160793 - RNA, 19 nt, Homo sapiens
ggaugugaauagguuauau

SEQ ID NO: 160794 - RNA, 19 nt, Homo sapiens
gcucugcuaaccauuuaua

SEQ ID NO: 160795 - RNA, 19 nt, Homo sapiens
ugaccgugauucuuauuau

SEQ ID NO: 160796 - RNA, 19 nt, Homo sapiens
gcaucuaucugguggacau

SEQ ID NO: 160797 - RNA, 19 nt, Homo sapiens
cagcuuugauaauugugua

SEQ ID NO: 160798 - RNA, 19 nt, Homo sapiens
aaccacaaaugcauaaaug

SEQ ID NO: 160799 - RNA, 19 nt, Homo sapiens
caauaaaucagcugcaauc

SEQ ID NO: 160800 - RNA, 19 nt, Homo sapiens
gugaggagagucugaauau

SEQ ID NO: 160801 - RNA, 19 nt, Homo sapiens
uauauacccuggugcaauc

SEQ ID NO: 160802 - RNA, 19 nt, Homo sapiens
gcucaacagacaauuagaa

SEQ ID NO: 160803 - RNA, 19 nt, Homo sapiens
ggucaaguguuaggucaau

SEQ ID NO: 160804 - RNA, 19 nt, Homo sapiens
ggauggugcugaguaaaca

SEQ ID NO: 160805 - RNA, 19 nt, Homo sapiens
gcacuaugcccuuuuauau

SEQ ID NO: 160806 - RNA, 19 nt, Homo sapiens
caccaugcccagcuaauuu

SEQ ID NO: 160807 - RNA, 19 nt, Homo sapiens
gcuaaaccuuugaguagag

SEQ ID NO: 160808 - RNA, 19 nt, Homo sapiens
aaccaaagaaggaauauga

SEQ ID NO: 160809 - RNA, 19 nt, Homo sapiens
cauugaacaucuugcauuc

SEQ ID NO: 160810 - RNA, 19 nt, Homo sapiens
caaagugaugggagaauug

SEQ ID NO: 160811 - RNA, 19 nt, Homo sapiens
guaugacccacauuacuuu

SEQ ID NO: 160812 - RNA, 19 nt, Homo sapiens
ccacugcugccaccacuuu

SEQ ID NO: 160813 - RNA, 19 nt, Homo sapiens
aaaguuguaucuugacaca

SEQ ID NO: 160814 - RNA, 19 nt, Homo sapiens
caaaugcacuuaagucuuu

SEQ ID NO: 160815 - RNA, 19 nt, Homo sapiens
gaaacucuauggucuuaua

SEQ ID NO: 160816 - RNA, 19 nt, Homo sapiens
gcacaucaguuacuacaaa

SEQ ID NO: 160817 - RNA, 19 nt, Homo sapiens
gaaggaacgagaauaaaua

SEQ ID NO: 160818 - RNA, 19 nt, Homo sapiens
gcacuuaagucuuuaucaa

SEQ ID NO: 160819 - RNA, 19 nt, Homo sapiens
gagagaaccuguaggaguu

SEQ ID NO: 160820 - RNA, 19 nt, Homo sapiens
gcaacaaugucucuucuug

SEQ ID NO: 160821 - RNA, 19 nt, Homo sapiens
gagcguauaugacaucgaa

SEQ ID NO: 160822 - RNA, 19 nt, Homo sapiens
gcaccaucaucuacuauuu

SEQ ID NO: 160823 - RNA, 19 nt, Homo sapiens
agacagcauuuguguguua

SEQ ID NO: 160824 - RNA, 19 nt, Homo sapiens
ggaaugcacucagacugua

SEQ ID NO: 160825 - RNA, 19 nt, Homo sapiens
ggaagacucccaggauuua

SEQ ID NO: 160826 - RNA, 19 nt, Homo sapiens
ggaaagagcugcgggaaaa

SEQ ID NO: 160827 - RNA, 19 nt, Homo sapiens
gaauuggaaugcacucaga

SEQ ID NO: 160828 - RNA, 19 nt, Homo sapiens
ggaaugagcagcuuuagca

SEQ ID NO: 160829 - RNA, 19 nt, Homo sapiens
ccaccaagcacuggaauua

SEQ ID NO: 160830 - RNA, 19 nt, Homo sapiens
gcaaguagugcaaaccuuu

SEQ ID NO: 160831 - RNA, 19 nt, Homo sapiens
ggacuuaaguaccuacagu

SEQ ID NO: 160832 - RNA, 19 nt, Homo sapiens
gagaauauuuacagugcaa

SEQ ID NO: 160833 - RNA, 19 nt, Homo sapiens
uagaugauguuuccucuga

SEQ ID NO: 160834 - RNA, 19 nt, Homo sapiens
ggaaggaacgagaauaaau

SEQ ID NO: 160835 - RNA, 19 nt, Homo sapiens
gcacuggaauuagaguauu

SEQ ID NO: 160836 - RNA, 19 nt, Homo sapiens
cugcauaaaugucuuggua

SEQ ID NO: 160837 - RNA, 19 nt, Homo sapiens
gccagacaccuuauucuua

SEQ ID NO: 160838 - RNA, 19 nt, Homo sapiens
gauguuuccucugaugaua

SEQ ID NO: 160839 - RNA, 19 nt, Homo sapiens
gaauuucagugguucacaa

SEQ ID NO: 160840 - RNA, 19 nt, Homo sapiens
gaucagcacaucaguauuc

SEQ ID NO: 160841 - RNA, 19 nt, Homo sapiens
cagaguggcugccucaguu

SEQ ID NO: 160842 - RNA, 19 nt, Homo sapiens
ggaacgagaauaaauacuu

SEQ ID NO: 160843 - RNA, 19 nt, Homo sapiens
gcucuacacauauaaauug

SEQ ID NO: 160844 - RNA, 19 nt, Homo sapiens
aggaguaacugcauaaaug

SEQ ID NO: 160845 - RNA, 19 nt, Homo sapiens
gaacgaauaaugcaaaggu

SEQ ID NO: 160846 - RNA, 19 nt, Homo sapiens
caagacagcauuugugugu

SEQ ID NO: 160847 - RNA, 19 nt, Homo sapiens
caacugaucccagcacuug

SEQ ID NO: 160848 - RNA, 19 nt, Homo sapiens
gcuaacaaaugcacuuaag

SEQ ID NO: 160849 - RNA, 19 nt, Homo sapiens
gaugauguuuccucugaug

SEQ ID NO: 160850 - RNA, 19 nt, Homo sapiens
gcagacugguugcugaguu

SEQ ID NO: 160851 - RNA, 19 nt, Homo sapiens
agaaucagauguuucacaa

SEQ ID NO: 160852 - RNA, 19 nt, Homo sapiens
ggucuuaugcacagaagua

SEQ ID NO: 160853 - RNA, 19 nt, Homo sapiens
gggaaaugggaauauaaua

SEQ ID NO: 160854 - RNA, 19 nt, Homo sapiens
gcauaaaugucuugguaac

SEQ ID NO: 160855 - RNA, 19 nt, Homo sapiens
gaugagagaaccuguagga

SEQ ID NO: 160856 - RNA, 19 nt, Homo sapiens
gcaaauaauucaguuucca

SEQ ID NO: 160857 - RNA, 19 nt, Homo sapiens
ccagacaccuuauucuuac

SEQ ID NO: 160858 - RNA, 19 nt, Homo sapiens
aaacagagcccuugaacag

SEQ ID NO: 160859 - RNA, 19 nt, Homo sapiens
aaucagauguuucacaauc

SEQ ID NO: 160860 - RNA, 19 nt, Homo sapiens
gaggauauccagucacuca

SEQ ID NO: 160861 - RNA, 19 nt, Homo sapiens
gagaguggacuuucccaaa

SEQ ID NO: 160862 - RNA, 19 nt, Homo sapiens
ggucaguaauuacaaguag

SEQ ID NO: 160863 - RNA, 19 nt, Homo sapiens
gcacucagacuguauaagg

SEQ ID NO: 160864 - RNA, 19 nt, Homo sapiens
cgaagguucuacucuauag

SEQ ID NO: 160865 - RNA, 19 nt, Homo sapiens
gugaucaaguucauauaga

SEQ ID NO: 160866 - RNA, 19 nt, Homo sapiens
gcagaaaaguaguguaugu

SEQ ID NO: 160867 - RNA, 19 nt, Homo sapiens
caaagaucuugaugagaga

SEQ ID NO: 160868 - RNA, 19 nt, Homo sapiens
aaaccaguaugcacaguau

SEQ ID NO: 160869 - RNA, 19 nt, Homo sapiens
aaacuuuagugcuacagaa

SEQ ID NO: 160870 - RNA, 19 nt, Homo sapiens
gccucuggcucuacacaua

SEQ ID NO: 160871 - RNA, 19 nt, Homo sapiens
uauaacaccuacaagaaca

SEQ ID NO: 160872 - RNA, 19 nt, Homo sapiens
caacguauggagcguauau

SEQ ID NO: 160873 - RNA, 19 nt, Homo sapiens
ggucuuauauuuacaacac

SEQ ID NO: 160874 - RNA, 19 nt, Homo sapiens
guucuacucuauaguuuag

SEQ ID NO: 160875 - RNA, 19 nt, Homo sapiens
uaacaaaugcacuuaaguc

SEQ ID NO: 160876 - RNA, 19 nt, Homo sapiens
gcguauaugacaucgaaua

SEQ ID NO: 160877 - RNA, 19 nt, Homo sapiens
caccaucaucuacuauuua

SEQ ID NO: 160878 - RNA, 19 nt, Homo sapiens
gaaguuggcuuuucguuac

SEQ ID NO: 160879 - RNA, 19 nt, Homo sapiens
auggagcgcuugacacuuu

SEQ ID NO: 160880 - RNA, 19 nt, Homo sapiens
gcacagaaucagauguuuc

SEQ ID NO: 160881 - RNA, 19 nt, Homo sapiens
acugauguguugugccuua

SEQ ID NO: 160882 - RNA, 19 nt, Homo sapiens
caaagcagcaacacacaug

SEQ ID NO: 160883 - RNA, 19 nt, Homo sapiens
gcgaagguucuacucuaua

SEQ ID NO: 160884 - RNA, 19 nt, Homo sapiens
ggaguaacugcauaaaugu

SEQ ID NO: 160885 - RNA, 19 nt, Homo sapiens
ccucuucaaccucuacuua

SEQ ID NO: 160886 - RNA, 19 nt, Homo sapiens
ucaacgaauuucagugguu

SEQ ID NO: 160887 - RNA, 19 nt, Homo sapiens
caaaugccagguucuaguu

SEQ ID NO: 160888 - RNA, 19 nt, Homo sapiens
caaacaaugucugccuaug

SEQ ID NO: 160889 - RNA, 19 nt, Homo sapiens
cgaaggggauguccuguuu

SEQ ID NO: 160890 - RNA, 19 nt, Homo sapiens
acagauuccuggcuaacaa

SEQ ID NO: 160891 - RNA, 19 nt, Homo sapiens
gauaaugggcaggacuuaa

SEQ ID NO: 160892 - RNA, 19 nt, Homo sapiens
ggagugugaucaaguucau

SEQ ID NO: 160893 - RNA, 19 nt, Homo sapiens
uuuauuagcagcugacuuu

SEQ ID NO: 160894 - RNA, 19 nt, Homo sapiens
caacaacauuccucaaaau

SEQ ID NO: 160895 - RNA, 19 nt, Homo sapiens
gggaugguguagaagaaga

SEQ ID NO: 160896 - RNA, 19 nt, Homo sapiens
gaaaaguaguguauguugu

SEQ ID NO: 160897 - RNA, 19 nt, Homo sapiens
agaggagugugaucaaguu

SEQ ID NO: 160898 - RNA, 19 nt, Homo sapiens
cagaucagcacaucaguau

SEQ ID NO: 160899 - RNA, 19 nt, Homo sapiens
guaacgacaacucaacuga

SEQ ID NO: 160900 - RNA, 19 nt, Homo sapiens
gggcaggacuuaaguaccu

SEQ ID NO: 160901 - RNA, 19 nt, Homo sapiens
ggacuccgcauggaagaaa

SEQ ID NO: 160902 - RNA, 19 nt, Homo sapiens
uaaagacaagacagcauuu

SEQ ID NO: 160903 - RNA, 19 nt, Homo sapiens
ccacacccaucaaagaucu

SEQ ID NO: 160904 - RNA, 19 nt, Homo sapiens
caagcccuauccacacauu

SEQ ID NO: 160905 - RNA, 19 nt, Homo sapiens
uagccuaccuaacccagaa

SEQ ID NO: 160906 - RNA, 19 nt, Homo sapiens
gagguuugaaucugacuuu

SEQ ID NO: 160907 - RNA, 19 nt, Homo sapiens
ggaugaggaaguuggcuuu

SEQ ID NO: 160908 - RNA, 19 nt, Homo sapiens
gaagacucccaggauuuaa

SEQ ID NO: 160909 - RNA, 19 nt, Homo sapiens
caaccucuacuuaucaguu

SEQ ID NO: 160910 - RNA, 19 nt, Homo sapiens
ggaaaugcaggaccuagca

SEQ ID NO: 160911 - RNA, 19 nt, Homo sapiens
gauguguugugccuuaaag

SEQ ID NO: 160912 - RNA, 19 nt, Homo sapiens
auaaaugucuugguaacga

SEQ ID NO: 160913 - RNA, 19 nt, Homo sapiens
ggaaguuggcuuuucguua

SEQ ID NO: 160914 - RNA, 19 nt, Homo sapiens
caaaugcacuuaagucuuu

SEQ ID NO: 160915 - RNA, 19 nt, Homo sapiens
gaaacucuauggucuuaua

SEQ ID NO: 160916 - RNA, 19 nt, Homo sapiens
gcacaucaguuacuacaaa

SEQ ID NO: 160917 - RNA, 19 nt, Homo sapiens
gaaggaacgagaauaaaua

SEQ ID NO: 160918 - RNA, 19 nt, Homo sapiens
gcacuuaagucuuuaucaa

SEQ ID NO: 160919 - RNA, 19 nt, Homo sapiens
gagagaaccuguaggaguu

SEQ ID NO: 160920 - RNA, 19 nt, Homo sapiens
gagcguauaugacaucgaa

SEQ ID NO: 160921 - RNA, 19 nt, Homo sapiens
gcaccaucaucuacuauuu

SEQ ID NO: 160922 - RNA, 19 nt, Homo sapiens
agacagcauuuguguguua

SEQ ID NO: 160923 - RNA, 19 nt, Homo sapiens
ggaaugcacucagacugua

SEQ ID NO: 160924 - RNA, 19 nt, Homo sapiens
ggaagacucccaggauuua

SEQ ID NO: 160925 - RNA, 19 nt, Homo sapiens
ggaaagagcugcgggaaaa

SEQ ID NO: 160926 - RNA, 19 nt, Homo sapiens
gaauuggaaugcacucaga

SEQ ID NO: 160927 - RNA, 19 nt, Homo sapiens
ggaaugagcagcuuuagca

SEQ ID NO: 160928 - RNA, 19 nt, Homo sapiens
ccaccaagcacuggaauua

SEQ ID NO: 160929 - RNA, 19 nt, Homo sapiens
gcaaguagugcaaaccuuu

SEQ ID NO: 160930 - RNA, 19 nt, Homo sapiens
ggacuuaaguaccuacagu

SEQ ID NO: 160931 - RNA, 19 nt, Homo sapiens
gagaauauuuacagugcaa

SEQ ID NO: 160932 - RNA, 19 nt, Homo sapiens
uagaugauguuuccucuga

SEQ ID NO: 160933 - RNA, 19 nt, Homo sapiens
ggaaggaacgagaauaaau

SEQ ID NO: 160934 - RNA, 19 nt, Homo sapiens
gcacuggaauuagaguauu

SEQ ID NO: 160935 - RNA, 19 nt, Homo sapiens
cugcauaaaugucuuggua

SEQ ID NO: 160936 - RNA, 19 nt, Homo sapiens
gccagacaccuuauucuua

SEQ ID NO: 160937 - RNA, 19 nt, Homo sapiens
gauguuuccucugaugaua

SEQ ID NO: 160938 - RNA, 19 nt, Homo sapiens
gaauuucagugguucacaa

SEQ ID NO: 160939 - RNA, 19 nt, Homo sapiens
gaucagcacaucaguauuc

SEQ ID NO: 160940 - RNA, 19 nt, Homo sapiens
cagaguggcugccucaguu

SEQ ID NO: 160941 - RNA, 19 nt, Homo sapiens
ggaacgagaauaaauacuu

SEQ ID NO: 160942 - RNA, 19 nt, Homo sapiens
gcucuacacauauaaauug

SEQ ID NO: 160943 - RNA, 19 nt, Homo sapiens
aggaguaacugcauaaaug

SEQ ID NO: 160944 - RNA, 19 nt, Homo sapiens
gaacgaauaaugcaaaggu

SEQ ID NO: 160945 - RNA, 19 nt, Homo sapiens
caagacagcauuugugugu

SEQ ID NO: 160946 - RNA, 19 nt, Homo sapiens
caacugaucccagcacuug

SEQ ID NO: 160947 - RNA, 19 nt, Homo sapiens
gcuaacaaaugcacuuaag

SEQ ID NO: 160948 - RNA, 19 nt, Homo sapiens
ggaggugucucuucuugca

SEQ ID NO: 160949 - RNA, 19 nt, Homo sapiens
gaugauguuuccucugaug

SEQ ID NO: 160950 - RNA, 19 nt, Homo sapiens
agaaucagauguuucacaa

SEQ ID NO: 160951 - RNA, 19 nt, Homo sapiens
ggucuuaugcacagaagua

SEQ ID NO: 160952 - RNA, 19 nt, Homo sapiens
gggaaaugggaauauaaua

SEQ ID NO: 160953 - RNA, 19 nt, Homo sapiens
gcauaaaugucuugguaac

SEQ ID NO: 160954 - RNA, 19 nt, Homo sapiens
gaugagagaaccuguagga

SEQ ID NO: 160955 - RNA, 19 nt, Homo sapiens
gcaaauaauucaguuucca

SEQ ID NO: 160956 - RNA, 19 nt, Homo sapiens
ccagacaccuuauucuuac

SEQ ID NO: 160957 - RNA, 19 nt, Homo sapiens
aaacagagcccuugaacag

SEQ ID NO: 160958 - RNA, 19 nt, Homo sapiens
aaucagauguuucacaauc

SEQ ID NO: 160959 - RNA, 19 nt, Homo sapiens
gaggauauccagucacuca

SEQ ID NO: 160960 - RNA, 19 nt, Homo sapiens
gagaguggacuuucccaaa

SEQ ID NO: 160961 - RNA, 19 nt, Homo sapiens
ggucaguaauuacaaguag

SEQ ID NO: 160962 - RNA, 19 nt, Homo sapiens
gcacucagacuguauaagg

SEQ ID NO: 160963 - RNA, 19 nt, Homo sapiens
cgaagguucuacucuauag

SEQ ID NO: 160964 - RNA, 19 nt, Homo sapiens
gugaucaaguucauauaga

SEQ ID NO: 160965 - RNA, 19 nt, Homo sapiens
gcagaaaaguaguguaugu

SEQ ID NO: 160966 - RNA, 19 nt, Homo sapiens
caaagaucuugaugagaga

SEQ ID NO: 160967 - RNA, 19 nt, Homo sapiens
aaaccaguaugcacaguau

SEQ ID NO: 160968 - RNA, 19 nt, Homo sapiens
caggaggugucucuucuug

SEQ ID NO: 160969 - RNA, 19 nt, Homo sapiens
aaacuuuagugcuacagaa

SEQ ID NO: 160970 - RNA, 19 nt, Homo sapiens
gccucuggcucuacacaua

SEQ ID NO: 160971 - RNA, 19 nt, Homo sapiens
uauaacaccuacaagaaca

SEQ ID NO: 160972 - RNA, 19 nt, Homo sapiens
caacguauggagcguauau

SEQ ID NO: 160973 - RNA, 19 nt, Homo sapiens
ggucuuauauuuacaacac

SEQ ID NO: 160974 - RNA, 19 nt, Homo sapiens
guucuacucuauaguuuag

SEQ ID NO: 160975 - RNA, 19 nt, Homo sapiens
uaacaaaugcacuuaaguc

SEQ ID NO: 160976 - RNA, 19 nt, Homo sapiens
gcguauaugacaucgaaua

SEQ ID NO: 160977 - RNA, 19 nt, Homo sapiens
caccaucaucuacuauuua

SEQ ID NO: 160978 - RNA, 19 nt, Homo sapiens
gaaguuggcuuuucguuac

SEQ ID NO: 160979 - RNA, 19 nt, Homo sapiens
auggagcgcuugacacuuu

SEQ ID NO: 160980 - RNA, 19 nt, Homo sapiens
gcacagaaucagauguuuc

SEQ ID NO: 160981 - RNA, 19 nt, Homo sapiens
acugauguguugugccuua

SEQ ID NO: 160982 - RNA, 19 nt, Homo sapiens
caaagcagcaacacacaug

SEQ ID NO: 160983 - RNA, 19 nt, Homo sapiens
gcgaagguucuacucuaua

SEQ ID NO: 160984 - RNA, 19 nt, Homo sapiens
ggaguaacugcauaaaugu

SEQ ID NO: 160985 - RNA, 19 nt, Homo sapiens
ccucuucaaccucuacuua

SEQ ID NO: 160986 - RNA, 19 nt, Homo sapiens
ucaacgaauuucagugguu

SEQ ID NO: 160987 - RNA, 19 nt, Homo sapiens
caaaugccagguucuaguu

SEQ ID NO: 160988 - RNA, 19 nt, Homo sapiens
caaacaaugucugccuaug

SEQ ID NO: 160989 - RNA, 19 nt, Homo sapiens
cgaaggggauguccuguuu

SEQ ID NO: 160990 - RNA, 19 nt, Homo sapiens
acagauuccuggcuaacaa

SEQ ID NO: 160991 - RNA, 19 nt, Homo sapiens
gauaaugggcaggacuuaa

SEQ ID NO: 160992 - RNA, 19 nt, Homo sapiens
ggagugugaucaaguucau

SEQ ID NO: 160993 - RNA, 19 nt, Homo sapiens
uuuauuagcagcugacuuu

SEQ ID NO: 160994 - RNA, 19 nt, Homo sapiens
caacaacauuccucaaaau

SEQ ID NO: 160995 - RNA, 19 nt, Homo sapiens
gggaugguguagaagaaga

SEQ ID NO: 160996 - RNA, 19 nt, Homo sapiens
gaaaaguaguguauguugu

SEQ ID NO: 160997 - RNA, 19 nt, Homo sapiens
agaggagugugaucaaguu

SEQ ID NO: 160998 - RNA, 19 nt, Homo sapiens
cagaucagcacaucaguau

SEQ ID NO: 160999 - RNA, 19 nt, Homo sapiens
guaacgacaacucaacuga

SEQ ID NO: 161000 - RNA, 19 nt, Homo sapiens
gggcaggacuuaaguaccu

SEQ ID NO: 161001 - RNA, 19 nt, Homo sapiens
ggacuccgcauggaagaaa

SEQ ID NO: 161002 - RNA, 19 nt, Homo sapiens
uaaagacaagacagcauuu

SEQ ID NO: 161003 - RNA, 19 nt, Homo sapiens
ccacacccaucaaagaucu

SEQ ID NO: 161004 - RNA, 19 nt, Homo sapiens
caagcccuauccacacauu

SEQ ID NO: 161005 - RNA, 19 nt, Homo sapiens
uagccuaccuaacccagaa

SEQ ID NO: 161006 - RNA, 19 nt, Homo sapiens
gagguuugaaucugacuuu

SEQ ID NO: 161007 - RNA, 19 nt, Homo sapiens
ggaugaggaaguuggcuuu

SEQ ID NO: 161008 - RNA, 19 nt, Homo sapiens
gaagacucccaggauuuaa

SEQ ID NO: 161009 - RNA, 19 nt, Homo sapiens
caaccucuacuuaucaguu

SEQ ID NO: 161010 - RNA, 19 nt, Homo sapiens
ggaaaugcaggaccuagca

SEQ ID NO: 161011 - RNA, 19 nt, Homo sapiens
gauguguugugccuuaaag

SEQ ID NO: 161012 - RNA, 19 nt, Homo sapiens
auaaaugucuugguaacga

SEQ ID NO: 161013 - RNA, 19 nt, Homo sapiens
ggaaguuggcuuuucguua

SEQ ID NO: 161014 - RNA, 19 nt, Homo sapiens
caaaugcacuuaagucuuu

SEQ ID NO: 161015 - RNA, 19 nt, Homo sapiens
gaaacucuauggucuuaua

SEQ ID NO: 161016 - RNA, 19 nt, Homo sapiens
gcacaucaguuacuacaaa

SEQ ID NO: 161017 - RNA, 19 nt, Homo sapiens
gaaggaacgagaauaaaua

SEQ ID NO: 161018 - RNA, 19 nt, Homo sapiens
gcacuuaagucuuuaucaa

SEQ ID NO: 161019 - RNA, 19 nt, Homo sapiens
gagagaaccuguaggaguu

SEQ ID NO: 161020 - RNA, 19 nt, Homo sapiens
gcaacaaugucucuucuug

SEQ ID NO: 161021 - RNA, 19 nt, Homo sapiens
gagcguauaugacaucgaa

SEQ ID NO: 161022 - RNA, 19 nt, Homo sapiens
gcaccaucaucuacuauuu

SEQ ID NO: 161023 - RNA, 19 nt, Homo sapiens
agacagcauuuguguguua

SEQ ID NO: 161024 - RNA, 19 nt, Homo sapiens
ggaaugcacucagacugua

SEQ ID NO: 161025 - RNA, 19 nt, Homo sapiens
ggaagacucccaggauuua

SEQ ID NO: 161026 - RNA, 19 nt, Homo sapiens
gggcaggacuuagguguaa

SEQ ID NO: 161027 - RNA, 19 nt, Homo sapiens
ggaaagagcugcgggaaaa

SEQ ID NO: 161028 - RNA, 19 nt, Homo sapiens
gaauuggaaugcacucaga

SEQ ID NO: 161029 - RNA, 19 nt, Homo sapiens
ggaaugagcagcuuuagca

SEQ ID NO: 161030 - RNA, 19 nt, Homo sapiens
ccaccaagcacuggaauua

SEQ ID NO: 161031 - RNA, 19 nt, Homo sapiens
gagaauauuuacagugcaa

SEQ ID NO: 161032 - RNA, 19 nt, Homo sapiens
uagaugauguuuccucuga

SEQ ID NO: 161033 - RNA, 19 nt, Homo sapiens
ggaaggaacgagaauaaau

SEQ ID NO: 161034 - RNA, 19 nt, Homo sapiens
gcacuggaauuagaguauu

SEQ ID NO: 161035 - RNA, 19 nt, Homo sapiens
cugcauaaaugucuuggua

SEQ ID NO: 161036 - RNA, 19 nt, Homo sapiens
gccagacaccuuauucuua

SEQ ID NO: 161037 - RNA, 19 nt, Homo sapiens
gauguuuccucugaugaua

SEQ ID NO: 161038 - RNA, 19 nt, Homo sapiens
gaauuucagugguucacaa

SEQ ID NO: 161039 - RNA, 19 nt, Homo sapiens
gaucagcacaucaguauuc

SEQ ID NO: 161040 - RNA, 19 nt, Homo sapiens
cagaguggcugccucaguu

SEQ ID NO: 161041 - RNA, 19 nt, Homo sapiens
ggaacgagaauaaauacuu

SEQ ID NO: 161042 - RNA, 19 nt, Homo sapiens
gcucuacacauauaaauug

SEQ ID NO: 161043 - RNA, 19 nt, Homo sapiens
aggaguaacugcauaaaug

SEQ ID NO: 161044 - RNA, 19 nt, Homo sapiens
gaacgaauaaugcaaaggu

SEQ ID NO: 161045 - RNA, 19 nt, Homo sapiens
caagacagcauuugugugu

SEQ ID NO: 161046 - RNA, 19 nt, Homo sapiens
caacugaucccagcacuug

SEQ ID NO: 161047 - RNA, 19 nt, Homo sapiens
gcuaacaaaugcacuuaag

SEQ ID NO: 161048 - RNA, 19 nt, Homo sapiens
gaugauguuuccucugaug

SEQ ID NO: 161049 - RNA, 19 nt, Homo sapiens
gcagacugguugcugaguu

SEQ ID NO: 161050 - RNA, 19 nt, Homo sapiens
agaaucagauguuucacaa

SEQ ID NO: 161051 - RNA, 19 nt, Homo sapiens
ggucuuaugcacagaagua

SEQ ID NO: 161052 - RNA, 19 nt, Homo sapiens
gggaaaugggaauauaaua

SEQ ID NO: 161053 - RNA, 19 nt, Homo sapiens
gcauaaaugucuugguaac

SEQ ID NO: 161054 - RNA, 19 nt, Homo sapiens
gaugagagaaccuguagga

SEQ ID NO: 161055 - RNA, 19 nt, Homo sapiens
gcaaauaauucaguuucca

SEQ ID NO: 161056 - RNA, 19 nt, Homo sapiens
ccagacaccuuauucuuac

SEQ ID NO: 161057 - RNA, 19 nt, Homo sapiens
aaacagagcccuugaacag

SEQ ID NO: 161058 - RNA, 19 nt, Homo sapiens
aaucagauguuucacaauc

SEQ ID NO: 161059 - RNA, 19 nt, Homo sapiens
gaggauauccagucacuca

SEQ ID NO: 161060 - RNA, 19 nt, Homo sapiens
gagaguggacuuucccaaa

SEQ ID NO: 161061 - RNA, 19 nt, Homo sapiens
ggucaguaauuacaaguag

SEQ ID NO: 161062 - RNA, 19 nt, Homo sapiens
gcacucagacuguauaagg

SEQ ID NO: 161063 - RNA, 19 nt, Homo sapiens
cgaagguucuacucuauag

SEQ ID NO: 161064 - RNA, 19 nt, Homo sapiens
gugaucaaguucauauaga

SEQ ID NO: 161065 - RNA, 19 nt, Homo sapiens
gcagaaaaguaguguaugu

SEQ ID NO: 161066 - RNA, 19 nt, Homo sapiens
caaagaucuugaugagaga

SEQ ID NO: 161067 - RNA, 19 nt, Homo sapiens
aaaccaguaugcacaguau

SEQ ID NO: 161068 - RNA, 19 nt, Homo sapiens
aaacuuuagugcuacagaa

SEQ ID NO: 161069 - RNA, 19 nt, Homo sapiens
gccucuggcucuacacaua

SEQ ID NO: 161070 - RNA, 19 nt, Homo sapiens
uauaacaccuacaagaaca

SEQ ID NO: 161071 - RNA, 19 nt, Homo sapiens
caacguauggagcguauau

SEQ ID NO: 161072 - RNA, 19 nt, Homo sapiens
ggucuuauauuuacaacac

SEQ ID NO: 161073 - RNA, 19 nt, Homo sapiens
guucuacucuauaguuuag

SEQ ID NO: 161074 - RNA, 19 nt, Homo sapiens
uaacaaaugcacuuaaguc

SEQ ID NO: 161075 - RNA, 19 nt, Homo sapiens
gcguauaugacaucgaaua

SEQ ID NO: 161076 - RNA, 19 nt, Homo sapiens
caccaucaucuacuauuua

SEQ ID NO: 161077 - RNA, 19 nt, Homo sapiens
gaaguuggcuuuucguuac

SEQ ID NO: 161078 - RNA, 19 nt, Homo sapiens
auggagcgcuugacacuuu

SEQ ID NO: 161079 - RNA, 19 nt, Homo sapiens
gcacagaaucagauguuuc

SEQ ID NO: 161080 - RNA, 19 nt, Homo sapiens
acugauguguugugccuua

SEQ ID NO: 161081 - RNA, 19 nt, Homo sapiens
caaagcagcaacacacaug

SEQ ID NO: 161082 - RNA, 19 nt, Homo sapiens
gcgaagguucuacucuaua

SEQ ID NO: 161083 - RNA, 19 nt, Homo sapiens
ggaguaacugcauaaaugu

SEQ ID NO: 161084 - RNA, 19 nt, Homo sapiens
ccucuucaaccucuacuua

SEQ ID NO: 161085 - RNA, 19 nt, Homo sapiens
ucaacgaauuucagugguu

SEQ ID NO: 161086 - RNA, 19 nt, Homo sapiens
caaaugccagguucuaguu

SEQ ID NO: 161087 - RNA, 19 nt, Homo sapiens
caaacaaugucugccuaug

SEQ ID NO: 161088 - RNA, 19 nt, Homo sapiens
cgaaggggauguccuguuu

SEQ ID NO: 161089 - RNA, 19 nt, Homo sapiens
acagauuccuggcuaacaa

SEQ ID NO: 161090 - RNA, 19 nt, Homo sapiens
ggagugugaucaaguucau

SEQ ID NO: 161091 - RNA, 19 nt, Homo sapiens
uuuauuagcagcugacuuu

SEQ ID NO: 161092 - RNA, 19 nt, Homo sapiens
caacaacauuccucaaaau

SEQ ID NO: 161093 - RNA, 19 nt, Homo sapiens
gggaugguguagaagaaga

SEQ ID NO: 161094 - RNA, 19 nt, Homo sapiens
gaaaaguaguguauguugu

SEQ ID NO: 161095 - RNA, 19 nt, Homo sapiens
agaggagugugaucaaguu

SEQ ID NO: 161096 - RNA, 19 nt, Homo sapiens
cagaucagcacaucaguau

SEQ ID NO: 161097 - RNA, 19 nt, Homo sapiens
guaacgacaacucaacuga

SEQ ID NO: 161098 - RNA, 19 nt, Homo sapiens
ggacuccgcauggaagaaa

SEQ ID NO: 161099 - RNA, 19 nt, Homo sapiens
uaaagacaagacagcauuu

SEQ ID NO: 161100 - RNA, 19 nt, Homo sapiens
ccacacccaucaaagaucu

SEQ ID NO: 161101 - RNA, 19 nt, Homo sapiens
caagcccuauccacacauu

SEQ ID NO: 161102 - RNA, 19 nt, Homo sapiens
uagccuaccuaacccagaa

SEQ ID NO: 161103 - RNA, 19 nt, Homo sapiens
gagguuugaaucugacuuu

SEQ ID NO: 161104 - RNA, 19 nt, Homo sapiens
ggaugaggaaguuggcuuu

SEQ ID NO: 161105 - RNA, 19 nt, Homo sapiens
caaccucuacuuaucaguu

SEQ ID NO: 161106 - RNA, 19 nt, Homo sapiens
ggaaaugcaggaccuagca

SEQ ID NO: 161107 - RNA, 19 nt, Homo sapiens
gaagacucccaggauuuaa

SEQ ID NO: 161108 - RNA, 19 nt, Homo sapiens
gauguguugugccuuaaag

SEQ ID NO: 161109 - RNA, 19 nt, Homo sapiens
auaaaugucuugguaacga

SEQ ID NO: 161110 - RNA, 19 nt, Homo sapiens
ggaaguuggcuuuucguua

SEQ ID NO: 161111 - RNA, 19 nt, Homo sapiens
gaucaaguucauauagaug

SEQ ID NO: 161112 - RNA, 19 nt, Homo sapiens
uaaccaaccaggagaguuc

SEQ ID NO: 161113 - RNA, 19 nt, Homo sapiens
guauggagcguauaugaca

SEQ ID NO: 161114 - RNA, 19 nt, Homo sapiens
caaaugcacuuaagucuuu

SEQ ID NO: 161115 - RNA, 19 nt, Homo sapiens
gaaacucuauggucuuaua

SEQ ID NO: 161116 - RNA, 19 nt, Homo sapiens
gcacaucaguuacuacaaa

SEQ ID NO: 161117 - RNA, 19 nt, Homo sapiens
gaaggaacgagaauaaaua

SEQ ID NO: 161118 - RNA, 19 nt, Homo sapiens
gcacuuaagucuuuaucaa

SEQ ID NO: 161119 - RNA, 19 nt, Homo sapiens
gagagaaccuguaggaguu

SEQ ID NO: 161120 - RNA, 19 nt, Homo sapiens
gcaacaaugucucuucuug

SEQ ID NO: 161121 - RNA, 19 nt, Homo sapiens
gagcguauaugacaucgaa

SEQ ID NO: 161122 - RNA, 19 nt, Homo sapiens
gcaccaucaucuacuauuu

SEQ ID NO: 161123 - RNA, 19 nt, Homo sapiens
agacagcauuuguguguua

SEQ ID NO: 161124 - RNA, 19 nt, Homo sapiens
ggaaugcacucagacugua

SEQ ID NO: 161125 - RNA, 19 nt, Homo sapiens
ggaagacucccaggauuua

SEQ ID NO: 161126 - RNA, 19 nt, Homo sapiens
ggaaagagcugcgggaaaa

SEQ ID NO: 161127 - RNA, 19 nt, Homo sapiens
uaacuuauguugugauugg

SEQ ID NO: 161128 - RNA, 19 nt, Homo sapiens
gaauuggaaugcacucaga

SEQ ID NO: 161129 - RNA, 19 nt, Homo sapiens
ggaaugagcagcuuuagca

SEQ ID NO: 161130 - RNA, 19 nt, Homo sapiens
ccaccaagcacuggaauua

SEQ ID NO: 161131 - RNA, 19 nt, Homo sapiens
gcaaguagugcaaaccuuu

SEQ ID NO: 161132 - RNA, 19 nt, Homo sapiens
ggacuuaaguaccuacagu

SEQ ID NO: 161133 - RNA, 19 nt, Homo sapiens
gagaauauuuacagugcaa

SEQ ID NO: 161134 - RNA, 19 nt, Homo sapiens
uagaugauguuuccucuga

SEQ ID NO: 161135 - RNA, 19 nt, Homo sapiens
ggaaggaacgagaauaaau

SEQ ID NO: 161136 - RNA, 19 nt, Homo sapiens
gcacuggaauuagaguauu

SEQ ID NO: 161137 - RNA, 19 nt, Homo sapiens
cugcauaaaugucuuggua

SEQ ID NO: 161138 - RNA, 19 nt, Homo sapiens
gccagacaccuuauucuua

SEQ ID NO: 161139 - RNA, 19 nt, Homo sapiens
gauguuuccucugaugaua

SEQ ID NO: 161140 - RNA, 19 nt, Homo sapiens
gaauuucagugguucacaa

SEQ ID NO: 161141 - RNA, 19 nt, Homo sapiens
gaucagcacaucaguauuc

SEQ ID NO: 161142 - RNA, 19 nt, Homo sapiens
cagaguggcugccucaguu

SEQ ID NO: 161143 - RNA, 19 nt, Homo sapiens
ggaacgagaauaaauacuu

SEQ ID NO: 161144 - RNA, 19 nt, Homo sapiens
gcucuacacauauaaauug

SEQ ID NO: 161145 - RNA, 19 nt, Homo sapiens
aggaguaacugcauaaaug

SEQ ID NO: 161146 - RNA, 19 nt, Homo sapiens
caagacagcauuugugugu

SEQ ID NO: 161147 - RNA, 19 nt, Homo sapiens
caacugaucccagcacuug

SEQ ID NO: 161148 - RNA, 19 nt, Homo sapiens
gcuaacaaaugcacuuaag

SEQ ID NO: 161149 - RNA, 19 nt, Homo sapiens
gaugauguuuccucugaug

SEQ ID NO: 161150 - RNA, 19 nt, Homo sapiens
gcagacugguugcugaguu

SEQ ID NO: 161151 - RNA, 19 nt, Homo sapiens
agaaucagauguuucacaa

SEQ ID NO: 161152 - RNA, 19 nt, Homo sapiens
ggucuuaugcacagaagua

SEQ ID NO: 161153 - RNA, 19 nt, Homo sapiens
gggaaaugggaauauaaua

SEQ ID NO: 161154 - RNA, 19 nt, Homo sapiens
gcauaaaugucuugguaac

SEQ ID NO: 161155 - RNA, 19 nt, Homo sapiens
gaugagagaaccuguagga

SEQ ID NO: 161156 - RNA, 19 nt, Homo sapiens
gcaaauaauucaguuucca

SEQ ID NO: 161157 - RNA, 19 nt, Homo sapiens
ccagacaccuuauucuuac

SEQ ID NO: 161158 - RNA, 19 nt, Homo sapiens
aaacagagcccuugaacag

SEQ ID NO: 161159 - RNA, 19 nt, Homo sapiens
aaucagauguuucacaauc

SEQ ID NO: 161160 - RNA, 19 nt, Homo sapiens
gaggauauccagucacuca

SEQ ID NO: 161161 - RNA, 19 nt, Homo sapiens
gagaguggacuuucccaaa

SEQ ID NO: 161162 - RNA, 19 nt, Homo sapiens
ggucaguaauuacaaguag

SEQ ID NO: 161163 - RNA, 19 nt, Homo sapiens
gcacucagacuguauaagg

SEQ ID NO: 161164 - RNA, 19 nt, Homo sapiens
cgaagguucuacucuauag

SEQ ID NO: 161165 - RNA, 19 nt, Homo sapiens
gugaucaaguucauauaga

SEQ ID NO: 161166 - RNA, 19 nt, Homo sapiens
caaagaucuugaugagaga

SEQ ID NO: 161167 - RNA, 19 nt, Homo sapiens
aaaccaguaugcacaguau

SEQ ID NO: 161168 - RNA, 19 nt, Homo sapiens
aaacuuuagugcuacagaa

SEQ ID NO: 161169 - RNA, 19 nt, Homo sapiens
gccucuggcucuacacaua

SEQ ID NO: 161170 - RNA, 19 nt, Homo sapiens
gauuggagauggccgagau

SEQ ID NO: 161171 - RNA, 19 nt, Homo sapiens
uauaacaccuacaagaaca

SEQ ID NO: 161172 - RNA, 19 nt, Homo sapiens
caacguauggagcguauau

SEQ ID NO: 161173 - RNA, 19 nt, Homo sapiens
ggucuuauauuuacaacac

SEQ ID NO: 161174 - RNA, 19 nt, Homo sapiens
guucuacucuauaguuuag

SEQ ID NO: 161175 - RNA, 19 nt, Homo sapiens
uaacaaaugcacuuaaguc

SEQ ID NO: 161176 - RNA, 19 nt, Homo sapiens
gcguauaugacaucgaaua

SEQ ID NO: 161177 - RNA, 19 nt, Homo sapiens
caccaucaucuacuauuua

SEQ ID NO: 161178 - RNA, 19 nt, Homo sapiens
cguauaguguccagauuug

SEQ ID NO: 161179 - RNA, 19 nt, Homo sapiens
gaaguuggcuuuucguuac

SEQ ID NO: 161180 - RNA, 19 nt, Homo sapiens
auggagcgcuugacacuuu

SEQ ID NO: 161181 - RNA, 19 nt, Homo sapiens
gcacagaaucagauguuuc

SEQ ID NO: 161182 - RNA, 19 nt, Homo sapiens
acugauguguugugccuua

SEQ ID NO: 161183 - RNA, 19 nt, Homo sapiens
caaagcagcaacacacaug

SEQ ID NO: 161184 - RNA, 19 nt, Homo sapiens
gcgaagguucuacucuaua

SEQ ID NO: 161185 - RNA, 19 nt, Homo sapiens
ggaguaacugcauaaaugu

SEQ ID NO: 161186 - RNA, 19 nt, Homo sapiens
ccucuucaaccucuacuua

SEQ ID NO: 161187 - RNA, 19 nt, Homo sapiens
ucaacgaauuucagugguu

SEQ ID NO: 161188 - RNA, 19 nt, Homo sapiens
caaaugccagguucuaguu

SEQ ID NO: 161189 - RNA, 19 nt, Homo sapiens
caaacaaugucugccuaug

SEQ ID NO: 161190 - RNA, 19 nt, Homo sapiens
cgaaggggauguccuguuu

SEQ ID NO: 161191 - RNA, 19 nt, Homo sapiens
acagauuccuggcuaacaa

SEQ ID NO: 161192 - RNA, 19 nt, Homo sapiens
gauaaugggcaggacuuaa

SEQ ID NO: 161193 - RNA, 19 nt, Homo sapiens
ggagugugaucaaguucau

SEQ ID NO: 161194 - RNA, 19 nt, Homo sapiens
uuuauuagcagcugacuuu

SEQ ID NO: 161195 - RNA, 19 nt, Homo sapiens
caacaacauuccucaaaau

SEQ ID NO: 161196 - RNA, 19 nt, Homo sapiens
agaggagugugaucaaguu

SEQ ID NO: 161197 - RNA, 19 nt, Homo sapiens
cagaucagcacaucaguau

SEQ ID NO: 161198 - RNA, 19 nt, Homo sapiens
guaacgacaacucaacuga

SEQ ID NO: 161199 - RNA, 19 nt, Homo sapiens
gggcaggacuuaaguaccu

SEQ ID NO: 161200 - RNA, 19 nt, Homo sapiens
ggacuccgcauggaagaaa

SEQ ID NO: 161201 - RNA, 19 nt, Homo sapiens
uaaagacaagacagcauuu

SEQ ID NO: 161202 - RNA, 19 nt, Homo sapiens
gcguauaguguccagauuu

SEQ ID NO: 161203 - RNA, 19 nt, Homo sapiens
ccacacccaucaaagaucu

SEQ ID NO: 161204 - RNA, 19 nt, Homo sapiens
caagcccuauccacacauu

SEQ ID NO: 161205 - RNA, 19 nt, Homo sapiens
uagccuaccuaacccagaa

SEQ ID NO: 161206 - RNA, 19 nt, Homo sapiens
gagguuugaaucugacuuu

SEQ ID NO: 161207 - RNA, 19 nt, Homo sapiens
ggaugaggaaguuggcuuu

SEQ ID NO: 161208 - RNA, 19 nt, Homo sapiens
gaagacucccaggauuuaa

SEQ ID NO: 161209 - RNA, 19 nt, Homo sapiens
caaccucuacuuaucaguu

SEQ ID NO: 161210 - RNA, 19 nt, Homo sapiens
ggaaaugcaggaccuagca

SEQ ID NO: 161211 - RNA, 19 nt, Homo sapiens
gauguguugugccuuaaag

SEQ ID NO: 161212 - RNA, 19 nt, Homo sapiens
agauuuggcacuaacauaa

SEQ ID NO: 161213 - RNA, 19 nt, Homo sapiens
auaaaugucuugguaacga

SEQ ID NO: 161214 - RNA, 19 nt, Homo sapiens
gagaagagcuugcgaaaga

SEQ ID NO: 161215 - RNA, 19 nt, Homo sapiens
ggauggagcugcagaauaa

SEQ ID NO: 161216 - RNA, 19 nt, Homo sapiens
ggacaaggaugaagaagaa

SEQ ID NO: 161217 - RNA, 19 nt, Homo sapiens
gcaccaaaguggaugaaua

SEQ ID NO: 161218 - RNA, 19 nt, Homo sapiens
gaacaaacccuauaucuac

SEQ ID NO: 161219 - RNA, 19 nt, Homo sapiens
ccacugagcucaucacaga

SEQ ID NO: 161220 - RNA, 19 nt, Homo sapiens
gaauaugacuuccggaaug

SEQ ID NO: 161221 - RNA, 19 nt, Homo sapiens
caaaguggaugaauaugga

SEQ ID NO: 161222 - RNA, 19 nt, Homo sapiens
gggaauauguggcaaucaa

SEQ ID NO: 161223 - RNA, 19 nt, Homo sapiens
aaacgaaucuugcuguaca

SEQ ID NO: 161224 - RNA, 19 nt, Homo sapiens
gcccacagcuguccucaga

SEQ ID NO: 161225 - RNA, 19 nt, Homo sapiens
gagaaugccgcuuaagaaa

SEQ ID NO: 161226 - RNA, 19 nt, Homo sapiens
gaaugccgcuuaagaaacu

SEQ ID NO: 161227 - RNA, 19 nt, Homo sapiens
caaccaagcggcagagauu

SEQ ID NO: 161228 - RNA, 19 nt, Homo sapiens
gggaaaggaugcaaauucu

SEQ ID NO: 161229 - RNA, 19 nt, Homo sapiens
gaauuuggcuccagaucca

SEQ ID NO: 161230 - RNA, 19 nt, Homo sapiens
ccaggaagcggcacuauga

SEQ ID NO: 161231 - RNA, 19 nt, Homo sapiens
ggaaagcccaguucaagau

SEQ ID NO: 161232 - RNA, 19 nt, Homo sapiens
ggaccuguuugacuucuau

SEQ ID NO: 161233 - RNA, 19 nt, Homo sapiens
ggaggaggagacaauauuu

SEQ ID NO: 161234 - RNA, 19 nt, Homo sapiens
gaucaagguuauagcuuca

SEQ ID NO: 161235 - RNA, 19 nt, Homo sapiens
ggaugaagaagaagaagaa

SEQ ID NO: 161236 - RNA, 19 nt, Homo sapiens
ugacagauccacaggguaa

SEQ ID NO: 161237 - RNA, 19 nt, Homo sapiens
gauccgagaaugccgcuua

SEQ ID NO: 161238 - RNA, 19 nt, Homo sapiens
gacaauguguuugcccuaa

SEQ ID NO: 161239 - RNA, 19 nt, Homo sapiens
caaauaugcccaagacuuc

SEQ ID NO: 161240 - RNA, 19 nt, Homo sapiens
cagcagcucuuacagaaag

SEQ ID NO: 161241 - RNA, 19 nt, Homo sapiens
gcagaauaauggcuacauc

SEQ ID NO: 161242 - RNA, 19 nt, Homo sapiens
gaaaguugccacccugaug

SEQ ID NO: 161243 - RNA, 19 nt, Homo sapiens
caacagcagcucuuacaga

SEQ ID NO: 161244 - RNA, 19 nt, Homo sapiens
gcacaacagauacuucguu

SEQ ID NO: 161245 - RNA, 19 nt, Homo sapiens
ggaggaagacuuggcguuu

SEQ ID NO: 161246 - RNA, 19 nt, Homo sapiens
ugaacaaacccuauaucua

SEQ ID NO: 161247 - RNA, 19 nt, Homo sapiens
ggaggaaugacaagauuau

SEQ ID NO: 161248 - RNA, 19 nt, Homo sapiens
auuuagagcuugccaguuu

SEQ ID NO: 161249 - RNA, 19 nt, Homo sapiens
ucucuccaguuuacaaaua

SEQ ID NO: 161250 - RNA, 19 nt, Homo sapiens
cgacugaacaaacccuaua

SEQ ID NO: 161251 - RNA, 19 nt, Homo sapiens
ccauggaccuguuugacuu

SEQ ID NO: 161252 - RNA, 19 nt, Homo sapiens
cgagaaugccgcuuaagaa

SEQ ID NO: 161253 - RNA, 19 nt, Homo sapiens
gauggaauuaugcaguuua

SEQ ID NO: 161254 - RNA, 19 nt, Homo sapiens
uauguuaccguucugaaua

SEQ ID NO: 161255 - RNA, 19 nt, Homo sapiens
ugaagaggaugaugaagag

SEQ ID NO: 161256 - RNA, 19 nt, Homo sapiens
gccaguuucugaucaaguu

SEQ ID NO: 161257 - RNA, 19 nt, Homo sapiens
agaaacgaaucuugcugua

SEQ ID NO: 161258 - RNA, 19 nt, Homo sapiens
cccuaugucuccugaauuu

SEQ ID NO: 161259 - RNA, 19 nt, Homo sapiens
gaaaggaggaaugacaaga

SEQ ID NO: 161260 - RNA, 19 nt, Homo sapiens
ucacagagacuuucacaag

SEQ ID NO: 161261 - RNA, 19 nt, Homo sapiens
gcuuggcugugccuucaua

SEQ ID NO: 161262 - RNA, 19 nt, Homo sapiens
caaauugugcugaggaaga

SEQ ID NO: 161263 - RNA, 19 nt, Homo sapiens
gaaauggcuuacucaacca

SEQ ID NO: 161264 - RNA, 19 nt, Homo sapiens
ggaugaagaggaugaugaa

SEQ ID NO: 161265 - RNA, 19 nt, Homo sapiens
gcaaauggacaaggaugaa

SEQ ID NO: 161266 - RNA, 19 nt, Homo sapiens
uggagucccugauggaauu

SEQ ID NO: 161267 - RNA, 19 nt, Homo sapiens
aacagcagcucuuacagaa

SEQ ID NO: 161268 - RNA, 19 nt, Homo sapiens
ggaugaagugcacaccaua

SEQ ID NO: 161269 - RNA, 19 nt, Homo sapiens
ugcgaaagauguuuggaaa

SEQ ID NO: 161270 - RNA, 19 nt, Homo sapiens
ugacuucuaugagcaaaug

SEQ ID NO: 161271 - RNA, 19 nt, Homo sapiens
gaagaagaagagacacaga

SEQ ID NO: 161272 - RNA, 19 nt, Homo sapiens
gcuucaaggugaucacgaa

SEQ ID NO: 161273 - RNA, 19 nt, Homo sapiens
aaggaggaaugacaagauu

SEQ ID NO: 161274 - RNA, 19 nt, Homo sapiens
gaaucuugcuguacaccau

SEQ ID NO: 161275 - RNA, 19 nt, Homo sapiens
ggaauauguggcaaucaaa

SEQ ID NO: 161276 - RNA, 19 nt, Homo sapiens
ggaaaugauugaggaacuc

SEQ ID NO: 161277 - RNA, 19 nt, Homo sapiens
gaagucaagcaggaaauga

SEQ ID NO: 161278 - RNA, 19 nt, Homo sapiens
uuacaaauaugcccaagac

SEQ ID NO: 161279 - RNA, 19 nt, Homo sapiens
cauaggucaucuaggguuu

SEQ ID NO: 161280 - RNA, 19 nt, Homo sapiens
gcgcuuggcacccuuguug

SEQ ID NO: 161281 - RNA, 19 nt, Homo sapiens
ccaggcaucucggcgcuuu

SEQ ID NO: 161282 - RNA, 19 nt, Homo sapiens
acacacaggaaauggcuua

SEQ ID NO: 161283 - RNA, 19 nt, Homo sapiens
gaagagcuugcgaaagaug

SEQ ID NO: 161284 - RNA, 19 nt, Homo sapiens
caacccugauaucaacauu

SEQ ID NO: 161285 - RNA, 19 nt, Homo sapiens
gaggaacuccagaaacguu

SEQ ID NO: 161286 - RNA, 19 nt, Homo sapiens
guauuuauguuaccguucu

SEQ ID NO: 161287 - RNA, 19 nt, Homo sapiens
gggcuuggcugugccuuca

SEQ ID NO: 161288 - RNA, 19 nt, Homo sapiens
ccgcgaagaugacaaaauu

SEQ ID NO: 161289 - RNA, 19 nt, Homo sapiens
gaaagcccaguucaagaug

SEQ ID NO: 161290 - RNA, 19 nt, Homo sapiens
caccaaaguggaugaauau

SEQ ID NO: 161291 - RNA, 19 nt, Homo sapiens
acaaauaugcccaagacuu

SEQ ID NO: 161292 - RNA, 19 nt, Homo sapiens
gccaaauugugcugaggaa

SEQ ID NO: 161293 - RNA, 19 nt, Homo sapiens
caggguacuucguucaaga

SEQ ID NO: 161294 - RNA, 19 nt, Homo sapiens
uucaagcgcuuuaggaaau

SEQ ID NO: 161295 - RNA, 19 nt, Homo sapiens
aauaugacuuccggaauga

SEQ ID NO: 161296 - RNA, 19 nt, Homo sapiens
acagauacuucguugaaag

SEQ ID NO: 161297 - RNA, 19 nt, Homo sapiens
aagcacaaccccaaaauua

SEQ ID NO: 161298 - RNA, 19 nt, Homo sapiens
gcaacucagcuguuucugu

SEQ ID NO: 161299 - RNA, 19 nt, Homo sapiens
acagagacuuucacaagca

SEQ ID NO: 161300 - RNA, 19 nt, Homo sapiens
gcagagauucuugguagau

SEQ ID NO: 161301 - RNA, 19 nt, Homo sapiens
caaggaugaagaagaagaa

SEQ ID NO: 161302 - RNA, 19 nt, Homo sapiens
ucuugaagcacaacagaua

SEQ ID NO: 161303 - RNA, 19 nt, Homo sapiens
aaagggauuuucagcauaa

SEQ ID NO: 161304 - RNA, 19 nt, Homo sapiens
ggugacacuucguuugauc

SEQ ID NO: 161305 - RNA, 19 nt, Homo sapiens
uguuugcccuaaaggaaua

SEQ ID NO: 161306 - RNA, 19 nt, Homo sapiens
acaauguguuugcccuaaa

SEQ ID NO: 161307 - RNA, 19 nt, Homo sapiens
gaggucuggugcccuaugu

SEQ ID NO: 161308 - RNA, 19 nt, Homo sapiens
ucaggaagcucagcaagac

SEQ ID NO: 161309 - RNA, 19 nt, Homo sapiens
ggaguggggucauuucugu

SEQ ID NO: 161310 - RNA, 19 nt, Homo sapiens
ucaaggugaucacgaaacu

SEQ ID NO: 161311 - RNA, 19 nt, Homo sapiens
caauguguuugcccuaaag

SEQ ID NO: 161312 - RNA, 19 nt, Homo sapiens
ugucaacccugauaucaac

SEQ ID NO: 161313 - RNA, 19 nt, Homo sapiens
ugaagaagaagaagaagag

SEQ ID NO: 161314 - RNA, 19 nt, Homo sapiens
ccaaacagcuuuaugauuu

SEQ ID NO: 161315 - RNA, 19 nt, Homo sapiens
gaagaagucuggaugaaau

SEQ ID NO: 161316 - RNA, 19 nt, Homo sapiens
gaccuuaacucaaauggua

SEQ ID NO: 161317 - RNA, 19 nt, Homo sapiens
ggaaggagaugucgaggaa

SEQ ID NO: 161318 - RNA, 19 nt, Homo sapiens
gaagacaguucaaagagaa

SEQ ID NO: 161319 - RNA, 19 nt, Homo sapiens
gaacuuugcugcaguaucu

SEQ ID NO: 161320 - RNA, 19 nt, Homo sapiens
ggaaggauaucgucgagaa

SEQ ID NO: 161321 - RNA, 19 nt, Homo sapiens
gcaccucgauguuuauaaa

SEQ ID NO: 161322 - RNA, 19 nt, Homo sapiens
guauagagcccacagaaua

SEQ ID NO: 161323 - RNA, 19 nt, Homo sapiens
ggcacugacugaaguauua

SEQ ID NO: 161324 - RNA, 19 nt, Homo sapiens
caaaugaaaucacaagcaa

SEQ ID NO: 161325 - RNA, 19 nt, Homo sapiens
gaagauagaaggaguugaa

SEQ ID NO: 161326 - RNA, 19 nt, Homo sapiens
ggaagacaguucaaagaga

SEQ ID NO: 161327 - RNA, 19 nt, Homo sapiens
ucaaucagcugaagauaga

SEQ ID NO: 161328 - RNA, 19 nt, Homo sapiens
aaacggaaguugaccuuaa

SEQ ID NO: 161329 - RNA, 19 nt, Homo sapiens
gccauuaucuggauccuuu

SEQ ID NO: 161330 - RNA, 19 nt, Homo sapiens
uagcaaagcugaagaaguc

SEQ ID NO: 161331 - RNA, 19 nt, Homo sapiens
gaauucagguuggcuguuu

SEQ ID NO: 161332 - RNA, 19 nt, Homo sapiens
gaaagccgguggccaggaa

SEQ ID NO: 161333 - RNA, 19 nt, Homo sapiens
cggaagaaauuaagcauga

SEQ ID NO: 161334 - RNA, 19 nt, Homo sapiens
gagcaaggguuuaucaucu

SEQ ID NO: 161335 - RNA, 19 nt, Homo sapiens
agacaaugcuguugccuuu

SEQ ID NO: 161336 - RNA, 19 nt, Homo sapiens
gauacgugguucuuuauga

SEQ ID NO: 161337 - RNA, 19 nt, Homo sapiens
gcggaggccuucuuauuga

SEQ ID NO: 161338 - RNA, 19 nt, Homo sapiens
acaaggugguguuauauuu

SEQ ID NO: 161339 - RNA, 19 nt, Homo sapiens
ugacaaggguacuacauga

SEQ ID NO: 161340 - RNA, 19 nt, Homo sapiens
uaacucaaaugguaggaaa

SEQ ID NO: 161341 - RNA, 19 nt, Homo sapiens
gauagaauaccuucagauu

SEQ ID NO: 161342 - RNA, 19 nt, Homo sapiens
gcaugaagaauuugaugua

SEQ ID NO: 161343 - RNA, 19 nt, Homo sapiens
gagcggaggccuucuuauu

SEQ ID NO: 161344 - RNA, 19 nt, Homo sapiens
gcaaaugccaaacagcuuu

SEQ ID NO: 161345 - RNA, 19 nt, Homo sapiens
caaacucacucuucuuaca

SEQ ID NO: 161346 - RNA, 19 nt, Homo sapiens
gaagucuggaugaaauuua

SEQ ID NO: 161347 - RNA, 19 nt, Homo sapiens
gaagauauuacgaacuuug

SEQ ID NO: 161348 - RNA, 19 nt, Homo sapiens
gcuaugaaguuuacacaca

SEQ ID NO: 161349 - RNA, 19 nt, Homo sapiens
cagguuggcuguuucuuga

SEQ ID NO: 161350 - RNA, 19 nt, Homo sapiens
cgacagcacuggccauuac

SEQ ID NO: 161351 - RNA, 19 nt, Homo sapiens
caaagagaauuaggaaauc

SEQ ID NO: 161352 - RNA, 19 nt, Homo sapiens
ggaagaaauuaagcaugaa

SEQ ID NO: 161353 - RNA, 19 nt, Homo sapiens
gaacgggcuucuaccaaag

SEQ ID NO: 161354 - RNA, 19 nt, Homo sapiens
aagacgagcucacgaguau

SEQ ID NO: 161355 - RNA, 19 nt, Homo sapiens
uagcagcccugucacaaga

SEQ ID NO: 161356 - RNA, 19 nt, Homo sapiens
ugcaguaucucucucagua

SEQ ID NO: 161357 - RNA, 19 nt, Homo sapiens
acaagacaauccgccauua

SEQ ID NO: 161358 - RNA, 19 nt, Homo sapiens
gaaagagugaugagaaauc

SEQ ID NO: 161359 - RNA, 19 nt, Homo sapiens
gcaaggguuuaucaucuuc

SEQ ID NO: 161360 - RNA, 19 nt, Homo sapiens
guaggauacuugugguuga

SEQ ID NO: 161361 - RNA, 19 nt, Homo sapiens
gcagauguuuccacugaca

SEQ ID NO: 161362 - RNA, 19 nt, Homo sapiens
ggauaucgucgagaaauaa

SEQ ID NO: 161363 - RNA, 19 nt, Homo sapiens
gaaggaagacaguucaaag

SEQ ID NO: 161364 - RNA, 19 nt, Homo sapiens
guugacuucuugacugaua

SEQ ID NO: 161365 - RNA, 19 nt, Homo sapiens
caaacagcuuuaugauuuc

SEQ ID NO: 161366 - RNA, 19 nt, Homo sapiens
cauccucacuccagaaaug

SEQ ID NO: 161367 - RNA, 19 nt, Homo sapiens
cugcagauguuuccacuga

SEQ ID NO: 161368 - RNA, 19 nt, Homo sapiens
gguugucccugaagaaaga

SEQ ID NO: 161369 - RNA, 19 nt, Homo sapiens
acaaugcuguugccuuuga

SEQ ID NO: 161370 - RNA, 19 nt, Homo sapiens
cuuuagagguuggagauua

SEQ ID NO: 161371 - RNA, 19 nt, Homo sapiens
gaaagagaaggcagagaug

SEQ ID NO: 161372 - RNA, 19 nt, Homo sapiens
uggaaagagugaugagaaa

SEQ ID NO: 161373 - RNA, 19 nt, Homo sapiens
uugcagaagucguaucaaa

SEQ ID NO: 161374 - RNA, 19 nt, Homo sapiens
ggauaugcgugaauuucga

SEQ ID NO: 161375 - RNA, 19 nt, Homo sapiens
ugaaacaaacuuagaccua

SEQ ID NO: 161376 - RNA, 19 nt, Homo sapiens
gagaugaaacaaacuuaga

SEQ ID NO: 161377 - RNA, 19 nt, Homo sapiens
uucggcagcuugaaauuua

SEQ ID NO: 161378 - RNA, 19 nt, Homo sapiens
gaaauuuacagggcgagua

SEQ ID NO: 161379 - RNA, 19 nt, Homo sapiens
guacugauuugugcaagug

SEQ ID NO: 161380 - RNA, 19 nt, Homo sapiens
gaacagcacaaaccugaag

SEQ ID NO: 161381 - RNA, 19 nt, Homo sapiens
caacagucgcuaugaaguu

SEQ ID NO: 161382 - RNA, 19 nt, Homo sapiens
caaaugccaaacagcuuua

SEQ ID NO: 161383 - RNA, 19 nt, Homo sapiens
acgcagagcuaaccuuugu

SEQ ID NO: 161384 - RNA, 19 nt, Homo sapiens
caaagaaagaacccucaaa

SEQ ID NO: 161385 - RNA, 19 nt, Homo sapiens
ggaaggaagacaguucaaa

SEQ ID NO: 161386 - RNA, 19 nt, Homo sapiens
gaacugguccuagaaagca

SEQ ID NO: 161387 - RNA, 19 nt, Homo sapiens
uccagcaccucgauguuua

SEQ ID NO: 161388 - RNA, 19 nt, Homo sapiens
gcagagaugaaacaaacuu

SEQ ID NO: 161389 - RNA, 19 nt, Homo sapiens
gaaagcugcccggaagaaa

SEQ ID NO: 161390 - RNA, 19 nt, Homo sapiens
gaugaaauuuaggaaggaa

SEQ ID NO: 161391 - RNA, 19 nt, Homo sapiens
gggaggcacugacugaagu

SEQ ID NO: 161392 - RNA, 19 nt, Homo sapiens
agccaagacuaaauccuua

SEQ ID NO: 161393 - RNA, 19 nt, Homo sapiens
gaggguuuacuuucuuaua

SEQ ID NO: 161394 - RNA, 19 nt, Homo sapiens
ggaugaaauuuaggaagga

SEQ ID NO: 161395 - RNA, 19 nt, Homo sapiens
gagccaagacuaaauccuu

SEQ ID NO: 161396 - RNA, 19 nt, Homo sapiens
gcuugaaguggaagauuua

SEQ ID NO: 161397 - RNA, 19 nt, Homo sapiens
uauagagcccacagaauaa

SEQ ID NO: 161398 - RNA, 19 nt, Homo sapiens
uaggaaaucucacaaaaga

SEQ ID NO: 161399 - RNA, 19 nt, Homo sapiens
uauugaggcucuacaggaa

SEQ ID NO: 161400 - RNA, 19 nt, Homo sapiens
uuaaaugcaugucuaaagg

SEQ ID NO: 161401 - RNA, 19 nt, Homo sapiens
uuacuggcaucuuggugua

SEQ ID NO: 161402 - RNA, 19 nt, Homo sapiens
gccaaacagcuuuaugauu

SEQ ID NO: 161403 - RNA, 19 nt, Homo sapiens
agaauuagcagcccuguca

SEQ ID NO: 161404 - RNA, 19 nt, Homo sapiens
aagcaacagucgcuaugaa

SEQ ID NO: 161405 - RNA, 19 nt, Homo sapiens
acagaauaaucgagucuug

SEQ ID NO: 161406 - RNA, 19 nt, Homo sapiens
caagacgagcucacgagua

SEQ ID NO: 161407 - RNA, 19 nt, Homo sapiens
uugaggagcugaaacaaag

SEQ ID NO: 161408 - RNA, 19 nt, Homo sapiens
acauugaacccgugacuuu

SEQ ID NO: 161409 - RNA, 19 nt, Homo sapiens
gcagagcuaaccuuuguuc

SEQ ID NO: 161410 - RNA, 19 nt, Homo sapiens
ggauagcaaagcugaagaa

SEQ ID NO: 161411 - RNA, 19 nt, Homo sapiens
caguaucucucucaguaug

SEQ ID NO: 161412 - RNA, 19 nt, Homo sapiens
aaaugcaugucuaaaggaa

SEQ ID NO: 161413 - RNA, 19 nt, Homo sapiens
uuuaauuacuggcaucuug

SEQ ID NO: 161414 - RNA, 19 nt, Homo sapiens
caugaaaucuugacugaua

SEQ ID NO: 161415 - RNA, 19 nt, Homo sapiens
gaaauugacucggaagaaa

SEQ ID NO: 161416 - RNA, 19 nt, Homo sapiens
gaacgcaccugcugcugua

SEQ ID NO: 161417 - RNA, 19 nt, Homo sapiens
gaaagaagaugcuaaacgu

SEQ ID NO: 161418 - RNA, 19 nt, Homo sapiens
gaacgaacuuugcccauau

SEQ ID NO: 161419 - RNA, 19 nt, Homo sapiens
gaaggaagcucccgugaag

SEQ ID NO: 161420 - RNA, 19 nt, Homo sapiens
cuaaagagcaugagaauuu

SEQ ID NO: 161421 - RNA, 19 nt, Homo sapiens
gaacagugaugaaggacuu

SEQ ID NO: 161422 - RNA, 19 nt, Homo sapiens
gaagucaucuccaugugaa

SEQ ID NO: 161423 - RNA, 19 nt, Homo sapiens
gauccuggcuguugauauu

SEQ ID NO: 161424 - RNA, 19 nt, Homo sapiens
gaagaaaugcguauaaaca

SEQ ID NO: 161425 - RNA, 19 nt, Homo sapiens
aaccguggcuucuguauua

SEQ ID NO: 161426 - RNA, 19 nt, Homo sapiens
gaaagaauuugagcuacuu

SEQ ID NO: 161427 - RNA, 19 nt, Homo sapiens
ggagaaagaauuugagcua

SEQ ID NO: 161428 - RNA, 19 nt, Homo sapiens
gaaagugaaucugauggaa

SEQ ID NO: 161429 - RNA, 19 nt, Homo sapiens
gaacuuugcccauaugaga

SEQ ID NO: 161430 - RNA, 19 nt, Homo sapiens
gaagagaggcauaacaaau

SEQ ID NO: 161431 - RNA, 19 nt, Homo sapiens
gaagaugcuaaacguauua

SEQ ID NO: 161432 - RNA, 19 nt, Homo sapiens
gcaagaaacaaguagcaua

SEQ ID NO: 161433 - RNA, 19 nt, Homo sapiens
caaaagagaugaagcacua

SEQ ID NO: 161434 - RNA, 19 nt, Homo sapiens
ggaagaaagugaaucugau

SEQ ID NO: 161435 - RNA, 19 nt, Homo sapiens
cgauagauauugagucuga

SEQ ID NO: 161436 - RNA, 19 nt, Homo sapiens
gcagaagaaaugcguauaa

SEQ ID NO: 161437 - RNA, 19 nt, Homo sapiens
gaauuugagcuacuugaua

SEQ ID NO: 161438 - RNA, 19 nt, Homo sapiens
ggagaaagaagaugcuaaa

SEQ ID NO: 161439 - RNA, 19 nt, Homo sapiens
ccauggaaauucucaauga

SEQ ID NO: 161440 - RNA, 19 nt, Homo sapiens
ggaauaccguuuacugcaa

SEQ ID NO: 161441 - RNA, 19 nt, Homo sapiens
aagaggagcuggagaguga

SEQ ID NO: 161442 - RNA, 19 nt, Homo sapiens
ugacugauaugaaagaguu

SEQ ID NO: 161443 - RNA, 19 nt, Homo sapiens
ggaagauccuggcuguuga

SEQ ID NO: 161444 - RNA, 19 nt, Homo sapiens
ccaagaacuuuacuagcua

SEQ ID NO: 161445 - RNA, 19 nt, Homo sapiens
gaauacaugcgguggauuu

SEQ ID NO: 161446 - RNA, 19 nt, Homo sapiens
gcugugacauguaugcuaa

SEQ ID NO: 161447 - RNA, 19 nt, Homo sapiens
gaaaccugaucucgacaaa

SEQ ID NO: 161448 - RNA, 19 nt, Homo sapiens
ggaccggaauaaguuaaua

SEQ ID NO: 161449 - RNA, 19 nt, Homo sapiens
gaagcacuacccagucuua

SEQ ID NO: 161450 - RNA, 19 nt, Homo sapiens
gaacgaagacagaugaauc

SEQ ID NO: 161451 - RNA, 19 nt, Homo sapiens
gcaugucuauagaaacuuu

SEQ ID NO: 161452 - RNA, 19 nt, Homo sapiens
cagaagaaaugcguauaaa

SEQ ID NO: 161453 - RNA, 19 nt, Homo sapiens
ugacauguaugcuaaggaa

SEQ ID NO: 161454 - RNA, 19 nt, Homo sapiens
agacacagcuccgaauuga

SEQ ID NO: 161455 - RNA, 19 nt, Homo sapiens
ggcaagauauuaauuugga

SEQ ID NO: 161456 - RNA, 19 nt, Homo sapiens
gauaagaccuaauccucau

SEQ ID NO: 161457 - RNA, 19 nt, Homo sapiens
gaaucucuguuuccuguau

SEQ ID NO: 161458 - RNA, 19 nt, Homo sapiens
ugaaacacaugcugaagug

SEQ ID NO: 161459 - RNA, 19 nt, Homo sapiens
uaagacaguugcagaagug

SEQ ID NO: 161460 - RNA, 19 nt, Homo sapiens
ggaaaugaaucagcaacau

SEQ ID NO: 161461 - RNA, 19 nt, Homo sapiens
gaagugcaaagugugauua

SEQ ID NO: 161462 - RNA, 19 nt, Homo sapiens
gaacuuuacuagcuaugca

SEQ ID NO: 161463 - RNA, 19 nt, Homo sapiens
gaaacagacuuuggugaag

SEQ ID NO: 161464 - RNA, 19 nt, Homo sapiens
gaagaaagugaaucugaug

SEQ ID NO: 161465 - RNA, 19 nt, Homo sapiens
gagaguaaauucgauucuu

SEQ ID NO: 161466 - RNA, 19 nt, Homo sapiens
agugaugagucuaugauua

SEQ ID NO: 161467 - RNA, 19 nt, Homo sapiens
gcacguagccagcacuaau

SEQ ID NO: 161468 - RNA, 19 nt, Homo sapiens
caacucaaaggcuugcuua

SEQ ID NO: 161469 - RNA, 19 nt, Homo sapiens
gcagaagaacauuauuuga

SEQ ID NO: 161470 - RNA, 19 nt, Homo sapiens
gcgcagaagaacauuauuu

SEQ ID NO: 161471 - RNA, 19 nt, Homo sapiens
acaaauaccuuagaagagu

SEQ ID NO: 161472 - RNA, 19 nt, Homo sapiens
aagagaggcauaacaaaua

SEQ ID NO: 161473 - RNA, 19 nt, Homo sapiens
cgagaacagugaugaagga

SEQ ID NO: 161474 - RNA, 19 nt, Homo sapiens
caagcagaauucccugaaa

SEQ ID NO: 161475 - RNA, 19 nt, Homo sapiens
gaacagcagaccacugaau

SEQ ID NO: 161476 - RNA, 19 nt, Homo sapiens
gugaugagucuaugauuaa

SEQ ID NO: 161477 - RNA, 19 nt, Homo sapiens
gacugaagccuuuccgaua

SEQ ID NO: 161478 - RNA, 19 nt, Homo sapiens
ucauaauccucaagcgaua

SEQ ID NO: 161479 - RNA, 19 nt, Homo sapiens
caagugaugaugaaacaaa

SEQ ID NO: 161480 - RNA, 19 nt, Homo sapiens
agaacgaacuuugcccaua

SEQ ID NO: 161481 - RNA, 19 nt, Homo sapiens
gaaugaaacacaugcugaa

SEQ ID NO: 161482 - RNA, 19 nt, Homo sapiens
gaaggcaguaugaagauga

SEQ ID NO: 161483 - RNA, 19 nt, Homo sapiens
gaaccagcauauagaacau

SEQ ID NO: 161484 - RNA, 19 nt, Homo sapiens
ugagaaagaugcggaagau

SEQ ID NO: 161485 - RNA, 19 nt, Homo sapiens
ggaaauugacucggaagaa

SEQ ID NO: 161486 - RNA, 19 nt, Homo sapiens
acugaagccuuuccgauaa

SEQ ID NO: 161487 - RNA, 19 nt, Homo sapiens
ggaaaaggaauaccguuua

SEQ ID NO: 161488 - RNA, 19 nt, Homo sapiens
aaacagacuuuggugaaga

SEQ ID NO: 161489 - RNA, 19 nt, Homo sapiens
accagcagcucuagugaua

SEQ ID NO: 161490 - RNA, 19 nt, Homo sapiens
acacagcuccgaauugauu

SEQ ID NO: 161491 - RNA, 19 nt, Homo sapiens
ucaaacccgugguggauga

SEQ ID NO: 161492 - RNA, 19 nt, Homo sapiens
gcauauagaacauguccaa

SEQ ID NO: 161493 - RNA, 19 nt, Homo sapiens
gaaaagacaagccaucaaa

SEQ ID NO: 161494 - RNA, 19 nt, Homo sapiens
ccaaagauaagaccuaauc

SEQ ID NO: 161495 - RNA, 19 nt, Homo sapiens
caaaggccguggaaccaau

SEQ ID NO: 161496 - RNA, 19 nt, Homo sapiens
gauaagugaugagucuaug

SEQ ID NO: 161497 - RNA, 19 nt, Homo sapiens
caagaacuuuacuagcuau

SEQ ID NO: 161498 - RNA, 19 nt, Homo sapiens
gaugcuaaacguauuaaga

SEQ ID NO: 161499 - RNA, 19 nt, Homo sapiens
gaacagaacgaagacagau

SEQ ID NO: 161500 - RNA, 19 nt, Homo sapiens
uuacggacauugcaacuca

SEQ ID NO: 161501 - RNA, 19 nt, Homo sapiens
gaauuagaguagaaguugu

SEQ ID NO: 161502 - RNA, 19 nt, Homo sapiens
acaggaagcugagaaagau

SEQ ID NO: 161503 - RNA, 19 nt, Homo sapiens
aaaccaagcacuuaaagga

SEQ ID NO: 161504 - RNA, 19 nt, Homo sapiens
gggaagauccuggcuguug

SEQ ID NO: 161505 - RNA, 19 nt, Homo sapiens
gcucugcaaacucuuauuu

SEQ ID NO: 161506 - RNA, 19 nt, Homo sapiens
cagaagagaggcauaacaa

SEQ ID NO: 161507 - RNA, 19 nt, Homo sapiens
agaagaugcuaaacguauu

SEQ ID NO: 161508 - RNA, 19 nt, Homo sapiens
agugauaucuggcuguuug

SEQ ID NO: 161509 - RNA, 19 nt, Homo sapiens
gcacagcagaauucacuga

SEQ ID NO: 161510 - RNA, 19 nt, Homo sapiens
guagaagaauuagaguaga

SEQ ID NO: 161511 - RNA, 19 nt, Homo sapiens
aguaaagcaugaaaucuug

SEQ ID NO: 161512 - RNA, 19 nt, Homo sapiens
caucaaaacugccuucaga

SEQ ID NO: 161513 - RNA, 19 nt, Homo sapiens
caucaagccugaaaagaaa

SEQ ID NO: 161514 - RNA, 19 nt, Homo sapiens
ggaaagugaugcugaauuu

SEQ ID NO: 161515 - RNA, 19 nt, Homo sapiens
uaaaggagcugaaguaaau

SEQ ID NO: 161516 - RNA, 19 nt, Homo sapiens
gaagcaagguuguaauaaa

SEQ ID NO: 161517 - RNA, 19 nt, Homo sapiens
uaacgggcauuucugauua

SEQ ID NO: 161518 - RNA, 19 nt, Homo sapiens
ggagauugaugaugacuuu

SEQ ID NO: 161519 - RNA, 19 nt, Homo sapiens
gcaugugucuuacgagaua

SEQ ID NO: 161520 - RNA, 19 nt, Homo sapiens
gaagaguugucagugauua

SEQ ID NO: 161521 - RNA, 19 nt, Homo sapiens
caaagaaguuuacaggauu

SEQ ID NO: 161522 - RNA, 19 nt, Homo sapiens
gaagucagaugucaagaug

SEQ ID NO: 161523 - RNA, 19 nt, Homo sapiens
gggcauuucugauuauuaa

SEQ ID NO: 161524 - RNA, 19 nt, Homo sapiens
gaagagggcuuugcaguuc

SEQ ID NO: 161525 - RNA, 19 nt, Homo sapiens
gcagagacaucaacaggaa

SEQ ID NO: 161526 - RNA, 19 nt, Homo sapiens
aaacagaguugucaucuau

SEQ ID NO: 161527 - RNA, 19 nt, Homo sapiens
ucaaaggucuuccugauga

SEQ ID NO: 161528 - RNA, 19 nt, Homo sapiens
caaccacccugaucucuuu

SEQ ID NO: 161529 - RNA, 19 nt, Homo sapiens
gaaacuaauucgagauguu

SEQ ID NO: 161530 - RNA, 19 nt, Homo sapiens
gaaggaauuuggaaacuca

SEQ ID NO: 161531 - RNA, 19 nt, Homo sapiens
ugagaaaucugugcacuuu

SEQ ID NO: 161532 - RNA, 19 nt, Homo sapiens
gaaaugggauugggcaaga

SEQ ID NO: 161533 - RNA, 19 nt, Homo sapiens
caacauugcuuccuaaacu

SEQ ID NO: 161534 - RNA, 19 nt, Homo sapiens
ccuaagaacucuaagcauu

SEQ ID NO: 161535 - RNA, 19 nt, Homo sapiens
gcaguaacuucuaaucgaa

SEQ ID NO: 161536 - RNA, 19 nt, Homo sapiens
gagauaccauaaauccaua

SEQ ID NO: 161537 - RNA, 19 nt, Homo sapiens
ggucugagcuacagcaaga

SEQ ID NO: 161538 - RNA, 19 nt, Homo sapiens
uaaacaacauugcuuccua

SEQ ID NO: 161539 - RNA, 19 nt, Homo sapiens
gaggacacauccauauuug

SEQ ID NO: 161540 - RNA, 19 nt, Homo sapiens
ccaaagaaguuuacaggau

SEQ ID NO: 161541 - RNA, 19 nt, Homo sapiens
ggaggacgauucugaggaa

SEQ ID NO: 161542 - RNA, 19 nt, Homo sapiens
gaucaggacucgugguuca

SEQ ID NO: 161543 - RNA, 19 nt, Homo sapiens
gcaagaccauccagauaau

SEQ ID NO: 161544 - RNA, 19 nt, Homo sapiens
gaguagauuugguaagaaa

SEQ ID NO: 161545 - RNA, 19 nt, Homo sapiens
gaacagagcaaugacgauu

SEQ ID NO: 161546 - RNA, 19 nt, Homo sapiens
gagcagaggugaaaauuga

SEQ ID NO: 161547 - RNA, 19 nt, Homo sapiens
aaacaacauugcuuccuaa

SEQ ID NO: 161548 - RNA, 19 nt, Homo sapiens
ggacucgugguucaaauua

SEQ ID NO: 161549 - RNA, 19 nt, Homo sapiens
ccagauaauugccuucuug

SEQ ID NO: 161550 - RNA, 19 nt, Homo sapiens
gaaaaggaauucuaacuuc

SEQ ID NO: 161551 - RNA, 19 nt, Homo sapiens
caaauccaaugaucucuau

SEQ ID NO: 161552 - RNA, 19 nt, Homo sapiens
gugaagagucugaguauuu

SEQ ID NO: 161553 - RNA, 19 nt, Homo sapiens
ggaagaagcaagguuguaa

SEQ ID NO: 161554 - RNA, 19 nt, Homo sapiens
gaugaaagcauugaugaaa

SEQ ID NO: 161555 - RNA, 19 nt, Homo sapiens
ccagaagaguugucaguga

SEQ ID NO: 161556 - RNA, 19 nt, Homo sapiens
gcaagaaagugguggugau

SEQ ID NO: 161557 - RNA, 19 nt, Homo sapiens
ugagaaacuucaucgcuuu

SEQ ID NO: 161558 - RNA, 19 nt, Homo sapiens
caaacagaguugucaucua

SEQ ID NO: 161559 - RNA, 19 nt, Homo sapiens
caagugugcaugugucuua

SEQ ID NO: 161560 - RNA, 19 nt, Homo sapiens
ucaagaaacuccagaagag

SEQ ID NO: 161561 - RNA, 19 nt, Homo sapiens
ggaguuugaauccaaguua

SEQ ID NO: 161562 - RNA, 19 nt, Homo sapiens
gcacguugccuguguuuau

SEQ ID NO: 161563 - RNA, 19 nt, Homo sapiens
ccagaauacugcuaaacaa

SEQ ID NO: 161564 - RNA, 19 nt, Homo sapiens
cgagaacuauugagaaauc

SEQ ID NO: 161565 - RNA, 19 nt, Homo sapiens
gagcgagcauggagaauag

SEQ ID NO: 161566 - RNA, 19 nt, Homo sapiens
ugauggagaugaagauuau

SEQ ID NO: 161567 - RNA, 19 nt, Homo sapiens
cacaucaucugaagagaaa

SEQ ID NO: 161568 - RNA, 19 nt, Homo sapiens
uaccauaaauccauaccua

SEQ ID NO: 161569 - RNA, 19 nt, Homo sapiens
cgacagaaguauaauaagg

SEQ ID NO: 161570 - RNA, 19 nt, Homo sapiens
gaugucuaccucagaauua

SEQ ID NO: 161571 - RNA, 19 nt, Homo sapiens
ggcaagaccauccagauaa

SEQ ID NO: 161572 - RNA, 19 nt, Homo sapiens
gagauggaauaaacugaga

SEQ ID NO: 161573 - RNA, 19 nt, Homo sapiens
ccagagcacugaaacaagu

SEQ ID NO: 161574 - RNA, 19 nt, Homo sapiens
ucaagacagccacugauua

SEQ ID NO: 161575 - RNA, 19 nt, Homo sapiens
gggcaagaccauccagaua

SEQ ID NO: 161576 - RNA, 19 nt, Homo sapiens
ggaaacggcagaagaaagu

SEQ ID NO: 161577 - RNA, 19 nt, Homo sapiens
guacccagaucccucagaa

SEQ ID NO: 161578 - RNA, 19 nt, Homo sapiens
agagaaaucugaggcuaaa

SEQ ID NO: 161579 - RNA, 19 nt, Homo sapiens
uaugagcuauuuacucuga

SEQ ID NO: 161580 - RNA, 19 nt, Homo sapiens
ggaaaaugauuguuguuga

SEQ ID NO: 161581 - RNA, 19 nt, Homo sapiens
gaauacugcuaaacaacau

SEQ ID NO: 161582 - RNA, 19 nt, Homo sapiens
agaaacaucugagaccaaa

SEQ ID NO: 161583 - RNA, 19 nt, Homo sapiens
ugaaguaaaugcaguaacu

SEQ ID NO: 161584 - RNA, 19 nt, Homo sapiens
ggagcgagcauggagaaua

SEQ ID NO: 161585 - RNA, 19 nt, Homo sapiens
uuaaggagauggaauaaac

SEQ ID NO: 161586 - RNA, 19 nt, Homo sapiens
aagaguagauuugguaaga

SEQ ID NO: 161587 - RNA, 19 nt, Homo sapiens
gaguggcaauucuacauga

SEQ ID NO: 161588 - RNA, 19 nt, Homo sapiens
gaggaauucugggagauga

SEQ ID NO: 161589 - RNA, 19 nt, Homo sapiens
gaaaggaagaagcaagguu

SEQ ID NO: 161590 - RNA, 19 nt, Homo sapiens
guaaaugcaguaacuucua

SEQ ID NO: 161591 - RNA, 19 nt, Homo sapiens
gcucaccgaugcaaaauaa

SEQ ID NO: 161592 - RNA, 19 nt, Homo sapiens
caugaaaccgguuccuaua

SEQ ID NO: 161593 - RNA, 19 nt, Homo sapiens
gagcaaugacgauuauguu

SEQ ID NO: 161594 - RNA, 19 nt, Homo sapiens
gaugguaccacuacaauag

SEQ ID NO: 161595 - RNA, 19 nt, Homo sapiens
ggacgauucugaggaaagu

SEQ ID NO: 161596 - RNA, 19 nt, Homo sapiens
caugaugucuaccucagaa

SEQ ID NO: 161597 - RNA, 19 nt, Homo sapiens
acagagcaaugacgauuau

SEQ ID NO: 161598 - RNA, 19 nt, Homo sapiens
uguagagaaugccaaauga

SEQ ID NO: 161599 - RNA, 19 nt, Homo sapiens
ugcaggagauugaugauga

SEQ ID NO: 161600 - RNA, 19 nt, Homo sapiens
ugaagagucugaguauuuc

SEQ ID NO: 161601 - RNA, 19 nt, Homo sapiens
caucugagaccaaagcaaa

SEQ ID NO: 161602 - RNA, 19 nt, Homo sapiens
cagaagaguugucagugau

SEQ ID NO: 161603 - RNA, 19 nt, Homo sapiens
guucccugcuucuaacaua

SEQ ID NO: 161604 - RNA, 19 nt, Homo sapiens
acacccaaaugccaucuaa

SEQ ID NO: 161605 - RNA, 19 nt, Homo sapiens
caaauagagugcuaaaaga

SEQ ID NO: 161606 - RNA, 19 nt, Homo sapiens
agaagcaagugacugugua

SEQ ID NO: 161607 - RNA, 19 nt, Homo sapiens
aaagugaugcugaauuuga

SEQ ID NO: 161608 - RNA, 19 nt, Homo sapiens
ccacagaggaggaggaaga

SEQ ID NO: 161609 - RNA, 19 nt, Homo sapiens
ggaaacucaagccagaaua

SEQ ID NO: 161610 - RNA, 19 nt, Homo sapiens
gggagauacugcaggaguu

SEQ ID NO: 161611 - RNA, 19 nt, Homo sapiens
caaccugucaguaauaaug

SEQ ID NO: 161612 - RNA, 19 nt, Homo sapiens
ccaaggaacagagcaauga

SEQ ID NO: 161613 - RNA, 19 nt, Homo sapiens
ucgaagugauccuuugaaa

SEQ ID NO: 161614 - RNA, 19 nt, Homo sapiens
ccacaaaucucuacaagug

SEQ ID NO: 161615 - RNA, 19 nt, Homo sapiens
ggucaagccuuauucugua

SEQ ID NO: 161616 - RNA, 19 nt, Homo sapiens
ggaaacgguucaccuacaa

SEQ ID NO: 161617 - RNA, 19 nt, Homo sapiens
uacaaucgcuuaggaagua

SEQ ID NO: 161618 - RNA, 19 nt, Homo sapiens
gcccugcgcuauuacuaua

SEQ ID NO: 161619 - RNA, 19 nt, Homo sapiens
gcagcucucuugucucuuc

SEQ ID NO: 161620 - RNA, 19 nt, Homo sapiens
gggaauucgucaucaaaga

SEQ ID NO: 161621 - RNA, 19 nt, Homo sapiens
caauaaacuuuggaccuuu

SEQ ID NO: 161622 - RNA, 19 nt, Homo sapiens
cccaggaacuuuucuauua

SEQ ID NO: 161623 - RNA, 19 nt, Homo sapiens
gagggcagcucucuugucu

SEQ ID NO: 161624 - RNA, 19 nt, Homo sapiens
gggcagcucucuugucucu

SEQ ID NO: 161625 - RNA, 19 nt, Homo sapiens
acaauaaacuuuggaccuu

SEQ ID NO: 161626 - RNA, 19 nt, Homo sapiens
gggaaacgguucaccuaca

SEQ ID NO: 161627 - RNA, 19 nt, Homo sapiens
ucaccuacaaguucaauuu

SEQ ID NO: 161628 - RNA, 19 nt, Homo sapiens
ccagaugaauuacgacaag

SEQ ID NO: 161629 - RNA, 19 nt, Homo sapiens
ugaagacugucgccucgaa

SEQ ID NO: 161630 - RNA, 19 nt, Homo sapiens
cccaaagcgucuacaacua

SEQ ID NO: 161631 - RNA, 19 nt, Homo sapiens
aacuggugcuggucaauua

SEQ ID NO: 161632 - RNA, 19 nt, Homo sapiens
ggccaugagugccuagguu

SEQ ID NO: 161633 - RNA, 19 nt, Homo sapiens
gcuggucaauuacccauuc

SEQ ID NO: 161634 - RNA, 19 nt, Homo sapiens
gcgcuggagugaagacugu

SEQ ID NO: 161635 - RNA, 19 nt, Homo sapiens
gcaagccccagaugaauua

SEQ ID NO: 161636 - RNA, 19 nt, Homo sapiens
caagccuuauucuguauug

SEQ ID NO: 161637 - RNA, 19 nt, Homo sapiens
ggugagggcagcucucuug

SEQ ID NO: 161638 - RNA, 19 nt, Homo sapiens
ccaugacccuggugucuuc

SEQ ID NO: 161639 - RNA, 19 nt, Homo sapiens
ggucaauuacccauucauu

SEQ ID NO: 161640 - RNA, 19 nt, Homo sapiens
aauaaacuuuggaccuuug

SEQ ID NO: 161641 - RNA, 19 nt, Homo sapiens
ggccacaaaucucuacaag

SEQ ID NO: 161642 - RNA, 19 nt, Homo sapiens
gugccuagguuucucauac

SEQ ID NO: 161643 - RNA, 19 nt, Homo sapiens
ggguuugccuucccggauu

SEQ ID NO: 161644 - RNA, 19 nt, Homo sapiens
uuucuaagcucugggcaaa

SEQ ID NO: 161645 - RNA, 19 nt, Homo sapiens
caaggcgggugagcucuga

SEQ ID NO: 161646 - RNA, 19 nt, Homo sapiens
ccuacaaguucaauuucaa

SEQ ID NO: 161647 - RNA, 19 nt, Homo sapiens
gagggacaauuuuauaaug

SEQ ID NO: 161648 - RNA, 19 nt, Homo sapiens
ggagggagggacaauuuua

SEQ ID NO: 161649 - RNA, 19 nt, Homo sapiens
ggaguaccagggcgucauu

SEQ ID NO: 161650 - RNA, 19 nt, Homo sapiens
ccaaagcgucuacaacuac

SEQ ID NO: 161651 - RNA, 19 nt, Homo sapiens
cuauuacaaucgcuuagga

SEQ ID NO: 161652 - RNA, 19 nt, Homo sapiens
gugaugaggaugaggaaga

SEQ ID NO: 161653 - RNA, 19 nt, Homo sapiens
guagugauggcacgucaga

SEQ ID NO: 161654 - RNA, 19 nt, Homo sapiens
ccaccagccugcucuucau

SEQ ID NO: 161655 - RNA, 19 nt, Homo sapiens
ggaugagggugaggacaag

SEQ ID NO: 161656 - RNA, 19 nt, Homo sapiens
gucaagccuuauucuguau

SEQ ID NO: 161657 - RNA, 19 nt, Homo sapiens
gccaugagugccuagguuu

SEQ ID NO: 161658 - RNA, 19 nt, Homo sapiens
cguagccgcugcugacaag

SEQ ID NO: 161659 - RNA, 19 nt, Homo sapiens
auccagcuguggcacuuua

SEQ ID NO: 161660 - RNA, 19 nt, Homo sapiens
ccuguucucugccucuugu

SEQ ID NO: 161661 - RNA, 19 nt, Homo sapiens
ggaauucgucaucaaagac

SEQ ID NO: 161662 - RNA, 19 nt, Homo sapiens
gcucuucaucuucaucuuc

SEQ ID NO: 161663 - RNA, 19 nt, Homo sapiens
aaacuuuggaccuuuggaa

SEQ ID NO: 161664 - RNA, 19 nt, Homo sapiens
gguuugccuucccggauug

SEQ ID NO: 161665 - RNA, 19 nt, Homo sapiens
aaacuggugcuggucaauu

SEQ ID NO: 161666 - RNA, 19 nt, Homo sapiens
acaagcgcauucugcacaa

SEQ ID NO: 161667 - RNA, 19 nt, Homo sapiens
ccagccugcucuucaucuu

SEQ ID NO: 161668 - RNA, 19 nt, Homo sapiens
acaaacuggugcuggucaa

SEQ ID NO: 161669 - RNA, 19 nt, Homo sapiens
gcuguggucaagccuuauu

SEQ ID NO: 161670 - RNA, 19 nt, Homo sapiens
ccuggugucuuccgagucu

SEQ ID NO: 161671 - RNA, 19 nt, Homo sapiens
gggagggacaauuuuauaa

SEQ ID NO: 161672 - RNA, 19 nt, Homo sapiens
aauuacccauucauugaug

SEQ ID NO: 161673 - RNA, 19 nt, Homo sapiens
ggggugcccugaaaccaaa

SEQ ID NO: 161674 - RNA, 19 nt, Homo sapiens
gaaacgguucaccuacaag

SEQ ID NO: 161675 - RNA, 19 nt, Homo sapiens
acaaucgcuuaggaaguaa

SEQ ID NO: 161676 - RNA, 19 nt, Homo sapiens
ggacagacuuccaagauga

SEQ ID NO: 161677 - RNA, 19 nt, Homo sapiens
gaacaucgaugggaaggaa

SEQ ID NO: 161678 - RNA, 19 nt, Homo sapiens
ggaaggaacugugcaagau

SEQ ID NO: 161679 - RNA, 19 nt, Homo sapiens
gaaagaauauggccuucca

SEQ ID NO: 161680 - RNA, 19 nt, Homo sapiens
agucaucucuguacaagua

SEQ ID NO: 161681 - RNA, 19 nt, Homo sapiens
gaaagcugcucaaccaucu

SEQ ID NO: 161682 - RNA, 19 nt, Homo sapiens
acacagauuuaccauauga

SEQ ID NO: 161683 - RNA, 19 nt, Homo sapiens
gaaacacagauuuaccaua

SEQ ID NO: 161684 - RNA, 19 nt, Homo sapiens
gcagcuacauggaggagaa

SEQ ID NO: 161685 - RNA, 19 nt, Homo sapiens
agacuccucuuccacauuu

SEQ ID NO: 161686 - RNA, 19 nt, Homo sapiens
gaacucuccugaugaaugc

SEQ ID NO: 161687 - RNA, 19 nt, Homo sapiens
cacagaagaugaacuuugu

SEQ ID NO: 161688 - RNA, 19 nt, Homo sapiens
guuagauccuuaucagauu

SEQ ID NO: 161689 - RNA, 19 nt, Homo sapiens
gaacuacggcagcuacaug

SEQ ID NO: 161690 - RNA, 19 nt, Homo sapiens
gcaaacccaacaugaacua

SEQ ID NO: 161691 - RNA, 19 nt, Homo sapiens
agaccagcguccucaguua

SEQ ID NO: 161692 - RNA, 19 nt, Homo sapiens
ccaaacccauacuggaauu

SEQ ID NO: 161693 - RNA, 19 nt, Homo sapiens
acaagaacaucaugaccaa

SEQ ID NO: 161694 - RNA, 19 nt, Homo sapiens
acaaaacucuccacgguua

SEQ ID NO: 161695 - RNA, 19 nt, Homo sapiens
gauccuacgcuauggagua

SEQ ID NO: 161696 - RNA, 19 nt, Homo sapiens
ggaacucuccugaugaaug

SEQ ID NO: 161697 - RNA, 19 nt, Homo sapiens
ucugggcacuuacuacuaa

SEQ ID NO: 161698 - RNA, 19 nt, Homo sapiens
gaagagcaaacccaacaug

SEQ ID NO: 161699 - RNA, 19 nt, Homo sapiens
gugaauggcucaaggaacu

SEQ ID NO: 161700 - RNA, 19 nt, Homo sapiens
ccucagaccucccguacau

SEQ ID NO: 161701 - RNA, 19 nt, Homo sapiens
ggagucaucucuguacaag

SEQ ID NO: 161702 - RNA, 19 nt, Homo sapiens
ccacagaagaugaacuuug

SEQ ID NO: 161703 - RNA, 19 nt, Homo sapiens
cuucucaucugggcacuua

SEQ ID NO: 161704 - RNA, 19 nt, Homo sapiens
gcgcuacgccuacaaguuc

SEQ ID NO: 161705 - RNA, 19 nt, Homo sapiens
gaggaccagucguuguuug

SEQ ID NO: 161706 - RNA, 19 nt, Homo sapiens
caacaugaacuacgauaag

SEQ ID NO: 161707 - RNA, 19 nt, Homo sapiens
gauaaagccuuacaaaacu

SEQ ID NO: 161708 - RNA, 19 nt, Homo sapiens
cagcagauccuacgcuaug

SEQ ID NO: 161709 - RNA, 19 nt, Homo sapiens
ugauguugauaaagccuua

SEQ ID NO: 161710 - RNA, 19 nt, Homo sapiens
cagaugauguugauaaagc

SEQ ID NO: 161711 - RNA, 19 nt, Homo sapiens
gaaggaacugugcaagaug

SEQ ID NO: 161712 - RNA, 19 nt, Homo sapiens
gagcaaacccaacaugaac

SEQ ID NO: 161713 - RNA, 19 nt, Homo sapiens
gucgaaagcugcucaacca

SEQ ID NO: 161714 - RNA, 19 nt, Homo sapiens
cuacaacgccgacauccuu

SEQ ID NO: 161715 - RNA, 19 nt, Homo sapiens
aaggaacugugcaagauga

SEQ ID NO: 161716 - RNA, 19 nt, Homo sapiens
ccauaugccuucucaucug

SEQ ID NO: 161717 - RNA, 19 nt, Homo sapiens
guccucaguuagauccuua

SEQ ID NO: 161718 - RNA, 19 nt, Homo sapiens
agugggcggugaaagaaua

SEQ ID NO: 161719 - RNA, 19 nt, Homo sapiens
ggagugggcggugaaagaa

SEQ ID NO: 161720 - RNA, 19 nt, Homo sapiens
ucaguuagauccuuaucag

SEQ ID NO: 161721 - RNA, 19 nt, Homo sapiens
guugauaaagccuuacaaa

SEQ ID NO: 161722 - RNA, 19 nt, Homo sapiens
cuucagaugauguugauaa

SEQ ID NO: 161723 - RNA, 19 nt, Homo sapiens
gggaaggaacugugcaaga

SEQ ID NO: 161724 - RNA, 19 nt, Homo sapiens
ccuuaucaguugugaguga

SEQ ID NO: 161725 - RNA, 19 nt, Homo sapiens
guuaaugcaugcuagaaac

SEQ ID NO: 161726 - RNA, 19 nt, Homo sapiens
ggacccagcagcucauauc

SEQ ID NO: 161727 - RNA, 19 nt, Homo sapiens
gaacgagcgcagaguuauc

SEQ ID NO: 161728 - RNA, 19 nt, Homo sapiens
cagcagcucauaucaagga

SEQ ID NO: 161729 - RNA, 19 nt, Homo sapiens
cgacauccuucucucacau

SEQ ID NO: 161730 - RNA, 19 nt, Homo sapiens
gacuucagaugauguugau

SEQ ID NO: 161731 - RNA, 19 nt, Homo sapiens
gaccagucguuguuugagu

SEQ ID NO: 161732 - RNA, 19 nt, Homo sapiens
gcucaaccaucuccuucca

SEQ ID NO: 161733 - RNA, 19 nt, Homo sapiens
gguuaaugcaugcuagaaa

SEQ ID NO: 161734 - RNA, 19 nt, Homo sapiens
ugaaugcaguguggccaaa

SEQ ID NO: 161735 - RNA, 19 nt, Homo sapiens
gaagccuuaucaguuguga

SEQ ID NO: 161736 - RNA, 19 nt, Homo sapiens
ccaacaugaacuacgauaa

SEQ ID NO: 161737 - RNA, 19 nt, Homo sapiens
cccagcagcucauaucaag

SEQ ID NO: 161738 - RNA, 19 nt, Homo sapiens
ccagccauaugccuucuca

SEQ ID NO: 161739 - RNA, 19 nt, Homo sapiens
gaagaccagcguccucagu

SEQ ID NO: 161740 - RNA, 19 nt, Homo sapiens
acauuugacuucagaugau

SEQ ID NO: 161741 - RNA, 19 nt, Homo sapiens
gggaagcgcuacgccuaca

SEQ ID NO: 161742 - RNA, 19 nt, Homo sapiens
ugugcaagaugaccaagga

SEQ ID NO: 161743 - RNA, 19 nt, Homo sapiens
cagccagggucaccaucaa

SEQ ID NO: 161744 - RNA, 19 nt, Homo sapiens
gugaggaccagucguuguu

SEQ ID NO: 161745 - RNA, 19 nt, Homo sapiens
uuacuacuaugacaagaac

SEQ ID NO: 161746 - RNA, 19 nt, Homo sapiens
agagcaaacccaacaugaa

SEQ ID NO: 161747 - RNA, 19 nt, Homo sapiens
gagacuccucuuccacauu

SEQ ID NO: 161748 - RNA, 19 nt, Homo sapiens
ugagugaggaccagucguu

SEQ ID NO: 161749 - RNA, 19 nt, Homo sapiens
cgugacaucuuccaguuuu

SEQ ID NO: 161750 - RNA, 19 nt, Homo sapiens
ggccaaaggcgggaagaug

SEQ ID NO: 161751 - RNA, 19 nt, Homo sapiens
uuagauccuuaucagauuc

SEQ ID NO: 161752 - RNA, 19 nt, Homo sapiens
ugacuucagaugauguuga

SEQ ID NO: 161753 - RNA, 19 nt, Homo sapiens
cacauuugacuucagauga

SEQ ID NO: 161754 - RNA, 19 nt, Homo sapiens
cgaacgagcgcagaguuau

SEQ ID NO: 161755 - RNA, 19 nt, Homo sapiens
ccagacaccguugggauga

SEQ ID NO: 161756 - RNA, 19 nt, Homo sapiens
cccgugacaucuuccaguu

SEQ ID NO: 161757 - RNA, 19 nt, Homo sapiens
cggaagagcaaacccaaca

SEQ ID NO: 161758 - RNA, 19 nt, Homo sapiens
guggccagauccagcuuug

SEQ ID NO: 161759 - RNA, 19 nt, Homo sapiens
gcuagaaacacagauuuac

SEQ ID NO: 161760 - RNA, 19 nt, Homo sapiens
ccacauuugacuucagaug

SEQ ID NO: 161761 - RNA, 19 nt, Homo sapiens
gaagcgcuacgccuacaag

SEQ ID NO: 161762 - RNA, 19 nt, Homo sapiens
caaacaugaccacgaacga

SEQ ID NO: 161763 - RNA, 19 nt, Homo sapiens
aagagcaaacccaacauga

SEQ ID NO: 161764 - RNA, 19 nt, Homo sapiens
gauccagcuuuggcaguuc

SEQ ID NO: 161765 - RNA, 19 nt, Homo sapiens
gcagauccuacgcuaugga

SEQ ID NO: 161766 - RNA, 19 nt, Homo sapiens
acgaacgagcgcagaguua

SEQ ID NO: 161767 - RNA, 19 nt, Homo sapiens
guacaugggcuccuaucac

SEQ ID NO: 161768 - RNA, 19 nt, Homo sapiens
gaccagcguccucaguuag

SEQ ID NO: 161769 - RNA, 19 nt, Homo sapiens
uagaaacacagauuuacca

SEQ ID NO: 161770 - RNA, 19 nt, Homo sapiens
ugcuagaaacacagauuua

SEQ ID NO: 161771 - RNA, 19 nt, Homo sapiens
ucucacaucuccacuaccu

SEQ ID NO: 161772 - RNA, 19 nt, Homo sapiens
cagcgacuauggacagacu

SEQ ID NO: 161773 - RNA, 19 nt, Homo sapiens
uuccagacgucaacaucuu

SEQ ID NO: 161774 - RNA, 19 nt, Homo sapiens
guauauaccccaacacuag

SEQ ID NO: 161775 - RNA, 19 nt, Homo sapiens
ggaagagcaaacccaacau

SEQ ID NO: 161776 - RNA, 19 nt, Homo sapiens
ggaaauaauuguguuggaa

SEQ ID NO: 161777 - RNA, 19 nt, Homo sapiens
ccaacaggcugggaaauaa

SEQ ID NO: 161778 - RNA, 19 nt, Homo sapiens
gaccucagcugccugguuu

SEQ ID NO: 161779 - RNA, 19 nt, Homo sapiens
agacauaccagccuuauaa

SEQ ID NO: 161780 - RNA, 19 nt, Homo sapiens
guaauccuguuuccacuuu

SEQ ID NO: 161781 - RNA, 19 nt, Homo sapiens
gagcugauacccagacaua

SEQ ID NO: 161782 - RNA, 19 nt, Homo sapiens
gaacuuaugcugacuacga

SEQ ID NO: 161783 - RNA, 19 nt, Homo sapiens
ucagucaguuguuugauuu

SEQ ID NO: 161784 - RNA, 19 nt, Homo sapiens
cauggaagguguuuguaaa

SEQ ID NO: 161785 - RNA, 19 nt, Homo sapiens
gugaggaucuuguucaauc

SEQ ID NO: 161786 - RNA, 19 nt, Homo sapiens
cuacgaaucugugaaugaa

SEQ ID NO: 161787 - RNA, 19 nt, Homo sapiens
uagccaagauugacuguau

SEQ ID NO: 161788 - RNA, 19 nt, Homo sapiens
gaugaaaugugaggaucuu

SEQ ID NO: 161789 - RNA, 19 nt, Homo sapiens
gaaaugugaggaucuuguu

SEQ ID NO: 161790 - RNA, 19 nt, Homo sapiens
gcauggaagguguuuguaa

SEQ ID NO: 161791 - RNA, 19 nt, Homo sapiens
gccauguccucaagauaaa

SEQ ID NO: 161792 - RNA, 19 nt, Homo sapiens
caagauugacuguauuaga

SEQ ID NO: 161793 - RNA, 19 nt, Homo sapiens
gccaagauugacuguauua

SEQ ID NO: 161794 - RNA, 19 nt, Homo sapiens
gauugacuguauuagauga

SEQ ID NO: 161795 - RNA, 19 nt, Homo sapiens
ugauuuagauggaaguugu

SEQ ID NO: 161796 - RNA, 19 nt, Homo sapiens
gggaaauaauuguguugga

SEQ ID NO: 161797 - RNA, 19 nt, Homo sapiens
auaccagccuuauaacaaa

SEQ ID NO: 161798 - RNA, 19 nt, Homo sapiens
guaugaagaacaucugaaa

SEQ ID NO: 161799 - RNA, 19 nt, Homo sapiens
cuucaacuguucauaucua

SEQ ID NO: 161800 - RNA, 19 nt, Homo sapiens
ggauuaaagagaagaucua

SEQ ID NO: 161801 - RNA, 19 nt, Homo sapiens
aacaaagacuggauuaaag

SEQ ID NO: 161802 - RNA, 19 nt, Homo sapiens
ccagaaggcagaacuuaug

SEQ ID NO: 161803 - RNA, 19 nt, Homo sapiens
uaucacauaugacaucagu

SEQ ID NO: 161804 - RNA, 19 nt, Homo sapiens
guuauacucuagccaagau

SEQ ID NO: 161805 - RNA, 19 nt, Homo sapiens
gcugggaaauaauuguguu

SEQ ID NO: 161806 - RNA, 19 nt, Homo sapiens
caacagucccucuaucaca

SEQ ID NO: 161807 - RNA, 19 nt, Homo sapiens
gaagguguuuguaaaaugu

SEQ ID NO: 161808 - RNA, 19 nt, Homo sapiens
caacuguucauaucuacuu

SEQ ID NO: 161809 - RNA, 19 nt, Homo sapiens
cauaccagccuuauaacaa

SEQ ID NO: 161810 - RNA, 19 nt, Homo sapiens
aagacuggauuaaagagaa

SEQ ID NO: 161811 - RNA, 19 nt, Homo sapiens
gaacaucugaaaagaauga

SEQ ID NO: 161812 - RNA, 19 nt, Homo sapiens
ggguggaaaugcaguuuag

SEQ ID NO: 161813 - RNA, 19 nt, Homo sapiens
acaaagacuggauuaaaga

SEQ ID NO: 161814 - RNA, 19 nt, Homo sapiens
ggccagaaggcagaacuua

SEQ ID NO: 161815 - RNA, 19 nt, Homo sapiens
gcagaacuuaugcugacua

SEQ ID NO: 161816 - RNA, 19 nt, Homo sapiens
ggaagguguuuguaaaaug

SEQ ID NO: 161817 - RNA, 19 nt, Homo sapiens
gaagaucuacgugcuccuu

SEQ ID NO: 161818 - RNA, 19 nt, Homo sapiens
gucccucuaucacauauga

SEQ ID NO: 161819 - RNA, 19 nt, Homo sapiens
acgaaucugugaaugaaug

SEQ ID NO: 161820 - RNA, 19 nt, Homo sapiens
ccacuuuguuauacucuag

SEQ ID NO: 161821 - RNA, 19 nt, Homo sapiens
aagaaugaaucccaacagu

SEQ ID NO: 161822 - RNA, 19 nt, Homo sapiens
gaagaacaucugaaaagaa

SEQ ID NO: 161823 - RNA, 19 nt, Homo sapiens
cgcgaugucucacaccauu

SEQ ID NO: 161824 - RNA, 19 nt, Homo sapiens
caacaggcugggaaauaau

SEQ ID NO: 161825 - RNA, 19 nt, Homo sapiens
ucaguuguuugauuucauc

SEQ ID NO: 161826 - RNA, 19 nt, Homo sapiens
agccauguccucaagauaa

SEQ ID NO: 161827 - RNA, 19 nt, Homo sapiens
ugacuacgaaucugugaau

SEQ ID NO: 161828 - RNA, 19 nt, Homo sapiens
ugaagaacaucugaaaaga

SEQ ID NO: 161829 - RNA, 19 nt, Homo sapiens
gaucuuguucaaucggaaa

SEQ ID NO: 161830 - RNA, 19 nt, Homo sapiens
guuguuugauuucaucgau

SEQ ID NO: 161831 - RNA, 19 nt, Homo sapiens
guggaaguuuuguaucaua

SEQ ID NO: 161832 - RNA, 19 nt, Homo sapiens
uuaaagagaagaucuacgu

SEQ ID NO: 161833 - RNA, 19 nt, Homo sapiens
gccagaaggcagaacuuau

SEQ ID NO: 161834 - RNA, 19 nt, Homo sapiens
gaaugcauggaagguguuu

SEQ ID NO: 161835 - RNA, 19 nt, Homo sapiens
cagaacuuaugcugacuac

SEQ ID NO: 161836 - RNA, 19 nt, Homo sapiens
ugaaaugugaggaucuugu

SEQ ID NO: 161837 - RNA, 19 nt, Homo sapiens
cagacauaccagccuuaua

SEQ ID NO: 161838 - RNA, 19 nt, Homo sapiens
gacaucagucaguuguuug

SEQ ID NO: 161839 - RNA, 19 nt, Homo sapiens
caaagacuggauuaaagag

SEQ ID NO: 161840 - RNA, 19 nt, Homo sapiens
guuuagccauguccucaag

SEQ ID NO: 161841 - RNA, 19 nt, Homo sapiens
aaaugcaguuuagccaugu

SEQ ID NO: 161842 - RNA, 19 nt, Homo sapiens
guccuucaacuguucauau

SEQ ID NO: 161843 - RNA, 19 nt, Homo sapiens
guucuucgucacuuaaugu

SEQ ID NO: 161844 - RNA, 19 nt, Homo sapiens
aauguugguuccaguccuu

SEQ ID NO: 161845 - RNA, 19 nt, Homo sapiens
gaaugaaugcauggaaggu

SEQ ID NO: 161846 - RNA, 19 nt, Homo sapiens
gacuguauuagaugaaaug

SEQ ID NO: 161847 - RNA, 19 nt, Homo sapiens
gacuacgaaucugugaaug

SEQ ID NO: 161848 - RNA, 19 nt, Homo sapiens
uuagauggaaguuguucuu

SEQ ID NO: 161849 - RNA, 19 nt, Homo sapiens
agacuggauuaaagagaag

SEQ ID NO: 161850 - RNA, 19 nt, Homo sapiens
aacuuaugcugacuacgaa

SEQ ID NO: 161851 - RNA, 19 nt, Homo sapiens
aaagacuggauuaaagaga

SEQ ID NO: 161852 - RNA, 19 nt, Homo sapiens
gcuguagcgaagagaguuu

SEQ ID NO: 161853 - RNA, 19 nt, Homo sapiens
aacagucccucuaucacau

SEQ ID NO: 161854 - RNA, 19 nt, Homo sapiens
gaaauaagaagcaccacua

SEQ ID NO: 161855 - RNA, 19 nt, Homo sapiens
uaaacuugcuucagacuuu

SEQ ID NO: 161856 - RNA, 19 nt, Homo sapiens
gagagaagcagcagacuuu

SEQ ID NO: 161857 - RNA, 19 nt, Homo sapiens
gcacgagaauugauagaga

SEQ ID NO: 161858 - RNA, 19 nt, Homo sapiens
agacagaccugcguaaauu

SEQ ID NO: 161859 - RNA, 19 nt, Homo sapiens
ggagagauuucccaacaau

SEQ ID NO: 161860 - RNA, 19 nt, Homo sapiens
ccaagaugcuggagagauu

SEQ ID NO: 161861 - RNA, 19 nt, Homo sapiens
ggaaguaccagcacaguga

SEQ ID NO: 161862 - RNA, 19 nt, Homo sapiens
agaacaagcucaacuacuu

SEQ ID NO: 161863 - RNA, 19 nt, Homo sapiens
ggacgugagcgacagaaua

SEQ ID NO: 161864 - RNA, 19 nt, Homo sapiens
gcaagaacaagcucaacua

SEQ ID NO: 161865 - RNA, 19 nt, Homo sapiens
gauagucucugcccaucaa

SEQ ID NO: 161866 - RNA, 19 nt, Homo sapiens
agaaggaacuggagaagau

SEQ ID NO: 161867 - RNA, 19 nt, Homo sapiens
caaccucucuucuguaucu

SEQ ID NO: 161868 - RNA, 19 nt, Homo sapiens
ggagagccguggugaagau

SEQ ID NO: 161869 - RNA, 19 nt, Homo sapiens
gagaauugauagagaagau

SEQ ID NO: 161870 - RNA, 19 nt, Homo sapiens
uggauaaacuugcuucaga

SEQ ID NO: 161871 - RNA, 19 nt, Homo sapiens
ggaaugccaccuacuuuga

SEQ ID NO: 161872 - RNA, 19 nt, Homo sapiens
guaaauucaggaccuauaa

SEQ ID NO: 161873 - RNA, 19 nt, Homo sapiens
ccaacaaucuacccaaaca

SEQ ID NO: 161874 - RNA, 19 nt, Homo sapiens
gaggacaggcucaaucaaa

SEQ ID NO: 161875 - RNA, 19 nt, Homo sapiens
gaauuacuggcuucugaua

SEQ ID NO: 161876 - RNA, 19 nt, Homo sapiens
ccaggucacuguuaacuag

SEQ ID NO: 161877 - RNA, 19 nt, Homo sapiens
guaaggagaacccuaccua

SEQ ID NO: 161878 - RNA, 19 nt, Homo sapiens
ggaagagccugccuuucuc

SEQ ID NO: 161879 - RNA, 19 nt, Homo sapiens
gcacgaagacgucauugca

SEQ ID NO: 161880 - RNA, 19 nt, Homo sapiens
ccacacaacauccucauau

SEQ ID NO: 161881 - RNA, 19 nt, Homo sapiens
cagccacccugcaagagua

SEQ ID NO: 161882 - RNA, 19 nt, Homo sapiens
gaauacaccaucaccaugu

SEQ ID NO: 161883 - RNA, 19 nt, Homo sapiens
cgaacgacgugcucaaaca

SEQ ID NO: 161884 - RNA, 19 nt, Homo sapiens
gaauugauagagaagauga

SEQ ID NO: 161885 - RNA, 19 nt, Homo sapiens
ggaacaagacgauggagau

SEQ ID NO: 161886 - RNA, 19 nt, Homo sapiens
uacaagaugucccacuuug

SEQ ID NO: 161887 - RNA, 19 nt, Homo sapiens
gaagaugauugcgauggau

SEQ ID NO: 161888 - RNA, 19 nt, Homo sapiens
gcagugggcagacacaguu

SEQ ID NO: 161889 - RNA, 19 nt, Homo sapiens
caagaugucccacuuugug

SEQ ID NO: 161890 - RNA, 19 nt, Homo sapiens
gaagcacgaagacgucauu

SEQ ID NO: 161891 - RNA, 19 nt, Homo sapiens
gaacgugauccgcuacuuc

SEQ ID NO: 161892 - RNA, 19 nt, Homo sapiens
gccaugaucuccgacuuug

SEQ ID NO: 161893 - RNA, 19 nt, Homo sapiens
aagaguauguggagcagaa

SEQ ID NO: 161894 - RNA, 19 nt, Homo sapiens
ggagaaggaccggcaauuc

SEQ ID NO: 161895 - RNA, 19 nt, Homo sapiens
gaacaagacgauggagaug

SEQ ID NO: 161896 - RNA, 19 nt, Homo sapiens
ggacaggcucaaucaaaug

SEQ ID NO: 161897 - RNA, 19 nt, Homo sapiens
gagcugagggcacaauugu

SEQ ID NO: 161898 - RNA, 19 nt, Homo sapiens
ccaucaaccucucuucugu

SEQ ID NO: 161899 - RNA, 19 nt, Homo sapiens
uagcccaggucacuguuaa

SEQ ID NO: 161900 - RNA, 19 nt, Homo sapiens
ggaagaugcuggccccaaa

SEQ ID NO: 161901 - RNA, 19 nt, Homo sapiens
cacgagaauugauagagaa

SEQ ID NO: 161902 - RNA, 19 nt, Homo sapiens
gcaccuuccugcugauugg

SEQ ID NO: 161903 - RNA, 19 nt, Homo sapiens
cagcacggacgucaaguuu

SEQ ID NO: 161904 - RNA, 19 nt, Homo sapiens
aggaauuacuggcuucuga

SEQ ID NO: 161905 - RNA, 19 nt, Homo sapiens
ugaggaaggugaugcacau

SEQ ID NO: 161906 - RNA, 19 nt, Homo sapiens
agacagaggccaagagcaa

SEQ ID NO: 161907 - RNA, 19 nt, Homo sapiens
ggagagaagcagcagacuu

SEQ ID NO: 161908 - RNA, 19 nt, Homo sapiens
aggagggaaucguacauuu

SEQ ID NO: 161909 - RNA, 19 nt, Homo sapiens
uagagaagcagcuccaguu

SEQ ID NO: 161910 - RNA, 19 nt, Homo sapiens
gggagaggagggaaucgua

SEQ ID NO: 161911 - RNA, 19 nt, Homo sapiens
ucucauugaucacagaugu

SEQ ID NO: 161912 - RNA, 19 nt, Homo sapiens
acagggaacugggaagaug

SEQ ID NO: 161913 - RNA, 19 nt, Homo sapiens
cuugaugccucccggcuuu

SEQ ID NO: 161914 - RNA, 19 nt, Homo sapiens
cgucauugcacgagaauug

SEQ ID NO: 161915 - RNA, 19 nt, Homo sapiens
gaaggggacuacaagaugu

SEQ ID NO: 161916 - RNA, 19 nt, Homo sapiens
cgagagcuccgguggaaug

SEQ ID NO: 161917 - RNA, 19 nt, Homo sapiens
cagagaugcugagcgaaga

SEQ ID NO: 161918 - RNA, 19 nt, Homo sapiens
cuggagagauuucccaaca

SEQ ID NO: 161919 - RNA, 19 nt, Homo sapiens
cgaacagaauacaccauca

SEQ ID NO: 161920 - RNA, 19 nt, Homo sapiens
cagauggaauccucuacau

SEQ ID NO: 161921 - RNA, 19 nt, Homo sapiens
aaugauggcagccuguaua

SEQ ID NO: 161922 - RNA, 19 nt, Homo sapiens
ugcgauggauccucagaaa

SEQ ID NO: 161923 - RNA, 19 nt, Homo sapiens
agaagaugauugcgaugga

SEQ ID NO: 161924 - RNA, 19 nt, Homo sapiens
caagaggacaggcucaauc

SEQ ID NO: 161925 - RNA, 19 nt, Homo sapiens
ggugauaguugggaaaauu

SEQ ID NO: 161926 - RNA, 19 nt, Homo sapiens
ccaccuacuuugacuaugc

SEQ ID NO: 161927 - RNA, 19 nt, Homo sapiens
gaagggagaggagggaauc

SEQ ID NO: 161928 - RNA, 19 nt, Homo sapiens
gagccguggugaagaugga

SEQ ID NO: 161929 - RNA, 19 nt, Homo sapiens
gacgugagcgacagaauag

SEQ ID NO: 161930 - RNA, 19 nt, Homo sapiens
gcgaagacuguaaggagaa

SEQ ID NO: 161931 - RNA, 19 nt, Homo sapiens
gagaagcagcagacuuugu

SEQ ID NO: 161932 - RNA, 19 nt, Homo sapiens
ucaaacacccguucuucug

SEQ ID NO: 161933 - RNA, 19 nt, Homo sapiens
gcucaaacacccguucuuc

SEQ ID NO: 161934 - RNA, 19 nt, Homo sapiens
agacgucauugcacgagaa

SEQ ID NO: 161935 - RNA, 19 nt, Homo sapiens
acaagacgauggagaugag

SEQ ID NO: 161936 - RNA, 19 nt, Homo sapiens
ucaucggccuuugcagaua

SEQ ID NO: 161937 - RNA, 19 nt, Homo sapiens
ugacgaaacuuccuuuuac

SEQ ID NO: 161938 - RNA, 19 nt, Homo sapiens
gaggagggaaucguacauu

SEQ ID NO: 161939 - RNA, 19 nt, Homo sapiens
aggacaggcucaaucaaau

SEQ ID NO: 161940 - RNA, 19 nt, Homo sapiens
gaccuaaagccacacaaca

SEQ ID NO: 161941 - RNA, 19 nt, Homo sapiens
uggaagagccugccuuucu

SEQ ID NO: 161942 - RNA, 19 nt, Homo sapiens
cguaaauucaggaccuaua

SEQ ID NO: 161943 - RNA, 19 nt, Homo sapiens
acagugacgcuuccugaaa

SEQ ID NO: 161944 - RNA, 19 nt, Homo sapiens
ggccaugaucuccgacuuu

SEQ ID NO: 161945 - RNA, 19 nt, Homo sapiens
gaccggcaauuccaguaca

SEQ ID NO: 161946 - RNA, 19 nt, Homo sapiens
guccagcuguugcgagaau

SEQ ID NO: 161947 - RNA, 19 nt, Homo sapiens
ggagcugagggcacaauug

SEQ ID NO: 161948 - RNA, 19 nt, Homo sapiens
ucccaacaaucuacccaaa

SEQ ID NO: 161949 - RNA, 19 nt, Homo sapiens
cuacaagaugucccacuuu

SEQ ID NO: 161950 - RNA, 19 nt, Homo sapiens
caucaaccucucuucugua

SEQ ID NO: 161951 - RNA, 19 nt, Homo sapiens
gacuuuggccucugcaaga

SEQ ID NO: 161952 - RNA, 19 nt, Homo sapiens
agaaggacuuugcgcaucu

SEQ ID NO: 161953 - RNA, 19 nt, Homo sapiens
gaacagaauacaccaucac

SEQ ID NO: 161954 - RNA, 19 nt, Homo sapiens
ggaaggagaugacaaaauu

SEQ ID NO: 161955 - RNA, 19 nt, Homo sapiens
ggaggacacuuugugauuu

SEQ ID NO: 161956 - RNA, 19 nt, Homo sapiens
cgagagauguguguugaua

SEQ ID NO: 161957 - RNA, 19 nt, Homo sapiens
gaagaggaccaacaucauu

SEQ ID NO: 161958 - RNA, 19 nt, Homo sapiens
guucagcgcugucaggauu

SEQ ID NO: 161959 - RNA, 19 nt, Homo sapiens
gaugugaucuuugcugaug

SEQ ID NO: 161960 - RNA, 19 nt, Homo sapiens
gcaccacggucucccaugu

SEQ ID NO: 161961 - RNA, 19 nt, Homo sapiens
gccgugaccucauuaacuu

SEQ ID NO: 161962 - RNA, 19 nt, Homo sapiens
gaggacacuuugugauuuc

SEQ ID NO: 161963 - RNA, 19 nt, Homo sapiens
gagggugucuucauuuguc

SEQ ID NO: 161964 - RNA, 19 nt, Homo sapiens
aaccagggcucgccaugaa

SEQ ID NO: 161965 - RNA, 19 nt, Homo sapiens
gauguguguugauacuguu

SEQ ID NO: 161966 - RNA, 19 nt, Homo sapiens
ggaccagauccacaucaaa

SEQ ID NO: 161967 - RNA, 19 nt, Homo sapiens
ggucgaggcggaggcuuua

SEQ ID NO: 161968 - RNA, 19 nt, Homo sapiens
aaugguggaugugaucuuu

SEQ ID NO: 161969 - RNA, 19 nt, Homo sapiens
gcucgacacccacacaaau

SEQ ID NO: 161970 - RNA, 19 nt, Homo sapiens
caagcuagcagcagcaauc

SEQ ID NO: 161971 - RNA, 19 nt, Homo sapiens
ccaagaagaggaccaacau

SEQ ID NO: 161972 - RNA, 19 nt, Homo sapiens
aagaagaggaccaacauca

SEQ ID NO: 161973 - RNA, 19 nt, Homo sapiens
gaccagauccacaucaaac

SEQ ID NO: 161974 - RNA, 19 nt, Homo sapiens
uggaggacacuuugugauu

SEQ ID NO: 161975 - RNA, 19 nt, Homo sapiens
cauuaaggccaacugcauu

SEQ ID NO: 161976 - RNA, 19 nt, Homo sapiens
agagauguguguugauacu

SEQ ID NO: 161977 - RNA, 19 nt, Homo sapiens
aguugacccuugagccaua

SEQ ID NO: 161978 - RNA, 19 nt, Homo sapiens
agauguguguugauacugu

SEQ ID NO: 161979 - RNA, 19 nt, Homo sapiens
cguaauggaggacacuuug

SEQ ID NO: 161980 - RNA, 19 nt, Homo sapiens
ugcgagagauguguguuga

SEQ ID NO: 161981 - RNA, 19 nt, Homo sapiens
guguuugccuccgaaguga

SEQ ID NO: 161982 - RNA, 19 nt, Homo sapiens
uaauggaggacacuuugug

SEQ ID NO: 161983 - RNA, 19 nt, Homo sapiens
cggauggucuagucuaugc

SEQ ID NO: 161984 - RNA, 19 nt, Homo sapiens
ugaagccgcaggagcaguu

SEQ ID NO: 161985 - RNA, 19 nt, Homo sapiens
gcguaauggaggacacuuu

SEQ ID NO: 161986 - RNA, 19 nt, Homo sapiens
gaaucaguuuauggagaga

SEQ ID NO: 161987 - RNA, 19 nt, Homo sapiens
acaaauaccgcaugcucau

SEQ ID NO: 161988 - RNA, 19 nt, Homo sapiens
aggagcaguugacccuuga

SEQ ID NO: 161989 - RNA, 19 nt, Homo sapiens
gcaacaggagaacaugaag

SEQ ID NO: 161990 - RNA, 19 nt, Homo sapiens
cacuuugugauuuccauua

SEQ ID NO: 161991 - RNA, 19 nt, Homo sapiens
gagaugacaaaauugagua

SEQ ID NO: 161992 - RNA, 19 nt, Homo sapiens
guaauggaggacacuuugu

SEQ ID NO: 161993 - RNA, 19 nt, Homo sapiens
cucgacacccacacaaaua

SEQ ID NO: 161994 - RNA, 19 nt, Homo sapiens
gccaagaagaggaccaaca

SEQ ID NO: 161995 - RNA, 19 nt, Homo sapiens
ccauuaaggccaacugcau

SEQ ID NO: 161996 - RNA, 19 nt, Homo sapiens
ggaaaccagucggggaaga

SEQ ID NO: 161997 - RNA, 19 nt, Homo sapiens
caagaagaggaccaacauc

SEQ ID NO: 161998 - RNA, 19 nt, Homo sapiens
gauaaucccugcugcauuu

SEQ ID NO: 161999 - RNA, 19 nt, Homo sapiens
gaagugcagucuuugauuu

SEQ ID NO: 162000 - RNA, 19 nt, Homo sapiens
caacauacuugucccauga

SEQ ID NO: 162001 - RNA, 19 nt, Homo sapiens
acagagaggucauugguua

SEQ ID NO: 162002 - RNA, 19 nt, Homo sapiens
gggaauggcaaauauauua

SEQ ID NO: 162003 - RNA, 19 nt, Homo sapiens
guaauucuguucuggauuu

SEQ ID NO: 162004 - RNA, 19 nt, Homo sapiens
agaagcaccuuauauagua

SEQ ID NO: 162005 - RNA, 19 nt, Homo sapiens
ggucaaggguuuauuauag

SEQ ID NO: 162006 - RNA, 19 nt, Homo sapiens
gcaugacacugauuacaaa

SEQ ID NO: 162007 - RNA, 19 nt, Homo sapiens
gagaagacccuaucaaugu

SEQ ID NO: 162008 - RNA, 19 nt, Homo sapiens
ggucauggguuccaguuaa

SEQ ID NO: 162009 - RNA, 19 nt, Homo sapiens
gagcaccuguaaacaauuu

SEQ ID NO: 162010 - RNA, 19 nt, Homo sapiens
gggacuuacugauaauuua

SEQ ID NO: 162011 - RNA, 19 nt, Homo sapiens
cuaaggaagugcagucuuu

SEQ ID NO: 162012 - RNA, 19 nt, Homo sapiens
caaaucaacuagcuccauu

SEQ ID NO: 162013 - RNA, 19 nt, Homo sapiens
caagagaaguauucaagga

SEQ ID NO: 162014 - RNA, 19 nt, Homo sapiens
guagacagcuguguuccua

SEQ ID NO: 162015 - RNA, 19 nt, Homo sapiens
agaagcagcugucaaguug

SEQ ID NO: 162016 - RNA, 19 nt, Homo sapiens
gcauggagcugaacaguac

SEQ ID NO: 162017 - RNA, 19 nt, Homo sapiens
gaaugugccuggcuagaga

SEQ ID NO: 162018 - RNA, 19 nt, Homo sapiens
caacaccaauggcuuucua

SEQ ID NO: 162019 - RNA, 19 nt, Homo sapiens
cuaguaaccuugcagauau

SEQ ID NO: 162020 - RNA, 19 nt, Homo sapiens
gauuugauuucccuaguaa

SEQ ID NO: 162021 - RNA, 19 nt, Homo sapiens
gaggguaaaugguaguuga

SEQ ID NO: 162022 - RNA, 19 nt, Homo sapiens
gagcaucuguacagcauga

SEQ ID NO: 162023 - RNA, 19 nt, Homo sapiens
gcaguaaaguccauggaau

SEQ ID NO: 162024 - RNA, 19 nt, Homo sapiens
ucaacuagcuccauuuaca

SEQ ID NO: 162025 - RNA, 19 nt, Homo sapiens
gaaaguauuuggaggaaaa

SEQ ID NO: 162026 - RNA, 19 nt, Homo sapiens
caugagagcugccaaccuu

SEQ ID NO: 162027 - RNA, 19 nt, Homo sapiens
gcaaagauuaugccugaaa

SEQ ID NO: 162028 - RNA, 19 nt, Homo sapiens
gaagaucacauuucauauc

SEQ ID NO: 162029 - RNA, 19 nt, Homo sapiens
gaaagugguacaccuuaaa

SEQ ID NO: 162030 - RNA, 19 nt, Homo sapiens
ggaagcuaguuaugugaaa

SEQ ID NO: 162031 - RNA, 19 nt, Homo sapiens
ccuaaagccuggugauuau

SEQ ID NO: 162032 - RNA, 19 nt, Homo sapiens
aaagcuaggucaaggguuu

SEQ ID NO: 162033 - RNA, 19 nt, Homo sapiens
agauaacucugugcauuua

SEQ ID NO: 162034 - RNA, 19 nt, Homo sapiens
agagaaagauuggccagua

SEQ ID NO: 162035 - RNA, 19 nt, Homo sapiens
guguagagcucuuguuuua

SEQ ID NO: 162036 - RNA, 19 nt, Homo sapiens
gaagcaccuuaguuuguuu

SEQ ID NO: 162037 - RNA, 19 nt, Homo sapiens
ggauuucauucauuucuga

SEQ ID NO: 162038 - RNA, 19 nt, Homo sapiens
caaggagacucgcuacugu

SEQ ID NO: 162039 - RNA, 19 nt, Homo sapiens
gaaacacacuuguaaaccu

SEQ ID NO: 162040 - RNA, 19 nt, Homo sapiens
agaagacccuaucaaugua

SEQ ID NO: 162041 - RNA, 19 nt, Homo sapiens
ggaagaagcagcugucaag

SEQ ID NO: 162042 - RNA, 19 nt, Homo sapiens
gaugaaaggugggauacga

SEQ ID NO: 162043 - RNA, 19 nt, Homo sapiens
uuaguuaagucucccuaua

SEQ ID NO: 162044 - RNA, 19 nt, Homo sapiens
ugacagacaaucuuaugua

SEQ ID NO: 162045 - RNA, 19 nt, Homo sapiens
gcacaauuauggguuacuu

SEQ ID NO: 162046 - RNA, 19 nt, Homo sapiens
ccaauggcuuucuagauga

SEQ ID NO: 162047 - RNA, 19 nt, Homo sapiens
ucaaggacauaacgacuau

SEQ ID NO: 162048 - RNA, 19 nt, Homo sapiens
gcauuuccuuuccaauuga

SEQ ID NO: 162049 - RNA, 19 nt, Homo sapiens
ugaaagugguacaccuuaa

SEQ ID NO: 162050 - RNA, 19 nt, Homo sapiens
gcaccacuuuagccaaauu

SEQ ID NO: 162051 - RNA, 19 nt, Homo sapiens
cuagagauccugaugauug

SEQ ID NO: 162052 - RNA, 19 nt, Homo sapiens
gauggucagugccuuguug

SEQ ID NO: 162053 - RNA, 19 nt, Homo sapiens
caauuuccuuugaccuaua

SEQ ID NO: 162054 - RNA, 19 nt, Homo sapiens
gcagcuaccuaggaacauu

SEQ ID NO: 162055 - RNA, 19 nt, Homo sapiens
gcacuguacuuggaucuuc

SEQ ID NO: 162056 - RNA, 19 nt, Homo sapiens
caucuucugucuucuguug

SEQ ID NO: 162057 - RNA, 19 nt, Homo sapiens
gaacaacaucagcaguaaa

SEQ ID NO: 162058 - RNA, 19 nt, Homo sapiens
ggaggaaaaugguuaauuc

SEQ ID NO: 162059 - RNA, 19 nt, Homo sapiens
gguguaggaacaugauuua

SEQ ID NO: 162060 - RNA, 19 nt, Homo sapiens
cagacaaucuuauguagca

SEQ ID NO: 162061 - RNA, 19 nt, Homo sapiens
ugaaugacagacaaucuua

SEQ ID NO: 162062 - RNA, 19 nt, Homo sapiens
ccaguuaagugaucaccaa

SEQ ID NO: 162063 - RNA, 19 nt, Homo sapiens
gguauuggguguaggaaca

SEQ ID NO: 162064 - RNA, 19 nt, Homo sapiens
cauccaauguguuucuauu

SEQ ID NO: 162065 - RNA, 19 nt, Homo sapiens
gacagacaaucuuauguag

SEQ ID NO: 162066 - RNA, 19 nt, Homo sapiens
gccuaaagccuggugauua

SEQ ID NO: 162067 - RNA, 19 nt, Homo sapiens
gaagcaccuuauauaguau

SEQ ID NO: 162068 - RNA, 19 nt, Homo sapiens
aagcagcugucaaguugua

SEQ ID NO: 162069 - RNA, 19 nt, Homo sapiens
agggauaaguuccugauuu

SEQ ID NO: 162070 - RNA, 19 nt, Homo sapiens
cagcaaagaauuuaaagug

SEQ ID NO: 162071 - RNA, 19 nt, Homo sapiens
ggaagugcagucuuugauu

SEQ ID NO: 162072 - RNA, 19 nt, Homo sapiens
gaaggcagauccccuaguu

SEQ ID NO: 162073 - RNA, 19 nt, Homo sapiens
gaagagggugccaggcuuu

SEQ ID NO: 162074 - RNA, 19 nt, Homo sapiens
gaucaaacgcucuaagaag

SEQ ID NO: 162075 - RNA, 19 nt, Homo sapiens
gccagcaggugcccuacua

SEQ ID NO: 162076 - RNA, 19 nt, Homo sapiens
gaagaaagaacaacaucag

SEQ ID NO: 162077 - RNA, 19 nt, Homo sapiens
gaucacauuucauaucaac

SEQ ID NO: 162078 - RNA, 19 nt, Homo sapiens
guucucaccuugaaaucuu

SEQ ID NO: 162079 - RNA, 19 nt, Homo sapiens
aauggcagcuucaguucua

SEQ ID NO: 162080 - RNA, 19 nt, Homo sapiens
ccagaugccuauuguugga

SEQ ID NO: 162081 - RNA, 19 nt, Homo sapiens
gagaggugaugucuguguu

SEQ ID NO: 162082 - RNA, 19 nt, Homo sapiens
cuagcacaauuauggguua

SEQ ID NO: 162083 - RNA, 19 nt, Homo sapiens
gggauaaguuccugauuuu

SEQ ID NO: 162084 - RNA, 19 nt, Homo sapiens
ccacagcaaagaauuuaaa

SEQ ID NO: 162085 - RNA, 19 nt, Homo sapiens
uguaaaugcugccauguuc

SEQ ID NO: 162086 - RNA, 19 nt, Homo sapiens
caguaaaguccauggaaua

SEQ ID NO: 162087 - RNA, 19 nt, Homo sapiens
gaaaguagggcagaaacug

SEQ ID NO: 162088 - RNA, 19 nt, Homo sapiens
uggcacaucuucugucuuc

SEQ ID NO: 162089 - RNA, 19 nt, Homo sapiens
caaauucugucuccugcau

SEQ ID NO: 162090 - RNA, 19 nt, Homo sapiens
caagaucacagacacuuug

SEQ ID NO: 162091 - RNA, 19 nt, Homo sapiens
gagaaagauuggccaguac

SEQ ID NO: 162092 - RNA, 19 nt, Homo sapiens
gcuuugcuuuguuuaauga

SEQ ID NO: 162093 - RNA, 19 nt, Homo sapiens
ugacacugauuacaaauac

SEQ ID NO: 162094 - RNA, 19 nt, Homo sapiens
uaaccuugcagauauguuu

SEQ ID NO: 162095 - RNA, 19 nt, Homo sapiens
gaggcuaggucauccaaag

SEQ ID NO: 162096 - RNA, 19 nt, Homo sapiens
agaacaacaucagcaguaa

SEQ ID NO: 162097 - RNA, 19 nt, Homo sapiens
ucagaugauugaaauguuc

SEQ ID NO: 162098 - RNA, 19 nt, Homo sapiens
gaacaucugcucaacauga

SEQ ID NO: 162099 - RNA, 19 nt, Homo sapiens
agaaauaacugccucuuga

SEQ ID NO: 162100 - RNA, 19 nt, Homo sapiens
gcccugcugugaugaauua

SEQ ID NO: 162101 - RNA, 19 nt, Homo sapiens
gcacggcuccauauacaua

SEQ ID NO: 162102 - RNA, 19 nt, Homo sapiens
gcuguuaucucaagacaug

SEQ ID NO: 162103 - RNA, 19 nt, Homo sapiens
gcaaagagggcucccagaa

SEQ ID NO: 162104 - RNA, 19 nt, Homo sapiens
gauuauauuuguccagcua

SEQ ID NO: 162105 - RNA, 19 nt, Homo sapiens
ggauggagguguuaaugau

SEQ ID NO: 162106 - RNA, 19 nt, Homo sapiens
auacauaccuuccuccuau

SEQ ID NO: 162107 - RNA, 19 nt, Homo sapiens
gaaaugcguagaaggaauu

SEQ ID NO: 162108 - RNA, 19 nt, Homo sapiens
gaagcaagaucgcuagaac

SEQ ID NO: 162109 - RNA, 19 nt, Homo sapiens
ggaaaugcguagaaggaau

SEQ ID NO: 162110 - RNA, 19 nt, Homo sapiens
caagaagauucccggcuuu

SEQ ID NO: 162111 - RNA, 19 nt, Homo sapiens
aaagagggaugcucacuuc

SEQ ID NO: 162112 - RNA, 19 nt, Homo sapiens
gcaccuuucuccuuuagug

SEQ ID NO: 162113 - RNA, 19 nt, Homo sapiens
gaaauaacugccucuugaa

SEQ ID NO: 162114 - RNA, 19 nt, Homo sapiens
gcaacuacuucaagguuuc

SEQ ID NO: 162115 - RNA, 19 nt, Homo sapiens
ccacgaaucuuugagaaca

SEQ ID NO: 162116 - RNA, 19 nt, Homo sapiens
aaacagagagacacugaaa

SEQ ID NO: 162117 - RNA, 19 nt, Homo sapiens
caaugucacuaacuuggaa

SEQ ID NO: 162118 - RNA, 19 nt, Homo sapiens
gccaugauccugcucaauu

SEQ ID NO: 162119 - RNA, 19 nt, Homo sapiens
guaaacagagagacacuga

SEQ ID NO: 162120 - RNA, 19 nt, Homo sapiens
ggcaacuacuucaagguuu

SEQ ID NO: 162121 - RNA, 19 nt, Homo sapiens
ccaguuaucacaucuguau

SEQ ID NO: 162122 - RNA, 19 nt, Homo sapiens
ccagcaaugucacuaacuu

SEQ ID NO: 162123 - RNA, 19 nt, Homo sapiens
cucaagacauggauauaaa

SEQ ID NO: 162124 - RNA, 19 nt, Homo sapiens
gccggaagcuggcucacuu

SEQ ID NO: 162125 - RNA, 19 nt, Homo sapiens
gaagauucccggcuuugug

SEQ ID NO: 162126 - RNA, 19 nt, Homo sapiens
acacaaagaauaucucugu

SEQ ID NO: 162127 - RNA, 19 nt, Homo sapiens
ugaugucccugaccaaguu

SEQ ID NO: 162128 - RNA, 19 nt, Homo sapiens
gagaaauaacugccucuug

SEQ ID NO: 162129 - RNA, 19 nt, Homo sapiens
gaacccacagucucaguga

SEQ ID NO: 162130 - RNA, 19 nt, Homo sapiens
guagacagccaccaugaau

SEQ ID NO: 162131 - RNA, 19 nt, Homo sapiens
gagagacacugaaaaggaa

SEQ ID NO: 162132 - RNA, 19 nt, Homo sapiens
acaaaucaguguacaaucg

SEQ ID NO: 162133 - RNA, 19 nt, Homo sapiens
uuucucagcuguuaucuca

SEQ ID NO: 162134 - RNA, 19 nt, Homo sapiens
aagaauaucucugugucaa

SEQ ID NO: 162135 - RNA, 19 nt, Homo sapiens
gcuguuggauggagguguu

SEQ ID NO: 162136 - RNA, 19 nt, Homo sapiens
agacagccaccaugaauau

SEQ ID NO: 162137 - RNA, 19 nt, Homo sapiens
ccaugauccugcucaauuc

SEQ ID NO: 162138 - RNA, 19 nt, Homo sapiens
cuauagcccugcugugaug

SEQ ID NO: 162139 - RNA, 19 nt, Homo sapiens
gcaaggccgguguguuuau

SEQ ID NO: 162140 - RNA, 19 nt, Homo sapiens
uggaacaucugcucaacau

SEQ ID NO: 162141 - RNA, 19 nt, Homo sapiens
gcccacgaaucuuugagaa

SEQ ID NO: 162142 - RNA, 19 nt, Homo sapiens
gggcugauguggcgcucaa

SEQ ID NO: 162143 - RNA, 19 nt, Homo sapiens
aggcaaggccgguguguuu

SEQ ID NO: 162144 - RNA, 19 nt, Homo sapiens
cauuauacuugcccacgaa

SEQ ID NO: 162145 - RNA, 19 nt, Homo sapiens
ggaauucuggaaaucuuug

SEQ ID NO: 162146 - RNA, 19 nt, Homo sapiens
ugugaugaauuacagcauu

SEQ ID NO: 162147 - RNA, 19 nt, Homo sapiens
uuaauucuccuuccuccua

SEQ ID NO: 162148 - RNA, 19 nt, Homo sapiens
uucaagguuucgagaguua

SEQ ID NO: 162149 - RNA, 19 nt, Homo sapiens
gaaggaauucuggaaaucu

SEQ ID NO: 162150 - RNA, 19 nt, Homo sapiens
ggacagggaugaggggaaa

SEQ ID NO: 162151 - RNA, 19 nt, Homo sapiens
acaaggaguugguacacau

SEQ ID NO: 162152 - RNA, 19 nt, Homo sapiens
ggauaucacuauggagucu

SEQ ID NO: 162153 - RNA, 19 nt, Homo sapiens
aaauaacugccucuugaaa

SEQ ID NO: 162154 - RNA, 19 nt, Homo sapiens
caaagagggaugcucacuu

SEQ ID NO: 162155 - RNA, 19 nt, Homo sapiens
agugguccaucgccaguua

SEQ ID NO: 162156 - RNA, 19 nt, Homo sapiens
gacaaggaguugguacaca

SEQ ID NO: 162157 - RNA, 19 nt, Homo sapiens
gcaaugucacuaacuugga

SEQ ID NO: 162158 - RNA, 19 nt, Homo sapiens
ucucaagacauggauauaa

SEQ ID NO: 162159 - RNA, 19 nt, Homo sapiens
gacaugcuccuggcaacua

SEQ ID NO: 162160 - RNA, 19 nt, Homo sapiens
gcaucgggauaucacuaug

SEQ ID NO: 162161 - RNA, 19 nt, Homo sapiens
gggcaccuuucuccuuuag

SEQ ID NO: 162162 - RNA, 19 nt, Homo sapiens
guaacaagggcauggaaca

SEQ ID NO: 162163 - RNA, 19 nt, Homo sapiens
cgugaccgaugcuuugguu

SEQ ID NO: 162164 - RNA, 19 nt, Homo sapiens
ggagucuggucgugugaag

SEQ ID NO: 162165 - RNA, 19 nt, Homo sapiens
cugggcaccuuucuccuuu

SEQ ID NO: 162166 - RNA, 19 nt, Homo sapiens
gcggaggcugcgagaaaua

SEQ ID NO: 162167 - RNA, 19 nt, Homo sapiens
gcauggaacaucugcucaa

SEQ ID NO: 162168 - RNA, 19 nt, Homo sapiens
gaaacuugcagggcgaaga

SEQ ID NO: 162169 - RNA, 19 nt, Homo sapiens
aaggaauucuggaaaucuu

SEQ ID NO: 162170 - RNA, 19 nt, Homo sapiens
gaccgaugcuuugguuugg

SEQ ID NO: 162171 - RNA, 19 nt, Homo sapiens
ggcaaggccgguguguuua

SEQ ID NO: 162172 - RNA, 19 nt, Homo sapiens
caacacaaagaauaucucu

SEQ ID NO: 162173 - RNA, 19 nt, Homo sapiens
agaacacaccuuaccugua

SEQ ID NO: 162174 - RNA, 19 nt, Homo sapiens
gccaacaccugggcaccuu

SEQ ID NO: 162175 - RNA, 19 nt, Homo sapiens
uagacagccaccaugaaua

SEQ ID NO: 162176 - RNA, 19 nt, Homo sapiens
ucucagcuguuaucucaag

SEQ ID NO: 162177 - RNA, 19 nt, Homo sapiens
caaagagggcucccagaac

SEQ ID NO: 162178 - RNA, 19 nt, Homo sapiens
acaagggcauggaacaucu

SEQ ID NO: 162179 - RNA, 19 nt, Homo sapiens
ugauguggcgcucaauuga

SEQ ID NO: 162180 - RNA, 19 nt, Homo sapiens
gaggugcgcucgcuuuccu

SEQ ID NO: 162181 - RNA, 19 nt, Homo sapiens
aagagucccuggugugaag

SEQ ID NO: 162182 - RNA, 19 nt, Homo sapiens
ugaccgaugcuuugguuug

SEQ ID NO: 162183 - RNA, 19 nt, Homo sapiens
acaaagaauaucucugugu

SEQ ID NO: 162184 - RNA, 19 nt, Homo sapiens
caagguuucgagaguuaaa

SEQ ID NO: 162185 - RNA, 19 nt, Homo sapiens
caaaucaguguacaaucga

SEQ ID NO: 162186 - RNA, 19 nt, Homo sapiens
uuacagcauucccagcaau

SEQ ID NO: 162187 - RNA, 19 nt, Homo sapiens
caaggccgguguguuuauc

SEQ ID NO: 162188 - RNA, 19 nt, Homo sapiens
gcugaaugcccacgugcuu

SEQ ID NO: 162189 - RNA, 19 nt, Homo sapiens
gggaaaugcguagaaggaa

SEQ ID NO: 162190 - RNA, 19 nt, Homo sapiens
gcugauguggcgcucaauu

SEQ ID NO: 162191 - RNA, 19 nt, Homo sapiens
gauggagguguuaaugaug

SEQ ID NO: 162192 - RNA, 19 nt, Homo sapiens
caucgccaguuaucacauc

SEQ ID NO: 162193 - RNA, 19 nt, Homo sapiens
cagcuguuaucucaagaca

SEQ ID NO: 162194 - RNA, 19 nt, Homo sapiens
gggugcaaguccuccauca

SEQ ID NO: 162195 - RNA, 19 nt, Homo sapiens
ggaguugguacacaugauc

SEQ ID NO: 162196 - RNA, 19 nt, Homo sapiens
accgaggccuccaugauga

SEQ ID NO: 162197 - RNA, 19 nt, Homo sapiens
caccgaggccuccaugaug

SEQ ID NO: 162198 - RNA, 19 nt, Homo sapiens
gcaaagugcuggcccauuu

SEQ ID NO: 162199 - RNA, 19 nt, Homo sapiens
gcagagcaauaacacuaua

SEQ ID NO: 162200 - RNA, 19 nt, Homo sapiens
ggccuucgcugaggacuua

SEQ ID NO: 162201 - RNA, 19 nt, Homo sapiens
ugaaugcacuggugucuca

SEQ ID NO: 162202 - RNA, 19 nt, Homo sapiens
gcccuuggcuguacagaga

SEQ ID NO: 162203 - RNA, 19 nt, Homo sapiens
gcauugagccucucuacau

SEQ ID NO: 162204 - RNA, 19 nt, Homo sapiens
ucauuugcauugggcauua

SEQ ID NO: 162205 - RNA, 19 nt, Homo sapiens
gagcaucccaggcuucuca

SEQ ID NO: 162206 - RNA, 19 nt, Homo sapiens
ccagacagcgggcaaagug

SEQ ID NO: 162207 - RNA, 19 nt, Homo sapiens
gaagcaauaacuccaagca

SEQ ID NO: 162208 - RNA, 19 nt, Homo sapiens
acgaggcccugcuggagua

SEQ ID NO: 162209 - RNA, 19 nt, Homo sapiens
gcgagaggaguauguucua

SEQ ID NO: 162210 - RNA, 19 nt, Homo sapiens
caaagcagagugggacuug

SEQ ID NO: 162211 - RNA, 19 nt, Homo sapiens
cugcaaagccuucuucaag

SEQ ID NO: 162212 - RNA, 19 nt, Homo sapiens
cugcagagcaauaacacua

SEQ ID NO: 162213 - RNA, 19 nt, Homo sapiens
cauugagccucucuacauc

SEQ ID NO: 162214 - RNA, 19 nt, Homo sapiens
uacccucugugaccucuuu

SEQ ID NO: 162215 - RNA, 19 nt, Homo sapiens
ccucucaucauuugcauug

SEQ ID NO: 162216 - RNA, 19 nt, Homo sapiens
gcuccuccucucaucauuu

SEQ ID NO: 162217 - RNA, 19 nt, Homo sapiens
ggagcgagaggaguauguu

SEQ ID NO: 162218 - RNA, 19 nt, Homo sapiens
gggugggcaugcucaagga

SEQ ID NO: 162219 - RNA, 19 nt, Homo sapiens
gggccuugcggaagccaua

SEQ ID NO: 162220 - RNA, 19 nt, Homo sapiens
gccagguggugggcauuga

SEQ ID NO: 162221 - RNA, 19 nt, Homo sapiens
cuccuccucucaucauuug

SEQ ID NO: 162222 - RNA, 19 nt, Homo sapiens
caaagugcuggcccauuuc

SEQ ID NO: 162223 - RNA, 19 nt, Homo sapiens
gagaugcucgaggccauga

SEQ ID NO: 162224 - RNA, 19 nt, Homo sapiens
cgagaggaguauguucuac

SEQ ID NO: 162225 - RNA, 19 nt, Homo sapiens
aggcccugcuggaguauga

SEQ ID NO: 162226 - RNA, 19 nt, Homo sapiens
gagcgagaggaguauguuc

SEQ ID NO: 162227 - RNA, 19 nt, Homo sapiens
gugggaggcagaaaccuau

SEQ ID NO: 162228 - RNA, 19 nt, Homo sapiens
ggcuggagcgagaggagua

SEQ ID NO: 162229 - RNA, 19 nt, Homo sapiens
ugaccaagauugucucaua

SEQ ID NO: 162230 - RNA, 19 nt, Homo sapiens
gaaaugagcuuggcuugca

SEQ ID NO: 162231 - RNA, 19 nt, Homo sapiens
gagcuuggcuugcaacuca

SEQ ID NO: 162232 - RNA, 19 nt, Homo sapiens
gcacuucuauagcgucaaa

SEQ ID NO: 162233 - RNA, 19 nt, Homo sapiens
ccaaucagcugccuucaca

SEQ ID NO: 162234 - RNA, 19 nt, Homo sapiens
gcacugcucaggcuggaua

SEQ ID NO: 162235 - RNA, 19 nt, Homo sapiens
gaggaucucccaaggauga

SEQ ID NO: 162236 - RNA, 19 nt, Homo sapiens
ucccugggcuggugaauaa

SEQ ID NO: 162237 - RNA, 19 nt, Homo sapiens
cagagugccuggauggaaa

SEQ ID NO: 162238 - RNA, 19 nt, Homo sapiens
gcacaucccaggcuucuca

SEQ ID NO: 162239 - RNA, 19 nt, Homo sapiens
caacuccgauuccauguac

SEQ ID NO: 162240 - RNA, 19 nt, Homo sapiens
gcaccucacuggaucuagu

SEQ ID NO: 162241 - RNA, 19 nt, Homo sapiens
ggacucgccacccauguuu

SEQ ID NO: 162242 - RNA, 19 nt, Homo sapiens
gaggugauccagugauuug

SEQ ID NO: 162243 - RNA, 19 nt, Homo sapiens
uagaggaucucccaaggau

SEQ ID NO: 162244 - RNA, 19 nt, Homo sapiens
cagaggugauccagugauu

SEQ ID NO: 162245 - RNA, 19 nt, Homo sapiens
ggagcacuguccucagaga

SEQ ID NO: 162246 - RNA, 19 nt, Homo sapiens
ccucagagaugcgcagguu

SEQ ID NO: 162247 - RNA, 19 nt, Homo sapiens
ggaggccacuggagcaagu

SEQ ID NO: 162248 - RNA, 19 nt, Homo sapiens
gcaagcugcugcugacacu

SEQ ID NO: 162249 - RNA, 19 nt, Homo sapiens
gcaugugcauuuccuaacu

SEQ ID NO: 162250 - RNA, 19 nt, Homo sapiens
caagauugucucauaccua

SEQ ID NO: 162251 - RNA, 19 nt, Homo sapiens
gaccaagauugucucauac

SEQ ID NO: 162252 - RNA, 19 nt, Homo sapiens
gaaaaugccccuuccaauc

SEQ ID NO: 162253 - RNA, 19 nt, Homo sapiens
ucaaggcccugaccacucu

SEQ ID NO: 162254 - RNA, 19 nt, Homo sapiens
ucccaaggaugaaagaaug

SEQ ID NO: 162255 - RNA, 19 nt, Homo sapiens
gcagagugccuggauggaa

SEQ ID NO: 162256 - RNA, 19 nt, Homo sapiens
gagcuuguggucaucauug

SEQ ID NO: 162257 - RNA, 19 nt, Homo sapiens
gagggcagguuggccaaga

SEQ ID NO: 162258 - RNA, 19 nt, Homo sapiens
agaggcagcaugugcauuu

SEQ ID NO: 162259 - RNA, 19 nt, Homo sapiens
guacaucgaggaucuagag

SEQ ID NO: 162260 - RNA, 19 nt, Homo sapiens
gagaaggaggaguuuguga

SEQ ID NO: 162261 - RNA, 19 nt, Homo sapiens
caugaaaugccucaaagug

SEQ ID NO: 162262 - RNA, 19 nt, Homo sapiens
ucuagaggcuguccagaag

SEQ ID NO: 162263 - RNA, 19 nt, Homo sapiens
gggcggaaguccugauggu

SEQ ID NO: 162264 - RNA, 19 nt, Homo sapiens
cagcaugugcauuuccuaa

SEQ ID NO: 162265 - RNA, 19 nt, Homo sapiens
ccauguacaucgaggaucu

SEQ ID NO: 162266 - RNA, 19 nt, Homo sapiens
gagagaggcaggcagaucu

SEQ ID NO: 162267 - RNA, 19 nt, Homo sapiens
caagagcagcuuagaggau

SEQ ID NO: 162268 - RNA, 19 nt, Homo sapiens
gguguacgcugaggacuac

SEQ ID NO: 162269 - RNA, 19 nt, Homo sapiens
gagggcugcugaacaggau

SEQ ID NO: 162270 - RNA, 19 nt, Homo sapiens
acgaggcacugcaggacua

SEQ ID NO: 162271 - RNA, 19 nt, Homo sapiens
gcuugcaacucagaccauu

SEQ ID NO: 162272 - RNA, 19 nt, Homo sapiens
gcagguacaagaagcucaa

SEQ ID NO: 162273 - RNA, 19 nt, Homo sapiens
ucagcugccuucacaagca

SEQ ID NO: 162274 - RNA, 19 nt, Homo sapiens
ccaccaagaggcagcaugu

SEQ ID NO: 162275 - RNA, 19 nt, Homo sapiens
ggagaaggaggaguuugug

SEQ ID NO: 162276 - RNA, 19 nt, Homo sapiens
ccaacuccgauuccaugua

SEQ ID NO: 162277 - RNA, 19 nt, Homo sapiens
ggaggacucggccaucaag

SEQ ID NO: 162278 - RNA, 19 nt, Homo sapiens
ucagagaugcgcagguuag

SEQ ID NO: 162279 - RNA, 19 nt, Homo sapiens
aaaaugguguccagaacuu

SEQ ID NO: 162280 - RNA, 19 nt, Homo sapiens
ccacgcccuucuaguccaa

SEQ ID NO: 162281 - RNA, 19 nt, Homo sapiens
gaggcagcaugugcauuuc

SEQ ID NO: 162282 - RNA, 19 nt, Homo sapiens
caagagcuacgaggacugu

SEQ ID NO: 162283 - RNA, 19 nt, Homo sapiens
caaacugcagggcaaagug

SEQ ID NO: 162284 - RNA, 19 nt, Homo sapiens
gguacaagaagcucaaggu

SEQ ID NO: 162285 - RNA, 19 nt, Homo sapiens
agguuaggcucacugucua

SEQ ID NO: 162286 - RNA, 19 nt, Homo sapiens
cagguuaggcucacugucu

SEQ ID NO: 162287 - RNA, 19 nt, Homo sapiens
auggagcacuguccucaga

SEQ ID NO: 162288 - RNA, 19 nt, Homo sapiens
cagcugcaccucacuggau

SEQ ID NO: 162289 - RNA, 19 nt, Homo sapiens
gcagggaucagagcaacuc

SEQ ID NO: 162290 - RNA, 19 nt, Homo sapiens
accgcucgcugcccuauga

SEQ ID NO: 162291 - RNA, 19 nt, Homo sapiens
gauugucucauaccuacug

SEQ ID NO: 162292 - RNA, 19 nt, Homo sapiens
ccaauccacgcccuucuag

SEQ ID NO: 162293 - RNA, 19 nt, Homo sapiens
aaaaugccccuuccaauca

SEQ ID NO: 162294 - RNA, 19 nt, Homo sapiens
aaaugagcuuggcuugcaa

SEQ ID NO: 162295 - RNA, 19 nt, Homo sapiens
gagagcuuguggucaucau

SEQ ID NO: 162296 - RNA, 19 nt, Homo sapiens
ccaagauugucucauaccu

SEQ ID NO: 162297 - RNA, 19 nt, Homo sapiens
caucaagugcgaguacaug

SEQ ID NO: 162298 - RNA, 19 nt, Homo sapiens
aaaguuuccugaggucaag

SEQ ID NO: 162299 - RNA, 19 nt, Homo sapiens
caaggaugaaagaauguca

SEQ ID NO: 162300 - RNA, 19 nt, Homo sapiens
gccaagagcugacaauuua

SEQ ID NO: 162301 - RNA, 19 nt, Homo sapiens
gggaauaguuuaagcuuua

SEQ ID NO: 162302 - RNA, 19 nt, Homo sapiens
guaauaagguucuuccuaa

SEQ ID NO: 162303 - RNA, 19 nt, Homo sapiens
gaaauaaacccaagaguga

SEQ ID NO: 162304 - RNA, 19 nt, Homo sapiens
guaaguaucucacaaauag

SEQ ID NO: 162305 - RNA, 19 nt, Homo sapiens
aaacaaagaucgacacauu

SEQ ID NO: 162306 - RNA, 19 nt, Homo sapiens
guuaagagguguaaucuaa

SEQ ID NO: 162307 - RNA, 19 nt, Homo sapiens
gaagggaaggugcauauua

SEQ ID NO: 162308 - RNA, 19 nt, Homo sapiens
ggagauauguucaaagaau

SEQ ID NO: 162309 - RNA, 19 nt, Homo sapiens
gaaaaugccugaccaaauu

SEQ ID NO: 162310 - RNA, 19 nt, Homo sapiens
agacugcacugauaauuua

SEQ ID NO: 162311 - RNA, 19 nt, Homo sapiens
gguaaaugcucaucuuaaa

SEQ ID NO: 162312 - RNA, 19 nt, Homo sapiens
gaaauuggcacaucccuuu

SEQ ID NO: 162313 - RNA, 19 nt, Homo sapiens
ggaauaauuucucuaaugg

SEQ ID NO: 162314 - RNA, 19 nt, Homo sapiens
gaacaauaaugaaggacaa

SEQ ID NO: 162315 - RNA, 19 nt, Homo sapiens
gaaaguuugugcaggguuu

SEQ ID NO: 162316 - RNA, 19 nt, Homo sapiens
gauaggaguucagaaauug

SEQ ID NO: 162317 - RNA, 19 nt, Homo sapiens
ucaggaaacuguaugauga

SEQ ID NO: 162318 - RNA, 19 nt, Homo sapiens
gcaagaccauuuacuuaau

SEQ ID NO: 162319 - RNA, 19 nt, Homo sapiens
ccagguauuuguuaguuua

SEQ ID NO: 162320 - RNA, 19 nt, Homo sapiens
gcacugcacaugagauaua

SEQ ID NO: 162321 - RNA, 19 nt, Homo sapiens
gaacuuauugugaaccaua

SEQ ID NO: 162322 - RNA, 19 nt, Homo sapiens
guagugugauucuugauaa

SEQ ID NO: 162323 - RNA, 19 nt, Homo sapiens
gguguaaucuaaugaagaa

SEQ ID NO: 162324 - RNA, 19 nt, Homo sapiens
gagcuaagccaauauaugu

SEQ ID NO: 162325 - RNA, 19 nt, Homo sapiens
caagagugaugucgaagaa

SEQ ID NO: 162326 - RNA, 19 nt, Homo sapiens
ggaaaguuauaaaggugua

SEQ ID NO: 162327 - RNA, 19 nt, Homo sapiens
ucaacagacugcacugaua

SEQ ID NO: 162328 - RNA, 19 nt, Homo sapiens
ucauucagauggucaauaa

SEQ ID NO: 162329 - RNA, 19 nt, Homo sapiens
uaacaugagcuccaguuua

SEQ ID NO: 162330 - RNA, 19 nt, Homo sapiens
ccagugaacuuauugugaa

SEQ ID NO: 162331 - RNA, 19 nt, Homo sapiens
ucaccucccuuauuucuuu

SEQ ID NO: 162332 - RNA, 19 nt, Homo sapiens
uuaaguaacucucagcauu

SEQ ID NO: 162333 - RNA, 19 nt, Homo sapiens
gaacagucuuauucuaugu

SEQ ID NO: 162334 - RNA, 19 nt, Homo sapiens
aaaguacagugcacauaua

SEQ ID NO: 162335 - RNA, 19 nt, Homo sapiens
gaagaccaguccaaauuag

SEQ ID NO: 162336 - RNA, 19 nt, Homo sapiens
gaugguagagcaauauuaa

SEQ ID NO: 162337 - RNA, 19 nt, Homo sapiens
gggacuauauuguagauug

SEQ ID NO: 162338 - RNA, 19 nt, Homo sapiens
augaagcgcugcaggauua

SEQ ID NO: 162339 - RNA, 19 nt, Homo sapiens
agaagugacuguaguguga

SEQ ID NO: 162340 - RNA, 19 nt, Homo sapiens
uaaguaacucucagcauua

SEQ ID NO: 162341 - RNA, 19 nt, Homo sapiens
cagaucagauuguuguauu

SEQ ID NO: 162342 - RNA, 19 nt, Homo sapiens
gagauuacaccuacaguga

SEQ ID NO: 162343 - RNA, 19 nt, Homo sapiens
caacagacugcacugauaa

SEQ ID NO: 162344 - RNA, 19 nt, Homo sapiens
ccaaggccgugcagcauuu

SEQ ID NO: 162345 - RNA, 19 nt, Homo sapiens
gcagagugcuuggauggaa

SEQ ID NO: 162346 - RNA, 19 nt, Homo sapiens
uaaacaagcuuccacuuuu

SEQ ID NO: 162347 - RNA, 19 nt, Homo sapiens
uaagagguguaaucuaaug

SEQ ID NO: 162348 - RNA, 19 nt, Homo sapiens
cgaagaccaguccaaauua

SEQ ID NO: 162349 - RNA, 19 nt, Homo sapiens
gaccaagugugaauacaug

SEQ ID NO: 162350 - RNA, 19 nt, Homo sapiens
caaauuagcaggccuucuu

SEQ ID NO: 162351 - RNA, 19 nt, Homo sapiens
ggaugaugguagagcaaua

SEQ ID NO: 162352 - RNA, 19 nt, Homo sapiens
ugauaggaguucagaaauu

SEQ ID NO: 162353 - RNA, 19 nt, Homo sapiens
gcaagaugcugaugacacu

SEQ ID NO: 162354 - RNA, 19 nt, Homo sapiens
gaaguaagaagccaaccaa

SEQ ID NO: 162355 - RNA, 19 nt, Homo sapiens
aaauacaacuccugggaaa

SEQ ID NO: 162356 - RNA, 19 nt, Homo sapiens
gagauauguucaaagaaug

SEQ ID NO: 162357 - RNA, 19 nt, Homo sapiens
acaguaaccuccaucaaau

SEQ ID NO: 162358 - RNA, 19 nt, Homo sapiens
caagagcuaagccaauaua

SEQ ID NO: 162359 - RNA, 19 nt, Homo sapiens
auacaugccuguuugcaaa

SEQ ID NO: 162360 - RNA, 19 nt, Homo sapiens
gagugcaccucucuacuug

SEQ ID NO: 162361 - RNA, 19 nt, Homo sapiens
gcuuucagauuccuccaua

SEQ ID NO: 162362 - RNA, 19 nt, Homo sapiens
uaaccuccaucaaaugcua

SEQ ID NO: 162363 - RNA, 19 nt, Homo sapiens
guaccagcuuuaccacuuu

SEQ ID NO: 162364 - RNA, 19 nt, Homo sapiens
aaggagauaugauucugua

SEQ ID NO: 162365 - RNA, 19 nt, Homo sapiens
aagcaagaccauuuacuua

SEQ ID NO: 162366 - RNA, 19 nt, Homo sapiens
gaguaaguaucucacaaau

SEQ ID NO: 162367 - RNA, 19 nt, Homo sapiens
guagagaagugacuguagu

SEQ ID NO: 162368 - RNA, 19 nt, Homo sapiens
ccaaaacuauugcuacuuu

SEQ ID NO: 162369 - RNA, 19 nt, Homo sapiens
gaacaaggaauaauuucuc

SEQ ID NO: 162370 - RNA, 19 nt, Homo sapiens
aaucuacagucgcugaaua

SEQ ID NO: 162371 - RNA, 19 nt, Homo sapiens
gugcacauauacaaauuga

SEQ ID NO: 162372 - RNA, 19 nt, Homo sapiens
uaauauggaugccagugaa

SEQ ID NO: 162373 - RNA, 19 nt, Homo sapiens
ggacuauauuguagauugu

SEQ ID NO: 162374 - RNA, 19 nt, Homo sapiens
uuaccuaaauguucacuga

SEQ ID NO: 162375 - RNA, 19 nt, Homo sapiens
ccacauuucucuuucucuu

SEQ ID NO: 162376 - RNA, 19 nt, Homo sapiens
gaaguacaagcgcaggaua

SEQ ID NO: 162377 - RNA, 19 nt, Homo sapiens
gagauaugauucuguaacu

SEQ ID NO: 162378 - RNA, 19 nt, Homo sapiens
guaagaagccaaccaacug

SEQ ID NO: 162379 - RNA, 19 nt, Homo sapiens
ggguuuaaguugcuacuau

SEQ ID NO: 162380 - RNA, 19 nt, Homo sapiens
ucucucagauguuguuauu

SEQ ID NO: 162381 - RNA, 19 nt, Homo sapiens
gaacagauacacaucaaaa

SEQ ID NO: 162382 - RNA, 19 nt, Homo sapiens
caaaugcuauaccaaugga

SEQ ID NO: 162383 - RNA, 19 nt, Homo sapiens
gcaaaugccagaauuaaaa

SEQ ID NO: 162384 - RNA, 19 nt, Homo sapiens
guacagugcacauauacaa

SEQ ID NO: 162385 - RNA, 19 nt, Homo sapiens
uaauuuagcagcaagacua

SEQ ID NO: 162386 - RNA, 19 nt, Homo sapiens
ucacaaagcgcagacguaa

SEQ ID NO: 162387 - RNA, 19 nt, Homo sapiens
gguuuaaguugcuacuauu

SEQ ID NO: 162388 - RNA, 19 nt, Homo sapiens
ugagugcaguauuagauuu

SEQ ID NO: 162389 - RNA, 19 nt, Homo sapiens
gaaaauggguguuggugau

SEQ ID NO: 162390 - RNA, 19 nt, Homo sapiens
gaaauguaguucagcuuuu

SEQ ID NO: 162391 - RNA, 19 nt, Homo sapiens
ugaacagucuuauucuaug

SEQ ID NO: 162392 - RNA, 19 nt, Homo sapiens
aagggaaggugcauauuau

SEQ ID NO: 162393 - RNA, 19 nt, Homo sapiens
cuccauagguuccugauga

SEQ ID NO: 162394 - RNA, 19 nt, Homo sapiens
cgacgacucaccugauuaa

SEQ ID NO: 162395 - RNA, 19 nt, Homo sapiens
gaccgagaguuggugguua

SEQ ID NO: 162396 - RNA, 19 nt, Homo sapiens
caagcaagaccauuuacuu

SEQ ID NO: 162397 - RNA, 19 nt, Homo sapiens
gugagccaguauucauuua

SEQ ID NO: 162398 - RNA, 19 nt, Homo sapiens
ggagugcaccucucuacuu

SEQ ID NO: 162399 - RNA, 19 nt, Homo sapiens
ggaugccagugaacuuauu

SEQ ID NO: 162400 - RNA, 19 nt, Homo sapiens
caaccaagcuauugaguua

SEQ ID NO: 162401 - RNA, 19 nt, Homo sapiens
gaaauugguugcucuugua

SEQ ID NO: 162402 - RNA, 19 nt, Homo sapiens
gaaaggauuugguggaauu

SEQ ID NO: 162403 - RNA, 19 nt, Homo sapiens
caaauggucugguuguaua

SEQ ID NO: 162404 - RNA, 19 nt, Homo sapiens
ggaacugcaucuaacauua

SEQ ID NO: 162405 - RNA, 19 nt, Homo sapiens
gaucagagguuacaaucaa

SEQ ID NO: 162406 - RNA, 19 nt, Homo sapiens
gaauguggcuggucuaguu

SEQ ID NO: 162407 - RNA, 19 nt, Homo sapiens
gaacuaagucaaucugaua

SEQ ID NO: 162408 - RNA, 19 nt, Homo sapiens
gaacccagcugauaugcaa

SEQ ID NO: 162409 - RNA, 19 nt, Homo sapiens
gagaaguccugcacaaauu

SEQ ID NO: 162410 - RNA, 19 nt, Homo sapiens
gaaauggagaagaguauua

SEQ ID NO: 162411 - RNA, 19 nt, Homo sapiens
gagcaucuguuucaaaugu

SEQ ID NO: 162412 - RNA, 19 nt, Homo sapiens
ugagaagaguccauuauuu

SEQ ID NO: 162413 - RNA, 19 nt, Homo sapiens
ugagauauguucuucauug

SEQ ID NO: 162414 - RNA, 19 nt, Homo sapiens
gaacaauuguaacagaaga

SEQ ID NO: 162415 - RNA, 19 nt, Homo sapiens
ucaagaagcucauuaagag

SEQ ID NO: 162416 - RNA, 19 nt, Homo sapiens
guaaaugggucugauguga

SEQ ID NO: 162417 - RNA, 19 nt, Homo sapiens
gaacauuuccagaacuuaa

SEQ ID NO: 162418 - RNA, 19 nt, Homo sapiens
caagaagggucucaguuug

SEQ ID NO: 162419 - RNA, 19 nt, Homo sapiens
aaugggagcuguagaaauu

SEQ ID NO: 162420 - RNA, 19 nt, Homo sapiens
gaacugcaucuaacauuaa

SEQ ID NO: 162421 - RNA, 19 nt, Homo sapiens
ccagagaaauuggauguaa

SEQ ID NO: 162422 - RNA, 19 nt, Homo sapiens
gagaagaguccauuauuug

SEQ ID NO: 162423 - RNA, 19 nt, Homo sapiens
gggaguaugucuuaaaugu

SEQ ID NO: 162424 - RNA, 19 nt, Homo sapiens
guacagaaauggagaagag

SEQ ID NO: 162425 - RNA, 19 nt, Homo sapiens
gcacuacuuucagaugaua

SEQ ID NO: 162426 - RNA, 19 nt, Homo sapiens
caaaguaccuccaaauggu

SEQ ID NO: 162427 - RNA, 19 nt, Homo sapiens
gguaucaccuccacacuga

SEQ ID NO: 162428 - RNA, 19 nt, Homo sapiens
cauacugguuuguuucuua

SEQ ID NO: 162429 - RNA, 19 nt, Homo sapiens
ggacgauacuuugaugaaa

SEQ ID NO: 162430 - RNA, 19 nt, Homo sapiens
gaaauucauucaagagaag

SEQ ID NO: 162431 - RNA, 19 nt, Homo sapiens
gaaccuuucaaaccaauua

SEQ ID NO: 162432 - RNA, 19 nt, Homo sapiens
gaacgacagacauguauga

SEQ ID NO: 162433 - RNA, 19 nt, Homo sapiens
caagagaaguccugcacaa

SEQ ID NO: 162434 - RNA, 19 nt, Homo sapiens
gaauaugcuuguuguuuca

SEQ ID NO: 162435 - RNA, 19 nt, Homo sapiens
aaaugggucugaugugaua

SEQ ID NO: 162436 - RNA, 19 nt, Homo sapiens
ggaaaugggagcuguagaa

SEQ ID NO: 162437 - RNA, 19 nt, Homo sapiens
gaagggaguaugucuuaaa

SEQ ID NO: 162438 - RNA, 19 nt, Homo sapiens
ggcaugagauuaugugaau

SEQ ID NO: 162439 - RNA, 19 nt, Homo sapiens
ggagcuacguuggaaauug

SEQ ID NO: 162440 - RNA, 19 nt, Homo sapiens
aaaucaaacugacucauga

SEQ ID NO: 162441 - RNA, 19 nt, Homo sapiens
gcuuugggcucugcuauuu

SEQ ID NO: 162442 - RNA, 19 nt, Homo sapiens
caaacugacucaugaagca

SEQ ID NO: 162443 - RNA, 19 nt, Homo sapiens
gagcuacguuggaaauugu

SEQ ID NO: 162444 - RNA, 19 nt, Homo sapiens
ugaauaugcuuguuguuuc

SEQ ID NO: 162445 - RNA, 19 nt, Homo sapiens
ucucuucggugauauauau

SEQ ID NO: 162446 - RNA, 19 nt, Homo sapiens
ggucugaugugauaugaca

SEQ ID NO: 162447 - RNA, 19 nt, Homo sapiens
aaaaugaacugcaagguuu

SEQ ID NO: 162448 - RNA, 19 nt, Homo sapiens
ugacaagaccagagaaauu

SEQ ID NO: 162449 - RNA, 19 nt, Homo sapiens
gaaaugggagcuguagaaa

SEQ ID NO: 162450 - RNA, 19 nt, Homo sapiens
gacgauacuuugaugaaau

SEQ ID NO: 162451 - RNA, 19 nt, Homo sapiens
uaacuauguucggaaagua

SEQ ID NO: 162452 - RNA, 19 nt, Homo sapiens
cagagaaauuggauguaaa

SEQ ID NO: 162453 - RNA, 19 nt, Homo sapiens
caaauacugucugucaaug

SEQ ID NO: 162454 - RNA, 19 nt, Homo sapiens
guucuuuacugacuugauu

SEQ ID NO: 162455 - RNA, 19 nt, Homo sapiens
gaaaagaaagucaacauug

SEQ ID NO: 162456 - RNA, 19 nt, Homo sapiens
aacauuaagucacgaguaa

SEQ ID NO: 162457 - RNA, 19 nt, Homo sapiens
caauaauccuguuucacuu

SEQ ID NO: 162458 - RNA, 19 nt, Homo sapiens
aaagggagguggauguguu

SEQ ID NO: 162459 - RNA, 19 nt, Homo sapiens
gcagugacccauuuacaug

SEQ ID NO: 162460 - RNA, 19 nt, Homo sapiens
aaacgccacuuuggacuaa

SEQ ID NO: 162461 - RNA, 19 nt, Homo sapiens
gacaagaccagagaaauug

SEQ ID NO: 162462 - RNA, 19 nt, Homo sapiens
acagaucccugccuuacaa

SEQ ID NO: 162463 - RNA, 19 nt, Homo sapiens
ggacaggaacaugagcuua

SEQ ID NO: 162464 - RNA, 19 nt, Homo sapiens
caaagagaccggacaggaa

SEQ ID NO: 162465 - RNA, 19 nt, Homo sapiens
cagcacuacuuucagauga

SEQ ID NO: 162466 - RNA, 19 nt, Homo sapiens
uuacagcacuacuuucaga

SEQ ID NO: 162467 - RNA, 19 nt, Homo sapiens
gaccaaagguuuuaaaagu

SEQ ID NO: 162468 - RNA, 19 nt, Homo sapiens
ggaaauugucacagauaaa

SEQ ID NO: 162469 - RNA, 19 nt, Homo sapiens
uagcaaguuuggauucauu

SEQ ID NO: 162470 - RNA, 19 nt, Homo sapiens
ggagaagaguauuaaacca

SEQ ID NO: 162471 - RNA, 19 nt, Homo sapiens
ggugacaguugaacaaagu

SEQ ID NO: 162472 - RNA, 19 nt, Homo sapiens
uugaaagggugagcuaaua

SEQ ID NO: 162473 - RNA, 19 nt, Homo sapiens
uauauguggugaaauguug

SEQ ID NO: 162474 - RNA, 19 nt, Homo sapiens
acagauaaaucacaagaag

SEQ ID NO: 162475 - RNA, 19 nt, Homo sapiens
gcuauugaguuaucuacug

SEQ ID NO: 162476 - RNA, 19 nt, Homo sapiens
gcucuuacagcacuacuuu

SEQ ID NO: 162477 - RNA, 19 nt, Homo sapiens
uaacaaaguaccuccaaau

SEQ ID NO: 162478 - RNA, 19 nt, Homo sapiens
ggaguaugucuuaaaugua

SEQ ID NO: 162479 - RNA, 19 nt, Homo sapiens
uacaagcacuucucacaug

SEQ ID NO: 162480 - RNA, 19 nt, Homo sapiens
acaagaagggucucaguuu

SEQ ID NO: 162481 - RNA, 19 nt, Homo sapiens
gaaauuaauaggacgauac

SEQ ID NO: 162482 - RNA, 19 nt, Homo sapiens
ugaguuaucuacugaaguc

SEQ ID NO: 162483 - RNA, 19 nt, Homo sapiens
gaucauuccucccaaagac

SEQ ID NO: 162484 - RNA, 19 nt, Homo sapiens
gauagcaaguuuggauuca

SEQ ID NO: 162485 - RNA, 19 nt, Homo sapiens
ugaaauugguugcucuugu

SEQ ID NO: 162486 - RNA, 19 nt, Homo sapiens
caugagcauuggauauuga

SEQ ID NO: 162487 - RNA, 19 nt, Homo sapiens
gaacuuaauccaugagcau

SEQ ID NO: 162488 - RNA, 19 nt, Homo sapiens
uggaaauugucacagauaa

SEQ ID NO: 162489 - RNA, 19 nt, Homo sapiens
aaacugaacuaagucaauc

SEQ ID NO: 162490 - RNA, 19 nt, Homo sapiens
uggauccgcugacuuuaaa

SEQ ID NO: 162491 - RNA, 19 nt, Homo sapiens
gugaaaggauuugguggaa

SEQ ID NO: 162492 - RNA, 19 nt, Homo sapiens
cuacugaaguccucuccaa

SEQ ID NO: 162493 - RNA, 19 nt, Homo sapiens
gaugauagcaaguuuggau

SEQ ID NO: 162494 - RNA, 19 nt, Homo sapiens
guggaacaauuguaacaga

SEQ ID NO: 162495 - RNA, 19 nt, Homo sapiens
uaaucaauguguucucuuc

SEQ ID NO: 162496 - RNA, 19 nt, Homo sapiens
ugaacaaaguguauaguac

SEQ ID NO: 162497 - RNA, 19 nt, Homo sapiens
ggaaugguuugcuaacaac

SEQ ID NO: 162498 - RNA, 19 nt, Homo sapiens
gacaacaaauuccauacag

SEQ ID NO: 162499 - RNA, 19 nt, Homo sapiens
aauguuagcggaugaguuu

SEQ ID NO: 162500 - RNA, 19 nt, Homo sapiens
gaacugacaccauugauuu

SEQ ID NO: 162501 - RNA, 19 nt, Homo sapiens
gaaucaggaucaugccuua

SEQ ID NO: 162502 - RNA, 19 nt, Homo sapiens
caagaucucuguaaaguag

SEQ ID NO: 162503 - RNA, 19 nt, Homo sapiens
ugaaaugacugagauauug

SEQ ID NO: 162504 - RNA, 19 nt, Homo sapiens
ugacugagauauugaagaa

SEQ ID NO: 162505 - RNA, 19 nt, Homo sapiens
uaagguaguuccugaaaug

SEQ ID NO: 162506 - RNA, 19 nt, Homo sapiens
gcuaacaggugccaaagug

SEQ ID NO: 162507 - RNA, 19 nt, Homo sapiens
cagaggaacugacaccauu

SEQ ID NO: 162508 - RNA, 19 nt, Homo sapiens
gaaguguccugcuuaguag

SEQ ID NO: 162509 - RNA, 19 nt, Homo sapiens
cagaguggcuugaccagaa

SEQ ID NO: 162510 - RNA, 19 nt, Homo sapiens
ggagagcuacauuucauaa

SEQ ID NO: 162511 - RNA, 19 nt, Homo sapiens
gaaaaggcaucaaguacuu

SEQ ID NO: 162512 - RNA, 19 nt, Homo sapiens
gguaauagcugagcaugca

SEQ ID NO: 162513 - RNA, 19 nt, Homo sapiens
gaaaugcucuauguacagu

SEQ ID NO: 162514 - RNA, 19 nt, Homo sapiens
gcaccagaacuuuauauug

SEQ ID NO: 162515 - RNA, 19 nt, Homo sapiens
cuuaguagcuggaaccaaa

SEQ ID NO: 162516 - RNA, 19 nt, Homo sapiens
ugaaguguccugcuuagua

SEQ ID NO: 162517 - RNA, 19 nt, Homo sapiens
gaaaugacugagauauuga

SEQ ID NO: 162518 - RNA, 19 nt, Homo sapiens
uagcugagcaugcaaauga

SEQ ID NO: 162519 - RNA, 19 nt, Homo sapiens
gaagugugaugagaaagug

SEQ ID NO: 162520 - RNA, 19 nt, Homo sapiens
gcacccauuacuuuaaaua

SEQ ID NO: 162521 - RNA, 19 nt, Homo sapiens
cucagaagcaguucaauua

SEQ ID NO: 162522 - RNA, 19 nt, Homo sapiens
ggcacaagaucucuguaaa

SEQ ID NO: 162523 - RNA, 19 nt, Homo sapiens
acauuuagcugggaugaaa

SEQ ID NO: 162524 - RNA, 19 nt, Homo sapiens
caccagaacuuuauauugc

SEQ ID NO: 162525 - RNA, 19 nt, Homo sapiens
ugacuuggcagaucaacua

SEQ ID NO: 162526 - RNA, 19 nt, Homo sapiens
uaaaguagcaggcauagca

SEQ ID NO: 162527 - RNA, 19 nt, Homo sapiens
ggaacugacaccauugauu

SEQ ID NO: 162528 - RNA, 19 nt, Homo sapiens
cacaagaucucuguaaagu

SEQ ID NO: 162529 - RNA, 19 nt, Homo sapiens
gaggugaaguguccugcuu

SEQ ID NO: 162530 - RNA, 19 nt, Homo sapiens
aaagacagcaagacaauug

SEQ ID NO: 162531 - RNA, 19 nt, Homo sapiens
uagcacccauuacuuuaaa

SEQ ID NO: 162532 - RNA, 19 nt, Homo sapiens
cagaagcaguucaauuaca

SEQ ID NO: 162533 - RNA, 19 nt, Homo sapiens
gaagaguggagagaacuuu

SEQ ID NO: 162534 - RNA, 19 nt, Homo sapiens
gcaggaaaugcucuaugua

SEQ ID NO: 162535 - RNA, 19 nt, Homo sapiens
gcacaagaucucuguaaag

SEQ ID NO: 162536 - RNA, 19 nt, Homo sapiens
aguggcagauuauggaaua

SEQ ID NO: 162537 - RNA, 19 nt, Homo sapiens
gugacaagguggcacaaga

SEQ ID NO: 162538 - RNA, 19 nt, Homo sapiens
gaaagacagcaagacaauu

SEQ ID NO: 162539 - RNA, 19 nt, Homo sapiens
gagcaucugccuucggaaa

SEQ ID NO: 162540 - RNA, 19 nt, Homo sapiens
gaugagaaagugaaagugu

SEQ ID NO: 162541 - RNA, 19 nt, Homo sapiens
cagaguagcagccaaacuu

SEQ ID NO: 162542 - RNA, 19 nt, Homo sapiens
gaugaaagacagcaagaca

SEQ ID NO: 162543 - RNA, 19 nt, Homo sapiens
guacaaaggccuacuucca

SEQ ID NO: 162544 - RNA, 19 nt, Homo sapiens
uugcuacgauuucagagua

SEQ ID NO: 162545 - RNA, 19 nt, Homo sapiens
uauaugacuuggcagauca

SEQ ID NO: 162546 - RNA, 19 nt, Homo sapiens
uauguacagugaaguguga

SEQ ID NO: 162547 - RNA, 19 nt, Homo sapiens
gcauggagagcuacauuuc

SEQ ID NO: 162548 - RNA, 19 nt, Homo sapiens
ugagaaagugaaaguguuu

SEQ ID NO: 162549 - RNA, 19 nt, Homo sapiens
ugacaucauugcaaucaag

SEQ ID NO: 162550 - RNA, 19 nt, Homo sapiens
gcaucugccuucggaaaga

SEQ ID NO: 162551 - RNA, 19 nt, Homo sapiens
uggaaagcauggagagcua

SEQ ID NO: 162552 - RNA, 19 nt, Homo sapiens
ggcagauuauggaauaguu

SEQ ID NO: 162553 - RNA, 19 nt, Homo sapiens
gguagugccaguucagaaa

SEQ ID NO: 162554 - RNA, 19 nt, Homo sapiens
ccaaguggcagauuaugga

SEQ ID NO: 162555 - RNA, 19 nt, Homo sapiens
ugaaagacagcaagacaau

SEQ ID NO: 162556 - RNA, 19 nt, Homo sapiens
guacuucaccaguggaaau

SEQ ID NO: 162557 - RNA, 19 nt, Homo sapiens
ggugaaguguccugcuuag

SEQ ID NO: 162558 - RNA, 19 nt, Homo sapiens
aauaguagcaccagaacuu

SEQ ID NO: 162559 - RNA, 19 nt, Homo sapiens
gaacuauuuaugcaggaaa

SEQ ID NO: 162560 - RNA, 19 nt, Homo sapiens
gaggaacugacaccauuga

SEQ ID NO: 162561 - RNA, 19 nt, Homo sapiens
ccuagcacccauuacuuua

SEQ ID NO: 162562 - RNA, 19 nt, Homo sapiens
acagauauuuguggguauu

SEQ ID NO: 162563 - RNA, 19 nt, Homo sapiens
agugaagugugaugagaaa

SEQ ID NO: 162564 - RNA, 19 nt, Homo sapiens
ggaaaugcucuauguacag

SEQ ID NO: 162565 - RNA, 19 nt, Homo sapiens
ugcaggaaaugcucuaugu

SEQ ID NO: 162566 - RNA, 19 nt, Homo sapiens
gguaguuccugaaaugacu

SEQ ID NO: 162567 - RNA, 19 nt, Homo sapiens
gcagauuauggaauaguug

SEQ ID NO: 162568 - RNA, 19 nt, Homo sapiens
ugugagaacuauuuaugca

SEQ ID NO: 162569 - RNA, 19 nt, Homo sapiens
cccgauuucugacaucauu

SEQ ID NO: 162570 - RNA, 19 nt, Homo sapiens
gaaccaaaugugacaaggu

SEQ ID NO: 162571 - RNA, 19 nt, Homo sapiens
acagugaagugugaugaga

SEQ ID NO: 162572 - RNA, 19 nt, Homo sapiens
uaauaaagacccagaagcu

SEQ ID NO: 162573 - RNA, 19 nt, Homo sapiens
uaguagcaccagaacuuua

SEQ ID NO: 162574 - RNA, 19 nt, Homo sapiens
guacagugaagugugauga

SEQ ID NO: 162575 - RNA, 19 nt, Homo sapiens
gacccagaagcuccaauuu

SEQ ID NO: 162576 - RNA, 19 nt, Homo sapiens
agaguggcuugaccagaaa

SEQ ID NO: 162577 - RNA, 19 nt, Homo sapiens
gaguagcagccaaacuuga

SEQ ID NO: 162578 - RNA, 19 nt, Homo sapiens
gaacuuuauauugcuguug

SEQ ID NO: 162579 - RNA, 19 nt, Homo sapiens
uggcuugaccagaaauuaa

SEQ ID NO: 162580 - RNA, 19 nt, Homo sapiens
aggaaaugcucuauguaca

SEQ ID NO: 162581 - RNA, 19 nt, Homo sapiens
caauuacacacacaucugu

SEQ ID NO: 162582 - RNA, 19 nt, Homo sapiens
uagcuggaaccaaauguga

SEQ ID NO: 162583 - RNA, 19 nt, Homo sapiens
ccucauugcuacgauuuca

SEQ ID NO: 162584 - RNA, 19 nt, Homo sapiens
uuaagguaguuccugaaau

SEQ ID NO: 162585 - RNA, 19 nt, Homo sapiens
ggagccauccaacauuuag

SEQ ID NO: 162586 - RNA, 19 nt, Homo sapiens
uuaugggauugcuguguuu

SEQ ID NO: 162587 - RNA, 19 nt, Homo sapiens
caacauuuagcugggauga

SEQ ID NO: 162588 - RNA, 19 nt, Homo sapiens
caggaaaugcucuauguac

SEQ ID NO: 162589 - RNA, 19 nt, Homo sapiens
caucugccuucggaaagaa

SEQ ID NO: 162590 - RNA, 19 nt, Homo sapiens
cuagcacccauuacuuuaa

SEQ ID NO: 162591 - RNA, 19 nt, Homo sapiens
acaagaucucuguaaagua

SEQ ID NO: 162592 - RNA, 19 nt, Homo sapiens
aaugcucuauguacaguga

SEQ ID NO: 162593 - RNA, 19 nt, Homo sapiens
caucauugcaaucaaguca

SEQ ID NO: 162594 - RNA, 19 nt, Homo sapiens
uuucugacaucauugcaau

SEQ ID NO: 162595 - RNA, 19 nt, Homo sapiens
uuuaugggauugcuguguu

SEQ ID NO: 162596 - RNA, 19 nt, Homo sapiens
uggcacaagaucucuguaa

SEQ ID NO: 162597 - RNA, 19 nt, Homo sapiens
aagaguggagagaacuuua

SEQ ID NO: 162598 - RNA, 19 nt, Homo sapiens
gcccagaguagcagccaaa

SEQ ID NO: 162599 - RNA, 19 nt, Homo sapiens
gaaagcauggagagcuaca

SEQ ID NO: 162600 - RNA, 19 nt, Homo sapiens
gaugacagcuggauuucuu

SEQ ID NO: 162601 - RNA, 19 nt, Homo sapiens
gcaaacaggccaucgauga

SEQ ID NO: 162602 - RNA, 19 nt, Homo sapiens
agaagaagcuggugaagga

SEQ ID NO: 162603 - RNA, 19 nt, Homo sapiens
gcagaugacagcuggauuu

SEQ ID NO: 162604 - RNA, 19 nt, Homo sapiens
ucaagagggucaucgacua

SEQ ID NO: 162605 - RNA, 19 nt, Homo sapiens
ucccagagauggcaauaaa

SEQ ID NO: 162606 - RNA, 19 nt, Homo sapiens
agaagaagaucgaggugau

SEQ ID NO: 162607 - RNA, 19 nt, Homo sapiens
gaaggagauugggcggauu

SEQ ID NO: 162608 - RNA, 19 nt, Homo sapiens
ugaaagccaagaagaagaa

SEQ ID NO: 162609 - RNA, 19 nt, Homo sapiens
caauaaaacugacucucaa

SEQ ID NO: 162610 - RNA, 19 nt, Homo sapiens
aaacugacucucaacauca

SEQ ID NO: 162611 - RNA, 19 nt, Homo sapiens
uggccaagcugaaggagau

SEQ ID NO: 162612 - RNA, 19 nt, Homo sapiens
ccuccaagcucucugugau

SEQ ID NO: 162613 - RNA, 19 nt, Homo sapiens
gcaauaaaacugacucuca

SEQ ID NO: 162614 - RNA, 19 nt, Homo sapiens
ccaagaagaagaagaucga

SEQ ID NO: 162615 - RNA, 19 nt, Homo sapiens
ucaugaaagccaagaagaa

SEQ ID NO: 162616 - RNA, 19 nt, Homo sapiens
gaaaguggagcgggagauc

SEQ ID NO: 162617 - RNA, 19 nt, Homo sapiens
caaacaggccaucgaugau

SEQ ID NO: 162618 - RNA, 19 nt, Homo sapiens
caagcucucugugaucagu

SEQ ID NO: 162619 - RNA, 19 nt, Homo sapiens
gagauugggcggauuugag

SEQ ID NO: 162620 - RNA, 19 nt, Homo sapiens
ggagauugggcggauuuga

SEQ ID NO: 162621 - RNA, 19 nt, Homo sapiens
ggugugaagcacuccauga

SEQ ID NO: 162622 - RNA, 19 nt, Homo sapiens
cgacuacgccgugaagauc

SEQ ID NO: 162623 - RNA, 19 nt, Homo sapiens
gggcaaacaggccaucgau

SEQ ID NO: 162624 - RNA, 19 nt, Homo sapiens
gugugaagcacuccaugaa

SEQ ID NO: 162625 - RNA, 19 nt, Homo sapiens
caugaaagccaagaagaag

SEQ ID NO: 162626 - RNA, 19 nt, Homo sapiens
uccaagcucucugugauca

SEQ ID NO: 162627 - RNA, 19 nt, Homo sapiens
ugacagcuggauuucuuga

SEQ ID NO: 162628 - RNA, 19 nt, Homo sapiens
caagagggucaucgacuac

SEQ ID NO: 162629 - RNA, 19 nt, Homo sapiens
aaaacugacucucaacauc

SEQ ID NO: 162630 - RNA, 19 nt, Homo sapiens
aaggagauugggcggauuu

SEQ ID NO: 162631 - RNA, 19 nt, Homo sapiens
ggagaaagcugcccagaua

SEQ ID NO: 162632 - RNA, 19 nt, Homo sapiens
ggaaagagcuauauucugu

SEQ ID NO: 162633 - RNA, 19 nt, Homo sapiens
gaagacagauuuggaauuu

SEQ ID NO: 162634 - RNA, 19 nt, Homo sapiens
ggaacaaggugauggauuu

SEQ ID NO: 162635 - RNA, 19 nt, Homo sapiens
gaagguggcuuucagucua

SEQ ID NO: 162636 - RNA, 19 nt, Homo sapiens
agaagcagauguuguaaua

SEQ ID NO: 162637 - RNA, 19 nt, Homo sapiens
ggauuucgguuacagauaa

SEQ ID NO: 162638 - RNA, 19 nt, Homo sapiens
gaucuuuccucuaucauuu

SEQ ID NO: 162639 - RNA, 19 nt, Homo sapiens
ggaaagguuugcagaagaa

SEQ ID NO: 162640 - RNA, 19 nt, Homo sapiens
gcucagaacuguguacauu

SEQ ID NO: 162641 - RNA, 19 nt, Homo sapiens
gagaguagaucacacuguu

SEQ ID NO: 162642 - RNA, 19 nt, Homo sapiens
gaucaaagguacucacaca

SEQ ID NO: 162643 - RNA, 19 nt, Homo sapiens
ccaagcaacuauauaagaa

SEQ ID NO: 162644 - RNA, 19 nt, Homo sapiens
gaaacaccauccuagcauu

SEQ ID NO: 162645 - RNA, 19 nt, Homo sapiens
gauccaagucagaauauua

SEQ ID NO: 162646 - RNA, 19 nt, Homo sapiens
gcagcuagccaguuucuuu

SEQ ID NO: 162647 - RNA, 19 nt, Homo sapiens
ggaacuacaugcuaaaguc

SEQ ID NO: 162648 - RNA, 19 nt, Homo sapiens
gauaaaugcucagaacugu

SEQ ID NO: 162649 - RNA, 19 nt, Homo sapiens
caguauaccuguaaauaga

SEQ ID NO: 162650 - RNA, 19 nt, Homo sapiens
ccacuuaacacuccuguaa

SEQ ID NO: 162651 - RNA, 19 nt, Homo sapiens
gcauauuacugaacagaau

SEQ ID NO: 162652 - RNA, 19 nt, Homo sapiens
gagauuaacagauuucaga

SEQ ID NO: 162653 - RNA, 19 nt, Homo sapiens
gcauaucagugcuuucaug

SEQ ID NO: 162654 - RNA, 19 nt, Homo sapiens
ggauuggacugaaggaguu

SEQ ID NO: 162655 - RNA, 19 nt, Homo sapiens
gacaauaggacuccaugua

SEQ ID NO: 162656 - RNA, 19 nt, Homo sapiens
gaaaucugucgauauauga

SEQ ID NO: 162657 - RNA, 19 nt, Homo sapiens
agaagaagcagauguugua

SEQ ID NO: 162658 - RNA, 19 nt, Homo sapiens
cuuaagggaugacaguaua

SEQ ID NO: 162659 - RNA, 19 nt, Homo sapiens
ugcaggaguuuaugaauuu

SEQ ID NO: 162660 - RNA, 19 nt, Homo sapiens
agaaaucugucgauauaug

SEQ ID NO: 162661 - RNA, 19 nt, Homo sapiens
cguggacucugaaacauaa

SEQ ID NO: 162662 - RNA, 19 nt, Homo sapiens
uaaaaggaauugccacuaa

SEQ ID NO: 162663 - RNA, 19 nt, Homo sapiens
acagagaaauacagaauuc

SEQ ID NO: 162664 - RNA, 19 nt, Homo sapiens
gugaaaaucuccaaucaaa

SEQ ID NO: 162665 - RNA, 19 nt, Homo sapiens
gaacucauggguauggaaa

SEQ ID NO: 162666 - RNA, 19 nt, Homo sapiens
cugaaggaguuauggguua

SEQ ID NO: 162667 - RNA, 19 nt, Homo sapiens
ggacuggaacuacaugcua

SEQ ID NO: 162668 - RNA, 19 nt, Homo sapiens
gagugaacauggaaagguu

SEQ ID NO: 162669 - RNA, 19 nt, Homo sapiens
gaaaaucuccaaucaaaga

SEQ ID NO: 162670 - RNA, 19 nt, Homo sapiens
gacuggaacuacaugcuaa

SEQ ID NO: 162671 - RNA, 19 nt, Homo sapiens
ccuaguagcucuuggucuu

SEQ ID NO: 162672 - RNA, 19 nt, Homo sapiens
cgaauuacuacccauuaua

SEQ ID NO: 162673 - RNA, 19 nt, Homo sapiens
ucagugcuuucaugccuua

SEQ ID NO: 162674 - RNA, 19 nt, Homo sapiens
acaauaggacuccauguaa

SEQ ID NO: 162675 - RNA, 19 nt, Homo sapiens
agccagagcucucaaugaa

SEQ ID NO: 162676 - RNA, 19 nt, Homo sapiens
gaaugucuuucugcauauu

SEQ ID NO: 162677 - RNA, 19 nt, Homo sapiens
uugaagaacucauggguau

SEQ ID NO: 162678 - RNA, 19 nt, Homo sapiens
gggaaggagugaacaugga

SEQ ID NO: 162679 - RNA, 19 nt, Homo sapiens
gccaguuucuuucaaguau

SEQ ID NO: 162680 - RNA, 19 nt, Homo sapiens
ucagaacuguguacauugu

SEQ ID NO: 162681 - RNA, 19 nt, Homo sapiens
guauauggagggaugauuu

SEQ ID NO: 162682 - RNA, 19 nt, Homo sapiens
gaggaggaccugcuuacaa

SEQ ID NO: 162683 - RNA, 19 nt, Homo sapiens
gcacaccuauugaguaucc

SEQ ID NO: 162684 - RNA, 19 nt, Homo sapiens
ggucuagacuaucagaauc

SEQ ID NO: 162685 - RNA, 19 nt, Homo sapiens
uagccaagcaacuauauaa

SEQ ID NO: 162686 - RNA, 19 nt, Homo sapiens
gcagaagcccuugguguug

SEQ ID NO: 162687 - RNA, 19 nt, Homo sapiens
aaagauccaagucagaaua

SEQ ID NO: 162688 - RNA, 19 nt, Homo sapiens
cacuaacgauguagggaua

SEQ ID NO: 162689 - RNA, 19 nt, Homo sapiens
cagaagcccuugguguuga

SEQ ID NO: 162690 - RNA, 19 nt, Homo sapiens
aagcagauguuguaauagu

SEQ ID NO: 162691 - RNA, 19 nt, Homo sapiens
gggaugauuuacacuggaa

SEQ ID NO: 162692 - RNA, 19 nt, Homo sapiens
gaauaugaggacaauuuga

SEQ ID NO: 162693 - RNA, 19 nt, Homo sapiens
ccauguaacugaauaugag

SEQ ID NO: 162694 - RNA, 19 nt, Homo sapiens
gaacuacaugcuaaaguca

SEQ ID NO: 162695 - RNA, 19 nt, Homo sapiens
gcagauguuguaauaguug

SEQ ID NO: 162696 - RNA, 19 nt, Homo sapiens
gaagaagcagauguuguaa

SEQ ID NO: 162697 - RNA, 19 nt, Homo sapiens
gaauuacuacccauuauac

SEQ ID NO: 162698 - RNA, 19 nt, Homo sapiens
uaacagauuucagaauguc

SEQ ID NO: 162699 - RNA, 19 nt, Homo sapiens
cugcaggaguuuaugaauu

SEQ ID NO: 162700 - RNA, 19 nt, Homo sapiens
cuaccucuaugugcuauaa

SEQ ID NO: 162701 - RNA, 19 nt, Homo sapiens
ccucaaaccuacgggauug

SEQ ID NO: 162702 - RNA, 19 nt, Homo sapiens
gaacagaauagucacaaaa

SEQ ID NO: 162703 - RNA, 19 nt, Homo sapiens
ccuggugguuuacuaauug

SEQ ID NO: 162704 - RNA, 19 nt, Homo sapiens
ugaacagaauagucacaaa

SEQ ID NO: 162705 - RNA, 19 nt, Homo sapiens
ggugauggauuucgguuac

SEQ ID NO: 162706 - RNA, 19 nt, Homo sapiens
gaagaacucauggguaugg

SEQ ID NO: 162707 - RNA, 19 nt, Homo sapiens
cugaauaugaggacaauuu

SEQ ID NO: 162708 - RNA, 19 nt, Homo sapiens
ggaaacaccauccuagcau

SEQ ID NO: 162709 - RNA, 19 nt, Homo sapiens
gccaagcaacuauauaaga

SEQ ID NO: 162710 - RNA, 19 nt, Homo sapiens
ggaaggagugaacauggaa

SEQ ID NO: 162711 - RNA, 19 nt, Homo sapiens
uauauggagggaugauuua

SEQ ID NO: 162712 - RNA, 19 nt, Homo sapiens
gggauaaggacaagagaug

SEQ ID NO: 162713 - RNA, 19 nt, Homo sapiens
agagcuauauucuguuaga

SEQ ID NO: 162714 - RNA, 19 nt, Homo sapiens
gaaagagcuauauucuguu

SEQ ID NO: 162715 - RNA, 19 nt, Homo sapiens
caauaggacuccauguaac

SEQ ID NO: 162716 - RNA, 19 nt, Homo sapiens
uggaaagguuugcagaaga

SEQ ID NO: 162717 - RNA, 19 nt, Homo sapiens
ggaccugcuuacaauggaa

SEQ ID NO: 162718 - RNA, 19 nt, Homo sapiens
uaaaugcucagaacugugu

SEQ ID NO: 162719 - RNA, 19 nt, Homo sapiens
gccaaggauugcacaccua

SEQ ID NO: 162720 - RNA, 19 nt, Homo sapiens
gcaaauugugaaccucaaa

SEQ ID NO: 162721 - RNA, 19 nt, Homo sapiens
aggaggaccugcuuacaau

SEQ ID NO: 162722 - RNA, 19 nt, Homo sapiens
acagauaaaugcucagaac

SEQ ID NO: 162723 - RNA, 19 nt, Homo sapiens
gcaggaguuuaugaauuug

SEQ ID NO: 162724 - RNA, 19 nt, Homo sapiens
uagacuaucagaauccaua

SEQ ID NO: 162725 - RNA, 19 nt, Homo sapiens
cuggaaaccugggagagua

SEQ ID NO: 162726 - RNA, 19 nt, Homo sapiens
gaauugccacuaacgaugu

SEQ ID NO: 162727 - RNA, 19 nt, Homo sapiens
ugaaguauacccugguuau

SEQ ID NO: 162728 - RNA, 19 nt, Homo sapiens
uguaacagaagacagauuu

SEQ ID NO: 162729 - RNA, 19 nt, Homo sapiens
gaaagcugcccagauagga

SEQ ID NO: 162730 - RNA, 19 nt, Homo sapiens
gaauauuaacuggguggua

SEQ ID NO: 162731 - RNA, 19 nt, Homo sapiens
gcaaagaaaugaugucuca

SEQ ID NO: 162732 - RNA, 19 nt, Homo sapiens
gaaaugaugucucaagcau

SEQ ID NO: 162733 - RNA, 19 nt, Homo sapiens
gugaaaccauaucaaguua

SEQ ID NO: 162734 - RNA, 19 nt, Homo sapiens
gcagaaagaggaugugaaa

SEQ ID NO: 162735 - RNA, 19 nt, Homo sapiens
ggagauggcugggaauuca

SEQ ID NO: 162736 - RNA, 19 nt, Homo sapiens
aacaauaacugcaaacuug

SEQ ID NO: 162737 - RNA, 19 nt, Homo sapiens
cagaaugacuacuuugcua

SEQ ID NO: 162738 - RNA, 19 nt, Homo sapiens
gcaguuucuucuggaauua

SEQ ID NO: 162739 - RNA, 19 nt, Homo sapiens
gugcugaccucaauaagga

SEQ ID NO: 162740 - RNA, 19 nt, Homo sapiens
gaaagaggaugugaaacca

SEQ ID NO: 162741 - RNA, 19 nt, Homo sapiens
uggaauuacucacugauaa

SEQ ID NO: 162742 - RNA, 19 nt, Homo sapiens
gauaaauccugucagucuu

SEQ ID NO: 162743 - RNA, 19 nt, Homo sapiens
aagaggaugugaaaccaua

SEQ ID NO: 162744 - RNA, 19 nt, Homo sapiens
ggaccgugcugaccucaau

SEQ ID NO: 162745 - RNA, 19 nt, Homo sapiens
gaugugggcugugaaugaa

SEQ ID NO: 162746 - RNA, 19 nt, Homo sapiens
ggaauuacucacugauaaa

SEQ ID NO: 162747 - RNA, 19 nt, Homo sapiens
ccugaaagguguagacuuc

SEQ ID NO: 162748 - RNA, 19 nt, Homo sapiens
acagacaccuugcagaaug

SEQ ID NO: 162749 - RNA, 19 nt, Homo sapiens
caacccagccuauccagaa

SEQ ID NO: 162750 - RNA, 19 nt, Homo sapiens
ggcaguuucuucuggaauu

SEQ ID NO: 162751 - RNA, 19 nt, Homo sapiens
auagagagcuacgauaguu

SEQ ID NO: 162752 - RNA, 19 nt, Homo sapiens
gcauagagagcuacgauag

SEQ ID NO: 162753 - RNA, 19 nt, Homo sapiens
gauauggaaugugcagaug

SEQ ID NO: 162754 - RNA, 19 nt, Homo sapiens
caacaauaacugcaaacuu

SEQ ID NO: 162755 - RNA, 19 nt, Homo sapiens
gaaaggcagcgggaauuug

SEQ ID NO: 162756 - RNA, 19 nt, Homo sapiens
cggauuacuucauuagcua

SEQ ID NO: 162757 - RNA, 19 nt, Homo sapiens
cagcgggaauuugagauuu

SEQ ID NO: 162758 - RNA, 19 nt, Homo sapiens
uagagauccugcagaaaga

SEQ ID NO: 162759 - RNA, 19 nt, Homo sapiens
gaaguucuguaugaaugga

SEQ ID NO: 162760 - RNA, 19 nt, Homo sapiens
ggagcagccagucaucuuu

SEQ ID NO: 162761 - RNA, 19 nt, Homo sapiens
gagcuacgauaguugugau

SEQ ID NO: 162762 - RNA, 19 nt, Homo sapiens
gagcuccucucccucaagu

SEQ ID NO: 162763 - RNA, 19 nt, Homo sapiens
gagcaugcccaguguguuc

SEQ ID NO: 162764 - RNA, 19 nt, Homo sapiens
ucaaguaugagaaugacua

SEQ ID NO: 162765 - RNA, 19 nt, Homo sapiens
aaaggcagcgggaauuuga

SEQ ID NO: 162766 - RNA, 19 nt, Homo sapiens
agacagacaccuugcagaa

SEQ ID NO: 162767 - RNA, 19 nt, Homo sapiens
gcugggaauucaaacuuuc

SEQ ID NO: 162768 - RNA, 19 nt, Homo sapiens
uauccagaaucccgcuaua

SEQ ID NO: 162769 - RNA, 19 nt, Homo sapiens
ggcugggaauucaaacuuu

SEQ ID NO: 162770 - RNA, 19 nt, Homo sapiens
cagacaccuugcagaauga

SEQ ID NO: 162771 - RNA, 19 nt, Homo sapiens
ccaagcagcaaagaaauga

SEQ ID NO: 162772 - RNA, 19 nt, Homo sapiens
gcagcgggaauuugagauu

SEQ ID NO: 162773 - RNA, 19 nt, Homo sapiens
uaccucggauuacuucauu

SEQ ID NO: 162774 - RNA, 19 nt, Homo sapiens
gaugugaaaccauaucaag

SEQ ID NO: 162775 - RNA, 19 nt, Homo sapiens
ggccaggacucuuuugaaa

SEQ ID NO: 162776 - RNA, 19 nt, Homo sapiens
ugugaaaccauaucaaguu

SEQ ID NO: 162777 - RNA, 19 nt, Homo sapiens
acgcuacuauuacgacaaa

SEQ ID NO: 162778 - RNA, 19 nt, Homo sapiens
uucauuagcuaugguauug

SEQ ID NO: 162779 - RNA, 19 nt, Homo sapiens
gaucucaagccgacucuca

SEQ ID NO: 162780 - RNA, 19 nt, Homo sapiens
caucuuaugggaacaucua

SEQ ID NO: 162781 - RNA, 19 nt, Homo sapiens
gaugaauuaugagaaacug

SEQ ID NO: 162782 - RNA, 19 nt, Homo sapiens
cuagagauccugcagaaag

SEQ ID NO: 162783 - RNA, 19 nt, Homo sapiens
gcgcucacuucgccgcaaa

SEQ ID NO: 162784 - RNA, 19 nt, Homo sapiens
ugauaaauccugucagucu

SEQ ID NO: 162785 - RNA, 19 nt, Homo sapiens
ggauauggaaugugcagau

SEQ ID NO: 162786 - RNA, 19 nt, Homo sapiens
gcuccucucccucaaguau

SEQ ID NO: 162787 - RNA, 19 nt, Homo sapiens
ugaugugggcugugaauga

SEQ ID NO: 162788 - RNA, 19 nt, Homo sapiens
gaaugacuacuuugcuauc

SEQ ID NO: 162789 - RNA, 19 nt, Homo sapiens
gcagcguguucccuccuau

SEQ ID NO: 162790 - RNA, 19 nt, Homo sapiens
gagcagccagucaucuuuc

SEQ ID NO: 162791 - RNA, 19 nt, Homo sapiens
ugugggcugugaaugaauu

SEQ ID NO: 162792 - RNA, 19 nt, Homo sapiens
aaagaaaugaugucucaag

SEQ ID NO: 162793 - RNA, 19 nt, Homo sapiens
gccagaugccgacgaguga

SEQ ID NO: 162794 - RNA, 19 nt, Homo sapiens
aaagaaaggcagcgggaau

SEQ ID NO: 162795 - RNA, 19 nt, Homo sapiens
cguguucccuccuaugaca

SEQ ID NO: 162796 - RNA, 19 nt, Homo sapiens
uauggaaugugcagauguc

SEQ ID NO: 162797 - RNA, 19 nt, Homo sapiens
guucgggacugggugaugu

SEQ ID NO: 162798 - RNA, 19 nt, Homo sapiens
aaacaucauccacaagaca

SEQ ID NO: 162799 - RNA, 19 nt, Homo sapiens
agaaaggcagcgggaauuu

SEQ ID NO: 162800 - RNA, 19 nt, Homo sapiens
ccuaagaugaauuaugaga

SEQ ID NO: 162801 - RNA, 19 nt, Homo sapiens
uugaaagcauagagagcua

SEQ ID NO: 162802 - RNA, 19 nt, Homo sapiens
cuugcagaaugacuacuuu

SEQ ID NO: 162803 - RNA, 19 nt, Homo sapiens
ucagagcccagcuucauca

SEQ ID NO: 162804 - RNA, 19 nt, Homo sapiens
ugaaagguguagacuucca

SEQ ID NO: 162805 - RNA, 19 nt, Homo sapiens
gcuauaccucggauuacuu

SEQ ID NO: 162806 - RNA, 19 nt, Homo sapiens
acuccaagcagcaaagaaa

SEQ ID NO: 162807 - RNA, 19 nt, Homo sapiens
auaaauccugucagucuuu

SEQ ID NO: 162808 - RNA, 19 nt, Homo sapiens
ucacugauaaauccuguca

SEQ ID NO: 162809 - RNA, 19 nt, Homo sapiens
gcagaaugacuacuuugcu

SEQ ID NO: 162810 - RNA, 19 nt, Homo sapiens
ucaaguuaauggagucaac

SEQ ID NO: 162811 - RNA, 19 nt, Homo sapiens
gggaauucaaacuuucuga

SEQ ID NO: 162812 - RNA, 19 nt, Homo sapiens
aagaaaggcagcgggaauu

SEQ ID NO: 162813 - RNA, 19 nt, Homo sapiens
gacagacaccuugcagaau

SEQ ID NO: 162814 - RNA, 19 nt, Homo sapiens
cauuagcuaugguauugag

SEQ ID NO: 162815 - RNA, 19 nt, Homo sapiens
ggccuacgcuacuauuacg

SEQ ID NO: 162816 - RNA, 19 nt, Homo sapiens
ggaugugaaaccauaucaa

SEQ ID NO: 162817 - RNA, 19 nt, Homo sapiens
gccguggccuacgcuacua

SEQ ID NO: 162818 - RNA, 19 nt, Homo sapiens
cacaggcaguggaccaauc

SEQ ID NO: 162819 - RNA, 19 nt, Homo sapiens
caccaucggaguucucaga

SEQ ID NO: 162820 - RNA, 19 nt, Homo sapiens
aagcuacuuucagugguuu

SEQ ID NO: 162821 - RNA, 19 nt, Homo sapiens
ucucaagcauuaaaagcua

SEQ ID NO: 162822 - RNA, 19 nt, Homo sapiens
aaugacuacuuugcuauca

SEQ ID NO: 162823 - RNA, 19 nt, Homo sapiens
agaaugacuacuuugcuau

SEQ ID NO: 162824 - RNA, 19 nt, Homo sapiens
cccgcuauaccucggauua

SEQ ID NO: 162825 - RNA, 19 nt, Homo sapiens
ggauuacuucauuagcuau

SEQ ID NO: 162826 - RNA, 19 nt, Homo sapiens
ggagucaacccagccuauc

SEQ ID NO: 162827 - RNA, 19 nt, Homo sapiens
ugggugaugugggcuguga

SEQ ID NO: 162828 - RNA, 19 nt, Homo sapiens
acaccuugcagaaugacua

SEQ ID NO: 162829 - RNA, 19 nt, Homo sapiens
ggacaucuuaugggaacau

SEQ ID NO: 162830 - RNA, 19 nt, Homo sapiens
gcaaggacuuuguacauuu

SEQ ID NO: 162831 - RNA, 19 nt, Homo sapiens
gacagaagaucaauaugaa

SEQ ID NO: 162832 - RNA, 19 nt, Homo sapiens
gaaugcagacacagaauua

SEQ ID NO: 162833 - RNA, 19 nt, Homo sapiens
cagaaucccuuaacaguug

SEQ ID NO: 162834 - RNA, 19 nt, Homo sapiens
gagcaaggcaaaccaguua

SEQ ID NO: 162835 - RNA, 19 nt, Homo sapiens
guuauuaucugggcuuaua

SEQ ID NO: 162836 - RNA, 19 nt, Homo sapiens
ggacacacacagacuauuu

SEQ ID NO: 162837 - RNA, 19 nt, Homo sapiens
ggagacggaugggaguuua

SEQ ID NO: 162838 - RNA, 19 nt, Homo sapiens
gggaacaucuggagcaaau

SEQ ID NO: 162839 - RNA, 19 nt, Homo sapiens
gagcaaaugaucaaagaaa

SEQ ID NO: 162840 - RNA, 19 nt, Homo sapiens
gaacaucuggagcaaauga

SEQ ID NO: 162841 - RNA, 19 nt, Homo sapiens
gcaaggcugugaugaguca

SEQ ID NO: 162842 - RNA, 19 nt, Homo sapiens
aaacaaccaugucauuuca

SEQ ID NO: 162843 - RNA, 19 nt, Homo sapiens
ggaaacaaccaugucauuu

SEQ ID NO: 162844 - RNA, 19 nt, Homo sapiens
gagcaggaguuucagaugu

SEQ ID NO: 162845 - RNA, 19 nt, Homo sapiens
ugaauuugcucaccaacaa

SEQ ID NO: 162846 - RNA, 19 nt, Homo sapiens
ccaggaaaguggccaagaa

SEQ ID NO: 162847 - RNA, 19 nt, Homo sapiens
gcaaggcaaaccaguuaua

SEQ ID NO: 162848 - RNA, 19 nt, Homo sapiens
caaggacuuuguacauuug

SEQ ID NO: 162849 - RNA, 19 nt, Homo sapiens
ccaagaagcaguggccuua

SEQ ID NO: 162850 - RNA, 19 nt, Homo sapiens
ccaugucuuucaaggauua

SEQ ID NO: 162851 - RNA, 19 nt, Homo sapiens
uaauagacuuacagggaua

SEQ ID NO: 162852 - RNA, 19 nt, Homo sapiens
gcggcaggaugaaugauuu

SEQ ID NO: 162853 - RNA, 19 nt, Homo sapiens
ggcaaggacuuuguacauu

SEQ ID NO: 162854 - RNA, 19 nt, Homo sapiens
gaaggaaacaaccauguca

SEQ ID NO: 162855 - RNA, 19 nt, Homo sapiens
agacagaagaucaauauga

SEQ ID NO: 162856 - RNA, 19 nt, Homo sapiens
uaacagcaauacauuaggu

SEQ ID NO: 162857 - RNA, 19 nt, Homo sapiens
gcacagcuaauucuacuca

SEQ ID NO: 162858 - RNA, 19 nt, Homo sapiens
acaagaacaucauccacaa

SEQ ID NO: 162859 - RNA, 19 nt, Homo sapiens
caauagcacauauggaauu

SEQ ID NO: 162860 - RNA, 19 nt, Homo sapiens
agacaaauccugccaguca

SEQ ID NO: 162861 - RNA, 19 nt, Homo sapiens
ggaaugcagacacagaauu

SEQ ID NO: 162862 - RNA, 19 nt, Homo sapiens
ggagcuggcaccugacuuu

SEQ ID NO: 162863 - RNA, 19 nt, Homo sapiens
ugugaugagucaagccuua

SEQ ID NO: 162864 - RNA, 19 nt, Homo sapiens
ggauuaacagcaauacauu

SEQ ID NO: 162865 - RNA, 19 nt, Homo sapiens
gagcaaacacugcaagaag

SEQ ID NO: 162866 - RNA, 19 nt, Homo sapiens
ggaugguucuggcuguuug

SEQ ID NO: 162867 - RNA, 19 nt, Homo sapiens
aagaagcaguggccuuauu

SEQ ID NO: 162868 - RNA, 19 nt, Homo sapiens
caugucauuucagaaguua

SEQ ID NO: 162869 - RNA, 19 nt, Homo sapiens
cagaagaucaauaugaaga

SEQ ID NO: 162870 - RNA, 19 nt, Homo sapiens
ggaaaguggccaagaagca

SEQ ID NO: 162871 - RNA, 19 nt, Homo sapiens
gagcugcuaucagacaaau

SEQ ID NO: 162872 - RNA, 19 nt, Homo sapiens
cagucucucugccucaaua

SEQ ID NO: 162873 - RNA, 19 nt, Homo sapiens
cacaggaaguggaccuauu

SEQ ID NO: 162874 - RNA, 19 nt, Homo sapiens
ggagugagcaacagguaug

SEQ ID NO: 162875 - RNA, 19 nt, Homo sapiens
uggagcaaaugaucaaaga

SEQ ID NO: 162876 - RNA, 19 nt, Homo sapiens
ucaccuccguuccucauug

SEQ ID NO: 162877 - RNA, 19 nt, Homo sapiens
gcuggcaccugacuuugug

SEQ ID NO: 162878 - RNA, 19 nt, Homo sapiens
caucugagguuuuauuuca

SEQ ID NO: 162879 - RNA, 19 nt, Homo sapiens
ucccuuaacaguuguauuu

SEQ ID NO: 162880 - RNA, 19 nt, Homo sapiens
guaggagggugggaaggaa

SEQ ID NO: 162881 - RNA, 19 nt, Homo sapiens
cugcagagguucggcauga

SEQ ID NO: 162882 - RNA, 19 nt, Homo sapiens
ccaugucauuucagaaguu

SEQ ID NO: 162883 - RNA, 19 nt, Homo sapiens
aaaauaagcccaagaugaa

SEQ ID NO: 162884 - RNA, 19 nt, Homo sapiens
gacauucucugggaacauc

SEQ ID NO: 162885 - RNA, 19 nt, Homo sapiens
acaaccaugucauuucaga

SEQ ID NO: 162886 - RNA, 19 nt, Homo sapiens
ggagcaaggcaaaccaguu

SEQ ID NO: 162887 - RNA, 19 nt, Homo sapiens
gcaggaguuucagauguuc

SEQ ID NO: 162888 - RNA, 19 nt, Homo sapiens
cggcaugaauggccagaug

SEQ ID NO: 162889 - RNA, 19 nt, Homo sapiens
ucaauaagccaaccauguc

SEQ ID NO: 162890 - RNA, 19 nt, Homo sapiens
uaccuucaguggcuucaaa

SEQ ID NO: 162891 - RNA, 19 nt, Homo sapiens
ggaaggaaacaaccauguc

SEQ ID NO: 162892 - RNA, 19 nt, Homo sapiens
gcagcaacggcacagcuaa

SEQ ID NO: 162893 - RNA, 19 nt, Homo sapiens
caagaugaacuacgagaag

SEQ ID NO: 162894 - RNA, 19 nt, Homo sapiens
aaccaugucuuucaaggau

SEQ ID NO: 162895 - RNA, 19 nt, Homo sapiens
ugaaaauggucgagaaaga

SEQ ID NO: 162896 - RNA, 19 nt, Homo sapiens
ccaggcagcaacuugaauu

SEQ ID NO: 162897 - RNA, 19 nt, Homo sapiens
gaucaaagaaaaccaagaa

SEQ ID NO: 162898 - RNA, 19 nt, Homo sapiens
gcagagguucggcaugaau

SEQ ID NO: 162899 - RNA, 19 nt, Homo sapiens
ucagaaucccuuaacaguu

SEQ ID NO: 162900 - RNA, 19 nt, Homo sapiens
gguucuggcuguuugagau

SEQ ID NO: 162901 - RNA, 19 nt, Homo sapiens
gcaacggcacagcuaauuc

SEQ ID NO: 162902 - RNA, 19 nt, Homo sapiens
aggaaaggcaggauugaaa

SEQ ID NO: 162903 - RNA, 19 nt, Homo sapiens
caacggcacagcuaauucu

SEQ ID NO: 162904 - RNA, 19 nt, Homo sapiens
gacaaauccugccagucau

SEQ ID NO: 162905 - RNA, 19 nt, Homo sapiens
gcagcggcaggaugaauga

SEQ ID NO: 162906 - RNA, 19 nt, Homo sapiens
gccaagggccgacuaagag

SEQ ID NO: 162907 - RNA, 19 nt, Homo sapiens
gggcuuacgcuacuauuac

SEQ ID NO: 162908 - RNA, 19 nt, Homo sapiens
cuauucagcuguggcaguu

SEQ ID NO: 162909 - RNA, 19 nt, Homo sapiens
uagcacauauggaauuuug

SEQ ID NO: 162910 - RNA, 19 nt, Homo sapiens
ggaaaggcaggauugaaaa

SEQ ID NO: 162911 - RNA, 19 nt, Homo sapiens
aagaacaucauccacaaga

SEQ ID NO: 162912 - RNA, 19 nt, Homo sapiens
uccuggagcugcuaucaga

SEQ ID NO: 162913 - RNA, 19 nt, Homo sapiens
ggaacagccagucguccuu

SEQ ID NO: 162914 - RNA, 19 nt, Homo sapiens
ggaugaaugauuucggaau

SEQ ID NO: 162915 - RNA, 19 nt, Homo sapiens
uucaauagcacauauggaa

SEQ ID NO: 162916 - RNA, 19 nt, Homo sapiens
caagaauauggaccaggua

SEQ ID NO: 162917 - RNA, 19 nt, Homo sapiens
gggaaggaaacaaccaugu

SEQ ID NO: 162918 - RNA, 19 nt, Homo sapiens
cggcacagcuaauucuacu

SEQ ID NO: 162919 - RNA, 19 nt, Homo sapiens
gauugaaaauguccaggaa

SEQ ID NO: 162920 - RNA, 19 nt, Homo sapiens
ugugcgaccuccagaacuu

SEQ ID NO: 162921 - RNA, 19 nt, Homo sapiens
ccuauggaaugcagacaca

SEQ ID NO: 162922 - RNA, 19 nt, Homo sapiens
caaagaaaaccaagaaaag

SEQ ID NO: 162923 - RNA, 19 nt, Homo sapiens
ggagcaaaugaucaaagaa

SEQ ID NO: 162924 - RNA, 19 nt, Homo sapiens
uuugaugggucccuguuug

SEQ ID NO: 162925 - RNA, 19 nt, Homo sapiens
gccugggcauuccaaagaa

SEQ ID NO: 162926 - RNA, 19 nt, Homo sapiens
agaagcaguggccuuauug

SEQ ID NO: 162927 - RNA, 19 nt, Homo sapiens
uaaaugaagagcaaacacu

SEQ ID NO: 162928 - RNA, 19 nt, Homo sapiens
gcuacuauuacgacaagaa

SEQ ID NO: 162929 - RNA, 19 nt, Homo sapiens
ccaagaugaacuacgagaa

SEQ ID NO: 162930 - RNA, 19 nt, Homo sapiens
gaacagcccuuuaaauuca

SEQ ID NO: 162931 - RNA, 19 nt, Homo sapiens
gagaauugcugaaucuuug

SEQ ID NO: 162932 - RNA, 19 nt, Homo sapiens
agagauaugucuacaaguu

SEQ ID NO: 162933 - RNA, 19 nt, Homo sapiens
caacgaaggcuacguguau

SEQ ID NO: 162934 - RNA, 19 nt, Homo sapiens
ggccagcuaugaacuauga

SEQ ID NO: 162935 - RNA, 19 nt, Homo sapiens
ucuccaaacucaacucaua

SEQ ID NO: 162936 - RNA, 19 nt, Homo sapiens
aagaacagcccuuuaaauu

SEQ ID NO: 162937 - RNA, 19 nt, Homo sapiens
gagaaauuguaacgagaaa

SEQ ID NO: 162938 - RNA, 19 nt, Homo sapiens
aaagguggcuggagagaga

SEQ ID NO: 162939 - RNA, 19 nt, Homo sapiens
ggacugugcacuuuauuug

SEQ ID NO: 162940 - RNA, 19 nt, Homo sapiens
gagaaaggaauuaugcaaa

SEQ ID NO: 162941 - RNA, 19 nt, Homo sapiens
gccguucacuccgcuauua

SEQ ID NO: 162942 - RNA, 19 nt, Homo sapiens
ugacaaugaugagcaguuu

SEQ ID NO: 162943 - RNA, 19 nt, Homo sapiens
gggaguaaucuaaacauuu

SEQ ID NO: 162944 - RNA, 19 nt, Homo sapiens
ggcauggaauuuaaacuga

SEQ ID NO: 162945 - RNA, 19 nt, Homo sapiens
cuaagucaauuacaggaaa

SEQ ID NO: 162946 - RNA, 19 nt, Homo sapiens
ggagagagauaugucuaca

SEQ ID NO: 162947 - RNA, 19 nt, Homo sapiens
ggucgaggcauggaauuua

SEQ ID NO: 162948 - RNA, 19 nt, Homo sapiens
ggaugacccuucaaauucu

SEQ ID NO: 162949 - RNA, 19 nt, Homo sapiens
ggaaggacccacauaccaa

SEQ ID NO: 162950 - RNA, 19 nt, Homo sapiens
caagaacagcccuuuaaau

SEQ ID NO: 162951 - RNA, 19 nt, Homo sapiens
ggaaacauggcuugcagaa

SEQ ID NO: 162952 - RNA, 19 nt, Homo sapiens
gagauaugucuacaaguuu

SEQ ID NO: 162953 - RNA, 19 nt, Homo sapiens
ggagaaauuguaacgagaa

SEQ ID NO: 162954 - RNA, 19 nt, Homo sapiens
gaacuaugauaaacuuagc

SEQ ID NO: 162955 - RNA, 19 nt, Homo sapiens
guaacuccuuuccuccuuu

SEQ ID NO: 162956 - RNA, 19 nt, Homo sapiens
gccauggacugugcacuuu

SEQ ID NO: 162957 - RNA, 19 nt, Homo sapiens
uccauggccuuuccagaua

SEQ ID NO: 162958 - RNA, 19 nt, Homo sapiens
agagagauaugucuacaag

SEQ ID NO: 162959 - RNA, 19 nt, Homo sapiens
aaacaggaacccagagauu

SEQ ID NO: 162960 - RNA, 19 nt, Homo sapiens
gucaagaacagcccuuuaa

SEQ ID NO: 162961 - RNA, 19 nt, Homo sapiens
gcuaugaacuaugauaaac

SEQ ID NO: 162962 - RNA, 19 nt, Homo sapiens
gucgaggcauggaauuuaa

SEQ ID NO: 162963 - RNA, 19 nt, Homo sapiens
uaaauucagcuauggagaa

SEQ ID NO: 162964 - RNA, 19 nt, Homo sapiens
ccagagauuuugcauauga

SEQ ID NO: 162965 - RNA, 19 nt, Homo sapiens
gcauggaauuuaaacugau

SEQ ID NO: 162966 - RNA, 19 nt, Homo sapiens
caaacaagagccaggaaug

SEQ ID NO: 162967 - RNA, 19 nt, Homo sapiens
gagaaaccaacaaauguca

SEQ ID NO: 162968 - RNA, 19 nt, Homo sapiens
cacaguccauguucagaaa

SEQ ID NO: 162969 - RNA, 19 nt, Homo sapiens
ucacuccgcuauuacuaug

SEQ ID NO: 162970 - RNA, 19 nt, Homo sapiens
aaauucagcuauggagaaa

SEQ ID NO: 162971 - RNA, 19 nt, Homo sapiens
acagagaauugcugaaucu

SEQ ID NO: 162972 - RNA, 19 nt, Homo sapiens
guaacgagaaaccaacaaa

SEQ ID NO: 162973 - RNA, 19 nt, Homo sapiens
ucaugcaucuccaaacuca

SEQ ID NO: 162974 - RNA, 19 nt, Homo sapiens
caucaugcaucuccaaacu

SEQ ID NO: 162975 - RNA, 19 nt, Homo sapiens
ucaagaacagcccuuuaaa

SEQ ID NO: 162976 - RNA, 19 nt, Homo sapiens
cauggacugugcacuuuau

SEQ ID NO: 162977 - RNA, 19 nt, Homo sapiens
ccauggccuuuccagauaa

SEQ ID NO: 162978 - RNA, 19 nt, Homo sapiens
agauaugucuacaaguuug

SEQ ID NO: 162979 - RNA, 19 nt, Homo sapiens
gaagagguggcccgacguu

SEQ ID NO: 162980 - RNA, 19 nt, Homo sapiens
uggaugacccuucaaauuc

SEQ ID NO: 162981 - RNA, 19 nt, Homo sapiens
ccauuuauaugaggcaaga

SEQ ID NO: 162982 - RNA, 19 nt, Homo sapiens
uaacuccuuuccuccuuug

SEQ ID NO: 162983 - RNA, 19 nt, Homo sapiens
ugguagcucuucuggauga

SEQ ID NO: 162984 - RNA, 19 nt, Homo sapiens
caacggcgaggaucacuuc

SEQ ID NO: 162985 - RNA, 19 nt, Homo sapiens
guaccacgacccaguguau

SEQ ID NO: 162986 - RNA, 19 nt, Homo sapiens
caacaaaugucaggaaaag

SEQ ID NO: 162987 - RNA, 19 nt, Homo sapiens
cgaaggcuacguguauuaa

SEQ ID NO: 162988 - RNA, 19 nt, Homo sapiens
acacagugccucuuucuca

SEQ ID NO: 162989 - RNA, 19 nt, Homo sapiens
cagcuaugaacuaugauaa

SEQ ID NO: 162990 - RNA, 19 nt, Homo sapiens
caaugucagugccuaugau

SEQ ID NO: 162991 - RNA, 19 nt, Homo sapiens
cagcgugggagaaauugua

SEQ ID NO: 162992 - RNA, 19 nt, Homo sapiens
gcugaagacagacauggaa

SEQ ID NO: 162993 - RNA, 19 nt, Homo sapiens
agaacagcccuuuaaauuc

SEQ ID NO: 162994 - RNA, 19 nt, Homo sapiens
ggacacagugccucuuucu

SEQ ID NO: 162995 - RNA, 19 nt, Homo sapiens
guccacugcugaagacaga

SEQ ID NO: 162996 - RNA, 19 nt, Homo sapiens
agaucuggcucaugauuca

SEQ ID NO: 162997 - RNA, 19 nt, Homo sapiens
ccacaguccauguucagaa

SEQ ID NO: 162998 - RNA, 19 nt, Homo sapiens
ggaagcuaaugggugaaug

SEQ ID NO: 162999 - RNA, 19 nt, Homo sapiens
uuugguagcucuucuggau

SEQ ID NO: 163000 - RNA, 19 nt, Homo sapiens
ugggaguaaucuaaacauu

SEQ ID NO: 163001 - RNA, 19 nt, Homo sapiens
agagaauugcugaaucuuu

SEQ ID NO: 163002 - RNA, 19 nt, Homo sapiens
cuggaugacccuucaaauu

SEQ ID NO: 163003 - RNA, 19 nt, Homo sapiens
gaaggcuguauguuugaaa

SEQ ID NO: 163004 - RNA, 19 nt, Homo sapiens
uaacgagaaaccaacaaau

SEQ ID NO: 163005 - RNA, 19 nt, Homo sapiens
caagaucuaagucaauuac

SEQ ID NO: 163006 - RNA, 19 nt, Homo sapiens
ugagaaaggaauuaugcaa

SEQ ID NO: 163007 - RNA, 19 nt, Homo sapiens
ccagcuaugaacuaugaua

SEQ ID NO: 163008 - RNA, 19 nt, Homo sapiens
cuagcugccacuccauuua

SEQ ID NO: 163009 - RNA, 19 nt, Homo sapiens
gaagcuaaugggugaaugg

SEQ ID NO: 163010 - RNA, 19 nt, Homo sapiens
gggaaggacccacauacca

SEQ ID NO: 163011 - RNA, 19 nt, Homo sapiens
acaagagccaggaauguau

SEQ ID NO: 163012 - RNA, 19 nt, Homo sapiens
aaacaagagccaggaaugu

SEQ ID NO: 163013 - RNA, 19 nt, Homo sapiens
gagggugggugggaguaau

SEQ ID NO: 163014 - RNA, 19 nt, Homo sapiens
gaauugcugaaucuuuguu

SEQ ID NO: 163015 - RNA, 19 nt, Homo sapiens
gaugagagcauggccuaca

SEQ ID NO: 163016 - RNA, 19 nt, Homo sapiens
cauggaacgucacaucaac

SEQ ID NO: 163017 - RNA, 19 nt, Homo sapiens
gacauggaacgucacauca

SEQ ID NO: 163018 - RNA, 19 nt, Homo sapiens
gaaaggaauuaugcaaaag

SEQ ID NO: 163019 - RNA, 19 nt, Homo sapiens
aacaagagccaggaaugua

SEQ ID NO: 163020 - RNA, 19 nt, Homo sapiens
auggagacaucaaacaaga

SEQ ID NO: 163021 - RNA, 19 nt, Homo sapiens
gaaauuguaacgagaaacc

SEQ ID NO: 163022 - RNA, 19 nt, Homo sapiens
gagagagauaugucuacaa

SEQ ID NO: 163023 - RNA, 19 nt, Homo sapiens
accaacaaaugucaggaaa

SEQ ID NO: 163024 - RNA, 19 nt, Homo sapiens
gugggugggaguaaucuaa

SEQ ID NO: 163025 - RNA, 19 nt, Homo sapiens
ccauggacugugcacuuua

SEQ ID NO: 163026 - RNA, 19 nt, Homo sapiens
ccuguugcauuauucuaug

SEQ ID NO: 163027 - RNA, 19 nt, Homo sapiens
ugcaagauacagagaauug

SEQ ID NO: 163028 - RNA, 19 nt, Homo sapiens
aaggcuacguguauuaaca

SEQ ID NO: 163029 - RNA, 19 nt, Homo sapiens
acgaaggcuacguguauua

SEQ ID NO: 163030 - RNA, 19 nt, Homo sapiens
guaccaaacuccauucaua

SEQ ID NO: 163031 - RNA, 19 nt, Homo sapiens
gcaaaccacagaugaauua

SEQ ID NO: 163032 - RNA, 19 nt, Homo sapiens
acaagaggauccuucauaa

SEQ ID NO: 163033 - RNA, 19 nt, Homo sapiens
gggaaaagauuuaccuaua

SEQ ID NO: 163034 - RNA, 19 nt, Homo sapiens
cagcaaauccucagagaaa

SEQ ID NO: 163035 - RNA, 19 nt, Homo sapiens
gcccagugguucuuucaua

SEQ ID NO: 163036 - RNA, 19 nt, Homo sapiens
ucacuuauaaggagaguua

SEQ ID NO: 163037 - RNA, 19 nt, Homo sapiens
uaaauuaggcacaguaaga

SEQ ID NO: 163038 - RNA, 19 nt, Homo sapiens
cuacaaacacuuccgauuu

SEQ ID NO: 163039 - RNA, 19 nt, Homo sapiens
aaccacagaugaauuauga

SEQ ID NO: 163040 - RNA, 19 nt, Homo sapiens
cuaccaagcucucccuuau

SEQ ID NO: 163041 - RNA, 19 nt, Homo sapiens
gggaaccuguuucuacaaa

SEQ ID NO: 163042 - RNA, 19 nt, Homo sapiens
gugaugaucuuuacguuca

SEQ ID NO: 163043 - RNA, 19 nt, Homo sapiens
cuauuacgcuaucuuguuu

SEQ ID NO: 163044 - RNA, 19 nt, Homo sapiens
agaaggagguggaggguau

SEQ ID NO: 163045 - RNA, 19 nt, Homo sapiens
gaagaguuccgccauguca

SEQ ID NO: 163046 - RNA, 19 nt, Homo sapiens
gaaaugcaaaccacagaug

SEQ ID NO: 163047 - RNA, 19 nt, Homo sapiens
gggaauuugucaucaagga

SEQ ID NO: 163048 - RNA, 19 nt, Homo sapiens
gaccuucucuccuguuaag

SEQ ID NO: 163049 - RNA, 19 nt, Homo sapiens
gauaguaccaaacuccauu

SEQ ID NO: 163050 - RNA, 19 nt, Homo sapiens
uaucugagcaguauauguu

SEQ ID NO: 163051 - RNA, 19 nt, Homo sapiens
ccucuugacuuuccugguu

SEQ ID NO: 163052 - RNA, 19 nt, Homo sapiens
caagaggauccuucauaaa

SEQ ID NO: 163053 - RNA, 19 nt, Homo sapiens
gaggagaccggaccgaaga

SEQ ID NO: 163054 - RNA, 19 nt, Homo sapiens
caucacagcuccccacauu

SEQ ID NO: 163055 - RNA, 19 nt, Homo sapiens
ucaauguucuuacucaagu

SEQ ID NO: 163056 - RNA, 19 nt, Homo sapiens
cagcauccuugaucagaga

SEQ ID NO: 163057 - RNA, 19 nt, Homo sapiens
aacauucggucaaguggua

SEQ ID NO: 163058 - RNA, 19 nt, Homo sapiens
gguuauagcuuuccaucac

SEQ ID NO: 163059 - RNA, 19 nt, Homo sapiens
gaugggaaccuguuucuac

SEQ ID NO: 163060 - RNA, 19 nt, Homo sapiens
aacaagaggauccuucaua

SEQ ID NO: 163061 - RNA, 19 nt, Homo sapiens
cagauacuauuacaacaag

SEQ ID NO: 163062 - RNA, 19 nt, Homo sapiens
ccaaacuccauucauauau

SEQ ID NO: 163063 - RNA, 19 nt, Homo sapiens
ucggucaagugguaagaua

SEQ ID NO: 163064 - RNA, 19 nt, Homo sapiens
gcacaguaagagauuaaug

SEQ ID NO: 163065 - RNA, 19 nt, Homo sapiens
acagaugaauuaugacaag

SEQ ID NO: 163066 - RNA, 19 nt, Homo sapiens
cacaguaagagauuaauga

SEQ ID NO: 163067 - RNA, 19 nt, Homo sapiens
agcaguauauguucuaaga

SEQ ID NO: 163068 - RNA, 19 nt, Homo sapiens
ccaagaaaauacaguaguu

SEQ ID NO: 163069 - RNA, 19 nt, Homo sapiens
ugaaagcagucucucaaaa

SEQ ID NO: 163070 - RNA, 19 nt, Homo sapiens
accaagcucucccuuauca

SEQ ID NO: 163071 - RNA, 19 nt, Homo sapiens
uacaaacacuuccgauuuu

SEQ ID NO: 163072 - RNA, 19 nt, Homo sapiens
gguagggaauuaauuuuga

SEQ ID NO: 163073 - RNA, 19 nt, Homo sapiens
gaagagcaggcgggugaaa

SEQ ID NO: 163074 - RNA, 19 nt, Homo sapiens
ucgcaaaccacagauagua

SEQ ID NO: 163075 - RNA, 19 nt, Homo sapiens
ccacagauaguaccaaacu

SEQ ID NO: 163076 - RNA, 19 nt, Homo sapiens
aaccacagauaguaccaaa

SEQ ID NO: 163077 - RNA, 19 nt, Homo sapiens
gcauauuguuuguaaucuc

SEQ ID NO: 163078 - RNA, 19 nt, Homo sapiens
gugguaagauacaaacucu

SEQ ID NO: 163079 - RNA, 19 nt, Homo sapiens
cauucucucuugauguuga

SEQ ID NO: 163080 - RNA, 19 nt, Homo sapiens
guucaggacucaguuuuaa

SEQ ID NO: 163081 - RNA, 19 nt, Homo sapiens
gcccucagauacuauuaca

SEQ ID NO: 163082 - RNA, 19 nt, Homo sapiens
ucauacuccugcccaagaa

SEQ ID NO: 163083 - RNA, 19 nt, Homo sapiens
gguggaggguaucaguuuc

SEQ ID NO: 163084 - RNA, 19 nt, Homo sapiens
ccaacuacccauucaucaa

SEQ ID NO: 163085 - RNA, 19 nt, Homo sapiens
ccacagaugaauuaugaca

SEQ ID NO: 163086 - RNA, 19 nt, Homo sapiens
ggaaaugcaaaccacagau

SEQ ID NO: 163087 - RNA, 19 nt, Homo sapiens
caacuacccauucaucaac

SEQ ID NO: 163088 - RNA, 19 nt, Homo sapiens
gcucucccuuaucaaguga

SEQ ID NO: 163089 - RNA, 19 nt, Homo sapiens
uaccaaacuccauucauau

SEQ ID NO: 163090 - RNA, 19 nt, Homo sapiens
guuauagcuuuccaucaca

SEQ ID NO: 163091 - RNA, 19 nt, Homo sapiens
accaaacuccauucauaua

SEQ ID NO: 163092 - RNA, 19 nt, Homo sapiens
ugagcaguauauguucuaa

SEQ ID NO: 163093 - RNA, 19 nt, Homo sapiens
gaaagcagucucucaaaag

SEQ ID NO: 163094 - RNA, 19 nt, Homo sapiens
gcaggcgggugaaaaugaa

SEQ ID NO: 163095 - RNA, 19 nt, Homo sapiens
ggagguggaggguaucagu

SEQ ID NO: 163096 - RNA, 19 nt, Homo sapiens
cagugguucuuucauagau

SEQ ID NO: 163097 - RNA, 19 nt, Homo sapiens
caagcucucccuuaucaag

SEQ ID NO: 163098 - RNA, 19 nt, Homo sapiens
guuugggaaugauguuuca

SEQ ID NO: 163099 - RNA, 19 nt, Homo sapiens
ggucaagugguaagauaca

SEQ ID NO: 163100 - RNA, 19 nt, Homo sapiens
aaaugcaaaccacagauga

SEQ ID NO: 163101 - RNA, 19 nt, Homo sapiens
uaggcacaguaagagauua

SEQ ID NO: 163102 - RNA, 19 nt, Homo sapiens
uaaccccacucauauguau

SEQ ID NO: 163103 - RNA, 19 nt, Homo sapiens
aaagcagucucucaaaaga

SEQ ID NO: 163104 - RNA, 19 nt, Homo sapiens
ugacuuuccugguuauagc

SEQ ID NO: 163105 - RNA, 19 nt, Homo sapiens
aacagcaaauccucagaga

SEQ ID NO: 163106 - RNA, 19 nt, Homo sapiens
gguuugugaugaucuuuac

SEQ ID NO: 163107 - RNA, 19 nt, Homo sapiens
ccucaauguucuuacucaa

SEQ ID NO: 163108 - RNA, 19 nt, Homo sapiens
gccucaauguucuuacuca

SEQ ID NO: 163109 - RNA, 19 nt, Homo sapiens
ucaagugguaagauacaaa

SEQ ID NO: 163110 - RNA, 19 nt, Homo sapiens
aagaggauccuucauaaaa

SEQ ID NO: 163111 - RNA, 19 nt, Homo sapiens
ggaauuugucaucaaggau

SEQ ID NO: 163112 - RNA, 19 nt, Homo sapiens
uugaccuucucuccuguua

SEQ ID NO: 163113 - RNA, 19 nt, Homo sapiens
gaggauccuucauaaaaca

SEQ ID NO: 163114 - RNA, 19 nt, Homo sapiens
ccucagauacuauuacaac

SEQ ID NO: 163115 - RNA, 19 nt, Homo sapiens
acucauauguaucugugau

SEQ ID NO: 163116 - RNA, 19 nt, Homo sapiens
gauucgcaaaccacagaua

SEQ ID NO: 163117 - RNA, 19 nt, Homo sapiens
uagauucgcaaaccacaga

SEQ ID NO: 163118 - RNA, 19 nt, Homo sapiens
cccagugguucuuucauag

SEQ ID NO: 163119 - RNA, 19 nt, Homo sapiens
uuacucaagucaucucacu

SEQ ID NO: 163120 - RNA, 19 nt, Homo sapiens
gcaacagcaaauccucaga

SEQ ID NO: 163121 - RNA, 19 nt, Homo sapiens
acuauuacgcuaucuuguu

SEQ ID NO: 163122 - RNA, 19 nt, Homo sapiens
cuagauacuauuacgcuau

SEQ ID NO: 163123 - RNA, 19 nt, Homo sapiens
caucaacauucggucaagu

SEQ ID NO: 163124 - RNA, 19 nt, Homo sapiens
ccagugguucuuucauaga

SEQ ID NO: 163125 - RNA, 19 nt, Homo sapiens
gagguggaggguaucaguu

SEQ ID NO: 163126 - RNA, 19 nt, Homo sapiens
gauacuauuacaacaagag

SEQ ID NO: 163127 - RNA, 19 nt, Homo sapiens
gcuguagcaucguggaaaa

SEQ ID NO: 163128 - RNA, 19 nt, Homo sapiens
ucccuuaucaagugaauau

SEQ ID NO: 163129 - RNA, 19 nt, Homo sapiens
cauagaugggaaccuguuu

SEQ ID NO: 163130 - RNA, 19 nt, Homo sapiens
gaugaaagccggauacuug

SEQ ID NO: 163131 - RNA, 19 nt, Homo sapiens
ccacagagaacaagaguuu

SEQ ID NO: 163132 - RNA, 19 nt, Homo sapiens
caauguaccuccacacaga

SEQ ID NO: 163133 - RNA, 19 nt, Homo sapiens
ggacuucgccuacgacuca

SEQ ID NO: 163134 - RNA, 19 nt, Homo sapiens
gggcagagcaacggaauuu

SEQ ID NO: 163135 - RNA, 19 nt, Homo sapiens
ccgauacuauuaugagaaa

SEQ ID NO: 163136 - RNA, 19 nt, Homo sapiens
gugcugcccuguguacaua

SEQ ID NO: 163137 - RNA, 19 nt, Homo sapiens
ccaccaggaucaagaagga

SEQ ID NO: 163138 - RNA, 19 nt, Homo sapiens
gcaguuuguuccugauuuc

SEQ ID NO: 163139 - RNA, 19 nt, Homo sapiens
ggagaaauggcaagucuag

SEQ ID NO: 163140 - RNA, 19 nt, Homo sapiens
ccaaggguggcuacucuua

SEQ ID NO: 163141 - RNA, 19 nt, Homo sapiens
gaauggaguucaagcucau

SEQ ID NO: 163142 - RNA, 19 nt, Homo sapiens
agacagugaugagcaguuu

SEQ ID NO: 163143 - RNA, 19 nt, Homo sapiens
gcaggagggugaggagguu

SEQ ID NO: 163144 - RNA, 19 nt, Homo sapiens
ccagacaaaucgccaucaa

SEQ ID NO: 163145 - RNA, 19 nt, Homo sapiens
gaaaggaaccugggaugag

SEQ ID NO: 163146 - RNA, 19 nt, Homo sapiens
gaaauuugaaggagacauc

SEQ ID NO: 163147 - RNA, 19 nt, Homo sapiens
caagugcccuacaccuuca

SEQ ID NO: 163148 - RNA, 19 nt, Homo sapiens
gaaauggcaagucuagagu

SEQ ID NO: 163149 - RNA, 19 nt, Homo sapiens
auaaaugaaucugguguug

SEQ ID NO: 163150 - RNA, 19 nt, Homo sapiens
ggccagccaugaauuacga

SEQ ID NO: 163151 - RNA, 19 nt, Homo sapiens
gaaccggccagccaugaau

SEQ ID NO: 163152 - RNA, 19 nt, Homo sapiens
gcugcccuguguacauaua

SEQ ID NO: 163153 - RNA, 19 nt, Homo sapiens
guggagaaauggcaagucu

SEQ ID NO: 163154 - RNA, 19 nt, Homo sapiens
uggcaagucuagagucuca

SEQ ID NO: 163155 - RNA, 19 nt, Homo sapiens
cguugucccugagaaauuu

SEQ ID NO: 163156 - RNA, 19 nt, Homo sapiens
ccugggcccuggaggaauu

SEQ ID NO: 163157 - RNA, 19 nt, Homo sapiens
agaaaccucugcgaccauu

SEQ ID NO: 163158 - RNA, 19 nt, Homo sapiens
gggcuauggcuaugagaaa

SEQ ID NO: 163159 - RNA, 19 nt, Homo sapiens
agacaaaucgccaucaagu

SEQ ID NO: 163160 - RNA, 19 nt, Homo sapiens
gcaggcggagguugaagaa

SEQ ID NO: 163161 - RNA, 19 nt, Homo sapiens
ggaggguaccgguuuguca

SEQ ID NO: 163162 - RNA, 19 nt, Homo sapiens
ucacugagcuccccagauc

SEQ ID NO: 163163 - RNA, 19 nt, Homo sapiens
ggauggagcggaggaugaa

SEQ ID NO: 163164 - RNA, 19 nt, Homo sapiens
gcaagucuagagucucaga

SEQ ID NO: 163165 - RNA, 19 nt, Homo sapiens
gcucgcuccgauacuauua

SEQ ID NO: 163166 - RNA, 19 nt, Homo sapiens
gccgcucgcuccgauacua

SEQ ID NO: 163167 - RNA, 19 nt, Homo sapiens
agacggacuucgccuacga

SEQ ID NO: 163168 - RNA, 19 nt, Homo sapiens
gaugaggggugcuggguau

SEQ ID NO: 163169 - RNA, 19 nt, Homo sapiens
aggcggagguugaagaaag

SEQ ID NO: 163170 - RNA, 19 nt, Homo sapiens
cugcagcuguggcaauuuc

SEQ ID NO: 163171 - RNA, 19 nt, Homo sapiens
gguaccgguuugucaguuc

SEQ ID NO: 163172 - RNA, 19 nt, Homo sapiens
gaaacccacagaugucucu

SEQ ID NO: 163173 - RNA, 19 nt, Homo sapiens
ggaggaugaaagccggaua

SEQ ID NO: 163174 - RNA, 19 nt, Homo sapiens
aagcaagaauaccaugauc

SEQ ID NO: 163175 - RNA, 19 nt, Homo sapiens
gagcaguuuguuccugauu

SEQ ID NO: 163176 - RNA, 19 nt, Homo sapiens
ggaaggggucggugcauuu

SEQ ID NO: 163177 - RNA, 19 nt, Homo sapiens
ggaugaaagccggauacuu

SEQ ID NO: 163178 - RNA, 19 nt, Homo sapiens
ggagucauugggaaggaaa

SEQ ID NO: 163179 - RNA, 19 nt, Homo sapiens
uaagcaagaauaccaugau

SEQ ID NO: 163180 - RNA, 19 nt, Homo sapiens
gcugcucaccggagucauu

SEQ ID NO: 163181 - RNA, 19 nt, Homo sapiens
gcguugucccugagaaauu

SEQ ID NO: 163182 - RNA, 19 nt, Homo sapiens
ggaacauagcuccgucuuc

SEQ ID NO: 163183 - RNA, 19 nt, Homo sapiens
agaaaggaaccugggauga

SEQ ID NO: 163184 - RNA, 19 nt, Homo sapiens
agaaauggcaagucuagag

SEQ ID NO: 163185 - RNA, 19 nt, Homo sapiens
agcguuacguguacaaguu

SEQ ID NO: 163186 - RNA, 19 nt, Homo sapiens
gaccauucccagaugaugu

SEQ ID NO: 163187 - RNA, 19 nt, Homo sapiens
ggguaccgguuugucaguu

SEQ ID NO: 163188 - RNA, 19 nt, Homo sapiens
aaggaaaaguggagaaaug

SEQ ID NO: 163189 - RNA, 19 nt, Homo sapiens
cuggaugacccaacaaaug

SEQ ID NO: 163190 - RNA, 19 nt, Homo sapiens
ccucgacucugaagaucuc

SEQ ID NO: 163191 - RNA, 19 nt, Homo sapiens
ccuguguacauauaaauga

SEQ ID NO: 163192 - RNA, 19 nt, Homo sapiens
gcguuacguguacaaguuu

SEQ ID NO: 163193 - RNA, 19 nt, Homo sapiens
gagcguuacguguacaagu

SEQ ID NO: 163194 - RNA, 19 nt, Homo sapiens
cuggugagcguuacgugua

SEQ ID NO: 163195 - RNA, 19 nt, Homo sapiens
gauacuauuaugagaaagg

SEQ ID NO: 163196 - RNA, 19 nt, Homo sapiens
gaagcucagguaccagaca

SEQ ID NO: 163197 - RNA, 19 nt, Homo sapiens
ccaccaccaggaucaagaa

SEQ ID NO: 163198 - RNA, 19 nt, Homo sapiens
agcaguuuguuccugauuu

SEQ ID NO: 163199 - RNA, 19 nt, Homo sapiens
guaccgguuugucaguucu

SEQ ID NO: 163200 - RNA, 19 nt, Homo sapiens
ucgcuccgauacuauuaug

SEQ ID NO: 163201 - RNA, 19 nt, Homo sapiens
gacauuugccacuccuuca

SEQ ID NO: 163202 - RNA, 19 nt, Homo sapiens
gcagauccccacuguccua

SEQ ID NO: 163203 - RNA, 19 nt, Homo sapiens
cugcgaccauucccagaug

SEQ ID NO: 163204 - RNA, 19 nt, Homo sapiens
gagaaaccucugcgaccau

SEQ ID NO: 163205 - RNA, 19 nt, Homo sapiens
gacaaaucgccaucaaguc

SEQ ID NO: 163206 - RNA, 19 nt, Homo sapiens
ccuggaggguaccgguuug

SEQ ID NO: 163207 - RNA, 19 nt, Homo sapiens
gcucagcuucuuccuaggu

SEQ ID NO: 163208 - RNA, 19 nt, Homo sapiens
gagaaauggcaagucuaga

SEQ ID NO: 163209 - RNA, 19 nt, Homo sapiens
gaggaugaaagccggauac

SEQ ID NO: 163210 - RNA, 19 nt, Homo sapiens
gcuccgauacuauuaugag

SEQ ID NO: 163211 - RNA, 19 nt, Homo sapiens
gccacuccuucacaucuca

SEQ ID NO: 163212 - RNA, 19 nt, Homo sapiens
gaagggcgauuaacacuuu

SEQ ID NO: 163213 - RNA, 19 nt, Homo sapiens
gcucugauuugcacaauuu

SEQ ID NO: 163214 - RNA, 19 nt, Homo sapiens
gcaccugaguuguacauuu

SEQ ID NO: 163215 - RNA, 19 nt, Homo sapiens
caacagugcuagcauucua

SEQ ID NO: 163216 - RNA, 19 nt, Homo sapiens
gaaguuugcuuuucguuua

SEQ ID NO: 163217 - RNA, 19 nt, Homo sapiens
gcaaagcaauaucuuguuc

SEQ ID NO: 163218 - RNA, 19 nt, Homo sapiens
gcugaaaccucucaaagug

SEQ ID NO: 163219 - RNA, 19 nt, Homo sapiens
ccagcuggcuagagauuua

SEQ ID NO: 163220 - RNA, 19 nt, Homo sapiens
gaucauggacuacuaaaug

SEQ ID NO: 163221 - RNA, 19 nt, Homo sapiens
gacaauacaugcaaagcaa

SEQ ID NO: 163222 - RNA, 19 nt, Homo sapiens
ccucugagcugucgucuug

SEQ ID NO: 163223 - RNA, 19 nt, Homo sapiens
gcauuguacucuaaucaaa

SEQ ID NO: 163224 - RNA, 19 nt, Homo sapiens
gggcaugacugaugacaau

SEQ ID NO: 163225 - RNA, 19 nt, Homo sapiens
gcaaaugucagaaccuauu

SEQ ID NO: 163226 - RNA, 19 nt, Homo sapiens
guagauugggccuuaauua

SEQ ID NO: 163227 - RNA, 19 nt, Homo sapiens
cgaaggcuuugcuuacuaa

SEQ ID NO: 163228 - RNA, 19 nt, Homo sapiens
caguaggguuugagacuua

SEQ ID NO: 163229 - RNA, 19 nt, Homo sapiens
gaucgaucauggacuacua

SEQ ID NO: 163230 - RNA, 19 nt, Homo sapiens
ggccagccaugaacuauga

SEQ ID NO: 163231 - RNA, 19 nt, Homo sapiens
ugaagacacugcagcuuga

SEQ ID NO: 163232 - RNA, 19 nt, Homo sapiens
gcuagagauuuauuuguug

SEQ ID NO: 163233 - RNA, 19 nt, Homo sapiens
ggcuagagauuuauuuguu

SEQ ID NO: 163234 - RNA, 19 nt, Homo sapiens
gaagagguucgcagggaua

SEQ ID NO: 163235 - RNA, 19 nt, Homo sapiens
caaaguagaggaaaaguua

SEQ ID NO: 163236 - RNA, 19 nt, Homo sapiens
gaugacaauuuccauuuca

SEQ ID NO: 163237 - RNA, 19 nt, Homo sapiens
gcgauacgucuacaaauuu

SEQ ID NO: 163238 - RNA, 19 nt, Homo sapiens
uaacaugcccucucuggaa

SEQ ID NO: 163239 - RNA, 19 nt, Homo sapiens
gaccacagcagcaaacauu

SEQ ID NO: 163240 - RNA, 19 nt, Homo sapiens
gcaauaucuuguucagguu

SEQ ID NO: 163241 - RNA, 19 nt, Homo sapiens
ccaaagaugaugccugaaa

SEQ ID NO: 163242 - RNA, 19 nt, Homo sapiens
gaaccugccagcugauuug

SEQ ID NO: 163243 - RNA, 19 nt, Homo sapiens
agacuuagcugugauacug

SEQ ID NO: 163244 - RNA, 19 nt, Homo sapiens
gccagugccucaacucuug

SEQ ID NO: 163245 - RNA, 19 nt, Homo sapiens
ucacgauucugaagagcua

SEQ ID NO: 163246 - RNA, 19 nt, Homo sapiens
gaaagucuacagugcagaa

SEQ ID NO: 163247 - RNA, 19 nt, Homo sapiens
cuaaagcuaugugaaaguu

SEQ ID NO: 163248 - RNA, 19 nt, Homo sapiens
cauagaagggcucugauuu

SEQ ID NO: 163249 - RNA, 19 nt, Homo sapiens
gaaauuacucaaugcugaa

SEQ ID NO: 163250 - RNA, 19 nt, Homo sapiens
aaagcuaugugaaaguuga

SEQ ID NO: 163251 - RNA, 19 nt, Homo sapiens
aagcacaaguuccugauga

SEQ ID NO: 163252 - RNA, 19 nt, Homo sapiens
gccauguggucgccaagua

SEQ ID NO: 163253 - RNA, 19 nt, Homo sapiens
caauacaugcaaagcaaua

SEQ ID NO: 163254 - RNA, 19 nt, Homo sapiens
ggccuuaauuagcauugua

SEQ ID NO: 163255 - RNA, 19 nt, Homo sapiens
gcaugacugaugacaauuu

SEQ ID NO: 163256 - RNA, 19 nt, Homo sapiens
ggacacaagcuuagauucu

SEQ ID NO: 163257 - RNA, 19 nt, Homo sapiens
gauugggccuuaauuagca

SEQ ID NO: 163258 - RNA, 19 nt, Homo sapiens
cuaauuagcccacaaaggu

SEQ ID NO: 163259 - RNA, 19 nt, Homo sapiens
cgugacacuuaguacauua

SEQ ID NO: 163260 - RNA, 19 nt, Homo sapiens
cuaccugugugauucagua

SEQ ID NO: 163261 - RNA, 19 nt, Homo sapiens
gaacauuugcaccugaguu

SEQ ID NO: 163262 - RNA, 19 nt, Homo sapiens
cagacaaccugauggaaca

SEQ ID NO: 163263 - RNA, 19 nt, Homo sapiens
gcuugcccuuugaguauua

SEQ ID NO: 163264 - RNA, 19 nt, Homo sapiens
gcaaacaagggcagugguu

SEQ ID NO: 163265 - RNA, 19 nt, Homo sapiens
cgauacgucuacaaauuug

SEQ ID NO: 163266 - RNA, 19 nt, Homo sapiens
gagauaaucgccccaguua

SEQ ID NO: 163267 - RNA, 19 nt, Homo sapiens
ugacaauaauccucuguag

SEQ ID NO: 163268 - RNA, 19 nt, Homo sapiens
aagaaugacuacacuguuc

SEQ ID NO: 163269 - RNA, 19 nt, Homo sapiens
aaaccaguauccaucagaa

SEQ ID NO: 163270 - RNA, 19 nt, Homo sapiens
aaaagugccucuacaacua

SEQ ID NO: 163271 - RNA, 19 nt, Homo sapiens
gaacaguuugucccagauu

SEQ ID NO: 163272 - RNA, 19 nt, Homo sapiens
acaaguuccugaugaugaa

SEQ ID NO: 163273 - RNA, 19 nt, Homo sapiens
guuauauucuguacugugu

SEQ ID NO: 163274 - RNA, 19 nt, Homo sapiens
ccugccagcugauuugaaa

SEQ ID NO: 163275 - RNA, 19 nt, Homo sapiens
ucacuaacaugcccucucu

SEQ ID NO: 163276 - RNA, 19 nt, Homo sapiens
gggaagagaucaaaaugga

SEQ ID NO: 163277 - RNA, 19 nt, Homo sapiens
ccgaaggcuuugcuuacua

SEQ ID NO: 163278 - RNA, 19 nt, Homo sapiens
caacuauugugccuaugau

SEQ ID NO: 163279 - RNA, 19 nt, Homo sapiens
gugguaaaccuguagauug

SEQ ID NO: 163280 - RNA, 19 nt, Homo sapiens
gccgcucucuccgcuauua

SEQ ID NO: 163281 - RNA, 19 nt, Homo sapiens
gcauggaguucaagcugau

SEQ ID NO: 163282 - RNA, 19 nt, Homo sapiens
cggcaaaugucagaaccua

SEQ ID NO: 163283 - RNA, 19 nt, Homo sapiens
caauuuccauuucaucagu

SEQ ID NO: 163284 - RNA, 19 nt, Homo sapiens
aaugugcacugugucuuua

SEQ ID NO: 163285 - RNA, 19 nt, Homo sapiens
cauaaaccauggcuacucu

SEQ ID NO: 163286 - RNA, 19 nt, Homo sapiens
caauaucuuguucagguua

SEQ ID NO: 163287 - RNA, 19 nt, Homo sapiens
ggacaauacaugcaaagca

SEQ ID NO: 163288 - RNA, 19 nt, Homo sapiens
ccucagggauucaaacaag

SEQ ID NO: 163289 - RNA, 19 nt, Homo sapiens
aacaggagccuaccaugua

SEQ ID NO: 163290 - RNA, 19 nt, Homo sapiens
caaagaugaugccugaaaa

SEQ ID NO: 163291 - RNA, 19 nt, Homo sapiens
agcgauacgucuacaaauu

SEQ ID NO: 163292 - RNA, 19 nt, Homo sapiens
cugccaagcugcguuauau

SEQ ID NO: 163293 - RNA, 19 nt, Homo sapiens
gccagggccgugcaacuua

SEQ ID NO: 163294 - RNA, 19 nt, Homo sapiens
ugacccagaugcccucuuc

SEQ ID NO: 163295 - RNA, 19 nt, Homo sapiens
ggugcuaacuauggagaaa

SEQ ID NO: 163296 - RNA, 19 nt, Homo sapiens
ggauuggcacccuuaaaga

SEQ ID NO: 163297 - RNA, 19 nt, Homo sapiens
ccagggaaaucucgaucug

SEQ ID NO: 163298 - RNA, 19 nt, Homo sapiens
ucugagcugucgucuugua

SEQ ID NO: 163299 - RNA, 19 nt, Homo sapiens
auaauccucuguagcuuga

SEQ ID NO: 163300 - RNA, 19 nt, Homo sapiens
aaauggccuuuacauagaa

SEQ ID NO: 163301 - RNA, 19 nt, Homo sapiens
ccauggcuuucccggauaa

SEQ ID NO: 163302 - RNA, 19 nt, Homo sapiens
gcaggagccucgggauuac

SEQ ID NO: 163303 - RNA, 19 nt, Homo sapiens
cugauaaccuggugcuuca

SEQ ID NO: 163304 - RNA, 19 nt, Homo sapiens
ugaugacaauuuccauuuc

SEQ ID NO: 163305 - RNA, 19 nt, Homo sapiens
gacacaagcuuagauucuc

SEQ ID NO: 163306 - RNA, 19 nt, Homo sapiens
acaaccugauggaacauuu

SEQ ID NO: 163307 - RNA, 19 nt, Homo sapiens
uaaugugcacugugucuuu

SEQ ID NO: 163308 - RNA, 19 nt, Homo sapiens
uugguuagcugaagcacaa

SEQ ID NO: 163309 - RNA, 19 nt, Homo sapiens
gggaggcucaaaccauuaa

SEQ ID NO: 163310 - RNA, 19 nt, Homo sapiens
gaugagguuucugggaaga

SEQ ID NO: 163311 - RNA, 19 nt, Homo sapiens
ggaucucagucaacuucaa

SEQ ID NO: 163312 - RNA, 19 nt, Homo sapiens
gaacaaacaugaccuauga

SEQ ID NO: 163313 - RNA, 19 nt, Homo sapiens
ggagcuggaugaacaaaua

SEQ ID NO: 163314 - RNA, 19 nt, Homo sapiens
gaacaaauauaccaagaag

SEQ ID NO: 163315 - RNA, 19 nt, Homo sapiens
gaagaugaaugcugaagga

SEQ ID NO: 163316 - RNA, 19 nt, Homo sapiens
uuaagaaccugcaguuuga

SEQ ID NO: 163317 - RNA, 19 nt, Homo sapiens
ggacaaagaauccaaaaua

SEQ ID NO: 163318 - RNA, 19 nt, Homo sapiens
guagacugcuuugggauua

SEQ ID NO: 163319 - RNA, 19 nt, Homo sapiens
gagaauagcagacuguaga

SEQ ID NO: 163320 - RNA, 19 nt, Homo sapiens
gggaagaccuggcuuacau

SEQ ID NO: 163321 - RNA, 19 nt, Homo sapiens
aaacaugaccuaugagaaa

SEQ ID NO: 163322 - RNA, 19 nt, Homo sapiens
gcaacacguuugaaaugaa

SEQ ID NO: 163323 - RNA, 19 nt, Homo sapiens
gggauuacgucuaucaguu

SEQ ID NO: 163324 - RNA, 19 nt, Homo sapiens
gaacgaauuucauauacac

SEQ ID NO: 163325 - RNA, 19 nt, Homo sapiens
caggugaugugcucuauga

SEQ ID NO: 163326 - RNA, 19 nt, Homo sapiens
ggaacgaauuucauauaca

SEQ ID NO: 163327 - RNA, 19 nt, Homo sapiens
uggauaaugugcaccauaa

SEQ ID NO: 163328 - RNA, 19 nt, Homo sapiens
ggucaccuaucacgacaaa

SEQ ID NO: 163329 - RNA, 19 nt, Homo sapiens
caacacguuugaaaugaau

SEQ ID NO: 163330 - RNA, 19 nt, Homo sapiens
gaaacucuauacacacaca

SEQ ID NO: 163331 - RNA, 19 nt, Homo sapiens
uugcaaaucucacaaagug

SEQ ID NO: 163332 - RNA, 19 nt, Homo sapiens
cauaagaacagaacaaaca

SEQ ID NO: 163333 - RNA, 19 nt, Homo sapiens
ccauaacccucccaccauu

SEQ ID NO: 163334 - RNA, 19 nt, Homo sapiens
caggaacgaauuucauaua

SEQ ID NO: 163335 - RNA, 19 nt, Homo sapiens
ucagaaccaugaagaagau

SEQ ID NO: 163336 - RNA, 19 nt, Homo sapiens
gcuuugggauuacgucuau

SEQ ID NO: 163337 - RNA, 19 nt, Homo sapiens
gaagaccuggcuuacauga

SEQ ID NO: 163338 - RNA, 19 nt, Homo sapiens
gaaauggcagggacacuuc

SEQ ID NO: 163339 - RNA, 19 nt, Homo sapiens
ucacguuuccuucugauuu

SEQ ID NO: 163340 - RNA, 19 nt, Homo sapiens
gcauuaagcaggaacgaau

SEQ ID NO: 163341 - RNA, 19 nt, Homo sapiens
gggacuccaugucacguuu

SEQ ID NO: 163342 - RNA, 19 nt, Homo sapiens
cagcaacacguuugaaaug

SEQ ID NO: 163343 - RNA, 19 nt, Homo sapiens
ccuggaaacucuauacaca

SEQ ID NO: 163344 - RNA, 19 nt, Homo sapiens
ggauuacgucuaucaguug

SEQ ID NO: 163345 - RNA, 19 nt, Homo sapiens
gcaggaacgaauuucauau

SEQ ID NO: 163346 - RNA, 19 nt, Homo sapiens
ugaaaugaauggcaaagcu

SEQ ID NO: 163347 - RNA, 19 nt, Homo sapiens
gacagcaacacguuugaaa

SEQ ID NO: 163348 - RNA, 19 nt, Homo sapiens
aaaggaagcgacccagaaa

SEQ ID NO: 163349 - RNA, 19 nt, Homo sapiens
ccacguggaucaggucugu

SEQ ID NO: 163350 - RNA, 19 nt, Homo sapiens
ggaaggagccaggacaaag

SEQ ID NO: 163351 - RNA, 19 nt, Homo sapiens
gggaaaccauaagaacaga

SEQ ID NO: 163352 - RNA, 19 nt, Homo sapiens
gcacuccguggauuucaaa

SEQ ID NO: 163353 - RNA, 19 nt, Homo sapiens
gagcacgccaugcccauug

SEQ ID NO: 163354 - RNA, 19 nt, Homo sapiens
gaacuccuucagcauauuc

SEQ ID NO: 163355 - RNA, 19 nt, Homo sapiens
caaacaugaccuaugagaa

SEQ ID NO: 163356 - RNA, 19 nt, Homo sapiens
aagaacagaacaaacauga

SEQ ID NO: 163357 - RNA, 19 nt, Homo sapiens
ggaggacaaagaauccaaa

SEQ ID NO: 163358 - RNA, 19 nt, Homo sapiens
cuaucgaucuccucauuca

SEQ ID NO: 163359 - RNA, 19 nt, Homo sapiens
aagcccagcuggucaggaa

SEQ ID NO: 163360 - RNA, 19 nt, Homo sapiens
ggaaucucuccaucuguaa

SEQ ID NO: 163361 - RNA, 19 nt, Homo sapiens
gaaggagccaggacaaagg

SEQ ID NO: 163362 - RNA, 19 nt, Homo sapiens
ggagagcacacgcgugauc

SEQ ID NO: 163363 - RNA, 19 nt, Homo sapiens
uggaaacucuauacacaca

SEQ ID NO: 163364 - RNA, 19 nt, Homo sapiens
gaugggaggacaaagaauc

SEQ ID NO: 163365 - RNA, 19 nt, Homo sapiens
ucaggaaagagaauacuug

SEQ ID NO: 163366 - RNA, 19 nt, Homo sapiens
uuuaagaaccugcaguuug

SEQ ID NO: 163367 - RNA, 19 nt, Homo sapiens
cacguuuccuucugauuug

SEQ ID NO: 163368 - RNA, 19 nt, Homo sapiens
agaccuggcuuacaugaac

SEQ ID NO: 163369 - RNA, 19 nt, Homo sapiens
uaaggccaauugacagcaa

SEQ ID NO: 163370 - RNA, 19 nt, Homo sapiens
gagcaccuuagacaaacua

SEQ ID NO: 163371 - RNA, 19 nt, Homo sapiens
gaggucauacugcaucaga

SEQ ID NO: 163372 - RNA, 19 nt, Homo sapiens
gcgccacuacuacaaacua

SEQ ID NO: 163373 - RNA, 19 nt, Homo sapiens
ucauauacaccuccagaga

SEQ ID NO: 163374 - RNA, 19 nt, Homo sapiens
ucaccuaucacgacaaauc

SEQ ID NO: 163375 - RNA, 19 nt, Homo sapiens
gcaucagaaccaugaagaa

SEQ ID NO: 163376 - RNA, 19 nt, Homo sapiens
gugaugugcucuaugaacu

SEQ ID NO: 163377 - RNA, 19 nt, Homo sapiens
aaucaugaguggccgaaca

SEQ ID NO: 163378 - RNA, 19 nt, Homo sapiens
agagcccagugccgaguua

SEQ ID NO: 163379 - RNA, 19 nt, Homo sapiens
cgcuaucgaucuccucauu

SEQ ID NO: 163380 - RNA, 19 nt, Homo sapiens
gaaaaccccagaugaaauc

SEQ ID NO: 163381 - RNA, 19 nt, Homo sapiens
caauugacagcaacacguu

SEQ ID NO: 163382 - RNA, 19 nt, Homo sapiens
cgccacuacuacaaacuaa

SEQ ID NO: 163383 - RNA, 19 nt, Homo sapiens
ggaagaccuggcuuacaug

SEQ ID NO: 163384 - RNA, 19 nt, Homo sapiens
ccaugaagaagauaacugu

SEQ ID NO: 163385 - RNA, 19 nt, Homo sapiens
ggaaaccucggauucuuuu

SEQ ID NO: 163386 - RNA, 19 nt, Homo sapiens
cagggacacuucucuugca

SEQ ID NO: 163387 - RNA, 19 nt, Homo sapiens
uaaacauuaucaggaagga

SEQ ID NO: 163388 - RNA, 19 nt, Homo sapiens
ggucuguuccuguuacugu

SEQ ID NO: 163389 - RNA, 19 nt, Homo sapiens
gaaccugcaguuugacucu

SEQ ID NO: 163390 - RNA, 19 nt, Homo sapiens
ggaagcgacccagaaaugg

SEQ ID NO: 163391 - RNA, 19 nt, Homo sapiens
gagcuggaugaacaaauau

SEQ ID NO: 163392 - RNA, 19 nt, Homo sapiens
acaaacaugaccuaugaga

SEQ ID NO: 163393 - RNA, 19 nt, Homo sapiens
gaaaccauaagaacagaac

SEQ ID NO: 163394 - RNA, 19 nt, Homo sapiens
ucugacagccgguacgaaa

SEQ ID NO: 163395 - RNA, 19 nt, Homo sapiens
guggauaaugugcaccaua

SEQ ID NO: 163396 - RNA, 19 nt, Homo sapiens
agcaacacguuugaaauga

SEQ ID NO: 163397 - RNA, 19 nt, Homo sapiens
caagugggcugaaaaugag

SEQ ID NO: 163398 - RNA, 19 nt, Homo sapiens
caaauauaccaagaagaug

SEQ ID NO: 163399 - RNA, 19 nt, Homo sapiens
ggaaaccauaagaacagaa

SEQ ID NO: 163400 - RNA, 19 nt, Homo sapiens
gggaagggaagcccaucaa

SEQ ID NO: 163401 - RNA, 19 nt, Homo sapiens
gaaucucuccaucuguaau

SEQ ID NO: 163402 - RNA, 19 nt, Homo sapiens
aggaacgaauuucauauac

SEQ ID NO: 163403 - RNA, 19 nt, Homo sapiens
ggaugaacaaauauaccaa

SEQ ID NO: 163404 - RNA, 19 nt, Homo sapiens
uaagaacagaacaaacaug
